United States Patent 7,250,289 (METHODS OF GENETIC ANALYSIS OF MOUSE) - sequence listing, part 7

SEQ ID NO: 241939 - DNA, 25 bp, Mus musculus
atccaagagaaccacaaggccagct

SEQ ID NO: 241940 - DNA, 25 bp, Mus musculus
atccaagagaacgacaaggccagct

SEQ ID NO: 241941 - DNA, 25 bp, Mus musculus
atccaagatcacatttgaaagtttt

SEQ ID NO: 241942 - DNA, 25 bp, Mus musculus
atccaagatcacttttgaaagtttt

SEQ ID NO: 241943 - DNA, 25 bp, Mus musculus
atccaagatcggatccaggccctgg

SEQ ID NO: 241944 - DNA, 25 bp, Mus musculus
atccaagatcggttccaggccctgg

SEQ ID NO: 241945 - DNA, 25 bp, Mus musculus
atccaagcacgcatattcgcaaggg

SEQ ID NO: 241946 - DNA, 25 bp, Mus musculus
atccaagcacgcttattcgcaaggg

SEQ ID NO: 241947 - DNA, 25 bp, Mus musculus
atccaagcatggaagggcccctcgt

SEQ ID NO: 241948 - DNA, 25 bp, Mus musculus
atccaagcatggtagggcccctcgt

SEQ ID NO: 241949 - DNA, 25 bp, Mus musculus
atccaagccgttcaagttttcctat

SEQ ID NO: 241950 - DNA, 25 bp, Mus musculus
atccaagccgttgaagttttcctat

SEQ ID NO: 241951 - DNA, 25 bp, Mus musculus
atccaaggaatccagcactgtctgc

SEQ ID NO: 241952 - DNA, 25 bp, Mus musculus
atccaaggaatcgagcactgtctgc

SEQ ID NO: 241953 - DNA, 25 bp, Mus musculus
atccaaggactcagggacactctag

SEQ ID NO: 241954 - DNA, 25 bp, Mus musculus
atccaaggactctgggacactctag

SEQ ID NO: 241955 - DNA, 25 bp, Mus musculus
atccaaggagatccacagccctggc

SEQ ID NO: 241956 - DNA, 25 bp, Mus musculus
atccaaggagatgcacagccctggc

SEQ ID NO: 241957 - DNA, 25 bp, Mus musculus
atccaaggaggccagcaaatgaaaa

SEQ ID NO: 241958 - DNA, 25 bp, Mus musculus
atccaaggaggcgagcaaatgaaaa

SEQ ID NO: 241959 - DNA, 25 bp, Mus musculus
atccaaggatgcagcgaccatgtga

SEQ ID NO: 241960 - DNA, 25 bp, Mus musculus
atccaaggatgctgcgaccatgtga

SEQ ID NO: 241961 - DNA, 25 bp, Mus musculus
atccaaggatttcttttcaccaaga

SEQ ID NO: 241962 - DNA, 25 bp, Mus musculus
atccaaggatttgttttcaccaaga

SEQ ID NO: 241963 - DNA, 25 bp, Mus musculus
atccaaggccctcagagtttgcttt

SEQ ID NO: 241964 - DNA, 25 bp, Mus musculus
atccaaggccctgagagtttgcttt

SEQ ID NO: 241965 - DNA, 25 bp, Mus musculus
atccaaggcgacagtatgttctact

SEQ ID NO: 241966 - DNA, 25 bp, Mus musculus
atccaaggcgactgtatgttctact

SEQ ID NO: 241967 - DNA, 25 bp, Mus musculus
atccaaggctagaggcctatttcca

SEQ ID NO: 241968 - DNA, 25 bp, Mus musculus
atccaaggctagtggcctatttcca

SEQ ID NO: 241969 - DNA, 25 bp, Mus musculus
atccaagggcatcaggtatgcaagt

SEQ ID NO: 241970 - DNA, 25 bp, Mus musculus
atccaagggcatgaggtatgcaagt

SEQ ID NO: 241971 - DNA, 25 bp, Mus musculus
atccaaggtcctcttcttggcagta

SEQ ID NO: 241972 - DNA, 25 bp, Mus musculus
atccaaggtcctgttcttggcagta

SEQ ID NO: 241973 - DNA, 25 bp, Mus musculus
atccaaggttacagtgctgaacaaa

SEQ ID NO: 241974 - DNA, 25 bp, Mus musculus
atccaaggttactgtgctgaacaaa

SEQ ID NO: 241975 - DNA, 25 bp, Mus musculus
atccaaggttccctgagccagagga

SEQ ID NO: 241976 - DNA, 25 bp, Mus musculus
atccaaggttccgtgagccagagga

SEQ ID NO: 241977 - DNA, 25 bp, Mus musculus
atccaagtaagtccctttgccagtg

SEQ ID NO: 241978 - DNA, 25 bp, Mus musculus
atccaagtaagtgcctttgccagtg

SEQ ID NO: 241979 - DNA, 25 bp, Mus musculus
atccaagtaccaatagctagccaga

SEQ ID NO: 241980 - DNA, 25 bp, Mus musculus
atccaagtaccattagctagccaga

SEQ ID NO: 241981 - DNA, 25 bp, Mus musculus
atccaagtcacgatggttggctttt

SEQ ID NO: 241982 - DNA, 25 bp, Mus musculus
atccaagtcacgttggttggctttt

SEQ ID NO: 241983 - DNA, 25 bp, Mus musculus
atccaagtccggctagttcgtgaat

SEQ ID NO: 241984 - DNA, 25 bp, Mus musculus
atccaagtccgggtagttcgtgaat

SEQ ID NO: 241985 - DNA, 25 bp, Mus musculus
atccaagtcctgactaagccacatg

SEQ ID NO: 241986 - DNA, 25 bp, Mus musculus
atccaagtcctgtctaagccacatg

SEQ ID NO: 241987 - DNA, 25 bp, Mus musculus
atccaagtctgtccaatgaaaccat

SEQ ID NO: 241988 - DNA, 25 bp, Mus musculus
atccaagtctgtccacctcacggtg

SEQ ID NO: 241989 - DNA, 25 bp, Mus musculus
atccaagtctgtgcaatgaaaccat

SEQ ID NO: 241990 - DNA, 25 bp, Mus musculus
atccaagtctgtgcacctcacggtg

SEQ ID NO: 241991 - DNA, 25 bp, Mus musculus
atccaagtgcagcaaagtgaccaaa

SEQ ID NO: 241992 - DNA, 25 bp, Mus musculus
atccaagtgcaggaaagtgaccaaa

SEQ ID NO: 241993 - DNA, 25 bp, Mus musculus
atccaagtgcctctttctgcagaag

SEQ ID NO: 241994 - DNA, 25 bp, Mus musculus
atccaagtgcctgtttctgcagaag

SEQ ID NO: 241995 - DNA, 25 bp, Mus musculus
atccaagtggagactggaccgtggc

SEQ ID NO: 241996 - DNA, 25 bp, Mus musculus
atccaagtggagtctggaccgtggc

SEQ ID NO: 241997 - DNA, 25 bp, Mus musculus
atccaagtggctagtgcagtgacaa

SEQ ID NO: 241998 - DNA, 25 bp, Mus musculus
atccaagtggcttgtgcagtgacaa

SEQ ID NO: 241999 - DNA, 25 bp, Mus musculus
atccaagtgtgacatgactgacggc

SEQ ID NO: 242000 - DNA, 25 bp, Mus musculus
atccaagtgtgagatgactgacggc

SEQ ID NO: 242001 - DNA, 25 bp, Mus musculus
atccaagttactcttctctgttcaa

SEQ ID NO: 242002 - DNA, 25 bp, Mus musculus
atccaagttactgttctctgttcaa

SEQ ID NO: 242003 - DNA, 25 bp, Mus musculus
atccaagttctgaggttctactatt

SEQ ID NO: 242004 - DNA, 25 bp, Mus musculus
atccaagttctgtggttctactatt

SEQ ID NO: 242005 - DNA, 25 bp, Mus musculus
atccaagtttgcactgttccaggtg

SEQ ID NO: 242006 - DNA, 25 bp, Mus musculus
atccaagtttgctctgttccaggtg

SEQ ID NO: 242007 - DNA, 25 bp, Mus musculus
atccaataacctacgattcttccat

SEQ ID NO: 242008 - DNA, 25 bp, Mus musculus
atccaataaccttcgattcttccat

SEQ ID NO: 242009 - DNA, 25 bp, Mus musculus
atccaatacggaagtacgcagcagt

SEQ ID NO: 242010 - DNA, 25 bp, Mus musculus
atccaatacggatgtacgcagcagt

SEQ ID NO: 242011 - DNA, 25 bp, Mus musculus
atccaatagggaagctggagcactg

SEQ ID NO: 242012 - DNA, 25 bp, Mus musculus
atccaatagggatgctggagcactg

SEQ ID NO: 242013 - DNA, 25 bp, Mus musculus
atccaatagttgaccagcccatgat

SEQ ID NO: 242014 - DNA, 25 bp, Mus musculus
atccaatagttgtccagcccatgat

SEQ ID NO: 242015 - DNA, 25 bp, Mus musculus
atccaatatcaacaggtcaccatcc

SEQ ID NO: 242016 - DNA, 25 bp, Mus musculus
atccaatatcaagaggtcaccatcc

SEQ ID NO: 242017 - DNA, 25 bp, Mus musculus
atccaatattcaacccagccataaa

SEQ ID NO: 242018 - DNA, 25 bp, Mus musculus
atccaatattcatcccagccataaa

SEQ ID NO: 242019 - DNA, 25 bp, Mus musculus
atccaatattgactgacccaagcat

SEQ ID NO: 242020 - DNA, 25 bp, Mus musculus
atccaatattgagtgacccaagcat

SEQ ID NO: 242021 - DNA, 25 bp, Mus musculus
atccaatcaactcgagggccgatct

SEQ ID NO: 242022 - DNA, 25 bp, Mus musculus
atccaatcaactggagggccgatct

SEQ ID NO: 242023 - DNA, 25 bp, Mus musculus
atccaatcacctctaattcttttgc

SEQ ID NO: 242024 - DNA, 25 bp, Mus musculus
atccaatcacctgtaattcttttgc

SEQ ID NO: 242025 - DNA, 25 bp, Mus musculus
atccaatcagtcatcaagggctcca

SEQ ID NO: 242026 - DNA, 25 bp, Mus musculus
atccaatcagtcttcaagggctcca

SEQ ID NO: 242027 - DNA, 25 bp, Mus musculus
atccaatccctgagcagcatcaaga

SEQ ID NO: 242028 - DNA, 25 bp, Mus musculus
atccaatccctgtgcagcatcaaga

SEQ ID NO: 242029 - DNA, 25 bp, Mus musculus
atccaatccgcactcagacctgata

SEQ ID NO: 242030 - DNA, 25 bp, Mus musculus
atccaatccgcagtcagacctgata

SEQ ID NO: 242031 - DNA, 25 bp, Mus musculus
atccaatccggtactctcggtcgaa

SEQ ID NO: 242032 - DNA, 25 bp, Mus musculus
atccaatccggttctctcggtcgaa

SEQ ID NO: 242033 - DNA, 25 bp, Mus musculus
atccaatcgcctcgctgagacagga

SEQ ID NO: 242034 - DNA, 25 bp, Mus musculus
atccaatcgcctggctgagacagga

SEQ ID NO: 242035 - DNA, 25 bp, Mus musculus
atccaatctccaagcctctggttta

SEQ ID NO: 242036 - DNA, 25 bp, Mus musculus
atccaatctccatgcctctggttta

SEQ ID NO: 242037 - DNA, 25 bp, Mus musculus
atccaatctcccactaacttattta

SEQ ID NO: 242038 - DNA, 25 bp, Mus musculus
atccaatctccctctaacttattta

SEQ ID NO: 242039 - DNA, 25 bp, Mus musculus
atccaatctggtcttgatcttttca

SEQ ID NO: 242040 - DNA, 25 bp, Mus musculus
atccaatctggtgttgatcttttca

SEQ ID NO: 242041 - DNA, 25 bp, Mus musculus
atccaatgacaaccttgacaccgag

SEQ ID NO: 242042 - DNA, 25 bp, Mus musculus
atccaatgacaagcttgacaccgag

SEQ ID NO: 242043 - DNA, 25 bp, Mus musculus
atccaatgagacaggcaccaatgct

SEQ ID NO: 242044 - DNA, 25 bp, Mus musculus
atccaatgagactggcaccaatgct

SEQ ID NO: 242045 - DNA, 25 bp, Mus musculus
atccaatgatcgacctggagtctaa

SEQ ID NO: 242046 - DNA, 25 bp, Mus musculus
atccaatgatcgtcctggagtctaa

SEQ ID NO: 242047 - DNA, 25 bp, Mus musculus
atccaatgcagactctcgctcctag

SEQ ID NO: 242048 - DNA, 25 bp, Mus musculus
atccaatgcagagtctcgctcctag

SEQ ID NO: 242049 - DNA, 25 bp, Mus musculus
atccaatgcatgaatccagggacag

SEQ ID NO: 242050 - DNA, 25 bp, Mus musculus
atccaatgcatgtatccagggacag

SEQ ID NO: 242051 - DNA, 25 bp, Mus musculus
atccaatgctgacccctgatgtttc

SEQ ID NO: 242052 - DNA, 25 bp, Mus musculus
atccaatgctgagccctgatgtttc

SEQ ID NO: 242053 - DNA, 25 bp, Mus musculus
atccaatgctgtactgtcaccttaa

SEQ ID NO: 242054 - DNA, 25 bp, Mus musculus
atccaatgctgttctgtcaccttaa

SEQ ID NO: 242055 - DNA, 25 bp, Mus musculus
atccaatggacacgttatcctacaa

SEQ ID NO: 242056 - DNA, 25 bp, Mus musculus
atccaatggacaggttatcctacaa

SEQ ID NO: 242057 - DNA, 25 bp, Mus musculus
atccaattagctatactgcattttg

SEQ ID NO: 242058 - DNA, 25 bp, Mus musculus
atccaattagctttactgcattttg

SEQ ID NO: 242059 - DNA, 25 bp, Mus musculus
atccaattcaggcagagggtactct

SEQ ID NO: 242060 - DNA, 25 bp, Mus musculus
atccaattcagggagagggtactct

SEQ ID NO: 242061 - DNA, 25 bp, Mus musculus
atccaattccagcaggaacggaggc

SEQ ID NO: 242062 - DNA, 25 bp, Mus musculus
atccaattccaggaggaacggaggc

SEQ ID NO: 242063 - DNA, 25 bp, Mus musculus
atccaattccatactgggctgccag

SEQ ID NO: 242064 - DNA, 25 bp, Mus musculus
atccaattccattctgggctgccag

SEQ ID NO: 242065 - DNA, 25 bp, Mus musculus
atccaattctgtcttttgcgggaaa

SEQ ID NO: 242066 - DNA, 25 bp, Mus musculus
atccaattctgtgttttgcgggaaa

SEQ ID NO: 242067 - DNA, 25 bp, Mus musculus
atccaattgagtcgagtaagacccg

SEQ ID NO: 242068 - DNA, 25 bp, Mus musculus
atccaattgagtggagtaagacccg

SEQ ID NO: 242069 - DNA, 25 bp, Mus musculus
atccaattggtgagcttcaaattca

SEQ ID NO: 242070 - DNA, 25 bp, Mus musculus
atccaattggtgtgcttcaaattca

SEQ ID NO: 242071 - DNA, 25 bp, Mus musculus
atccaattgtggagttctgtctcct

SEQ ID NO: 242072 - DNA, 25 bp, Mus musculus
atccaattgtggtgttctgtctcct

SEQ ID NO: 242073 - DNA, 25 bp, Mus musculus
atccaatttacaagtctctgtggct

SEQ ID NO: 242074 - DNA, 25 bp, Mus musculus
atccaatttacatgtctctgtggct

SEQ ID NO: 242075 - DNA, 25 bp, Mus musculus
atccaatttcttaaactcttcctgc

SEQ ID NO: 242076 - DNA, 25 bp, Mus musculus
atccaatttctttaactcttcctgc

SEQ ID NO: 242077 - DNA, 25 bp, Mus musculus
atccacaaaacccaaaccagcttgt

SEQ ID NO: 242078 - DNA, 25 bp, Mus musculus
atccacaaaaccgaaaccagcttgt

SEQ ID NO: 242079 - DNA, 25 bp, Mus musculus
atccacaaccatattgtcattgggt

SEQ ID NO: 242080 - DNA, 25 bp, Mus musculus
atccacaaccattttgtcattgggt

SEQ ID NO: 242081 - DNA, 25 bp, Mus musculus
atccacaacggcatgttcttcagca

SEQ ID NO: 242082 - DNA, 25 bp, Mus musculus
atccacaacggcttgttcttcagca

SEQ ID NO: 242083 - DNA, 25 bp, Mus musculus
atccacaagcgcatggaggtctcag

SEQ ID NO: 242084 - DNA, 25 bp, Mus musculus
atccacaagcgcttggaggtctcag

SEQ ID NO: 242085 - DNA, 25 bp, Mus musculus
atccacaagcgtatgtattttttga

SEQ ID NO: 242086 - DNA, 25 bp, Mus musculus
atccacaagcgtttgtattttttga

SEQ ID NO: 242087 - DNA, 25 bp, Mus musculus
atccacaagtgtccttccaagcaag

SEQ ID NO: 242088 - DNA, 25 bp, Mus musculus
atccacaagtgtgcttccaagcaag

SEQ ID NO: 242089 - DNA, 25 bp, Mus musculus
atccacaagtttattccagaagcct

SEQ ID NO: 242090 - DNA, 25 bp, Mus musculus
atccacaagttttttccagaagcct

SEQ ID NO: 242091 - DNA, 25 bp, Mus musculus
atccacacaaaaaccaaccatactg

SEQ ID NO: 242092 - DNA, 25 bp, Mus musculus
atccacacaaaatccaaccatactg

SEQ ID NO: 242093 - DNA, 25 bp, Mus musculus
atccacacactcacagctgaaaatg

SEQ ID NO: 242094 - DNA, 25 bp, Mus musculus
atccacacactctcagctgaaaatg

SEQ ID NO: 242095 - DNA, 25 bp, Mus musculus
atccacacactgaaactgaccacat

SEQ ID NO: 242096 - DNA, 25 bp, Mus musculus
atccacacactgtaactgaccacat

SEQ ID NO: 242097 - DNA, 25 bp, Mus musculus
atccacacagctaattaggaatggg

SEQ ID NO: 242098 - DNA, 25 bp, Mus musculus
atccacacagcttattaggaatggg

SEQ ID NO: 242099 - DNA, 25 bp, Mus musculus
atccacacatctagggttctaccca

SEQ ID NO: 242100 - DNA, 25 bp, Mus musculus
atccacacatcttgggttctaccca

SEQ ID NO: 242101 - DNA, 25 bp, Mus musculus
atccacacctttcagaccatgatgt

SEQ ID NO: 242102 - DNA, 25 bp, Mus musculus
atccacacctttgagaccatgatgt

SEQ ID NO: 242103 - DNA, 25 bp, Mus musculus
atccacacgctgctcgaacaatcaa

SEQ ID NO: 242104 - DNA, 25 bp, Mus musculus
atccacacgctggtcgaacaatcaa

SEQ ID NO: 242105 - DNA, 25 bp, Mus musculus
atccacacgtgtcaatgttttcccc

SEQ ID NO: 242106 - DNA, 25 bp, Mus musculus
atccacacgtgtgaatgttttcccc

SEQ ID NO: 242107 - DNA, 25 bp, Mus musculus
atccacactgcaagctagagaccca

SEQ ID NO: 242108 - DNA, 25 bp, Mus musculus
atccacactgcatgctagagaccca

SEQ ID NO: 242109 - DNA, 25 bp, Mus musculus
atccacactggccaccgtgtaagtg

SEQ ID NO: 242110 - DNA, 25 bp, Mus musculus
atccacactggcgaccgtgtaagtg

SEQ ID NO: 242111 - DNA, 25 bp, Mus musculus
atccacactggtcctttagcattgt

SEQ ID NO: 242112 - DNA, 25 bp, Mus musculus
atccacactggtgctttagcattgt

SEQ ID NO: 242113 - DNA, 25 bp, Mus musculus
atccacacttggaaactgcgagaag

SEQ ID NO: 242114 - DNA, 25 bp, Mus musculus
atccacacttggattctctttcctt

SEQ ID NO: 242115 - DNA, 25 bp, Mus musculus
atccacacttggtaactgcgagaag

SEQ ID NO: 242116 - DNA, 25 bp, Mus musculus
atccacacttggtttctctttcctt

SEQ ID NO: 242117 - DNA, 25 bp, Mus musculus
atccacagaggtacagtggctcctt

SEQ ID NO: 242118 - DNA, 25 bp, Mus musculus
atccacagaggttcagtggctcctt

SEQ ID NO: 242119 - DNA, 25 bp, Mus musculus
atccacagcgatattgcagttccac

SEQ ID NO: 242120 - DNA, 25 bp, Mus musculus
atccacagcgattttgcagttccac

SEQ ID NO: 242121 - DNA, 25 bp, Mus musculus
atccacagcttaccagtcttgtaag

SEQ ID NO: 242122 - DNA, 25 bp, Mus musculus
atccacagcttagcagtcttgtaag

SEQ ID NO: 242123 - DNA, 25 bp, Mus musculus
atccacagggtcagtgggtccttcc

SEQ ID NO: 242124 - DNA, 25 bp, Mus musculus
atccacagggtctgtgggtccttcc

SEQ ID NO: 242125 - DNA, 25 bp, Mus musculus
atccacaggtagatggtttccagac

SEQ ID NO: 242126 - DNA, 25 bp, Mus musculus
atccacaggtagttggtttccagac

SEQ ID NO: 242127 - DNA, 25 bp, Mus musculus
atccacaggttcagagatgcatatg

SEQ ID NO: 242128 - DNA, 25 bp, Mus musculus
atccacaggttcatgtactcacata

SEQ ID NO: 242129 - DNA, 25 bp, Mus musculus
atccacaggttctgagatgcatatg

SEQ ID NO: 242130 - DNA, 25 bp, Mus musculus
atccacaggttcttgtactcacata

SEQ ID NO: 242131 - DNA, 25 bp, Mus musculus
atccacagtcccagctggaaatgga

SEQ ID NO: 242132 - DNA, 25 bp, Mus musculus
atccacagtccctgctggaaatgga

SEQ ID NO: 242133 - DNA, 25 bp, Mus musculus
atccacagtgcactatttcatgtat

SEQ ID NO: 242134 - DNA, 25 bp, Mus musculus
atccacagtgcagtatttcatgtat

SEQ ID NO: 242135 - DNA, 25 bp, Mus musculus
atccacagtgttccagtgctgaggc

SEQ ID NO: 242136 - DNA, 25 bp, Mus musculus
atccacagtgttgcagtgctgaggc

SEQ ID NO: 242137 - DNA, 25 bp, Mus musculus
atccacatgcctataggtaggagtt

SEQ ID NO: 242138 - DNA, 25 bp, Mus musculus
atccacatgcctttaggtaggagtt

SEQ ID NO: 242139 - DNA, 25 bp, Mus musculus
atccacatgggactgcatttgctga

SEQ ID NO: 242140 - DNA, 25 bp, Mus musculus
atccacatgggagtgcatttgctga

SEQ ID NO: 242141 - DNA, 25 bp, Mus musculus
atccacattattaccctttataagg

SEQ ID NO: 242142 - DNA, 25 bp, Mus musculus
atccacattatttccctttataagg

SEQ ID NO: 242143 - DNA, 25 bp, Mus musculus
atccacattctcagagtgctcattg

SEQ ID NO: 242144 - DNA, 25 bp, Mus musculus
atccacattctctgagtgctcattg

SEQ ID NO: 242145 - DNA, 25 bp, Mus musculus
atccacatttggacattgggccaga

SEQ ID NO: 242146 - DNA, 25 bp, Mus musculus
atccacatttggtcattgggccaga

SEQ ID NO: 242147 - DNA, 25 bp, Mus musculus
atccaccaacatcatgggtcatcgg

SEQ ID NO: 242148 - DNA, 25 bp, Mus musculus
atccaccaacatgatgggtcatcgg

SEQ ID NO: 242149 - DNA, 25 bp, Mus musculus
atccaccaaggtccacagttctaag

SEQ ID NO: 242150 - DNA, 25 bp, Mus musculus
atccaccaaggtgcacagttctaag

SEQ ID NO: 242151 - DNA, 25 bp, Mus musculus
atccaccaagttccaggcagttgag

SEQ ID NO: 242152 - DNA, 25 bp, Mus musculus
atccaccaagttgcaggcagttgag

SEQ ID NO: 242153 - DNA, 25 bp, Mus musculus
atccaccacagcattagtacagcaa

SEQ ID NO: 242154 - DNA, 25 bp, Mus musculus
atccaccacagctttagtacagcaa

SEQ ID NO: 242155 - DNA, 25 bp, Mus musculus
atccaccaccaaagtaccttatgac

SEQ ID NO: 242156 - DNA, 25 bp, Mus musculus
atccaccaccaatgtaccttatgac

SEQ ID NO: 242157 - DNA, 25 bp, Mus musculus
atccaccactggatttgggtcagag

SEQ ID NO: 242158 - DNA, 25 bp, Mus musculus
atccaccactggttttgggtcagag

SEQ ID NO: 242159 - DNA, 25 bp, Mus musculus
atccaccagctacgacgtaactgac

SEQ ID NO: 242160 - DNA, 25 bp, Mus musculus
atccaccagctaggacgtaactgac

SEQ ID NO: 242161 - DNA, 25 bp, Mus musculus
atccaccagctcattctggtatttt

SEQ ID NO: 242162 - DNA, 25 bp, Mus musculus
atccaccagctctttctggtatttt

SEQ ID NO: 242163 - DNA, 25 bp, Mus musculus
atccaccatctgaaatttccttggc

SEQ ID NO: 242164 - DNA, 25 bp, Mus musculus
atccaccatctgtaatttccttggc

SEQ ID NO: 242165 - DNA, 25 bp, Mus musculus
atccaccatggcaggtgcacacaat

SEQ ID NO: 242166 - DNA, 25 bp, Mus musculus
atccaccatggctggtgcacacaat

SEQ ID NO: 242167 - DNA, 25 bp, Mus musculus
atccacccactgcaggagtcagttg

SEQ ID NO: 242168 - DNA, 25 bp, Mus musculus
atccacccactggaggagtcagttg

SEQ ID NO: 242169 - DNA, 25 bp, Mus musculus
atccacccagctacttcaaggatgt

SEQ ID NO: 242170 - DNA, 25 bp, Mus musculus
atccacccagcttcttcaaggatgt

SEQ ID NO: 242171 - DNA, 25 bp, Mus musculus
atccacccggtgcttgacgagaagg

SEQ ID NO: 242172 - DNA, 25 bp, Mus musculus
atccacccggtggttgacgagaagg

SEQ ID NO: 242173 - DNA, 25 bp, Mus musculus
atccaccctaaacgagcggttccag

SEQ ID NO: 242174 - DNA, 25 bp, Mus musculus
atccaccctaaaggagcggttccag

SEQ ID NO: 242175 - DNA, 25 bp, Mus musculus
atccaccgactcagggaacatggtc

SEQ ID NO: 242176 - DNA, 25 bp, Mus musculus
atccaccgactctgggaacatggtc

SEQ ID NO: 242177 - DNA, 25 bp, Mus musculus
atccaccggctccaacatggtaaac

SEQ ID NO: 242178 - DNA, 25 bp, Mus musculus
atccaccggctcgaacatggtaaac

SEQ ID NO: 242179 - DNA, 25 bp, Mus musculus
atccaccgtcttaaatgagaggcct

SEQ ID NO: 242180 - DNA, 25 bp, Mus musculus
atccaccgtctttaatgagaggcct

SEQ ID NO: 242181 - DNA, 25 bp, Mus musculus
atccacctgaccaaactgcagaatc

SEQ ID NO: 242182 - DNA, 25 bp, Mus musculus
atccacctgacctaactgcagaatc

SEQ ID NO: 242183 - DNA, 25 bp, Mus musculus
atccacctgagtccaattttctctg

SEQ ID NO: 242184 - DNA, 25 bp, Mus musculus
atccacctgagtgcaattttctctg

SEQ ID NO: 242185 - DNA, 25 bp, Mus musculus
atccacctgggtagagacaattaat

SEQ ID NO: 242186 - DNA, 25 bp, Mus musculus
atccacctgggttgagacaattaat

SEQ ID NO: 242187 - DNA, 25 bp, Mus musculus
atccacctgtagctctttcaattga

SEQ ID NO: 242188 - DNA, 25 bp, Mus musculus
atccacctgtaggtctttcaattga

SEQ ID NO: 242189 - DNA, 25 bp, Mus musculus
atccacctgtctataacaaatgagt

SEQ ID NO: 242190 - DNA, 25 bp, Mus musculus
atccacctgtctttaacaaatgagt

SEQ ID NO: 242191 - DNA, 25 bp, Mus musculus
atccaccttcccagggtgacatggg

SEQ ID NO: 242192 - DNA, 25 bp, Mus musculus
atccaccttccctgggtgacatggg

SEQ ID NO: 242193 - DNA, 25 bp, Mus musculus
atccaccttgtcatgttcagccgca

SEQ ID NO: 242194 - DNA, 25 bp, Mus musculus
atccaccttgtcttgttcagccgca

SEQ ID NO: 242195 - DNA, 25 bp, Mus musculus
atccaccttttcagctataagtagg

SEQ ID NO: 242196 - DNA, 25 bp, Mus musculus
atccaccttttctgctataagtagg

SEQ ID NO: 242197 - DNA, 25 bp, Mus musculus
atccacgcgtggctcgaggacacaa

SEQ ID NO: 242198 - DNA, 25 bp, Mus musculus
atccacgcgtgggtcgaggacacaa

SEQ ID NO: 242199 - DNA, 25 bp, Mus musculus
atccacgctgtcctgtttcaaataa

SEQ ID NO: 242200 - DNA, 25 bp, Mus musculus
atccacgctgtcgtgtttcaaataa

SEQ ID NO: 242201 - DNA, 25 bp, Mus musculus
atccacggaaaaccagcaactcagc

SEQ ID NO: 242202 - DNA, 25 bp, Mus musculus
atccacggaaaagcagcaactcagc

SEQ ID NO: 242203 - DNA, 25 bp, Mus musculus
atccacggacatctacccttgcata

SEQ ID NO: 242204 - DNA, 25 bp, Mus musculus
atccacggacatgtacccttgcata

SEQ ID NO: 242205 - DNA, 25 bp, Mus musculus
atccacggcgtcctgagcagattca

SEQ ID NO: 242206 - DNA, 25 bp, Mus musculus
atccacggcgtcgtgagcagattca

SEQ ID NO: 242207 - DNA, 25 bp, Mus musculus
atccacgtaccaccggctcggagag

SEQ ID NO: 242208 - DNA, 25 bp, Mus musculus
atccacgtaccagcggctcggagag

SEQ ID NO: 242209 - DNA, 25 bp, Mus musculus
atccacgtacttaataatgacctca

SEQ ID NO: 242210 - DNA, 25 bp, Mus musculus
atccacgtactttataatgacctca

SEQ ID NO: 242211 - DNA, 25 bp, Mus musculus
atccacgtgtgaactcagggcattc

SEQ ID NO: 242212 - DNA, 25 bp, Mus musculus
atccacgtgtgatctcagggcattc

SEQ ID NO: 242213 - DNA, 25 bp, Mus musculus
atccacgtgtttaaatggcccctgt

SEQ ID NO: 242214 - DNA, 25 bp, Mus musculus
atccacgtgttttaatggcccctgt

SEQ ID NO: 242215 - DNA, 25 bp, Mus musculus
atccacgttgagctgcatggactct

SEQ ID NO: 242216 - DNA, 25 bp, Mus musculus
atccacgttgaggtgcatggactct

SEQ ID NO: 242217 - DNA, 25 bp, Mus musculus
atccacgtttgcacagatgatccaa

SEQ ID NO: 242218 - DNA, 25 bp, Mus musculus
atccacgtttgctcagatgatccaa

SEQ ID NO: 242219 - DNA, 25 bp, Mus musculus
atccactaaccactctcagattcta

SEQ ID NO: 242220 - DNA, 25 bp, Mus musculus
atccactaaccagtctcagattcta

SEQ ID NO: 242221 - DNA, 25 bp, Mus musculus
atccactaattgacttttatagctt

SEQ ID NO: 242222 - DNA, 25 bp, Mus musculus
atccactaattgtcttttatagctt

SEQ ID NO: 242223 - DNA, 25 bp, Mus musculus
atccactacacactatttgccttct

SEQ ID NO: 242224 - DNA, 25 bp, Mus musculus
atccactacacagtatttgccttct

SEQ ID NO: 242225 - DNA, 25 bp, Mus musculus
atccactagggaatctggggtccct

SEQ ID NO: 242226 - DNA, 25 bp, Mus musculus
atccactagggattctggggtccct

SEQ ID NO: 242227 - DNA, 25 bp, Mus musculus
atccactagtcccttctgaaagctg

SEQ ID NO: 242228 - DNA, 25 bp, Mus musculus
atccactagtccgttctgaaagctg

SEQ ID NO: 242229 - DNA, 25 bp, Mus musculus
atccactatggtacttgttatacag

SEQ ID NO: 242230 - DNA, 25 bp, Mus musculus
atccactatggttcttgttatacag

SEQ ID NO: 242231 - DNA, 25 bp, Mus musculus
atccactcaagtattctaggcatat

SEQ ID NO: 242232 - DNA, 25 bp, Mus musculus
atccactcaagttttctaggcatat

SEQ ID NO: 242233 - DNA, 25 bp, Mus musculus
atccactcacgaaccatagctagct

SEQ ID NO: 242234 - DNA, 25 bp, Mus musculus
atccactcacgatccatagctagct

SEQ ID NO: 242235 - DNA, 25 bp, Mus musculus
atccactccctcaatgtgatggagg

SEQ ID NO: 242236 - DNA, 25 bp, Mus musculus
atccactccctctatgtgatggagg

SEQ ID NO: 242237 - DNA, 25 bp, Mus musculus
atccactcgcggcacaaggtgtcaa

SEQ ID NO: 242238 - DNA, 25 bp, Mus musculus
atccactcgcgggacaaggtgtcaa

SEQ ID NO: 242239 - DNA, 25 bp, Mus musculus
atccactgacggcaaactgtgggtc

SEQ ID NO: 242240 - DNA, 25 bp, Mus musculus
atccactgacgggaaactgtgggtc

SEQ ID NO: 242241 - DNA, 25 bp, Mus musculus
atccactggctgatcatgggttact

SEQ ID NO: 242242 - DNA, 25 bp, Mus musculus
atccactggctgctagtctgtgaga

SEQ ID NO: 242243 - DNA, 25 bp, Mus musculus
atccactggctggtagtctgtgaga

SEQ ID NO: 242244 - DNA, 25 bp, Mus musculus
atccactggctgttcatgggttact

SEQ ID NO: 242245 - DNA, 25 bp, Mus musculus
atccactgggccctcagatagaaag

SEQ ID NO: 242246 - DNA, 25 bp, Mus musculus
atccactgggccgtcagatagaaag

SEQ ID NO: 242247 - DNA, 25 bp, Mus musculus
atccactgggctcgccaaatgttac

SEQ ID NO: 242248 - DNA, 25 bp, Mus musculus
atccactgggctggccaaatgttac

SEQ ID NO: 242249 - DNA, 25 bp, Mus musculus
atccactggtgcaagcccgtattat

SEQ ID NO: 242250 - DNA, 25 bp, Mus musculus
atccactggtgctagcccgtattat

SEQ ID NO: 242251 - DNA, 25 bp, Mus musculus
atccactgtcttagagttgtaagta

SEQ ID NO: 242252 - DNA, 25 bp, Mus musculus
atccactgtctttgagttgtaagta

SEQ ID NO: 242253 - DNA, 25 bp, Mus musculus
atccactgtgctctggctcgctgac

SEQ ID NO: 242254 - DNA, 25 bp, Mus musculus
atccactgtgctcttgtctatggtg

SEQ ID NO: 242255 - DNA, 25 bp, Mus musculus
atccactgtgctgtggctcgctgac

SEQ ID NO: 242256 - DNA, 25 bp, Mus musculus
atccactgtgctgttgtctatggtg

SEQ ID NO: 242257 - DNA, 25 bp, Mus musculus
atccacttacctcctgaagcacatt

SEQ ID NO: 242258 - DNA, 25 bp, Mus musculus
atccacttacctgctgaagcacatt

SEQ ID NO: 242259 - DNA, 25 bp, Mus musculus
atccacttagcaccctcattcaaga

SEQ ID NO: 242260 - DNA, 25 bp, Mus musculus
atccacttagcagcctcattcaaga

SEQ ID NO: 242261 - DNA, 25 bp, Mus musculus
atccacttataaaccaagacagctt

SEQ ID NO: 242262 - DNA, 25 bp, Mus musculus
atccacttataatccaagacagctt

SEQ ID NO: 242263 - DNA, 25 bp, Mus musculus
atccacttatcaatgggtctgccct

SEQ ID NO: 242264 - DNA, 25 bp, Mus musculus
atccacttatcattgggtctgccct

SEQ ID NO: 242265 - DNA, 25 bp, Mus musculus
atccacttattcctgaaaccctgtg

SEQ ID NO: 242266 - DNA, 25 bp, Mus musculus
atccacttattcgtgaaaccctgtg

SEQ ID NO: 242267 - DNA, 25 bp, Mus musculus
atccacttcaggccccaagtgaggt

SEQ ID NO: 242268 - DNA, 25 bp, Mus musculus
atccacttcagggcccaagtgaggt

SEQ ID NO: 242269 - DNA, 25 bp, Mus musculus
atccacttcagtcctgctatatggg

SEQ ID NO: 242270 - DNA, 25 bp, Mus musculus
atccacttcagtgctgctatatggg

SEQ ID NO: 242271 - DNA, 25 bp, Mus musculus
atccacttcataactgatgtagggc

SEQ ID NO: 242272 - DNA, 25 bp, Mus musculus
atccacttcatatctgatgtagggc

SEQ ID NO: 242273 - DNA, 25 bp, Mus musculus
atccacttccctaaccaagtgtatc

SEQ ID NO: 242274 - DNA, 25 bp, Mus musculus
atccacttcccttaccaagtgtatc

SEQ ID NO: 242275 - DNA, 25 bp, Mus musculus
atccacttccggctggctgtagaag

SEQ ID NO: 242276 - DNA, 25 bp, Mus musculus
atccacttccgggtggctgtagaag

SEQ ID NO: 242277 - DNA, 25 bp, Mus musculus
atccacttctgtaacttctttgttg

SEQ ID NO: 242278 - DNA, 25 bp, Mus musculus
atccacttctgttacttctttgttg

SEQ ID NO: 242279 - DNA, 25 bp, Mus musculus
atccacttgcctccaaagctttatg

SEQ ID NO: 242280 - DNA, 25 bp, Mus musculus
atccacttgcctgcaaagctttatg

SEQ ID NO: 242281 - DNA, 25 bp, Mus musculus
atccacttggaacctggcagacaac

SEQ ID NO: 242282 - DNA, 25 bp, Mus musculus
atccacttggaagctggcagacaac

SEQ ID NO: 242283 - DNA, 25 bp, Mus musculus
atccacttggacagtgcacagctct

SEQ ID NO: 242284 - DNA, 25 bp, Mus musculus
atccacttggactgtgcacagctct

SEQ ID NO: 242285 - DNA, 25 bp, Mus musculus
atccactttcagaacagcactaggc

SEQ ID NO: 242286 - DNA, 25 bp, Mus musculus
atccactttcagtacagcactaggc

SEQ ID NO: 242287 - DNA, 25 bp, Mus musculus
atccactttctactcgtctaagcaa

SEQ ID NO: 242288 - DNA, 25 bp, Mus musculus
atccactttctagtcgtctaagcaa

SEQ ID NO: 242289 - DNA, 25 bp, Mus musculus
atccactttgccatcagcagggtag

SEQ ID NO: 242290 - DNA, 25 bp, Mus musculus
atccactttgccttcagcagggtag

SEQ ID NO: 242291 - DNA, 25 bp, Mus musculus
atccactttgtgcaccgagacagga

SEQ ID NO: 242292 - DNA, 25 bp, Mus musculus
atccactttgtggaccgagacagga

SEQ ID NO: 242293 - DNA, 25 bp, Mus musculus
atccacttttcaagggctcagttct

SEQ ID NO: 242294 - DNA, 25 bp, Mus musculus
atccacttttcatgggctcagttct

SEQ ID NO: 242295 - DNA, 25 bp, Mus musculus
atccacttttgcaaatccatagaca

SEQ ID NO: 242296 - DNA, 25 bp, Mus musculus
atccacttttgctaatccatagaca

SEQ ID NO: 242297 - DNA, 25 bp, Mus musculus
atccagaaactgagaagctaatccg

SEQ ID NO: 242298 - DNA, 25 bp, Mus musculus
atccagaaactgtgaagctaatccg

SEQ ID NO: 242299 - DNA, 25 bp, Mus musculus
atccagaagaaacaggcctcgccag

SEQ ID NO: 242300 - DNA, 25 bp, Mus musculus
atccagaagaaagaggcctcgccag

SEQ ID NO: 242301 - DNA, 25 bp, Mus musculus
atccagaagacccttcatcaggacc

SEQ ID NO: 242302 - DNA, 25 bp, Mus musculus
atccagaagaccgttcatcaggacc

SEQ ID NO: 242303 - DNA, 25 bp, Mus musculus
atccagaagaggaccctgatgacca

SEQ ID NO: 242304 - DNA, 25 bp, Mus musculus
atccagaagaggtccctgatgacca

SEQ ID NO: 242305 - DNA, 25 bp, Mus musculus
atccagaagattacagattaacgaa

SEQ ID NO: 242306 - DNA, 25 bp, Mus musculus
atccagaagatttcagattaacgaa

SEQ ID NO: 242307 - DNA, 25 bp, Mus musculus
atccagaagccccagtcagcgtgag

SEQ ID NO: 242308 - DNA, 25 bp, Mus musculus
atccagaagcccgagtcagcgtgag

SEQ ID NO: 242309 - DNA, 25 bp, Mus musculus
atccagaagcggaagctgaaggaga

SEQ ID NO: 242310 - DNA, 25 bp, Mus musculus
atccagaagcggtagctgaaggaga

SEQ ID NO: 242311 - DNA, 25 bp, Mus musculus
atccagaagctgatccggcctgtgg

SEQ ID NO: 242312 - DNA, 25 bp, Mus musculus
atccagaagctgttccggcctgtgg

SEQ ID NO: 242313 - DNA, 25 bp, Mus musculus
atccagaatccacgttctttctatg

SEQ ID NO: 242314 - DNA, 25 bp, Mus musculus
atccagaatccaggttctttctatg

SEQ ID NO: 242315 - DNA, 25 bp, Mus musculus
atccagaattcacctgaatgcactg

SEQ ID NO: 242316 - DNA, 25 bp, Mus musculus
atccagaattcagctgaatgcactg

SEQ ID NO: 242317 - DNA, 25 bp, Mus musculus
atccagaattccacacagtctttta

SEQ ID NO: 242318 - DNA, 25 bp, Mus musculus
atccagaattcctcacagtctttta

SEQ ID NO: 242319 - DNA, 25 bp, Mus musculus
atccagaattgtctgctccagactc

SEQ ID NO: 242320 - DNA, 25 bp, Mus musculus
atccagaattgtgtgctccagactc

SEQ ID NO: 242321 - DNA, 25 bp, Mus musculus
atccagaattttacacgcctttaga

SEQ ID NO: 242322 - DNA, 25 bp, Mus musculus
atccagaatttttcacgcctttaga

SEQ ID NO: 242323 - DNA, 25 bp, Mus musculus
atccagacaaccctaccgagtgaag

SEQ ID NO: 242324 - DNA, 25 bp, Mus musculus
atccagacaaccgtaccgagtgaag

SEQ ID NO: 242325 - DNA, 25 bp, Mus musculus
atccagacactcatctttgtgattg

SEQ ID NO: 242326 - DNA, 25 bp, Mus musculus
atccagacactcttctttgtgattg

SEQ ID NO: 242327 - DNA, 25 bp, Mus musculus
atccagacacttctcacaacctctg

SEQ ID NO: 242328 - DNA, 25 bp, Mus musculus
atccagacacttgtcacaacctctg

SEQ ID NO: 242329 - DNA, 25 bp, Mus musculus
atccagaccctaaactcgacctgtt

SEQ ID NO: 242330 - DNA, 25 bp, Mus musculus
atccagaccctatactcgacctgtt

SEQ ID NO: 242331 - DNA, 25 bp, Mus musculus
atccagaccctgaagcctccaaatg

SEQ ID NO: 242332 - DNA, 25 bp, Mus musculus
atccagaccctgtagcctccaaatg

SEQ ID NO: 242333 - DNA, 25 bp, Mus musculus
atccagacgatgcaggtctgtccct

SEQ ID NO: 242334 - DNA, 25 bp, Mus musculus
atccagacgatggaggtctgtccct

SEQ ID NO: 242335 - DNA, 25 bp, Mus musculus
atccagacgtggcactggctcatga

SEQ ID NO: 242336 - DNA, 25 bp, Mus musculus
atccagacgtgggactggctcatga

SEQ ID NO: 242337 - DNA, 25 bp, Mus musculus
atccagacgttcacaaaggctgctt

SEQ ID NO: 242338 - DNA, 25 bp, Mus musculus
atccagacgttctcaaaggctgctt

SEQ ID NO: 242339 - DNA, 25 bp, Mus musculus
atccagactacacagaggcagcgct

SEQ ID NO: 242340 - DNA, 25 bp, Mus musculus
atccagactacagagaggcagcgct

SEQ ID NO: 242341 - DNA, 25 bp, Mus musculus
atccagactcagaccgagctagcct

SEQ ID NO: 242342 - DNA, 25 bp, Mus musculus
atccagactcagtccgagctagcct

SEQ ID NO: 242343 - DNA, 25 bp, Mus musculus
atccagactccacccctgaagggac

SEQ ID NO: 242344 - DNA, 25 bp, Mus musculus
atccagactccagccctgaagggac

SEQ ID NO: 242345 - DNA, 25 bp, Mus musculus
atccagactcctcacgttcaagttc

SEQ ID NO: 242346 - DNA, 25 bp, Mus musculus
atccagactcctgacgttcaagttc

SEQ ID NO: 242347 - DNA, 25 bp, Mus musculus
atccagactggaagctttcagataa

SEQ ID NO: 242348 - DNA, 25 bp, Mus musculus
atccagactggatgctttcagataa

SEQ ID NO: 242349 - DNA, 25 bp, Mus musculus
atccagactgtactgatgacctcaa

SEQ ID NO: 242350 - DNA, 25 bp, Mus musculus
atccagactgtagtgatgacctcaa

SEQ ID NO: 242351 - DNA, 25 bp, Mus musculus
atccagactgtgatgcaatatgcta

SEQ ID NO: 242352 - DNA, 25 bp, Mus musculus
atccagactgtgttgcaatatgcta

SEQ ID NO: 242353 - DNA, 25 bp, Mus musculus
atccagacttctctctacttacgag

SEQ ID NO: 242354 - DNA, 25 bp, Mus musculus
atccagacttctgtctacttacgag

SEQ ID NO: 242355 - DNA, 25 bp, Mus musculus
atccagagacctatcgggatccccg

SEQ ID NO: 242356 - DNA, 25 bp, Mus musculus
atccagagacctttcgggatccccg

SEQ ID NO: 242357 - DNA, 25 bp, Mus musculus
atccagagatataccaggagtgtgg

SEQ ID NO: 242358 - DNA, 25 bp, Mus musculus
atccagagatattccaggagtgtgg

SEQ ID NO: 242359 - DNA, 25 bp, Mus musculus
atccagagatgtatcctccagtcgc

SEQ ID NO: 242360 - DNA, 25 bp, Mus musculus
atccagagatgtttcctccagtcgc

SEQ ID NO: 242361 - DNA, 25 bp, Mus musculus
atccagagcactaagctgccggttc

SEQ ID NO: 242362 - DNA, 25 bp, Mus musculus
atccagagcacttagctgccggttc

SEQ ID NO: 242363 - DNA, 25 bp, Mus musculus
atccagagccagagttggttataaa

SEQ ID NO: 242364 - DNA, 25 bp, Mus musculus
atccagagccagtgttggttataaa

SEQ ID NO: 242365 - DNA, 25 bp, Mus musculus
atccagagcccaattcaaaagacac

SEQ ID NO: 242366 - DNA, 25 bp, Mus musculus
atccagagcccatttcaaaagacac

SEQ ID NO: 242367 - DNA, 25 bp, Mus musculus
atccagagccctacactattgaaaa

SEQ ID NO: 242368 - DNA, 25 bp, Mus musculus
atccagagcccttcactattgaaaa

SEQ ID NO: 242369 - DNA, 25 bp, Mus musculus
atccagagcctgattcccttgcaag

SEQ ID NO: 242370 - DNA, 25 bp, Mus musculus
atccagagcctgtttcccttgcaag

SEQ ID NO: 242371 - DNA, 25 bp, Mus musculus
atccagagcgtgatcagcggttttg

SEQ ID NO: 242372 - DNA, 25 bp, Mus musculus
atccagagcgtgttcagcggttttg

SEQ ID NO: 242373 - DNA, 25 bp, Mus musculus
atccagagctctctgttcacagtcg

SEQ ID NO: 242374 - DNA, 25 bp, Mus musculus
atccagagctctgtgttcacagtcg

SEQ ID NO: 242375 - DNA, 25 bp, Mus musculus
atccagaggcccaagccaggtggac

SEQ ID NO: 242376 - DNA, 25 bp, Mus musculus
atccagaggccctagccaggtggac

SEQ ID NO: 242377 - DNA, 25 bp, Mus musculus
atccagagtctcatctttacaccaa

SEQ ID NO: 242378 - DNA, 25 bp, Mus musculus
atccagagtctcttctttacaccaa

SEQ ID NO: 242379 - DNA, 25 bp, Mus musculus
atccagataactcagctctcacaga

SEQ ID NO: 242380 - DNA, 25 bp, Mus musculus
atccagataactgagctctcacaga

SEQ ID NO: 242381 - DNA, 25 bp, Mus musculus
atccagatacctcttcgcaaactgc

SEQ ID NO: 242382 - DNA, 25 bp, Mus musculus
atccagatacctgttcgcaaactgc

SEQ ID NO: 242383 - DNA, 25 bp, Mus musculus
atccagatagagagcagctcacgct

SEQ ID NO: 242384 - DNA, 25 bp, Mus musculus
atccagatagagtgcagctcacgct

SEQ ID NO: 242385 - DNA, 25 bp, Mus musculus
atccagatatatatgccttcagttc

SEQ ID NO: 242386 - DNA, 25 bp, Mus musculus
atccagatatatttgccttcagttc

SEQ ID NO: 242387 - DNA, 25 bp, Mus musculus
atccagatccaacttgatacacctt

SEQ ID NO: 242388 - DNA, 25 bp, Mus musculus
atccagatccaagttgatacacctt

SEQ ID NO: 242389 - DNA, 25 bp, Mus musculus
atccagatctgcaaactctccggtg

SEQ ID NO: 242390 - DNA, 25 bp, Mus musculus
atccagatctgctaactctccggtg

SEQ ID NO: 242391 - DNA, 25 bp, Mus musculus
atccagatggcactgggcccattcc

SEQ ID NO: 242392 - DNA, 25 bp, Mus musculus
atccagatggcagtgggcccattcc

SEQ ID NO: 242393 - DNA, 25 bp, Mus musculus
atccagatggccagtcagctcaaga

SEQ ID NO: 242394 - DNA, 25 bp, Mus musculus
atccagatggcctgtcagctcaaga

SEQ ID NO: 242395 - DNA, 25 bp, Mus musculus
atccagatgggcctgtctgacagaa

SEQ ID NO: 242396 - DNA, 25 bp, Mus musculus
atccagatgggcgtgtctgacagaa

SEQ ID NO: 242397 - DNA, 25 bp, Mus musculus
atccagatggtaaggttgctctcct

SEQ ID NO: 242398 - DNA, 25 bp, Mus musculus
atccagatggtacgagcacagcgct

SEQ ID NO: 242399 - DNA, 25 bp, Mus musculus
atccagatggtaggagcacagcgct

SEQ ID NO: 242400 - DNA, 25 bp, Mus musculus
atccagatggtatggttgctctcct

SEQ ID NO: 242401 - DNA, 25 bp, Mus musculus
atccagatggtcatccagagagatt

SEQ ID NO: 242402 - DNA, 25 bp, Mus musculus
atccagatggtcttccagagagatt

SEQ ID NO: 242403 - DNA, 25 bp, Mus musculus
atccagatgtggctattgacaatat

SEQ ID NO: 242404 - DNA, 25 bp, Mus musculus
atccagatgtgggtattgacaatat

SEQ ID NO: 242405 - DNA, 25 bp, Mus musculus
atccagattactcaagtacagcacg

SEQ ID NO: 242406 - DNA, 25 bp, Mus musculus
atccagattactgaagtacagcacg

SEQ ID NO: 242407 - DNA, 25 bp, Mus musculus
atccagattggacaccttaaccaac

SEQ ID NO: 242408 - DNA, 25 bp, Mus musculus
atccagattggagaccttaaccaac

SEQ ID NO: 242409 - DNA, 25 bp, Mus musculus
atccagattgtgcagactcttcctg

SEQ ID NO: 242410 - DNA, 25 bp, Mus musculus
atccagattgtggagactcttcctg

SEQ ID NO: 242411 - DNA, 25 bp, Mus musculus
atccagatttcacaggccaatttta

SEQ ID NO: 242412 - DNA, 25 bp, Mus musculus
atccagatttcagaggccaatttta

SEQ ID NO: 242413 - DNA, 25 bp, Mus musculus
atccagcaatttacccaccattttt

SEQ ID NO: 242414 - DNA, 25 bp, Mus musculus
atccagcaattttcccaccattttt

SEQ ID NO: 242415 - DNA, 25 bp, Mus musculus
atccagcaggcaaggtcccttgtat

SEQ ID NO: 242416 - DNA, 25 bp, Mus musculus
atccagcaggcatggtcccttgtat

SEQ ID NO: 242417 - DNA, 25 bp, Mus musculus
atccagcagggaccagtagcacctt

SEQ ID NO: 242418 - DNA, 25 bp, Mus musculus
atccagcagggagcagtagcacctt

SEQ ID NO: 242419 - DNA, 25 bp, Mus musculus
atccagcaggtcatggccgcacagg

SEQ ID NO: 242420 - DNA, 25 bp, Mus musculus
atccagcaggtcttggccgcacagg

SEQ ID NO: 242421 - DNA, 25 bp, Mus musculus
atccagcagtagcttgccacgagga

SEQ ID NO: 242422 - DNA, 25 bp, Mus musculus
atccagcagtaggttgccacgagga

SEQ ID NO: 242423 - DNA, 25 bp, Mus musculus
atccagcagtgtctcagccatgggt

SEQ ID NO: 242424 - DNA, 25 bp, Mus musculus
atccagcagtgtgtcagccatgggt

SEQ ID NO: 242425 - DNA, 25 bp, Mus musculus
atccagcatggcagatcacaccaag

SEQ ID NO: 242426 - DNA, 25 bp, Mus musculus
atccagcatggctgatcacaccaag

SEQ ID NO: 242427 - DNA, 25 bp, Mus musculus
atccagccaacaagacctcagaagt

SEQ ID NO: 242428 - DNA, 25 bp, Mus musculus
atccagccaacatgacctcagaagt

SEQ ID NO: 242429 - DNA, 25 bp, Mus musculus
atccagccaggaatagccttcggga

SEQ ID NO: 242430 - DNA, 25 bp, Mus musculus
atccagccaggattagccttcggga

SEQ ID NO: 242431 - DNA, 25 bp, Mus musculus
atccagccagttcctaagcaactct

SEQ ID NO: 242432 - DNA, 25 bp, Mus musculus
atccagccagttgctaagcaactct

SEQ ID NO: 242433 - DNA, 25 bp, Mus musculus
atccagcccaaaattccttggtgtt

SEQ ID NO: 242434 - DNA, 25 bp, Mus musculus
atccagcccaaatttccttggtgtt

SEQ ID NO: 242435 - DNA, 25 bp, Mus musculus
atccagcccactagacccttgggga

SEQ ID NO: 242436 - DNA, 25 bp, Mus musculus
atccagcccacttgacccttgggga

SEQ ID NO: 242437 - DNA, 25 bp, Mus musculus
atccagcccagcatgctaaaatctg

SEQ ID NO: 242438 - DNA, 25 bp, Mus musculus
atccagcccagcttgctaaaatctg

SEQ ID NO: 242439 - DNA, 25 bp, Mus musculus
atccagcctagtctgatggtacaca

SEQ ID NO: 242440 - DNA, 25 bp, Mus musculus
atccagcctagtgtgatggtacaca

SEQ ID NO: 242441 - DNA, 25 bp, Mus musculus
atccagccttggaacctgcggatgg

SEQ ID NO: 242442 - DNA, 25 bp, Mus musculus
atccagccttggtacctgcggatgg

SEQ ID NO: 242443 - DNA, 25 bp, Mus musculus
atccagccttgtcgttttatgcctg

SEQ ID NO: 242444 - DNA, 25 bp, Mus musculus
atccagccttgtggttttatgcctg

SEQ ID NO: 242445 - DNA, 25 bp, Mus musculus
atccagcgacctcgttccaggagga

SEQ ID NO: 242446 - DNA, 25 bp, Mus musculus
atccagcgacctggttccaggagga

SEQ ID NO: 242447 - DNA, 25 bp, Mus musculus
atccagcgcataatgacccagcagg

SEQ ID NO: 242448 - DNA, 25 bp, Mus musculus
atccagcgcatattgacccagcagg

SEQ ID NO: 242449 - DNA, 25 bp, Mus musculus
atccagcgggatcaactggctcctt

SEQ ID NO: 242450 - DNA, 25 bp, Mus musculus
atccagcgggatgaactggctcctt

SEQ ID NO: 242451 - DNA, 25 bp, Mus musculus
atccagcgtgctcgctccagagctg

SEQ ID NO: 242452 - DNA, 25 bp, Mus musculus
atccagcgtgctggctccagagctg

SEQ ID NO: 242453 - DNA, 25 bp, Mus musculus
atccagctaggtctagtgggtgcac

SEQ ID NO: 242454 - DNA, 25 bp, Mus musculus
atccagctaggtgtagtgggtgcac

SEQ ID NO: 242455 - DNA, 25 bp, Mus musculus
atccagctcatcaactgaaggcttc

SEQ ID NO: 242456 - DNA, 25 bp, Mus musculus
atccagctcatctactgaaggcttc

SEQ ID NO: 242457 - DNA, 25 bp, Mus musculus
atccagctccagatggcggagtcag

SEQ ID NO: 242458 - DNA, 25 bp, Mus musculus
atccagctccagttggcggagtcag

SEQ ID NO: 242459 - DNA, 25 bp, Mus musculus
atccagctcttacttgtgggaacaa

SEQ ID NO: 242460 - DNA, 25 bp, Mus musculus
atccagctcttagttgtgggaacaa

SEQ ID NO: 242461 - DNA, 25 bp, Mus musculus
atccagctcttcatatgtagtcagg

SEQ ID NO: 242462 - DNA, 25 bp, Mus musculus
atccagctcttcttatgtagtcagg

SEQ ID NO: 242463 - DNA, 25 bp, Mus musculus
atccagctctttaagtgatccttgt

SEQ ID NO: 242464 - DNA, 25 bp, Mus musculus
atccagctcttttagtgatccttgt

SEQ ID NO: 242465 - DNA, 25 bp, Mus musculus
atccagctgagcctgttatgcagag

SEQ ID NO: 242466 - DNA, 25 bp, Mus musculus
atccagctgagcgtgttatgcagag

SEQ ID NO: 242467 - DNA, 25 bp, Mus musculus
atccagctgcagaacagggcgctgt

SEQ ID NO: 242468 - DNA, 25 bp, Mus musculus
atccagctgcagtacagggcgctgt

SEQ ID NO: 242469 - DNA, 25 bp, Mus musculus
atccagctgccgaagaacttgctaa

SEQ ID NO: 242470 - DNA, 25 bp, Mus musculus
atccagctgccgtagaacttgctaa

SEQ ID NO: 242471 - DNA, 25 bp, Mus musculus
atccagctggcccatgtgtaacagg

SEQ ID NO: 242472 - DNA, 25 bp, Mus musculus
atccagctggccctgaggttagtaa

SEQ ID NO: 242473 - DNA, 25 bp, Mus musculus
atccagctggccgatgtgtaacagg

SEQ ID NO: 242474 - DNA, 25 bp, Mus musculus
atccagctggccgtgaggttagtaa

SEQ ID NO: 242475 - DNA, 25 bp, Mus musculus
atccagctgtaacgctctggtcaga

SEQ ID NO: 242476 - DNA, 25 bp, Mus musculus
atccagctgtaaggctctggtcaga

SEQ ID NO: 242477 - DNA, 25 bp, Mus musculus
atccagctgtcaaagggttcagacc

SEQ ID NO: 242478 - DNA, 25 bp, Mus musculus
atccagctgtcatagggttcagacc

SEQ ID NO: 242479 - DNA, 25 bp, Mus musculus
atccagctgttcagctactaatatt

SEQ ID NO: 242480 - DNA, 25 bp, Mus musculus
atccagctgttctgctactaatatt

SEQ ID NO: 242481 - DNA, 25 bp, Mus musculus
atccagcttccgcagtaatggctca

SEQ ID NO: 242482 - DNA, 25 bp, Mus musculus
atccagcttccggagtaatggctca

SEQ ID NO: 242483 - DNA, 25 bp, Mus musculus
atccagcttttacacgtggacgtct

SEQ ID NO: 242484 - DNA, 25 bp, Mus musculus
atccagcttttagacgtggacgtct

SEQ ID NO: 242485 - DNA, 25 bp, Mus musculus
atccaggaccatagggtttatgtag

SEQ ID NO: 242486 - DNA, 25 bp, Mus musculus
atccaggaccattgggtttatgtag

SEQ ID NO: 242487 - DNA, 25 bp, Mus musculus
atccaggaccggaagagtgccgcaa

SEQ ID NO: 242488 - DNA, 25 bp, Mus musculus
atccaggaccggtagagtgccgcaa

SEQ ID NO: 242489 - DNA, 25 bp, Mus musculus
atccaggacctgctagcaaggaaac

SEQ ID NO: 242490 - DNA, 25 bp, Mus musculus
atccaggacctggtagcaaggaaac

SEQ ID NO: 242491 - DNA, 25 bp, Mus musculus
atccaggacggcacattgataccca

SEQ ID NO: 242492 - DNA, 25 bp, Mus musculus
atccaggacggctcattgataccca

SEQ ID NO: 242493 - DNA, 25 bp, Mus musculus
atccaggactggaaggccttgctgc

SEQ ID NO: 242494 - DNA, 25 bp, Mus musculus
atccaggactggtaggccttgctgc

SEQ ID NO: 242495 - DNA, 25 bp, Mus musculus
atccaggagctgatattttgcccaa

SEQ ID NO: 242496 - DNA, 25 bp, Mus musculus
atccaggagctgttattttgcccaa

SEQ ID NO: 242497 - DNA, 25 bp, Mus musculus
atccaggagtcgcaggcacagctgt

SEQ ID NO: 242498 - DNA, 25 bp, Mus musculus
atccaggagtcggaggcacagctgt

SEQ ID NO: 242499 - DNA, 25 bp, Mus musculus
atccaggagtgtctacgtgtctctc

SEQ ID NO: 242500 - DNA, 25 bp, Mus musculus
atccaggagtgtgtacgtgtctctc

SEQ ID NO: 242501 - DNA, 25 bp, Mus musculus
atccaggatataaacctctcaggta

SEQ ID NO: 242502 - DNA, 25 bp, Mus musculus
atccaggatatatacctctcaggta

SEQ ID NO: 242503 - DNA, 25 bp, Mus musculus
atccaggcagagaacacctttggac

SEQ ID NO: 242504 - DNA, 25 bp, Mus musculus
atccaggcagagacagcgcccagag

SEQ ID NO: 242505 - DNA, 25 bp, Mus musculus
atccaggcagagtacacctttggac

SEQ ID NO: 242506 - DNA, 25 bp, Mus musculus
atccaggcagagtcagcgcccagag

SEQ ID NO: 242507 - DNA, 25 bp, Mus musculus
atccaggcagccactatcaaatcaa

SEQ ID NO: 242508 - DNA, 25 bp, Mus musculus
atccaggcagccactttaagtgcag

SEQ ID NO: 242509 - DNA, 25 bp, Mus musculus
atccaggcagcctctatcaaatcaa

SEQ ID NO: 242510 - DNA, 25 bp, Mus musculus
atccaggcagcctctttaagtgcag

SEQ ID NO: 242511 - DNA, 25 bp, Mus musculus
atccaggcaggtataggctgctcca

SEQ ID NO: 242512 - DNA, 25 bp, Mus musculus
atccaggcaggtttaggctgctcca

SEQ ID NO: 242513 - DNA, 25 bp, Mus musculus
atccaggccaggaacgaactgagac

SEQ ID NO: 242514 - DNA, 25 bp, Mus musculus
atccaggccaggctgattgaatgct

SEQ ID NO: 242515 - DNA, 25 bp, Mus musculus
atccaggccagggtgattgaatgct

SEQ ID NO: 242516 - DNA, 25 bp, Mus musculus
atccaggccaggtacgaactgagac

SEQ ID NO: 242517 - DNA, 25 bp, Mus musculus
atccaggcctggagtactgctaaat

SEQ ID NO: 242518 - DNA, 25 bp, Mus musculus
atccaggcctggataatgcacattg

SEQ ID NO: 242519 - DNA, 25 bp, Mus musculus
atccaggcctggtgtactgctaaat

SEQ ID NO: 242520 - DNA, 25 bp, Mus musculus
atccaggcctggttaatgcacattg

SEQ ID NO: 242521 - DNA, 25 bp, Mus musculus
atccaggcgagccactgtgggcatt

SEQ ID NO: 242522 - DNA, 25 bp, Mus musculus
atccaggcgagcgactgtgggcatt

SEQ ID NO: 242523 - DNA, 25 bp, Mus musculus
atccaggcggcccatgactccgtgg

SEQ ID NO: 242524 - DNA, 25 bp, Mus musculus
atccaggcggccgatgactccgtgg

SEQ ID NO: 242525 - DNA, 25 bp, Mus musculus
atccaggctaaaaactctaagcttg

SEQ ID NO: 242526 - DNA, 25 bp, Mus musculus
atccaggctaaatactctaagcttg

SEQ ID NO: 242527 - DNA, 25 bp, Mus musculus
atccaggctactcggaggtaagcgt

SEQ ID NO: 242528 - DNA, 25 bp, Mus musculus
atccaggctactgggaggtaagcgt

SEQ ID NO: 242529 - DNA, 25 bp, Mus musculus
atccaggctcctctatgtctctaaa

SEQ ID NO: 242530 - DNA, 25 bp, Mus musculus
atccaggctcctgtatgtctctaaa

SEQ ID NO: 242531 - DNA, 25 bp, Mus musculus
atccaggctgcgaatgaagtcttga

SEQ ID NO: 242532 - DNA, 25 bp, Mus musculus
atccaggctgcgtatgaagtcttga

SEQ ID NO: 242533 - DNA, 25 bp, Mus musculus
atccaggctggaaggcaccacaaag

SEQ ID NO: 242534 - DNA, 25 bp, Mus musculus
atccaggctggatggcaccacaaag

SEQ ID NO: 242535 - DNA, 25 bp, Mus musculus
atccaggctggtattgtaagatgct

SEQ ID NO: 242536 - DNA, 25 bp, Mus musculus
atccaggctggtcggctcagtcaaa

SEQ ID NO: 242537 - DNA, 25 bp, Mus musculus
atccaggctggtgggctcagtcaaa

SEQ ID NO: 242538 - DNA, 25 bp, Mus musculus
atccaggctggttttgtaagatgct

SEQ ID NO: 242539 - DNA, 25 bp, Mus musculus
atccaggctgttcaaagcacctctg

SEQ ID NO: 242540 - DNA, 25 bp, Mus musculus
atccaggctgttgaaagcacctctg

SEQ ID NO: 242541 - DNA, 25 bp, Mus musculus
atccaggcttcccaagatacactag

SEQ ID NO: 242542 - DNA, 25 bp, Mus musculus
atccaggcttccgaagatacactag

SEQ ID NO: 242543 - DNA, 25 bp, Mus musculus
atccagggacctcctaggctactag

SEQ ID NO: 242544 - DNA, 25 bp, Mus musculus
atccagggacctgctaggctactag

SEQ ID NO: 242545 - DNA, 25 bp, Mus musculus
atccagggacggattttcctcagtg

SEQ ID NO: 242546 - DNA, 25 bp, Mus musculus
atccagggacggtttttcctcagtg

SEQ ID NO: 242547 - DNA, 25 bp, Mus musculus
atccagggaggaaactctctgcggc

SEQ ID NO: 242548 - DNA, 25 bp, Mus musculus
atccagggaggacccgtggaaccct

SEQ ID NO: 242549 - DNA, 25 bp, Mus musculus
atccagggaggagccgtggaaccct

SEQ ID NO: 242550 - DNA, 25 bp, Mus musculus
atccagggaggatactctctgcggc

SEQ ID NO: 242551 - DNA, 25 bp, Mus musculus
atccagggataccagctccacagca

SEQ ID NO: 242552 - DNA, 25 bp, Mus musculus
atccagggatacgagctccacagca

SEQ ID NO: 242553 - DNA, 25 bp, Mus musculus
atccagggcacgctgactgctgagc

SEQ ID NO: 242554 - DNA, 25 bp, Mus musculus
atccagggcacggtgactgctgagc

SEQ ID NO: 242555 - DNA, 25 bp, Mus musculus
atccagggcattcatctctcatcgt

SEQ ID NO: 242556 - DNA, 25 bp, Mus musculus
atccagggcattgatctctcatcgt

SEQ ID NO: 242557 - DNA, 25 bp, Mus musculus
atccagggcctgagaatcatcattc

SEQ ID NO: 242558 - DNA, 25 bp, Mus musculus
atccagggcctgtgaatcatcattc

SEQ ID NO: 242559 - DNA, 25 bp, Mus musculus
atccagggccttcatcatacgagat

SEQ ID NO: 242560 - DNA, 25 bp, Mus musculus
atccagggccttgatcatacgagat

SEQ ID NO: 242561 - DNA, 25 bp, Mus musculus
atccagggctagcttcactgatgct

SEQ ID NO: 242562 - DNA, 25 bp, Mus musculus
atccagggctaggttcactgatgct

SEQ ID NO: 242563 - DNA, 25 bp, Mus musculus
atccagggctccaatgatgtagaga

SEQ ID NO: 242564 - DNA, 25 bp, Mus musculus
atccagggctcctatgatgtagaga

SEQ ID NO: 242565 - DNA, 25 bp, Mus musculus
atccagggtggtatgatgtcaagcc

SEQ ID NO: 242566 - DNA, 25 bp, Mus musculus
atccagggtggtttgatgtcaagcc

SEQ ID NO: 242567 - DNA, 25 bp, Mus musculus
atccaggtaagtcatggccatacac

SEQ ID NO: 242568 - DNA, 25 bp, Mus musculus
atccaggtaagtgatggccatacac

SEQ ID NO: 242569 - DNA, 25 bp, Mus musculus
atccaggtaattctggacgcccact

SEQ ID NO: 242570 - DNA, 25 bp, Mus musculus
atccaggtaattgtggacgcccact

SEQ ID NO: 242571 - DNA, 25 bp, Mus musculus
atccaggtatcacagggtctcacag

SEQ ID NO: 242572 - DNA, 25 bp, Mus musculus
atccaggtatcagagggtctcacag

SEQ ID NO: 242573 - DNA, 25 bp, Mus musculus
atccaggtattaatcgtgtagtcca

SEQ ID NO: 242574 - DNA, 25 bp, Mus musculus
atccaggtattattcgtgtagtcca

SEQ ID NO: 242575 - DNA, 25 bp, Mus musculus
atccaggtcctcaaagatagcagcc

SEQ ID NO: 242576 - DNA, 25 bp, Mus musculus
atccaggtcctctaagatagcagcc

SEQ ID NO: 242577 - DNA, 25 bp, Mus musculus
atccaggtccttaggcatgcgtggc

SEQ ID NO: 242578 - DNA, 25 bp, Mus musculus
atccaggtcctttggcatgcgtggc

SEQ ID NO: 242579 - DNA, 25 bp, Mus musculus
atccaggtgaccagtgtgatccctg

SEQ ID NO: 242580 - DNA, 25 bp, Mus musculus
atccaggtgacctgtgtgatccctg

SEQ ID NO: 242581 - DNA, 25 bp, Mus musculus
atccaggtgctgctttgccaactga

SEQ ID NO: 242582 - DNA, 25 bp, Mus musculus
atccaggtgctggtttgccaactga

SEQ ID NO: 242583 - DNA, 25 bp, Mus musculus
atccaggtgcttatcatgtgacatt

SEQ ID NO: 242584 - DNA, 25 bp, Mus musculus
atccaggtgcttttcatgtgacatt

SEQ ID NO: 242585 - DNA, 25 bp, Mus musculus
atccaggtggtgacctctgccattg

SEQ ID NO: 242586 - DNA, 25 bp, Mus musculus
atccaggtggtgtcctctgccattg

SEQ ID NO: 242587 - DNA, 25 bp, Mus musculus
atccaggttctaccaccgatggcaa

SEQ ID NO: 242588 - DNA, 25 bp, Mus musculus
atccaggttctagcaccgatggcaa

SEQ ID NO: 242589 - DNA, 25 bp, Mus musculus
atccaggttctcactaaaggtacag

SEQ ID NO: 242590 - DNA, 25 bp, Mus musculus
atccaggttctctctaaaggtacag

SEQ ID NO: 242591 - DNA, 25 bp, Mus musculus
atccaggttggcacacaatatgcac

SEQ ID NO: 242592 - DNA, 25 bp, Mus musculus
atccaggttggctcacaatatgcac

SEQ ID NO: 242593 - DNA, 25 bp, Mus musculus
atccagtagataatatttccctttt

SEQ ID NO: 242594 - DNA, 25 bp, Mus musculus
atccagtagatattatttccctttt

SEQ ID NO: 242595 - DNA, 25 bp, Mus musculus
atccagtagctgataaatcgtgagt

SEQ ID NO: 242596 - DNA, 25 bp, Mus musculus
atccagtagctgatcccatccacaa

SEQ ID NO: 242597 - DNA, 25 bp, Mus musculus
atccagtagctgttaaatcgtgagt

SEQ ID NO: 242598 - DNA, 25 bp, Mus musculus
atccagtagctgttcccatccacaa

SEQ ID NO: 242599 - DNA, 25 bp, Mus musculus
atccagtatgcaaatgtctctgtgt

SEQ ID NO: 242600 - DNA, 25 bp, Mus musculus
atccagtatgcatatgtctctgtgt

SEQ ID NO: 242601 - DNA, 25 bp, Mus musculus
atccagtcagaccatcacattcagt

SEQ ID NO: 242602 - DNA, 25 bp, Mus musculus
atccagtcagacgatcacattcagt

SEQ ID NO: 242603 - DNA, 25 bp, Mus musculus
atccagtcagatcctatcacagatg

SEQ ID NO: 242604 - DNA, 25 bp, Mus musculus
atccagtcagatgctatcacagatg

SEQ ID NO: 242605 - DNA, 25 bp, Mus musculus
atccagtcagcacttctggctactg

SEQ ID NO: 242606 - DNA, 25 bp, Mus musculus
atccagtcagcagttctggctactg

SEQ ID NO: 242607 - DNA, 25 bp, Mus musculus
atccagtcagcgcaagaattttcct

SEQ ID NO: 242608 - DNA, 25 bp, Mus musculus
atccagtcagcggaagaattttcct

SEQ ID NO: 242609 - DNA, 25 bp, Mus musculus
atccagtccaagacaatcagggctt

SEQ ID NO: 242610 - DNA, 25 bp, Mus musculus
atccagtccaagtcaatcagggctt

SEQ ID NO: 242611 - DNA, 25 bp, Mus musculus
atccagtcccttctctaacaaagag

SEQ ID NO: 242612 - DNA, 25 bp, Mus musculus
atccagtcccttgtctaacaaagag

SEQ ID NO: 242613 - DNA, 25 bp, Mus musculus
atccagtcctgactggtcaactcta

SEQ ID NO: 242614 - DNA, 25 bp, Mus musculus
atccagtcctgagtggtcaactcta

SEQ ID NO: 242615 - DNA, 25 bp, Mus musculus
atccagtctcccaggtaagcagaga

SEQ ID NO: 242616 - DNA, 25 bp, Mus musculus
atccagtctccctggtaagcagaga

SEQ ID NO: 242617 - DNA, 25 bp, Mus musculus
atccagtctctaaggcatatcagcc

SEQ ID NO: 242618 - DNA, 25 bp, Mus musculus
atccagtctctatggcatatcagcc

SEQ ID NO: 242619 - DNA, 25 bp, Mus musculus
atccagtctctgatcagacccaaaa

SEQ ID NO: 242620 - DNA, 25 bp, Mus musculus
atccagtctctgttcagacccaaaa

SEQ ID NO: 242621 - DNA, 25 bp, Mus musculus
atccagtctgcaaagcagggcgaca

SEQ ID NO: 242622 - DNA, 25 bp, Mus musculus
atccagtctgcatagcagggcgaca

SEQ ID NO: 242623 - DNA, 25 bp, Mus musculus
atccagtctgccctgacttggaaaa

SEQ ID NO: 242624 - DNA, 25 bp, Mus musculus
atccagtctgccgtgacttggaaaa

SEQ ID NO: 242625 - DNA, 25 bp, Mus musculus
atccagtctggcagcaacggtgact

SEQ ID NO: 242626 - DNA, 25 bp, Mus musculus
atccagtctggctgcaacggtgact

SEQ ID NO: 242627 - DNA, 25 bp, Mus musculus
atccagtgagctctgccctatgtgt

SEQ ID NO: 242628 - DNA, 25 bp, Mus musculus
atccagtgagctgtgccctatgtgt

SEQ ID NO: 242629 - DNA, 25 bp, Mus musculus
atccagtgcaagctaggcaccttta

SEQ ID NO: 242630 - DNA, 25 bp, Mus musculus
atccagtgcaaggtaggcaccttta

SEQ ID NO: 242631 - DNA, 25 bp, Mus musculus
atccagtgccggcaccatgaggctg

SEQ ID NO: 242632 - DNA, 25 bp, Mus musculus
atccagtgccgggaccatgaggctg

SEQ ID NO: 242633 - DNA, 25 bp, Mus musculus
atccagtgcctgagatccgcagaga

SEQ ID NO: 242634 - DNA, 25 bp, Mus musculus
atccagtgcctgtgatccgcagaga

SEQ ID NO: 242635 - DNA, 25 bp, Mus musculus
atccagtgctcacttagcacatgct

SEQ ID NO: 242636 - DNA, 25 bp, Mus musculus
atccagtgctcagttagcacatgct

SEQ ID NO: 242637 - DNA, 25 bp, Mus musculus
atccagtgctggctaatttgaacga

SEQ ID NO: 242638 - DNA, 25 bp, Mus musculus
atccagtgctggcttacttgtgtag

SEQ ID NO: 242639 - DNA, 25 bp, Mus musculus
atccagtgctgggtaatttgaacga

SEQ ID NO: 242640 - DNA, 25 bp, Mus musculus
atccagtgctgggttacttgtgtag

SEQ ID NO: 242641 - DNA, 25 bp, Mus musculus
atccagtgggtgagctccaggtcca

SEQ ID NO: 242642 - DNA, 25 bp, Mus musculus
atccagtgggtgaggttcacactaa

SEQ ID NO: 242643 - DNA, 25 bp, Mus musculus
atccagtgggtgtgctccaggtcca

SEQ ID NO: 242644 - DNA, 25 bp, Mus musculus
atccagtgggtgtggttcacactaa

SEQ ID NO: 242645 - DNA, 25 bp, Mus musculus
atccagtggtagattgttccacaag

SEQ ID NO: 242646 - DNA, 25 bp, Mus musculus
atccagtggtagtttgttccacaag

SEQ ID NO: 242647 - DNA, 25 bp, Mus musculus
atccagtggtgcacctgtctgctgg

SEQ ID NO: 242648 - DNA, 25 bp, Mus musculus
atccagtggtgctcctgtctgctgg

SEQ ID NO: 242649 - DNA, 25 bp, Mus musculus
atccagtggttcaggcaggttgtca

SEQ ID NO: 242650 - DNA, 25 bp, Mus musculus
atccagtggttctggcaggttgtca

SEQ ID NO: 242651 - DNA, 25 bp, Mus musculus
atccagtggttgaacggctgccagc

SEQ ID NO: 242652 - DNA, 25 bp, Mus musculus
atccagtggttgtacggctgccagc

SEQ ID NO: 242653 - DNA, 25 bp, Mus musculus
atccagtgtatcatcagagtcactt

SEQ ID NO: 242654 - DNA, 25 bp, Mus musculus
atccagtgtatcttcagagtcactt

SEQ ID NO: 242655 - DNA, 25 bp, Mus musculus
atccagtgtatgctgtccagtggca

SEQ ID NO: 242656 - DNA, 25 bp, Mus musculus
atccagtgtatggtgtccagtggca

SEQ ID NO: 242657 - DNA, 25 bp, Mus musculus
atccagtgtgcccactacattgatg

SEQ ID NO: 242658 - DNA, 25 bp, Mus musculus
atccagtgtgccgactacattgatg

SEQ ID NO: 242659 - DNA, 25 bp, Mus musculus
atccagtgttcaaagctgctgtcag

SEQ ID NO: 242660 - DNA, 25 bp, Mus musculus
atccagtgttcatagctgctgtcag

SEQ ID NO: 242661 - DNA, 25 bp, Mus musculus
atccagtgttctacatcaatgttag

SEQ ID NO: 242662 - DNA, 25 bp, Mus musculus
atccagtgttcttcatcaatgttag

SEQ ID NO: 242663 - DNA, 25 bp, Mus musculus
atccagtgttgtatagcaccttcat

SEQ ID NO: 242664 - DNA, 25 bp, Mus musculus
atccagtgttgtttagcaccttcat

SEQ ID NO: 242665 - DNA, 25 bp, Mus musculus
atccagttatctagtctcaccaggg

SEQ ID NO: 242666 - DNA, 25 bp, Mus musculus
atccagttatcttgtctcaccaggg

SEQ ID NO: 242667 - DNA, 25 bp, Mus musculus
atccagttcctgaaagtgtgccatt

SEQ ID NO: 242668 - DNA, 25 bp, Mus musculus
atccagttcctgtaagtgtgccatt

SEQ ID NO: 242669 - DNA, 25 bp, Mus musculus
atccagttctcactgagcccattag

SEQ ID NO: 242670 - DNA, 25 bp, Mus musculus
atccagttctcagtgagcccattag

SEQ ID NO: 242671 - DNA, 25 bp, Mus musculus
atccagttcttcacgtttacagttt

SEQ ID NO: 242672 - DNA, 25 bp, Mus musculus
atccagttcttctcgtttacagttt

SEQ ID NO: 242673 - DNA, 25 bp, Mus musculus
atccagttggagatgtatgatgtca

SEQ ID NO: 242674 - DNA, 25 bp, Mus musculus
atccagttggagttgtatgatgtca

SEQ ID NO: 242675 - DNA, 25 bp, Mus musculus
atccagttgtttctgggctgtgcga

SEQ ID NO: 242676 - DNA, 25 bp, Mus musculus
atccagttgtttgtgggctgtgcga

SEQ ID NO: 242677 - DNA, 25 bp, Mus musculus
atccagtttcgaagttgaaccattg

SEQ ID NO: 242678 - DNA, 25 bp, Mus musculus
atccagtttcgatgttgaaccattg

SEQ ID NO: 242679 - DNA, 25 bp, Mus musculus
atccataaaatccaagccctttctt

SEQ ID NO: 242680 - DNA, 25 bp, Mus musculus
atccataaaatcgaagccctttctt

SEQ ID NO: 242681 - DNA, 25 bp, Mus musculus
atccataactaacttaaatcccagc

SEQ ID NO: 242682 - DNA, 25 bp, Mus musculus
atccataactaagttaaatcccagc

SEQ ID NO: 242683 - DNA, 25 bp, Mus musculus
atccataagccgattgctaaccgtc

SEQ ID NO: 242684 - DNA, 25 bp, Mus musculus
atccataagccgtttgctaaccgtc

SEQ ID NO: 242685 - DNA, 25 bp, Mus musculus
atccataagtaactcgccattgcca

SEQ ID NO: 242686 - DNA, 25 bp, Mus musculus
atccataagtaagtcgccattgcca

SEQ ID NO: 242687 - DNA, 25 bp, Mus musculus
atccataatcacaagtagccaccat

SEQ ID NO: 242688 - DNA, 25 bp, Mus musculus
atccataatcactagtagccaccat

SEQ ID NO: 242689 - DNA, 25 bp, Mus musculus
atccatacagcaaccccagtataaa

SEQ ID NO: 242690 - DNA, 25 bp, Mus musculus
atccatacagcaatctcatctgctt

SEQ ID NO: 242691 - DNA, 25 bp, Mus musculus
atccatacagcatccccagtataaa

SEQ ID NO: 242692 - DNA, 25 bp, Mus musculus
atccatacagcattctcatctgctt

SEQ ID NO: 242693 - DNA, 25 bp, Mus musculus
atccatacccaactgaatgtgatgg

SEQ ID NO: 242694 - DNA, 25 bp, Mus musculus
atccatacccaagtgaatgtgatgg

SEQ ID NO: 242695 - DNA, 25 bp, Mus musculus
atccatacccagatctcaaggcata

SEQ ID NO: 242696 - DNA, 25 bp, Mus musculus
atccatacccagttctcaaggcata

SEQ ID NO: 242697 - DNA, 25 bp, Mus musculus
atccatacctgacttttgagcaatg

SEQ ID NO: 242698 - DNA, 25 bp, Mus musculus
atccatacctgagttttgagcaatg

SEQ ID NO: 242699 - DNA, 25 bp, Mus musculus
atccatacctgtccatgcgctgtat

SEQ ID NO: 242700 - DNA, 25 bp, Mus musculus
atccatacctgtgcatgcgctgtat

SEQ ID NO: 242701 - DNA, 25 bp, Mus musculus
atccatactaatattcaagtccttt

SEQ ID NO: 242702 - DNA, 25 bp, Mus musculus
atccatactaattttcaagtccttt

SEQ ID NO: 242703 - DNA, 25 bp, Mus musculus
atccatactgccattcaaactatct

SEQ ID NO: 242704 - DNA, 25 bp, Mus musculus
atccatactgcctttcaaactatct

SEQ ID NO: 242705 - DNA, 25 bp, Mus musculus
atccatacttttaactgtggccagg

SEQ ID NO: 242706 - DNA, 25 bp, Mus musculus
atccatactttttactgtggccagg

SEQ ID NO: 242707 - DNA, 25 bp, Mus musculus
atccatagaccaatcttgaccgagc

SEQ ID NO: 242708 - DNA, 25 bp, Mus musculus
atccatagaccattcttgaccgagc

SEQ ID NO: 242709 - DNA, 25 bp, Mus musculus
atccatagccctaggaagtggagtt

SEQ ID NO: 242710 - DNA, 25 bp, Mus musculus
atccatagcccttggaagtggagtt

SEQ ID NO: 242711 - DNA, 25 bp, Mus musculus
atccataggacacatcaggcttcaa

SEQ ID NO: 242712 - DNA, 25 bp, Mus musculus
atccataggacagatcaggcttcaa

SEQ ID NO: 242713 - DNA, 25 bp, Mus musculus
atccatagtggaataacccaatttt

SEQ ID NO: 242714 - DNA, 25 bp, Mus musculus
atccatagtggattaacccaatttt

SEQ ID NO: 242715 - DNA, 25 bp, Mus musculus
atccatatatgcacctcacattgtc

SEQ ID NO: 242716 - DNA, 25 bp, Mus musculus
atccatatatgctcctcacattgtc

SEQ ID NO: 242717 - DNA, 25 bp, Mus musculus
atccatatctccaatcggtgtctct

SEQ ID NO: 242718 - DNA, 25 bp, Mus musculus
atccatatctcctatcggtgtctct

SEQ ID NO: 242719 - DNA, 25 bp, Mus musculus
atccatatctcgatttctctgctaa

SEQ ID NO: 242720 - DNA, 25 bp, Mus musculus
atccatatctcgttttctctgctaa

SEQ ID NO: 242721 - DNA, 25 bp, Mus musculus
atccatatctttctgtgaccatccg

SEQ ID NO: 242722 - DNA, 25 bp, Mus musculus
atccatatctttgtgtgaccatccg

SEQ ID NO: 242723 - DNA, 25 bp, Mus musculus
atccatatgctacactctccctatc

SEQ ID NO: 242724 - DNA, 25 bp, Mus musculus
atccatatgctagactctccctatc

SEQ ID NO: 242725 - DNA, 25 bp, Mus musculus
atccatcaatgcctttcttgaccaa

SEQ ID NO: 242726 - DNA, 25 bp, Mus musculus
atccatcaatgcgtttcttgaccaa

SEQ ID NO: 242727 - DNA, 25 bp, Mus musculus
atccatcacagaccagttcaggtag

SEQ ID NO: 242728 - DNA, 25 bp, Mus musculus
atccatcacagagcagttcaggtag

SEQ ID NO: 242729 - DNA, 25 bp, Mus musculus
atccatcaccgcctgaaggaacagc

SEQ ID NO: 242730 - DNA, 25 bp, Mus musculus
atccatcaccgcgtgaaggaacagc

SEQ ID NO: 242731 - DNA, 25 bp, Mus musculus
atccatcacctcatggtggagctga

SEQ ID NO: 242732 - DNA, 25 bp, Mus musculus
atccatcacctcttggtggagctga

SEQ ID NO: 242733 - DNA, 25 bp, Mus musculus
atccatcacgtcctggtaatcacaa

SEQ ID NO: 242734 - DNA, 25 bp, Mus musculus
atccatcacgtcgtggtaatcacaa

SEQ ID NO: 242735 - DNA, 25 bp, Mus musculus
atccatcacgttagacaactaggaa

SEQ ID NO: 242736 - DNA, 25 bp, Mus musculus
atccatcacgtttgacaactaggaa

SEQ ID NO: 242737 - DNA, 25 bp, Mus musculus
atccatcactagctacatggcaagt

SEQ ID NO: 242738 - DNA, 25 bp, Mus musculus
atccatcactaggtacatggcaagt

SEQ ID NO: 242739 - DNA, 25 bp, Mus musculus
atccatcagcagcattagtgactta

SEQ ID NO: 242740 - DNA, 25 bp, Mus musculus
atccatcagcaggattagtgactta

SEQ ID NO: 242741 - DNA, 25 bp, Mus musculus
atccatcagcgcctatgcagaagat

SEQ ID NO: 242742 - DNA, 25 bp, Mus musculus
atccatcagcgcgtatgcagaagat

SEQ ID NO: 242743 - DNA, 25 bp, Mus musculus
atccatcaggacacgatctgagtca

SEQ ID NO: 242744 - DNA, 25 bp, Mus musculus
atccatcaggactcgatctgagtca

SEQ ID NO: 242745 - DNA, 25 bp, Mus musculus
atccatcatcagcagtgttcctcta

SEQ ID NO: 242746 - DNA, 25 bp, Mus musculus
atccatcatcaggagtgttcctcta

SEQ ID NO: 242747 - DNA, 25 bp, Mus musculus
atccatccaataaacaagcctgcca

SEQ ID NO: 242748 - DNA, 25 bp, Mus musculus
atccatccaatatacaagcctgcca

SEQ ID NO: 242749 - DNA, 25 bp, Mus musculus
atccatccagaaagggacctacaac

SEQ ID NO: 242750 - DNA, 25 bp, Mus musculus
atccatccagaatgggacctacaac

SEQ ID NO: 242751 - DNA, 25 bp, Mus musculus
atccatccatcaatgattcctcaga

SEQ ID NO: 242752 - DNA, 25 bp, Mus musculus
atccatccatcattgattcctcaga

SEQ ID NO: 242753 - DNA, 25 bp, Mus musculus
atccatccatgtcagttgcaaaagc

SEQ ID NO: 242754 - DNA, 25 bp, Mus musculus
atccatccatgtgagttgcaaaagc

SEQ ID NO: 242755 - DNA, 25 bp, Mus musculus
atccatcccaaaattctgcttttaa

SEQ ID NO: 242756 - DNA, 25 bp, Mus musculus
atccatcccaaatttctgcttttaa

SEQ ID NO: 242757 - DNA, 25 bp, Mus musculus
atccatcccagcaattcaaacaagt

SEQ ID NO: 242758 - DNA, 25 bp, Mus musculus
atccatcccagctattcaaacaagt

SEQ ID NO: 242759 - DNA, 25 bp, Mus musculus
atccatccccaaaaatctgctattt

SEQ ID NO: 242760 - DNA, 25 bp, Mus musculus
atccatccccaataatctgctattt

SEQ ID NO: 242761 - DNA, 25 bp, Mus musculus
atccatccccagcatatactagaat

SEQ ID NO: 242762 - DNA, 25 bp, Mus musculus
atccatccccaggatatactagaat

SEQ ID NO: 242763 - DNA, 25 bp, Mus musculus
atccatcccgagcagtgcagtgaac

SEQ ID NO: 242764 - DNA, 25 bp, Mus musculus
atccatcccgaggagtgcagtgaac

SEQ ID NO: 242765 - DNA, 25 bp, Mus musculus
atccatccctcaaagctaagcgagg

SEQ ID NO: 242766 - DNA, 25 bp, Mus musculus
atccatccctcatagctaagcgagg

SEQ ID NO: 242767 - DNA, 25 bp, Mus musculus
atccatccgttacatggctttgcca

SEQ ID NO: 242768 - DNA, 25 bp, Mus musculus
atccatccgttagatggctttgcca

SEQ ID NO: 242769 - DNA, 25 bp, Mus musculus
atccatcctcacagtgtttttctaa

SEQ ID NO: 242770 - DNA, 25 bp, Mus musculus
atccatcctcactgtgtttttctaa

SEQ ID NO: 242771 - DNA, 25 bp, Mus musculus
atccatcctccaagatgtatagagg

SEQ ID NO: 242772 - DNA, 25 bp, Mus musculus
atccatcctccatgatgtatagagg

SEQ ID NO: 242773 - DNA, 25 bp, Mus musculus
atccatcctcgcaccgatggcatgg

SEQ ID NO: 242774 - DNA, 25 bp, Mus musculus
atccatcctcgctccgatggcatgg

SEQ ID NO: 242775 - DNA, 25 bp, Mus musculus
atccatccttgacactggctcattc

SEQ ID NO: 242776 - DNA, 25 bp, Mus musculus
atccatccttgagactggctcattc

SEQ ID NO: 242777 - DNA, 25 bp, Mus musculus
atccatcgaggcagtctgagtgtct

SEQ ID NO: 242778 - DNA, 25 bp, Mus musculus
atccatcgaggctgtctgagtgtct

SEQ ID NO: 242779 - DNA, 25 bp, Mus musculus
atccatcgcagcacgcacacggagg

SEQ ID NO: 242780 - DNA, 25 bp, Mus musculus
atccatcgcagctcgcacacggagg

SEQ ID NO: 242781 - DNA, 25 bp, Mus musculus
atccatcgttgtcctgcttaacaca

SEQ ID NO: 242782 - DNA, 25 bp, Mus musculus
atccatcgttgtgctgcttaacaca

SEQ ID NO: 242783 - DNA, 25 bp, Mus musculus
atccatctacaaaacactctcaaac

SEQ ID NO: 242784 - DNA, 25 bp, Mus musculus
atccatctacaatacactctcaaac

SEQ ID NO: 242785 - DNA, 25 bp, Mus musculus
atccatctacttcctgtcagtggaa

SEQ ID NO: 242786 - DNA, 25 bp, Mus musculus
atccatctacttgctgtcagtggaa

SEQ ID NO: 242787 - DNA, 25 bp, Mus musculus
atccatctagccaccaagggcatga

SEQ ID NO: 242788 - DNA, 25 bp, Mus musculus
atccatctagcctccaagggcatga

SEQ ID NO: 242789 - DNA, 25 bp, Mus musculus
atccatctaggaagctacctggtgg

SEQ ID NO: 242790 - DNA, 25 bp, Mus musculus
atccatctaggatgctacctggtgg

SEQ ID NO: 242791 - DNA, 25 bp, Mus musculus
atccatctagtccaagcaagttctc

SEQ ID NO: 242792 - DNA, 25 bp, Mus musculus
atccatctagtcgaagcaagttctc

SEQ ID NO: 242793 - DNA, 25 bp, Mus musculus
atccatctcggtctgatgacgcgtc

SEQ ID NO: 242794 - DNA, 25 bp, Mus musculus
atccatctcggtgtgatgacgcgtc

SEQ ID NO: 242795 - DNA, 25 bp, Mus musculus
atccatctctatcctgtggtcacaa

SEQ ID NO: 242796 - DNA, 25 bp, Mus musculus
atccatctctatgctgtggtcacaa

SEQ ID NO: 242797 - DNA, 25 bp, Mus musculus
atccatctgaaacgtcccattgttt

SEQ ID NO: 242798 - DNA, 25 bp, Mus musculus
atccatctgaaaggtcccattgttt

SEQ ID NO: 242799 - DNA, 25 bp, Mus musculus
atccatctgcatatcccagggatgc

SEQ ID NO: 242800 - DNA, 25 bp, Mus musculus
atccatctgcatttcccagggatgc

SEQ ID NO: 242801 - DNA, 25 bp, Mus musculus
atccatctgcttactgcgggtatca

SEQ ID NO: 242802 - DNA, 25 bp, Mus musculus
atccatctgctttctgcgggtatca

SEQ ID NO: 242803 - DNA, 25 bp, Mus musculus
atccatcttcccaggcagttaatat

SEQ ID NO: 242804 - DNA, 25 bp, Mus musculus
atccatcttccctggcagttaatat

SEQ ID NO: 242805 - DNA, 25 bp, Mus musculus
atccatcttgctcattatcctgtat

SEQ ID NO: 242806 - DNA, 25 bp, Mus musculus
atccatcttgctgattatcctgtat

SEQ ID NO: 242807 - DNA, 25 bp, Mus musculus
atccatgaaatcattccctcgggag

SEQ ID NO: 242808 - DNA, 25 bp, Mus musculus
atccatgaaatctttccctcgggag

SEQ ID NO: 242809 - DNA, 25 bp, Mus musculus
atccatgaagacagtgttacacgta

SEQ ID NO: 242810 - DNA, 25 bp, Mus musculus
atccatgaagactgtgttacacgta

SEQ ID NO: 242811 - DNA, 25 bp, Mus musculus
atccatgaagcccaatgatgcgtgt

SEQ ID NO: 242812 - DNA, 25 bp, Mus musculus
atccatgaagccgaatgatgcgtgt

SEQ ID NO: 242813 - DNA, 25 bp, Mus musculus
atccatgaattcagcatgtgcaggg

SEQ ID NO: 242814 - DNA, 25 bp, Mus musculus
atccatgaattctgcatgtgcaggg

SEQ ID NO: 242815 - DNA, 25 bp, Mus musculus
atccatgactgcctctctcataggg

SEQ ID NO: 242816 - DNA, 25 bp, Mus musculus
atccatgactgcgtctctcataggg

SEQ ID NO: 242817 - DNA, 25 bp, Mus musculus
atccatgagacacacccttcgggac

SEQ ID NO: 242818 - DNA, 25 bp, Mus musculus
atccatgagacagacccttcgggac

SEQ ID NO: 242819 - DNA, 25 bp, Mus musculus
atccatgagtatacagacccagcct

SEQ ID NO: 242820 - DNA, 25 bp, Mus musculus
atccatgagtattcagacccagcct

SEQ ID NO: 242821 - DNA, 25 bp, Mus musculus
atccatgatgaccttacgtgggtac

SEQ ID NO: 242822 - DNA, 25 bp, Mus musculus
atccatgatgacgttacgtgggtac

SEQ ID NO: 242823 - DNA, 25 bp, Mus musculus
atccatgatgatccagcccggtctc

SEQ ID NO: 242824 - DNA, 25 bp, Mus musculus
atccatgatgatgcagcccggtctc

SEQ ID NO: 242825 - DNA, 25 bp, Mus musculus
atccatgcaaacagccgtatccgaa

SEQ ID NO: 242826 - DNA, 25 bp, Mus musculus
atccatgcaaactgccgtatccgaa

SEQ ID NO: 242827 - DNA, 25 bp, Mus musculus
atccatgcactgcttggctttcttt

SEQ ID NO: 242828 - DNA, 25 bp, Mus musculus
atccatgcactggttggctttcttt

SEQ ID NO: 242829 - DNA, 25 bp, Mus musculus
atccatgcagccattgggccccagg

SEQ ID NO: 242830 - DNA, 25 bp, Mus musculus
atccatgcagcctttgggccccagg

SEQ ID NO: 242831 - DNA, 25 bp, Mus musculus
atccatgccataacatgtgtgcaca

SEQ ID NO: 242832 - DNA, 25 bp, Mus musculus
atccatgccatatcatgtgtgcaca

SEQ ID NO: 242833 - DNA, 25 bp, Mus musculus
atccatgcccaaagatctcttcctg

SEQ ID NO: 242834 - DNA, 25 bp, Mus musculus
atccatgcccaatgatctcttcctg

SEQ ID NO: 242835 - DNA, 25 bp, Mus musculus
atccatgcccgaccagtacttcgtt

SEQ ID NO: 242836 - DNA, 25 bp, Mus musculus
atccatgcccgagcagtacttcgtt

SEQ ID NO: 242837 - DNA, 25 bp, Mus musculus
atccatgccttacagtgatcctgta

SEQ ID NO: 242838 - DNA, 25 bp, Mus musculus
atccatgccttagagtgatcctgta

SEQ ID NO: 242839 - DNA, 25 bp, Mus musculus
atccatgctgcactcatactgtttt

SEQ ID NO: 242840 - DNA, 25 bp, Mus musculus
atccatgctgcagtcatactgtttt

SEQ ID NO: 242841 - DNA, 25 bp, Mus musculus
atccatgctttaatgctttgaacag

SEQ ID NO: 242842 - DNA, 25 bp, Mus musculus
atccatgctttattgctttgaacag

SEQ ID NO: 242843 - DNA, 25 bp, Mus musculus
atccatggacataccctggcagcaa

SEQ ID NO: 242844 - DNA, 25 bp, Mus musculus
atccatggacattccctggcagcaa

SEQ ID NO: 242845 - DNA, 25 bp, Mus musculus
atccatggagataacaagacagctt

SEQ ID NO: 242846 - DNA, 25 bp, Mus musculus
atccatggagattacaagacagctt

SEQ ID NO: 242847 - DNA, 25 bp, Mus musculus
atccatggctctcatactatgattt

SEQ ID NO: 242848 - DNA, 25 bp, Mus musculus
atccatggctctgatactatgattt

SEQ ID NO: 242849 - DNA, 25 bp, Mus musculus
atccatgggctcctttgtgaacaac

SEQ ID NO: 242850 - DNA, 25 bp, Mus musculus
atccatgggctcgtttgtgaacaac

SEQ ID NO: 242851 - DNA, 25 bp, Mus musculus
atccatgtacgaatttgacccctgc

SEQ ID NO: 242852 - DNA, 25 bp, Mus musculus
atccatgtacgattttgacccctgc

SEQ ID NO: 242853 - DNA, 25 bp, Mus musculus
atccatgtactgaagtccttcagcg

SEQ ID NO: 242854 - DNA, 25 bp, Mus musculus
atccatgtactgtagtccttcagcg

SEQ ID NO: 242855 - DNA, 25 bp, Mus musculus
atccatgtatctcacccaaaaaatg

SEQ ID NO: 242856 - DNA, 25 bp, Mus musculus
atccatgtatctgacccaaaaaatg

SEQ ID NO: 242857 - DNA, 25 bp, Mus musculus
atccatgtcggacctgaactttttg

SEQ ID NO: 242858 - DNA, 25 bp, Mus musculus
atccatgtcggagctgaactttttg

SEQ ID NO: 242859 - DNA, 25 bp, Mus musculus
atccatgtgaacctctggacctaca

SEQ ID NO: 242860 - DNA, 25 bp, Mus musculus
atccatgtgaacgtctggacctaca

SEQ ID NO: 242861 - DNA, 25 bp, Mus musculus
atccatgtgagcacaataaatttct

SEQ ID NO: 242862 - DNA, 25 bp, Mus musculus
atccatgtgagctcaataaatttct

SEQ ID NO: 242863 - DNA, 25 bp, Mus musculus
atccatgtgtaacctttggcacctg

SEQ ID NO: 242864 - DNA, 25 bp, Mus musculus
atccatgtgtaagctttggcacctg

SEQ ID NO: 242865 - DNA, 25 bp, Mus musculus
atccatgtgtccaattttgccactt

SEQ ID NO: 242866 - DNA, 25 bp, Mus musculus
atccatgtgtcctattttgccactt

SEQ ID NO: 242867 - DNA, 25 bp, Mus musculus
atccatgtgtgcagaagatcccagc

SEQ ID NO: 242868 - DNA, 25 bp, Mus musculus
atccatgtgtgctgaagatcccagc

SEQ ID NO: 242869 - DNA, 25 bp, Mus musculus
atccatgtgtgtccattgttgtact

SEQ ID NO: 242870 - DNA, 25 bp, Mus musculus
atccatgtgtgtgcattgttgtact

SEQ ID NO: 242871 - DNA, 25 bp, Mus musculus
atccatgtgttacttttcactgtaa

SEQ ID NO: 242872 - DNA, 25 bp, Mus musculus
atccatgtgttagttttcactgtaa

SEQ ID NO: 242873 - DNA, 25 bp, Mus musculus
atccatgtgttcaaaaagcccagtt

SEQ ID NO: 242874 - DNA, 25 bp, Mus musculus
atccatgtgttctaaaagcccagtt

SEQ ID NO: 242875 - DNA, 25 bp, Mus musculus
atccatgttaccatatggagtgctt

SEQ ID NO: 242876 - DNA, 25 bp, Mus musculus
atccatgttaccttatggagtgctt

SEQ ID NO: 242877 - DNA, 25 bp, Mus musculus
atccatgttcctatcagcaatggac

SEQ ID NO: 242878 - DNA, 25 bp, Mus musculus
atccatgttcctttcagcaatggac

SEQ ID NO: 242879 - DNA, 25 bp, Mus musculus
atccatgttcttcctaagtctattg

SEQ ID NO: 242880 - DNA, 25 bp, Mus musculus
atccatgttcttgctaagtctattg

SEQ ID NO: 242881 - DNA, 25 bp, Mus musculus
atccatgttgccattggctaaacca

SEQ ID NO: 242882 - DNA, 25 bp, Mus musculus
atccatgttgcctttggctaaacca

SEQ ID NO: 242883 - DNA, 25 bp, Mus musculus
atccatgttttcatacggttgggca

SEQ ID NO: 242884 - DNA, 25 bp, Mus musculus
atccatgttttccaataggagataa

SEQ ID NO: 242885 - DNA, 25 bp, Mus musculus
atccatgttttcgaataggagataa

SEQ ID NO: 242886 - DNA, 25 bp, Mus musculus
atccatgttttcttacggttgggca

SEQ ID NO: 242887 - DNA, 25 bp, Mus musculus
atccattaacctaccctaagatagg

SEQ ID NO: 242888 - DNA, 25 bp, Mus musculus
atccattaaccttccctaagatagg

SEQ ID NO: 242889 - DNA, 25 bp, Mus musculus
atccattacctgctctttgccttta

SEQ ID NO: 242890 - DNA, 25 bp, Mus musculus
atccattacctggtctttgccttta

SEQ ID NO: 242891 - DNA, 25 bp, Mus musculus
atccattactcccaaagtgccagca

SEQ ID NO: 242892 - DNA, 25 bp, Mus musculus
atccattactccgaaagtgccagca

SEQ ID NO: 242893 - DNA, 25 bp, Mus musculus
atccattagctccttgtgctgtgac

SEQ ID NO: 242894 - DNA, 25 bp, Mus musculus
atccattagctcgttgtgctgtgac

SEQ ID NO: 242895 - DNA, 25 bp, Mus musculus
atccattaggcactgtgtcagataa

SEQ ID NO: 242896 - DNA, 25 bp, Mus musculus
atccattaggcagtgtgtcagataa

SEQ ID NO: 242897 - DNA, 25 bp, Mus musculus
atccattagtccacatcacaagcta

SEQ ID NO: 242898 - DNA, 25 bp, Mus musculus
atccattagtcctcatcacaagcta

SEQ ID NO: 242899 - DNA, 25 bp, Mus musculus
atccattagtgtatgctggtcgcta

SEQ ID NO: 242900 - DNA, 25 bp, Mus musculus
atccattagtgtttgctggtcgcta

SEQ ID NO: 242901 - DNA, 25 bp, Mus musculus
atccattcacccatttgtctatcca

SEQ ID NO: 242902 - DNA, 25 bp, Mus musculus
atccattcacccttttgtctatcca

SEQ ID NO: 242903 - DNA, 25 bp, Mus musculus
atccattcagccatctggctactga

SEQ ID NO: 242904 - DNA, 25 bp, Mus musculus
atccattcagccttctggctactga

SEQ ID NO: 242905 - DNA, 25 bp, Mus musculus
atccattcagtcaaggttcctgcag

SEQ ID NO: 242906 - DNA, 25 bp, Mus musculus
atccattcagtctaggttcctgcag

SEQ ID NO: 242907 - DNA, 25 bp, Mus musculus
atccattccagacctcttaggagct

SEQ ID NO: 242908 - DNA, 25 bp, Mus musculus
atccattccagagctcttaggagct

SEQ ID NO: 242909 - DNA, 25 bp, Mus musculus
atccattcccagagggtggatgggt

SEQ ID NO: 242910 - DNA, 25 bp, Mus musculus
atccattcccagtgggtggatgggt

SEQ ID NO: 242911 - DNA, 25 bp, Mus musculus
atccattcccttcatttacaactaa

SEQ ID NO: 242912 - DNA, 25 bp, Mus musculus
atccattcccttgatttacaactaa

SEQ ID NO: 242913 - DNA, 25 bp, Mus musculus
atccattcctccctagttgagacag

SEQ ID NO: 242914 - DNA, 25 bp, Mus musculus
atccattcctccgtagttgagacag

SEQ ID NO: 242915 - DNA, 25 bp, Mus musculus
atccattcgaaaactgtatcccatt

SEQ ID NO: 242916 - DNA, 25 bp, Mus musculus
atccattcgaaatctgtatcccatt

SEQ ID NO: 242917 - DNA, 25 bp, Mus musculus
atccattcgaatctttgcctggctc

SEQ ID NO: 242918 - DNA, 25 bp, Mus musculus
atccattcgaatgtttgcctggctc

SEQ ID NO: 242919 - DNA, 25 bp, Mus musculus
atccattctcacctttaggaactgg

SEQ ID NO: 242920 - DNA, 25 bp, Mus musculus
atccattctcacgtttaggaactgg

SEQ ID NO: 242921 - DNA, 25 bp, Mus musculus
atccattctccaaaatgtagaccat

SEQ ID NO: 242922 - DNA, 25 bp, Mus musculus
atccattctccataatgtagaccat

SEQ ID NO: 242923 - DNA, 25 bp, Mus musculus
atccattctggtaatttgcctgttg

SEQ ID NO: 242924 - DNA, 25 bp, Mus musculus
atccattctggttatttgcctgttg

SEQ ID NO: 242925 - DNA, 25 bp, Mus musculus
atccattctgtacaacacatcatgt

SEQ ID NO: 242926 - DNA, 25 bp, Mus musculus
atccattctgtagaacacatcatgt

SEQ ID NO: 242927 - DNA, 25 bp, Mus musculus
atccattctgttaagtgggcagggc

SEQ ID NO: 242928 - DNA, 25 bp, Mus musculus
atccattctgtttagtgggcagggc

SEQ ID NO: 242929 - DNA, 25 bp, Mus musculus
atccattcttccatgccaatagcag

SEQ ID NO: 242930 - DNA, 25 bp, Mus musculus
atccattcttccttgccaatagcag

SEQ ID NO: 242931 - DNA, 25 bp, Mus musculus
atccattcttctaagactctgcaag

SEQ ID NO: 242932 - DNA, 25 bp, Mus musculus
atccattcttcttagactctgcaag

SEQ ID NO: 242933 - DNA, 25 bp, Mus musculus
atccattgacccagatgtgcagtgt

SEQ ID NO: 242934 - DNA, 25 bp, Mus musculus
atccattgaccctgatgtgcagtgt

SEQ ID NO: 242935 - DNA, 25 bp, Mus musculus
atccattgattgagaagtagcggca

SEQ ID NO: 242936 - DNA, 25 bp, Mus musculus
atccattgattgtgaagtagcggca

SEQ ID NO: 242937 - DNA, 25 bp, Mus musculus
atccattgcccgatgtcctctcctc

SEQ ID NO: 242938 - DNA, 25 bp, Mus musculus
atccattgcccgttgtcctctcctc

SEQ ID NO: 242939 - DNA, 25 bp, Mus musculus
atccattggatgcagcccaaggttt

SEQ ID NO: 242940 - DNA, 25 bp, Mus musculus
atccattggatggagcccaaggttt

SEQ ID NO: 242941 - DNA, 25 bp, Mus musculus
atccattggattatgttttgctaac

SEQ ID NO: 242942 - DNA, 25 bp, Mus musculus
atccattggattttgttttgctaac

SEQ ID NO: 242943 - DNA, 25 bp, Mus musculus
atccattggcctcgaagtttctgag

SEQ ID NO: 242944 - DNA, 25 bp, Mus musculus
atccattggcctggaagtttctgag

SEQ ID NO: 242945 - DNA, 25 bp, Mus musculus
atccattgggtacggagagaagctc

SEQ ID NO: 242946 - DNA, 25 bp, Mus musculus
atccattgggtagggagagaagctc

SEQ ID NO: 242947 - DNA, 25 bp, Mus musculus
atccattgtcacagttcagataatt

SEQ ID NO: 242948 - DNA, 25 bp, Mus musculus
atccattgtcactgttcagataatt

SEQ ID NO: 242949 - DNA, 25 bp, Mus musculus
atccattgtgaaacttgacatcgcc

SEQ ID NO: 242950 - DNA, 25 bp, Mus musculus
atccattgtgaatcttgacatcgcc

SEQ ID NO: 242951 - DNA, 25 bp, Mus musculus
atccattgtgacatgttctctgttc

SEQ ID NO: 242952 - DNA, 25 bp, Mus musculus
atccattgtgacttgttctctgttc

SEQ ID NO: 242953 - DNA, 25 bp, Mus musculus
atccatttacataatcctggtctgt

SEQ ID NO: 242954 - DNA, 25 bp, Mus musculus
atccatttacattatcctggtctgt

SEQ ID NO: 242955 - DNA, 25 bp, Mus musculus
atccatttatgaccagcatccacta

SEQ ID NO: 242956 - DNA, 25 bp, Mus musculus
atccatttatgagcagcatccacta

SEQ ID NO: 242957 - DNA, 25 bp, Mus musculus
atccatttattgctattctcagaaa

SEQ ID NO: 242958 - DNA, 25 bp, Mus musculus
atccatttattggtattctcagaaa

SEQ ID NO: 242959 - DNA, 25 bp, Mus musculus
atccatttatttagacagtgtcctg

SEQ ID NO: 242960 - DNA, 25 bp, Mus musculus
atccatttattttgacagtgtcctg

SEQ ID NO: 242961 - DNA, 25 bp, Mus musculus
atccatttcccaccctataaagaat

SEQ ID NO: 242962 - DNA, 25 bp, Mus musculus
atccatttcccagcctataaagaat

SEQ ID NO: 242963 - DNA, 25 bp, Mus musculus
atccatttctataaacttcatcaaa

SEQ ID NO: 242964 - DNA, 25 bp, Mus musculus
atccatttctattaacttcatcaaa

SEQ ID NO: 242965 - DNA, 25 bp, Mus musculus
atccatttcttcaaccacagagatc

SEQ ID NO: 242966 - DNA, 25 bp, Mus musculus
atccatttcttctaccacagagatc

SEQ ID NO: 242967 - DNA, 25 bp, Mus musculus
atccatttctttagtgtcctcataa

SEQ ID NO: 242968 - DNA, 25 bp, Mus musculus
atccatttcttttgtgtcctcataa

SEQ ID NO: 242969 - DNA, 25 bp, Mus musculus
atccatttggatcattagggctcaa

SEQ ID NO: 242970 - DNA, 25 bp, Mus musculus
atccatttggatgattagggctcaa

SEQ ID NO: 242971 - DNA, 25 bp, Mus musculus
atccatttgtgccttaatgtttaat

SEQ ID NO: 242972 - DNA, 25 bp, Mus musculus
atccatttgtgcgttaatgtttaat

SEQ ID NO: 242973 - DNA, 25 bp, Mus musculus
atccattttattatgcccccataat

SEQ ID NO: 242974 - DNA, 25 bp, Mus musculus
atccattttattttgcccccataat

SEQ ID NO: 242975 - DNA, 25 bp, Mus musculus
atccattttcacagaccatgatata

SEQ ID NO: 242976 - DNA, 25 bp, Mus musculus
atccattttcactgaccatgatata

SEQ ID NO: 242977 - DNA, 25 bp, Mus musculus
atccatttttgccttggcggctgga

SEQ ID NO: 242978 - DNA, 25 bp, Mus musculus
atccatttttgcgttggcggctgga

SEQ ID NO: 242979 - DNA, 25 bp, Mus musculus
atcccaaaccgacctagagggcagt

SEQ ID NO: 242980 - DNA, 25 bp, Mus musculus
atcccaaaccgagctagagggcagt

SEQ ID NO: 242981 - DNA, 25 bp, Mus musculus
atcccaaactcactgttgttgttcc

SEQ ID NO: 242982 - DNA, 25 bp, Mus musculus
atcccaaactcagtgttgttgttcc

SEQ ID NO: 242983 - DNA, 25 bp, Mus musculus
atcccaaactctctctgagctgata

SEQ ID NO: 242984 - DNA, 25 bp, Mus musculus
atcccaaactctgtctgagctgata

SEQ ID NO: 242985 - DNA, 25 bp, Mus musculus
atcccaaaggtgatcaggtggagat

SEQ ID NO: 242986 - DNA, 25 bp, Mus musculus
atcccaaaggtgttcaggtggagat

SEQ ID NO: 242987 - DNA, 25 bp, Mus musculus
atcccaaagttgatgtaacctgctg

SEQ ID NO: 242988 - DNA, 25 bp, Mus musculus
atcccaaagttgttgtaacctgctg

SEQ ID NO: 242989 - DNA, 25 bp, Mus musculus
atcccaaatccacaaagcctacttt

SEQ ID NO: 242990 - DNA, 25 bp, Mus musculus
atcccaaatccagaaagcctacttt

SEQ ID NO: 242991 - DNA, 25 bp, Mus musculus
atcccaaatggtagaattaaacaca

SEQ ID NO: 242992 - DNA, 25 bp, Mus musculus
atcccaaatggttgaattaaacaca

SEQ ID NO: 242993 - DNA, 25 bp, Mus musculus
atcccaacactcaagtggacagaga

SEQ ID NO: 242994 - DNA, 25 bp, Mus musculus
atcccaacactctagtggacagaga

SEQ ID NO: 242995 - DNA, 25 bp, Mus musculus
atcccaaccaggcagaactcattgt

SEQ ID NO: 242996 - DNA, 25 bp, Mus musculus
atcccaaccagggagaactcattgt

SEQ ID NO: 242997 - DNA, 25 bp, Mus musculus
atcccaaccgagatcctatgattga

SEQ ID NO: 242998 - DNA, 25 bp, Mus musculus
atcccaaccgagttcctatgattga

SEQ ID NO: 242999 - DNA, 25 bp, Mus musculus
atcccaacgctcacctgaatggaat

SEQ ID NO: 243000 - DNA, 25 bp, Mus musculus
atcccaacgctctcctgaatggaat

SEQ ID NO: 243001 - DNA, 25 bp, Mus musculus
atcccaactcagcaggatgtcctca

SEQ ID NO: 243002 - DNA, 25 bp, Mus musculus
atcccaactcaggaggatgtcctca

SEQ ID NO: 243003 - DNA, 25 bp, Mus musculus
atcccaactccaagtatcagcttga

SEQ ID NO: 243004 - DNA, 25 bp, Mus musculus
atcccaactccatgtatcagcttga

SEQ ID NO: 243005 - DNA, 25 bp, Mus musculus
atcccaactggtacaaagccttaag

SEQ ID NO: 243006 - DNA, 25 bp, Mus musculus
atcccaactggttcaaagccttaag

SEQ ID NO: 243007 - DNA, 25 bp, Mus musculus
atcccaactgtgctcccagaagttt

SEQ ID NO: 243008 - DNA, 25 bp, Mus musculus
atcccaactgtggtcccagaagttt

SEQ ID NO: 243009 - DNA, 25 bp, Mus musculus
atcccaagaatcaagcagaacagtt

SEQ ID NO: 243010 - DNA, 25 bp, Mus musculus
atcccaagaatctagcagaacagtt

SEQ ID NO: 243011 - DNA, 25 bp, Mus musculus
atcccaagaccccaaagcagtacag

SEQ ID NO: 243012 - DNA, 25 bp, Mus musculus
atcccaagacccgaaagcagtacag

SEQ ID NO: 243013 - DNA, 25 bp, Mus musculus
atcccaagagtgctgcagtccgcca

SEQ ID NO: 243014 - DNA, 25 bp, Mus musculus
atcccaagagtggtgcagtccgcca

SEQ ID NO: 243015 - DNA, 25 bp, Mus musculus
atcccaagatcactgctgtacttca

SEQ ID NO: 243016 - DNA, 25 bp, Mus musculus
atcccaagatcagtgctgtacttca

SEQ ID NO: 243017 - DNA, 25 bp, Mus musculus
atcccaagatgccttaatccacttc

SEQ ID NO: 243018 - DNA, 25 bp, Mus musculus
atcccaagatgcgttaatccacttc

SEQ ID NO: 243019 - DNA, 25 bp, Mus musculus
atcccaagatggaaatgtagcagca

SEQ ID NO: 243020 - DNA, 25 bp, Mus musculus
atcccaagatggtaatgtagcagca

SEQ ID NO: 243021 - DNA, 25 bp, Mus musculus
atcccaagcaacacgcgttcaagca

SEQ ID NO: 243022 - DNA, 25 bp, Mus musculus
atcccaagcaactcgcgttcaagca

SEQ ID NO: 243023 - DNA, 25 bp, Mus musculus
atcccaagggctacctagctagaga

SEQ ID NO: 243024 - DNA, 25 bp, Mus musculus
atcccaagggcttcctagctagaga

SEQ ID NO: 243025 - DNA, 25 bp, Mus musculus
atcccaagtaagaatagtgtgtcta

SEQ ID NO: 243026 - DNA, 25 bp, Mus musculus
atcccaagtaagtatagtgtgtcta

SEQ ID NO: 243027 - DNA, 25 bp, Mus musculus
atcccaagtattagattcactcctc

SEQ ID NO: 243028 - DNA, 25 bp, Mus musculus
atcccaagtatttgattcactcctc

SEQ ID NO: 243029 - DNA, 25 bp, Mus musculus
atcccaagtgctcttattccggtga

SEQ ID NO: 243030 - DNA, 25 bp, Mus musculus
atcccaagtgctgttattccggtga

SEQ ID NO: 243031 - DNA, 25 bp, Mus musculus
atcccaagtggtcaatacactctgt

SEQ ID NO: 243032 - DNA, 25 bp, Mus musculus
atcccaagtggtgaatacactctgt

SEQ ID NO: 243033 - DNA, 25 bp, Mus musculus
atcccaataaatacatcatgaattt

SEQ ID NO: 243034 - DNA, 25 bp, Mus musculus
atcccaataaattcatcatgaattt

SEQ ID NO: 243035 - DNA, 25 bp, Mus musculus
atcccaatatccagtgtatttccca

SEQ ID NO: 243036 - DNA, 25 bp, Mus musculus
atcccaatatcctgtgtatttccca

SEQ ID NO: 243037 - DNA, 25 bp, Mus musculus
atcccaatggttagaaggcagaggc

SEQ ID NO: 243038 - DNA, 25 bp, Mus musculus
atcccaatggtttgaaggcagaggc

SEQ ID NO: 243039 - DNA, 25 bp, Mus musculus
atcccaatgttactgcagccatgag

SEQ ID NO: 243040 - DNA, 25 bp, Mus musculus
atcccaatgttagtgcagccatgag

SEQ ID NO: 243041 - DNA, 25 bp, Mus musculus
atcccaattatactgtgaatgtcga

SEQ ID NO: 243042 - DNA, 25 bp, Mus musculus
atcccaattatagtgtgaatgtcga

SEQ ID NO: 243043 - DNA, 25 bp, Mus musculus
atcccacaaacaagaaccttaagag

SEQ ID NO: 243044 - DNA, 25 bp, Mus musculus
atcccacaaacatgaaccttaagag

SEQ ID NO: 243045 - DNA, 25 bp, Mus musculus
atcccacaaagcctttcgaggtagg

SEQ ID NO: 243046 - DNA, 25 bp, Mus musculus
atcccacaaagcgtttcgaggtagg

SEQ ID NO: 243047 - DNA, 25 bp, Mus musculus
atcccacaacggcatgcagttcagt

SEQ ID NO: 243048 - DNA, 25 bp, Mus musculus
atcccacaacgggatgcagttcagt

SEQ ID NO: 243049 - DNA, 25 bp, Mus musculus
atcccacacagaaactgttctccaa

SEQ ID NO: 243050 - DNA, 25 bp, Mus musculus
atcccacacagatactgttctccaa

SEQ ID NO: 243051 - DNA, 25 bp, Mus musculus
atcccacacagtaccaagattggcg

SEQ ID NO: 243052 - DNA, 25 bp, Mus musculus
atcccacacagttccaagattggcg

SEQ ID NO: 243053 - DNA, 25 bp, Mus musculus
atcccacaccgtaccgtgggtgctg

SEQ ID NO: 243054 - DNA, 25 bp, Mus musculus
atcccacaccgttccgtgggtgctg

SEQ ID NO: 243055 - DNA, 25 bp, Mus musculus
atcccacacctaacagacaaagatg

SEQ ID NO: 243056 - DNA, 25 bp, Mus musculus
atcccacacctatcagacaaagatg

SEQ ID NO: 243057 - DNA, 25 bp, Mus musculus
atcccacagataacctgctggacgt

SEQ ID NO: 243058 - DNA, 25 bp, Mus musculus
atcccacagatatcctgctggacgt

SEQ ID NO: 243059 - DNA, 25 bp, Mus musculus
atcccacagtatatcccctgtttga

SEQ ID NO: 243060 - DNA, 25 bp, Mus musculus
atcccacagtatttcccctgtttga

SEQ ID NO: 243061 - DNA, 25 bp, Mus musculus
atcccaccaaggcaagttgtgctgg

SEQ ID NO: 243062 - DNA, 25 bp, Mus musculus
atcccaccaagggaagttgtgctgg

SEQ ID NO: 243063 - DNA, 25 bp, Mus musculus
atcccaccacaaaagttaccacaga

SEQ ID NO: 243064 - DNA, 25 bp, Mus musculus
atcccaccacaatagttaccacaga

SEQ ID NO: 243065 - DNA, 25 bp, Mus musculus
atcccaccagggagttcatttcatc

SEQ ID NO: 243066 - DNA, 25 bp, Mus musculus
atcccaccagggtgttcatttcatc

SEQ ID NO: 243067 - DNA, 25 bp, Mus musculus
atcccaccccagaaacatattgttt

SEQ ID NO: 243068 - DNA, 25 bp, Mus musculus
atcccaccccagtaacatattgttt

SEQ ID NO: 243069 - DNA, 25 bp, Mus musculus
atcccaccctcacgagtaagtcgta

SEQ ID NO: 243070 - DNA, 25 bp, Mus musculus
atcccaccctcaggagtaagtcgta

SEQ ID NO: 243071 - DNA, 25 bp, Mus musculus
atcccaccctgcatggagtgaaaca

SEQ ID NO: 243072 - DNA, 25 bp, Mus musculus
atcccaccctgcttggagtgaaaca

SEQ ID NO: 243073 - DNA, 25 bp, Mus musculus
atcccaccgggtcacattggcacaa

SEQ ID NO: 243074 - DNA, 25 bp, Mus musculus
atcccaccgggtgacattggcacaa

SEQ ID NO: 243075 - DNA, 25 bp, Mus musculus
atcccacctcaaagaacccagataa

SEQ ID NO: 243076 - DNA, 25 bp, Mus musculus
atcccacctcaatgaacccagataa

SEQ ID NO: 243077 - DNA, 25 bp, Mus musculus
atcccacctcacagaagataggcaa

SEQ ID NO: 243078 - DNA, 25 bp, Mus musculus
atcccacctcactgaagataggcaa

SEQ ID NO: 243079 - DNA, 25 bp, Mus musculus
atcccacctcagaaccagtgttata

SEQ ID NO: 243080 - DNA, 25 bp, Mus musculus
atcccacctcagtaccagtgttata

SEQ ID NO: 243081 - DNA, 25 bp, Mus musculus
atcccacctgcgagctagagaactt

SEQ ID NO: 243082 - DNA, 25 bp, Mus musculus
atcccacctgcgtgctagagaactt

SEQ ID NO: 243083 - DNA, 25 bp, Mus musculus
atcccacctgggacttgctagaaga

SEQ ID NO: 243084 - DNA, 25 bp, Mus musculus
atcccacctgggtcttgctagaaga

SEQ ID NO: 243085 - DNA, 25 bp, Mus musculus
atcccacctgtgcacctgtaagctg

SEQ ID NO: 243086 - DNA, 25 bp, Mus musculus
atcccacctgtggacctgtaagctg

SEQ ID NO: 243087 - DNA, 25 bp, Mus musculus
atcccaccttggctattgacagtag

SEQ ID NO: 243088 - DNA, 25 bp, Mus musculus
atcccaccttgggtattgacagtag

SEQ ID NO: 243089 - DNA, 25 bp, Mus musculus
atcccacgagctccatttttattta

SEQ ID NO: 243090 - DNA, 25 bp, Mus musculus
atcccacgagctgcatttttattta

SEQ ID NO: 243091 - DNA, 25 bp, Mus musculus
atcccactagccaatatttaccaag

SEQ ID NO: 243092 - DNA, 25 bp, Mus musculus
atcccactagcctatatttaccaag

SEQ ID NO: 243093 - DNA, 25 bp, Mus musculus
atcccactcaccaggtatggtagct

SEQ ID NO: 243094 - DNA, 25 bp, Mus musculus
atcccactcacctggtatggtagct

SEQ ID NO: 243095 - DNA, 25 bp, Mus musculus
atcccactgctcatttgacctttaa

SEQ ID NO: 243096 - DNA, 25 bp, Mus musculus
atcccactgctcttttgacctttaa

SEQ ID NO: 243097 - DNA, 25 bp, Mus musculus
atcccactgggcaagttcgctgagg

SEQ ID NO: 243098 - DNA, 25 bp, Mus musculus
atcccactgggctagttcgctgagg

SEQ ID NO: 243099 - DNA, 25 bp, Mus musculus
atcccactgggtataaaagcatctt

SEQ ID NO: 243100 - DNA, 25 bp, Mus musculus
atcccactgggtttaaaagcatctt

SEQ ID NO: 243101 - DNA, 25 bp, Mus musculus
atcccactgtgaagagcccatgtat

SEQ ID NO: 243102 - DNA, 25 bp, Mus musculus
atcccactgtgatgagcccatgtat

SEQ ID NO: 243103 - DNA, 25 bp, Mus musculus
atcccagaaaggactcagccacact

SEQ ID NO: 243104 - DNA, 25 bp, Mus musculus
atcccagaaaggtctcagccacact

SEQ ID NO: 243105 - DNA, 25 bp, Mus musculus
atcccagaaatgaactcttgtagag

SEQ ID NO: 243106 - DNA, 25 bp, Mus musculus
atcccagaaatgtactcttgtagag

SEQ ID NO: 243107 - DNA, 25 bp, Mus musculus
atcccagaacttcactggacagtcc

SEQ ID NO: 243108 - DNA, 25 bp, Mus musculus
atcccagaacttgactggacagtcc

SEQ ID NO: 243109 - DNA, 25 bp, Mus musculus
atcccagaagctagttggctggcca

SEQ ID NO: 243110 - DNA, 25 bp, Mus musculus
atcccagaagcttgttggctggcca

SEQ ID NO: 243111 - DNA, 25 bp, Mus musculus
atcccagaaggactgatagctcgaa

SEQ ID NO: 243112 - DNA, 25 bp, Mus musculus
atcccagaaggagtgatagctcgaa

SEQ ID NO: 243113 - DNA, 25 bp, Mus musculus
atcccagaagttaggcctgctctaa

SEQ ID NO: 243114 - DNA, 25 bp, Mus musculus
atcccagaagtttggcctgctctaa

SEQ ID NO: 243115 - DNA, 25 bp, Mus musculus
atcccagacagcctggacttggtca

SEQ ID NO: 243116 - DNA, 25 bp, Mus musculus
atcccagacagcgtggacttggtca

SEQ ID NO: 243117 - DNA, 25 bp, Mus musculus
atcccagacctcaagtggaaccagc

SEQ ID NO: 243118 - DNA, 25 bp, Mus musculus
atcccagacctctagtggaaccagc

SEQ ID NO: 243119 - DNA, 25 bp, Mus musculus
atcccagacttacagcaccagtgag

SEQ ID NO: 243120 - DNA, 25 bp, Mus musculus
atcccagacttagagcaccagtgag

SEQ ID NO: 243121 - DNA, 25 bp, Mus musculus
atcccagagacaacaggcagccttg

SEQ ID NO: 243122 - DNA, 25 bp, Mus musculus
atcccagagacatcaggcagccttg

SEQ ID NO: 243123 - DNA, 25 bp, Mus musculus
atcccagagatactgttttgcggca

SEQ ID NO: 243124 - DNA, 25 bp, Mus musculus
atcccagagatagtgttttgcggca

SEQ ID NO: 243125 - DNA, 25 bp, Mus musculus
atcccagagcaccataacctagaga

SEQ ID NO: 243126 - DNA, 25 bp, Mus musculus
atcccagagcacgataacctagaga

SEQ ID NO: 243127 - DNA, 25 bp, Mus musculus
atcccagagccaccgtgcttattgt

SEQ ID NO: 243128 - DNA, 25 bp, Mus musculus
atcccagagccagcgtgcttattgt

SEQ ID NO: 243129 - DNA, 25 bp, Mus musculus
atcccagagctacagcctggcagaa

SEQ ID NO: 243130 - DNA, 25 bp, Mus musculus
atcccagagctagagcctggcagaa

SEQ ID NO: 243131 - DNA, 25 bp, Mus musculus
atcccagagctgaacgggaagctca

SEQ ID NO: 243132 - DNA, 25 bp, Mus musculus
atcccagagctgtacgggaagctca

SEQ ID NO: 243133 - DNA, 25 bp, Mus musculus
atcccagaggagatgcccgagagta

SEQ ID NO: 243134 - DNA, 25 bp, Mus musculus
atcccagaggagttgcccgagagta

SEQ ID NO: 243135 - DNA, 25 bp, Mus musculus
atcccagatattatggcatgtctca

SEQ ID NO: 243136 - DNA, 25 bp, Mus musculus
atcccagatattttggcatgtctca

SEQ ID NO: 243137 - DNA, 25 bp, Mus musculus
atcccagatgaacacgttcctcaga

SEQ ID NO: 243138 - DNA, 25 bp, Mus musculus
atcccagatgaagacgttcctcaga

SEQ ID NO: 243139 - DNA, 25 bp, Mus musculus
atcccagatgttatcagacctgctt

SEQ ID NO: 243140 - DNA, 25 bp, Mus musculus
atcccagatgttttcagacctgctt

SEQ ID NO: 243141 - DNA, 25 bp, Mus musculus
atcccagattccagctaagacttgc

SEQ ID NO: 243142 - DNA, 25 bp, Mus musculus
atcccagattcctgctaagacttgc

SEQ ID NO: 243143 - DNA, 25 bp, Mus musculus
atcccagattttcggtgcatgctac

SEQ ID NO: 243144 - DNA, 25 bp, Mus musculus
atcccagattttgggtgcatgctac

SEQ ID NO: 243145 - DNA, 25 bp, Mus musculus
atcccagcaaccaagttccgagtaa

SEQ ID NO: 243146 - DNA, 25 bp, Mus musculus
atcccagcaacctagttccgagtaa

SEQ ID NO: 243147 - DNA, 25 bp, Mus musculus
atcccagcaagaaccagttaccaga

SEQ ID NO: 243148 - DNA, 25 bp, Mus musculus
atcccagcaagatccagttaccaga

SEQ ID NO: 243149 - DNA, 25 bp, Mus musculus
atcccagcacatattcgatgacgct

SEQ ID NO: 243150 - DNA, 25 bp, Mus musculus
atcccagcacattttcgatgacgct

SEQ ID NO: 243151 - DNA, 25 bp, Mus musculus
atcccagcactactgtggttaagac

SEQ ID NO: 243152 - DNA, 25 bp, Mus musculus
atcccagcactagtgtggttaagac

SEQ ID NO: 243153 - DNA, 25 bp, Mus musculus
atcccagcactgcagtaagagtcat

SEQ ID NO: 243154 - DNA, 25 bp, Mus musculus
atcccagcactggagtaagagtcat

SEQ ID NO: 243155 - DNA, 25 bp, Mus musculus
atcccagcagagcatctttctaatc

SEQ ID NO: 243156 - DNA, 25 bp, Mus musculus
atcccagcagaggatctttctaatc

SEQ ID NO: 243157 - DNA, 25 bp, Mus musculus
atcccagcagcgctgaacaatataa

SEQ ID NO: 243158 - DNA, 25 bp, Mus musculus
atcccagcagcggtgaacaatataa

SEQ ID NO: 243159 - DNA, 25 bp, Mus musculus
atcccagcaggtacctgttgcaaat

SEQ ID NO: 243160 - DNA, 25 bp, Mus musculus
atcccagcaggtcatgaccccacag

SEQ ID NO: 243161 - DNA, 25 bp, Mus musculus
atcccagcaggtcgatgctttcaga

SEQ ID NO: 243162 - DNA, 25 bp, Mus musculus
atcccagcaggtgatgaccccacag

SEQ ID NO: 243163 - DNA, 25 bp, Mus musculus
atcccagcaggtggatgctttcaga

SEQ ID NO: 243164 - DNA, 25 bp, Mus musculus
atcccagcaggttcctgttgcaaat

SEQ ID NO: 243165 - DNA, 25 bp, Mus musculus
atcccagcatgtcggccaggcataa

SEQ ID NO: 243166 - DNA, 25 bp, Mus musculus
atcccagcatgtgggccaggcataa

SEQ ID NO: 243167 - DNA, 25 bp, Mus musculus
atcccagccagaactcctggagata

SEQ ID NO: 243168 - DNA, 25 bp, Mus musculus
atcccagccagatctcctggagata

SEQ ID NO: 243169 - DNA, 25 bp, Mus musculus
atcccagccatgctaaccaggcagg

SEQ ID NO: 243170 - DNA, 25 bp, Mus musculus
atcccagccatggtaaccaggcagg

SEQ ID NO: 243171 - DNA, 25 bp, Mus musculus
atcccagcctggagtgtatctatct

SEQ ID NO: 243172 - DNA, 25 bp, Mus musculus
atcccagcctggtgtgtatctatct

SEQ ID NO: 243173 - DNA, 25 bp, Mus musculus
atcccagcctttacaacatcaatgt

SEQ ID NO: 243174 - DNA, 25 bp, Mus musculus
atcccagccttttcaacatcaatgt

SEQ ID NO: 243175 - DNA, 25 bp, Mus musculus
atcccagcgtctcagaggatcgtga

SEQ ID NO: 243176 - DNA, 25 bp, Mus musculus
atcccagcgtctgagaggatcgtga

SEQ ID NO: 243177 - DNA, 25 bp, Mus musculus
atcccagctatgatgtagccaggac

SEQ ID NO: 243178 - DNA, 25 bp, Mus musculus
atcccagctatgttgtagccaggac

SEQ ID NO: 243179 - DNA, 25 bp, Mus musculus
atcccagctattcaaacaagtgatt

SEQ ID NO: 243180 - DNA, 25 bp, Mus musculus
atcccagctattgaaacaagtgatt

SEQ ID NO: 243181 - DNA, 25 bp, Mus musculus
atcccagctcagcatccaggagtat

SEQ ID NO: 243182 - DNA, 25 bp, Mus musculus
atcccagctcaggatccaggagtat

SEQ ID NO: 243183 - DNA, 25 bp, Mus musculus
atcccagcttcgagtgattgcttca

SEQ ID NO: 243184 - DNA, 25 bp, Mus musculus
atcccagcttcgtgtgattgcttca

SEQ ID NO: 243185 - DNA, 25 bp, Mus musculus
atcccaggaagcaagcatgaggtca

SEQ ID NO: 243186 - DNA, 25 bp, Mus musculus
atcccaggaagctagcatgaggtca

SEQ ID NO: 243187 - DNA, 25 bp, Mus musculus
atcccaggacaaaaagccagccatg

SEQ ID NO: 243188 - DNA, 25 bp, Mus musculus
atcccaggacaataagccagccatg

SEQ ID NO: 243189 - DNA, 25 bp, Mus musculus
atcccaggacagatcttccgttctt

SEQ ID NO: 243190 - DNA, 25 bp, Mus musculus
atcccaggacagttcttccgttctt

SEQ ID NO: 243191 - DNA, 25 bp, Mus musculus
atcccaggaggaaacaaaacttgct

SEQ ID NO: 243192 - DNA, 25 bp, Mus musculus
atcccaggaggatacaaaacttgct

SEQ ID NO: 243193 - DNA, 25 bp, Mus musculus
atcccaggatccactaagccttagg

SEQ ID NO: 243194 - DNA, 25 bp, Mus musculus
atcccaggatccatagcacaaagcc

SEQ ID NO: 243195 - DNA, 25 bp, Mus musculus
atcccaggatcctctaagccttagg

SEQ ID NO: 243196 - DNA, 25 bp, Mus musculus
atcccaggatccttagcacaaagcc

SEQ ID NO: 243197 - DNA, 25 bp, Mus musculus
atcccaggatgtacggacttggcgc

SEQ ID NO: 243198 - DNA, 25 bp, Mus musculus
atcccaggatgttcggacttggcgc

SEQ ID NO: 243199 - DNA, 25 bp, Mus musculus
atcccaggccatctaggcggccatt

SEQ ID NO: 243200 - DNA, 25 bp, Mus musculus
atcccaggccatgtaggcggccatt

SEQ ID NO: 243201 - DNA, 25 bp, Mus musculus
atcccaggcgtcctcagggcagctg

SEQ ID NO: 243202 - DNA, 25 bp, Mus musculus
atcccaggcgtcgtcagggcagctg

SEQ ID NO: 243203 - DNA, 25 bp, Mus musculus
atcccaggctgccaagtctgtctat

SEQ ID NO: 243204 - DNA, 25 bp, Mus musculus
atcccaggctgcgaagtctgtctat

SEQ ID NO: 243205 - DNA, 25 bp, Mus musculus
atcccaggctggctgcatggtacca

SEQ ID NO: 243206 - DNA, 25 bp, Mus musculus
atcccaggctgggtgcatggtacca

SEQ ID NO: 243207 - DNA, 25 bp, Mus musculus
atcccaggcttcagttctgctgtgg

SEQ ID NO: 243208 - DNA, 25 bp, Mus musculus
atcccaggcttctgttctgctgtgg

SEQ ID NO: 243209 - DNA, 25 bp, Mus musculus
atcccaggctttagggccaaaggct

SEQ ID NO: 243210 - DNA, 25 bp, Mus musculus
atcccaggcttttgggccaaaggct

SEQ ID NO: 243211 - DNA, 25 bp, Mus musculus
atcccagggatgctacaatccggca

SEQ ID NO: 243212 - DNA, 25 bp, Mus musculus
atcccagggatggtacaatccggca

SEQ ID NO: 243213 - DNA, 25 bp, Mus musculus
atcccagggctcatgctcacacatg

SEQ ID NO: 243214 - DNA, 25 bp, Mus musculus
atcccagggctcttgctcacacatg

SEQ ID NO: 243215 - DNA, 25 bp, Mus musculus
atcccagggctgagcgcaaataaac

SEQ ID NO: 243216 - DNA, 25 bp, Mus musculus
atcccagggctgtgcgcaaataaac

SEQ ID NO: 243217 - DNA, 25 bp, Mus musculus
atcccagggtaaaactccagtcagc

SEQ ID NO: 243218 - DNA, 25 bp, Mus musculus
atcccagggtaatactccagtcagc

SEQ ID NO: 243219 - DNA, 25 bp, Mus musculus
atcccaggtctaaagccacaagttt

SEQ ID NO: 243220 - DNA, 25 bp, Mus musculus
atcccaggtctatagccacaagttt

SEQ ID NO: 243221 - DNA, 25 bp, Mus musculus
atcccaggtcttactgctaggtact

SEQ ID NO: 243222 - DNA, 25 bp, Mus musculus
atcccaggtctttctgctaggtact

SEQ ID NO: 243223 - DNA, 25 bp, Mus musculus
atcccaggtgcaattccttgttcaa

SEQ ID NO: 243224 - DNA, 25 bp, Mus musculus
atcccaggtgcatttccttgttcaa

SEQ ID NO: 243225 - DNA, 25 bp, Mus musculus
atcccagtaaatacagtacttcagg

SEQ ID NO: 243226 - DNA, 25 bp, Mus musculus
atcccagtaaattcagtacttcagg

SEQ ID NO: 243227 - DNA, 25 bp, Mus musculus
atcccagtaactcacatcaacagcg

SEQ ID NO: 243228 - DNA, 25 bp, Mus musculus
atcccagtaactgacatcaacagcg

SEQ ID NO: 243229 - DNA, 25 bp, Mus musculus
atcccagtacatatttaacacatca

SEQ ID NO: 243230 - DNA, 25 bp, Mus musculus
atcccagtacatttttaacacatca

SEQ ID NO: 243231 - DNA, 25 bp, Mus musculus
atcccagtaccaatgaagagatttg

SEQ ID NO: 243232 - DNA, 25 bp, Mus musculus
atcccagtaccattgaagagatttg

SEQ ID NO: 243233 - DNA, 25 bp, Mus musculus
atcccagtacgtcttggtagttcct

SEQ ID NO: 243234 - DNA, 25 bp, Mus musculus
atcccagtacgtgttggtagttcct

SEQ ID NO: 243235 - DNA, 25 bp, Mus musculus
atcccagtattaaatgttcatcagg

SEQ ID NO: 243236 - DNA, 25 bp, Mus musculus
atcccagtattatatgttcatcagg

SEQ ID NO: 243237 - DNA, 25 bp, Mus musculus
atcccagtattccaggtgagggctt

SEQ ID NO: 243238 - DNA, 25 bp, Mus musculus
atcccagtattccatgtatctcagt

SEQ ID NO: 243239 - DNA, 25 bp, Mus musculus
atcccagtattcgaggtgagggctt

SEQ ID NO: 243240 - DNA, 25 bp, Mus musculus
atcccagtattcgatgtatctcagt

SEQ ID NO: 243241 - DNA, 25 bp, Mus musculus
atcccagtatttactgccaccagta

SEQ ID NO: 243242 - DNA, 25 bp, Mus musculus
atcccagtatttccttttctcattc

SEQ ID NO: 243243 - DNA, 25 bp, Mus musculus
atcccagtatttgcttttctcattc

SEQ ID NO: 243244 - DNA, 25 bp, Mus musculus
atcccagtattttctgccaccagta

SEQ ID NO: 243245 - DNA, 25 bp, Mus musculus
atcccagtcttgcagtatttgtaca

SEQ ID NO: 243246 - DNA, 25 bp, Mus musculus
atcccagtcttggagtatttgtaca

SEQ ID NO: 243247 - DNA, 25 bp, Mus musculus
atcccagtgtgaccacagatgacac

SEQ ID NO: 243248 - DNA, 25 bp, Mus musculus
atcccagtgtgagcacagatgacac

SEQ ID NO: 243249 - DNA, 25 bp, Mus musculus
atcccagtgtggcaagtgggctact

SEQ ID NO: 243250 - DNA, 25 bp, Mus musculus
atcccagtgtggctgacatgcagga

SEQ ID NO: 243251 - DNA, 25 bp, Mus musculus
atcccagtgtgggaagtgggctact

SEQ ID NO: 243252 - DNA, 25 bp, Mus musculus
atcccagtgtgggtgacatgcagga

SEQ ID NO: 243253 - DNA, 25 bp, Mus musculus
atcccagtgttccttgtaatgcagt

SEQ ID NO: 243254 - DNA, 25 bp, Mus musculus
atcccagtgttcgttgtaatgcagt

SEQ ID NO: 243255 - DNA, 25 bp, Mus musculus
atcccagttccaagctagtaaaaag

SEQ ID NO: 243256 - DNA, 25 bp, Mus musculus
atcccagttccatgctagtaaaaag

SEQ ID NO: 243257 - DNA, 25 bp, Mus musculus
atcccagttcctcgtgtgcaggagt

SEQ ID NO: 243258 - DNA, 25 bp, Mus musculus
atcccagttcctggtgtgcaggagt

SEQ ID NO: 243259 - DNA, 25 bp, Mus musculus
atcccagttctgagtgtctctgttg

SEQ ID NO: 243260 - DNA, 25 bp, Mus musculus
atcccagttctgtgtgtctctgttg

SEQ ID NO: 243261 - DNA, 25 bp, Mus musculus
atcccagttggaaaggcattctaaa

SEQ ID NO: 243262 - DNA, 25 bp, Mus musculus
atcccagttggataggcattctaaa

SEQ ID NO: 243263 - DNA, 25 bp, Mus musculus
atcccagttgtaaaggaccactcta

SEQ ID NO: 243264 - DNA, 25 bp, Mus musculus
atcccagttgtataggaccactcta

SEQ ID NO: 243265 - DNA, 25 bp, Mus musculus
atcccagtttaaactgagttcaagg

SEQ ID NO: 243266 - DNA, 25 bp, Mus musculus
atcccagtttaatctgagttcaagg

SEQ ID NO: 243267 - DNA, 25 bp, Mus musculus
atcccagtttctagtggttggccct

SEQ ID NO: 243268 - DNA, 25 bp, Mus musculus
atcccagtttcttgtggttggccct

SEQ ID NO: 243269 - DNA, 25 bp, Mus musculus
atcccagttttcagctcctttgaaa

SEQ ID NO: 243270 - DNA, 25 bp, Mus musculus
atcccagttttctgctcctttgaaa

SEQ ID NO: 243271 - DNA, 25 bp, Mus musculus
atcccataaatgagtgtgctgtgac

SEQ ID NO: 243272 - DNA, 25 bp, Mus musculus
atcccataaatgtgtgtgctgtgac

SEQ ID NO: 243273 - DNA, 25 bp, Mus musculus
atcccataacccaaccttgaagaat

SEQ ID NO: 243274 - DNA, 25 bp, Mus musculus
atcccataaccctaccttgaagaat

SEQ ID NO: 243275 - DNA, 25 bp, Mus musculus
atcccataccacaaggcctttgtaa

SEQ ID NO: 243276 - DNA, 25 bp, Mus musculus
atcccataccactaggcctttgtaa

SEQ ID NO: 243277 - DNA, 25 bp, Mus musculus
atcccatagcgtaggcattcacagc

SEQ ID NO: 243278 - DNA, 25 bp, Mus musculus
atcccatagcgttggcattcacagc

SEQ ID NO: 243279 - DNA, 25 bp, Mus musculus
atcccatataacatttgcccactgt

SEQ ID NO: 243280 - DNA, 25 bp, Mus musculus
atcccatataacttttgcccactgt

SEQ ID NO: 243281 - DNA, 25 bp, Mus musculus
atcccatcaatccagagtggctcta

SEQ ID NO: 243282 - DNA, 25 bp, Mus musculus
atcccatcaatcgagagtggctcta

SEQ ID NO: 243283 - DNA, 25 bp, Mus musculus
atcccatcacccactatttggagaa

SEQ ID NO: 243284 - DNA, 25 bp, Mus musculus
atcccatcaccctctatttggagaa

SEQ ID NO: 243285 - DNA, 25 bp, Mus musculus
atcccatcagcactctcatgacata

SEQ ID NO: 243286 - DNA, 25 bp, Mus musculus
atcccatcagcagtctcatgacata

SEQ ID NO: 243287 - DNA, 25 bp, Mus musculus
atcccatcaggaagccaagatccct

SEQ ID NO: 243288 - DNA, 25 bp, Mus musculus
atcccatcaggatgccaagatccct

SEQ ID NO: 243289 - DNA, 25 bp, Mus musculus
atcccatcccaacgctgatgctaag

SEQ ID NO: 243290 - DNA, 25 bp, Mus musculus
atcccatcccaaggctgatgctaag

SEQ ID NO: 243291 - DNA, 25 bp, Mus musculus
atcccatccccgaatattatttaga

SEQ ID NO: 243292 - DNA, 25 bp, Mus musculus
atcccatccccgtatattatttaga

SEQ ID NO: 243293 - DNA, 25 bp, Mus musculus
atcccatccctacagaaaactgcag

SEQ ID NO: 243294 - DNA, 25 bp, Mus musculus
atcccatccctagagaaaactgcag

SEQ ID NO: 243295 - DNA, 25 bp, Mus musculus
atcccatccgtacccagtgacatat

SEQ ID NO: 243296 - DNA, 25 bp, Mus musculus
atcccatccgtagccagtgacatat

SEQ ID NO: 243297 - DNA, 25 bp, Mus musculus
atcccatcctcacttttgtgcagat

SEQ ID NO: 243298 - DNA, 25 bp, Mus musculus
atcccatcctcagttttgtgcagat

SEQ ID NO: 243299 - DNA, 25 bp, Mus musculus
atcccatccttgcagccattgatga

SEQ ID NO: 243300 - DNA, 25 bp, Mus musculus
atcccatccttggagccattgatga

SEQ ID NO: 243301 - DNA, 25 bp, Mus musculus
atcccatcgaatagaccttaggttg

SEQ ID NO: 243302 - DNA, 25 bp, Mus musculus
atcccatcgaattgaccttaggttg

SEQ ID NO: 243303 - DNA, 25 bp, Mus musculus
atcccatcgtttcatggctaaccca

SEQ ID NO: 243304 - DNA, 25 bp, Mus musculus
atcccatcgtttgatggctaaccca

SEQ ID NO: 243305 - DNA, 25 bp, Mus musculus
atcccatctcatatattgaaaagag

SEQ ID NO: 243306 - DNA, 25 bp, Mus musculus
atcccatctcatttattgaaaagag

SEQ ID NO: 243307 - DNA, 25 bp, Mus musculus
atcccatctgatactcctggccaga

SEQ ID NO: 243308 - DNA, 25 bp, Mus musculus
atcccatctgattctcctggccaga

SEQ ID NO: 243309 - DNA, 25 bp, Mus musculus
atcccatctgtgctgtgacggagac

SEQ ID NO: 243310 - DNA, 25 bp, Mus musculus
atcccatctgtggtgtgacggagac

SEQ ID NO: 243311 - DNA, 25 bp, Mus musculus
atcccatgacttacctaaggagtgt

SEQ ID NO: 243312 - DNA, 25 bp, Mus musculus
atcccatgactttcctaaggagtgt

SEQ ID NO: 243313 - DNA, 25 bp, Mus musculus
atcccatgccctcgatgattccaaa

SEQ ID NO: 243314 - DNA, 25 bp, Mus musculus
atcccatgccctggatgattccaaa

SEQ ID NO: 243315 - DNA, 25 bp, Mus musculus
atcccatggaccacaggactggagt

SEQ ID NO: 243316 - DNA, 25 bp, Mus musculus
atcccatggacctcaggactggagt

SEQ ID NO: 243317 - DNA, 25 bp, Mus musculus
atcccatggaggacgtggagaaagc

SEQ ID NO: 243318 - DNA, 25 bp, Mus musculus
atcccatggaggtcgtggagaaagc

SEQ ID NO: 243319 - DNA, 25 bp, Mus musculus
atcccatggcaactctaacctaaaa

SEQ ID NO: 243320 - DNA, 25 bp, Mus musculus
atcccatggcaagtctaacctaaaa

SEQ ID NO: 243321 - DNA, 25 bp, Mus musculus
atcccatggccgctggttcagagaa

SEQ ID NO: 243322 - DNA, 25 bp, Mus musculus
atcccatggccggtggttcagagaa

SEQ ID NO: 243323 - DNA, 25 bp, Mus musculus
atcccatgtctgacgatgtccagga

SEQ ID NO: 243324 - DNA, 25 bp, Mus musculus
atcccatgtctgaggcagtccagaa

SEQ ID NO: 243325 - DNA, 25 bp, Mus musculus
atcccatgtctgtcgatgtccagga

SEQ ID NO: 243326 - DNA, 25 bp, Mus musculus
atcccatgtctgtggcagtccagaa

SEQ ID NO: 243327 - DNA, 25 bp, Mus musculus
atcccatgttcaacacttgtgtcca

SEQ ID NO: 243328 - DNA, 25 bp, Mus musculus
atcccatgttcatcacttgtgtcca

SEQ ID NO: 243329 - DNA, 25 bp, Mus musculus
atcccatgttgtctaccctacaagg

SEQ ID NO: 243330 - DNA, 25 bp, Mus musculus
atcccatgttgtgtaccctacaagg

SEQ ID NO: 243331 - DNA, 25 bp, Mus musculus
atcccattagctacttgaatcctca

SEQ ID NO: 243332 - DNA, 25 bp, Mus musculus
atcccattagcttcttgaatcctca

SEQ ID NO: 243333 - DNA, 25 bp, Mus musculus
atcccattatctacacccttaggaa

SEQ ID NO: 243334 - DNA, 25 bp, Mus musculus
atcccattatcttcacccttaggaa

SEQ ID NO: 243335 - DNA, 25 bp, Mus musculus
atcccattattacctccaaacgctg

SEQ ID NO: 243336 - DNA, 25 bp, Mus musculus
atcccattattagctccaaacgctg

SEQ ID NO: 243337 - DNA, 25 bp, Mus musculus
atcccattccaactggcttgatgct

SEQ ID NO: 243338 - DNA, 25 bp, Mus musculus
atcccattccaagtggcttgatgct

SEQ ID NO: 243339 - DNA, 25 bp, Mus musculus
atcccattccctatctttaggacat

SEQ ID NO: 243340 - DNA, 25 bp, Mus musculus
atcccattccctttctttaggacat

SEQ ID NO: 243341 - DNA, 25 bp, Mus musculus
atcccattctatcctgaccatattc

SEQ ID NO: 243342 - DNA, 25 bp, Mus musculus
atcccattctatgctgaccatattc

SEQ ID NO: 243343 - DNA, 25 bp, Mus musculus
atcccattctctatgctttcttgga

SEQ ID NO: 243344 - DNA, 25 bp, Mus musculus
atcccattctctttgctttcttgga

SEQ ID NO: 243345 - DNA, 25 bp, Mus musculus
atcccattcttgatgctcctaggaa

SEQ ID NO: 243346 - DNA, 25 bp, Mus musculus
atcccattcttgttgctcctaggaa

SEQ ID NO: 243347 - DNA, 25 bp, Mus musculus
atcccattgccaaaacagttgacag

SEQ ID NO: 243348 - DNA, 25 bp, Mus musculus
atcccattgccataacagttgacag

SEQ ID NO: 243349 - DNA, 25 bp, Mus musculus
atcccattggacacacattggtttg

SEQ ID NO: 243350 - DNA, 25 bp, Mus musculus
atcccattggactcacattggtttg

SEQ ID NO: 243351 - DNA, 25 bp, Mus musculus
atcccatttctaatttgctcatagg

SEQ ID NO: 243352 - DNA, 25 bp, Mus musculus
atcccatttctattttgctcatagg

SEQ ID NO: 243353 - DNA, 25 bp, Mus musculus
atcccatttgcgctgattggcagca

SEQ ID NO: 243354 - DNA, 25 bp, Mus musculus
atcccatttgcggtgattggcagca

SEQ ID NO: 243355 - DNA, 25 bp, Mus musculus
atcccatttgttagccagttcctgt

SEQ ID NO: 243356 - DNA, 25 bp, Mus musculus
atcccatttgtttgccagttcctgt

SEQ ID NO: 243357 - DNA, 25 bp, Mus musculus
atccccaaacagaacagccgagtgt

SEQ ID NO: 243358 - DNA, 25 bp, Mus musculus
atccccaaacagtacagccgagtgt

SEQ ID NO: 243359 - DNA, 25 bp, Mus musculus
atccccaaatccaatgtctatgtgc

SEQ ID NO: 243360 - DNA, 25 bp, Mus musculus
atccccaaatcctatgtctatgtgc

SEQ ID NO: 243361 - DNA, 25 bp, Mus musculus
atccccaaccgcaagattgtagaat

SEQ ID NO: 243362 - DNA, 25 bp, Mus musculus
atccccaaccgctagattgtagaat

SEQ ID NO: 243363 - DNA, 25 bp, Mus musculus
atccccaagacacctattctgatta

SEQ ID NO: 243364 - DNA, 25 bp, Mus musculus
atccccaagacagctattctgatta

SEQ ID NO: 243365 - DNA, 25 bp, Mus musculus
atccccaagacgcagagtcggcaat

SEQ ID NO: 243366 - DNA, 25 bp, Mus musculus
atccccaagacggagagtcggcaat

SEQ ID NO: 243367 - DNA, 25 bp, Mus musculus
atccccaagctgctggtcatcaagc

SEQ ID NO: 243368 - DNA, 25 bp, Mus musculus
atccccaagctggtggtcatcaagc

SEQ ID NO: 243369 - DNA, 25 bp, Mus musculus
atccccaaggaaacgtatgctgact

SEQ ID NO: 243370 - DNA, 25 bp, Mus musculus
atccccaaggaatcgtatgctgact

SEQ ID NO: 243371 - DNA, 25 bp, Mus musculus
atccccaaggagagctgcgcagtga

SEQ ID NO: 243372 - DNA, 25 bp, Mus musculus
atccccaaggagtgctgcgcagtga

SEQ ID NO: 243373 - DNA, 25 bp, Mus musculus
atccccaataccatttgcaggtctg

SEQ ID NO: 243374 - DNA, 25 bp, Mus musculus
atccccaataccttttgcaggtctg

SEQ ID NO: 243375 - DNA, 25 bp, Mus musculus
atccccaatgtgacccttttaaatg

SEQ ID NO: 243376 - DNA, 25 bp, Mus musculus
atccccaatgtgtcccttttaaatg

SEQ ID NO: 243377 - DNA, 25 bp, Mus musculus
atccccaatgttactcaccagaaaa

SEQ ID NO: 243378 - DNA, 25 bp, Mus musculus
atccccaatgtttctcaccagaaaa

SEQ ID NO: 243379 - DNA, 25 bp, Mus musculus
atccccacaatgactagctgttgct

SEQ ID NO: 243380 - DNA, 25 bp, Mus musculus
atccccacaatgtctagctgttgct

SEQ ID NO: 243381 - DNA, 25 bp, Mus musculus
atccccacacaactgcaggcagtaa

SEQ ID NO: 243382 - DNA, 25 bp, Mus musculus
atccccacacaagtgcaggcagtaa

SEQ ID NO: 243383 - DNA, 25 bp, Mus musculus
atccccacagtgaagacaaaggcag

SEQ ID NO: 243384 - DNA, 25 bp, Mus musculus
atccccacagtgtagacaaaggcag

SEQ ID NO: 243385 - DNA, 25 bp, Mus musculus
atccccacagttaatgacagcaaca

SEQ ID NO: 243386 - DNA, 25 bp, Mus musculus
atccccacagtttatgacagcaaca

SEQ ID NO: 243387 - DNA, 25 bp, Mus musculus
atccccactaggctgtaacacggtg

SEQ ID NO: 243388 - DNA, 25 bp, Mus musculus
atccccactagggtgtaacacggtg

SEQ ID NO: 243389 - DNA, 25 bp, Mus musculus
atccccacttatagccaatgtacct

SEQ ID NO: 243390 - DNA, 25 bp, Mus musculus
atccccacttatctgacttcattga

SEQ ID NO: 243391 - DNA, 25 bp, Mus musculus
atccccacttatgtgacttcattga

SEQ ID NO: 243392 - DNA, 25 bp, Mus musculus
atccccacttattgccaatgtacct

SEQ ID NO: 243393 - DNA, 25 bp, Mus musculus
atccccacttgaagattcggcaaca

SEQ ID NO: 243394 - DNA, 25 bp, Mus musculus
atccccacttgatgattcggcaaca

SEQ ID NO: 243395 - DNA, 25 bp, Mus musculus
atccccagaaccactgtataatctg

SEQ ID NO: 243396 - DNA, 25 bp, Mus musculus
atccccagaacctctgtataatctg

SEQ ID NO: 243397 - DNA, 25 bp, Mus musculus
atccccagaatgaactgctcaaggg

SEQ ID NO: 243398 - DNA, 25 bp, Mus musculus
atccccagaatgtactgctcaaggg

SEQ ID NO: 243399 - DNA, 25 bp, Mus musculus
atccccagacatcttggagcctgag

SEQ ID NO: 243400 - DNA, 25 bp, Mus musculus
atccccagacatgttggagcctgag

SEQ ID NO: 243401 - DNA, 25 bp, Mus musculus
atccccagagcacagataatagtga

SEQ ID NO: 243402 - DNA, 25 bp, Mus musculus
atccccagagcagagataatagtga

SEQ ID NO: 243403 - DNA, 25 bp, Mus musculus
atccccagagctcaaaaatctcagt

SEQ ID NO: 243404 - DNA, 25 bp, Mus musculus
atccccagagctgaaaaatctcagt

SEQ ID NO: 243405 - DNA, 25 bp, Mus musculus
atccccagataaatttagttgaaca

SEQ ID NO: 243406 - DNA, 25 bp, Mus musculus
atccccagataattttagttgaaca

SEQ ID NO: 243407 - DNA, 25 bp, Mus musculus
atccccagatcccacataaaggtag

SEQ ID NO: 243408 - DNA, 25 bp, Mus musculus
atccccagatccgacataaaggtag

SEQ ID NO: 243409 - DNA, 25 bp, Mus musculus
atccccagcattaccagtatcggta

SEQ ID NO: 243410 - DNA, 25 bp, Mus musculus
atccccagcatttccagtatcggta

SEQ ID NO: 243411 - DNA, 25 bp, Mus musculus
atccccagccacataatgagttgaa

SEQ ID NO: 243412 - DNA, 25 bp, Mus musculus
atccccagccacttaatgagttgaa

SEQ ID NO: 243413 - DNA, 25 bp, Mus musculus
atccccagcgggagcagcttgaaaa

SEQ ID NO: 243414 - DNA, 25 bp, Mus musculus
atccccagcgggtgcagcttgaaaa

SEQ ID NO: 243415 - DNA, 25 bp, Mus musculus
atccccagctccaaaacattattaa

SEQ ID NO: 243416 - DNA, 25 bp, Mus musculus
atccccagctcctaaacattattaa

SEQ ID NO: 243417 - DNA, 25 bp, Mus musculus
atccccaggaaactgctggcttaca

SEQ ID NO: 243418 - DNA, 25 bp, Mus musculus
atccccaggaaagtgctggcttaca

SEQ ID NO: 243419 - DNA, 25 bp, Mus musculus
atccccaggaagagaccggttcgtg

SEQ ID NO: 243420 - DNA, 25 bp, Mus musculus
atccccaggaagtgaccggttcgtg

SEQ ID NO: 243421 - DNA, 25 bp, Mus musculus
atccccaggatcaggattacccctg

SEQ ID NO: 243422 - DNA, 25 bp, Mus musculus
atccccaggatctggattacccctg

SEQ ID NO: 243423 - DNA, 25 bp, Mus musculus
atccccaggcgtaggcaggaacgaa

SEQ ID NO: 243424 - DNA, 25 bp, Mus musculus
atccccaggcgttggcaggaacgaa

SEQ ID NO: 243425 - DNA, 25 bp, Mus musculus
atccccaggctgaatggagtacaca

SEQ ID NO: 243426 - DNA, 25 bp, Mus musculus
atccccaggctgtatggagtacaca

SEQ ID NO: 243427 - DNA, 25 bp, Mus musculus
atccccagtcagacagctacagtag

SEQ ID NO: 243428 - DNA, 25 bp, Mus musculus
atccccagtcagtcagctacagtag

SEQ ID NO: 243429 - DNA, 25 bp, Mus musculus
atccccagtcatagcctttgatcag

SEQ ID NO: 243430 - DNA, 25 bp, Mus musculus
atccccagtcattgcctttgatcag

SEQ ID NO: 243431 - DNA, 25 bp, Mus musculus
atccccataagcactcttcaataat

SEQ ID NO: 243432 - DNA, 25 bp, Mus musculus
atccccataagctctcttcaataat

SEQ ID NO: 243433 - DNA, 25 bp, Mus musculus
atccccatagagatagtacaggcca

SEQ ID NO: 243434 - DNA, 25 bp, Mus musculus
atccccatagagttagtacaggcca

SEQ ID NO: 243435 - DNA, 25 bp, Mus musculus
atccccatagggagacctgcggcag

SEQ ID NO: 243436 - DNA, 25 bp, Mus musculus
atccccatagggtgacctgcggcag

SEQ ID NO: 243437 - DNA, 25 bp, Mus musculus
atccccatagttccttggtctaatt

SEQ ID NO: 243438 - DNA, 25 bp, Mus musculus
atccccatagttgcttggtctaatt

SEQ ID NO: 243439 - DNA, 25 bp, Mus musculus
atccccatctaacccttaaacagag

SEQ ID NO: 243440 - DNA, 25 bp, Mus musculus
atccccatctaagccttaaacagag

SEQ ID NO: 243441 - DNA, 25 bp, Mus musculus
atccccatcttcctttgaaactttg

SEQ ID NO: 243442 - DNA, 25 bp, Mus musculus
atccccatcttcgtttgaaactttg

SEQ ID NO: 243443 - DNA, 25 bp, Mus musculus
atccccatgggaactctgagttacc

SEQ ID NO: 243444 - DNA, 25 bp, Mus musculus
atccccatgggatctctgagttacc

SEQ ID NO: 243445 - DNA, 25 bp, Mus musculus
atccccatgtatccgccaggaagca

SEQ ID NO: 243446 - DNA, 25 bp, Mus musculus
atccccatgtatgcgccaggaagca

SEQ ID NO: 243447 - DNA, 25 bp, Mus musculus
atccccatgtgaagttaactgtgtt

SEQ ID NO: 243448 - DNA, 25 bp, Mus musculus
atccccatgtgatgttaactgtgtt

SEQ ID NO: 243449 - DNA, 25 bp, Mus musculus
atccccatgtttcttatagcttggc

SEQ ID NO: 243450 - DNA, 25 bp, Mus musculus
atccccatgtttgttatagcttggc

SEQ ID NO: 243451 - DNA, 25 bp, Mus musculus
atccccattcttcttgttcatattg

SEQ ID NO: 243452 - DNA, 25 bp, Mus musculus
atccccattcttgttgttcatattg

SEQ ID NO: 243453 - DNA, 25 bp, Mus musculus
atccccattgctcctgacatgaaag

SEQ ID NO: 243454 - DNA, 25 bp, Mus musculus
atccccattgctgctgacatgaaag

SEQ ID NO: 243455 - DNA, 25 bp, Mus musculus
atccccattgtactcaggttcccag

SEQ ID NO: 243456 - DNA, 25 bp, Mus musculus
atccccattgtagtcaggttcccag

SEQ ID NO: 243457 - DNA, 25 bp, Mus musculus
atccccatttggagagctcctgtgg

SEQ ID NO: 243458 - DNA, 25 bp, Mus musculus
atccccatttggtgagctcctgtgg

SEQ ID NO: 243459 - DNA, 25 bp, Mus musculus
atccccattttactgcatcgtcaag

SEQ ID NO: 243460 - DNA, 25 bp, Mus musculus
atccccattttagtgcatcgtcaag

SEQ ID NO: 243461 - DNA, 25 bp, Mus musculus
atccccctcagaaggaacggctcgg

SEQ ID NO: 243462 - DNA, 25 bp, Mus musculus
atccccctcagatggaacggctcgg

SEQ ID NO: 243463 - DNA, 25 bp, Mus musculus
atccccgaactaagctgctttctta

SEQ ID NO: 243464 - DNA, 25 bp, Mus musculus
atccccgaactatgctgctttctta

SEQ ID NO: 243465 - DNA, 25 bp, Mus musculus
atccccgagagccacctgggcctta

SEQ ID NO: 243466 - DNA, 25 bp, Mus musculus
atccccgagagcgacctgggcctta

SEQ ID NO: 243467 - DNA, 25 bp, Mus musculus
atccccgagtaaacaggccgcacag

SEQ ID NO: 243468 - DNA, 25 bp, Mus musculus
atccccgagtaatcaggccgcacag

SEQ ID NO: 243469 - DNA, 25 bp, Mus musculus
atccccgatttcctgaagttctttg

SEQ ID NO: 243470 - DNA, 25 bp, Mus musculus
atccccgatttcgtgaagttctttg

SEQ ID NO: 243471 - DNA, 25 bp, Mus musculus
atccccgccacacgagtggaggtgt

SEQ ID NO: 243472 - DNA, 25 bp, Mus musculus
atccccgccacaggagtggaggtgt

SEQ ID NO: 243473 - DNA, 25 bp, Mus musculus
atccccgccatcagagctaggagat

SEQ ID NO: 243474 - DNA, 25 bp, Mus musculus
atccccgccatctgagctaggagat

SEQ ID NO: 243475 - DNA, 25 bp, Mus musculus
atccccgctgctctcaaagaagtgt

SEQ ID NO: 243476 - DNA, 25 bp, Mus musculus
atccccgctgctgtcaaagaagtgt

SEQ ID NO: 243477 - DNA, 25 bp, Mus musculus
atccccggcgggagctgtacacttg

SEQ ID NO: 243478 - DNA, 25 bp, Mus musculus
atccccggcgggtgctgtacacttg

SEQ ID NO: 243479 - DNA, 25 bp, Mus musculus
atccccggcgtcagtttgaaggcaa

SEQ ID NO: 243480 - DNA, 25 bp, Mus musculus
atccccggcgtctgtttgaaggcaa

SEQ ID NO: 243481 - DNA, 25 bp, Mus musculus
atccccgggattactgaatggctca

SEQ ID NO: 243482 - DNA, 25 bp, Mus musculus
atccccgggatttctgaatggctca

SEQ ID NO: 243483 - DNA, 25 bp, Mus musculus
atccccgggcaaaaccacaggtggc

SEQ ID NO: 243484 - DNA, 25 bp, Mus musculus
atccccgggcaataccacaggtggc

SEQ ID NO: 243485 - DNA, 25 bp, Mus musculus
atccccgtagagcagtttgtgcaga

SEQ ID NO: 243486 - DNA, 25 bp, Mus musculus
atccccgtagaggagtttgtgcaga

SEQ ID NO: 243487 - DNA, 25 bp, Mus musculus
atccccgtaggaaccctgaagaatg

SEQ ID NO: 243488 - DNA, 25 bp, Mus musculus
atccccgtaggatccctgaagaatg

SEQ ID NO: 243489 - DNA, 25 bp, Mus musculus
atccccgtatacctgtgtgagctgt

SEQ ID NO: 243490 - DNA, 25 bp, Mus musculus
atccccgtatacgtgtgtgagctgt

SEQ ID NO: 243491 - DNA, 25 bp, Mus musculus
atccccgtgacgacaatagcacagc

SEQ ID NO: 243492 - DNA, 25 bp, Mus musculus
atccccgtgacgtcaatagcacagc

SEQ ID NO: 243493 - DNA, 25 bp, Mus musculus
atccccgtgggcactttggctgtcc

SEQ ID NO: 243494 - DNA, 25 bp, Mus musculus
atccccgtgggctctttggctgtcc

SEQ ID NO: 243495 - DNA, 25 bp, Mus musculus
atccccgttcggctctgtatgttcc

SEQ ID NO: 243496 - DNA, 25 bp, Mus musculus
atccccgttcgggtctgtatgttcc

SEQ ID NO: 243497 - DNA, 25 bp, Mus musculus
atccccgttgtacctggtgtggaca

SEQ ID NO: 243498 - DNA, 25 bp, Mus musculus
atccccgttgtagctggtgtggaca

SEQ ID NO: 243499 - DNA, 25 bp, Mus musculus
atccccgtttggagcacctgagcct

SEQ ID NO: 243500 - DNA, 25 bp, Mus musculus
atccccgtttggtgcacctgagcct

SEQ ID NO: 243501 - DNA, 25 bp, Mus musculus
atcccctaagtgaggaccctacagg

SEQ ID NO: 243502 - DNA, 25 bp, Mus musculus
atcccctaagtgtggaccctacagg

SEQ ID NO: 243503 - DNA, 25 bp, Mus musculus
atcccctacacacatgcactttaag

SEQ ID NO: 243504 - DNA, 25 bp, Mus musculus
atcccctacacagatgcactttaag

SEQ ID NO: 243505 - DNA, 25 bp, Mus musculus
atcccctacggaactggagcctaag

SEQ ID NO: 243506 - DNA, 25 bp, Mus musculus
atcccctacggatctggagcctaag

SEQ ID NO: 243507 - DNA, 25 bp, Mus musculus
atcccctagagcagcagacttcata

SEQ ID NO: 243508 - DNA, 25 bp, Mus musculus
atcccctagagctgcagacttcata

SEQ ID NO: 243509 - DNA, 25 bp, Mus musculus
atcccctagccaactaagaaatgag

SEQ ID NO: 243510 - DNA, 25 bp, Mus musculus
atcccctagccatctaagaaatgag

SEQ ID NO: 243511 - DNA, 25 bp, Mus musculus
atcccctagtctatgttactgaaaa

SEQ ID NO: 243512 - DNA, 25 bp, Mus musculus
atcccctagtctttgttactgaaaa

SEQ ID NO: 243513 - DNA, 25 bp, Mus musculus
atcccctataaccagaattacagac

SEQ ID NO: 243514 - DNA, 25 bp, Mus musculus
atcccctataacgagaattacagac

SEQ ID NO: 243515 - DNA, 25 bp, Mus musculus
atcccctatcttagattgttgacaa

SEQ ID NO: 243516 - DNA, 25 bp, Mus musculus
atcccctatctttgattgttgacaa

SEQ ID NO: 243517 - DNA, 25 bp, Mus musculus
atcccctatttactctgccttaaag

SEQ ID NO: 243518 - DNA, 25 bp, Mus musculus
atcccctatttagtctgccttaaag

SEQ ID NO: 243519 - DNA, 25 bp, Mus musculus
atcccctcaaggagtctccaatggc

SEQ ID NO: 243520 - DNA, 25 bp, Mus musculus
atcccctcaaggtgtctccaatggc

SEQ ID NO: 243521 - DNA, 25 bp, Mus musculus
atcccctcaattcacttttcaatag

SEQ ID NO: 243522 - DNA, 25 bp, Mus musculus
atcccctcaattgacttttcaatag

SEQ ID NO: 243523 - DNA, 25 bp, Mus musculus
atcccctccctcaatttagttatgg

SEQ ID NO: 243524 - DNA, 25 bp, Mus musculus
atcccctccctctatttagttatgg

SEQ ID NO: 243525 - DNA, 25 bp, Mus musculus
atcccctcctgtattccagagaaga

SEQ ID NO: 243526 - DNA, 25 bp, Mus musculus
atcccctcctgttttccagagaaga

SEQ ID NO: 243527 - DNA, 25 bp, Mus musculus
atcccctctcggagaaccaggaaag

SEQ ID NO: 243528 - DNA, 25 bp, Mus musculus
atcccctctcggtgaaccaggaaag

SEQ ID NO: 243529 - DNA, 25 bp, Mus musculus
atcccctctggaaatcggtcattgg

SEQ ID NO: 243530 - DNA, 25 bp, Mus musculus
atcccctctggatatcggtcattgg

SEQ ID NO: 243531 - DNA, 25 bp, Mus musculus
atcccctgacaacctccagtaggag

SEQ ID NO: 243532 - DNA, 25 bp, Mus musculus
atcccctgacaagctccagtaggag

SEQ ID NO: 243533 - DNA, 25 bp, Mus musculus
atcccctgagaaagaaaatcccgag

SEQ ID NO: 243534 - DNA, 25 bp, Mus musculus
atcccctgagaatgaaaatcccgag

SEQ ID NO: 243535 - DNA, 25 bp, Mus musculus
atcccctgatacaccaggttagttt

SEQ ID NO: 243536 - DNA, 25 bp, Mus musculus
atcccctgatactccaggttagttt

SEQ ID NO: 243537 - DNA, 25 bp, Mus musculus
atcccctgctaaaagttctctttac

SEQ ID NO: 243538 - DNA, 25 bp, Mus musculus
atcccctgctaatagttctctttac

SEQ ID NO: 243539 - DNA, 25 bp, Mus musculus
atcccctgctacactgatgggaggt

SEQ ID NO: 243540 - DNA, 25 bp, Mus musculus
atcccctgctactctgatgggaggt

SEQ ID NO: 243541 - DNA, 25 bp, Mus musculus
atcccctggattccatccttgaagt

SEQ ID NO: 243542 - DNA, 25 bp, Mus musculus
atcccctggattgcatccttgaagt

SEQ ID NO: 243543 - DNA, 25 bp, Mus musculus
atcccctggcttccagaaaatccag

SEQ ID NO: 243544 - DNA, 25 bp, Mus musculus
atcccctggcttgcagaaaatccag

SEQ ID NO: 243545 - DNA, 25 bp, Mus musculus
atcccctgtcttctgatggatcgag

SEQ ID NO: 243546 - DNA, 25 bp, Mus musculus
atcccctgtcttgtgatggatcgag

SEQ ID NO: 243547 - DNA, 25 bp, Mus musculus
atcccctgttaaatagaagcgtaat

SEQ ID NO: 243548 - DNA, 25 bp, Mus musculus
atcccctgttaattagaagcgtaat

SEQ ID NO: 243549 - DNA, 25 bp, Mus musculus
atcccctgttacatctgttctgaga

SEQ ID NO: 243550 - DNA, 25 bp, Mus musculus
atcccctgttacttctgttctgaga

SEQ ID NO: 243551 - DNA, 25 bp, Mus musculus
atccccttaaaacatcctgctgaga

SEQ ID NO: 243552 - DNA, 25 bp, Mus musculus
atccccttaaaagatcctgctgaga

SEQ ID NO: 243553 - DNA, 25 bp, Mus musculus
atccccttaatacctaatgtaccca

SEQ ID NO: 243554 - DNA, 25 bp, Mus musculus
atccccttaatagctaatgtaccca

SEQ ID NO: 243555 - DNA, 25 bp, Mus musculus
atccccttcctgcagaatgttctca

SEQ ID NO: 243556 - DNA, 25 bp, Mus musculus
atccccttcctggagaatgttctca

SEQ ID NO: 243557 - DNA, 25 bp, Mus musculus
atccccttcgttaggaaagagcaca

SEQ ID NO: 243558 - DNA, 25 bp, Mus musculus
atccccttcgtttggaaagagcaca

SEQ ID NO: 243559 - DNA, 25 bp, Mus musculus
atccccttctgtcagttatgtacgg

SEQ ID NO: 243560 - DNA, 25 bp, Mus musculus
atccccttctgtgagttatgtacgg

SEQ ID NO: 243561 - DNA, 25 bp, Mus musculus
atccccttgccaataactttggagg

SEQ ID NO: 243562 - DNA, 25 bp, Mus musculus
atccccttgccattaactttggagg

SEQ ID NO: 243563 - DNA, 25 bp, Mus musculus
atccccttggagagctgactgcagc

SEQ ID NO: 243564 - DNA, 25 bp, Mus musculus
atccccttggagtgctgactgcagc

SEQ ID NO: 243565 - DNA, 25 bp, Mus musculus
atccccttgtcgacatggttacaga

SEQ ID NO: 243566 - DNA, 25 bp, Mus musculus
atccccttgtcgtcatggttacaga

SEQ ID NO: 243567 - DNA, 25 bp, Mus musculus
atccccttgtgaagagtacgggttg

SEQ ID NO: 243568 - DNA, 25 bp, Mus musculus
atccccttgtgatgagtacgggttg

SEQ ID NO: 243569 - DNA, 25 bp, Mus musculus
atccccttgtgtctatctgatttga

SEQ ID NO: 243570 - DNA, 25 bp, Mus musculus
atccccttgtgtgtatctgatttga

SEQ ID NO: 243571 - DNA, 25 bp, Mus musculus
atcccctttataatagcatctttgg

SEQ ID NO: 243572 - DNA, 25 bp, Mus musculus
atcccctttatattagcatctttgg

SEQ ID NO: 243573 - DNA, 25 bp, Mus musculus
atcccctttctgacgattcaataaa

SEQ ID NO: 243574 - DNA, 25 bp, Mus musculus
atcccctttctgtcgattcaataaa

SEQ ID NO: 243575 - DNA, 25 bp, Mus musculus
atcccctttgttctttccagagtca

SEQ ID NO: 243576 - DNA, 25 bp, Mus musculus
atcccctttgttgtttccagagtca

SEQ ID NO: 243577 - DNA, 25 bp, Mus musculus
atccccttttagaattctcccacag

SEQ ID NO: 243578 - DNA, 25 bp, Mus musculus
atccccttttagtattctcccacag

SEQ ID NO: 243579 - DNA, 25 bp, Mus musculus
atcccgaaacccaagtgcctatggg

SEQ ID NO: 243580 - DNA, 25 bp, Mus musculus
atcccgaaaccctagtgcctatggg

SEQ ID NO: 243581 - DNA, 25 bp, Mus musculus
atcccgaaaggccttctatagagtc

SEQ ID NO: 243582 - DNA, 25 bp, Mus musculus
atcccgaaaggcgttctatagagtc

SEQ ID NO: 243583 - DNA, 25 bp, Mus musculus
atcccgaaaggtctctggaggtgtc

SEQ ID NO: 243584 - DNA, 25 bp, Mus musculus
atcccgaaaggtgtctggaggtgtc

SEQ ID NO: 243585 - DNA, 25 bp, Mus musculus
atcccgaaggccaccttgttcttca

SEQ ID NO: 243586 - DNA, 25 bp, Mus musculus
atcccgaaggcctccttgttcttca

SEQ ID NO: 243587 - DNA, 25 bp, Mus musculus
atcccgaatttcagcttcagctctg

SEQ ID NO: 243588 - DNA, 25 bp, Mus musculus
atcccgaatttctgcttcagctctg

SEQ ID NO: 243589 - DNA, 25 bp, Mus musculus
atcccgaccctgaatttgattgtcc

SEQ ID NO: 243590 - DNA, 25 bp, Mus musculus
atcccgaccctgtatttgattgtcc

SEQ ID NO: 243591 - DNA, 25 bp, Mus musculus
atcccgagttacaaacaacattctt

SEQ ID NO: 243592 - DNA, 25 bp, Mus musculus
atcccgagttactaacaacattctt

SEQ ID NO: 243593 - DNA, 25 bp, Mus musculus
atcccgatgggactgttaagactgt

SEQ ID NO: 243594 - DNA, 25 bp, Mus musculus
atcccgatgggagtgttaagactgt

SEQ ID NO: 243595 - DNA, 25 bp, Mus musculus
atcccgattctgagtcctggtggac

SEQ ID NO: 243596 - DNA, 25 bp, Mus musculus
atcccgattctgtgtcctggtggac

SEQ ID NO: 243597 - DNA, 25 bp, Mus musculus
atcccgatttttatatatgtctgca

SEQ ID NO: 243598 - DNA, 25 bp, Mus musculus
atcccgatttttttatatgtctgca

SEQ ID NO: 243599 - DNA, 25 bp, Mus musculus
atcccgcagcacagggtacggccag

SEQ ID NO: 243600 - DNA, 25 bp, Mus musculus
atcccgcagcactgggtacggccag

SEQ ID NO: 243601 - DNA, 25 bp, Mus musculus
atcccgcagcgcagagaggtactca

SEQ ID NO: 243602 - DNA, 25 bp, Mus musculus
atcccgcagcgctgagaggtactca

SEQ ID NO: 243603 - DNA, 25 bp, Mus musculus
atcccgccagtgacaagaggtgctc

SEQ ID NO: 243604 - DNA, 25 bp, Mus musculus
atcccgccagtgtcaagaggtgctc

SEQ ID NO: 243605 - DNA, 25 bp, Mus musculus
atcccgcgttctctgtctgtaaaag

SEQ ID NO: 243606 - DNA, 25 bp, Mus musculus
atcccgcgttctgtgtctgtaaaag

SEQ ID NO: 243607 - DNA, 25 bp, Mus musculus
atcccgctcaagctcgagatcaaga

SEQ ID NO: 243608 - DNA, 25 bp, Mus musculus
atcccgctcaaggtcgagatcaaga

SEQ ID NO: 243609 - DNA, 25 bp, Mus musculus
atcccgctcaggagacacaatactg

SEQ ID NO: 243610 - DNA, 25 bp, Mus musculus
atcccgctcaggtgacacaatactg

SEQ ID NO: 243611 - DNA, 25 bp, Mus musculus
atcccgctcgagctcaaggtccagg

SEQ ID NO: 243612 - DNA, 25 bp, Mus musculus
atcccgctcgaggtcaaggtccagg

SEQ ID NO: 243613 - DNA, 25 bp, Mus musculus
atcccgctgacaaagactatggctt

SEQ ID NO: 243614 - DNA, 25 bp, Mus musculus
atcccgctgacatagactatggctt

SEQ ID NO: 243615 - DNA, 25 bp, Mus musculus
atcccgctgacgcatttgcaggtag

SEQ ID NO: 243616 - DNA, 25 bp, Mus musculus
atcccgctgacggatttgcaggtag

SEQ ID NO: 243617 - DNA, 25 bp, Mus musculus
atcccgctgctgatgtcctcattag

SEQ ID NO: 243618 - DNA, 25 bp, Mus musculus
atcccgctgctgttgtcctcattag

SEQ ID NO: 243619 - DNA, 25 bp, Mus musculus
atcccgctttacaggacaaacacat

SEQ ID NO: 243620 - DNA, 25 bp, Mus musculus
atcccgctttactggacaaacacat

SEQ ID NO: 243621 - DNA, 25 bp, Mus musculus
atcccggaatctcggtgcttgcaga

SEQ ID NO: 243622 - DNA, 25 bp, Mus musculus
atcccggaatctgggtgcttgcaga

SEQ ID NO: 243623 - DNA, 25 bp, Mus musculus
atcccggaccacagtgaaggcgttg

SEQ ID NO: 243624 - DNA, 25 bp, Mus musculus
atcccggaccactgtgaaggcgttg

SEQ ID NO: 243625 - DNA, 25 bp, Mus musculus
atcccggatagcacctcccagaggt

SEQ ID NO: 243626 - DNA, 25 bp, Mus musculus
atcccggatagctcctcccagaggt

SEQ ID NO: 243627 - DNA, 25 bp, Mus musculus
atcccggattggaggctgttggaat

SEQ ID NO: 243628 - DNA, 25 bp, Mus musculus
atcccggattggtggctgttggaat

SEQ ID NO: 243629 - DNA, 25 bp, Mus musculus
atcccggcaagaagagcaccagcga

SEQ ID NO: 243630 - DNA, 25 bp, Mus musculus
atcccggcaagatgagcaccagcga

SEQ ID NO: 243631 - DNA, 25 bp, Mus musculus
atcccggctcttatgatgtggttca

SEQ ID NO: 243632 - DNA, 25 bp, Mus musculus
atcccggctcttttgatgtggttca

SEQ ID NO: 243633 - DNA, 25 bp, Mus musculus
atcccgggaattatatcaacacaag

SEQ ID NO: 243634 - DNA, 25 bp, Mus musculus
atcccgggaattttatcaacacaag

SEQ ID NO: 243635 - DNA, 25 bp, Mus musculus
atcccgggatatcccaacactggga

SEQ ID NO: 243636 - DNA, 25 bp, Mus musculus
atcccgggatatgccaacactggga

SEQ ID NO: 243637 - DNA, 25 bp, Mus musculus
atcccgggcaatatttccattcttc

SEQ ID NO: 243638 - DNA, 25 bp, Mus musculus
atcccgggcaatttttccattcttc

SEQ ID NO: 243639 - DNA, 25 bp, Mus musculus
atcccggtccatcatggtctgctga

SEQ ID NO: 243640 - DNA, 25 bp, Mus musculus
atcccggtccatgatggtctgctga

SEQ ID NO: 243641 - DNA, 25 bp, Mus musculus
atcccggtgatcaatatagcaagtt

SEQ ID NO: 243642 - DNA, 25 bp, Mus musculus
atcccggtgatctatatagcaagtt

SEQ ID NO: 243643 - DNA, 25 bp, Mus musculus
atcccggtgcacatcagaccagagg

SEQ ID NO: 243644 - DNA, 25 bp, Mus musculus
atcccggtgcacttcagaccagagg

SEQ ID NO: 243645 - DNA, 25 bp, Mus musculus
atcccggtgcccatgtactggagga

SEQ ID NO: 243646 - DNA, 25 bp, Mus musculus
atcccggtgcccttgtactggagga

SEQ ID NO: 243647 - DNA, 25 bp, Mus musculus
atcccggtgggcacaggagagactt

SEQ ID NO: 243648 - DNA, 25 bp, Mus musculus
atcccggtgggctcaggagagactt

SEQ ID NO: 243649 - DNA, 25 bp, Mus musculus
atcccggttgtcacatgaaggtttc

SEQ ID NO: 243650 - DNA, 25 bp, Mus musculus
atcccggttgtctcatgaaggtttc

SEQ ID NO: 243651 - DNA, 25 bp, Mus musculus
atcccgtgtggaatgaactggcatc

SEQ ID NO: 243652 - DNA, 25 bp, Mus musculus
atcccgtgtggattgaactggcatc

SEQ ID NO: 243653 - DNA, 25 bp, Mus musculus
atcccgttgatgacccttgaagtga

SEQ ID NO: 243654 - DNA, 25 bp, Mus musculus
atcccgttgatgtcccttgaagtga

SEQ ID NO: 243655 - DNA, 25 bp, Mus musculus
atccctaaaccaaccaccgtggagt

SEQ ID NO: 243656 - DNA, 25 bp, Mus musculus
atccctaaaccatccaccgtggagt

SEQ ID NO: 243657 - DNA, 25 bp, Mus musculus
atccctaacagtaccttttcattag

SEQ ID NO: 243658 - DNA, 25 bp, Mus musculus
atccctaacagttccttttcattag

SEQ ID NO: 243659 - DNA, 25 bp, Mus musculus
atccctaagagcaagcgccaaaaaa

SEQ ID NO: 243660 - DNA, 25 bp, Mus musculus
atccctaagagctagcgccaaaaaa

SEQ ID NO: 243661 - DNA, 25 bp, Mus musculus
atccctaagcaaagttattcctcag

SEQ ID NO: 243662 - DNA, 25 bp, Mus musculus
atccctaagcaatgttattcctcag

SEQ ID NO: 243663 - DNA, 25 bp, Mus musculus
atccctaagcagctgatcttgggtt

SEQ ID NO: 243664 - DNA, 25 bp, Mus musculus
atccctaagcaggtgatcttgggtt

SEQ ID NO: 243665 - DNA, 25 bp, Mus musculus
atccctaattgtctgcatctggcaa

SEQ ID NO: 243666 - DNA, 25 bp, Mus musculus
atccctaattgtgtgcatctggcaa

SEQ ID NO: 243667 - DNA, 25 bp, Mus musculus
atccctacactaccaggtacctata

SEQ ID NO: 243668 - DNA, 25 bp, Mus musculus
atccctacactagcaggtacctata

SEQ ID NO: 243669 - DNA, 25 bp, Mus musculus
atccctaccactacttagcttgtat

SEQ ID NO: 243670 - DNA, 25 bp, Mus musculus
atccctaccacttcttagcttgtat

SEQ ID NO: 243671 - DNA, 25 bp, Mus musculus
atccctaccgatataaagcataatt

SEQ ID NO: 243672 - DNA, 25 bp, Mus musculus
atccctaccgatttaaagcataatt

SEQ ID NO: 243673 - DNA, 25 bp, Mus musculus
atccctacctatctggccgaggaga

SEQ ID NO: 243674 - DNA, 25 bp, Mus musculus
atccctacctatgtggccgaggaga

SEQ ID NO: 243675 - DNA, 25 bp, Mus musculus
atccctacctgcagtctggtctgag

SEQ ID NO: 243676 - DNA, 25 bp, Mus musculus
atccctacctgctgtctggtctgag

SEQ ID NO: 243677 - DNA, 25 bp, Mus musculus
atccctaccttgcattatgtcatct

SEQ ID NO: 243678 - DNA, 25 bp, Mus musculus
atccctaccttggattatgtcatct

SEQ ID NO: 243679 - DNA, 25 bp, Mus musculus
atccctactgtgacatgtggtttgg

SEQ ID NO: 243680 - DNA, 25 bp, Mus musculus
atccctactgtgtcatgtggtttgg

SEQ ID NO: 243681 - DNA, 25 bp, Mus musculus
atccctacttagcaatacgatggca

SEQ ID NO: 243682 - DNA, 25 bp, Mus musculus
atccctacttaggaatacgatggca

SEQ ID NO: 243683 - DNA, 25 bp, Mus musculus
atccctagagagctgatccttgttc

SEQ ID NO: 243684 - DNA, 25 bp, Mus musculus
atccctagagaggtgatccttgttc

SEQ ID NO: 243685 - DNA, 25 bp, Mus musculus
atccctagagctcttgacaaccaag

SEQ ID NO: 243686 - DNA, 25 bp, Mus musculus
atccctagagctgttgacaaccaag

SEQ ID NO: 243687 - DNA, 25 bp, Mus musculus
atccctagagtcagcatgtcatggt

SEQ ID NO: 243688 - DNA, 25 bp, Mus musculus
atccctagagtctgcatgtcatggt

SEQ ID NO: 243689 - DNA, 25 bp, Mus musculus
atccctagcaccatgaaagactgga

SEQ ID NO: 243690 - DNA, 25 bp, Mus musculus
atccctagcaccttgaaagactgga

SEQ ID NO: 243691 - DNA, 25 bp, Mus musculus
atccctagcagcaagctcaatgctt

SEQ ID NO: 243692 - DNA, 25 bp, Mus musculus
atccctagcagctagctcaatgctt

SEQ ID NO: 243693 - DNA, 25 bp, Mus musculus
atccctagccttcagaatagaattt

SEQ ID NO: 243694 - DNA, 25 bp, Mus musculus
atccctagccttgagaatagaattt

SEQ ID NO: 243695 - DNA, 25 bp, Mus musculus
atccctaggaaactggcaggcctct

SEQ ID NO: 243696 - DNA, 25 bp, Mus musculus
atccctaggaaagtggcaggcctct

SEQ ID NO: 243697 - DNA, 25 bp, Mus musculus
atccctaggcaaacctctggagcta

SEQ ID NO: 243698 - DNA, 25 bp, Mus musculus
atccctaggcaatcctctggagcta

SEQ ID NO: 243699 - DNA, 25 bp, Mus musculus
atccctagggtgcatgagatttgtg

SEQ ID NO: 243700 - DNA, 25 bp, Mus musculus
atccctagggtggatgagatttgtg

SEQ ID NO: 243701 - DNA, 25 bp, Mus musculus
atccctaggtcaagggagcgggcat

SEQ ID NO: 243702 - DNA, 25 bp, Mus musculus
atccctaggtcatgggagcgggcat

SEQ ID NO: 243703 - DNA, 25 bp, Mus musculus
atccctagtgggagttgacacatcc

SEQ ID NO: 243704 - DNA, 25 bp, Mus musculus
atccctagtgggtgttgacacatcc

SEQ ID NO: 243705 - DNA, 25 bp, Mus musculus
atccctatcataccccatcatgaag

SEQ ID NO: 243706 - DNA, 25 bp, Mus musculus
atccctatcatagcccatcatgaag

SEQ ID NO: 243707 - DNA, 25 bp, Mus musculus
atccctatctctctatatacttgtg

SEQ ID NO: 243708 - DNA, 25 bp, Mus musculus
atccctatctctgtatatacttgtg

SEQ ID NO: 243709 - DNA, 25 bp, Mus musculus
atccctatgaaaagtaccagtctgg

SEQ ID NO: 243710 - DNA, 25 bp, Mus musculus
atccctatgaaatgtaccagtctgg

SEQ ID NO: 243711 - DNA, 25 bp, Mus musculus
atccctatgaggctggctgaatcta

SEQ ID NO: 243712 - DNA, 25 bp, Mus musculus
atccctatgagggtggctgaatcta

SEQ ID NO: 243713 - DNA, 25 bp, Mus musculus
atccctatgatgctgtaaattgtaa

SEQ ID NO: 243714 - DNA, 25 bp, Mus musculus
atccctatgatggtgtaaattgtaa

SEQ ID NO: 243715 - DNA, 25 bp, Mus musculus
atccctattattaacattggtactc

SEQ ID NO: 243716 - DNA, 25 bp, Mus musculus
atccctattatttacattggtactc

SEQ ID NO: 243717 - DNA, 25 bp, Mus musculus
atccctattcctatgttttggcttg

SEQ ID NO: 243718 - DNA, 25 bp, Mus musculus
atccctattcctttgttttggcttg

SEQ ID NO: 243719 - DNA, 25 bp, Mus musculus
atccctattgagatttcgacagcat

SEQ ID NO: 243720 - DNA, 25 bp, Mus musculus
atccctattgagttttcgacagcat

SEQ ID NO: 243721 - DNA, 25 bp, Mus musculus
atccctattgctcaaggcttgccta

SEQ ID NO: 243722 - DNA, 25 bp, Mus musculus
atccctattgctgaaggcttgccta

SEQ ID NO: 243723 - DNA, 25 bp, Mus musculus
atccctattggaagtgatgcacaaa

SEQ ID NO: 243724 - DNA, 25 bp, Mus musculus
atccctattggatgtgatgcacaaa

SEQ ID NO: 243725 - DNA, 25 bp, Mus musculus
atccctcagactcgcaacaagtttg

SEQ ID NO: 243726 - DNA, 25 bp, Mus musculus
atccctcagactggcaacaagtttg

SEQ ID NO: 243727 - DNA, 25 bp, Mus musculus
atccctcagcttattatgttatcag

SEQ ID NO: 243728 - DNA, 25 bp, Mus musculus
atccctcagctttttatgttatcag

SEQ ID NO: 243729 - DNA, 25 bp, Mus musculus
atccctcaggagaattgcatcaatg

SEQ ID NO: 243730 - DNA, 25 bp, Mus musculus
atccctcaggagtattgcatcaatg

SEQ ID NO: 243731 - DNA, 25 bp, Mus musculus
atccctcagggaataaagtagagct

SEQ ID NO: 243732 - DNA, 25 bp, Mus musculus
atccctcagggattaaagtagagct

SEQ ID NO: 243733 - DNA, 25 bp, Mus musculus
atccctcagggcctttctcaagaag

SEQ ID NO: 243734 - DNA, 25 bp, Mus musculus
atccctcagggcgtttctcaagaag

SEQ ID NO: 243735 - DNA, 25 bp, Mus musculus
atccctcatgctatcatggagtggc

SEQ ID NO: 243736 - DNA, 25 bp, Mus musculus
atccctcatgctttcatggagtggc

SEQ ID NO: 243737 - DNA, 25 bp, Mus musculus
atccctcatgttattgcttctgtta

SEQ ID NO: 243738 - DNA, 25 bp, Mus musculus
atccctcatgtttttgcttctgtta

SEQ ID NO: 243739 - DNA, 25 bp, Mus musculus
atccctcattcaactctgagtggtt

SEQ ID NO: 243740 - DNA, 25 bp, Mus musculus
atccctcattcatctctgagtggtt

SEQ ID NO: 243741 - DNA, 25 bp, Mus musculus
atccctccacaaaaaaggctctggg

SEQ ID NO: 243742 - DNA, 25 bp, Mus musculus
atccctccacaataaaggctctggg

SEQ ID NO: 243743 - DNA, 25 bp, Mus musculus
atccctccagaaacagtgggctcta

SEQ ID NO: 243744 - DNA, 25 bp, Mus musculus
atccctccagaatcagtgggctcta

SEQ ID NO: 243745 - DNA, 25 bp, Mus musculus
atccctccagccaggctgtactaaa

SEQ ID NO: 243746 - DNA, 25 bp, Mus musculus
atccctccagcctggctgtactaaa

SEQ ID NO: 243747 - DNA, 25 bp, Mus musculus
atccctcccaacaggtggatgtgaa

SEQ ID NO: 243748 - DNA, 25 bp, Mus musculus
atccctcccaactggtggatgtgaa

SEQ ID NO: 243749 - DNA, 25 bp, Mus musculus
atccctccgaagagcctgtgaacga

SEQ ID NO: 243750 - DNA, 25 bp, Mus musculus
atccctccgaagtgcctgtgaacga

SEQ ID NO: 243751 - DNA, 25 bp, Mus musculus
atccctccgagaaatggtggaactg

SEQ ID NO: 243752 - DNA, 25 bp, Mus musculus
atccctccgagatatggtggaactg

SEQ ID NO: 243753 - DNA, 25 bp, Mus musculus
atccctccggagataagagtacttg

SEQ ID NO: 243754 - DNA, 25 bp, Mus musculus
atccctccggagttaagagtacttg

SEQ ID NO: 243755 - DNA, 25 bp, Mus musculus
atccctccggtaatctctgcagatt

SEQ ID NO: 243756 - DNA, 25 bp, Mus musculus
atccctccggtattctctgcagatt

SEQ ID NO: 243757 - DNA, 25 bp, Mus musculus
atccctccgtagagcaagcagtcag

SEQ ID NO: 243758 - DNA, 25 bp, Mus musculus
atccctccgtagtgcaagcagtcag

SEQ ID NO: 243759 - DNA, 25 bp, Mus musculus
atccctcctggtaggttttggctag

SEQ ID NO: 243760 - DNA, 25 bp, Mus musculus
atccctcctggtattctgtgagatg

SEQ ID NO: 243761 - DNA, 25 bp, Mus musculus
atccctcctggttggttttggctag

SEQ ID NO: 243762 - DNA, 25 bp, Mus musculus
atccctcctggttttctgtgagatg

SEQ ID NO: 243763 - DNA, 25 bp, Mus musculus
atccctcctgttacatagccaaata

SEQ ID NO: 243764 - DNA, 25 bp, Mus musculus
atccctcctgtttcatagccaaata

SEQ ID NO: 243765 - DNA, 25 bp, Mus musculus
atccctcgagtcctttcaaatagtg

SEQ ID NO: 243766 - DNA, 25 bp, Mus musculus
atccctcgagtcgtttcaaatagtg

SEQ ID NO: 243767 - DNA, 25 bp, Mus musculus
atccctcggattaggctgtgcagga

SEQ ID NO: 243768 - DNA, 25 bp, Mus musculus
atccctcggatttggctgtgcagga

SEQ ID NO: 243769 - DNA, 25 bp, Mus musculus
atccctcggtgaagcgcagcaagca

SEQ ID NO: 243770 - DNA, 25 bp, Mus musculus
atccctcggtgatgcgcagcaagca

SEQ ID NO: 243771 - DNA, 25 bp, Mus musculus
atccctcgtccaaacatcagaatct

SEQ ID NO: 243772 - DNA, 25 bp, Mus musculus
atccctcgtccatacatcagaatct

SEQ ID NO: 243773 - DNA, 25 bp, Mus musculus
atccctcgtttccagacagctgtgg

SEQ ID NO: 243774 - DNA, 25 bp, Mus musculus
atccctcgtttcgagacagctgtgg

SEQ ID NO: 243775 - DNA, 25 bp, Mus musculus
atccctctaacgaactatgtctttt

SEQ ID NO: 243776 - DNA, 25 bp, Mus musculus
atccctctaacgtactatgtctttt

SEQ ID NO: 243777 - DNA, 25 bp, Mus musculus
atccctctacgtcggaaaaccagag

SEQ ID NO: 243778 - DNA, 25 bp, Mus musculus
atccctctacgtgggaaaaccagag

SEQ ID NO: 243779 - DNA, 25 bp, Mus musculus
atccctctagccctggtgtatatgt

SEQ ID NO: 243780 - DNA, 25 bp, Mus musculus
atccctctagccgtggtgtatatgt

SEQ ID NO: 243781 - DNA, 25 bp, Mus musculus
atccctctatgtcccagtagccaag

SEQ ID NO: 243782 - DNA, 25 bp, Mus musculus
atccctctatgtgccagtagccaag

SEQ ID NO: 243783 - DNA, 25 bp, Mus musculus
atccctctcaccctagaaatgcttg

SEQ ID NO: 243784 - DNA, 25 bp, Mus musculus
atccctctcaccgtagaaatgcttg

SEQ ID NO: 243785 - DNA, 25 bp, Mus musculus
atccctctcataaaggtagaaacca

SEQ ID NO: 243786 - DNA, 25 bp, Mus musculus
atccctctcatactacggacatatg

SEQ ID NO: 243787 - DNA, 25 bp, Mus musculus
atccctctcatagtacggacatatg

SEQ ID NO: 243788 - DNA, 25 bp, Mus musculus
atccctctcatataggtagaaacca

SEQ ID NO: 243789 - DNA, 25 bp, Mus musculus
atccctctcccgagtagagtgtaga

SEQ ID NO: 243790 - DNA, 25 bp, Mus musculus
atccctctcccgtgtagagtgtaga

SEQ ID NO: 243791 - DNA, 25 bp, Mus musculus
atccctctgatgattcctgtgacag

SEQ ID NO: 243792 - DNA, 25 bp, Mus musculus
atccctctgatgtttcctgtgacag

SEQ ID NO: 243793 - DNA, 25 bp, Mus musculus
atccctctgcccctatgtactgggt

SEQ ID NO: 243794 - DNA, 25 bp, Mus musculus
atccctctgcccgtatgtactgggt

SEQ ID NO: 243795 - DNA, 25 bp, Mus musculus
atccctctggagcagcttaaaacct

SEQ ID NO: 243796 - DNA, 25 bp, Mus musculus
atccctctggaggagcttaaaacct

SEQ ID NO: 243797 - DNA, 25 bp, Mus musculus
atccctctggatattcgagttgccc

SEQ ID NO: 243798 - DNA, 25 bp, Mus musculus
atccctctggattttcgagttgccc

SEQ ID NO: 243799 - DNA, 25 bp, Mus musculus
atccctctggccatagggatggcat

SEQ ID NO: 243800 - DNA, 25 bp, Mus musculus
atccctctggccttagggatggcat

SEQ ID NO: 243801 - DNA, 25 bp, Mus musculus
atccctctggtaatgatttcacagt

SEQ ID NO: 243802 - DNA, 25 bp, Mus musculus
atccctctggtattgatttcacagt

SEQ ID NO: 243803 - DNA, 25 bp, Mus musculus
atccctctgtgccacatcaacgaaa

SEQ ID NO: 243804 - DNA, 25 bp, Mus musculus
atccctctgtgcgacatcaacgaaa

SEQ ID NO: 243805 - DNA, 25 bp, Mus musculus
atccctctgtttagccattgctgga

SEQ ID NO: 243806 - DNA, 25 bp, Mus musculus
atccctctgttttgccattgctgga

SEQ ID NO: 243807 - DNA, 25 bp, Mus musculus
atccctcttccacatcgctttagaa

SEQ ID NO: 243808 - DNA, 25 bp, Mus musculus
atccctcttccagatcgctttagaa

SEQ ID NO: 243809 - DNA, 25 bp, Mus musculus
atccctctttccatttggagtcttt

SEQ ID NO: 243810 - DNA, 25 bp, Mus musculus
atccctctttccttttggagtcttt

SEQ ID NO: 243811 - DNA, 25 bp, Mus musculus
atccctcttttcaggtcacgtagca

SEQ ID NO: 243812 - DNA, 25 bp, Mus musculus
atccctcttttctggtcacgtagca

SEQ ID NO: 243813 - DNA, 25 bp, Mus musculus
atccctgaagcaaccccaaggacaa

SEQ ID NO: 243814 - DNA, 25 bp, Mus musculus
atccctgaagcatccccaaggacaa

SEQ ID NO: 243815 - DNA, 25 bp, Mus musculus
atccctgaagccacctgggcgatga

SEQ ID NO: 243816 - DNA, 25 bp, Mus musculus
atccctgaagcctcctgggcgatga

SEQ ID NO: 243817 - DNA, 25 bp, Mus musculus
atccctgaaggtatctgttttgtaa

SEQ ID NO: 243818 - DNA, 25 bp, Mus musculus
atccctgaaggtttctgttttgtaa

SEQ ID NO: 243819 - DNA, 25 bp, Mus musculus
atccctgacaccattaaactactga

SEQ ID NO: 243820 - DNA, 25 bp, Mus musculus
atccctgacacctttaaactactga

SEQ ID NO: 243821 - DNA, 25 bp, Mus musculus
atccctgacagtcctctgtagtgac

SEQ ID NO: 243822 - DNA, 25 bp, Mus musculus
atccctgacagtgctctgtagtgac

SEQ ID NO: 243823 - DNA, 25 bp, Mus musculus
atccctgaccccaggaatgacagat

SEQ ID NO: 243824 - DNA, 25 bp, Mus musculus
atccctgacccctggaatgacagat

SEQ ID NO: 243825 - DNA, 25 bp, Mus musculus
atccctgagctacgatccagaataa

SEQ ID NO: 243826 - DNA, 25 bp, Mus musculus
atccctgagctaggatccagaataa

SEQ ID NO: 243827 - DNA, 25 bp, Mus musculus
atccctgaggtacgttagatggccc

SEQ ID NO: 243828 - DNA, 25 bp, Mus musculus
atccctgaggtaggttagatggccc

SEQ ID NO: 243829 - DNA, 25 bp, Mus musculus
atccctgagtgcctttggtctctgg

SEQ ID NO: 243830 - DNA, 25 bp, Mus musculus
atccctgagtgcgtttggtctctgg

SEQ ID NO: 243831 - DNA, 25 bp, Mus musculus
atccctgagtgtccaacatcttggg

SEQ ID NO: 243832 - DNA, 25 bp, Mus musculus
atccctgagtgtgcaacatcttggg

SEQ ID NO: 243833 - DNA, 25 bp, Mus musculus
atccctgatgatcaaaaagttataa

SEQ ID NO: 243834 - DNA, 25 bp, Mus musculus
atccctgatgatcgtgttggccgac

SEQ ID NO: 243835 - DNA, 25 bp, Mus musculus
atccctgatgatgaaaaagttataa

SEQ ID NO: 243836 - DNA, 25 bp, Mus musculus
atccctgatgatggtgttggccgac

SEQ ID NO: 243837 - DNA, 25 bp, Mus musculus
atccctgatgcgatgctcggcactt

SEQ ID NO: 243838 - DNA, 25 bp, Mus musculus
atccctgatgcgttgctcggcactt

SEQ ID NO: 243839 - DNA, 25 bp, Mus musculus
atccctgattttagcttaccactgg

SEQ ID NO: 243840 - DNA, 25 bp, Mus musculus
atccctgatttttgcttaccactgg

SEQ ID NO: 243841 - DNA, 25 bp, Mus musculus
atccctgcaacacctggtcagatta

SEQ ID NO: 243842 - DNA, 25 bp, Mus musculus
atccctgcaacagctggtcagatta

SEQ ID NO: 243843 - DNA, 25 bp, Mus musculus
atccctgcaagtatcatacctgtag

SEQ ID NO: 243844 - DNA, 25 bp, Mus musculus
atccctgcaagtttcatacctgtag

SEQ ID NO: 243845 - DNA, 25 bp, Mus musculus
atccctgcacaactttgcctacaat

SEQ ID NO: 243846 - DNA, 25 bp, Mus musculus
atccctgcacaagtttgcctacaat

SEQ ID NO: 243847 - DNA, 25 bp, Mus musculus
atccctgcagagagcctccagtgaa

SEQ ID NO: 243848 - DNA, 25 bp, Mus musculus
atccctgcagagtgcctccagtgaa

SEQ ID NO: 243849 - DNA, 25 bp, Mus musculus
atccctgcaggcaactactgtgttt

SEQ ID NO: 243850 - DNA, 25 bp, Mus musculus
atccctgcaggctactactgtgttt

SEQ ID NO: 243851 - DNA, 25 bp, Mus musculus
atccctgcaggtcgcggaccgaata

SEQ ID NO: 243852 - DNA, 25 bp, Mus musculus
atccctgcaggtggcggaccgaata

SEQ ID NO: 243853 - DNA, 25 bp, Mus musculus
atccctgcagttatagacactcaca

SEQ ID NO: 243854 - DNA, 25 bp, Mus musculus
atccctgcagttttagacactcaca

SEQ ID NO: 243855 - DNA, 25 bp, Mus musculus
atccctgccaagaagtagctatgaa

SEQ ID NO: 243856 - DNA, 25 bp, Mus musculus
atccctgccaagatgcaagctaggt

SEQ ID NO: 243857 - DNA, 25 bp, Mus musculus
atccctgccaagtagtagctatgaa

SEQ ID NO: 243858 - DNA, 25 bp, Mus musculus
atccctgccaagttgcaagctaggt

SEQ ID NO: 243859 - DNA, 25 bp, Mus musculus
atccctgccatccattaactgtggg

SEQ ID NO: 243860 - DNA, 25 bp, Mus musculus
atccctgccatcgattaactgtggg

SEQ ID NO: 243861 - DNA, 25 bp, Mus musculus
atccctgccccaatcaataaataaa

SEQ ID NO: 243862 - DNA, 25 bp, Mus musculus
atccctgccccattcaataaataaa

SEQ ID NO: 243863 - DNA, 25 bp, Mus musculus
atccctgcccttacattgcttgatg

SEQ ID NO: 243864 - DNA, 25 bp, Mus musculus
atccctgccctttcattgcttgatg

SEQ ID NO: 243865 - DNA, 25 bp, Mus musculus
atccctgccggacgaaggtccagag

SEQ ID NO: 243866 - DNA, 25 bp, Mus musculus
atccctgccggaggaaggtccagag

SEQ ID NO: 243867 - DNA, 25 bp, Mus musculus
atccctgcgaatatttaatcccctg

SEQ ID NO: 243868 - DNA, 25 bp, Mus musculus
atccctgcgaatttttaatcccctg

SEQ ID NO: 243869 - DNA, 25 bp, Mus musculus
atccctgctagcagtgaactaataa

SEQ ID NO: 243870 - DNA, 25 bp, Mus musculus
atccctgctagctgtgaactaataa

SEQ ID NO: 243871 - DNA, 25 bp, Mus musculus
atccctgctgacattatcttcattg

SEQ ID NO: 243872 - DNA, 25 bp, Mus musculus
atccctgctgactttatcttcattg

SEQ ID NO: 243873 - DNA, 25 bp, Mus musculus
atccctgctgtgaataaccaatctc

SEQ ID NO: 243874 - DNA, 25 bp, Mus musculus
atccctgctgtgtataaccaatctc

SEQ ID NO: 243875 - DNA, 25 bp, Mus musculus
atccctgcttttaccaaaggctgag

SEQ ID NO: 243876 - DNA, 25 bp, Mus musculus
atccctgctttttccaaaggctgag

SEQ ID NO: 243877 - DNA, 25 bp, Mus musculus
atccctggaattctggtctctttga

SEQ ID NO: 243878 - DNA, 25 bp, Mus musculus
atccctggaattgtggtctctttga

SEQ ID NO: 243879 - DNA, 25 bp, Mus musculus
atccctggatctccaccaaagagta

SEQ ID NO: 243880 - DNA, 25 bp, Mus musculus
atccctggatctgcaccaaagagta

SEQ ID NO: 243881 - DNA, 25 bp, Mus musculus
atccctggcagcagttagatggcgc

SEQ ID NO: 243882 - DNA, 25 bp, Mus musculus
atccctggcagctgttagatggcgc

SEQ ID NO: 243883 - DNA, 25 bp, Mus musculus
atccctggcaggattggacactgtc

SEQ ID NO: 243884 - DNA, 25 bp, Mus musculus
atccctggcaggtttggacactgtc

SEQ ID NO: 243885 - DNA, 25 bp, Mus musculus
atccctggcatcaagagacactgtg

SEQ ID NO: 243886 - DNA, 25 bp, Mus musculus
atccctggcatcactcctgagaaag

SEQ ID NO: 243887 - DNA, 25 bp, Mus musculus
atccctggcatctagagacactgtg

SEQ ID NO: 243888 - DNA, 25 bp, Mus musculus
atccctggcatctctcctgagaaag

SEQ ID NO: 243889 - DNA, 25 bp, Mus musculus
atccctggccaacataaggctcagc

SEQ ID NO: 243890 - DNA, 25 bp, Mus musculus
atccctggccaagataaggctcagc

SEQ ID NO: 243891 - DNA, 25 bp, Mus musculus
atccctggctgaacctggtatggta

SEQ ID NO: 243892 - DNA, 25 bp, Mus musculus
atccctggctgatcctggtatggta

SEQ ID NO: 243893 - DNA, 25 bp, Mus musculus
atccctggcttaactgatgttcagt

SEQ ID NO: 243894 - DNA, 25 bp, Mus musculus
atccctggcttatctgatgttcagt

SEQ ID NO: 243895 - DNA, 25 bp, Mus musculus
atccctgggatcaaactctagctgt

SEQ ID NO: 243896 - DNA, 25 bp, Mus musculus
atccctgggatctaactctagctgt

SEQ ID NO: 243897 - DNA, 25 bp, Mus musculus
atccctgggcctaatcctggacatg

SEQ ID NO: 243898 - DNA, 25 bp, Mus musculus
atccctgggcctacacaaaggagac

SEQ ID NO: 243899 - DNA, 25 bp, Mus musculus
atccctgggccttatcctggacatg

SEQ ID NO: 243900 - DNA, 25 bp, Mus musculus
atccctgggccttcacaaaggagac

SEQ ID NO: 243901 - DNA, 25 bp, Mus musculus
atccctgggtccatcatggcgggag

SEQ ID NO: 243902 - DNA, 25 bp, Mus musculus
atccctgggtccttcatggcgggag

SEQ ID NO: 243903 - DNA, 25 bp, Mus musculus
atccctggtcatatggatggtctga

SEQ ID NO: 243904 - DNA, 25 bp, Mus musculus
atccctggtcatttggatggtctga

SEQ ID NO: 243905 - DNA, 25 bp, Mus musculus
atccctggtgtgattcagtggaaca

SEQ ID NO: 243906 - DNA, 25 bp, Mus musculus
atccctggtgtgtttcagtggaaca

SEQ ID NO: 243907 - DNA, 25 bp, Mus musculus
atccctgtagatagactgccataac

SEQ ID NO: 243908 - DNA, 25 bp, Mus musculus
atccctgtagattgactgccataac

SEQ ID NO: 243909 - DNA, 25 bp, Mus musculus
atccctgtagcccagttattactaa

SEQ ID NO: 243910 - DNA, 25 bp, Mus musculus
atccctgtagccgagttattactaa

SEQ ID NO: 243911 - DNA, 25 bp, Mus musculus
atccctgtatcccaacgacgataaa

SEQ ID NO: 243912 - DNA, 25 bp, Mus musculus
atccctgtatccgaacgacgataaa

SEQ ID NO: 243913 - DNA, 25 bp, Mus musculus
atccctgtatggctcaggcatgtga

SEQ ID NO: 243914 - DNA, 25 bp, Mus musculus
atccctgtatgggtcaggcatgtga

SEQ ID NO: 243915 - DNA, 25 bp, Mus musculus
atccctgtcatcacttggtattgtc

SEQ ID NO: 243916 - DNA, 25 bp, Mus musculus
atccctgtcatctcttggtattgtc

SEQ ID NO: 243917 - DNA, 25 bp, Mus musculus
atccctgtcccaccatgtgactgtt

SEQ ID NO: 243918 - DNA, 25 bp, Mus musculus
atccctgtcccagcatgtgactgtt

SEQ ID NO: 243919 - DNA, 25 bp, Mus musculus
atccctgtctctcgcagatggaggt

SEQ ID NO: 243920 - DNA, 25 bp, Mus musculus
atccctgtctctggcagatggaggt

SEQ ID NO: 243921 - DNA, 25 bp, Mus musculus
atccctgtgcagcatcaagaagccc

SEQ ID NO: 243922 - DNA, 25 bp, Mus musculus
atccctgtgcaggatcaagaagccc

SEQ ID NO: 243923 - DNA, 25 bp, Mus musculus
atccctgtgctcaggacggtgagac

SEQ ID NO: 243924 - DNA, 25 bp, Mus musculus
atccctgtgctctggacggtgagac

SEQ ID NO: 243925 - DNA, 25 bp, Mus musculus
atccctgtgcttaagagcctgtgct

SEQ ID NO: 243926 - DNA, 25 bp, Mus musculus
atccctgtgctttagagcctgtgct

SEQ ID NO: 243927 - DNA, 25 bp, Mus musculus
atccctgtggaaatgacttggtggc

SEQ ID NO: 243928 - DNA, 25 bp, Mus musculus
atccctgtggaacccgattttcctg

SEQ ID NO: 243929 - DNA, 25 bp, Mus musculus
atccctgtggaagccgattttcctg

SEQ ID NO: 243930 - DNA, 25 bp, Mus musculus
atccctgtggaattgacttggtggc

SEQ ID NO: 243931 - DNA, 25 bp, Mus musculus
atccctgtggctattcaagtagtct

SEQ ID NO: 243932 - DNA, 25 bp, Mus musculus
atccctgtggcttttcaagtagtct

SEQ ID NO: 243933 - DNA, 25 bp, Mus musculus
atccctgtggttaagtgagtcccta

SEQ ID NO: 243934 - DNA, 25 bp, Mus musculus
atccctgtggtttagtgagtcccta

SEQ ID NO: 243935 - DNA, 25 bp, Mus musculus
atccctgtgtcccaaggagatgctc

SEQ ID NO: 243936 - DNA, 25 bp, Mus musculus
atccctgtgtccgaaggagatgctc

SEQ ID NO: 243937 - DNA, 25 bp, Mus musculus
atccctgtgtggaatatgcctgcca

SEQ ID NO: 243938 - DNA, 25 bp, Mus musculus
atccctgtgtggtatatgcctgcca

SEQ ID NO: 243939 - DNA, 25 bp, Mus musculus
atccctgtgtgtccttagccactac

SEQ ID NO: 243940 - DNA, 25 bp, Mus musculus
atccctgtgtgtgcttagccactac

SEQ ID NO: 243941 - DNA, 25 bp, Mus musculus
atccctgtgttgatagctcctgctt

SEQ ID NO: 243942 - DNA, 25 bp, Mus musculus
atccctgtgttgttagctcctgctt

SEQ ID NO: 243943 - DNA, 25 bp, Mus musculus
atccctgttataaaacacttcttca

SEQ ID NO: 243944 - DNA, 25 bp, Mus musculus
atccctgttatataacacttcttca

SEQ ID NO: 243945 - DNA, 25 bp, Mus musculus
atccctgttcctctagacgtataga

SEQ ID NO: 243946 - DNA, 25 bp, Mus musculus
atccctgttcctgtagacgtataga

SEQ ID NO: 243947 - DNA, 25 bp, Mus musculus
atccctgttcttatccactgtaaaa

SEQ ID NO: 243948 - DNA, 25 bp, Mus musculus
atccctgttcttttccactgtaaaa

SEQ ID NO: 243949 - DNA, 25 bp, Mus musculus
atccctgttgacctggcaggcgcag

SEQ ID NO: 243950 - DNA, 25 bp, Mus musculus
atccctgttgacgtggcaggcgcag

SEQ ID NO: 243951 - DNA, 25 bp, Mus musculus
atccctgttgtgacctttaggtcat

SEQ ID NO: 243952 - DNA, 25 bp, Mus musculus
atccctgttgtgtcctttaggtcat

SEQ ID NO: 243953 - DNA, 25 bp, Mus musculus
atccctgttttgcagcgctgctaga

SEQ ID NO: 243954 - DNA, 25 bp, Mus musculus
atccctgttttggagcgctgctaga

SEQ ID NO: 243955 - DNA, 25 bp, Mus musculus
atcccttaagaacagatttgcctgt

SEQ ID NO: 243956 - DNA, 25 bp, Mus musculus
atcccttaagaagagatttgcctgt

SEQ ID NO: 243957 - DNA, 25 bp, Mus musculus
atcccttacagaagtgtcagtccct

SEQ ID NO: 243958 - DNA, 25 bp, Mus musculus
atcccttacagatgtgtcagtccct

SEQ ID NO: 243959 - DNA, 25 bp, Mus musculus
atcccttactagcactaagctcagg

SEQ ID NO: 243960 - DNA, 25 bp, Mus musculus
atcccttactaggactaagctcagg

SEQ ID NO: 243961 - DNA, 25 bp, Mus musculus
atcccttagcctaccagaggtgctt

SEQ ID NO: 243962 - DNA, 25 bp, Mus musculus
atcccttagccttccagaggtgctt

SEQ ID NO: 243963 - DNA, 25 bp, Mus musculus
atcccttaggtgaaggtcctgttca

SEQ ID NO: 243964 - DNA, 25 bp, Mus musculus
atcccttaggtgtaggtcctgttca

SEQ ID NO: 243965 - DNA, 25 bp, Mus musculus
atcccttattccctgagatctcagg

SEQ ID NO: 243966 - DNA, 25 bp, Mus musculus
atcccttattccgtgagatctcagg

SEQ ID NO: 243967 - DNA, 25 bp, Mus musculus
atcccttcacgtccctgagagagac

SEQ ID NO: 243968 - DNA, 25 bp, Mus musculus
atcccttcacgtgcctgagagagac

SEQ ID NO: 243969 - DNA, 25 bp, Mus musculus
atcccttcactgaggcttctgacag

SEQ ID NO: 243970 - DNA, 25 bp, Mus musculus
atcccttcactgtggcttctgacag

SEQ ID NO: 243971 - DNA, 25 bp, Mus musculus
atcccttcagatagagctcatggtg

SEQ ID NO: 243972 - DNA, 25 bp, Mus musculus
atcccttcagattgagctcatggtg

SEQ ID NO: 243973 - DNA, 25 bp, Mus musculus
atcccttcaggaatacaggagttga

SEQ ID NO: 243974 - DNA, 25 bp, Mus musculus
atcccttcaggattacaggagttga

SEQ ID NO: 243975 - DNA, 25 bp, Mus musculus
atcccttcagtacaatggaccagaa

SEQ ID NO: 243976 - DNA, 25 bp, Mus musculus
atcccttcagtagaatggaccagaa

SEQ ID NO: 243977 - DNA, 25 bp, Mus musculus
atcccttcataaagatttccagctt

SEQ ID NO: 243978 - DNA, 25 bp, Mus musculus
atcccttcataaatctttgctccaa

SEQ ID NO: 243979 - DNA, 25 bp, Mus musculus
atcccttcataatgatttccagctt

SEQ ID NO: 243980 - DNA, 25 bp, Mus musculus
atcccttcataattctttgctccaa

SEQ ID NO: 243981 - DNA, 25 bp, Mus musculus
atcccttcatatatgccttaaacca

SEQ ID NO: 243982 - DNA, 25 bp, Mus musculus
atcccttcatatttgccttaaacca

SEQ ID NO: 243983 - DNA, 25 bp, Mus musculus
atcccttcatgcattttaatctctc

SEQ ID NO: 243984 - DNA, 25 bp, Mus musculus
atcccttcatgctttttaatctctc

SEQ ID NO: 243985 - DNA, 25 bp, Mus musculus
atcccttccaggatgtgacaccagg

SEQ ID NO: 243986 - DNA, 25 bp, Mus musculus
atcccttccaggttgtgacaccagg

SEQ ID NO: 243987 - DNA, 25 bp, Mus musculus
atcccttccccacctaggaagagag

SEQ ID NO: 243988 - DNA, 25 bp, Mus musculus
atcccttccccagctaggaagagag

SEQ ID NO: 243989 - DNA, 25 bp, Mus musculus
atcccttcccgtacaggtgcttcgg

SEQ ID NO: 243990 - DNA, 25 bp, Mus musculus
atcccttcccgttcaggtgcttcgg

SEQ ID NO: 243991 - DNA, 25 bp, Mus musculus
atcccttcctgtattcagatataac

SEQ ID NO: 243992 - DNA, 25 bp, Mus musculus
atcccttcctgttttcagatataac

SEQ ID NO: 243993 - DNA, 25 bp, Mus musculus
atcccttcgagtacgactatgaaac

SEQ ID NO: 243994 - DNA, 25 bp, Mus musculus
atcccttcgagttcgactatgaaac

SEQ ID NO: 243995 - DNA, 25 bp, Mus musculus
atcccttcggtgcaccatgaggagc

SEQ ID NO: 243996 - DNA, 25 bp, Mus musculus
atcccttcggtggaccatgaggagc

SEQ ID NO: 243997 - DNA, 25 bp, Mus musculus
atcccttctccactggcaggacgtt

SEQ ID NO: 243998 - DNA, 25 bp, Mus musculus
atcccttctccagtggcaggacgtt

SEQ ID NO: 243999 - DNA, 25 bp, Mus musculus
atcccttgaatgagcattctcaccg

SEQ ID NO: 244000 - DNA, 25 bp, Mus musculus
atcccttgaatgtgcattctcaccg

SEQ ID NO: 244001 - DNA, 25 bp, Mus musculus
atcccttgaattctacctttgagct

SEQ ID NO: 244002 - DNA, 25 bp, Mus musculus
atcccttgaattgtacctttgagct

SEQ ID NO: 244003 - DNA, 25 bp, Mus musculus
atcccttgatgaaaaatctgagttc

SEQ ID NO: 244004 - DNA, 25 bp, Mus musculus
atcccttgatgataaatctgagttc

SEQ ID NO: 244005 - DNA, 25 bp, Mus musculus
atcccttgatttccaggctttcttt

SEQ ID NO: 244006 - DNA, 25 bp, Mus musculus
atcccttgatttgcaggctttcttt

SEQ ID NO: 244007 - DNA, 25 bp, Mus musculus
atcccttgcataccgtgcacagatg

SEQ ID NO: 244008 - DNA, 25 bp, Mus musculus
atcccttgcatagcgtgcacagatg

SEQ ID NO: 244009 - DNA, 25 bp, Mus musculus
atcccttgcattacgggcaacttta

SEQ ID NO: 244010 - DNA, 25 bp, Mus musculus
atcccttgcatttcgggcaacttta

SEQ ID NO: 244011 - DNA, 25 bp, Mus musculus
atcccttgcccaaatgttgttgtga

SEQ ID NO: 244012 - DNA, 25 bp, Mus musculus
atcccttgcccatatgttgttgtga

SEQ ID NO: 244013 - DNA, 25 bp, Mus musculus
atcccttgcctcctgagttacggga

SEQ ID NO: 244014 - DNA, 25 bp, Mus musculus
atcccttgcctcgtgagttacggga

SEQ ID NO: 244015 - DNA, 25 bp, Mus musculus
atcccttgctggagaggttctgagc

SEQ ID NO: 244016 - DNA, 25 bp, Mus musculus
atcccttgctggtgaggttctgagc

SEQ ID NO: 244017 - DNA, 25 bp, Mus musculus
atcccttgcttgactggtggtagga

SEQ ID NO: 244018 - DNA, 25 bp, Mus musculus
atcccttgcttgtctggtggtagga

SEQ ID NO: 244019 - DNA, 25 bp, Mus musculus
atcccttggcagctagcctgagttg

SEQ ID NO: 244020 - DNA, 25 bp, Mus musculus
atcccttggcaggtagcctgagttg

SEQ ID NO: 244021 - DNA, 25 bp, Mus musculus
atcccttggttgagactaatctttt

SEQ ID NO: 244022 - DNA, 25 bp, Mus musculus
atcccttggttgcactgcttagttt

SEQ ID NO: 244023 - DNA, 25 bp, Mus musculus
atcccttggttggactgcttagttt

SEQ ID NO: 244024 - DNA, 25 bp, Mus musculus
atcccttggttgtgactaatctttt

SEQ ID NO: 244025 - DNA, 25 bp, Mus musculus
atcccttgtacgagttaccttgaca

SEQ ID NO: 244026 - DNA, 25 bp, Mus musculus
atcccttgtacgtgttaccttgaca

SEQ ID NO: 244027 - DNA, 25 bp, Mus musculus
atcccttgtagccagagttcaggcg

SEQ ID NO: 244028 - DNA, 25 bp, Mus musculus
atcccttgtagcgagagttcaggcg

SEQ ID NO: 244029 - DNA, 25 bp, Mus musculus
atccctttaaaaaatccaatctctt

SEQ ID NO: 244030 - DNA, 25 bp, Mus musculus
atccctttaaaatatccaatctctt

SEQ ID NO: 244031 - DNA, 25 bp, Mus musculus
atccctttaagtatgggcatttaat

SEQ ID NO: 244032 - DNA, 25 bp, Mus musculus
atccctttaagtttgggcatttaat

SEQ ID NO: 244033 - DNA, 25 bp, Mus musculus
atccctttacttcatccatttctca

SEQ ID NO: 244034 - DNA, 25 bp, Mus musculus
atccctttacttgatccatttctca

SEQ ID NO: 244035 - DNA, 25 bp, Mus musculus
atccctttatgaaccttgtgattga

SEQ ID NO: 244036 - DNA, 25 bp, Mus musculus
atccctttatgatccttgtgattga

SEQ ID NO: 244037 - DNA, 25 bp, Mus musculus
atccctttcaagatccgtgttagat

SEQ ID NO: 244038 - DNA, 25 bp, Mus musculus
atccctttcaagctatgcaaattat

SEQ ID NO: 244039 - DNA, 25 bp, Mus musculus
atccctttcaaggtatgcaaattat

SEQ ID NO: 244040 - DNA, 25 bp, Mus musculus
atccctttcaagttccgtgttagat

SEQ ID NO: 244041 - DNA, 25 bp, Mus musculus
atccctttcacgcacaagttctgtg

SEQ ID NO: 244042 - DNA, 25 bp, Mus musculus
atccctttcacggacaagttctgtg

SEQ ID NO: 244043 - DNA, 25 bp, Mus musculus
atccctttcccaccatgagattgtt

SEQ ID NO: 244044 - DNA, 25 bp, Mus musculus
atccctttcccagcatgagattgtt

SEQ ID NO: 244045 - DNA, 25 bp, Mus musculus
atccctttctctatcactgagagca

SEQ ID NO: 244046 - DNA, 25 bp, Mus musculus
atccctttctctttcactgagagca

SEQ ID NO: 244047 - DNA, 25 bp, Mus musculus
atccctttctgtacagataaatgac

SEQ ID NO: 244048 - DNA, 25 bp, Mus musculus
atccctttctgttcagataaatgac

SEQ ID NO: 244049 - DNA, 25 bp, Mus musculus
atccctttgattataccatgcttca

SEQ ID NO: 244050 - DNA, 25 bp, Mus musculus
atccctttgattatatggagaacat

SEQ ID NO: 244051 - DNA, 25 bp, Mus musculus
atccctttgattttaccatgcttca

SEQ ID NO: 244052 - DNA, 25 bp, Mus musculus
atccctttgattttatggagaacat

SEQ ID NO: 244053 - DNA, 25 bp, Mus musculus
atccctttggagcttgaataactct

SEQ ID NO: 244054 - DNA, 25 bp, Mus musculus
atccctttggaggttgaataactct

SEQ ID NO: 244055 - DNA, 25 bp, Mus musculus
atccctttgggaatataatatgctt

SEQ ID NO: 244056 - DNA, 25 bp, Mus musculus
atccctttgggacttcatgtatcag

SEQ ID NO: 244057 - DNA, 25 bp, Mus musculus
atccctttgggagttcatgtatcag

SEQ ID NO: 244058 - DNA, 25 bp, Mus musculus
atccctttgggattataatatgctt

SEQ ID NO: 244059 - DNA, 25 bp, Mus musculus
atccctttgggcctttgtagccagt

SEQ ID NO: 244060 - DNA, 25 bp, Mus musculus
atccctttgggcgtttgtagccagt

SEQ ID NO: 244061 - DNA, 25 bp, Mus musculus
atccctttgtatatacctcgtatat

SEQ ID NO: 244062 - DNA, 25 bp, Mus musculus
atccctttgtatttacctcgtatat

SEQ ID NO: 244063 - DNA, 25 bp, Mus musculus
atccctttgtccatgtgattagcgc

SEQ ID NO: 244064 - DNA, 25 bp, Mus musculus
atccctttgtccttgtgattagcgc

SEQ ID NO: 244065 - DNA, 25 bp, Mus musculus
atccctttgttccttgcattttcat

SEQ ID NO: 244066 - DNA, 25 bp, Mus musculus
atccctttgttcgttgcattttcat

SEQ ID NO: 244067 - DNA, 25 bp, Mus musculus
atcccttttaagacagtgcatcagc

SEQ ID NO: 244068 - DNA, 25 bp, Mus musculus
atcccttttaagtcagtgcatcagc

SEQ ID NO: 244069 - DNA, 25 bp, Mus musculus
atcccttttatcactatggcttcca

SEQ ID NO: 244070 - DNA, 25 bp, Mus musculus
atcccttttatctctatggcttcca

SEQ ID NO: 244071 - DNA, 25 bp, Mus musculus
atcccttttcaccacttggagcgac

SEQ ID NO: 244072 - DNA, 25 bp, Mus musculus
atcccttttcacgacttggagcgac

SEQ ID NO: 244073 - DNA, 25 bp, Mus musculus
atcccttttcctatcttttgagcat

SEQ ID NO: 244074 - DNA, 25 bp, Mus musculus
atcccttttcctttcttttgagcat

SEQ ID NO: 244075 - DNA, 25 bp, Mus musculus
atcccttttcttcggttgaccatgg

SEQ ID NO: 244076 - DNA, 25 bp, Mus musculus
atcccttttcttgggttgaccatgg

SEQ ID NO: 244077 - DNA, 25 bp, Mus musculus
atcccttttgaccagacaggttgga

SEQ ID NO: 244078 - DNA, 25 bp, Mus musculus
atcccttttgacgagacaggttgga

SEQ ID NO: 244079 - DNA, 25 bp, Mus musculus
atccgaaacgttcaggcgtcctctc

SEQ ID NO: 244080 - DNA, 25 bp, Mus musculus
atccgaaacgttgaggcgtcctctc

SEQ ID NO: 244081 - DNA, 25 bp, Mus musculus
atccgaaatcccaggagtggctgga

SEQ ID NO: 244082 - DNA, 25 bp, Mus musculus
atccgaaatccctggagtggctgga

SEQ ID NO: 244083 - DNA, 25 bp, Mus musculus
atccgaaccattaatccctggagcg

SEQ ID NO: 244084 - DNA, 25 bp, Mus musculus
atccgaaccatttatccctggagcg

SEQ ID NO: 244085 - DNA, 25 bp, Mus musculus
atccgaaccttacaatttcttgaca

SEQ ID NO: 244086 - DNA, 25 bp, Mus musculus
atccgaaccttagaatttcttgaca

SEQ ID NO: 244087 - DNA, 25 bp, Mus musculus
atccgaacgggccttgactcttagg

SEQ ID NO: 244088 - DNA, 25 bp, Mus musculus
atccgaacgggcgttgactcttagg

SEQ ID NO: 244089 - DNA, 25 bp, Mus musculus
atccgaactcggctctctcttaagg

SEQ ID NO: 244090 - DNA, 25 bp, Mus musculus
atccgaactcgggtctctcttaagg

SEQ ID NO: 244091 - DNA, 25 bp, Mus musculus
atccgaagggttaacttctcagaca

SEQ ID NO: 244092 - DNA, 25 bp, Mus musculus
atccgaagggtttacttctcagaca

SEQ ID NO: 244093 - DNA, 25 bp, Mus musculus
atccgaagtgcacccaatgtggtca

SEQ ID NO: 244094 - DNA, 25 bp, Mus musculus
atccgaagtgcagccaatgtggtca

SEQ ID NO: 244095 - DNA, 25 bp, Mus musculus
atccgaatctttcttaacataaggc

SEQ ID NO: 244096 - DNA, 25 bp, Mus musculus
atccgaatctttgttaacataaggc

SEQ ID NO: 244097 - DNA, 25 bp, Mus musculus
atccgaatggtcagtgaggctgcaa

SEQ ID NO: 244098 - DNA, 25 bp, Mus musculus
atccgaatggtctgtgaggctgcaa

SEQ ID NO: 244099 - DNA, 25 bp, Mus musculus
atccgaatgtaccaattggcgcaca

SEQ ID NO: 244100 - DNA, 25 bp, Mus musculus
atccgaatgtacgaattggcgcaca

SEQ ID NO: 244101 - DNA, 25 bp, Mus musculus
atccgacatatcaaactagctcagc

SEQ ID NO: 244102 - DNA, 25 bp, Mus musculus
atccgacatatctaactagctcagc

SEQ ID NO: 244103 - DNA, 25 bp, Mus musculus
atccgacatttcaggccagagcttg

SEQ ID NO: 244104 - DNA, 25 bp, Mus musculus
atccgacatttctggccagagcttg

SEQ ID NO: 244105 - DNA, 25 bp, Mus musculus
atccgaccagcaaaggaagagcgtt

SEQ ID NO: 244106 - DNA, 25 bp, Mus musculus
atccgaccagcataggaagagcgtt

SEQ ID NO: 244107 - DNA, 25 bp, Mus musculus
atccgacctatccaagctgttgttt

SEQ ID NO: 244108 - DNA, 25 bp, Mus musculus
atccgacctatcgaagctgttgttt

SEQ ID NO: 244109 - DNA, 25 bp, Mus musculus
atccgacctctaaggagttctctta

SEQ ID NO: 244110 - DNA, 25 bp, Mus musculus
atccgacctctatggagttctctta

SEQ ID NO: 244111 - DNA, 25 bp, Mus musculus
atccgacgacagctgtcatcctttt

SEQ ID NO: 244112 - DNA, 25 bp, Mus musculus
atccgacgacaggtgtcatcctttt

SEQ ID NO: 244113 - DNA, 25 bp, Mus musculus
atccgactaacacctgccttaatat

SEQ ID NO: 244114 - DNA, 25 bp, Mus musculus
atccgactaacagctgccttaatat

SEQ ID NO: 244115 - DNA, 25 bp, Mus musculus
atccgactccatatgatttagggct

SEQ ID NO: 244116 - DNA, 25 bp, Mus musculus
atccgactccatttgatttagggct

SEQ ID NO: 244117 - DNA, 25 bp, Mus musculus
atccgacttgagaaaaccaccctgt

SEQ ID NO: 244118 - DNA, 25 bp, Mus musculus
atccgacttgagtaaaccaccctgt

SEQ ID NO: 244119 - DNA, 25 bp, Mus musculus
atccgagaactgctgggccacaagg

SEQ ID NO: 244120 - DNA, 25 bp, Mus musculus
atccgagaactggtgggccacaagg

SEQ ID NO: 244121 - DNA, 25 bp, Mus musculus
atccgagagactaacctatactaag

SEQ ID NO: 244122 - DNA, 25 bp, Mus musculus
atccgagagacttacctatactaag

SEQ ID NO: 244123 - DNA, 25 bp, Mus musculus
atccgagaggcgattctcctacgaa

SEQ ID NO: 244124 - DNA, 25 bp, Mus musculus
atccgagaggcgtttctcctacgaa

SEQ ID NO: 244125 - DNA, 25 bp, Mus musculus
atccgagagtggaggtcagcacatt

SEQ ID NO: 244126 - DNA, 25 bp, Mus musculus
atccgagagtggtggtcagcacatt

SEQ ID NO: 244127 - DNA, 25 bp, Mus musculus
atccgagagttcattgctccagtca

SEQ ID NO: 244128 - DNA, 25 bp, Mus musculus
atccgagagttctttgctccagtca

SEQ ID NO: 244129 - DNA, 25 bp, Mus musculus
atccgagatgatctgctactagtaa

SEQ ID NO: 244130 - DNA, 25 bp, Mus musculus
atccgagatgatgtgctactagtaa

SEQ ID NO: 244131 - DNA, 25 bp, Mus musculus
atccgagcagcaacagcagcgaaag

SEQ ID NO: 244132 - DNA, 25 bp, Mus musculus
atccgagcagcatcagcagcgaaag

SEQ ID NO: 244133 - DNA, 25 bp, Mus musculus
atccgagcatctaaaggtgccccag

SEQ ID NO: 244134 - DNA, 25 bp, Mus musculus
atccgagcatcttaaggtgccccag

SEQ ID NO: 244135 - DNA, 25 bp, Mus musculus
atccgagccaccacgaaaagcgagg

SEQ ID NO: 244136 - DNA, 25 bp, Mus musculus
atccgagccacctcgaaaagcgagg

SEQ ID NO: 244137 - DNA, 25 bp, Mus musculus
atccgagcctggaagggaaagagcc

SEQ ID NO: 244138 - DNA, 25 bp, Mus musculus
atccgagcctggtagggaaagagcc

SEQ ID NO: 244139 - DNA, 25 bp, Mus musculus
atccgagctcctcagcatctacgtg

SEQ ID NO: 244140 - DNA, 25 bp, Mus musculus
atccgagctcctgagcatctacgtg

SEQ ID NO: 244141 - DNA, 25 bp, Mus musculus
atccgagctcggacagcagcgggat

SEQ ID NO: 244142 - DNA, 25 bp, Mus musculus
atccgagctcggtcagcagcgggat

SEQ ID NO: 244143 - DNA, 25 bp, Mus musculus
atccgagcttctctccaacagacag

SEQ ID NO: 244144 - DNA, 25 bp, Mus musculus
atccgagcttctgtccaacagacag

SEQ ID NO: 244145 - DNA, 25 bp, Mus musculus
atccgaggcttccagggcggactcc

SEQ ID NO: 244146 - DNA, 25 bp, Mus musculus
atccgaggcttcgagggcggactcc

SEQ ID NO: 244147 - DNA, 25 bp, Mus musculus
atccgagggtgcagagagctgccac

SEQ ID NO: 244148 - DNA, 25 bp, Mus musculus
atccgagggtgctgagagctgccac

SEQ ID NO: 244149 - DNA, 25 bp, Mus musculus
atccgaggtgacatggccaagcaga

SEQ ID NO: 244150 - DNA, 25 bp, Mus musculus
atccgaggtgacttggccaagcaga

SEQ ID NO: 244151 - DNA, 25 bp, Mus musculus
atccgaggtggcaagcagtttgtcc

SEQ ID NO: 244152 - DNA, 25 bp, Mus musculus
atccgaggtggctagcagtttgtcc

SEQ ID NO: 244153 - DNA, 25 bp, Mus musculus
atccgaggtgtcatttctagctgct

SEQ ID NO: 244154 - DNA, 25 bp, Mus musculus
atccgaggtgtcttttctagctgct

SEQ ID NO: 244155 - DNA, 25 bp, Mus musculus
atccgagtcctgacaaaaactcttg

SEQ ID NO: 244156 - DNA, 25 bp, Mus musculus
atccgagtcctgtcaaaaactcttg

SEQ ID NO: 244157 - DNA, 25 bp, Mus musculus
atccgagtcgtgatcgctgtggttc

SEQ ID NO: 244158 - DNA, 25 bp, Mus musculus
atccgagtcgtgttcgctgtggttc

SEQ ID NO: 244159 - DNA, 25 bp, Mus musculus
atccgagtgaaacccggagagactc

SEQ ID NO: 244160 - DNA, 25 bp, Mus musculus
atccgagtgaaagccggagagactc

SEQ ID NO: 244161 - DNA, 25 bp, Mus musculus
atccgagtgggcatcgtgatgtctg

SEQ ID NO: 244162 - DNA, 25 bp, Mus musculus
atccgagtgggcttcgtgatgtctg

SEQ ID NO: 244163 - DNA, 25 bp, Mus musculus
atccgagtgtttcgtgcgtgcacag

SEQ ID NO: 244164 - DNA, 25 bp, Mus musculus
atccgagtgtttggtgcgtgcacag

SEQ ID NO: 244165 - DNA, 25 bp, Mus musculus
atccgagttgacataaagggcccca

SEQ ID NO: 244166 - DNA, 25 bp, Mus musculus
atccgagttgacttaaagggcccca

SEQ ID NO: 244167 - DNA, 25 bp, Mus musculus
atccgagtttggagtgggcacccaa

SEQ ID NO: 244168 - DNA, 25 bp, Mus musculus
atccgagtttggtgtgggcacccaa

SEQ ID NO: 244169 - DNA, 25 bp, Mus musculus
atccgatacataagtggttctagct

SEQ ID NO: 244170 - DNA, 25 bp, Mus musculus
atccgatacatatgtggttctagct

SEQ ID NO: 244171 - DNA, 25 bp, Mus musculus
atccgatagggtcttggctttctac

SEQ ID NO: 244172 - DNA, 25 bp, Mus musculus
atccgatagggtgttggctttctac

SEQ ID NO: 244173 - DNA, 25 bp, Mus musculus
atccgatgacgcaaggaccttgagt

SEQ ID NO: 244174 - DNA, 25 bp, Mus musculus
atccgatgacgctaggaccttgagt

SEQ ID NO: 244175 - DNA, 25 bp, Mus musculus
atccgatgccctcttaaatctttat

SEQ ID NO: 244176 - DNA, 25 bp, Mus musculus
atccgatgccctgttaaatctttat

SEQ ID NO: 244177 - DNA, 25 bp, Mus musculus
atccgatggtgcagagactgctgcc

SEQ ID NO: 244178 - DNA, 25 bp, Mus musculus
atccgatggtgctgagactgctgcc

SEQ ID NO: 244179 - DNA, 25 bp, Mus musculus
atccgatgtctaaactaactcatgt

SEQ ID NO: 244180 - DNA, 25 bp, Mus musculus
atccgatgtctatactaactcatgt

SEQ ID NO: 244181 - DNA, 25 bp, Mus musculus
atccgattccttcagtatgactaca

SEQ ID NO: 244182 - DNA, 25 bp, Mus musculus
atccgattccttgagtatgactaca

SEQ ID NO: 244183 - DNA, 25 bp, Mus musculus
atccgattcgatcacaggcagcttc

SEQ ID NO: 244184 - DNA, 25 bp, Mus musculus
atccgattcgatgacaggcagcttc

SEQ ID NO: 244185 - DNA, 25 bp, Mus musculus
atccgattctagagccatggcccag

SEQ ID NO: 244186 - DNA, 25 bp, Mus musculus
atccgattctagtgccatggcccag

SEQ ID NO: 244187 - DNA, 25 bp, Mus musculus
atccgattctttctttactggctcc

SEQ ID NO: 244188 - DNA, 25 bp, Mus musculus
atccgattctttgtttactggctcc

SEQ ID NO: 244189 - DNA, 25 bp, Mus musculus
atccgattgggcatttactgggaat

SEQ ID NO: 244190 - DNA, 25 bp, Mus musculus
atccgattgggcttttactgggaat

SEQ ID NO: 244191 - DNA, 25 bp, Mus musculus
atccgattttcccatgtaatgttgg

SEQ ID NO: 244192 - DNA, 25 bp, Mus musculus
atccgattttccgatgtaatgttgg

SEQ ID NO: 244193 - DNA, 25 bp, Mus musculus
atccgcaaataccggctgaacatgt

SEQ ID NO: 244194 - DNA, 25 bp, Mus musculus
atccgcaaatacgggctgaacatgt

SEQ ID NO: 244195 - DNA, 25 bp, Mus musculus
atccgcaagcctctgactgtccatt

SEQ ID NO: 244196 - DNA, 25 bp, Mus musculus
atccgcaagcctgtgactgtccatt

SEQ ID NO: 244197 - DNA, 25 bp, Mus musculus
atccgcacagttaggtttgcccatt

SEQ ID NO: 244198 - DNA, 25 bp, Mus musculus
atccgcacagtttggtttgcccatt

SEQ ID NO: 244199 - DNA, 25 bp, Mus musculus
atccgcagatgtctctgcacgtgac

SEQ ID NO: 244200 - DNA, 25 bp, Mus musculus
atccgcagatgtgtctgcacgtgac

SEQ ID NO: 244201 - DNA, 25 bp, Mus musculus
atccgcagctttaccagcataaaat

SEQ ID NO: 244202 - DNA, 25 bp, Mus musculus
atccgcagcttttccagcataaaat

SEQ ID NO: 244203 - DNA, 25 bp, Mus musculus
atccgcaggctgctggtcaaagacc

SEQ ID NO: 244204 - DNA, 25 bp, Mus musculus
atccgcaggctggtggtcaaagacc

SEQ ID NO: 244205 - DNA, 25 bp, Mus musculus
atccgcagggagatgtccacttttg

SEQ ID NO: 244206 - DNA, 25 bp, Mus musculus
atccgcagggagttgtccacttttg

SEQ ID NO: 244207 - DNA, 25 bp, Mus musculus
atccgcagggatcagtcactctggg

SEQ ID NO: 244208 - DNA, 25 bp, Mus musculus
atccgcagggatgagtcactctggg

SEQ ID NO: 244209 - DNA, 25 bp, Mus musculus
atccgcagtcagcaacacacactag

SEQ ID NO: 244210 - DNA, 25 bp, Mus musculus
atccgcagtcaggaacacacactag

SEQ ID NO: 244211 - DNA, 25 bp, Mus musculus
atccgcataatgaatatcgttggcc

SEQ ID NO: 244212 - DNA, 25 bp, Mus musculus
atccgcataatgtatatcgttggcc

SEQ ID NO: 244213 - DNA, 25 bp, Mus musculus
atccgcatgtgcctatctattaatc

SEQ ID NO: 244214 - DNA, 25 bp, Mus musculus
atccgcatgtgcgtatctattaatc

SEQ ID NO: 244215 - DNA, 25 bp, Mus musculus
atccgccagcagcagtacaaattcc

SEQ ID NO: 244216 - DNA, 25 bp, Mus musculus
atccgccagcaggagtacaaattcc

SEQ ID NO: 244217 - DNA, 25 bp, Mus musculus
atccgccagcgcaaagggtttgtta

SEQ ID NO: 244218 - DNA, 25 bp, Mus musculus
atccgccagcgctaagggtttgtta

SEQ ID NO: 244219 - DNA, 25 bp, Mus musculus
atccgcccacagacgttatgagata

SEQ ID NO: 244220 - DNA, 25 bp, Mus musculus
atccgcccacagtcgttatgagata

SEQ ID NO: 244221 - DNA, 25 bp, Mus musculus
atccgccctgccattaatgtgggtt

SEQ ID NO: 244222 - DNA, 25 bp, Mus musculus
atccgccctgcctttaatgtgggtt

SEQ ID NO: 244223 - DNA, 25 bp, Mus musculus
atccgcctcatcatgatattgttcc

SEQ ID NO: 244224 - DNA, 25 bp, Mus musculus
atccgcctcatcttgatattgttcc

SEQ ID NO: 244225 - DNA, 25 bp, Mus musculus
atccgccttcaactctgcatgagat

SEQ ID NO: 244226 - DNA, 25 bp, Mus musculus
atccgccttcaagtctgcatgagat

SEQ ID NO: 244227 - DNA, 25 bp, Mus musculus
atccgccttcagaaatgctttgcct

SEQ ID NO: 244228 - DNA, 25 bp, Mus musculus
atccgccttcagtaatgctttgcct

SEQ ID NO: 244229 - DNA, 25 bp, Mus musculus
atccgccttcttatgaggagggaca

SEQ ID NO: 244230 - DNA, 25 bp, Mus musculus
atccgccttcttttgaggagggaca

SEQ ID NO: 244231 - DNA, 25 bp, Mus musculus
atccgcctttagcttacaggctatt

SEQ ID NO: 244232 - DNA, 25 bp, Mus musculus
atccgcctttaggttacaggctatt

SEQ ID NO: 244233 - DNA, 25 bp, Mus musculus
atccgcgacctgcagtcaagttggg

SEQ ID NO: 244234 - DNA, 25 bp, Mus musculus
atccgcgacctggagtcaagttggg

SEQ ID NO: 244235 - DNA, 25 bp, Mus musculus
atccgcgagtttatccagggccagg

SEQ ID NO: 244236 - DNA, 25 bp, Mus musculus
atccgcgagtttttccagggccagg

SEQ ID NO: 244237 - DNA, 25 bp, Mus musculus
atccgcgtggtcctggctgtgtttt

SEQ ID NO: 244238 - DNA, 25 bp, Mus musculus
atccgcgtggtcgtggctgtgtttt

SEQ ID NO: 244239 - DNA, 25 bp, Mus musculus
atccgctacgtgaccgctttcaatg

SEQ ID NO: 244240 - DNA, 25 bp, Mus musculus
atccgctacgtgtccgctttcaatg

SEQ ID NO: 244241 - DNA, 25 bp, Mus musculus
atccgctagggtacttgtggtcact

SEQ ID NO: 244242 - DNA, 25 bp, Mus musculus
atccgctagggttcttgtggtcact

SEQ ID NO: 244243 - DNA, 25 bp, Mus musculus
atccgctccactatgcactaaaagt

SEQ ID NO: 244244 - DNA, 25 bp, Mus musculus
atccgctccactttgcactaaaagt

SEQ ID NO: 244245 - DNA, 25 bp, Mus musculus
atccgctcctacagatgaaacctga

SEQ ID NO: 244246 - DNA, 25 bp, Mus musculus
atccgctcctactgatgaaacctga

SEQ ID NO: 244247 - DNA, 25 bp, Mus musculus
atccgctcgcggaaggctgtggact

SEQ ID NO: 244248 - DNA, 25 bp, Mus musculus
atccgctcgcggtaggctgtggact

SEQ ID NO: 244249 - DNA, 25 bp, Mus musculus
atccgctcgctgcaagctgtggtca

SEQ ID NO: 244250 - DNA, 25 bp, Mus musculus
atccgctcgctggaagctgtggtca

SEQ ID NO: 244251 - DNA, 25 bp, Mus musculus
atccgctctgtgcagggacgtcgaa

SEQ ID NO: 244252 - DNA, 25 bp, Mus musculus
atccgctctgtggagggacgtcgaa

SEQ ID NO: 244253 - DNA, 25 bp, Mus musculus
atccgctgcttgatatttacctggt

SEQ ID NO: 244254 - DNA, 25 bp, Mus musculus
atccgctgcttgttatttacctggt

SEQ ID NO: 244255 - DNA, 25 bp, Mus musculus
atccgcttacaaagactcgagtcag

SEQ ID NO: 244256 - DNA, 25 bp, Mus musculus
atccgcttacaatgactcgagtcag

SEQ ID NO: 244257 - DNA, 25 bp, Mus musculus
atccgcttcatgatcaggtccagga

SEQ ID NO: 244258 - DNA, 25 bp, Mus musculus
atccgcttcatgttcaggtccagga

SEQ ID NO: 244259 - DNA, 25 bp, Mus musculus
atccgcttgtacacttgccaaaaca

SEQ ID NO: 244260 - DNA, 25 bp, Mus musculus
atccgcttgtactcttgccaaaaca

SEQ ID NO: 244261 - DNA, 25 bp, Mus musculus
atccgctttgacatcatcgtgtttg

SEQ ID NO: 244262 - DNA, 25 bp, Mus musculus
atccgctttgacttcatcgtgtttg

SEQ ID NO: 244263 - DNA, 25 bp, Mus musculus
atccgctttgtaactgccttattga

SEQ ID NO: 244264 - DNA, 25 bp, Mus musculus
atccgctttgtatctgccttattga

SEQ ID NO: 244265 - DNA, 25 bp, Mus musculus
atccgcttttcacgatgtcttcttc

SEQ ID NO: 244266 - DNA, 25 bp, Mus musculus
atccgcttttcaggatgtcttcttc

SEQ ID NO: 244267 - DNA, 25 bp, Mus musculus
atccggaaccagagtggcctgcaga

SEQ ID NO: 244268 - DNA, 25 bp, Mus musculus
atccggaaccagtgtggcctgcaga

SEQ ID NO: 244269 - DNA, 25 bp, Mus musculus
atccggacgctgacaccttgaagca

SEQ ID NO: 244270 - DNA, 25 bp, Mus musculus
atccggacgctgtcaccttgaagca

SEQ ID NO: 244271 - DNA, 25 bp, Mus musculus
atccggactgggaggcttcaagtta

SEQ ID NO: 244272 - DNA, 25 bp, Mus musculus
atccggactgggtggcttcaagtta

SEQ ID NO: 244273 - DNA, 25 bp, Mus musculus
atccggagacaaaccctggacgcct

SEQ ID NO: 244274 - DNA, 25 bp, Mus musculus
atccggagacaatccctggacgcct

SEQ ID NO: 244275 - DNA, 25 bp, Mus musculus
atccggagcagaacgccaggacgag

SEQ ID NO: 244276 - DNA, 25 bp, Mus musculus
atccggagcagatcgccaggacgag

SEQ ID NO: 244277 - DNA, 25 bp, Mus musculus
atccggaggcacctgttcctgggaa

SEQ ID NO: 244278 - DNA, 25 bp, Mus musculus
atccggaggcacgtgttcctgggaa

SEQ ID NO: 244279 - DNA, 25 bp, Mus musculus
atccggagtgctacatgtgcagcga

SEQ ID NO: 244280 - DNA, 25 bp, Mus musculus
atccggagtgcttcatgtgcagcga

SEQ ID NO: 244281 - DNA, 25 bp, Mus musculus
atccggatcaaacgtggctgagcgc

SEQ ID NO: 244282 - DNA, 25 bp, Mus musculus
atccggatcaaaggtggctgagcgc

SEQ ID NO: 244283 - DNA, 25 bp, Mus musculus
atccggatctgcctgttgttatagt

SEQ ID NO: 244284 - DNA, 25 bp, Mus musculus
atccggatctgcgtgttgttatagt

SEQ ID NO: 244285 - DNA, 25 bp, Mus musculus
atccggatgccgctcaagctaataa

SEQ ID NO: 244286 - DNA, 25 bp, Mus musculus
atccggatgccggtcaagctaataa

SEQ ID NO: 244287 - DNA, 25 bp, Mus musculus
atccggatgggaacctggtctctta

SEQ ID NO: 244288 - DNA, 25 bp, Mus musculus
atccggatgggatcctggtctctta

SEQ ID NO: 244289 - DNA, 25 bp, Mus musculus
atccggatgttgatcaattcacaat

SEQ ID NO: 244290 - DNA, 25 bp, Mus musculus
atccggatgttgttcaattcacaat

SEQ ID NO: 244291 - DNA, 25 bp, Mus musculus
atccggattgataacgtgctttaca

SEQ ID NO: 244292 - DNA, 25 bp, Mus musculus
atccggattgattacgtgctttaca

SEQ ID NO: 244293 - DNA, 25 bp, Mus musculus
atccggcacacacatgctcacaata

SEQ ID NO: 244294 - DNA, 25 bp, Mus musculus
atccggcacacagatgctcacaata

SEQ ID NO: 244295 - DNA, 25 bp, Mus musculus
atccggcaccccaattataattcat

SEQ ID NO: 244296 - DNA, 25 bp, Mus musculus
atccggcacccctattataattcat

SEQ ID NO: 244297 - DNA, 25 bp, Mus musculus
atccggccagaccacaagatcttag

SEQ ID NO: 244298 - DNA, 25 bp, Mus musculus
atccggccagacgacaagatcttag

SEQ ID NO: 244299 - DNA, 25 bp, Mus musculus
atccggccaggaatggtgcctatca

SEQ ID NO: 244300 - DNA, 25 bp, Mus musculus
atccggccaggattggtgcctatca

SEQ ID NO: 244301 - DNA, 25 bp, Mus musculus
atccggcccaagattgtggtggtct

SEQ ID NO: 244302 - DNA, 25 bp, Mus musculus
atccggcccaagtttgtggtggtct

SEQ ID NO: 244303 - DNA, 25 bp, Mus musculus
atccggccgaagaaatgccatgcca

SEQ ID NO: 244304 - DNA, 25 bp, Mus musculus
atccggccgaagtaatgccatgcca

SEQ ID NO: 244305 - DNA, 25 bp, Mus musculus
atccggcctgaaaacataagacttt

SEQ ID NO: 244306 - DNA, 25 bp, Mus musculus
atccggcctgaatacataagacttt

SEQ ID NO: 244307 - DNA, 25 bp, Mus musculus
atccggcgcggaacagagacactga

SEQ ID NO: 244308 - DNA, 25 bp, Mus musculus
atccggcgcggatcagagacactga

SEQ ID NO: 244309 - DNA, 25 bp, Mus musculus
atccggctccaccaacagggtggtg

SEQ ID NO: 244310 - DNA, 25 bp, Mus musculus
atccggctccacgaacagggtggtg

SEQ ID NO: 244311 - DNA, 25 bp, Mus musculus
atccggctccggatgcagatggaag

SEQ ID NO: 244312 - DNA, 25 bp, Mus musculus
atccggctccggttgcagatggaag

SEQ ID NO: 244313 - DNA, 25 bp, Mus musculus
atccggctggaaagcagacatgcct

SEQ ID NO: 244314 - DNA, 25 bp, Mus musculus
atccggctggaatgcagacatgcct

SEQ ID NO: 244315 - DNA, 25 bp, Mus musculus
atccggcttcggacaaagagggtga

SEQ ID NO: 244316 - DNA, 25 bp, Mus musculus
atccggcttcggtcaaagagggtga

SEQ ID NO: 244317 - DNA, 25 bp, Mus musculus
atccgggacatgaccttgcacagtg

SEQ ID NO: 244318 - DNA, 25 bp, Mus musculus
atccgggacatgcttctgtcaggga

SEQ ID NO: 244319 - DNA, 25 bp, Mus musculus
atccgggacatggttctgtcaggga

SEQ ID NO: 244320 - DNA, 25 bp, Mus musculus
atccgggacatgtccttgcacagtg

SEQ ID NO: 244321 - DNA, 25 bp, Mus musculus
atccgggaccagatcacagggcaag

SEQ ID NO: 244322 - DNA, 25 bp, Mus musculus
atccgggaccagttcacagggcaag

SEQ ID NO: 244323 - DNA, 25 bp, Mus musculus
atccgggagtaccagcaggtcatta

SEQ ID NO: 244324 - DNA, 25 bp, Mus musculus
atccgggagtacgagcaggtcatta

SEQ ID NO: 244325 - DNA, 25 bp, Mus musculus
atccgggccaatactgtgcatgtga

SEQ ID NO: 244326 - DNA, 25 bp, Mus musculus
atccgggccaattctgtgcatgtga

SEQ ID NO: 244327 - DNA, 25 bp, Mus musculus
atccgggctgaaactggcaccaggg

SEQ ID NO: 244328 - DNA, 25 bp, Mus musculus
atccgggctgaatctggcaccaggg

SEQ ID NO: 244329 - DNA, 25 bp, Mus musculus
atccgggctggaacagaactcactt

SEQ ID NO: 244330 - DNA, 25 bp, Mus musculus
atccgggctggatcagaactcactt

SEQ ID NO: 244331 - DNA, 25 bp, Mus musculus
atccggtacgatcctgtgacaatta

SEQ ID NO: 244332 - DNA, 25 bp, Mus musculus
atccggtacgatgctgtgacaatta

SEQ ID NO: 244333 - DNA, 25 bp, Mus musculus
atccggtactagcgtgtatcgcctg

SEQ ID NO: 244334 - DNA, 25 bp, Mus musculus
atccggtactagggtgtatcgcctg

SEQ ID NO: 244335 - DNA, 25 bp, Mus musculus
atccggtccaccagtaggcttggaa

SEQ ID NO: 244336 - DNA, 25 bp, Mus musculus
atccggtccacctgtaggcttggaa

SEQ ID NO: 244337 - DNA, 25 bp, Mus musculus
atccggtcgaatcagacaatgggct

SEQ ID NO: 244338 - DNA, 25 bp, Mus musculus
atccggtcgaatgagacaatgggct

SEQ ID NO: 244339 - DNA, 25 bp, Mus musculus
atccggtcttcaactctatttatct

SEQ ID NO: 244340 - DNA, 25 bp, Mus musculus
atccggtcttcatctctatttatct

SEQ ID NO: 244341 - DNA, 25 bp, Mus musculus
atccggtgaccgcattcttctccgt

SEQ ID NO: 244342 - DNA, 25 bp, Mus musculus
atccggtgaccggattcttctccgt

SEQ ID NO: 244343 - DNA, 25 bp, Mus musculus
atccggtgcaggacggttttgtcaa

SEQ ID NO: 244344 - DNA, 25 bp, Mus musculus
atccggtgcaggtcggttttgtcaa

SEQ ID NO: 244345 - DNA, 25 bp, Mus musculus
atccggtgcctactgcttaggagag

SEQ ID NO: 244346 - DNA, 25 bp, Mus musculus
atccggtgcctagtgcttaggagag

SEQ ID NO: 244347 - DNA, 25 bp, Mus musculus
atccggtggaaacagctccaggtgt

SEQ ID NO: 244348 - DNA, 25 bp, Mus musculus
atccggtggaaagagctccaggtgt

SEQ ID NO: 244349 - DNA, 25 bp, Mus musculus
atccggtggcagatctccaaaccag

SEQ ID NO: 244350 - DNA, 25 bp, Mus musculus
atccggtggcagttctccaaaccag

SEQ ID NO: 244351 - DNA, 25 bp, Mus musculus
atccggtgggtgatggcctttgtca

SEQ ID NO: 244352 - DNA, 25 bp, Mus musculus
atccggtgggtgttggcctttgtca

SEQ ID NO: 244353 - DNA, 25 bp, Mus musculus
atccggtgttttcggatgtgctgcc

SEQ ID NO: 244354 - DNA, 25 bp, Mus musculus
atccggtgttttgggatgtgctgcc

SEQ ID NO: 244355 - DNA, 25 bp, Mus musculus
atccggttatgcctcgtttatatga

SEQ ID NO: 244356 - DNA, 25 bp, Mus musculus
atccggttatgcgtcgtttatatga

SEQ ID NO: 244357 - DNA, 25 bp, Mus musculus
atccggttccaccaggactgcaaga

SEQ ID NO: 244358 - DNA, 25 bp, Mus musculus
atccggttccacgaggactgcaaga

SEQ ID NO: 244359 - DNA, 25 bp, Mus musculus
atccgtaacagcagtaaccccgagt

SEQ ID NO: 244360 - DNA, 25 bp, Mus musculus
atccgtaacagctgtaaccccgagt

SEQ ID NO: 244361 - DNA, 25 bp, Mus musculus
atccgtaatgaactctgatgtctga

SEQ ID NO: 244362 - DNA, 25 bp, Mus musculus
atccgtaatgaagtctgatgtctga

SEQ ID NO: 244363 - DNA, 25 bp, Mus musculus
atccgtaccatcagtcttcagaact

SEQ ID NO: 244364 - DNA, 25 bp, Mus musculus
atccgtaccatctgtcttcagaact

SEQ ID NO: 244365 - DNA, 25 bp, Mus musculus
atccgtacccagagacatatcacat

SEQ ID NO: 244366 - DNA, 25 bp, Mus musculus
atccgtacccagtgacatatcacat

SEQ ID NO: 244367 - DNA, 25 bp, Mus musculus
atccgtagggagatgggccaagcca

SEQ ID NO: 244368 - DNA, 25 bp, Mus musculus
atccgtagggagttgggccaagcca

SEQ ID NO: 244369 - DNA, 25 bp, Mus musculus
atccgtatcaggcaggttttggtat

SEQ ID NO: 244370 - DNA, 25 bp, Mus musculus
atccgtatcagggaggttttggtat

SEQ ID NO: 244371 - DNA, 25 bp, Mus musculus
atccgtatgttcaaattcagcccca

SEQ ID NO: 244372 - DNA, 25 bp, Mus musculus
atccgtatgttctaattcagcccca

SEQ ID NO: 244373 - DNA, 25 bp, Mus musculus
atccgtattaccaattgtgaaccta

SEQ ID NO: 244374 - DNA, 25 bp, Mus musculus
atccgtattacctattgtgaaccta

SEQ ID NO: 244375 - DNA, 25 bp, Mus musculus
atccgtattgataaactttgcagtc

SEQ ID NO: 244376 - DNA, 25 bp, Mus musculus
atccgtattgattaactttgcagtc

SEQ ID NO: 244377 - DNA, 25 bp, Mus musculus
atccgtcatgggatgtactgggtcc

SEQ ID NO: 244378 - DNA, 25 bp, Mus musculus
atccgtcatgggttgtactgggtcc

SEQ ID NO: 244379 - DNA, 25 bp, Mus musculus
atccgtccagacatccaaagaggga

SEQ ID NO: 244380 - DNA, 25 bp, Mus musculus
atccgtccagacttccaaagaggga

SEQ ID NO: 244381 - DNA, 25 bp, Mus musculus
atccgtcctcagagctttctcaaaa

SEQ ID NO: 244382 - DNA, 25 bp, Mus musculus
atccgtcctcagtgctttctcaaaa

SEQ ID NO: 244383 - DNA, 25 bp, Mus musculus
atccgtcctttcaatctctgaaggt

SEQ ID NO: 244384 - DNA, 25 bp, Mus musculus
atccgtcctttctatctctgaaggt

SEQ ID NO: 244385 - DNA, 25 bp, Mus musculus
atccgtcgctttctccagatggtgt

SEQ ID NO: 244386 - DNA, 25 bp, Mus musculus
atccgtcgctttgtccagatggtgt

SEQ ID NO: 244387 - DNA, 25 bp, Mus musculus
atccgtctacacagatttacaacca

SEQ ID NO: 244388 - DNA, 25 bp, Mus musculus
atccgtctacactgatttacaacca

SEQ ID NO: 244389 - DNA, 25 bp, Mus musculus
atccgtctctaactctatagaacga

SEQ ID NO: 244390 - DNA, 25 bp, Mus musculus
atccgtctctaagtctatagaacga

SEQ ID NO: 244391 - DNA, 25 bp, Mus musculus
atccgtctgtccctcttgaaaggta

SEQ ID NO: 244392 - DNA, 25 bp, Mus musculus
atccgtctgtccgtcttgaaaggta

SEQ ID NO: 244393 - DNA, 25 bp, Mus musculus
atccgtctgtggactcctgaaatga

SEQ ID NO: 244394 - DNA, 25 bp, Mus musculus
atccgtctgtggtctcctgaaatga

SEQ ID NO: 244395 - DNA, 25 bp, Mus musculus
atccgtctgttcctatgtgtttgca

SEQ ID NO: 244396 - DNA, 25 bp, Mus musculus
atccgtctgttcgtatgtgtttgca

SEQ ID NO: 244397 - DNA, 25 bp, Mus musculus
atccgtcttaccatctaaatgagca

SEQ ID NO: 244398 - DNA, 25 bp, Mus musculus
atccgtcttaccttctaaatgagca

SEQ ID NO: 244399 - DNA, 25 bp, Mus musculus
atccgtcttcaccagaggtttgcct

SEQ ID NO: 244400 - DNA, 25 bp, Mus musculus
atccgtcttcacgagaggtttgcct

SEQ ID NO: 244401 - DNA, 25 bp, Mus musculus
atccgtcttcatctgcttcctgagt

SEQ ID NO: 244402 - DNA, 25 bp, Mus musculus
atccgtcttcatgtgcttcctgagt

SEQ ID NO: 244403 - DNA, 25 bp, Mus musculus
atccgtgaacagatgacttcccatg

SEQ ID NO: 244404 - DNA, 25 bp, Mus musculus
atccgtgaacagttgacttcccatg

SEQ ID NO: 244405 - DNA, 25 bp, Mus musculus
atccgtgagtacctttgctctgaca

SEQ ID NO: 244406 - DNA, 25 bp, Mus musculus
atccgtgagtacgtttgctctgaca

SEQ ID NO: 244407 - DNA, 25 bp, Mus musculus
atccgtgattgtagattctcctcca

SEQ ID NO: 244408 - DNA, 25 bp, Mus musculus
atccgtgattgttgattctcctcca

SEQ ID NO: 244409 - DNA, 25 bp, Mus musculus
atccgtgcacacaactggcagctga

SEQ ID NO: 244410 - DNA, 25 bp, Mus musculus
atccgtgcacactactggcagctga

SEQ ID NO: 244411 - DNA, 25 bp, Mus musculus
atccgtgccagcagggatggagacc

SEQ ID NO: 244412 - DNA, 25 bp, Mus musculus
atccgtgccagctgggatggagacc

SEQ ID NO: 244413 - DNA, 25 bp, Mus musculus
atccgtgcctgtcgaccattagcaa

SEQ ID NO: 244414 - DNA, 25 bp, Mus musculus
atccgtgcctgtggaccattagcaa

SEQ ID NO: 244415 - DNA, 25 bp, Mus musculus
atccgtgccttcacgaggatcttca

SEQ ID NO: 244416 - DNA, 25 bp, Mus musculus
atccgtgccttctcgaggatcttca

SEQ ID NO: 244417 - DNA, 25 bp, Mus musculus
atccgtgcggtaccgagtcttggaa

SEQ ID NO: 244418 - DNA, 25 bp, Mus musculus
atccgtgcggtagcgagtcttggaa

SEQ ID NO: 244419 - DNA, 25 bp, Mus musculus
atccgtgctctcaaaaactgctagg

SEQ ID NO: 244420 - DNA, 25 bp, Mus musculus
atccgtgctctctaaaactgctagg

SEQ ID NO: 244421 - DNA, 25 bp, Mus musculus
atccgtggatgcagggtgacctcct

SEQ ID NO: 244422 - DNA, 25 bp, Mus musculus
atccgtggatgctgggtgacctcct

SEQ ID NO: 244423 - DNA, 25 bp, Mus musculus
atccgtggctctacatccttggact

SEQ ID NO: 244424 - DNA, 25 bp, Mus musculus
atccgtggctcttcatccttggact

SEQ ID NO: 244425 - DNA, 25 bp, Mus musculus
atccgtgggccaaggtggaccgctt

SEQ ID NO: 244426 - DNA, 25 bp, Mus musculus
atccgtgggccatggtggaccgctt

SEQ ID NO: 244427 - DNA, 25 bp, Mus musculus
atccgtgggctccttaactttatga

SEQ ID NO: 244428 - DNA, 25 bp, Mus musculus
atccgtgggctcgttaactttatga

SEQ ID NO: 244429 - DNA, 25 bp, Mus musculus
atccgtgtacccagctgttctgaga

SEQ ID NO: 244430 - DNA, 25 bp, Mus musculus
atccgtgtaccctgctgttctgaga

SEQ ID NO: 244431 - DNA, 25 bp, Mus musculus
atccgtgtgactctaggcttcaagt

SEQ ID NO: 244432 - DNA, 25 bp, Mus musculus
atccgtgtgactgtaggcttcaagt

SEQ ID NO: 244433 - DNA, 25 bp, Mus musculus
atccgtgtgcacatagttcagtttg

SEQ ID NO: 244434 - DNA, 25 bp, Mus musculus
atccgtgtgcacttagttcagtttg

SEQ ID NO: 244435 - DNA, 25 bp, Mus musculus
atccgtgtgcggctgtccagaaaac

SEQ ID NO: 244436 - DNA, 25 bp, Mus musculus
atccgtgtgcgggtgtccagaaaac

SEQ ID NO: 244437 - DNA, 25 bp, Mus musculus
atccgtgtggatcttcatggtgtct

SEQ ID NO: 244438 - DNA, 25 bp, Mus musculus
atccgtgtggatgttcatggtgtct

SEQ ID NO: 244439 - DNA, 25 bp, Mus musculus
atccgtgtgggcatgaagctgccac

SEQ ID NO: 244440 - DNA, 25 bp, Mus musculus
atccgtgtgggcttgaagctgccac

SEQ ID NO: 244441 - DNA, 25 bp, Mus musculus
atccgtgtggtaacaattgctccag

SEQ ID NO: 244442 - DNA, 25 bp, Mus musculus
atccgtgtggtatcaattgctccag

SEQ ID NO: 244443 - DNA, 25 bp, Mus musculus
atccgtgtgtatatttaagaccctg

SEQ ID NO: 244444 - DNA, 25 bp, Mus musculus
atccgtgtgtatttttaagaccctg

SEQ ID NO: 244445 - DNA, 25 bp, Mus musculus
atccgtgttcacagtcaacctgact

SEQ ID NO: 244446 - DNA, 25 bp, Mus musculus
atccgtgttcactgtcaacctgact

SEQ ID NO: 244447 - DNA, 25 bp, Mus musculus
atccgtgttgatcattccagttgct

SEQ ID NO: 244448 - DNA, 25 bp, Mus musculus
atccgtgttgatgattccagttgct

SEQ ID NO: 244449 - DNA, 25 bp, Mus musculus
atccgttcacagattctttgtcttt

SEQ ID NO: 244450 - DNA, 25 bp, Mus musculus
atccgttcacagtttctttgtcttt

SEQ ID NO: 244451 - DNA, 25 bp, Mus musculus
atccgttcggtcaacaagctctgaa

SEQ ID NO: 244452 - DNA, 25 bp, Mus musculus
atccgttcggtctacaagctctgaa

SEQ ID NO: 244453 - DNA, 25 bp, Mus musculus
atccgttcttggcttcttattggaa

SEQ ID NO: 244454 - DNA, 25 bp, Mus musculus
atccgttcttgggttcttattggaa

SEQ ID NO: 244455 - DNA, 25 bp, Mus musculus
atccgttgccttatttctagagtca

SEQ ID NO: 244456 - DNA, 25 bp, Mus musculus
atccgttgccttttttctagagtca

SEQ ID NO: 244457 - DNA, 25 bp, Mus musculus
atccgttgtgcaccactggttgaac

SEQ ID NO: 244458 - DNA, 25 bp, Mus musculus
atccgttgtgcagcactggttgaac

SEQ ID NO: 244459 - DNA, 25 bp, Mus musculus
atccgtttatttccattaagcccca

SEQ ID NO: 244460 - DNA, 25 bp, Mus musculus
atccgtttatttgcattaagcccca

SEQ ID NO: 244461 - DNA, 25 bp, Mus musculus
atccgtttccttatgcacatttgtt

SEQ ID NO: 244462 - DNA, 25 bp, Mus musculus
atccgtttccttttgcacatttgtt

SEQ ID NO: 244463 - DNA, 25 bp, Mus musculus
atccgtttgacactgttcgtcgtag

SEQ ID NO: 244464 - DNA, 25 bp, Mus musculus
atccgtttgacagtgttcgtcgtag

SEQ ID NO: 244465 - DNA, 25 bp, Mus musculus
atcctaaaatccctgcatggagata

SEQ ID NO: 244466 - DNA, 25 bp, Mus musculus
atcctaaaatccgtgcatggagata

SEQ ID NO: 244467 - DNA, 25 bp, Mus musculus
atcctaaagctaacaagtacctgtg

SEQ ID NO: 244468 - DNA, 25 bp, Mus musculus
atcctaaagctatcaagtacctgtg

SEQ ID NO: 244469 - DNA, 25 bp, Mus musculus
atcctaaaggtgcattctggaacca

SEQ ID NO: 244470 - DNA, 25 bp, Mus musculus
atcctaaaggtggattctggaacca

SEQ ID NO: 244471 - DNA, 25 bp, Mus musculus
atcctaaagtgaagcccgccctcag

SEQ ID NO: 244472 - DNA, 25 bp, Mus musculus
atcctaaagtgatgcccgccctcag

SEQ ID NO: 244473 - DNA, 25 bp, Mus musculus
atcctaaatctgactttgcatggct

SEQ ID NO: 244474 - DNA, 25 bp, Mus musculus
atcctaaatctgtctttgcatggct

SEQ ID NO: 244475 - DNA, 25 bp, Mus musculus
atcctaaatggcaccttacagacac

SEQ ID NO: 244476 - DNA, 25 bp, Mus musculus
atcctaaatggctccttacagacac

SEQ ID NO: 244477 - DNA, 25 bp, Mus musculus
atcctaacaaggagcaaaatgtgct

SEQ ID NO: 244478 - DNA, 25 bp, Mus musculus
atcctaacaaggtgcaaaatgtgct

SEQ ID NO: 244479 - DNA, 25 bp, Mus musculus
atcctaacactaagccacatcatgt

SEQ ID NO: 244480 - DNA, 25 bp, Mus musculus
atcctaacactatgccacatcatgt

SEQ ID NO: 244481 - DNA, 25 bp, Mus musculus
atcctaacatggaggatgtctcagc

SEQ ID NO: 244482 - DNA, 25 bp, Mus musculus
atcctaacatggtggatgtctcagc

SEQ ID NO: 244483 - DNA, 25 bp, Mus musculus
atcctaaccatgatacccgtctctg

SEQ ID NO: 244484 - DNA, 25 bp, Mus musculus
atcctaaccatgttacccgtctctg

SEQ ID NO: 244485 - DNA, 25 bp, Mus musculus
atcctaacccaaatcagaacctgac

SEQ ID NO: 244486 - DNA, 25 bp, Mus musculus
atcctaacccaattcagaacctgac

SEQ ID NO: 244487 - DNA, 25 bp, Mus musculus
atcctaactcggattgtcctacaga

SEQ ID NO: 244488 - DNA, 25 bp, Mus musculus
atcctaactcggtttgtcctacaga

SEQ ID NO: 244489 - DNA, 25 bp, Mus musculus
atcctaactgccacagaatcactca

SEQ ID NO: 244490 - DNA, 25 bp, Mus musculus
atcctaactgcctcagaatcactca

SEQ ID NO: 244491 - DNA, 25 bp, Mus musculus
atcctaagccgtcctagatggacat

SEQ ID NO: 244492 - DNA, 25 bp, Mus musculus
atcctaagccgtgctagatggacat

SEQ ID NO: 244493 - DNA, 25 bp, Mus musculus
atcctaagctccctgaagctgtgat

SEQ ID NO: 244494 - DNA, 25 bp, Mus musculus
atcctaagctccgtgaagctgtgat

SEQ ID NO: 244495 - DNA, 25 bp, Mus musculus
atcctaaggagccacagtttctgca

SEQ ID NO: 244496 - DNA, 25 bp, Mus musculus
atcctaaggagcgacagtttctgca

SEQ ID NO: 244497 - DNA, 25 bp, Mus musculus
atcctaagtaggcaggacactgtca

SEQ ID NO: 244498 - DNA, 25 bp, Mus musculus
atcctaagtagggaggacactgtca

SEQ ID NO: 244499 - DNA, 25 bp, Mus musculus
atcctaagtcataaaccactgctag

SEQ ID NO: 244500 - DNA, 25 bp, Mus musculus
atcctaagtcattaaccactgctag

SEQ ID NO: 244501 - DNA, 25 bp, Mus musculus
atcctaagtggacactgcttttctc

SEQ ID NO: 244502 - DNA, 25 bp, Mus musculus
atcctaagtggagactgcttttctc

SEQ ID NO: 244503 - DNA, 25 bp, Mus musculus
atcctaatacagccgcgacgaacct

SEQ ID NO: 244504 - DNA, 25 bp, Mus musculus
atcctaatacaggcgcgacgaacct

SEQ ID NO: 244505 - DNA, 25 bp, Mus musculus
atcctaatagtgatacttcctgggc

SEQ ID NO: 244506 - DNA, 25 bp, Mus musculus
atcctaatagtgttacttcctgggc

SEQ ID NO: 244507 - DNA, 25 bp, Mus musculus
atcctaatagttcagctctttgctt

SEQ ID NO: 244508 - DNA, 25 bp, Mus musculus
atcctaatagttgagctctttgctt

SEQ ID NO: 244509 - DNA, 25 bp, Mus musculus
atcctaatatcccttacctagctaa

SEQ ID NO: 244510 - DNA, 25 bp, Mus musculus
atcctaatatccgttacctagctaa

SEQ ID NO: 244511 - DNA, 25 bp, Mus musculus
atcctaatctatagatattctgttg

SEQ ID NO: 244512 - DNA, 25 bp, Mus musculus
atcctaatctattgatattctgttg

SEQ ID NO: 244513 - DNA, 25 bp, Mus musculus
atcctaatctcacctcgagtggtat

SEQ ID NO: 244514 - DNA, 25 bp, Mus musculus
atcctaatctcagctcgagtggtat

SEQ ID NO: 244515 - DNA, 25 bp, Mus musculus
atcctaatctgaacaccggatggga

SEQ ID NO: 244516 - DNA, 25 bp, Mus musculus
atcctaatctgatcaccggatggga

SEQ ID NO: 244517 - DNA, 25 bp, Mus musculus
atcctaatctgtaacctggctctgg

SEQ ID NO: 244518 - DNA, 25 bp, Mus musculus
atcctaatctgttacctggctctgg

SEQ ID NO: 244519 - DNA, 25 bp, Mus musculus
atcctaattcaaagccagtctcaaa

SEQ ID NO: 244520 - DNA, 25 bp, Mus musculus
atcctaattcaatgccagtctcaaa

SEQ ID NO: 244521 - DNA, 25 bp, Mus musculus
atcctacaagagaccatttccaagt

SEQ ID NO: 244522 - DNA, 25 bp, Mus musculus
atcctacaagagtccatttccaagt

SEQ ID NO: 244523 - DNA, 25 bp, Mus musculus
atcctacacgtgctggcttaggtac

SEQ ID NO: 244524 - DNA, 25 bp, Mus musculus
atcctacacgtggtggcttaggtac

SEQ ID NO: 244525 - DNA, 25 bp, Mus musculus
atcctacacttcacatttatccttt

SEQ ID NO: 244526 - DNA, 25 bp, Mus musculus
atcctacacttctcatttatccttt

SEQ ID NO: 244527 - DNA, 25 bp, Mus musculus
atcctacagactcttcgtcagcttc

SEQ ID NO: 244528 - DNA, 25 bp, Mus musculus
atcctacagactgttcgtcagcttc

SEQ ID NO: 244529 - DNA, 25 bp, Mus musculus
atcctacagataaaaccgttgccaa

SEQ ID NO: 244530 - DNA, 25 bp, Mus musculus
atcctacagatataaccgttgccaa

SEQ ID NO: 244531 - DNA, 25 bp, Mus musculus
atcctacagggacggctagtcccct

SEQ ID NO: 244532 - DNA, 25 bp, Mus musculus
atcctacagggagggctagtcccct

SEQ ID NO: 244533 - DNA, 25 bp, Mus musculus
atcctacagtgaataacttccgaca

SEQ ID NO: 244534 - DNA, 25 bp, Mus musculus
atcctacagtgattaacttccgaca

SEQ ID NO: 244535 - DNA, 25 bp, Mus musculus
atcctacagtgcacaagacagtcta

SEQ ID NO: 244536 - DNA, 25 bp, Mus musculus
atcctacagtgctcaagacagtcta

SEQ ID NO: 244537 - DNA, 25 bp, Mus musculus
atcctaccactgcaggcagggcaga

SEQ ID NO: 244538 - DNA, 25 bp, Mus musculus
atcctaccactggaggcagggcaga

SEQ ID NO: 244539 - DNA, 25 bp, Mus musculus
atcctaccatcaactgctttgatca

SEQ ID NO: 244540 - DNA, 25 bp, Mus musculus
atcctaccatcatctgctttgatca

SEQ ID NO: 244541 - DNA, 25 bp, Mus musculus
atcctaccattcacttctataaaac

SEQ ID NO: 244542 - DNA, 25 bp, Mus musculus
atcctaccattctcttctataaaac

SEQ ID NO: 244543 - DNA, 25 bp, Mus musculus
atcctacccacaaaagtgccaactg

SEQ ID NO: 244544 - DNA, 25 bp, Mus musculus
atcctacccacataagtgccaactg

SEQ ID NO: 244545 - DNA, 25 bp, Mus musculus
atcctacccagtagctgtggtgcta

SEQ ID NO: 244546 - DNA, 25 bp, Mus musculus
atcctacccagtcggcagaagatat

SEQ ID NO: 244547 - DNA, 25 bp, Mus musculus
atcctacccagtgggcagaagatat

SEQ ID NO: 244548 - DNA, 25 bp, Mus musculus
atcctacccagttgctgtggtgcta

SEQ ID NO: 244549 - DNA, 25 bp, Mus musculus
atcctaccctgcagatggttggttt

SEQ ID NO: 244550 - DNA, 25 bp, Mus musculus
atcctaccctgctgatggttggttt

SEQ ID NO: 244551 - DNA, 25 bp, Mus musculus
atcctacccttcagattgctcctaa

SEQ ID NO: 244552 - DNA, 25 bp, Mus musculus
atcctacccttctgattgctcctaa

SEQ ID NO: 244553 - DNA, 25 bp, Mus musculus
atcctaccgctacagtggagtccct

SEQ ID NO: 244554 - DNA, 25 bp, Mus musculus
atcctaccgctagagtggagtccct

SEQ ID NO: 244555 - DNA, 25 bp, Mus musculus
atcctacctcagacagcgatgtgaa

SEQ ID NO: 244556 - DNA, 25 bp, Mus musculus
atcctacctcagtcagcgatgtgaa

SEQ ID NO: 244557 - DNA, 25 bp, Mus musculus
atcctacctgcaaaaaggtttgaca

SEQ ID NO: 244558 - DNA, 25 bp, Mus musculus
atcctacctgcataaaggtttgaca

SEQ ID NO: 244559 - DNA, 25 bp, Mus musculus
atcctacctgtgcagacggtgctac

SEQ ID NO: 244560 - DNA, 25 bp, Mus musculus
atcctacctgtggagacggtgctac

SEQ ID NO: 244561 - DNA, 25 bp, Mus musculus
atcctacctttaagtgtcccttatg

SEQ ID NO: 244562 - DNA, 25 bp, Mus musculus
atcctacctttatgtgtcccttatg

SEQ ID NO: 244563 - DNA, 25 bp, Mus musculus
atcctacgagatcagctacgtaact

SEQ ID NO: 244564 - DNA, 25 bp, Mus musculus
atcctacgagatgagctacgtaact

SEQ ID NO: 244565 - DNA, 25 bp, Mus musculus
atcctacgaggcattttcttgggtt

SEQ ID NO: 244566 - DNA, 25 bp, Mus musculus
atcctacgaggctttttcttgggtt

SEQ ID NO: 244567 - DNA, 25 bp, Mus musculus
atcctactaattatcctgctgttct

SEQ ID NO: 244568 - DNA, 25 bp, Mus musculus
atcctactaattttcctgctgttct

SEQ ID NO: 244569 - DNA, 25 bp, Mus musculus
atcctactagtaaagccagtctcag

SEQ ID NO: 244570 - DNA, 25 bp, Mus musculus
atcctactagtatagccagtctcag

SEQ ID NO: 244571 - DNA, 25 bp, Mus musculus
atcctactcgggataacataacaat

SEQ ID NO: 244572 - DNA, 25 bp, Mus musculus
atcctactcgggttaacataacaat

SEQ ID NO: 244573 - DNA, 25 bp, Mus musculus
atcctactggagagtctgtccaggg

SEQ ID NO: 244574 - DNA, 25 bp, Mus musculus
atcctactggagtgtctgtccaggg

SEQ ID NO: 244575 - DNA, 25 bp, Mus musculus
atcctactgtccctgtgctacagtt

SEQ ID NO: 244576 - DNA, 25 bp, Mus musculus
atcctactgtccgtgtgctacagtt

SEQ ID NO: 244577 - DNA, 25 bp, Mus musculus
atcctactgtgtccataggcctgca

SEQ ID NO: 244578 - DNA, 25 bp, Mus musculus
atcctactgtgtgcataggcctgca

SEQ ID NO: 244579 - DNA, 25 bp, Mus musculus
atcctagacccacctttgctgctaa

SEQ ID NO: 244580 - DNA, 25 bp, Mus musculus
atcctagacccagctttgctgctaa

SEQ ID NO: 244581 - DNA, 25 bp, Mus musculus
atcctagagcccatcacactaaagt

SEQ ID NO: 244582 - DNA, 25 bp, Mus musculus
atcctagagcccttcacactaaagt

SEQ ID NO: 244583 - DNA, 25 bp, Mus musculus
atcctagataccagcttctctgctg

SEQ ID NO: 244584 - DNA, 25 bp, Mus musculus
atcctagatacctgcttctctgctg

SEQ ID NO: 244585 - DNA, 25 bp, Mus musculus
atcctagatactcggccgggccaag

SEQ ID NO: 244586 - DNA, 25 bp, Mus musculus
atcctagatactgggccgggccaag

SEQ ID NO: 244587 - DNA, 25 bp, Mus musculus
atcctagatcttcggaagctaaggc

SEQ ID NO: 244588 - DNA, 25 bp, Mus musculus
atcctagatcttgggaagctaaggc

SEQ ID NO: 244589 - DNA, 25 bp, Mus musculus
atcctagcacttagatagcagagat

SEQ ID NO: 244590 - DNA, 25 bp, Mus musculus
atcctagcactttgatagcagagat

SEQ ID NO: 244591 - DNA, 25 bp, Mus musculus
atcctagcatgcacacatgagggta

SEQ ID NO: 244592 - DNA, 25 bp, Mus musculus
atcctagcatgctcacatgagggta

SEQ ID NO: 244593 - DNA, 25 bp, Mus musculus
atcctagccgaacccgagcgggact

SEQ ID NO: 244594 - DNA, 25 bp, Mus musculus
atcctagccgaagccgagcgggact

SEQ ID NO: 244595 - DNA, 25 bp, Mus musculus
atcctagcgcaaaaaagcctcctga

SEQ ID NO: 244596 - DNA, 25 bp, Mus musculus
atcctagcgcaataaagcctcctga

SEQ ID NO: 244597 - DNA, 25 bp, Mus musculus
atcctagctagtatctcgatgtgat

SEQ ID NO: 244598 - DNA, 25 bp, Mus musculus
atcctagctagtttctcgatgtgat

SEQ ID NO: 244599 - DNA, 25 bp, Mus musculus
atcctagctcttcacagctggctgg

SEQ ID NO: 244600 - DNA, 25 bp, Mus musculus
atcctagctcttgacagctggctgg

SEQ ID NO: 244601 - DNA, 25 bp, Mus musculus
atcctagctgccacacagggtctgt

SEQ ID NO: 244602 - DNA, 25 bp, Mus musculus
atcctagctgcctcacagggtctgt

SEQ ID NO: 244603 - DNA, 25 bp, Mus musculus
atcctagctgggacaggaacacgca

SEQ ID NO: 244604 - DNA, 25 bp, Mus musculus
atcctagctgggtcaggaacacgca

SEQ ID NO: 244605 - DNA, 25 bp, Mus musculus
atcctagctggtatttccaactaag

SEQ ID NO: 244606 - DNA, 25 bp, Mus musculus
atcctagctggtttttccaactaag

SEQ ID NO: 244607 - DNA, 25 bp, Mus musculus
atcctaggacccatctttaaagcac

SEQ ID NO: 244608 - DNA, 25 bp, Mus musculus
atcctaggacccttctttaaagcac

SEQ ID NO: 244609 - DNA, 25 bp, Mus musculus
atcctaggctaaatgttgtactgtc

SEQ ID NO: 244610 - DNA, 25 bp, Mus musculus
atcctaggctaattgttgtactgtc

SEQ ID NO: 244611 - DNA, 25 bp, Mus musculus
atcctaggtaagaggcaccctggca

SEQ ID NO: 244612 - DNA, 25 bp, Mus musculus
atcctaggtaagtggcaccctggca

SEQ ID NO: 244613 - DNA, 25 bp, Mus musculus
atcctaggttcaagcggcgccaccg

SEQ ID NO: 244614 - DNA, 25 bp, Mus musculus
atcctaggttcatgcggcgccaccg

SEQ ID NO: 244615 - DNA, 25 bp, Mus musculus
atcctagtaaaaattccatgaatct

SEQ ID NO: 244616 - DNA, 25 bp, Mus musculus
atcctagtaaaatttccatgaatct

SEQ ID NO: 244617 - DNA, 25 bp, Mus musculus
atcctagtatccatggtctatctca

SEQ ID NO: 244618 - DNA, 25 bp, Mus musculus
atcctagtatccttggtctatctca

SEQ ID NO: 244619 - DNA, 25 bp, Mus musculus
atcctagtatttcagtgacatgcct

SEQ ID NO: 244620 - DNA, 25 bp, Mus musculus
atcctagtatttgagtgacatgcct

SEQ ID NO: 244621 - DNA, 25 bp, Mus musculus
atcctagtcccactacatcacatgg

SEQ ID NO: 244622 - DNA, 25 bp, Mus musculus
atcctagtcccagtacatcacatgg

SEQ ID NO: 244623 - DNA, 25 bp, Mus musculus
atcctagtgaggcaggccaccgcac

SEQ ID NO: 244624 - DNA, 25 bp, Mus musculus
atcctagtgagggaggccaccgcac

SEQ ID NO: 244625 - DNA, 25 bp, Mus musculus
atcctagtgcaaagcgtctgagcct

SEQ ID NO: 244626 - DNA, 25 bp, Mus musculus
atcctagtgcaatgcgtctgagcct

SEQ ID NO: 244627 - DNA, 25 bp, Mus musculus
atcctagtgggcctgagcaggtttc

SEQ ID NO: 244628 - DNA, 25 bp, Mus musculus
atcctagtgggcgtgagcaggtttc

SEQ ID NO: 244629 - DNA, 25 bp, Mus musculus
atcctagttactatccctcatgttt

SEQ ID NO: 244630 - DNA, 25 bp, Mus musculus
atcctagttactttccctcatgttt

SEQ ID NO: 244631 - DNA, 25 bp, Mus musculus
atcctagttctaagggctgctgctc

SEQ ID NO: 244632 - DNA, 25 bp, Mus musculus
atcctagttctatgggctgctgctc

SEQ ID NO: 244633 - DNA, 25 bp, Mus musculus
atcctagttctgaaccatgggcaaa

SEQ ID NO: 244634 - DNA, 25 bp, Mus musculus
atcctagttctgtaccatgggcaaa

SEQ ID NO: 244635 - DNA, 25 bp, Mus musculus
atcctagtttgtctgtggacctcca

SEQ ID NO: 244636 - DNA, 25 bp, Mus musculus
atcctagtttgtgtgtggacctcca

SEQ ID NO: 244637 - DNA, 25 bp, Mus musculus
atcctataaccacttctgcctgtaa

SEQ ID NO: 244638 - DNA, 25 bp, Mus musculus
atcctataaccagttctgcctgtaa

SEQ ID NO: 244639 - DNA, 25 bp, Mus musculus
atcctataatatccctacagatgtg

SEQ ID NO: 244640 - DNA, 25 bp, Mus musculus
atcctataatatgcctacagatgtg

SEQ ID NO: 244641 - DNA, 25 bp, Mus musculus
atcctataccccagcaatggagatt

SEQ ID NO: 244642 - DNA, 25 bp, Mus musculus
atcctatacccctgcaatggagatt

SEQ ID NO: 244643 - DNA, 25 bp, Mus musculus
atcctatatttaagtcctctgccta

SEQ ID NO: 244644 - DNA, 25 bp, Mus musculus
atcctatatttatgtcctctgccta

SEQ ID NO: 244645 - DNA, 25 bp, Mus musculus
atcctatcagccactacagcgaaaa

SEQ ID NO: 244646 - DNA, 25 bp, Mus musculus
atcctatcagcctctacagcgaaaa

SEQ ID NO: 244647 - DNA, 25 bp, Mus musculus
atcctatcatttctgtaaccttgtc

SEQ ID NO: 244648 - DNA, 25 bp, Mus musculus
atcctatcatttgtgtaaccttgtc

SEQ ID NO: 244649 - DNA, 25 bp, Mus musculus
atcctatccacacctaagcagtaat

SEQ ID NO: 244650 - DNA, 25 bp, Mus musculus
atcctatccacagctaagcagtaat

SEQ ID NO: 244651 - DNA, 25 bp, Mus musculus
atcctatcccagcaggagataatca

SEQ ID NO: 244652 - DNA, 25 bp, Mus musculus
atcctatcccaggaggagataatca

SEQ ID NO: 244653 - DNA, 25 bp, Mus musculus
atcctatcctgcaactgaggatgca

SEQ ID NO: 244654 - DNA, 25 bp, Mus musculus
atcctatcctgctactgaggatgca

SEQ ID NO: 244655 - DNA, 25 bp, Mus musculus
atcctatctatcctatctgggaagg

SEQ ID NO: 244656 - DNA, 25 bp, Mus musculus
atcctatctatcgtatctgggaagg

SEQ ID NO: 244657 - DNA, 25 bp, Mus musculus
atcctatcttcccttctaaggtctt

SEQ ID NO: 244658 - DNA, 25 bp, Mus musculus
atcctatcttccgttctaaggtctt

SEQ ID NO: 244659 - DNA, 25 bp, Mus musculus
atcctatgacaaatcgttctacggc

SEQ ID NO: 244660 - DNA, 25 bp, Mus musculus
atcctatgacaattcgttctacggc

SEQ ID NO: 244661 - DNA, 25 bp, Mus musculus
atcctatgcaggctggaggaccctg

SEQ ID NO: 244662 - DNA, 25 bp, Mus musculus
atcctatgcagggtggaggaccctg

SEQ ID NO: 244663 - DNA, 25 bp, Mus musculus
atcctatgctgaatttgtgtggctg

SEQ ID NO: 244664 - DNA, 25 bp, Mus musculus
atcctatgctgattttgtgtggctg

SEQ ID NO: 244665 - DNA, 25 bp, Mus musculus
atcctatgctggctgggatttggct

SEQ ID NO: 244666 - DNA, 25 bp, Mus musculus
atcctatgctgggtgggatttggct

SEQ ID NO: 244667 - DNA, 25 bp, Mus musculus
atcctatgctgtatctgtcagggta

SEQ ID NO: 244668 - DNA, 25 bp, Mus musculus
atcctatgctgtttctgtcagggta

SEQ ID NO: 244669 - DNA, 25 bp, Mus musculus
atcctatgtaggactcggacgctgt

SEQ ID NO: 244670 - DNA, 25 bp, Mus musculus
atcctatgtaggtctcggacgctgt

SEQ ID NO: 244671 - DNA, 25 bp, Mus musculus
atcctatgttgcaggagctcgccaa

SEQ ID NO: 244672 - DNA, 25 bp, Mus musculus
atcctatgttgctggagctcgccaa

SEQ ID NO: 244673 - DNA, 25 bp, Mus musculus
atcctattaaccctagtatataagc

SEQ ID NO: 244674 - DNA, 25 bp, Mus musculus
atcctattaaccgtagtatataagc

SEQ ID NO: 244675 - DNA, 25 bp, Mus musculus
atcctattcaccatggaagttcctg

SEQ ID NO: 244676 - DNA, 25 bp, Mus musculus
atcctattcaccttggaagttcctg

SEQ ID NO: 244677 - DNA, 25 bp, Mus musculus
atcctattgaagatcctgatcctga

SEQ ID NO: 244678 - DNA, 25 bp, Mus musculus
atcctattgaagttcctgatcctga

SEQ ID NO: 244679 - DNA, 25 bp, Mus musculus
atcctattggcaactcgcttttaat

SEQ ID NO: 244680 - DNA, 25 bp, Mus musculus
atcctattggcatctcgcttttaat

SEQ ID NO: 244681 - DNA, 25 bp, Mus musculus
atcctatttaccatctttcctggag

SEQ ID NO: 244682 - DNA, 25 bp, Mus musculus
atcctatttaccttctttcctggag

SEQ ID NO: 244683 - DNA, 25 bp, Mus musculus
atcctatttagactggagggacaca

SEQ ID NO: 244684 - DNA, 25 bp, Mus musculus
atcctatttagagtggagggacaca

SEQ ID NO: 244685 - DNA, 25 bp, Mus musculus
atcctatttcttacgtttctctgct

SEQ ID NO: 244686 - DNA, 25 bp, Mus musculus
atcctatttctttcgtttctctgct

SEQ ID NO: 244687 - DNA, 25 bp, Mus musculus
atcctatttgagagtctccaggcct

SEQ ID NO: 244688 - DNA, 25 bp, Mus musculus
atcctatttgagtgtctccaggcct

SEQ ID NO: 244689 - DNA, 25 bp, Mus musculus
atcctatttggaagtctggaaatct

SEQ ID NO: 244690 - DNA, 25 bp, Mus musculus
atcctatttggatgtctggaaatct

SEQ ID NO: 244691 - DNA, 25 bp, Mus musculus
atcctcaacgaacaggagagcctta

SEQ ID NO: 244692 - DNA, 25 bp, Mus musculus
atcctcaacgaagaggagagcctta

SEQ ID NO: 244693 - DNA, 25 bp, Mus musculus
atcctcaagcttatttagtgcctta

SEQ ID NO: 244694 - DNA, 25 bp, Mus musculus
atcctcaagcttttttagtgcctta

SEQ ID NO: 244695 - DNA, 25 bp, Mus musculus
atcctcaaggataagtggtctgcac

SEQ ID NO: 244696 - DNA, 25 bp, Mus musculus
atcctcaaggattagtggtctgcac

SEQ ID NO: 244697 - DNA, 25 bp, Mus musculus
atcctcaatggactggccgcctttg

SEQ ID NO: 244698 - DNA, 25 bp, Mus musculus
atcctcaatggagtggccgcctttg

SEQ ID NO: 244699 - DNA, 25 bp, Mus musculus
atcctcaatgtcactcatttaatta

SEQ ID NO: 244700 - DNA, 25 bp, Mus musculus
atcctcaatgtctctcatttaatta

SEQ ID NO: 244701 - DNA, 25 bp, Mus musculus
atcctcacaaagacaccgggaacat

SEQ ID NO: 244702 - DNA, 25 bp, Mus musculus
atcctcacaaagtcaccgggaacat

SEQ ID NO: 244703 - DNA, 25 bp, Mus musculus
atcctcaccacacagcagcgaagag

SEQ ID NO: 244704 - DNA, 25 bp, Mus musculus
atcctcaccacagagcagcgaagag

SEQ ID NO: 244705 - DNA, 25 bp, Mus musculus
atcctcacccgcactgtaaaatgtt

SEQ ID NO: 244706 - DNA, 25 bp, Mus musculus
atcctcacccgctctgtaaaatgtt

SEQ ID NO: 244707 - DNA, 25 bp, Mus musculus
atcctcaccgcgaggctgtgggttg

SEQ ID NO: 244708 - DNA, 25 bp, Mus musculus
atcctcaccgcgtggctgtgggttg

SEQ ID NO: 244709 - DNA, 25 bp, Mus musculus
atcctcacctacctaaatgatggag

SEQ ID NO: 244710 - DNA, 25 bp, Mus musculus
atcctcacctacgtaaatgatggag

SEQ ID NO: 244711 - DNA, 25 bp, Mus musculus
atcctcacgcagactgtggacgaaa

SEQ ID NO: 244712 - DNA, 25 bp, Mus musculus
atcctcacgcagtctgtggacgaaa

SEQ ID NO: 244713 - DNA, 25 bp, Mus musculus
atcctcacggcaatagctgtgataa

SEQ ID NO: 244714 - DNA, 25 bp, Mus musculus
atcctcacggcattagctgtgataa

SEQ ID NO: 244715 - DNA, 25 bp, Mus musculus
atcctcactgagaagaattggttcc

SEQ ID NO: 244716 - DNA, 25 bp, Mus musculus
atcctcactgagctactgatggtgg

SEQ ID NO: 244717 - DNA, 25 bp, Mus musculus
atcctcactgaggtactgatggtgg

SEQ ID NO: 244718 - DNA, 25 bp, Mus musculus
atcctcactgagtagaattggttcc

SEQ ID NO: 244719 - DNA, 25 bp, Mus musculus
atcctcactgctatgagttgggtct

SEQ ID NO: 244720 - DNA, 25 bp, Mus musculus
atcctcactgctttgagttgggtct

SEQ ID NO: 244721 - DNA, 25 bp, Mus musculus
atcctcactggcaggttgtatgtgg

SEQ ID NO: 244722 - DNA, 25 bp, Mus musculus
atcctcactggctggttgtatgtgg

SEQ ID NO: 244723 - DNA, 25 bp, Mus musculus
atcctcacttctaaaagagcgctta

SEQ ID NO: 244724 - DNA, 25 bp, Mus musculus
atcctcacttcttaaagagcgctta

SEQ ID NO: 244725 - DNA, 25 bp, Mus musculus
atcctcacttggcacaaaagcctgg

SEQ ID NO: 244726 - DNA, 25 bp, Mus musculus
atcctcacttgggacaaaagcctgg

SEQ ID NO: 244727 - DNA, 25 bp, Mus musculus
atcctcacttgtaggctggaggcct

SEQ ID NO: 244728 - DNA, 25 bp, Mus musculus
atcctcacttgttggctggaggcct

SEQ ID NO: 244729 - DNA, 25 bp, Mus musculus
atcctcagaattcacatccgttttg

SEQ ID NO: 244730 - DNA, 25 bp, Mus musculus
atcctcagaattgacatccgttttg

SEQ ID NO: 244731 - DNA, 25 bp, Mus musculus
atcctcagacacacttagacatcac

SEQ ID NO: 244732 - DNA, 25 bp, Mus musculus
atcctcagacactcttagacatcac

SEQ ID NO: 244733 - DNA, 25 bp, Mus musculus
atcctcagacagcatgggctagaaa

SEQ ID NO: 244734 - DNA, 25 bp, Mus musculus
atcctcagacaggatgggctagaaa

SEQ ID NO: 244735 - DNA, 25 bp, Mus musculus
atcctcagagatctactttcctcct

SEQ ID NO: 244736 - DNA, 25 bp, Mus musculus
atcctcagagatgtactttcctcct

SEQ ID NO: 244737 - DNA, 25 bp, Mus musculus
atcctcagattccactcacagtttg

SEQ ID NO: 244738 - DNA, 25 bp, Mus musculus
atcctcagattcgactcacagtttg

SEQ ID NO: 244739 - DNA, 25 bp, Mus musculus
atcctcagcaatcttacatttcgtc

SEQ ID NO: 244740 - DNA, 25 bp, Mus musculus
atcctcagcaatgttacatttcgtc

SEQ ID NO: 244741 - DNA, 25 bp, Mus musculus
atcctcagcaccaaaagtctttctt

SEQ ID NO: 244742 - DNA, 25 bp, Mus musculus
atcctcagcacctaaagtctttctt

SEQ ID NO: 244743 - DNA, 25 bp, Mus musculus
atcctcagcggcatcctgctcatgg

SEQ ID NO: 244744 - DNA, 25 bp, Mus musculus
atcctcagcggcttcctgctcatgg

SEQ ID NO: 244745 - DNA, 25 bp, Mus musculus
atcctcaggaaaaacctatgttggt

SEQ ID NO: 244746 - DNA, 25 bp, Mus musculus
atcctcaggaaatacctatgttggt

SEQ ID NO: 244747 - DNA, 25 bp, Mus musculus
atcctcaggagaatgttccgtgtct

SEQ ID NO: 244748 - DNA, 25 bp, Mus musculus
atcctcaggagattgttccgtgtct

SEQ ID NO: 244749 - DNA, 25 bp, Mus musculus
atcctcaggatcatgcttttactct

SEQ ID NO: 244750 - DNA, 25 bp, Mus musculus
atcctcaggatcttgcttttactct

SEQ ID NO: 244751 - DNA, 25 bp, Mus musculus
atcctcaggctcatagtcttcttaa

SEQ ID NO: 244752 - DNA, 25 bp, Mus musculus
atcctcaggctcttagtcttcttaa

SEQ ID NO: 244753 - DNA, 25 bp, Mus musculus
atcctcaggctgaatgtgatatcaa

SEQ ID NO: 244754 - DNA, 25 bp, Mus musculus
atcctcaggctgagccttgaataat

SEQ ID NO: 244755 - DNA, 25 bp, Mus musculus
atcctcaggctgtatgtgatatcaa

SEQ ID NO: 244756 - DNA, 25 bp, Mus musculus
atcctcaggctgtgccttgaataat

SEQ ID NO: 244757 - DNA, 25 bp, Mus musculus
atcctcagggttacacaacttctta

SEQ ID NO: 244758 - DNA, 25 bp, Mus musculus
atcctcagggtttcacaacttctta

SEQ ID NO: 244759 - DNA, 25 bp, Mus musculus
atcctcaggtctatgggaaccatta

SEQ ID NO: 244760 - DNA, 25 bp, Mus musculus
atcctcaggtctttgggaaccatta

SEQ ID NO: 244761 - DNA, 25 bp, Mus musculus
atcctcaggtgtccagtcctttgat

SEQ ID NO: 244762 - DNA, 25 bp, Mus musculus
atcctcaggtgtgcagtcctttgat

SEQ ID NO: 244763 - DNA, 25 bp, Mus musculus
atcctcaggtttctctctcagactg

SEQ ID NO: 244764 - DNA, 25 bp, Mus musculus
atcctcaggtttgtctctcagactg

SEQ ID NO: 244765 - DNA, 25 bp, Mus musculus
atcctcagtaatacgctcaccctga

SEQ ID NO: 244766 - DNA, 25 bp, Mus musculus
atcctcagtaattcgctcaccctga

SEQ ID NO: 244767 - DNA, 25 bp, Mus musculus
atcctcagtctcactattcactgaa

SEQ ID NO: 244768 - DNA, 25 bp, Mus musculus
atcctcagtctctctattcactgaa

SEQ ID NO: 244769 - DNA, 25 bp, Mus musculus
atcctcagtcttctggttggctgaa

SEQ ID NO: 244770 - DNA, 25 bp, Mus musculus
atcctcagtcttgtggttggctgaa

SEQ ID NO: 244771 - DNA, 25 bp, Mus musculus
atcctcatagctaatatcatttgta

SEQ ID NO: 244772 - DNA, 25 bp, Mus musculus
atcctcatagcttatatcatttgta

SEQ ID NO: 244773 - DNA, 25 bp, Mus musculus
atcctcatcaacagcaccatacaag

SEQ ID NO: 244774 - DNA, 25 bp, Mus musculus
atcctcatcaactgcaccatacaag

SEQ ID NO: 244775 - DNA, 25 bp, Mus musculus
atcctcatcccaagatgccttaatc

SEQ ID NO: 244776 - DNA, 25 bp, Mus musculus
atcctcatcccatgatgccttaatc

SEQ ID NO: 244777 - DNA, 25 bp, Mus musculus
atcctcatcggactgtttgtgctct

SEQ ID NO: 244778 - DNA, 25 bp, Mus musculus
atcctcatcggagtgtttgtgctct

SEQ ID NO: 244779 - DNA, 25 bp, Mus musculus
atcctcatctctcttactcagtgtt

SEQ ID NO: 244780 - DNA, 25 bp, Mus musculus
atcctcatctctgttactcagtgtt

SEQ ID NO: 244781 - DNA, 25 bp, Mus musculus
atcctcatgacccagtagtggcttt

SEQ ID NO: 244782 - DNA, 25 bp, Mus musculus
atcctcatgaccgagtagtggcttt

SEQ ID NO: 244783 - DNA, 25 bp, Mus musculus
atcctcatggagcacatccacaagc

SEQ ID NO: 244784 - DNA, 25 bp, Mus musculus
atcctcatggaggacatccacaagc

SEQ ID NO: 244785 - DNA, 25 bp, Mus musculus
atcctcatgtatctgatgcccgagg

SEQ ID NO: 244786 - DNA, 25 bp, Mus musculus
atcctcatgtatgtgatgcccgagg

SEQ ID NO: 244787 - DNA, 25 bp, Mus musculus
atcctcattagccaagaagttttat

SEQ ID NO: 244788 - DNA, 25 bp, Mus musculus
atcctcattagcgaagaagttttat

SEQ ID NO: 244789 - DNA, 25 bp, Mus musculus
atcctcattataagtcctctgtacc

SEQ ID NO: 244790 - DNA, 25 bp, Mus musculus
atcctcattatatgtcctctgtacc

SEQ ID NO: 244791 - DNA, 25 bp, Mus musculus
atcctcattgaaattagtactactg

SEQ ID NO: 244792 - DNA, 25 bp, Mus musculus
atcctcattgaatttagtactactg

SEQ ID NO: 244793 - DNA, 25 bp, Mus musculus
atcctcattgagcttagtccttgtt

SEQ ID NO: 244794 - DNA, 25 bp, Mus musculus
atcctcattgaggttagtccttgtt

SEQ ID NO: 244795 - DNA, 25 bp, Mus musculus
atcctcattggcatgtgtctcaccc

SEQ ID NO: 244796 - DNA, 25 bp, Mus musculus
atcctcattggcttgtgtctcaccc

SEQ ID NO: 244797 - DNA, 25 bp, Mus musculus
atcctccaaagaaaaccttgattac

SEQ ID NO: 244798 - DNA, 25 bp, Mus musculus
atcctccaaagataaccttgattac

SEQ ID NO: 244799 - DNA, 25 bp, Mus musculus
atcctccaaagcactgggcctggag

SEQ ID NO: 244800 - DNA, 25 bp, Mus musculus
atcctccaaagctctgggcctggag

SEQ ID NO: 244801 - DNA, 25 bp, Mus musculus
atcctccaagaaatgtacgtggttg

SEQ ID NO: 244802 - DNA, 25 bp, Mus musculus
atcctccaagaattgtacgtggttg

SEQ ID NO: 244803 - DNA, 25 bp, Mus musculus
atcctccaatgcctgagagttcaag

SEQ ID NO: 244804 - DNA, 25 bp, Mus musculus
atcctccaatgcgtgagagttcaag

SEQ ID NO: 244805 - DNA, 25 bp, Mus musculus
atcctccacgctatcagttcttatg

SEQ ID NO: 244806 - DNA, 25 bp, Mus musculus
atcctccacgctttcagttcttatg

SEQ ID NO: 244807 - DNA, 25 bp, Mus musculus
atcctccagagcacactcacagatg

SEQ ID NO: 244808 - DNA, 25 bp, Mus musculus
atcctccagagctcactcacagatg

SEQ ID NO: 244809 - DNA, 25 bp, Mus musculus
atcctccagctgaccattgtgtgtg

SEQ ID NO: 244810 - DNA, 25 bp, Mus musculus
atcctccagctgtccattgtgtgtg

SEQ ID NO: 244811 - DNA, 25 bp, Mus musculus
atcctccagggaatatcggtatctc

SEQ ID NO: 244812 - DNA, 25 bp, Mus musculus
atcctccagggattatcggtatctc

SEQ ID NO: 244813 - DNA, 25 bp, Mus musculus
atcctccagtacaccaatgtgtatt

SEQ ID NO: 244814 - DNA, 25 bp, Mus musculus
atcctccagtactccaatgtgtatt

SEQ ID NO: 244815 - DNA, 25 bp, Mus musculus
atcctccagttgatgtctagctaca

SEQ ID NO: 244816 - DNA, 25 bp, Mus musculus
atcctccagttgttgtctagctaca

SEQ ID NO: 244817 - DNA, 25 bp, Mus musculus
atcctccatcacacagcatgtgcaa

SEQ ID NO: 244818 - DNA, 25 bp, Mus musculus
atcctccatcactcagcatgtgcaa

SEQ ID NO: 244819 - DNA, 25 bp, Mus musculus
atcctccatgaaacatctccttgta

SEQ ID NO: 244820 - DNA, 25 bp, Mus musculus
atcctccatgaatcatctccttgta

SEQ ID NO: 244821 - DNA, 25 bp, Mus musculus
atcctccatgctatcggttccaatg

SEQ ID NO: 244822 - DNA, 25 bp, Mus musculus
atcctccatgctttcggttccaatg

SEQ ID NO: 244823 - DNA, 25 bp, Mus musculus
atcctccatgtcattattcagaaca

SEQ ID NO: 244824 - DNA, 25 bp, Mus musculus
atcctccatgtctttattcagaaca

SEQ ID NO: 244825 - DNA, 25 bp, Mus musculus
atcctccatgttccctgggctttat

SEQ ID NO: 244826 - DNA, 25 bp, Mus musculus
atcctccatgttgcctgggctttat

SEQ ID NO: 244827 - DNA, 25 bp, Mus musculus
atcctcccaggacattgatttactc

SEQ ID NO: 244828 - DNA, 25 bp, Mus musculus
atcctcccaggagattgatttactc

SEQ ID NO: 244829 - DNA, 25 bp, Mus musculus
atcctcccctggacagacattttaa

SEQ ID NO: 244830 - DNA, 25 bp, Mus musculus
atcctcccctggtcagacattttaa

SEQ ID NO: 244831 - DNA, 25 bp, Mus musculus
atcctcccgggcattgcaataggta

SEQ ID NO: 244832 - DNA, 25 bp, Mus musculus
atcctcccgggctttgcaataggta

SEQ ID NO: 244833 - DNA, 25 bp, Mus musculus
atcctcccttacattgctggcaata

SEQ ID NO: 244834 - DNA, 25 bp, Mus musculus
atcctcccttactttgctggcaata

SEQ ID NO: 244835 - DNA, 25 bp, Mus musculus
atcctcccttgaagtcattcttaca

SEQ ID NO: 244836 - DNA, 25 bp, Mus musculus
atcctcccttgatgtcattcttaca

SEQ ID NO: 244837 - DNA, 25 bp, Mus musculus
atcctccggaccagactgagacatg

SEQ ID NO: 244838 - DNA, 25 bp, Mus musculus
atcctccggacctgactgagacatg

SEQ ID NO: 244839 - DNA, 25 bp, Mus musculus
atcctccgtctgatgagaaccagtc

SEQ ID NO: 244840 - DNA, 25 bp, Mus musculus
atcctccgtctgttgagaaccagtc

SEQ ID NO: 244841 - DNA, 25 bp, Mus musculus
atcctcctacacagattcttgttgg

SEQ ID NO: 244842 - DNA, 25 bp, Mus musculus
atcctcctacactgattcttgttgg

SEQ ID NO: 244843 - DNA, 25 bp, Mus musculus
atcctcctacatcagttgcttcaaa

SEQ ID NO: 244844 - DNA, 25 bp, Mus musculus
atcctcctacatgagttgcttcaaa

SEQ ID NO: 244845 - DNA, 25 bp, Mus musculus
atcctcctaggaattagttcacaca

SEQ ID NO: 244846 - DNA, 25 bp, Mus musculus
atcctcctaggatttagttcacaca

SEQ ID NO: 244847 - DNA, 25 bp, Mus musculus
atcctcctctacacatttacctaga

SEQ ID NO: 244848 - DNA, 25 bp, Mus musculus
atcctcctctactcatttacctaga

SEQ ID NO: 244849 - DNA, 25 bp, Mus musculus
atcctcctctatcctttcttttgat

SEQ ID NO: 244850 - DNA, 25 bp, Mus musculus
atcctcctctatgctttcttttgat

SEQ ID NO: 244851 - DNA, 25 bp, Mus musculus
atcctcctgaaaataatcattcctg

SEQ ID NO: 244852 - DNA, 25 bp, Mus musculus
atcctcctgaaacatccatttgtcg

SEQ ID NO: 244853 - DNA, 25 bp, Mus musculus
atcctcctgaaagatccatttgtcg

SEQ ID NO: 244854 - DNA, 25 bp, Mus musculus
atcctcctgaaattaatcattcctg

SEQ ID NO: 244855 - DNA, 25 bp, Mus musculus
atcctcctgagtctaatttcgctgc

SEQ ID NO: 244856 - DNA, 25 bp, Mus musculus
atcctcctgagtgtaatttcgctgc

SEQ ID NO: 244857 - DNA, 25 bp, Mus musculus
atcctcctggccagtttgatggtca

SEQ ID NO: 244858 - DNA, 25 bp, Mus musculus
atcctcctggcctgtttgatggtca

SEQ ID NO: 244859 - DNA, 25 bp, Mus musculus
atcctcctgggacgacaggtggcta

SEQ ID NO: 244860 - DNA, 25 bp, Mus musculus
atcctcctgggaggacaggtggcta

SEQ ID NO: 244861 - DNA, 25 bp, Mus musculus
atcctcctgttacaggcctaatcct

SEQ ID NO: 244862 - DNA, 25 bp, Mus musculus
atcctcctgttagaggcctaatcct

SEQ ID NO: 244863 - DNA, 25 bp, Mus musculus
atcctcctgttgagcaaccatacct

SEQ ID NO: 244864 - DNA, 25 bp, Mus musculus
atcctcctgttgtgcaaccatacct

SEQ ID NO: 244865 - DNA, 25 bp, Mus musculus
atcctccttgctcgggcttcttggc

SEQ ID NO: 244866 - DNA, 25 bp, Mus musculus
atcctccttgctggggcttcttggc

SEQ ID NO: 244867 - DNA, 25 bp, Mus musculus
atcctcctttagactcatgtgtcac

SEQ ID NO: 244868 - DNA, 25 bp, Mus musculus
atcctcctttagtctcatgtgtcac

SEQ ID NO: 244869 - DNA, 25 bp, Mus musculus
atcctcctttcacttgggctgactt

SEQ ID NO: 244870 - DNA, 25 bp, Mus musculus
atcctcctttcagttgggctgactt

SEQ ID NO: 244871 - DNA, 25 bp, Mus musculus
atcctcctttggaagcttacatggc

SEQ ID NO: 244872 - DNA, 25 bp, Mus musculus
atcctcctttggtagcttacatggc

SEQ ID NO: 244873 - DNA, 25 bp, Mus musculus
atcctcctttgtccaacattttatc

SEQ ID NO: 244874 - DNA, 25 bp, Mus musculus
atcctcctttgtgcaacattttatc

SEQ ID NO: 244875 - DNA, 25 bp, Mus musculus
atcctccttttgcatttttctccat

SEQ ID NO: 244876 - DNA, 25 bp, Mus musculus
atcctccttttggatttttctccat

SEQ ID NO: 244877 - DNA, 25 bp, Mus musculus
atcctcgaacgtcggatgcagaggc

SEQ ID NO: 244878 - DNA, 25 bp, Mus musculus
atcctcgaacgtgggatgcagaggc

SEQ ID NO: 244879 - DNA, 25 bp, Mus musculus
atcctcgagggcatgcacatttggc

SEQ ID NO: 244880 - DNA, 25 bp, Mus musculus
atcctcgagggcttgcacatttggc

SEQ ID NO: 244881 - DNA, 25 bp, Mus musculus
atcctcgagtacagcctgtcaggca

SEQ ID NO: 244882 - DNA, 25 bp, Mus musculus
atcctcgagtactgcctgtcaggca

SEQ ID NO: 244883 - DNA, 25 bp, Mus musculus
atcctcgcaaagcaagaaaccccag

SEQ ID NO: 244884 - DNA, 25 bp, Mus musculus
atcctcgcaaaggaagaaaccccag

SEQ ID NO: 244885 - DNA, 25 bp, Mus musculus
atcctcgcacagatctcgatttgaa

SEQ ID NO: 244886 - DNA, 25 bp, Mus musculus
atcctcgcacagttctcgatttgaa

SEQ ID NO: 244887 - DNA, 25 bp, Mus musculus
atcctcgcacccaggcttttatttt

SEQ ID NO: 244888 - DNA, 25 bp, Mus musculus
atcctcgcaccctggcttttatttt

SEQ ID NO: 244889 - DNA, 25 bp, Mus musculus
atcctcgccgtcactgctgcaaata

SEQ ID NO: 244890 - DNA, 25 bp, Mus musculus
atcctcgccgtctctgctgcaaata

SEQ ID NO: 244891 - DNA, 25 bp, Mus musculus
atcctcgcgggaagacttcttccgt

SEQ ID NO: 244892 - DNA, 25 bp, Mus musculus
atcctcgcgggatgacttcttccgt

SEQ ID NO: 244893 - DNA, 25 bp, Mus musculus
atcctcgctattcgagctggcatta

SEQ ID NO: 244894 - DNA, 25 bp, Mus musculus
atcctcgctattggagctggcatta

SEQ ID NO: 244895 - DNA, 25 bp, Mus musculus
atcctcgctcctccaaaatatcttg

SEQ ID NO: 244896 - DNA, 25 bp, Mus musculus
atcctcgctcctgcaaaatatcttg

SEQ ID NO: 244897 - DNA, 25 bp, Mus musculus
atcctcgctcttcttccaagggaga

SEQ ID NO: 244898 - DNA, 25 bp, Mus musculus
atcctcgctcttgttccaagggaga

SEQ ID NO: 244899 - DNA, 25 bp, Mus musculus
atcctcggaagactgcgcccaggag

SEQ ID NO: 244900 - DNA, 25 bp, Mus musculus
atcctcggaagagtgcgcccaggag

SEQ ID NO: 244901 - DNA, 25 bp, Mus musculus
atcctcggccctcatgctctttgga

SEQ ID NO: 244902 - DNA, 25 bp, Mus musculus
atcctcggccctgatgctctttgga

SEQ ID NO: 244903 - DNA, 25 bp, Mus musculus
atcctcgggaaaccgctcacagaag

SEQ ID NO: 244904 - DNA, 25 bp, Mus musculus
atcctcgggaaagcgctcacagaag

SEQ ID NO: 244905 - DNA, 25 bp, Mus musculus
atcctcggtcggcagtctccacttt

SEQ ID NO: 244906 - DNA, 25 bp, Mus musculus
atcctcggtcgggagtctccacttt

SEQ ID NO: 244907 - DNA, 25 bp, Mus musculus
atcctcgtcatccttgagcagagct

SEQ ID NO: 244908 - DNA, 25 bp, Mus musculus
atcctcgtcatcgttgagcagagct

SEQ ID NO: 244909 - DNA, 25 bp, Mus musculus
atcctcgtccatcgttgttactatc

SEQ ID NO: 244910 - DNA, 25 bp, Mus musculus
atcctcgtccatggttgttactatc

SEQ ID NO: 244911 - DNA, 25 bp, Mus musculus
atcctcgtggctacgttaataagta

SEQ ID NO: 244912 - DNA, 25 bp, Mus musculus
atcctcgtggcttcgttaataagta

SEQ ID NO: 244913 - DNA, 25 bp, Mus musculus
atcctctacctcatacagtctctaa

SEQ ID NO: 244914 - DNA, 25 bp, Mus musculus
atcctctacctcttacagtctctaa

SEQ ID NO: 244915 - DNA, 25 bp, Mus musculus
atcctctaggatcgtaactgttcag

SEQ ID NO: 244916 - DNA, 25 bp, Mus musculus
atcctctaggatggtaactgttcag

SEQ ID NO: 244917 - DNA, 25 bp, Mus musculus
atcctctagggcacgagactttccg

SEQ ID NO: 244918 - DNA, 25 bp, Mus musculus
atcctctagggctcgagactttccg

SEQ ID NO: 244919 - DNA, 25 bp, Mus musculus
atcctctcagggactcagggtttga

SEQ ID NO: 244920 - DNA, 25 bp, Mus musculus
atcctctcagggtctcagggtttga

SEQ ID NO: 244921 - DNA, 25 bp, Mus musculus
atcctctcaggtcgtaatgccttgt

SEQ ID NO: 244922 - DNA, 25 bp, Mus musculus
atcctctcaggtggtaatgccttgt

SEQ ID NO: 244923 - DNA, 25 bp, Mus musculus
atcctctcagtcattgtgaccagtg

SEQ ID NO: 244924 - DNA, 25 bp, Mus musculus
atcctctcagtctttgtgaccagtg

SEQ ID NO: 244925 - DNA, 25 bp, Mus musculus
atcctctcatgcacagaattctcgt

SEQ ID NO: 244926 - DNA, 25 bp, Mus musculus
atcctctcatgctcagaattctcgt

SEQ ID NO: 244927 - DNA, 25 bp, Mus musculus
atcctctccaggcaactgatgtgga

SEQ ID NO: 244928 - DNA, 25 bp, Mus musculus
atcctctccaggcatttgagtggac

SEQ ID NO: 244929 - DNA, 25 bp, Mus musculus
atcctctccagggaactgatgtgga

SEQ ID NO: 244930 - DNA, 25 bp, Mus musculus
atcctctccagggatttgagtggac

SEQ ID NO: 244931 - DNA, 25 bp, Mus musculus
atcctctcctataagaagtcttcta

SEQ ID NO: 244932 - DNA, 25 bp, Mus musculus
atcctctcctattagaagtcttcta

SEQ ID NO: 244933 - DNA, 25 bp, Mus musculus
atcctctcctgaccagactgtggca

SEQ ID NO: 244934 - DNA, 25 bp, Mus musculus
atcctctcctgagcagactgtggca

SEQ ID NO: 244935 - DNA, 25 bp, Mus musculus
atcctctcctggaagatgaccccaa

SEQ ID NO: 244936 - DNA, 25 bp, Mus musculus
atcctctcctggtagatgaccccaa

SEQ ID NO: 244937 - DNA, 25 bp, Mus musculus
atcctctctacaatctattctctaa

SEQ ID NO: 244938 - DNA, 25 bp, Mus musculus
atcctctctacattctattctctaa

SEQ ID NO: 244939 - DNA, 25 bp, Mus musculus
atcctctctaccactatttcttctt

SEQ ID NO: 244940 - DNA, 25 bp, Mus musculus
atcctctctacctctatttcttctt

SEQ ID NO: 244941 - DNA, 25 bp, Mus musculus
atcctctctcagatctgctgaaact

SEQ ID NO: 244942 - DNA, 25 bp, Mus musculus
atcctctctcagttctgctgaaact

SEQ ID NO: 244943 - DNA, 25 bp, Mus musculus
atcctctctcccatgggaaacttta

SEQ ID NO: 244944 - DNA, 25 bp, Mus musculus
atcctctctcccttgggaaacttta

SEQ ID NO: 244945 - DNA, 25 bp, Mus musculus
atcctctctcgaaagtggctcacac

SEQ ID NO: 244946 - DNA, 25 bp, Mus musculus
atcctctctcgatagtggctcacac

SEQ ID NO: 244947 - DNA, 25 bp, Mus musculus
atcctctctgtgacaagtggttaca

SEQ ID NO: 244948 - DNA, 25 bp, Mus musculus
atcctctctgtgtcaagtggttaca

SEQ ID NO: 244949 - DNA, 25 bp, Mus musculus
atcctctgaatgatttcccttggac

SEQ ID NO: 244950 - DNA, 25 bp, Mus musculus
atcctctgaatgttttcccttggac

SEQ ID NO: 244951 - DNA, 25 bp, Mus musculus
atcctctgactgacagggcactgtt

SEQ ID NO: 244952 - DNA, 25 bp, Mus musculus
atcctctgactgtcagggcactgtt

SEQ ID NO: 244953 - DNA, 25 bp, Mus musculus
atcctctgagctacacacataacat

SEQ ID NO: 244954 - DNA, 25 bp, Mus musculus
atcctctgagcttcacacataacat

SEQ ID NO: 244955 - DNA, 25 bp, Mus musculus
atcctctgctgtagaatcacatcct

SEQ ID NO: 244956 - DNA, 25 bp, Mus musculus
atcctctgctgttgaatcacatcct

SEQ ID NO: 244957 - DNA, 25 bp, Mus musculus
atcctctggagtcttgtgctttcac

SEQ ID NO: 244958 - DNA, 25 bp, Mus musculus
atcctctggagtgttgtgctttcac

SEQ ID NO: 244959 - DNA, 25 bp, Mus musculus
atcctctgggtgctgtggatgttac

SEQ ID NO: 244960 - DNA, 25 bp, Mus musculus
atcctctgggtggtgtggatgttac

SEQ ID NO: 244961 - DNA, 25 bp, Mus musculus
atcctctggtagaactatgtcaaag

SEQ ID NO: 244962 - DNA, 25 bp, Mus musculus
atcctctggtagtactatgtcaaag

SEQ ID NO: 244963 - DNA, 25 bp, Mus musculus
atcctctgtccacactgtcatggaa

SEQ ID NO: 244964 - DNA, 25 bp, Mus musculus
atcctctgtccagactgtcatggaa

SEQ ID NO: 244965 - DNA, 25 bp, Mus musculus
atcctctgtgcgagctagcatgggt

SEQ ID NO: 244966 - DNA, 25 bp, Mus musculus
atcctctgtgcgctctggagtgagc

SEQ ID NO: 244967 - DNA, 25 bp, Mus musculus
atcctctgtgcggtctggagtgagc

SEQ ID NO: 244968 - DNA, 25 bp, Mus musculus
atcctctgtgcgtgctagcatgggt

SEQ ID NO: 244969 - DNA, 25 bp, Mus musculus
atcctctgtgtacgctacttgccat

SEQ ID NO: 244970 - DNA, 25 bp, Mus musculus
atcctctgtgtaggctacttgccat

SEQ ID NO: 244971 - DNA, 25 bp, Mus musculus
atcctcttagggaagacactgtctt

SEQ ID NO: 244972 - DNA, 25 bp, Mus musculus
atcctcttagggtagacactgtctt

SEQ ID NO: 244973 - DNA, 25 bp, Mus musculus
atcctcttaggtcaccagctggtcc

SEQ ID NO: 244974 - DNA, 25 bp, Mus musculus
atcctcttaggtgaccagctggtcc

SEQ ID NO: 244975 - DNA, 25 bp, Mus musculus
atcctcttcattacttgctatcaca

SEQ ID NO: 244976 - DNA, 25 bp, Mus musculus
atcctcttcatttcttgctatcaca

SEQ ID NO: 244977 - DNA, 25 bp, Mus musculus
atcctcttccaaacaccttgaaagc

SEQ ID NO: 244978 - DNA, 25 bp, Mus musculus
atcctcttccaatcaccttgaaagc

SEQ ID NO: 244979 - DNA, 25 bp, Mus musculus
atcctcttccagactctagtgacta

SEQ ID NO: 244980 - DNA, 25 bp, Mus musculus
atcctcttccagtctctagtgacta

SEQ ID NO: 244981 - DNA, 25 bp, Mus musculus
atcctcttcctaaaacctgtggtct

SEQ ID NO: 244982 - DNA, 25 bp, Mus musculus
atcctcttcctataacctgtggtct

SEQ ID NO: 244983 - DNA, 25 bp, Mus musculus
atcctcttcctgactagtgatgcac

SEQ ID NO: 244984 - DNA, 25 bp, Mus musculus
atcctcttcctgtctagtgatgcac

SEQ ID NO: 244985 - DNA, 25 bp, Mus musculus
atcctcttctctagtgctgtctatt

SEQ ID NO: 244986 - DNA, 25 bp, Mus musculus
atcctcttctcttgtgctgtctatt

SEQ ID NO: 244987 - DNA, 25 bp, Mus musculus
atcctcttctgcagtcacaggaaac

SEQ ID NO: 244988 - DNA, 25 bp, Mus musculus
atcctcttctgctgtcacaggaaac

SEQ ID NO: 244989 - DNA, 25 bp, Mus musculus
atcctcttctttcgcagaatctcct

SEQ ID NO: 244990 - DNA, 25 bp, Mus musculus
atcctcttctttggcagaatctcct

SEQ ID NO: 244991 - DNA, 25 bp, Mus musculus
atcctcttgacacttgcaagcctgc

SEQ ID NO: 244992 - DNA, 25 bp, Mus musculus
atcctcttgacagttgcaagcctgc

SEQ ID NO: 244993 - DNA, 25 bp, Mus musculus
atcctcttgcggcacagtcctggta

SEQ ID NO: 244994 - DNA, 25 bp, Mus musculus
atcctcttgcgggacagtcctggta

SEQ ID NO: 244995 - DNA, 25 bp, Mus musculus
atcctcttgtgaaggctgaattcct

SEQ ID NO: 244996 - DNA, 25 bp, Mus musculus
atcctcttgtgatggctgaattcct

SEQ ID NO: 244997 - DNA, 25 bp, Mus musculus
atcctcttgttgcaggtgctgctaa

SEQ ID NO: 244998 - DNA, 25 bp, Mus musculus
atcctcttgttggaggtgctgctaa

SEQ ID NO: 244999 - DNA, 25 bp, Mus musculus
atcctctttaagaccgactgcaaaa

SEQ ID NO: 245000 - DNA, 25 bp, Mus musculus
atcctctttaagtccgactgcaaaa

SEQ ID NO: 245001 - DNA, 25 bp, Mus musculus
atcctctttcttctagccttttgac

SEQ ID NO: 245002 - DNA, 25 bp, Mus musculus
atcctctttcttgtagccttttgac

SEQ ID NO: 245003 - DNA, 25 bp, Mus musculus
atcctgaaccagcaatgcctatggg

SEQ ID NO: 245004 - DNA, 25 bp, Mus musculus
atcctgaaccaggaatgcctatggg

SEQ ID NO: 245005 - DNA, 25 bp, Mus musculus
atcctgaacgctctcactctagaag

SEQ ID NO: 245006 - DNA, 25 bp, Mus musculus
atcctgaacgctgtcactctagaag

SEQ ID NO: 245007 - DNA, 25 bp, Mus musculus
atcctgaagcatatgaggcacctta

SEQ ID NO: 245008 - DNA, 25 bp, Mus musculus
atcctgaagcatttgaggcacctta

SEQ ID NO: 245009 - DNA, 25 bp, Mus musculus
atcctgaagcgcaaccaggtgacag

SEQ ID NO: 245010 - DNA, 25 bp, Mus musculus
atcctgaagcgctaccaggtgacag

SEQ ID NO: 245011 - DNA, 25 bp, Mus musculus
atcctgaaggacaccatgggacgtg

SEQ ID NO: 245012 - DNA, 25 bp, Mus musculus
atcctgaaggaccagggctttgcct

SEQ ID NO: 245013 - DNA, 25 bp, Mus musculus
atcctgaaggacgagggctttgcct

SEQ ID NO: 245014 - DNA, 25 bp, Mus musculus
atcctgaaggactccatgggacgtg

SEQ ID NO: 245015 - DNA, 25 bp, Mus musculus
atcctgaaggagctcctcagatatg

SEQ ID NO: 245016 - DNA, 25 bp, Mus musculus
atcctgaaggaggtcctcagatatg

SEQ ID NO: 245017 - DNA, 25 bp, Mus musculus
atcctgaagttaaggcaaaggtaaa

SEQ ID NO: 245018 - DNA, 25 bp, Mus musculus
atcctgaagttatggcaaaggtaaa

SEQ ID NO: 245019 - DNA, 25 bp, Mus musculus
atcctgaagttcaaagactagatct

SEQ ID NO: 245020 - DNA, 25 bp, Mus musculus
atcctgaagttctaagactagatct

SEQ ID NO: 245021 - DNA, 25 bp, Mus musculus
atcctgaatcttctctgtacgcaaa

SEQ ID NO: 245022 - DNA, 25 bp, Mus musculus
atcctgaatcttgtctgtacgcaaa

SEQ ID NO: 245023 - DNA, 25 bp, Mus musculus
atcctgaatgcgacttgcaggtcag

SEQ ID NO: 245024 - DNA, 25 bp, Mus musculus
atcctgaatgcgtcttgcaggtcag

SEQ ID NO: 245025 - DNA, 25 bp, Mus musculus
atcctgacaccgagcacctggttgg

SEQ ID NO: 245026 - DNA, 25 bp, Mus musculus
atcctgacaccgtgcacctggttgg

SEQ ID NO: 245027 - DNA, 25 bp, Mus musculus
atcctgacaggaactgatttaccta

SEQ ID NO: 245028 - DNA, 25 bp, Mus musculus
atcctgacaggatctgatttaccta

SEQ ID NO: 245029 - DNA, 25 bp, Mus musculus
atcctgaccaaacatgttgctttcc

SEQ ID NO: 245030 - DNA, 25 bp, Mus musculus
atcctgaccaaagatgttgctttcc

SEQ ID NO: 245031 - DNA, 25 bp, Mus musculus
atcctgaccacaagaacaatttggg

SEQ ID NO: 245032 - DNA, 25 bp, Mus musculus
atcctgaccacatgaacaatttggg

SEQ ID NO: 245033 - DNA, 25 bp, Mus musculus
atcctgaccatactgaccatatcaa

SEQ ID NO: 245034 - DNA, 25 bp, Mus musculus
atcctgaccatagtgaccatatcaa

SEQ ID NO: 245035 - DNA, 25 bp, Mus musculus
atcctgaccatcactataccctggg

SEQ ID NO: 245036 - DNA, 25 bp, Mus musculus
atcctgaccatctctataccctggg

SEQ ID NO: 245037 - DNA, 25 bp, Mus musculus
atcctgacccacatgtagatctgta

SEQ ID NO: 245038 - DNA, 25 bp, Mus musculus
atcctgacccacttgtagatctgta

SEQ ID NO: 245039 - DNA, 25 bp, Mus musculus
atcctgaccccgagttaacaacata

SEQ ID NO: 245040 - DNA, 25 bp, Mus musculus
atcctgaccccgtgttaacaacata

SEQ ID NO: 245041 - DNA, 25 bp, Mus musculus
atcctgacggccatccggaagaagg

SEQ ID NO: 245042 - DNA, 25 bp, Mus musculus
atcctgacggccttccggaagaagg

SEQ ID NO: 245043 - DNA, 25 bp, Mus musculus
atcctgactatgaggtcacctgggc

SEQ ID NO: 245044 - DNA, 25 bp, Mus musculus
atcctgactatgtggtcacctgggc

SEQ ID NO: 245045 - DNA, 25 bp, Mus musculus
atcctgactcacacggaagcacggg

SEQ ID NO: 245046 - DNA, 25 bp, Mus musculus
atcctgactcactcggaagcacggg

SEQ ID NO: 245047 - DNA, 25 bp, Mus musculus
atcctgactcatcactgtgaaccac

SEQ ID NO: 245048 - DNA, 25 bp, Mus musculus
atcctgactcatgactgtgaaccac

SEQ ID NO: 245049 - DNA, 25 bp, Mus musculus
atcctgactgaactagaatccctgg

SEQ ID NO: 245050 - DNA, 25 bp, Mus musculus
atcctgactgaagtagaatccctgg

SEQ ID NO: 245051 - DNA, 25 bp, Mus musculus
atcctgactgttctgtcctgggcaa

SEQ ID NO: 245052 - DNA, 25 bp, Mus musculus
atcctgactgttgtgtcctgggcaa

SEQ ID NO: 245053 - DNA, 25 bp, Mus musculus
atcctgagaacacttctcccaacgt

SEQ ID NO: 245054 - DNA, 25 bp, Mus musculus
atcctgagaacagttctcccaacgt

SEQ ID NO: 245055 - DNA, 25 bp, Mus musculus
atcctgagagtgacaaaaatactgg

SEQ ID NO: 245056 - DNA, 25 bp, Mus musculus
atcctgagagtgtcaaaaatactgg

SEQ ID NO: 245057 - DNA, 25 bp, Mus musculus
atcctgagcgttcctccataagaaa

SEQ ID NO: 245058 - DNA, 25 bp, Mus musculus
atcctgagcgttgctccataagaaa

SEQ ID NO: 245059 - DNA, 25 bp, Mus musculus
atcctgagctgtccaagtaacatta

SEQ ID NO: 245060 - DNA, 25 bp, Mus musculus
atcctgagctgtgcaagtaacatta

SEQ ID NO: 245061 - DNA, 25 bp, Mus musculus
atcctgaggctacagactctgttcc

SEQ ID NO: 245062 - DNA, 25 bp, Mus musculus
atcctgaggctagagactctgttcc

SEQ ID NO: 245063 - DNA, 25 bp, Mus musculus
atcctgagggtacatccattccaca

SEQ ID NO: 245064 - DNA, 25 bp, Mus musculus
atcctgagggtagatccattccaca

SEQ ID NO: 245065 - DNA, 25 bp, Mus musculus
atcctgaggtcaccttctctatgca

SEQ ID NO: 245066 - DNA, 25 bp, Mus musculus
atcctgaggtcagcttctctatgca

SEQ ID NO: 245067 - DNA, 25 bp, Mus musculus
atcctgagtagaactatgtccctgc

SEQ ID NO: 245068 - DNA, 25 bp, Mus musculus
atcctgagtagatctatgtccctgc

SEQ ID NO: 245069 - DNA, 25 bp, Mus musculus
atcctgagttgtcatctgagtccac

SEQ ID NO: 245070 - DNA, 25 bp, Mus musculus
atcctgagttgtgatctgagtccac

SEQ ID NO: 245071 - DNA, 25 bp, Mus musculus
atcctgagttttcctctaggccaat

SEQ ID NO: 245072 - DNA, 25 bp, Mus musculus
atcctgagttttgctctaggccaat

SEQ ID NO: 245073 - DNA, 25 bp, Mus musculus
atcctgatatacaccatccagtttg

SEQ ID NO: 245074 - DNA, 25 bp, Mus musculus
atcctgatatactccatccagtttg

SEQ ID NO: 245075 - DNA, 25 bp, Mus musculus
atcctgattgctccagctaggcttt

SEQ ID NO: 245076 - DNA, 25 bp, Mus musculus
atcctgattgctgcagctaggcttt

SEQ ID NO: 245077 - DNA, 25 bp, Mus musculus
atcctgcaaactaccctgggtgagt

SEQ ID NO: 245078 - DNA, 25 bp, Mus musculus
atcctgcaaacttccctgggtgagt

SEQ ID NO: 245079 - DNA, 25 bp, Mus musculus
atcctgcaaatcaatgggttcaaac

SEQ ID NO: 245080 - DNA, 25 bp, Mus musculus
atcctgcaaatctatgggttcaaac

SEQ ID NO: 245081 - DNA, 25 bp, Mus musculus
atcctgcaatttattgggtcaagct

SEQ ID NO: 245082 - DNA, 25 bp, Mus musculus
atcctgcaattttttgggtcaagct

SEQ ID NO: 245083 - DNA, 25 bp, Mus musculus
atcctgcacaggcaccagcatgata

SEQ ID NO: 245084 - DNA, 25 bp, Mus musculus
atcctgcacagggaccagcatgata

SEQ ID NO: 245085 - DNA, 25 bp, Mus musculus
atcctgcacctcctggtcaagggca

SEQ ID NO: 245086 - DNA, 25 bp, Mus musculus
atcctgcacctcgtggtcaagggca

SEQ ID NO: 245087 - DNA, 25 bp, Mus musculus
atcctgcacctgatgctgggttcac

SEQ ID NO: 245088 - DNA, 25 bp, Mus musculus
atcctgcacctgttgctgggttcac

SEQ ID NO: 245089 - DNA, 25 bp, Mus musculus
atcctgcagcccaaacacagagagg

SEQ ID NO: 245090 - DNA, 25 bp, Mus musculus
atcctgcagccctaacacagagagg

SEQ ID NO: 245091 - DNA, 25 bp, Mus musculus
atcctgcagctgaaggctaatgact

SEQ ID NO: 245092 - DNA, 25 bp, Mus musculus
atcctgcagctgtaggctaatgact

SEQ ID NO: 245093 - DNA, 25 bp, Mus musculus
atcctgcagtttcagtggtccatct

SEQ ID NO: 245094 - DNA, 25 bp, Mus musculus
atcctgcagtttgagtggtccatct

SEQ ID NO: 245095 - DNA, 25 bp, Mus musculus
atcctgcatcctatgactggagctc

SEQ ID NO: 245096 - DNA, 25 bp, Mus musculus
atcctgcatcctttgactggagctc

SEQ ID NO: 245097 - DNA, 25 bp, Mus musculus
atcctgcatctgaccttgtctatac

SEQ ID NO: 245098 - DNA, 25 bp, Mus musculus
atcctgcatctgtccttgtctatac

SEQ ID NO: 245099 - DNA, 25 bp, Mus musculus
atcctgcattcaacagctcagctct

SEQ ID NO: 245100 - DNA, 25 bp, Mus musculus
atcctgcattcatcagctcagctct

SEQ ID NO: 245101 - DNA, 25 bp, Mus musculus
atcctgccacataaagtcctgagag

SEQ ID NO: 245102 - DNA, 25 bp, Mus musculus
atcctgccacattaagtcctgagag

SEQ ID NO: 245103 - DNA, 25 bp, Mus musculus
atcctgccacggacctgtaactgag

SEQ ID NO: 245104 - DNA, 25 bp, Mus musculus
atcctgccacggtcctgtaactgag

SEQ ID NO: 245105 - DNA, 25 bp, Mus musculus
atcctgccatttctactggtatcaa

SEQ ID NO: 245106 - DNA, 25 bp, Mus musculus
atcctgccatttgtactggtatcaa

SEQ ID NO: 245107 - DNA, 25 bp, Mus musculus
atcctgcccaccctgaaagaaattt

SEQ ID NO: 245108 - DNA, 25 bp, Mus musculus
atcctgcccaccgtgaaagaaattt

SEQ ID NO: 245109 - DNA, 25 bp, Mus musculus
atcctgccctctctgctctgggatg

SEQ ID NO: 245110 - DNA, 25 bp, Mus musculus
atcctgccctctgtgctctgggatg

SEQ ID NO: 245111 - DNA, 25 bp, Mus musculus
atcctgccctggacaaagacaggct

SEQ ID NO: 245112 - DNA, 25 bp, Mus musculus
atcctgccctggtcaaagacaggct

SEQ ID NO: 245113 - DNA, 25 bp, Mus musculus
atcctgccggagatggtgggtagca

SEQ ID NO: 245114 - DNA, 25 bp, Mus musculus
atcctgccggagttggtgggtagca

SEQ ID NO: 245115 - DNA, 25 bp, Mus musculus
atcctgccgtgtcctatcggataaa

SEQ ID NO: 245116 - DNA, 25 bp, Mus musculus
atcctgccgtgtgctatcggataaa

SEQ ID NO: 245117 - DNA, 25 bp, Mus musculus
atcctgcctactatcatgaacttta

SEQ ID NO: 245118 - DNA, 25 bp, Mus musculus
atcctgcctactttcatgaacttta

SEQ ID NO: 245119 - DNA, 25 bp, Mus musculus
atcctgcctagtcgtacgctattta

SEQ ID NO: 245120 - DNA, 25 bp, Mus musculus
atcctgcctagtggtacgctattta

SEQ ID NO: 245121 - DNA, 25 bp, Mus musculus
atcctgcctatcagttctatgtgag

SEQ ID NO: 245122 - DNA, 25 bp, Mus musculus
atcctgcctatctgttctatgtgag

SEQ ID NO: 245123 - DNA, 25 bp, Mus musculus
atcctgcctgccaatgcattttggg

SEQ ID NO: 245124 - DNA, 25 bp, Mus musculus
atcctgcctgcctatgcattttggg

SEQ ID NO: 245125 - DNA, 25 bp, Mus musculus
atcctgcctggaagctgtatatgag

SEQ ID NO: 245126 - DNA, 25 bp, Mus musculus
atcctgcctggatgctgtatatgag

SEQ ID NO: 245127 - DNA, 25 bp, Mus musculus
atcctgccttaaacactttgcttta

SEQ ID NO: 245128 - DNA, 25 bp, Mus musculus
atcctgccttaatcactttgcttta

SEQ ID NO: 245129 - DNA, 25 bp, Mus musculus
atcctgccttttcaggccctagcat

SEQ ID NO: 245130 - DNA, 25 bp, Mus musculus
atcctgccttttgaggccctagcat

SEQ ID NO: 245131 - DNA, 25 bp, Mus musculus
atcctgcgcaaccttggtcgaaagg

SEQ ID NO: 245132 - DNA, 25 bp, Mus musculus
atcctgcgcaacgttggtcgaaagg

SEQ ID NO: 245133 - DNA, 25 bp, Mus musculus
atcctgcgctttcaagaggtgtctg

SEQ ID NO: 245134 - DNA, 25 bp, Mus musculus
atcctgcgctttgaagaggtgtctg

SEQ ID NO: 245135 - DNA, 25 bp, Mus musculus
atcctgcgtgccaattgatggcaaa

SEQ ID NO: 245136 - DNA, 25 bp, Mus musculus
atcctgcgtgcctattgatggcaaa

SEQ ID NO: 245137 - DNA, 25 bp, Mus musculus
atcctgctactaacaacatgtatgt

SEQ ID NO: 245138 - DNA, 25 bp, Mus musculus
atcctgctactatcaacatgtatgt

SEQ ID NO: 245139 - DNA, 25 bp, Mus musculus
atcctgctagataccacctgctttg

SEQ ID NO: 245140 - DNA, 25 bp, Mus musculus
atcctgctagattccacctgctttg

SEQ ID NO: 245141 - DNA, 25 bp, Mus musculus
atcctgctcaggagtgggtccccag

SEQ ID NO: 245142 - DNA, 25 bp, Mus musculus
atcctgctcaggtgtgggtccccag

SEQ ID NO: 245143 - DNA, 25 bp, Mus musculus
atcctgctcatgctggacttgatga

SEQ ID NO: 245144 - DNA, 25 bp, Mus musculus
atcctgctcatggtggacttgatga

SEQ ID NO: 245145 - DNA, 25 bp, Mus musculus
atcctgctccagagttgtttagttg

SEQ ID NO: 245146 - DNA, 25 bp, Mus musculus
atcctgctccagtgttgtttagttg

SEQ ID NO: 245147 - DNA, 25 bp, Mus musculus
atcctgctcctcactagccatgaga

SEQ ID NO: 245148 - DNA, 25 bp, Mus musculus
atcctgctcctctctagccatgaga

SEQ ID NO: 245149 - DNA, 25 bp, Mus musculus
atcctgctcgatcaggccctcaagt

SEQ ID NO: 245150 - DNA, 25 bp, Mus musculus
atcctgctcgatgaggccctcaagt

SEQ ID NO: 245151 - DNA, 25 bp, Mus musculus
atcctgctcggcctgtgctgcatct

SEQ ID NO: 245152 - DNA, 25 bp, Mus musculus
atcctgctcggcgtgtgctgcatct

SEQ ID NO: 245153 - DNA, 25 bp, Mus musculus
atcctgctcttgacacatgttgtca

SEQ ID NO: 245154 - DNA, 25 bp, Mus musculus
atcctgctcttgtcacatgttgtca

SEQ ID NO: 245155 - DNA, 25 bp, Mus musculus
atcctgctgacaacgtgtaggcttt

SEQ ID NO: 245156 - DNA, 25 bp, Mus musculus
atcctgctgacatcgtgtaggcttt

SEQ ID NO: 245157 - DNA, 25 bp, Mus musculus
atcctgctgcagcatctggagttta

SEQ ID NO: 245158 - DNA, 25 bp, Mus musculus
atcctgctgcaggatctggagttta

SEQ ID NO: 245159 - DNA, 25 bp, Mus musculus
atcctgctgctcacgaagggtcaat

SEQ ID NO: 245160 - DNA, 25 bp, Mus musculus
atcctgctgctctcgaagggtcaat

SEQ ID NO: 245161 - DNA, 25 bp, Mus musculus
atcctgctgtgactgtgatggcacc

SEQ ID NO: 245162 - DNA, 25 bp, Mus musculus
atcctgctgtgagtgtgatggcacc

SEQ ID NO: 245163 - DNA, 25 bp, Mus musculus
atcctgctgtttcctgagtggtgtc

SEQ ID NO: 245164 - DNA, 25 bp, Mus musculus
atcctgctgtttgctgagtggtgtc

SEQ ID NO: 245165 - DNA, 25 bp, Mus musculus
atcctgcttcgacggacggtccatg

SEQ ID NO: 245166 - DNA, 25 bp, Mus musculus
atcctgcttcgagggacggtccatg

SEQ ID NO: 245167 - DNA, 25 bp, Mus musculus
atcctgcttgcaaaactattctgag

SEQ ID NO: 245168 - DNA, 25 bp, Mus musculus
atcctgcttgcataactattctgag

SEQ ID NO: 245169 - DNA, 25 bp, Mus musculus
atcctgctttctcagggcaatccta

SEQ ID NO: 245170 - DNA, 25 bp, Mus musculus
atcctgctttctgagggcaatccta

SEQ ID NO: 245171 - DNA, 25 bp, Mus musculus
atcctggaaatgaacctagattctt

SEQ ID NO: 245172 - DNA, 25 bp, Mus musculus
atcctggaaatgtacctagattctt

SEQ ID NO: 245173 - DNA, 25 bp, Mus musculus
atcctggaacgcctggaaaattcga

SEQ ID NO: 245174 - DNA, 25 bp, Mus musculus
atcctggaacgcgtggaaaattcga

SEQ ID NO: 245175 - DNA, 25 bp, Mus musculus
atcctggaagggaaagggccaagca

SEQ ID NO: 245176 - DNA, 25 bp, Mus musculus
atcctggaagggtaagggccaagca

SEQ ID NO: 245177 - DNA, 25 bp, Mus musculus
atcctggacaacaagaacggcacct

SEQ ID NO: 245178 - DNA, 25 bp, Mus musculus
atcctggacaactagaacggcacct

SEQ ID NO: 245179 - DNA, 25 bp, Mus musculus
atcctggacacactcgtttgtcaat

SEQ ID NO: 245180 - DNA, 25 bp, Mus musculus
atcctggacacagtcgtttgtcaat

SEQ ID NO: 245181 - DNA, 25 bp, Mus musculus
atcctggacagaaagcccagtggct

SEQ ID NO: 245182 - DNA, 25 bp, Mus musculus
atcctggacagaatcaaaccttgac

SEQ ID NO: 245183 - DNA, 25 bp, Mus musculus
atcctggacagatagcccagtggct

SEQ ID NO: 245184 - DNA, 25 bp, Mus musculus
atcctggacagattcaaaccttgac

SEQ ID NO: 245185 - DNA, 25 bp, Mus musculus
atcctggacagcaagccggctgcaa

SEQ ID NO: 245186 - DNA, 25 bp, Mus musculus
atcctggacagctagccggctgcaa

SEQ ID NO: 245187 - DNA, 25 bp, Mus musculus
atcctggacatgaggcagaccctgt

SEQ ID NO: 245188 - DNA, 25 bp, Mus musculus
atcctggacatgtggcagaccctgt

SEQ ID NO: 245189 - DNA, 25 bp, Mus musculus
atcctggacccgaggtctaggcaag

SEQ ID NO: 245190 - DNA, 25 bp, Mus musculus
atcctggacccgtggtctaggcaag

SEQ ID NO: 245191 - DNA, 25 bp, Mus musculus
atcctggacctcctccaatgggcat

SEQ ID NO: 245192 - DNA, 25 bp, Mus musculus
atcctggacctcgtccaatgggcat

SEQ ID NO: 245193 - DNA, 25 bp, Mus musculus
atcctggactctctaaccctagaat

SEQ ID NO: 245194 - DNA, 25 bp, Mus musculus
atcctggactctgtaaccctagaat

SEQ ID NO: 245195 - DNA, 25 bp, Mus musculus
atcctggactgtaggctgttctctg

SEQ ID NO: 245196 - DNA, 25 bp, Mus musculus
atcctggactgttggctgttctctg

SEQ ID NO: 245197 - DNA, 25 bp, Mus musculus
atcctggagaacaaccaggcagaga

SEQ ID NO: 245198 - DNA, 25 bp, Mus musculus
atcctggagaactaccaggcagaga

SEQ ID NO: 245199 - DNA, 25 bp, Mus musculus
atcctggagagaaacattgcaaata

SEQ ID NO: 245200 - DNA, 25 bp, Mus musculus
atcctggagagatacattgcaaata

SEQ ID NO: 245201 - DNA, 25 bp, Mus musculus
atcctggagatcacagtggaaatta

SEQ ID NO: 245202 - DNA, 25 bp, Mus musculus
atcctggagatctcagtggaaatta

SEQ ID NO: 245203 - DNA, 25 bp, Mus musculus
atcctggaggagaatcttcggcgct

SEQ ID NO: 245204 - DNA, 25 bp, Mus musculus
atcctggaggagtatcttcggcgct

SEQ ID NO: 245205 - DNA, 25 bp, Mus musculus
atcctggaggcgcagtgcattcctg

SEQ ID NO: 245206 - DNA, 25 bp, Mus musculus
atcctggaggcggagtgcattcctg

SEQ ID NO: 245207 - DNA, 25 bp, Mus musculus
atcctggagtttaatgccagcattg

SEQ ID NO: 245208 - DNA, 25 bp, Mus musculus
atcctggagttttatgccagcattg

SEQ ID NO: 245209 - DNA, 25 bp, Mus musculus
atcctggatagactccggccggatg

SEQ ID NO: 245210 - DNA, 25 bp, Mus musculus
atcctggatagagtccggccggatg

SEQ ID NO: 245211 - DNA, 25 bp, Mus musculus
atcctggatgagctgaagcccttca

SEQ ID NO: 245212 - DNA, 25 bp, Mus musculus
atcctggatgaggtgaagcccttca

SEQ ID NO: 245213 - DNA, 25 bp, Mus musculus
atcctggatgctcagaacactgttg

SEQ ID NO: 245214 - DNA, 25 bp, Mus musculus
atcctggatgctctgtagctcctgg

SEQ ID NO: 245215 - DNA, 25 bp, Mus musculus
atcctggatgctgagaacactgttg

SEQ ID NO: 245216 - DNA, 25 bp, Mus musculus
atcctggatgctgtgtagctcctgg

SEQ ID NO: 245217 - DNA, 25 bp, Mus musculus
atcctggatttaacacctgtatcta

SEQ ID NO: 245218 - DNA, 25 bp, Mus musculus
atcctggatttatcacctgtatcta

SEQ ID NO: 245219 - DNA, 25 bp, Mus musculus
atcctggcatttatcttcactgtag

SEQ ID NO: 245220 - DNA, 25 bp, Mus musculus
atcctggcatttttcttcactgtag

SEQ ID NO: 245221 - DNA, 25 bp, Mus musculus
atcctggccactatcttgatgagaa

SEQ ID NO: 245222 - DNA, 25 bp, Mus musculus
atcctggccactttcttgatgagaa

SEQ ID NO: 245223 - DNA, 25 bp, Mus musculus
atcctggccatgctgtgggcacgcc

SEQ ID NO: 245224 - DNA, 25 bp, Mus musculus
atcctggccatggtgtgggcacgcc

SEQ ID NO: 245225 - DNA, 25 bp, Mus musculus
atcctggcccagacattcctacatt

SEQ ID NO: 245226 - DNA, 25 bp, Mus musculus
atcctggcccagtcattcctacatt

SEQ ID NO: 245227 - DNA, 25 bp, Mus musculus
atcctggccgatagctgcagaactg

SEQ ID NO: 245228 - DNA, 25 bp, Mus musculus
atcctggccgattgctgcagaactg

SEQ ID NO: 245229 - DNA, 25 bp, Mus musculus
atcctggccttcaggtgtacctgct

SEQ ID NO: 245230 - DNA, 25 bp, Mus musculus
atcctggccttctggtgtacctgct

SEQ ID NO: 245231 - DNA, 25 bp, Mus musculus
atcctggcgcacagggactgaagta

SEQ ID NO: 245232 - DNA, 25 bp, Mus musculus
atcctggcgcactgggactgaagta

SEQ ID NO: 245233 - DNA, 25 bp, Mus musculus
atcctggctccacggtgtatatagc

SEQ ID NO: 245234 - DNA, 25 bp, Mus musculus
atcctggctccagggtgtatatagc

SEQ ID NO: 245235 - DNA, 25 bp, Mus musculus
atcctggctgagatctcccagaaac

SEQ ID NO: 245236 - DNA, 25 bp, Mus musculus
atcctggctgagttctcccagaaac

SEQ ID NO: 245237 - DNA, 25 bp, Mus musculus
atcctggctgataccagcctgatct

SEQ ID NO: 245238 - DNA, 25 bp, Mus musculus
atcctggctgattccagcctgatct

SEQ ID NO: 245239 - DNA, 25 bp, Mus musculus
atcctggctggcaggatgcctacct

SEQ ID NO: 245240 - DNA, 25 bp, Mus musculus
atcctggctggctggatgcctacct

SEQ ID NO: 245241 - DNA, 25 bp, Mus musculus
atcctggcttggcagatttccttaa

SEQ ID NO: 245242 - DNA, 25 bp, Mus musculus
atcctggcttgggagatttccttaa

SEQ ID NO: 245243 - DNA, 25 bp, Mus musculus
atcctggctttgacccggttgtgtt

SEQ ID NO: 245244 - DNA, 25 bp, Mus musculus
atcctggctttgtcccggttgtgtt

SEQ ID NO: 245245 - DNA, 25 bp, Mus musculus
atcctgggactaaactgagcgccgg

SEQ ID NO: 245246 - DNA, 25 bp, Mus musculus
atcctgggactatactgagcgccgg

SEQ ID NO: 245247 - DNA, 25 bp, Mus musculus
atcctgggagcacttctgtatagcc

SEQ ID NO: 245248 - DNA, 25 bp, Mus musculus
atcctgggagcagttctgtatagcc

SEQ ID NO: 245249 - DNA, 25 bp, Mus musculus
atcctgggaggtagtgtccccattt

SEQ ID NO: 245250 - DNA, 25 bp, Mus musculus
atcctgggaggttgtgtccccattt

SEQ ID NO: 245251 - DNA, 25 bp, Mus musculus
atcctgggagtcacctgcaccaaag

SEQ ID NO: 245252 - DNA, 25 bp, Mus musculus
atcctgggagtcctagtggctgcac

SEQ ID NO: 245253 - DNA, 25 bp, Mus musculus
atcctgggagtcgtagtggctgcac

SEQ ID NO: 245254 - DNA, 25 bp, Mus musculus
atcctgggagtctcctgcaccaaag

SEQ ID NO: 245255 - DNA, 25 bp, Mus musculus
atcctgggatacataggcagatcct

SEQ ID NO: 245256 - DNA, 25 bp, Mus musculus
atcctgggatacttaggcagatcct

SEQ ID NO: 245257 - DNA, 25 bp, Mus musculus
atcctgggatgcatctaacttcact

SEQ ID NO: 245258 - DNA, 25 bp, Mus musculus
atcctgggatgcttctaacttcact

SEQ ID NO: 245259 - DNA, 25 bp, Mus musculus
atcctgggcaacagatatctgtaca

SEQ ID NO: 245260 - DNA, 25 bp, Mus musculus
atcctgggcaactgatatctgtaca

SEQ ID NO: 245261 - DNA, 25 bp, Mus musculus
atcctgggcattccatgtaaaacaa

SEQ ID NO: 245262 - DNA, 25 bp, Mus musculus
atcctgggcattgcatgtaaaacaa

SEQ ID NO: 245263 - DNA, 25 bp, Mus musculus
atcctgggcccgctcgtgcagttct

SEQ ID NO: 245264 - DNA, 25 bp, Mus musculus
atcctgggcccggtcgtgcagttct

SEQ ID NO: 245265 - DNA, 25 bp, Mus musculus
atcctgggctttcgtgcttggagaa

SEQ ID NO: 245266 - DNA, 25 bp, Mus musculus
atcctgggctttggtgcttggagaa

SEQ ID NO: 245267 - DNA, 25 bp, Mus musculus
atcctggggtcaatttatcaatatg

SEQ ID NO: 245268 - DNA, 25 bp, Mus musculus
atcctggggtcattttatcaatatg

SEQ ID NO: 245269 - DNA, 25 bp, Mus musculus
atcctgggtcagctgggatgtgaca

SEQ ID NO: 245270 - DNA, 25 bp, Mus musculus
atcctgggtcaggtgggatgtgaca

SEQ ID NO: 245271 - DNA, 25 bp, Mus musculus
atcctgggtgatcctgtggcctgca

SEQ ID NO: 245272 - DNA, 25 bp, Mus musculus
atcctgggtgatgctgtggcctgca

SEQ ID NO: 245273 - DNA, 25 bp, Mus musculus
atcctgggttatctttaggtgccat

SEQ ID NO: 245274 - DNA, 25 bp, Mus musculus
atcctgggttatgtttaggtgccat

SEQ ID NO: 245275 - DNA, 25 bp, Mus musculus
atcctggtactgctggtactcagac

SEQ ID NO: 245276 - DNA, 25 bp, Mus musculus
atcctggtactggtggtactcagac

SEQ ID NO: 245277 - DNA, 25 bp, Mus musculus
atcctggtacttagtgcacactgct

SEQ ID NO: 245278 - DNA, 25 bp, Mus musculus
atcctggtacttctcttaggcgtaa

SEQ ID NO: 245279 - DNA, 25 bp, Mus musculus
atcctggtacttgtcttaggcgtaa

SEQ ID NO: 245280 - DNA, 25 bp, Mus musculus
atcctggtactttgtgcacactgct

SEQ ID NO: 245281 - DNA, 25 bp, Mus musculus
atcctggtatggaagctgctgttcc

SEQ ID NO: 245282 - DNA, 25 bp, Mus musculus
atcctggtatggtagctgctgttcc

SEQ ID NO: 245283 - DNA, 25 bp, Mus musculus
atcctggtcattcgtgtgctcactg

SEQ ID NO: 245284 - DNA, 25 bp, Mus musculus
atcctggtcattggtgtgctcactg

SEQ ID NO: 245285 - DNA, 25 bp, Mus musculus
atcctggtccagcagtggtctgaca

SEQ ID NO: 245286 - DNA, 25 bp, Mus musculus
atcctggtccaggagtggtctgaca

SEQ ID NO: 245287 - DNA, 25 bp, Mus musculus
atcctggtctccaggcgtttgtgga

SEQ ID NO: 245288 - DNA, 25 bp, Mus musculus
atcctggtctcctggcgtttgtgga

SEQ ID NO: 245289 - DNA, 25 bp, Mus musculus
atcctggtctgtacgcatttgcata

SEQ ID NO: 245290 - DNA, 25 bp, Mus musculus
atcctggtctgtatggtgacttcca

SEQ ID NO: 245291 - DNA, 25 bp, Mus musculus
atcctggtctgttcgcatttgcata

SEQ ID NO: 245292 - DNA, 25 bp, Mus musculus
atcctggtctgtttggtgacttcca

SEQ ID NO: 245293 - DNA, 25 bp, Mus musculus
atcctggtgacaacattgcctgcag

SEQ ID NO: 245294 - DNA, 25 bp, Mus musculus
atcctggtgacatcattgcctgcag

SEQ ID NO: 245295 - DNA, 25 bp, Mus musculus
atcctggtgattccttttgtatttt

SEQ ID NO: 245296 - DNA, 25 bp, Mus musculus
atcctggtgattgcttttgtatttt

SEQ ID NO: 245297 - DNA, 25 bp, Mus musculus
atcctggtgcttacatggactgtct

SEQ ID NO: 245298 - DNA, 25 bp, Mus musculus
atcctggtgctttcatggactgtct

SEQ ID NO: 245299 - DNA, 25 bp, Mus musculus
atcctggtggacatgctgaatctga

SEQ ID NO: 245300 - DNA, 25 bp, Mus musculus
atcctggtggacttgctgaatctga

SEQ ID NO: 245301 - DNA, 25 bp, Mus musculus
atcctggtgggcaacaaggccgacc

SEQ ID NO: 245302 - DNA, 25 bp, Mus musculus
atcctggtgggctacaaggccgacc

SEQ ID NO: 245303 - DNA, 25 bp, Mus musculus
atcctggtgttactcatctcatcat

SEQ ID NO: 245304 - DNA, 25 bp, Mus musculus
atcctggtgttactgccagactcac

SEQ ID NO: 245305 - DNA, 25 bp, Mus musculus
atcctggtgttagtcatctcatcat

SEQ ID NO: 245306 - DNA, 25 bp, Mus musculus
atcctggtgttagtgccagactcac

SEQ ID NO: 245307 - DNA, 25 bp, Mus musculus
atcctggttcttcactcagcatcaa

SEQ ID NO: 245308 - DNA, 25 bp, Mus musculus
atcctggttcttgactcagcatcaa

SEQ ID NO: 245309 - DNA, 25 bp, Mus musculus
atcctggttggaaatgctagcattt

SEQ ID NO: 245310 - DNA, 25 bp, Mus musculus
atcctggttggatatgctagcattt

SEQ ID NO: 245311 - DNA, 25 bp, Mus musculus
atcctggttggcctcgttggtttca

SEQ ID NO: 245312 - DNA, 25 bp, Mus musculus
atcctggttggcgtcgttggtttca

SEQ ID NO: 245313 - DNA, 25 bp, Mus musculus
atcctgtacaggaagctaactttgt

SEQ ID NO: 245314 - DNA, 25 bp, Mus musculus
atcctgtacaggtagctaactttgt

SEQ ID NO: 245315 - DNA, 25 bp, Mus musculus
atcctgtactagactttctcttaac

SEQ ID NO: 245316 - DNA, 25 bp, Mus musculus
atcctgtactagtctttctcttaac

SEQ ID NO: 245317 - DNA, 25 bp, Mus musculus
atcctgtacttgaccctgtggaaag

SEQ ID NO: 245318 - DNA, 25 bp, Mus musculus
atcctgtacttgtccctgtggaaag

SEQ ID NO: 245319 - DNA, 25 bp, Mus musculus
atcctgtagtgtagggccactcctg

SEQ ID NO: 245320 - DNA, 25 bp, Mus musculus
atcctgtagtgttgggccactcctg

SEQ ID NO: 245321 - DNA, 25 bp, Mus musculus
atcctgtatcctcgtggctgtcatg

SEQ ID NO: 245322 - DNA, 25 bp, Mus musculus
atcctgtatcctggtggctgtcatg

SEQ ID NO: 245323 - DNA, 25 bp, Mus musculus
atcctgtatgtgcatggtgtggaac

SEQ ID NO: 245324 - DNA, 25 bp, Mus musculus
atcctgtatgtggatggtgtggaac

SEQ ID NO: 245325 - DNA, 25 bp, Mus musculus
atcctgtattagaatctagcaatca

SEQ ID NO: 245326 - DNA, 25 bp, Mus musculus
atcctgtattagtatctagcaatca

SEQ ID NO: 245327 - DNA, 25 bp, Mus musculus
atcctgtcaggaagctggacatgct

SEQ ID NO: 245328 - DNA, 25 bp, Mus musculus
atcctgtcaggatgctggacatgct

SEQ ID NO: 245329 - DNA, 25 bp, Mus musculus
atcctgtcagggattctcattccca

SEQ ID NO: 245330 - DNA, 25 bp, Mus musculus
atcctgtcagggtttctcattccca

SEQ ID NO: 245331 - DNA, 25 bp, Mus musculus
atcctgtcatttacatgtgacccag

SEQ ID NO: 245332 - DNA, 25 bp, Mus musculus
atcctgtcattttcatgtgacccag

SEQ ID NO: 245333 - DNA, 25 bp, Mus musculus
atcctgtccaaacgactcctgtctt

SEQ ID NO: 245334 - DNA, 25 bp, Mus musculus
atcctgtccaaaggactcctgtctt

SEQ ID NO: 245335 - DNA, 25 bp, Mus musculus
atcctgtccagcattgcagtgtcag

SEQ ID NO: 245336 - DNA, 25 bp, Mus musculus
atcctgtccagctttgcagtgtcag

SEQ ID NO: 245337 - DNA, 25 bp, Mus musculus
atcctgtccatcctgtgcctgatga

SEQ ID NO: 245338 - DNA, 25 bp, Mus musculus
atcctgtccatcgtgtgcctgatga

SEQ ID NO: 245339 - DNA, 25 bp, Mus musculus
atcctgtcctagctgtgtgtcatag

SEQ ID NO: 245340 - DNA, 25 bp, Mus musculus
atcctgtcctaggtgtgtgtcatag

SEQ ID NO: 245341 - DNA, 25 bp, Mus musculus
atcctgtcctgtcagcacatgcaag

SEQ ID NO: 245342 - DNA, 25 bp, Mus musculus
atcctgtcctgtgagcacatgcaag

SEQ ID NO: 245343 - DNA, 25 bp, Mus musculus
atcctgtcctttctgggctacggct

SEQ ID NO: 245344 - DNA, 25 bp, Mus musculus
atcctgtcctttgtgggctacggct

SEQ ID NO: 245345 - DNA, 25 bp, Mus musculus
atcctgtcgttgacctaaagctgaa

SEQ ID NO: 245346 - DNA, 25 bp, Mus musculus
atcctgtcgttgtcctaaagctgaa

SEQ ID NO: 245347 - DNA, 25 bp, Mus musculus
atcctgtctggaacgatcagtggtc

SEQ ID NO: 245348 - DNA, 25 bp, Mus musculus
atcctgtctggatcgatcagtggtc

SEQ ID NO: 245349 - DNA, 25 bp, Mus musculus
atcctgtcttctccagtgacacagt

SEQ ID NO: 245350 - DNA, 25 bp, Mus musculus
atcctgtcttctcttgcttccgtga

SEQ ID NO: 245351 - DNA, 25 bp, Mus musculus
atcctgtcttctgcagtgacacagt

SEQ ID NO: 245352 - DNA, 25 bp, Mus musculus
atcctgtcttctgttgcttccgtga

SEQ ID NO: 245353 - DNA, 25 bp, Mus musculus
atcctgtcttttacgagcatggctc

SEQ ID NO: 245354 - DNA, 25 bp, Mus musculus
atcctgtctttttcgagcatggctc

SEQ ID NO: 245355 - DNA, 25 bp, Mus musculus
atcctgtgaaggcttgtggttgaca

SEQ ID NO: 245356 - DNA, 25 bp, Mus musculus
atcctgtgaagggttgtggttgaca

SEQ ID NO: 245357 - DNA, 25 bp, Mus musculus
atcctgtgaatcacctttgaacctt

SEQ ID NO: 245358 - DNA, 25 bp, Mus musculus
atcctgtgaatctcctttgaacctt

SEQ ID NO: 245359 - DNA, 25 bp, Mus musculus
atcctgtgaccgaccagagtctgat

SEQ ID NO: 245360 - DNA, 25 bp, Mus musculus
atcctgtgaccgtccagagtctgat

SEQ ID NO: 245361 - DNA, 25 bp, Mus musculus
atcctgtgacctcttgcttaactct

SEQ ID NO: 245362 - DNA, 25 bp, Mus musculus
atcctgtgacctgttgcttaactct

SEQ ID NO: 245363 - DNA, 25 bp, Mus musculus
atcctgtgaggaagctgccaaaagg

SEQ ID NO: 245364 - DNA, 25 bp, Mus musculus
atcctgtgaggatgctgccaaaagg

SEQ ID NO: 245365 - DNA, 25 bp, Mus musculus
atcctgtgcaggacaaaaccccact

SEQ ID NO: 245366 - DNA, 25 bp, Mus musculus
atcctgtgcaggtcaaaaccccact

SEQ ID NO: 245367 - DNA, 25 bp, Mus musculus
atcctgtgccgcctcgatttatggg

SEQ ID NO: 245368 - DNA, 25 bp, Mus musculus
atcctgtgccgcgtcgatttatggg

SEQ ID NO: 245369 - DNA, 25 bp, Mus musculus
atcctgtgctagagcttgtgaaagc

SEQ ID NO: 245370 - DNA, 25 bp, Mus musculus
atcctgtgctagtgcttgtgaaagc

SEQ ID NO: 245371 - DNA, 25 bp, Mus musculus
atcctgtggactattgaagatattc

SEQ ID NO: 245372 - DNA, 25 bp, Mus musculus
atcctgtggacttttgaagatattc

SEQ ID NO: 245373 - DNA, 25 bp, Mus musculus
atcctgtggcacattgactgagact

SEQ ID NO: 245374 - DNA, 25 bp, Mus musculus
atcctgtggcactttgactgagact

SEQ ID NO: 245375 - DNA, 25 bp, Mus musculus
atcctgtgggtactcttgcagaagg

SEQ ID NO: 245376 - DNA, 25 bp, Mus musculus
atcctgtgggtagtcttgcagaagg

SEQ ID NO: 245377 - DNA, 25 bp, Mus musculus
atcctgtgtcctagatttctcagct

SEQ ID NO: 245378 - DNA, 25 bp, Mus musculus
atcctgtgtcctctggtgccttgga

SEQ ID NO: 245379 - DNA, 25 bp, Mus musculus
atcctgtgtcctgtggtgccttgga

SEQ ID NO: 245380 - DNA, 25 bp, Mus musculus
atcctgtgtccttgatttctcagct

SEQ ID NO: 245381 - DNA, 25 bp, Mus musculus
atcctgtgtcttcttttattctaat

SEQ ID NO: 245382 - DNA, 25 bp, Mus musculus
atcctgtgtcttgttttattctaat

SEQ ID NO: 245383 - DNA, 25 bp, Mus musculus
atcctgtgtgataatcttttcatgt

SEQ ID NO: 245384 - DNA, 25 bp, Mus musculus
atcctgtgtgattatcttttcatgt

SEQ ID NO: 245385 - DNA, 25 bp, Mus musculus
atcctgtgtttaacctgtgcagaca

SEQ ID NO: 245386 - DNA, 25 bp, Mus musculus
atcctgtgtttatcctgtgcagaca

SEQ ID NO: 245387 - DNA, 25 bp, Mus musculus
atcctgtgtttgcaaactgttgcga

SEQ ID NO: 245388 - DNA, 25 bp, Mus musculus
atcctgtgtttggaaactgttgcga

SEQ ID NO: 245389 - DNA, 25 bp, Mus musculus
atcctgttatccatcttttttctta

SEQ ID NO: 245390 - DNA, 25 bp, Mus musculus
atcctgttatccttcttttttctta

SEQ ID NO: 245391 - DNA, 25 bp, Mus musculus
atcctgttatgcacatccctttggc

SEQ ID NO: 245392 - DNA, 25 bp, Mus musculus
atcctgttatgctcatccctttggc

SEQ ID NO: 245393 - DNA, 25 bp, Mus musculus
atcctgttcacccaggactcaggga

SEQ ID NO: 245394 - DNA, 25 bp, Mus musculus
atcctgttcaccgaggactcaggga

SEQ ID NO: 245395 - DNA, 25 bp, Mus musculus
atcctgttcagaagacccgtcagaa

SEQ ID NO: 245396 - DNA, 25 bp, Mus musculus
atcctgttcagatgacccgtcagaa

SEQ ID NO: 245397 - DNA, 25 bp, Mus musculus
atcctgttcctgctgaatatggtca

SEQ ID NO: 245398 - DNA, 25 bp, Mus musculus
atcctgttcctggtgaatatggtca

SEQ ID NO: 245399 - DNA, 25 bp, Mus musculus
atcctgttgaccatgcttgcacttt

SEQ ID NO: 245400 - DNA, 25 bp, Mus musculus
atcctgttgaccttgcttgcacttt

SEQ ID NO: 245401 - DNA, 25 bp, Mus musculus
atcctgttgagtccatttgtatatg

SEQ ID NO: 245402 - DNA, 25 bp, Mus musculus
atcctgttgagtgcatttgtatatg

SEQ ID NO: 245403 - DNA, 25 bp, Mus musculus
atcctgttgccccagggagtgactc

SEQ ID NO: 245404 - DNA, 25 bp, Mus musculus
atcctgttgcccgagggagtgactc

SEQ ID NO: 245405 - DNA, 25 bp, Mus musculus
atcctgttgctcattgactgcaaaa

SEQ ID NO: 245406 - DNA, 25 bp, Mus musculus
atcctgttgctctttgactgcaaaa

SEQ ID NO: 245407 - DNA, 25 bp, Mus musculus
atcctgttgctgatcgtggctgtgc

SEQ ID NO: 245408 - DNA, 25 bp, Mus musculus
atcctgttgctgttcgtggctgtgc

SEQ ID NO: 245409 - DNA, 25 bp, Mus musculus
atcctgttggccacatgtggtgtgg

SEQ ID NO: 245410 - DNA, 25 bp, Mus musculus
atcctgttggccctcattgagggtg

SEQ ID NO: 245411 - DNA, 25 bp, Mus musculus
atcctgttggccgtcattgagggtg

SEQ ID NO: 245412 - DNA, 25 bp, Mus musculus
atcctgttggcctcatgtggtgtgg

SEQ ID NO: 245413 - DNA, 25 bp, Mus musculus
atcctgttgtccctggtggtgccca

SEQ ID NO: 245414 - DNA, 25 bp, Mus musculus
atcctgttgtccgtggtggtgccca

SEQ ID NO: 245415 - DNA, 25 bp, Mus musculus
atcctgttgtgtcgcgcttgtgaca

SEQ ID NO: 245416 - DNA, 25 bp, Mus musculus
atcctgttgtgtggcgcttgtgaca

SEQ ID NO: 245417 - DNA, 25 bp, Mus musculus
atcctgtttaatcctgttctctgtc

SEQ ID NO: 245418 - DNA, 25 bp, Mus musculus
atcctgtttaatgctgttctctgtc

SEQ ID NO: 245419 - DNA, 25 bp, Mus musculus
atcctgtttatgatctgtgcactgg

SEQ ID NO: 245420 - DNA, 25 bp, Mus musculus
atcctgtttatgttctgtgcactgg

SEQ ID NO: 245421 - DNA, 25 bp, Mus musculus
atcctgtttgcacaggctgtgctgc

SEQ ID NO: 245422 - DNA, 25 bp, Mus musculus
atcctgtttgcagaggctgtgctgc

SEQ ID NO: 245423 - DNA, 25 bp, Mus musculus
atcctgtttgtcaataaaggccaca

SEQ ID NO: 245424 - DNA, 25 bp, Mus musculus
atcctgtttgtctataaaggccaca

SEQ ID NO: 245425 - DNA, 25 bp, Mus musculus
atcctgttttcaaatatagcaccta

SEQ ID NO: 245426 - DNA, 25 bp, Mus musculus
atcctgttttcatatatagcaccta

SEQ ID NO: 245427 - DNA, 25 bp, Mus musculus
atcctgttttgaaacctcttgttca

SEQ ID NO: 245428 - DNA, 25 bp, Mus musculus
atcctgttttgatacctcttgttca

SEQ ID NO: 245429 - DNA, 25 bp, Mus musculus
atcctgttttgtccaattctctgag

SEQ ID NO: 245430 - DNA, 25 bp, Mus musculus
atcctgttttgtgcaattctctgag

SEQ ID NO: 245431 - DNA, 25 bp, Mus musculus
atcctgtttttgagtgttgtgtgtc

SEQ ID NO: 245432 - DNA, 25 bp, Mus musculus
atcctgtttttgtgtgttgtgtgtc

SEQ ID NO: 245433 - DNA, 25 bp, Mus musculus
atccttaaaatgatccttgcccagc

SEQ ID NO: 245434 - DNA, 25 bp, Mus musculus
atccttaaaatgttccttgcccagc

SEQ ID NO: 245435 - DNA, 25 bp, Mus musculus
atccttaaactgactcatggcaaaa

SEQ ID NO: 245436 - DNA, 25 bp, Mus musculus
atccttaaactgtctcatggcaaaa

SEQ ID NO: 245437 - DNA, 25 bp, Mus musculus
atccttaaaggcacagcacacaggc

SEQ ID NO: 245438 - DNA, 25 bp, Mus musculus
atccttaaaggctcagcacacaggc

SEQ ID NO: 245439 - DNA, 25 bp, Mus musculus
atccttaacaggaggtctggtgcac

SEQ ID NO: 245440 - DNA, 25 bp, Mus musculus
atccttaacaggtggtctggtgcac

SEQ ID NO: 245441 - DNA, 25 bp, Mus musculus
atccttaactgtcctttaacatcac

SEQ ID NO: 245442 - DNA, 25 bp, Mus musculus
atccttaactgtgctttaacatcac

SEQ ID NO: 245443 - DNA, 25 bp, Mus musculus
atccttaagacaattccccaacact

SEQ ID NO: 245444 - DNA, 25 bp, Mus musculus
atccttaagacatttccccaacact

SEQ ID NO: 245445 - DNA, 25 bp, Mus musculus
atccttaatggtactttgaacttca

SEQ ID NO: 245446 - DNA, 25 bp, Mus musculus
atccttaatggttctttgaacttca

SEQ ID NO: 245447 - DNA, 25 bp, Mus musculus
atccttaatttgatccattgtatac

SEQ ID NO: 245448 - DNA, 25 bp, Mus musculus
atccttaatttgttccattgtatac

SEQ ID NO: 245449 - DNA, 25 bp, Mus musculus
atccttacatgtctaggcctcaggc

SEQ ID NO: 245450 - DNA, 25 bp, Mus musculus
atccttacatgtgtaggcctcaggc

SEQ ID NO: 245451 - DNA, 25 bp, Mus musculus
atccttacattcaagattttcatct

SEQ ID NO: 245452 - DNA, 25 bp, Mus musculus
atccttacattctagattttcatct

SEQ ID NO: 245453 - DNA, 25 bp, Mus musculus
atccttactgacatggactttccaa

SEQ ID NO: 245454 - DNA, 25 bp, Mus musculus
atccttactgacttggactttccaa

SEQ ID NO: 245455 - DNA, 25 bp, Mus musculus
atccttactgggaaggtggcattat

SEQ ID NO: 245456 - DNA, 25 bp, Mus musculus
atccttactgggtaggtggcattat

SEQ ID NO: 245457 - DNA, 25 bp, Mus musculus
atccttagacctatacacgtgcatt

SEQ ID NO: 245458 - DNA, 25 bp, Mus musculus
atccttagacctttacacgtgcatt

SEQ ID NO: 245459 - DNA, 25 bp, Mus musculus
atccttagaggcaccgggagtcagg

SEQ ID NO: 245460 - DNA, 25 bp, Mus musculus
atccttagaggctccgggagtcagg

SEQ ID NO: 245461 - DNA, 25 bp, Mus musculus
atccttagcagcacctgaccactgt

SEQ ID NO: 245462 - DNA, 25 bp, Mus musculus
atccttagcagctcctgaccactgt

SEQ ID NO: 245463 - DNA, 25 bp, Mus musculus
atccttagcttgcttttgctttggt

SEQ ID NO: 245464 - DNA, 25 bp, Mus musculus
atccttagcttggttttgctttggt

SEQ ID NO: 245465 - DNA, 25 bp, Mus musculus
atccttagtcaaacaggcagcccag

SEQ ID NO: 245466 - DNA, 25 bp, Mus musculus
atccttagtcaatcaggcagcccag

SEQ ID NO: 245467 - DNA, 25 bp, Mus musculus
atccttagtcccattgcttttgtag

SEQ ID NO: 245468 - DNA, 25 bp, Mus musculus
atccttagtccctttgcttttgtag

SEQ ID NO: 245469 - DNA, 25 bp, Mus musculus
atccttatataaatctcccccaata

SEQ ID NO: 245470 - DNA, 25 bp, Mus musculus
atccttatataattctcccccaata

SEQ ID NO: 245471 - DNA, 25 bp, Mus musculus
atccttatctttcctcaggcggtac

SEQ ID NO: 245472 - DNA, 25 bp, Mus musculus
atccttatctttgctcaggcggtac

SEQ ID NO: 245473 - DNA, 25 bp, Mus musculus
atccttatggatactggcacatgca

SEQ ID NO: 245474 - DNA, 25 bp, Mus musculus
atccttatggattctggcacatgca

SEQ ID NO: 245475 - DNA, 25 bp, Mus musculus
atccttatgggaaatcacgtcaata

SEQ ID NO: 245476 - DNA, 25 bp, Mus musculus
atccttatgggatatcacgtcaata

SEQ ID NO: 245477 - DNA, 25 bp, Mus musculus
atccttattaagctgctcacaacaa

SEQ ID NO: 245478 - DNA, 25 bp, Mus musculus
atccttattaaggtgctcacaacaa

SEQ ID NO: 245479 - DNA, 25 bp, Mus musculus
atccttcaaatgaatggctgctata

SEQ ID NO: 245480 - DNA, 25 bp, Mus musculus
atccttcaaatgtatggctgctata

SEQ ID NO: 245481 - DNA, 25 bp, Mus musculus
atccttcaaccaaaccttgcaaatt

SEQ ID NO: 245482 - DNA, 25 bp, Mus musculus
atccttcaaccaaagttaatgcagc

SEQ ID NO: 245483 - DNA, 25 bp, Mus musculus
atccttcaaccataccttgcaaatt

SEQ ID NO: 245484 - DNA, 25 bp, Mus musculus
atccttcaaccatagttaatgcagc

SEQ ID NO: 245485 - DNA, 25 bp, Mus musculus
atccttcaacgcagtacaagattgg

SEQ ID NO: 245486 - DNA, 25 bp, Mus musculus
atccttcaacgctgtacaagattgg

SEQ ID NO: 245487 - DNA, 25 bp, Mus musculus
atccttcacagtcgacagatgaaga

SEQ ID NO: 245488 - DNA, 25 bp, Mus musculus
atccttcacagtggacagatgaaga

SEQ ID NO: 245489 - DNA, 25 bp, Mus musculus
atccttcaccaacaaagcatcacac

SEQ ID NO: 245490 - DNA, 25 bp, Mus musculus
atccttcaccaagaaagcatcacac

SEQ ID NO: 245491 - DNA, 25 bp, Mus musculus
atccttcacctcaacaagcagaagc

SEQ ID NO: 245492 - DNA, 25 bp, Mus musculus
atccttcacctctacaagcagaagc

SEQ ID NO: 245493 - DNA, 25 bp, Mus musculus
atccttcacgaacgcagtggactca

SEQ ID NO: 245494 - DNA, 25 bp, Mus musculus
atccttcacgaaggcagtggactca

SEQ ID NO: 245495 - DNA, 25 bp, Mus musculus
atccttcacgcaaatcagctgatcg

SEQ ID NO: 245496 - DNA, 25 bp, Mus musculus
atccttcacgcatatcagctgatcg

SEQ ID NO: 245497 - DNA, 25 bp, Mus musculus
atccttcactccatgcaagagatgt

SEQ ID NO: 245498 - DNA, 25 bp, Mus musculus
atccttcactccttgcaagagatgt

SEQ ID NO: 245499 - DNA, 25 bp, Mus musculus
atccttcactgacctcaaatattcc

SEQ ID NO: 245500 - DNA, 25 bp, Mus musculus
atccttcactgagctcaaatattcc

SEQ ID NO: 245501 - DNA, 25 bp, Mus musculus
atccttcaggacattgaccatgacg

SEQ ID NO: 245502 - DNA, 25 bp, Mus musculus
atccttcaggactttgaccatgacg

SEQ ID NO: 245503 - DNA, 25 bp, Mus musculus
atccttcagtgcctttgtcgtaaaa

SEQ ID NO: 245504 - DNA, 25 bp, Mus musculus
atccttcagtgcgtttgtcgtaaaa

SEQ ID NO: 245505 - DNA, 25 bp, Mus musculus
atccttcatcacacttctcatattt

SEQ ID NO: 245506 - DNA, 25 bp, Mus musculus
atccttcatcactcttctcatattt

SEQ ID NO: 245507 - DNA, 25 bp, Mus musculus
atccttcatcttacgcatgtgcaga

SEQ ID NO: 245508 - DNA, 25 bp, Mus musculus
atccttcatctttcgcatgtgcaga

SEQ ID NO: 245509 - DNA, 25 bp, Mus musculus
atccttcattggattcttcacacac

SEQ ID NO: 245510 - DNA, 25 bp, Mus musculus
atccttcattggtttcttcacacac

SEQ ID NO: 245511 - DNA, 25 bp, Mus musculus
atccttcattttagcttaatggcct

SEQ ID NO: 245512 - DNA, 25 bp, Mus musculus
atccttcatttttgcttaatggcct

SEQ ID NO: 245513 - DNA, 25 bp, Mus musculus
atccttccacagaagacctttgtct

SEQ ID NO: 245514 - DNA, 25 bp, Mus musculus
atccttccacagtagacctttgtct

SEQ ID NO: 245515 - DNA, 25 bp, Mus musculus
atccttccacttaagatatctgact

SEQ ID NO: 245516 - DNA, 25 bp, Mus musculus
atccttccactttagatatctgact

SEQ ID NO: 245517 - DNA, 25 bp, Mus musculus
atccttccagtgacagcgaggtctc

SEQ ID NO: 245518 - DNA, 25 bp, Mus musculus
atccttccagtgtcagcgaggtctc

SEQ ID NO: 245519 - DNA, 25 bp, Mus musculus
atccttccatcccatgctcagatat

SEQ ID NO: 245520 - DNA, 25 bp, Mus musculus
atccttccatccgatgctcagatat

SEQ ID NO: 245521 - DNA, 25 bp, Mus musculus
atccttccatgaccaatggatggac

SEQ ID NO: 245522 - DNA, 25 bp, Mus musculus
atccttccatgagcaatggatggac

SEQ ID NO: 245523 - DNA, 25 bp, Mus musculus
atccttcccaccagtcaaatgtgaa

SEQ ID NO: 245524 - DNA, 25 bp, Mus musculus
atccttcccacctgtcaaatgtgaa

SEQ ID NO: 245525 - DNA, 25 bp, Mus musculus
atccttccgaggagtctgctaggtg

SEQ ID NO: 245526 - DNA, 25 bp, Mus musculus
atccttccgaggtgtctgctaggtg

SEQ ID NO: 245527 - DNA, 25 bp, Mus musculus
atccttcctgaccaactaagctaaa

SEQ ID NO: 245528 - DNA, 25 bp, Mus musculus
atccttcctgacgaactaagctaaa

SEQ ID NO: 245529 - DNA, 25 bp, Mus musculus
atccttcctgccacattggaatagc

SEQ ID NO: 245530 - DNA, 25 bp, Mus musculus
atccttcctgccatgacagtaacag

SEQ ID NO: 245531 - DNA, 25 bp, Mus musculus
atccttcctgcctcattggaatagc

SEQ ID NO: 245532 - DNA, 25 bp, Mus musculus
atccttcctgccttgacagtaacag

SEQ ID NO: 245533 - DNA, 25 bp, Mus musculus
atccttcctgctctttagtgtaata

SEQ ID NO: 245534 - DNA, 25 bp, Mus musculus
atccttcctgctgtttagtgtaata

SEQ ID NO: 245535 - DNA, 25 bp, Mus musculus
atccttcctgtgacgtcatgcatgg

SEQ ID NO: 245536 - DNA, 25 bp, Mus musculus
atccttcctgtgaggcagatgagtg

SEQ ID NO: 245537 - DNA, 25 bp, Mus musculus
atccttcctgtgtcgtcatgcatgg

SEQ ID NO: 245538 - DNA, 25 bp, Mus musculus
atccttcctgtgtggcagatgagtg

SEQ ID NO: 245539 - DNA, 25 bp, Mus musculus
atccttcgaccaatatctgggccac

SEQ ID NO: 245540 - DNA, 25 bp, Mus musculus
atccttcgaccattatctgggccac

SEQ ID NO: 245541 - DNA, 25 bp, Mus musculus
atccttcgcaccatggtactttgaa

SEQ ID NO: 245542 - DNA, 25 bp, Mus musculus
atccttcgcaccttggtactttgaa

SEQ ID NO: 245543 - DNA, 25 bp, Mus musculus
atccttcggagcatgtacaggtgca

SEQ ID NO: 245544 - DNA, 25 bp, Mus musculus
atccttcggagcttgtacaggtgca

SEQ ID NO: 245545 - DNA, 25 bp, Mus musculus
atccttcggcagcttagcatgcgga

SEQ ID NO: 245546 - DNA, 25 bp, Mus musculus
atccttcggcaggttagcatgcgga

SEQ ID NO: 245547 - DNA, 25 bp, Mus musculus
atccttcgtccaactctgggaatga

SEQ ID NO: 245548 - DNA, 25 bp, Mus musculus
atccttcgtccatctctgggaatga

SEQ ID NO: 245549 - DNA, 25 bp, Mus musculus
atccttctaatgaggctctttccct

SEQ ID NO: 245550 - DNA, 25 bp, Mus musculus
atccttctaatgtggctctttccct

SEQ ID NO: 245551 - DNA, 25 bp, Mus musculus
atccttctagatcctcctgaatggg

SEQ ID NO: 245552 - DNA, 25 bp, Mus musculus
atccttctagatgctcctgaatggg

SEQ ID NO: 245553 - DNA, 25 bp, Mus musculus
atccttctcaaaacttgcctcatgc

SEQ ID NO: 245554 - DNA, 25 bp, Mus musculus
atccttctcaaatcttgcctcatgc

SEQ ID NO: 245555 - DNA, 25 bp, Mus musculus
atccttctcatgcacatccggagga

SEQ ID NO: 245556 - DNA, 25 bp, Mus musculus
atccttctcatggacatccggagga

SEQ ID NO: 245557 - DNA, 25 bp, Mus musculus
atccttctccctctctagaaatgta

SEQ ID NO: 245558 - DNA, 25 bp, Mus musculus
atccttctccctgtctagaaatgta

SEQ ID NO: 245559 - DNA, 25 bp, Mus musculus
atccttctcgcaccaagggctaaac

SEQ ID NO: 245560 - DNA, 25 bp, Mus musculus
atccttctcgcagcaagggctaaac

SEQ ID NO: 245561 - DNA, 25 bp, Mus musculus
atccttctctggactgttcaatggc

SEQ ID NO: 245562 - DNA, 25 bp, Mus musculus
atccttctctggcaatcagccagta

SEQ ID NO: 245563 - DNA, 25 bp, Mus musculus
atccttctctgggaatcagccagta

SEQ ID NO: 245564 - DNA, 25 bp, Mus musculus
atccttctctggtctgttcaatggc

SEQ ID NO: 245565 - DNA, 25 bp, Mus musculus
atccttctgatcacatagcacttgt

SEQ ID NO: 245566 - DNA, 25 bp, Mus musculus
atccttctgatctcatagcacttgt

SEQ ID NO: 245567 - DNA, 25 bp, Mus musculus
atccttctgatgcttctacatatga

SEQ ID NO: 245568 - DNA, 25 bp, Mus musculus
atccttctgatggttctacatatga

SEQ ID NO: 245569 - DNA, 25 bp, Mus musculus
atccttctgcacaactgcatacata

SEQ ID NO: 245570 - DNA, 25 bp, Mus musculus
atccttctgcactactgcatacata

SEQ ID NO: 245571 - DNA, 25 bp, Mus musculus
atccttctgcgtatctgtacataca

SEQ ID NO: 245572 - DNA, 25 bp, Mus musculus
atccttctgcgtttctgtacataca

SEQ ID NO: 245573 - DNA, 25 bp, Mus musculus
atccttctggcgcaatgttacccag

SEQ ID NO: 245574 - DNA, 25 bp, Mus musculus
atccttctggcggaatgttacccag

SEQ ID NO: 245575 - DNA, 25 bp, Mus musculus
atccttctggtaatgtgtcactctg

SEQ ID NO: 245576 - DNA, 25 bp, Mus musculus
atccttctggtattgtgtcactctg

SEQ ID NO: 245577 - DNA, 25 bp, Mus musculus
atccttctggtgcttagcgtagggc

SEQ ID NO: 245578 - DNA, 25 bp, Mus musculus
atccttctggtggttagcgtagggc

SEQ ID NO: 245579 - DNA, 25 bp, Mus musculus
atccttctgtccaggatttccatgc

SEQ ID NO: 245580 - DNA, 25 bp, Mus musculus
atccttctgtcctggatttccatgc

SEQ ID NO: 245581 - DNA, 25 bp, Mus musculus
atccttctgttcatcaggagagctc

SEQ ID NO: 245582 - DNA, 25 bp, Mus musculus
atccttctgttcttcaggagagctc

SEQ ID NO: 245583 - DNA, 25 bp, Mus musculus
atccttcttaaactgcaggtgtgac

SEQ ID NO: 245584 - DNA, 25 bp, Mus musculus
atccttcttaaagtgcaggtgtgac

SEQ ID NO: 245585 - DNA, 25 bp, Mus musculus
atccttcttagtccattacaaacct

SEQ ID NO: 245586 - DNA, 25 bp, Mus musculus
atccttcttagtgcattacaaacct

SEQ ID NO: 245587 - DNA, 25 bp, Mus musculus
atccttcttcacaacgacgcagaaa

SEQ ID NO: 245588 - DNA, 25 bp, Mus musculus
atccttcttcactacgacgcagaaa

SEQ ID NO: 245589 - DNA, 25 bp, Mus musculus
atccttcttcagaccatattttgtg

SEQ ID NO: 245590 - DNA, 25 bp, Mus musculus
atccttcttcagtccatattttgtg

SEQ ID NO: 245591 - DNA, 25 bp, Mus musculus
atccttcttcatatacccagaacta

SEQ ID NO: 245592 - DNA, 25 bp, Mus musculus
atccttcttcatttacccagaacta

SEQ ID NO: 245593 - DNA, 25 bp, Mus musculus
atccttcttgatcgtttttgtgctg

SEQ ID NO: 245594 - DNA, 25 bp, Mus musculus
atccttcttgatggtttttgtgctg

SEQ ID NO: 245595 - DNA, 25 bp, Mus musculus
atccttctttctagtactctgtgta

SEQ ID NO: 245596 - DNA, 25 bp, Mus musculus
atccttctttcttgtactctgtgta

SEQ ID NO: 245597 - DNA, 25 bp, Mus musculus
atccttgaaatgcttctgacaagac

SEQ ID NO: 245598 - DNA, 25 bp, Mus musculus
atccttgaaatggttctgacaagac

SEQ ID NO: 245599 - DNA, 25 bp, Mus musculus
atccttgaactcatgctgtagctta

SEQ ID NO: 245600 - DNA, 25 bp, Mus musculus
atccttgaactcttgctgtagctta

SEQ ID NO: 245601 - DNA, 25 bp, Mus musculus
atccttgaccaaaaacgcactacac

SEQ ID NO: 245602 - DNA, 25 bp, Mus musculus
atccttgaccaataacgcactacac

SEQ ID NO: 245603 - DNA, 25 bp, Mus musculus
atccttgaccttcattttgctcagg

SEQ ID NO: 245604 - DNA, 25 bp, Mus musculus
atccttgaccttgattttgctcagg

SEQ ID NO: 245605 - DNA, 25 bp, Mus musculus
atccttgacttgcttgtgggttgtg

SEQ ID NO: 245606 - DNA, 25 bp, Mus musculus
atccttgacttggttgtgggttgtg

SEQ ID NO: 245607 - DNA, 25 bp, Mus musculus
atccttgagatgcaaaagtacacgt

SEQ ID NO: 245608 - DNA, 25 bp, Mus musculus
atccttgagatggaaaagtacacgt

SEQ ID NO: 245609 - DNA, 25 bp, Mus musculus
atccttgagattccattccggttac

SEQ ID NO: 245610 - DNA, 25 bp, Mus musculus
atccttgagattgcattccggttac

SEQ ID NO: 245611 - DNA, 25 bp, Mus musculus
atccttgagtatcgtctggttgccc

SEQ ID NO: 245612 - DNA, 25 bp, Mus musculus
atccttgagtatggtctggttgccc

SEQ ID NO: 245613 - DNA, 25 bp, Mus musculus
atccttgatgttagccgcctggcgg

SEQ ID NO: 245614 - DNA, 25 bp, Mus musculus
atccttgatgtttgccgcctggcgg

SEQ ID NO: 245615 - DNA, 25 bp, Mus musculus
atccttgcaattcaggtggtagaag

SEQ ID NO: 245616 - DNA, 25 bp, Mus musculus
atccttgcaattgaggtggtagaag

SEQ ID NO: 245617 - DNA, 25 bp, Mus musculus
atccttgcactgagaaggctaaggc

SEQ ID NO: 245618 - DNA, 25 bp, Mus musculus
atccttgcactgtgaaggctaaggc

SEQ ID NO: 245619 - DNA, 25 bp, Mus musculus
atccttgcagaaatcagtattgtac

SEQ ID NO: 245620 - DNA, 25 bp, Mus musculus
atccttgcagaattcagtattgtac

SEQ ID NO: 245621 - DNA, 25 bp, Mus musculus
atccttgcagcactttgttggtaag

SEQ ID NO: 245622 - DNA, 25 bp, Mus musculus
atccttgcagcagtttgttggtaag

SEQ ID NO: 245623 - DNA, 25 bp, Mus musculus
atccttgcatgaaaatgttgttccc

SEQ ID NO: 245624 - DNA, 25 bp, Mus musculus
atccttgcatgataatgttgttccc

SEQ ID NO: 245625 - DNA, 25 bp, Mus musculus
atccttgcatgtcttatcagactag

SEQ ID NO: 245626 - DNA, 25 bp, Mus musculus
atccttgcatgtgttatcagactag

SEQ ID NO: 245627 - DNA, 25 bp, Mus musculus
atccttgcccagacaacgggaggga

SEQ ID NO: 245628 - DNA, 25 bp, Mus musculus
atccttgcccagtcaacgggaggga

SEQ ID NO: 245629 - DNA, 25 bp, Mus musculus
atccttgccctgatctatgagttct

SEQ ID NO: 245630 - DNA, 25 bp, Mus musculus
atccttgccctgttctatgagttct

SEQ ID NO: 245631 - DNA, 25 bp, Mus musculus
atccttgccgacagcatgatgaaac

SEQ ID NO: 245632 - DNA, 25 bp, Mus musculus
atccttgccgactgcatgatgaaac

SEQ ID NO: 245633 - DNA, 25 bp, Mus musculus
atccttgcctctacagagacttaac

SEQ ID NO: 245634 - DNA, 25 bp, Mus musculus
atccttgcctcttcagagacttaac

SEQ ID NO: 245635 - DNA, 25 bp, Mus musculus
atccttgcctgcatgcactatgcac

SEQ ID NO: 245636 - DNA, 25 bp, Mus musculus
atccttgcctgcttgcactatgcac

SEQ ID NO: 245637 - DNA, 25 bp, Mus musculus
atccttgctacactttctcattgta

SEQ ID NO: 245638 - DNA, 25 bp, Mus musculus
atccttgctacagtttctcattgta

SEQ ID NO: 245639 - DNA, 25 bp, Mus musculus
atccttgctcccatgcagagagagg

SEQ ID NO: 245640 - DNA, 25 bp, Mus musculus
atccttgctcccttgcagagagagg

SEQ ID NO: 245641 - DNA, 25 bp, Mus musculus
atccttgctgtcaagaaagcccgga

SEQ ID NO: 245642 - DNA, 25 bp, Mus musculus
atccttgctgtctagaaagcccgga

SEQ ID NO: 245643 - DNA, 25 bp, Mus musculus
atccttgcttctctgtctcttccat

SEQ ID NO: 245644 - DNA, 25 bp, Mus musculus
atccttgcttctgtgtctcttccat

SEQ ID NO: 245645 - DNA, 25 bp, Mus musculus
atccttggagccaccttttgtgtca

SEQ ID NO: 245646 - DNA, 25 bp, Mus musculus
atccttggagcctccttttgtgtca

SEQ ID NO: 245647 - DNA, 25 bp, Mus musculus
atccttggaggcaaactggctagct

SEQ ID NO: 245648 - DNA, 25 bp, Mus musculus
atccttggaggccatcagacagcag

SEQ ID NO: 245649 - DNA, 25 bp, Mus musculus
atccttggaggcgatcagacagcag

SEQ ID NO: 245650 - DNA, 25 bp, Mus musculus
atccttggaggctaactggctagct

SEQ ID NO: 245651 - DNA, 25 bp, Mus musculus
atccttggatctagctgtattgtta

SEQ ID NO: 245652 - DNA, 25 bp, Mus musculus
atccttggatcttgctgtattgtta

SEQ ID NO: 245653 - DNA, 25 bp, Mus musculus
atccttggattcctggaacaccttc

SEQ ID NO: 245654 - DNA, 25 bp, Mus musculus
atccttggattcgtggaacaccttc

SEQ ID NO: 245655 - DNA, 25 bp, Mus musculus
atccttggcaaccaacactggtcaa

SEQ ID NO: 245656 - DNA, 25 bp, Mus musculus
atccttggcaacgaacactggtcaa

SEQ ID NO: 245657 - DNA, 25 bp, Mus musculus
atccttggcactcagcgtcagttta

SEQ ID NO: 245658 - DNA, 25 bp, Mus musculus
atccttggcactgagcgtcagttta

SEQ ID NO: 245659 - DNA, 25 bp, Mus musculus
atccttggcatcaagcacttacatc

SEQ ID NO: 245660 - DNA, 25 bp, Mus musculus
atccttggcatctagcacttacatc

SEQ ID NO: 245661 - DNA, 25 bp, Mus musculus
atccttggcctactcccagcagtag

SEQ ID NO: 245662 - DNA, 25 bp, Mus musculus
atccttggcctagtcccagcagtag

SEQ ID NO: 245663 - DNA, 25 bp, Mus musculus
atccttggccttagacctcatggag

SEQ ID NO: 245664 - DNA, 25 bp, Mus musculus
atccttggcctttgacctcatggag

SEQ ID NO: 245665 - DNA, 25 bp, Mus musculus
atccttgggagcagtctcttcctct

SEQ ID NO: 245666 - DNA, 25 bp, Mus musculus
atccttgggagccttgggcattgat

SEQ ID NO: 245667 - DNA, 25 bp, Mus musculus
atccttgggagcgttgggcattgat

SEQ ID NO: 245668 - DNA, 25 bp, Mus musculus
atccttgggagctgtctcttcctct

SEQ ID NO: 245669 - DNA, 25 bp, Mus musculus
atccttgggccaaagcaggcagaga

SEQ ID NO: 245670 - DNA, 25 bp, Mus musculus
atccttgggccaactgtccacctat

SEQ ID NO: 245671 - DNA, 25 bp, Mus musculus
atccttgggccatagcaggcagaga

SEQ ID NO: 245672 - DNA, 25 bp, Mus musculus
atccttgggccatctgtccacctat

SEQ ID NO: 245673 - DNA, 25 bp, Mus musculus
atccttgggtagctggtccatgcaa

SEQ ID NO: 245674 - DNA, 25 bp, Mus musculus
atccttgggtaggtggtccatgcaa

SEQ ID NO: 245675 - DNA, 25 bp, Mus musculus
atccttggtcatcatcacagtgtgc

SEQ ID NO: 245676 - DNA, 25 bp, Mus musculus
atccttggtcatgatcacagtgtgc

SEQ ID NO: 245677 - DNA, 25 bp, Mus musculus
atccttggtttccaagcaaccagag

SEQ ID NO: 245678 - DNA, 25 bp, Mus musculus
atccttggtttcgaagcaaccagag

SEQ ID NO: 245679 - DNA, 25 bp, Mus musculus
atccttggtttgattctatagcttt

SEQ ID NO: 245680 - DNA, 25 bp, Mus musculus
atccttggtttgtttctatagcttt

SEQ ID NO: 245681 - DNA, 25 bp, Mus musculus
atccttgtacctagccatcatgtat

SEQ ID NO: 245682 - DNA, 25 bp, Mus musculus
atccttgtacctcaggtttaggatt

SEQ ID NO: 245683 - DNA, 25 bp, Mus musculus
atccttgtacctgaggtttaggatt

SEQ ID NO: 245684 - DNA, 25 bp, Mus musculus
atccttgtaccttgccatcatgtat

SEQ ID NO: 245685 - DNA, 25 bp, Mus musculus
atccttgtagctatgccccgtgttt

SEQ ID NO: 245686 - DNA, 25 bp, Mus musculus
atccttgtagctttgccccgtgttt

SEQ ID NO: 245687 - DNA, 25 bp, Mus musculus
atccttgtaggactccatgctgcca

SEQ ID NO: 245688 - DNA, 25 bp, Mus musculus
atccttgtaggagtccatgctgcca

SEQ ID NO: 245689 - DNA, 25 bp, Mus musculus
atccttgtagtgcttcacacatgaa

SEQ ID NO: 245690 - DNA, 25 bp, Mus musculus
atccttgtagtggttcacacatgaa

SEQ ID NO: 245691 - DNA, 25 bp, Mus musculus
atccttgtatagagacgtgttgtgt

SEQ ID NO: 245692 - DNA, 25 bp, Mus musculus
atccttgtatagtgacgtgttgtgt

SEQ ID NO: 245693 - DNA, 25 bp, Mus musculus
atccttgtcaggactctgatgagga

SEQ ID NO: 245694 - DNA, 25 bp, Mus musculus
atccttgtcaggtctctgatgagga

SEQ ID NO: 245695 - DNA, 25 bp, Mus musculus
atccttgtcatccatccggacgtga

SEQ ID NO: 245696 - DNA, 25 bp, Mus musculus
atccttgtcatcgatccggacgtga

SEQ ID NO: 245697 - DNA, 25 bp, Mus musculus
atccttgtcctaagtgctgctgaat

SEQ ID NO: 245698 - DNA, 25 bp, Mus musculus
atccttgtcctatgtgctgctgaat

SEQ ID NO: 245699 - DNA, 25 bp, Mus musculus
atccttgtcttgattcttatcttaa

SEQ ID NO: 245700 - DNA, 25 bp, Mus musculus
atccttgtcttgtttcttatcttaa

SEQ ID NO: 245701 - DNA, 25 bp, Mus musculus
atccttgtgcaacaccagagagtcc

SEQ ID NO: 245702 - DNA, 25 bp, Mus musculus
atccttgtgcaagaccagagagtcc

SEQ ID NO: 245703 - DNA, 25 bp, Mus musculus
atccttgtgcctatgatgatattgg

SEQ ID NO: 245704 - DNA, 25 bp, Mus musculus
atccttgtgcctttgatgatattgg

SEQ ID NO: 245705 - DNA, 25 bp, Mus musculus
atccttgtgcgtccagaaagtacaa

SEQ ID NO: 245706 - DNA, 25 bp, Mus musculus
atccttgtgcgtgcagaaagtacaa

SEQ ID NO: 245707 - DNA, 25 bp, Mus musculus
atccttgtggaccttgggctagtct

SEQ ID NO: 245708 - DNA, 25 bp, Mus musculus
atccttgtggacgttgggctagtct

SEQ ID NO: 245709 - DNA, 25 bp, Mus musculus
atccttgtggagaaacagaataaac

SEQ ID NO: 245710 - DNA, 25 bp, Mus musculus
atccttgtggagtaacagaataaac

SEQ ID NO: 245711 - DNA, 25 bp, Mus musculus
atccttgtggccacggcagagtgtc

SEQ ID NO: 245712 - DNA, 25 bp, Mus musculus
atccttgtggccactatggagaggg

SEQ ID NO: 245713 - DNA, 25 bp, Mus musculus
atccttgtggcctcggcagagtgtc

SEQ ID NO: 245714 - DNA, 25 bp, Mus musculus
atccttgtggcctctatggagaggg

SEQ ID NO: 245715 - DNA, 25 bp, Mus musculus
atccttgtggctactcgatgaatgg

SEQ ID NO: 245716 - DNA, 25 bp, Mus musculus
atccttgtggctactggctataaca

SEQ ID NO: 245717 - DNA, 25 bp, Mus musculus
atccttgtggcttctcgatgaatgg

SEQ ID NO: 245718 - DNA, 25 bp, Mus musculus
atccttgtggcttctggctataaca

SEQ ID NO: 245719 - DNA, 25 bp, Mus musculus
atccttgtggtgcttacacacaccc

SEQ ID NO: 245720 - DNA, 25 bp, Mus musculus
atccttgtggtggttacacacaccc

SEQ ID NO: 245721 - DNA, 25 bp, Mus musculus
atccttgtgtccagaatcccagatg

SEQ ID NO: 245722 - DNA, 25 bp, Mus musculus
atccttgtgtcctgaatcccagatg

SEQ ID NO: 245723 - DNA, 25 bp, Mus musculus
atccttgtgtgaagcattttcctgc

SEQ ID NO: 245724 - DNA, 25 bp, Mus musculus
atccttgtgtgatgcattttcctgc

SEQ ID NO: 245725 - DNA, 25 bp, Mus musculus
atccttgttaagaggccagcctggg

SEQ ID NO: 245726 - DNA, 25 bp, Mus musculus
atccttgttaagtggccagcctggg

SEQ ID NO: 245727 - DNA, 25 bp, Mus musculus
atccttgttgatatttgggaacact

SEQ ID NO: 245728 - DNA, 25 bp, Mus musculus
atccttgttgatcatatcctgccct

SEQ ID NO: 245729 - DNA, 25 bp, Mus musculus
atccttgttgatgatatcctgccct

SEQ ID NO: 245730 - DNA, 25 bp, Mus musculus
atccttgttgatttttgggaacact

SEQ ID NO: 245731 - DNA, 25 bp, Mus musculus
atccttgttttgctggagcccattg

SEQ ID NO: 245732 - DNA, 25 bp, Mus musculus
atccttgttttggtggagcccattg

SEQ ID NO: 245733 - DNA, 25 bp, Mus musculus
atcctttacatcctagctttgtggc

SEQ ID NO: 245734 - DNA, 25 bp, Mus musculus
atcctttacatcgtagctttgtggc

SEQ ID NO: 245735 - DNA, 25 bp, Mus musculus
atcctttaccacattactgccagtg

SEQ ID NO: 245736 - DNA, 25 bp, Mus musculus
atcctttaccactttactgccagtg

SEQ ID NO: 245737 - DNA, 25 bp, Mus musculus
atcctttacctcaatggcgacttcg

SEQ ID NO: 245738 - DNA, 25 bp, Mus musculus
atcctttacctctatggcgacttcg

SEQ ID NO: 245739 - DNA, 25 bp, Mus musculus
atcctttagaggctaccttcattgc

SEQ ID NO: 245740 - DNA, 25 bp, Mus musculus
atcctttagagggtaccttcattgc

SEQ ID NO: 245741 - DNA, 25 bp, Mus musculus
atcctttaggccctgtggccatgaa

SEQ ID NO: 245742 - DNA, 25 bp, Mus musculus
atcctttaggccgtgtggccatgaa

SEQ ID NO: 245743 - DNA, 25 bp, Mus musculus
atcctttatcagagttggtcctccc

SEQ ID NO: 245744 - DNA, 25 bp, Mus musculus
atcctttatcagtgttggtcctccc

SEQ ID NO: 245745 - DNA, 25 bp, Mus musculus
atcctttattccacttctaggaagt

SEQ ID NO: 245746 - DNA, 25 bp, Mus musculus
atcctttattcctcttctaggaagt

SEQ ID NO: 245747 - DNA, 25 bp, Mus musculus
atcctttcaactctgaagtcccact

SEQ ID NO: 245748 - DNA, 25 bp, Mus musculus
atcctttcaactgtgaagtcccact

SEQ ID NO: 245749 - DNA, 25 bp, Mus musculus
atcctttcaggaatccgttttagtg

SEQ ID NO: 245750 - DNA, 25 bp, Mus musculus
atcctttcaggattccgttttagtg

SEQ ID NO: 245751 - DNA, 25 bp, Mus musculus
atcctttcccaaagatctcaactat

SEQ ID NO: 245752 - DNA, 25 bp, Mus musculus
atcctttcccaatgatctcaactat

SEQ ID NO: 245753 - DNA, 25 bp, Mus musculus
atcctttctataacgtgtttactaa

SEQ ID NO: 245754 - DNA, 25 bp, Mus musculus
atcctttctatatcgtgtttactaa

SEQ ID NO: 245755 - DNA, 25 bp, Mus musculus
atcctttctcaaccacctgaaggtg

SEQ ID NO: 245756 - DNA, 25 bp, Mus musculus
atcctttctcaagcacctgaaggtg

SEQ ID NO: 245757 - DNA, 25 bp, Mus musculus
atcctttctcagaaaaagtgttcaa

SEQ ID NO: 245758 - DNA, 25 bp, Mus musculus
atcctttctcagtaaaagtgttcaa

SEQ ID NO: 245759 - DNA, 25 bp, Mus musculus
atcctttctcttatgtatgttctcg

SEQ ID NO: 245760 - DNA, 25 bp, Mus musculus
atcctttctcttttgtatgttctcg

SEQ ID NO: 245761 - DNA, 25 bp, Mus musculus
atcctttctgaactcatcctgaaac

SEQ ID NO: 245762 - DNA, 25 bp, Mus musculus
atcctttctgaagtcatcctgaaac

SEQ ID NO: 245763 - DNA, 25 bp, Mus musculus
atcctttctgccctgatgaaattga

SEQ ID NO: 245764 - DNA, 25 bp, Mus musculus
atcctttctgccgtgatgaaattga

SEQ ID NO: 245765 - DNA, 25 bp, Mus musculus
atcctttgaggcaagtgttcccttt

SEQ ID NO: 245766 - DNA, 25 bp, Mus musculus
atcctttgaggctagtgttcccttt

SEQ ID NO: 245767 - DNA, 25 bp, Mus musculus
atcctttgatctctgcatacatgca

SEQ ID NO: 245768 - DNA, 25 bp, Mus musculus
atcctttgatctgtgcatacatgca

SEQ ID NO: 245769 - DNA, 25 bp, Mus musculus
atcctttgatttatgccagtgctat

SEQ ID NO: 245770 - DNA, 25 bp, Mus musculus
atcctttgatttttgccagtgctat

SEQ ID NO: 245771 - DNA, 25 bp, Mus musculus
atcctttgcaagacatccatgtcat

SEQ ID NO: 245772 - DNA, 25 bp, Mus musculus
atcctttgcaagtcatccatgtcat

SEQ ID NO: 245773 - DNA, 25 bp, Mus musculus
atcctttgctacatagtgagcttga

SEQ ID NO: 245774 - DNA, 25 bp, Mus musculus
atcctttgctacttagtgagcttga

SEQ ID NO: 245775 - DNA, 25 bp, Mus musculus
atcctttgctcaaagtaaaatgtgc

SEQ ID NO: 245776 - DNA, 25 bp, Mus musculus
atcctttgctcactgggcctcagct

SEQ ID NO: 245777 - DNA, 25 bp, Mus musculus
atcctttgctcagtgggcctcagct

SEQ ID NO: 245778 - DNA, 25 bp, Mus musculus
atcctttgctcatagtaaaatgtgc

SEQ ID NO: 245779 - DNA, 25 bp, Mus musculus
atcctttgctggcattgggatcctc

SEQ ID NO: 245780 - DNA, 25 bp, Mus musculus
atcctttgctgggattgggatcctc

SEQ ID NO: 245781 - DNA, 25 bp, Mus musculus
atcctttgctttcagactagccgtc

SEQ ID NO: 245782 - DNA, 25 bp, Mus musculus
atcctttgctttgagactagccgtc

SEQ ID NO: 245783 - DNA, 25 bp, Mus musculus
atcctttggcacacagcgttcagtt

SEQ ID NO: 245784 - DNA, 25 bp, Mus musculus
atcctttggcactcagcgttcagtt

SEQ ID NO: 245785 - DNA, 25 bp, Mus musculus
atcctttggctgaataatgtgttta

SEQ ID NO: 245786 - DNA, 25 bp, Mus musculus
atcctttggctgtataatgtgttta

SEQ ID NO: 245787 - DNA, 25 bp, Mus musculus
atcctttgtaggagagtcagtcggt

SEQ ID NO: 245788 - DNA, 25 bp, Mus musculus
atcctttgtaggtgagtcagtcggt

SEQ ID NO: 245789 - DNA, 25 bp, Mus musculus
atcctttgtatgagcagtttgtaaa

SEQ ID NO: 245790 - DNA, 25 bp, Mus musculus
atcctttgtatgagctatggcttct

SEQ ID NO: 245791 - DNA, 25 bp, Mus musculus
atcctttgtatgtgcagtttgtaaa

SEQ ID NO: 245792 - DNA, 25 bp, Mus musculus
atcctttgtatgtgctatggcttct

SEQ ID NO: 245793 - DNA, 25 bp, Mus musculus
atcctttgtggcacttctgttctgt

SEQ ID NO: 245794 - DNA, 25 bp, Mus musculus
atcctttgtggctcttctgttctgt

SEQ ID NO: 245795 - DNA, 25 bp, Mus musculus
atcctttgttagagtcgccaccttt

SEQ ID NO: 245796 - DNA, 25 bp, Mus musculus
atcctttgttagtgtcgccaccttt

SEQ ID NO: 245797 - DNA, 25 bp, Mus musculus
atcctttgtttacatgtggcccaca

SEQ ID NO: 245798 - DNA, 25 bp, Mus musculus
atcctttgtttagatgtggcccaca

SEQ ID NO: 245799 - DNA, 25 bp, Mus musculus
atccttttaaaaatcattggtggtg

SEQ ID NO: 245800 - DNA, 25 bp, Mus musculus
atccttttaaaattcattggtggtg

SEQ ID NO: 245801 - DNA, 25 bp, Mus musculus
atccttttaacaatttcactccctg

SEQ ID NO: 245802 - DNA, 25 bp, Mus musculus
atccttttaacattttcactccctg

SEQ ID NO: 245803 - DNA, 25 bp, Mus musculus
atccttttagaacacggcactagaa

SEQ ID NO: 245804 - DNA, 25 bp, Mus musculus
atccttttagaagacggcactagaa

SEQ ID NO: 245805 - DNA, 25 bp, Mus musculus
atccttttagagctgttgtgggtgt

SEQ ID NO: 245806 - DNA, 25 bp, Mus musculus
atccttttagaggtgttgtgggtgt

SEQ ID NO: 245807 - DNA, 25 bp, Mus musculus
atccttttatccacttatgacaagt

SEQ ID NO: 245808 - DNA, 25 bp, Mus musculus
atccttttatcctcttatgacaagt

SEQ ID NO: 245809 - DNA, 25 bp, Mus musculus
atccttttatggatctttccaaatc

SEQ ID NO: 245810 - DNA, 25 bp, Mus musculus
atccttttatggttctttccaaatc

SEQ ID NO: 245811 - DNA, 25 bp, Mus musculus
atccttttattaactgagccctgag

SEQ ID NO: 245812 - DNA, 25 bp, Mus musculus
atccttttattatctgagccctgag

SEQ ID NO: 245813 - DNA, 25 bp, Mus musculus
atccttttcaaacgctctggacggt

SEQ ID NO: 245814 - DNA, 25 bp, Mus musculus
atccttttcaaaggctctggacggt

SEQ ID NO: 245815 - DNA, 25 bp, Mus musculus
atccttttcattcggtgtggcatcc

SEQ ID NO: 245816 - DNA, 25 bp, Mus musculus
atccttttcattgggtgtggcatcc

SEQ ID NO: 245817 - DNA, 25 bp, Mus musculus
atccttttccgtcaagccaagatgc

SEQ ID NO: 245818 - DNA, 25 bp, Mus musculus
atccttttccgtgaagccaagatgc

SEQ ID NO: 245819 - DNA, 25 bp, Mus musculus
atccttttcctgcacgaaagccaag

SEQ ID NO: 245820 - DNA, 25 bp, Mus musculus
atccttttcctggacgaaagccaag

SEQ ID NO: 245821 - DNA, 25 bp, Mus musculus
atccttttctctatccaaacagctt

SEQ ID NO: 245822 - DNA, 25 bp, Mus musculus
atccttttctctttccaaacagctt

SEQ ID NO: 245823 - DNA, 25 bp, Mus musculus
atccttttgcacaccatactgtact

SEQ ID NO: 245824 - DNA, 25 bp, Mus musculus
atccttttgcactccatactgtact

SEQ ID NO: 245825 - DNA, 25 bp, Mus musculus
atccttttgcagagccctgttccag

SEQ ID NO: 245826 - DNA, 25 bp, Mus musculus
atccttttgcagtgccctgttccag

SEQ ID NO: 245827 - DNA, 25 bp, Mus musculus
atccttttgccacttaccacagtaa

SEQ ID NO: 245828 - DNA, 25 bp, Mus musculus
atccttttgccagttaccacagtaa

SEQ ID NO: 245829 - DNA, 25 bp, Mus musculus
atccttttggacacccagagcatgt

SEQ ID NO: 245830 - DNA, 25 bp, Mus musculus
atccttttggactcccagagcatgt

SEQ ID NO: 245831 - DNA, 25 bp, Mus musculus
atcctttttcggagcagggccagag

SEQ ID NO: 245832 - DNA, 25 bp, Mus musculus
atcctttttcggtgcagggccagag

SEQ ID NO: 245833 - DNA, 25 bp, Mus musculus
atccttttttccaagaccgtctgca

SEQ ID NO: 245834 - DNA, 25 bp, Mus musculus
atccttttttcctagaccgtctgca

SEQ ID NO: 245835 - DNA, 25 bp, Mus musculus
atcgaaaaactccatgttctgcatg

SEQ ID NO: 245836 - DNA, 25 bp, Mus musculus
atcgaaaaactcgatgttctgcatg

SEQ ID NO: 245837 - DNA, 25 bp, Mus musculus
atcgaaaacccaattcatggcctaa

SEQ ID NO: 245838 - DNA, 25 bp, Mus musculus
atcgaaaacccatttcatggcctaa

SEQ ID NO: 245839 - DNA, 25 bp, Mus musculus
atcgaaaacccgctggaggatcctg

SEQ ID NO: 245840 - DNA, 25 bp, Mus musculus
atcgaaaacccggtggaggatcctg

SEQ ID NO: 245841 - DNA, 25 bp, Mus musculus
atcgaaaattacaacacgcgtctgg

SEQ ID NO: 245842 - DNA, 25 bp, Mus musculus
atcgaaaattactacacgcgtctgg

SEQ ID NO: 245843 - DNA, 25 bp, Mus musculus
atcgaaacatttacagctgcctgcc

SEQ ID NO: 245844 - DNA, 25 bp, Mus musculus
atcgaaacattttcagctgcctgcc

SEQ ID NO: 245845 - DNA, 25 bp, Mus musculus
atcgaaacttggctatgatccctgc

SEQ ID NO: 245846 - DNA, 25 bp, Mus musculus
atcgaaacttgggtatgatccctgc

SEQ ID NO: 245847 - DNA, 25 bp, Mus musculus
atcgaaagctgcaacaaggccttgg

SEQ ID NO: 245848 - DNA, 25 bp, Mus musculus
atcgaaagctgctacaaggccttgg

SEQ ID NO: 245849 - DNA, 25 bp, Mus musculus
atcgaaaggccccgctacagtagaa

SEQ ID NO: 245850 - DNA, 25 bp, Mus musculus
atcgaaaggcccggctacagtagaa

SEQ ID NO: 245851 - DNA, 25 bp, Mus musculus
atcgaaatgtcaccggcacagcaga

SEQ ID NO: 245852 - DNA, 25 bp, Mus musculus
atcgaaatgtcagcggcacagcaga

SEQ ID NO: 245853 - DNA, 25 bp, Mus musculus
atcgaacaagcaaatctcctattat

SEQ ID NO: 245854 - DNA, 25 bp, Mus musculus
atcgaacaagcatatctcctattat

SEQ ID NO: 245855 - DNA, 25 bp, Mus musculus
atcgaacaagtgctgtggtccacac

SEQ ID NO: 245856 - DNA, 25 bp, Mus musculus
atcgaacaagtggtgtggtccacac

SEQ ID NO: 245857 - DNA, 25 bp, Mus musculus
atcgaacacttcctcatggacctgg

SEQ ID NO: 245858 - DNA, 25 bp, Mus musculus
atcgaacacttcgtcatggacctgg

SEQ ID NO: 245859 - DNA, 25 bp, Mus musculus
atcgaacccctaatccctggttgag

SEQ ID NO: 245860 - DNA, 25 bp, Mus musculus
atcgaacccctattccctggttgag

SEQ ID NO: 245861 - DNA, 25 bp, Mus musculus
atcgaacgaggacttgcctcctcct

SEQ ID NO: 245862 - DNA, 25 bp, Mus musculus
atcgaacgaggagttgcctcctcct

SEQ ID NO: 245863 - DNA, 25 bp, Mus musculus
atcgaactgaggcttcttctctgga

SEQ ID NO: 245864 - DNA, 25 bp, Mus musculus
atcgaactgagggttcttctctgga

SEQ ID NO: 245865 - DNA, 25 bp, Mus musculus
atcgaagaagacctggtgccacagc

SEQ ID NO: 245866 - DNA, 25 bp, Mus musculus
atcgaagaagacgtggtgccacagc

SEQ ID NO: 245867 - DNA, 25 bp, Mus musculus
atcgaagaagagatccgggcagccc

SEQ ID NO: 245868 - DNA, 25 bp, Mus musculus
atcgaagaagagttccgggcagccc

SEQ ID NO: 245869 - DNA, 25 bp, Mus musculus
atcgaagagagaagctgcggctgct

SEQ ID NO: 245870 - DNA, 25 bp, Mus musculus
atcgaagagagatgctgcggctgct

SEQ ID NO: 245871 - DNA, 25 bp, Mus musculus
atcgaagagcagctcagccgtgcca

SEQ ID NO: 245872 - DNA, 25 bp, Mus musculus
atcgaagagcaggtcagccgtgcca

SEQ ID NO: 245873 - DNA, 25 bp, Mus musculus
atcgaagcatttcggaagcattagc

SEQ ID NO: 245874 - DNA, 25 bp, Mus musculus
atcgaagcatttgggaagcattagc

SEQ ID NO: 245875 - DNA, 25 bp, Mus musculus
atcgaagcccacctgtactgaaagt

SEQ ID NO: 245876 - DNA, 25 bp, Mus musculus
atcgaagcccacgtgtactgaaagt

SEQ ID NO: 245877 - DNA, 25 bp, Mus musculus
atcgaagcggaccatgatcggctca

SEQ ID NO: 245878 - DNA, 25 bp, Mus musculus
atcgaagcggacgatgatcggctca

SEQ ID NO: 245879 - DNA, 25 bp, Mus musculus
atcgaagctggcagttctcgtcgga

SEQ ID NO: 245880 - DNA, 25 bp, Mus musculus
atcgaagctggctgttctcgtcgga

SEQ ID NO: 245881 - DNA, 25 bp, Mus musculus
atcgaaggacatctggtgaaatgct

SEQ ID NO: 245882 - DNA, 25 bp, Mus musculus
atcgaaggacatgtggtgaaatgct

SEQ ID NO: 245883 - DNA, 25 bp, Mus musculus
atcgaaggcagtcaggcaggcacct

SEQ ID NO: 245884 - DNA, 25 bp, Mus musculus
atcgaaggcagtgaggcaggcacct

SEQ ID NO: 245885 - DNA, 25 bp, Mus musculus
atcgaagtatcgagacccttcagaa

SEQ ID NO: 245886 - DNA, 25 bp, Mus musculus
atcgaagtatcgtgacccttcagaa

SEQ ID NO: 245887 - DNA, 25 bp, Mus musculus
atcgaagtcctacattactcccaag

SEQ ID NO: 245888 - DNA, 25 bp, Mus musculus
atcgaagtcctagattactcccaag

SEQ ID NO: 245889 - DNA, 25 bp, Mus musculus
atcgaatcggctcggcgtttggcct

SEQ ID NO: 245890 - DNA, 25 bp, Mus musculus
atcgaatcggctgggcgtttggcct

SEQ ID NO: 245891 - DNA, 25 bp, Mus musculus
atcgaatgcaatctctgactgcacg

SEQ ID NO: 245892 - DNA, 25 bp, Mus musculus
atcgaatgcaatgtctgactgcacg

SEQ ID NO: 245893 - DNA, 25 bp, Mus musculus
atcgaatgtttgaacccacgtgcct

SEQ ID NO: 245894 - DNA, 25 bp, Mus musculus
atcgaatgtttgtacccacgtgcct

SEQ ID NO: 245895 - DNA, 25 bp, Mus musculus
atcgaattgtctcctcagtttccct

SEQ ID NO: 245896 - DNA, 25 bp, Mus musculus
atcgaattgtctgctcagtttccct

SEQ ID NO: 245897 - DNA, 25 bp, Mus musculus
atcgacaacctcactagtgctttga

SEQ ID NO: 245898 - DNA, 25 bp, Mus musculus
atcgacaacctctctagtgctttga

SEQ ID NO: 245899 - DNA, 25 bp, Mus musculus
atcgacaagatgagcttcggcagca

SEQ ID NO: 245900 - DNA, 25 bp, Mus musculus
atcgacaagatgtgcttcggcagca

SEQ ID NO: 245901 - DNA, 25 bp, Mus musculus
atcgacaatctcatagacccagggt

SEQ ID NO: 245902 - DNA, 25 bp, Mus musculus
atcgacaatctcttagacccagggt

SEQ ID NO: 245903 - DNA, 25 bp, Mus musculus
atcgacaccgtcactgtgccgtatg

SEQ ID NO: 245904 - DNA, 25 bp, Mus musculus
atcgacaccgtctctgtgccgtatg

SEQ ID NO: 245905 - DNA, 25 bp, Mus musculus
atcgacacgcttcagatccatgtga

SEQ ID NO: 245906 - DNA, 25 bp, Mus musculus
atcgacacgcttgagatccatgtga

SEQ ID NO: 245907 - DNA, 25 bp, Mus musculus
atcgacagaactcggctgactcttc

SEQ ID NO: 245908 - DNA, 25 bp, Mus musculus
atcgacagaactgggctgactcttc

SEQ ID NO: 245909 - DNA, 25 bp, Mus musculus
atcgacagccacatccgcctggtgt

SEQ ID NO: 245910 - DNA, 25 bp, Mus musculus
atcgacagccacttccgcctggtgt

SEQ ID NO: 245911 - DNA, 25 bp, Mus musculus
atcgacaggttgctccagatggcct

SEQ ID NO: 245912 - DNA, 25 bp, Mus musculus
atcgacaggttggtccagatggcct

SEQ ID NO: 245913 - DNA, 25 bp, Mus musculus
atcgacatatataaggtgcgtgtac

SEQ ID NO: 245914 - DNA, 25 bp, Mus musculus
atcgacatatattaggtgcgtgtac

SEQ ID NO: 245915 - DNA, 25 bp, Mus musculus
atcgacatgtacctgatgggctgct

SEQ ID NO: 245916 - DNA, 25 bp, Mus musculus
atcgacatgtacgtgatgggctgct

SEQ ID NO: 245917 - DNA, 25 bp, Mus musculus
atcgacatgtggacagccggctgca

SEQ ID NO: 245918 - DNA, 25 bp, Mus musculus
atcgacatgtggtcagccggctgca

SEQ ID NO: 245919 - DNA, 25 bp, Mus musculus
atcgacattccaatactcgggcatg

SEQ ID NO: 245920 - DNA, 25 bp, Mus musculus
atcgacattccattactcgggcatg

SEQ ID NO: 245921 - DNA, 25 bp, Mus musculus
atcgaccaagctatggatgctcagc

SEQ ID NO: 245922 - DNA, 25 bp, Mus musculus
atcgaccaagctttggatgctcagc

SEQ ID NO: 245923 - DNA, 25 bp, Mus musculus
atcgaccaatctattcttaatgttc

SEQ ID NO: 245924 - DNA, 25 bp, Mus musculus
atcgaccaatcttttcttaatgttc

SEQ ID NO: 245925 - DNA, 25 bp, Mus musculus
atcgaccagcgcatagtctgaagaa

SEQ ID NO: 245926 - DNA, 25 bp, Mus musculus
atcgaccagcgcttagtctgaagaa

SEQ ID NO: 245927 - DNA, 25 bp, Mus musculus
atcgaccagctgaccatggacgaca

SEQ ID NO: 245928 - DNA, 25 bp, Mus musculus
atcgaccagctgtccatggacgaca

SEQ ID NO: 245929 - DNA, 25 bp, Mus musculus
atcgaccaggttagtccacttgccc

SEQ ID NO: 245930 - DNA, 25 bp, Mus musculus
atcgaccaggtttgtccacttgccc

SEQ ID NO: 245931 - DNA, 25 bp, Mus musculus
atcgaccatgacatatccagggact

SEQ ID NO: 245932 - DNA, 25 bp, Mus musculus
atcgaccatgacttatccagggact

SEQ ID NO: 245933 - DNA, 25 bp, Mus musculus
atcgacccactgaccactttaagga

SEQ ID NO: 245934 - DNA, 25 bp, Mus musculus
atcgacccactgtccactttaagga

SEQ ID NO: 245935 - DNA, 25 bp, Mus musculus
atcgaccctgctctgtggagtactt

SEQ ID NO: 245936 - DNA, 25 bp, Mus musculus
atcgaccctgctgtgtggagtactt

SEQ ID NO: 245937 - DNA, 25 bp, Mus musculus
atcgaccgccatagtcactgaccaa

SEQ ID NO: 245938 - DNA, 25 bp, Mus musculus
atcgaccgccattgtcactgaccaa

SEQ ID NO: 245939 - DNA, 25 bp, Mus musculus
atcgacctcaccaagagggctggag

SEQ ID NO: 245940 - DNA, 25 bp, Mus musculus
atcgacctcacctagagggctggag

SEQ ID NO: 245941 - DNA, 25 bp, Mus musculus
atcgacctcattcacaacccactca

SEQ ID NO: 245942 - DNA, 25 bp, Mus musculus
atcgacctcattgacaacccactca

SEQ ID NO: 245943 - DNA, 25 bp, Mus musculus
atcgacgagggtagacttccatcat

SEQ ID NO: 245944 - DNA, 25 bp, Mus musculus
atcgacgagggttgacttccatcat

SEQ ID NO: 245945 - DNA, 25 bp, Mus musculus
atcgacgatttaaacatggaattca

SEQ ID NO: 245946 - DNA, 25 bp, Mus musculus
atcgacgatttatacatggaattca

SEQ ID NO: 245947 - DNA, 25 bp, Mus musculus
atcgacgccagtaatataatcccaa

SEQ ID NO: 245948 - DNA, 25 bp, Mus musculus
atcgacgccagttatataatcccaa

SEQ ID NO: 245949 - DNA, 25 bp, Mus musculus
atcgacggcttgcaggattgccagc

SEQ ID NO: 245950 - DNA, 25 bp, Mus musculus
atcgacggcttggaggattgccagc

SEQ ID NO: 245951 - DNA, 25 bp, Mus musculus
atcgacgttgtaactaatttgctca

SEQ ID NO: 245952 - DNA, 25 bp, Mus musculus
atcgacgttgtatctaatttgctca

SEQ ID NO: 245953 - DNA, 25 bp, Mus musculus
atcgactatcggatctgtgcctgtg

SEQ ID NO: 245954 - DNA, 25 bp, Mus musculus
atcgactatcggttctgtgcctgtg

SEQ ID NO: 245955 - DNA, 25 bp, Mus musculus
atcgactcagacactcagacagact

SEQ ID NO: 245956 - DNA, 25 bp, Mus musculus
atcgactcagactctcagacagact

SEQ ID NO: 245957 - DNA, 25 bp, Mus musculus
atcgactccctgagcatcgagaaag

SEQ ID NO: 245958 - DNA, 25 bp, Mus musculus
atcgactccctgtgcatcgagaaag

SEQ ID NO: 245959 - DNA, 25 bp, Mus musculus
atcgactctgccaacaacgtggtgt

SEQ ID NO: 245960 - DNA, 25 bp, Mus musculus
atcgactctgcctacaacgtggtgt

SEQ ID NO: 245961 - DNA, 25 bp, Mus musculus
atcgactgcgtgctactaagcttta

SEQ ID NO: 245962 - DNA, 25 bp, Mus musculus
atcgactgcgtggtactaagcttta

SEQ ID NO: 245963 - DNA, 25 bp, Mus musculus
atcgactgcttccaggcctttttac

SEQ ID NO: 245964 - DNA, 25 bp, Mus musculus
atcgactgcttcgaggcctttttac

SEQ ID NO: 245965 - DNA, 25 bp, Mus musculus
atcgactggctccttgatgacattt

SEQ ID NO: 245966 - DNA, 25 bp, Mus musculus
atcgactggctcgttgatgacattt

SEQ ID NO: 245967 - DNA, 25 bp, Mus musculus
atcgactgggagcactagttcctgc

SEQ ID NO: 245968 - DNA, 25 bp, Mus musculus
atcgactgggaggactagttcctgc

SEQ ID NO: 245969 - DNA, 25 bp, Mus musculus
atcgactgtgataggatgtcactga

SEQ ID NO: 245970 - DNA, 25 bp, Mus musculus
atcgactgtgattggatgtcactga

SEQ ID NO: 245971 - DNA, 25 bp, Mus musculus
atcgactgtggcctggtccggctac

SEQ ID NO: 245972 - DNA, 25 bp, Mus musculus
atcgactgtggcgtggtccggctac

SEQ ID NO: 245973 - DNA, 25 bp, Mus musculus
atcgacttcacgcaggcatttcagg

SEQ ID NO: 245974 - DNA, 25 bp, Mus musculus
atcgacttcacggaggcatttcagg

SEQ ID NO: 245975 - DNA, 25 bp, Mus musculus
atcgacttcactcacgctgtgtcca

SEQ ID NO: 245976 - DNA, 25 bp, Mus musculus
atcgacttcactgacgctgtgtcca

SEQ ID NO: 245977 - DNA, 25 bp, Mus musculus
atcgacttgctgattagtctccaaa

SEQ ID NO: 245978 - DNA, 25 bp, Mus musculus
atcgacttgctgtttagtctccaaa

SEQ ID NO: 245979 - DNA, 25 bp, Mus musculus
atcgactttgacagcttcatctgct

SEQ ID NO: 245980 - DNA, 25 bp, Mus musculus
atcgactttgactgcttcatctgct

SEQ ID NO: 245981 - DNA, 25 bp, Mus musculus
atcgagaaggatattgcggcccata

SEQ ID NO: 245982 - DNA, 25 bp, Mus musculus
atcgagaaggattttgcggcccata

SEQ ID NO: 245983 - DNA, 25 bp, Mus musculus
atcgagaatgtgaaggccaagatcc

SEQ ID NO: 245984 - DNA, 25 bp, Mus musculus
atcgagaatgtgtaggccaagatcc

SEQ ID NO: 245985 - DNA, 25 bp, Mus musculus
atcgagacaaggaatatgagcagct

SEQ ID NO: 245986 - DNA, 25 bp, Mus musculus
atcgagacaaggtatatgagcagct

SEQ ID NO: 245987 - DNA, 25 bp, Mus musculus
atcgagacagtgacagcttgctttc

SEQ ID NO: 245988 - DNA, 25 bp, Mus musculus
atcgagacagtgtcagcttgctttc

SEQ ID NO: 245989 - DNA, 25 bp, Mus musculus
atcgagaccagtaccctgactgagg

SEQ ID NO: 245990 - DNA, 25 bp, Mus musculus
atcgagaccagttccctgactgagg

SEQ ID NO: 245991 - DNA, 25 bp, Mus musculus
atcgagaccctcatccgggacatgc

SEQ ID NO: 245992 - DNA, 25 bp, Mus musculus
atcgagaccctcttccgggacatgc

SEQ ID NO: 245993 - DNA, 25 bp, Mus musculus
atcgagacctggaagctatggccaa

SEQ ID NO: 245994 - DNA, 25 bp, Mus musculus
atcgagacctggtagctatggccaa

SEQ ID NO: 245995 - DNA, 25 bp, Mus musculus
atcgagagagccaggatgcgaaact

SEQ ID NO: 245996 - DNA, 25 bp, Mus musculus
atcgagagagcctggatgcgaaact

SEQ ID NO: 245997 - DNA, 25 bp, Mus musculus
atcgagagccgtcagctgagtgaca

SEQ ID NO: 245998 - DNA, 25 bp, Mus musculus
atcgagagccgtgagctgagtgaca

SEQ ID NO: 245999 - DNA, 25 bp, Mus musculus
atcgagagggcaaaccacggaaggt

SEQ ID NO: 246000 - DNA, 25 bp, Mus musculus
atcgagagggcataccacggaaggt

SEQ ID NO: 246001 - DNA, 25 bp, Mus musculus
atcgagcaccggagcttgagccctg

SEQ ID NO: 246002 - DNA, 25 bp, Mus musculus
atcgagcaccggtgcttgagccctg

SEQ ID NO: 246003 - DNA, 25 bp, Mus musculus
atcgagcactgcatacttgggctgc

SEQ ID NO: 246004 - DNA, 25 bp, Mus musculus
atcgagcactgcttacttgggctgc

SEQ ID NO: 246005 - DNA, 25 bp, Mus musculus
atcgagcagcatatgagctcatgct

SEQ ID NO: 246006 - DNA, 25 bp, Mus musculus
atcgagcagcatttgagctcatgct

SEQ ID NO: 246007 - DNA, 25 bp, Mus musculus
atcgagcctgtacaccagaacgaag

SEQ ID NO: 246008 - DNA, 25 bp, Mus musculus
atcgagcctgtagaccagaacgaag

SEQ ID NO: 246009 - DNA, 25 bp, Mus musculus
atcgagcgttgtcgcttcttcctgt

SEQ ID NO: 246010 - DNA, 25 bp, Mus musculus
atcgagcgttgtggcttcttcctgt

SEQ ID NO: 246011 - DNA, 25 bp, Mus musculus
atcgagctagccacggtgcagcctg

SEQ ID NO: 246012 - DNA, 25 bp, Mus musculus
atcgagctagcctcggtgcagcctg

SEQ ID NO: 246013 - DNA, 25 bp, Mus musculus
atcgagctcgcacagaagttacaag

SEQ ID NO: 246014 - DNA, 25 bp, Mus musculus
atcgagctcgcagagaagttacaag

SEQ ID NO: 246015 - DNA, 25 bp, Mus musculus
atcgagcttctgctctacagcaatc

SEQ ID NO: 246016 - DNA, 25 bp, Mus musculus
atcgagcttctggtctacagcaatc

SEQ ID NO: 246017 - DNA, 25 bp, Mus musculus
atcgagcttgtgagagacgctgtca

SEQ ID NO: 246018 - DNA, 25 bp, Mus musculus
atcgagcttgtgtgagacgctgtca

SEQ ID NO: 246019 - DNA, 25 bp, Mus musculus
atcgaggaaacaccttgaggccccg

SEQ ID NO: 246020 - DNA, 25 bp, Mus musculus
atcgaggaaacagcttgaggccccg

SEQ ID NO: 246021 - DNA, 25 bp, Mus musculus
atcgaggaagcgctggtcatcacag

SEQ ID NO: 246022 - DNA, 25 bp, Mus musculus
atcgaggaagcggtggtcatcacag

SEQ ID NO: 246023 - DNA, 25 bp, Mus musculus
atcgaggacggcatcggcctgttcc

SEQ ID NO: 246024 - DNA, 25 bp, Mus musculus
atcgaggacggcttcggcctgttcc

SEQ ID NO: 246025 - DNA, 25 bp, Mus musculus
atcgaggactttcctgacctgggca

SEQ ID NO: 246026 - DNA, 25 bp, Mus musculus
atcgaggactttgctgacctgggca

SEQ ID NO: 246027 - DNA, 25 bp, Mus musculus
atcgaggagaatcaagtgcacacac

SEQ ID NO: 246028 - DNA, 25 bp, Mus musculus
atcgaggagaatgaagtgcacacac

SEQ ID NO: 246029 - DNA, 25 bp, Mus musculus
atcgaggagatcatcgcctctctgc

SEQ ID NO: 246030 - DNA, 25 bp, Mus musculus
atcgaggagatcttcgcctctctgc

SEQ ID NO: 246031 - DNA, 25 bp, Mus musculus
atcgaggatctcaagtgtgccctct

SEQ ID NO: 246032 - DNA, 25 bp, Mus musculus
atcgaggatctctagtgtgccctct

SEQ ID NO: 246033 - DNA, 25 bp, Mus musculus
atcgaggcctcgcttcatccaggtc

SEQ ID NO: 246034 - DNA, 25 bp, Mus musculus
atcgaggcctcggttcatccaggtc

SEQ ID NO: 246035 - DNA, 25 bp, Mus musculus
atcgaggccttgaatggccaggcct

SEQ ID NO: 246036 - DNA, 25 bp, Mus musculus
atcgaggccttgtatggccaggcct

SEQ ID NO: 246037 - DNA, 25 bp, Mus musculus
atcgaggctgcacgcttcaagctta

SEQ ID NO: 246038 - DNA, 25 bp, Mus musculus
atcgaggctgcaggcttcaagctta

SEQ ID NO: 246039 - DNA, 25 bp, Mus musculus
atcgagggaattacagacaacatac

SEQ ID NO: 246040 - DNA, 25 bp, Mus musculus
atcgagggaatttcagacaacatac

SEQ ID NO: 246041 - DNA, 25 bp, Mus musculus
atcgagggacagactggatgccatt

SEQ ID NO: 246042 - DNA, 25 bp, Mus musculus
atcgagggacagtctggatgccatt

SEQ ID NO: 246043 - DNA, 25 bp, Mus musculus
atcgagggctgactgttggtacaac

SEQ ID NO: 246044 - DNA, 25 bp, Mus musculus
atcgagggctgagtgttggtacaac

SEQ ID NO: 246045 - DNA, 25 bp, Mus musculus
atcgaggtcttcatttacggctctc

SEQ ID NO: 246046 - DNA, 25 bp, Mus musculus
atcgaggtcttcttttacggctctc

SEQ ID NO: 246047 - DNA, 25 bp, Mus musculus
atcgagtactctctgtacctggcca

SEQ ID NO: 246048 - DNA, 25 bp, Mus musculus
atcgagtactctgtgtacctggcca

SEQ ID NO: 246049 - DNA, 25 bp, Mus musculus
atcgagtagcacatagagcccactt

SEQ ID NO: 246050 - DNA, 25 bp, Mus musculus
atcgagtagcacttagagcccactt

SEQ ID NO: 246051 - DNA, 25 bp, Mus musculus
atcgagtcagagactggagagagac

SEQ ID NO: 246052 - DNA, 25 bp, Mus musculus
atcgagtcagagtctggagagagac

SEQ ID NO: 246053 - DNA, 25 bp, Mus musculus
atcgagtccccaaattgaccatgta

SEQ ID NO: 246054 - DNA, 25 bp, Mus musculus
atcgagtccccatattgaccatgta

SEQ ID NO: 246055 - DNA, 25 bp, Mus musculus
atcgagtccttcagtttaactttgg

SEQ ID NO: 246056 - DNA, 25 bp, Mus musculus
atcgagtccttctgtttaactttgg

SEQ ID NO: 246057 - DNA, 25 bp, Mus musculus
atcgagtccttgacatttcatctaa

SEQ ID NO: 246058 - DNA, 25 bp, Mus musculus
atcgagtccttgtcatttcatctaa

SEQ ID NO: 246059 - DNA, 25 bp, Mus musculus
atcgagtctcatacgcttgctagtg

SEQ ID NO: 246060 - DNA, 25 bp, Mus musculus
atcgagtctcattcgcttgctagtg

SEQ ID NO: 246061 - DNA, 25 bp, Mus musculus
atcgagtgcataagcgtggtcaact

SEQ ID NO: 246062 - DNA, 25 bp, Mus musculus
atcgagtgcatatgcgtggtcaact

SEQ ID NO: 246063 - DNA, 25 bp, Mus musculus
atcgagtgccctaggctgcaaaatt

SEQ ID NO: 246064 - DNA, 25 bp, Mus musculus
atcgagtgcccttggctgcaaaatt

SEQ ID NO: 246065 - DNA, 25 bp, Mus musculus
atcgagtgtctcaagtaactgcctc

SEQ ID NO: 246066 - DNA, 25 bp, Mus musculus
atcgagtgtctctagtaactgcctc

SEQ ID NO: 246067 - DNA, 25 bp, Mus musculus
atcgagtgtcttctttgtcttctct

SEQ ID NO: 246068 - DNA, 25 bp, Mus musculus
atcgagtgtcttgtttgtcttctct

SEQ ID NO: 246069 - DNA, 25 bp, Mus musculus
atcgagttaaacacatgcggacccc

SEQ ID NO: 246070 - DNA, 25 bp, Mus musculus
atcgagttaaactcatgcggacccc

SEQ ID NO: 246071 - DNA, 25 bp, Mus musculus
atcgataatgccagagaactccaag

SEQ ID NO: 246072 - DNA, 25 bp, Mus musculus
atcgataatgcctgagaactccaag

SEQ ID NO: 246073 - DNA, 25 bp, Mus musculus
atcgatacagcaatgggtgacaagt

SEQ ID NO: 246074 - DNA, 25 bp, Mus musculus
atcgatacagcattgggtgacaagt

SEQ ID NO: 246075 - DNA, 25 bp, Mus musculus
atcgatagaactaccaactccatct

SEQ ID NO: 246076 - DNA, 25 bp, Mus musculus
atcgatagaacttccaactccatct

SEQ ID NO: 246077 - DNA, 25 bp, Mus musculus
atcgatagcaacagccacagtggca

SEQ ID NO: 246078 - DNA, 25 bp, Mus musculus
atcgatagcaactgccacagtggca

SEQ ID NO: 246079 - DNA, 25 bp, Mus musculus
atcgatagccttattcggtctttat

SEQ ID NO: 246080 - DNA, 25 bp, Mus musculus
atcgatagcctttttcggtctttat

SEQ ID NO: 246081 - DNA, 25 bp, Mus musculus
atcgatagctaactcactgccctac

SEQ ID NO: 246082 - DNA, 25 bp, Mus musculus
atcgatagctaagtcactgccctac

SEQ ID NO: 246083 - DNA, 25 bp, Mus musculus
atcgatatacctcttgaatttccca

SEQ ID NO: 246084 - DNA, 25 bp, Mus musculus
atcgatatacctgttgaatttccca

SEQ ID NO: 246085 - DNA, 25 bp, Mus musculus
atcgatattttgctcctcaggctgc

SEQ ID NO: 246086 - DNA, 25 bp, Mus musculus
atcgatattttggtcctcaggctgc

SEQ ID NO: 246087 - DNA, 25 bp, Mus musculus
atcgatcaagaactcagcctgctct

SEQ ID NO: 246088 - DNA, 25 bp, Mus musculus
atcgatcaagaagtcagcctgctct

SEQ ID NO: 246089 - DNA, 25 bp, Mus musculus
atcgatcagtgtatggctgggaccc

SEQ ID NO: 246090 - DNA, 25 bp, Mus musculus
atcgatcagtgtttggctgggaccc

SEQ ID NO: 246091 - DNA, 25 bp, Mus musculus
atcgatcatattattggcgaaataa

SEQ ID NO: 246092 - DNA, 25 bp, Mus musculus
atcgatcatatttttggcgaaataa

SEQ ID NO: 246093 - DNA, 25 bp, Mus musculus
atcgatccctgtctttggcacttgt

SEQ ID NO: 246094 - DNA, 25 bp, Mus musculus
atcgatccctgtgtttggcacttgt

SEQ ID NO: 246095 - DNA, 25 bp, Mus musculus
atcgatccgcctacgaagcagtgag

SEQ ID NO: 246096 - DNA, 25 bp, Mus musculus
atcgatccgccttcgaagcagtgag

SEQ ID NO: 246097 - DNA, 25 bp, Mus musculus
atcgatcctgatctagtagctcata

SEQ ID NO: 246098 - DNA, 25 bp, Mus musculus
atcgatcctgatgtagtagctcata

SEQ ID NO: 246099 - DNA, 25 bp, Mus musculus
atcgatctgcggacaattgtgcctt

SEQ ID NO: 246100 - DNA, 25 bp, Mus musculus
atcgatctgcggtcaattgtgcctt

SEQ ID NO: 246101 - DNA, 25 bp, Mus musculus
atcgatgacatgctcttcttcctgc

SEQ ID NO: 246102 - DNA, 25 bp, Mus musculus
atcgatgacatggtcttcttcctgc

SEQ ID NO: 246103 - DNA, 25 bp, Mus musculus
atcgatgagacaagatcttcaagca

SEQ ID NO: 246104 - DNA, 25 bp, Mus musculus
atcgatgagacatgatcttcaagca

SEQ ID NO: 246105 - DNA, 25 bp, Mus musculus
atcgatgagtccagaaatatgttca

SEQ ID NO: 246106 - DNA, 25 bp, Mus musculus
atcgatgagtcctgaaatatgttca

SEQ ID NO: 246107 - DNA, 25 bp, Mus musculus
atcgatgagtgcaactgtgccccgg

SEQ ID NO: 246108 - DNA, 25 bp, Mus musculus
atcgatgagtgctactgtgccccgg

SEQ ID NO: 246109 - DNA, 25 bp, Mus musculus
atcgatgatgacaacgtcccgtgtc

SEQ ID NO: 246110 - DNA, 25 bp, Mus musculus
atcgatgatgactacgtcccgtgtc

SEQ ID NO: 246111 - DNA, 25 bp, Mus musculus
atcgatgattttaaccctctcttaa

SEQ ID NO: 246112 - DNA, 25 bp, Mus musculus
atcgatgatttttaccctctcttaa

SEQ ID NO: 246113 - DNA, 25 bp, Mus musculus
atcgatgcaatgagacaggcttctg

SEQ ID NO: 246114 - DNA, 25 bp, Mus musculus
atcgatgcaatgtgacaggcttctg

SEQ ID NO: 246115 - DNA, 25 bp, Mus musculus
atcgatgcaggaccgagatctgtca

SEQ ID NO: 246116 - DNA, 25 bp, Mus musculus
atcgatgcaggagcgagatctgtca

SEQ ID NO: 246117 - DNA, 25 bp, Mus musculus
atcgatgcgggtccctgcagtttcc

SEQ ID NO: 246118 - DNA, 25 bp, Mus musculus
atcgatgcgggtgcctgcagtttcc

SEQ ID NO: 246119 - DNA, 25 bp, Mus musculus
atcgatgctaagagtactaagtgct

SEQ ID NO: 246120 - DNA, 25 bp, Mus musculus
atcgatgctaagtgtactaagtgct

SEQ ID NO: 246121 - DNA, 25 bp, Mus musculus
atcgatgctcaacaccatcatactg

SEQ ID NO: 246122 - DNA, 25 bp, Mus musculus
atcgatgctcaagaccatcatactg

SEQ ID NO: 246123 - DNA, 25 bp, Mus musculus
atcgatggagccacggaaccggaat

SEQ ID NO: 246124 - DNA, 25 bp, Mus musculus
atcgatggagcctcggaaccggaat

SEQ ID NO: 246125 - DNA, 25 bp, Mus musculus
atcgatggcaccactgggcagaaca

SEQ ID NO: 246126 - DNA, 25 bp, Mus musculus
atcgatggcacctctgggcagaaca

SEQ ID NO: 246127 - DNA, 25 bp, Mus musculus
atcgatgtgctgacattaagggttt

SEQ ID NO: 246128 - DNA, 25 bp, Mus musculus
atcgatgtgctgtcattaagggttt

SEQ ID NO: 246129 - DNA, 25 bp, Mus musculus
atcgatgttgtaatcacagtggctg

SEQ ID NO: 246130 - DNA, 25 bp, Mus musculus
atcgatgttgtattcacagtggctg

SEQ ID NO: 246131 - DNA, 25 bp, Mus musculus
atcgattacatcatggacctgcaga

SEQ ID NO: 246132 - DNA, 25 bp, Mus musculus
atcgattacatcttggacctgcaga

SEQ ID NO: 246133 - DNA, 25 bp, Mus musculus
atcgattccagcctctcaaagggta

SEQ ID NO: 246134 - DNA, 25 bp, Mus musculus
atcgattccagcgtctcaaagggta

SEQ ID NO: 246135 - DNA, 25 bp, Mus musculus
atcgattgctacagcctgattggaa

SEQ ID NO: 246136 - DNA, 25 bp, Mus musculus
atcgattgctactgcctgattggaa

SEQ ID NO: 246137 - DNA, 25 bp, Mus musculus
atcgatttcttaatttggacatgca

SEQ ID NO: 246138 - DNA, 25 bp, Mus musculus
atcgatttcttattttggacatgca

SEQ ID NO: 246139 - DNA, 25 bp, Mus musculus
atcgattttaccacggatatcctgc

SEQ ID NO: 246140 - DNA, 25 bp, Mus musculus
atcgattttacctcggatatcctgc

SEQ ID NO: 246141 - DNA, 25 bp, Mus musculus
atcgcaaaagatcctaagcccttgt

SEQ ID NO: 246142 - DNA, 25 bp, Mus musculus
atcgcaaaagatgctaagcccttgt

SEQ ID NO: 246143 - DNA, 25 bp, Mus musculus
atcgcaaacgcgacgacgctggctg

SEQ ID NO: 246144 - DNA, 25 bp, Mus musculus
atcgcaaacgcgtcgacgctggctg

SEQ ID NO: 246145 - DNA, 25 bp, Mus musculus
atcgcaagcaatagtgagccacctg

SEQ ID NO: 246146 - DNA, 25 bp, Mus musculus
atcgcaagcaattgtgagccacctg

SEQ ID NO: 246147 - DNA, 25 bp, Mus musculus
atcgcaaggcagagactgtcctgca

SEQ ID NO: 246148 - DNA, 25 bp, Mus musculus
atcgcaaggcagtgactgtcctgca

SEQ ID NO: 246149 - DNA, 25 bp, Mus musculus
atcgcaagtacaccctaaccatgga

SEQ ID NO: 246150 - DNA, 25 bp, Mus musculus
atcgcaagtacagcctaaccatgga

SEQ ID NO: 246151 - DNA, 25 bp, Mus musculus
atcgcaatcgtcagttccccaaagt

SEQ ID NO: 246152 - DNA, 25 bp, Mus musculus
atcgcaatcgtctgttccccaaagt

SEQ ID NO: 246153 - DNA, 25 bp, Mus musculus
atcgcaattactcgttagcacacat

SEQ ID NO: 246154 - DNA, 25 bp, Mus musculus
atcgcaattactggttagcacacat

SEQ ID NO: 246155 - DNA, 25 bp, Mus musculus
atcgcacaagatatcgcctatggat

SEQ ID NO: 246156 - DNA, 25 bp, Mus musculus
atcgcacaagatttcgcctatggat

SEQ ID NO: 246157 - DNA, 25 bp, Mus musculus
atcgcacaagtgctttatggagtgt

SEQ ID NO: 246158 - DNA, 25 bp, Mus musculus
atcgcacaagtggtttatggagtgt

SEQ ID NO: 246159 - DNA, 25 bp, Mus musculus
atcgcacacagactcaataactttg

SEQ ID NO: 246160 - DNA, 25 bp, Mus musculus
atcgcacacagagtcaataactttg

SEQ ID NO: 246161 - DNA, 25 bp, Mus musculus
atcgcacaccgaaagggctggctgt

SEQ ID NO: 246162 - DNA, 25 bp, Mus musculus
atcgcacaccgatagggctggctgt

SEQ ID NO: 246163 - DNA, 25 bp, Mus musculus
atcgcacaggcgcacagggctgcca

SEQ ID NO: 246164 - DNA, 25 bp, Mus musculus
atcgcacaggcggacagggctgcca

SEQ ID NO: 246165 - DNA, 25 bp, Mus musculus
atcgcacaggctcgcactagtggac

SEQ ID NO: 246166 - DNA, 25 bp, Mus musculus
atcgcacaggctggcactagtggac

SEQ ID NO: 246167 - DNA, 25 bp, Mus musculus
atcgcaccattgactcagagcgtga

SEQ ID NO: 246168 - DNA, 25 bp, Mus musculus
atcgcaccattgtctcagagcgtga

SEQ ID NO: 246169 - DNA, 25 bp, Mus musculus
atcgcacctcttcttgcttctggag

SEQ ID NO: 246170 - DNA, 25 bp, Mus musculus
atcgcacctcttgttgcttctggag

SEQ ID NO: 246171 - DNA, 25 bp, Mus musculus
atcgcacgtttcctgttctctctgt

SEQ ID NO: 246172 - DNA, 25 bp, Mus musculus
atcgcacgtttcgtgttctctctgt

SEQ ID NO: 246173 - DNA, 25 bp, Mus musculus
atcgcactcggccaactaacgtcgg

SEQ ID NO: 246174 - DNA, 25 bp, Mus musculus
atcgcactcggcgaactaacgtcgg

SEQ ID NO: 246175 - DNA, 25 bp, Mus musculus
atcgcagaccaaacagcagcagctt

SEQ ID NO: 246176 - DNA, 25 bp, Mus musculus
atcgcagaccaatcagcagcagctt

SEQ ID NO: 246177 - DNA, 25 bp, Mus musculus
atcgcagactttcgcttagctcgag

SEQ ID NO: 246178 - DNA, 25 bp, Mus musculus
atcgcagactttggcttagctcgag

SEQ ID NO: 246179 - DNA, 25 bp, Mus musculus
atcgcagagatgcttcggcacgccc

SEQ ID NO: 246180 - DNA, 25 bp, Mus musculus
atcgcagagatggttcggcacgccc

SEQ ID NO: 246181 - DNA, 25 bp, Mus musculus
atcgcagatgacacccttgctggaa

SEQ ID NO: 246182 - DNA, 25 bp, Mus musculus
atcgcagatgactcccttgctggaa

SEQ ID NO: 246183 - DNA, 25 bp, Mus musculus
atcgcagcacgcacacggaggagaa

SEQ ID NO: 246184 - DNA, 25 bp, Mus musculus
atcgcagcacgctcacggaggagaa

SEQ ID NO: 246185 - DNA, 25 bp, Mus musculus
atcgcagcagagatcattgcccagg

SEQ ID NO: 246186 - DNA, 25 bp, Mus musculus
atcgcagcagagttcattgcccagg

SEQ ID NO: 246187 - DNA, 25 bp, Mus musculus
atcgcagcattgaggaatgacgttt

SEQ ID NO: 246188 - DNA, 25 bp, Mus musculus
atcgcagcattgtggaatgacgttt

SEQ ID NO: 246189 - DNA, 25 bp, Mus musculus
atcgcagccctgctagagaatgaat

SEQ ID NO: 246190 - DNA, 25 bp, Mus musculus
atcgcagccctggtagagaatgaat

SEQ ID NO: 246191 - DNA, 25 bp, Mus musculus
atcgcagcctgtaacagtcctgtgg

SEQ ID NO: 246192 - DNA, 25 bp, Mus musculus
atcgcagcctgttacagtcctgtgg

SEQ ID NO: 246193 - DNA, 25 bp, Mus musculus
atcgcagggctgatagccttagcta

SEQ ID NO: 246194 - DNA, 25 bp, Mus musculus
atcgcagggctgttagccttagcta

SEQ ID NO: 246195 - DNA, 25 bp, Mus musculus
atcgcaggtacaagtgcaagagaca

SEQ ID NO: 246196 - DNA, 25 bp, Mus musculus
atcgcaggtacatgtgcaagagaca

SEQ ID NO: 246197 - DNA, 25 bp, Mus musculus
atcgcagtattgaccatcagccttg

SEQ ID NO: 246198 - DNA, 25 bp, Mus musculus
atcgcagtattgtccatcagccttg

SEQ ID NO: 246199 - DNA, 25 bp, Mus musculus
atcgcagtcctgctgatgtttgccc

SEQ ID NO: 246200 - DNA, 25 bp, Mus musculus
atcgcagtcctggtgatgtttgccc

SEQ ID NO: 246201 - DNA, 25 bp, Mus musculus
atcgcagtctctagggcaccggcaa

SEQ ID NO: 246202 - DNA, 25 bp, Mus musculus
atcgcagtctcttgggcaccggcaa

SEQ ID NO: 246203 - DNA, 25 bp, Mus musculus
atcgcagtcttgcttctgaacacac

SEQ ID NO: 246204 - DNA, 25 bp, Mus musculus
atcgcagtcttggttctgaacacac

SEQ ID NO: 246205 - DNA, 25 bp, Mus musculus
atcgcagtggccagtttacatgcct

SEQ ID NO: 246206 - DNA, 25 bp, Mus musculus
atcgcagtggcctgtttacatgcct

SEQ ID NO: 246207 - DNA, 25 bp, Mus musculus
atcgcataatctcactttcacagag

SEQ ID NO: 246208 - DNA, 25 bp, Mus musculus
atcgcataatctgactttcacagag

SEQ ID NO: 246209 - DNA, 25 bp, Mus musculus
atcgcatcaattatgaggatacctc

SEQ ID NO: 246210 - DNA, 25 bp, Mus musculus
atcgcatcaattttgaggatacctc

SEQ ID NO: 246211 - DNA, 25 bp, Mus musculus
atcgcatcacagacaagcgctgctt

SEQ ID NO: 246212 - DNA, 25 bp, Mus musculus
atcgcatcacagtcaagcgctgctt

SEQ ID NO: 246213 - DNA, 25 bp, Mus musculus
atcgcatcatttcaatgttccggtt

SEQ ID NO: 246214 - DNA, 25 bp, Mus musculus
atcgcatcatttgaatgttccggtt

SEQ ID NO: 246215 - DNA, 25 bp, Mus musculus
atcgcatccgtgagtttcactggag

SEQ ID NO: 246216 - DNA, 25 bp, Mus musculus
atcgcatccgtgtgtttcactggag

SEQ ID NO: 246217 - DNA, 25 bp, Mus musculus
atcgcatcctgcaattcacagtgtg

SEQ ID NO: 246218 - DNA, 25 bp, Mus musculus
atcgcatcctgctattcacagtgtg

SEQ ID NO: 246219 - DNA, 25 bp, Mus musculus
atcgcatctcacctaaaaatcctta

SEQ ID NO: 246220 - DNA, 25 bp, Mus musculus
atcgcatctcacgtaaaaatcctta

SEQ ID NO: 246221 - DNA, 25 bp, Mus musculus
atcgcatgaaggagtcgcaggcagc

SEQ ID NO: 246222 - DNA, 25 bp, Mus musculus
atcgcatgaaggtgtcgcaggcagc

SEQ ID NO: 246223 - DNA, 25 bp, Mus musculus
atcgcatgagccctttccagaaaag

SEQ ID NO: 246224 - DNA, 25 bp, Mus musculus
atcgcatgagccgtttccagaaaag

SEQ ID NO: 246225 - DNA, 25 bp, Mus musculus
atcgcatgctgaacctgattcgtcg

SEQ ID NO: 246226 - DNA, 25 bp, Mus musculus
atcgcatgctgatcctgattcgtcg

SEQ ID NO: 246227 - DNA, 25 bp, Mus musculus
atcgcatgtgacactttgggttttc

SEQ ID NO: 246228 - DNA, 25 bp, Mus musculus
atcgcatgtgactctttgggttttc

SEQ ID NO: 246229 - DNA, 25 bp, Mus musculus
atcgcatgttatctcttgttctcat

SEQ ID NO: 246230 - DNA, 25 bp, Mus musculus
atcgcatgttatgtcttgttctcat

SEQ ID NO: 246231 - DNA, 25 bp, Mus musculus
atcgcattgccgagactgtcgatgc

SEQ ID NO: 246232 - DNA, 25 bp, Mus musculus
atcgcattgccgtgactgtcgatgc

SEQ ID NO: 246233 - DNA, 25 bp, Mus musculus
atcgccaagcctacacaggtattga

SEQ ID NO: 246234 - DNA, 25 bp, Mus musculus
atcgccaagccttcacaggtattga

SEQ ID NO: 246235 - DNA, 25 bp, Mus musculus
atcgccaagttccatcttcgcgtgg

SEQ ID NO: 246236 - DNA, 25 bp, Mus musculus
atcgccaagttcgatcttcgcgtgg

SEQ ID NO: 246237 - DNA, 25 bp, Mus musculus
atcgccacaagcaacttcagcaaga

SEQ ID NO: 246238 - DNA, 25 bp, Mus musculus
atcgccacaagctacttcagcaaga

SEQ ID NO: 246239 - DNA, 25 bp, Mus musculus
atcgccacaatgacactttgaaaac

SEQ ID NO: 246240 - DNA, 25 bp, Mus musculus
atcgccacaatgtcactttgaaaac

SEQ ID NO: 246241 - DNA, 25 bp, Mus musculus
atcgccaccaaaaatgacctctatg

SEQ ID NO: 246242 - DNA, 25 bp, Mus musculus
atcgccaccaaatatgacctctatg

SEQ ID NO: 246243 - DNA, 25 bp, Mus musculus
atcgccaccctgaatgctatgtgtg

SEQ ID NO: 246244 - DNA, 25 bp, Mus musculus
atcgccaccctgtatgctatgtgtg

SEQ ID NO: 246245 - DNA, 25 bp, Mus musculus
atcgccagaagaagaacagctgagc

SEQ ID NO: 246246 - DNA, 25 bp, Mus musculus
atcgccagaagatgaacagctgagc

SEQ ID NO: 246247 - DNA, 25 bp, Mus musculus
atcgccagatggatcgcacagagag

SEQ ID NO: 246248 - DNA, 25 bp, Mus musculus
atcgccagatggttcgcacagagag

SEQ ID NO: 246249 - DNA, 25 bp, Mus musculus
atcgccagcttccataaggccaagc

SEQ ID NO: 246250 - DNA, 25 bp, Mus musculus
atcgccagcttcgataaggccaagc

SEQ ID NO: 246251 - DNA, 25 bp, Mus musculus
atcgccaggcttctatatactccag

SEQ ID NO: 246252 - DNA, 25 bp, Mus musculus
atcgccaggcttgtatatactccag

SEQ ID NO: 246253 - DNA, 25 bp, Mus musculus
atcgccagtgacagcccaaagaaag

SEQ ID NO: 246254 - DNA, 25 bp, Mus musculus
atcgccagtgactgcccaaagaaag

SEQ ID NO: 246255 - DNA, 25 bp, Mus musculus
atcgccataggccaaggtgcatata

SEQ ID NO: 246256 - DNA, 25 bp, Mus musculus
atcgccataggcgaaggtgcatata

SEQ ID NO: 246257 - DNA, 25 bp, Mus musculus
atcgccatgatcacaccaggcataa

SEQ ID NO: 246258 - DNA, 25 bp, Mus musculus
atcgccatgatctcaccaggcataa

SEQ ID NO: 246259 - DNA, 25 bp, Mus musculus
atcgccatggcgatccgcgagagcg

SEQ ID NO: 246260 - DNA, 25 bp, Mus musculus
atcgccatggcgttccgcgagagcg

SEQ ID NO: 246261 - DNA, 25 bp, Mus musculus
atcgccattacgagcgtcctagata

SEQ ID NO: 246262 - DNA, 25 bp, Mus musculus
atcgccattacgtgcgtcctagata

SEQ ID NO: 246263 - DNA, 25 bp, Mus musculus
atcgcccaaatgatgacactaagta

SEQ ID NO: 246264 - DNA, 25 bp, Mus musculus
atcgcccaaatgttgacactaagta

SEQ ID NO: 246265 - DNA, 25 bp, Mus musculus
atcgccctagacacgaggacgcagc

SEQ ID NO: 246266 - DNA, 25 bp, Mus musculus
atcgccctagactcgaggacgcagc

SEQ ID NO: 246267 - DNA, 25 bp, Mus musculus
atcgccctagagagctcctgtgtat

SEQ ID NO: 246268 - DNA, 25 bp, Mus musculus
atcgccctagagtgctcctgtgtat

SEQ ID NO: 246269 - DNA, 25 bp, Mus musculus
atcgccctcatgactgcaagaacaa

SEQ ID NO: 246270 - DNA, 25 bp, Mus musculus
atcgccctcatgtctgcaagaacaa

SEQ ID NO: 246271 - DNA, 25 bp, Mus musculus
atcgccctcgtgcaggaacttcctg

SEQ ID NO: 246272 - DNA, 25 bp, Mus musculus
atcgccctcgtggaggaacttcctg

SEQ ID NO: 246273 - DNA, 25 bp, Mus musculus
atcgccctctgcaaatggcggatga

SEQ ID NO: 246274 - DNA, 25 bp, Mus musculus
atcgccctctgctaatggcggatga

SEQ ID NO: 246275 - DNA, 25 bp, Mus musculus
atcgccctgcaccagaactaattgg

SEQ ID NO: 246276 - DNA, 25 bp, Mus musculus
atcgccctgcacgagaactaattgg

SEQ ID NO: 246277 - DNA, 25 bp, Mus musculus
atcgccctggagactataccaacat

SEQ ID NO: 246278 - DNA, 25 bp, Mus musculus
atcgccctggagtctataccaacat

SEQ ID NO: 246279 - DNA, 25 bp, Mus musculus
atcgccctggtacaaaaggccctgc

SEQ ID NO: 246280 - DNA, 25 bp, Mus musculus
atcgccctggtagaaaaggccctgc

SEQ ID NO: 246281 - DNA, 25 bp, Mus musculus
atcgccctggtcaagctctcaagaa

SEQ ID NO: 246282 - DNA, 25 bp, Mus musculus
atcgccctggtctagctctcaagaa

SEQ ID NO: 246283 - DNA, 25 bp, Mus musculus
atcgccctgtggatgactgagtacc

SEQ ID NO: 246284 - DNA, 25 bp, Mus musculus
atcgccctgtggttgactgagtacc

SEQ ID NO: 246285 - DNA, 25 bp, Mus musculus
atcgccctttttagtatccccatgt

SEQ ID NO: 246286 - DNA, 25 bp, Mus musculus
atcgcccttttttgtatccccatgt

SEQ ID NO: 246287 - DNA, 25 bp, Mus musculus
atcgccgacaacatccaggcatttg

SEQ ID NO: 246288 - DNA, 25 bp, Mus musculus
atcgccgacaacttccaggcatttg

SEQ ID NO: 246289 - DNA, 25 bp, Mus musculus
atcgccgagatgacagagctggcaa

SEQ ID NO: 246290 - DNA, 25 bp, Mus musculus
atcgccgagatgtcagagctggcaa

SEQ ID NO: 246291 - DNA, 25 bp, Mus musculus
atcgccgagcacataggagtagact

SEQ ID NO: 246292 - DNA, 25 bp, Mus musculus
atcgccgagcacttaggagtagact

SEQ ID NO: 246293 - DNA, 25 bp, Mus musculus
atcgccgatgcgctggccagtgctg

SEQ ID NO: 246294 - DNA, 25 bp, Mus musculus
atcgccgatgcggtggccagtgctg

SEQ ID NO: 246295 - DNA, 25 bp, Mus musculus
atcgccgcacagacagcaggcatag

SEQ ID NO: 246296 - DNA, 25 bp, Mus musculus
atcgccgcacagtcagcaggcatag

SEQ ID NO: 246297 - DNA, 25 bp, Mus musculus
atcgccgcctgtcaggagatgctgc

SEQ ID NO: 246298 - DNA, 25 bp, Mus musculus
atcgccgcctgtgaggagatgctgc

SEQ ID NO: 246299 - DNA, 25 bp, Mus musculus
atcgccgggcagctgtccatagatg

SEQ ID NO: 246300 - DNA, 25 bp, Mus musculus
atcgccgggcaggtgtccatagatg

SEQ ID NO: 246301 - DNA, 25 bp, Mus musculus
atcgccgtcatcatggctctaggaa

SEQ ID NO: 246302 - DNA, 25 bp, Mus musculus
atcgccgtcatcttggctctaggaa

SEQ ID NO: 246303 - DNA, 25 bp, Mus musculus
atcgcctaaaacatgcaccagttgg

SEQ ID NO: 246304 - DNA, 25 bp, Mus musculus
atcgcctaaaacttgcaccagttgg

SEQ ID NO: 246305 - DNA, 25 bp, Mus musculus
atcgcctaaagaacatcaccctgga

SEQ ID NO: 246306 - DNA, 25 bp, Mus musculus
atcgcctaaagatcatcaccctgga

SEQ ID NO: 246307 - DNA, 25 bp, Mus musculus
atcgcctacttgatggacgtgctgg

SEQ ID NO: 246308 - DNA, 25 bp, Mus musculus
atcgcctacttgttggacgtgctgg

SEQ ID NO: 246309 - DNA, 25 bp, Mus musculus
atcgcctatggaacttgctaaccaa

SEQ ID NO: 246310 - DNA, 25 bp, Mus musculus
atcgcctatggatcttgctaaccaa

SEQ ID NO: 246311 - DNA, 25 bp, Mus musculus
atcgcctcaggcaagggtgctcctt

SEQ ID NO: 246312 - DNA, 25 bp, Mus musculus
atcgcctcaggctagggtgctcctt

SEQ ID NO: 246313 - DNA, 25 bp, Mus musculus
atcgcctcggaacctagtttttcat

SEQ ID NO: 246314 - DNA, 25 bp, Mus musculus
atcgcctcggaagctagtttttcat

SEQ ID NO: 246315 - DNA, 25 bp, Mus musculus
atcgcctctttcatccagtattttg

SEQ ID NO: 246316 - DNA, 25 bp, Mus musculus
atcgcctctttcttccagtattttg

SEQ ID NO: 246317 - DNA, 25 bp, Mus musculus
atcgcctgacagaatcttccatttt

SEQ ID NO: 246318 - DNA, 25 bp, Mus musculus
atcgcctgacagtatcttccatttt

SEQ ID NO: 246319 - DNA, 25 bp, Mus musculus
atcgcctgcctcaagaatctgcaga

SEQ ID NO: 246320 - DNA, 25 bp, Mus musculus
atcgcctgcctctagaatctgcaga

SEQ ID NO: 246321 - DNA, 25 bp, Mus musculus
atcgcctggagtcaagcagttttcg

SEQ ID NO: 246322 - DNA, 25 bp, Mus musculus
atcgcctggagtgaagcagttttcg

SEQ ID NO: 246323 - DNA, 25 bp, Mus musculus
atcgcctgggcccttagatctatca

SEQ ID NO: 246324 - DNA, 25 bp, Mus musculus
atcgcctgggccgttagatctatca

SEQ ID NO: 246325 - DNA, 25 bp, Mus musculus
atcgcctggtaacatgctggcagtt

SEQ ID NO: 246326 - DNA, 25 bp, Mus musculus
atcgcctggtaagatgctggcagtt

SEQ ID NO: 246327 - DNA, 25 bp, Mus musculus
atcgcctgtacccagaagagtgctc

SEQ ID NO: 246328 - DNA, 25 bp, Mus musculus
atcgcctgtaccgagaagagtgctc

SEQ ID NO: 246329 - DNA, 25 bp, Mus musculus
atcgcctgtcctacaatttctgtga

SEQ ID NO: 246330 - DNA, 25 bp, Mus musculus
atcgcctgtccttcaatttctgtga

SEQ ID NO: 246331 - DNA, 25 bp, Mus musculus
atcgcctgtctgcttatgacttgag

SEQ ID NO: 246332 - DNA, 25 bp, Mus musculus
atcgcctgtctggttatgacttgag

SEQ ID NO: 246333 - DNA, 25 bp, Mus musculus
atcgccttagggagtttctgcatcg

SEQ ID NO: 246334 - DNA, 25 bp, Mus musculus
atcgccttagggtgtttctgcatcg

SEQ ID NO: 246335 - DNA, 25 bp, Mus musculus
atcgccttcagtaatgagctctcta

SEQ ID NO: 246336 - DNA, 25 bp, Mus musculus
atcgccttcagttatgagctctcta

SEQ ID NO: 246337 - DNA, 25 bp, Mus musculus
atcgccttccatagggtcaagttgt

SEQ ID NO: 246338 - DNA, 25 bp, Mus musculus
atcgccttccattgggtcaagttgt

SEQ ID NO: 246339 - DNA, 25 bp, Mus musculus
atcgccttccttctcaagtttgctg

SEQ ID NO: 246340 - DNA, 25 bp, Mus musculus
atcgccttccttgtcaagtttgctg

SEQ ID NO: 246341 - DNA, 25 bp, Mus musculus
atcgccttgtctacactgcatgtgt

SEQ ID NO: 246342 - DNA, 25 bp, Mus musculus
atcgccttgtcttcactgcatgtgt

SEQ ID NO: 246343 - DNA, 25 bp, Mus musculus
atcgcgaatgacattggactgctgt

SEQ ID NO: 246344 - DNA, 25 bp, Mus musculus
atcgcgaatgactttggactgctgt

SEQ ID NO: 246345 - DNA, 25 bp, Mus musculus
atcgcgagaccacaacgtgacagct

SEQ ID NO: 246346 - DNA, 25 bp, Mus musculus
atcgcgagaccagaacgtgacagct

SEQ ID NO: 246347 - DNA, 25 bp, Mus musculus
atcgcgattcagagtgaccagccta

SEQ ID NO: 246348 - DNA, 25 bp, Mus musculus
atcgcgattcagtgtgaccagccta

SEQ ID NO: 246349 - DNA, 25 bp, Mus musculus
atcgcgcacaggatcgaggctggca

SEQ ID NO: 246350 - DNA, 25 bp, Mus musculus
atcgcgcacaggttcgaggctggca

SEQ ID NO: 246351 - DNA, 25 bp, Mus musculus
atcgcgcccggcaattgtttttgag

SEQ ID NO: 246352 - DNA, 25 bp, Mus musculus
atcgcgcccggctattgtttttgag

SEQ ID NO: 246353 - DNA, 25 bp, Mus musculus
atcgcgcgcgtcaaggagatcctgg

SEQ ID NO: 246354 - DNA, 25 bp, Mus musculus
atcgcgcgcgtctaggagatcctgg

SEQ ID NO: 246355 - DNA, 25 bp, Mus musculus
atcgcgctcaggacttcactgaaga

SEQ ID NO: 246356 - DNA, 25 bp, Mus musculus
atcgcgctcaggtcttcactgaaga

SEQ ID NO: 246357 - DNA, 25 bp, Mus musculus
atcgcgctccctcgagaaatctcaa

SEQ ID NO: 246358 - DNA, 25 bp, Mus musculus
atcgcgctccctggagaaatctcaa

SEQ ID NO: 246359 - DNA, 25 bp, Mus musculus
atcgcggaagctatcggcatcagtg

SEQ ID NO: 246360 - DNA, 25 bp, Mus musculus
atcgcggaagctttcggcatcagtg

SEQ ID NO: 246361 - DNA, 25 bp, Mus musculus
atcgcggatctgagttgctcatgtg

SEQ ID NO: 246362 - DNA, 25 bp, Mus musculus
atcgcggatctgtgttgctcatgtg

SEQ ID NO: 246363 - DNA, 25 bp, Mus musculus
atcgcggccatcattctgtgtggag

SEQ ID NO: 246364 - DNA, 25 bp, Mus musculus
atcgcggccatctttctgtgtggag

SEQ ID NO: 246365 - DNA, 25 bp, Mus musculus
atcgcgggcaccatcaaggcagagg

SEQ ID NO: 246366 - DNA, 25 bp, Mus musculus
atcgcgggcaccttcaaggcagagg

SEQ ID NO: 246367 - DNA, 25 bp, Mus musculus
atcgcggtacacagtggcatcgcgc

SEQ ID NO: 246368 - DNA, 25 bp, Mus musculus
atcgcggtacactgtggcatcgcgc

SEQ ID NO: 246369 - DNA, 25 bp, Mus musculus
atcgcgtatctcaaggatctgcaga

SEQ ID NO: 246370 - DNA, 25 bp, Mus musculus
atcgcgtatctctaggatctgcaga

SEQ ID NO: 246371 - DNA, 25 bp, Mus musculus
atcgcgtctgacagtatcttggact

SEQ ID NO: 246372 - DNA, 25 bp, Mus musculus
atcgcgtctgactgtatcttggact

SEQ ID NO: 246373 - DNA, 25 bp, Mus musculus
atcgcgttaggaaagcagtgaagca

SEQ ID NO: 246374 - DNA, 25 bp, Mus musculus
atcgcgttaggatagcagtgaagca

SEQ ID NO: 246375 - DNA, 25 bp, Mus musculus
atcgcgttatttactgcattcgtac

SEQ ID NO: 246376 - DNA, 25 bp, Mus musculus
atcgcgttattttctgcattcgtac

SEQ ID NO: 246377 - DNA, 25 bp, Mus musculus
atcgctagctcgaaggtctacttgt

SEQ ID NO: 246378 - DNA, 25 bp, Mus musculus
atcgctagctcgtaggtctacttgt

SEQ ID NO: 246379 - DNA, 25 bp, Mus musculus
atcgctatcggtaattgatccatcg

SEQ ID NO: 246380 - DNA, 25 bp, Mus musculus
atcgctatcggttattgatccatcg

SEQ ID NO: 246381 - DNA, 25 bp, Mus musculus
atcgctatggagctgtcttctggaa

SEQ ID NO: 246382 - DNA, 25 bp, Mus musculus
atcgctatggaggtgtcttctggaa

SEQ ID NO: 246383 - DNA, 25 bp, Mus musculus
atcgctcacttaaagcattgatttt

SEQ ID NO: 246384 - DNA, 25 bp, Mus musculus
atcgctcacttatagcattgatttt

SEQ ID NO: 246385 - DNA, 25 bp, Mus musculus
atcgctcatcccaagaacctgtttt

SEQ ID NO: 246386 - DNA, 25 bp, Mus musculus
atcgctcatccctagaacctgtttt

SEQ ID NO: 246387 - DNA, 25 bp, Mus musculus
atcgctcatgacaacctcaaagggt

SEQ ID NO: 246388 - DNA, 25 bp, Mus musculus
atcgctcatgactacctcaaagggt

SEQ ID NO: 246389 - DNA, 25 bp, Mus musculus
atcgctccaggactctacgctgtcg

SEQ ID NO: 246390 - DNA, 25 bp, Mus musculus
atcgctccaggagtctacgctgtcg

SEQ ID NO: 246391 - DNA, 25 bp, Mus musculus
atcgctcctgtaatgctagtgctgg

SEQ ID NO: 246392 - DNA, 25 bp, Mus musculus
atcgctcctgtattgctagtgctgg

SEQ ID NO: 246393 - DNA, 25 bp, Mus musculus
atcgctcgtaaccaggtgcgcaaga

SEQ ID NO: 246394 - DNA, 25 bp, Mus musculus
atcgctcgtaacgaggtgcgcaaga

SEQ ID NO: 246395 - DNA, 25 bp, Mus musculus
atcgctctagctccggtttatttaa

SEQ ID NO: 246396 - DNA, 25 bp, Mus musculus
atcgctctagctgcggtttatttaa

SEQ ID NO: 246397 - DNA, 25 bp, Mus musculus
atcgctctagtgactacggtctgta

SEQ ID NO: 246398 - DNA, 25 bp, Mus musculus
atcgctctagtgtctacggtctgta

SEQ ID NO: 246399 - DNA, 25 bp, Mus musculus
atcgctctgagcatgtcctaaaaca

SEQ ID NO: 246400 - DNA, 25 bp, Mus musculus
atcgctctgagcttgtcctaaaaca

SEQ ID NO: 246401 - DNA, 25 bp, Mus musculus
atcgctctgttaccttttgtatatg

SEQ ID NO: 246402 - DNA, 25 bp, Mus musculus
atcgctctgttagcttttgtatatg

SEQ ID NO: 246403 - DNA, 25 bp, Mus musculus
atcgctcttcctctcctgattgtgg

SEQ ID NO: 246404 - DNA, 25 bp, Mus musculus
atcgctcttcctgtcctgattgtgg

SEQ ID NO: 246405 - DNA, 25 bp, Mus musculus
atcgctgacaggagaacgagcgctc

SEQ ID NO: 246406 - DNA, 25 bp, Mus musculus
atcgctgacaggtgaacgagcgctc

SEQ ID NO: 246407 - DNA, 25 bp, Mus musculus
atcgctgaccgcatgcagaaggaga

SEQ ID NO: 246408 - DNA, 25 bp, Mus musculus
atcgctgaccgcttgcagaaggaga

SEQ ID NO: 246409 - DNA, 25 bp, Mus musculus
atcgctgactcgcaggacgccaagt

SEQ ID NO: 246410 - DNA, 25 bp, Mus musculus
atcgctgactcggaggacgccaagt

SEQ ID NO: 246411 - DNA, 25 bp, Mus musculus
atcgctgagaatcctttatcctggg

SEQ ID NO: 246412 - DNA, 25 bp, Mus musculus
atcgctgagaatgctttatcctggg

SEQ ID NO: 246413 - DNA, 25 bp, Mus musculus
atcgctgagagcaactttaaacact

SEQ ID NO: 246414 - DNA, 25 bp, Mus musculus
atcgctgagagctactttaaacact

SEQ ID NO: 246415 - DNA, 25 bp, Mus musculus
atcgctgagcggagtgcatctggtc

SEQ ID NO: 246416 - DNA, 25 bp, Mus musculus
atcgctgagcggtgtgcatctggtc

SEQ ID NO: 246417 - DNA, 25 bp, Mus musculus
atcgctgcaactcctgctgtgggaa

SEQ ID NO: 246418 - DNA, 25 bp, Mus musculus
atcgctgcaactgctgctgtgggaa

SEQ ID NO: 246419 - DNA, 25 bp, Mus musculus
atcgctgcactcaattggactggaa

SEQ ID NO: 246420 - DNA, 25 bp, Mus musculus
atcgctgcactctattggactggaa

SEQ ID NO: 246421 - DNA, 25 bp, Mus musculus
atcgctgcatgaagcatctcagccc

SEQ ID NO: 246422 - DNA, 25 bp, Mus musculus
atcgctgcatgatgcatctcagccc

SEQ ID NO: 246423 - DNA, 25 bp, Mus musculus
atcgctgccaaaagagagtcaatca

SEQ ID NO: 246424 - DNA, 25 bp, Mus musculus
atcgctgccaaatgagagtcaatca

SEQ ID NO: 246425 - DNA, 25 bp, Mus musculus
atcgctgccaggatatacgtaatct

SEQ ID NO: 246426 - DNA, 25 bp, Mus musculus
atcgctgccaggttatacgtaatct

SEQ ID NO: 246427 - DNA, 25 bp, Mus musculus
atcgctgccataagatatttcctaa

SEQ ID NO: 246428 - DNA, 25 bp, Mus musculus
atcgctgccatatgatatttcctaa

SEQ ID NO: 246429 - DNA, 25 bp, Mus musculus
atcgctgccctaaaggccttggaac

SEQ ID NO: 246430 - DNA, 25 bp, Mus musculus
atcgctgccctataggccttggaac

SEQ ID NO: 246431 - DNA, 25 bp, Mus musculus
atcgctgccttcctggaagtccgag

SEQ ID NO: 246432 - DNA, 25 bp, Mus musculus
atcgctgccttcgtggaagtccgag

SEQ ID NO: 246433 - DNA, 25 bp, Mus musculus
atcgctgcgctgctcgtcgacaacg

SEQ ID NO: 246434 - DNA, 25 bp, Mus musculus
atcgctgcgctggtcgtcgacaacg

SEQ ID NO: 246435 - DNA, 25 bp, Mus musculus
atcgctgcgtcaacgttgttgtcgt

SEQ ID NO: 246436 - DNA, 25 bp, Mus musculus
atcgctgcgtcatcgttgttgtcgt

SEQ ID NO: 246437 - DNA, 25 bp, Mus musculus
atcgctgctgcgaggatatagacca

SEQ ID NO: 246438 - DNA, 25 bp, Mus musculus
atcgctgctgcgtggatatagacca

SEQ ID NO: 246439 - DNA, 25 bp, Mus musculus
atcgctggaatcctgggcaccatct

SEQ ID NO: 246440 - DNA, 25 bp, Mus musculus
atcgctggaatcgtgggcaccatct

SEQ ID NO: 246441 - DNA, 25 bp, Mus musculus
atcgctggaattcccatggccctga

SEQ ID NO: 246442 - DNA, 25 bp, Mus musculus
atcgctggaattgccatggccctga

SEQ ID NO: 246443 - DNA, 25 bp, Mus musculus
atcgctggaccacggatcgcaaagt

SEQ ID NO: 246444 - DNA, 25 bp, Mus musculus
atcgctggaccagggatcgcaaagt

SEQ ID NO: 246445 - DNA, 25 bp, Mus musculus
atcgctggctgcatgtcagggtgtt

SEQ ID NO: 246446 - DNA, 25 bp, Mus musculus
atcgctggctgcttgtcagggtgtt

SEQ ID NO: 246447 - DNA, 25 bp, Mus musculus
atcgctgggataaacgggctggaca

SEQ ID NO: 246448 - DNA, 25 bp, Mus musculus
atcgctgggatatacgggctggaca

SEQ ID NO: 246449 - DNA, 25 bp, Mus musculus
atcgctgggccgaacaacagacttg

SEQ ID NO: 246450 - DNA, 25 bp, Mus musculus
atcgctgggccgtacaacagacttg

SEQ ID NO: 246451 - DNA, 25 bp, Mus musculus
atcgctgtgccaagaggaactgtgt

SEQ ID NO: 246452 - DNA, 25 bp, Mus musculus
atcgctgtgccatgaggaactgtgt

SEQ ID NO: 246453 - DNA, 25 bp, Mus musculus
atcgctgtgggtagcacctgcatct

SEQ ID NO: 246454 - DNA, 25 bp, Mus musculus
atcgctgtgggttgcacctgcatct

SEQ ID NO: 246455 - DNA, 25 bp, Mus musculus
atcgctgtggtgattgcggagaaac

SEQ ID NO: 246456 - DNA, 25 bp, Mus musculus
atcgctgtggtgtttgcggagaaac

SEQ ID NO: 246457 - DNA, 25 bp, Mus musculus
atcgctgttgcgcaatccacttagg

SEQ ID NO: 246458 - DNA, 25 bp, Mus musculus
atcgctgttgcggaatccacttagg

SEQ ID NO: 246459 - DNA, 25 bp, Mus musculus
atcgcttcacatatccagattcaga

SEQ ID NO: 246460 - DNA, 25 bp, Mus musculus
atcgcttcacatttccagattcaga

SEQ ID NO: 246461 - DNA, 25 bp, Mus musculus
atcgcttcagcactagcgactagct

SEQ ID NO: 246462 - DNA, 25 bp, Mus musculus
atcgcttcagcagtagcgactagct

SEQ ID NO: 246463 - DNA, 25 bp, Mus musculus
atcgcttctagactatgagccgcaa

SEQ ID NO: 246464 - DNA, 25 bp, Mus musculus
atcgcttctagagtatgagccgcaa

SEQ ID NO: 246465 - DNA, 25 bp, Mus musculus
atcgcttctgtgctacttgctctgg

SEQ ID NO: 246466 - DNA, 25 bp, Mus musculus
atcgcttctgtggtacttgctctgg

SEQ ID NO: 246467 - DNA, 25 bp, Mus musculus
atcgcttgcagtcatgggtaccctg

SEQ ID NO: 246468 - DNA, 25 bp, Mus musculus
atcgcttgcagtgatgggtaccctg

SEQ ID NO: 246469 - DNA, 25 bp, Mus musculus
atcgcttgccagaaatttccttctt

SEQ ID NO: 246470 - DNA, 25 bp, Mus musculus
atcgcttgccagtaatttccttctt

SEQ ID NO: 246471 - DNA, 25 bp, Mus musculus
atcgcttggcttattgcagtggccg

SEQ ID NO: 246472 - DNA, 25 bp, Mus musculus
atcgcttggctttttgcagtggccg

SEQ ID NO: 246473 - DNA, 25 bp, Mus musculus
atcgcttgtttactgaccatggctc

SEQ ID NO: 246474 - DNA, 25 bp, Mus musculus
atcgcttgtttagtgaccatggctc

SEQ ID NO: 246475 - DNA, 25 bp, Mus musculus
atcgctttaatcctctttcaaggcc

SEQ ID NO: 246476 - DNA, 25 bp, Mus musculus
atcgctttaatcgtctttcaaggcc

SEQ ID NO: 246477 - DNA, 25 bp, Mus musculus
atcgctttattgaggcagtccctca

SEQ ID NO: 246478 - DNA, 25 bp, Mus musculus
atcgctttattgtggcagtccctca

SEQ ID NO: 246479 - DNA, 25 bp, Mus musculus
atcgctttcaacagtatggtcttgg

SEQ ID NO: 246480 - DNA, 25 bp, Mus musculus
atcgctttcaactgtatggtcttgg

SEQ ID NO: 246481 - DNA, 25 bp, Mus musculus
atcgctttcactcatgttcttgttg

SEQ ID NO: 246482 - DNA, 25 bp, Mus musculus
atcgctttcactgatgttcttgttg

SEQ ID NO: 246483 - DNA, 25 bp, Mus musculus
atcgctttcagcagactcaatacct

SEQ ID NO: 246484 - DNA, 25 bp, Mus musculus
atcgctttcagctgactcaatacct

SEQ ID NO: 246485 - DNA, 25 bp, Mus musculus
atcgctttccatccctagggcttta

SEQ ID NO: 246486 - DNA, 25 bp, Mus musculus
atcgctttccatgcctagggcttta

SEQ ID NO: 246487 - DNA, 25 bp, Mus musculus
atcgctttctggcagggttcctcga

SEQ ID NO: 246488 - DNA, 25 bp, Mus musculus
atcgctttctgggagggttcctcga

SEQ ID NO: 246489 - DNA, 25 bp, Mus musculus
atcgctttctttctcttccgcgaac

SEQ ID NO: 246490 - DNA, 25 bp, Mus musculus
atcgctttctttgtcttccgcgaac

SEQ ID NO: 246491 - DNA, 25 bp, Mus musculus
atcgctttgcagattgggtgtttga

SEQ ID NO: 246492 - DNA, 25 bp, Mus musculus
atcgctttgcagtttgggtgtttga

SEQ ID NO: 246493 - DNA, 25 bp, Mus musculus
atcgctttggacaagaccgacgaca

SEQ ID NO: 246494 - DNA, 25 bp, Mus musculus
atcgctttggactagaccgacgaca

SEQ ID NO: 246495 - DNA, 25 bp, Mus musculus
atcggaacccgcaaacggactgttg

SEQ ID NO: 246496 - DNA, 25 bp, Mus musculus
atcggaacccgctaacggactgttg

SEQ ID NO: 246497 - DNA, 25 bp, Mus musculus
atcggaacgggaaactgctcctcta

SEQ ID NO: 246498 - DNA, 25 bp, Mus musculus
atcggaacgggatactgctcctcta

SEQ ID NO: 246499 - DNA, 25 bp, Mus musculus
atcggaactcatctacaagtccaag

SEQ ID NO: 246500 - DNA, 25 bp, Mus musculus
atcggaactcatgtacaagtccaag

SEQ ID NO: 246501 - DNA, 25 bp, Mus musculus
atcggaacttctagctgactctcaa

SEQ ID NO: 246502 - DNA, 25 bp, Mus musculus
atcggaacttcttgctgactctcaa

SEQ ID NO: 246503 - DNA, 25 bp, Mus musculus
atcggaagagctaggcccagcagcg

SEQ ID NO: 246504 - DNA, 25 bp, Mus musculus
atcggaagagcttggcccagcagcg

SEQ ID NO: 246505 - DNA, 25 bp, Mus musculus
atcggaagcccacgggcccaagtga

SEQ ID NO: 246506 - DNA, 25 bp, Mus musculus
atcggaagcccaggggcccaagtga

SEQ ID NO: 246507 - DNA, 25 bp, Mus musculus
atcggaaggagcactttctctggcc

SEQ ID NO: 246508 - DNA, 25 bp, Mus musculus
atcggaaggagctctttctctggcc

SEQ ID NO: 246509 - DNA, 25 bp, Mus musculus
atcggaagggaaatactcacaggta

SEQ ID NO: 246510 - DNA, 25 bp, Mus musculus
atcggaagggaattactcacaggta

SEQ ID NO: 246511 - DNA, 25 bp, Mus musculus
atcggaagtctcagttcatggaacc

SEQ ID NO: 246512 - DNA, 25 bp, Mus musculus
atcggaagtctctgttcatggaacc

SEQ ID NO: 246513 - DNA, 25 bp, Mus musculus
atcggaatctttaatgtctagtcag

SEQ ID NO: 246514 - DNA, 25 bp, Mus musculus
atcggaatcttttatgtctagtcag

SEQ ID NO: 246515 - DNA, 25 bp, Mus musculus
atcggaatgttgaagctgaagtaaa

SEQ ID NO: 246516 - DNA, 25 bp, Mus musculus
atcggaatgttgtagctgaagtaaa

SEQ ID NO: 246517 - DNA, 25 bp, Mus musculus
atcggaattatgaactttgtttcag

SEQ ID NO: 246518 - DNA, 25 bp, Mus musculus
atcggaattatgtactttgtttcag

SEQ ID NO: 246519 - DNA, 25 bp, Mus musculus
atcggacaaattatacaatctagac

SEQ ID NO: 246520 - DNA, 25 bp, Mus musculus
atcggacaaattttacaatctagac

SEQ ID NO: 246521 - DNA, 25 bp, Mus musculus
atcggacatctcaggcactagtgta

SEQ ID NO: 246522 - DNA, 25 bp, Mus musculus
atcggacatctctggcactagtgta

SEQ ID NO: 246523 - DNA, 25 bp, Mus musculus
atcggaccgaccatgtctgacggtg

SEQ ID NO: 246524 - DNA, 25 bp, Mus musculus
atcggaccgaccttgtctgacggtg

SEQ ID NO: 246525 - DNA, 25 bp, Mus musculus
atcggactctgtccatactcagtga

SEQ ID NO: 246526 - DNA, 25 bp, Mus musculus
atcggactctgtgcatactcagtga

SEQ ID NO: 246527 - DNA, 25 bp, Mus musculus
atcggactctttctgtagccttcaa

SEQ ID NO: 246528 - DNA, 25 bp, Mus musculus
atcggactctttgtgtagccttcaa

SEQ ID NO: 246529 - DNA, 25 bp, Mus musculus
atcggactgccaaatttcaccggtt

SEQ ID NO: 246530 - DNA, 25 bp, Mus musculus
atcggactgccatatttcaccggtt

SEQ ID NO: 246531 - DNA, 25 bp, Mus musculus
atcggacttcatcccaagcctaggc

SEQ ID NO: 246532 - DNA, 25 bp, Mus musculus
atcggacttcatgccaagcctaggc

SEQ ID NO: 246533 - DNA, 25 bp, Mus musculus
atcggactttccacagggctttgag

SEQ ID NO: 246534 - DNA, 25 bp, Mus musculus
atcggactttcctcagggctttgag

SEQ ID NO: 246535 - DNA, 25 bp, Mus musculus
atcggagattgccttcttcctggga

SEQ ID NO: 246536 - DNA, 25 bp, Mus musculus
atcggagattgcgttcttcctggga

SEQ ID NO: 246537 - DNA, 25 bp, Mus musculus
atcggagcagcacacactctgcagg

SEQ ID NO: 246538 - DNA, 25 bp, Mus musculus
atcggagcagcagacactctgcagg

SEQ ID NO: 246539 - DNA, 25 bp, Mus musculus
atcggagctgtcaccagaggtccaa

SEQ ID NO: 246540 - DNA, 25 bp, Mus musculus
atcggagctgtctccagaggtccaa

SEQ ID NO: 246541 - DNA, 25 bp, Mus musculus
atcggagcttccatctatacagacc

SEQ ID NO: 246542 - DNA, 25 bp, Mus musculus
atcggagcttccttctatacagacc

SEQ ID NO: 246543 - DNA, 25 bp, Mus musculus
atcggagcttgcagaattagcctgc

SEQ ID NO: 246544 - DNA, 25 bp, Mus musculus
atcggagcttgctgaattagcctgc

SEQ ID NO: 246545 - DNA, 25 bp, Mus musculus
atcggaggatacatccacagttccc

SEQ ID NO: 246546 - DNA, 25 bp, Mus musculus
atcggaggatacttccacagttccc

SEQ ID NO: 246547 - DNA, 25 bp, Mus musculus
atcggaggatccagggcttctaaat

SEQ ID NO: 246548 - DNA, 25 bp, Mus musculus
atcggaggatcctgggcttctaaat

SEQ ID NO: 246549 - DNA, 25 bp, Mus musculus
atcggaggcctcatgtatgcactgt

SEQ ID NO: 246550 - DNA, 25 bp, Mus musculus
atcggaggcctcttgtatgcactgt

SEQ ID NO: 246551 - DNA, 25 bp, Mus musculus
atcggagggaagcacgcatctaagt

SEQ ID NO: 246552 - DNA, 25 bp, Mus musculus
atcggagggaaggacgcatctaagt

SEQ ID NO: 246553 - DNA, 25 bp, Mus musculus
atcggagtcatcctttggctcggaa

SEQ ID NO: 246554 - DNA, 25 bp, Mus musculus
atcggagtcatcgtttggctcggaa

SEQ ID NO: 246555 - DNA, 25 bp, Mus musculus
atcggagtcctgctggctagtcaaa

SEQ ID NO: 246556 - DNA, 25 bp, Mus musculus
atcggagtcctggtggctagtcaaa

SEQ ID NO: 246557 - DNA, 25 bp, Mus musculus
atcggagtggcgaactgtttggtct

SEQ ID NO: 246558 - DNA, 25 bp, Mus musculus
atcggagtggcgtactgtttggtct

SEQ ID NO: 246559 - DNA, 25 bp, Mus musculus
atcggagtgtctcgatgagtagcca

SEQ ID NO: 246560 - DNA, 25 bp, Mus musculus
atcggagtgtctggatgagtagcca

SEQ ID NO: 246561 - DNA, 25 bp, Mus musculus
atcggataatatagctgaagacttc

SEQ ID NO: 246562 - DNA, 25 bp, Mus musculus
atcggataatattgctgaagacttc

SEQ ID NO: 246563 - DNA, 25 bp, Mus musculus
atcggataccccatagtgttgagaa

SEQ ID NO: 246564 - DNA, 25 bp, Mus musculus
atcggataccccttagtgttgagaa

SEQ ID NO: 246565 - DNA, 25 bp, Mus musculus
atcggataccgaattcagacagatc

SEQ ID NO: 246566 - DNA, 25 bp, Mus musculus
atcggataccgatttcagacagatc

SEQ ID NO: 246567 - DNA, 25 bp, Mus musculus
atcggatcagtaacagctcagacag

SEQ ID NO: 246568 - DNA, 25 bp, Mus musculus
atcggatcagtatcagctcagacag

SEQ ID NO: 246569 - DNA, 25 bp, Mus musculus
atcggatccatcagggtgaggctta

SEQ ID NO: 246570 - DNA, 25 bp, Mus musculus
atcggatccatctgggtgaggctta

SEQ ID NO: 246571 - DNA, 25 bp, Mus musculus
atcggatccgtcagtcgtttgggct

SEQ ID NO: 246572 - DNA, 25 bp, Mus musculus
atcggatccgtctgtcgtttgggct

SEQ ID NO: 246573 - DNA, 25 bp, Mus musculus
atcggatctgctaaaggctctttct

SEQ ID NO: 246574 - DNA, 25 bp, Mus musculus
atcggatctgcttaaggctctttct

SEQ ID NO: 246575 - DNA, 25 bp, Mus musculus
atcggatgactcacagggactgtgt

SEQ ID NO: 246576 - DNA, 25 bp, Mus musculus
atcggatgactctcagggactgtgt

SEQ ID NO: 246577 - DNA, 25 bp, Mus musculus
atcggatgaggacgtcctggccttt

SEQ ID NO: 246578 - DNA, 25 bp, Mus musculus
atcggatgaggaggtcctggccttt

SEQ ID NO: 246579 - DNA, 25 bp, Mus musculus
atcggatgatctataataaggcagg

SEQ ID NO: 246580 - DNA, 25 bp, Mus musculus
atcggatgatctttaataaggcagg

SEQ ID NO: 246581 - DNA, 25 bp, Mus musculus
atcggattgtgtagactgacagtct

SEQ ID NO: 246582 - DNA, 25 bp, Mus musculus
atcggattgtgttgactgacagtct

SEQ ID NO: 246583 - DNA, 25 bp, Mus musculus
atcggcaagcggcttaacagaggac

SEQ ID NO: 246584 - DNA, 25 bp, Mus musculus
atcggcaagcgggttaacagaggac

SEQ ID NO: 246585 - DNA, 25 bp, Mus musculus
atcggcaatggcaatgggttgatca

SEQ ID NO: 246586 - DNA, 25 bp, Mus musculus
atcggcaatggctatgggttgatca

SEQ ID NO: 246587 - DNA, 25 bp, Mus musculus
atcggcactacaccaagagcagcaa

SEQ ID NO: 246588 - DNA, 25 bp, Mus musculus
atcggcactacagcaagagcagcaa

SEQ ID NO: 246589 - DNA, 25 bp, Mus musculus
atcggcactccgaaagacggcaagc

SEQ ID NO: 246590 - DNA, 25 bp, Mus musculus
atcggcactccgtaagacggcaagc

SEQ ID NO: 246591 - DNA, 25 bp, Mus musculus
atcggcagggaaactcagtgcgttt

SEQ ID NO: 246592 - DNA, 25 bp, Mus musculus
atcggcagggaatctcagtgcgttt

SEQ ID NO: 246593 - DNA, 25 bp, Mus musculus
atcggcaggttcctgctccggatgt

SEQ ID NO: 246594 - DNA, 25 bp, Mus musculus
atcggcaggttcgtgctccggatgt

SEQ ID NO: 246595 - DNA, 25 bp, Mus musculus
atcggcataggcatcattatttctg

SEQ ID NO: 246596 - DNA, 25 bp, Mus musculus
atcggcataggcttcattatttctg

SEQ ID NO: 246597 - DNA, 25 bp, Mus musculus
atcggcatcaaacccatggtgaaga

SEQ ID NO: 246598 - DNA, 25 bp, Mus musculus
atcggcatcaaagccatggtgaaga

SEQ ID NO: 246599 - DNA, 25 bp, Mus musculus
atcggcatccccatgaccaacttaa

SEQ ID NO: 246600 - DNA, 25 bp, Mus musculus
atcggcatccccttgaccaacttaa

SEQ ID NO: 246601 - DNA, 25 bp, Mus musculus
atcggcatcgccctggtgatgatct

SEQ ID NO: 246602 - DNA, 25 bp, Mus musculus
atcggcatcgccgtggtgatgatct

SEQ ID NO: 246603 - DNA, 25 bp, Mus musculus
atcggcatctttcttttctgcgaac

SEQ ID NO: 246604 - DNA, 25 bp, Mus musculus
atcggcatctttgttttctgcgaac

SEQ ID NO: 246605 - DNA, 25 bp, Mus musculus
atcggcatgtcacccatgagctcgg

SEQ ID NO: 246606 - DNA, 25 bp, Mus musculus
atcggcatgtcagccatgagctcgg

SEQ ID NO: 246607 - DNA, 25 bp, Mus musculus
atcggcattactctcttcattggct

SEQ ID NO: 246608 - DNA, 25 bp, Mus musculus
atcggcattactgtcttcattggct

SEQ ID NO: 246609 - DNA, 25 bp, Mus musculus
atcggcattggcattgcactctcag

SEQ ID NO: 246610 - DNA, 25 bp, Mus musculus
atcggcattggctttgcactctcag

SEQ ID NO: 246611 - DNA, 25 bp, Mus musculus
atcggccattgaatgtctctcctgg

SEQ ID NO: 246612 - DNA, 25 bp, Mus musculus
atcggccattgattgtctctcctgg

SEQ ID NO: 246613 - DNA, 25 bp, Mus musculus
atcggccccaagcatggaatgcaga

SEQ ID NO: 246614 - DNA, 25 bp, Mus musculus
atcggccccaaggatggaatgcaga

SEQ ID NO: 246615 - DNA, 25 bp, Mus musculus
atcggccctcgacttgattggattg

SEQ ID NO: 246616 - DNA, 25 bp, Mus musculus
atcggccctcgagttgattggattg

SEQ ID NO: 246617 - DNA, 25 bp, Mus musculus
atcggccctgttagctgacagtaac

SEQ ID NO: 246618 - DNA, 25 bp, Mus musculus
atcggccctgtttgctgacagtaac

SEQ ID NO: 246619 - DNA, 25 bp, Mus musculus
atcggcccttgaccaggctgagtaa

SEQ ID NO: 246620 - DNA, 25 bp, Mus musculus
atcggcccttgagcaggctgagtaa

SEQ ID NO: 246621 - DNA, 25 bp, Mus musculus
atcggccgtgcccttaacgtgggca

SEQ ID NO: 246622 - DNA, 25 bp, Mus musculus
atcggccgtgccgttaacgtgggca

SEQ ID NO: 246623 - DNA, 25 bp, Mus musculus
atcggcctcatcctagctgtctgga

SEQ ID NO: 246624 - DNA, 25 bp, Mus musculus
atcggcctcatcgtagctgtctgga

SEQ ID NO: 246625 - DNA, 25 bp, Mus musculus
atcggcctcctgataaatcgagata

SEQ ID NO: 246626 - DNA, 25 bp, Mus musculus
atcggcctcctgttaaatcgagata

SEQ ID NO: 246627 - DNA, 25 bp, Mus musculus
atcggcctgaggaaaatccctgtgt

SEQ ID NO: 246628 - DNA, 25 bp, Mus musculus
atcggcctgaggtaaatccctgtgt

SEQ ID NO: 246629 - DNA, 25 bp, Mus musculus
atcggcctgcgaatggctcaggaga

SEQ ID NO: 246630 - DNA, 25 bp, Mus musculus
atcggcctgcgattggctcaggaga

SEQ ID NO: 246631 - DNA, 25 bp, Mus musculus
atcggcctgcggatcctgccaagtg

SEQ ID NO: 246632 - DNA, 25 bp, Mus musculus
atcggcctgcggttcctgccaagtg

SEQ ID NO: 246633 - DNA, 25 bp, Mus musculus
atcggcctgctccattaaatgaggt

SEQ ID NO: 246634 - DNA, 25 bp, Mus musculus
atcggcctgctcgattaaatgaggt

SEQ ID NO: 246635 - DNA, 25 bp, Mus musculus
atcggcctgtttagtccacatgaaa

SEQ ID NO: 246636 - DNA, 25 bp, Mus musculus
atcggcctgttttgtccacatgaaa

SEQ ID NO: 246637 - DNA, 25 bp, Mus musculus
atcggccttcatcctctggttaggg

SEQ ID NO: 246638 - DNA, 25 bp, Mus musculus
atcggccttcatgctctggttaggg

SEQ ID NO: 246639 - DNA, 25 bp, Mus musculus
atcggccttgctactgaaacatgtg

SEQ ID NO: 246640 - DNA, 25 bp, Mus musculus
atcggccttgcttctgaaacatgtg

SEQ ID NO: 246641 - DNA, 25 bp, Mus musculus
atcggcgccagcctaaggacaggaa

SEQ ID NO: 246642 - DNA, 25 bp, Mus musculus
atcggcgccagcgtaaggacaggaa

SEQ ID NO: 246643 - DNA, 25 bp, Mus musculus
atcggcgctcgaacgggacctggat

SEQ ID NO: 246644 - DNA, 25 bp, Mus musculus
atcggcgctcgatcgggacctggat

SEQ ID NO: 246645 - DNA, 25 bp, Mus musculus
atcggcggcctcactatcgctggga

SEQ ID NO: 246646 - DNA, 25 bp, Mus musculus
atcggcggcctctctatcgctggga

SEQ ID NO: 246647 - DNA, 25 bp, Mus musculus
atcggcgttgcgattgtggacatgc

SEQ ID NO: 246648 - DNA, 25 bp, Mus musculus
atcggcgttgcgtttgtggacatgc

SEQ ID NO: 246649 - DNA, 25 bp, Mus musculus
atcggctaaagcaccctgaaggacc

SEQ ID NO: 246650 - DNA, 25 bp, Mus musculus
atcggctaaagctccctgaaggacc

SEQ ID NO: 246651 - DNA, 25 bp, Mus musculus
atcggctaccgccagctaggtgact

SEQ ID NO: 246652 - DNA, 25 bp, Mus musculus
atcggctaccgcgagctaggtgact

SEQ ID NO: 246653 - DNA, 25 bp, Mus musculus
atcggctccggccaaaggtacatga

SEQ ID NO: 246654 - DNA, 25 bp, Mus musculus
atcggctccggcgaaaggtacatga

SEQ ID NO: 246655 - DNA, 25 bp, Mus musculus
atcggctcgcttcttgctctgggaa

SEQ ID NO: 246656 - DNA, 25 bp, Mus musculus
atcggctcgcttgttgctctgggaa

SEQ ID NO: 246657 - DNA, 25 bp, Mus musculus
atcggctctagcaggagaacaacag

SEQ ID NO: 246658 - DNA, 25 bp, Mus musculus
atcggctctagctggagaacaacag

SEQ ID NO: 246659 - DNA, 25 bp, Mus musculus
atcggctctggaactgatggtccac

SEQ ID NO: 246660 - DNA, 25 bp, Mus musculus
atcggctctggatctgatggtccac

SEQ ID NO: 246661 - DNA, 25 bp, Mus musculus
atcggctctgggattggcatctttg

SEQ ID NO: 246662 - DNA, 25 bp, Mus musculus
atcggctctgggtttggcatctttg

SEQ ID NO: 246663 - DNA, 25 bp, Mus musculus
atcggctgaacgcaattcttctgca

SEQ ID NO: 246664 - DNA, 25 bp, Mus musculus
atcggctgaacggaattcttctgca

SEQ ID NO: 246665 - DNA, 25 bp, Mus musculus
atcggctgattaagcgcggtgccca

SEQ ID NO: 246666 - DNA, 25 bp, Mus musculus
atcggctgattatgcgcggtgccca

SEQ ID NO: 246667 - DNA, 25 bp, Mus musculus
atcggctgcaagaagcttaccgtct

SEQ ID NO: 246668 - DNA, 25 bp, Mus musculus
atcggctgcaagtagcttaccgtct

SEQ ID NO: 246669 - DNA, 25 bp, Mus musculus
atcggctgcttcaaacagacatttt

SEQ ID NO: 246670 - DNA, 25 bp, Mus musculus
atcggctgcttctaacagacatttt

SEQ ID NO: 246671 - DNA, 25 bp, Mus musculus
atcggctggagcaatttcattggtt

SEQ ID NO: 246672 - DNA, 25 bp, Mus musculus
atcggctggagctatttcattggtt

SEQ ID NO: 246673 - DNA, 25 bp, Mus musculus
atcggcttaagacctgaaggcatct

SEQ ID NO: 246674 - DNA, 25 bp, Mus musculus
atcggcttaagagctgaaggcatct

SEQ ID NO: 246675 - DNA, 25 bp, Mus musculus
atcggcttcggacgaccatttcatt

SEQ ID NO: 246676 - DNA, 25 bp, Mus musculus
atcggcttcggaggaccatttcatt

SEQ ID NO: 246677 - DNA, 25 bp, Mus musculus
atcggcttctgaaccttaggtgtcc

SEQ ID NO: 246678 - DNA, 25 bp, Mus musculus
atcggcttctgatccttaggtgtcc

SEQ ID NO: 246679 - DNA, 25 bp, Mus musculus
atcggcttgcatagacctgaggtga

SEQ ID NO: 246680 - DNA, 25 bp, Mus musculus
atcggcttgcattgacctgaggtga

SEQ ID NO: 246681 - DNA, 25 bp, Mus musculus
atcggcttgcttcctagacagtcta

SEQ ID NO: 246682 - DNA, 25 bp, Mus musculus
atcggcttgcttgctagacagtcta

SEQ ID NO: 246683 - DNA, 25 bp, Mus musculus
atcgggaaactacctcatcacagcc

SEQ ID NO: 246684 - DNA, 25 bp, Mus musculus
atcgggaaactagctcatcacagcc

SEQ ID NO: 246685 - DNA, 25 bp, Mus musculus
atcgggaaccatcaagttactcttc

SEQ ID NO: 246686 - DNA, 25 bp, Mus musculus
atcgggaaccatgaagttactcttc

SEQ ID NO: 246687 - DNA, 25 bp, Mus musculus
atcgggaagactatgatcctgctcc

SEQ ID NO: 246688 - DNA, 25 bp, Mus musculus
atcgggaagactttgatcctgctcc

SEQ ID NO: 246689 - DNA, 25 bp, Mus musculus
atcgggaagagcacacacggcctgg

SEQ ID NO: 246690 - DNA, 25 bp, Mus musculus
atcgggaagagctcacacggcctgg

SEQ ID NO: 246691 - DNA, 25 bp, Mus musculus
atcgggactgacatatgctggcctg

SEQ ID NO: 246692 - DNA, 25 bp, Mus musculus
atcgggactgacttatgctggcctg

SEQ ID NO: 246693 - DNA, 25 bp, Mus musculus
atcgggagcacgctcatcctatcct

SEQ ID NO: 246694 - DNA, 25 bp, Mus musculus
atcgggagcacggtcatcctatcct

SEQ ID NO: 246695 - DNA, 25 bp, Mus musculus
atcgggagctggacaagttccgcac

SEQ ID NO: 246696 - DNA, 25 bp, Mus musculus
atcgggagctggtcaagttccgcac

SEQ ID NO: 246697 - DNA, 25 bp, Mus musculus
atcgggagggaacctaccatgtgcc

SEQ ID NO: 246698 - DNA, 25 bp, Mus musculus
atcgggagggaagctaccatgtgcc

SEQ ID NO: 246699 - DNA, 25 bp, Mus musculus
atcgggatagctaagttactgcact

SEQ ID NO: 246700 - DNA, 25 bp, Mus musculus
atcgggatagcttagttactgcact

SEQ ID NO: 246701 - DNA, 25 bp, Mus musculus
atcgggatgcaaccagccgtgcgcc

SEQ ID NO: 246702 - DNA, 25 bp, Mus musculus
atcgggatgcaagcagccgtgcgcc

SEQ ID NO: 246703 - DNA, 25 bp, Mus musculus
atcgggatttgtcgacctggaccag

SEQ ID NO: 246704 - DNA, 25 bp, Mus musculus
atcgggatttgtggacctggaccag

SEQ ID NO: 246705 - DNA, 25 bp, Mus musculus
atcgggcaaaccagtcgctcagaag

SEQ ID NO: 246706 - DNA, 25 bp, Mus musculus
atcgggcaaacctgtcgctcagaag

SEQ ID NO: 246707 - DNA, 25 bp, Mus musculus
atcgggcaacagctgtcgagtagat

SEQ ID NO: 246708 - DNA, 25 bp, Mus musculus
atcgggcaacaggtgtcgagtagat

SEQ ID NO: 246709 - DNA, 25 bp, Mus musculus
atcgggcataataatgcatgccttt

SEQ ID NO: 246710 - DNA, 25 bp, Mus musculus
atcgggcataattatgcatgccttt

SEQ ID NO: 246711 - DNA, 25 bp, Mus musculus
atcgggccacctacagagctgatca

SEQ ID NO: 246712 - DNA, 25 bp, Mus musculus
atcgggccaccttcagagctgatca

SEQ ID NO: 246713 - DNA, 25 bp, Mus musculus
atcgggccagccagcagaaagtatt

SEQ ID NO: 246714 - DNA, 25 bp, Mus musculus
atcgggccagcctgcagaaagtatt

SEQ ID NO: 246715 - DNA, 25 bp, Mus musculus
atcgggccaggtacgtttcactgag

SEQ ID NO: 246716 - DNA, 25 bp, Mus musculus
atcgggccaggttcgtttcactgag

SEQ ID NO: 246717 - DNA, 25 bp, Mus musculus
atcgggcgagccacaccgcagagaa

SEQ ID NO: 246718 - DNA, 25 bp, Mus musculus
atcgggcgagcctcaccgcagagaa

SEQ ID NO: 246719 - DNA, 25 bp, Mus musculus
atcgggcgcatcatccatatcgtgg

SEQ ID NO: 246720 - DNA, 25 bp, Mus musculus
atcgggcgcatcttccatatcgtgg

SEQ ID NO: 246721 - DNA, 25 bp, Mus musculus
atcgggctacccaatgtggagatcc

SEQ ID NO: 246722 - DNA, 25 bp, Mus musculus
atcgggctaccctatgtggagatcc

SEQ ID NO: 246723 - DNA, 25 bp, Mus musculus
atcgggctcattactaatcgtcgca

SEQ ID NO: 246724 - DNA, 25 bp, Mus musculus
atcgggctcatttctaatcgtcgca

SEQ ID NO: 246725 - DNA, 25 bp, Mus musculus
atcgggctgcccaagatattttatc

SEQ ID NO: 246726 - DNA, 25 bp, Mus musculus
atcgggctgcccatagacgctgtct

SEQ ID NO: 246727 - DNA, 25 bp, Mus musculus
atcgggctgccctagatattttatc

SEQ ID NO: 246728 - DNA, 25 bp, Mus musculus
atcgggctgcccttagacgctgtct

SEQ ID NO: 246729 - DNA, 25 bp, Mus musculus
atcgggctgttaaatgagggctctt

SEQ ID NO: 246730 - DNA, 25 bp, Mus musculus
atcgggctgttatatgagggctctt

SEQ ID NO: 246731 - DNA, 25 bp, Mus musculus
atcgggctgttcaatactgtgcata

SEQ ID NO: 246732 - DNA, 25 bp, Mus musculus
atcgggctgttctatactgtgcata

SEQ ID NO: 246733 - DNA, 25 bp, Mus musculus
atcgggcttagaccagtcaccctta

SEQ ID NO: 246734 - DNA, 25 bp, Mus musculus
atcgggcttagagcagtcaccctta

SEQ ID NO: 246735 - DNA, 25 bp, Mus musculus
atcgggcttcgaagagcacactctg

SEQ ID NO: 246736 - DNA, 25 bp, Mus musculus
atcgggcttcgatgagcacactctg

SEQ ID NO: 246737 - DNA, 25 bp, Mus musculus
atcgggctttcgcatacgtttgcgg

SEQ ID NO: 246738 - DNA, 25 bp, Mus musculus
atcgggctttcggatacgtttgcgg

SEQ ID NO: 246739 - DNA, 25 bp, Mus musculus
atcggggtcattcccaatgatatgg

SEQ ID NO: 246740 - DNA, 25 bp, Mus musculus
atcggggtcattgccaatgatatgg

SEQ ID NO: 246741 - DNA, 25 bp, Mus musculus
atcgggtagcagactgtcttcatcc

SEQ ID NO: 246742 - DNA, 25 bp, Mus musculus
atcgggtagcagtctgtcttcatcc

SEQ ID NO: 246743 - DNA, 25 bp, Mus musculus
atcgggtcccagagagggcttacca

SEQ ID NO: 246744 - DNA, 25 bp, Mus musculus
atcgggtcccagtgagggcttacca

SEQ ID NO: 246745 - DNA, 25 bp, Mus musculus
atcgggtcccatcagatactctgaa

SEQ ID NO: 246746 - DNA, 25 bp, Mus musculus
atcgggtcccatgagatactctgaa

SEQ ID NO: 246747 - DNA, 25 bp, Mus musculus
atcgggtctaagagattggcagaac

SEQ ID NO: 246748 - DNA, 25 bp, Mus musculus
atcgggtctaagtgattggcagaac

SEQ ID NO: 246749 - DNA, 25 bp, Mus musculus
atcgggtctcatacttgtgcagcaa

SEQ ID NO: 246750 - DNA, 25 bp, Mus musculus
atcgggtctcattcttgtgcagcaa

SEQ ID NO: 246751 - DNA, 25 bp, Mus musculus
atcgggtctgcgactataaaagggt

SEQ ID NO: 246752 - DNA, 25 bp, Mus musculus
atcgggtctgcgtctataaaagggt

SEQ ID NO: 246753 - DNA, 25 bp, Mus musculus
atcgggtcttatacatacagttcaa

SEQ ID NO: 246754 - DNA, 25 bp, Mus musculus
atcgggtcttattcatacagttcaa

SEQ ID NO: 246755 - DNA, 25 bp, Mus musculus
atcgggtcttgtaactggatgggtc

SEQ ID NO: 246756 - DNA, 25 bp, Mus musculus
atcgggtcttgttactggatgggtc

SEQ ID NO: 246757 - DNA, 25 bp, Mus musculus
atcgggtgacaaagccaatcgtgga

SEQ ID NO: 246758 - DNA, 25 bp, Mus musculus
atcgggtgacaatgccaatcgtgga

SEQ ID NO: 246759 - DNA, 25 bp, Mus musculus
atcgggtgacacagttggacgcagt

SEQ ID NO: 246760 - DNA, 25 bp, Mus musculus
atcgggtgacactgttggacgcagt

SEQ ID NO: 246761 - DNA, 25 bp, Mus musculus
atcgggtgccttcctttggaaacat

SEQ ID NO: 246762 - DNA, 25 bp, Mus musculus
atcgggtgccttgctttggaaacat

SEQ ID NO: 246763 - DNA, 25 bp, Mus musculus
atcgggttatgacaccgcccaggca

SEQ ID NO: 246764 - DNA, 25 bp, Mus musculus
atcgggttatgagaccgcccaggca

SEQ ID NO: 246765 - DNA, 25 bp, Mus musculus
atcgggttcaagatacttctttgct

SEQ ID NO: 246766 - DNA, 25 bp, Mus musculus
atcgggttcaagttacttctttgct

SEQ ID NO: 246767 - DNA, 25 bp, Mus musculus
atcgggttcccaaaaagtcactctg

SEQ ID NO: 246768 - DNA, 25 bp, Mus musculus
atcgggttcccataaagtcactctg

SEQ ID NO: 246769 - DNA, 25 bp, Mus musculus
atcgggttgactattttattgcttc

SEQ ID NO: 246770 - DNA, 25 bp, Mus musculus
atcgggttgacttttttattgcttc

SEQ ID NO: 246771 - DNA, 25 bp, Mus musculus
atcgggttttctcactgttgccagt

SEQ ID NO: 246772 - DNA, 25 bp, Mus musculus
atcgggttttctgactgttgccagt

SEQ ID NO: 246773 - DNA, 25 bp, Mus musculus
atcggtaacgtgaccggctccaatg

SEQ ID NO: 246774 - DNA, 25 bp, Mus musculus
atcggtaacgtgtccggctccaatg

SEQ ID NO: 246775 - DNA, 25 bp, Mus musculus
atcggtaagtatcctctggtggaga

SEQ ID NO: 246776 - DNA, 25 bp, Mus musculus
atcggtaagtatgctctggtggaga

SEQ ID NO: 246777 - DNA, 25 bp, Mus musculus
atcggtacaccgagtggaccagctt

SEQ ID NO: 246778 - DNA, 25 bp, Mus musculus
atcggtacaccgtgtggaccagctt

SEQ ID NO: 246779 - DNA, 25 bp, Mus musculus
atcggtactcttcctctcgtgtgca

SEQ ID NO: 246780 - DNA, 25 bp, Mus musculus
atcggtactcttgctctcgtgtgca

SEQ ID NO: 246781 - DNA, 25 bp, Mus musculus
atcggtattttactttctatctcgt

SEQ ID NO: 246782 - DNA, 25 bp, Mus musculus
atcggtattttagtttctatctcgt

SEQ ID NO: 246783 - DNA, 25 bp, Mus musculus
atcggtccccagagcaggtcgggtc

SEQ ID NO: 246784 - DNA, 25 bp, Mus musculus
atcggtccccagtgcaggtcgggtc

SEQ ID NO: 246785 - DNA, 25 bp, Mus musculus
atcggtcggtcaccagggttttctc

SEQ ID NO: 246786 - DNA, 25 bp, Mus musculus
atcggtcggtcagcagggttttctc

SEQ ID NO: 246787 - DNA, 25 bp, Mus musculus
atcggtctagttccagtgagcagca

SEQ ID NO: 246788 - DNA, 25 bp, Mus musculus
atcggtctagttgcagtgagcagca

SEQ ID NO: 246789 - DNA, 25 bp, Mus musculus
atcggtctgggtaacatatcagttt

SEQ ID NO: 246790 - DNA, 25 bp, Mus musculus
atcggtctgggttacatatcagttt

SEQ ID NO: 246791 - DNA, 25 bp, Mus musculus
atcggtctgttaaaccaaataagga

SEQ ID NO: 246792 - DNA, 25 bp, Mus musculus
atcggtctgttataccaaataagga

SEQ ID NO: 246793 - DNA, 25 bp, Mus musculus
atcggtctgttcaggcagtttctta

SEQ ID NO: 246794 - DNA, 25 bp, Mus musculus
atcggtctgttctggcagtttctta

SEQ ID NO: 246795 - DNA, 25 bp, Mus musculus
atcggtcttgccacagcgcatgcat

SEQ ID NO: 246796 - DNA, 25 bp, Mus musculus
atcggtcttgcctcagcgcatgcat

SEQ ID NO: 246797 - DNA, 25 bp, Mus musculus
atcggtgaatatcaacttactgcta

SEQ ID NO: 246798 - DNA, 25 bp, Mus musculus
atcggtgaatatgaacttactgcta

SEQ ID NO: 246799 - DNA, 25 bp, Mus musculus
atcggtgcccatcatgtctataagg

SEQ ID NO: 246800 - DNA, 25 bp, Mus musculus
atcggtgcccatgatgtctataagg

SEQ ID NO: 246801 - DNA, 25 bp, Mus musculus
atcggtgccccaacaacaatgaaat

SEQ ID NO: 246802 - DNA, 25 bp, Mus musculus
atcggtgccccaaggtgtgtgatga

SEQ ID NO: 246803 - DNA, 25 bp, Mus musculus
atcggtgccccatcaacaatgaaat

SEQ ID NO: 246804 - DNA, 25 bp, Mus musculus
atcggtgccccatggtgtgtgatga

SEQ ID NO: 246805 - DNA, 25 bp, Mus musculus
atcggtgctaccattacaaagtgaa

SEQ ID NO: 246806 - DNA, 25 bp, Mus musculus
atcggtgctacctttacaaagtgaa

SEQ ID NO: 246807 - DNA, 25 bp, Mus musculus
atcggtgctatgacagagctccaca

SEQ ID NO: 246808 - DNA, 25 bp, Mus musculus
atcggtgctatgtcagagctccaca

SEQ ID NO: 246809 - DNA, 25 bp, Mus musculus
atcggtgctggcagtgtcccaacag

SEQ ID NO: 246810 - DNA, 25 bp, Mus musculus
atcggtgctggctgtgtcccaacag

SEQ ID NO: 246811 - DNA, 25 bp, Mus musculus
atcggtgctgttacgggaagttcct

SEQ ID NO: 246812 - DNA, 25 bp, Mus musculus
atcggtgctgtttcgggaagttcct

SEQ ID NO: 246813 - DNA, 25 bp, Mus musculus
atcggtggtaacactgcctaaatgt

SEQ ID NO: 246814 - DNA, 25 bp, Mus musculus
atcggtggtaactctgcctaaatgt

SEQ ID NO: 246815 - DNA, 25 bp, Mus musculus
atcggtggtaatccctaccagcaca

SEQ ID NO: 246816 - DNA, 25 bp, Mus musculus
atcggtggtaatgcctaccagcaca

SEQ ID NO: 246817 - DNA, 25 bp, Mus musculus
atcggtgtcacacctgccacagcaa

SEQ ID NO: 246818 - DNA, 25 bp, Mus musculus
atcggtgtcacagctgccacagcaa

SEQ ID NO: 246819 - DNA, 25 bp, Mus musculus
atcggtgtcctgcacaagtggtgta

SEQ ID NO: 246820 - DNA, 25 bp, Mus musculus
atcggtgtcctggacaagtggtgta

SEQ ID NO: 246821 - DNA, 25 bp, Mus musculus
atcggtgtctcgattgaaaggtcca

SEQ ID NO: 246822 - DNA, 25 bp, Mus musculus
atcggtgtctcgtttgaaaggtcca

SEQ ID NO: 246823 - DNA, 25 bp, Mus musculus
atcggtgtggcgaagtttgcaaaca

SEQ ID NO: 246824 - DNA, 25 bp, Mus musculus
atcggtgtggcgtagtttgcaaaca

SEQ ID NO: 246825 - DNA, 25 bp, Mus musculus
atcggtgtggtacagcattgccttc

SEQ ID NO: 246826 - DNA, 25 bp, Mus musculus
atcggtgtggtagagcattgccttc

SEQ ID NO: 246827 - DNA, 25 bp, Mus musculus
atcggtgttacaacatgtgacgaat

SEQ ID NO: 246828 - DNA, 25 bp, Mus musculus
atcggtgttacatcatgtgacgaat

SEQ ID NO: 246829 - DNA, 25 bp, Mus musculus
atcggtgttcggacagtaatgctta

SEQ ID NO: 246830 - DNA, 25 bp, Mus musculus
atcggtgttcggtcagtaatgctta

SEQ ID NO: 246831 - DNA, 25 bp, Mus musculus
atcggttaccagaggccgctaggcc

SEQ ID NO: 246832 - DNA, 25 bp, Mus musculus
atcggttaccagtggccgctaggcc

SEQ ID NO: 246833 - DNA, 25 bp, Mus musculus
atcggttatgatctgcaatacctaa

SEQ ID NO: 246834 - DNA, 25 bp, Mus musculus
atcggttatgatgtgcaatacctaa

SEQ ID NO: 246835 - DNA, 25 bp, Mus musculus
atcggttcatccatccagggttgcc

SEQ ID NO: 246836 - DNA, 25 bp, Mus musculus
atcggttcatccttccagggttgcc

SEQ ID NO: 246837 - DNA, 25 bp, Mus musculus
atcggttcatgtctctgcccatgct

SEQ ID NO: 246838 - DNA, 25 bp, Mus musculus
atcggttcatgtgtctgcccatgct

SEQ ID NO: 246839 - DNA, 25 bp, Mus musculus
atcggttccatcctcagggagctag

SEQ ID NO: 246840 - DNA, 25 bp, Mus musculus
atcggttccatcgtcagggagctag

SEQ ID NO: 246841 - DNA, 25 bp, Mus musculus
atcggttcctacctcctcctggttg

SEQ ID NO: 246842 - DNA, 25 bp, Mus musculus
atcggttcctacgtcctcctggttg

SEQ ID NO: 246843 - DNA, 25 bp, Mus musculus
atcggttgctgaagtctacttcatt

SEQ ID NO: 246844 - DNA, 25 bp, Mus musculus
atcggttgctgatgtctacttcatt

SEQ ID NO: 246845 - DNA, 25 bp, Mus musculus
atcggtttcgtgacgtgcatcagca

SEQ ID NO: 246846 - DNA, 25 bp, Mus musculus
atcggtttcgtgtcgtgcatcagca

SEQ ID NO: 246847 - DNA, 25 bp, Mus musculus
atcggtttgtaaaggagtcggctct

SEQ ID NO: 246848 - DNA, 25 bp, Mus musculus
atcggtttgtaatggagtcggctct

SEQ ID NO: 246849 - DNA, 25 bp, Mus musculus
atcgtaagagacatagccaaccagg

SEQ ID NO: 246850 - DNA, 25 bp, Mus musculus
atcgtaagagacttagccaaccagg

SEQ ID NO: 246851 - DNA, 25 bp, Mus musculus
atcgtaagttgcacctattgttaag

SEQ ID NO: 246852 - DNA, 25 bp, Mus musculus
atcgtaagttgctcctattgttaag

SEQ ID NO: 246853 - DNA, 25 bp, Mus musculus
atcgtacactgcaactaataagcca

SEQ ID NO: 246854 - DNA, 25 bp, Mus musculus
atcgtacactgctactaataagcca

SEQ ID NO: 246855 - DNA, 25 bp, Mus musculus
atcgtacgcagtcgcgaacactcac

SEQ ID NO: 246856 - DNA, 25 bp, Mus musculus
atcgtacgcagtggcgaacactcac

SEQ ID NO: 246857 - DNA, 25 bp, Mus musculus
atcgtactaaaaacactttctgttt

SEQ ID NO: 246858 - DNA, 25 bp, Mus musculus
atcgtactaaaatcactttctgttt

SEQ ID NO: 246859 - DNA, 25 bp, Mus musculus
atcgtagattaaaatggcagcttgc

SEQ ID NO: 246860 - DNA, 25 bp, Mus musculus
atcgtagattaatatggcagcttgc

SEQ ID NO: 246861 - DNA, 25 bp, Mus musculus
atcgtaggcaacattgtagggtgct

SEQ ID NO: 246862 - DNA, 25 bp, Mus musculus
atcgtaggcaactttgtagggtgct

SEQ ID NO: 246863 - DNA, 25 bp, Mus musculus
atcgtagtggctctcttcatcttct

SEQ ID NO: 246864 - DNA, 25 bp, Mus musculus
atcgtagtggctgtcttcatcttct

SEQ ID NO: 246865 - DNA, 25 bp, Mus musculus
atcgtatcccccatgaagttaattc

SEQ ID NO: 246866 - DNA, 25 bp, Mus musculus
atcgtatcccccttgaagttaattc

SEQ ID NO: 246867 - DNA, 25 bp, Mus musculus
atcgtatctggcaaggtgggtcaca

SEQ ID NO: 246868 - DNA, 25 bp, Mus musculus
atcgtatctggctaggtgggtcaca

SEQ ID NO: 246869 - DNA, 25 bp, Mus musculus
atcgtatggcatagacacaggcgga

SEQ ID NO: 246870 - DNA, 25 bp, Mus musculus
atcgtatggcattgacacaggcgga

SEQ ID NO: 246871 - DNA, 25 bp, Mus musculus
atcgtattctggatgctgtcttgaa

SEQ ID NO: 246872 - DNA, 25 bp, Mus musculus
atcgtattctggttgctgtcttgaa

SEQ ID NO: 246873 - DNA, 25 bp, Mus musculus
atcgtcaacatcagcctaccttttg

SEQ ID NO: 246874 - DNA, 25 bp, Mus musculus
atcgtcaacatctgcctaccttttg

SEQ ID NO: 246875 - DNA, 25 bp, Mus musculus
atcgtcaacgaaagccagaggtctc

SEQ ID NO: 246876 - DNA, 25 bp, Mus musculus
atcgtcaacgaatgccagaggtctc

SEQ ID NO: 246877 - DNA, 25 bp, Mus musculus
atcgtcaagctgctctccactgcta

SEQ ID NO: 246878 - DNA, 25 bp, Mus musculus
atcgtcaagctggtctccactgcta

SEQ ID NO: 246879 - DNA, 25 bp, Mus musculus
atcgtcaagttaaggccatctcggc

SEQ ID NO: 246880 - DNA, 25 bp, Mus musculus
atcgtcaagttatggccatctcggc

SEQ ID NO: 246881 - DNA, 25 bp, Mus musculus
atcgtcacaccacagaacaagtcta

SEQ ID NO: 246882 - DNA, 25 bp, Mus musculus
atcgtcacaccagagaacaagtcta

SEQ ID NO: 246883 - DNA, 25 bp, Mus musculus
atcgtcactctaatgtatcctcctt

SEQ ID NO: 246884 - DNA, 25 bp, Mus musculus
atcgtcactctattgtatcctcctt

SEQ ID NO: 246885 - DNA, 25 bp, Mus musculus
atcgtcaggcacatcatcaaggagt

SEQ ID NO: 246886 - DNA, 25 bp, Mus musculus
atcgtcaggcacttcatcaaggagt

SEQ ID NO: 246887 - DNA, 25 bp, Mus musculus
atcgtcagtcaaatcagtgcacctc

SEQ ID NO: 246888 - DNA, 25 bp, Mus musculus
atcgtcagtcaattcagtgcacctc

SEQ ID NO: 246889 - DNA, 25 bp, Mus musculus
atcgtcatacgtccctggaggctgt

SEQ ID NO: 246890 - DNA, 25 bp, Mus musculus
atcgtcatacgtgcctggaggctgt

SEQ ID NO: 246891 - DNA, 25 bp, Mus musculus
atcgtcatagcacacaggctctcaa

SEQ ID NO: 246892 - DNA, 25 bp, Mus musculus
atcgtcatagcagacaggctctcaa

SEQ ID NO: 246893 - DNA, 25 bp, Mus musculus
atcgtcatgcaacctgtccagtggc

SEQ ID NO: 246894 - DNA, 25 bp, Mus musculus
atcgtcatgcaagctgtccagtggc

SEQ ID NO: 246895 - DNA, 25 bp, Mus musculus
atcgtccaatatatccttggcacta

SEQ ID NO: 246896 - DNA, 25 bp, Mus musculus
atcgtccaatatttccttggcacta

SEQ ID NO: 246897 - DNA, 25 bp, Mus musculus
atcgtccagcaaactcctgtctgct

SEQ ID NO: 246898 - DNA, 25 bp, Mus musculus
atcgtccagcaatctcctgtctgct

SEQ ID NO: 246899 - DNA, 25 bp, Mus musculus
atcgtccaggacatcatttgcttaa

SEQ ID NO: 246900 - DNA, 25 bp, Mus musculus
atcgtccaggacttcatttgcttaa

SEQ ID NO: 246901 - DNA, 25 bp, Mus musculus
atcgtccatcatctagaaggtggtg

SEQ ID NO: 246902 - DNA, 25 bp, Mus musculus
atcgtccatcatgtagaaggtggtg

SEQ ID NO: 246903 - DNA, 25 bp, Mus musculus
atcgtccatgcgctgcaagctggga

SEQ ID NO: 246904 - DNA, 25 bp, Mus musculus
atcgtccatgcggtgcaagctggga

SEQ ID NO: 246905 - DNA, 25 bp, Mus musculus
atcgtccattcaaacatacactcaa

SEQ ID NO: 246906 - DNA, 25 bp, Mus musculus
atcgtccattcatacatacactcaa

SEQ ID NO: 246907 - DNA, 25 bp, Mus musculus
atcgtcccaagactgctgaacaaca

SEQ ID NO: 246908 - DNA, 25 bp, Mus musculus
atcgtcccaagagtgctgaacaaca

SEQ ID NO: 246909 - DNA, 25 bp, Mus musculus
atcgtcccacctatgatcacaggaa

SEQ ID NO: 246910 - DNA, 25 bp, Mus musculus
atcgtcccacctttgatcacaggaa

SEQ ID NO: 246911 - DNA, 25 bp, Mus musculus
atcgtcccaggaacactacatatag

SEQ ID NO: 246912 - DNA, 25 bp, Mus musculus
atcgtcccaggatcactacatatag

SEQ ID NO: 246913 - DNA, 25 bp, Mus musculus
atcgtcccctggaggcctattagag

SEQ ID NO: 246914 - DNA, 25 bp, Mus musculus
atcgtcccctggtggcctattagag

SEQ ID NO: 246915 - DNA, 25 bp, Mus musculus
atcgtccctagacctgagtccagga

SEQ ID NO: 246916 - DNA, 25 bp, Mus musculus
atcgtccctagagctgagtccagga

SEQ ID NO: 246917 - DNA, 25 bp, Mus musculus
atcgtccctgttcatgtgctctgca

SEQ ID NO: 246918 - DNA, 25 bp, Mus musculus
atcgtccctgttgatgtgctctgca

SEQ ID NO: 246919 - DNA, 25 bp, Mus musculus
atcgtcctaggacctgtgctacgga

SEQ ID NO: 246920 - DNA, 25 bp, Mus musculus
atcgtcctaggagctgtgctacgga

SEQ ID NO: 246921 - DNA, 25 bp, Mus musculus
atcgtcctggctatgggcggtgtca

SEQ ID NO: 246922 - DNA, 25 bp, Mus musculus
atcgtcctggctttgggcggtgtca

SEQ ID NO: 246923 - DNA, 25 bp, Mus musculus
atcgtcctgtgcactttgaacttat

SEQ ID NO: 246924 - DNA, 25 bp, Mus musculus
atcgtcctgtgctctttgaacttat

SEQ ID NO: 246925 - DNA, 25 bp, Mus musculus
atcgtccttgtgatctttgtggtat

SEQ ID NO: 246926 - DNA, 25 bp, Mus musculus
atcgtccttgtgttctttgtggtat

SEQ ID NO: 246927 - DNA, 25 bp, Mus musculus
atcgtcctttttaggtctgcttatt

SEQ ID NO: 246928 - DNA, 25 bp, Mus musculus
atcgtccttttttggtctgcttatt

SEQ ID NO: 246929 - DNA, 25 bp, Mus musculus
atcgtcgaggtcacgtaccagcaga

SEQ ID NO: 246930 - DNA, 25 bp, Mus musculus
atcgtcgaggtctcgtaccagcaga

SEQ ID NO: 246931 - DNA, 25 bp, Mus musculus
atcgtcgctgttactgtgtcaagtc

SEQ ID NO: 246932 - DNA, 25 bp, Mus musculus
atcgtcgctgtttctgtgtcaagtc

SEQ ID NO: 246933 - DNA, 25 bp, Mus musculus
atcgtcgggctgagctctgcatggt

SEQ ID NO: 246934 - DNA, 25 bp, Mus musculus
atcgtcgggctgtgctctgcatggt

SEQ ID NO: 246935 - DNA, 25 bp, Mus musculus
atcgtcgtgcggctgtgttttcatt

SEQ ID NO: 246936 - DNA, 25 bp, Mus musculus
atcgtcgtgcgggtgtgttttcatt

SEQ ID NO: 246937 - DNA, 25 bp, Mus musculus
atcgtctactacctgggtcgcaagc

SEQ ID NO: 246938 - DNA, 25 bp, Mus musculus
atcgtctactacgtgggtcgcaagc

SEQ ID NO: 246939 - DNA, 25 bp, Mus musculus
atcgtctatctaactgtgtgtcgcg

SEQ ID NO: 246940 - DNA, 25 bp, Mus musculus
atcgtctatctatctgtgtgtcgcg

SEQ ID NO: 246941 - DNA, 25 bp, Mus musculus
atcgtctatgtccagagcatctgcc

SEQ ID NO: 246942 - DNA, 25 bp, Mus musculus
atcgtctatgtcgagagcatctgcc

SEQ ID NO: 246943 - DNA, 25 bp, Mus musculus
atcgtctcatgtaatgatggctttt

SEQ ID NO: 246944 - DNA, 25 bp, Mus musculus
atcgtctcatgttatgatggctttt

SEQ ID NO: 246945 - DNA, 25 bp, Mus musculus
atcgtctctggtcaacttacaggga

SEQ ID NO: 246946 - DNA, 25 bp, Mus musculus
atcgtctctggtgaacttacaggga

SEQ ID NO: 246947 - DNA, 25 bp, Mus musculus
atcgtctgagagatattctcttggt

SEQ ID NO: 246948 - DNA, 25 bp, Mus musculus
atcgtctgagagttattctcttggt

SEQ ID NO: 246949 - DNA, 25 bp, Mus musculus
atcgtctgcagaattctgttcttat

SEQ ID NO: 246950 - DNA, 25 bp, Mus musculus
atcgtctgcagatttctgttcttat

SEQ ID NO: 246951 - DNA, 25 bp, Mus musculus
atcgtctgctcccatgagattgcgg

SEQ ID NO: 246952 - DNA, 25 bp, Mus musculus
atcgtctgctccgatgagattgcgg

SEQ ID NO: 246953 - DNA, 25 bp, Mus musculus
atcgtctgctctcaatatgtttaac

SEQ ID NO: 246954 - DNA, 25 bp, Mus musculus
atcgtctgctctgaatatgtttaac

SEQ ID NO: 246955 - DNA, 25 bp, Mus musculus
atcgtctgtcgacatgtttctatac

SEQ ID NO: 246956 - DNA, 25 bp, Mus musculus
atcgtctgtcgagatgtttctatac

SEQ ID NO: 246957 - DNA, 25 bp, Mus musculus
atcgtcttatttacagtttagcctg

SEQ ID NO: 246958 - DNA, 25 bp, Mus musculus
atcgtcttattttcagtttagcctg

SEQ ID NO: 246959 - DNA, 25 bp, Mus musculus
atcgtcttcctgacacagatgttgt

SEQ ID NO: 246960 - DNA, 25 bp, Mus musculus
atcgtcttcctgtcacagatgttgt

SEQ ID NO: 246961 - DNA, 25 bp, Mus musculus
atcgtcttctggactatggtcgggc

SEQ ID NO: 246962 - DNA, 25 bp, Mus musculus
atcgtcttctggactcttagctata

SEQ ID NO: 246963 - DNA, 25 bp, Mus musculus
atcgtcttctggtctatggtcgggc

SEQ ID NO: 246964 - DNA, 25 bp, Mus musculus
atcgtcttctggtctcttagctata

SEQ ID NO: 246965 - DNA, 25 bp, Mus musculus
atcgtcttgcctcaatagactgtgg

SEQ ID NO: 246966 - DNA, 25 bp, Mus musculus
atcgtcttgcctgaatagactgtgg

SEQ ID NO: 246967 - DNA, 25 bp, Mus musculus
atcgtcttgtctctcgtcagtagac

SEQ ID NO: 246968 - DNA, 25 bp, Mus musculus
atcgtcttgtctgtcgtcagtagac

SEQ ID NO: 246969 - DNA, 25 bp, Mus musculus
atcgtgaccatgatcgagagcgaga

SEQ ID NO: 246970 - DNA, 25 bp, Mus musculus
atcgtgaccatgttcgagagcgaga

SEQ ID NO: 246971 - DNA, 25 bp, Mus musculus
atcgtgagcagtctgggacttctcc

SEQ ID NO: 246972 - DNA, 25 bp, Mus musculus
atcgtgagcagtgtgggacttctcc

SEQ ID NO: 246973 - DNA, 25 bp, Mus musculus
atcgtgagcgcgaagtcgtccgaga

SEQ ID NO: 246974 - DNA, 25 bp, Mus musculus
atcgtgagcgcgtagtcgtccgaga

SEQ ID NO: 246975 - DNA, 25 bp, Mus musculus
atcgtgagcggaagtcaggaaatct

SEQ ID NO: 246976 - DNA, 25 bp, Mus musculus
atcgtgagcggatgtcaggaaatct

SEQ ID NO: 246977 - DNA, 25 bp, Mus musculus
atcgtgagctggatgattgcccaga

SEQ ID NO: 246978 - DNA, 25 bp, Mus musculus
atcgtgagctggttgattgcccaga

SEQ ID NO: 246979 - DNA, 25 bp, Mus musculus
atcgtgcaggccctgatgctaacag

SEQ ID NO: 246980 - DNA, 25 bp, Mus musculus
atcgtgcaggccgtgatgctaacag

SEQ ID NO: 246981 - DNA, 25 bp, Mus musculus
atcgtgcagtctctcaaggccgtgg

SEQ ID NO: 246982 - DNA, 25 bp, Mus musculus
atcgtgcagtctgtcaaggccgtgg

SEQ ID NO: 246983 - DNA, 25 bp, Mus musculus
atcgtgcatggcaacatgtccaaga

SEQ ID NO: 246984 - DNA, 25 bp, Mus musculus
atcgtgcatggctacatgtccaaga

SEQ ID NO: 246985 - DNA, 25 bp, Mus musculus
atcgtgcgcgctattcttgattcgg

SEQ ID NO: 246986 - DNA, 25 bp, Mus musculus
atcgtgcgcgcttttcttgattcgg

SEQ ID NO: 246987 - DNA, 25 bp, Mus musculus
atcgtgcggacgatttggctaaaga

SEQ ID NO: 246988 - DNA, 25 bp, Mus musculus
atcgtgcggacgttttggctaaaga

SEQ ID NO: 246989 - DNA, 25 bp, Mus musculus
atcgtgcggtgtcccataagtatgg

SEQ ID NO: 246990 - DNA, 25 bp, Mus musculus
atcgtgcggtgtgccataagtatgg

SEQ ID NO: 246991 - DNA, 25 bp, Mus musculus
atcgtgctaccaaagccagctagac

SEQ ID NO: 246992 - DNA, 25 bp, Mus musculus
atcgtgctaccatagccagctagac

SEQ ID NO: 246993 - DNA, 25 bp, Mus musculus
atcgtgctcaagaacatcatggctg

SEQ ID NO: 246994 - DNA, 25 bp, Mus musculus
atcgtgctcaagtacatcatggctg

SEQ ID NO: 246995 - DNA, 25 bp, Mus musculus
atcgtgctcattatatgatctctct

SEQ ID NO: 246996 - DNA, 25 bp, Mus musculus
atcgtgctcattttatgatctctct

SEQ ID NO: 246997 - DNA, 25 bp, Mus musculus
atcgtgctcggacttggaaggcctt

SEQ ID NO: 246998 - DNA, 25 bp, Mus musculus
atcgtgctcggagttggaaggcctt

SEQ ID NO: 246999 - DNA, 25 bp, Mus musculus
atcgtgctcttcagctatatgcagt

SEQ ID NO: 247000 - DNA, 25 bp, Mus musculus
atcgtgctcttctgctatatgcagt

SEQ ID NO: 247001 - DNA, 25 bp, Mus musculus
atcgtggaatacacaagcacttttc

SEQ ID NO: 247002 - DNA, 25 bp, Mus musculus
atcgtggaatactcaagcacttttc

SEQ ID NO: 247003 - DNA, 25 bp, Mus musculus
atcgtggacggacctcaggaccaag

SEQ ID NO: 247004 - DNA, 25 bp, Mus musculus
atcgtggacggagctcaggaccaag

SEQ ID NO: 247005 - DNA, 25 bp, Mus musculus
atcgtggagattacactgacctgca

SEQ ID NO: 247006 - DNA, 25 bp, Mus musculus
atcgtggagatttcactgacctgca

SEQ ID NO: 247007 - DNA, 25 bp, Mus musculus
atcgtggccacgagtaggacctaat

SEQ ID NO: 247008 - DNA, 25 bp, Mus musculus
atcgtggccacgtgtaggacctaat

SEQ ID NO: 247009 - DNA, 25 bp, Mus musculus
atcgtggcggcaagatgattcccat

SEQ ID NO: 247010 - DNA, 25 bp, Mus musculus
atcgtggcggcatgatgattcccat

SEQ ID NO: 247011 - DNA, 25 bp, Mus musculus
atcgtggcgggactgcttttcctgt

SEQ ID NO: 247012 - DNA, 25 bp, Mus musculus
atcgtggcgggagtgcttttcctgt

SEQ ID NO: 247013 - DNA, 25 bp, Mus musculus
atcgtggctggtattttcataggca

SEQ ID NO: 247014 - DNA, 25 bp, Mus musculus
atcgtggctggttttttcataggca

SEQ ID NO: 247015 - DNA, 25 bp, Mus musculus
atcgtgggcattattgctctgtgtt

SEQ ID NO: 247016 - DNA, 25 bp, Mus musculus
atcgtgggcatttttgctctgtgtt

SEQ ID NO: 247017 - DNA, 25 bp, Mus musculus
atcgtgggctccatgtgtgccatcg

SEQ ID NO: 247018 - DNA, 25 bp, Mus musculus
atcgtgggctccttgtgtgccatcg

SEQ ID NO: 247019 - DNA, 25 bp, Mus musculus
atcgtgggtgctcgtcaggttccat

SEQ ID NO: 247020 - DNA, 25 bp, Mus musculus
atcgtgggtgctggtcaggttccat

SEQ ID NO: 247021 - DNA, 25 bp, Mus musculus
atcgtgggtggcatcccaaacaggg

SEQ ID NO: 247022 - DNA, 25 bp, Mus musculus
atcgtgggtggcttcccaaacaggg

SEQ ID NO: 247023 - DNA, 25 bp, Mus musculus
atcgtggtccagatcattgctcaaa

SEQ ID NO: 247024 - DNA, 25 bp, Mus musculus
atcgtggtccagttcattgctcaaa

SEQ ID NO: 247025 - DNA, 25 bp, Mus musculus
atcgtggtcctcctactctacgtat

SEQ ID NO: 247026 - DNA, 25 bp, Mus musculus
atcgtggtcctcgtactctacgtat

SEQ ID NO: 247027 - DNA, 25 bp, Mus musculus
atcgtggtccttacccatgaggaac

SEQ ID NO: 247028 - DNA, 25 bp, Mus musculus
atcgtggtcctttcccatgaggaac

SEQ ID NO: 247029 - DNA, 25 bp, Mus musculus
atcgtggtctgtcttggaatcctga

SEQ ID NO: 247030 - DNA, 25 bp, Mus musculus
atcgtggtctgtgttggaatcctga

SEQ ID NO: 247031 - DNA, 25 bp, Mus musculus
atcgtggtgtggaactgctctgtgc

SEQ ID NO: 247032 - DNA, 25 bp, Mus musculus
atcgtggtgtggtactgctctgtgc

SEQ ID NO: 247033 - DNA, 25 bp, Mus musculus
atcgtggttccccagtctcccaaag

SEQ ID NO: 247034 - DNA, 25 bp, Mus musculus
atcgtggttcccgagtctcccaaag

SEQ ID NO: 247035 - DNA, 25 bp, Mus musculus
atcgtggttctcaattgtaatttta

SEQ ID NO: 247036 - DNA, 25 bp, Mus musculus
atcgtggttctctattgtaatttta

SEQ ID NO: 247037 - DNA, 25 bp, Mus musculus
atcgtggttgtgagtaccttcgcca

SEQ ID NO: 247038 - DNA, 25 bp, Mus musculus
atcgtggttgtgtgtaccttcgcca

SEQ ID NO: 247039 - DNA, 25 bp, Mus musculus
atcgtgtacagtcaaactgcttcct

SEQ ID NO: 247040 - DNA, 25 bp, Mus musculus
atcgtgtacagtgaaactgcttcct

SEQ ID NO: 247041 - DNA, 25 bp, Mus musculus
atcgtgtactccatagcggatcgca

SEQ ID NO: 247042 - DNA, 25 bp, Mus musculus
atcgtgtactccttagcggatcgca

SEQ ID NO: 247043 - DNA, 25 bp, Mus musculus
atcgtgtactctctgcttttcactc

SEQ ID NO: 247044 - DNA, 25 bp, Mus musculus
atcgtgtactctgtgcttttcactc

SEQ ID NO: 247045 - DNA, 25 bp, Mus musculus
atcgtgtccgtgaaccatattgtaa

SEQ ID NO: 247046 - DNA, 25 bp, Mus musculus
atcgtgtccgtgtaccatattgtaa

SEQ ID NO: 247047 - DNA, 25 bp, Mus musculus
atcgtgtctctcactctgggctgat

SEQ ID NO: 247048 - DNA, 25 bp, Mus musculus
atcgtgtctctctctctgggctgat

SEQ ID NO: 247049 - DNA, 25 bp, Mus musculus
atcgtgtctgtcattacctctgtct

SEQ ID NO: 247050 - DNA, 25 bp, Mus musculus
atcgtgtctgtctttacctctgtct

SEQ ID NO: 247051 - DNA, 25 bp, Mus musculus
atcgtgtgcaagatcctggcagacc

SEQ ID NO: 247052 - DNA, 25 bp, Mus musculus
atcgtgtgcaagttcctggcagacc

SEQ ID NO: 247053 - DNA, 25 bp, Mus musculus
atcgtgtgcaccatccaggagtatg

SEQ ID NO: 247054 - DNA, 25 bp, Mus musculus
atcgtgtgcaccttccaggagtatg

SEQ ID NO: 247055 - DNA, 25 bp, Mus musculus
atcgtgtgttgccattttgtctgac

SEQ ID NO: 247056 - DNA, 25 bp, Mus musculus
atcgtgtgttgcgattttgtctgac

SEQ ID NO: 247057 - DNA, 25 bp, Mus musculus
atcgtgttcttccaaggacttccag

SEQ ID NO: 247058 - DNA, 25 bp, Mus musculus
atcgtgttcttcgaaggacttccag

SEQ ID NO: 247059 - DNA, 25 bp, Mus musculus
atcgtgttgcccatgaaatccattc

SEQ ID NO: 247060 - DNA, 25 bp, Mus musculus
atcgtgttgcccttgaaatccattc

SEQ ID NO: 247061 - DNA, 25 bp, Mus musculus
atcgtgtttgagcactttgcccggc

SEQ ID NO: 247062 - DNA, 25 bp, Mus musculus
atcgtgtttgaggactttgcccggc

SEQ ID NO: 247063 - DNA, 25 bp, Mus musculus
atcgtgtttgcgagcatcctggcag

SEQ ID NO: 247064 - DNA, 25 bp, Mus musculus
atcgtgtttgcgtgcatcctggcag

SEQ ID NO: 247065 - DNA, 25 bp, Mus musculus
atcgttacatgtaaccctttcccag

SEQ ID NO: 247066 - DNA, 25 bp, Mus musculus
atcgttacatgttaccctttcccag

SEQ ID NO: 247067 - DNA, 25 bp, Mus musculus
atcgttcacaacagaggccaggcta

SEQ ID NO: 247068 - DNA, 25 bp, Mus musculus
atcgttcacaactgaggccaggcta

SEQ ID NO: 247069 - DNA, 25 bp, Mus musculus
atcgttcacccaaagtacaacttct

SEQ ID NO: 247070 - DNA, 25 bp, Mus musculus
atcgttcacccatagtacaacttct

SEQ ID NO: 247071 - DNA, 25 bp, Mus musculus
atcgttcacttcagggcatttcaac

SEQ ID NO: 247072 - DNA, 25 bp, Mus musculus
atcgttcacttctgggcatttcaac

SEQ ID NO: 247073 - DNA, 25 bp, Mus musculus
atcgttcccatcacaacagtcactg

SEQ ID NO: 247074 - DNA, 25 bp, Mus musculus
atcgttcccatctcaacagtcactg

SEQ ID NO: 247075 - DNA, 25 bp, Mus musculus
atcgttccccttatctgagcagtgt

SEQ ID NO: 247076 - DNA, 25 bp, Mus musculus
atcgttccccttttctgagcagtgt

SEQ ID NO: 247077 - DNA, 25 bp, Mus musculus
atcgttccttcaattctccaagaga

SEQ ID NO: 247078 - DNA, 25 bp, Mus musculus
atcgttccttcatttctccaagaga

SEQ ID NO: 247079 - DNA, 25 bp, Mus musculus
atcgttcggctcagtgctggaggac

SEQ ID NO: 247080 - DNA, 25 bp, Mus musculus
atcgttcggctctgtgctggaggac

SEQ ID NO: 247081 - DNA, 25 bp, Mus musculus
atcgttctctgcctccgaaaaagaa

SEQ ID NO: 247082 - DNA, 25 bp, Mus musculus
atcgttctctgcgtccgaaaaagaa

SEQ ID NO: 247083 - DNA, 25 bp, Mus musculus
atcgttctgacgagtggcttcatac

SEQ ID NO: 247084 - DNA, 25 bp, Mus musculus
atcgttctgacgtgtggcttcatac

SEQ ID NO: 247085 - DNA, 25 bp, Mus musculus
atcgttctgttcataattatcatgg

SEQ ID NO: 247086 - DNA, 25 bp, Mus musculus
atcgttctgttcttaattatcatgg

SEQ ID NO: 247087 - DNA, 25 bp, Mus musculus
atcgttcttctcacattctgaggtt

SEQ ID NO: 247088 - DNA, 25 bp, Mus musculus
atcgttcttctctcattctgaggtt

SEQ ID NO: 247089 - DNA, 25 bp, Mus musculus
atcgttgagagacgccctatgcagg

SEQ ID NO: 247090 - DNA, 25 bp, Mus musculus
atcgttgagagaggccctatgcagg

SEQ ID NO: 247091 - DNA, 25 bp, Mus musculus
atcgttgatctcagggaccacttca

SEQ ID NO: 247092 - DNA, 25 bp, Mus musculus
atcgttgatctctgggaccacttca

SEQ ID NO: 247093 - DNA, 25 bp, Mus musculus
atcgttgcatcacctcaggtctgga

SEQ ID NO: 247094 - DNA, 25 bp, Mus musculus
atcgttgcatcagctcaggtctgga

SEQ ID NO: 247095 - DNA, 25 bp, Mus musculus
atcgttgcttgccttgggattcact

SEQ ID NO: 247096 - DNA, 25 bp, Mus musculus
atcgttgcttgcgttgggattcact

SEQ ID NO: 247097 - DNA, 25 bp, Mus musculus
atcgttggagatctgcttatttgta

SEQ ID NO: 247098 - DNA, 25 bp, Mus musculus
atcgttggagatgtgcttatttgta

SEQ ID NO: 247099 - DNA, 25 bp, Mus musculus
atcgttggccatagctgtcttatat

SEQ ID NO: 247100 - DNA, 25 bp, Mus musculus
atcgttggccattgctgtcttatat

SEQ ID NO: 247101 - DNA, 25 bp, Mus musculus
atcgttgggagtcagccctcaaggc

SEQ ID NO: 247102 - DNA, 25 bp, Mus musculus
atcgttgggagtgagccctcaaggc

SEQ ID NO: 247103 - DNA, 25 bp, Mus musculus
atcgttgggtctaaaggcttctctc

SEQ ID NO: 247104 - DNA, 25 bp, Mus musculus
atcgttgggtcttaaggcttctctc

SEQ ID NO: 247105 - DNA, 25 bp, Mus musculus
atcgttggtgagagtggagccttcc

SEQ ID NO: 247106 - DNA, 25 bp, Mus musculus
atcgttggtgagtgtggagccttcc

SEQ ID NO: 247107 - DNA, 25 bp, Mus musculus
atcgttggttatctgcgttggagca

SEQ ID NO: 247108 - DNA, 25 bp, Mus musculus
atcgttggttatgtgcgttggagca

SEQ ID NO: 247109 - DNA, 25 bp, Mus musculus
atcgttggtttcagtcccgtcagat

SEQ ID NO: 247110 - DNA, 25 bp, Mus musculus
atcgttggtttctgtcccgtcagat

SEQ ID NO: 247111 - DNA, 25 bp, Mus musculus
atcgttgtctggcacacgtacgtca

SEQ ID NO: 247112 - DNA, 25 bp, Mus musculus
atcgttgtctgggacacgtacgtca

SEQ ID NO: 247113 - DNA, 25 bp, Mus musculus
atcgttgtgacgatagctggtacct

SEQ ID NO: 247114 - DNA, 25 bp, Mus musculus
atcgttgtgacgttagctggtacct

SEQ ID NO: 247115 - DNA, 25 bp, Mus musculus
atcgttgtgtgtaggctgcatgcag

SEQ ID NO: 247116 - DNA, 25 bp, Mus musculus
atcgttgtgtgttggctgcatgcag

SEQ ID NO: 247117 - DNA, 25 bp, Mus musculus
atcgttgttgatatcccactgtaga

SEQ ID NO: 247118 - DNA, 25 bp, Mus musculus
atcgttgttgatcgctatcatcctc

SEQ ID NO: 247119 - DNA, 25 bp, Mus musculus
atcgttgttgatggctatcatcctc

SEQ ID NO: 247120 - DNA, 25 bp, Mus musculus
atcgttgttgatttcccactgtaga

SEQ ID NO: 247121 - DNA, 25 bp, Mus musculus
atcgtttaactacgcacatcccact

SEQ ID NO: 247122 - DNA, 25 bp, Mus musculus
atcgtttaactaggcacatcccact

SEQ ID NO: 247123 - DNA, 25 bp, Mus musculus
atcgtttagcagaggtcgtgttctt

SEQ ID NO: 247124 - DNA, 25 bp, Mus musculus
atcgtttagcagtggtcgtgttctt

SEQ ID NO: 247125 - DNA, 25 bp, Mus musculus
atcgtttcatggctaacccacagct

SEQ ID NO: 247126 - DNA, 25 bp, Mus musculus
atcgtttcatgggtaacccacagct

SEQ ID NO: 247127 - DNA, 25 bp, Mus musculus
atcgtttcccaacatgtcccatgtg

SEQ ID NO: 247128 - DNA, 25 bp, Mus musculus
atcgtttcccaagatgtcccatgtg

SEQ ID NO: 247129 - DNA, 25 bp, Mus musculus
atcgtttgggtgcagtatttgagta

SEQ ID NO: 247130 - DNA, 25 bp, Mus musculus
atcgtttgggtggagtatttgagta

SEQ ID NO: 247131 - DNA, 25 bp, Mus musculus
atcgttttacgtccttgtgtccaag

SEQ ID NO: 247132 - DNA, 25 bp, Mus musculus
atcgttttacgtgcttgtgtccaag

SEQ ID NO: 247133 - DNA, 25 bp, Mus musculus
atcgttttcctgattcaggagtgat

SEQ ID NO: 247134 - DNA, 25 bp, Mus musculus
atcgttttcctgtttcaggagtgat

SEQ ID NO: 247135 - DNA, 25 bp, Mus musculus
atcgttttgctcatggtcgtgattt

SEQ ID NO: 247136 - DNA, 25 bp, Mus musculus
atcgttttgctcttggtcgtgattt

SEQ ID NO: 247137 - DNA, 25 bp, Mus musculus
atctaaaagctactaccaacatttt

SEQ ID NO: 247138 - DNA, 25 bp, Mus musculus
atctaaaagctagtaccaacatttt

SEQ ID NO: 247139 - DNA, 25 bp, Mus musculus
atctaaaatcctccagagaacatag

SEQ ID NO: 247140 - DNA, 25 bp, Mus musculus
atctaaaatcctgcagagaacatag

SEQ ID NO: 247141 - DNA, 25 bp, Mus musculus
atctaaaatcgacgctggcgggacc

SEQ ID NO: 247142 - DNA, 25 bp, Mus musculus
atctaaaatcgaggctggcgggacc

SEQ ID NO: 247143 - DNA, 25 bp, Mus musculus
atctaaacaccaacgaacccattga

SEQ ID NO: 247144 - DNA, 25 bp, Mus musculus
atctaaacaccatcgaacccattga

SEQ ID NO: 247145 - DNA, 25 bp, Mus musculus
atctaaacatcacacccactgcgag

SEQ ID NO: 247146 - DNA, 25 bp, Mus musculus
atctaaacatcagacccactgcgag

SEQ ID NO: 247147 - DNA, 25 bp, Mus musculus
atctaaaccataagcacggccctga

SEQ ID NO: 247148 - DNA, 25 bp, Mus musculus
atctaaaccatatgcacggccctga

SEQ ID NO: 247149 - DNA, 25 bp, Mus musculus
atctaaactgttctacttggctatg

SEQ ID NO: 247150 - DNA, 25 bp, Mus musculus
atctaaactgttgtacttggctatg

SEQ ID NO: 247151 - DNA, 25 bp, Mus musculus
atctaaagagccacacctttttctt

SEQ ID NO: 247152 - DNA, 25 bp, Mus musculus
atctaaagagcctcacctttttctt

SEQ ID NO: 247153 - DNA, 25 bp, Mus musculus
atctaaagagtgaccggcacccttg

SEQ ID NO: 247154 - DNA, 25 bp, Mus musculus
atctaaagagtgtccggcacccttg

SEQ ID NO: 247155 - DNA, 25 bp, Mus musculus
atctaaagccaaaagttgaactcat

SEQ ID NO: 247156 - DNA, 25 bp, Mus musculus
atctaaagccaatagttgaactcat

SEQ ID NO: 247157 - DNA, 25 bp, Mus musculus
atctaaagtgacataagactctgtc

SEQ ID NO: 247158 - DNA, 25 bp, Mus musculus
atctaaagtgacttaagactctgtc

SEQ ID NO: 247159 - DNA, 25 bp, Mus musculus
atctaaagtttcagctgtggtcagt

SEQ ID NO: 247160 - DNA, 25 bp, Mus musculus
atctaaagtttctgctgtggtcagt

SEQ ID NO: 247161 - DNA, 25 bp, Mus musculus
atctaaatctatccgtcttccacat

SEQ ID NO: 247162 - DNA, 25 bp, Mus musculus
atctaaatctatgcgtcttccacat

SEQ ID NO: 247163 - DNA, 25 bp, Mus musculus
atctaaatgtatctcctggagtgca

SEQ ID NO: 247164 - DNA, 25 bp, Mus musculus
atctaaatgtatgtcctggagtgca

SEQ ID NO: 247165 - DNA, 25 bp, Mus musculus
atctaaatgtgaagcccaagggaac

SEQ ID NO: 247166 - DNA, 25 bp, Mus musculus
atctaaatgtgatgcccaagggaac

SEQ ID NO: 247167 - DNA, 25 bp, Mus musculus
atctaaattcttctttcccttactg

SEQ ID NO: 247168 - DNA, 25 bp, Mus musculus
atctaaattcttgtttcccttactg

SEQ ID NO: 247169 - DNA, 25 bp, Mus musculus
atctaaatttcaaaggttgtctcta

SEQ ID NO: 247170 - DNA, 25 bp, Mus musculus
atctaaatttcataggttgtctcta

SEQ ID NO: 247171 - DNA, 25 bp, Mus musculus
atctaacaagagctgccctggaaag

SEQ ID NO: 247172 - DNA, 25 bp, Mus musculus
atctaacaagaggtgccctggaaag

SEQ ID NO: 247173 - DNA, 25 bp, Mus musculus
atctaacaatctacaggaggctgag

SEQ ID NO: 247174 - DNA, 25 bp, Mus musculus
atctaacaatcttcaggaggctgag

SEQ ID NO: 247175 - DNA, 25 bp, Mus musculus
atctaacacgtgcttttgaagacga

SEQ ID NO: 247176 - DNA, 25 bp, Mus musculus
atctaacacgtggttttgaagacga

SEQ ID NO: 247177 - DNA, 25 bp, Mus musculus
atctaacatcgtctatatattcccc

SEQ ID NO: 247178 - DNA, 25 bp, Mus musculus
atctaacatcgtgtatatattcccc

SEQ ID NO: 247179 - DNA, 25 bp, Mus musculus
atctaacatctgatggatttttcag

SEQ ID NO: 247180 - DNA, 25 bp, Mus musculus
atctaacatctgttggatttttcag

SEQ ID NO: 247181 - DNA, 25 bp, Mus musculus
atctaaccgcatcctgcaaatgctt

SEQ ID NO: 247182 - DNA, 25 bp, Mus musculus
atctaaccgcatgctgcaaatgctt

SEQ ID NO: 247183 - DNA, 25 bp, Mus musculus
atctaaccttaccatgcatcaacat

SEQ ID NO: 247184 - DNA, 25 bp, Mus musculus
atctaaccttacgatgcatcaacat

SEQ ID NO: 247185 - DNA, 25 bp, Mus musculus
atctaaccttgtaagccttgctcgg

SEQ ID NO: 247186 - DNA, 25 bp, Mus musculus
atctaaccttgttagccttgctcgg

SEQ ID NO: 247187 - DNA, 25 bp, Mus musculus
atctaacgctacacactggattttg

SEQ ID NO: 247188 - DNA, 25 bp, Mus musculus
atctaacgctactcactggattttg

SEQ ID NO: 247189 - DNA, 25 bp, Mus musculus
atctaactagttatcttttcctgag

SEQ ID NO: 247190 - DNA, 25 bp, Mus musculus
atctaactagttttcttttcctgag

SEQ ID NO: 247191 - DNA, 25 bp, Mus musculus
atctaactccttaagtatcgtgccc

SEQ ID NO: 247192 - DNA, 25 bp, Mus musculus
atctaactcctttagtatcgtgccc

SEQ ID NO: 247193 - DNA, 25 bp, Mus musculus
atctaagagaccaaaccaagtccta

SEQ ID NO: 247194 - DNA, 25 bp, Mus musculus
atctaagagacctaaccaagtccta

SEQ ID NO: 247195 - DNA, 25 bp, Mus musculus
atctaagaggttagacttcgatgtt

SEQ ID NO: 247196 - DNA, 25 bp, Mus musculus
atctaagaggtttgacttcgatgtt

SEQ ID NO: 247197 - DNA, 25 bp, Mus musculus
atctaagcacctctattcttgtgtg

SEQ ID NO: 247198 - DNA, 25 bp, Mus musculus
atctaagcacctgtattcttgtgtg

SEQ ID NO: 247199 - DNA, 25 bp, Mus musculus
atctaagcgtgaaggctcagacagc

SEQ ID NO: 247200 - DNA, 25 bp, Mus musculus
atctaagcgtgatggctcagacagc

SEQ ID NO: 247201 - DNA, 25 bp, Mus musculus
atctaagctaatcccataatgaata

SEQ ID NO: 247202 - DNA, 25 bp, Mus musculus
atctaagctaatgccataatgaata

SEQ ID NO: 247203 - DNA, 25 bp, Mus musculus
atctaagctctcaccagtcagaaga

SEQ ID NO: 247204 - DNA, 25 bp, Mus musculus
atctaagctctctccagtcagaaga

SEQ ID NO: 247205 - DNA, 25 bp, Mus musculus
atctaaggacaccatggagaaatca

SEQ ID NO: 247206 - DNA, 25 bp, Mus musculus
atctaaggacacgatggagaaatca

SEQ ID NO: 247207 - DNA, 25 bp, Mus musculus
atctaaggccagatgaaggttgttc

SEQ ID NO: 247208 - DNA, 25 bp, Mus musculus
atctaaggccagttgaaggttgttc

SEQ ID NO: 247209 - DNA, 25 bp, Mus musculus
atctaaggtcttacctgctttcact

SEQ ID NO: 247210 - DNA, 25 bp, Mus musculus
atctaaggtctttcctgctttcact

SEQ ID NO: 247211 - DNA, 25 bp, Mus musculus
atctaagtagtaaacaggctttgga

SEQ ID NO: 247212 - DNA, 25 bp, Mus musculus
atctaagtagtatacaggctttgga

SEQ ID NO: 247213 - DNA, 25 bp, Mus musculus
atctaagtcagcattataacacaag

SEQ ID NO: 247214 - DNA, 25 bp, Mus musculus
atctaagtcagctttataacacaag

SEQ ID NO: 247215 - DNA, 25 bp, Mus musculus
atctaagtccttaggcctcagtagg

SEQ ID NO: 247216 - DNA, 25 bp, Mus musculus
atctaagtcctttggcctcagtagg

SEQ ID NO: 247217 - DNA, 25 bp, Mus musculus
atctaagtggatattcatctgaaga

SEQ ID NO: 247218 - DNA, 25 bp, Mus musculus
atctaagtggattttcatctgaaga

SEQ ID NO: 247219 - DNA, 25 bp, Mus musculus
atctaagtttcccatctgagtttgc

SEQ ID NO: 247220 - DNA, 25 bp, Mus musculus
atctaagtttccgatctgagtttgc

SEQ ID NO: 247221 - DNA, 25 bp, Mus musculus
atctaataaaccctggtggtctatc

SEQ ID NO: 247222 - DNA, 25 bp, Mus musculus
atctaataaaccgtggtggtctatc

SEQ ID NO: 247223 - DNA, 25 bp, Mus musculus
atctaatattcaatccctgtgggag

SEQ ID NO: 247224 - DNA, 25 bp, Mus musculus
atctaatattcattccctgtgggag

SEQ ID NO: 247225 - DNA, 25 bp, Mus musculus
atctaatccaggaagcttcctagtt

SEQ ID NO: 247226 - DNA, 25 bp, Mus musculus
atctaatccaggtagcttcctagtt

SEQ ID NO: 247227 - DNA, 25 bp, Mus musculus
atctaatcctacactacttcggcag

SEQ ID NO: 247228 - DNA, 25 bp, Mus musculus
atctaatcctactctacttcggcag

SEQ ID NO: 247229 - DNA, 25 bp, Mus musculus
atctaatcctagaaatccctcacag

SEQ ID NO: 247230 - DNA, 25 bp, Mus musculus
atctaatcctagtaatccctcacag

SEQ ID NO: 247231 - DNA, 25 bp, Mus musculus
atctaatcgattattaaccacaggg

SEQ ID NO: 247232 - DNA, 25 bp, Mus musculus
atctaatcgatttttaaccacaggg

SEQ ID NO: 247233 - DNA, 25 bp, Mus musculus
atctaatcttatcgccgtcaacaac

SEQ ID NO: 247234 - DNA, 25 bp, Mus musculus
atctaatcttatggccgtcaacaac

SEQ ID NO: 247235 - DNA, 25 bp, Mus musculus
atctaatcttccacattcgtttgca

SEQ ID NO: 247236 - DNA, 25 bp, Mus musculus
atctaatcttcctcattcgtttgca

SEQ ID NO: 247237 - DNA, 25 bp, Mus musculus
atctaatgacatagctgagggtggt

SEQ ID NO: 247238 - DNA, 25 bp, Mus musculus
atctaatgacattgctgagggtggt

SEQ ID NO: 247239 - DNA, 25 bp, Mus musculus
atctaatgagatcaccgtatggttt

SEQ ID NO: 247240 - DNA, 25 bp, Mus musculus
atctaatgagatgaccgtatggttt

SEQ ID NO: 247241 - DNA, 25 bp, Mus musculus
atctaatggcggacagtttactggg

SEQ ID NO: 247242 - DNA, 25 bp, Mus musculus
atctaatggcggtcagtttactggg

SEQ ID NO: 247243 - DNA, 25 bp, Mus musculus
atctaatgtcacaggttcttccgtc

SEQ ID NO: 247244 - DNA, 25 bp, Mus musculus
atctaatgtcactggttcttccgtc

SEQ ID NO: 247245 - DNA, 25 bp, Mus musculus
atctaattactacctctcaccagac

SEQ ID NO: 247246 - DNA, 25 bp, Mus musculus
atctaattactagctctcaccagac

SEQ ID NO: 247247 - DNA, 25 bp, Mus musculus
atctaattattcaccaggccccttg

SEQ ID NO: 247248 - DNA, 25 bp, Mus musculus
atctaattattctccaggccccttg

SEQ ID NO: 247249 - DNA, 25 bp, Mus musculus
atctaatttcttcgtgttgtctctt

SEQ ID NO: 247250 - DNA, 25 bp, Mus musculus
atctaatttcttggtgttgtctctt

SEQ ID NO: 247251 - DNA, 25 bp, Mus musculus
atctacaaatgtcccctgacttcag

SEQ ID NO: 247252 - DNA, 25 bp, Mus musculus
atctacaaatgtgccctgacttcag

SEQ ID NO: 247253 - DNA, 25 bp, Mus musculus
atctacaactgtatgctggctgtct

SEQ ID NO: 247254 - DNA, 25 bp, Mus musculus
atctacaactgtttgctggctgtct

SEQ ID NO: 247255 - DNA, 25 bp, Mus musculus
atctacaagactcgagccccgcagt

SEQ ID NO: 247256 - DNA, 25 bp, Mus musculus
atctacaagactggagccccgcagt

SEQ ID NO: 247257 - DNA, 25 bp, Mus musculus
atctacaaggccctgctagggttcc

SEQ ID NO: 247258 - DNA, 25 bp, Mus musculus
atctacaaggccgtgctagggttcc

SEQ ID NO: 247259 - DNA, 25 bp, Mus musculus
atctacaaggctatcaggtctgaca

SEQ ID NO: 247260 - DNA, 25 bp, Mus musculus
atctacaaggctttcaggtctgaca

SEQ ID NO: 247261 - DNA, 25 bp, Mus musculus
atctacaatcatccttgaccttttt

SEQ ID NO: 247262 - DNA, 25 bp, Mus musculus
atctacaatcatgcttgaccttttt

SEQ ID NO: 247263 - DNA, 25 bp, Mus musculus
atctacacatccacgggcgaacact

SEQ ID NO: 247264 - DNA, 25 bp, Mus musculus
atctacacatcctcgggcgaacact

SEQ ID NO: 247265 - DNA, 25 bp, Mus musculus
atctacaccacccagatgaacggca

SEQ ID NO: 247266 - DNA, 25 bp, Mus musculus
atctacaccaccgagatgaacggca

SEQ ID NO: 247267 - DNA, 25 bp, Mus musculus
atctacaccattaggatcagggcgt

SEQ ID NO: 247268 - DNA, 25 bp, Mus musculus
atctacaccatttggatcagggcgt

SEQ ID NO: 247269 - DNA, 25 bp, Mus musculus
atctacactccaaagaatacagtga

SEQ ID NO: 247270 - DNA, 25 bp, Mus musculus
atctacactccatagaatacagtga

SEQ ID NO: 247271 - DNA, 25 bp, Mus musculus
atctacactgatatgcttggcttgg

SEQ ID NO: 247272 - DNA, 25 bp, Mus musculus
atctacactgatttgcttggcttgg

SEQ ID NO: 247273 - DNA, 25 bp, Mus musculus
atctacagcacccttatcaacgcag

SEQ ID NO: 247274 - DNA, 25 bp, Mus musculus
atctacagcaccgttatcaacgcag

SEQ ID NO: 247275 - DNA, 25 bp, Mus musculus
atctacagcggaagaaacagcaggc

SEQ ID NO: 247276 - DNA, 25 bp, Mus musculus
atctacagcggatgaaacagcaggc

SEQ ID NO: 247277 - DNA, 25 bp, Mus musculus
atctacagtcacatcaaacaagcta

SEQ ID NO: 247278 - DNA, 25 bp, Mus musculus
atctacagtcacttcaaacaagcta

SEQ ID NO: 247279 - DNA, 25 bp, Mus musculus
atctacatgaggatcttagccccaa

SEQ ID NO: 247280 - DNA, 25 bp, Mus musculus
atctacatgaggttcttagccccaa

SEQ ID NO: 247281 - DNA, 25 bp, Mus musculus
atctacatggttcaaaagtccgtga

SEQ ID NO: 247282 - DNA, 25 bp, Mus musculus
atctacatggttgaaaagtccgtga

SEQ ID NO: 247283 - DNA, 25 bp, Mus musculus
atctacatgttgatttttaccatct

SEQ ID NO: 247284 - DNA, 25 bp, Mus musculus
atctacatgttgttttttaccatct

SEQ ID NO: 247285 - DNA, 25 bp, Mus musculus
atctacattcatcgccactttctct

SEQ ID NO: 247286 - DNA, 25 bp, Mus musculus
atctacattcatcgcttgggcctgg

SEQ ID NO: 247287 - DNA, 25 bp, Mus musculus
atctacattcatggccactttctct

SEQ ID NO: 247288 - DNA, 25 bp, Mus musculus
atctacattcatggcttgggcctgg

SEQ ID NO: 247289 - DNA, 25 bp, Mus musculus
atctacattttgcatctgctttccc

SEQ ID NO: 247290 - DNA, 25 bp, Mus musculus
atctacattttggatctgctttccc

SEQ ID NO: 247291 - DNA, 25 bp, Mus musculus
atctaccaatgaatgctgaataatg

SEQ ID NO: 247292 - DNA, 25 bp, Mus musculus
atctaccaatgattgctgaataatg

SEQ ID NO: 247293 - DNA, 25 bp, Mus musculus
atctaccacaccattgcttacttga

SEQ ID NO: 247294 - DNA, 25 bp, Mus musculus
atctaccacacctttgcttacttga

SEQ ID NO: 247295 - DNA, 25 bp, Mus musculus
atctaccacagtatatcagcatttg

SEQ ID NO: 247296 - DNA, 25 bp, Mus musculus
atctaccacagtttatcagcatttg

SEQ ID NO: 247297 - DNA, 25 bp, Mus musculus
atctaccaccctaacatcgatgaga

SEQ ID NO: 247298 - DNA, 25 bp, Mus musculus
atctaccacccttacatcgatgaga

SEQ ID NO: 247299 - DNA, 25 bp, Mus musculus
atctaccatggtattgcgtttataa

SEQ ID NO: 247300 - DNA, 25 bp, Mus musculus
atctaccatggttttgcgtttataa

SEQ ID NO: 247301 - DNA, 25 bp, Mus musculus
atctacccacttagtttctgttgga

SEQ ID NO: 247302 - DNA, 25 bp, Mus musculus
atctacccactttgtttctgttgga

SEQ ID NO: 247303 - DNA, 25 bp, Mus musculus
atctacccatctacttgggacttgg

SEQ ID NO: 247304 - DNA, 25 bp, Mus musculus
atctacccatcttcttgggacttgg

SEQ ID NO: 247305 - DNA, 25 bp, Mus musculus
atctacccctggaggcagagagagg

SEQ ID NO: 247306 - DNA, 25 bp, Mus musculus
atctacccctggtggcagagagagg

SEQ ID NO: 247307 - DNA, 25 bp, Mus musculus
atctacccgtgcaccagcaaggagt

SEQ ID NO: 247308 - DNA, 25 bp, Mus musculus
atctacccgtgctccagcaaggagt

SEQ ID NO: 247309 - DNA, 25 bp, Mus musculus
atctaccctcatacgtgagtgggta

SEQ ID NO: 247310 - DNA, 25 bp, Mus musculus
atctaccctcattcgtgagtgggta

SEQ ID NO: 247311 - DNA, 25 bp, Mus musculus
atctaccctgacacttatttgcttg

SEQ ID NO: 247312 - DNA, 25 bp, Mus musculus
atctaccctgactcttatttgcttg

SEQ ID NO: 247313 - DNA, 25 bp, Mus musculus
atctaccctgagacagatggctact

SEQ ID NO: 247314 - DNA, 25 bp, Mus musculus
atctaccctgagtcagatggctact

SEQ ID NO: 247315 - DNA, 25 bp, Mus musculus
atctacccttagagtttgccatcaa

SEQ ID NO: 247316 - DNA, 25 bp, Mus musculus
atctacccttagtgtttgccatcaa

SEQ ID NO: 247317 - DNA, 25 bp, Mus musculus
atctaccgactgagtcacgacaagg

SEQ ID NO: 247318 - DNA, 25 bp, Mus musculus
atctaccgactgtgtcacgacaagg

SEQ ID NO: 247319 - DNA, 25 bp, Mus musculus
atctaccgcgatatatttacctctc

SEQ ID NO: 247320 - DNA, 25 bp, Mus musculus
atctaccgcgatttatttacctctc

SEQ ID NO: 247321 - DNA, 25 bp, Mus musculus
atctacctcagaagtggctgtgctc

SEQ ID NO: 247322 - DNA, 25 bp, Mus musculus
atctacctcagatgtggctgtgctc

SEQ ID NO: 247323 - DNA, 25 bp, Mus musculus
atctacctccatagagatgtccggc

SEQ ID NO: 247324 - DNA, 25 bp, Mus musculus
atctacctccattgagatgtccggc

SEQ ID NO: 247325 - DNA, 25 bp, Mus musculus
atctacctcgtgattgggaaagcag

SEQ ID NO: 247326 - DNA, 25 bp, Mus musculus
atctacctcgtgatttaaatggcta

SEQ ID NO: 247327 - DNA, 25 bp, Mus musculus
atctacctcgtgtttgggaaagcag

SEQ ID NO: 247328 - DNA, 25 bp, Mus musculus
atctacctcgtgttttaaatggcta

SEQ ID NO: 247329 - DNA, 25 bp, Mus musculus
atctacctctataacattttagaat

SEQ ID NO: 247330 - DNA, 25 bp, Mus musculus
atctacctctattacattttagaat

SEQ ID NO: 247331 - DNA, 25 bp, Mus musculus
atctacctctttcggaaactacaag

SEQ ID NO: 247332 - DNA, 25 bp, Mus musculus
atctacctctttgggaaactacaag

SEQ ID NO: 247333 - DNA, 25 bp, Mus musculus
atctacctgagtcggaattgcaaac

SEQ ID NO: 247334 - DNA, 25 bp, Mus musculus
atctacctgagtgggaattgcaaac

SEQ ID NO: 247335 - DNA, 25 bp, Mus musculus
atctacctggctcatctacctttga

SEQ ID NO: 247336 - DNA, 25 bp, Mus musculus
atctacctggctgatctacctttga

SEQ ID NO: 247337 - DNA, 25 bp, Mus musculus
atctacctggtacctgagactaact

SEQ ID NO: 247338 - DNA, 25 bp, Mus musculus
atctacctggtagctgagactaact

SEQ ID NO: 247339 - DNA, 25 bp, Mus musculus
atctacctggtcaatgtgtctagta

SEQ ID NO: 247340 - DNA, 25 bp, Mus musculus
atctacctggtctatgtgtctagta

SEQ ID NO: 247341 - DNA, 25 bp, Mus musculus
atctacctgtggagctggagccaga

SEQ ID NO: 247342 - DNA, 25 bp, Mus musculus
atctacctgtggtgctggagccaga

SEQ ID NO: 247343 - DNA, 25 bp, Mus musculus
atctaccttaaaactggaccacacc

SEQ ID NO: 247344 - DNA, 25 bp, Mus musculus
atctaccttaaatctggaccacacc

SEQ ID NO: 247345 - DNA, 25 bp, Mus musculus
atctaccttgacatccccaaaatga

SEQ ID NO: 247346 - DNA, 25 bp, Mus musculus
atctaccttgacttccccaaaatga

SEQ ID NO: 247347 - DNA, 25 bp, Mus musculus
atctaccttgatacacctttattgg

SEQ ID NO: 247348 - DNA, 25 bp, Mus musculus
atctaccttgattcacctttattgg

SEQ ID NO: 247349 - DNA, 25 bp, Mus musculus
atctacgaatctcctcaaatctttg

SEQ ID NO: 247350 - DNA, 25 bp, Mus musculus
atctacgaatctgctcaaatctttg

SEQ ID NO: 247351 - DNA, 25 bp, Mus musculus
atctacgagacgcagggcttcagcc

SEQ ID NO: 247352 - DNA, 25 bp, Mus musculus
atctacgagacggagggcttcagcc

SEQ ID NO: 247353 - DNA, 25 bp, Mus musculus
atctacgctgttcgtgctgcggcag

SEQ ID NO: 247354 - DNA, 25 bp, Mus musculus
atctacgctgttggtgctgcggcag

SEQ ID NO: 247355 - DNA, 25 bp, Mus musculus
atctacggaagcaactgctgctctc

SEQ ID NO: 247356 - DNA, 25 bp, Mus musculus
atctacggaagctactgctgctctc

SEQ ID NO: 247357 - DNA, 25 bp, Mus musculus
atctacgggttgacttctaacttct

SEQ ID NO: 247358 - DNA, 25 bp, Mus musculus
atctacgggttgtcttctaacttct

SEQ ID NO: 247359 - DNA, 25 bp, Mus musculus
atctacggtcgcctaagccacacgg

SEQ ID NO: 247360 - DNA, 25 bp, Mus musculus
atctacggtcgcgtaagccacacgg

SEQ ID NO: 247361 - DNA, 25 bp, Mus musculus
atctacgtacctccatgatattttt

SEQ ID NO: 247362 - DNA, 25 bp, Mus musculus
atctacgtacctgcatgatattttt

SEQ ID NO: 247363 - DNA, 25 bp, Mus musculus
atctacgtcgtactcccaagggatg

SEQ ID NO: 247364 - DNA, 25 bp, Mus musculus
atctacgtcgtagtcccaagggatg

SEQ ID NO: 247365 - DNA, 25 bp, Mus musculus
atctacgtctgaaaccacagctcta

SEQ ID NO: 247366 - DNA, 25 bp, Mus musculus
atctacgtctgataccacagctcta

SEQ ID NO: 247367 - DNA, 25 bp, Mus musculus
atctacgtggccctgctgcgagtca

SEQ ID NO: 247368 - DNA, 25 bp, Mus musculus
atctacgtggccgtgctgcgagtca

SEQ ID NO: 247369 - DNA, 25 bp, Mus musculus
atctacgtggtcctggcccagagta

SEQ ID NO: 247370 - DNA, 25 bp, Mus musculus
atctacgtggtcgtggcccagagta

SEQ ID NO: 247371 - DNA, 25 bp, Mus musculus
atctactacaggcatcactaccgta

SEQ ID NO: 247372 - DNA, 25 bp, Mus musculus
atctactacagggatcactaccgta

SEQ ID NO: 247373 - DNA, 25 bp, Mus musculus
atctactcacaaagccaaacccggg

SEQ ID NO: 247374 - DNA, 25 bp, Mus musculus
atctactcacaatgccaaacccggg

SEQ ID NO: 247375 - DNA, 25 bp, Mus musculus
atctactcagacatgcgttgcaacc

SEQ ID NO: 247376 - DNA, 25 bp, Mus musculus
atctactcagacttgcgttgcaacc

SEQ ID NO: 247377 - DNA, 25 bp, Mus musculus
atctactcagagactaaggcaaggg

SEQ ID NO: 247378 - DNA, 25 bp, Mus musculus
atctactcagagtctaaggcaaggg

SEQ ID NO: 247379 - DNA, 25 bp, Mus musculus
atctactcaggtccagatgacttct

SEQ ID NO: 247380 - DNA, 25 bp, Mus musculus
atctactcaggtgcagatgacttct

SEQ ID NO: 247381 - DNA, 25 bp, Mus musculus
atctactcagtcacattcactttac

SEQ ID NO: 247382 - DNA, 25 bp, Mus musculus
atctactcagtctcattcactttac

SEQ ID NO: 247383 - DNA, 25 bp, Mus musculus
atctactcctataattttatcccaa

SEQ ID NO: 247384 - DNA, 25 bp, Mus musculus
atctactcctattattttatcccaa

SEQ ID NO: 247385 - DNA, 25 bp, Mus musculus
atctactcgctcatcaacgtcatct

SEQ ID NO: 247386 - DNA, 25 bp, Mus musculus
atctactcgctcttcaacgtcatct

SEQ ID NO: 247387 - DNA, 25 bp, Mus musculus
atctactcgggcatcctgtggaggc

SEQ ID NO: 247388 - DNA, 25 bp, Mus musculus
atctactcgggcttcctgtggaggc

SEQ ID NO: 247389 - DNA, 25 bp, Mus musculus
atctactctagaaacattcttgttg

SEQ ID NO: 247390 - DNA, 25 bp, Mus musculus
atctactctagatacattcttgttg

SEQ ID NO: 247391 - DNA, 25 bp, Mus musculus
atctactctattacctagcctgtga

SEQ ID NO: 247392 - DNA, 25 bp, Mus musculus
atctactctatttcctagcctgtga

SEQ ID NO: 247393 - DNA, 25 bp, Mus musculus
atctactctgccctggatgatgcgt

SEQ ID NO: 247394 - DNA, 25 bp, Mus musculus
atctactctgccgtggatgatgcgt

SEQ ID NO: 247395 - DNA, 25 bp, Mus musculus
atctactcttacctcagaccagaga

SEQ ID NO: 247396 - DNA, 25 bp, Mus musculus
atctactcttacgtcagaccagaga

SEQ ID NO: 247397 - DNA, 25 bp, Mus musculus
atctactcttagctgcagtcttgcc

SEQ ID NO: 247398 - DNA, 25 bp, Mus musculus
atctactcttaggtgcagtcttgcc

SEQ ID NO: 247399 - DNA, 25 bp, Mus musculus
atctactcttctaagggccttggcg

SEQ ID NO: 247400 - DNA, 25 bp, Mus musculus
atctactcttcttagggccttggcg

SEQ ID NO: 247401 - DNA, 25 bp, Mus musculus
atctactcttgacaaccgaaccata

SEQ ID NO: 247402 - DNA, 25 bp, Mus musculus
atctactcttgagaaccgaaccata

SEQ ID NO: 247403 - DNA, 25 bp, Mus musculus
atctactgcagactctctcagagac

SEQ ID NO: 247404 - DNA, 25 bp, Mus musculus
atctactgcagagtctctcagagac

SEQ ID NO: 247405 - DNA, 25 bp, Mus musculus
atctactgcccacaagtagctggca

SEQ ID NO: 247406 - DNA, 25 bp, Mus musculus
atctactgcccagaagtagctggca

SEQ ID NO: 247407 - DNA, 25 bp, Mus musculus
atctactgctctctgcagaagccta

SEQ ID NO: 247408 - DNA, 25 bp, Mus musculus
atctactgctctgtgcagaagccta

SEQ ID NO: 247409 - DNA, 25 bp, Mus musculus
atctactgctgcctcaatgacaggt

SEQ ID NO: 247410 - DNA, 25 bp, Mus musculus
atctactgctgcgtcaatgacaggt

SEQ ID NO: 247411 - DNA, 25 bp, Mus musculus
atctactgggcccacttcaaggaga

SEQ ID NO: 247412 - DNA, 25 bp, Mus musculus
atctactgggccgacttcaaggaga

SEQ ID NO: 247413 - DNA, 25 bp, Mus musculus
atctactggttaatatccatctggg

SEQ ID NO: 247414 - DNA, 25 bp, Mus musculus
atctactggttattatccatctggg

SEQ ID NO: 247415 - DNA, 25 bp, Mus musculus
atctactgtaaacggtgctacgcaa

SEQ ID NO: 247416 - DNA, 25 bp, Mus musculus
atctactgtaaagggtgctacgcaa

SEQ ID NO: 247417 - DNA, 25 bp, Mus musculus
atctactgtgaaaagcatgcccggg

SEQ ID NO: 247418 - DNA, 25 bp, Mus musculus
atctactgtgaatagcatgcccggg

SEQ ID NO: 247419 - DNA, 25 bp, Mus musculus
atctactgtggtatctgccaggaag

SEQ ID NO: 247420 - DNA, 25 bp, Mus musculus
atctactgtggtttctgccaggaag

SEQ ID NO: 247421 - DNA, 25 bp, Mus musculus
atctacttagcaagaagctctgttg

SEQ ID NO: 247422 - DNA, 25 bp, Mus musculus
atctacttagcatgaagctctgttg

SEQ ID NO: 247423 - DNA, 25 bp, Mus musculus
atctacttatcccatctcatttatt

SEQ ID NO: 247424 - DNA, 25 bp, Mus musculus
atctacttatccgatctcatttatt

SEQ ID NO: 247425 - DNA, 25 bp, Mus musculus
atctacttatctcgctatacctttg

SEQ ID NO: 247426 - DNA, 25 bp, Mus musculus
atctacttatctggctatacctttg

SEQ ID NO: 247427 - DNA, 25 bp, Mus musculus
atctacttatgtatgaaggaacctt

SEQ ID NO: 247428 - DNA, 25 bp, Mus musculus
atctacttatgtttgaaggaacctt

SEQ ID NO: 247429 - DNA, 25 bp, Mus musculus
atctacttcctactcgattctgaat

SEQ ID NO: 247430 - DNA, 25 bp, Mus musculus
atctacttcctagtcgattctgaat

SEQ ID NO: 247431 - DNA, 25 bp, Mus musculus
atctacttcggcacagcctacgtgg

SEQ ID NO: 247432 - DNA, 25 bp, Mus musculus
atctacttcggctcagcctacgtgg

SEQ ID NO: 247433 - DNA, 25 bp, Mus musculus
atctacttctgtatcggctcactca

SEQ ID NO: 247434 - DNA, 25 bp, Mus musculus
atctacttctgtttcggctcactca

SEQ ID NO: 247435 - DNA, 25 bp, Mus musculus
atctacttcttgacaacttttccca

SEQ ID NO: 247436 - DNA, 25 bp, Mus musculus
atctacttcttgtcaacttttccca

SEQ ID NO: 247437 - DNA, 25 bp, Mus musculus
atctactttcaacccagttctacct

SEQ ID NO: 247438 - DNA, 25 bp, Mus musculus
atctactttcaagccagttctacct

SEQ ID NO: 247439 - DNA, 25 bp, Mus musculus
atctactttctgcatgcgtctggca

SEQ ID NO: 247440 - DNA, 25 bp, Mus musculus
atctactttctggatgcgtctggca

SEQ ID NO: 247441 - DNA, 25 bp, Mus musculus
atctactttgctcactttcaagatt

SEQ ID NO: 247442 - DNA, 25 bp, Mus musculus
atctactttgctgactttcaagatt

SEQ ID NO: 247443 - DNA, 25 bp, Mus musculus
atctagaacgcgatacacactgtta

SEQ ID NO: 247444 - DNA, 25 bp, Mus musculus
atctagaacgcgttacacactgtta

SEQ ID NO: 247445 - DNA, 25 bp, Mus musculus
atctagaactcactagccacttgta

SEQ ID NO: 247446 - DNA, 25 bp, Mus musculus
atctagaactcagtagccacttgta

SEQ ID NO: 247447 - DNA, 25 bp, Mus musculus
atctagaagctaagttcctgcccta

SEQ ID NO: 247448 - DNA, 25 bp, Mus musculus
atctagaagctatgttcctgcccta

SEQ ID NO: 247449 - DNA, 25 bp, Mus musculus
atctagaagctgaggatcacccttc

SEQ ID NO: 247450 - DNA, 25 bp, Mus musculus
atctagaagctgtggatcacccttc

SEQ ID NO: 247451 - DNA, 25 bp, Mus musculus
atctagacagtgagattcttttcaa

SEQ ID NO: 247452 - DNA, 25 bp, Mus musculus
atctagacagtgtgattcttttcaa

SEQ ID NO: 247453 - DNA, 25 bp, Mus musculus
atctagacatacactgcttccttat

SEQ ID NO: 247454 - DNA, 25 bp, Mus musculus
atctagacatactctgcttccttat

SEQ ID NO: 247455 - DNA, 25 bp, Mus musculus
atctagactagacttgggtgacctg

SEQ ID NO: 247456 - DNA, 25 bp, Mus musculus
atctagactagagttgggtgacctg

SEQ ID NO: 247457 - DNA, 25 bp, Mus musculus
atctagacttgcatggcttgccaat

SEQ ID NO: 247458 - DNA, 25 bp, Mus musculus
atctagacttgcttggcttgccaat

SEQ ID NO: 247459 - DNA, 25 bp, Mus musculus
atctagagcggtccttgctaggcta

SEQ ID NO: 247460 - DNA, 25 bp, Mus musculus
atctagagcggtgcttgctaggcta

SEQ ID NO: 247461 - DNA, 25 bp, Mus musculus
atctagaggcggcagagtctcacct

SEQ ID NO: 247462 - DNA, 25 bp, Mus musculus
atctagaggcgggagagtctcacct

SEQ ID NO: 247463 - DNA, 25 bp, Mus musculus
atctagagttctcacactccctgat

SEQ ID NO: 247464 - DNA, 25 bp, Mus musculus
atctagagttctgacactccctgat

SEQ ID NO: 247465 - DNA, 25 bp, Mus musculus
atctagataggccttcagtactcac

SEQ ID NO: 247466 - DNA, 25 bp, Mus musculus
atctagataggcgttcagtactcac

SEQ ID NO: 247467 - DNA, 25 bp, Mus musculus
atctagatatacaccctttctgtct

SEQ ID NO: 247468 - DNA, 25 bp, Mus musculus
atctagatatactccctttctgtct

SEQ ID NO: 247469 - DNA, 25 bp, Mus musculus
atctagatgaggacactctgccagc

SEQ ID NO: 247470 - DNA, 25 bp, Mus musculus
atctagatgaggtcactctgccagc

SEQ ID NO: 247471 - DNA, 25 bp, Mus musculus
atctagatgcagaccccaagctgga

SEQ ID NO: 247472 - DNA, 25 bp, Mus musculus
atctagatgcagtccccaagctgga

SEQ ID NO: 247473 - DNA, 25 bp, Mus musculus
atctagatgctgacaggtgctccca

SEQ ID NO: 247474 - DNA, 25 bp, Mus musculus
atctagatgctgtcaggtgctccca

SEQ ID NO: 247475 - DNA, 25 bp, Mus musculus
atctagatgttaccatggccgtacc

SEQ ID NO: 247476 - DNA, 25 bp, Mus musculus
atctagatgttagcatggccgtacc

SEQ ID NO: 247477 - DNA, 25 bp, Mus musculus
atctagatgtttatactgaagaaca

SEQ ID NO: 247478 - DNA, 25 bp, Mus musculus
atctagatgtttttactgaagaaca

SEQ ID NO: 247479 - DNA, 25 bp, Mus musculus
atctagatttacatgcgcaagttat

SEQ ID NO: 247480 - DNA, 25 bp, Mus musculus
atctagatttacttgcgcaagttat

SEQ ID NO: 247481 - DNA, 25 bp, Mus musculus
atctagcaacgaatggcaccagtgg

SEQ ID NO: 247482 - DNA, 25 bp, Mus musculus
atctagcaacgattggcaccagtgg

SEQ ID NO: 247483 - DNA, 25 bp, Mus musculus
atctagcaacttaggcttggcttgt

SEQ ID NO: 247484 - DNA, 25 bp, Mus musculus
atctagcaactttggcttggcttgt

SEQ ID NO: 247485 - DNA, 25 bp, Mus musculus
atctagcaaggtctgactgcctctt

SEQ ID NO: 247486 - DNA, 25 bp, Mus musculus
atctagcaaggtgtgactgcctctt

SEQ ID NO: 247487 - DNA, 25 bp, Mus musculus
atctagcaagtacctggatagccag

SEQ ID NO: 247488 - DNA, 25 bp, Mus musculus
atctagcaagtagctggatagccag

SEQ ID NO: 247489 - DNA, 25 bp, Mus musculus
atctagcacatactttgctgaatat

SEQ ID NO: 247490 - DNA, 25 bp, Mus musculus
atctagcacatagtttgctgaatat

SEQ ID NO: 247491 - DNA, 25 bp, Mus musculus
atctagcacttccttccatagttat

SEQ ID NO: 247492 - DNA, 25 bp, Mus musculus
atctagcacttcgttccatagttat

SEQ ID NO: 247493 - DNA, 25 bp, Mus musculus
atctagcattagaagtcctgactgc

SEQ ID NO: 247494 - DNA, 25 bp, Mus musculus
atctagcattagtagtcctgactgc

SEQ ID NO: 247495 - DNA, 25 bp, Mus musculus
atctagccagtgatgaacagctaag

SEQ ID NO: 247496 - DNA, 25 bp, Mus musculus
atctagccagtgttgaacagctaag

SEQ ID NO: 247497 - DNA, 25 bp, Mus musculus
atctagccccagacatacagtgttg

SEQ ID NO: 247498 - DNA, 25 bp, Mus musculus
atctagccccagtcatacagtgttg

SEQ ID NO: 247499 - DNA, 25 bp, Mus musculus
atctagcctaagaaatagtgctgaa

SEQ ID NO: 247500 - DNA, 25 bp, Mus musculus
atctagcctaagtaatagtgctgaa

SEQ ID NO: 247501 - DNA, 25 bp, Mus musculus
atctagcctgctctgtgtttgacaa

SEQ ID NO: 247502 - DNA, 25 bp, Mus musculus
atctagcctgctgtgtgtttgacaa

SEQ ID NO: 247503 - DNA, 25 bp, Mus musculus
atctagccttccagtcattcttaat

SEQ ID NO: 247504 - DNA, 25 bp, Mus musculus
atctagccttcctgtcattcttaat

SEQ ID NO: 247505 - DNA, 25 bp, Mus musculus
atctagccttgaaaagtagaccagg

SEQ ID NO: 247506 - DNA, 25 bp, Mus musculus
atctagccttgataagtagaccagg

SEQ ID NO: 247507 - DNA, 25 bp, Mus musculus
atctagcgggtgatttcttcttgga

SEQ ID NO: 247508 - DNA, 25 bp, Mus musculus
atctagcgggtgttttcttcttgga

SEQ ID NO: 247509 - DNA, 25 bp, Mus musculus
atctagctcagcactactggaagga

SEQ ID NO: 247510 - DNA, 25 bp, Mus musculus
atctagctcagctctactggaagga

SEQ ID NO: 247511 - DNA, 25 bp, Mus musculus
atctagctcatactctgagtcggtt

SEQ ID NO: 247512 - DNA, 25 bp, Mus musculus
atctagctcatagtctgagtcggtt

SEQ ID NO: 247513 - DNA, 25 bp, Mus musculus
atctagctgaccagtgtttacaatg

SEQ ID NO: 247514 - DNA, 25 bp, Mus musculus
atctagctgacctgtgtttacaatg

SEQ ID NO: 247515 - DNA, 25 bp, Mus musculus
atctagctgctaacattgaacgtct

SEQ ID NO: 247516 - DNA, 25 bp, Mus musculus
atctagctgctatcattgaacgtct

SEQ ID NO: 247517 - DNA, 25 bp, Mus musculus
atctagctggctattgggatatgct

SEQ ID NO: 247518 - DNA, 25 bp, Mus musculus
atctagctggcttttgggatatgct

SEQ ID NO: 247519 - DNA, 25 bp, Mus musculus
atctagcttcgtcctcagacacgtc

SEQ ID NO: 247520 - DNA, 25 bp, Mus musculus
atctagcttcgtgctcagacacgtc

SEQ ID NO: 247521 - DNA, 25 bp, Mus musculus
atctaggaaaacacacaggtctgtg

SEQ ID NO: 247522 - DNA, 25 bp, Mus musculus
atctaggaaaactcacaggtctgtg

SEQ ID NO: 247523 - DNA, 25 bp, Mus musculus
atctaggaatcaatggatgtctcaa

SEQ ID NO: 247524 - DNA, 25 bp, Mus musculus
atctaggaatcattggatgtctcaa

SEQ ID NO: 247525 - DNA, 25 bp, Mus musculus
atctaggaatgcctttcttctctcg

SEQ ID NO: 247526 - DNA, 25 bp, Mus musculus
atctaggaatgcgtttcttctctcg

SEQ ID NO: 247527 - DNA, 25 bp, Mus musculus
atctaggacccacccatgaaagaac

SEQ ID NO: 247528 - DNA, 25 bp, Mus musculus
atctaggacccagccatgaaagaac

SEQ ID NO: 247529 - DNA, 25 bp, Mus musculus
atctaggagcccagtcgggagccag

SEQ ID NO: 247530 - DNA, 25 bp, Mus musculus
atctaggagccctgtcgggagccag

SEQ ID NO: 247531 - DNA, 25 bp, Mus musculus
atctaggatagaaggctctgctggc

SEQ ID NO: 247532 - DNA, 25 bp, Mus musculus
atctaggatagatggctctgctggc

SEQ ID NO: 247533 - DNA, 25 bp, Mus musculus
atctaggatgcccagcgacttgttg

SEQ ID NO: 247534 - DNA, 25 bp, Mus musculus
atctaggatgccgagcgacttgttg

SEQ ID NO: 247535 - DNA, 25 bp, Mus musculus
atctaggattctacctccatatttc

SEQ ID NO: 247536 - DNA, 25 bp, Mus musculus
atctaggattcttcctccatatttc

SEQ ID NO: 247537 - DNA, 25 bp, Mus musculus
atctaggcacttccattgttgtgac

SEQ ID NO: 247538 - DNA, 25 bp, Mus musculus
atctaggcacttgcattgttgtgac

SEQ ID NO: 247539 - DNA, 25 bp, Mus musculus
atctaggcagtcagggtttcgagca

SEQ ID NO: 247540 - DNA, 25 bp, Mus musculus
atctaggcagtccagtttcttgtct

SEQ ID NO: 247541 - DNA, 25 bp, Mus musculus
atctaggcagtcgagtttcttgtct

SEQ ID NO: 247542 - DNA, 25 bp, Mus musculus
atctaggcagtctgggtttcgagca

SEQ ID NO: 247543 - DNA, 25 bp, Mus musculus
atctaggcatttcagtgcaggcctc

SEQ ID NO: 247544 - DNA, 25 bp, Mus musculus
atctaggcatttgagtgcaggcctc

SEQ ID NO: 247545 - DNA, 25 bp, Mus musculus
atctaggccacccaaaggcaacagg

SEQ ID NO: 247546 - DNA, 25 bp, Mus musculus
atctaggccaccgaaaggcaacagg

SEQ ID NO: 247547 - DNA, 25 bp, Mus musculus
atctaggccagcagcctccctaaag

SEQ ID NO: 247548 - DNA, 25 bp, Mus musculus
atctaggccagctgcctccctaaag

SEQ ID NO: 247549 - DNA, 25 bp, Mus musculus
atctaggccttgaggcttgacagaa

SEQ ID NO: 247550 - DNA, 25 bp, Mus musculus
atctaggccttgtggcttgacagaa

SEQ ID NO: 247551 - DNA, 25 bp, Mus musculus
atctaggcgggcacggctttaatgc

SEQ ID NO: 247552 - DNA, 25 bp, Mus musculus
atctaggcgggctcggctttaatgc

SEQ ID NO: 247553 - DNA, 25 bp, Mus musculus
atctagggacctacatttcattatt

SEQ ID NO: 247554 - DNA, 25 bp, Mus musculus
atctagggaccttcatttcattatt

SEQ ID NO: 247555 - DNA, 25 bp, Mus musculus
atctagggccaaatggaggaccacc

SEQ ID NO: 247556 - DNA, 25 bp, Mus musculus
atctagggccaattggaggaccacc

SEQ ID NO: 247557 - DNA, 25 bp, Mus musculus
atctagggctggactctaaggagct

SEQ ID NO: 247558 - DNA, 25 bp, Mus musculus
atctagggctggtctctaaggagct

SEQ ID NO: 247559 - DNA, 25 bp, Mus musculus
atctagggctgtaatcctttttcct

SEQ ID NO: 247560 - DNA, 25 bp, Mus musculus
atctagggctgttatcctttttcct

SEQ ID NO: 247561 - DNA, 25 bp, Mus musculus
atctagggcttgcaaggacttatct

SEQ ID NO: 247562 - DNA, 25 bp, Mus musculus
atctagggcttggaaggacttatct

SEQ ID NO: 247563 - DNA, 25 bp, Mus musculus
atctagggtttcaactttggctgga

SEQ ID NO: 247564 - DNA, 25 bp, Mus musculus
atctagggtttctactttggctgga

SEQ ID NO: 247565 - DNA, 25 bp, Mus musculus
atctaggtagtgacattttcacact

SEQ ID NO: 247566 - DNA, 25 bp, Mus musculus
atctaggtagtgtcattttcacact

SEQ ID NO: 247567 - DNA, 25 bp, Mus musculus
atctaggtcccacccatgagagaaa

SEQ ID NO: 247568 - DNA, 25 bp, Mus musculus
atctaggtcccagccatgagagaaa

SEQ ID NO: 247569 - DNA, 25 bp, Mus musculus
atctaggtcctactaactgctgcac

SEQ ID NO: 247570 - DNA, 25 bp, Mus musculus
atctaggtcctagtaactgctgcac

SEQ ID NO: 247571 - DNA, 25 bp, Mus musculus
atctaggttaacaaccctctcgagt

SEQ ID NO: 247572 - DNA, 25 bp, Mus musculus
atctaggttaactaccctctcgagt

SEQ ID NO: 247573 - DNA, 25 bp, Mus musculus
atctaggttattacatggtcaatca

SEQ ID NO: 247574 - DNA, 25 bp, Mus musculus
atctaggttatttcatggtcaatca

SEQ ID NO: 247575 - DNA, 25 bp, Mus musculus
atctaggttcatacacaagggcatt

SEQ ID NO: 247576 - DNA, 25 bp, Mus musculus
atctaggttcattcacaagggcatt

SEQ ID NO: 247577 - DNA, 25 bp, Mus musculus
atctagtagcagagtggcggaaaca

SEQ ID NO: 247578 - DNA, 25 bp, Mus musculus
atctagtagcagtgtggcggaaaca

SEQ ID NO: 247579 - DNA, 25 bp, Mus musculus
atctagtagtagaatccgtgtgtta

SEQ ID NO: 247580 - DNA, 25 bp, Mus musculus
atctagtagtagtatccgtgtgtta

SEQ ID NO: 247581 - DNA, 25 bp, Mus musculus
atctagtatgtccaatcccaacact

SEQ ID NO: 247582 - DNA, 25 bp, Mus musculus
atctagtatgtcgaatcccaacact

SEQ ID NO: 247583 - DNA, 25 bp, Mus musculus
atctagtattcacggcggaccagag

SEQ ID NO: 247584 - DNA, 25 bp, Mus musculus
atctagtattcagggcggaccagag

SEQ ID NO: 247585 - DNA, 25 bp, Mus musculus
atctagtcaactcactcctgccaag

SEQ ID NO: 247586 - DNA, 25 bp, Mus musculus
atctagtcaactgactcctgccaag

SEQ ID NO: 247587 - DNA, 25 bp, Mus musculus
atctagtcactcaaactttgattca

SEQ ID NO: 247588 - DNA, 25 bp, Mus musculus
atctagtcactctaactttgattca

SEQ ID NO: 247589 - DNA, 25 bp, Mus musculus
atctagtccttgagttctctcatat

SEQ ID NO: 247590 - DNA, 25 bp, Mus musculus
atctagtccttgtgttctctcatat

SEQ ID NO: 247591 - DNA, 25 bp, Mus musculus
atctagtctctgaattcctacctcc

SEQ ID NO: 247592 - DNA, 25 bp, Mus musculus
atctagtctctgtattcctacctcc

SEQ ID NO: 247593 - DNA, 25 bp, Mus musculus
atctagtctgacatcattgtcaacc

SEQ ID NO: 247594 - DNA, 25 bp, Mus musculus
atctagtctgacttcattgtcaacc

SEQ ID NO: 247595 - DNA, 25 bp, Mus musculus
atctagtcttttccttcttgctgtt

SEQ ID NO: 247596 - DNA, 25 bp, Mus musculus
atctagtcttttgcttcttgctgtt

SEQ ID NO: 247597 - DNA, 25 bp, Mus musculus
atctagtgcggaacttacgcggcga

SEQ ID NO: 247598 - DNA, 25 bp, Mus musculus
atctagtgcggatcttacgcggcga

SEQ ID NO: 247599 - DNA, 25 bp, Mus musculus
atctagtgtctcctggtccaaggga

SEQ ID NO: 247600 - DNA, 25 bp, Mus musculus
atctagtgtctcgtggtccaaggga

SEQ ID NO: 247601 - DNA, 25 bp, Mus musculus
atctagttagccacccagtatatta

SEQ ID NO: 247602 - DNA, 25 bp, Mus musculus
atctagttagcctcccagtatatta

SEQ ID NO: 247603 - DNA, 25 bp, Mus musculus
atctagttggatcgacactcacaat

SEQ ID NO: 247604 - DNA, 25 bp, Mus musculus
atctagttggatggacactcacaat

SEQ ID NO: 247605 - DNA, 25 bp, Mus musculus
atctagttgggtcggaccttgacct

SEQ ID NO: 247606 - DNA, 25 bp, Mus musculus
atctagttgggtgggaccttgacct

SEQ ID NO: 247607 - DNA, 25 bp, Mus musculus
atctagttgtttctgtgtctcaaat

SEQ ID NO: 247608 - DNA, 25 bp, Mus musculus
atctagttgtttgtgtgtctcaaat

SEQ ID NO: 247609 - DNA, 25 bp, Mus musculus
atctagtttagaagcttttactgca

SEQ ID NO: 247610 - DNA, 25 bp, Mus musculus
atctagtttagatgcttttactgca

SEQ ID NO: 247611 - DNA, 25 bp, Mus musculus
atctagtttctacccaattcctatg

SEQ ID NO: 247612 - DNA, 25 bp, Mus musculus
atctagtttctagccaattcctatg

SEQ ID NO: 247613 - DNA, 25 bp, Mus musculus
atctataaaatgacctcttctgcca

SEQ ID NO: 247614 - DNA, 25 bp, Mus musculus
atctataaaatgtcctcttctgcca

SEQ ID NO: 247615 - DNA, 25 bp, Mus musculus
atctataatcttcccatcgaattta

SEQ ID NO: 247616 - DNA, 25 bp, Mus musculus
atctataatcttgccatcgaattta

SEQ ID NO: 247617 - DNA, 25 bp, Mus musculus
atctatacaggaaccaaccaggaga

SEQ ID NO: 247618 - DNA, 25 bp, Mus musculus
atctatacaggatccaaccaggaga

SEQ ID NO: 247619 - DNA, 25 bp, Mus musculus
atctatacccatcttgtgctagcct

SEQ ID NO: 247620 - DNA, 25 bp, Mus musculus
atctatacccatgttgtgctagcct

SEQ ID NO: 247621 - DNA, 25 bp, Mus musculus
atctatactggtcaggctctggcag

SEQ ID NO: 247622 - DNA, 25 bp, Mus musculus
atctatactggtgaggctctggcag

SEQ ID NO: 247623 - DNA, 25 bp, Mus musculus
atctatagctgtaagtcatgttctt

SEQ ID NO: 247624 - DNA, 25 bp, Mus musculus
atctatagctgttagtcatgttctt

SEQ ID NO: 247625 - DNA, 25 bp, Mus musculus
atctatatagcaagttcaggtccct

SEQ ID NO: 247626 - DNA, 25 bp, Mus musculus
atctatatagcatgttcaggtccct

SEQ ID NO: 247627 - DNA, 25 bp, Mus musculus
atctatatatggacagtgctgtgca

SEQ ID NO: 247628 - DNA, 25 bp, Mus musculus
atctatatatggtcagtgctgtgca

SEQ ID NO: 247629 - DNA, 25 bp, Mus musculus
atctatatattgaagctgcttcagc

SEQ ID NO: 247630 - DNA, 25 bp, Mus musculus
atctatatattgtagctgcttcagc

SEQ ID NO: 247631 - DNA, 25 bp, Mus musculus
atctatatcatcacagcattcttgg

SEQ ID NO: 247632 - DNA, 25 bp, Mus musculus
atctatatcatctcagcattcttgg

SEQ ID NO: 247633 - DNA, 25 bp, Mus musculus
atctatatcgatctgcccgtgccgg

SEQ ID NO: 247634 - DNA, 25 bp, Mus musculus
atctatatcgatgtgcccgtgccgg

SEQ ID NO: 247635 - DNA, 25 bp, Mus musculus
atctatatctctcgagtcatccctg

SEQ ID NO: 247636 - DNA, 25 bp, Mus musculus
atctatatctctggagtcatccctg

SEQ ID NO: 247637 - DNA, 25 bp, Mus musculus
atctatatctttcggctgtatgttt

SEQ ID NO: 247638 - DNA, 25 bp, Mus musculus
atctatatctttgggctgtatgttt

SEQ ID NO: 247639 - DNA, 25 bp, Mus musculus
atctatatgataagcagccgctgtc

SEQ ID NO: 247640 - DNA, 25 bp, Mus musculus
atctatatgatatgcagccgctgtc

SEQ ID NO: 247641 - DNA, 25 bp, Mus musculus
atctatattctgaaaatggtctgac

SEQ ID NO: 247642 - DNA, 25 bp, Mus musculus
atctatattctgtaaatggtctgac

SEQ ID NO: 247643 - DNA, 25 bp, Mus musculus
atctatattgccatacctgcactta

SEQ ID NO: 247644 - DNA, 25 bp, Mus musculus
atctatattgccttacctgcactta

SEQ ID NO: 247645 - DNA, 25 bp, Mus musculus
atctatattttaatgggccttgtgt

SEQ ID NO: 247646 - DNA, 25 bp, Mus musculus
atctatattttattgggccttgtgt

SEQ ID NO: 247647 - DNA, 25 bp, Mus musculus
atctatcaaagcatgctgctgctct

SEQ ID NO: 247648 - DNA, 25 bp, Mus musculus
atctatcaaagcttgctgctgctct

SEQ ID NO: 247649 - DNA, 25 bp, Mus musculus
atctatcaactgctgactggtctct

SEQ ID NO: 247650 - DNA, 25 bp, Mus musculus
atctatcaactggtgactggtctct

SEQ ID NO: 247651 - DNA, 25 bp, Mus musculus
atctatcaatctcaacagccttggg

SEQ ID NO: 247652 - DNA, 25 bp, Mus musculus
atctatcaatctgaacagccttggg

SEQ ID NO: 247653 - DNA, 25 bp, Mus musculus
atctatcacctgacaccataattgg

SEQ ID NO: 247654 - DNA, 25 bp, Mus musculus
atctatcacctgtcaccataattgg

SEQ ID NO: 247655 - DNA, 25 bp, Mus musculus
atctatcatgtactgggtctatttt

SEQ ID NO: 247656 - DNA, 25 bp, Mus musculus
atctatcatgtagtgggtctatttt

SEQ ID NO: 247657 - DNA, 25 bp, Mus musculus
atctatccacagactgtctctcttt

SEQ ID NO: 247658 - DNA, 25 bp, Mus musculus
atctatccacagtctgtctctcttt

SEQ ID NO: 247659 - DNA, 25 bp, Mus musculus
atctatccatatacacttagcaatg

SEQ ID NO: 247660 - DNA, 25 bp, Mus musculus
atctatccatattcacttagcaatg

SEQ ID NO: 247661 - DNA, 25 bp, Mus musculus
atctatccattactttcctcgttgc

SEQ ID NO: 247662 - DNA, 25 bp, Mus musculus
atctatccattagtttcctcgttgc

SEQ ID NO: 247663 - DNA, 25 bp, Mus musculus
atctatccctgaatcacagtccata

SEQ ID NO: 247664 - DNA, 25 bp, Mus musculus
atctatccctgattcacagtccata

SEQ ID NO: 247665 - DNA, 25 bp, Mus musculus
atctatccgactcatgctttgaaga

SEQ ID NO: 247666 - DNA, 25 bp, Mus musculus
atctatccgactgatgctttgaaga

SEQ ID NO: 247667 - DNA, 25 bp, Mus musculus
atctatcctgatacattcactggtg

SEQ ID NO: 247668 - DNA, 25 bp, Mus musculus
atctatcctgatcgcagagtctgca

SEQ ID NO: 247669 - DNA, 25 bp, Mus musculus
atctatcctgatggcagagtctgca

SEQ ID NO: 247670 - DNA, 25 bp, Mus musculus
atctatcctgattcattcactggtg

SEQ ID NO: 247671 - DNA, 25 bp, Mus musculus
atctatccttttatcctgagtccaa

SEQ ID NO: 247672 - DNA, 25 bp, Mus musculus
atctatccttttttcctgagtccaa

SEQ ID NO: 247673 - DNA, 25 bp, Mus musculus
atctatcgaaagacccaaccagtac

SEQ ID NO: 247674 - DNA, 25 bp, Mus musculus
atctatcgaaagtcccaaccagtac

SEQ ID NO: 247675 - DNA, 25 bp, Mus musculus
atctatcgttccacctgagcagcaa

SEQ ID NO: 247676 - DNA, 25 bp, Mus musculus
atctatcgttcctcctgagcagcaa

SEQ ID NO: 247677 - DNA, 25 bp, Mus musculus
atctatctagtcagccaattctggg

SEQ ID NO: 247678 - DNA, 25 bp, Mus musculus
atctatctagtctgccaattctggg

SEQ ID NO: 247679 - DNA, 25 bp, Mus musculus
atctatctatacatgctggcttaag

SEQ ID NO: 247680 - DNA, 25 bp, Mus musculus
atctatctatacttgctggcttaag

SEQ ID NO: 247681 - DNA, 25 bp, Mus musculus
atctatctatcaaagcttgctgctg

SEQ ID NO: 247682 - DNA, 25 bp, Mus musculus
atctatctatcacctttgctgcatg

SEQ ID NO: 247683 - DNA, 25 bp, Mus musculus
atctatctatcagctttgctgcatg

SEQ ID NO: 247684 - DNA, 25 bp, Mus musculus
atctatctatcatagcttgctgctg

SEQ ID NO: 247685 - DNA, 25 bp, Mus musculus
atctatctattaagtgctttaagta

SEQ ID NO: 247686 - DNA, 25 bp, Mus musculus
atctatctattatgtgctttaagta

SEQ ID NO: 247687 - DNA, 25 bp, Mus musculus
atctatctcctcaaacagttgtact

SEQ ID NO: 247688 - DNA, 25 bp, Mus musculus
atctatctcctctaacagttgtact

SEQ ID NO: 247689 - DNA, 25 bp, Mus musculus
atctatctctaaaggcacctcactg

SEQ ID NO: 247690 - DNA, 25 bp, Mus musculus
atctatctctaatggcacctcactg

SEQ ID NO: 247691 - DNA, 25 bp, Mus musculus
atctatctgactatccaaggccttg

SEQ ID NO: 247692 - DNA, 25 bp, Mus musculus
atctatctgactttccaaggccttg

SEQ ID NO: 247693 - DNA, 25 bp, Mus musculus
atctatcttattacagtacttcggc

SEQ ID NO: 247694 - DNA, 25 bp, Mus musculus
atctatcttatttcagtacttcggc

SEQ ID NO: 247695 - DNA, 25 bp, Mus musculus
atctatcttcttaatccatcctcag

SEQ ID NO: 247696 - DNA, 25 bp, Mus musculus
atctatcttcttataaccacttacg

SEQ ID NO: 247697 - DNA, 25 bp, Mus musculus
atctatcttctttatccatcctcag

SEQ ID NO: 247698 - DNA, 25 bp, Mus musculus
atctatcttcttttaaccacttacg

SEQ ID NO: 247699 - DNA, 25 bp, Mus musculus
atctatgaaatgcaactgcacatgc

SEQ ID NO: 247700 - DNA, 25 bp, Mus musculus
atctatgaaatggaactgcacatgc

SEQ ID NO: 247701 - DNA, 25 bp, Mus musculus
atctatgaacctcatgtgacatccc

SEQ ID NO: 247702 - DNA, 25 bp, Mus musculus
atctatgaacctgatgtgacatccc

SEQ ID NO: 247703 - DNA, 25 bp, Mus musculus
atctatgaaggtcttggatccccaa

SEQ ID NO: 247704 - DNA, 25 bp, Mus musculus
atctatgaaggtgttggatccccaa

SEQ ID NO: 247705 - DNA, 25 bp, Mus musculus
atctatgagcctatgggtaccattc

SEQ ID NO: 247706 - DNA, 25 bp, Mus musculus
atctatgagcctttgggtaccattc

SEQ ID NO: 247707 - DNA, 25 bp, Mus musculus
atctatgatcctcaactggaccttt

SEQ ID NO: 247708 - DNA, 25 bp, Mus musculus
atctatgatcctgaactggaccttt

SEQ ID NO: 247709 - DNA, 25 bp, Mus musculus
atctatgatcttcgtgtggctcctc

SEQ ID NO: 247710 - DNA, 25 bp, Mus musculus
atctatgatcttggtgtggctcctc

SEQ ID NO: 247711 - DNA, 25 bp, Mus musculus
atctatgcactcctctttaaatcag

SEQ ID NO: 247712 - DNA, 25 bp, Mus musculus
atctatgcactcgtctttaaatcag

SEQ ID NO: 247713 - DNA, 25 bp, Mus musculus
atctatgcatttatgccaagccata

SEQ ID NO: 247714 - DNA, 25 bp, Mus musculus
atctatgcatttttgccaagccata

SEQ ID NO: 247715 - DNA, 25 bp, Mus musculus
atctatgccatccacaccgaggaga

SEQ ID NO: 247716 - DNA, 25 bp, Mus musculus
atctatgccatccacttccaagatg

SEQ ID NO: 247717 - DNA, 25 bp, Mus musculus
atctatgccatcgacaccgaggaga

SEQ ID NO: 247718 - DNA, 25 bp, Mus musculus
atctatgccatcgacttccaagatg

SEQ ID NO: 247719 - DNA, 25 bp, Mus musculus
atctatgcccaacgagtgttgagta

SEQ ID NO: 247720 - DNA, 25 bp, Mus musculus
atctatgcccaaggagtgttgagta

SEQ ID NO: 247721 - DNA, 25 bp, Mus musculus
atctatgccggaacatgtcttgaca

SEQ ID NO: 247722 - DNA, 25 bp, Mus musculus
atctatgccggatcatgtcttgaca

SEQ ID NO: 247723 - DNA, 25 bp, Mus musculus
atctatgcctccaaaccctggaggg

SEQ ID NO: 247724 - DNA, 25 bp, Mus musculus
atctatgcctcctaaccctggaggg

SEQ ID NO: 247725 - DNA, 25 bp, Mus musculus
atctatgcggttccaatcaaggccc

SEQ ID NO: 247726 - DNA, 25 bp, Mus musculus
atctatgcggttgcaatcaaggccc

SEQ ID NO: 247727 - DNA, 25 bp, Mus musculus
atctatgctacgctggagggatcct

SEQ ID NO: 247728 - DNA, 25 bp, Mus musculus
atctatgctacggtggagggatcct

SEQ ID NO: 247729 - DNA, 25 bp, Mus musculus
atctatgctatactccaacagtcta

SEQ ID NO: 247730 - DNA, 25 bp, Mus musculus
atctatgctatagtccaacagtcta

SEQ ID NO: 247731 - DNA, 25 bp, Mus musculus
atctatgctctgatacaagtgcctt

SEQ ID NO: 247732 - DNA, 25 bp, Mus musculus
atctatgctctgttacaagtgcctt

SEQ ID NO: 247733 - DNA, 25 bp, Mus musculus
atctatgctgagctggaagggccat

SEQ ID NO: 247734 - DNA, 25 bp, Mus musculus
atctatgctgaggtggaagggccat

SEQ ID NO: 247735 - DNA, 25 bp, Mus musculus
atctatgctgggcagttatctccta

SEQ ID NO: 247736 - DNA, 25 bp, Mus musculus
atctatgctggggagttatctccta

SEQ ID NO: 247737 - DNA, 25 bp, Mus musculus
atctatgcttctctttgcgtcacca

SEQ ID NO: 247738 - DNA, 25 bp, Mus musculus
atctatgcttctgtttgcgtcacca

SEQ ID NO: 247739 - DNA, 25 bp, Mus musculus
atctatgcttgtaaatcgaattgaa

SEQ ID NO: 247740 - DNA, 25 bp, Mus musculus
atctatgcttgtcaaattgtgagtt

SEQ ID NO: 247741 - DNA, 25 bp, Mus musculus
atctatgcttgtgaaattgtgagtt

SEQ ID NO: 247742 - DNA, 25 bp, Mus musculus
atctatgcttgttaatcgaattgaa

SEQ ID NO: 247743 - DNA, 25 bp, Mus musculus
atctatggactgcatctgaggccct

SEQ ID NO: 247744 - DNA, 25 bp, Mus musculus
atctatggactggatctgaggccct

SEQ ID NO: 247745 - DNA, 25 bp, Mus musculus
atctatggattgatccaggcagaca

SEQ ID NO: 247746 - DNA, 25 bp, Mus musculus
atctatggattgttccaggcagaca

SEQ ID NO: 247747 - DNA, 25 bp, Mus musculus
atctatggctctctgttactgtttc

SEQ ID NO: 247748 - DNA, 25 bp, Mus musculus
atctatggctctgtgttactgtttc

SEQ ID NO: 247749 - DNA, 25 bp, Mus musculus
atctatgggacaaggcgacactgcc

SEQ ID NO: 247750 - DNA, 25 bp, Mus musculus
atctatgggacatggcgacactgcc

SEQ ID NO: 247751 - DNA, 25 bp, Mus musculus
atctatgggtatctgcttccagcta

SEQ ID NO: 247752 - DNA, 25 bp, Mus musculus
atctatgggtatgtgcttccagcta

SEQ ID NO: 247753 - DNA, 25 bp, Mus musculus
atctatgggtgcacttgtctcagac

SEQ ID NO: 247754 - DNA, 25 bp, Mus musculus
atctatgggtgctcttgtctcagac

SEQ ID NO: 247755 - DNA, 25 bp, Mus musculus
atctatggtctcctgaaacttgcta

SEQ ID NO: 247756 - DNA, 25 bp, Mus musculus
atctatggtctcgtgaaacttgcta

SEQ ID NO: 247757 - DNA, 25 bp, Mus musculus
atctatggtttcatcccaggagcag

SEQ ID NO: 247758 - DNA, 25 bp, Mus musculus
atctatggtttcttcccaggagcag

SEQ ID NO: 247759 - DNA, 25 bp, Mus musculus
atctatgtagatacttgatttccaa

SEQ ID NO: 247760 - DNA, 25 bp, Mus musculus
atctatgtagattcttgatttccaa

SEQ ID NO: 247761 - DNA, 25 bp, Mus musculus
atctatgtatctctctatgtttcta

SEQ ID NO: 247762 - DNA, 25 bp, Mus musculus
atctatgtatctgtctatgtttcta

SEQ ID NO: 247763 - DNA, 25 bp, Mus musculus
atctatgtccttagggattggcaca

SEQ ID NO: 247764 - DNA, 25 bp, Mus musculus
atctatgtcctttgggattggcaca

SEQ ID NO: 247765 - DNA, 25 bp, Mus musculus
atctatgtctggcatcttcttgaga

SEQ ID NO: 247766 - DNA, 25 bp, Mus musculus
atctatgtctgggatcttcttgaga

SEQ ID NO: 247767 - DNA, 25 bp, Mus musculus
atctatgtgcataattggctattta

SEQ ID NO: 247768 - DNA, 25 bp, Mus musculus
atctatgtgcattattggctattta

SEQ ID NO: 247769 - DNA, 25 bp, Mus musculus
atctatgtggcaccttatcaccctc

SEQ ID NO: 247770 - DNA, 25 bp, Mus musculus
atctatgtggcagcttatcaccctc

SEQ ID NO: 247771 - DNA, 25 bp, Mus musculus
atctatgtgggtaaccagccactcc

SEQ ID NO: 247772 - DNA, 25 bp, Mus musculus
atctatgtgggttaccagccactcc

SEQ ID NO: 247773 - DNA, 25 bp, Mus musculus
atctatgtggtgctgcggaccgcca

SEQ ID NO: 247774 - DNA, 25 bp, Mus musculus
atctatgtggtggtgcggaccgcca

SEQ ID NO: 247775 - DNA, 25 bp, Mus musculus
atctatgtgtaccatcctcttgtaa

SEQ ID NO: 247776 - DNA, 25 bp, Mus musculus
atctatgtgtacgatcctcttgtaa

SEQ ID NO: 247777 - DNA, 25 bp, Mus musculus
atctatgtgtgaatgtatcctgctg

SEQ ID NO: 247778 - DNA, 25 bp, Mus musculus
atctatgtgtgattgtatcctgctg

SEQ ID NO: 247779 - DNA, 25 bp, Mus musculus
atctatgttcctacttaggtcatgc

SEQ ID NO: 247780 - DNA, 25 bp, Mus musculus
atctatgttccttcttaggtcatgc

SEQ ID NO: 247781 - DNA, 25 bp, Mus musculus
atctatgtttataatatttggatac

SEQ ID NO: 247782 - DNA, 25 bp, Mus musculus
atctatgtttattatatttggatac

SEQ ID NO: 247783 - DNA, 25 bp, Mus musculus
atctatgtttggattctttcgttat

SEQ ID NO: 247784 - DNA, 25 bp, Mus musculus
atctatgtttggtttctttcgttat

SEQ ID NO: 247785 - DNA, 25 bp, Mus musculus
atctatgtttgtccccggcttgtga

SEQ ID NO: 247786 - DNA, 25 bp, Mus musculus
atctatgtttgtgcccggcttgtga

SEQ ID NO: 247787 - DNA, 25 bp, Mus musculus
atctattaaaggatcatccctgggt

SEQ ID NO: 247788 - DNA, 25 bp, Mus musculus
atctattaaaggttcatccctgggt

SEQ ID NO: 247789 - DNA, 25 bp, Mus musculus
atctattacatcacaggctctgcaa

SEQ ID NO: 247790 - DNA, 25 bp, Mus musculus
atctattacatctcaggctctgcaa

SEQ ID NO: 247791 - DNA, 25 bp, Mus musculus
atctattatcctctgtagggctgga

SEQ ID NO: 247792 - DNA, 25 bp, Mus musculus
atctattatcctgtgtagggctgga

SEQ ID NO: 247793 - DNA, 25 bp, Mus musculus
atctattcatacaggtctcagctca

SEQ ID NO: 247794 - DNA, 25 bp, Mus musculus
atctattcatactggtctcagctca

SEQ ID NO: 247795 - DNA, 25 bp, Mus musculus
atctattcccgaagactctgaactc

SEQ ID NO: 247796 - DNA, 25 bp, Mus musculus
atctattcccgatgactctgaactc

SEQ ID NO: 247797 - DNA, 25 bp, Mus musculus
atctattcggccacacgctgtcaaa

SEQ ID NO: 247798 - DNA, 25 bp, Mus musculus
atctattcggcctcacgctgtcaaa

SEQ ID NO: 247799 - DNA, 25 bp, Mus musculus
atctattcgtgaatctttgacaaat

SEQ ID NO: 247800 - DNA, 25 bp, Mus musculus
atctattcgtgattctttgacaaat

SEQ ID NO: 247801 - DNA, 25 bp, Mus musculus
atctattgatacacccgtggttcag

SEQ ID NO: 247802 - DNA, 25 bp, Mus musculus
atctattgatactcccgtggttcag

SEQ ID NO: 247803 - DNA, 25 bp, Mus musculus
atctattgcactctgtgatgtctac

SEQ ID NO: 247804 - DNA, 25 bp, Mus musculus
atctattgcactgtgtgatgtctac

SEQ ID NO: 247805 - DNA, 25 bp, Mus musculus
atctatttagttactttgagcctca

SEQ ID NO: 247806 - DNA, 25 bp, Mus musculus
atctatttagtttctttgagcctca

SEQ ID NO: 247807 - DNA, 25 bp, Mus musculus
atctatttatagagtatgtgctgct

SEQ ID NO: 247808 - DNA, 25 bp, Mus musculus
atctatttatagtgtatgtgctgct

SEQ ID NO: 247809 - DNA, 25 bp, Mus musculus
atctatttatataaactgtactttt

SEQ ID NO: 247810 - DNA, 25 bp, Mus musculus
atctatttatattaactgtactttt

SEQ ID NO: 247811 - DNA, 25 bp, Mus musculus
atctatttattgatactgttgttta

SEQ ID NO: 247812 - DNA, 25 bp, Mus musculus
atctatttattgttactgttgttta

SEQ ID NO: 247813 - DNA, 25 bp, Mus musculus
atctatttcagtcctgtagctgtta

SEQ ID NO: 247814 - DNA, 25 bp, Mus musculus
atctatttcagtgctgtagctgtta

SEQ ID NO: 247815 - DNA, 25 bp, Mus musculus
atctatttcattccagcctacttgg

SEQ ID NO: 247816 - DNA, 25 bp, Mus musculus
atctatttcattgcagcctacttgg

SEQ ID NO: 247817 - DNA, 25 bp, Mus musculus
atctatttccaaacgtgtgtcttcg

SEQ ID NO: 247818 - DNA, 25 bp, Mus musculus
atctatttccaatcgtgtgtcttcg

SEQ ID NO: 247819 - DNA, 25 bp, Mus musculus
atctatttccttctgataccttggt

SEQ ID NO: 247820 - DNA, 25 bp, Mus musculus
atctatttccttgtgataccttggt

SEQ ID NO: 247821 - DNA, 25 bp, Mus musculus
atctatttctatccactacttgtac

SEQ ID NO: 247822 - DNA, 25 bp, Mus musculus
atctatttctatgcactacttgtac

SEQ ID NO: 247823 - DNA, 25 bp, Mus musculus
atctatttctgtctggatgcacacc

SEQ ID NO: 247824 - DNA, 25 bp, Mus musculus
atctatttctgtgtggatgcacacc

SEQ ID NO: 247825 - DNA, 25 bp, Mus musculus
atctatttgagacatcctttcccta

SEQ ID NO: 247826 - DNA, 25 bp, Mus musculus
atctatttgagagatcctttcccta

SEQ ID NO: 247827 - DNA, 25 bp, Mus musculus
atctatttgctacgtgttatggcac

SEQ ID NO: 247828 - DNA, 25 bp, Mus musculus
atctatttgctaggtgttatggcac

SEQ ID NO: 247829 - DNA, 25 bp, Mus musculus
atctattttatactctctctgctac

SEQ ID NO: 247830 - DNA, 25 bp, Mus musculus
atctattttatagtctctctgctac

SEQ ID NO: 247831 - DNA, 25 bp, Mus musculus
atctattttctcacttctattttaa

SEQ ID NO: 247832 - DNA, 25 bp, Mus musculus
atctattttctctcttctattttaa

SEQ ID NO: 247833 - DNA, 25 bp, Mus musculus
atctattttctgagaattatcctga

SEQ ID NO: 247834 - DNA, 25 bp, Mus musculus
atctattttctgcagtttactacac

SEQ ID NO: 247835 - DNA, 25 bp, Mus musculus
atctattttctggagtttactacac

SEQ ID NO: 247836 - DNA, 25 bp, Mus musculus
atctattttctgtgaattatcctga

SEQ ID NO: 247837 - DNA, 25 bp, Mus musculus
atctcaaaacacaagggcagcaaac

SEQ ID NO: 247838 - DNA, 25 bp, Mus musculus
atctcaaaacactagggcagcaaac

SEQ ID NO: 247839 - DNA, 25 bp, Mus musculus
atctcaaaagctatctgtggacaaa

SEQ ID NO: 247840 - DNA, 25 bp, Mus musculus
atctcaaaagctttctgtggacaaa

SEQ ID NO: 247841 - DNA, 25 bp, Mus musculus
atctcaaaattcctaggttccttct

SEQ ID NO: 247842 - DNA, 25 bp, Mus musculus
atctcaaaattcgtaggttccttct

SEQ ID NO: 247843 - DNA, 25 bp, Mus musculus
atctcaaacattacttccttccctt

SEQ ID NO: 247844 - DNA, 25 bp, Mus musculus
atctcaaacatttcttccttccctt

SEQ ID NO: 247845 - DNA, 25 bp, Mus musculus
atctcaaacttgagagctcactcct

SEQ ID NO: 247846 - DNA, 25 bp, Mus musculus
atctcaaacttgtgagctcactcct

SEQ ID NO: 247847 - DNA, 25 bp, Mus musculus
atctcaaagcctctctcagtgaaaa

SEQ ID NO: 247848 - DNA, 25 bp, Mus musculus
atctcaaagcctgtctcagtgaaaa

SEQ ID NO: 247849 - DNA, 25 bp, Mus musculus
atctcaaaggccctggtagcttatt

SEQ ID NO: 247850 - DNA, 25 bp, Mus musculus
atctcaaaggccgtggtagcttatt

SEQ ID NO: 247851 - DNA, 25 bp, Mus musculus
atctcaaagggtcggttgttgcgac

SEQ ID NO: 247852 - DNA, 25 bp, Mus musculus
atctcaaagggtgggttgttgcgac

SEQ ID NO: 247853 - DNA, 25 bp, Mus musculus
atctcaacagatatgctattgcctt

SEQ ID NO: 247854 - DNA, 25 bp, Mus musculus
atctcaacagatttgctattgcctt

SEQ ID NO: 247855 - DNA, 25 bp, Mus musculus
atctcaaccctgaatgaaggatcca

SEQ ID NO: 247856 - DNA, 25 bp, Mus musculus
atctcaaccctgcttaggcagagac

SEQ ID NO: 247857 - DNA, 25 bp, Mus musculus
atctcaaccctggttaggcagagac

SEQ ID NO: 247858 - DNA, 25 bp, Mus musculus
atctcaaccctgtatgaaggatcca

SEQ ID NO: 247859 - DNA, 25 bp, Mus musculus
atctcaacctcaacaattactacaa

SEQ ID NO: 247860 - DNA, 25 bp, Mus musculus
atctcaacctcatcaattactacaa

SEQ ID NO: 247861 - DNA, 25 bp, Mus musculus
atctcaacttgccaaccaggatgtc

SEQ ID NO: 247862 - DNA, 25 bp, Mus musculus
atctcaacttgcgaaccaggatgtc

SEQ ID NO: 247863 - DNA, 25 bp, Mus musculus
atctcaagactccaagcattctgaa

SEQ ID NO: 247864 - DNA, 25 bp, Mus musculus
atctcaagactcgaagcattctgaa

SEQ ID NO: 247865 - DNA, 25 bp, Mus musculus
atctcaagagagaggtggaagtctt

SEQ ID NO: 247866 - DNA, 25 bp, Mus musculus
atctcaagagagtggtggaagtctt

SEQ ID NO: 247867 - DNA, 25 bp, Mus musculus
atctcaagatcaaggccttgccctt

SEQ ID NO: 247868 - DNA, 25 bp, Mus musculus
atctcaagatcatggccttgccctt

SEQ ID NO: 247869 - DNA, 25 bp, Mus musculus
atctcaaggccgacagtggtgttca

SEQ ID NO: 247870 - DNA, 25 bp, Mus musculus
atctcaaggccgtcagtggtgttca

SEQ ID NO: 247871 - DNA, 25 bp, Mus musculus
atctcaagggccatgataggacaca

SEQ ID NO: 247872 - DNA, 25 bp, Mus musculus
atctcaagggccttgataggacaca

SEQ ID NO: 247873 - DNA, 25 bp, Mus musculus
atctcaagtgagacggttggccgcc

SEQ ID NO: 247874 - DNA, 25 bp, Mus musculus
atctcaagtgagtcggttggccgcc

SEQ ID NO: 247875 - DNA, 25 bp, Mus musculus
atctcaagttaccaccagagctctt

SEQ ID NO: 247876 - DNA, 25 bp, Mus musculus
atctcaagttacgaccagagctctt

SEQ ID NO: 247877 - DNA, 25 bp, Mus musculus
atctcaataatgactccagggccag

SEQ ID NO: 247878 - DNA, 25 bp, Mus musculus
atctcaataatgtctccagggccag

SEQ ID NO: 247879 - DNA, 25 bp, Mus musculus
atctcaatcagaatgtcaaaaggtt

SEQ ID NO: 247880 - DNA, 25 bp, Mus musculus
atctcaatcagattgtcaaaaggtt

SEQ ID NO: 247881 - DNA, 25 bp, Mus musculus
atctcaatggtacgaaggtggcagc

SEQ ID NO: 247882 - DNA, 25 bp, Mus musculus
atctcaatggtaggaaggtggcagc

SEQ ID NO: 247883 - DNA, 25 bp, Mus musculus
atctcaattagaaatcacggtttct

SEQ ID NO: 247884 - DNA, 25 bp, Mus musculus
atctcaattagatatcacggtttct

SEQ ID NO: 247885 - DNA, 25 bp, Mus musculus
atctcaatttccctggtaacgtgtg

SEQ ID NO: 247886 - DNA, 25 bp, Mus musculus
atctcaatttccgtggtaacgtgtg

SEQ ID NO: 247887 - DNA, 25 bp, Mus musculus
atctcacaatcccatgacatgctgg

SEQ ID NO: 247888 - DNA, 25 bp, Mus musculus
atctcacaatccgatgacatgctgg

SEQ ID NO: 247889 - DNA, 25 bp, Mus musculus
atctcacacattcttgctgccttta

SEQ ID NO: 247890 - DNA, 25 bp, Mus musculus
atctcacacattgttgctgccttta

SEQ ID NO: 247891 - DNA, 25 bp, Mus musculus
atctcacactctcaactcaaggtgg

SEQ ID NO: 247892 - DNA, 25 bp, Mus musculus
atctcacactctgaactcaaggtgg

SEQ ID NO: 247893 - DNA, 25 bp, Mus musculus
atctcacagacaacgaaattgttcg

SEQ ID NO: 247894 - DNA, 25 bp, Mus musculus
atctcacagacatcgaaattgttcg

SEQ ID NO: 247895 - DNA, 25 bp, Mus musculus
atctcacagagcaacgtatggtttt

SEQ ID NO: 247896 - DNA, 25 bp, Mus musculus
atctcacagagctacgtatggtttt

SEQ ID NO: 247897 - DNA, 25 bp, Mus musculus
atctcacataacctgaccgccttca

SEQ ID NO: 247898 - DNA, 25 bp, Mus musculus
atctcacataacgtgaccgccttca

SEQ ID NO: 247899 - DNA, 25 bp, Mus musculus
atctcacatataagggtcgatctga

SEQ ID NO: 247900 - DNA, 25 bp, Mus musculus
atctcacatatatgggtcgatctga

SEQ ID NO: 247901 - DNA, 25 bp, Mus musculus
atctcacatgccatacattgctgta

SEQ ID NO: 247902 - DNA, 25 bp, Mus musculus
atctcacatgccttacattgctgta

SEQ ID NO: 247903 - DNA, 25 bp, Mus musculus
atctcacatgctcagtctccagaaa

SEQ ID NO: 247904 - DNA, 25 bp, Mus musculus
atctcacatgctgagtctccagaaa

SEQ ID NO: 247905 - DNA, 25 bp, Mus musculus
atctcaccagagacacatagaccaa

SEQ ID NO: 247906 - DNA, 25 bp, Mus musculus
atctcaccagagtcacatagaccaa

SEQ ID NO: 247907 - DNA, 25 bp, Mus musculus
atctcaccagctctgaactcaataa

SEQ ID NO: 247908 - DNA, 25 bp, Mus musculus
atctcaccagctgtgaactcaataa

SEQ ID NO: 247909 - DNA, 25 bp, Mus musculus
atctcaccagtgcatcttaaaccag

SEQ ID NO: 247910 - DNA, 25 bp, Mus musculus
atctcaccagtggatcttaaaccag

SEQ ID NO: 247911 - DNA, 25 bp, Mus musculus
atctcacccaccatatttggacagg

SEQ ID NO: 247912 - DNA, 25 bp, Mus musculus
atctcacccaccttatttggacagg

SEQ ID NO: 247913 - DNA, 25 bp, Mus musculus
atctcacccagaagacggcttctga

SEQ ID NO: 247914 - DNA, 25 bp, Mus musculus
atctcacccagatgacggcttctga

SEQ ID NO: 247915 - DNA, 25 bp, Mus musculus
atctcacccctccataggagagctg

SEQ ID NO: 247916 - DNA, 25 bp, Mus musculus
atctcacccctcgataggagagctg

SEQ ID NO: 247917 - DNA, 25 bp, Mus musculus
atctcaccgagaaagggatcctgca

SEQ ID NO: 247918 - DNA, 25 bp, Mus musculus
atctcaccgagatagggatcctgca

SEQ ID NO: 247919 - DNA, 25 bp, Mus musculus
atctcaccgttcctttggatacagg

SEQ ID NO: 247920 - DNA, 25 bp, Mus musculus
atctcaccgttcgtttggatacagg

SEQ ID NO: 247921 - DNA, 25 bp, Mus musculus
atctcacctcataggttttcaccat

SEQ ID NO: 247922 - DNA, 25 bp, Mus musculus
atctcacctcattggttttcaccat

SEQ ID NO: 247923 - DNA, 25 bp, Mus musculus
atctcacctccaacctataagtatc

SEQ ID NO: 247924 - DNA, 25 bp, Mus musculus
atctcacctccatcctataagtatc

SEQ ID NO: 247925 - DNA, 25 bp, Mus musculus
atctcaccttttaccaatcttttca

SEQ ID NO: 247926 - DNA, 25 bp, Mus musculus
atctcacctttttccaatcttttca

SEQ ID NO: 247927 - DNA, 25 bp, Mus musculus
atctcacgatgacctatgaatcact

SEQ ID NO: 247928 - DNA, 25 bp, Mus musculus
atctcacgatgagctatgaatcact

SEQ ID NO: 247929 - DNA, 25 bp, Mus musculus
atctcacgctctaaatgctgactga

SEQ ID NO: 247930 - DNA, 25 bp, Mus musculus
atctcacgctcttaatgctgactga

SEQ ID NO: 247931 - DNA, 25 bp, Mus musculus
atctcacgctgaagggcactgtagg

SEQ ID NO: 247932 - DNA, 25 bp, Mus musculus
atctcacgctgatgggcactgtagg

SEQ ID NO: 247933 - DNA, 25 bp, Mus musculus
atctcacgcttaacttcctgatgtt

SEQ ID NO: 247934 - DNA, 25 bp, Mus musculus
atctcacgcttatcttcctgatgtt

SEQ ID NO: 247935 - DNA, 25 bp, Mus musculus
atctcacggagcacccaggactcct

SEQ ID NO: 247936 - DNA, 25 bp, Mus musculus
atctcacggagctcccaggactcct

SEQ ID NO: 247937 - DNA, 25 bp, Mus musculus
atctcacggcttaggacttctatat

SEQ ID NO: 247938 - DNA, 25 bp, Mus musculus
atctcacggctttggacttctatat

SEQ ID NO: 247939 - DNA, 25 bp, Mus musculus
atctcacgtcacaaggcacggcaag

SEQ ID NO: 247940 - DNA, 25 bp, Mus musculus
atctcacgtcactaggcacggcaag

SEQ ID NO: 247941 - DNA, 25 bp, Mus musculus
atctcacgtgtaacatattctaaaa

SEQ ID NO: 247942 - DNA, 25 bp, Mus musculus
atctcacgtgtatcatattctaaaa

SEQ ID NO: 247943 - DNA, 25 bp, Mus musculus
atctcactatgcagcactgactggc

SEQ ID NO: 247944 - DNA, 25 bp, Mus musculus
atctcactatgctgcactgactggc

SEQ ID NO: 247945 - DNA, 25 bp, Mus musculus
atctcactctgtcactggtgtggac

SEQ ID NO: 247946 - DNA, 25 bp, Mus musculus
atctcactctgtgactggtgtggac

SEQ ID NO: 247947 - DNA, 25 bp, Mus musculus
atctcactgaatcaggctgcttctg

SEQ ID NO: 247948 - DNA, 25 bp, Mus musculus
atctcactgaatgaggctgcttctg

SEQ ID NO: 247949 - DNA, 25 bp, Mus musculus
atctcactgactccgaggaagagaa

SEQ ID NO: 247950 - DNA, 25 bp, Mus musculus
atctcactgactgcgaggaagagaa

SEQ ID NO: 247951 - DNA, 25 bp, Mus musculus
atctcactgatgctagactgcagcc

SEQ ID NO: 247952 - DNA, 25 bp, Mus musculus
atctcactgatggtagactgcagcc

SEQ ID NO: 247953 - DNA, 25 bp, Mus musculus
atctcactgcccaggtgtcaagatg

SEQ ID NO: 247954 - DNA, 25 bp, Mus musculus
atctcactgccctggtgtcaagatg

SEQ ID NO: 247955 - DNA, 25 bp, Mus musculus
atctcactgcctctttgtaattttt

SEQ ID NO: 247956 - DNA, 25 bp, Mus musculus
atctcactgcctgtttgtaattttt

SEQ ID NO: 247957 - DNA, 25 bp, Mus musculus
atctcactgctgaattccagatgct

SEQ ID NO: 247958 - DNA, 25 bp, Mus musculus
atctcactgctgtattccagatgct

SEQ ID NO: 247959 - DNA, 25 bp, Mus musculus
atctcactgcttatgtccagatggc

SEQ ID NO: 247960 - DNA, 25 bp, Mus musculus
atctcactgcttttgtccagatggc

SEQ ID NO: 247961 - DNA, 25 bp, Mus musculus
atctcactggccaaaaagacacatt

SEQ ID NO: 247962 - DNA, 25 bp, Mus musculus
atctcactggcctaaaagacacatt

SEQ ID NO: 247963 - DNA, 25 bp, Mus musculus
atctcactgggactatttgctggaa

SEQ ID NO: 247964 - DNA, 25 bp, Mus musculus
atctcactgggagtatttgctggaa

SEQ ID NO: 247965 - DNA, 25 bp, Mus musculus
atctcactgtgtccgtggccaggag

SEQ ID NO: 247966 - DNA, 25 bp, Mus musculus
atctcactgtgtgcgtggccaggag

SEQ ID NO: 247967 - DNA, 25 bp, Mus musculus
atctcacttactcacccagtgtgac

SEQ ID NO: 247968 - DNA, 25 bp, Mus musculus
atctcacttactgacccagtgtgac

SEQ ID NO: 247969 - DNA, 25 bp, Mus musculus
atctcacttcgaccgaaaggcttcg

SEQ ID NO: 247970 - DNA, 25 bp, Mus musculus
atctcacttcgagcgaaaggcttcg

SEQ ID NO: 247971 - DNA, 25 bp, Mus musculus
atctcactttctcggctcaaactga

SEQ ID NO: 247972 - DNA, 25 bp, Mus musculus
atctcactttctgggctcaaactga

SEQ ID NO: 247973 - DNA, 25 bp, Mus musculus
atctcagaaccaccttgggacagtt

SEQ ID NO: 247974 - DNA, 25 bp, Mus musculus
atctcagaaccagcttgggacagtt

SEQ ID NO: 247975 - DNA, 25 bp, Mus musculus
atctcagaagctccacgaactctag

SEQ ID NO: 247976 - DNA, 25 bp, Mus musculus
atctcagaagctgcacgaactctag

SEQ ID NO: 247977 - DNA, 25 bp, Mus musculus
atctcagaagtcctagatgctagga

SEQ ID NO: 247978 - DNA, 25 bp, Mus musculus
atctcagaagtcgtagatgctagga

SEQ ID NO: 247979 - DNA, 25 bp, Mus musculus
atctcagacagacggtaggttacta

SEQ ID NO: 247980 - DNA, 25 bp, Mus musculus
atctcagacagagggtaggttacta

SEQ ID NO: 247981 - DNA, 25 bp, Mus musculus
atctcagaccaacaagtaaaccatg

SEQ ID NO: 247982 - DNA, 25 bp, Mus musculus
atctcagaccaagaagtaaaccatg

SEQ ID NO: 247983 - DNA, 25 bp, Mus musculus
atctcagactccagcttaggatggg

SEQ ID NO: 247984 - DNA, 25 bp, Mus musculus
atctcagactcctgcttaggatggg

SEQ ID NO: 247985 - DNA, 25 bp, Mus musculus
atctcagacttaagggccctcttat

SEQ ID NO: 247986 - DNA, 25 bp, Mus musculus
atctcagacttatgggccctcttat

SEQ ID NO: 247987 - DNA, 25 bp, Mus musculus
atctcagagactatatatgctaata

SEQ ID NO: 247988 - DNA, 25 bp, Mus musculus
atctcagagactttatatgctaata

SEQ ID NO: 247989 - DNA, 25 bp, Mus musculus
atctcagagcacaagtccgtggcaa

SEQ ID NO: 247990 - DNA, 25 bp, Mus musculus
atctcagagcactagtccgtggcaa

SEQ ID NO: 247991 - DNA, 25 bp, Mus musculus
atctcagagctcacgtggtgctgac

SEQ ID NO: 247992 - DNA, 25 bp, Mus musculus
atctcagagctctcgtggtgctgac

SEQ ID NO: 247993 - DNA, 25 bp, Mus musculus
atctcagaggagctgaccacgacca

SEQ ID NO: 247994 - DNA, 25 bp, Mus musculus
atctcagaggaggtgaccacgacca

SEQ ID NO: 247995 - DNA, 25 bp, Mus musculus
atctcagaggctcgtctggcgtgac

SEQ ID NO: 247996 - DNA, 25 bp, Mus musculus
atctcagaggctggtctggcgtgac

SEQ ID NO: 247997 - DNA, 25 bp, Mus musculus
atctcagaggttatacacctaccag

SEQ ID NO: 247998 - DNA, 25 bp, Mus musculus
atctcagaggttttacacctaccag

SEQ ID NO: 247999 - DNA, 25 bp, Mus musculus
atctcagagtccctagctatttccc

SEQ ID NO: 248000 - DNA, 25 bp, Mus musculus
atctcagagtccgtagctatttccc

SEQ ID NO: 248001 - DNA, 25 bp, Mus musculus
atctcagagttgctcaagctcttga

SEQ ID NO: 248002 - DNA, 25 bp, Mus musculus
atctcagagttggtcaagctcttga

SEQ ID NO: 248003 - DNA, 25 bp, Mus musculus
atctcagatagtagtttccaccatt

SEQ ID NO: 248004 - DNA, 25 bp, Mus musculus
atctcagatagttgtttccaccatt

SEQ ID NO: 248005 - DNA, 25 bp, Mus musculus
atctcagatctcagcttcctcaata

SEQ ID NO: 248006 - DNA, 25 bp, Mus musculus
atctcagatctctgcttcctcaata

SEQ ID NO: 248007 - DNA, 25 bp, Mus musculus
atctcagatgataacggaaggacgc

SEQ ID NO: 248008 - DNA, 25 bp, Mus musculus
atctcagatgattacggaaggacgc

SEQ ID NO: 248009 - DNA, 25 bp, Mus musculus
atctcagatgttctacccacgttta

SEQ ID NO: 248010 - DNA, 25 bp, Mus musculus
atctcagatgttgtacccacgttta

SEQ ID NO: 248011 - DNA, 25 bp, Mus musculus
atctcagatttactgtccccatgtg

SEQ ID NO: 248012 - DNA, 25 bp, Mus musculus
atctcagatttagtgtccccatgtg

SEQ ID NO: 248013 - DNA, 25 bp, Mus musculus
atctcagcacccatacagaaggcag

SEQ ID NO: 248014 - DNA, 25 bp, Mus musculus
atctcagcacccttacagaaggcag

SEQ ID NO: 248015 - DNA, 25 bp, Mus musculus
atctcagcactgaggccatgcccgt

SEQ ID NO: 248016 - DNA, 25 bp, Mus musculus
atctcagcactgtggccatgcccgt

SEQ ID NO: 248017 - DNA, 25 bp, Mus musculus
atctcagcagatcaagtccttcctt

SEQ ID NO: 248018 - DNA, 25 bp, Mus musculus
atctcagcagatgaagtccttcctt

SEQ ID NO: 248019 - DNA, 25 bp, Mus musculus
atctcagcagccagaaccgatactt

SEQ ID NO: 248020 - DNA, 25 bp, Mus musculus
atctcagcagccctcaaagatattt

SEQ ID NO: 248021 - DNA, 25 bp, Mus musculus
atctcagcagccgtcaaagatattt

SEQ ID NO: 248022 - DNA, 25 bp, Mus musculus
atctcagcagcctgaaccgatactt

SEQ ID NO: 248023 - DNA, 25 bp, Mus musculus
atctcagcatctaatatccagtgta

SEQ ID NO: 248024 - DNA, 25 bp, Mus musculus
atctcagcatcttatatccagtgta

SEQ ID NO: 248025 - DNA, 25 bp, Mus musculus
atctcagcatgacctctgcatttga

SEQ ID NO: 248026 - DNA, 25 bp, Mus musculus
atctcagcatgagctctgcatttga

SEQ ID NO: 248027 - DNA, 25 bp, Mus musculus
atctcagccaaacccggttcagtca

SEQ ID NO: 248028 - DNA, 25 bp, Mus musculus
atctcagccaaagccggttcagtca

SEQ ID NO: 248029 - DNA, 25 bp, Mus musculus
atctcagcccgcctagtgatggttc

SEQ ID NO: 248030 - DNA, 25 bp, Mus musculus
atctcagcccgcgtagtgatggttc

SEQ ID NO: 248031 - DNA, 25 bp, Mus musculus
atctcagccgagcagaagcagccct

SEQ ID NO: 248032 - DNA, 25 bp, Mus musculus
atctcagccgaggagaagcagccct

SEQ ID NO: 248033 - DNA, 25 bp, Mus musculus
atctcagcctccctgtagtgtgcac

SEQ ID NO: 248034 - DNA, 25 bp, Mus musculus
atctcagcctccgtgtagtgtgcac

SEQ ID NO: 248035 - DNA, 25 bp, Mus musculus
atctcagcgtttcagaagccggatc

SEQ ID NO: 248036 - DNA, 25 bp, Mus musculus
atctcagcgtttgagaagccggatc

SEQ ID NO: 248037 - DNA, 25 bp, Mus musculus
atctcagctaacagaatctctcaag

SEQ ID NO: 248038 - DNA, 25 bp, Mus musculus
atctcagctaactgaatctctcaag

SEQ ID NO: 248039 - DNA, 25 bp, Mus musculus
atctcagctacacacgggaggtggt

SEQ ID NO: 248040 - DNA, 25 bp, Mus musculus
atctcagctacagacgggaggtggt

SEQ ID NO: 248041 - DNA, 25 bp, Mus musculus
atctcagctcttatggttgctgcta

SEQ ID NO: 248042 - DNA, 25 bp, Mus musculus
atctcagctcttttggttgctgcta

SEQ ID NO: 248043 - DNA, 25 bp, Mus musculus
atctcagctgcaacaaagccacagg

SEQ ID NO: 248044 - DNA, 25 bp, Mus musculus
atctcagctgcactctttcacgatc

SEQ ID NO: 248045 - DNA, 25 bp, Mus musculus
atctcagctgcagtctttcacgatc

SEQ ID NO: 248046 - DNA, 25 bp, Mus musculus
atctcagctgcatcaaagccacagg

SEQ ID NO: 248047 - DNA, 25 bp, Mus musculus
atctcagcttcacgtgaatctctgt

SEQ ID NO: 248048 - DNA, 25 bp, Mus musculus
atctcagcttcaggtgaatctctgt

SEQ ID NO: 248049 - DNA, 25 bp, Mus musculus
atctcagcttctaatgtgttagaat

SEQ ID NO: 248050 - DNA, 25 bp, Mus musculus
atctcagcttcttatgtgttagaat

SEQ ID NO: 248051 - DNA, 25 bp, Mus musculus
atctcagctttcacgcaagacaaca

SEQ ID NO: 248052 - DNA, 25 bp, Mus musculus
atctcagctttctcgcaagacaaca

SEQ ID NO: 248053 - DNA, 25 bp, Mus musculus
atctcagcttttcgtcatctgcaaa

SEQ ID NO: 248054 - DNA, 25 bp, Mus musculus
atctcagcttttggtcatctgcaaa

SEQ ID NO: 248055 - DNA, 25 bp, Mus musculus
atctcaggaggtcatggctgctctc

SEQ ID NO: 248056 - DNA, 25 bp, Mus musculus
atctcaggaggtgatggctgctctc

SEQ ID NO: 248057 - DNA, 25 bp, Mus musculus
atctcaggcaacacagtgaggaaat

SEQ ID NO: 248058 - DNA, 25 bp, Mus musculus
atctcaggcaactcagtgaggaaat

SEQ ID NO: 248059 - DNA, 25 bp, Mus musculus
atctcaggccaaaagggagtctcaa

SEQ ID NO: 248060 - DNA, 25 bp, Mus musculus
atctcaggccaatagggagtctcaa

SEQ ID NO: 248061 - DNA, 25 bp, Mus musculus
atctcaggctcacactcacaaacag

SEQ ID NO: 248062 - DNA, 25 bp, Mus musculus
atctcaggctcagactcacaaacag

SEQ ID NO: 248063 - DNA, 25 bp, Mus musculus
atctcaggctgcaaggctcagacag

SEQ ID NO: 248064 - DNA, 25 bp, Mus musculus
atctcaggctgctaggctcagacag

SEQ ID NO: 248065 - DNA, 25 bp, Mus musculus
atctcaggctggatcccaatttatg

SEQ ID NO: 248066 - DNA, 25 bp, Mus musculus
atctcaggctggttcccaatttatg

SEQ ID NO: 248067 - DNA, 25 bp, Mus musculus
atctcagggcaacttctacaaagaa

SEQ ID NO: 248068 - DNA, 25 bp, Mus musculus
atctcagggcaagttctacaaagaa

SEQ ID NO: 248069 - DNA, 25 bp, Mus musculus
atctcagggcctcgtgtgaaatgtc

SEQ ID NO: 248070 - DNA, 25 bp, Mus musculus
atctcagggcctggtgtgaaatgtc

SEQ ID NO: 248071 - DNA, 25 bp, Mus musculus
atctcaggtccaaatcatgtcgttg

SEQ ID NO: 248072 - DNA, 25 bp, Mus musculus
atctcaggtccatatcatgtcgttg

SEQ ID NO: 248073 - DNA, 25 bp, Mus musculus
atctcaggtgttactcatggataca

SEQ ID NO: 248074 - DNA, 25 bp, Mus musculus
atctcaggtgtttctcatggataca

SEQ ID NO: 248075 - DNA, 25 bp, Mus musculus
atctcaggttctacaccagcacggt

SEQ ID NO: 248076 - DNA, 25 bp, Mus musculus
atctcaggttcttcaccagcacggt

SEQ ID NO: 248077 - DNA, 25 bp, Mus musculus
atctcaggttttaagactggttgac

SEQ ID NO: 248078 - DNA, 25 bp, Mus musculus
atctcaggtttttagactggttgac

SEQ ID NO: 248079 - DNA, 25 bp, Mus musculus
atctcagtactgaggtttgaaagca

SEQ ID NO: 248080 - DNA, 25 bp, Mus musculus
atctcagtactgtggtttgaaagca

SEQ ID NO: 248081 - DNA, 25 bp, Mus musculus
atctcagtatagacccgagcctttc

SEQ ID NO: 248082 - DNA, 25 bp, Mus musculus
atctcagtatagtcccgagcctttc

SEQ ID NO: 248083 - DNA, 25 bp, Mus musculus
atctcagtatgtctttacctctgga

SEQ ID NO: 248084 - DNA, 25 bp, Mus musculus
atctcagtatgtgtttacctctgga

SEQ ID NO: 248085 - DNA, 25 bp, Mus musculus
atctcagtcactaccttttaaggca

SEQ ID NO: 248086 - DNA, 25 bp, Mus musculus
atctcagtcacttccttttaaggca

SEQ ID NO: 248087 - DNA, 25 bp, Mus musculus
atctcagtcatgacagccttgtcgg

SEQ ID NO: 248088 - DNA, 25 bp, Mus musculus
atctcagtcatgtcagccttgtcgg

SEQ ID NO: 248089 - DNA, 25 bp, Mus musculus
atctcagtctggagcatcatcgcta

SEQ ID NO: 248090 - DNA, 25 bp, Mus musculus
atctcagtctggtgcatcatcgcta

SEQ ID NO: 248091 - DNA, 25 bp, Mus musculus
atctcagtgaggctgtacgcttgcc

SEQ ID NO: 248092 - DNA, 25 bp, Mus musculus
atctcagtgagggtgtacgcttgcc

SEQ ID NO: 248093 - DNA, 25 bp, Mus musculus
atctcagtgatgatgtcatggtgat

SEQ ID NO: 248094 - DNA, 25 bp, Mus musculus
atctcagtgatgttgtcatggtgat

SEQ ID NO: 248095 - DNA, 25 bp, Mus musculus
atctcagtgccgcttcattcctttg

SEQ ID NO: 248096 - DNA, 25 bp, Mus musculus
atctcagtgccggttcattcctttg

SEQ ID NO: 248097 - DNA, 25 bp, Mus musculus
atctcagtgcctaaaacttttttgt

SEQ ID NO: 248098 - DNA, 25 bp, Mus musculus
atctcagtgccttaaacttttttgt

SEQ ID NO: 248099 - DNA, 25 bp, Mus musculus
atctcagtggccacagttttgttta

SEQ ID NO: 248100 - DNA, 25 bp, Mus musculus
atctcagtggcctcagttttgttta

SEQ ID NO: 248101 - DNA, 25 bp, Mus musculus
atctcagtggctactaatctaaagg

SEQ ID NO: 248102 - DNA, 25 bp, Mus musculus
atctcagtggcttctaatctaaagg

SEQ ID NO: 248103 - DNA, 25 bp, Mus musculus
atctcagtgtctctcccaagagagg

SEQ ID NO: 248104 - DNA, 25 bp, Mus musculus
atctcagtgtctgtcccaagagagg

SEQ ID NO: 248105 - DNA, 25 bp, Mus musculus
atctcagttctaacttctagcctag

SEQ ID NO: 248106 - DNA, 25 bp, Mus musculus
atctcagttctatcttctagcctag

SEQ ID NO: 248107 - DNA, 25 bp, Mus musculus
atctcagttctcatggcctcaaaac

SEQ ID NO: 248108 - DNA, 25 bp, Mus musculus
atctcagttctcttggcctcaaaac

SEQ ID NO: 248109 - DNA, 25 bp, Mus musculus
atctcagttgccaacaataggcttt

SEQ ID NO: 248110 - DNA, 25 bp, Mus musculus
atctcagttgcctacaataggcttt

SEQ ID NO: 248111 - DNA, 25 bp, Mus musculus
atctcagttgctcgcatgtcaaatt

SEQ ID NO: 248112 - DNA, 25 bp, Mus musculus
atctcagttgctggcatgtcaaatt

SEQ ID NO: 248113 - DNA, 25 bp, Mus musculus
atctcagtttgcaaaaagcactgac

SEQ ID NO: 248114 - DNA, 25 bp, Mus musculus
atctcagtttgctaaaagcactgac

SEQ ID NO: 248115 - DNA, 25 bp, Mus musculus
atctcagttttcaggtacatttcta

SEQ ID NO: 248116 - DNA, 25 bp, Mus musculus
atctcagttttctggtacatttcta

SEQ ID NO: 248117 - DNA, 25 bp, Mus musculus
atctcataaccaccagcttcttgta

SEQ ID NO: 248118 - DNA, 25 bp, Mus musculus
atctcataaccagcagcttcttgta

SEQ ID NO: 248119 - DNA, 25 bp, Mus musculus
atctcataatatctggccttctgtg

SEQ ID NO: 248120 - DNA, 25 bp, Mus musculus
atctcataatatgtggccttctgtg

SEQ ID NO: 248121 - DNA, 25 bp, Mus musculus
atctcataccatattctggctgtat

SEQ ID NO: 248122 - DNA, 25 bp, Mus musculus
atctcataccattttctggctgtat

SEQ ID NO: 248123 - DNA, 25 bp, Mus musculus
atctcatactggcacctgcatgtac

SEQ ID NO: 248124 - DNA, 25 bp, Mus musculus
atctcatactgggacctgcatgtac

SEQ ID NO: 248125 - DNA, 25 bp, Mus musculus
atctcatactttacactgatttgga

SEQ ID NO: 248126 - DNA, 25 bp, Mus musculus
atctcatacttttcactgatttgga

SEQ ID NO: 248127 - DNA, 25 bp, Mus musculus
atctcatagcagctttggtattttt

SEQ ID NO: 248128 - DNA, 25 bp, Mus musculus
atctcatagcaggtttggtattttt

SEQ ID NO: 248129 - DNA, 25 bp, Mus musculus
atctcatagctaaggatgcttatca

SEQ ID NO: 248130 - DNA, 25 bp, Mus musculus
atctcatagctatggatgcttatca

SEQ ID NO: 248131 - DNA, 25 bp, Mus musculus
atctcatagtttagattccttgcaa

SEQ ID NO: 248132 - DNA, 25 bp, Mus musculus
atctcatagttttgattccttgcaa

SEQ ID NO: 248133 - DNA, 25 bp, Mus musculus
atctcatatcctacaaactcttgca

SEQ ID NO: 248134 - DNA, 25 bp, Mus musculus
atctcatatccttcaaactcttgca

SEQ ID NO: 248135 - DNA, 25 bp, Mus musculus
atctcatatctgctttagtctgggt

SEQ ID NO: 248136 - DNA, 25 bp, Mus musculus
atctcatatctggtttagtctgggt

SEQ ID NO: 248137 - DNA, 25 bp, Mus musculus
atctcatcaaccctcaactaaggac

SEQ ID NO: 248138 - DNA, 25 bp, Mus musculus
atctcatcaaccgtcaactaaggac

SEQ ID NO: 248139 - DNA, 25 bp, Mus musculus
atctcatcaactcttccacttaaaa

SEQ ID NO: 248140 - DNA, 25 bp, Mus musculus
atctcatcaactgttccacttaaaa

SEQ ID NO: 248141 - DNA, 25 bp, Mus musculus
atctcatcaattaccagcagctcag

SEQ ID NO: 248142 - DNA, 25 bp, Mus musculus
atctcatcaatttccagcagctcag

SEQ ID NO: 248143 - DNA, 25 bp, Mus musculus
atctcatcactcagtttttatctgt

SEQ ID NO: 248144 - DNA, 25 bp, Mus musculus
atctcatcactctgtttttatctgt

SEQ ID NO: 248145 - DNA, 25 bp, Mus musculus
atctcatcagacatacttaagggaa

SEQ ID NO: 248146 - DNA, 25 bp, Mus musculus
atctcatcagacttacttaagggaa

SEQ ID NO: 248147 - DNA, 25 bp, Mus musculus
atctcatcagcccagtactgtttat

SEQ ID NO: 248148 - DNA, 25 bp, Mus musculus
atctcatcagccgagtactgtttat

SEQ ID NO: 248149 - DNA, 25 bp, Mus musculus
atctcatccccgctgaagaagacag

SEQ ID NO: 248150 - DNA, 25 bp, Mus musculus
atctcatccccggtgaagaagacag

SEQ ID NO: 248151 - DNA, 25 bp, Mus musculus
atctcatctcaactaaagccagtca

SEQ ID NO: 248152 - DNA, 25 bp, Mus musculus
atctcatctcaagtaaagccagtca

SEQ ID NO: 248153 - DNA, 25 bp, Mus musculus
atctcatctgacagagggctcctga

SEQ ID NO: 248154 - DNA, 25 bp, Mus musculus
atctcatctgactgagggctcctga

SEQ ID NO: 248155 - DNA, 25 bp, Mus musculus
atctcatgaatcatctggacttggc

SEQ ID NO: 248156 - DNA, 25 bp, Mus musculus
atctcatgaatcttctggacttggc

SEQ ID NO: 248157 - DNA, 25 bp, Mus musculus
atctcatgcaacagagcatcccttt

SEQ ID NO: 248158 - DNA, 25 bp, Mus musculus
atctcatgcaactgagcatcccttt

SEQ ID NO: 248159 - DNA, 25 bp, Mus musculus
atctcatgcatgcttcatcacagcc

SEQ ID NO: 248160 - DNA, 25 bp, Mus musculus
atctcatgcatggttcatcacagcc

SEQ ID NO: 248161 - DNA, 25 bp, Mus musculus
atctcatgcttgaagtccttgccag

SEQ ID NO: 248162 - DNA, 25 bp, Mus musculus
atctcatgcttgtagtccttgccag

SEQ ID NO: 248163 - DNA, 25 bp, Mus musculus
atctcatggtagagtccagcttctg

SEQ ID NO: 248164 - DNA, 25 bp, Mus musculus
atctcatggtagtgtccagcttctg

SEQ ID NO: 248165 - DNA, 25 bp, Mus musculus
atctcatggtggcaagccttcatta

SEQ ID NO: 248166 - DNA, 25 bp, Mus musculus
atctcatggtgggaagccttcatta

SEQ ID NO: 248167 - DNA, 25 bp, Mus musculus
atctcatggtttcttgttttgctat

SEQ ID NO: 248168 - DNA, 25 bp, Mus musculus
atctcatggtttgttgttttgctat

SEQ ID NO: 248169 - DNA, 25 bp, Mus musculus
atctcatgtcctcttgttgctagcc

SEQ ID NO: 248170 - DNA, 25 bp, Mus musculus
atctcatgtcctgttgttgctagcc

SEQ ID NO: 248171 - DNA, 25 bp, Mus musculus
atctcatgtctcactgtattctatt

SEQ ID NO: 248172 - DNA, 25 bp, Mus musculus
atctcatgtctctctgtattctatt

SEQ ID NO: 248173 - DNA, 25 bp, Mus musculus
atctcatgtgaccactgactttcag

SEQ ID NO: 248174 - DNA, 25 bp, Mus musculus
atctcatgtgacgactgactttcag

SEQ ID NO: 248175 - DNA, 25 bp, Mus musculus
atctcatgttagctgtaccaagtca

SEQ ID NO: 248176 - DNA, 25 bp, Mus musculus
atctcatgttaggtgtaccaagtca

SEQ ID NO: 248177 - DNA, 25 bp, Mus musculus
atctcatgttctagagaaaggcctg

SEQ ID NO: 248178 - DNA, 25 bp, Mus musculus
atctcatgttcttgagaaaggcctg

SEQ ID NO: 248179 - DNA, 25 bp, Mus musculus
atctcattaaggctccatgctaaca

SEQ ID NO: 248180 - DNA, 25 bp, Mus musculus
atctcattaagggtccatgctaaca

SEQ ID NO: 248181 - DNA, 25 bp, Mus musculus
atctcattacataccgagcatccat

SEQ ID NO: 248182 - DNA, 25 bp, Mus musculus
atctcattacattccgagcatccat

SEQ ID NO: 248183 - DNA, 25 bp, Mus musculus
atctcattattccttgcactaacca

SEQ ID NO: 248184 - DNA, 25 bp, Mus musculus
atctcattattcgttgcactaacca

SEQ ID NO: 248185 - DNA, 25 bp, Mus musculus
atctcattcactagccaggtttcag

SEQ ID NO: 248186 - DNA, 25 bp, Mus musculus
atctcattcacttgccaggtttcag

SEQ ID NO: 248187 - DNA, 25 bp, Mus musculus
atctcattcagacatccactcaagt

SEQ ID NO: 248188 - DNA, 25 bp, Mus musculus
atctcattcagagatccactcaagt

SEQ ID NO: 248189 - DNA, 25 bp, Mus musculus
atctcattcaggctgcttctaaaac

SEQ ID NO: 248190 - DNA, 25 bp, Mus musculus
atctcattcagggtgcttctaaaac

SEQ ID NO: 248191 - DNA, 25 bp, Mus musculus
atctcattctgacgcttatggcaaa

SEQ ID NO: 248192 - DNA, 25 bp, Mus musculus
atctcattctgaggcttatggcaaa

SEQ ID NO: 248193 - DNA, 25 bp, Mus musculus
atctcattgagaccgtgctaaccca

SEQ ID NO: 248194 - DNA, 25 bp, Mus musculus
atctcattgagagcgtgctaaccca

SEQ ID NO: 248195 - DNA, 25 bp, Mus musculus
atctcattggacagaggcttcaccc

SEQ ID NO: 248196 - DNA, 25 bp, Mus musculus
atctcattggactgaggcttcaccc

SEQ ID NO: 248197 - DNA, 25 bp, Mus musculus
atctcattggctctcctcgtaacaa

SEQ ID NO: 248198 - DNA, 25 bp, Mus musculus
atctcattggctcttgcatttctgt

SEQ ID NO: 248199 - DNA, 25 bp, Mus musculus
atctcattggctgtcctcgtaacaa

SEQ ID NO: 248200 - DNA, 25 bp, Mus musculus
atctcattggctgttgcatttctgt

SEQ ID NO: 248201 - DNA, 25 bp, Mus musculus
atctcattttgtattccactgattt

SEQ ID NO: 248202 - DNA, 25 bp, Mus musculus
atctcattttgttttccactgattt

SEQ ID NO: 248203 - DNA, 25 bp, Mus musculus
atctcattttttctaccctatggta

SEQ ID NO: 248204 - DNA, 25 bp, Mus musculus
atctcattttttgtaccctatggta

SEQ ID NO: 248205 - DNA, 25 bp, Mus musculus
atctccaaaatgatggtgggtcaaa

SEQ ID NO: 248206 - DNA, 25 bp, Mus musculus
atctccaaaatgttggtgggtcaaa

SEQ ID NO: 248207 - DNA, 25 bp, Mus musculus
atctccaaaggtaccatggcccaag

SEQ ID NO: 248208 - DNA, 25 bp, Mus musculus
atctccaaaggttccatggcccaag

SEQ ID NO: 248209 - DNA, 25 bp, Mus musculus
atctccaactgtaggcctctgaggt

SEQ ID NO: 248210 - DNA, 25 bp, Mus musculus
atctccaactgttggcctctgaggt

SEQ ID NO: 248211 - DNA, 25 bp, Mus musculus
atctccaagactaacagctacctga

SEQ ID NO: 248212 - DNA, 25 bp, Mus musculus
atctccaagacttacagctacctga

SEQ ID NO: 248213 - DNA, 25 bp, Mus musculus
atctccaaggaccagggtgtaccct

SEQ ID NO: 248214 - DNA, 25 bp, Mus musculus
atctccaaggacgagggtgtaccct

SEQ ID NO: 248215 - DNA, 25 bp, Mus musculus
atctccaaggatcaggtcagccctg

SEQ ID NO: 248216 - DNA, 25 bp, Mus musculus
atctccaaggatgaggtcagccctg

SEQ ID NO: 248217 - DNA, 25 bp, Mus musculus
atctccaaggccactctggatgctt

SEQ ID NO: 248218 - DNA, 25 bp, Mus musculus
atctccaaggcctctctggatgctt

SEQ ID NO: 248219 - DNA, 25 bp, Mus musculus
atctccaatcatcgactctattgcc

SEQ ID NO: 248220 - DNA, 25 bp, Mus musculus
atctccaatcatggactctattgcc

SEQ ID NO: 248221 - DNA, 25 bp, Mus musculus
atctccaatgccctcaatttgatgc

SEQ ID NO: 248222 - DNA, 25 bp, Mus musculus
atctccaatgccgtcaatttgatgc

SEQ ID NO: 248223 - DNA, 25 bp, Mus musculus
atctccaatgggacattctctcaca

SEQ ID NO: 248224 - DNA, 25 bp, Mus musculus
atctccaatgggtcattctctcaca

SEQ ID NO: 248225 - DNA, 25 bp, Mus musculus
atctccacacaccaacctttgaagg

SEQ ID NO: 248226 - DNA, 25 bp, Mus musculus
atctccacacacgaacctttgaagg

SEQ ID NO: 248227 - DNA, 25 bp, Mus musculus
atctccacagatatcttatcgatag

SEQ ID NO: 248228 - DNA, 25 bp, Mus musculus
atctccacagatcctcaagggcaag

SEQ ID NO: 248229 - DNA, 25 bp, Mus musculus
atctccacagatgctcaagggcaag

SEQ ID NO: 248230 - DNA, 25 bp, Mus musculus
atctccacagatttcttatcgatag

SEQ ID NO: 248231 - DNA, 25 bp, Mus musculus
atctccacaggaccttcttggttaa

SEQ ID NO: 248232 - DNA, 25 bp, Mus musculus
atctccacaggagcttcttggttaa

SEQ ID NO: 248233 - DNA, 25 bp, Mus musculus
atctccaccaagacacagtgtagcg

SEQ ID NO: 248234 - DNA, 25 bp, Mus musculus
atctccaccaagtcacagtgtagcg

SEQ ID NO: 248235 - DNA, 25 bp, Mus musculus
atctccaccattagaggagtctcct

SEQ ID NO: 248236 - DNA, 25 bp, Mus musculus
atctccaccatttgaggagtctcct

SEQ ID NO: 248237 - DNA, 25 bp, Mus musculus
atctccaccggtattgctagcatga

SEQ ID NO: 248238 - DNA, 25 bp, Mus musculus
atctccaccggttttgctagcatga

SEQ ID NO: 248239 - DNA, 25 bp, Mus musculus
atctccacctagcagccagcaaaaa

SEQ ID NO: 248240 - DNA, 25 bp, Mus musculus
atctccacctaggagccagcaaaaa

SEQ ID NO: 248241 - DNA, 25 bp, Mus musculus
atctccacggtcagttcgggcggaa

SEQ ID NO: 248242 - DNA, 25 bp, Mus musculus
atctccacggtctgttcgggcggaa

SEQ ID NO: 248243 - DNA, 25 bp, Mus musculus
atctccactgtgagtcccattgagg

SEQ ID NO: 248244 - DNA, 25 bp, Mus musculus
atctccactgtgtgtcccattgagg

SEQ ID NO: 248245 - DNA, 25 bp, Mus musculus
atctccacttcaaccctgatgaagg

SEQ ID NO: 248246 - DNA, 25 bp, Mus musculus
atctccacttcatccctgatgaagg

SEQ ID NO: 248247 - DNA, 25 bp, Mus musculus
atctccacttctcttgtgttttgta

SEQ ID NO: 248248 - DNA, 25 bp, Mus musculus
atctccacttctgttgtgttttgta

SEQ ID NO: 248249 - DNA, 25 bp, Mus musculus
atctccacttgcatttgtccttcat

SEQ ID NO: 248250 - DNA, 25 bp, Mus musculus
atctccacttgcttttgtccttcat

SEQ ID NO: 248251 - DNA, 25 bp, Mus musculus
atctccagagacagtggatcttgta

SEQ ID NO: 248252 - DNA, 25 bp, Mus musculus
atctccagagacctgtagggaccca

SEQ ID NO: 248253 - DNA, 25 bp, Mus musculus
atctccagagacgtgtagggaccca

SEQ ID NO: 248254 - DNA, 25 bp, Mus musculus
atctccagagactgtggatcttgta

SEQ ID NO: 248255 - DNA, 25 bp, Mus musculus
atctccagagctacggtactaccaa

SEQ ID NO: 248256 - DNA, 25 bp, Mus musculus
atctccagagctccagctgagcggc

SEQ ID NO: 248257 - DNA, 25 bp, Mus musculus
atctccagagctgcagctgagcggc

SEQ ID NO: 248258 - DNA, 25 bp, Mus musculus
atctccagagcttcggtactaccaa

SEQ ID NO: 248259 - DNA, 25 bp, Mus musculus
atctccagattaccctgtggaaatg

SEQ ID NO: 248260 - DNA, 25 bp, Mus musculus
atctccagattagcctgtggaaatg

SEQ ID NO: 248261 - DNA, 25 bp, Mus musculus
atctccagatttactctatgtccgt

SEQ ID NO: 248262 - DNA, 25 bp, Mus musculus
atctccagattttctctatgtccgt

SEQ ID NO: 248263 - DNA, 25 bp, Mus musculus
atctccagcaggatgtatgaatgct

SEQ ID NO: 248264 - DNA, 25 bp, Mus musculus
atctccagcaggttgtatgaatgct

SEQ ID NO: 248265 - DNA, 25 bp, Mus musculus
atctccagcatcaacgacgaggtca

SEQ ID NO: 248266 - DNA, 25 bp, Mus musculus
atctccagcatcacaacgcagggtc

SEQ ID NO: 248267 - DNA, 25 bp, Mus musculus
atctccagcatctacgacgaggtca

SEQ ID NO: 248268 - DNA, 25 bp, Mus musculus
atctccagcatctcaacgcagggtc

SEQ ID NO: 248269 - DNA, 25 bp, Mus musculus
atctccagctcacatcttgcttaga

SEQ ID NO: 248270 - DNA, 25 bp, Mus musculus
atctccagctcagatcttgcttaga

SEQ ID NO: 248271 - DNA, 25 bp, Mus musculus
atctccagctgtaggtgcccagaga

SEQ ID NO: 248272 - DNA, 25 bp, Mus musculus
atctccagctgttggtgcccagaga

SEQ ID NO: 248273 - DNA, 25 bp, Mus musculus
atctccagcttgagtgacttgccag

SEQ ID NO: 248274 - DNA, 25 bp, Mus musculus
atctccagcttgtgtgacttgccag

SEQ ID NO: 248275 - DNA, 25 bp, Mus musculus
atctccaggaagaacatggactgaa

SEQ ID NO: 248276 - DNA, 25 bp, Mus musculus
atctccaggaagtacatggactgaa

SEQ ID NO: 248277 - DNA, 25 bp, Mus musculus
atctccaggacccagcattatgtga

SEQ ID NO: 248278 - DNA, 25 bp, Mus musculus
atctccaggaccgagcattatgtga

SEQ ID NO: 248279 - DNA, 25 bp, Mus musculus
atctccagtccactctgttatcagt

SEQ ID NO: 248280 - DNA, 25 bp, Mus musculus
atctccagtccagtctgttatcagt

SEQ ID NO: 248281 - DNA, 25 bp, Mus musculus
atctccagtctaaaaggttccagct

SEQ ID NO: 248282 - DNA, 25 bp, Mus musculus
atctccagtctataaggttccagct

SEQ ID NO: 248283 - DNA, 25 bp, Mus musculus
atctccagtgagagaaagcgtgtgc

SEQ ID NO: 248284 - DNA, 25 bp, Mus musculus
atctccagtgagattatacctgcaa

SEQ ID NO: 248285 - DNA, 25 bp, Mus musculus
atctccagtgagtgaaagcgtgtgc

SEQ ID NO: 248286 - DNA, 25 bp, Mus musculus
atctccagtgagtttatacctgcaa

SEQ ID NO: 248287 - DNA, 25 bp, Mus musculus
atctccagttgaactaaaagacctt

SEQ ID NO: 248288 - DNA, 25 bp, Mus musculus
atctccagttgatctaaaagacctt

SEQ ID NO: 248289 - DNA, 25 bp, Mus musculus
atctccagttgcatgggataccctg

SEQ ID NO: 248290 - DNA, 25 bp, Mus musculus
atctccagttgcttgggataccctg

SEQ ID NO: 248291 - DNA, 25 bp, Mus musculus
atctccatagacagattggctgctg

SEQ ID NO: 248292 - DNA, 25 bp, Mus musculus
atctccatagactgattggctgctg

SEQ ID NO: 248293 - DNA, 25 bp, Mus musculus
atctccatagctatgtctctgagca

SEQ ID NO: 248294 - DNA, 25 bp, Mus musculus
atctccatagctttgtctctgagca

SEQ ID NO: 248295 - DNA, 25 bp, Mus musculus
atctccatatcactcaccttatgag

SEQ ID NO: 248296 - DNA, 25 bp, Mus musculus
atctccatatcagtcaccttatgag

SEQ ID NO: 248297 - DNA, 25 bp, Mus musculus
atctccatcaatacattagcctaag

SEQ ID NO: 248298 - DNA, 25 bp, Mus musculus
atctccatcaattcattagcctaag

SEQ ID NO: 248299 - DNA, 25 bp, Mus musculus
atctccatcagtcggcctttttttt

SEQ ID NO: 248300 - DNA, 25 bp, Mus musculus
atctccatcagtgggcctttttttt

SEQ ID NO: 248301 - DNA, 25 bp, Mus musculus
atctccatccatatctcgttttctc

SEQ ID NO: 248302 - DNA, 25 bp, Mus musculus
atctccatccatcaattatctcacg

SEQ ID NO: 248303 - DNA, 25 bp, Mus musculus
atctccatccatgaattatctcacg

SEQ ID NO: 248304 - DNA, 25 bp, Mus musculus
atctccatccatttctcgttttctc

SEQ ID NO: 248305 - DNA, 25 bp, Mus musculus
atctccatccccatagtatttgttt

SEQ ID NO: 248306 - DNA, 25 bp, Mus musculus
atctccatccccttagtatttgttt

SEQ ID NO: 248307 - DNA, 25 bp, Mus musculus
atctccatccgtcggctcagcaatg

SEQ ID NO: 248308 - DNA, 25 bp, Mus musculus
atctccatccgtgggctcagcaatg

SEQ ID NO: 248309 - DNA, 25 bp, Mus musculus
atctccatctctaagacagttctgc

SEQ ID NO: 248310 - DNA, 25 bp, Mus musculus
atctccatctcttagacagttctgc

SEQ ID NO: 248311 - DNA, 25 bp, Mus musculus
atctccatgaacaaacccttgctag

SEQ ID NO: 248312 - DNA, 25 bp, Mus musculus
atctccatgaactaacccttgctag

SEQ ID NO: 248313 - DNA, 25 bp, Mus musculus
atctccatgaccacggcttgaactc

SEQ ID NO: 248314 - DNA, 25 bp, Mus musculus
atctccatgacctcggcttgaactc

SEQ ID NO: 248315 - DNA, 25 bp, Mus musculus
atctccatgtacaccctcagtaggg

SEQ ID NO: 248316 - DNA, 25 bp, Mus musculus
atctccatgtactccctcagtaggg

SEQ ID NO: 248317 - DNA, 25 bp, Mus musculus
atctccatgtctctattttcttcta

SEQ ID NO: 248318 - DNA, 25 bp, Mus musculus
atctccatgtctgtattttcttcta

SEQ ID NO: 248319 - DNA, 25 bp, Mus musculus
atctccattctgataagagctgtat

SEQ ID NO: 248320 - DNA, 25 bp, Mus musculus
atctccattctgttaagagctgtat

SEQ ID NO: 248321 - DNA, 25 bp, Mus musculus
atctccattgatctacttttcctcg

SEQ ID NO: 248322 - DNA, 25 bp, Mus musculus
atctccattgatgtacttttcctcg

SEQ ID NO: 248323 - DNA, 25 bp, Mus musculus
atctccattgggaagtttgcatctg

SEQ ID NO: 248324 - DNA, 25 bp, Mus musculus
atctccattgggtagtttgcatctg

SEQ ID NO: 248325 - DNA, 25 bp, Mus musculus
atctccattgtaactgatcctttca

SEQ ID NO: 248326 - DNA, 25 bp, Mus musculus
atctccattgtatctgatcctttca

SEQ ID NO: 248327 - DNA, 25 bp, Mus musculus
atctccattttcaccgtttatcgga

SEQ ID NO: 248328 - DNA, 25 bp, Mus musculus
atctccattttcaggtcatctcttc

SEQ ID NO: 248329 - DNA, 25 bp, Mus musculus
atctccattttctccgtttatcgga

SEQ ID NO: 248330 - DNA, 25 bp, Mus musculus
atctccattttctggtcatctcttc

SEQ ID NO: 248331 - DNA, 25 bp, Mus musculus
atctccattttgcttgacctgtctc

SEQ ID NO: 248332 - DNA, 25 bp, Mus musculus
atctccattttggttgacctgtctc

SEQ ID NO: 248333 - DNA, 25 bp, Mus musculus
atctcccaaagcatgtcttctgatc

SEQ ID NO: 248334 - DNA, 25 bp, Mus musculus
atctcccaaagcttgtcttctgatc

SEQ ID NO: 248335 - DNA, 25 bp, Mus musculus
atctcccaacaaaacacaaggcctg

SEQ ID NO: 248336 - DNA, 25 bp, Mus musculus
atctcccaacaatacacaaggcctg

SEQ ID NO: 248337 - DNA, 25 bp, Mus musculus
atctcccaacttactatctgaatcc

SEQ ID NO: 248338 - DNA, 25 bp, Mus musculus
atctcccaactttctatctgaatcc

SEQ ID NO: 248339 - DNA, 25 bp, Mus musculus
atctcccaatccagacaacatttaa

SEQ ID NO: 248340 - DNA, 25 bp, Mus musculus
atctcccaatcctgacaacatttaa

SEQ ID NO: 248341 - DNA, 25 bp, Mus musculus
atctcccaatggattttgctcatgt

SEQ ID NO: 248342 - DNA, 25 bp, Mus musculus
atctcccaatggtttttgctcatgt

SEQ ID NO: 248343 - DNA, 25 bp, Mus musculus
atctcccaccacatagatcctaggg

SEQ ID NO: 248344 - DNA, 25 bp, Mus musculus
atctcccaccacttagatcctaggg

SEQ ID NO: 248345 - DNA, 25 bp, Mus musculus
atctcccacccgactacctgagaaa

SEQ ID NO: 248346 - DNA, 25 bp, Mus musculus
atctcccacccgtctacctgagaaa

SEQ ID NO: 248347 - DNA, 25 bp, Mus musculus
atctcccacctaatacctttgtgta

SEQ ID NO: 248348 - DNA, 25 bp, Mus musculus
atctcccacctacatttctattctt

SEQ ID NO: 248349 - DNA, 25 bp, Mus musculus
atctcccacctagatttctattctt

SEQ ID NO: 248350 - DNA, 25 bp, Mus musculus
atctcccacctattacctttgtgta

SEQ ID NO: 248351 - DNA, 25 bp, Mus musculus
atctcccacctgaatctatattcta

SEQ ID NO: 248352 - DNA, 25 bp, Mus musculus
atctcccacctgtatctatattcta

SEQ ID NO: 248353 - DNA, 25 bp, Mus musculus
atctcccagaacactaacatcttga

SEQ ID NO: 248354 - DNA, 25 bp, Mus musculus
atctcccagaactctaacatcttga

SEQ ID NO: 248355 - DNA, 25 bp, Mus musculus
atctcccagactaatggctgctgct

SEQ ID NO: 248356 - DNA, 25 bp, Mus musculus
atctcccagacttatggctgctgct

SEQ ID NO: 248357 - DNA, 25 bp, Mus musculus
atctcccagcaacacaccagttgaa

SEQ ID NO: 248358 - DNA, 25 bp, Mus musculus
atctcccagcaagacaccagttgaa

SEQ ID NO: 248359 - DNA, 25 bp, Mus musculus
atctcccagggaagctcttgcaggt

SEQ ID NO: 248360 - DNA, 25 bp, Mus musculus
atctcccagggatgctcttgcaggt

SEQ ID NO: 248361 - DNA, 25 bp, Mus musculus
atctccccagagaattttgtagctg

SEQ ID NO: 248362 - DNA, 25 bp, Mus musculus
atctccccagagtattttgtagctg

SEQ ID NO: 248363 - DNA, 25 bp, Mus musculus
atctccccatcacatatgatcatca

SEQ ID NO: 248364 - DNA, 25 bp, Mus musculus
atctccccatcagatatgatcatca

SEQ ID NO: 248365 - DNA, 25 bp, Mus musculus
atctccccgcttcgagcagcagagg

SEQ ID NO: 248366 - DNA, 25 bp, Mus musculus
atctccccgcttggagcagcagagg

SEQ ID NO: 248367 - DNA, 25 bp, Mus musculus
atctcccctgttctcatgaatatgt

SEQ ID NO: 248368 - DNA, 25 bp, Mus musculus
atctcccctgttgtcatgaatatgt

SEQ ID NO: 248369 - DNA, 25 bp, Mus musculus
atctcccgaaagcaaggtgtcatca

SEQ ID NO: 248370 - DNA, 25 bp, Mus musculus
atctcccgaaaggaaggtgtcatca

SEQ ID NO: 248371 - DNA, 25 bp, Mus musculus
atctcccgaatcaacttggccaagg

SEQ ID NO: 248372 - DNA, 25 bp, Mus musculus
atctcccgaatctacttggccaagg

SEQ ID NO: 248373 - DNA, 25 bp, Mus musculus
atctcccggccccagctggtactgg

SEQ ID NO: 248374 - DNA, 25 bp, Mus musculus
atctcccggcccgagctggtactgg

SEQ ID NO: 248375 - DNA, 25 bp, Mus musculus
atctcccgggtgaattttgatgtca

SEQ ID NO: 248376 - DNA, 25 bp, Mus musculus
atctcccgggtgtattttgatgtca

SEQ ID NO: 248377 - DNA, 25 bp, Mus musculus
atctcccggttcagcatgaagatgc

SEQ ID NO: 248378 - DNA, 25 bp, Mus musculus
atctcccggttctgcatgaagatgc

SEQ ID NO: 248379 - DNA, 25 bp, Mus musculus
atctcccgtggaagctgaacgttag

SEQ ID NO: 248380 - DNA, 25 bp, Mus musculus
atctcccgtggatgctgaacgttag

SEQ ID NO: 248381 - DNA, 25 bp, Mus musculus
atctccctaagaagttactggcaac

SEQ ID NO: 248382 - DNA, 25 bp, Mus musculus
atctccctaagatgttactggcaac

SEQ ID NO: 248383 - DNA, 25 bp, Mus musculus
atctccctagggagtgaccggctga

SEQ ID NO: 248384 - DNA, 25 bp, Mus musculus
atctccctagggtgtgaccggctga

SEQ ID NO: 248385 - DNA, 25 bp, Mus musculus
atctccctccagaaacaataaccta

SEQ ID NO: 248386 - DNA, 25 bp, Mus musculus
atctccctccagtaacaataaccta

SEQ ID NO: 248387 - DNA, 25 bp, Mus musculus
atctccctctctagagaacttgtca

SEQ ID NO: 248388 - DNA, 25 bp, Mus musculus
atctccctctcttgagaacttgtca

SEQ ID NO: 248389 - DNA, 25 bp, Mus musculus
atctccctgaacaaatacctagtaa

SEQ ID NO: 248390 - DNA, 25 bp, Mus musculus
atctccctgaactaatacctagtaa

SEQ ID NO: 248391 - DNA, 25 bp, Mus musculus
atctccctgaatccactttcagaac

SEQ ID NO: 248392 - DNA, 25 bp, Mus musculus
atctccctgaatgcactttcagaac

SEQ ID NO: 248393 - DNA, 25 bp, Mus musculus
atctccctgaggagtgatgtagcac

SEQ ID NO: 248394 - DNA, 25 bp, Mus musculus
atctccctgaggtgtgatgtagcac

SEQ ID NO: 248395 - DNA, 25 bp, Mus musculus
atctccctggaaatacagcaactga

SEQ ID NO: 248396 - DNA, 25 bp, Mus musculus
atctccctggaattacagcaactga

SEQ ID NO: 248397 - DNA, 25 bp, Mus musculus
atctccctgggcaagatctacaact

SEQ ID NO: 248398 - DNA, 25 bp, Mus musculus
atctccctgggctagatctacaact

SEQ ID NO: 248399 - DNA, 25 bp, Mus musculus
atctccctgtacagggattccaggt

SEQ ID NO: 248400 - DNA, 25 bp, Mus musculus
atctccctgtactgggattccaggt

SEQ ID NO: 248401 - DNA, 25 bp, Mus musculus
atctccctgtccatttgtattatcc

SEQ ID NO: 248402 - DNA, 25 bp, Mus musculus
atctccctgtccttttgtattatcc

SEQ ID NO: 248403 - DNA, 25 bp, Mus musculus
atctcccttggaagacacaggtcat

SEQ ID NO: 248404 - DNA, 25 bp, Mus musculus
atctcccttggatgacacaggtcat

SEQ ID NO: 248405 - DNA, 25 bp, Mus musculus
atctcccttgtcaaatcagactcga

SEQ ID NO: 248406 - DNA, 25 bp, Mus musculus
atctcccttgtctaatcagactcga

SEQ ID NO: 248407 - DNA, 25 bp, Mus musculus
atctcccttgttctctaaaagtata

SEQ ID NO: 248408 - DNA, 25 bp, Mus musculus
atctcccttgttgtctaaaagtata

SEQ ID NO: 248409 - DNA, 25 bp, Mus musculus
atctccctttcacgatctgttacag

SEQ ID NO: 248410 - DNA, 25 bp, Mus musculus
atctccctttcaggatctgttacag

SEQ ID NO: 248411 - DNA, 25 bp, Mus musculus
atctccgaagtgaacgagagtgaga

SEQ ID NO: 248412 - DNA, 25 bp, Mus musculus
atctccgaagtgtacgagagtgaga

SEQ ID NO: 248413 - DNA, 25 bp, Mus musculus
atctccgacatgacacagaccaaag

SEQ ID NO: 248414 - DNA, 25 bp, Mus musculus
atctccgacatgacaccgtggtgga

SEQ ID NO: 248415 - DNA, 25 bp, Mus musculus
atctccgacatgtcacagaccaaag

SEQ ID NO: 248416 - DNA, 25 bp, Mus musculus
atctccgacatgtcaccgtggtgga

SEQ ID NO: 248417 - DNA, 25 bp, Mus musculus
atctccgacattagcagctcactaa

SEQ ID NO: 248418 - DNA, 25 bp, Mus musculus
atctccgacatttgcagctcactaa

SEQ ID NO: 248419 - DNA, 25 bp, Mus musculus
atctccgagcatccctaagaacaag

SEQ ID NO: 248420 - DNA, 25 bp, Mus musculus
atctccgagcatgcctaagaacaag

SEQ ID NO: 248421 - DNA, 25 bp, Mus musculus
atctccgaggtcacacacctgaagg

SEQ ID NO: 248422 - DNA, 25 bp, Mus musculus
atctccgaggtctcacacctgaagg

SEQ ID NO: 248423 - DNA, 25 bp, Mus musculus
atctccgatcccaatcaggactgaa

SEQ ID NO: 248424 - DNA, 25 bp, Mus musculus
atctccgatccctatcaggactgaa

SEQ ID NO: 248425 - DNA, 25 bp, Mus musculus
atctccgcatgtctacgcatctgta

SEQ ID NO: 248426 - DNA, 25 bp, Mus musculus
atctccgcatgtgtacgcatctgta

SEQ ID NO: 248427 - DNA, 25 bp, Mus musculus
atctccgccatgcactacaacaagg

SEQ ID NO: 248428 - DNA, 25 bp, Mus musculus
atctccgccatggactacaacaagg

SEQ ID NO: 248429 - DNA, 25 bp, Mus musculus
atctccgccctcattgcctattttt

SEQ ID NO: 248430 - DNA, 25 bp, Mus musculus
atctccgccctctttgcctattttt

SEQ ID NO: 248431 - DNA, 25 bp, Mus musculus
atctccgccgatctctacattggga

SEQ ID NO: 248432 - DNA, 25 bp, Mus musculus
atctccgccgatgtctacattggga

SEQ ID NO: 248433 - DNA, 25 bp, Mus musculus
atctccgctatgaacaaggtggctg

SEQ ID NO: 248434 - DNA, 25 bp, Mus musculus
atctccgctatgtacaaggtggctg

SEQ ID NO: 248435 - DNA, 25 bp, Mus musculus
atctccgctcttcagcagcgacatg

SEQ ID NO: 248436 - DNA, 25 bp, Mus musculus
atctccgctcttgagcagcgacatg

SEQ ID NO: 248437 - DNA, 25 bp, Mus musculus
atctccgctgaacaggacctattta

SEQ ID NO: 248438 - DNA, 25 bp, Mus musculus
atctccgctgaagaggacctattta

SEQ ID NO: 248439 - DNA, 25 bp, Mus musculus
atctccggatggctggctcaggtta

SEQ ID NO: 248440 - DNA, 25 bp, Mus musculus
atctccggatgggtggctcaggtta

SEQ ID NO: 248441 - DNA, 25 bp, Mus musculus
atctccggcctcatctacgaggaga

SEQ ID NO: 248442 - DNA, 25 bp, Mus musculus
atctccggcctcttctacgaggaga

SEQ ID NO: 248443 - DNA, 25 bp, Mus musculus
atctccgggagaacagggctcttga

SEQ ID NO: 248444 - DNA, 25 bp, Mus musculus
atctccgggagatcagggctcttga

SEQ ID NO: 248445 - DNA, 25 bp, Mus musculus
atctccgtggacactgtgaaaatgc

SEQ ID NO: 248446 - DNA, 25 bp, Mus musculus
atctccgtggactctgtgaaaatgc

SEQ ID NO: 248447 - DNA, 25 bp, Mus musculus
atctccgtgtccacggcacaggaag

SEQ ID NO: 248448 - DNA, 25 bp, Mus musculus
atctccgtgtcctcggcacaggaag

SEQ ID NO: 248449 - DNA, 25 bp, Mus musculus
atctccgttgttaaggattcctctg

SEQ ID NO: 248450 - DNA, 25 bp, Mus musculus
atctccgttgtttaggattcctctg

SEQ ID NO: 248451 - DNA, 25 bp, Mus musculus
atctcctaaagccatcgtcagtgac

SEQ ID NO: 248452 - DNA, 25 bp, Mus musculus
atctcctaaagcgatcgtcagtgac

SEQ ID NO: 248453 - DNA, 25 bp, Mus musculus
atctcctaaccacattcctcttttg

SEQ ID NO: 248454 - DNA, 25 bp, Mus musculus
atctcctaaccagattcctcttttg

SEQ ID NO: 248455 - DNA, 25 bp, Mus musculus
atctcctaagtcattggacccattt

SEQ ID NO: 248456 - DNA, 25 bp, Mus musculus
atctcctaagtctttggacccattt

SEQ ID NO: 248457 - DNA, 25 bp, Mus musculus
atctcctaatgtactgtggcgtgtc

SEQ ID NO: 248458 - DNA, 25 bp, Mus musculus
atctcctaatgttctgtggcgtgtc

SEQ ID NO: 248459 - DNA, 25 bp, Mus musculus
atctcctacgtgactgactacagtt

SEQ ID NO: 248460 - DNA, 25 bp, Mus musculus
atctcctacgtgtctgactacagtt

SEQ ID NO: 248461 - DNA, 25 bp, Mus musculus
atctcctactgaagattccagccat

SEQ ID NO: 248462 - DNA, 25 bp, Mus musculus
atctcctactgatgattccagccat

SEQ ID NO: 248463 - DNA, 25 bp, Mus musculus
atctcctagagaatgccctgtgtgg

SEQ ID NO: 248464 - DNA, 25 bp, Mus musculus
atctcctagagattgccctgtgtgg

SEQ ID NO: 248465 - DNA, 25 bp, Mus musculus
atctcctagcaacattggtcacgtt

SEQ ID NO: 248466 - DNA, 25 bp, Mus musculus
atctcctagcaagattggtcacgtt

SEQ ID NO: 248467 - DNA, 25 bp, Mus musculus
atctcctatctgaaggtgggaccca

SEQ ID NO: 248468 - DNA, 25 bp, Mus musculus
atctcctatctgtaggtgggaccca

SEQ ID NO: 248469 - DNA, 25 bp, Mus musculus
atctcctcacaaaaattccatctct

SEQ ID NO: 248470 - DNA, 25 bp, Mus musculus
atctcctcacaataattccatctct

SEQ ID NO: 248471 - DNA, 25 bp, Mus musculus
atctcctcacagaattctacttgtc

SEQ ID NO: 248472 - DNA, 25 bp, Mus musculus
atctcctcacagtattctacttgtc

SEQ ID NO: 248473 - DNA, 25 bp, Mus musculus
atctcctcccctcgaagtttctgaa

SEQ ID NO: 248474 - DNA, 25 bp, Mus musculus
atctcctcccctggaagtttctgaa

SEQ ID NO: 248475 - DNA, 25 bp, Mus musculus
atctcctccgacacttagagaaaca

SEQ ID NO: 248476 - DNA, 25 bp, Mus musculus
atctcctccgactcttagagaaaca

SEQ ID NO: 248477 - DNA, 25 bp, Mus musculus
atctcctcggagaacttgcagaagg

SEQ ID NO: 248478 - DNA, 25 bp, Mus musculus
atctcctcggagtacttgcagaagg

SEQ ID NO: 248479 - DNA, 25 bp, Mus musculus
atctcctcggcactgaagcagagca

SEQ ID NO: 248480 - DNA, 25 bp, Mus musculus
atctcctcggcagtgaagcagagca

SEQ ID NO: 248481 - DNA, 25 bp, Mus musculus
atctcctctaacagttgtactcctg

SEQ ID NO: 248482 - DNA, 25 bp, Mus musculus
atctcctctaactgttgtactcctg

SEQ ID NO: 248483 - DNA, 25 bp, Mus musculus
atctcctctaggagtcttattgctc

SEQ ID NO: 248484 - DNA, 25 bp, Mus musculus
atctcctctaggtgtcttattgctc

SEQ ID NO: 248485 - DNA, 25 bp, Mus musculus
atctcctctcctaggttagggaaga

SEQ ID NO: 248486 - DNA, 25 bp, Mus musculus
atctcctctccttggttagggaaga

SEQ ID NO: 248487 - DNA, 25 bp, Mus musculus
atctcctctgctcatttgccattgg

SEQ ID NO: 248488 - DNA, 25 bp, Mus musculus
atctcctctgctgatttgccattgg

SEQ ID NO: 248489 - DNA, 25 bp, Mus musculus
atctcctctgttctggtcagctaag

SEQ ID NO: 248490 - DNA, 25 bp, Mus musculus
atctcctctgttgtggtcagctaag

SEQ ID NO: 248491 - DNA, 25 bp, Mus musculus
atctcctctttcaaagttctcagtg

SEQ ID NO: 248492 - DNA, 25 bp, Mus musculus
atctcctctttctaagttctcagtg

SEQ ID NO: 248493 - DNA, 25 bp, Mus musculus
atctcctcttttcggaaatatattg

SEQ ID NO: 248494 - DNA, 25 bp, Mus musculus
atctcctcttttgggaaatatattg

SEQ ID NO: 248495 - DNA, 25 bp, Mus musculus
atctcctgaagactgcatgtcagtg

SEQ ID NO: 248496 - DNA, 25 bp, Mus musculus
atctcctgaagagtgcatgtcagtg

SEQ ID NO: 248497 - DNA, 25 bp, Mus musculus
atctcctgactactgagattacagg

SEQ ID NO: 248498 - DNA, 25 bp, Mus musculus
atctcctgactagtgagattacagg

SEQ ID NO: 248499 - DNA, 25 bp, Mus musculus
atctcctgaggcaccactgaaataa

SEQ ID NO: 248500 - DNA, 25 bp, Mus musculus
atctcctgaggctccactgaaataa

SEQ ID NO: 248501 - DNA, 25 bp, Mus musculus
atctcctgagggaccaaggacacca

SEQ ID NO: 248502 - DNA, 25 bp, Mus musculus
atctcctgagggtccaaggacacca

SEQ ID NO: 248503 - DNA, 25 bp, Mus musculus
atctcctgatagaaacatttctctg

SEQ ID NO: 248504 - DNA, 25 bp, Mus musculus
atctcctgatagtaacatttctctg

SEQ ID NO: 248505 - DNA, 25 bp, Mus musculus
atctcctgccatctagaccagaagt

SEQ ID NO: 248506 - DNA, 25 bp, Mus musculus
atctcctgccatgtagaccagaagt

SEQ ID NO: 248507 - DNA, 25 bp, Mus musculus
atctcctgccttatttcagagtctc

SEQ ID NO: 248508 - DNA, 25 bp, Mus musculus
atctcctgccttttttcagagtctc

SEQ ID NO: 248509 - DNA, 25 bp, Mus musculus
atctcctgctttattgccatcgtgg

SEQ ID NO: 248510 - DNA, 25 bp, Mus musculus
atctcctgcttttttgccatcgtgg

SEQ ID NO: 248511 - DNA, 25 bp, Mus musculus
atctcctggactagttttgtaccca

SEQ ID NO: 248512 - DNA, 25 bp, Mus musculus
atctcctggactccggaggactgag

SEQ ID NO: 248513 - DNA, 25 bp, Mus musculus
atctcctggactgcggaggactgag

SEQ ID NO: 248514 - DNA, 25 bp, Mus musculus
atctcctggacttgttttgtaccca

SEQ ID NO: 248515 - DNA, 25 bp, Mus musculus
atctcctggcagatcttgcttgtgg

SEQ ID NO: 248516 - DNA, 25 bp, Mus musculus
atctcctggcagttcttgcttgtgg

SEQ ID NO: 248517 - DNA, 25 bp, Mus musculus
atctcctgggatctacaatctcttg

SEQ ID NO: 248518 - DNA, 25 bp, Mus musculus
atctcctgggatgtacaatctcttg

SEQ ID NO: 248519 - DNA, 25 bp, Mus musculus
atctcctgtaatctggcctgtctta

SEQ ID NO: 248520 - DNA, 25 bp, Mus musculus
atctcctgtaatgtggcctgtctta

SEQ ID NO: 248521 - DNA, 25 bp, Mus musculus
atctcctgtagtctgatccttaaac

SEQ ID NO: 248522 - DNA, 25 bp, Mus musculus
atctcctgtagtgtgatccttaaac

SEQ ID NO: 248523 - DNA, 25 bp, Mus musculus
atctcctgtctgaatcgggacccag

SEQ ID NO: 248524 - DNA, 25 bp, Mus musculus
atctcctgtctgtatcgggacccag

SEQ ID NO: 248525 - DNA, 25 bp, Mus musculus
atctcctgtcttattgtatgtatcc

SEQ ID NO: 248526 - DNA, 25 bp, Mus musculus
atctcctgtctttttgtatgtatcc

SEQ ID NO: 248527 - DNA, 25 bp, Mus musculus
atctcctgtgtaaggacacctctga

SEQ ID NO: 248528 - DNA, 25 bp, Mus musculus
atctcctgtgtatggacacctctga

SEQ ID NO: 248529 - DNA, 25 bp, Mus musculus
atctccttacataggaattgccaag

SEQ ID NO: 248530 - DNA, 25 bp, Mus musculus
atctccttacattggaattgccaag

SEQ ID NO: 248531 - DNA, 25 bp, Mus musculus
atctccttcaaaacatcagccatag

SEQ ID NO: 248532 - DNA, 25 bp, Mus musculus
atctccttcaaatcatcagccatag

SEQ ID NO: 248533 - DNA, 25 bp, Mus musculus
atctccttcatgcagtgtggacaca

SEQ ID NO: 248534 - DNA, 25 bp, Mus musculus
atctccttcatggagtgtggacaca

SEQ ID NO: 248535 - DNA, 25 bp, Mus musculus
atctccttccataacttcagtgatt

SEQ ID NO: 248536 - DNA, 25 bp, Mus musculus
atctccttccataagatcatcgcgg

SEQ ID NO: 248537 - DNA, 25 bp, Mus musculus
atctccttccattacttcagtgatt

SEQ ID NO: 248538 - DNA, 25 bp, Mus musculus
atctccttccattagatcatcgcgg

SEQ ID NO: 248539 - DNA, 25 bp, Mus musculus
atctccttccggctcaagtcgaggt

SEQ ID NO: 248540 - DNA, 25 bp, Mus musculus
atctccttccgggtcaagtcgaggt

SEQ ID NO: 248541 - DNA, 25 bp, Mus musculus
atctccttccttaatcctggtggtt

SEQ ID NO: 248542 - DNA, 25 bp, Mus musculus
atctccttcctttatcctggtggtt

SEQ ID NO: 248543 - DNA, 25 bp, Mus musculus
atctccttctgacgccatctgcaga

SEQ ID NO: 248544 - DNA, 25 bp, Mus musculus
atctccttctgaggccatctgcaga

SEQ ID NO: 248545 - DNA, 25 bp, Mus musculus
atctccttgggcacttgtcaaatat

SEQ ID NO: 248546 - DNA, 25 bp, Mus musculus
atctccttgggctcttgtcaaatat

SEQ ID NO: 248547 - DNA, 25 bp, Mus musculus
atctccttgtgtcctcgattagaaa

SEQ ID NO: 248548 - DNA, 25 bp, Mus musculus
atctccttgtgtgctcgattagaaa

SEQ ID NO: 248549 - DNA, 25 bp, Mus musculus
atctccttgttaatctagctggcac

SEQ ID NO: 248550 - DNA, 25 bp, Mus musculus
atctccttgttattctagctggcac

SEQ ID NO: 248551 - DNA, 25 bp, Mus musculus
atctcctttagtacagtttgtctcc

SEQ ID NO: 248552 - DNA, 25 bp, Mus musculus
atctcctttagttcagtttgtctcc

SEQ ID NO: 248553 - DNA, 25 bp, Mus musculus
atctcctttattcacacatccatat

SEQ ID NO: 248554 - DNA, 25 bp, Mus musculus
atctcctttattgacacatccatat

SEQ ID NO: 248555 - DNA, 25 bp, Mus musculus
atctcctttcaaaactgttgcctgt

SEQ ID NO: 248556 - DNA, 25 bp, Mus musculus
atctcctttcaatactgttgcctgt

SEQ ID NO: 248557 - DNA, 25 bp, Mus musculus
atctcctttctcctatacactatag

SEQ ID NO: 248558 - DNA, 25 bp, Mus musculus
atctcctttctcgtatacactatag

SEQ ID NO: 248559 - DNA, 25 bp, Mus musculus
atctcctttgttagtgctcttccta

SEQ ID NO: 248560 - DNA, 25 bp, Mus musculus
atctcctttgtttgtgctcttccta

SEQ ID NO: 248561 - DNA, 25 bp, Mus musculus
atctccttttagactcttctgtata

SEQ ID NO: 248562 - DNA, 25 bp, Mus musculus
atctccttttagtctcttctgtata

SEQ ID NO: 248563 - DNA, 25 bp, Mus musculus
atctccttttcgcattctccatgat

SEQ ID NO: 248564 - DNA, 25 bp, Mus musculus
atctccttttcggattctccatgat

SEQ ID NO: 248565 - DNA, 25 bp, Mus musculus
atctcgaatggtcaggtgttggaca

SEQ ID NO: 248566 - DNA, 25 bp, Mus musculus
atctcgaatggtgaggtgttggaca

SEQ ID NO: 248567 - DNA, 25 bp, Mus musculus
atctcgaattcacgtgtggctgtat

SEQ ID NO: 248568 - DNA, 25 bp, Mus musculus
atctcgaattcaggtgtggctgtat

SEQ ID NO: 248569 - DNA, 25 bp, Mus musculus
atctcgacagtaccatgctttttca

SEQ ID NO: 248570 - DNA, 25 bp, Mus musculus
atctcgacagtagcatgctttttca

SEQ ID NO: 248571 - DNA, 25 bp, Mus musculus
atctcgaggtctagatgtccatgat

SEQ ID NO: 248572 - DNA, 25 bp, Mus musculus
atctcgaggtcttgatgtccatgat

SEQ ID NO: 248573 - DNA, 25 bp, Mus musculus
atctcgatgctgcattacaacccca

SEQ ID NO: 248574 - DNA, 25 bp, Mus musculus
atctcgatgctggattacaacccca

SEQ ID NO: 248575 - DNA, 25 bp, Mus musculus
atctcgatgcttctgggcaacctca

SEQ ID NO: 248576 - DNA, 25 bp, Mus musculus
atctcgatgcttgtgggcaacctca

SEQ ID NO: 248577 - DNA, 25 bp, Mus musculus
atctcgcattttaagggtttatctg

SEQ ID NO: 248578 - DNA, 25 bp, Mus musculus
atctcgcatttttagggtttatctg

SEQ ID NO: 248579 - DNA, 25 bp, Mus musculus
atctcgctcaccacgggcgtgcaat

SEQ ID NO: 248580 - DNA, 25 bp, Mus musculus
atctcgctcacctcgggcgtgcaat

SEQ ID NO: 248581 - DNA, 25 bp, Mus musculus
atctcgctcatcacctcaggagagg

SEQ ID NO: 248582 - DNA, 25 bp, Mus musculus
atctcgctcatctcctcaggagagg

SEQ ID NO: 248583 - DNA, 25 bp, Mus musculus
atctcgctgctgatggctggtttca

SEQ ID NO: 248584 - DNA, 25 bp, Mus musculus
atctcgctgctgttggctggtttca

SEQ ID NO: 248585 - DNA, 25 bp, Mus musculus
atctcgctgtagactcattgctgca

SEQ ID NO: 248586 - DNA, 25 bp, Mus musculus
atctcgctgtagtctcattgctgca

SEQ ID NO: 248587 - DNA, 25 bp, Mus musculus
atctcgctgtatagcttataacgat

SEQ ID NO: 248588 - DNA, 25 bp, Mus musculus
atctcgctgtattgcttataacgat

SEQ ID NO: 248589 - DNA, 25 bp, Mus musculus
atctcgcttataatgggcagacctc

SEQ ID NO: 248590 - DNA, 25 bp, Mus musculus
atctcgcttatattgggcagacctc

SEQ ID NO: 248591 - DNA, 25 bp, Mus musculus
atctcgcttggaatctctacaccta

SEQ ID NO: 248592 - DNA, 25 bp, Mus musculus
atctcgcttggattctctacaccta

SEQ ID NO: 248593 - DNA, 25 bp, Mus musculus
atctcgcttttgagtatttcttctc

SEQ ID NO: 248594 - DNA, 25 bp, Mus musculus
atctcgcttttgtgtatttcttctc

SEQ ID NO: 248595 - DNA, 25 bp, Mus musculus
atctcggacaatccagttgacaatg

SEQ ID NO: 248596 - DNA, 25 bp, Mus musculus
atctcggacaatgcagttgacaatg

SEQ ID NO: 248597 - DNA, 25 bp, Mus musculus
atctcggaccagaagttcctctagg

SEQ ID NO: 248598 - DNA, 25 bp, Mus musculus
atctcggaccagtagttcctctagg

SEQ ID NO: 248599 - DNA, 25 bp, Mus musculus
atctcggacgccacgtttcaaagag

SEQ ID NO: 248600 - DNA, 25 bp, Mus musculus
atctcggacgcctcgtttcaaagag

SEQ ID NO: 248601 - DNA, 25 bp, Mus musculus
atctcggaggatctggctggctact

SEQ ID NO: 248602 - DNA, 25 bp, Mus musculus
atctcggaggatgtggctggctact

SEQ ID NO: 248603 - DNA, 25 bp, Mus musculus
atctcggagttgctcagcacagcct

SEQ ID NO: 248604 - DNA, 25 bp, Mus musculus
atctcggagttggtcagcacagcct

SEQ ID NO: 248605 - DNA, 25 bp, Mus musculus
atctcggatacaatagaggcaaaga

SEQ ID NO: 248606 - DNA, 25 bp, Mus musculus
atctcggatacattagaggcaaaga

SEQ ID NO: 248607 - DNA, 25 bp, Mus musculus
atctcggatttacatctcacagttg

SEQ ID NO: 248608 - DNA, 25 bp, Mus musculus
atctcggatttagatctcacagttg

SEQ ID NO: 248609 - DNA, 25 bp, Mus musculus
atctcggcaatactgattgctggag

SEQ ID NO: 248610 - DNA, 25 bp, Mus musculus
atctcggcaatagtgattgctggag

SEQ ID NO: 248611 - DNA, 25 bp, Mus musculus
atctcggcaatgaagtgtctgatga

SEQ ID NO: 248612 - DNA, 25 bp, Mus musculus
atctcggcaatgtagtgtctgatga

SEQ ID NO: 248613 - DNA, 25 bp, Mus musculus
atctcggccaagcagaagacgcaga

SEQ ID NO: 248614 - DNA, 25 bp, Mus musculus
atctcggccaaggagaagacgcaga

SEQ ID NO: 248615 - DNA, 25 bp, Mus musculus
atctcggcggaccatattaaggctg

SEQ ID NO: 248616 - DNA, 25 bp, Mus musculus
atctcggcggacgatattaaggctg

SEQ ID NO: 248617 - DNA, 25 bp, Mus musculus
atctcggcgtctcaggaggagctac

SEQ ID NO: 248618 - DNA, 25 bp, Mus musculus
atctcggcgtctgaggaggagctac

SEQ ID NO: 248619 - DNA, 25 bp, Mus musculus
atctcggcttcgcactccaggtaaa

SEQ ID NO: 248620 - DNA, 25 bp, Mus musculus
atctcggcttcggactccaggtaaa

SEQ ID NO: 248621 - DNA, 25 bp, Mus musculus
atctcggcttttaccgcaacaattt

SEQ ID NO: 248622 - DNA, 25 bp, Mus musculus
atctcggctttttccgcaacaattt

SEQ ID NO: 248623 - DNA, 25 bp, Mus musculus
atctcgggagataggctggagtcca

SEQ ID NO: 248624 - DNA, 25 bp, Mus musculus
atctcgggagattggctggagtcca

SEQ ID NO: 248625 - DNA, 25 bp, Mus musculus
atctcgggaggcacctttttgagcc

SEQ ID NO: 248626 - DNA, 25 bp, Mus musculus
atctcgggaggctcctttttgagcc

SEQ ID NO: 248627 - DNA, 25 bp, Mus musculus
atctcggggattagcatggtcctgg

SEQ ID NO: 248628 - DNA, 25 bp, Mus musculus
atctcggggatttgcatggtcctgg

SEQ ID NO: 248629 - DNA, 25 bp, Mus musculus
atctcgggtcttattggctcagcag

SEQ ID NO: 248630 - DNA, 25 bp, Mus musculus
atctcgggtctttttggctcagcag

SEQ ID NO: 248631 - DNA, 25 bp, Mus musculus
atctcggtagtgagctgaggctagc

SEQ ID NO: 248632 - DNA, 25 bp, Mus musculus
atctcggtagtgtgctgaggctagc

SEQ ID NO: 248633 - DNA, 25 bp, Mus musculus
atctcggtagttacggtcatgctat

SEQ ID NO: 248634 - DNA, 25 bp, Mus musculus
atctcggtagtttcggtcatgctat

SEQ ID NO: 248635 - DNA, 25 bp, Mus musculus
atctcggtcattcttacagtgaggg

SEQ ID NO: 248636 - DNA, 25 bp, Mus musculus
atctcggtcattgttacagtgaggg

SEQ ID NO: 248637 - DNA, 25 bp, Mus musculus
atctcggtcggccatgatcacaaga

SEQ ID NO: 248638 - DNA, 25 bp, Mus musculus
atctcggtcggcgatgatcacaaga

SEQ ID NO: 248639 - DNA, 25 bp, Mus musculus
atctcggtctgcagaatctccatgc

SEQ ID NO: 248640 - DNA, 25 bp, Mus musculus
atctcggtctgctgaatctccatgc

SEQ ID NO: 248641 - DNA, 25 bp, Mus musculus
atctcggttcgtctaaacggcgtgt

SEQ ID NO: 248642 - DNA, 25 bp, Mus musculus
atctcggttcgtgtaaacggcgtgt

SEQ ID NO: 248643 - DNA, 25 bp, Mus musculus
atctcggttgccatagcttacatta

SEQ ID NO: 248644 - DNA, 25 bp, Mus musculus
atctcggttgccttagcttacatta

SEQ ID NO: 248645 - DNA, 25 bp, Mus musculus
atctcggtttctcccaatagtgagg

SEQ ID NO: 248646 - DNA, 25 bp, Mus musculus
atctcggtttctgccaatagtgagg

SEQ ID NO: 248647 - DNA, 25 bp, Mus musculus
atctcgtaacctagtgatcctactt

SEQ ID NO: 248648 - DNA, 25 bp, Mus musculus
atctcgtaaccttgtgatcctactt

SEQ ID NO: 248649 - DNA, 25 bp, Mus musculus
atctcgtaaggaatgtggcccctaa

SEQ ID NO: 248650 - DNA, 25 bp, Mus musculus
atctcgtaaggattgtggcccctaa

SEQ ID NO: 248651 - DNA, 25 bp, Mus musculus
atctcgtaccccaacttgcttgaga

SEQ ID NO: 248652 - DNA, 25 bp, Mus musculus
atctcgtacccctacttgcttgaga

SEQ ID NO: 248653 - DNA, 25 bp, Mus musculus
atctcgtacgtcagttcttggcata

SEQ ID NO: 248654 - DNA, 25 bp, Mus musculus
atctcgtacgtctgttcttggcata

SEQ ID NO: 248655 - DNA, 25 bp, Mus musculus
atctcgtcctggagaaagcggctgc

SEQ ID NO: 248656 - DNA, 25 bp, Mus musculus
atctcgtcctggtgaaagcggctgc

SEQ ID NO: 248657 - DNA, 25 bp, Mus musculus
atctcgtctagtattatgtaggttc

SEQ ID NO: 248658 - DNA, 25 bp, Mus musculus
atctcgtctagttttatgtaggttc

SEQ ID NO: 248659 - DNA, 25 bp, Mus musculus
atctcgtctttaactgctaaaagta

SEQ ID NO: 248660 - DNA, 25 bp, Mus musculus
atctcgtctttatctgctaaaagta

SEQ ID NO: 248661 - DNA, 25 bp, Mus musculus
atctcgtgaccaaaacccttagaag

SEQ ID NO: 248662 - DNA, 25 bp, Mus musculus
atctcgtgaccataacccttagaag

SEQ ID NO: 248663 - DNA, 25 bp, Mus musculus
atctcgttaggcatatggtcagtga

SEQ ID NO: 248664 - DNA, 25 bp, Mus musculus
atctcgttaggcttatggtcagtga

SEQ ID NO: 248665 - DNA, 25 bp, Mus musculus
atctcgttatgtatgctactggtta

SEQ ID NO: 248666 - DNA, 25 bp, Mus musculus
atctcgttatgtttgctactggtta

SEQ ID NO: 248667 - DNA, 25 bp, Mus musculus
atctcgttcacacacgcagaagagg

SEQ ID NO: 248668 - DNA, 25 bp, Mus musculus
atctcgttcacagacgcagaagagg

SEQ ID NO: 248669 - DNA, 25 bp, Mus musculus
atctcgtttattcttgtactttcct

SEQ ID NO: 248670 - DNA, 25 bp, Mus musculus
atctcgtttattgttgtactttcct

SEQ ID NO: 248671 - DNA, 25 bp, Mus musculus
atctcgtttgacactctagtggttt

SEQ ID NO: 248672 - DNA, 25 bp, Mus musculus
atctcgtttgactctctagtggttt

SEQ ID NO: 248673 - DNA, 25 bp, Mus musculus
atctcgtttgcccaatgtcactggc

SEQ ID NO: 248674 - DNA, 25 bp, Mus musculus
atctcgtttgccgaatgtcactggc

SEQ ID NO: 248675 - DNA, 25 bp, Mus musculus
atctctaaaccaaaagggtgccact

SEQ ID NO: 248676 - DNA, 25 bp, Mus musculus
atctctaaaccataagggtgccact

SEQ ID NO: 248677 - DNA, 25 bp, Mus musculus
atctctaacctcaatgcagacggga

SEQ ID NO: 248678 - DNA, 25 bp, Mus musculus
atctctaacctctatgcagacggga

SEQ ID NO: 248679 - DNA, 25 bp, Mus musculus
atctctaactctaaagctactcacc

SEQ ID NO: 248680 - DNA, 25 bp, Mus musculus
atctctaactctcattaaccccaat

SEQ ID NO: 248681 - DNA, 25 bp, Mus musculus
atctctaactctgattaaccccaat

SEQ ID NO: 248682 - DNA, 25 bp, Mus musculus
atctctaactcttaagctactcacc

SEQ ID NO: 248683 - DNA, 25 bp, Mus musculus
atctctaagacacatgctgacccca

SEQ ID NO: 248684 - DNA, 25 bp, Mus musculus
atctctaagacagatgctgacccca

SEQ ID NO: 248685 - DNA, 25 bp, Mus musculus
atctctaagcctccgatgagttgag

SEQ ID NO: 248686 - DNA, 25 bp, Mus musculus
atctctaagcctgcgatgagttgag

SEQ ID NO: 248687 - DNA, 25 bp, Mus musculus
atctctaattatagctgtttaactg

SEQ ID NO: 248688 - DNA, 25 bp, Mus musculus
atctctaattattgctgtttaactg

SEQ ID NO: 248689 - DNA, 25 bp, Mus musculus
atctctaattgtactgtacatcaca

SEQ ID NO: 248690 - DNA, 25 bp, Mus musculus
atctctaattgttctgtacatcaca

SEQ ID NO: 248691 - DNA, 25 bp, Mus musculus
atctctacagaccttccccattttt

SEQ ID NO: 248692 - DNA, 25 bp, Mus musculus
atctctacagacgttccccattttt

SEQ ID NO: 248693 - DNA, 25 bp, Mus musculus
atctctacagtaaaatctctcctct

SEQ ID NO: 248694 - DNA, 25 bp, Mus musculus
atctctacagtataatctctcctct

SEQ ID NO: 248695 - DNA, 25 bp, Mus musculus
atctctacatccatcagcgagtcca

SEQ ID NO: 248696 - DNA, 25 bp, Mus musculus
atctctacatccttcagcgagtcca

SEQ ID NO: 248697 - DNA, 25 bp, Mus musculus
atctctacccatctccttcattttt

SEQ ID NO: 248698 - DNA, 25 bp, Mus musculus
atctctacccatctgatgccattag

SEQ ID NO: 248699 - DNA, 25 bp, Mus musculus
atctctacccatgtccttcattttt

SEQ ID NO: 248700 - DNA, 25 bp, Mus musculus
atctctacccatgtgatgccattag

SEQ ID NO: 248701 - DNA, 25 bp, Mus musculus
atctctaccctgctgtcagtcagat

SEQ ID NO: 248702 - DNA, 25 bp, Mus musculus
atctctaccctggtgtcagtcagat

SEQ ID NO: 248703 - DNA, 25 bp, Mus musculus
atctctacccttcatgattgttggc

SEQ ID NO: 248704 - DNA, 25 bp, Mus musculus
atctctacccttgatgattgttggc

SEQ ID NO: 248705 - DNA, 25 bp, Mus musculus
atctctacctcgaggagcctttgcc

SEQ ID NO: 248706 - DNA, 25 bp, Mus musculus
atctctacctcgtggagcctttgcc

SEQ ID NO: 248707 - DNA, 25 bp, Mus musculus
atctctacctggcacaaggtgatac

SEQ ID NO: 248708 - DNA, 25 bp, Mus musculus
atctctacctgggacaaggtgatac

SEQ ID NO: 248709 - DNA, 25 bp, Mus musculus
atctctacgaggctaatcaatcaac

SEQ ID NO: 248710 - DNA, 25 bp, Mus musculus
atctctacgagggtaatcaatcaac

SEQ ID NO: 248711 - DNA, 25 bp, Mus musculus
atctctactagccacactgaatgta

SEQ ID NO: 248712 - DNA, 25 bp, Mus musculus
atctctactagcgacactgaatgta

SEQ ID NO: 248713 - DNA, 25 bp, Mus musculus
atctctactatactatcttctctca

SEQ ID NO: 248714 - DNA, 25 bp, Mus musculus
atctctactatagtatcttctctca

SEQ ID NO: 248715 - DNA, 25 bp, Mus musculus
atctctactgtgaagtccatttttc

SEQ ID NO: 248716 - DNA, 25 bp, Mus musculus
atctctactgtgcaacatcctttta

SEQ ID NO: 248717 - DNA, 25 bp, Mus musculus
atctctactgtggaacatcctttta

SEQ ID NO: 248718 - DNA, 25 bp, Mus musculus
atctctactgtgtagtccatttttc

SEQ ID NO: 248719 - DNA, 25 bp, Mus musculus
atctctactgttagtgtgccagtgg

SEQ ID NO: 248720 - DNA, 25 bp, Mus musculus
atctctactgtttgtgtgccagtgg

SEQ ID NO: 248721 - DNA, 25 bp, Mus musculus
atctctagagcaacacgcacacaca

SEQ ID NO: 248722 - DNA, 25 bp, Mus musculus
atctctagagcatcacgcacacaca

SEQ ID NO: 248723 - DNA, 25 bp, Mus musculus
atctctagctgaaagaccgcatgta

SEQ ID NO: 248724 - DNA, 25 bp, Mus musculus
atctctagctgatagaccgcatgta

SEQ ID NO: 248725 - DNA, 25 bp, Mus musculus
atctctagctgtatctggattaggt

SEQ ID NO: 248726 - DNA, 25 bp, Mus musculus
atctctagctgtttctggattaggt

SEQ ID NO: 248727 - DNA, 25 bp, Mus musculus
atctctaggataatgccttctccag

SEQ ID NO: 248728 - DNA, 25 bp, Mus musculus
atctctaggatattgccttctccag

SEQ ID NO: 248729 - DNA, 25 bp, Mus musculus
atctctagggatcgttcttacccat

SEQ ID NO: 248730 - DNA, 25 bp, Mus musculus
atctctagggatggttcttacccat

SEQ ID NO: 248731 - DNA, 25 bp, Mus musculus
atctctagtcacagggtatgttcag

SEQ ID NO: 248732 - DNA, 25 bp, Mus musculus
atctctagtcacctttctggtgtca

SEQ ID NO: 248733 - DNA, 25 bp, Mus musculus
atctctagtcacgtttctggtgtca

SEQ ID NO: 248734 - DNA, 25 bp, Mus musculus
atctctagtcactgggtatgttcag

SEQ ID NO: 248735 - DNA, 25 bp, Mus musculus
atctctagtctgaagcaactgctta

SEQ ID NO: 248736 - DNA, 25 bp, Mus musculus
atctctagtctgaggtttttctccc

SEQ ID NO: 248737 - DNA, 25 bp, Mus musculus
atctctagtctgtagcaactgctta

SEQ ID NO: 248738 - DNA, 25 bp, Mus musculus
atctctagtctgtggtttttctccc

SEQ ID NO: 248739 - DNA, 25 bp, Mus musculus
atctctagttggcaagttaaggcag

SEQ ID NO: 248740 - DNA, 25 bp, Mus musculus
atctctagttgggaagttaaggcag

SEQ ID NO: 248741 - DNA, 25 bp, Mus musculus
atctctagttttactcctctggagc

SEQ ID NO: 248742 - DNA, 25 bp, Mus musculus
atctctagtttttctcctctggagc

SEQ ID NO: 248743 - DNA, 25 bp, Mus musculus
atctctatacatatacctatcccta

SEQ ID NO: 248744 - DNA, 25 bp, Mus musculus
atctctatacatttacctatcccta

SEQ ID NO: 248745 - DNA, 25 bp, Mus musculus
atctctatacctctctgggatatcc

SEQ ID NO: 248746 - DNA, 25 bp, Mus musculus
atctctatacctgtctgggatatcc

SEQ ID NO: 248747 - DNA, 25 bp, Mus musculus
atctctatagatcaagtgtcccaat

SEQ ID NO: 248748 - DNA, 25 bp, Mus musculus
atctctatagatgaagtgtcccaat

SEQ ID NO: 248749 - DNA, 25 bp, Mus musculus
atctctatatttatgggcagctttc

SEQ ID NO: 248750 - DNA, 25 bp, Mus musculus
atctctatatttttgggcagctttc

SEQ ID NO: 248751 - DNA, 25 bp, Mus musculus
atctctatcaggaatactgcctcag

SEQ ID NO: 248752 - DNA, 25 bp, Mus musculus
atctctatcaggtatactgcctcag

SEQ ID NO: 248753 - DNA, 25 bp, Mus musculus
atctctatccatcaagtagcgtcct

SEQ ID NO: 248754 - DNA, 25 bp, Mus musculus
atctctatccatgaagtagcgtcct

SEQ ID NO: 248755 - DNA, 25 bp, Mus musculus
atctctatcctcaggtaaccggttg

SEQ ID NO: 248756 - DNA, 25 bp, Mus musculus
atctctatcctctggtaaccggttg

SEQ ID NO: 248757 - DNA, 25 bp, Mus musculus
atctctatcctgactcaggtgctga

SEQ ID NO: 248758 - DNA, 25 bp, Mus musculus
atctctatcctgtctcaggtgctga

SEQ ID NO: 248759 - DNA, 25 bp, Mus musculus
atctctatcgagatcctggttatgg

SEQ ID NO: 248760 - DNA, 25 bp, Mus musculus
atctctatcgagttcctggttatgg

SEQ ID NO: 248761 - DNA, 25 bp, Mus musculus
atctctatctagactggatctcagc

SEQ ID NO: 248762 - DNA, 25 bp, Mus musculus
atctctatctagtctggatctcagc

SEQ ID NO: 248763 - DNA, 25 bp, Mus musculus
atctctatctccaggcacaacaaat

SEQ ID NO: 248764 - DNA, 25 bp, Mus musculus
atctctatctcctggcacaacaaat

SEQ ID NO: 248765 - DNA, 25 bp, Mus musculus
atctctatgatgcagtccagacttg

SEQ ID NO: 248766 - DNA, 25 bp, Mus musculus
atctctatgatggagtccagacttg

SEQ ID NO: 248767 - DNA, 25 bp, Mus musculus
atctctatgctgctaatctctgcca

SEQ ID NO: 248768 - DNA, 25 bp, Mus musculus
atctctatgctggtaatctctgcca

SEQ ID NO: 248769 - DNA, 25 bp, Mus musculus
atctctattactattctgctctcta

SEQ ID NO: 248770 - DNA, 25 bp, Mus musculus
atctctattacttttctgctctcta

SEQ ID NO: 248771 - DNA, 25 bp, Mus musculus
atctctattcatatcctctagcgta

SEQ ID NO: 248772 - DNA, 25 bp, Mus musculus
atctctattcatttcctctagcgta

SEQ ID NO: 248773 - DNA, 25 bp, Mus musculus
atctctattcgaccctgaccctttt

SEQ ID NO: 248774 - DNA, 25 bp, Mus musculus
atctctattcgagcctgaccctttt

SEQ ID NO: 248775 - DNA, 25 bp, Mus musculus
atctctcaaagcatgtttccttctc

SEQ ID NO: 248776 - DNA, 25 bp, Mus musculus
atctctcaaagcttgtttccttctc

SEQ ID NO: 248777 - DNA, 25 bp, Mus musculus
atctctcaaataactccgtctgcag

SEQ ID NO: 248778 - DNA, 25 bp, Mus musculus
atctctcaaatatctccgtctgcag

SEQ ID NO: 248779 - DNA, 25 bp, Mus musculus
atctctcaagcacccaaggaacaac

SEQ ID NO: 248780 - DNA, 25 bp, Mus musculus
atctctcaagcagccaaggaacaac

SEQ ID NO: 248781 - DNA, 25 bp, Mus musculus
atctctcaagttcctatttgtactt

SEQ ID NO: 248782 - DNA, 25 bp, Mus musculus
atctctcaagttcctgctaaacagg

SEQ ID NO: 248783 - DNA, 25 bp, Mus musculus
atctctcaagttgctatttgtactt

SEQ ID NO: 248784 - DNA, 25 bp, Mus musculus
atctctcaagttgctgctaaacagg

SEQ ID NO: 248785 - DNA, 25 bp, Mus musculus
atctctcaccccaagtgaaatacct

SEQ ID NO: 248786 - DNA, 25 bp, Mus musculus
atctctcacccctagtgaaatacct

SEQ ID NO: 248787 - DNA, 25 bp, Mus musculus
atctctcacctccttttgttttgac

SEQ ID NO: 248788 - DNA, 25 bp, Mus musculus
atctctcacctcgttttgttttgac

SEQ ID NO: 248789 - DNA, 25 bp, Mus musculus
atctctcacctgctctcaaagaaaa

SEQ ID NO: 248790 - DNA, 25 bp, Mus musculus
atctctcacctggtctcaaagaaaa

SEQ ID NO: 248791 - DNA, 25 bp, Mus musculus
atctctcaccttacctgtggtggtt

SEQ ID NO: 248792 - DNA, 25 bp, Mus musculus
atctctcacctttcctgtggtggtt

SEQ ID NO: 248793 - DNA, 25 bp, Mus musculus
atctctcactctcgatgcatatcta

SEQ ID NO: 248794 - DNA, 25 bp, Mus musculus
atctctcactctggatgcatatcta

SEQ ID NO: 248795 - DNA, 25 bp, Mus musculus
atctctcagaacacttgtctgtgaa

SEQ ID NO: 248796 - DNA, 25 bp, Mus musculus
atctctcagaactcttgtctgtgaa

SEQ ID NO: 248797 - DNA, 25 bp, Mus musculus
atctctcagagaacagtgcaaccag

SEQ ID NO: 248798 - DNA, 25 bp, Mus musculus
atctctcagagatcagtgcaaccag

SEQ ID NO: 248799 - DNA, 25 bp, Mus musculus
atctctcagatgagaacctgctcat

SEQ ID NO: 248800 - DNA, 25 bp, Mus musculus
atctctcagatgtgaacctgctcat

SEQ ID NO: 248801 - DNA, 25 bp, Mus musculus
atctctcagattcccagttaaggcc

SEQ ID NO: 248802 - DNA, 25 bp, Mus musculus
atctctcagattgccagttaaggcc

SEQ ID NO: 248803 - DNA, 25 bp, Mus musculus
atctctcagcctccgcggatagtga

SEQ ID NO: 248804 - DNA, 25 bp, Mus musculus
atctctcagcctgcgcggatagtga

SEQ ID NO: 248805 - DNA, 25 bp, Mus musculus
atctctcagcgactctgcaacaatt

SEQ ID NO: 248806 - DNA, 25 bp, Mus musculus
atctctcagcgagtctgcaacaatt

SEQ ID NO: 248807 - DNA, 25 bp, Mus musculus
atctctcagcgcatgacggtcatag

SEQ ID NO: 248808 - DNA, 25 bp, Mus musculus
atctctcagcgcttgacggtcatag

SEQ ID NO: 248809 - DNA, 25 bp, Mus musculus
atctctcataaaatgtgttctgtgc

SEQ ID NO: 248810 - DNA, 25 bp, Mus musculus
atctctcataaattgtgttctgtgc

SEQ ID NO: 248811 - DNA, 25 bp, Mus musculus
atctctcatgagactggcgaacact

SEQ ID NO: 248812 - DNA, 25 bp, Mus musculus
atctctcatgagtctggcgaacact

SEQ ID NO: 248813 - DNA, 25 bp, Mus musculus
atctctcatggcctcagctgaggca

SEQ ID NO: 248814 - DNA, 25 bp, Mus musculus
atctctcatggcgtcagctgaggca

SEQ ID NO: 248815 - DNA, 25 bp, Mus musculus
atctctcatttaccctgtgcatcat

SEQ ID NO: 248816 - DNA, 25 bp, Mus musculus
atctctcatttagcctgtgcatcat

SEQ ID NO: 248817 - DNA, 25 bp, Mus musculus
atctctccaaccactcaaaataagc

SEQ ID NO: 248818 - DNA, 25 bp, Mus musculus
atctctccaacctctcaaaataagc

SEQ ID NO: 248819 - DNA, 25 bp, Mus musculus
atctctccaagtctttgctgttttt

SEQ ID NO: 248820 - DNA, 25 bp, Mus musculus
atctctccaagtgtttgctgttttt

SEQ ID NO: 248821 - DNA, 25 bp, Mus musculus
atctctccagacactgctccttcac

SEQ ID NO: 248822 - DNA, 25 bp, Mus musculus
atctctccagactctgctccttcac

SEQ ID NO: 248823 - DNA, 25 bp, Mus musculus
atctctcccaaacggtgatagagga

SEQ ID NO: 248824 - DNA, 25 bp, Mus musculus
atctctcccaaagggtgatagagga

SEQ ID NO: 248825 - DNA, 25 bp, Mus musculus
atctctcccagaagccgagtgctga

SEQ ID NO: 248826 - DNA, 25 bp, Mus musculus
atctctcccagatgccgagtgctga

SEQ ID NO: 248827 - DNA, 25 bp, Mus musculus
atctctcccagcatcatatggtatt

SEQ ID NO: 248828 - DNA, 25 bp, Mus musculus
atctctcccagcttcatatggtatt

SEQ ID NO: 248829 - DNA, 25 bp, Mus musculus
atctctcccattaggctttgcaatc

SEQ ID NO: 248830 - DNA, 25 bp, Mus musculus
atctctcccatttggctttgcaatc

SEQ ID NO: 248831 - DNA, 25 bp, Mus musculus
atctctccccagagcaacgtggact

SEQ ID NO: 248832 - DNA, 25 bp, Mus musculus
atctctccccagtgcaacgtggact

SEQ ID NO: 248833 - DNA, 25 bp, Mus musculus
atctctccctctcgacagggtgtct

SEQ ID NO: 248834 - DNA, 25 bp, Mus musculus
atctctccctctggacagggtgtct

SEQ ID NO: 248835 - DNA, 25 bp, Mus musculus
atctctccggcacacctttgctaat

SEQ ID NO: 248836 - DNA, 25 bp, Mus musculus
atctctccggcagacctttgctaat

SEQ ID NO: 248837 - DNA, 25 bp, Mus musculus
atctctccgttcaatccatcggact

SEQ ID NO: 248838 - DNA, 25 bp, Mus musculus
atctctccgttctatccatcggact

SEQ ID NO: 248839 - DNA, 25 bp, Mus musculus
atctctcctagtatctgtccgataa

SEQ ID NO: 248840 - DNA, 25 bp, Mus musculus
atctctcctagtttctgtccgataa

SEQ ID NO: 248841 - DNA, 25 bp, Mus musculus
atctctcctcttcgtggaggccctg

SEQ ID NO: 248842 - DNA, 25 bp, Mus musculus
atctctcctcttggtggaggccctg

SEQ ID NO: 248843 - DNA, 25 bp, Mus musculus
atctctcctggaccatgtcaatgac

SEQ ID NO: 248844 - DNA, 25 bp, Mus musculus
atctctcctggagcatgtcaatgac

SEQ ID NO: 248845 - DNA, 25 bp, Mus musculus
atctctcctggcactggctctgatt

SEQ ID NO: 248846 - DNA, 25 bp, Mus musculus
atctctcctggctctggctctgatt

SEQ ID NO: 248847 - DNA, 25 bp, Mus musculus
atctctccttcccttgttatgaatt

SEQ ID NO: 248848 - DNA, 25 bp, Mus musculus
atctctccttccgttgttatgaatt

SEQ ID NO: 248849 - DNA, 25 bp, Mus musculus
atctctccttgtatctggctgatgt

SEQ ID NO: 248850 - DNA, 25 bp, Mus musculus
atctctccttgtttctggctgatgt

SEQ ID NO: 248851 - DNA, 25 bp, Mus musculus
atctctcctttgagagtcaggtgtt

SEQ ID NO: 248852 - DNA, 25 bp, Mus musculus
atctctcctttgagatcagtgtttc

SEQ ID NO: 248853 - DNA, 25 bp, Mus musculus
atctctcctttgtgagtcaggtgtt

SEQ ID NO: 248854 - DNA, 25 bp, Mus musculus
atctctcctttgtgatcagtgtttc

SEQ ID NO: 248855 - DNA, 25 bp, Mus musculus
atctctccttttcctatttggattt

SEQ ID NO: 248856 - DNA, 25 bp, Mus musculus
atctctccttttgctatttggattt

SEQ ID NO: 248857 - DNA, 25 bp, Mus musculus
atctctcgagtcatcgccagaggga

SEQ ID NO: 248858 - DNA, 25 bp, Mus musculus
atctctcgagtcttcgccagaggga

SEQ ID NO: 248859 - DNA, 25 bp, Mus musculus
atctctcggaacatacttacgcagt

SEQ ID NO: 248860 - DNA, 25 bp, Mus musculus
atctctcggaacttacttacgcagt

SEQ ID NO: 248861 - DNA, 25 bp, Mus musculus
atctctcggtgcatcacccggaaat

SEQ ID NO: 248862 - DNA, 25 bp, Mus musculus
atctctcggtgcttcacccggaaat

SEQ ID NO: 248863 - DNA, 25 bp, Mus musculus
atctctctaaccctgacatttaatg

SEQ ID NO: 248864 - DNA, 25 bp, Mus musculus
atctctctaaccgtgacatttaatg

SEQ ID NO: 248865 - DNA, 25 bp, Mus musculus
atctctctaagtctctatggcaccc

SEQ ID NO: 248866 - DNA, 25 bp, Mus musculus
atctctctaagtgtctatggcaccc

SEQ ID NO: 248867 - DNA, 25 bp, Mus musculus
atctctctacctcttctgaaacaac

SEQ ID NO: 248868 - DNA, 25 bp, Mus musculus
atctctctacctgttctgaaacaac

SEQ ID NO: 248869 - DNA, 25 bp, Mus musculus
atctctctagacattactctcgagg

SEQ ID NO: 248870 - DNA, 25 bp, Mus musculus
atctctctagactttactctcgagg

SEQ ID NO: 248871 - DNA, 25 bp, Mus musculus
atctctctagcccataagcccatat

SEQ ID NO: 248872 - DNA, 25 bp, Mus musculus
atctctctagccgataagcccatat

SEQ ID NO: 248873 - DNA, 25 bp, Mus musculus
atctctctatccctctaatacataa

SEQ ID NO: 248874 - DNA, 25 bp, Mus musculus
atctctctatccgtctaatacataa

SEQ ID NO: 248875 - DNA, 25 bp, Mus musculus
atctctctcaggaggtgagtcagga

SEQ ID NO: 248876 - DNA, 25 bp, Mus musculus
atctctctcaggtggtgagtcagga

SEQ ID NO: 248877 - DNA, 25 bp, Mus musculus
atctctctcataatctgtctggcgg

SEQ ID NO: 248878 - DNA, 25 bp, Mus musculus
atctctctcatattctgtctggcgg

SEQ ID NO: 248879 - DNA, 25 bp, Mus musculus
atctctctcctacacatgcatgtgg

SEQ ID NO: 248880 - DNA, 25 bp, Mus musculus
atctctctcctagacatgcatgtgg

SEQ ID NO: 248881 - DNA, 25 bp, Mus musculus
atctctctctgcagagtcaggctca

SEQ ID NO: 248882 - DNA, 25 bp, Mus musculus
atctctctctgctgagtcaggctca

SEQ ID NO: 248883 - DNA, 25 bp, Mus musculus
atctctctgatgcataccagtggca

SEQ ID NO: 248884 - DNA, 25 bp, Mus musculus
atctctctgatggataccagtggca

SEQ ID NO: 248885 - DNA, 25 bp, Mus musculus
atctctctgcacaggtagtcttggg

SEQ ID NO: 248886 - DNA, 25 bp, Mus musculus
atctctctgcactggtagtcttggg

SEQ ID NO: 248887 - DNA, 25 bp, Mus musculus
atctctctggcaccaacatttgatg

SEQ ID NO: 248888 - DNA, 25 bp, Mus musculus
atctctctggcaccactaaggacag

SEQ ID NO: 248889 - DNA, 25 bp, Mus musculus
atctctctggcagcaacatttgatg

SEQ ID NO: 248890 - DNA, 25 bp, Mus musculus
atctctctggcagcactaaggacag

SEQ ID NO: 248891 - DNA, 25 bp, Mus musculus
atctctctgggaaagttgttcgtgt

SEQ ID NO: 248892 - DNA, 25 bp, Mus musculus
atctctctgggatagttgttcgtgt

SEQ ID NO: 248893 - DNA, 25 bp, Mus musculus
atctctctgggcactaggatctaaa

SEQ ID NO: 248894 - DNA, 25 bp, Mus musculus
atctctctgggctctaggatctaaa

SEQ ID NO: 248895 - DNA, 25 bp, Mus musculus
atctctctggtcacaatgcaatcat

SEQ ID NO: 248896 - DNA, 25 bp, Mus musculus
atctctctggtctcaatgcaatcat

SEQ ID NO: 248897 - DNA, 25 bp, Mus musculus
atctctctgtagaatatgccagtgg

SEQ ID NO: 248898 - DNA, 25 bp, Mus musculus
atctctctgtagtatatgccagtgg

SEQ ID NO: 248899 - DNA, 25 bp, Mus musculus
atctctctgttacacacttggagga

SEQ ID NO: 248900 - DNA, 25 bp, Mus musculus
atctctctgttagacacttggagga

SEQ ID NO: 248901 - DNA, 25 bp, Mus musculus
atctctcttagtacctttcatttct

SEQ ID NO: 248902 - DNA, 25 bp, Mus musculus
atctctcttagttcctttcatttct

SEQ ID NO: 248903 - DNA, 25 bp, Mus musculus
atctctcttctgacaggcactgaac

SEQ ID NO: 248904 - DNA, 25 bp, Mus musculus
atctctcttctgctctttattcttt

SEQ ID NO: 248905 - DNA, 25 bp, Mus musculus
atctctcttctggtctttattcttt

SEQ ID NO: 248906 - DNA, 25 bp, Mus musculus
atctctcttctgtcaggcactgaac

SEQ ID NO: 248907 - DNA, 25 bp, Mus musculus
atctctcttgacaatgttcctgtgc

SEQ ID NO: 248908 - DNA, 25 bp, Mus musculus
atctctcttgactatgttcctgtgc

SEQ ID NO: 248909 - DNA, 25 bp, Mus musculus
atctctcttgagcttcagggtaggt

SEQ ID NO: 248910 - DNA, 25 bp, Mus musculus
atctctcttgaggttcagggtaggt

SEQ ID NO: 248911 - DNA, 25 bp, Mus musculus
atctctcttgcaaccaacctagaat

SEQ ID NO: 248912 - DNA, 25 bp, Mus musculus
atctctcttgcaattttgtgactct

SEQ ID NO: 248913 - DNA, 25 bp, Mus musculus
atctctcttgcatccaacctagaat

SEQ ID NO: 248914 - DNA, 25 bp, Mus musculus
atctctcttgcatttttgtgactct

SEQ ID NO: 248915 - DNA, 25 bp, Mus musculus
atctctcttgcgaatattggactaa

SEQ ID NO: 248916 - DNA, 25 bp, Mus musculus
atctctcttgcgtatattggactaa

SEQ ID NO: 248917 - DNA, 25 bp, Mus musculus
atctctcttgctattagttaattca

SEQ ID NO: 248918 - DNA, 25 bp, Mus musculus
atctctcttgctcggcgggcgatca

SEQ ID NO: 248919 - DNA, 25 bp, Mus musculus
atctctcttgctgggcgggcgatca

SEQ ID NO: 248920 - DNA, 25 bp, Mus musculus
atctctcttgcttttagttaattca

SEQ ID NO: 248921 - DNA, 25 bp, Mus musculus
atctctcttgttcataccaggctca

SEQ ID NO: 248922 - DNA, 25 bp, Mus musculus
atctctcttgttgataccaggctca

SEQ ID NO: 248923 - DNA, 25 bp, Mus musculus
atctctctttgtaccccatggaatg

SEQ ID NO: 248924 - DNA, 25 bp, Mus musculus
atctctctttgttccccatggaatg

SEQ ID NO: 248925 - DNA, 25 bp, Mus musculus
atctctcttttcagccataggtggc

SEQ ID NO: 248926 - DNA, 25 bp, Mus musculus
atctctcttttctgccataggtggc

SEQ ID NO: 248927 - DNA, 25 bp, Mus musculus
atctctctttttcggatggctggga

SEQ ID NO: 248928 - DNA, 25 bp, Mus musculus
atctctctttttgggatggctggga

SEQ ID NO: 248929 - DNA, 25 bp, Mus musculus
atctctgaaaaactccttgtatagg

SEQ ID NO: 248930 - DNA, 25 bp, Mus musculus
atctctgaaaaagtccttgtatagg

SEQ ID NO: 248931 - DNA, 25 bp, Mus musculus
atctctgaaacgctggtggcactgc

SEQ ID NO: 248932 - DNA, 25 bp, Mus musculus
atctctgaaacggtggtggcactgc

SEQ ID NO: 248933 - DNA, 25 bp, Mus musculus
atctctgaaatccaggctagtctag

SEQ ID NO: 248934 - DNA, 25 bp, Mus musculus
atctctgaaatcgaggctagtctag

SEQ ID NO: 248935 - DNA, 25 bp, Mus musculus
atctctgaaccccaggagtctgagg

SEQ ID NO: 248936 - DNA, 25 bp, Mus musculus
atctctgaacccgaggagtctgagg

SEQ ID NO: 248937 - DNA, 25 bp, Mus musculus
atctctgaagtcatctaaaccctcc

SEQ ID NO: 248938 - DNA, 25 bp, Mus musculus
atctctgaagtcttctaaaccctcc

SEQ ID NO: 248939 - DNA, 25 bp, Mus musculus
atctctgaatgaattcggctgcgtt

SEQ ID NO: 248940 - DNA, 25 bp, Mus musculus
atctctgaatgatttcggctgcgtt

SEQ ID NO: 248941 - DNA, 25 bp, Mus musculus
atctctgacaaaacgggaaggctat

SEQ ID NO: 248942 - DNA, 25 bp, Mus musculus
atctctgacaaatcgggaaggctat

SEQ ID NO: 248943 - DNA, 25 bp, Mus musculus
atctctgacaggctcatgtgtgggt

SEQ ID NO: 248944 - DNA, 25 bp, Mus musculus
atctctgacagggtcatgtgtgggt

SEQ ID NO: 248945 - DNA, 25 bp, Mus musculus
atctctgacattaccctgaagcaag

SEQ ID NO: 248946 - DNA, 25 bp, Mus musculus
atctctgacatttccctgaagcaag

SEQ ID NO: 248947 - DNA, 25 bp, Mus musculus
atctctgaccaacgcaggcagtatt

SEQ ID NO: 248948 - DNA, 25 bp, Mus musculus
atctctgaccaaggcaggcagtatt

SEQ ID NO: 248949 - DNA, 25 bp, Mus musculus
atctctgaccagagtggaacttgtc

SEQ ID NO: 248950 - DNA, 25 bp, Mus musculus
atctctgaccagtgtggaacttgtc

SEQ ID NO: 248951 - DNA, 25 bp, Mus musculus
atctctgacgcaaccttcctgtcgg

SEQ ID NO: 248952 - DNA, 25 bp, Mus musculus
atctctgacgcatccttcctgtcgg

SEQ ID NO: 248953 - DNA, 25 bp, Mus musculus
atctctgactcacgcttatagctca

SEQ ID NO: 248954 - DNA, 25 bp, Mus musculus
atctctgactcaggcttatagctca

SEQ ID NO: 248955 - DNA, 25 bp, Mus musculus
atctctgactccatcacgcaaggac

SEQ ID NO: 248956 - DNA, 25 bp, Mus musculus
atctctgactccttcacgcaaggac

SEQ ID NO: 248957 - DNA, 25 bp, Mus musculus
atctctgacttcatgacatctgttg

SEQ ID NO: 248958 - DNA, 25 bp, Mus musculus
atctctgacttcttgacatctgttg

SEQ ID NO: 248959 - DNA, 25 bp, Mus musculus
atctctgagacaccttcaaggctgc

SEQ ID NO: 248960 - DNA, 25 bp, Mus musculus
atctctgagacagcttcaaggctgc

SEQ ID NO: 248961 - DNA, 25 bp, Mus musculus
atctctgagaggaataccctcccta

SEQ ID NO: 248962 - DNA, 25 bp, Mus musculus
atctctgagaggtataccctcccta

SEQ ID NO: 248963 - DNA, 25 bp, Mus musculus
atctctgagataaccccattagtcc

SEQ ID NO: 248964 - DNA, 25 bp, Mus musculus
atctctgagatatccccattagtcc

SEQ ID NO: 248965 - DNA, 25 bp, Mus musculus
atctctgagcatcctaaaacactgt

SEQ ID NO: 248966 - DNA, 25 bp, Mus musculus
atctctgagcatgctaaaacactgt

SEQ ID NO: 248967 - DNA, 25 bp, Mus musculus
atctctgagcccattgtcttaccta

SEQ ID NO: 248968 - DNA, 25 bp, Mus musculus
atctctgagccctttgtcttaccta

SEQ ID NO: 248969 - DNA, 25 bp, Mus musculus
atctctgagtggattcttcctttca

SEQ ID NO: 248970 - DNA, 25 bp, Mus musculus
atctctgagtggtttcttcctttca

SEQ ID NO: 248971 - DNA, 25 bp, Mus musculus
atctctgatggaaacatggtcacaa

SEQ ID NO: 248972 - DNA, 25 bp, Mus musculus
atctctgatggatacatggtcacaa

SEQ ID NO: 248973 - DNA, 25 bp, Mus musculus
atctctgcacagagagcagccggac

SEQ ID NO: 248974 - DNA, 25 bp, Mus musculus
atctctgcacagtgagcagccggac

SEQ ID NO: 248975 - DNA, 25 bp, Mus musculus
atctctgcacgaactcacggagttc

SEQ ID NO: 248976 - DNA, 25 bp, Mus musculus
atctctgcacgatctcacggagttc

SEQ ID NO: 248977 - DNA, 25 bp, Mus musculus
atctctgcactgaaaggtgctgtca

SEQ ID NO: 248978 - DNA, 25 bp, Mus musculus
atctctgcactgtaaggtgctgtca

SEQ ID NO: 248979 - DNA, 25 bp, Mus musculus
atctctgcagaacagctggctgtga

SEQ ID NO: 248980 - DNA, 25 bp, Mus musculus
atctctgcagaagagctggctgtga

SEQ ID NO: 248981 - DNA, 25 bp, Mus musculus
atctctgcagccactgcttaaggag

SEQ ID NO: 248982 - DNA, 25 bp, Mus musculus
atctctgcagcctctgcttaaggag

SEQ ID NO: 248983 - DNA, 25 bp, Mus musculus
atctctgcagctactagttactatt

SEQ ID NO: 248984 - DNA, 25 bp, Mus musculus
atctctgcagcttctagttactatt

SEQ ID NO: 248985 - DNA, 25 bp, Mus musculus
atctctgcaggcaacttctgacgag

SEQ ID NO: 248986 - DNA, 25 bp, Mus musculus
atctctgcaggcagaccgggttggt

SEQ ID NO: 248987 - DNA, 25 bp, Mus musculus
atctctgcaggctacttctgacgag

SEQ ID NO: 248988 - DNA, 25 bp, Mus musculus
atctctgcaggctgaccgggttggt

SEQ ID NO: 248989 - DNA, 25 bp, Mus musculus
atctctgccaatacaggatcctttg

SEQ ID NO: 248990 - DNA, 25 bp, Mus musculus
atctctgccaattcaggatcctttg

SEQ ID NO: 248991 - DNA, 25 bp, Mus musculus
atctctgccactaagttctctgatt

SEQ ID NO: 248992 - DNA, 25 bp, Mus musculus
atctctgccacttagttctctgatt

SEQ ID NO: 248993 - DNA, 25 bp, Mus musculus
atctctgccagtctgttcttactgc

SEQ ID NO: 248994 - DNA, 25 bp, Mus musculus
atctctgccagtgtgttcttactgc

SEQ ID NO: 248995 - DNA, 25 bp, Mus musculus
atctctgccatgaggtgcttgggaa

SEQ ID NO: 248996 - DNA, 25 bp, Mus musculus
atctctgccatgtggtgcttgggaa

SEQ ID NO: 248997 - DNA, 25 bp, Mus musculus
atctctgccattaagttatgcttga

SEQ ID NO: 248998 - DNA, 25 bp, Mus musculus
atctctgccatttagttatgcttga

SEQ ID NO: 248999 - DNA, 25 bp, Mus musculus
atctctgccgaacgaagatggcgca

SEQ ID NO: 249000 - DNA, 25 bp, Mus musculus
atctctgccgaaggaagatggcgca

SEQ ID NO: 249001 - DNA, 25 bp, Mus musculus
atctctgccggtcactcagtgaagc

SEQ ID NO: 249002 - DNA, 25 bp, Mus musculus
atctctgccggtgactcagtgaagc

SEQ ID NO: 249003 - DNA, 25 bp, Mus musculus
atctctgccgtcagggatgtttgac

SEQ ID NO: 249004 - DNA, 25 bp, Mus musculus
atctctgccgtctgggatgtttgac

SEQ ID NO: 249005 - DNA, 25 bp, Mus musculus
atctctgcctacacattaacatgtt

SEQ ID NO: 249006 - DNA, 25 bp, Mus musculus
atctctgcctacatggctgcagcgt

SEQ ID NO: 249007 - DNA, 25 bp, Mus musculus
atctctgcctactcattaacatgtt

SEQ ID NO: 249008 - DNA, 25 bp, Mus musculus
atctctgcctacttggctgcagcgt

SEQ ID NO: 249009 - DNA, 25 bp, Mus musculus
atctctgcctcacttttgtgtatta

SEQ ID NO: 249010 - DNA, 25 bp, Mus musculus
atctctgcctcagttttgtgtatta

SEQ ID NO: 249011 - DNA, 25 bp, Mus musculus
atctctgcggtcaaccgcaaacgga

SEQ ID NO: 249012 - DNA, 25 bp, Mus musculus
atctctgcggtctaccgcaaacgga

SEQ ID NO: 249013 - DNA, 25 bp, Mus musculus
atctctgctagcactgtgagggttg

SEQ ID NO: 249014 - DNA, 25 bp, Mus musculus
atctctgctagctctgtgagggttg

SEQ ID NO: 249015 - DNA, 25 bp, Mus musculus
atctctgctaggacatgtctccact

SEQ ID NO: 249016 - DNA, 25 bp, Mus musculus
atctctgctaggtcatgtctccact

SEQ ID NO: 249017 - DNA, 25 bp, Mus musculus
atctctgctccaaaatgtgtgcaat

SEQ ID NO: 249018 - DNA, 25 bp, Mus musculus
atctctgctccataatgtgtgcaat

SEQ ID NO: 249019 - DNA, 25 bp, Mus musculus
atctctgctccgaggtgcgggtccc

SEQ ID NO: 249020 - DNA, 25 bp, Mus musculus
atctctgctccgtggtgcgggtccc

SEQ ID NO: 249021 - DNA, 25 bp, Mus musculus
atctctgctctcatagtgttgctgc

SEQ ID NO: 249022 - DNA, 25 bp, Mus musculus
atctctgctctcttagtgttgctgc

SEQ ID NO: 249023 - DNA, 25 bp, Mus musculus
atctctgctgcacctatcatctaaa

SEQ ID NO: 249024 - DNA, 25 bp, Mus musculus
atctctgctgcactggatgcttcct

SEQ ID NO: 249025 - DNA, 25 bp, Mus musculus
atctctgctgcagctatcatctaaa

SEQ ID NO: 249026 - DNA, 25 bp, Mus musculus
atctctgctgcagtggatgcttcct

SEQ ID NO: 249027 - DNA, 25 bp, Mus musculus
atctctgctggaatccatgtttccc

SEQ ID NO: 249028 - DNA, 25 bp, Mus musculus
atctctgctggattccatgtttccc

SEQ ID NO: 249029 - DNA, 25 bp, Mus musculus
atctctgcttccaatactgttacac

SEQ ID NO: 249030 - DNA, 25 bp, Mus musculus
atctctgcttcctatactgttacac

SEQ ID NO: 249031 - DNA, 25 bp, Mus musculus
atctctggaaataatgcttttgtca

SEQ ID NO: 249032 - DNA, 25 bp, Mus musculus
atctctggaaattatgcttttgtca

SEQ ID NO: 249033 - DNA, 25 bp, Mus musculus
atctctggagccagaattctgtgaa

SEQ ID NO: 249034 - DNA, 25 bp, Mus musculus
atctctggagcctgaattctgtgaa

SEQ ID NO: 249035 - DNA, 25 bp, Mus musculus
atctctggatctactcaagtgcaga

SEQ ID NO: 249036 - DNA, 25 bp, Mus musculus
atctctggatcttctcaagtgcaga

SEQ ID NO: 249037 - DNA, 25 bp, Mus musculus
atctctggatgtagagtcctggacc

SEQ ID NO: 249038 - DNA, 25 bp, Mus musculus
atctctggatgttgagtcctggacc

SEQ ID NO: 249039 - DNA, 25 bp, Mus musculus
atctctggcccgatttatctgagca

SEQ ID NO: 249040 - DNA, 25 bp, Mus musculus
atctctggcccgttttatctgagca

SEQ ID NO: 249041 - DNA, 25 bp, Mus musculus
atctctggccttcggcttgagtgtc

SEQ ID NO: 249042 - DNA, 25 bp, Mus musculus
atctctggccttgggcttgagtgtc

SEQ ID NO: 249043 - DNA, 25 bp, Mus musculus
atctctggctctcagcatcgtggat

SEQ ID NO: 249044 - DNA, 25 bp, Mus musculus
atctctggctctgagcatcgtggat

SEQ ID NO: 249045 - DNA, 25 bp, Mus musculus
atctctggctgtaagcagtccgtgg

SEQ ID NO: 249046 - DNA, 25 bp, Mus musculus
atctctggctgttagcagtccgtgg

SEQ ID NO: 249047 - DNA, 25 bp, Mus musculus
atctctgggcataacactaagttga

SEQ ID NO: 249048 - DNA, 25 bp, Mus musculus
atctctgggcattacactaagttga

SEQ ID NO: 249049 - DNA, 25 bp, Mus musculus
atctctggggtcagaactcagtggt

SEQ ID NO: 249050 - DNA, 25 bp, Mus musculus
atctctggggtctgaactcagtggt

SEQ ID NO: 249051 - DNA, 25 bp, Mus musculus
atctctgggtatctagtaagttcaa

SEQ ID NO: 249052 - DNA, 25 bp, Mus musculus
atctctgggtatgtagtaagttcaa

SEQ ID NO: 249053 - DNA, 25 bp, Mus musculus
atctctgggtttcctttctcttcat

SEQ ID NO: 249054 - DNA, 25 bp, Mus musculus
atctctgggtttgctttctcttcat

SEQ ID NO: 249055 - DNA, 25 bp, Mus musculus
atctctggtcaactcggagccgagc

SEQ ID NO: 249056 - DNA, 25 bp, Mus musculus
atctctggtcaagtcggagccgagc

SEQ ID NO: 249057 - DNA, 25 bp, Mus musculus
atctctggtccaattttccttgatt

SEQ ID NO: 249058 - DNA, 25 bp, Mus musculus
atctctggtccatttttccttgatt

SEQ ID NO: 249059 - DNA, 25 bp, Mus musculus
atctctggtcctctttgcatcttta

SEQ ID NO: 249060 - DNA, 25 bp, Mus musculus
atctctggtcctgtttgcatcttta

SEQ ID NO: 249061 - DNA, 25 bp, Mus musculus
atctctggtgccagtggtaccgtga

SEQ ID NO: 249062 - DNA, 25 bp, Mus musculus
atctctggtgcctgtggtaccgtga

SEQ ID NO: 249063 - DNA, 25 bp, Mus musculus
atctctggtttcaatgttctgtgga

SEQ ID NO: 249064 - DNA, 25 bp, Mus musculus
atctctggtttcactcagtggttca

SEQ ID NO: 249065 - DNA, 25 bp, Mus musculus
atctctggtttctatgttctgtgga

SEQ ID NO: 249066 - DNA, 25 bp, Mus musculus
atctctggtttctctcagtggttca

SEQ ID NO: 249067 - DNA, 25 bp, Mus musculus
atctctgtaaacagggcagctgccc

SEQ ID NO: 249068 - DNA, 25 bp, Mus musculus
atctctgtaaactgggcagctgccc

SEQ ID NO: 249069 - DNA, 25 bp, Mus musculus
atctctgtaacgaaggactcctggc

SEQ ID NO: 249070 - DNA, 25 bp, Mus musculus
atctctgtaacgtaggactcctggc

SEQ ID NO: 249071 - DNA, 25 bp, Mus musculus
atctctgtaactccttcgagtgagt

SEQ ID NO: 249072 - DNA, 25 bp, Mus musculus
atctctgtaactgcttcgagtgagt

SEQ ID NO: 249073 - DNA, 25 bp, Mus musculus
atctctgtaataagctgccatccga

SEQ ID NO: 249074 - DNA, 25 bp, Mus musculus
atctctgtaatatgctgccatccga

SEQ ID NO: 249075 - DNA, 25 bp, Mus musculus
atctctgtacacaaaggatgctgga

SEQ ID NO: 249076 - DNA, 25 bp, Mus musculus
atctctgtacactaaggatgctgga

SEQ ID NO: 249077 - DNA, 25 bp, Mus musculus
atctctgtacagacttctgtgtgcc

SEQ ID NO: 249078 - DNA, 25 bp, Mus musculus
atctctgtacagagagttttcccct

SEQ ID NO: 249079 - DNA, 25 bp, Mus musculus
atctctgtacagtcttctgtgtgcc

SEQ ID NO: 249080 - DNA, 25 bp, Mus musculus
atctctgtacagtgagttttcccct

SEQ ID NO: 249081 - DNA, 25 bp, Mus musculus
atctctgtagaaactagaggcctgt

SEQ ID NO: 249082 - DNA, 25 bp, Mus musculus
atctctgtagaatctagaggcctgt

SEQ ID NO: 249083 - DNA, 25 bp, Mus musculus
atctctgtagagatctaccacctct

SEQ ID NO: 249084 - DNA, 25 bp, Mus musculus
atctctgtagagttctaccacctct

SEQ ID NO: 249085 - DNA, 25 bp, Mus musculus
atctctgtagatcacctaggttcca

SEQ ID NO: 249086 - DNA, 25 bp, Mus musculus
atctctgtagatgacctaggttcca

SEQ ID NO: 249087 - DNA, 25 bp, Mus musculus
atctctgtatagcacttgctggcaa

SEQ ID NO: 249088 - DNA, 25 bp, Mus musculus
atctctgtataggacttgctggcaa

SEQ ID NO: 249089 - DNA, 25 bp, Mus musculus
atctctgtatttatgctgctttctt

SEQ ID NO: 249090 - DNA, 25 bp, Mus musculus
atctctgtatttctgcgcctagcac

SEQ ID NO: 249091 - DNA, 25 bp, Mus musculus
atctctgtatttgtgcgcctagcac

SEQ ID NO: 249092 - DNA, 25 bp, Mus musculus
atctctgtatttttgctgctttctt

SEQ ID NO: 249093 - DNA, 25 bp, Mus musculus
atctctgtccctcaaagtagaaccc

SEQ ID NO: 249094 - DNA, 25 bp, Mus musculus
atctctgtccctgaaagtagaaccc

SEQ ID NO: 249095 - DNA, 25 bp, Mus musculus
atctctgtcctcaagttaacctaag

SEQ ID NO: 249096 - DNA, 25 bp, Mus musculus
atctctgtcctctagttaacctaag

SEQ ID NO: 249097 - DNA, 25 bp, Mus musculus
atctctgtccttagtaccttggctt

SEQ ID NO: 249098 - DNA, 25 bp, Mus musculus
atctctgtcctttgtaccttggctt

SEQ ID NO: 249099 - DNA, 25 bp, Mus musculus
atctctgtctgcctatggagtgctc

SEQ ID NO: 249100 - DNA, 25 bp, Mus musculus
atctctgtctgcgtatggagtgctc

SEQ ID NO: 249101 - DNA, 25 bp, Mus musculus
atctctgtgaccctatttggcaaaa

SEQ ID NO: 249102 - DNA, 25 bp, Mus musculus
atctctgtgaccgtatttggcaaaa

SEQ ID NO: 249103 - DNA, 25 bp, Mus musculus
atctctgtgcatcctgacatcactt

SEQ ID NO: 249104 - DNA, 25 bp, Mus musculus
atctctgtgcatgctgacatcactt

SEQ ID NO: 249105 - DNA, 25 bp, Mus musculus
atctctgtggatcacaagtacattg

SEQ ID NO: 249106 - DNA, 25 bp, Mus musculus
atctctgtggatgacaagtacattg

SEQ ID NO: 249107 - DNA, 25 bp, Mus musculus
atctctgtggctaactcaactggtt

SEQ ID NO: 249108 - DNA, 25 bp, Mus musculus
atctctgtggcttactcaactggtt

SEQ ID NO: 249109 - DNA, 25 bp, Mus musculus
atctctgtgtccattgattccagca

SEQ ID NO: 249110 - DNA, 25 bp, Mus musculus
atctctgtgtcctttgattccagca

SEQ ID NO: 249111 - DNA, 25 bp, Mus musculus
atctctgtgtgaagaccagtctgcc

SEQ ID NO: 249112 - DNA, 25 bp, Mus musculus
atctctgtgtgatgaccagtctgcc

SEQ ID NO: 249113 - DNA, 25 bp, Mus musculus
atctctgtgtgtaacaggagctctg

SEQ ID NO: 249114 - DNA, 25 bp, Mus musculus
atctctgtgtgtcctcaaatggtcc

SEQ ID NO: 249115 - DNA, 25 bp, Mus musculus
atctctgtgtgtgctcaaatggtcc

SEQ ID NO: 249116 - DNA, 25 bp, Mus musculus
atctctgtgtgttacaggagctctg

SEQ ID NO: 249117 - DNA, 25 bp, Mus musculus
atctctgttagtaatttttccgttg

SEQ ID NO: 249118 - DNA, 25 bp, Mus musculus
atctctgttagttatttttccgttg

SEQ ID NO: 249119 - DNA, 25 bp, Mus musculus
atctctgttccacgatctagggatt

SEQ ID NO: 249120 - DNA, 25 bp, Mus musculus
atctctgttccaggatctagggatt

SEQ ID NO: 249121 - DNA, 25 bp, Mus musculus
atctctgttcctagctggagtcaac

SEQ ID NO: 249122 - DNA, 25 bp, Mus musculus
atctctgttccttgctggagtcaac

SEQ ID NO: 249123 - DNA, 25 bp, Mus musculus
atctctgttcttagtgtatcatgca

SEQ ID NO: 249124 - DNA, 25 bp, Mus musculus
atctctgttctttgtgtatcatgca

SEQ ID NO: 249125 - DNA, 25 bp, Mus musculus
atctctgttgagcaaggatcctgga

SEQ ID NO: 249126 - DNA, 25 bp, Mus musculus
atctctgttgaggaaggatcctgga

SEQ ID NO: 249127 - DNA, 25 bp, Mus musculus
atctctgttgcacttgatgccagcc

SEQ ID NO: 249128 - DNA, 25 bp, Mus musculus
atctctgttgcagttgatgccagcc

SEQ ID NO: 249129 - DNA, 25 bp, Mus musculus
atctctgtttccatcaaatgcatga

SEQ ID NO: 249130 - DNA, 25 bp, Mus musculus
atctctgtttccttcaaatgcatga

SEQ ID NO: 249131 - DNA, 25 bp, Mus musculus
atctcttaaacactgcacgctctct

SEQ ID NO: 249132 - DNA, 25 bp, Mus musculus
atctcttaaacagtgcacgctctct

SEQ ID NO: 249133 - DNA, 25 bp, Mus musculus
atctcttaaaggcattccctgtcac

SEQ ID NO: 249134 - DNA, 25 bp, Mus musculus
atctcttaaagggattccctgtcac

SEQ ID NO: 249135 - DNA, 25 bp, Mus musculus
atctcttaagtgatctttgctgttc

SEQ ID NO: 249136 - DNA, 25 bp, Mus musculus
atctcttaagtgttctttgctgttc

SEQ ID NO: 249137 - DNA, 25 bp, Mus musculus
atctcttaatggatgcccagcaggc

SEQ ID NO: 249138 - DNA, 25 bp, Mus musculus
atctcttaatggttgcccagcaggc

SEQ ID NO: 249139 - DNA, 25 bp, Mus musculus
atctcttactccagctactgtttct

SEQ ID NO: 249140 - DNA, 25 bp, Mus musculus
atctcttactcctgctactgtttct

SEQ ID NO: 249141 - DNA, 25 bp, Mus musculus
atctcttagagaagtcagtaccagt

SEQ ID NO: 249142 - DNA, 25 bp, Mus musculus
atctcttagagatgtcagtaccagt

SEQ ID NO: 249143 - DNA, 25 bp, Mus musculus
atctcttaggataccttccttccag

SEQ ID NO: 249144 - DNA, 25 bp, Mus musculus
atctcttaggattccttccttccag

SEQ ID NO: 249145 - DNA, 25 bp, Mus musculus
atctcttagtggacttttcgttaag

SEQ ID NO: 249146 - DNA, 25 bp, Mus musculus
atctcttagtggtcttttcgttaag

SEQ ID NO: 249147 - DNA, 25 bp, Mus musculus
atctcttatcagacaccttactaaa

SEQ ID NO: 249148 - DNA, 25 bp, Mus musculus
atctcttatcagtcaccttactaaa

SEQ ID NO: 249149 - DNA, 25 bp, Mus musculus
atctcttatgaacaggctcagctcc

SEQ ID NO: 249150 - DNA, 25 bp, Mus musculus
atctcttatgaagaggctcagctcc

SEQ ID NO: 249151 - DNA, 25 bp, Mus musculus
atctcttattccacagttccacaca

SEQ ID NO: 249152 - DNA, 25 bp, Mus musculus
atctcttattcctcagttccacaca

SEQ ID NO: 249153 - DNA, 25 bp, Mus musculus
atctcttcaacccttctatcttcaa

SEQ ID NO: 249154 - DNA, 25 bp, Mus musculus
atctcttcaaccgttctatcttcaa

SEQ ID NO: 249155 - DNA, 25 bp, Mus musculus
atctcttcaacgaaggtttcttcct

SEQ ID NO: 249156 - DNA, 25 bp, Mus musculus
atctcttcaacgtaggtttcttcct

SEQ ID NO: 249157 - DNA, 25 bp, Mus musculus
atctcttcacagaagcctactgtag

SEQ ID NO: 249158 - DNA, 25 bp, Mus musculus
atctcttcacagtagcctactgtag

SEQ ID NO: 249159 - DNA, 25 bp, Mus musculus
atctcttcaccaccacttagcaaga

SEQ ID NO: 249160 - DNA, 25 bp, Mus musculus
atctcttcaccagcacttagcaaga

SEQ ID NO: 249161 - DNA, 25 bp, Mus musculus
atctcttcactgatatgcaatgtct

SEQ ID NO: 249162 - DNA, 25 bp, Mus musculus
atctcttcactgttatgcaatgtct

SEQ ID NO: 249163 - DNA, 25 bp, Mus musculus
atctcttcagaaccaaactcagtat

SEQ ID NO: 249164 - DNA, 25 bp, Mus musculus
atctcttcagaagcaaactcagtat

SEQ ID NO: 249165 - DNA, 25 bp, Mus musculus
atctcttcagccctgtattcataat

SEQ ID NO: 249166 - DNA, 25 bp, Mus musculus
atctcttcagccgtgtattcataat

SEQ ID NO: 249167 - DNA, 25 bp, Mus musculus
atctcttcagggactcatagtgcca

SEQ ID NO: 249168 - DNA, 25 bp, Mus musculus
atctcttcagggtctcatagtgcca

SEQ ID NO: 249169 - DNA, 25 bp, Mus musculus
atctcttcaggtagtgtttgccagg

SEQ ID NO: 249170 - DNA, 25 bp, Mus musculus
atctcttcaggttgtgtttgccagg

SEQ ID NO: 249171 - DNA, 25 bp, Mus musculus
atctcttcatccatgtcgtttaagc

SEQ ID NO: 249172 - DNA, 25 bp, Mus musculus
atctcttcatccttgtcgtttaagc

SEQ ID NO: 249173 - DNA, 25 bp, Mus musculus
atctcttccaccatcatgatctgaa

SEQ ID NO: 249174 - DNA, 25 bp, Mus musculus
atctcttccaccttcatgatctgaa

SEQ ID NO: 249175 - DNA, 25 bp, Mus musculus
atctcttccatgcttgctgtttgct

SEQ ID NO: 249176 - DNA, 25 bp, Mus musculus
atctcttccatggttgctgtttgct

SEQ ID NO: 249177 - DNA, 25 bp, Mus musculus
atctcttcccaactctatactcagt

SEQ ID NO: 249178 - DNA, 25 bp, Mus musculus
atctcttcccaagtctatactcagt

SEQ ID NO: 249179 - DNA, 25 bp, Mus musculus
atctcttccgacaagtagaacctgg

SEQ ID NO: 249180 - DNA, 25 bp, Mus musculus
atctcttccgactagtagaacctgg

SEQ ID NO: 249181 - DNA, 25 bp, Mus musculus
atctcttcctaccatggctgatgcc

SEQ ID NO: 249182 - DNA, 25 bp, Mus musculus
atctcttcctacgatggctgatgcc

SEQ ID NO: 249183 - DNA, 25 bp, Mus musculus
atctcttccttgcttctctaacttt

SEQ ID NO: 249184 - DNA, 25 bp, Mus musculus
atctcttccttggttctctaacttt

SEQ ID NO: 249185 - DNA, 25 bp, Mus musculus
atctcttcggctactctgtaaacag

SEQ ID NO: 249186 - DNA, 25 bp, Mus musculus
atctcttcggcttctctgtaaacag

SEQ ID NO: 249187 - DNA, 25 bp, Mus musculus
atctcttcgggaaccatcattgtgg

SEQ ID NO: 249188 - DNA, 25 bp, Mus musculus
atctcttcgggatccatcattgtgg

SEQ ID NO: 249189 - DNA, 25 bp, Mus musculus
atctcttcgggtagtgtgcgtgcac

SEQ ID NO: 249190 - DNA, 25 bp, Mus musculus
atctcttcgggttgtgtgcgtgcac

SEQ ID NO: 249191 - DNA, 25 bp, Mus musculus
atctcttcgtttctggaaaggcaag

SEQ ID NO: 249192 - DNA, 25 bp, Mus musculus
atctcttcgtttgtggaaaggcaag

SEQ ID NO: 249193 - DNA, 25 bp, Mus musculus
atctcttctacaacgagcagcagga

SEQ ID NO: 249194 - DNA, 25 bp, Mus musculus
atctcttctacatcgagcagcagga

SEQ ID NO: 249195 - DNA, 25 bp, Mus musculus
atctcttctgaaagggctgatttct

SEQ ID NO: 249196 - DNA, 25 bp, Mus musculus
atctcttctgaatgggctgatttct

SEQ ID NO: 249197 - DNA, 25 bp, Mus musculus
atctcttctggaacctaaggcctgt

SEQ ID NO: 249198 - DNA, 25 bp, Mus musculus
atctcttctggaacgttttccttct

SEQ ID NO: 249199 - DNA, 25 bp, Mus musculus
atctcttctggatcctaaggcctgt

SEQ ID NO: 249200 - DNA, 25 bp, Mus musculus
atctcttctggatcgttttccttct

SEQ ID NO: 249201 - DNA, 25 bp, Mus musculus
atctcttctggcactcatggacaat

SEQ ID NO: 249202 - DNA, 25 bp, Mus musculus
atctcttctggctctcatggacaat

SEQ ID NO: 249203 - DNA, 25 bp, Mus musculus
atctcttctgggatttttggtgttg

SEQ ID NO: 249204 - DNA, 25 bp, Mus musculus
atctcttctgggttttttggtgttg

SEQ ID NO: 249205 - DNA, 25 bp, Mus musculus
atctcttgagccagcttgatctagc

SEQ ID NO: 249206 - DNA, 25 bp, Mus musculus
atctcttgagcctgcttgatctagc

SEQ ID NO: 249207 - DNA, 25 bp, Mus musculus
atctcttgatacaatactctctggg

SEQ ID NO: 249208 - DNA, 25 bp, Mus musculus
atctcttgatactatactctctggg

SEQ ID NO: 249209 - DNA, 25 bp, Mus musculus
atctcttgcaagcttcgatagtggc

SEQ ID NO: 249210 - DNA, 25 bp, Mus musculus
atctcttgcaaggttcgatagtggc

SEQ ID NO: 249211 - DNA, 25 bp, Mus musculus
atctcttgcacgattgcagcgaagc

SEQ ID NO: 249212 - DNA, 25 bp, Mus musculus
atctcttgcacgtttgcagcgaagc

SEQ ID NO: 249213 - DNA, 25 bp, Mus musculus
atctcttgcatacaccactggcagt

SEQ ID NO: 249214 - DNA, 25 bp, Mus musculus
atctcttgcatagaccactggcagt

SEQ ID NO: 249215 - DNA, 25 bp, Mus musculus
atctcttgctgcattaagacgagga

SEQ ID NO: 249216 - DNA, 25 bp, Mus musculus
atctcttgctgctttaagacgagga

SEQ ID NO: 249217 - DNA, 25 bp, Mus musculus
atctcttgggctagagggcagcctg

SEQ ID NO: 249218 - DNA, 25 bp, Mus musculus
atctcttgggcttgagggcagcctg

SEQ ID NO: 249219 - DNA, 25 bp, Mus musculus
atctcttggtgcctagaactcagcc

SEQ ID NO: 249220 - DNA, 25 bp, Mus musculus
atctcttggtgcgtagaactcagcc

SEQ ID NO: 249221 - DNA, 25 bp, Mus musculus
atctcttgtcccagaaaaatcttga

SEQ ID NO: 249222 - DNA, 25 bp, Mus musculus
atctcttgtccctgaaaaatcttga

SEQ ID NO: 249223 - DNA, 25 bp, Mus musculus
atctcttgtgagatctgcttgctat

SEQ ID NO: 249224 - DNA, 25 bp, Mus musculus
atctcttgtgagctcccactcctta

SEQ ID NO: 249225 - DNA, 25 bp, Mus musculus
atctcttgtgaggtcccactcctta

SEQ ID NO: 249226 - DNA, 25 bp, Mus musculus
atctcttgtgagttctgcttgctat

SEQ ID NO: 249227 - DNA, 25 bp, Mus musculus
atctcttgtgcccatgggtcatcat

SEQ ID NO: 249228 - DNA, 25 bp, Mus musculus
atctcttgtgccgatgggtcatcat

SEQ ID NO: 249229 - DNA, 25 bp, Mus musculus
atctcttgttccattgcagatgttt

SEQ ID NO: 249230 - DNA, 25 bp, Mus musculus
atctcttgttcctttgcagatgttt

SEQ ID NO: 249231 - DNA, 25 bp, Mus musculus
atctcttgttgtcagctggatcgtt

SEQ ID NO: 249232 - DNA, 25 bp, Mus musculus
atctcttgttgtgagctggatcgtt

SEQ ID NO: 249233 - DNA, 25 bp, Mus musculus
atctcttgtttgcagttgtatcaga

SEQ ID NO: 249234 - DNA, 25 bp, Mus musculus
atctcttgtttggagttgtatcaga

SEQ ID NO: 249235 - DNA, 25 bp, Mus musculus
atctctttaataactcacttttgcc

SEQ ID NO: 249236 - DNA, 25 bp, Mus musculus
atctctttaatatctcacttttgcc

SEQ ID NO: 249237 - DNA, 25 bp, Mus musculus
atctctttacagatgcatctcacat

SEQ ID NO: 249238 - DNA, 25 bp, Mus musculus
atctctttacagttgcatctcacat

SEQ ID NO: 249239 - DNA, 25 bp, Mus musculus
atctctttactgattgtcacctgct

SEQ ID NO: 249240 - DNA, 25 bp, Mus musculus
atctctttactgtttgtcacctgct

SEQ ID NO: 249241 - DNA, 25 bp, Mus musculus
atctctttacttagtgcttcttcta

SEQ ID NO: 249242 - DNA, 25 bp, Mus musculus
atctctttactttgtgcttcttcta

SEQ ID NO: 249243 - DNA, 25 bp, Mus musculus
atctctttagatcagcgaagcccct

SEQ ID NO: 249244 - DNA, 25 bp, Mus musculus
atctctttagatgagcgaagcccct

SEQ ID NO: 249245 - DNA, 25 bp, Mus musculus
atctctttagggaacatcaggaagc

SEQ ID NO: 249246 - DNA, 25 bp, Mus musculus
atctctttagggtacatcaggaagc

SEQ ID NO: 249247 - DNA, 25 bp, Mus musculus
atctctttatcaattgttggtctta

SEQ ID NO: 249248 - DNA, 25 bp, Mus musculus
atctctttatcatttgttggtctta

SEQ ID NO: 249249 - DNA, 25 bp, Mus musculus
atctctttcaacacatctatgagct

SEQ ID NO: 249250 - DNA, 25 bp, Mus musculus
atctctttcaactcatctatgagct

SEQ ID NO: 249251 - DNA, 25 bp, Mus musculus
atctctttccagactttccagtcat

SEQ ID NO: 249252 - DNA, 25 bp, Mus musculus
atctctttccagtctttccagtcat

SEQ ID NO: 249253 - DNA, 25 bp, Mus musculus
atctctttccttaggccttttgcat

SEQ ID NO: 249254 - DNA, 25 bp, Mus musculus
atctctttcctttggccttttgcat

SEQ ID NO: 249255 - DNA, 25 bp, Mus musculus
atctctttcggtcattttagccact

SEQ ID NO: 249256 - DNA, 25 bp, Mus musculus
atctctttcggtgattttagccact

SEQ ID NO: 249257 - DNA, 25 bp, Mus musculus
atctctttctcacgtcacaggcaga

SEQ ID NO: 249258 - DNA, 25 bp, Mus musculus
atctctttctcaggtcacaggcaga

SEQ ID NO: 249259 - DNA, 25 bp, Mus musculus
atctctttctgcataggtaatcctt

SEQ ID NO: 249260 - DNA, 25 bp, Mus musculus
atctctttctgcttaggtaatcctt

SEQ ID NO: 249261 - DNA, 25 bp, Mus musculus
atctctttctggaagcgctcaagga

SEQ ID NO: 249262 - DNA, 25 bp, Mus musculus
atctctttctggtagcgctcaagga

SEQ ID NO: 249263 - DNA, 25 bp, Mus musculus
atctctttctttaaatggtctacag

SEQ ID NO: 249264 - DNA, 25 bp, Mus musculus
atctctttctttcgcatgttggcgt

SEQ ID NO: 249265 - DNA, 25 bp, Mus musculus
atctctttctttggcatgttggcgt

SEQ ID NO: 249266 - DNA, 25 bp, Mus musculus
atctctttcttttaatggtctacag

SEQ ID NO: 249267 - DNA, 25 bp, Mus musculus
atctctttgagcacctatttctttt

SEQ ID NO: 249268 - DNA, 25 bp, Mus musculus
atctctttgagctcctatttctttt

SEQ ID NO: 249269 - DNA, 25 bp, Mus musculus
atctctttgaggaaccaagtgagct

SEQ ID NO: 249270 - DNA, 25 bp, Mus musculus
atctctttgaggtaccaagtgagct

SEQ ID NO: 249271 - DNA, 25 bp, Mus musculus
atctctttgcacacggacagctttg

SEQ ID NO: 249272 - DNA, 25 bp, Mus musculus
atctctttgcactcggacagctttg

SEQ ID NO: 249273 - DNA, 25 bp, Mus musculus
atctctttggctaagtcagaaaaac

SEQ ID NO: 249274 - DNA, 25 bp, Mus musculus
atctctttggcttagtcagaaaaac

SEQ ID NO: 249275 - DNA, 25 bp, Mus musculus
atctctttggttaggctgggtggcc

SEQ ID NO: 249276 - DNA, 25 bp, Mus musculus
atctctttggtttggctgggtggcc

SEQ ID NO: 249277 - DNA, 25 bp, Mus musculus
atctctttgtgcagaaacccatggc

SEQ ID NO: 249278 - DNA, 25 bp, Mus musculus
atctctttgtgctgaaacccatggc

SEQ ID NO: 249279 - DNA, 25 bp, Mus musculus
atctctttgttgctaaatgggagct

SEQ ID NO: 249280 - DNA, 25 bp, Mus musculus
atctctttgttggtaaatgggagct

SEQ ID NO: 249281 - DNA, 25 bp, Mus musculus
atctcttttaacctggaattttgtg

SEQ ID NO: 249282 - DNA, 25 bp, Mus musculus
atctcttttaacgtggaattttgtg

SEQ ID NO: 249283 - DNA, 25 bp, Mus musculus
atctcttttccaacatgtgctgcat

SEQ ID NO: 249284 - DNA, 25 bp, Mus musculus
atctcttttccatcatgtgctgcat

SEQ ID NO: 249285 - DNA, 25 bp, Mus musculus
atctctttttcaacataaaacctag

SEQ ID NO: 249286 - DNA, 25 bp, Mus musculus
atctctttttcatcataaaacctag

SEQ ID NO: 249287 - DNA, 25 bp, Mus musculus
atctgaaaatccaccttaactgcct

SEQ ID NO: 249288 - DNA, 25 bp, Mus musculus
atctgaaaatcctccttaactgcct

SEQ ID NO: 249289 - DNA, 25 bp, Mus musculus
atctgaaacttgcagtgtctgaggc

SEQ ID NO: 249290 - DNA, 25 bp, Mus musculus
atctgaaacttggagtgtctgaggc

SEQ ID NO: 249291 - DNA, 25 bp, Mus musculus
atctgaaagttgacttcccatcctc

SEQ ID NO: 249292 - DNA, 25 bp, Mus musculus
atctgaaagttgtcttcccatcctc

SEQ ID NO: 249293 - DNA, 25 bp, Mus musculus
atctgaacagatctactttaccatt

SEQ ID NO: 249294 - DNA, 25 bp, Mus musculus
atctgaacagatgtactttaccatt

SEQ ID NO: 249295 - DNA, 25 bp, Mus musculus
atctgaacatgcagaccgctcatca

SEQ ID NO: 249296 - DNA, 25 bp, Mus musculus
atctgaacatgctgaccgctcatca

SEQ ID NO: 249297 - DNA, 25 bp, Mus musculus
atctgaacattcatttatctattaa

SEQ ID NO: 249298 - DNA, 25 bp, Mus musculus
atctgaacattcttttatctattaa

SEQ ID NO: 249299 - DNA, 25 bp, Mus musculus
atctgaacccaacacccaataaagt

SEQ ID NO: 249300 - DNA, 25 bp, Mus musculus
atctgaacccaagacccaataaagt

SEQ ID NO: 249301 - DNA, 25 bp, Mus musculus
atctgaacgcagatcaccagcccat

SEQ ID NO: 249302 - DNA, 25 bp, Mus musculus
atctgaacgcagttcaccagcccat

SEQ ID NO: 249303 - DNA, 25 bp, Mus musculus
atctgaacgctgagcaggcatctgc

SEQ ID NO: 249304 - DNA, 25 bp, Mus musculus
atctgaacgctgtgcaggcatctgc

SEQ ID NO: 249305 - DNA, 25 bp, Mus musculus
atctgaactaggcagctgcgtggaa

SEQ ID NO: 249306 - DNA, 25 bp, Mus musculus
atctgaactagggagctgcgtggaa

SEQ ID NO: 249307 - DNA, 25 bp, Mus musculus
atctgaactgagcagccacctgggc

SEQ ID NO: 249308 - DNA, 25 bp, Mus musculus
atctgaactgaggagccacctgggc

SEQ ID NO: 249309 - DNA, 25 bp, Mus musculus
atctgaagaagaagccacgctaaaa

SEQ ID NO: 249310 - DNA, 25 bp, Mus musculus
atctgaagaagatgccacgctaaaa

SEQ ID NO: 249311 - DNA, 25 bp, Mus musculus
atctgaagcatgaggtctagttgac

SEQ ID NO: 249312 - DNA, 25 bp, Mus musculus
atctgaagcatgtggtctagttgac

SEQ ID NO: 249313 - DNA, 25 bp, Mus musculus
atctgaagcccgctctctgctcagg

SEQ ID NO: 249314 - DNA, 25 bp, Mus musculus
atctgaagcccggtctctgctcagg

SEQ ID NO: 249315 - DNA, 25 bp, Mus musculus
atctgaaggctcctgtcctgtctgc

SEQ ID NO: 249316 - DNA, 25 bp, Mus musculus
atctgaaggctcgtgtcctgtctgc

SEQ ID NO: 249317 - DNA, 25 bp, Mus musculus
atctgaagtctcaggttgaccctaa

SEQ ID NO: 249318 - DNA, 25 bp, Mus musculus
atctgaagtctctggttgaccctaa

SEQ ID NO: 249319 - DNA, 25 bp, Mus musculus
atctgaagttttatagtcctatttt

SEQ ID NO: 249320 - DNA, 25 bp, Mus musculus
atctgaagttttttagtcctatttt

SEQ ID NO: 249321 - DNA, 25 bp, Mus musculus
atctgaatccaaccctttagaataa

SEQ ID NO: 249322 - DNA, 25 bp, Mus musculus
atctgaatccaagcctttagaataa

SEQ ID NO: 249323 - DNA, 25 bp, Mus musculus
atctgaattttgcaatgtatttagc

SEQ ID NO: 249324 - DNA, 25 bp, Mus musculus
atctgaattttggaatgtatttagc

SEQ ID NO: 249325 - DNA, 25 bp, Mus musculus
atctgacacacaccgaaggcctgga

SEQ ID NO: 249326 - DNA, 25 bp, Mus musculus
atctgacacacagcgaaggcctgga

SEQ ID NO: 249327 - DNA, 25 bp, Mus musculus
atctgacactaaccagttgcactgg

SEQ ID NO: 249328 - DNA, 25 bp, Mus musculus
atctgacactaagcagttgcactgg

SEQ ID NO: 249329 - DNA, 25 bp, Mus musculus
atctgacactctagctttgcctcgg

SEQ ID NO: 249330 - DNA, 25 bp, Mus musculus
atctgacactcttgctttgcctcgg

SEQ ID NO: 249331 - DNA, 25 bp, Mus musculus
atctgacagacccaacctgccgggt

SEQ ID NO: 249332 - DNA, 25 bp, Mus musculus
atctgacagaccgaacctgccgggt

SEQ ID NO: 249333 - DNA, 25 bp, Mus musculus
atctgacagtaccagctgcttcaga

SEQ ID NO: 249334 - DNA, 25 bp, Mus musculus
atctgacagtacgagctgcttcaga

SEQ ID NO: 249335 - DNA, 25 bp, Mus musculus
atctgacatccccagcattaggtta

SEQ ID NO: 249336 - DNA, 25 bp, Mus musculus
atctgacatcccgagcattaggtta

SEQ ID NO: 249337 - DNA, 25 bp, Mus musculus
atctgaccaagtcaagccagacagt

SEQ ID NO: 249338 - DNA, 25 bp, Mus musculus
atctgaccaagtgaagccagacagt

SEQ ID NO: 249339 - DNA, 25 bp, Mus musculus
atctgaccaatccaggcttaccttg

SEQ ID NO: 249340 - DNA, 25 bp, Mus musculus
atctgaccaatcgaggcttaccttg

SEQ ID NO: 249341 - DNA, 25 bp, Mus musculus
atctgaccacggcatgtgtttctga

SEQ ID NO: 249342 - DNA, 25 bp, Mus musculus
atctgaccacgggatgtgtttctga

SEQ ID NO: 249343 - DNA, 25 bp, Mus musculus
atctgaccagtgagtttatagtaaa

SEQ ID NO: 249344 - DNA, 25 bp, Mus musculus
atctgaccagtgtgtttatagtaaa

SEQ ID NO: 249345 - DNA, 25 bp, Mus musculus
atctgacccaaaatgttgcttttca

SEQ ID NO: 249346 - DNA, 25 bp, Mus musculus
atctgacccaaattgttgcttttca

SEQ ID NO: 249347 - DNA, 25 bp, Mus musculus
atctgacccagtcaaagcgtggaaa

SEQ ID NO: 249348 - DNA, 25 bp, Mus musculus
atctgacccagtcctatttttctag

SEQ ID NO: 249349 - DNA, 25 bp, Mus musculus
atctgacccagtgaaagcgtggaaa

SEQ ID NO: 249350 - DNA, 25 bp, Mus musculus
atctgacccagtgctatttttctag

SEQ ID NO: 249351 - DNA, 25 bp, Mus musculus
atctgaccctcaagtccaaacatag

SEQ ID NO: 249352 - DNA, 25 bp, Mus musculus
atctgaccctcatgtccaaacatag

SEQ ID NO: 249353 - DNA, 25 bp, Mus musculus
atctgacccttgacgtcatgagcat

SEQ ID NO: 249354 - DNA, 25 bp, Mus musculus
atctgacccttgtcgtcatgagcat

SEQ ID NO: 249355 - DNA, 25 bp, Mus musculus
atctgaccgcttaggccaaggatgc

SEQ ID NO: 249356 - DNA, 25 bp, Mus musculus
atctgaccgctttggccaaggatgc

SEQ ID NO: 249357 - DNA, 25 bp, Mus musculus
atctgaccgggccaggaagccaatt

SEQ ID NO: 249358 - DNA, 25 bp, Mus musculus
atctgaccgggcgaggaagccaatt

SEQ ID NO: 249359 - DNA, 25 bp, Mus musculus
atctgacctaacctcttttctgttg

SEQ ID NO: 249360 - DNA, 25 bp, Mus musculus
atctgacctaacgtcttttctgttg

SEQ ID NO: 249361 - DNA, 25 bp, Mus musculus
atctgacctataagctgcggcaggc

SEQ ID NO: 249362 - DNA, 25 bp, Mus musculus
atctgacctatatgctgcggcaggc

SEQ ID NO: 249363 - DNA, 25 bp, Mus musculus
atctgacctcttacaggtgcttaga

SEQ ID NO: 249364 - DNA, 25 bp, Mus musculus
atctgacctctttcaggtgcttaga

SEQ ID NO: 249365 - DNA, 25 bp, Mus musculus
atctgacctgacatctcctaggtat

SEQ ID NO: 249366 - DNA, 25 bp, Mus musculus
atctgacctgacttctcctaggtat

SEQ ID NO: 249367 - DNA, 25 bp, Mus musculus
atctgaccttcaacatggtttctga

SEQ ID NO: 249368 - DNA, 25 bp, Mus musculus
atctgaccttcatcatggtttctga

SEQ ID NO: 249369 - DNA, 25 bp, Mus musculus
atctgacgacagattccacgtgccc

SEQ ID NO: 249370 - DNA, 25 bp, Mus musculus
atctgacgacagtttccacgtgccc

SEQ ID NO: 249371 - DNA, 25 bp, Mus musculus
atctgacgactcacattttagacat

SEQ ID NO: 249372 - DNA, 25 bp, Mus musculus
atctgacgactcagtggtctattat

SEQ ID NO: 249373 - DNA, 25 bp, Mus musculus
atctgacgactctcattttagacat

SEQ ID NO: 249374 - DNA, 25 bp, Mus musculus
atctgacgactctgtggtctattat

SEQ ID NO: 249375 - DNA, 25 bp, Mus musculus
atctgacgagggagattcttttcct

SEQ ID NO: 249376 - DNA, 25 bp, Mus musculus
atctgacgagggtgattcttttcct

SEQ ID NO: 249377 - DNA, 25 bp, Mus musculus
atctgacggcccaggcttcagtggg

SEQ ID NO: 249378 - DNA, 25 bp, Mus musculus
atctgacggccctggcttcagtggg

SEQ ID NO: 249379 - DNA, 25 bp, Mus musculus
atctgactaaatctgcttttattgg

SEQ ID NO: 249380 - DNA, 25 bp, Mus musculus
atctgactaaatgtgcttttattgg

SEQ ID NO: 249381 - DNA, 25 bp, Mus musculus
atctgactacatcaagagcagccgc

SEQ ID NO: 249382 - DNA, 25 bp, Mus musculus
atctgactacatgaagagcagccgc

SEQ ID NO: 249383 - DNA, 25 bp, Mus musculus
atctgactccttagtacctttgttg

SEQ ID NO: 249384 - DNA, 25 bp, Mus musculus
atctgactccttctagggactctgg

SEQ ID NO: 249385 - DNA, 25 bp, Mus musculus
atctgactccttgtagggactctgg

SEQ ID NO: 249386 - DNA, 25 bp, Mus musculus
atctgactcctttgtacctttgttg

SEQ ID NO: 249387 - DNA, 25 bp, Mus musculus
atctgactctacactttttctgtct

SEQ ID NO: 249388 - DNA, 25 bp, Mus musculus
atctgactctactctttttctgtct

SEQ ID NO: 249389 - DNA, 25 bp, Mus musculus
atctgactctctaggtgttctgtaa

SEQ ID NO: 249390 - DNA, 25 bp, Mus musculus
atctgactctcttggtgttctgtaa

SEQ ID NO: 249391 - DNA, 25 bp, Mus musculus
atctgactctgacggcacggctgga

SEQ ID NO: 249392 - DNA, 25 bp, Mus musculus
atctgactctgagggcacggctgga

SEQ ID NO: 249393 - DNA, 25 bp, Mus musculus
atctgactgagaaatcagccatttc

SEQ ID NO: 249394 - DNA, 25 bp, Mus musculus
atctgactgagatatcagccatttc

SEQ ID NO: 249395 - DNA, 25 bp, Mus musculus
atctgactgctcataaagctgctgc

SEQ ID NO: 249396 - DNA, 25 bp, Mus musculus
atctgactgctcttaaagctgctgc

SEQ ID NO: 249397 - DNA, 25 bp, Mus musculus
atctgactgtggaccttgtacaaaa

SEQ ID NO: 249398 - DNA, 25 bp, Mus musculus
atctgactgtggtccttgtacaaaa

SEQ ID NO: 249399 - DNA, 25 bp, Mus musculus
atctgacttaagcacccagtgccct

SEQ ID NO: 249400 - DNA, 25 bp, Mus musculus
atctgacttaaggacccagtgccct

SEQ ID NO: 249401 - DNA, 25 bp, Mus musculus
atctgacttatgatgttctctacga

SEQ ID NO: 249402 - DNA, 25 bp, Mus musculus
atctgacttatgttgttctctacga

SEQ ID NO: 249403 - DNA, 25 bp, Mus musculus
atctgacttcccctgcaggtctaat

SEQ ID NO: 249404 - DNA, 25 bp, Mus musculus
atctgacttcccgtgcaggtctaat

SEQ ID NO: 249405 - DNA, 25 bp, Mus musculus
atctgacttttgctcgcagacttcc

SEQ ID NO: 249406 - DNA, 25 bp, Mus musculus
atctgacttttggtcgcagacttcc

SEQ ID NO: 249407 - DNA, 25 bp, Mus musculus
atctgagaaacccacctcgaggcag

SEQ ID NO: 249408 - DNA, 25 bp, Mus musculus
atctgagaaaccgacctcgaggcag

SEQ ID NO: 249409 - DNA, 25 bp, Mus musculus
atctgagaccctctgctggttttgt

SEQ ID NO: 249410 - DNA, 25 bp, Mus musculus
atctgagaccctgtgctggttttgt

SEQ ID NO: 249411 - DNA, 25 bp, Mus musculus
atctgagactcaagcccatttttaa

SEQ ID NO: 249412 - DNA, 25 bp, Mus musculus
atctgagactcatgcccatttttaa

SEQ ID NO: 249413 - DNA, 25 bp, Mus musculus
atctgagactttcactgtatctgag

SEQ ID NO: 249414 - DNA, 25 bp, Mus musculus
atctgagactttgactgtatctgag

SEQ ID NO: 249415 - DNA, 25 bp, Mus musculus
atctgagagcagatcattcattagt

SEQ ID NO: 249416 - DNA, 25 bp, Mus musculus
atctgagagcagttcattcattagt

SEQ ID NO: 249417 - DNA, 25 bp, Mus musculus
atctgagagtggagcagcctgcccc

SEQ ID NO: 249418 - DNA, 25 bp, Mus musculus
atctgagagtggtgcagcctgcccc

SEQ ID NO: 249419 - DNA, 25 bp, Mus musculus
atctgagatacacttagctctgcct

SEQ ID NO: 249420 - DNA, 25 bp, Mus musculus
atctgagatacagttagctctgcct

SEQ ID NO: 249421 - DNA, 25 bp, Mus musculus
atctgagataccagttccattccca

SEQ ID NO: 249422 - DNA, 25 bp, Mus musculus
atctgagatacctgttccattccca

SEQ ID NO: 249423 - DNA, 25 bp, Mus musculus
atctgagatgagcagcctacgccgt

SEQ ID NO: 249424 - DNA, 25 bp, Mus musculus
atctgagatgaggagcctacgccgt

SEQ ID NO: 249425 - DNA, 25 bp, Mus musculus
atctgagattagacctgcccaggtg

SEQ ID NO: 249426 - DNA, 25 bp, Mus musculus
atctgagattagtcctgcccaggtg

SEQ ID NO: 249427 - DNA, 25 bp, Mus musculus
atctgagcactaagtaggtaaaggc

SEQ ID NO: 249428 - DNA, 25 bp, Mus musculus
atctgagcactatgtaggtaaaggc

SEQ ID NO: 249429 - DNA, 25 bp, Mus musculus
atctgagcagtgatgccagccccag

SEQ ID NO: 249430 - DNA, 25 bp, Mus musculus
atctgagcagtgttgccagccccag

SEQ ID NO: 249431 - DNA, 25 bp, Mus musculus
atctgagcatatactctgccactgc

SEQ ID NO: 249432 - DNA, 25 bp, Mus musculus
atctgagcatattctctgccactgc

SEQ ID NO: 249433 - DNA, 25 bp, Mus musculus
atctgagccaaaacctccacacaga

SEQ ID NO: 249434 - DNA, 25 bp, Mus musculus
atctgagccaaatcctccacacaga

SEQ ID NO: 249435 - DNA, 25 bp, Mus musculus
atctgagccacacttgtgattctac

SEQ ID NO: 249436 - DNA, 25 bp, Mus musculus
atctgagccacagttgtgattctac

SEQ ID NO: 249437 - DNA, 25 bp, Mus musculus
atctgagccatacgcacatcctgga

SEQ ID NO: 249438 - DNA, 25 bp, Mus musculus
atctgagccataggcacatcctgga

SEQ ID NO: 249439 - DNA, 25 bp, Mus musculus
atctgagcccgtagattttctctgc

SEQ ID NO: 249440 - DNA, 25 bp, Mus musculus
atctgagcccgttgattttctctgc

SEQ ID NO: 249441 - DNA, 25 bp, Mus musculus
atctgagccctccatggctgagaag

SEQ ID NO: 249442 - DNA, 25 bp, Mus musculus
atctgagccctcgatggctgagaag

SEQ ID NO: 249443 - DNA, 25 bp, Mus musculus
atctgagcctctatgctggtcatgt

SEQ ID NO: 249444 - DNA, 25 bp, Mus musculus
atctgagcctctttgctggtcatgt

SEQ ID NO: 249445 - DNA, 25 bp, Mus musculus
atctgagccttaaagctaagatgtc

SEQ ID NO: 249446 - DNA, 25 bp, Mus musculus
atctgagccttatagctaagatgtc

SEQ ID NO: 249447 - DNA, 25 bp, Mus musculus
atctgagccttgcaatgcaggcctt

SEQ ID NO: 249448 - DNA, 25 bp, Mus musculus
atctgagccttggaatgcaggcctt

SEQ ID NO: 249449 - DNA, 25 bp, Mus musculus
atctgagctcataggtaggttgaag

SEQ ID NO: 249450 - DNA, 25 bp, Mus musculus
atctgagctcattggtaggttgaag

SEQ ID NO: 249451 - DNA, 25 bp, Mus musculus
atctgagctccacaacgacaacttc

SEQ ID NO: 249452 - DNA, 25 bp, Mus musculus
atctgagctccagaacgacaacttc

SEQ ID NO: 249453 - DNA, 25 bp, Mus musculus
atctgagctcccattttggctagta

SEQ ID NO: 249454 - DNA, 25 bp, Mus musculus
atctgagctccctttttggctagta

SEQ ID NO: 249455 - DNA, 25 bp, Mus musculus
atctgagctctcaatgactatgtga

SEQ ID NO: 249456 - DNA, 25 bp, Mus musculus
atctgagctctctatgactatgtga

SEQ ID NO: 249457 - DNA, 25 bp, Mus musculus
atctgagctctgcatgcacagcaac

SEQ ID NO: 249458 - DNA, 25 bp, Mus musculus
atctgagctctggatgcacagcaac

SEQ ID NO: 249459 - DNA, 25 bp, Mus musculus
atctgagctgagcatcctcttctaa

SEQ ID NO: 249460 - DNA, 25 bp, Mus musculus
atctgagctgaggatcctcttctaa

SEQ ID NO: 249461 - DNA, 25 bp, Mus musculus
atctgagctgcccaacaaaaaaggc

SEQ ID NO: 249462 - DNA, 25 bp, Mus musculus
atctgagctgccgaacaaaaaaggc

SEQ ID NO: 249463 - DNA, 25 bp, Mus musculus
atctgagctgtgcacatggcggcca

SEQ ID NO: 249464 - DNA, 25 bp, Mus musculus
atctgagctgtggacatggcggcca

SEQ ID NO: 249465 - DNA, 25 bp, Mus musculus
atctgagctgttagagtttcccaag

SEQ ID NO: 249466 - DNA, 25 bp, Mus musculus
atctgagctgtttgagtttcccaag

SEQ ID NO: 249467 - DNA, 25 bp, Mus musculus
atctgaggatccaaaaggagacttc

SEQ ID NO: 249468 - DNA, 25 bp, Mus musculus
atctgaggatcctaaaggagacttc

SEQ ID NO: 249469 - DNA, 25 bp, Mus musculus
atctgaggattccacttctgggcaa

SEQ ID NO: 249470 - DNA, 25 bp, Mus musculus
atctgaggattcgacttctgggcaa

SEQ ID NO: 249471 - DNA, 25 bp, Mus musculus
atctgaggccaacagcctggctggc

SEQ ID NO: 249472 - DNA, 25 bp, Mus musculus
atctgaggccaagagcctggctggc

SEQ ID NO: 249473 - DNA, 25 bp, Mus musculus
atctgaggctcaatctgtctttata

SEQ ID NO: 249474 - DNA, 25 bp, Mus musculus
atctgaggctcattctgtctttata

SEQ ID NO: 249475 - DNA, 25 bp, Mus musculus
atctgaggctcgctcccagttaggg

SEQ ID NO: 249476 - DNA, 25 bp, Mus musculus
atctgaggctcggtcccagttaggg

SEQ ID NO: 249477 - DNA, 25 bp, Mus musculus
atctgaggctgcagcaagccagcag

SEQ ID NO: 249478 - DNA, 25 bp, Mus musculus
atctgaggctgccagcttctccaag

SEQ ID NO: 249479 - DNA, 25 bp, Mus musculus
atctgaggctgcgagcttctccaag

SEQ ID NO: 249480 - DNA, 25 bp, Mus musculus
atctgaggctgctgcaagccagcag

SEQ ID NO: 249481 - DNA, 25 bp, Mus musculus
atctgaggctttaatcttctctctc

SEQ ID NO: 249482 - DNA, 25 bp, Mus musculus
atctgaggcttttatcttctctctc

SEQ ID NO: 249483 - DNA, 25 bp, Mus musculus
atctgagggaccagaatcgctgcac

SEQ ID NO: 249484 - DNA, 25 bp, Mus musculus
atctgagggacctgaatcgctgcac

SEQ ID NO: 249485 - DNA, 25 bp, Mus musculus
atctgagggtgaccagcggcaccat

SEQ ID NO: 249486 - DNA, 25 bp, Mus musculus
atctgagggtgagcagcggcaccat

SEQ ID NO: 249487 - DNA, 25 bp, Mus musculus
atctgagggtgtcatgcacgacctt

SEQ ID NO: 249488 - DNA, 25 bp, Mus musculus
atctgagggtgtgatgcacgacctt

SEQ ID NO: 249489 - DNA, 25 bp, Mus musculus
atctgaggtagaacccgaacatcta

SEQ ID NO: 249490 - DNA, 25 bp, Mus musculus
atctgaggtagatcccgaacatcta

SEQ ID NO: 249491 - DNA, 25 bp, Mus musculus
atctgaggtcagcttggtttacatg

SEQ ID NO: 249492 - DNA, 25 bp, Mus musculus
atctgaggtcaggttggtttacatg

SEQ ID NO: 249493 - DNA, 25 bp, Mus musculus
atctgaggtgccacgcagcttgtgt

SEQ ID NO: 249494 - DNA, 25 bp, Mus musculus
atctgaggtgcctcgcagcttgtgt

SEQ ID NO: 249495 - DNA, 25 bp, Mus musculus
atctgaggtgggaaccacccttcct

SEQ ID NO: 249496 - DNA, 25 bp, Mus musculus
atctgaggtgggtaccacccttcct

SEQ ID NO: 249497 - DNA, 25 bp, Mus musculus
atctgaggttctcctgtagggatcc

SEQ ID NO: 249498 - DNA, 25 bp, Mus musculus
atctgaggttctgctgtagggatcc

SEQ ID NO: 249499 - DNA, 25 bp, Mus musculus
atctgaggttggctctggtgttcct

SEQ ID NO: 249500 - DNA, 25 bp, Mus musculus
atctgaggttgggtctggtgttcct

SEQ ID NO: 249501 - DNA, 25 bp, Mus musculus
atctgagtaactcctcttggtggct

SEQ ID NO: 249502 - DNA, 25 bp, Mus musculus
atctgagtaactgctcttggtggct

SEQ ID NO: 249503 - DNA, 25 bp, Mus musculus
atctgagtaagcactgaccacctct

SEQ ID NO: 249504 - DNA, 25 bp, Mus musculus
atctgagtaagctctgaccacctct

SEQ ID NO: 249505 - DNA, 25 bp, Mus musculus
atctgagtacctccatgctgggcac

SEQ ID NO: 249506 - DNA, 25 bp, Mus musculus
atctgagtacctgcatgctgggcac

SEQ ID NO: 249507 - DNA, 25 bp, Mus musculus
atctgagtagggagacggtccctag

SEQ ID NO: 249508 - DNA, 25 bp, Mus musculus
atctgagtagggtgacggtccctag

SEQ ID NO: 249509 - DNA, 25 bp, Mus musculus
atctgagtattcagtagctgttttc

SEQ ID NO: 249510 - DNA, 25 bp, Mus musculus
atctgagtattctgtagctgttttc

SEQ ID NO: 249511 - DNA, 25 bp, Mus musculus
atctgagtccagcaagtgtcctata

SEQ ID NO: 249512 - DNA, 25 bp, Mus musculus
atctgagtccaggaagtgtcctata

SEQ ID NO: 249513 - DNA, 25 bp, Mus musculus
atctgagtgacgagagcctgcgttc

SEQ ID NO: 249514 - DNA, 25 bp, Mus musculus
atctgagtgacgtgagcctgcgttc

SEQ ID NO: 249515 - DNA, 25 bp, Mus musculus
atctgagtgattagccttctgtggc

SEQ ID NO: 249516 - DNA, 25 bp, Mus musculus
atctgagtgatttgccttctgtggc

SEQ ID NO: 249517 - DNA, 25 bp, Mus musculus
atctgagtgcataagccgagcttct

SEQ ID NO: 249518 - DNA, 25 bp, Mus musculus
atctgagtgcattagccgagcttct

SEQ ID NO: 249519 - DNA, 25 bp, Mus musculus
atctgagtgctaatgcgggtttcca

SEQ ID NO: 249520 - DNA, 25 bp, Mus musculus
atctgagtgctattgcgggtttcca

SEQ ID NO: 249521 - DNA, 25 bp, Mus musculus
atctgagtggcaagctacaaaagtt

SEQ ID NO: 249522 - DNA, 25 bp, Mus musculus
atctgagtggcaaggcagcttgccg

SEQ ID NO: 249523 - DNA, 25 bp, Mus musculus
atctgagtggcatgctacaaaagtt

SEQ ID NO: 249524 - DNA, 25 bp, Mus musculus
atctgagtggcatggcagcttgccg

SEQ ID NO: 249525 - DNA, 25 bp, Mus musculus
atctgagttactcagcaagttgcaa

SEQ ID NO: 249526 - DNA, 25 bp, Mus musculus
atctgagttactgagcaagttgcaa

SEQ ID NO: 249527 - DNA, 25 bp, Mus musculus
atctgagttaggatcccagcgcaca

SEQ ID NO: 249528 - DNA, 25 bp, Mus musculus
atctgagttaggttcccagcgcaca

SEQ ID NO: 249529 - DNA, 25 bp, Mus musculus
atctgagttcagacatggccaccac

SEQ ID NO: 249530 - DNA, 25 bp, Mus musculus
atctgagttcagtcatggccaccac

SEQ ID NO: 249531 - DNA, 25 bp, Mus musculus
atctgagttcccatgtcctataaca

SEQ ID NO: 249532 - DNA, 25 bp, Mus musculus
atctgagttcccttgtcctataaca

SEQ ID NO: 249533 - DNA, 25 bp, Mus musculus
atctgagtttccacaatttgtctag

SEQ ID NO: 249534 - DNA, 25 bp, Mus musculus
atctgagtttcctcaatttgtctag

SEQ ID NO: 249535 - DNA, 25 bp, Mus musculus
atctgataaaccactgtaccaaagt

SEQ ID NO: 249536 - DNA, 25 bp, Mus musculus
atctgataaacctctgtaccaaagt

SEQ ID NO: 249537 - DNA, 25 bp, Mus musculus
atctgataaactcatttccaaattt

SEQ ID NO: 249538 - DNA, 25 bp, Mus musculus
atctgataaactgatttccaaattt

SEQ ID NO: 249539 - DNA, 25 bp, Mus musculus
atctgataaagtacacccttccata

SEQ ID NO: 249540 - DNA, 25 bp, Mus musculus
atctgataaagttcacccttccata

SEQ ID NO: 249541 - DNA, 25 bp, Mus musculus
atctgataatggagtctcggcgcct

SEQ ID NO: 249542 - DNA, 25 bp, Mus musculus
atctgataatggtgtctcggcgcct

SEQ ID NO: 249543 - DNA, 25 bp, Mus musculus
atctgatactacaaagtgttctcac

SEQ ID NO: 249544 - DNA, 25 bp, Mus musculus
atctgatactactaagtgttctcac

SEQ ID NO: 249545 - DNA, 25 bp, Mus musculus
atctgatacttcagtcactgagctc

SEQ ID NO: 249546 - DNA, 25 bp, Mus musculus
atctgatacttctgtcactgagctc

SEQ ID NO: 249547 - DNA, 25 bp, Mus musculus
atctgatagatccacccttacaagg

SEQ ID NO: 249548 - DNA, 25 bp, Mus musculus
atctgatagatcgacccttacaagg

SEQ ID NO: 249549 - DNA, 25 bp, Mus musculus
atctgataggaaagctaacagctca

SEQ ID NO: 249550 - DNA, 25 bp, Mus musculus
atctgataggaatgctaacagctca

SEQ ID NO: 249551 - DNA, 25 bp, Mus musculus
atctgataggacacgcaccctggga

SEQ ID NO: 249552 - DNA, 25 bp, Mus musculus
atctgataggactcgcaccctggga

SEQ ID NO: 249553 - DNA, 25 bp, Mus musculus
atctgatatttgataccccactggt

SEQ ID NO: 249554 - DNA, 25 bp, Mus musculus
atctgatatttgttaccccactggt

SEQ ID NO: 249555 - DNA, 25 bp, Mus musculus
atctgatcattcattcccaaattcc

SEQ ID NO: 249556 - DNA, 25 bp, Mus musculus
atctgatcattctttcccaaattcc

SEQ ID NO: 249557 - DNA, 25 bp, Mus musculus
atctgatccccacagcttatatgag

SEQ ID NO: 249558 - DNA, 25 bp, Mus musculus
atctgatccccagagcttatatgag

SEQ ID NO: 249559 - DNA, 25 bp, Mus musculus
atctgatccttcattacgtgtctaa

SEQ ID NO: 249560 - DNA, 25 bp, Mus musculus
atctgatccttctttacgtgtctaa

SEQ ID NO: 249561 - DNA, 25 bp, Mus musculus
atctgatcgaggagactggccactt

SEQ ID NO: 249562 - DNA, 25 bp, Mus musculus
atctgatcgaggtgactggccactt

SEQ ID NO: 249563 - DNA, 25 bp, Mus musculus
atctgatcgcggagatccacacagc

SEQ ID NO: 249564 - DNA, 25 bp, Mus musculus
atctgatcgcggtgatccacacagc

SEQ ID NO: 249565 - DNA, 25 bp, Mus musculus
atctgatcgtcccaattctactata

SEQ ID NO: 249566 - DNA, 25 bp, Mus musculus
atctgatcgtccgaattctactata

SEQ ID NO: 249567 - DNA, 25 bp, Mus musculus
atctgatctgttcaggctcttttct

SEQ ID NO: 249568 - DNA, 25 bp, Mus musculus
atctgatctgttgaggctcttttct

SEQ ID NO: 249569 - DNA, 25 bp, Mus musculus
atctgatctttgatttccactccat

SEQ ID NO: 249570 - DNA, 25 bp, Mus musculus
atctgatctttgttttccactccat

SEQ ID NO: 249571 - DNA, 25 bp, Mus musculus
atctgatgaagacgtccccacgtgt

SEQ ID NO: 249572 - DNA, 25 bp, Mus musculus
atctgatgaagaggtccccacgtgt

SEQ ID NO: 249573 - DNA, 25 bp, Mus musculus
atctgatgaattacaataaaactga

SEQ ID NO: 249574 - DNA, 25 bp, Mus musculus
atctgatgaatttcaataaaactga

SEQ ID NO: 249575 - DNA, 25 bp, Mus musculus
atctgatgacctcttttgacttcca

SEQ ID NO: 249576 - DNA, 25 bp, Mus musculus
atctgatgacctgttttgacttcca

SEQ ID NO: 249577 - DNA, 25 bp, Mus musculus
atctgatgagtaactgagctcttct

SEQ ID NO: 249578 - DNA, 25 bp, Mus musculus
atctgatgagtatctgagctcttct

SEQ ID NO: 249579 - DNA, 25 bp, Mus musculus
atctgatggcctcgtgtcctatgga

SEQ ID NO: 249580 - DNA, 25 bp, Mus musculus
atctgatggcctggtgtcctatgga

SEQ ID NO: 249581 - DNA, 25 bp, Mus musculus
atctgatggctcagtggacccaatt

SEQ ID NO: 249582 - DNA, 25 bp, Mus musculus
atctgatggctctgtggacccaatt

SEQ ID NO: 249583 - DNA, 25 bp, Mus musculus
atctgatgggagctcatgccgttat

SEQ ID NO: 249584 - DNA, 25 bp, Mus musculus
atctgatgggaggtcatgccgttat

SEQ ID NO: 249585 - DNA, 25 bp, Mus musculus
atctgatgtataccttccctgcaat

SEQ ID NO: 249586 - DNA, 25 bp, Mus musculus
atctgatgtatagcttccctgcaat

SEQ ID NO: 249587 - DNA, 25 bp, Mus musculus
atctgatgtcatactgttttgtaag

SEQ ID NO: 249588 - DNA, 25 bp, Mus musculus
atctgatgtcattctgttttgtaag

SEQ ID NO: 249589 - DNA, 25 bp, Mus musculus
atctgattagataagtgggtgcctt

SEQ ID NO: 249590 - DNA, 25 bp, Mus musculus
atctgattagattagtgggtgcctt

SEQ ID NO: 249591 - DNA, 25 bp, Mus musculus
atctgattatccataagttcccctg

SEQ ID NO: 249592 - DNA, 25 bp, Mus musculus
atctgattatccttaagttcccctg

SEQ ID NO: 249593 - DNA, 25 bp, Mus musculus
atctgatttgccatacactgtgaat

SEQ ID NO: 249594 - DNA, 25 bp, Mus musculus
atctgatttgccttacactgtgaat

SEQ ID NO: 249595 - DNA, 25 bp, Mus musculus
atctgattttataactgggcaaggc

SEQ ID NO: 249596 - DNA, 25 bp, Mus musculus
atctgattttattactgggcaaggc

SEQ ID NO: 249597 - DNA, 25 bp, Mus musculus
atctgcaaaacgatcgatttctggt

SEQ ID NO: 249598 - DNA, 25 bp, Mus musculus
atctgcaaaacgttcgatttctggt

SEQ ID NO: 249599 - DNA, 25 bp, Mus musculus
atctgcaaaatcatataatcctctt

SEQ ID NO: 249600 - DNA, 25 bp, Mus musculus
atctgcaaaatcttataatcctctt

SEQ ID NO: 249601 - DNA, 25 bp, Mus musculus
atctgcaaagcaagagagtggcccc

SEQ ID NO: 249602 - DNA, 25 bp, Mus musculus
atctgcaaagcatgagagtggcccc

SEQ ID NO: 249603 - DNA, 25 bp, Mus musculus
atctgcaacacaacgtgcggtgcgt

SEQ ID NO: 249604 - DNA, 25 bp, Mus musculus
atctgcaacacatcgtgcggtgcgt

SEQ ID NO: 249605 - DNA, 25 bp, Mus musculus
atctgcaactttacatggtctttca

SEQ ID NO: 249606 - DNA, 25 bp, Mus musculus
atctgcaacttttcatggtctttca

SEQ ID NO: 249607 - DNA, 25 bp, Mus musculus
atctgcaaggacaattacggttttg

SEQ ID NO: 249608 - DNA, 25 bp, Mus musculus
atctgcaaggactattacggttttg

SEQ ID NO: 249609 - DNA, 25 bp, Mus musculus
atctgcaaggctccagtctggcagg

SEQ ID NO: 249610 - DNA, 25 bp, Mus musculus
atctgcaaggctgcagtctggcagg

SEQ ID NO: 249611 - DNA, 25 bp, Mus musculus
atctgcaagggccaaagaccgtcta

SEQ ID NO: 249612 - DNA, 25 bp, Mus musculus
atctgcaagggcgaaagaccgtcta

SEQ ID NO: 249613 - DNA, 25 bp, Mus musculus
atctgcaatccccagcagagagttg

SEQ ID NO: 249614 - DNA, 25 bp, Mus musculus
atctgcaatcccgagcagagagttg

SEQ ID NO: 249615 - DNA, 25 bp, Mus musculus
atctgcaatggcattcttcatggag

SEQ ID NO: 249616 - DNA, 25 bp, Mus musculus
atctgcaatggctttcttcatggag

SEQ ID NO: 249617 - DNA, 25 bp, Mus musculus
atctgcaattctagagctcctggcg

SEQ ID NO: 249618 - DNA, 25 bp, Mus musculus
atctgcaattcttgagctcctggcg

SEQ ID NO: 249619 - DNA, 25 bp, Mus musculus
atctgcacagacacctcaagaagga

SEQ ID NO: 249620 - DNA, 25 bp, Mus musculus
atctgcacagactcctcaagaagga

SEQ ID NO: 249621 - DNA, 25 bp, Mus musculus
atctgcacagggaaaaactgattcc

SEQ ID NO: 249622 - DNA, 25 bp, Mus musculus
atctgcacagggtaaaactgattcc

SEQ ID NO: 249623 - DNA, 25 bp, Mus musculus
atctgcacaggtaatcttggcttct

SEQ ID NO: 249624 - DNA, 25 bp, Mus musculus
atctgcacaggttatcttggcttct

SEQ ID NO: 249625 - DNA, 25 bp, Mus musculus
atctgcacccagcattgagcacagt

SEQ ID NO: 249626 - DNA, 25 bp, Mus musculus
atctgcacccaggattgagcacagt

SEQ ID NO: 249627 - DNA, 25 bp, Mus musculus
atctgcacccatatgttcttattta

SEQ ID NO: 249628 - DNA, 25 bp, Mus musculus
atctgcacccatcagagtttaataa

SEQ ID NO: 249629 - DNA, 25 bp, Mus musculus
atctgcacccatgagagtttaataa

SEQ ID NO: 249630 - DNA, 25 bp, Mus musculus
atctgcacccatttgttcttattta

SEQ ID NO: 249631 - DNA, 25 bp, Mus musculus
atctgcacgggcataagtccttatc

SEQ ID NO: 249632 - DNA, 25 bp, Mus musculus
atctgcacgggcttaagtccttatc

SEQ ID NO: 249633 - DNA, 25 bp, Mus musculus
atctgcactaatcggtctgcacagc

SEQ ID NO: 249634 - DNA, 25 bp, Mus musculus
atctgcactaatgggtctgcacagc

SEQ ID NO: 249635 - DNA, 25 bp, Mus musculus
atctgcagagacacatgtttcctta

SEQ ID NO: 249636 - DNA, 25 bp, Mus musculus
atctgcagagactcatgtttcctta

SEQ ID NO: 249637 - DNA, 25 bp, Mus musculus
atctgcagagcacgacaccgtgctt

SEQ ID NO: 249638 - DNA, 25 bp, Mus musculus
atctgcagagcaggacaccgtgctt

SEQ ID NO: 249639 - DNA, 25 bp, Mus musculus
atctgcagaggtccaagcgagcact

SEQ ID NO: 249640 - DNA, 25 bp, Mus musculus
atctgcagaggtgcaagcgagcact

SEQ ID NO: 249641 - DNA, 25 bp, Mus musculus
atctgcagatctacccggatggcaa

SEQ ID NO: 249642 - DNA, 25 bp, Mus musculus
atctgcagatcttcccggatggcaa

SEQ ID NO: 249643 - DNA, 25 bp, Mus musculus
atctgcagatgcagggcatttccgg

SEQ ID NO: 249644 - DNA, 25 bp, Mus musculus
atctgcagatgctgggcatttccgg

SEQ ID NO: 249645 - DNA, 25 bp, Mus musculus
atctgcagatggcacgcgctgcctg

SEQ ID NO: 249646 - DNA, 25 bp, Mus musculus
atctgcagatgggacgcgctgcctg

SEQ ID NO: 249647 - DNA, 25 bp, Mus musculus
atctgcagattgcacctctcaagaa

SEQ ID NO: 249648 - DNA, 25 bp, Mus musculus
atctgcagattggacctctcaagaa

SEQ ID NO: 249649 - DNA, 25 bp, Mus musculus
atctgcagcagcatacggacgggcc

SEQ ID NO: 249650 - DNA, 25 bp, Mus musculus
atctgcagcagcttacggacgggcc

SEQ ID NO: 249651 - DNA, 25 bp, Mus musculus
atctgcagcagtccttgaacttcaa

SEQ ID NO: 249652 - DNA, 25 bp, Mus musculus
atctgcagcagtgcttgaacttcaa

SEQ ID NO: 249653 - DNA, 25 bp, Mus musculus
atctgcagcatacctttgggcgtct

SEQ ID NO: 249654 - DNA, 25 bp, Mus musculus
atctgcagcatagctttgggcgtct

SEQ ID NO: 249655 - DNA, 25 bp, Mus musculus
atctgcagcatcaactcctttgtga

SEQ ID NO: 249656 - DNA, 25 bp, Mus musculus
atctgcagcatctactcctttgtga

SEQ ID NO: 249657 - DNA, 25 bp, Mus musculus
atctgcagccctccgattcggtatc

SEQ ID NO: 249658 - DNA, 25 bp, Mus musculus
atctgcagccctgcgattcggtatc

SEQ ID NO: 249659 - DNA, 25 bp, Mus musculus
atctgcagctatctaatgcccgtaa

SEQ ID NO: 249660 - DNA, 25 bp, Mus musculus
atctgcagctatgtaatgcccgtaa

SEQ ID NO: 249661 - DNA, 25 bp, Mus musculus
atctgcagcttccaaacgcaccagg

SEQ ID NO: 249662 - DNA, 25 bp, Mus musculus
atctgcagcttcgaaacgcaccagg

SEQ ID NO: 249663 - DNA, 25 bp, Mus musculus
atctgcaggacccaatggcaagcaa

SEQ ID NO: 249664 - DNA, 25 bp, Mus musculus
atctgcaggaccgaatggcaagcaa

SEQ ID NO: 249665 - DNA, 25 bp, Mus musculus
atctgcaggcagacacggatctgag

SEQ ID NO: 249666 - DNA, 25 bp, Mus musculus
atctgcaggcagtcacggatctgag

SEQ ID NO: 249667 - DNA, 25 bp, Mus musculus
atctgcagggtcagagccatggtgc

SEQ ID NO: 249668 - DNA, 25 bp, Mus musculus
atctgcagggtcaggaccgagtttg

SEQ ID NO: 249669 - DNA, 25 bp, Mus musculus
atctgcagggtctgagccatggtgc

SEQ ID NO: 249670 - DNA, 25 bp, Mus musculus
atctgcagggtctggaccgagtttg

SEQ ID NO: 249671 - DNA, 25 bp, Mus musculus
atctgcagtagtcgagctaccccta

SEQ ID NO: 249672 - DNA, 25 bp, Mus musculus
atctgcagtagtggagctaccccta

SEQ ID NO: 249673 - DNA, 25 bp, Mus musculus
atctgcagtccaattcgtgtagtga

SEQ ID NO: 249674 - DNA, 25 bp, Mus musculus
atctgcagtccatttcgtgtagtga

SEQ ID NO: 249675 - DNA, 25 bp, Mus musculus
atctgcagtgggacagtgtgagcct

SEQ ID NO: 249676 - DNA, 25 bp, Mus musculus
atctgcagtgggatcttccggaacg

SEQ ID NO: 249677 - DNA, 25 bp, Mus musculus
atctgcagtgggtcagtgtgagcct

SEQ ID NO: 249678 - DNA, 25 bp, Mus musculus
atctgcagtgggttcttccggaacg

SEQ ID NO: 249679 - DNA, 25 bp, Mus musculus
atctgcagttggagatccttccagg

SEQ ID NO: 249680 - DNA, 25 bp, Mus musculus
atctgcagttggtgatccttccagg

SEQ ID NO: 249681 - DNA, 25 bp, Mus musculus
atctgcagttttaatggcttccctc

SEQ ID NO: 249682 - DNA, 25 bp, Mus musculus
atctgcagtttttatggcttccctc

SEQ ID NO: 249683 - DNA, 25 bp, Mus musculus
atctgcatacatcttacggctgcca

SEQ ID NO: 249684 - DNA, 25 bp, Mus musculus
atctgcatacatgttacggctgcca

SEQ ID NO: 249685 - DNA, 25 bp, Mus musculus
atctgcatatagaatctgtactcct

SEQ ID NO: 249686 - DNA, 25 bp, Mus musculus
atctgcatatagtatctgtactcct

SEQ ID NO: 249687 - DNA, 25 bp, Mus musculus
atctgcatatttctgatcttcgtat

SEQ ID NO: 249688 - DNA, 25 bp, Mus musculus
atctgcatatttgtgatcttcgtat

SEQ ID NO: 249689 - DNA, 25 bp, Mus musculus
atctgcatcaatacatgccctcata

SEQ ID NO: 249690 - DNA, 25 bp, Mus musculus
atctgcatcaattcatgccctcata

SEQ ID NO: 249691 - DNA, 25 bp, Mus musculus
atctgcatcattcttgtatctcccc

SEQ ID NO: 249692 - DNA, 25 bp, Mus musculus
atctgcatcattgttgtatctcccc

SEQ ID NO: 249693 - DNA, 25 bp, Mus musculus
atctgcatctgcatccaaggtctaa

SEQ ID NO: 249694 - DNA, 25 bp, Mus musculus
atctgcatctgcttccaaggtctaa

SEQ ID NO: 249695 - DNA, 25 bp, Mus musculus
atctgcatgcagaggtgaatcattc

SEQ ID NO: 249696 - DNA, 25 bp, Mus musculus
atctgcatgcagtggtgaatcattc

SEQ ID NO: 249697 - DNA, 25 bp, Mus musculus
atctgcatggccaaaacacacttgt

SEQ ID NO: 249698 - DNA, 25 bp, Mus musculus
atctgcatggcctaaacacacttgt

SEQ ID NO: 249699 - DNA, 25 bp, Mus musculus
atctgcatgggaacaaaccccgcta

SEQ ID NO: 249700 - DNA, 25 bp, Mus musculus
atctgcatgggatcaaaccccgcta

SEQ ID NO: 249701 - DNA, 25 bp, Mus musculus
atctgcatgtatcctgtgacacttg

SEQ ID NO: 249702 - DNA, 25 bp, Mus musculus
atctgcatgtatgctgtgacacttg

SEQ ID NO: 249703 - DNA, 25 bp, Mus musculus
atctgcatgtgcacactgtaatttt

SEQ ID NO: 249704 - DNA, 25 bp, Mus musculus
atctgcatgtgctcactgtaatttt

SEQ ID NO: 249705 - DNA, 25 bp, Mus musculus
atctgcattattaattaggttctat

SEQ ID NO: 249706 - DNA, 25 bp, Mus musculus
atctgcattatttattaggttctat

SEQ ID NO: 249707 - DNA, 25 bp, Mus musculus
atctgcattcccaccaatggatgtt

SEQ ID NO: 249708 - DNA, 25 bp, Mus musculus
atctgcattccctccaatggatgtt

SEQ ID NO: 249709 - DNA, 25 bp, Mus musculus
atctgcattcgacggctcagcagcg

SEQ ID NO: 249710 - DNA, 25 bp, Mus musculus
atctgcattcgagggctcagcagcg

SEQ ID NO: 249711 - DNA, 25 bp, Mus musculus
atctgcattcgcacactggtgcaca

SEQ ID NO: 249712 - DNA, 25 bp, Mus musculus
atctgcattcgctcactggtgcaca

SEQ ID NO: 249713 - DNA, 25 bp, Mus musculus
atctgcattctacctgatgagggca

SEQ ID NO: 249714 - DNA, 25 bp, Mus musculus
atctgcattctagctgatgagggca

SEQ ID NO: 249715 - DNA, 25 bp, Mus musculus
atctgcattgaacacatctgcaagt

SEQ ID NO: 249716 - DNA, 25 bp, Mus musculus
atctgcattgaagacatctgcaagt

SEQ ID NO: 249717 - DNA, 25 bp, Mus musculus
atctgcattgctctgtctcctgaat

SEQ ID NO: 249718 - DNA, 25 bp, Mus musculus
atctgcattgctgtgtctcctgaat

SEQ ID NO: 249719 - DNA, 25 bp, Mus musculus
atctgcattgggatcataagcctgg

SEQ ID NO: 249720 - DNA, 25 bp, Mus musculus
atctgcattgggttcataagcctgg

SEQ ID NO: 249721 - DNA, 25 bp, Mus musculus
atctgcatttctcggcacagttcca

SEQ ID NO: 249722 - DNA, 25 bp, Mus musculus
atctgcatttctgggcacagttcca

SEQ ID NO: 249723 - DNA, 25 bp, Mus musculus
atctgccaaacaccgagatatagga

SEQ ID NO: 249724 - DNA, 25 bp, Mus musculus
atctgccaaacagcgagatatagga

SEQ ID NO: 249725 - DNA, 25 bp, Mus musculus
atctgccaaatgctaggacttcctg

SEQ ID NO: 249726 - DNA, 25 bp, Mus musculus
atctgccaaatggtaggacttcctg

SEQ ID NO: 249727 - DNA, 25 bp, Mus musculus
atctgccaacttcccaaatgtgtgt

SEQ ID NO: 249728 - DNA, 25 bp, Mus musculus
atctgccaacttgccaaatgtgtgt

SEQ ID NO: 249729 - DNA, 25 bp, Mus musculus
atctgccaagcacctagccgatatc

SEQ ID NO: 249730 - DNA, 25 bp, Mus musculus
atctgccaagcagctagccgatatc

SEQ ID NO: 249731 - DNA, 25 bp, Mus musculus
atctgccaagggatagagagtccca

SEQ ID NO: 249732 - DNA, 25 bp, Mus musculus
atctgccaagggttagagagtccca

SEQ ID NO: 249733 - DNA, 25 bp, Mus musculus
atctgccacaacaggaaatgctcaa

SEQ ID NO: 249734 - DNA, 25 bp, Mus musculus
atctgccacaactggaaatgctcaa

SEQ ID NO: 249735 - DNA, 25 bp, Mus musculus
atctgccacccaaagttacattact

SEQ ID NO: 249736 - DNA, 25 bp, Mus musculus
atctgccacccatagttacattact

SEQ ID NO: 249737 - DNA, 25 bp, Mus musculus
atctgccacgtgatgacgagctcgg

SEQ ID NO: 249738 - DNA, 25 bp, Mus musculus
atctgccacgtgttgacgagctcgg

SEQ ID NO: 249739 - DNA, 25 bp, Mus musculus
atctgccactgtcacttcggttatg

SEQ ID NO: 249740 - DNA, 25 bp, Mus musculus
atctgccactgtgacttcggttatg

SEQ ID NO: 249741 - DNA, 25 bp, Mus musculus
atctgccagagtatccttttggtgt

SEQ ID NO: 249742 - DNA, 25 bp, Mus musculus
atctgccagagtttccttttggtgt

SEQ ID NO: 249743 - DNA, 25 bp, Mus musculus
atctgccagcggacctaatggtgat

SEQ ID NO: 249744 - DNA, 25 bp, Mus musculus
atctgccagcggtcctaatggtgat

SEQ ID NO: 249745 - DNA, 25 bp, Mus musculus
atctgccagggcaagatcatgctgg

SEQ ID NO: 249746 - DNA, 25 bp, Mus musculus
atctgccagggctagatcatgctgg

SEQ ID NO: 249747 - DNA, 25 bp, Mus musculus
atctgccagtcccaacatgtatgag

SEQ ID NO: 249748 - DNA, 25 bp, Mus musculus
atctgccagtccgaacatgtatgag

SEQ ID NO: 249749 - DNA, 25 bp, Mus musculus
atctgccatctccagaggtccaggt

SEQ ID NO: 249750 - DNA, 25 bp, Mus musculus
atctgccatctcgagaggtccaggt

SEQ ID NO: 249751 - DNA, 25 bp, Mus musculus
atctgccatggtcgaaagtgcccct

SEQ ID NO: 249752 - DNA, 25 bp, Mus musculus
atctgccatggtggaaagtgcccct

SEQ ID NO: 249753 - DNA, 25 bp, Mus musculus
atctgcccaatgaatagccgtgttt

SEQ ID NO: 249754 - DNA, 25 bp, Mus musculus
atctgcccaatgtatagccgtgttt

SEQ ID NO: 249755 - DNA, 25 bp, Mus musculus
atctgcccacagcaatgatggacca

SEQ ID NO: 249756 - DNA, 25 bp, Mus musculus
atctgcccacaggaatgatggacca

SEQ ID NO: 249757 - DNA, 25 bp, Mus musculus
atctgcccactaaagcttcataaac

SEQ ID NO: 249758 - DNA, 25 bp, Mus musculus
atctgcccactatagcttcataaac

SEQ ID NO: 249759 - DNA, 25 bp, Mus musculus
atctgcccactgagctttggtgaaa

SEQ ID NO: 249760 - DNA, 25 bp, Mus musculus
atctgcccactgtgctttggtgaaa

SEQ ID NO: 249761 - DNA, 25 bp, Mus musculus
atctgcccagatccaagctgatctc

SEQ ID NO: 249762 - DNA, 25 bp, Mus musculus
atctgcccagatgcaagctgatctc

SEQ ID NO: 249763 - DNA, 25 bp, Mus musculus
atctgcccagttaactttgagtttt

SEQ ID NO: 249764 - DNA, 25 bp, Mus musculus
atctgcccagtttactttgagtttt

SEQ ID NO: 249765 - DNA, 25 bp, Mus musculus
atctgcccatttaatggcttcttgt

SEQ ID NO: 249766 - DNA, 25 bp, Mus musculus
atctgcccattttatggcttcttgt

SEQ ID NO: 249767 - DNA, 25 bp, Mus musculus
atctgccccactaaggaactgcaga

SEQ ID NO: 249768 - DNA, 25 bp, Mus musculus
atctgccccacttaggaactgcaga

SEQ ID NO: 249769 - DNA, 25 bp, Mus musculus
atctgccccataacacagctggaaa

SEQ ID NO: 249770 - DNA, 25 bp, Mus musculus
atctgccccatatcacagctggaaa

SEQ ID NO: 249771 - DNA, 25 bp, Mus musculus
atctgccccttcagaattctgcagg

SEQ ID NO: 249772 - DNA, 25 bp, Mus musculus
atctgccccttctgaattctgcagg

SEQ ID NO: 249773 - DNA, 25 bp, Mus musculus
atctgcccctttaatttactcttgg

SEQ ID NO: 249774 - DNA, 25 bp, Mus musculus
atctgccccttttatttactcttgg

SEQ ID NO: 249775 - DNA, 25 bp, Mus musculus
atctgcccgctacgcctcagggagt

SEQ ID NO: 249776 - DNA, 25 bp, Mus musculus
atctgcccgctaggcctcagggagt

SEQ ID NO: 249777 - DNA, 25 bp, Mus musculus
atctgcccttcaagcagtggctata

SEQ ID NO: 249778 - DNA, 25 bp, Mus musculus
atctgcccttcatgcagtggctata

SEQ ID NO: 249779 - DNA, 25 bp, Mus musculus
atctgccctttgagtataagcccga

SEQ ID NO: 249780 - DNA, 25 bp, Mus musculus
atctgccctttgtgtataagcccga

SEQ ID NO: 249781 - DNA, 25 bp, Mus musculus
atctgccggagaatcttcaaggctt

SEQ ID NO: 249782 - DNA, 25 bp, Mus musculus
atctgccggagattcttcaaggctt

SEQ ID NO: 249783 - DNA, 25 bp, Mus musculus
atctgccgtcctccatctgggaagc

SEQ ID NO: 249784 - DNA, 25 bp, Mus musculus
atctgccgtcctgcatctgggaagc

SEQ ID NO: 249785 - DNA, 25 bp, Mus musculus
atctgccgtggaattggtatcgtat

SEQ ID NO: 249786 - DNA, 25 bp, Mus musculus
atctgccgtggatttggtatcgtat

SEQ ID NO: 249787 - DNA, 25 bp, Mus musculus
atctgcctagaaagagaccttcctg

SEQ ID NO: 249788 - DNA, 25 bp, Mus musculus
atctgcctagaatgagaccttcctg

SEQ ID NO: 249789 - DNA, 25 bp, Mus musculus
atctgcctagcaaagagtggcgcat

SEQ ID NO: 249790 - DNA, 25 bp, Mus musculus
atctgcctagcatagagtggcgcat

SEQ ID NO: 249791 - DNA, 25 bp, Mus musculus
atctgcctaggtaatgctcaaagaa

SEQ ID NO: 249792 - DNA, 25 bp, Mus musculus
atctgcctaggttatgctcaaagaa

SEQ ID NO: 249793 - DNA, 25 bp, Mus musculus
atctgcctatttcctcgagatcaaa

SEQ ID NO: 249794 - DNA, 25 bp, Mus musculus
atctgcctatttgctcgagatcaaa

SEQ ID NO: 249795 - DNA, 25 bp, Mus musculus
atctgcctcagcaggacacttgtaa

SEQ ID NO: 249796 - DNA, 25 bp, Mus musculus
atctgcctcagctggacacttgtaa

SEQ ID NO: 249797 - DNA, 25 bp, Mus musculus
atctgcctcatccttatgtacagtg

SEQ ID NO: 249798 - DNA, 25 bp, Mus musculus
atctgcctcatcgttatgtacagtg

SEQ ID NO: 249799 - DNA, 25 bp, Mus musculus
atctgcctcattagaacctgatgta

SEQ ID NO: 249800 - DNA, 25 bp, Mus musculus
atctgcctcatttgaacctgatgta

SEQ ID NO: 249801 - DNA, 25 bp, Mus musculus
atctgcctcctaaaagactcggatg

SEQ ID NO: 249802 - DNA, 25 bp, Mus musculus
atctgcctcctataagactcggatg

SEQ ID NO: 249803 - DNA, 25 bp, Mus musculus
atctgcctctccatgattctaaaaa

SEQ ID NO: 249804 - DNA, 25 bp, Mus musculus
atctgcctctccttgattctaaaaa

SEQ ID NO: 249805 - DNA, 25 bp, Mus musculus
atctgcctctggagacatgcataca

SEQ ID NO: 249806 - DNA, 25 bp, Mus musculus
atctgcctctggtgacatgcataca

SEQ ID NO: 249807 - DNA, 25 bp, Mus musculus
atctgcctgaacaaatacctagtaa

SEQ ID NO: 249808 - DNA, 25 bp, Mus musculus
atctgcctgaactaatacctagtaa

SEQ ID NO: 249809 - DNA, 25 bp, Mus musculus
atctgcctgagtatgggtcatctcc

SEQ ID NO: 249810 - DNA, 25 bp, Mus musculus
atctgcctgagtttgggtcatctcc

SEQ ID NO: 249811 - DNA, 25 bp, Mus musculus
atctgcctgcacatatatctgtatg

SEQ ID NO: 249812 - DNA, 25 bp, Mus musculus
atctgcctgcacttatatctgtatg

SEQ ID NO: 249813 - DNA, 25 bp, Mus musculus
atctgcctgccgaacaatgggctgg

SEQ ID NO: 249814 - DNA, 25 bp, Mus musculus
atctgcctgccgtacaatgggctgg

SEQ ID NO: 249815 - DNA, 25 bp, Mus musculus
atctgcctggtgacacagtgtattc

SEQ ID NO: 249816 - DNA, 25 bp, Mus musculus
atctgcctggtgtcacagtgtattc

SEQ ID NO: 249817 - DNA, 25 bp, Mus musculus
atctgcctgtagagatggcctgtgc

SEQ ID NO: 249818 - DNA, 25 bp, Mus musculus
atctgcctgtagtgatggcctgtgc

SEQ ID NO: 249819 - DNA, 25 bp, Mus musculus
atctgccttagtagcttcctaactt

SEQ ID NO: 249820 - DNA, 25 bp, Mus musculus
atctgccttagttgcttcctaactt

SEQ ID NO: 249821 - DNA, 25 bp, Mus musculus
atctgccttcagagcctaagatgaa

SEQ ID NO: 249822 - DNA, 25 bp, Mus musculus
atctgccttcagtgcctaagatgaa

SEQ ID NO: 249823 - DNA, 25 bp, Mus musculus
atctgccttcccaaaggaaagtgtc

SEQ ID NO: 249824 - DNA, 25 bp, Mus musculus
atctgccttccctaaggaaagtgtc

SEQ ID NO: 249825 - DNA, 25 bp, Mus musculus
atctgccttcctaacacatgtaatt

SEQ ID NO: 249826 - DNA, 25 bp, Mus musculus
atctgccttcctcagggccaaggaa

SEQ ID NO: 249827 - DNA, 25 bp, Mus musculus
atctgccttcctgagggccaaggaa

SEQ ID NO: 249828 - DNA, 25 bp, Mus musculus
atctgccttccttacacatgtaatt

SEQ ID NO: 249829 - DNA, 25 bp, Mus musculus
atctgccttctcagacgttgagagt

SEQ ID NO: 249830 - DNA, 25 bp, Mus musculus
atctgccttctctgacgttgagagt

SEQ ID NO: 249831 - DNA, 25 bp, Mus musculus
atctgccttggaattgttccttcac

SEQ ID NO: 249832 - DNA, 25 bp, Mus musculus
atctgccttggatttgttccttcac

SEQ ID NO: 249833 - DNA, 25 bp, Mus musculus
atctgccttgtccagctaataaatg

SEQ ID NO: 249834 - DNA, 25 bp, Mus musculus
atctgccttgtcgagctaataaatg

SEQ ID NO: 249835 - DNA, 25 bp, Mus musculus
atctgcctttccctttgaactatta

SEQ ID NO: 249836 - DNA, 25 bp, Mus musculus
atctgcctttccgtttgaactatta

SEQ ID NO: 249837 - DNA, 25 bp, Mus musculus
atctgccttttgcaactgccagttc

SEQ ID NO: 249838 - DNA, 25 bp, Mus musculus
atctgccttttggaactgccagttc

SEQ ID NO: 249839 - DNA, 25 bp, Mus musculus
atctgcgagggacctgtgtttccca

SEQ ID NO: 249840 - DNA, 25 bp, Mus musculus
atctgcgagggagctgtgtttccca

SEQ ID NO: 249841 - DNA, 25 bp, Mus musculus
atctgcgagttcaccagcatgatga

SEQ ID NO: 249842 - DNA, 25 bp, Mus musculus
atctgcgagttctccagcatgatga

SEQ ID NO: 249843 - DNA, 25 bp, Mus musculus
atctgcgatcaacagcaatctcctg

SEQ ID NO: 249844 - DNA, 25 bp, Mus musculus
atctgcgatcaagagcaatctcctg

SEQ ID NO: 249845 - DNA, 25 bp, Mus musculus
atctgcgattacacctactacctgt

SEQ ID NO: 249846 - DNA, 25 bp, Mus musculus
atctgcgattactcctactacctgt

SEQ ID NO: 249847 - DNA, 25 bp, Mus musculus
atctgcgatttcagattcaatccag

SEQ ID NO: 249848 - DNA, 25 bp, Mus musculus
atctgcgatttctgattcaatccag

SEQ ID NO: 249849 - DNA, 25 bp, Mus musculus
atctgcgcacctcagttgtgatgaa

SEQ ID NO: 249850 - DNA, 25 bp, Mus musculus
atctgcgcacctgagttgtgatgaa

SEQ ID NO: 249851 - DNA, 25 bp, Mus musculus
atctgcgcccggagatacggattgc

SEQ ID NO: 249852 - DNA, 25 bp, Mus musculus
atctgcgcccggtgatacggattgc

SEQ ID NO: 249853 - DNA, 25 bp, Mus musculus
atctgcgcgcggagcgttcagtgct

SEQ ID NO: 249854 - DNA, 25 bp, Mus musculus
atctgcgcgcggtgcgttcagtgct

SEQ ID NO: 249855 - DNA, 25 bp, Mus musculus
atctgcgctgagcacacctgtaggc

SEQ ID NO: 249856 - DNA, 25 bp, Mus musculus
atctgcgctgaggacacctgtaggc

SEQ ID NO: 249857 - DNA, 25 bp, Mus musculus
atctgcggccataaatcccatcctt

SEQ ID NO: 249858 - DNA, 25 bp, Mus musculus
atctgcggccattaatcccatcctt

SEQ ID NO: 249859 - DNA, 25 bp, Mus musculus
atctgcggctccctagaggaatttc

SEQ ID NO: 249860 - DNA, 25 bp, Mus musculus
atctgcggctccgtagaggaatttc

SEQ ID NO: 249861 - DNA, 25 bp, Mus musculus
atctgcgggccaagcgttggacaca

SEQ ID NO: 249862 - DNA, 25 bp, Mus musculus
atctgcgggccatgcgttggacaca

SEQ ID NO: 249863 - DNA, 25 bp, Mus musculus
atctgcgggcctcggtctctctggt

SEQ ID NO: 249864 - DNA, 25 bp, Mus musculus
atctgcgggcctgggtctctctggt

SEQ ID NO: 249865 - DNA, 25 bp, Mus musculus
atctgcgggtgaagtttgtgccaac

SEQ ID NO: 249866 - DNA, 25 bp, Mus musculus
atctgcgggtgatgtttgtgccaac

SEQ ID NO: 249867 - DNA, 25 bp, Mus musculus
atctgcggtgaacccaaggaagccc

SEQ ID NO: 249868 - DNA, 25 bp, Mus musculus
atctgcggtgaagccaaggaagccc

SEQ ID NO: 249869 - DNA, 25 bp, Mus musculus
atctgcgtcatccatcggaggcatc

SEQ ID NO: 249870 - DNA, 25 bp, Mus musculus
atctgcgtcatcgatcggaggcatc

SEQ ID NO: 249871 - DNA, 25 bp, Mus musculus
atctgcgtgagcctaaagttcatat

SEQ ID NO: 249872 - DNA, 25 bp, Mus musculus
atctgcgtgagcgtaaagttcatat

SEQ ID NO: 249873 - DNA, 25 bp, Mus musculus
atctgcgtggtaagtgggatgcccc

SEQ ID NO: 249874 - DNA, 25 bp, Mus musculus
atctgcgtggtatgtgggatgcccc

SEQ ID NO: 249875 - DNA, 25 bp, Mus musculus
atctgctaaaaactgcctgctccgg

SEQ ID NO: 249876 - DNA, 25 bp, Mus musculus
atctgctaaaaagtgcctgctccgg

SEQ ID NO: 249877 - DNA, 25 bp, Mus musculus
atctgctaaagaaaagtatgctgct

SEQ ID NO: 249878 - DNA, 25 bp, Mus musculus
atctgctaaagataagtatgctgct

SEQ ID NO: 249879 - DNA, 25 bp, Mus musculus
atctgctaatgaacgggaccactta

SEQ ID NO: 249880 - DNA, 25 bp, Mus musculus
atctgctaatgacacagcccctgag

SEQ ID NO: 249881 - DNA, 25 bp, Mus musculus
atctgctaatgagacagcccctgag

SEQ ID NO: 249882 - DNA, 25 bp, Mus musculus
atctgctaatgatcgggaccactta

SEQ ID NO: 249883 - DNA, 25 bp, Mus musculus
atctgctaatttcagctgctggctc

SEQ ID NO: 249884 - DNA, 25 bp, Mus musculus
atctgctaatttgagctgctggctc

SEQ ID NO: 249885 - DNA, 25 bp, Mus musculus
atctgctacacaactcctaaaaaca

SEQ ID NO: 249886 - DNA, 25 bp, Mus musculus
atctgctacacatctcctaaaaaca

SEQ ID NO: 249887 - DNA, 25 bp, Mus musculus
atctgctacagaaacgggccttcta

SEQ ID NO: 249888 - DNA, 25 bp, Mus musculus
atctgctacagatacgggccttcta

SEQ ID NO: 249889 - DNA, 25 bp, Mus musculus
atctgctacatacggatttgtcatt

SEQ ID NO: 249890 - DNA, 25 bp, Mus musculus
atctgctacatagggatttgtcatt

SEQ ID NO: 249891 - DNA, 25 bp, Mus musculus
atctgctaccaaccagtggcatttg

SEQ ID NO: 249892 - DNA, 25 bp, Mus musculus
atctgctaccaagcagtggcatttg

SEQ ID NO: 249893 - DNA, 25 bp, Mus musculus
atctgctaccgtccagcttcattaa

SEQ ID NO: 249894 - DNA, 25 bp, Mus musculus
atctgctaccgtgcagcttcattaa

SEQ ID NO: 249895 - DNA, 25 bp, Mus musculus
atctgctacctgattgtgtctggaa

SEQ ID NO: 249896 - DNA, 25 bp, Mus musculus
atctgctacctgcataatttgtact

SEQ ID NO: 249897 - DNA, 25 bp, Mus musculus
atctgctacctggataatttgtact

SEQ ID NO: 249898 - DNA, 25 bp, Mus musculus
atctgctacctgtttgtgtctggaa

SEQ ID NO: 249899 - DNA, 25 bp, Mus musculus
atctgctacgctacgctgagttcgg

SEQ ID NO: 249900 - DNA, 25 bp, Mus musculus
atctgctacgcttcgctgagttcgg

SEQ ID NO: 249901 - DNA, 25 bp, Mus musculus
atctgctactgcaaagtggcccagg

SEQ ID NO: 249902 - DNA, 25 bp, Mus musculus
atctgctactgctaagtggcccagg

SEQ ID NO: 249903 - DNA, 25 bp, Mus musculus
atctgctactgtcgaacccaagttt

SEQ ID NO: 249904 - DNA, 25 bp, Mus musculus
atctgctactgtggaacccaagttt

SEQ ID NO: 249905 - DNA, 25 bp, Mus musculus
atctgctagagcactggtgttctat

SEQ ID NO: 249906 - DNA, 25 bp, Mus musculus
atctgctagagctctggtgttctat

SEQ ID NO: 249907 - DNA, 25 bp, Mus musculus
atctgctaggcaccttacttagttc

SEQ ID NO: 249908 - DNA, 25 bp, Mus musculus
atctgctaggcagcttacttagttc

SEQ ID NO: 249909 - DNA, 25 bp, Mus musculus
atctgctaggccaggatggactgcc

SEQ ID NO: 249910 - DNA, 25 bp, Mus musculus
atctgctaggcctggatggactgcc

SEQ ID NO: 249911 - DNA, 25 bp, Mus musculus
atctgctagggtctgggcaccttac

SEQ ID NO: 249912 - DNA, 25 bp, Mus musculus
atctgctagggtgtgggcaccttac

SEQ ID NO: 249913 - DNA, 25 bp, Mus musculus
atctgctatgatatgcgcttcgcgg

SEQ ID NO: 249914 - DNA, 25 bp, Mus musculus
atctgctatgatttgcgcttcgcgg

SEQ ID NO: 249915 - DNA, 25 bp, Mus musculus
atctgctatgccaaaatagctcttt

SEQ ID NO: 249916 - DNA, 25 bp, Mus musculus
atctgctatgcctaaatagctcttt

SEQ ID NO: 249917 - DNA, 25 bp, Mus musculus
atctgctattagaccagctgctcca

SEQ ID NO: 249918 - DNA, 25 bp, Mus musculus
atctgctattagtccagctgctcca

SEQ ID NO: 249919 - DNA, 25 bp, Mus musculus
atctgctattcaagtacttgtctct

SEQ ID NO: 249920 - DNA, 25 bp, Mus musculus
atctgctattcatgtacttgtctct

SEQ ID NO: 249921 - DNA, 25 bp, Mus musculus
atctgctcaaagctgtcctgatggt

SEQ ID NO: 249922 - DNA, 25 bp, Mus musculus
atctgctcaaaggtgtcctgatggt

SEQ ID NO: 249923 - DNA, 25 bp, Mus musculus
atctgctcaagcatcagccaggagg

SEQ ID NO: 249924 - DNA, 25 bp, Mus musculus
atctgctcaagcttcagccaggagg

SEQ ID NO: 249925 - DNA, 25 bp, Mus musculus
atctgctcagctccacaaagacgtt

SEQ ID NO: 249926 - DNA, 25 bp, Mus musculus
atctgctcagctgcacaaagacgtt

SEQ ID NO: 249927 - DNA, 25 bp, Mus musculus
atctgctcaggcatacacgtgtggt

SEQ ID NO: 249928 - DNA, 25 bp, Mus musculus
atctgctcaggcttacacgtgtggt

SEQ ID NO: 249929 - DNA, 25 bp, Mus musculus
atctgctcagtcattatactttata

SEQ ID NO: 249930 - DNA, 25 bp, Mus musculus
atctgctcagtctttatactttata

SEQ ID NO: 249931 - DNA, 25 bp, Mus musculus
atctgctcatctcccttggaggaca

SEQ ID NO: 249932 - DNA, 25 bp, Mus musculus
atctgctcatctgccttggaggaca

SEQ ID NO: 249933 - DNA, 25 bp, Mus musculus
atctgctccaacaacaggactcata

SEQ ID NO: 249934 - DNA, 25 bp, Mus musculus
atctgctccaactacaggactcata

SEQ ID NO: 249935 - DNA, 25 bp, Mus musculus
atctgctcccaaaaagatcctctca

SEQ ID NO: 249936 - DNA, 25 bp, Mus musculus
atctgctcccaataagatcctctca

SEQ ID NO: 249937 - DNA, 25 bp, Mus musculus
atctgctcctaaaagggtcctgcag

SEQ ID NO: 249938 - DNA, 25 bp, Mus musculus
atctgctcctaatagggtcctgcag

SEQ ID NO: 249939 - DNA, 25 bp, Mus musculus
atctgctccttgctaatgagcttgc

SEQ ID NO: 249940 - DNA, 25 bp, Mus musculus
atctgctccttggtaatgagcttgc

SEQ ID NO: 249941 - DNA, 25 bp, Mus musculus
atctgctcggcaaccaggagggcta

SEQ ID NO: 249942 - DNA, 25 bp, Mus musculus
atctgctcggcatccaggagggcta

SEQ ID NO: 249943 - DNA, 25 bp, Mus musculus
atctgctctatactcaggtcctgtt

SEQ ID NO: 249944 - DNA, 25 bp, Mus musculus
atctgctctatagtcaggtcctgtt

SEQ ID NO: 249945 - DNA, 25 bp, Mus musculus
atctgctctgacctcatcggaatga

SEQ ID NO: 249946 - DNA, 25 bp, Mus musculus
atctgctctgacgtcatcggaatga

SEQ ID NO: 249947 - DNA, 25 bp, Mus musculus
atctgctctgatcgtatgtttatat

SEQ ID NO: 249948 - DNA, 25 bp, Mus musculus
atctgctctgatggtatgtttatat

SEQ ID NO: 249949 - DNA, 25 bp, Mus musculus
atctgctctgctctacaagtcagtc

SEQ ID NO: 249950 - DNA, 25 bp, Mus musculus
atctgctctgctgtacaagtcagtc

SEQ ID NO: 249951 - DNA, 25 bp, Mus musculus
atctgctctgtcacagcaacctgta

SEQ ID NO: 249952 - DNA, 25 bp, Mus musculus
atctgctctgtctcagcaacctgta

SEQ ID NO: 249953 - DNA, 25 bp, Mus musculus
atctgctctgtgcttgtagttcatg

SEQ ID NO: 249954 - DNA, 25 bp, Mus musculus
atctgctctgtggttgtagttcatg

SEQ ID NO: 249955 - DNA, 25 bp, Mus musculus
atctgctcttgcaaataaccatgct

SEQ ID NO: 249956 - DNA, 25 bp, Mus musculus
atctgctcttgcaaatatgtagaag

SEQ ID NO: 249957 - DNA, 25 bp, Mus musculus
atctgctcttgcatatttgccaatg

SEQ ID NO: 249958 - DNA, 25 bp, Mus musculus
atctgctcttgctaataaccatgct

SEQ ID NO: 249959 - DNA, 25 bp, Mus musculus
atctgctcttgctaatatgtagaag

SEQ ID NO: 249960 - DNA, 25 bp, Mus musculus
atctgctcttgcttatttgccaatg

SEQ ID NO: 249961 - DNA, 25 bp, Mus musculus
atctgctcttttcgtgttcccaact

SEQ ID NO: 249962 - DNA, 25 bp, Mus musculus
atctgctcttttggtgttcccaact

SEQ ID NO: 249963 - DNA, 25 bp, Mus musculus
atctgctgaaagacatgaatgccat

SEQ ID NO: 249964 - DNA, 25 bp, Mus musculus
atctgctgaaagtcatgaatgccat

SEQ ID NO: 249965 - DNA, 25 bp, Mus musculus
atctgctgaaatacttcaacgactg

SEQ ID NO: 249966 - DNA, 25 bp, Mus musculus
atctgctgaaattcttcaacgactg

SEQ ID NO: 249967 - DNA, 25 bp, Mus musculus
atctgctgacttctctgtgagctga

SEQ ID NO: 249968 - DNA, 25 bp, Mus musculus
atctgctgacttgtctgtgagctga

SEQ ID NO: 249969 - DNA, 25 bp, Mus musculus
atctgctgagtaataacagtaggcc

SEQ ID NO: 249970 - DNA, 25 bp, Mus musculus
atctgctgagtattaacagtaggcc

SEQ ID NO: 249971 - DNA, 25 bp, Mus musculus
atctgctgatagctgtcggtgtctc

SEQ ID NO: 249972 - DNA, 25 bp, Mus musculus
atctgctgataggtgtcggtgtctc

SEQ ID NO: 249973 - DNA, 25 bp, Mus musculus
atctgctgatcaatgcctgccttgc

SEQ ID NO: 249974 - DNA, 25 bp, Mus musculus
atctgctgatcattgcctgccttgc

SEQ ID NO: 249975 - DNA, 25 bp, Mus musculus
atctgctgatctctcatggatgtcc

SEQ ID NO: 249976 - DNA, 25 bp, Mus musculus
atctgctgatctgtcatggatgtcc

SEQ ID NO: 249977 - DNA, 25 bp, Mus musculus
atctgctgcagcctgggattgtcat

SEQ ID NO: 249978 - DNA, 25 bp, Mus musculus
atctgctgcagcgtgggattgtcat

SEQ ID NO: 249979 - DNA, 25 bp, Mus musculus
atctgctgcaggaatcatgacattt

SEQ ID NO: 249980 - DNA, 25 bp, Mus musculus
atctgctgcaggtatcatgacattt

SEQ ID NO: 249981 - DNA, 25 bp, Mus musculus
atctgctgcatccatctacagggtg

SEQ ID NO: 249982 - DNA, 25 bp, Mus musculus
atctgctgcatcgatctacagggtg

SEQ ID NO: 249983 - DNA, 25 bp, Mus musculus
atctgctgcccaaactaactccatg

SEQ ID NO: 249984 - DNA, 25 bp, Mus musculus
atctgctgcccatactaactccatg

SEQ ID NO: 249985 - DNA, 25 bp, Mus musculus
atctgctgcgatattctgctagttg

SEQ ID NO: 249986 - DNA, 25 bp, Mus musculus
atctgctgcgattttctgctagttg

SEQ ID NO: 249987 - DNA, 25 bp, Mus musculus
atctgctgcggaccgtttttatgaa

SEQ ID NO: 249988 - DNA, 25 bp, Mus musculus
atctgctgcggagcgtttttatgaa

SEQ ID NO: 249989 - DNA, 25 bp, Mus musculus
atctgctgctccagacaccaacagg

SEQ ID NO: 249990 - DNA, 25 bp, Mus musculus
atctgctgctcctgacaccaacagg

SEQ ID NO: 249991 - DNA, 25 bp, Mus musculus
atctgctgctgtatacattctaggg

SEQ ID NO: 249992 - DNA, 25 bp, Mus musculus
atctgctgctgtttacattctaggg

SEQ ID NO: 249993 - DNA, 25 bp, Mus musculus
atctgctgcttcctacaagtggtga

SEQ ID NO: 249994 - DNA, 25 bp, Mus musculus
atctgctgcttcctcaggctggaag

SEQ ID NO: 249995 - DNA, 25 bp, Mus musculus
atctgctgcttcgtacaagtggtga

SEQ ID NO: 249996 - DNA, 25 bp, Mus musculus
atctgctgcttcgtcaggctggaag

SEQ ID NO: 249997 - DNA, 25 bp, Mus musculus
atctgctggagtattacatcccaag

SEQ ID NO: 249998 - DNA, 25 bp, Mus musculus
atctgctggagttttacatcccaag

SEQ ID NO: 249999 - DNA, 25 bp, Mus musculus
atctgctggtcgctgagacacttac

SEQ ID NO: 250000 - DNA, 25 bp, Mus musculus
atctgctggtcggtgagacacttac

SEQ ID NO: 250001 - DNA, 25 bp, Mus musculus
atctgctgtagcatcaagctttggc

SEQ ID NO: 250002 - DNA, 25 bp, Mus musculus
atctgctgtagcttcaagctttggc

SEQ ID NO: 250003 - DNA, 25 bp, Mus musculus
atctgctgtatcacaaccaactggt

SEQ ID NO: 250004 - DNA, 25 bp, Mus musculus
atctgctgtatctcaaccaactggt

SEQ ID NO: 250005 - DNA, 25 bp, Mus musculus
atctgctgtgacatgtatagaggcc

SEQ ID NO: 250006 - DNA, 25 bp, Mus musculus
atctgctgtgacttgtatagaggcc

SEQ ID NO: 250007 - DNA, 25 bp, Mus musculus
atctgctgtgatatcttgctggcct

SEQ ID NO: 250008 - DNA, 25 bp, Mus musculus
atctgctgtgatttcttgctggcct

SEQ ID NO: 250009 - DNA, 25 bp, Mus musculus
atctgctgtgttccgtcattggtga

SEQ ID NO: 250010 - DNA, 25 bp, Mus musculus
atctgctgtgttgcgtcattggtga

SEQ ID NO: 250011 - DNA, 25 bp, Mus musculus
atctgctgttataagcggacaaagc

SEQ ID NO: 250012 - DNA, 25 bp, Mus musculus
atctgctgttattagcggacaaagc

SEQ ID NO: 250013 - DNA, 25 bp, Mus musculus
atctgctgttctcctttccccaaaa

SEQ ID NO: 250014 - DNA, 25 bp, Mus musculus
atctgctgttctgctttccccaaaa

SEQ ID NO: 250015 - DNA, 25 bp, Mus musculus
atctgctgttgcatacctgtgttaa

SEQ ID NO: 250016 - DNA, 25 bp, Mus musculus
atctgctgttgcttacctgtgttaa

SEQ ID NO: 250017 - DNA, 25 bp, Mus musculus
atctgctgtttgaggagccccaggt

SEQ ID NO: 250018 - DNA, 25 bp, Mus musculus
atctgctgtttgtggagccccaggt

SEQ ID NO: 250019 - DNA, 25 bp, Mus musculus
atctgcttagcacactaacccagag

SEQ ID NO: 250020 - DNA, 25 bp, Mus musculus
atctgcttagcagactaacccagag

SEQ ID NO: 250021 - DNA, 25 bp, Mus musculus
atctgcttagctcttcccgagacaa

SEQ ID NO: 250022 - DNA, 25 bp, Mus musculus
atctgcttagctgttcccgagacaa

SEQ ID NO: 250023 - DNA, 25 bp, Mus musculus
atctgcttatacacacaccttactg

SEQ ID NO: 250024 - DNA, 25 bp, Mus musculus
atctgcttatactcacaccttactg

SEQ ID NO: 250025 - DNA, 25 bp, Mus musculus
atctgcttcagactagaatcccatc

SEQ ID NO: 250026 - DNA, 25 bp, Mus musculus
atctgcttcagagtagaatcccatc

SEQ ID NO: 250027 - DNA, 25 bp, Mus musculus
atctgcttcaggctttagactatgg

SEQ ID NO: 250028 - DNA, 25 bp, Mus musculus
atctgcttcagggtttagactatgg

SEQ ID NO: 250029 - DNA, 25 bp, Mus musculus
atctgcttcagtagcctcaaggaca

SEQ ID NO: 250030 - DNA, 25 bp, Mus musculus
atctgcttcagttgcctcaaggaca

SEQ ID NO: 250031 - DNA, 25 bp, Mus musculus
atctgcttcattagtgcccaacagt

SEQ ID NO: 250032 - DNA, 25 bp, Mus musculus
atctgcttcatttgtgcccaacagt

SEQ ID NO: 250033 - DNA, 25 bp, Mus musculus
atctgcttccacatattattttccc

SEQ ID NO: 250034 - DNA, 25 bp, Mus musculus
atctgcttccacttattattttccc

SEQ ID NO: 250035 - DNA, 25 bp, Mus musculus
atctgcttccccaagaaccgtgagg

SEQ ID NO: 250036 - DNA, 25 bp, Mus musculus
atctgcttcccctagaaccgtgagg

SEQ ID NO: 250037 - DNA, 25 bp, Mus musculus
atctgcttcctacgactatttttct

SEQ ID NO: 250038 - DNA, 25 bp, Mus musculus
atctgcttcctaggactatttttct

SEQ ID NO: 250039 - DNA, 25 bp, Mus musculus
atctgcttcgccatcatcaacgtgg

SEQ ID NO: 250040 - DNA, 25 bp, Mus musculus
atctgcttcgccttcatcaacgtgg

SEQ ID NO: 250041 - DNA, 25 bp, Mus musculus
atctgcttcgttaggtggctctggc

SEQ ID NO: 250042 - DNA, 25 bp, Mus musculus
atctgcttcgtttggtggctctggc

SEQ ID NO: 250043 - DNA, 25 bp, Mus musculus
atctgcttctgcattatttaacacc

SEQ ID NO: 250044 - DNA, 25 bp, Mus musculus
atctgcttctgctttatttaacacc

SEQ ID NO: 250045 - DNA, 25 bp, Mus musculus
atctgcttctggagggagcccaaac

SEQ ID NO: 250046 - DNA, 25 bp, Mus musculus
atctgcttctggtgggagcccaaac

SEQ ID NO: 250047 - DNA, 25 bp, Mus musculus
atctgcttgactatagactttctgt

SEQ ID NO: 250048 - DNA, 25 bp, Mus musculus
atctgcttgactttagactttctgt

SEQ ID NO: 250049 - DNA, 25 bp, Mus musculus
atctgcttggcgctactactggtac

SEQ ID NO: 250050 - DNA, 25 bp, Mus musculus
atctgcttggcggtactactggtac

SEQ ID NO: 250051 - DNA, 25 bp, Mus musculus
atctgcttggtcattactctgtaaa

SEQ ID NO: 250052 - DNA, 25 bp, Mus musculus
atctgcttggtctttactctgtaaa

SEQ ID NO: 250053 - DNA, 25 bp, Mus musculus
atctgcttgtcacatgcctcctgta

SEQ ID NO: 250054 - DNA, 25 bp, Mus musculus
atctgcttgtcagatgcctcctgta

SEQ ID NO: 250055 - DNA, 25 bp, Mus musculus
atctgctttatcatcttcattcctg

SEQ ID NO: 250056 - DNA, 25 bp, Mus musculus
atctgctttatcttcttcattcctg

SEQ ID NO: 250057 - DNA, 25 bp, Mus musculus
atctgctttcaacaaacttccgagt

SEQ ID NO: 250058 - DNA, 25 bp, Mus musculus
atctgctttcaagaaacttccgagt

SEQ ID NO: 250059 - DNA, 25 bp, Mus musculus
atctgctttgaaccctataagccta

SEQ ID NO: 250060 - DNA, 25 bp, Mus musculus
atctgctttgaagcctataagccta

SEQ ID NO: 250061 - DNA, 25 bp, Mus musculus
atctgctttgagatccactgtgcta

SEQ ID NO: 250062 - DNA, 25 bp, Mus musculus
atctgctttgagttccactgtgcta

SEQ ID NO: 250063 - DNA, 25 bp, Mus musculus
atctgctttgcacgagcactgggct

SEQ ID NO: 250064 - DNA, 25 bp, Mus musculus
atctgctttgcacttggcatcctgg

SEQ ID NO: 250065 - DNA, 25 bp, Mus musculus
atctgctttgcaggagcactgggct

SEQ ID NO: 250066 - DNA, 25 bp, Mus musculus
atctgctttgcagttggcatcctgg

SEQ ID NO: 250067 - DNA, 25 bp, Mus musculus
atctgctttggaaagctgaggaaga

SEQ ID NO: 250068 - DNA, 25 bp, Mus musculus
atctgctttggaatcattgcccttt

SEQ ID NO: 250069 - DNA, 25 bp, Mus musculus
atctgctttggatagctgaggaaga

SEQ ID NO: 250070 - DNA, 25 bp, Mus musculus
atctgctttggattcattgcccttt

SEQ ID NO: 250071 - DNA, 25 bp, Mus musculus
atctgctttgtcatcaactcaggga

SEQ ID NO: 250072 - DNA, 25 bp, Mus musculus
atctgctttgtcttcaactcaggga

SEQ ID NO: 250073 - DNA, 25 bp, Mus musculus
atctgcttttacaccccttagaata

SEQ ID NO: 250074 - DNA, 25 bp, Mus musculus
atctgcttttactccccttagaata

SEQ ID NO: 250075 - DNA, 25 bp, Mus musculus
atctgcttttagacataatgttaac

SEQ ID NO: 250076 - DNA, 25 bp, Mus musculus
atctgcttttagtcataatgttaac

SEQ ID NO: 250077 - DNA, 25 bp, Mus musculus
atctgcttttccagtaagactccac

SEQ ID NO: 250078 - DNA, 25 bp, Mus musculus
atctgcttttcctgtaagactccac

SEQ ID NO: 250079 - DNA, 25 bp, Mus musculus
atctggaaacgaagccggatccctt

SEQ ID NO: 250080 - DNA, 25 bp, Mus musculus
atctggaaacgatgccggatccctt

SEQ ID NO: 250081 - DNA, 25 bp, Mus musculus
atctggaaagagctgttttggatga

SEQ ID NO: 250082 - DNA, 25 bp, Mus musculus
atctggaaagaggtgttttggatga

SEQ ID NO: 250083 - DNA, 25 bp, Mus musculus
atctggaaattccaaaccctcgcta

SEQ ID NO: 250084 - DNA, 25 bp, Mus musculus
atctggaaattcctaatttcctgag

SEQ ID NO: 250085 - DNA, 25 bp, Mus musculus
atctggaaattcgaaaccctcgcta

SEQ ID NO: 250086 - DNA, 25 bp, Mus musculus
atctggaaattcgtaatttcctgag

SEQ ID NO: 250087 - DNA, 25 bp, Mus musculus
atctggaaccgcaggtggttgacca

SEQ ID NO: 250088 - DNA, 25 bp, Mus musculus
atctggaaccgctggtggttgacca

SEQ ID NO: 250089 - DNA, 25 bp, Mus musculus
atctggaacctgaagaactgtctga

SEQ ID NO: 250090 - DNA, 25 bp, Mus musculus
atctggaacctgtagaactgtctga

SEQ ID NO: 250091 - DNA, 25 bp, Mus musculus
atctggaagaggctgtcaagtcctt

SEQ ID NO: 250092 - DNA, 25 bp, Mus musculus
atctggaagagggtgtcaagtcctt

SEQ ID NO: 250093 - DNA, 25 bp, Mus musculus
atctggaagcccaataacttataag

SEQ ID NO: 250094 - DNA, 25 bp, Mus musculus
atctggaagccctataacttataag

SEQ ID NO: 250095 - DNA, 25 bp, Mus musculus
atctggaagctgctcgtcaccatcc

SEQ ID NO: 250096 - DNA, 25 bp, Mus musculus
atctggaagctggtcgtcaccatcc

SEQ ID NO: 250097 - DNA, 25 bp, Mus musculus
atctggaagcttatgtcaacattac

SEQ ID NO: 250098 - DNA, 25 bp, Mus musculus
atctggaagcttttgtcaacattac

SEQ ID NO: 250099 - DNA, 25 bp, Mus musculus
atctggaatagaaccccagtctcca

SEQ ID NO: 250100 - DNA, 25 bp, Mus musculus
atctggaatagatccccagtctcca

SEQ ID NO: 250101 - DNA, 25 bp, Mus musculus
atctggaatccaagtttatagcttt

SEQ ID NO: 250102 - DNA, 25 bp, Mus musculus
atctggaatccatgtttatagcttt

SEQ ID NO: 250103 - DNA, 25 bp, Mus musculus
atctggacagctcttagctctactt

SEQ ID NO: 250104 - DNA, 25 bp, Mus musculus
atctggacagctgttagctctactt

SEQ ID NO: 250105 - DNA, 25 bp, Mus musculus
atctggacagtcacccgcaacacat

SEQ ID NO: 250106 - DNA, 25 bp, Mus musculus
atctggacagtctcccgcaacacat

SEQ ID NO: 250107 - DNA, 25 bp, Mus musculus
atctggaccagaaaaggtgtgtgtc

SEQ ID NO: 250108 - DNA, 25 bp, Mus musculus
atctggaccagataaggtgtgtgtc

SEQ ID NO: 250109 - DNA, 25 bp, Mus musculus
atctggacccaaccagcagttcatt

SEQ ID NO: 250110 - DNA, 25 bp, Mus musculus
atctggacccaagcagcagttcatt

SEQ ID NO: 250111 - DNA, 25 bp, Mus musculus
atctggaccctcagtaagtcacgag

SEQ ID NO: 250112 - DNA, 25 bp, Mus musculus
atctggaccctctgtaagtcacgag

SEQ ID NO: 250113 - DNA, 25 bp, Mus musculus
atctggaccttcagcataagctgcg

SEQ ID NO: 250114 - DNA, 25 bp, Mus musculus
atctggaccttctgcataagctgcg

SEQ ID NO: 250115 - DNA, 25 bp, Mus musculus
atctggacgccaaaacgtaggctta

SEQ ID NO: 250116 - DNA, 25 bp, Mus musculus
atctggacgccataacgtaggctta

SEQ ID NO: 250117 - DNA, 25 bp, Mus musculus
atctggactcggctcgggctagctt

SEQ ID NO: 250118 - DNA, 25 bp, Mus musculus
atctggactcgggtcgggctagctt

SEQ ID NO: 250119 - DNA, 25 bp, Mus musculus
atctggactgcacctgtggctgatg

SEQ ID NO: 250120 - DNA, 25 bp, Mus musculus
atctggactgcagctgtggctgatg

SEQ ID NO: 250121 - DNA, 25 bp, Mus musculus
atctggacttttcgctgcttctcac

SEQ ID NO: 250122 - DNA, 25 bp, Mus musculus
atctggacttttggctgcttctcac

SEQ ID NO: 250123 - DNA, 25 bp, Mus musculus
atctggagaaagatcatgccgaaga

SEQ ID NO: 250124 - DNA, 25 bp, Mus musculus
atctggagaaagttcatgccgaaga

SEQ ID NO: 250125 - DNA, 25 bp, Mus musculus
atctggagaagcagcctgtgagcat

SEQ ID NO: 250126 - DNA, 25 bp, Mus musculus
atctggagaagctgcctgtgagcat

SEQ ID NO: 250127 - DNA, 25 bp, Mus musculus
atctggagacatactctgagacaaa

SEQ ID NO: 250128 - DNA, 25 bp, Mus musculus
atctggagacattctctgagacaaa

SEQ ID NO: 250129 - DNA, 25 bp, Mus musculus
atctggagaccacgttctctgccaa

SEQ ID NO: 250130 - DNA, 25 bp, Mus musculus
atctggagaccaggttctctgccaa

SEQ ID NO: 250131 - DNA, 25 bp, Mus musculus
atctggagaggcagcagcggcacca

SEQ ID NO: 250132 - DNA, 25 bp, Mus musculus
atctggagaggctgcagcggcacca

SEQ ID NO: 250133 - DNA, 25 bp, Mus musculus
atctggagagttacccttccaacac

SEQ ID NO: 250134 - DNA, 25 bp, Mus musculus
atctggagagtttcccttccaacac

SEQ ID NO: 250135 - DNA, 25 bp, Mus musculus
atctggagcatgcactaggcagcta

SEQ ID NO: 250136 - DNA, 25 bp, Mus musculus
atctggagcatggactaggcagcta

SEQ ID NO: 250137 - DNA, 25 bp, Mus musculus
atctggagcccaaatttaggacatt

SEQ ID NO: 250138 - DNA, 25 bp, Mus musculus
atctggagcccatatttaggacatt

SEQ ID NO: 250139 - DNA, 25 bp, Mus musculus
atctggagccccagcagacgttagg

SEQ ID NO: 250140 - DNA, 25 bp, Mus musculus
atctggagcccctgcagacgttagg

SEQ ID NO: 250141 - DNA, 25 bp, Mus musculus
atctggagctctcgactacgtggct

SEQ ID NO: 250142 - DNA, 25 bp, Mus musculus
atctggagctctggactacgtggct

SEQ ID NO: 250143 - DNA, 25 bp, Mus musculus
atctggagctgcatgagcttgctca

SEQ ID NO: 250144 - DNA, 25 bp, Mus musculus
atctggagctgcttgagcttgctca

SEQ ID NO: 250145 - DNA, 25 bp, Mus musculus
atctggagggcacagaaacccaaaa

SEQ ID NO: 250146 - DNA, 25 bp, Mus musculus
atctggagggcagagaaacccaaaa

SEQ ID NO: 250147 - DNA, 25 bp, Mus musculus
atctggagtcacactagaggagcgg

SEQ ID NO: 250148 - DNA, 25 bp, Mus musculus
atctggagtcactctagaggagcgg

SEQ ID NO: 250149 - DNA, 25 bp, Mus musculus
atctggagtcccaaggaccgcaagt

SEQ ID NO: 250150 - DNA, 25 bp, Mus musculus
atctggagtccctaggaccgcaagt

SEQ ID NO: 250151 - DNA, 25 bp, Mus musculus
atctggagtctcagctgacggcatg

SEQ ID NO: 250152 - DNA, 25 bp, Mus musculus
atctggagtctctgctgacggcatg

SEQ ID NO: 250153 - DNA, 25 bp, Mus musculus
atctggagtctgctgtggccaacgc

SEQ ID NO: 250154 - DNA, 25 bp, Mus musculus
atctggagtctggtgtggccaacgc

SEQ ID NO: 250155 - DNA, 25 bp, Mus musculus
atctggagttcccagactcctgtgt

SEQ ID NO: 250156 - DNA, 25 bp, Mus musculus
atctggagttccgagactcctgtgt

SEQ ID NO: 250157 - DNA, 25 bp, Mus musculus
atctggagttggcttgtgctgcaca

SEQ ID NO: 250158 - DNA, 25 bp, Mus musculus
atctggagttgggttgtgctgcaca

SEQ ID NO: 250159 - DNA, 25 bp, Mus musculus
atctggatactgatccaactcttcc

SEQ ID NO: 250160 - DNA, 25 bp, Mus musculus
atctggatactgttccaactcttcc

SEQ ID NO: 250161 - DNA, 25 bp, Mus musculus
atctggatagcacatcctttcgccc

SEQ ID NO: 250162 - DNA, 25 bp, Mus musculus
atctggatagcagatcctttcgccc

SEQ ID NO: 250163 - DNA, 25 bp, Mus musculus
atctggatctccatcatcgcggcta

SEQ ID NO: 250164 - DNA, 25 bp, Mus musculus
atctggatctccttcatcgcggcta

SEQ ID NO: 250165 - DNA, 25 bp, Mus musculus
atctggatctgaaggctcgcactag

SEQ ID NO: 250166 - DNA, 25 bp, Mus musculus
atctggatctgatggctcgcactag

SEQ ID NO: 250167 - DNA, 25 bp, Mus musculus
atctggatgccccagtcacctcagg

SEQ ID NO: 250168 - DNA, 25 bp, Mus musculus
atctggatgcccgagtcacctcagg

SEQ ID NO: 250169 - DNA, 25 bp, Mus musculus
atctggattccaaccatgtaatgca

SEQ ID NO: 250170 - DNA, 25 bp, Mus musculus
atctggattccatccatgtaatgca

SEQ ID NO: 250171 - DNA, 25 bp, Mus musculus
atctggattcttacctgtgtcatca

SEQ ID NO: 250172 - DNA, 25 bp, Mus musculus
atctggattctttcctgtgtcatca

SEQ ID NO: 250173 - DNA, 25 bp, Mus musculus
atctggcaactcagctaaccatcat

SEQ ID NO: 250174 - DNA, 25 bp, Mus musculus
atctggcaactctgctaaccatcat

SEQ ID NO: 250175 - DNA, 25 bp, Mus musculus
atctggcaacttctgtatgacttaa

SEQ ID NO: 250176 - DNA, 25 bp, Mus musculus
atctggcaacttgtgtatgacttaa

SEQ ID NO: 250177 - DNA, 25 bp, Mus musculus
atctggcaagttccgtcgtggcagt

SEQ ID NO: 250178 - DNA, 25 bp, Mus musculus
atctggcaagttgcgtcgtggcagt

SEQ ID NO: 250179 - DNA, 25 bp, Mus musculus
atctggcaccttcggattgctgtaa

SEQ ID NO: 250180 - DNA, 25 bp, Mus musculus
atctggcaccttgggattgctgtaa

SEQ ID NO: 250181 - DNA, 25 bp, Mus musculus
atctggcactgtcctttactactta

SEQ ID NO: 250182 - DNA, 25 bp, Mus musculus
atctggcactgtgctttactactta

SEQ ID NO: 250183 - DNA, 25 bp, Mus musculus
atctggcagcatcctctcccaaggt

SEQ ID NO: 250184 - DNA, 25 bp, Mus musculus
atctggcagcatgctctcccaaggt

SEQ ID NO: 250185 - DNA, 25 bp, Mus musculus
atctggcagccaacacgaagggaat

SEQ ID NO: 250186 - DNA, 25 bp, Mus musculus
atctggcagccatcacgaagggaat

SEQ ID NO: 250187 - DNA, 25 bp, Mus musculus
atctggcagctgatctccaaagtcc

SEQ ID NO: 250188 - DNA, 25 bp, Mus musculus
atctggcagctgttctccaaagtcc

SEQ ID NO: 250189 - DNA, 25 bp, Mus musculus
atctggcagtctcaggcagtgccat

SEQ ID NO: 250190 - DNA, 25 bp, Mus musculus
atctggcagtctgaggcagtgccat

SEQ ID NO: 250191 - DNA, 25 bp, Mus musculus
atctggcatacgaaaccgtggccca

SEQ ID NO: 250192 - DNA, 25 bp, Mus musculus
atctggcatacgtaaccgtggccca

SEQ ID NO: 250193 - DNA, 25 bp, Mus musculus
atctggcatactagggagcaaaacc

SEQ ID NO: 250194 - DNA, 25 bp, Mus musculus
atctggcatacttgggagcaaaacc

SEQ ID NO: 250195 - DNA, 25 bp, Mus musculus
atctggcatcgtaggtttcttggct

SEQ ID NO: 250196 - DNA, 25 bp, Mus musculus
atctggcatcgttggtttcttggct

SEQ ID NO: 250197 - DNA, 25 bp, Mus musculus
atctggcatgggagctcctgctggc

SEQ ID NO: 250198 - DNA, 25 bp, Mus musculus
atctggcatgggtgctcctgctggc

SEQ ID NO: 250199 - DNA, 25 bp, Mus musculus
atctggccaaggatactgagttctc

SEQ ID NO: 250200 - DNA, 25 bp, Mus musculus
atctggccaaggttactgagttctc

SEQ ID NO: 250201 - DNA, 25 bp, Mus musculus
atctggccaataccactcgatattt

SEQ ID NO: 250202 - DNA, 25 bp, Mus musculus
atctggccaatagcactcgatattt

SEQ ID NO: 250203 - DNA, 25 bp, Mus musculus
atctggccaattcgtaagcttcagg

SEQ ID NO: 250204 - DNA, 25 bp, Mus musculus
atctggccaattggtaagcttcagg

SEQ ID NO: 250205 - DNA, 25 bp, Mus musculus
atctggccacctctggaagaggtct

SEQ ID NO: 250206 - DNA, 25 bp, Mus musculus
atctggccacctgtggaagaggtct

SEQ ID NO: 250207 - DNA, 25 bp, Mus musculus
atctggccacgacgaattttcgtca

SEQ ID NO: 250208 - DNA, 25 bp, Mus musculus
atctggccacgaggaattttcgtca

SEQ ID NO: 250209 - DNA, 25 bp, Mus musculus
atctggccacttcagaaggattctc

SEQ ID NO: 250210 - DNA, 25 bp, Mus musculus
atctggccacttgagaaggattctc

SEQ ID NO: 250211 - DNA, 25 bp, Mus musculus
atctggccagtgatcatcaaggtgc

SEQ ID NO: 250212 - DNA, 25 bp, Mus musculus
atctggccagtgttcatcaaggtgc

SEQ ID NO: 250213 - DNA, 25 bp, Mus musculus
atctggccatctatgagtgttctct

SEQ ID NO: 250214 - DNA, 25 bp, Mus musculus
atctggccatctttgagtgttctct

SEQ ID NO: 250215 - DNA, 25 bp, Mus musculus
atctggcccctgctgtaggaatgaa

SEQ ID NO: 250216 - DNA, 25 bp, Mus musculus
atctggcccctggtgtaggaatgaa

SEQ ID NO: 250217 - DNA, 25 bp, Mus musculus
atctggccgaaaccttctggagtct

SEQ ID NO: 250218 - DNA, 25 bp, Mus musculus
atctggccgaaagcttctggagtct

SEQ ID NO: 250219 - DNA, 25 bp, Mus musculus
atctggccggtcacaaagaaaatgt

SEQ ID NO: 250220 - DNA, 25 bp, Mus musculus
atctggccggtctcaaagaaaatgt

SEQ ID NO: 250221 - DNA, 25 bp, Mus musculus
atctggcctcagcaacttagttgca

SEQ ID NO: 250222 - DNA, 25 bp, Mus musculus
atctggcctcaggaacttagttgca

SEQ ID NO: 250223 - DNA, 25 bp, Mus musculus
atctggcctgagctcatcctgtgac

SEQ ID NO: 250224 - DNA, 25 bp, Mus musculus
atctggcctgaggtcatcctgtgac

SEQ ID NO: 250225 - DNA, 25 bp, Mus musculus
atctggcctgccaggatgtcctgaa

SEQ ID NO: 250226 - DNA, 25 bp, Mus musculus
atctggcctgcctggatgtcctgaa

SEQ ID NO: 250227 - DNA, 25 bp, Mus musculus
atctggcctggcaataatgacctcc

SEQ ID NO: 250228 - DNA, 25 bp, Mus musculus
atctggcctggcataatacttaact

SEQ ID NO: 250229 - DNA, 25 bp, Mus musculus
atctggcctggctataatgacctcc

SEQ ID NO: 250230 - DNA, 25 bp, Mus musculus
atctggcctggcttaatacttaact

SEQ ID NO: 250231 - DNA, 25 bp, Mus musculus
atctggcctttcaccggaagcggat

SEQ ID NO: 250232 - DNA, 25 bp, Mus musculus
atctggcctttctccggaagcggat

SEQ ID NO: 250233 - DNA, 25 bp, Mus musculus
atctggcgacggctgatgacatccg

SEQ ID NO: 250234 - DNA, 25 bp, Mus musculus
atctggcgacgggtgatgacatccg

SEQ ID NO: 250235 - DNA, 25 bp, Mus musculus
atctggcgcagtacgtgcaggacga

SEQ ID NO: 250236 - DNA, 25 bp, Mus musculus
atctggcgcagttcgtgcaggacga

SEQ ID NO: 250237 - DNA, 25 bp, Mus musculus
atctggcgcctgcagtgagagccca

SEQ ID NO: 250238 - DNA, 25 bp, Mus musculus
atctggcgcctggagtgagagccca

SEQ ID NO: 250239 - DNA, 25 bp, Mus musculus
atctggcgttctcaaagtcccatag

SEQ ID NO: 250240 - DNA, 25 bp, Mus musculus
atctggcgttctgaaagtcccatag

SEQ ID NO: 250241 - DNA, 25 bp, Mus musculus
atctggctaataaggcagctctcga

SEQ ID NO: 250242 - DNA, 25 bp, Mus musculus
atctggctaatatggcagctctcga

SEQ ID NO: 250243 - DNA, 25 bp, Mus musculus
atctggctactgatgtcatgagtaa

SEQ ID NO: 250244 - DNA, 25 bp, Mus musculus
atctggctactgttgtcatgagtaa

SEQ ID NO: 250245 - DNA, 25 bp, Mus musculus
atctggctagtacttagctctctgc

SEQ ID NO: 250246 - DNA, 25 bp, Mus musculus
atctggctagtagttagctctctgc

SEQ ID NO: 250247 - DNA, 25 bp, Mus musculus
atctggctccagatctactatggca

SEQ ID NO: 250248 - DNA, 25 bp, Mus musculus
atctggctccagttctactatggca

SEQ ID NO: 250249 - DNA, 25 bp, Mus musculus
atctggctcctcacaggtatttccc

SEQ ID NO: 250250 - DNA, 25 bp, Mus musculus
atctggctcctctcaggtatttccc

SEQ ID NO: 250251 - DNA, 25 bp, Mus musculus
atctggctcgaacttgaaagccttt

SEQ ID NO: 250252 - DNA, 25 bp, Mus musculus
atctggctcgaagttgaaagccttt

SEQ ID NO: 250253 - DNA, 25 bp, Mus musculus
atctggctctcacggttcatgtgga

SEQ ID NO: 250254 - DNA, 25 bp, Mus musculus
atctggctctcagggttcatgtgga

SEQ ID NO: 250255 - DNA, 25 bp, Mus musculus
atctggctctctcaagaattcttcc

SEQ ID NO: 250256 - DNA, 25 bp, Mus musculus
atctggctctctgaagaattcttcc

SEQ ID NO: 250257 - DNA, 25 bp, Mus musculus
atctggctgaagatggcagtgtgca

SEQ ID NO: 250258 - DNA, 25 bp, Mus musculus
atctggctgaagttggcagtgtgca

SEQ ID NO: 250259 - DNA, 25 bp, Mus musculus
atctggctgcacatggagaggctcc

SEQ ID NO: 250260 - DNA, 25 bp, Mus musculus
atctggctgcacttggagaggctcc

SEQ ID NO: 250261 - DNA, 25 bp, Mus musculus
atctggctgccaagagggcttgttc

SEQ ID NO: 250262 - DNA, 25 bp, Mus musculus
atctggctgccatgagggcttgttc

SEQ ID NO: 250263 - DNA, 25 bp, Mus musculus
atctggctggacaagatctcttctg

SEQ ID NO: 250264 - DNA, 25 bp, Mus musculus
atctggctggactagatctcttctg

SEQ ID NO: 250265 - DNA, 25 bp, Mus musculus
atctggctgtcaatttcttggtgtc

SEQ ID NO: 250266 - DNA, 25 bp, Mus musculus
atctggctgtcacttgtctaatgca

SEQ ID NO: 250267 - DNA, 25 bp, Mus musculus
atctggctgtcagttgtctaatgca

SEQ ID NO: 250268 - DNA, 25 bp, Mus musculus
atctggctgtcattttcttggtgtc

SEQ ID NO: 250269 - DNA, 25 bp, Mus musculus
atctggctgttgaacctcttaggga

SEQ ID NO: 250270 - DNA, 25 bp, Mus musculus
atctggctgttgtacctcttaggga

SEQ ID NO: 250271 - DNA, 25 bp, Mus musculus
atctggcttagaacaccgtgggatg

SEQ ID NO: 250272 - DNA, 25 bp, Mus musculus
atctggcttagatcaccgtgggatg

SEQ ID NO: 250273 - DNA, 25 bp, Mus musculus
atctggcttctaccgagggcgtcaa

SEQ ID NO: 250274 - DNA, 25 bp, Mus musculus
atctggcttctagcgagggcgtcaa

SEQ ID NO: 250275 - DNA, 25 bp, Mus musculus
atctggcttgtaagtggaagactaa

SEQ ID NO: 250276 - DNA, 25 bp, Mus musculus
atctggcttgtatgtggaagactaa

SEQ ID NO: 250277 - DNA, 25 bp, Mus musculus
atctgggaaactcaactgtcttttt

SEQ ID NO: 250278 - DNA, 25 bp, Mus musculus
atctgggaaactgaactgtcttttt

SEQ ID NO: 250279 - DNA, 25 bp, Mus musculus
atctgggaacaaatttttctgtata

SEQ ID NO: 250280 - DNA, 25 bp, Mus musculus
atctgggaacaattttttctgtata

SEQ ID NO: 250281 - DNA, 25 bp, Mus musculus
atctgggaacttcgtgtgtgtttct

SEQ ID NO: 250282 - DNA, 25 bp, Mus musculus
atctgggaacttggtgtgtgtttct

SEQ ID NO: 250283 - DNA, 25 bp, Mus musculus
atctgggaagagctcttggtctctc

SEQ ID NO: 250284 - DNA, 25 bp, Mus musculus
atctgggaagaggtcttggtctctc

SEQ ID NO: 250285 - DNA, 25 bp, Mus musculus
atctgggaagggatcattcacttaa

SEQ ID NO: 250286 - DNA, 25 bp, Mus musculus
atctgggaagggttcattcacttaa

SEQ ID NO: 250287 - DNA, 25 bp, Mus musculus
atctgggacatcaattgcctttaag

SEQ ID NO: 250288 - DNA, 25 bp, Mus musculus
atctgggacatctattgcctttaag

SEQ ID NO: 250289 - DNA, 25 bp, Mus musculus
atctgggacccgaaggccccaattg

SEQ ID NO: 250290 - DNA, 25 bp, Mus musculus
atctgggacccgctctgagcaggac

SEQ ID NO: 250291 - DNA, 25 bp, Mus musculus
atctgggacccggtctgagcaggac

SEQ ID NO: 250292 - DNA, 25 bp, Mus musculus
atctgggacccgtaggccccaattg

SEQ ID NO: 250293 - DNA, 25 bp, Mus musculus
atctgggaccttcgccggaattatg

SEQ ID NO: 250294 - DNA, 25 bp, Mus musculus
atctgggaccttggccggaattatg

SEQ ID NO: 250295 - DNA, 25 bp, Mus musculus
atctgggacgaccagacagtgctcc

SEQ ID NO: 250296 - DNA, 25 bp, Mus musculus
atctgggacgacgagacagtgctcc

SEQ ID NO: 250297 - DNA, 25 bp, Mus musculus
atctgggacgtccaatttgcccttt

SEQ ID NO: 250298 - DNA, 25 bp, Mus musculus
atctgggacgtcgaatttgcccttt

SEQ ID NO: 250299 - DNA, 25 bp, Mus musculus
atctgggacgttacatttagttgct

SEQ ID NO: 250300 - DNA, 25 bp, Mus musculus
atctgggacgtttcatttagttgct

SEQ ID NO: 250301 - DNA, 25 bp, Mus musculus
atctgggactcacgcgcatgaacat

SEQ ID NO: 250302 - DNA, 25 bp, Mus musculus
atctgggactcaggcgcatgaacat

SEQ ID NO: 250303 - DNA, 25 bp, Mus musculus
atctgggactgtcttgggaccattc

SEQ ID NO: 250304 - DNA, 25 bp, Mus musculus
atctgggactgtgttgggaccattc

SEQ ID NO: 250305 - DNA, 25 bp, Mus musculus
atctgggagatgaacctctggcatg

SEQ ID NO: 250306 - DNA, 25 bp, Mus musculus
atctgggagatgtacctctggcatg

SEQ ID NO: 250307 - DNA, 25 bp, Mus musculus
atctgggaggcaatgtctgtgtttc

SEQ ID NO: 250308 - DNA, 25 bp, Mus musculus
atctgggaggcattgtctgtgtttc

SEQ ID NO: 250309 - DNA, 25 bp, Mus musculus
atctgggatacactctaactcatct

SEQ ID NO: 250310 - DNA, 25 bp, Mus musculus
atctgggatacagtctaactcatct

SEQ ID NO: 250311 - DNA, 25 bp, Mus musculus
atctgggatcgcagacatgtatttt

SEQ ID NO: 250312 - DNA, 25 bp, Mus musculus
atctgggatcgctgacatgtatttt

SEQ ID NO: 250313 - DNA, 25 bp, Mus musculus
atctgggatgcactaaacttggaac

SEQ ID NO: 250314 - DNA, 25 bp, Mus musculus
atctgggatgcagtaaacttggaac

SEQ ID NO: 250315 - DNA, 25 bp, Mus musculus
atctgggatgccatgaagggtgacc

SEQ ID NO: 250316 - DNA, 25 bp, Mus musculus
atctgggatgccttgaagggtgacc

SEQ ID NO: 250317 - DNA, 25 bp, Mus musculus
atctgggattgcaccgactgggaaa

SEQ ID NO: 250318 - DNA, 25 bp, Mus musculus
atctgggattgctccgactgggaaa

SEQ ID NO: 250319 - DNA, 25 bp, Mus musculus
atctgggcaaccacagcagctgttt

SEQ ID NO: 250320 - DNA, 25 bp, Mus musculus
atctgggcaacctcagcagctgttt

SEQ ID NO: 250321 - DNA, 25 bp, Mus musculus
atctgggcagacacgtcgcatcaag

SEQ ID NO: 250322 - DNA, 25 bp, Mus musculus
atctgggcagactcgtcgcatcaag

SEQ ID NO: 250323 - DNA, 25 bp, Mus musculus
atctgggcagctatcctatggtgct

SEQ ID NO: 250324 - DNA, 25 bp, Mus musculus
atctgggcagctttcctatggtgct

SEQ ID NO: 250325 - DNA, 25 bp, Mus musculus
atctgggcaggcagggtgaacacca

SEQ ID NO: 250326 - DNA, 25 bp, Mus musculus
atctgggcaggctgggtgaacacca

SEQ ID NO: 250327 - DNA, 25 bp, Mus musculus
atctgggccccacaaagtgaagtgt

SEQ ID NO: 250328 - DNA, 25 bp, Mus musculus
atctgggccccagaaagtgaagtgt

SEQ ID NO: 250329 - DNA, 25 bp, Mus musculus
atctgggccggcatagaggtctcta

SEQ ID NO: 250330 - DNA, 25 bp, Mus musculus
atctgggccggcttagaggtctcta

SEQ ID NO: 250331 - DNA, 25 bp, Mus musculus
atctgggcctccagggacttggaac

SEQ ID NO: 250332 - DNA, 25 bp, Mus musculus
atctgggcctcctgggacttggaac

SEQ ID NO: 250333 - DNA, 25 bp, Mus musculus
atctgggccttgcaggtacactcaa

SEQ ID NO: 250334 - DNA, 25 bp, Mus musculus
atctgggccttggaggtacactcaa

SEQ ID NO: 250335 - DNA, 25 bp, Mus musculus
atctgggcgaggaggtattgctcta

SEQ ID NO: 250336 - DNA, 25 bp, Mus musculus
atctgggcgaggtggtattgctcta

SEQ ID NO: 250337 - DNA, 25 bp, Mus musculus
atctgggctctgcaactgaaggctc

SEQ ID NO: 250338 - DNA, 25 bp, Mus musculus
atctgggctctggaactgaaggctc

SEQ ID NO: 250339 - DNA, 25 bp, Mus musculus
atctgggctgagcttggtttatcca

SEQ ID NO: 250340 - DNA, 25 bp, Mus musculus
atctgggctgaggttggtttatcca

SEQ ID NO: 250341 - DNA, 25 bp, Mus musculus
atctggggctgactctgacatctga

SEQ ID NO: 250342 - DNA, 25 bp, Mus musculus
atctggggctgagtctgacatctga

SEQ ID NO: 250343 - DNA, 25 bp, Mus musculus
atctgggtacctctgatggcctaca

SEQ ID NO: 250344 - DNA, 25 bp, Mus musculus
atctgggtacctgtgatggcctaca

SEQ ID NO: 250345 - DNA, 25 bp, Mus musculus
atctgggtatatactcagttttgaa

SEQ ID NO: 250346 - DNA, 25 bp, Mus musculus
atctgggtatattctcagttttgaa

SEQ ID NO: 250347 - DNA, 25 bp, Mus musculus
atctgggtcaaccaacctagcaggt

SEQ ID NO: 250348 - DNA, 25 bp, Mus musculus
atctgggtcaacgaacctagcaggt

SEQ ID NO: 250349 - DNA, 25 bp, Mus musculus
atctgggtcagtcgactgtcttcta

SEQ ID NO: 250350 - DNA, 25 bp, Mus musculus
atctgggtcagtggactgtcttcta

SEQ ID NO: 250351 - DNA, 25 bp, Mus musculus
atctgggtctgcagcggcatctgcg

SEQ ID NO: 250352 - DNA, 25 bp, Mus musculus
atctgggtctgctgcggcatctgcg

SEQ ID NO: 250353 - DNA, 25 bp, Mus musculus
atctgggtgcatctctgctgcagtc

SEQ ID NO: 250354 - DNA, 25 bp, Mus musculus
atctgggtgcatgtctgctgcagtc

SEQ ID NO: 250355 - DNA, 25 bp, Mus musculus
atctgggtggtcatgagagactcca

SEQ ID NO: 250356 - DNA, 25 bp, Mus musculus
atctgggtggtcttgagagactcca

SEQ ID NO: 250357 - DNA, 25 bp, Mus musculus
atctgggttccaaaaatgagtttca

SEQ ID NO: 250358 - DNA, 25 bp, Mus musculus
atctgggttccataaatgagtttca

SEQ ID NO: 250359 - DNA, 25 bp, Mus musculus
atctgggttctcagcctccaccttg

SEQ ID NO: 250360 - DNA, 25 bp, Mus musculus
atctgggttctctgcctccaccttg

SEQ ID NO: 250361 - DNA, 25 bp, Mus musculus
atctgggtttaacatctgcttaggc

SEQ ID NO: 250362 - DNA, 25 bp, Mus musculus
atctgggtttaagatctgcttaggc

SEQ ID NO: 250363 - DNA, 25 bp, Mus musculus
atctgggtttgacctcagagcccgg

SEQ ID NO: 250364 - DNA, 25 bp, Mus musculus
atctgggtttgagctcagagcccgg

SEQ ID NO: 250365 - DNA, 25 bp, Mus musculus
atctgggtttggcagctcagatcct

SEQ ID NO: 250366 - DNA, 25 bp, Mus musculus
atctgggtttgggagctcagatcct

SEQ ID NO: 250367 - DNA, 25 bp, Mus musculus
atctgggttttactgccgaacactc

SEQ ID NO: 250368 - DNA, 25 bp, Mus musculus
atctgggttttagtgccgaacactc

SEQ ID NO: 250369 - DNA, 25 bp, Mus musculus
atctggtaacaaatgcacaaccaat

SEQ ID NO: 250370 - DNA, 25 bp, Mus musculus
atctggtaacaattgcacaaccaat

SEQ ID NO: 250371 - DNA, 25 bp, Mus musculus
atctggtaccaaatctttctaaatc

SEQ ID NO: 250372 - DNA, 25 bp, Mus musculus
atctggtaccaattctttctaaatc

SEQ ID NO: 250373 - DNA, 25 bp, Mus musculus
atctggtaccagcttgctctcagag

SEQ ID NO: 250374 - DNA, 25 bp, Mus musculus
atctggtaccaggttgctctcagag

SEQ ID NO: 250375 - DNA, 25 bp, Mus musculus
atctggtaccgcatgtgaccttcag

SEQ ID NO: 250376 - DNA, 25 bp, Mus musculus
atctggtaccgcttgtgaccttcag

SEQ ID NO: 250377 - DNA, 25 bp, Mus musculus
atctggtacctgaaggtctaggcct

SEQ ID NO: 250378 - DNA, 25 bp, Mus musculus
atctggtacctgtaggtctaggcct

SEQ ID NO: 250379 - DNA, 25 bp, Mus musculus
atctggtagttgaggcatgtttttt

SEQ ID NO: 250380 - DNA, 25 bp, Mus musculus
atctggtagttgtggcatgtttttt

SEQ ID NO: 250381 - DNA, 25 bp, Mus musculus
atctggtattctctgcttgcaaatc

SEQ ID NO: 250382 - DNA, 25 bp, Mus musculus
atctggtattctgtgcttgcaaatc

SEQ ID NO: 250383 - DNA, 25 bp, Mus musculus
atctggtcaagtaaggctccctggg

SEQ ID NO: 250384 - DNA, 25 bp, Mus musculus
atctggtcaagttaggctccctggg

SEQ ID NO: 250385 - DNA, 25 bp, Mus musculus
atctggtcagtcacccacagtaggg

SEQ ID NO: 250386 - DNA, 25 bp, Mus musculus
atctggtcagtctcccacagtaggg

SEQ ID NO: 250387 - DNA, 25 bp, Mus musculus
atctggtcccaacctgtagctcagt

SEQ ID NO: 250388 - DNA, 25 bp, Mus musculus
atctggtcccaagctgtagctcagt

SEQ ID NO: 250389 - DNA, 25 bp, Mus musculus
atctggtcccgtctttctagtagaa

SEQ ID NO: 250390 - DNA, 25 bp, Mus musculus
atctggtcccgtgtttctagtagaa

SEQ ID NO: 250391 - DNA, 25 bp, Mus musculus
atctggtccctacctgtcaaagtgg

SEQ ID NO: 250392 - DNA, 25 bp, Mus musculus
atctggtccctagctgtcaaagtgg

SEQ ID NO: 250393 - DNA, 25 bp, Mus musculus
atctggtccctgactctgatgacag

SEQ ID NO: 250394 - DNA, 25 bp, Mus musculus
atctggtccctgtctctgatgacag

SEQ ID NO: 250395 - DNA, 25 bp, Mus musculus
atctggtcctctaatgagagtctct

SEQ ID NO: 250396 - DNA, 25 bp, Mus musculus
atctggtcctcttatgagagtctct

SEQ ID NO: 250397 - DNA, 25 bp, Mus musculus
atctggtcgtccctgtagccatcat

SEQ ID NO: 250398 - DNA, 25 bp, Mus musculus
atctggtcgtccgtgtagccatcat

SEQ ID NO: 250399 - DNA, 25 bp, Mus musculus
atctggtctctcatggtctggtcat

SEQ ID NO: 250400 - DNA, 25 bp, Mus musculus
atctggtctctcttggtctggtcat

SEQ ID NO: 250401 - DNA, 25 bp, Mus musculus
atctggtctgaacttgtcgttaaaa

SEQ ID NO: 250402 - DNA, 25 bp, Mus musculus
atctggtctgaagttgtcgttaaaa

SEQ ID NO: 250403 - DNA, 25 bp, Mus musculus
atctggtcttggctacgaagttgca

SEQ ID NO: 250404 - DNA, 25 bp, Mus musculus
atctggtcttgggtacgaagttgca

SEQ ID NO: 250405 - DNA, 25 bp, Mus musculus
atctggtgaccaagtgagaattaca

SEQ ID NO: 250406 - DNA, 25 bp, Mus musculus
atctggtgaccatgtgagaattaca

SEQ ID NO: 250407 - DNA, 25 bp, Mus musculus
atctggtgacttagtggtgcactca

SEQ ID NO: 250408 - DNA, 25 bp, Mus musculus
atctggtgactttgtggtgcactca

SEQ ID NO: 250409 - DNA, 25 bp, Mus musculus
atctggtgcatgacctgctgagttt

SEQ ID NO: 250410 - DNA, 25 bp, Mus musculus
atctggtgcatgtcctgctgagttt

SEQ ID NO: 250411 - DNA, 25 bp, Mus musculus
atctggtgccctcactgtttctttc

SEQ ID NO: 250412 - DNA, 25 bp, Mus musculus
atctggtgccctgactgtttctttc

SEQ ID NO: 250413 - DNA, 25 bp, Mus musculus
atctggtgccggcaactagcaacag

SEQ ID NO: 250414 - DNA, 25 bp, Mus musculus
atctggtgccgggaactagcaacag

SEQ ID NO: 250415 - DNA, 25 bp, Mus musculus
atctggtgctagacagcgcttgccc

SEQ ID NO: 250416 - DNA, 25 bp, Mus musculus
atctggtgctagacagcgcttggcc

SEQ ID NO: 250417 - DNA, 25 bp, Mus musculus
atctggtgctagtcagcgcttgccc

SEQ ID NO: 250418 - DNA, 25 bp, Mus musculus
atctggtgctagtcagcgcttggcc

SEQ ID NO: 250419 - DNA, 25 bp, Mus musculus
atctggtggcacagctccgagctgc

SEQ ID NO: 250420 - DNA, 25 bp, Mus musculus
atctggtggcactgctccgagctgc

SEQ ID NO: 250421 - DNA, 25 bp, Mus musculus
atctggtggtgtatgtcctcatcta

SEQ ID NO: 250422 - DNA, 25 bp, Mus musculus
atctggtggtgtttgtcctcatcta

SEQ ID NO: 250423 - DNA, 25 bp, Mus musculus
atctggtgtcaacgacacctgcctg

SEQ ID NO: 250424 - DNA, 25 bp, Mus musculus
atctggtgtcaaggacacctgcctg

SEQ ID NO: 250425 - DNA, 25 bp, Mus musculus
atctggtgtgtaaacattatatctc

SEQ ID NO: 250426 - DNA, 25 bp, Mus musculus
atctggtgtgtatacattatatctc

SEQ ID NO: 250427 - DNA, 25 bp, Mus musculus
atctggtgttttctacaaattaagt

SEQ ID NO: 250428 - DNA, 25 bp, Mus musculus
atctggtgttttgtacaaattaagt

SEQ ID NO: 250429 - DNA, 25 bp, Mus musculus
atctggttactgctgttacttcctt

SEQ ID NO: 250430 - DNA, 25 bp, Mus musculus
atctggttactggtgttacttcctt

SEQ ID NO: 250431 - DNA, 25 bp, Mus musculus
atctggttcacgcagaagcggcaaa

SEQ ID NO: 250432 - DNA, 25 bp, Mus musculus
atctggttcacggagaagcggcaaa

SEQ ID NO: 250433 - DNA, 25 bp, Mus musculus
atctggttctgcaggcccagtagag

SEQ ID NO: 250434 - DNA, 25 bp, Mus musculus
atctggttctgctggcccagtagag

SEQ ID NO: 250435 - DNA, 25 bp, Mus musculus
atctggttgtcacttcgcgtccggg

SEQ ID NO: 250436 - DNA, 25 bp, Mus musculus
atctggttgtcagttcgcgtccggg

SEQ ID NO: 250437 - DNA, 25 bp, Mus musculus
atctggtttacaatttcgtcctgca

SEQ ID NO: 250438 - DNA, 25 bp, Mus musculus
atctggtttacattttcgtcctgca

SEQ ID NO: 250439 - DNA, 25 bp, Mus musculus
atctggtttatcacaggctgtctat

SEQ ID NO: 250440 - DNA, 25 bp, Mus musculus
atctggtttatctcaggctgtctat

SEQ ID NO: 250441 - DNA, 25 bp, Mus musculus
atctggtttcatatcaccaagtgca

SEQ ID NO: 250442 - DNA, 25 bp, Mus musculus
atctggtttcatttcaccaagtgca

SEQ ID NO: 250443 - DNA, 25 bp, Mus musculus
atctggtttctcacacgtgtgttct

SEQ ID NO: 250444 - DNA, 25 bp, Mus musculus
atctggtttctctcacgtgtgttct

SEQ ID NO: 250445 - DNA, 25 bp, Mus musculus
atctggtttgatacagtgtgcctcc

SEQ ID NO: 250446 - DNA, 25 bp, Mus musculus
atctggtttgattcagtgtgcctcc

SEQ ID NO: 250447 - DNA, 25 bp, Mus musculus
atctgtaaaagacgatccttctagg

SEQ ID NO: 250448 - DNA, 25 bp, Mus musculus
atctgtaaaagaggatccttctagg

SEQ ID NO: 250449 - DNA, 25 bp, Mus musculus
atctgtaaatgtcgcttgttctctg

SEQ ID NO: 250450 - DNA, 25 bp, Mus musculus
atctgtaaatgtggcttgttctctg

SEQ ID NO: 250451 - DNA, 25 bp, Mus musculus
atctgtaacactactatggagactg

SEQ ID NO: 250452 - DNA, 25 bp, Mus musculus
atctgtaacacttctatggagactg

SEQ ID NO: 250453 - DNA, 25 bp, Mus musculus
atctgtaacatccaaggccgcccaa

SEQ ID NO: 250454 - DNA, 25 bp, Mus musculus
atctgtaacatcgaaggccgcccaa

SEQ ID NO: 250455 - DNA, 25 bp, Mus musculus
atctgtaacccacaaagattctggg

SEQ ID NO: 250456 - DNA, 25 bp, Mus musculus
atctgtaacccagaaagattctggg

SEQ ID NO: 250457 - DNA, 25 bp, Mus musculus
atctgtaaccctagacactgggact

SEQ ID NO: 250458 - DNA, 25 bp, Mus musculus
atctgtaacccttgacactgggact

SEQ ID NO: 250459 - DNA, 25 bp, Mus musculus
atctgtaaccgtcagcttttccacc

SEQ ID NO: 250460 - DNA, 25 bp, Mus musculus
atctgtaaccgtgagcttttccacc

SEQ ID NO: 250461 - DNA, 25 bp, Mus musculus
atctgtaacgagcagccttttgtgg

SEQ ID NO: 250462 - DNA, 25 bp, Mus musculus
atctgtaacgaggagccttttgtgg

SEQ ID NO: 250463 - DNA, 25 bp, Mus musculus
atctgtaagaaaagtctgggcccca

SEQ ID NO: 250464 - DNA, 25 bp, Mus musculus
atctgtaagaaatgtctgggcccca

SEQ ID NO: 250465 - DNA, 25 bp, Mus musculus
atctgtaagagccaccagtcttctt

SEQ ID NO: 250466 - DNA, 25 bp, Mus musculus
atctgtaagagcgaccagtcttctt

SEQ ID NO: 250467 - DNA, 25 bp, Mus musculus
atctgtaagatccataagccgtttg

SEQ ID NO: 250468 - DNA, 25 bp, Mus musculus
atctgtaagatcgataagccgtttg

SEQ ID NO: 250469 - DNA, 25 bp, Mus musculus
atctgtaagcccagcccttcggagg

SEQ ID NO: 250470 - DNA, 25 bp, Mus musculus
atctgtaagccctgcccttcggagg

SEQ ID NO: 250471 - DNA, 25 bp, Mus musculus
atctgtaaggatccagtcttctggt

SEQ ID NO: 250472 - DNA, 25 bp, Mus musculus
atctgtaaggatgcagtcttctggt

SEQ ID NO: 250473 - DNA, 25 bp, Mus musculus
atctgtaatatcatcacgagctttg

SEQ ID NO: 250474 - DNA, 25 bp, Mus musculus
atctgtaatatcttcacgagctttg

SEQ ID NO: 250475 - DNA, 25 bp, Mus musculus
atctgtaatccaagaactttctgaa

SEQ ID NO: 250476 - DNA, 25 bp, Mus musculus
atctgtaatccatgaactttctgaa

SEQ ID NO: 250477 - DNA, 25 bp, Mus musculus
atctgtaatgggacctgtagccttc

SEQ ID NO: 250478 - DNA, 25 bp, Mus musculus
atctgtaatgggtcctgtagccttc

SEQ ID NO: 250479 - DNA, 25 bp, Mus musculus
atctgtaatgtaattggagttcttg

SEQ ID NO: 250480 - DNA, 25 bp, Mus musculus
atctgtaatgtatttggagttcttg

SEQ ID NO: 250481 - DNA, 25 bp, Mus musculus
atctgtaatttccttggcacaataa

SEQ ID NO: 250482 - DNA, 25 bp, Mus musculus
atctgtaatttcgttggcacaataa

SEQ ID NO: 250483 - DNA, 25 bp, Mus musculus
atctgtacagatatcaacaagcagg

SEQ ID NO: 250484 - DNA, 25 bp, Mus musculus
atctgtacagatttcaacaagcagg

SEQ ID NO: 250485 - DNA, 25 bp, Mus musculus
atctgtacctcacccttgactaggc

SEQ ID NO: 250486 - DNA, 25 bp, Mus musculus
atctgtacctcagccttgactaggc

SEQ ID NO: 250487 - DNA, 25 bp, Mus musculus
atctgtacctcccaggctatttgtt

SEQ ID NO: 250488 - DNA, 25 bp, Mus musculus
atctgtacctccgaggctatttgtt

SEQ ID NO: 250489 - DNA, 25 bp, Mus musculus
atctgtacgtacacagcagtgttgt

SEQ ID NO: 250490 - DNA, 25 bp, Mus musculus
atctgtacgtactcagcagtgttgt

SEQ ID NO: 250491 - DNA, 25 bp, Mus musculus
atctgtactcacagccaaagctgta

SEQ ID NO: 250492 - DNA, 25 bp, Mus musculus
atctgtactcactgccaaagctgta

SEQ ID NO: 250493 - DNA, 25 bp, Mus musculus
atctgtactgacctttatttttcca

SEQ ID NO: 250494 - DNA, 25 bp, Mus musculus
atctgtactgacgtttatttttcca

SEQ ID NO: 250495 - DNA, 25 bp, Mus musculus
atctgtactgggatctatatcttag

SEQ ID NO: 250496 - DNA, 25 bp, Mus musculus
atctgtactgggttctatatcttag

SEQ ID NO: 250497 - DNA, 25 bp, Mus musculus
atctgtactgttaactttgttcatc

SEQ ID NO: 250498 - DNA, 25 bp, Mus musculus
atctgtactgtttactttgttcatc

SEQ ID NO: 250499 - DNA, 25 bp, Mus musculus
atctgtagcacgctgggctgagcac

SEQ ID NO: 250500 - DNA, 25 bp, Mus musculus
atctgtagcacggtgggctgagcac

SEQ ID NO: 250501 - DNA, 25 bp, Mus musculus
atctgtagcataaatccggtcgaat

SEQ ID NO: 250502 - DNA, 25 bp, Mus musculus
atctgtagcatatatccggtcgaat

SEQ ID NO: 250503 - DNA, 25 bp, Mus musculus
atctgtagctgactggcgtgttacc

SEQ ID NO: 250504 - DNA, 25 bp, Mus musculus
atctgtagctgagtggcgtgttacc

SEQ ID NO: 250505 - DNA, 25 bp, Mus musculus
atctgtagctgcactcagtgggtag

SEQ ID NO: 250506 - DNA, 25 bp, Mus musculus
atctgtagctgcatggcatccggaa

SEQ ID NO: 250507 - DNA, 25 bp, Mus musculus
atctgtagctgctctcagtgggtag

SEQ ID NO: 250508 - DNA, 25 bp, Mus musculus
atctgtagctgcttggcatccggaa

SEQ ID NO: 250509 - DNA, 25 bp, Mus musculus
atctgtagctggatgttgacactaa

SEQ ID NO: 250510 - DNA, 25 bp, Mus musculus
atctgtagctggttgttgacactaa

SEQ ID NO: 250511 - DNA, 25 bp, Mus musculus
atctgtaggcacaaatggacactta

SEQ ID NO: 250512 - DNA, 25 bp, Mus musculus
atctgtaggcactaatggacactta

SEQ ID NO: 250513 - DNA, 25 bp, Mus musculus
atctgtagtcagactgtgctggctg

SEQ ID NO: 250514 - DNA, 25 bp, Mus musculus
atctgtagtcagtctgtgctggctg

SEQ ID NO: 250515 - DNA, 25 bp, Mus musculus
atctgtagtcctagcgtgtgtgtgt

SEQ ID NO: 250516 - DNA, 25 bp, Mus musculus
atctgtagtccttgcgtgtgtgtgt

SEQ ID NO: 250517 - DNA, 25 bp, Mus musculus
atctgtagtcgtaactggcctactg

SEQ ID NO: 250518 - DNA, 25 bp, Mus musculus
atctgtagtcgttactggcctactg

SEQ ID NO: 250519 - DNA, 25 bp, Mus musculus
atctgtagtgagaaatccaggtgca

SEQ ID NO: 250520 - DNA, 25 bp, Mus musculus
atctgtagtgagtaatccaggtgca

SEQ ID NO: 250521 - DNA, 25 bp, Mus musculus
atctgtagtggaagctgcccatcta

SEQ ID NO: 250522 - DNA, 25 bp, Mus musculus
atctgtagtggatgctgcccatcta

SEQ ID NO: 250523 - DNA, 25 bp, Mus musculus
atctgtagtggcactgtcacctttt

SEQ ID NO: 250524 - DNA, 25 bp, Mus musculus
atctgtagtggctctgtcacctttt

SEQ ID NO: 250525 - DNA, 25 bp, Mus musculus
atctgtagtggtcctgactttgctt

SEQ ID NO: 250526 - DNA, 25 bp, Mus musculus
atctgtagtggtgctgactttgctt

SEQ ID NO: 250527 - DNA, 25 bp, Mus musculus
atctgtataataccccatcaagcaa

SEQ ID NO: 250528 - DNA, 25 bp, Mus musculus
atctgtataatagcccatcaagcaa

SEQ ID NO: 250529 - DNA, 25 bp, Mus musculus
atctgtatccccacagcatggaagt

SEQ ID NO: 250530 - DNA, 25 bp, Mus musculus
atctgtatcccctcagcatggaagt

SEQ ID NO: 250531 - DNA, 25 bp, Mus musculus
atctgtatctagaacccatagtagc

SEQ ID NO: 250532 - DNA, 25 bp, Mus musculus
atctgtatctagtacccatagtagc

SEQ ID NO: 250533 - DNA, 25 bp, Mus musculus
atctgtatctgtaatcactctggaa

SEQ ID NO: 250534 - DNA, 25 bp, Mus musculus
atctgtatctgttatcactctggaa

SEQ ID NO: 250535 - DNA, 25 bp, Mus musculus
atctgtatctttatcatctttgtgc

SEQ ID NO: 250536 - DNA, 25 bp, Mus musculus
atctgtatctttttcatctttgtgc

SEQ ID NO: 250537 - DNA, 25 bp, Mus musculus
atctgtatgcaactcagcatccctt

SEQ ID NO: 250538 - DNA, 25 bp, Mus musculus
atctgtatgcaagtcagcatccctt

SEQ ID NO: 250539 - DNA, 25 bp, Mus musculus
atctgtatgcagaaacccacttctc

SEQ ID NO: 250540 - DNA, 25 bp, Mus musculus
atctgtatgcagtaacccacttctc

SEQ ID NO: 250541 - DNA, 25 bp, Mus musculus
atctgtatggcacctgtctgggttc

SEQ ID NO: 250542 - DNA, 25 bp, Mus musculus
atctgtatggcagctgtctgggttc

SEQ ID NO: 250543 - DNA, 25 bp, Mus musculus
atctgtatgtatcattttctattat

SEQ ID NO: 250544 - DNA, 25 bp, Mus musculus
atctgtatgtatgattttctattat

SEQ ID NO: 250545 - DNA, 25 bp, Mus musculus
atctgtattatgactgctggtggta

SEQ ID NO: 250546 - DNA, 25 bp, Mus musculus
atctgtattatgtctgctggtggta

SEQ ID NO: 250547 - DNA, 25 bp, Mus musculus
atctgtattcctagtgctcagctgt

SEQ ID NO: 250548 - DNA, 25 bp, Mus musculus
atctgtattccttgtgctcagctgt

SEQ ID NO: 250549 - DNA, 25 bp, Mus musculus
atctgtattcttcagctcaccctgt

SEQ ID NO: 250550 - DNA, 25 bp, Mus musculus
atctgtattcttgagctcaccctgt

SEQ ID NO: 250551 - DNA, 25 bp, Mus musculus
atctgtattgagaacctcagttaat

SEQ ID NO: 250552 - DNA, 25 bp, Mus musculus
atctgtattgagtacctcagttaat

SEQ ID NO: 250553 - DNA, 25 bp, Mus musculus
atctgtatttgcagctgtccttttg

SEQ ID NO: 250554 - DNA, 25 bp, Mus musculus
atctgtatttgctgctgtccttttg

SEQ ID NO: 250555 - DNA, 25 bp, Mus musculus
atctgtattttgcaatggtcttctt

SEQ ID NO: 250556 - DNA, 25 bp, Mus musculus
atctgtattttggaatggtcttctt

SEQ ID NO: 250557 - DNA, 25 bp, Mus musculus
atctgtcaacccacctgactgtgtg

SEQ ID NO: 250558 - DNA, 25 bp, Mus musculus
atctgtcaaccctcctgactgtgtg

SEQ ID NO: 250559 - DNA, 25 bp, Mus musculus
atctgtcaatgtcctgtgactcact

SEQ ID NO: 250560 - DNA, 25 bp, Mus musculus
atctgtcaatgtgctgtgactcact

SEQ ID NO: 250561 - DNA, 25 bp, Mus musculus
atctgtcaccccaagtcggattaga

SEQ ID NO: 250562 - DNA, 25 bp, Mus musculus
atctgtcaccccattggttgccagg

SEQ ID NO: 250563 - DNA, 25 bp, Mus musculus
atctgtcacccctagtcggattaga

SEQ ID NO: 250564 - DNA, 25 bp, Mus musculus
atctgtcacccctttggttgccagg

SEQ ID NO: 250565 - DNA, 25 bp, Mus musculus
atctgtcaccgcatatgaccttgag

SEQ ID NO: 250566 - DNA, 25 bp, Mus musculus
atctgtcaccgcttatgaccttgag

SEQ ID NO: 250567 - DNA, 25 bp, Mus musculus
atctgtcacgatactgtgtccagtg

SEQ ID NO: 250568 - DNA, 25 bp, Mus musculus
atctgtcacgattctgtgtccagtg

SEQ ID NO: 250569 - DNA, 25 bp, Mus musculus
atctgtcactatataatcctaggga

SEQ ID NO: 250570 - DNA, 25 bp, Mus musculus
atctgtcactatttaatcctaggga

SEQ ID NO: 250571 - DNA, 25 bp, Mus musculus
atctgtcactgtcgactcaggctcc

SEQ ID NO: 250572 - DNA, 25 bp, Mus musculus
atctgtcactgtggactcaggctcc

SEQ ID NO: 250573 - DNA, 25 bp, Mus musculus
atctgtcagatacaccatgtcatgt

SEQ ID NO: 250574 - DNA, 25 bp, Mus musculus
atctgtcagatagaccatgtcatgt

SEQ ID NO: 250575 - DNA, 25 bp, Mus musculus
atctgtcagctcactgcagtggcat

SEQ ID NO: 250576 - DNA, 25 bp, Mus musculus
atctgtcagctctctgcagtggcat

SEQ ID NO: 250577 - DNA, 25 bp, Mus musculus
atctgtcagctgatcccggagttag

SEQ ID NO: 250578 - DNA, 25 bp, Mus musculus
atctgtcagctgttcccggagttag

SEQ ID NO: 250579 - DNA, 25 bp, Mus musculus
atctgtcaggttatgaagcatttca

SEQ ID NO: 250580 - DNA, 25 bp, Mus musculus
atctgtcaggttttgaagcatttca

SEQ ID NO: 250581 - DNA, 25 bp, Mus musculus
atctgtcagttcactgttttctggg

SEQ ID NO: 250582 - DNA, 25 bp, Mus musculus
atctgtcagttctctgttttctggg

SEQ ID NO: 250583 - DNA, 25 bp, Mus musculus
atctgtcatcaactcatttcgtggt

SEQ ID NO: 250584 - DNA, 25 bp, Mus musculus
atctgtcatcaagtcatttcgtggt

SEQ ID NO: 250585 - DNA, 25 bp, Mus musculus
atctgtcatccaccttgtactagaa

SEQ ID NO: 250586 - DNA, 25 bp, Mus musculus
atctgtcatccagcttgtactagaa

SEQ ID NO: 250587 - DNA, 25 bp, Mus musculus
atctgtcatctcagtctggcttcaa

SEQ ID NO: 250588 - DNA, 25 bp, Mus musculus
atctgtcatctcatagtcacggtca

SEQ ID NO: 250589 - DNA, 25 bp, Mus musculus
atctgtcatctctgtctggcttcaa

SEQ ID NO: 250590 - DNA, 25 bp, Mus musculus
atctgtcatctcttagtcacggtca

SEQ ID NO: 250591 - DNA, 25 bp, Mus musculus
atctgtcatgtcatggcatccttaa

SEQ ID NO: 250592 - DNA, 25 bp, Mus musculus
atctgtcatgtcttggcatccttaa

SEQ ID NO: 250593 - DNA, 25 bp, Mus musculus
atctgtcattgacttcctactctga

SEQ ID NO: 250594 - DNA, 25 bp, Mus musculus
atctgtcattgagttcctactctga

SEQ ID NO: 250595 - DNA, 25 bp, Mus musculus
atctgtccaataattgtcttactat

SEQ ID NO: 250596 - DNA, 25 bp, Mus musculus
atctgtccaatatttgtcttactat

SEQ ID NO: 250597 - DNA, 25 bp, Mus musculus
atctgtccagccaatgtatttacta

SEQ ID NO: 250598 - DNA, 25 bp, Mus musculus
atctgtccagcctatgtatttacta

SEQ ID NO: 250599 - DNA, 25 bp, Mus musculus
atctgtccagcgacttacagtggtt

SEQ ID NO: 250600 - DNA, 25 bp, Mus musculus
atctgtccagcgtcttacagtggtt

SEQ ID NO: 250601 - DNA, 25 bp, Mus musculus
atctgtccagctaccagagagaaca

SEQ ID NO: 250602 - DNA, 25 bp, Mus musculus
atctgtccagcttccagagagaaca

SEQ ID NO: 250603 - DNA, 25 bp, Mus musculus
atctgtccatatacaggaatctgag

SEQ ID NO: 250604 - DNA, 25 bp, Mus musculus
atctgtccatattcaggaatctgag

SEQ ID NO: 250605 - DNA, 25 bp, Mus musculus
atctgtccatgtagtctagactcca

SEQ ID NO: 250606 - DNA, 25 bp, Mus musculus
atctgtccatgttgtctagactcca

SEQ ID NO: 250607 - DNA, 25 bp, Mus musculus
atctgtccattgcaactggtctcca

SEQ ID NO: 250608 - DNA, 25 bp, Mus musculus
atctgtccattggaactggtctcca

SEQ ID NO: 250609 - DNA, 25 bp, Mus musculus
atctgtccccgtccaggcagagttt

SEQ ID NO: 250610 - DNA, 25 bp, Mus musculus
atctgtccccgtgcaggcagagttt

SEQ ID NO: 250611 - DNA, 25 bp, Mus musculus
atctgtccctatcgctggcccattt

SEQ ID NO: 250612 - DNA, 25 bp, Mus musculus
atctgtccctatggctggcccattt

SEQ ID NO: 250613 - DNA, 25 bp, Mus musculus
atctgtccctgtccttggcttgtta

SEQ ID NO: 250614 - DNA, 25 bp, Mus musculus
atctgtccctgtgcttggcttgtta

SEQ ID NO: 250615 - DNA, 25 bp, Mus musculus
atctgtccgctgctgttttgttttc

SEQ ID NO: 250616 - DNA, 25 bp, Mus musculus
atctgtccgctggtgttttgttttc

SEQ ID NO: 250617 - DNA, 25 bp, Mus musculus
atctgtccgtatacaggtcacaact

SEQ ID NO: 250618 - DNA, 25 bp, Mus musculus
atctgtccgtattcaggtcacaact

SEQ ID NO: 250619 - DNA, 25 bp, Mus musculus
atctgtcctggactttcccggctgg

SEQ ID NO: 250620 - DNA, 25 bp, Mus musculus
atctgtcctggagtttcccggctgg

SEQ ID NO: 250621 - DNA, 25 bp, Mus musculus
atctgtcctgttcgcttaatagctg

SEQ ID NO: 250622 - DNA, 25 bp, Mus musculus
atctgtcctgttggcttaatagctg

SEQ ID NO: 250623 - DNA, 25 bp, Mus musculus
atctgtccttttcttcctaatagtt

SEQ ID NO: 250624 - DNA, 25 bp, Mus musculus
atctgtccttttgttcctaatagtt

SEQ ID NO: 250625 - DNA, 25 bp, Mus musculus
atctgtctaatgaatgaactttcaa

SEQ ID NO: 250626 - DNA, 25 bp, Mus musculus
atctgtctaatgtatgaactttcaa

SEQ ID NO: 250627 - DNA, 25 bp, Mus musculus
atctgtctacctcttaactgaataa

SEQ ID NO: 250628 - DNA, 25 bp, Mus musculus
atctgtctacctgttaactgaataa

SEQ ID NO: 250629 - DNA, 25 bp, Mus musculus
atctgtctagtcatacttgtcttta

SEQ ID NO: 250630 - DNA, 25 bp, Mus musculus
atctgtctagtcttacttgtcttta

SEQ ID NO: 250631 - DNA, 25 bp, Mus musculus
atctgtctatcaactgctaggatta

SEQ ID NO: 250632 - DNA, 25 bp, Mus musculus
atctgtctatcatctgctaggatta

SEQ ID NO: 250633 - DNA, 25 bp, Mus musculus
atctgtctccaaatacaactctgca

SEQ ID NO: 250634 - DNA, 25 bp, Mus musculus
atctgtctccaaatttaatccatac

SEQ ID NO: 250635 - DNA, 25 bp, Mus musculus
atctgtctccaacatttagcctgcg

SEQ ID NO: 250636 - DNA, 25 bp, Mus musculus
atctgtctccaagatttagcctgcg

SEQ ID NO: 250637 - DNA, 25 bp, Mus musculus
atctgtctccaattacaactctgca

SEQ ID NO: 250638 - DNA, 25 bp, Mus musculus
atctgtctccaattttaatccatac

SEQ ID NO: 250639 - DNA, 25 bp, Mus musculus
atctgtctccccagcacggagggaa

SEQ ID NO: 250640 - DNA, 25 bp, Mus musculus
atctgtctcccctgcacggagggaa

SEQ ID NO: 250641 - DNA, 25 bp, Mus musculus
atctgtctctctcagaactggctgc

SEQ ID NO: 250642 - DNA, 25 bp, Mus musculus
atctgtctctctgagaactggctgc

SEQ ID NO: 250643 - DNA, 25 bp, Mus musculus
atctgtctctgtaaggctggcccaa

SEQ ID NO: 250644 - DNA, 25 bp, Mus musculus
atctgtctctgtatactctgccgag

SEQ ID NO: 250645 - DNA, 25 bp, Mus musculus
atctgtctctgttaggctggcccaa

SEQ ID NO: 250646 - DNA, 25 bp, Mus musculus
atctgtctctgtttactctgccgag

SEQ ID NO: 250647 - DNA, 25 bp, Mus musculus
atctgtctcttccacaaacgaggag

SEQ ID NO: 250648 - DNA, 25 bp, Mus musculus
atctgtctcttcgacaaacgaggag

SEQ ID NO: 250649 - DNA, 25 bp, Mus musculus
atctgtctcttgaagcgcttgatca

SEQ ID NO: 250650 - DNA, 25 bp, Mus musculus
atctgtctcttgtagcgcttgatca

SEQ ID NO: 250651 - DNA, 25 bp, Mus musculus
atctgtctgagcatctcccatcagt

SEQ ID NO: 250652 - DNA, 25 bp, Mus musculus
atctgtctgagcttctcccatcagt

SEQ ID NO: 250653 - DNA, 25 bp, Mus musculus
atctgtctgcagctgttatttccaa

SEQ ID NO: 250654 - DNA, 25 bp, Mus musculus
atctgtctgcaggtgttatttccaa

SEQ ID NO: 250655 - DNA, 25 bp, Mus musculus
atctgtctgccaagggtttcattga

SEQ ID NO: 250656 - DNA, 25 bp, Mus musculus
atctgtctgccatgggtttcattga

SEQ ID NO: 250657 - DNA, 25 bp, Mus musculus
atctgtctgggcaccttaggtgcct

SEQ ID NO: 250658 - DNA, 25 bp, Mus musculus
atctgtctgggctccttaggtgcct

SEQ ID NO: 250659 - DNA, 25 bp, Mus musculus
atctgtctgtccaaatttgctagca

SEQ ID NO: 250660 - DNA, 25 bp, Mus musculus
atctgtctgtcctaatttgctagca

SEQ ID NO: 250661 - DNA, 25 bp, Mus musculus
atctgtctgtgcagtgagatgacta

SEQ ID NO: 250662 - DNA, 25 bp, Mus musculus
atctgtctgtgctgtgagatgacta

SEQ ID NO: 250663 - DNA, 25 bp, Mus musculus
atctgtctgtggcatacaagcacca

SEQ ID NO: 250664 - DNA, 25 bp, Mus musculus
atctgtctgtgggatacaagcacca

SEQ ID NO: 250665 - DNA, 25 bp, Mus musculus
atctgtcttcaacccatggactacc

SEQ ID NO: 250666 - DNA, 25 bp, Mus musculus
atctgtcttcaagccatggactacc

SEQ ID NO: 250667 - DNA, 25 bp, Mus musculus
atctgtcttcacatacaccacaatg

SEQ ID NO: 250668 - DNA, 25 bp, Mus musculus
atctgtcttcacttacaccacaatg

SEQ ID NO: 250669 - DNA, 25 bp, Mus musculus
atctgtcttccgatacacttacata

SEQ ID NO: 250670 - DNA, 25 bp, Mus musculus
atctgtcttccgttacacttacata

SEQ ID NO: 250671 - DNA, 25 bp, Mus musculus
atctgtcttcttcatagtatcatat

SEQ ID NO: 250672 - DNA, 25 bp, Mus musculus
atctgtcttcttgatagtatcatat

SEQ ID NO: 250673 - DNA, 25 bp, Mus musculus
atctgtctttctaggagtaattccg

SEQ ID NO: 250674 - DNA, 25 bp, Mus musculus
atctgtctttcttggagtaattccg

SEQ ID NO: 250675 - DNA, 25 bp, Mus musculus
atctgtctttgcctacttgttttca

SEQ ID NO: 250676 - DNA, 25 bp, Mus musculus
atctgtctttgcgtacttgttttca

SEQ ID NO: 250677 - DNA, 25 bp, Mus musculus
atctgtgaaacacttgactctgtta

SEQ ID NO: 250678 - DNA, 25 bp, Mus musculus
atctgtgaaacagttgactctgtta

SEQ ID NO: 250679 - DNA, 25 bp, Mus musculus
atctgtgaaacccaataaacctctt

SEQ ID NO: 250680 - DNA, 25 bp, Mus musculus
atctgtgaaaccgaataaacctctt

SEQ ID NO: 250681 - DNA, 25 bp, Mus musculus
atctgtgaaatccaggtgcccagta

SEQ ID NO: 250682 - DNA, 25 bp, Mus musculus
atctgtgaaatcgaggtgcccagta

SEQ ID NO: 250683 - DNA, 25 bp, Mus musculus
atctgtgaagccatactacatgtgg

SEQ ID NO: 250684 - DNA, 25 bp, Mus musculus
atctgtgaagccttactacatgtgg

SEQ ID NO: 250685 - DNA, 25 bp, Mus musculus
atctgtgaattcatctgacccttgc

SEQ ID NO: 250686 - DNA, 25 bp, Mus musculus
atctgtgaattcttctgacccttgc

SEQ ID NO: 250687 - DNA, 25 bp, Mus musculus
atctgtgacaaacgcttatcctctg

SEQ ID NO: 250688 - DNA, 25 bp, Mus musculus
atctgtgacaaaggcttatcctctg

SEQ ID NO: 250689 - DNA, 25 bp, Mus musculus
atctgtgacactacggcatgagctg

SEQ ID NO: 250690 - DNA, 25 bp, Mus musculus
atctgtgacacttcggcatgagctg

SEQ ID NO: 250691 - DNA, 25 bp, Mus musculus
atctgtgacctcactagttctggag

SEQ ID NO: 250692 - DNA, 25 bp, Mus musculus
atctgtgacctcctcaaagacaatt

SEQ ID NO: 250693 - DNA, 25 bp, Mus musculus
atctgtgacctcgtcaaagacaatt

SEQ ID NO: 250694 - DNA, 25 bp, Mus musculus
atctgtgacctctctagttctggag

SEQ ID NO: 250695 - DNA, 25 bp, Mus musculus
atctgtgacctgaatgagaacattt

SEQ ID NO: 250696 - DNA, 25 bp, Mus musculus
atctgtgacctgtatgagaacattt

SEQ ID NO: 250697 - DNA, 25 bp, Mus musculus
atctgtgactaacggagctgggttc

SEQ ID NO: 250698 - DNA, 25 bp, Mus musculus
atctgtgactaagggagctgggttc

SEQ ID NO: 250699 - DNA, 25 bp, Mus musculus
atctgtgactgtccttgtcaacagg

SEQ ID NO: 250700 - DNA, 25 bp, Mus musculus
atctgtgactgtgcttgtcaacagg

SEQ ID NO: 250701 - DNA, 25 bp, Mus musculus
atctgtgactttaaccacctggatc

SEQ ID NO: 250702 - DNA, 25 bp, Mus musculus
atctgtgacttttaccacctggatc

SEQ ID NO: 250703 - DNA, 25 bp, Mus musculus
atctgtgagactcctgctgaactgg

SEQ ID NO: 250704 - DNA, 25 bp, Mus musculus
atctgtgagactgctgctgaactgg

SEQ ID NO: 250705 - DNA, 25 bp, Mus musculus
atctgtgagagtccatgaggcctat

SEQ ID NO: 250706 - DNA, 25 bp, Mus musculus
atctgtgagagtgcatgaggcctat

SEQ ID NO: 250707 - DNA, 25 bp, Mus musculus
atctgtgagatcacgcccttggtgt

SEQ ID NO: 250708 - DNA, 25 bp, Mus musculus
atctgtgagatctcgcccttggtgt

SEQ ID NO: 250709 - DNA, 25 bp, Mus musculus
atctgtgagcaactgtaagcatgta

SEQ ID NO: 250710 - DNA, 25 bp, Mus musculus
atctgtgagcaagtgtaagcatgta

SEQ ID NO: 250711 - DNA, 25 bp, Mus musculus
atctgtgagcacagggtcctctatg

SEQ ID NO: 250712 - DNA, 25 bp, Mus musculus
atctgtgagcactgggtcctctatg

SEQ ID NO: 250713 - DNA, 25 bp, Mus musculus
atctgtgagcccaaagtcagcctga

SEQ ID NO: 250714 - DNA, 25 bp, Mus musculus
atctgtgagccctaagtcagcctga

SEQ ID NO: 250715 - DNA, 25 bp, Mus musculus
atctgtgagcggctgcatctaagcc

SEQ ID NO: 250716 - DNA, 25 bp, Mus musculus
atctgtgagcgggtgcatctaagcc

SEQ ID NO: 250717 - DNA, 25 bp, Mus musculus
atctgtgagctactacactgcggct

SEQ ID NO: 250718 - DNA, 25 bp, Mus musculus
atctgtgagctagtacactgcggct

SEQ ID NO: 250719 - DNA, 25 bp, Mus musculus
atctgtgagcttcgtatcaagtcca

SEQ ID NO: 250720 - DNA, 25 bp, Mus musculus
atctgtgagcttctatgacttttgt

SEQ ID NO: 250721 - DNA, 25 bp, Mus musculus
atctgtgagcttggtatcaagtcca

SEQ ID NO: 250722 - DNA, 25 bp, Mus musculus
atctgtgagcttgtatgacttttgt

SEQ ID NO: 250723 - DNA, 25 bp, Mus musculus
atctgtgagtgtacttcaggcaggg

SEQ ID NO: 250724 - DNA, 25 bp, Mus musculus
atctgtgagtgttcttcaggcaggg

SEQ ID NO: 250725 - DNA, 25 bp, Mus musculus
atctgtgataagaccaaggtggtat

SEQ ID NO: 250726 - DNA, 25 bp, Mus musculus
atctgtgataagtccaaggtggtat

SEQ ID NO: 250727 - DNA, 25 bp, Mus musculus
atctgtgataggacttttgttctga

SEQ ID NO: 250728 - DNA, 25 bp, Mus musculus
atctgtgataggtcttttgttctga

SEQ ID NO: 250729 - DNA, 25 bp, Mus musculus
atctgtgatcatatgattcccctcc

SEQ ID NO: 250730 - DNA, 25 bp, Mus musculus
atctgtgatcatttgattcccctcc

SEQ ID NO: 250731 - DNA, 25 bp, Mus musculus
atctgtgatccaaatatgtctaaac

SEQ ID NO: 250732 - DNA, 25 bp, Mus musculus
atctgtgatccacatgtttttccct

SEQ ID NO: 250733 - DNA, 25 bp, Mus musculus
atctgtgatccagatgtttttccct

SEQ ID NO: 250734 - DNA, 25 bp, Mus musculus
atctgtgatccatatatgtctaaac

SEQ ID NO: 250735 - DNA, 25 bp, Mus musculus
atctgtgatgctctcgaagtttctg

SEQ ID NO: 250736 - DNA, 25 bp, Mus musculus
atctgtgatgctgtcgaagtttctg

SEQ ID NO: 250737 - DNA, 25 bp, Mus musculus
atctgtgatggaatcgatgcactct

SEQ ID NO: 250738 - DNA, 25 bp, Mus musculus
atctgtgatggacctccttcccttc

SEQ ID NO: 250739 - DNA, 25 bp, Mus musculus
atctgtgatggagctccttcccttc

SEQ ID NO: 250740 - DNA, 25 bp, Mus musculus
atctgtgatggattcgatgcactct

SEQ ID NO: 250741 - DNA, 25 bp, Mus musculus
atctgtgcaatgacgcgtactggct

SEQ ID NO: 250742 - DNA, 25 bp, Mus musculus
atctgtgcaatgtcgcgtactggct

SEQ ID NO: 250743 - DNA, 25 bp, Mus musculus
atctgtgcactcacacaactgtaaa

SEQ ID NO: 250744 - DNA, 25 bp, Mus musculus
atctgtgcactctcacaactgtaaa

SEQ ID NO: 250745 - DNA, 25 bp, Mus musculus
atctgtgcacttcggagtgtgctct

SEQ ID NO: 250746 - DNA, 25 bp, Mus musculus
atctgtgcacttgggagtgtgctct

SEQ ID NO: 250747 - DNA, 25 bp, Mus musculus
atctgtgcagacacctggaagccga

SEQ ID NO: 250748 - DNA, 25 bp, Mus musculus
atctgtgcagactcctggaagccga

SEQ ID NO: 250749 - DNA, 25 bp, Mus musculus
atctgtgcagtactttattcctata

SEQ ID NO: 250750 - DNA, 25 bp, Mus musculus
atctgtgcagtagtttattcctata

SEQ ID NO: 250751 - DNA, 25 bp, Mus musculus
atctgtgcatccacaatacggtgcg

SEQ ID NO: 250752 - DNA, 25 bp, Mus musculus
atctgtgcatcctcaatacggtgcg

SEQ ID NO: 250753 - DNA, 25 bp, Mus musculus
atctgtgcatgtcagccggacggaa

SEQ ID NO: 250754 - DNA, 25 bp, Mus musculus
atctgtgcatgtgagccggacggaa

SEQ ID NO: 250755 - DNA, 25 bp, Mus musculus
atctgtgcccaacttttgtggtgac

SEQ ID NO: 250756 - DNA, 25 bp, Mus musculus
atctgtgcccaagttttgtggtgac

SEQ ID NO: 250757 - DNA, 25 bp, Mus musculus
atctgtgcctgaagccaggtacacc

SEQ ID NO: 250758 - DNA, 25 bp, Mus musculus
atctgtgcctgatgccaggtacacc

SEQ ID NO: 250759 - DNA, 25 bp, Mus musculus
atctgtgccttgcagcttttggctg

SEQ ID NO: 250760 - DNA, 25 bp, Mus musculus
atctgtgccttggagcttttggctg

SEQ ID NO: 250761 - DNA, 25 bp, Mus musculus
atctgtgcgagccttataggtgcaa

SEQ ID NO: 250762 - DNA, 25 bp, Mus musculus
atctgtgcgagcgttataggtgcaa

SEQ ID NO: 250763 - DNA, 25 bp, Mus musculus
atctgtgcgtgccaggagacccctt

SEQ ID NO: 250764 - DNA, 25 bp, Mus musculus
atctgtgcgtgcgaggagacccctt

SEQ ID NO: 250765 - DNA, 25 bp, Mus musculus
atctgtgctaggcaacatgccccaa

SEQ ID NO: 250766 - DNA, 25 bp, Mus musculus
atctgtgctagggaacatgccccaa

SEQ ID NO: 250767 - DNA, 25 bp, Mus musculus
atctgtgctcaccttgaacctacaa

SEQ ID NO: 250768 - DNA, 25 bp, Mus musculus
atctgtgctcacgttgaacctacaa

SEQ ID NO: 250769 - DNA, 25 bp, Mus musculus
atctgtggacatcgaagtggaccta

SEQ ID NO: 250770 - DNA, 25 bp, Mus musculus
atctgtggacatcgatgggcctgaa

SEQ ID NO: 250771 - DNA, 25 bp, Mus musculus
atctgtggacatggaagtggaccta

SEQ ID NO: 250772 - DNA, 25 bp, Mus musculus
atctgtggacatggatgggcctgaa

SEQ ID NO: 250773 - DNA, 25 bp, Mus musculus
atctgtggacgtcttgatgcccaac

SEQ ID NO: 250774 - DNA, 25 bp, Mus musculus
atctgtggacgtgttgatgcccaac

SEQ ID NO: 250775 - DNA, 25 bp, Mus musculus
atctgtggactccttctcggtgtga

SEQ ID NO: 250776 - DNA, 25 bp, Mus musculus
atctgtggactcgttctcggtgtga

SEQ ID NO: 250777 - DNA, 25 bp, Mus musculus
atctgtggacttcgttgcaggctca

SEQ ID NO: 250778 - DNA, 25 bp, Mus musculus
atctgtggacttggttgcaggctca

SEQ ID NO: 250779 - DNA, 25 bp, Mus musculus
atctgtggataaagctgtatttctg

SEQ ID NO: 250780 - DNA, 25 bp, Mus musculus
atctgtggataacgagggctcagaa

SEQ ID NO: 250781 - DNA, 25 bp, Mus musculus
atctgtggataaggagggctcagaa

SEQ ID NO: 250782 - DNA, 25 bp, Mus musculus
atctgtggataatgctgtatttctg

SEQ ID NO: 250783 - DNA, 25 bp, Mus musculus
atctgtggattcaagttactgaagt

SEQ ID NO: 250784 - DNA, 25 bp, Mus musculus
atctgtggattctagttactgaagt

SEQ ID NO: 250785 - DNA, 25 bp, Mus musculus
atctgtggcaaacttggagaaaacc

SEQ ID NO: 250786 - DNA, 25 bp, Mus musculus
atctgtggcaaagttggagaaaacc

SEQ ID NO: 250787 - DNA, 25 bp, Mus musculus
atctgtggcctaatgattcctcaaa

SEQ ID NO: 250788 - DNA, 25 bp, Mus musculus
atctgtggcctattgattcctcaaa

SEQ ID NO: 250789 - DNA, 25 bp, Mus musculus
atctgtggcttgaattttcactgga

SEQ ID NO: 250790 - DNA, 25 bp, Mus musculus
atctgtggcttgacggttctcccta

SEQ ID NO: 250791 - DNA, 25 bp, Mus musculus
atctgtggcttgtattttcactgga

SEQ ID NO: 250792 - DNA, 25 bp, Mus musculus
atctgtggcttgtcggttctcccta

SEQ ID NO: 250793 - DNA, 25 bp, Mus musculus
atctgtgggctacttgtgtcttgaa

SEQ ID NO: 250794 - DNA, 25 bp, Mus musculus
atctgtgggctagttgtgtcttgaa

SEQ ID NO: 250795 - DNA, 25 bp, Mus musculus
atctgtgggtcgaaacaagctcctt

SEQ ID NO: 250796 - DNA, 25 bp, Mus musculus
atctgtgggtcgtaacaagctcctt

SEQ ID NO: 250797 - DNA, 25 bp, Mus musculus
atctgtggtcaaacactagggcccc

SEQ ID NO: 250798 - DNA, 25 bp, Mus musculus
atctgtggtcaatcactagggcccc

SEQ ID NO: 250799 - DNA, 25 bp, Mus musculus
atctgtggtgatcgcccagactcaa

SEQ ID NO: 250800 - DNA, 25 bp, Mus musculus
atctgtggtgatggcccagactcaa

SEQ ID NO: 250801 - DNA, 25 bp, Mus musculus
atctgtggtgccctaaagtccaatt

SEQ ID NO: 250802 - DNA, 25 bp, Mus musculus
atctgtggtgccgtaaagtccaatt

SEQ ID NO: 250803 - DNA, 25 bp, Mus musculus
atctgtggttctcattttctgttca

SEQ ID NO: 250804 - DNA, 25 bp, Mus musculus
atctgtggttctgattttctgttca

SEQ ID NO: 250805 - DNA, 25 bp, Mus musculus
atctgtgtaatgacaactctcccca

SEQ ID NO: 250806 - DNA, 25 bp, Mus musculus
atctgtgtaatgtcaactctcccca

SEQ ID NO: 250807 - DNA, 25 bp, Mus musculus
atctgtgtacccagttgctgaatgt

SEQ ID NO: 250808 - DNA, 25 bp, Mus musculus
atctgtgtaccctgttgctgaatgt

SEQ ID NO: 250809 - DNA, 25 bp, Mus musculus
atctgtgtacttagggagttttgtc

SEQ ID NO: 250810 - DNA, 25 bp, Mus musculus
atctgtgtactttgggagttttgtc

SEQ ID NO: 250811 - DNA, 25 bp, Mus musculus
atctgtgtagagagttttcctcatc

SEQ ID NO: 250812 - DNA, 25 bp, Mus musculus
atctgtgtagagtgttttcctcatc

SEQ ID NO: 250813 - DNA, 25 bp, Mus musculus
atctgtgtaggaaccaggtccgtga

SEQ ID NO: 250814 - DNA, 25 bp, Mus musculus
atctgtgtaggatccaggtccgtga

SEQ ID NO: 250815 - DNA, 25 bp, Mus musculus
atctgtgtcactctgttttgggtca

SEQ ID NO: 250816 - DNA, 25 bp, Mus musculus
atctgtgtcactgtgttttgggtca

SEQ ID NO: 250817 - DNA, 25 bp, Mus musculus
atctgtgtcccaacaagcctgaaac

SEQ ID NO: 250818 - DNA, 25 bp, Mus musculus
atctgtgtcccatcaagcctgaaac

SEQ ID NO: 250819 - DNA, 25 bp, Mus musculus
atctgtgtccccacttgaaaacaag

SEQ ID NO: 250820 - DNA, 25 bp, Mus musculus
atctgtgtcccctcttgaaaacaag

SEQ ID NO: 250821 - DNA, 25 bp, Mus musculus
atctgtgtccctacatgttgcatca

SEQ ID NO: 250822 - DNA, 25 bp, Mus musculus
atctgtgtcccttcatgttgcatca

SEQ ID NO: 250823 - DNA, 25 bp, Mus musculus
atctgtgtccgtagttcatcagcaa

SEQ ID NO: 250824 - DNA, 25 bp, Mus musculus
atctgtgtccgttgttcatcagcaa

SEQ ID NO: 250825 - DNA, 25 bp, Mus musculus
atctgtgtcctgaatgaggaggccc

SEQ ID NO: 250826 - DNA, 25 bp, Mus musculus
atctgtgtcctgtatgaggaggccc

SEQ ID NO: 250827 - DNA, 25 bp, Mus musculus
atctgtgtcgataggctgttgtgct

SEQ ID NO: 250828 - DNA, 25 bp, Mus musculus
atctgtgtcgattggctgttgtgct

SEQ ID NO: 250829 - DNA, 25 bp, Mus musculus
atctgtgtctagagtctggaacgca

SEQ ID NO: 250830 - DNA, 25 bp, Mus musculus
atctgtgtctagtgtctggaacgca

SEQ ID NO: 250831 - DNA, 25 bp, Mus musculus
atctgtgtctctaccctttgggtat

SEQ ID NO: 250832 - DNA, 25 bp, Mus musculus
atctgtgtctcttccctttgggtat

SEQ ID NO: 250833 - DNA, 25 bp, Mus musculus
atctgtgtcttgatgctttttgggc

SEQ ID NO: 250834 - DNA, 25 bp, Mus musculus
atctgtgtcttgttgctttttgggc

SEQ ID NO: 250835 - DNA, 25 bp, Mus musculus
atctgtgtgaatacctaacctgtag

SEQ ID NO: 250836 - DNA, 25 bp, Mus musculus
atctgtgtgaattcctaacctgtag

SEQ ID NO: 250837 - DNA, 25 bp, Mus musculus
atctgtgtgaggctttgtgcacttg

SEQ ID NO: 250838 - DNA, 25 bp, Mus musculus
atctgtgtgagggtttgtgcacttg

SEQ ID NO: 250839 - DNA, 25 bp, Mus musculus
atctgtgtgagtccccaggaactag

SEQ ID NO: 250840 - DNA, 25 bp, Mus musculus
atctgtgtgagtgcccaggaactag

SEQ ID NO: 250841 - DNA, 25 bp, Mus musculus
atctgtgtggagattctctctcttc

SEQ ID NO: 250842 - DNA, 25 bp, Mus musculus
atctgtgtggagtttctctctcttc

SEQ ID NO: 250843 - DNA, 25 bp, Mus musculus
atctgtgtggatctggcttcctgct

SEQ ID NO: 250844 - DNA, 25 bp, Mus musculus
atctgtgtggatgtggcttcctgct

SEQ ID NO: 250845 - DNA, 25 bp, Mus musculus
atctgtgtggctaagaccaaggttc

SEQ ID NO: 250846 - DNA, 25 bp, Mus musculus
atctgtgtggctcgtccagatgtaa

SEQ ID NO: 250847 - DNA, 25 bp, Mus musculus
atctgtgtggctggtccagatgtaa

SEQ ID NO: 250848 - DNA, 25 bp, Mus musculus
atctgtgtggcttagaccaaggttc

SEQ ID NO: 250849 - DNA, 25 bp, Mus musculus
atctgtgtgtccagtatcttaaaca

SEQ ID NO: 250850 - DNA, 25 bp, Mus musculus
atctgtgtgtcctgtatcttaaaca

SEQ ID NO: 250851 - DNA, 25 bp, Mus musculus
atctgtgtgtctcatacagcccatt

SEQ ID NO: 250852 - DNA, 25 bp, Mus musculus
atctgtgtgtctgatacagcccatt

SEQ ID NO: 250853 - DNA, 25 bp, Mus musculus
atctgtgtgtgaatccattttggac

SEQ ID NO: 250854 - DNA, 25 bp, Mus musculus
atctgtgtgtgattccattttggac

SEQ ID NO: 250855 - DNA, 25 bp, Mus musculus
atctgtgtgtgcatcgccgaattct

SEQ ID NO: 250856 - DNA, 25 bp, Mus musculus
atctgtgtgtgccaccctgtgagtg

SEQ ID NO: 250857 - DNA, 25 bp, Mus musculus
atctgtgtgtgcgaccctgtgagtg

SEQ ID NO: 250858 - DNA, 25 bp, Mus musculus
atctgtgtgtgcttcgccgaattct

SEQ ID NO: 250859 - DNA, 25 bp, Mus musculus
atctgtgtgtggctgtcagactcct

SEQ ID NO: 250860 - DNA, 25 bp, Mus musculus
atctgtgtgtgggtgtcagactcct

SEQ ID NO: 250861 - DNA, 25 bp, Mus musculus
atctgtgtgtgtctcctaatgtggc

SEQ ID NO: 250862 - DNA, 25 bp, Mus musculus
atctgtgtgtgtgtcctaatgtggc

SEQ ID NO: 250863 - DNA, 25 bp, Mus musculus
atctgtgtgttgaagccactcactg

SEQ ID NO: 250864 - DNA, 25 bp, Mus musculus
atctgtgtgttgcaattcaaatgta

SEQ ID NO: 250865 - DNA, 25 bp, Mus musculus
atctgtgtgttggaattcaaatgta

SEQ ID NO: 250866 - DNA, 25 bp, Mus musculus
atctgtgtgttgtagccactcactg

SEQ ID NO: 250867 - DNA, 25 bp, Mus musculus
atctgtgttacaccctcctgacttg

SEQ ID NO: 250868 - DNA, 25 bp, Mus musculus
atctgtgttacagcctcctgacttg

SEQ ID NO: 250869 - DNA, 25 bp, Mus musculus
atctgtgttcttacaacctccaaat

SEQ ID NO: 250870 - DNA, 25 bp, Mus musculus
atctgtgttctttcaacctccaaat

SEQ ID NO: 250871 - DNA, 25 bp, Mus musculus
atctgtgttggtcctcatttgagaa

SEQ ID NO: 250872 - DNA, 25 bp, Mus musculus
atctgtgttggtgctcatttgagaa

SEQ ID NO: 250873 - DNA, 25 bp, Mus musculus
atctgtgtttctctccatatctatg

SEQ ID NO: 250874 - DNA, 25 bp, Mus musculus
atctgtgtttctgtccatatctatg

SEQ ID NO: 250875 - DNA, 25 bp, Mus musculus
atctgtgtttgtcgagatcgacctg

SEQ ID NO: 250876 - DNA, 25 bp, Mus musculus
atctgtgtttgtggagatcgacctg

SEQ ID NO: 250877 - DNA, 25 bp, Mus musculus
atctgtgttttcaccattcaaagtg

SEQ ID NO: 250878 - DNA, 25 bp, Mus musculus
atctgtgttttctccattcaaagtg

SEQ ID NO: 250879 - DNA, 25 bp, Mus musculus
atctgttaactcatcactctcctta

SEQ ID NO: 250880 - DNA, 25 bp, Mus musculus
atctgttaactcttcactctcctta

SEQ ID NO: 250881 - DNA, 25 bp, Mus musculus
atctgttaatggcatttcccaattg

SEQ ID NO: 250882 - DNA, 25 bp, Mus musculus
atctgttaatgggatttcccaattg

SEQ ID NO: 250883 - DNA, 25 bp, Mus musculus
atctgttacaagattatctatctat

SEQ ID NO: 250884 - DNA, 25 bp, Mus musculus
atctgttacaagtttatctatctat

SEQ ID NO: 250885 - DNA, 25 bp, Mus musculus
atctgttacaggctgttcctccaga

SEQ ID NO: 250886 - DNA, 25 bp, Mus musculus
atctgttacagggtgttcctccaga

SEQ ID NO: 250887 - DNA, 25 bp, Mus musculus
atctgttaccttcatcctgtctgtg

SEQ ID NO: 250888 - DNA, 25 bp, Mus musculus
atctgttaccttgatcctgtctgtg

SEQ ID NO: 250889 - DNA, 25 bp, Mus musculus
atctgttactttcgcactattcttg

SEQ ID NO: 250890 - DNA, 25 bp, Mus musculus
atctgttactttggcactattcttg

SEQ ID NO: 250891 - DNA, 25 bp, Mus musculus
atctgttagctcataaggctctcct

SEQ ID NO: 250892 - DNA, 25 bp, Mus musculus
atctgttagctcttaaggctctcct

SEQ ID NO: 250893 - DNA, 25 bp, Mus musculus
atctgttatctcaatctgcaggtaa

SEQ ID NO: 250894 - DNA, 25 bp, Mus musculus
atctgttatctctatctgcaggtaa

SEQ ID NO: 250895 - DNA, 25 bp, Mus musculus
atctgttatggtagacctgggctcc

SEQ ID NO: 250896 - DNA, 25 bp, Mus musculus
atctgttatggttgacctgggctcc

SEQ ID NO: 250897 - DNA, 25 bp, Mus musculus
atctgttatgtcacacttgtgtgct

SEQ ID NO: 250898 - DNA, 25 bp, Mus musculus
atctgttatgtctcacttgtgtgct

SEQ ID NO: 250899 - DNA, 25 bp, Mus musculus
atctgttattaactcatgttttcaa

SEQ ID NO: 250900 - DNA, 25 bp, Mus musculus
atctgttattaagtcatgttttcaa

SEQ ID NO: 250901 - DNA, 25 bp, Mus musculus
atctgttattcgactccatttttga

SEQ ID NO: 250902 - DNA, 25 bp, Mus musculus
atctgttattcgtctccatttttga

SEQ ID NO: 250903 - DNA, 25 bp, Mus musculus
atctgttattgtcttgtggtttcca

SEQ ID NO: 250904 - DNA, 25 bp, Mus musculus
atctgttattgtgttgtggtttcca

SEQ ID NO: 250905 - DNA, 25 bp, Mus musculus
atctgttcaagcaccatgtcttgtt

SEQ ID NO: 250906 - DNA, 25 bp, Mus musculus
atctgttcaagcctgggctcctcag

SEQ ID NO: 250907 - DNA, 25 bp, Mus musculus
atctgttcaagcgtgggctcctcag

SEQ ID NO: 250908 - DNA, 25 bp, Mus musculus
atctgttcaagctccatgtcttgtt

SEQ ID NO: 250909 - DNA, 25 bp, Mus musculus
atctgttcaatgatcttttctcaag

SEQ ID NO: 250910 - DNA, 25 bp, Mus musculus
atctgttcaatgttcttttctcaag

SEQ ID NO: 250911 - DNA, 25 bp, Mus musculus
atctgttcacccataagattctgtg

SEQ ID NO: 250912 - DNA, 25 bp, Mus musculus
atctgttcacccttaagattctgtg

SEQ ID NO: 250913 - DNA, 25 bp, Mus musculus
atctgttcacctcgtgccaccgagt

SEQ ID NO: 250914 - DNA, 25 bp, Mus musculus
atctgttcacctggtgccaccgagt

SEQ ID NO: 250915 - DNA, 25 bp, Mus musculus
atctgttcagtcacacagagctgta

SEQ ID NO: 250916 - DNA, 25 bp, Mus musculus
atctgttcagtctcacagagctgta

SEQ ID NO: 250917 - DNA, 25 bp, Mus musculus
atctgttcatctactcaatctcaag

SEQ ID NO: 250918 - DNA, 25 bp, Mus musculus
atctgttcatcttctcaatctcaag

SEQ ID NO: 250919 - DNA, 25 bp, Mus musculus
atctgttcctcactctgtgatagca

SEQ ID NO: 250920 - DNA, 25 bp, Mus musculus
atctgttcctcagtctgtgatagca

SEQ ID NO: 250921 - DNA, 25 bp, Mus musculus
atctgttcctgccagaccctgtggg

SEQ ID NO: 250922 - DNA, 25 bp, Mus musculus
atctgttcctgcgagaccctgtggg

SEQ ID NO: 250923 - DNA, 25 bp, Mus musculus
atctgttcctgtaatggcagctttc

SEQ ID NO: 250924 - DNA, 25 bp, Mus musculus
atctgttcctgttatggcagctttc

SEQ ID NO: 250925 - DNA, 25 bp, Mus musculus
atctgttcgcatcatcaagcccttt

SEQ ID NO: 250926 - DNA, 25 bp, Mus musculus
atctgttcgcatgatcaagcccttt

SEQ ID NO: 250927 - DNA, 25 bp, Mus musculus
atctgttctagtctcttcctgaagc

SEQ ID NO: 250928 - DNA, 25 bp, Mus musculus
atctgttctagtgtcttcctgaagc

SEQ ID NO: 250929 - DNA, 25 bp, Mus musculus
atctgttctgagcactggcgggcca

SEQ ID NO: 250930 - DNA, 25 bp, Mus musculus
atctgttctgaggactggcgggcca

SEQ ID NO: 250931 - DNA, 25 bp, Mus musculus
atctgttcttagcatgactgtactt

SEQ ID NO: 250932 - DNA, 25 bp, Mus musculus
atctgttcttaggatgactgtactt

SEQ ID NO: 250933 - DNA, 25 bp, Mus musculus
atctgttcttctcaaagggagtaag

SEQ ID NO: 250934 - DNA, 25 bp, Mus musculus
atctgttcttctgaaagggagtaag

SEQ ID NO: 250935 - DNA, 25 bp, Mus musculus
atctgttgacgtcaaaatacctatc

SEQ ID NO: 250936 - DNA, 25 bp, Mus musculus
atctgttgacgtgaaaatacctatc

SEQ ID NO: 250937 - DNA, 25 bp, Mus musculus
atctgttgagtaaccagcactgggc

SEQ ID NO: 250938 - DNA, 25 bp, Mus musculus
atctgttgagtatccagcactgggc

SEQ ID NO: 250939 - DNA, 25 bp, Mus musculus
atctgttgatttcctctgttgtttc

SEQ ID NO: 250940 - DNA, 25 bp, Mus musculus
atctgttgatttgctctgttgtttc

SEQ ID NO: 250941 - DNA, 25 bp, Mus musculus
atctgttgccagatatgtgtgttgt

SEQ ID NO: 250942 - DNA, 25 bp, Mus musculus
atctgttgccagttatgtgtgttgt

SEQ ID NO: 250943 - DNA, 25 bp, Mus musculus
atctgttgccatctagtctgccgtg

SEQ ID NO: 250944 - DNA, 25 bp, Mus musculus
atctgttgccatgtagtctgccgtg

SEQ ID NO: 250945 - DNA, 25 bp, Mus musculus
atctgttgcccacattggcatctcg

SEQ ID NO: 250946 - DNA, 25 bp, Mus musculus
atctgttgcccagattggcatctcg

SEQ ID NO: 250947 - DNA, 25 bp, Mus musculus
atctgttgcctgcaatgtgtctacc

SEQ ID NO: 250948 - DNA, 25 bp, Mus musculus
atctgttgcctggaatgtgtctacc

SEQ ID NO: 250949 - DNA, 25 bp, Mus musculus
atctgttgctctccttctcatggtg

SEQ ID NO: 250950 - DNA, 25 bp, Mus musculus
atctgttgctctgcttctcatggtg

SEQ ID NO: 250951 - DNA, 25 bp, Mus musculus
atctgttggctactgaattatcccc

SEQ ID NO: 250952 - DNA, 25 bp, Mus musculus
atctgttggctagtgaattatcccc

SEQ ID NO: 250953 - DNA, 25 bp, Mus musculus
atctgttggttaaagtgtcttcctg

SEQ ID NO: 250954 - DNA, 25 bp, Mus musculus
atctgttggttatagtgtcttcctg

SEQ ID NO: 250955 - DNA, 25 bp, Mus musculus
atctgttgtaaaaatcacctgagtg

SEQ ID NO: 250956 - DNA, 25 bp, Mus musculus
atctgttgtaaatatcacctgagtg

SEQ ID NO: 250957 - DNA, 25 bp, Mus musculus
atctgttgtcataacttttggcttc

SEQ ID NO: 250958 - DNA, 25 bp, Mus musculus
atctgttgtcattacttttggcttc

SEQ ID NO: 250959 - DNA, 25 bp, Mus musculus
atctgttgtctcaattccggaggct

SEQ ID NO: 250960 - DNA, 25 bp, Mus musculus
atctgttgtctctattccggaggct

SEQ ID NO: 250961 - DNA, 25 bp, Mus musculus
atctgttgtggcaactcatggttta

SEQ ID NO: 250962 - DNA, 25 bp, Mus musculus
atctgttgtggcatattaacctgta

SEQ ID NO: 250963 - DNA, 25 bp, Mus musculus
atctgttgtggctactcatggttta

SEQ ID NO: 250964 - DNA, 25 bp, Mus musculus
atctgttgtggcttattaacctgta

SEQ ID NO: 250965 - DNA, 25 bp, Mus musculus
atctgttgttggagactttgctatg

SEQ ID NO: 250966 - DNA, 25 bp, Mus musculus
atctgttgttggtgactttgctatg

SEQ ID NO: 250967 - DNA, 25 bp, Mus musculus
atctgttgttgtaaggctagttgac

SEQ ID NO: 250968 - DNA, 25 bp, Mus musculus
atctgttgttgttaggctagttgac

SEQ ID NO: 250969 - DNA, 25 bp, Mus musculus
atctgtttacgaactggaaggcgca

SEQ ID NO: 250970 - DNA, 25 bp, Mus musculus
atctgtttacgatctggaaggcgca

SEQ ID NO: 250971 - DNA, 25 bp, Mus musculus
atctgtttactcatgaattgctcta

SEQ ID NO: 250972 - DNA, 25 bp, Mus musculus
atctgtttactcttgaattgctcta

SEQ ID NO: 250973 - DNA, 25 bp, Mus musculus
atctgtttatttctagtgcctggct

SEQ ID NO: 250974 - DNA, 25 bp, Mus musculus
atctgtttatttgtagtgcctggct

SEQ ID NO: 250975 - DNA, 25 bp, Mus musculus
atctgtttccacctgcttctggaaa

SEQ ID NO: 250976 - DNA, 25 bp, Mus musculus
atctgtttccacgtgcttctggaaa

SEQ ID NO: 250977 - DNA, 25 bp, Mus musculus
atctgtttcccaaatggtgcctgca

SEQ ID NO: 250978 - DNA, 25 bp, Mus musculus
atctgtttcccatatggtgcctgca

SEQ ID NO: 250979 - DNA, 25 bp, Mus musculus
atctgtttcctacatgtgatatata

SEQ ID NO: 250980 - DNA, 25 bp, Mus musculus
atctgtttcctagatgtgatatata

SEQ ID NO: 250981 - DNA, 25 bp, Mus musculus
atctgtttctccctattgtgcagtg

SEQ ID NO: 250982 - DNA, 25 bp, Mus musculus
atctgtttctccgtattgtgcagtg

SEQ ID NO: 250983 - DNA, 25 bp, Mus musculus
atctgtttgaacactgtctgtgccg

SEQ ID NO: 250984 - DNA, 25 bp, Mus musculus
atctgtttgaactctgtctgtgccg

SEQ ID NO: 250985 - DNA, 25 bp, Mus musculus
atctgtttgcatatgagagcatgcc

SEQ ID NO: 250986 - DNA, 25 bp, Mus musculus
atctgtttgcatttgagagcatgcc

SEQ ID NO: 250987 - DNA, 25 bp, Mus musculus
atctgtttgcccatctggctcaggg

SEQ ID NO: 250988 - DNA, 25 bp, Mus musculus
atctgtttgcccttctggctcaggg

SEQ ID NO: 250989 - DNA, 25 bp, Mus musculus
atctgtttggatctgagactgtcga

SEQ ID NO: 250990 - DNA, 25 bp, Mus musculus
atctgtttggatgtgagactgtcga

SEQ ID NO: 250991 - DNA, 25 bp, Mus musculus
atctgtttgtatccagctatagcaa

SEQ ID NO: 250992 - DNA, 25 bp, Mus musculus
atctgtttgtatctcttcaaaacaa

SEQ ID NO: 250993 - DNA, 25 bp, Mus musculus
atctgtttgtatgcagctatagcaa

SEQ ID NO: 250994 - DNA, 25 bp, Mus musculus
atctgtttgtatgtcttcaaaacaa

SEQ ID NO: 250995 - DNA, 25 bp, Mus musculus
atctgtttgttaaggtttcagctta

SEQ ID NO: 250996 - DNA, 25 bp, Mus musculus
atctgtttgttatggtttcagctta

SEQ ID NO: 250997 - DNA, 25 bp, Mus musculus
atctgttttcagactatagtttggg

SEQ ID NO: 250998 - DNA, 25 bp, Mus musculus
atctgttttcagtctatagtttggg

SEQ ID NO: 250999 - DNA, 25 bp, Mus musculus
atctgttttgtacacttctgttaca

SEQ ID NO: 251000 - DNA, 25 bp, Mus musculus
atctgttttgtagacttctgttaca

SEQ ID NO: 251001 - DNA, 25 bp, Mus musculus
atctgtttttacctttgaaattcat

SEQ ID NO: 251002 - DNA, 25 bp, Mus musculus
atctgtttttacgtttgaaattcat

SEQ ID NO: 251003 - DNA, 25 bp, Mus musculus
atctgtttttctaaactctgttttg

SEQ ID NO: 251004 - DNA, 25 bp, Mus musculus
atctgtttttcttaactctgttttg

SEQ ID NO: 251005 - DNA, 25 bp, Mus musculus
atctgtttttgtatggcctgtgagc

SEQ ID NO: 251006 - DNA, 25 bp, Mus musculus
atctgtttttgtttggcctgtgagc

SEQ ID NO: 251007 - DNA, 25 bp, Mus musculus
atcttaaaacagactagattttctg

SEQ ID NO: 251008 - DNA, 25 bp, Mus musculus
atcttaaaacagtctagattttctg

SEQ ID NO: 251009 - DNA, 25 bp, Mus musculus
atcttaaactgacactgttttctga

SEQ ID NO: 251010 - DNA, 25 bp, Mus musculus
atcttaaactgagactgttttctga

SEQ ID NO: 251011 - DNA, 25 bp, Mus musculus
atcttaaatcgtctacttctctttt

SEQ ID NO: 251012 - DNA, 25 bp, Mus musculus
atcttaaatcgtgtacttctctttt

SEQ ID NO: 251013 - DNA, 25 bp, Mus musculus
atcttaaatctaaatctggtcactt

SEQ ID NO: 251014 - DNA, 25 bp, Mus musculus
atcttaaatctatatctggtcactt

SEQ ID NO: 251015 - DNA, 25 bp, Mus musculus
atcttaacgggcacagaagactgaa

SEQ ID NO: 251016 - DNA, 25 bp, Mus musculus
atcttaacgggctcagaagactgaa

SEQ ID NO: 251017 - DNA, 25 bp, Mus musculus
atcttaactattcaatccacctatt

SEQ ID NO: 251018 - DNA, 25 bp, Mus musculus
atcttaactattgaatccacctatt

SEQ ID NO: 251019 - DNA, 25 bp, Mus musculus
atcttaactcaacgcactgggctct

SEQ ID NO: 251020 - DNA, 25 bp, Mus musculus
atcttaactcaaggcactgggctct

SEQ ID NO: 251021 - DNA, 25 bp, Mus musculus
atcttaactcataccccataccttt

SEQ ID NO: 251022 - DNA, 25 bp, Mus musculus
atcttaactcattccccataccttt

SEQ ID NO: 251023 - DNA, 25 bp, Mus musculus
atcttaactttgatctcacacaccc

SEQ ID NO: 251024 - DNA, 25 bp, Mus musculus
atcttaactttgttctcacacaccc

SEQ ID NO: 251025 - DNA, 25 bp, Mus musculus
atcttaagaagtaccctctaaaatg

SEQ ID NO: 251026 - DNA, 25 bp, Mus musculus
atcttaagaagttccctctaaaatg

SEQ ID NO: 251027 - DNA, 25 bp, Mus musculus
atcttaagaccccacctgcacaaga

SEQ ID NO: 251028 - DNA, 25 bp, Mus musculus
atcttaagacccgacctgcacaaga

SEQ ID NO: 251029 - DNA, 25 bp, Mus musculus
atcttaagagccaagattggcgtct

SEQ ID NO: 251030 - DNA, 25 bp, Mus musculus
atcttaagagcctagattggcgtct

SEQ ID NO: 251031 - DNA, 25 bp, Mus musculus
atcttaaggcccatttctttctcag

SEQ ID NO: 251032 - DNA, 25 bp, Mus musculus
atcttaaggcccttttctttctcag

SEQ ID NO: 251033 - DNA, 25 bp, Mus musculus
atcttaatcattacggctgcttctg

SEQ ID NO: 251034 - DNA, 25 bp, Mus musculus
atcttaatcatttcggctgcttctg

SEQ ID NO: 251035 - DNA, 25 bp, Mus musculus
atcttaatcgacctcattcacaacc

SEQ ID NO: 251036 - DNA, 25 bp, Mus musculus
atcttaatcgacgtcattcacaacc

SEQ ID NO: 251037 - DNA, 25 bp, Mus musculus
atcttaatctctacatgttctccac

SEQ ID NO: 251038 - DNA, 25 bp, Mus musculus
atcttaatctcttcatgttctccac

SEQ ID NO: 251039 - DNA, 25 bp, Mus musculus
atcttaatgtgtatccctggttgtc

SEQ ID NO: 251040 - DNA, 25 bp, Mus musculus
atcttaatgtgtttccctggttgtc

SEQ ID NO: 251041 - DNA, 25 bp, Mus musculus
atcttaattgacctttgactgtgga

SEQ ID NO: 251042 - DNA, 25 bp, Mus musculus
atcttaattgacgtttgactgtgga

SEQ ID NO: 251043 - DNA, 25 bp, Mus musculus
atcttacaatctatcagacaatttc

SEQ ID NO: 251044 - DNA, 25 bp, Mus musculus
atcttacaatctttcagacaatttc

SEQ ID NO: 251045 - DNA, 25 bp, Mus musculus
atcttacaatgcacaggttccacct

SEQ ID NO: 251046 - DNA, 25 bp, Mus musculus
atcttacaatgctcaggttccacct

SEQ ID NO: 251047 - DNA, 25 bp, Mus musculus
atcttacacctcctacttttaccat

SEQ ID NO: 251048 - DNA, 25 bp, Mus musculus
atcttacacctcgtacttttaccat

SEQ ID NO: 251049 - DNA, 25 bp, Mus musculus
atcttacagattacagtctatcatg

SEQ ID NO: 251050 - DNA, 25 bp, Mus musculus
atcttacagatttcagtctatcatg

SEQ ID NO: 251051 - DNA, 25 bp, Mus musculus
atcttacagcgacattccagggaca

SEQ ID NO: 251052 - DNA, 25 bp, Mus musculus
atcttacagcgagattccagggaca

SEQ ID NO: 251053 - DNA, 25 bp, Mus musculus
atcttacatatacacctttctgaca

SEQ ID NO: 251054 - DNA, 25 bp, Mus musculus
atcttacatatagacctttctgaca

SEQ ID NO: 251055 - DNA, 25 bp, Mus musculus
atcttacatgaactgacttctagag

SEQ ID NO: 251056 - DNA, 25 bp, Mus musculus
atcttacatgaagtgacttctagag

SEQ ID NO: 251057 - DNA, 25 bp, Mus musculus
atcttacatgatagctgtcacattt

SEQ ID NO: 251058 - DNA, 25 bp, Mus musculus
atcttacatgattgctgtcacattt

SEQ ID NO: 251059 - DNA, 25 bp, Mus musculus
atcttacattgtatggttccagaaa

SEQ ID NO: 251060 - DNA, 25 bp, Mus musculus
atcttacattgtttggttccagaaa

SEQ ID NO: 251061 - DNA, 25 bp, Mus musculus
atcttaccagccaagattccatatc

SEQ ID NO: 251062 - DNA, 25 bp, Mus musculus
atcttaccagcctagattccatatc

SEQ ID NO: 251063 - DNA, 25 bp, Mus musculus
atcttaccatttactgatacttttg

SEQ ID NO: 251064 - DNA, 25 bp, Mus musculus
atcttaccattttctgatacttttg

SEQ ID NO: 251065 - DNA, 25 bp, Mus musculus
atcttaccctcacctgatgtctgtg

SEQ ID NO: 251066 - DNA, 25 bp, Mus musculus
atcttaccctcagctgatgtctgtg

SEQ ID NO: 251067 - DNA, 25 bp, Mus musculus
atcttacctatccacccaaccacag

SEQ ID NO: 251068 - DNA, 25 bp, Mus musculus
atcttacctatcgacccaaccacag

SEQ ID NO: 251069 - DNA, 25 bp, Mus musculus
atcttacctgaaactttgtactctg

SEQ ID NO: 251070 - DNA, 25 bp, Mus musculus
atcttacctgaatctttgtactctg

SEQ ID NO: 251071 - DNA, 25 bp, Mus musculus
atcttacctgggaatgtgtgtccca

SEQ ID NO: 251072 - DNA, 25 bp, Mus musculus
atcttacctgggtatgtgtgtccca

SEQ ID NO: 251073 - DNA, 25 bp, Mus musculus
atcttacggcctcaacttggctgtt

SEQ ID NO: 251074 - DNA, 25 bp, Mus musculus
atcttacggcctgaacttggctgtt

SEQ ID NO: 251075 - DNA, 25 bp, Mus musculus
atcttacgttttcattactgatgta

SEQ ID NO: 251076 - DNA, 25 bp, Mus musculus
atcttacgttttgattactgatgta

SEQ ID NO: 251077 - DNA, 25 bp, Mus musculus
atcttactcttcatatactagctag

SEQ ID NO: 251078 - DNA, 25 bp, Mus musculus
atcttactcttcttatactagctag

SEQ ID NO: 251079 - DNA, 25 bp, Mus musculus
atcttactgaacatagctggtggac

SEQ ID NO: 251080 - DNA, 25 bp, Mus musculus
atcttactgaacttagctggtggac

SEQ ID NO: 251081 - DNA, 25 bp, Mus musculus
atcttactggttaaacatggacaca

SEQ ID NO: 251082 - DNA, 25 bp, Mus musculus
atcttactggtttaacatggacaca

SEQ ID NO: 251083 - DNA, 25 bp, Mus musculus
atcttacttcttccgccatgtgggt

SEQ ID NO: 251084 - DNA, 25 bp, Mus musculus
atcttacttcttgcgccatgtgggt

SEQ ID NO: 251085 - DNA, 25 bp, Mus musculus
atcttactttacatcatgtattctt

SEQ ID NO: 251086 - DNA, 25 bp, Mus musculus
atcttactttacttcatgtattctt

SEQ ID NO: 251087 - DNA, 25 bp, Mus musculus
atcttacttttcagaggtgtcctct

SEQ ID NO: 251088 - DNA, 25 bp, Mus musculus
atcttacttttctgaggtgtcctct

SEQ ID NO: 251089 - DNA, 25 bp, Mus musculus
atcttagaagcccagtactcaggaa

SEQ ID NO: 251090 - DNA, 25 bp, Mus musculus
atcttagaagccgagtactcaggaa

SEQ ID NO: 251091 - DNA, 25 bp, Mus musculus
atcttagactgtaatgataccctat

SEQ ID NO: 251092 - DNA, 25 bp, Mus musculus
atcttagactgttatgataccctat

SEQ ID NO: 251093 - DNA, 25 bp, Mus musculus
atcttagagagtacttttgtgcaag

SEQ ID NO: 251094 - DNA, 25 bp, Mus musculus
atcttagagagttcttttgtgcaag

SEQ ID NO: 251095 - DNA, 25 bp, Mus musculus
atcttagagggacacgcttccacac

SEQ ID NO: 251096 - DNA, 25 bp, Mus musculus
atcttagagggagacgcttccacac

SEQ ID NO: 251097 - DNA, 25 bp, Mus musculus
atcttagagtgactgcaggcatcga

SEQ ID NO: 251098 - DNA, 25 bp, Mus musculus
atcttagagtgagtgcaggcatcga

SEQ ID NO: 251099 - DNA, 25 bp, Mus musculus
atcttagatttcctctgggacccct

SEQ ID NO: 251100 - DNA, 25 bp, Mus musculus
atcttagatttcgtctgggacccct

SEQ ID NO: 251101 - DNA, 25 bp, Mus musculus
atcttagcactcactgccacacttg

SEQ ID NO: 251102 - DNA, 25 bp, Mus musculus
atcttagcactctctgccacacttg

SEQ ID NO: 251103 - DNA, 25 bp, Mus musculus
atcttagccaccattgtacgtcttc

SEQ ID NO: 251104 - DNA, 25 bp, Mus musculus
atcttagccacctttgtacgtcttc

SEQ ID NO: 251105 - DNA, 25 bp, Mus musculus
atcttagccactagagctgctctga

SEQ ID NO: 251106 - DNA, 25 bp, Mus musculus
atcttagccacttgagctgctctga

SEQ ID NO: 251107 - DNA, 25 bp, Mus musculus
atcttagcccctatcaacttttctt

SEQ ID NO: 251108 - DNA, 25 bp, Mus musculus
atcttagcccctttcaacttttctt

SEQ ID NO: 251109 - DNA, 25 bp, Mus musculus
atcttagcctagacactggagctcg

SEQ ID NO: 251110 - DNA, 25 bp, Mus musculus
atcttagcctagtcactggagctcg

SEQ ID NO: 251111 - DNA, 25 bp, Mus musculus
atcttagcggtcagcagtgcccaag

SEQ ID NO: 251112 - DNA, 25 bp, Mus musculus
atcttagcggtctgcagtgcccaag

SEQ ID NO: 251113 - DNA, 25 bp, Mus musculus
atcttagctatgagtaattctcgag

SEQ ID NO: 251114 - DNA, 25 bp, Mus musculus
atcttagctatgtgtaattctcgag

SEQ ID NO: 251115 - DNA, 25 bp, Mus musculus
atcttagctccacttcaacaggaca

SEQ ID NO: 251116 - DNA, 25 bp, Mus musculus
atcttagctccagttcaacaggaca

SEQ ID NO: 251117 - DNA, 25 bp, Mus musculus
atcttagctgccaggccagagaagt

SEQ ID NO: 251118 - DNA, 25 bp, Mus musculus
atcttagctgcctggccagagaagt

SEQ ID NO: 251119 - DNA, 25 bp, Mus musculus
atcttaggattacctgggacacgtc

SEQ ID NO: 251120 - DNA, 25 bp, Mus musculus
atcttaggattagctgggacacgtc

SEQ ID NO: 251121 - DNA, 25 bp, Mus musculus
atcttaggcgttccctcctcgattg

SEQ ID NO: 251122 - DNA, 25 bp, Mus musculus
atcttaggcgttgcctcctcgattg

SEQ ID NO: 251123 - DNA, 25 bp, Mus musculus
atcttagggacacactgctggcacg

SEQ ID NO: 251124 - DNA, 25 bp, Mus musculus
atcttagggacagactgctggcacg

SEQ ID NO: 251125 - DNA, 25 bp, Mus musculus
atcttagggattcgtgaggtacact

SEQ ID NO: 251126 - DNA, 25 bp, Mus musculus
atcttagggattggtgaggtacact

SEQ ID NO: 251127 - DNA, 25 bp, Mus musculus
atcttaggggaaagctggcacatgc

SEQ ID NO: 251128 - DNA, 25 bp, Mus musculus
atcttaggggaatgctggcacatgc

SEQ ID NO: 251129 - DNA, 25 bp, Mus musculus
atcttaggtcacagtagtctctctt

SEQ ID NO: 251130 - DNA, 25 bp, Mus musculus
atcttaggtcactgtagtctctctt

SEQ ID NO: 251131 - DNA, 25 bp, Mus musculus
atcttagtatcaccctagccaggac

SEQ ID NO: 251132 - DNA, 25 bp, Mus musculus
atcttagtatcagcctagccaggac

SEQ ID NO: 251133 - DNA, 25 bp, Mus musculus
atcttagtcaagaagtggtggtcac

SEQ ID NO: 251134 - DNA, 25 bp, Mus musculus
atcttagtcaagtagtggtggtcac

SEQ ID NO: 251135 - DNA, 25 bp, Mus musculus
atcttagtcctaacccgactgtatc

SEQ ID NO: 251136 - DNA, 25 bp, Mus musculus
atcttagtcctatcccgactgtatc

SEQ ID NO: 251137 - DNA, 25 bp, Mus musculus
atcttagtgcaaagagcccatgaaa

SEQ ID NO: 251138 - DNA, 25 bp, Mus musculus
atcttagtgcaatgagcccatgaaa

SEQ ID NO: 251139 - DNA, 25 bp, Mus musculus
atcttagtgggcactgaagctcctt

SEQ ID NO: 251140 - DNA, 25 bp, Mus musculus
atcttagtgggctctgaagctcctt

SEQ ID NO: 251141 - DNA, 25 bp, Mus musculus
atcttagtggtgagtggcttttctc

SEQ ID NO: 251142 - DNA, 25 bp, Mus musculus
atcttagtggtgtgtggcttttctc

SEQ ID NO: 251143 - DNA, 25 bp, Mus musculus
atcttagtgtacatttccatccctg

SEQ ID NO: 251144 - DNA, 25 bp, Mus musculus
atcttagtgtacttttccatccctg

SEQ ID NO: 251145 - DNA, 25 bp, Mus musculus
atcttagtgtatcattactggcctt

SEQ ID NO: 251146 - DNA, 25 bp, Mus musculus
atcttagtgtatgattactggcctt

SEQ ID NO: 251147 - DNA, 25 bp, Mus musculus
atcttagtgttaacgctcttttaga

SEQ ID NO: 251148 - DNA, 25 bp, Mus musculus
atcttagtgttatcgctcttttaga

SEQ ID NO: 251149 - DNA, 25 bp, Mus musculus
atcttatacgttcctatttcacatg

SEQ ID NO: 251150 - DNA, 25 bp, Mus musculus
atcttatacgttgctatttcacatg

SEQ ID NO: 251151 - DNA, 25 bp, Mus musculus
atcttatagtgccaggcacctaggc

SEQ ID NO: 251152 - DNA, 25 bp, Mus musculus
atcttatagtgcgaggcacctaggc

SEQ ID NO: 251153 - DNA, 25 bp, Mus musculus
atcttatctaccatcagctggaaga

SEQ ID NO: 251154 - DNA, 25 bp, Mus musculus
atcttatctaccttcagctggaaga

SEQ ID NO: 251155 - DNA, 25 bp, Mus musculus
atcttatctcctaccaatcttttta

SEQ ID NO: 251156 - DNA, 25 bp, Mus musculus
atcttatctccttccaatcttttta

SEQ ID NO: 251157 - DNA, 25 bp, Mus musculus
atcttatctctcatacggggctgtt

SEQ ID NO: 251158 - DNA, 25 bp, Mus musculus
atcttatctctcttacggggctgtt

SEQ ID NO: 251159 - DNA, 25 bp, Mus musculus
atcttatctgcacacaggccttcta

SEQ ID NO: 251160 - DNA, 25 bp, Mus musculus
atcttatctgcactggccagaatac

SEQ ID NO: 251161 - DNA, 25 bp, Mus musculus
atcttatctgcagacaggccttcta

SEQ ID NO: 251162 - DNA, 25 bp, Mus musculus
atcttatctgcagtggccagaatac

SEQ ID NO: 251163 - DNA, 25 bp, Mus musculus
atcttatctggcatcaactcgttaa

SEQ ID NO: 251164 - DNA, 25 bp, Mus musculus
atcttatctggcttcaactcgttaa

SEQ ID NO: 251165 - DNA, 25 bp, Mus musculus
atcttatgcctcacatagggaacag

SEQ ID NO: 251166 - DNA, 25 bp, Mus musculus
atcttatgcctctcatagggaacag

SEQ ID NO: 251167 - DNA, 25 bp, Mus musculus
atcttatgtggactctccctacata

SEQ ID NO: 251168 - DNA, 25 bp, Mus musculus
atcttatgtggagtctccctacata

SEQ ID NO: 251169 - DNA, 25 bp, Mus musculus
atcttatgtgggactgagctctcag

SEQ ID NO: 251170 - DNA, 25 bp, Mus musculus
atcttatgtgggtctgagctctcag

SEQ ID NO: 251171 - DNA, 25 bp, Mus musculus
atcttatgttggagagggagccctc

SEQ ID NO: 251172 - DNA, 25 bp, Mus musculus
atcttatgttggtgagggagccctc

SEQ ID NO: 251173 - DNA, 25 bp, Mus musculus
atcttattcattcatggtccgtcca

SEQ ID NO: 251174 - DNA, 25 bp, Mus musculus
atcttattcattgatggtccgtcca

SEQ ID NO: 251175 - DNA, 25 bp, Mus musculus
atcttattccaaatgtctccctatg

SEQ ID NO: 251176 - DNA, 25 bp, Mus musculus
atcttattccaattgtctccctatg

SEQ ID NO: 251177 - DNA, 25 bp, Mus musculus
atcttattgccaaagctaacagaga

SEQ ID NO: 251178 - DNA, 25 bp, Mus musculus
atcttattgccatagctaacagaga

SEQ ID NO: 251179 - DNA, 25 bp, Mus musculus
atcttattggacattttccgcacaa

SEQ ID NO: 251180 - DNA, 25 bp, Mus musculus
atcttattggactttttccgcacaa

SEQ ID NO: 251181 - DNA, 25 bp, Mus musculus
atcttatttattccctgtgcccatc

SEQ ID NO: 251182 - DNA, 25 bp, Mus musculus
atcttatttattgcctgtgcccatc

SEQ ID NO: 251183 - DNA, 25 bp, Mus musculus
atcttatttggcacgttctaggctg

SEQ ID NO: 251184 - DNA, 25 bp, Mus musculus
atcttatttggctcgttctaggctg

SEQ ID NO: 251185 - DNA, 25 bp, Mus musculus
atcttatttgttacacttcccaagt

SEQ ID NO: 251186 - DNA, 25 bp, Mus musculus
atcttatttgtttcacttcccaagt

SEQ ID NO: 251187 - DNA, 25 bp, Mus musculus
atcttcaaagatctcagggcacatg

SEQ ID NO: 251188 - DNA, 25 bp, Mus musculus
atcttcaaagatgtcagggcacatg

SEQ ID NO: 251189 - DNA, 25 bp, Mus musculus
atcttcaacaagatttcccacttct

SEQ ID NO: 251190 - DNA, 25 bp, Mus musculus
atcttcaacaagttttcccacttct

SEQ ID NO: 251191 - DNA, 25 bp, Mus musculus
atcttcaaccgactcctggatatgc

SEQ ID NO: 251192 - DNA, 25 bp, Mus musculus
atcttcaaccgagtcctggatatgc

SEQ ID NO: 251193 - DNA, 25 bp, Mus musculus
atcttcaacctaacctaagtgagca

SEQ ID NO: 251194 - DNA, 25 bp, Mus musculus
atcttcaacctatcctaagtgagca

SEQ ID NO: 251195 - DNA, 25 bp, Mus musculus
atcttcaacggcatgactcttgtca

SEQ ID NO: 251196 - DNA, 25 bp, Mus musculus
atcttcaacggcttgactcttgtca

SEQ ID NO: 251197 - DNA, 25 bp, Mus musculus
atcttcaactcaattttctacccat

SEQ ID NO: 251198 - DNA, 25 bp, Mus musculus
atcttcaactcatttttctacccat

SEQ ID NO: 251199 - DNA, 25 bp, Mus musculus
atcttcaactccaatagcattatgt

SEQ ID NO: 251200 - DNA, 25 bp, Mus musculus
atcttcaactcctatagcattatgt

SEQ ID NO: 251201 - DNA, 25 bp, Mus musculus
atcttcaagaacatcaacctcttcc

SEQ ID NO: 251202 - DNA, 25 bp, Mus musculus
atcttcaagaacttcaacctcttcc

SEQ ID NO: 251203 - DNA, 25 bp, Mus musculus
atcttcaagacgatggcacccagac

SEQ ID NO: 251204 - DNA, 25 bp, Mus musculus
atcttcaagacgttggcacccagac

SEQ ID NO: 251205 - DNA, 25 bp, Mus musculus
atcttcaagagcattgcatttgagc

SEQ ID NO: 251206 - DNA, 25 bp, Mus musculus
atcttcaagagctttgcatttgagc

SEQ ID NO: 251207 - DNA, 25 bp, Mus musculus
atcttcaagcagacagacacctgta

SEQ ID NO: 251208 - DNA, 25 bp, Mus musculus
atcttcaagcagtcagacacctgta

SEQ ID NO: 251209 - DNA, 25 bp, Mus musculus
atcttcaaggtccatgtcctcacaa

SEQ ID NO: 251210 - DNA, 25 bp, Mus musculus
atcttcaaggtcgatgtcctcacaa

SEQ ID NO: 251211 - DNA, 25 bp, Mus musculus
atcttcaagtccagcccttatttgt

SEQ ID NO: 251212 - DNA, 25 bp, Mus musculus
atcttcaagtcctgcccttatttgt

SEQ ID NO: 251213 - DNA, 25 bp, Mus musculus
atcttcaatttgagaaactccaaag

SEQ ID NO: 251214 - DNA, 25 bp, Mus musculus
atcttcaatttgtgaaactccaaag

SEQ ID NO: 251215 - DNA, 25 bp, Mus musculus
atcttcacatccatttcagtttata

SEQ ID NO: 251216 - DNA, 25 bp, Mus musculus
atcttcacatccttttcagtttata

SEQ ID NO: 251217 - DNA, 25 bp, Mus musculus
atcttcaccaagacagctgcgttaa

SEQ ID NO: 251218 - DNA, 25 bp, Mus musculus
atcttcaccaagagccagttcctat

SEQ ID NO: 251219 - DNA, 25 bp, Mus musculus
atcttcaccaagtcagctgcgttaa

SEQ ID NO: 251220 - DNA, 25 bp, Mus musculus
atcttcaccaagtgccagttcctat

SEQ ID NO: 251221 - DNA, 25 bp, Mus musculus
atcttcaccaatacactgactcaag

SEQ ID NO: 251222 - DNA, 25 bp, Mus musculus
atcttcaccaattcactgactcaag

SEQ ID NO: 251223 - DNA, 25 bp, Mus musculus
atcttcaccgtcctggtagcatact

SEQ ID NO: 251224 - DNA, 25 bp, Mus musculus
atcttcaccgtcgtggtagcatact

SEQ ID NO: 251225 - DNA, 25 bp, Mus musculus
atcttcacggaactcctcatagatg

SEQ ID NO: 251226 - DNA, 25 bp, Mus musculus
atcttcacggaagtcctcatagatg

SEQ ID NO: 251227 - DNA, 25 bp, Mus musculus
atcttcacggacattctctgcatgg

SEQ ID NO: 251228 - DNA, 25 bp, Mus musculus
atcttcacggactttctctgcatgg

SEQ ID NO: 251229 - DNA, 25 bp, Mus musculus
atcttcactaacacctgttctggtt

SEQ ID NO: 251230 - DNA, 25 bp, Mus musculus
atcttcactaactcctgttctggtt

SEQ ID NO: 251231 - DNA, 25 bp, Mus musculus
atcttcactcctaatattattcctt

SEQ ID NO: 251232 - DNA, 25 bp, Mus musculus
atcttcactccttatattattcctt

SEQ ID NO: 251233 - DNA, 25 bp, Mus musculus
atcttcactgaaactgactggcttt

SEQ ID NO: 251234 - DNA, 25 bp, Mus musculus
atcttcactgaatctgactggcttt

SEQ ID NO: 251235 - DNA, 25 bp, Mus musculus
atcttcacttctcggatcattgact

SEQ ID NO: 251236 - DNA, 25 bp, Mus musculus
atcttcacttctgggatcattgact

SEQ ID NO: 251237 - DNA, 25 bp, Mus musculus
atcttcagacttagtatctccttta

SEQ ID NO: 251238 - DNA, 25 bp, Mus musculus
atcttcagactttgtatctccttta

SEQ ID NO: 251239 - DNA, 25 bp, Mus musculus
atcttcagatagctgtctcacatat

SEQ ID NO: 251240 - DNA, 25 bp, Mus musculus
atcttcagataggtgtctcacatat

SEQ ID NO: 251241 - DNA, 25 bp, Mus musculus
atcttcagatgcacaaatcaccaag

SEQ ID NO: 251242 - DNA, 25 bp, Mus musculus
atcttcagatgctcaaatcaccaag

SEQ ID NO: 251243 - DNA, 25 bp, Mus musculus
atcttcagccacatgagagatgtga

SEQ ID NO: 251244 - DNA, 25 bp, Mus musculus
atcttcagccacttgagagatgtga

SEQ ID NO: 251245 - DNA, 25 bp, Mus musculus
atcttcagctctcatactgactcag

SEQ ID NO: 251246 - DNA, 25 bp, Mus musculus
atcttcagctctgatactgactcag

SEQ ID NO: 251247 - DNA, 25 bp, Mus musculus
atcttcagctgcctgttagcatgtg

SEQ ID NO: 251248 - DNA, 25 bp, Mus musculus
atcttcagctgcgtgttagcatgtg

SEQ ID NO: 251249 - DNA, 25 bp, Mus musculus
atcttcaggagtaaggcagccttac

SEQ ID NO: 251250 - DNA, 25 bp, Mus musculus
atcttcaggagttaggcagccttac

SEQ ID NO: 251251 - DNA, 25 bp, Mus musculus
atcttcagggatcctgttggctcat

SEQ ID NO: 251252 - DNA, 25 bp, Mus musculus
atcttcagggatgctgttggctcat

SEQ ID NO: 251253 - DNA, 25 bp, Mus musculus
atcttcaggtttaatcctccttctg

SEQ ID NO: 251254 - DNA, 25 bp, Mus musculus
atcttcaggttttatcctccttctg

SEQ ID NO: 251255 - DNA, 25 bp, Mus musculus
atcttcagtgaaccaactcatttgg

SEQ ID NO: 251256 - DNA, 25 bp, Mus musculus
atcttcagtgaagcaactcatttgg

SEQ ID NO: 251257 - DNA, 25 bp, Mus musculus
atcttcagttatcaggctgcccagc

SEQ ID NO: 251258 - DNA, 25 bp, Mus musculus
atcttcagttatgaggctgcccagc

SEQ ID NO: 251259 - DNA, 25 bp, Mus musculus
atcttcagtttgctttgtggtcatc

SEQ ID NO: 251260 - DNA, 25 bp, Mus musculus
atcttcagtttggtttgtggtcatc

SEQ ID NO: 251261 - DNA, 25 bp, Mus musculus
atcttcatagcaacaaaagcctgag

SEQ ID NO: 251262 - DNA, 25 bp, Mus musculus
atcttcatagcatcaaaagcctgag

SEQ ID NO: 251263 - DNA, 25 bp, Mus musculus
atcttcatccccaaccttggagagg

SEQ ID NO: 251264 - DNA, 25 bp, Mus musculus
atcttcatcccctaccttggagagg

SEQ ID NO: 251265 - DNA, 25 bp, Mus musculus
atcttcatccgaaggctgtctgtcc

SEQ ID NO: 251266 - DNA, 25 bp, Mus musculus
atcttcatccgatggctgtctgtcc

SEQ ID NO: 251267 - DNA, 25 bp, Mus musculus
atcttcatctggaccctgtctctga

SEQ ID NO: 251268 - DNA, 25 bp, Mus musculus
atcttcatctggtccctgtctctga

SEQ ID NO: 251269 - DNA, 25 bp, Mus musculus
atcttcatctttaggtccccaatat

SEQ ID NO: 251270 - DNA, 25 bp, Mus musculus
atcttcatcttttggtccccaatat

SEQ ID NO: 251271 - DNA, 25 bp, Mus musculus
atcttcatgaagcgcgcgacccgcg

SEQ ID NO: 251272 - DNA, 25 bp, Mus musculus
atcttcatgaagggcgcgacccgcg

SEQ ID NO: 251273 - DNA, 25 bp, Mus musculus
atcttcatgagcagtcccagcagaa

SEQ ID NO: 251274 - DNA, 25 bp, Mus musculus
atcttcatgagctgtcccagcagaa

SEQ ID NO: 251275 - DNA, 25 bp, Mus musculus
atcttcatgatgcaaggcctccacg

SEQ ID NO: 251276 - DNA, 25 bp, Mus musculus
atcttcatgatggaaggcctccacg

SEQ ID NO: 251277 - DNA, 25 bp, Mus musculus
atcttcatgtggctcaggcctccag

SEQ ID NO: 251278 - DNA, 25 bp, Mus musculus
atcttcatgtgggtcaggcctccag

SEQ ID NO: 251279 - DNA, 25 bp, Mus musculus
atcttcattaggatttggtcattgt

SEQ ID NO: 251280 - DNA, 25 bp, Mus musculus
atcttcattaggttttggtcattgt

SEQ ID NO: 251281 - DNA, 25 bp, Mus musculus
atcttcattgataccagcaaatgtt

SEQ ID NO: 251282 - DNA, 25 bp, Mus musculus
atcttcattgattccagcaaatgtt

SEQ ID NO: 251283 - DNA, 25 bp, Mus musculus
atcttcattgttagtccaagctgcc

SEQ ID NO: 251284 - DNA, 25 bp, Mus musculus
atcttcattgtttgtccaagctgcc

SEQ ID NO: 251285 - DNA, 25 bp, Mus musculus
atcttcatttaaatcccacgtgctg

SEQ ID NO: 251286 - DNA, 25 bp, Mus musculus
atcttcatttaattcccacgtgctg

SEQ ID NO: 251287 - DNA, 25 bp, Mus musculus
atcttcatttataggcagcactcag

SEQ ID NO: 251288 - DNA, 25 bp, Mus musculus
atcttcatttattggcagcactcag

SEQ ID NO: 251289 - DNA, 25 bp, Mus musculus
atcttcatttctcatatcagcacat

SEQ ID NO: 251290 - DNA, 25 bp, Mus musculus
atcttcatttctgatatcagcacat

SEQ ID NO: 251291 - DNA, 25 bp, Mus musculus
atcttcatttgccatcaacagccac

SEQ ID NO: 251292 - DNA, 25 bp, Mus musculus
atcttcatttgcgatcaacagccac

SEQ ID NO: 251293 - DNA, 25 bp, Mus musculus
atcttccaacatatcctaggtactg

SEQ ID NO: 251294 - DNA, 25 bp, Mus musculus
atcttccaacatttcctaggtactg

SEQ ID NO: 251295 - DNA, 25 bp, Mus musculus
atcttccaagtaccatcaatgctcc

SEQ ID NO: 251296 - DNA, 25 bp, Mus musculus
atcttccaagtagcatcaatgctcc

SEQ ID NO: 251297 - DNA, 25 bp, Mus musculus
atcttccaatttcaccctctacaat

SEQ ID NO: 251298 - DNA, 25 bp, Mus musculus
atcttccaatttgaccctctacaat

SEQ ID NO: 251299 - DNA, 25 bp, Mus musculus
atcttccacaagaactctggcaagg

SEQ ID NO: 251300 - DNA, 25 bp, Mus musculus
atcttccacaagtactctggcaagg

SEQ ID NO: 251301 - DNA, 25 bp, Mus musculus
atcttccacccaatcatgatatatg

SEQ ID NO: 251302 - DNA, 25 bp, Mus musculus
atcttccacccattcatgatatatg

SEQ ID NO: 251303 - DNA, 25 bp, Mus musculus
atcttccagaagagcggtgtgtttc

SEQ ID NO: 251304 - DNA, 25 bp, Mus musculus
atcttccagaagtgcggtgtgtttc

SEQ ID NO: 251305 - DNA, 25 bp, Mus musculus
atcttccagaggatgccactgtctg

SEQ ID NO: 251306 - DNA, 25 bp, Mus musculus
atcttccagaggttgccactgtctg

SEQ ID NO: 251307 - DNA, 25 bp, Mus musculus
atcttccagatcaacagtcgttact

SEQ ID NO: 251308 - DNA, 25 bp, Mus musculus
atcttccagatctacagtcgttact

SEQ ID NO: 251309 - DNA, 25 bp, Mus musculus
atcttccaggccaaagtatgttgct

SEQ ID NO: 251310 - DNA, 25 bp, Mus musculus
atcttccaggcctaagtatgttgct

SEQ ID NO: 251311 - DNA, 25 bp, Mus musculus
atcttccagtctaataagtccccaa

SEQ ID NO: 251312 - DNA, 25 bp, Mus musculus
atcttccagtctatgatctccaagg

SEQ ID NO: 251313 - DNA, 25 bp, Mus musculus
atcttccagtcttataagtccccaa

SEQ ID NO: 251314 - DNA, 25 bp, Mus musculus
atcttccagtctttgatctccaagg

SEQ ID NO: 251315 - DNA, 25 bp, Mus musculus
atcttccagtgcagtgtacagccca

SEQ ID NO: 251316 - DNA, 25 bp, Mus musculus
atcttccagtgctgtgtacagccca

SEQ ID NO: 251317 - DNA, 25 bp, Mus musculus
atcttccatatcctgacaaagggtg

SEQ ID NO: 251318 - DNA, 25 bp, Mus musculus
atcttccatatcgtgacaaagggtg

SEQ ID NO: 251319 - DNA, 25 bp, Mus musculus
atcttccatcacaggttggcatgtg

SEQ ID NO: 251320 - DNA, 25 bp, Mus musculus
atcttccatcactggttggcatgtg

SEQ ID NO: 251321 - DNA, 25 bp, Mus musculus
atcttccatctcaccggccaaaatg

SEQ ID NO: 251322 - DNA, 25 bp, Mus musculus
atcttccatctctccggccaaaatg

SEQ ID NO: 251323 - DNA, 25 bp, Mus musculus
atcttccatggcattgcgagtccat

SEQ ID NO: 251324 - DNA, 25 bp, Mus musculus
atcttccatggctttgcgagtccat

SEQ ID NO: 251325 - DNA, 25 bp, Mus musculus
atcttcccaaaacagttctaccagc

SEQ ID NO: 251326 - DNA, 25 bp, Mus musculus
atcttcccaaaagagttctaccagc

SEQ ID NO: 251327 - DNA, 25 bp, Mus musculus
atcttcccactaaccttcaaatgta

SEQ ID NO: 251328 - DNA, 25 bp, Mus musculus
atcttcccactatccttcaaatgta

SEQ ID NO: 251329 - DNA, 25 bp, Mus musculus
atcttcccacttaactcctgaaagt

SEQ ID NO: 251330 - DNA, 25 bp, Mus musculus
atcttcccactttactcctgaaagt

SEQ ID NO: 251331 - DNA, 25 bp, Mus musculus
atcttcccagcccaagagacagaaa

SEQ ID NO: 251332 - DNA, 25 bp, Mus musculus
atcttcccagccgaagagacagaaa

SEQ ID NO: 251333 - DNA, 25 bp, Mus musculus
atcttcccagctcagtgtgatgtgt

SEQ ID NO: 251334 - DNA, 25 bp, Mus musculus
atcttcccagctgagtgtgatgtgt

SEQ ID NO: 251335 - DNA, 25 bp, Mus musculus
atcttcccaggcaaggattacctat

SEQ ID NO: 251336 - DNA, 25 bp, Mus musculus
atcttcccaggctaggattacctat

SEQ ID NO: 251337 - DNA, 25 bp, Mus musculus
atcttcccatttactagttccataa

SEQ ID NO: 251338 - DNA, 25 bp, Mus musculus
atcttcccattttctagttccataa

SEQ ID NO: 251339 - DNA, 25 bp, Mus musculus
atcttccccaaactcagacaatgtg

SEQ ID NO: 251340 - DNA, 25 bp, Mus musculus
atcttccccaaagtcagacaatgtg

SEQ ID NO: 251341 - DNA, 25 bp, Mus musculus
atcttccccactctggcgggcaaaa

SEQ ID NO: 251342 - DNA, 25 bp, Mus musculus
atcttccccactgtggcgggcaaaa

SEQ ID NO: 251343 - DNA, 25 bp, Mus musculus
atcttccccagcatgacaaacgtta

SEQ ID NO: 251344 - DNA, 25 bp, Mus musculus
atcttccccagcttgacaaacgtta

SEQ ID NO: 251345 - DNA, 25 bp, Mus musculus
atcttccccgccaagtgggcaaaat

SEQ ID NO: 251346 - DNA, 25 bp, Mus musculus
atcttccccgcctagtgggcaaaat

SEQ ID NO: 251347 - DNA, 25 bp, Mus musculus
atcttcccgaacactgagccaaaag

SEQ ID NO: 251348 - DNA, 25 bp, Mus musculus
atcttcccgaactctgagccaaaag

SEQ ID NO: 251349 - DNA, 25 bp, Mus musculus
atcttcccgagtatcctttcatttg

SEQ ID NO: 251350 - DNA, 25 bp, Mus musculus
atcttcccgagtttcctttcatttg

SEQ ID NO: 251351 - DNA, 25 bp, Mus musculus
atcttcccgcaaactgtccagaaaa

SEQ ID NO: 251352 - DNA, 25 bp, Mus musculus
atcttcccgcaatctgtccagaaaa

SEQ ID NO: 251353 - DNA, 25 bp, Mus musculus
atcttcccggacactagtccaacaa

SEQ ID NO: 251354 - DNA, 25 bp, Mus musculus
atcttcccggactctagtccaacaa

SEQ ID NO: 251355 - DNA, 25 bp, Mus musculus
atcttcccggatcatccagcttcag

SEQ ID NO: 251356 - DNA, 25 bp, Mus musculus
atcttcccggatgatccagcttcag

SEQ ID NO: 251357 - DNA, 25 bp, Mus musculus
atcttccctactatgatggtgtgta

SEQ ID NO: 251358 - DNA, 25 bp, Mus musculus
atcttccctactttgatggtgtgta

SEQ ID NO: 251359 - DNA, 25 bp, Mus musculus
atcttccctccaaagccattcatgg

SEQ ID NO: 251360 - DNA, 25 bp, Mus musculus
atcttccctccaactaaaggcgaaa

SEQ ID NO: 251361 - DNA, 25 bp, Mus musculus
atcttccctccatagccattcatgg

SEQ ID NO: 251362 - DNA, 25 bp, Mus musculus
atcttccctccatctaaaggcgaaa

SEQ ID NO: 251363 - DNA, 25 bp, Mus musculus
atcttccctcctctgtgagtccgtg

SEQ ID NO: 251364 - DNA, 25 bp, Mus musculus
atcttccctcctgtgtgagtccgtg

SEQ ID NO: 251365 - DNA, 25 bp, Mus musculus
atcttcccttagaccctgtcaatct

SEQ ID NO: 251366 - DNA, 25 bp, Mus musculus
atcttcccttagtccctgtcaatct

SEQ ID NO: 251367 - DNA, 25 bp, Mus musculus
atcttccgagaaccagagctgctgt

SEQ ID NO: 251368 - DNA, 25 bp, Mus musculus
atcttccgagaagcagagctgctgt

SEQ ID NO: 251369 - DNA, 25 bp, Mus musculus
atcttccgaggcagtcctagacata

SEQ ID NO: 251370 - DNA, 25 bp, Mus musculus
atcttccgaggctgtcctagacata

SEQ ID NO: 251371 - DNA, 25 bp, Mus musculus
atcttccgatttctagtgtttggca

SEQ ID NO: 251372 - DNA, 25 bp, Mus musculus
atcttccgatttgtagtgtttggca

SEQ ID NO: 251373 - DNA, 25 bp, Mus musculus
atcttccgcaggctttgctcttgtt

SEQ ID NO: 251374 - DNA, 25 bp, Mus musculus
atcttccgcagggtttgctcttgtt

SEQ ID NO: 251375 - DNA, 25 bp, Mus musculus
atcttccgccagcttgaaactccga

SEQ ID NO: 251376 - DNA, 25 bp, Mus musculus
atcttccgccaggttgaaactccga

SEQ ID NO: 251377 - DNA, 25 bp, Mus musculus
atcttccggaatccaaacacagtat

SEQ ID NO: 251378 - DNA, 25 bp, Mus musculus
atcttccggaatgcaaacacagtat

SEQ ID NO: 251379 - DNA, 25 bp, Mus musculus
atcttccggaccatgcagcatcagg

SEQ ID NO: 251380 - DNA, 25 bp, Mus musculus
atcttccggaccttgcagcatcagg

SEQ ID NO: 251381 - DNA, 25 bp, Mus musculus
atcttccgggcacgtcccacagaag

SEQ ID NO: 251382 - DNA, 25 bp, Mus musculus
atcttccgggcaggtcccacagaag

SEQ ID NO: 251383 - DNA, 25 bp, Mus musculus
atcttccggtgcaatttgaaaatca

SEQ ID NO: 251384 - DNA, 25 bp, Mus musculus
atcttccggtgctatttgaaaatca

SEQ ID NO: 251385 - DNA, 25 bp, Mus musculus
atcttcctacaaataccagcaacac

SEQ ID NO: 251386 - DNA, 25 bp, Mus musculus
atcttcctacaattaccagcaacac

SEQ ID NO: 251387 - DNA, 25 bp, Mus musculus
atcttcctaccaatggtggccatgg

SEQ ID NO: 251388 - DNA, 25 bp, Mus musculus
atcttcctaccattggtggccatgg

SEQ ID NO: 251389 - DNA, 25 bp, Mus musculus
atcttcctagaacagctcagggtta

SEQ ID NO: 251390 - DNA, 25 bp, Mus musculus
atcttcctagaactcccaactaaat

SEQ ID NO: 251391 - DNA, 25 bp, Mus musculus
atcttcctagaagagctcagggtta

SEQ ID NO: 251392 - DNA, 25 bp, Mus musculus
atcttcctagaagtcccaactaaat

SEQ ID NO: 251393 - DNA, 25 bp, Mus musculus
atcttcctcacaatttcattcttca

SEQ ID NO: 251394 - DNA, 25 bp, Mus musculus
atcttcctcacattttcattcttca

SEQ ID NO: 251395 - DNA, 25 bp, Mus musculus
atcttcctcaggagttcttctcttg

SEQ ID NO: 251396 - DNA, 25 bp, Mus musculus
atcttcctcaggcacatacttgtaa

SEQ ID NO: 251397 - DNA, 25 bp, Mus musculus
atcttcctcagggacatacttgtaa

SEQ ID NO: 251398 - DNA, 25 bp, Mus musculus
atcttcctcaggtgttcttctcttg

SEQ ID NO: 251399 - DNA, 25 bp, Mus musculus
atcttcctcattcattcctgtgaag

SEQ ID NO: 251400 - DNA, 25 bp, Mus musculus
atcttcctcattgattcctgtgaag

SEQ ID NO: 251401 - DNA, 25 bp, Mus musculus
atcttcctccatcggatgcatttgg

SEQ ID NO: 251402 - DNA, 25 bp, Mus musculus
atcttcctccatgggatgcatttgg

SEQ ID NO: 251403 - DNA, 25 bp, Mus musculus
atcttcctcgaaaagggcgtgctca

SEQ ID NO: 251404 - DNA, 25 bp, Mus musculus
atcttcctcgaatagggcgtgctca

SEQ ID NO: 251405 - DNA, 25 bp, Mus musculus
atcttcctctatagttcctgtagca

SEQ ID NO: 251406 - DNA, 25 bp, Mus musculus
atcttcctctattgttcctgtagca

SEQ ID NO: 251407 - DNA, 25 bp, Mus musculus
atcttcctctgaatttgtcaggctc

SEQ ID NO: 251408 - DNA, 25 bp, Mus musculus
atcttcctctgattttgtcaggctc

SEQ ID NO: 251409 - DNA, 25 bp, Mus musculus
atcttcctgaagaacggtatcactg

SEQ ID NO: 251410 - DNA, 25 bp, Mus musculus
atcttcctgaagaatgctacctgtc

SEQ ID NO: 251411 - DNA, 25 bp, Mus musculus
atcttcctgaagtacggtatcactg

SEQ ID NO: 251412 - DNA, 25 bp, Mus musculus
atcttcctgaagtatgctacctgtc

SEQ ID NO: 251413 - DNA, 25 bp, Mus musculus
atcttcctgagaatgtgtcatattt

SEQ ID NO: 251414 - DNA, 25 bp, Mus musculus
atcttcctgagattgtgtcatattt

SEQ ID NO: 251415 - DNA, 25 bp, Mus musculus
atcttcctgcctagcctagtaagta

SEQ ID NO: 251416 - DNA, 25 bp, Mus musculus
atcttcctgccttgcctagtaagta

SEQ ID NO: 251417 - DNA, 25 bp, Mus musculus
atcttcctgctaacagagccttatg

SEQ ID NO: 251418 - DNA, 25 bp, Mus musculus
atcttcctgctatcagagccttatg

SEQ ID NO: 251419 - DNA, 25 bp, Mus musculus
atcttcctgctgctttactgtatgg

SEQ ID NO: 251420 - DNA, 25 bp, Mus musculus
atcttcctgctggtttactgtatgg

SEQ ID NO: 251421 - DNA, 25 bp, Mus musculus
atcttcctggaaattgcctgctgta

SEQ ID NO: 251422 - DNA, 25 bp, Mus musculus
atcttcctggaatttgcctgctgta

SEQ ID NO: 251423 - DNA, 25 bp, Mus musculus
atcttcctggagcagcactgaatca

SEQ ID NO: 251424 - DNA, 25 bp, Mus musculus
atcttcctggaggagcactgaatca

SEQ ID NO: 251425 - DNA, 25 bp, Mus musculus
atcttcctggatcagaatttcttga

SEQ ID NO: 251426 - DNA, 25 bp, Mus musculus
atcttcctggatgagaatttcttga

SEQ ID NO: 251427 - DNA, 25 bp, Mus musculus
atcttcctgtaactcaccagcgaaa

SEQ ID NO: 251428 - DNA, 25 bp, Mus musculus
atcttcctgtaagtcaccagcgaaa

SEQ ID NO: 251429 - DNA, 25 bp, Mus musculus
atcttcctgtccacccgagagcggg

SEQ ID NO: 251430 - DNA, 25 bp, Mus musculus
atcttcctgtcctcccgagagcggg

SEQ ID NO: 251431 - DNA, 25 bp, Mus musculus
atcttcctgtctaatgtactgggcc

SEQ ID NO: 251432 - DNA, 25 bp, Mus musculus
atcttcctgtcttatgtactgggcc

SEQ ID NO: 251433 - DNA, 25 bp, Mus musculus
atcttcctgtgcagtcctcagaggt

SEQ ID NO: 251434 - DNA, 25 bp, Mus musculus
atcttcctgtgctgtcctcagaggt

SEQ ID NO: 251435 - DNA, 25 bp, Mus musculus
atcttccttagaatgccatgtctct

SEQ ID NO: 251436 - DNA, 25 bp, Mus musculus
atcttccttagattgccatgtctct

SEQ ID NO: 251437 - DNA, 25 bp, Mus musculus
atcttccttccaaatcctggcatga

SEQ ID NO: 251438 - DNA, 25 bp, Mus musculus
atcttccttccaagcgattgattaa

SEQ ID NO: 251439 - DNA, 25 bp, Mus musculus
atcttccttccatatcctggcatga

SEQ ID NO: 251440 - DNA, 25 bp, Mus musculus
atcttccttccatgcgattgattaa

SEQ ID NO: 251441 - DNA, 25 bp, Mus musculus
atcttccttcggctctgaggcactt

SEQ ID NO: 251442 - DNA, 25 bp, Mus musculus
atcttccttcgggtctgaggcactt

SEQ ID NO: 251443 - DNA, 25 bp, Mus musculus
atcttccttctccagttcactttaa

SEQ ID NO: 251444 - DNA, 25 bp, Mus musculus
atcttccttctcgagttcactttaa

SEQ ID NO: 251445 - DNA, 25 bp, Mus musculus
atcttccttgatatccctgtatgtt

SEQ ID NO: 251446 - DNA, 25 bp, Mus musculus
atcttccttgatttccctgtatgtt

SEQ ID NO: 251447 - DNA, 25 bp, Mus musculus
atcttccttgctagtgtgggaggcc

SEQ ID NO: 251448 - DNA, 25 bp, Mus musculus
atcttccttgctcagacacatacac

SEQ ID NO: 251449 - DNA, 25 bp, Mus musculus
atcttccttgctgagacacatacac

SEQ ID NO: 251450 - DNA, 25 bp, Mus musculus
atcttccttgcttgtgtgggaggcc

SEQ ID NO: 251451 - DNA, 25 bp, Mus musculus
atcttcctttacaactcaattcctt

SEQ ID NO: 251452 - DNA, 25 bp, Mus musculus
atcttcctttactactcaattcctt

SEQ ID NO: 251453 - DNA, 25 bp, Mus musculus
atcttcctttctatttggtcagcca

SEQ ID NO: 251454 - DNA, 25 bp, Mus musculus
atcttcctttctttttggtcagcca

SEQ ID NO: 251455 - DNA, 25 bp, Mus musculus
atcttccttttcacatggacacctc

SEQ ID NO: 251456 - DNA, 25 bp, Mus musculus
atcttccttttcagtgaagccttcc

SEQ ID NO: 251457 - DNA, 25 bp, Mus musculus
atcttccttttctcatggacacctc

SEQ ID NO: 251458 - DNA, 25 bp, Mus musculus
atcttccttttctgtgaagccttcc

SEQ ID NO: 251459 - DNA, 25 bp, Mus musculus
atcttcgacgatacttagtaaacag

SEQ ID NO: 251460 - DNA, 25 bp, Mus musculus
atcttcgacgattcttagtaaacag

SEQ ID NO: 251461 - DNA, 25 bp, Mus musculus
atcttcgatgctccaaaggaattta

SEQ ID NO: 251462 - DNA, 25 bp, Mus musculus
atcttcgatgctgcaaaggaattta

SEQ ID NO: 251463 - DNA, 25 bp, Mus musculus
atcttcgccaagctcggagaggcca

SEQ ID NO: 251464 - DNA, 25 bp, Mus musculus
atcttcgccaaggtcggagaggcca

SEQ ID NO: 251465 - DNA, 25 bp, Mus musculus
atcttcgcctatctgatggctgtca

SEQ ID NO: 251466 - DNA, 25 bp, Mus musculus
atcttcgcctatgtgatggctgtca

SEQ ID NO: 251467 - DNA, 25 bp, Mus musculus
atcttcgcctctcccatgtctgaga

SEQ ID NO: 251468 - DNA, 25 bp, Mus musculus
atcttcgcctctgccatgtctgaga

SEQ ID NO: 251469 - DNA, 25 bp, Mus musculus
atcttcgcgactattctaggcttct

SEQ ID NO: 251470 - DNA, 25 bp, Mus musculus
atcttcgcgacttttctaggcttct

SEQ ID NO: 251471 - DNA, 25 bp, Mus musculus
atcttcgcgggcctggccttcgtcg

SEQ ID NO: 251472 - DNA, 25 bp, Mus musculus
atcttcgcgggcgtggccttcgtcg

SEQ ID NO: 251473 - DNA, 25 bp, Mus musculus
atcttcgctgttaggcgctctggag

SEQ ID NO: 251474 - DNA, 25 bp, Mus musculus
atcttcgctgtttggcgctctggag

SEQ ID NO: 251475 - DNA, 25 bp, Mus musculus
atcttcgcttagctcttggagtggg

SEQ ID NO: 251476 - DNA, 25 bp, Mus musculus
atcttcgcttaggtcttggagtggg

SEQ ID NO: 251477 - DNA, 25 bp, Mus musculus
atcttcggagtcaggagtcccgtgg

SEQ ID NO: 251478 - DNA, 25 bp, Mus musculus
atcttcggagtctggagtcccgtgg

SEQ ID NO: 251479 - DNA, 25 bp, Mus musculus
atcttcggcttgcagatgctcattg

SEQ ID NO: 251480 - DNA, 25 bp, Mus musculus
atcttcggcttggagatgctcattg

SEQ ID NO: 251481 - DNA, 25 bp, Mus musculus
atcttcggtgagcaagtggctcgaa

SEQ ID NO: 251482 - DNA, 25 bp, Mus musculus
atcttcggtgaggaagtggctcgaa

SEQ ID NO: 251483 - DNA, 25 bp, Mus musculus
atcttcgtccttcctgttttcagag

SEQ ID NO: 251484 - DNA, 25 bp, Mus musculus
atcttcgtccttgctgttttcagag

SEQ ID NO: 251485 - DNA, 25 bp, Mus musculus
atcttcgtctttcttggctttcgta

SEQ ID NO: 251486 - DNA, 25 bp, Mus musculus
atcttcgtctttgttggctttcgta

SEQ ID NO: 251487 - DNA, 25 bp, Mus musculus
atcttcgtggctatatttggtttaa

SEQ ID NO: 251488 - DNA, 25 bp, Mus musculus
atcttcgtggctttatttggtttaa

SEQ ID NO: 251489 - DNA, 25 bp, Mus musculus
atcttctaattcacctcaggccaat

SEQ ID NO: 251490 - DNA, 25 bp, Mus musculus
atcttctaattctcctcaggccaat

SEQ ID NO: 251491 - DNA, 25 bp, Mus musculus
atcttctaccccacataatatttct

SEQ ID NO: 251492 - DNA, 25 bp, Mus musculus
atcttctacccctcataatatttct

SEQ ID NO: 251493 - DNA, 25 bp, Mus musculus
atcttctaccgtctcataggctgag

SEQ ID NO: 251494 - DNA, 25 bp, Mus musculus
atcttctaccgtgtcataggctgag

SEQ ID NO: 251495 - DNA, 25 bp, Mus musculus
atcttctactgaagcacccgagtta

SEQ ID NO: 251496 - DNA, 25 bp, Mus musculus
atcttctactgacgacttgggttgg

SEQ ID NO: 251497 - DNA, 25 bp, Mus musculus
atcttctactgaggacttgggttgg

SEQ ID NO: 251498 - DNA, 25 bp, Mus musculus
atcttctactgatgcacccgagtta

SEQ ID NO: 251499 - DNA, 25 bp, Mus musculus
atcttctactgcaatatttctttta

SEQ ID NO: 251500 - DNA, 25 bp, Mus musculus
atcttctactgctatatttctttta

SEQ ID NO: 251501 - DNA, 25 bp, Mus musculus
atcttctcaagactccagagctcct

SEQ ID NO: 251502 - DNA, 25 bp, Mus musculus
atcttctcaagagtccagagctcct

SEQ ID NO: 251503 - DNA, 25 bp, Mus musculus
atcttctcagatccatgtactcaga

SEQ ID NO: 251504 - DNA, 25 bp, Mus musculus
atcttctcagatgcatgtactcaga

SEQ ID NO: 251505 - DNA, 25 bp, Mus musculus
atcttctcatgaaggcacagtccct

SEQ ID NO: 251506 - DNA, 25 bp, Mus musculus
atcttctcatgatggcacagtccct

SEQ ID NO: 251507 - DNA, 25 bp, Mus musculus
atcttctcatggaaaggtgccccta

SEQ ID NO: 251508 - DNA, 25 bp, Mus musculus
atcttctcatggtaaggtgccccta

SEQ ID NO: 251509 - DNA, 25 bp, Mus musculus
atcttctcattgctgggagtggacc

SEQ ID NO: 251510 - DNA, 25 bp, Mus musculus
atcttctcattggtgggagtggacc

SEQ ID NO: 251511 - DNA, 25 bp, Mus musculus
atcttctccaaacctatgtctgttg

SEQ ID NO: 251512 - DNA, 25 bp, Mus musculus
atcttctccaaagctatgtctgttg

SEQ ID NO: 251513 - DNA, 25 bp, Mus musculus
atcttctccacacggaataactcgg

SEQ ID NO: 251514 - DNA, 25 bp, Mus musculus
atcttctccacagggaataactcgg

SEQ ID NO: 251515 - DNA, 25 bp, Mus musculus
atcttctccatcatttggactaagc

SEQ ID NO: 251516 - DNA, 25 bp, Mus musculus
atcttctccatcttttggactaagc

SEQ ID NO: 251517 - DNA, 25 bp, Mus musculus
atcttctccattatcgatctgatct

SEQ ID NO: 251518 - DNA, 25 bp, Mus musculus
atcttctccattttcgatctgatct

SEQ ID NO: 251519 - DNA, 25 bp, Mus musculus
atcttctccctgaaaataatgcttt

SEQ ID NO: 251520 - DNA, 25 bp, Mus musculus
atcttctccctgtaaataatgcttt

SEQ ID NO: 251521 - DNA, 25 bp, Mus musculus
atcttctccgaacaggtggccatgg

SEQ ID NO: 251522 - DNA, 25 bp, Mus musculus
atcttctccgaagaggtggccatgg

SEQ ID NO: 251523 - DNA, 25 bp, Mus musculus
atcttctcctagactacgagttgtc

SEQ ID NO: 251524 - DNA, 25 bp, Mus musculus
atcttctcctagtctacgagttgtc

SEQ ID NO: 251525 - DNA, 25 bp, Mus musculus
atcttctcctcaattgtaagtaggg

SEQ ID NO: 251526 - DNA, 25 bp, Mus musculus
atcttctcctcatttgtaagtaggg

SEQ ID NO: 251527 - DNA, 25 bp, Mus musculus
atcttctcggtgacagggagacaga

SEQ ID NO: 251528 - DNA, 25 bp, Mus musculus
atcttctcggtgtcagggagacaga

SEQ ID NO: 251529 - DNA, 25 bp, Mus musculus
atcttctctactcctaggtacttgg

SEQ ID NO: 251530 - DNA, 25 bp, Mus musculus
atcttctctactgctaggtacttgg

SEQ ID NO: 251531 - DNA, 25 bp, Mus musculus
atcttctctcacatcaaactgacgt

SEQ ID NO: 251532 - DNA, 25 bp, Mus musculus
atcttctctcacttcaaactgacgt

SEQ ID NO: 251533 - DNA, 25 bp, Mus musculus
atcttctctgaacagcttgtttccg

SEQ ID NO: 251534 - DNA, 25 bp, Mus musculus
atcttctctgaagagcttgtttccg

SEQ ID NO: 251535 - DNA, 25 bp, Mus musculus
atcttctctgagacacagtgtgcct

SEQ ID NO: 251536 - DNA, 25 bp, Mus musculus
atcttctctgagtcacagtgtgcct

SEQ ID NO: 251537 - DNA, 25 bp, Mus musculus
atcttctctggactatggagctcaa

SEQ ID NO: 251538 - DNA, 25 bp, Mus musculus
atcttctctggagtatggagctcaa

SEQ ID NO: 251539 - DNA, 25 bp, Mus musculus
atcttctctggtcccgcaaaacttg

SEQ ID NO: 251540 - DNA, 25 bp, Mus musculus
atcttctctggtgccgcaaaacttg

SEQ ID NO: 251541 - DNA, 25 bp, Mus musculus
atcttctcttacaaggtaggcccag

SEQ ID NO: 251542 - DNA, 25 bp, Mus musculus
atcttctcttactaggtaggcccag

SEQ ID NO: 251543 - DNA, 25 bp, Mus musculus
atcttctcttggaggaaggaccgac

SEQ ID NO: 251544 - DNA, 25 bp, Mus musculus
atcttctcttggtggaaggaccgac

SEQ ID NO: 251545 - DNA, 25 bp, Mus musculus
atcttctcttttaaagaccatttgg

SEQ ID NO: 251546 - DNA, 25 bp, Mus musculus
atcttctctttttaagaccatttgg

SEQ ID NO: 251547 - DNA, 25 bp, Mus musculus
atcttctgagctatactggccctaa

SEQ ID NO: 251548 - DNA, 25 bp, Mus musculus
atcttctgagctttactggccctaa

SEQ ID NO: 251549 - DNA, 25 bp, Mus musculus
atcttctgaggccaaaagtccatct

SEQ ID NO: 251550 - DNA, 25 bp, Mus musculus
atcttctgaggcgaaaagtccatct

SEQ ID NO: 251551 - DNA, 25 bp, Mus musculus
atcttctgattcatacacagcccta

SEQ ID NO: 251552 - DNA, 25 bp, Mus musculus
atcttctgattcttacacagcccta

SEQ ID NO: 251553 - DNA, 25 bp, Mus musculus
atcttctgcacacagaggcttccct

SEQ ID NO: 251554 - DNA, 25 bp, Mus musculus
atcttctgcacagagaggcttccct

SEQ ID NO: 251555 - DNA, 25 bp, Mus musculus
atcttctgcatcacccagtatgata

SEQ ID NO: 251556 - DNA, 25 bp, Mus musculus
atcttctgcatctcccagtatgata

SEQ ID NO: 251557 - DNA, 25 bp, Mus musculus
atcttctgccatcgcgctatgtaac

SEQ ID NO: 251558 - DNA, 25 bp, Mus musculus
atcttctgccatggcgctatgtaac

SEQ ID NO: 251559 - DNA, 25 bp, Mus musculus
atcttctgctctatttcactatttc

SEQ ID NO: 251560 - DNA, 25 bp, Mus musculus
atcttctgctctttttcactatttc

SEQ ID NO: 251561 - DNA, 25 bp, Mus musculus
atcttctggcttcctgaggtcatgc

SEQ ID NO: 251562 - DNA, 25 bp, Mus musculus
atcttctggcttgctgaggtcatgc

SEQ ID NO: 251563 - DNA, 25 bp, Mus musculus
atcttctgggcccaggcaaagaaaa

SEQ ID NO: 251564 - DNA, 25 bp, Mus musculus
atcttctgggccgaggcaaagaaaa

SEQ ID NO: 251565 - DNA, 25 bp, Mus musculus
atcttctggtgcctcctattgcctt

SEQ ID NO: 251566 - DNA, 25 bp, Mus musculus
atcttctggtgcgtcctattgcctt

SEQ ID NO: 251567 - DNA, 25 bp, Mus musculus
atcttctgtatcatggaagcctgag

SEQ ID NO: 251568 - DNA, 25 bp, Mus musculus
atcttctgtatcttggaagcctgag

SEQ ID NO: 251569 - DNA, 25 bp, Mus musculus
atcttctgtcatagatgctgggact

SEQ ID NO: 251570 - DNA, 25 bp, Mus musculus
atcttctgtcattgatgctgggact

SEQ ID NO: 251571 - DNA, 25 bp, Mus musculus
atcttctgtgaacccatgtcatact

SEQ ID NO: 251572 - DNA, 25 bp, Mus musculus
atcttctgtgaagccatgtcatact

SEQ ID NO: 251573 - DNA, 25 bp, Mus musculus
atcttctgtgccagtggttggaatc

SEQ ID NO: 251574 - DNA, 25 bp, Mus musculus
atcttctgtgcctgtggttggaatc

SEQ ID NO: 251575 - DNA, 25 bp, Mus musculus
atcttctgtgtaactacgaagaaaa

SEQ ID NO: 251576 - DNA, 25 bp, Mus musculus
atcttctgtgtactggccaaccaaa

SEQ ID NO: 251577 - DNA, 25 bp, Mus musculus
atcttctgtgtagtggccaaccaaa

SEQ ID NO: 251578 - DNA, 25 bp, Mus musculus
atcttctgtgtatctacgaagaaaa

SEQ ID NO: 251579 - DNA, 25 bp, Mus musculus
atcttctgttcccatcagtgctgtt

SEQ ID NO: 251580 - DNA, 25 bp, Mus musculus
atcttctgttccgatcagtgctgtt

SEQ ID NO: 251581 - DNA, 25 bp, Mus musculus
atcttctgttgaaccaggacattaa

SEQ ID NO: 251582 - DNA, 25 bp, Mus musculus
atcttctgttgatccaggacattaa

SEQ ID NO: 251583 - DNA, 25 bp, Mus musculus
atcttcttactcaaaagccagtcaa

SEQ ID NO: 251584 - DNA, 25 bp, Mus musculus
atcttcttactctaaagccagtcaa

SEQ ID NO: 251585 - DNA, 25 bp, Mus musculus
atcttcttagtaattcatctgtctc

SEQ ID NO: 251586 - DNA, 25 bp, Mus musculus
atcttcttagtatttcatctgtctc

SEQ ID NO: 251587 - DNA, 25 bp, Mus musculus
atcttcttatcccattccgggagac

SEQ ID NO: 251588 - DNA, 25 bp, Mus musculus
atcttcttatccgattccgggagac

SEQ ID NO: 251589 - DNA, 25 bp, Mus musculus
atcttcttatctatccacagagctg

SEQ ID NO: 251590 - DNA, 25 bp, Mus musculus
atcttcttatctttccacagagctg

SEQ ID NO: 251591 - DNA, 25 bp, Mus musculus
atcttcttcactccggtgacaggaa

SEQ ID NO: 251592 - DNA, 25 bp, Mus musculus
atcttcttcactgcggtgacaggaa

SEQ ID NO: 251593 - DNA, 25 bp, Mus musculus
atcttcttcatactgttctccaatt

SEQ ID NO: 251594 - DNA, 25 bp, Mus musculus
atcttcttcatagtgttctccaatt

SEQ ID NO: 251595 - DNA, 25 bp, Mus musculus
atcttcttcatcaggcgccggtact

SEQ ID NO: 251596 - DNA, 25 bp, Mus musculus
atcttcttcatctggcgccggtact

SEQ ID NO: 251597 - DNA, 25 bp, Mus musculus
atcttcttccacacaacagctaaaa

SEQ ID NO: 251598 - DNA, 25 bp, Mus musculus
atcttcttccaccaaggagccgcag

SEQ ID NO: 251599 - DNA, 25 bp, Mus musculus
atcttcttccacgaaggagccgcag

SEQ ID NO: 251600 - DNA, 25 bp, Mus musculus
atcttcttccactcaacagctaaaa

SEQ ID NO: 251601 - DNA, 25 bp, Mus musculus
atcttcttccctattgcactggttg

SEQ ID NO: 251602 - DNA, 25 bp, Mus musculus
atcttcttcccttttgcactggttg

SEQ ID NO: 251603 - DNA, 25 bp, Mus musculus
atcttcttcctgcttgcaagttgag

SEQ ID NO: 251604 - DNA, 25 bp, Mus musculus
atcttcttcctggttgcaagttgag

SEQ ID NO: 251605 - DNA, 25 bp, Mus musculus
atcttcttccttcttaattaattag

SEQ ID NO: 251606 - DNA, 25 bp, Mus musculus
atcttcttccttgttaattaattag

SEQ ID NO: 251607 - DNA, 25 bp, Mus musculus
atcttcttcgtcactgcagggctaa

SEQ ID NO: 251608 - DNA, 25 bp, Mus musculus
atcttcttcgtctctgcagggctaa

SEQ ID NO: 251609 - DNA, 25 bp, Mus musculus
atcttcttctgtcttgtgccatcct

SEQ ID NO: 251610 - DNA, 25 bp, Mus musculus
atcttcttctgtgttgtgccatcct

SEQ ID NO: 251611 - DNA, 25 bp, Mus musculus
atcttcttcttcaactatcccagaa

SEQ ID NO: 251612 - DNA, 25 bp, Mus musculus
atcttcttcttctactatcccagaa

SEQ ID NO: 251613 - DNA, 25 bp, Mus musculus
atcttcttcttgagtctaattgccc

SEQ ID NO: 251614 - DNA, 25 bp, Mus musculus
atcttcttcttgtgtctaattgccc

SEQ ID NO: 251615 - DNA, 25 bp, Mus musculus
atcttcttgatgacttggcccagca

SEQ ID NO: 251616 - DNA, 25 bp, Mus musculus
atcttcttgatgtcttggcccagca

SEQ ID NO: 251617 - DNA, 25 bp, Mus musculus
atcttcttgcctcgactgcttggtg

SEQ ID NO: 251618 - DNA, 25 bp, Mus musculus
atcttcttgcctggactgcttggtg

SEQ ID NO: 251619 - DNA, 25 bp, Mus musculus
atcttcttggatagttgcctgtgcc

SEQ ID NO: 251620 - DNA, 25 bp, Mus musculus
atcttcttggattgttgcctgtgcc

SEQ ID NO: 251621 - DNA, 25 bp, Mus musculus
atcttctttcaccaaggagactctc

SEQ ID NO: 251622 - DNA, 25 bp, Mus musculus
atcttctttcacgaaggagactctc

SEQ ID NO: 251623 - DNA, 25 bp, Mus musculus
atcttctttcccatctctagtattt

SEQ ID NO: 251624 - DNA, 25 bp, Mus musculus
atcttctttcccttctctagtattt

SEQ ID NO: 251625 - DNA, 25 bp, Mus musculus
atcttctttggtccccggcagatgg

SEQ ID NO: 251626 - DNA, 25 bp, Mus musculus
atcttctttggtgcccggcagatgg

SEQ ID NO: 251627 - DNA, 25 bp, Mus musculus
atcttcttttgaaacccatctcaga

SEQ ID NO: 251628 - DNA, 25 bp, Mus musculus
atcttcttttgatacccatctcaga

SEQ ID NO: 251629 - DNA, 25 bp, Mus musculus
atcttcttttgcacccatggaacat

SEQ ID NO: 251630 - DNA, 25 bp, Mus musculus
atcttcttttgctcccatggaacat

SEQ ID NO: 251631 - DNA, 25 bp, Mus musculus
atcttgaacatcacgaacatctccc

SEQ ID NO: 251632 - DNA, 25 bp, Mus musculus
atcttgaacatctcgaacatctccc

SEQ ID NO: 251633 - DNA, 25 bp, Mus musculus
atcttgaacatgacgcttactttta

SEQ ID NO: 251634 - DNA, 25 bp, Mus musculus
atcttgaacatgtcgcttactttta

SEQ ID NO: 251635 - DNA, 25 bp, Mus musculus
atcttgaacctgacactaggcttta

SEQ ID NO: 251636 - DNA, 25 bp, Mus musculus
atcttgaacctgtcactaggcttta

SEQ ID NO: 251637 - DNA, 25 bp, Mus musculus
atcttgaactcgagtgcggcaacct

SEQ ID NO: 251638 - DNA, 25 bp, Mus musculus
atcttgaactcgtgtgcggcaacct

SEQ ID NO: 251639 - DNA, 25 bp, Mus musculus
atcttgaaggtgaggctggagagat

SEQ ID NO: 251640 - DNA, 25 bp, Mus musculus
atcttgaaggtgtggctggagagat

SEQ ID NO: 251641 - DNA, 25 bp, Mus musculus
atcttgaagtaaacattgcccgaac

SEQ ID NO: 251642 - DNA, 25 bp, Mus musculus
atcttgaagtaatcattgcccgaac

SEQ ID NO: 251643 - DNA, 25 bp, Mus musculus
atcttgaagtgtctgccatatgcca

SEQ ID NO: 251644 - DNA, 25 bp, Mus musculus
atcttgaagtgtgtgccatatgcca

SEQ ID NO: 251645 - DNA, 25 bp, Mus musculus
atcttgacagaaaggccagcctggt

SEQ ID NO: 251646 - DNA, 25 bp, Mus musculus
atcttgacagaatggccagcctggt

SEQ ID NO: 251647 - DNA, 25 bp, Mus musculus
atcttgacagggaaattgtcatttt

SEQ ID NO: 251648 - DNA, 25 bp, Mus musculus
atcttgacagggtaattgtcatttt

SEQ ID NO: 251649 - DNA, 25 bp, Mus musculus
atcttgacagtacccagtggattgg

SEQ ID NO: 251650 - DNA, 25 bp, Mus musculus
atcttgacagtagccagtggattgg

SEQ ID NO: 251651 - DNA, 25 bp, Mus musculus
atcttgaccagtaatgttgtttgaa

SEQ ID NO: 251652 - DNA, 25 bp, Mus musculus
atcttgaccagttatgttgtttgaa

SEQ ID NO: 251653 - DNA, 25 bp, Mus musculus
atcttgaccctcaaaagtgccctca

SEQ ID NO: 251654 - DNA, 25 bp, Mus musculus
atcttgaccctctaaagtgccctca

SEQ ID NO: 251655 - DNA, 25 bp, Mus musculus
atcttgaccgtgctaactgtgtgta

SEQ ID NO: 251656 - DNA, 25 bp, Mus musculus
atcttgaccgtggtaactgtgtgta

SEQ ID NO: 251657 - DNA, 25 bp, Mus musculus
atcttgacggtgctcccatcgagga

SEQ ID NO: 251658 - DNA, 25 bp, Mus musculus
atcttgacggtggtcccatcgagga

SEQ ID NO: 251659 - DNA, 25 bp, Mus musculus
atcttgactcgtcgattttgtgccc

SEQ ID NO: 251660 - DNA, 25 bp, Mus musculus
atcttgactcgtggattttgtgccc

SEQ ID NO: 251661 - DNA, 25 bp, Mus musculus
atcttgactgagaaatcctacttta

SEQ ID NO: 251662 - DNA, 25 bp, Mus musculus
atcttgactgagtaatcctacttta

SEQ ID NO: 251663 - DNA, 25 bp, Mus musculus
atcttgactggcctataatgctgca

SEQ ID NO: 251664 - DNA, 25 bp, Mus musculus
atcttgactggcgtataatgctgca

SEQ ID NO: 251665 - DNA, 25 bp, Mus musculus
atcttgagaactctacagacaaaac

SEQ ID NO: 251666 - DNA, 25 bp, Mus musculus
atcttgagaactgtacagacaaaac

SEQ ID NO: 251667 - DNA, 25 bp, Mus musculus
atcttgagaagtctgtcctcttcgc

SEQ ID NO: 251668 - DNA, 25 bp, Mus musculus
atcttgagaagtgtgtcctcttcgc

SEQ ID NO: 251669 - DNA, 25 bp, Mus musculus
atcttgagatcaagttacacttgcc

SEQ ID NO: 251670 - DNA, 25 bp, Mus musculus
atcttgagatcatgttacacttgcc

SEQ ID NO: 251671 - DNA, 25 bp, Mus musculus
atcttgagctacagccatcctaact

SEQ ID NO: 251672 - DNA, 25 bp, Mus musculus
atcttgagctactgccatcctaact

SEQ ID NO: 251673 - DNA, 25 bp, Mus musculus
atcttgagtctgaggtagatttcaa

SEQ ID NO: 251674 - DNA, 25 bp, Mus musculus
atcttgagtctgtggtagatttcaa

SEQ ID NO: 251675 - DNA, 25 bp, Mus musculus
atcttgagtgtgattcgaagtgctc

SEQ ID NO: 251676 - DNA, 25 bp, Mus musculus
atcttgagtgtgtttcgaagtgctc

SEQ ID NO: 251677 - DNA, 25 bp, Mus musculus
atcttgagttgtctactgcatatta

SEQ ID NO: 251678 - DNA, 25 bp, Mus musculus
atcttgagttgtgtactgcatatta

SEQ ID NO: 251679 - DNA, 25 bp, Mus musculus
atcttgagtttgctttactggttca

SEQ ID NO: 251680 - DNA, 25 bp, Mus musculus
atcttgagtttggtttactggttca

SEQ ID NO: 251681 - DNA, 25 bp, Mus musculus
atcttgatatttcgcctctttgaag

SEQ ID NO: 251682 - DNA, 25 bp, Mus musculus
atcttgatatttggcctctttgaag

SEQ ID NO: 251683 - DNA, 25 bp, Mus musculus
atcttgatgatcattatggccccat

SEQ ID NO: 251684 - DNA, 25 bp, Mus musculus
atcttgatgatctttatggccccat

SEQ ID NO: 251685 - DNA, 25 bp, Mus musculus
atcttgatggacaccttggcatttc

SEQ ID NO: 251686 - DNA, 25 bp, Mus musculus
atcttgatggactccttggcatttc

SEQ ID NO: 251687 - DNA, 25 bp, Mus musculus
atcttgatgggaactttagggccct

SEQ ID NO: 251688 - DNA, 25 bp, Mus musculus
atcttgatgggatctttagggccct

SEQ ID NO: 251689 - DNA, 25 bp, Mus musculus
atcttgatgggcagccattgggcac

SEQ ID NO: 251690 - DNA, 25 bp, Mus musculus
atcttgatgggctgccattgggcac

SEQ ID NO: 251691 - DNA, 25 bp, Mus musculus
atcttgatgggtctgtctcctggca

SEQ ID NO: 251692 - DNA, 25 bp, Mus musculus
atcttgatgggtgtgtctcctggca

SEQ ID NO: 251693 - DNA, 25 bp, Mus musculus
atcttgatgtggaccctccctgtga

SEQ ID NO: 251694 - DNA, 25 bp, Mus musculus
atcttgatgtggtccctccctgtga

SEQ ID NO: 251695 - DNA, 25 bp, Mus musculus
atcttgattatcaccttttatgtta

SEQ ID NO: 251696 - DNA, 25 bp, Mus musculus
atcttgattatctccttttatgtta

SEQ ID NO: 251697 - DNA, 25 bp, Mus musculus
atcttgattctgaattctttgttaa

SEQ ID NO: 251698 - DNA, 25 bp, Mus musculus
atcttgattctgtattctttgttaa

SEQ ID NO: 251699 - DNA, 25 bp, Mus musculus
atcttgatttctatcagcacctggg

SEQ ID NO: 251700 - DNA, 25 bp, Mus musculus
atcttgatttctttcagcacctggg

SEQ ID NO: 251701 - DNA, 25 bp, Mus musculus
atcttgcaccaactcctcaaagtga

SEQ ID NO: 251702 - DNA, 25 bp, Mus musculus
atcttgcaccaagtcctcaaagtga

SEQ ID NO: 251703 - DNA, 25 bp, Mus musculus
atcttgcacgggacatgagccacag

SEQ ID NO: 251704 - DNA, 25 bp, Mus musculus
atcttgcacgggtcatgagccacag

SEQ ID NO: 251705 - DNA, 25 bp, Mus musculus
atcttgcagacacaggtgtggcttt

SEQ ID NO: 251706 - DNA, 25 bp, Mus musculus
atcttgcagacagaggtgtggcttt

SEQ ID NO: 251707 - DNA, 25 bp, Mus musculus
atcttgcagtgtcctgcagcctgga

SEQ ID NO: 251708 - DNA, 25 bp, Mus musculus
atcttgcagtgtgctgcagcctgga

SEQ ID NO: 251709 - DNA, 25 bp, Mus musculus
atcttgcatcggatctggtggtgtt

SEQ ID NO: 251710 - DNA, 25 bp, Mus musculus
atcttgcatcggttctggtggtgtt

SEQ ID NO: 251711 - DNA, 25 bp, Mus musculus
atcttgcattgtacctctcatgaga

SEQ ID NO: 251712 - DNA, 25 bp, Mus musculus
atcttgcattgttcctctcatgaga

SEQ ID NO: 251713 - DNA, 25 bp, Mus musculus
atcttgccaacaaggccactttgtt

SEQ ID NO: 251714 - DNA, 25 bp, Mus musculus
atcttgccaacatggccactttgtt

SEQ ID NO: 251715 - DNA, 25 bp, Mus musculus
atcttgccacaacgcttgtccaggc

SEQ ID NO: 251716 - DNA, 25 bp, Mus musculus
atcttgccacaaggcttgtccaggc

SEQ ID NO: 251717 - DNA, 25 bp, Mus musculus
atcttgccacatcagcaggttgata

SEQ ID NO: 251718 - DNA, 25 bp, Mus musculus
atcttgccacatgagcaggttgata

SEQ ID NO: 251719 - DNA, 25 bp, Mus musculus
atcttgccagccctagtaacttaaa

SEQ ID NO: 251720 - DNA, 25 bp, Mus musculus
atcttgccagcccttcaagacttaa

SEQ ID NO: 251721 - DNA, 25 bp, Mus musculus
atcttgccagccgtagtaacttaaa

SEQ ID NO: 251722 - DNA, 25 bp, Mus musculus
atcttgccagccgttcaagacttaa

SEQ ID NO: 251723 - DNA, 25 bp, Mus musculus
atcttgccatgtccaagctcaggat

SEQ ID NO: 251724 - DNA, 25 bp, Mus musculus
atcttgccatgtgcaagctcaggat

SEQ ID NO: 251725 - DNA, 25 bp, Mus musculus
atcttgccattaccagctctgagaa

SEQ ID NO: 251726 - DNA, 25 bp, Mus musculus
atcttgccattagcagctctgagaa

SEQ ID NO: 251727 - DNA, 25 bp, Mus musculus
atcttgcccatgagatgcgcatttt

SEQ ID NO: 251728 - DNA, 25 bp, Mus musculus
atcttgcccatgtgatgcgcatttt

SEQ ID NO: 251729 - DNA, 25 bp, Mus musculus
atcttgcccgagatgcccgaggtgc

SEQ ID NO: 251730 - DNA, 25 bp, Mus musculus
atcttgcccgagttgcccgaggtgc

SEQ ID NO: 251731 - DNA, 25 bp, Mus musculus
atcttgcccgtcctgaagtcacagt

SEQ ID NO: 251732 - DNA, 25 bp, Mus musculus
atcttgcccgtcgtgaagtcacagt

SEQ ID NO: 251733 - DNA, 25 bp, Mus musculus
atcttgccctaacctcttcaggaat

SEQ ID NO: 251734 - DNA, 25 bp, Mus musculus
atcttgccctaagctcttcaggaat

SEQ ID NO: 251735 - DNA, 25 bp, Mus musculus
atcttgccggttccctgtacacttg

SEQ ID NO: 251736 - DNA, 25 bp, Mus musculus
atcttgccggttgcctgtacacttg

SEQ ID NO: 251737 - DNA, 25 bp, Mus musculus
atcttgcctctgagtttacatgttc

SEQ ID NO: 251738 - DNA, 25 bp, Mus musculus
atcttgcctctgtgtttacatgttc

SEQ ID NO: 251739 - DNA, 25 bp, Mus musculus
atcttgcctcttaggctcagacaag

SEQ ID NO: 251740 - DNA, 25 bp, Mus musculus
atcttgcctctttggctcagacaag

SEQ ID NO: 251741 - DNA, 25 bp, Mus musculus
atcttgcctgccacgtaagcgtttc

SEQ ID NO: 251742 - DNA, 25 bp, Mus musculus
atcttgcctgcctcgtaagcgtttc

SEQ ID NO: 251743 - DNA, 25 bp, Mus musculus
atcttgcctggtcgactggactgga

SEQ ID NO: 251744 - DNA, 25 bp, Mus musculus
atcttgcctggtggactggactgga

SEQ ID NO: 251745 - DNA, 25 bp, Mus musculus
atcttgcgtggtaagcagtgctctg

SEQ ID NO: 251746 - DNA, 25 bp, Mus musculus
atcttgcgtggttagcagtgctctg

SEQ ID NO: 251747 - DNA, 25 bp, Mus musculus
atcttgctacctaggaacaacattg

SEQ ID NO: 251748 - DNA, 25 bp, Mus musculus
atcttgctaccttggaacaacattg

SEQ ID NO: 251749 - DNA, 25 bp, Mus musculus
atcttgctcttcatttgtggctcag

SEQ ID NO: 251750 - DNA, 25 bp, Mus musculus
atcttgctcttcctcggtgggctgt

SEQ ID NO: 251751 - DNA, 25 bp, Mus musculus
atcttgctcttcgtcggtgggctgt

SEQ ID NO: 251752 - DNA, 25 bp, Mus musculus
atcttgctcttcttttgtggctcag

SEQ ID NO: 251753 - DNA, 25 bp, Mus musculus
atcttgctgaacatcggcctggcta

SEQ ID NO: 251754 - DNA, 25 bp, Mus musculus
atcttgctgaacttcggcctggcta

SEQ ID NO: 251755 - DNA, 25 bp, Mus musculus
atcttgctgactctggaatccctgg

SEQ ID NO: 251756 - DNA, 25 bp, Mus musculus
atcttgctgactgtggaatccctgg

SEQ ID NO: 251757 - DNA, 25 bp, Mus musculus
atcttgctgagaaacgagctacttg

SEQ ID NO: 251758 - DNA, 25 bp, Mus musculus
atcttgctgagatacgagctacttg

SEQ ID NO: 251759 - DNA, 25 bp, Mus musculus
atcttgctgcttaattcacgtgtca

SEQ ID NO: 251760 - DNA, 25 bp, Mus musculus
atcttgctgcttatgtgtcaattta

SEQ ID NO: 251761 - DNA, 25 bp, Mus musculus
atcttgctgctttattcacgtgtca

SEQ ID NO: 251762 - DNA, 25 bp, Mus musculus
atcttgctgcttttgtgtcaattta

SEQ ID NO: 251763 - DNA, 25 bp, Mus musculus
atcttgctggcccaatgagattttt

SEQ ID NO: 251764 - DNA, 25 bp, Mus musculus
atcttgctggccgaatgagattttt

SEQ ID NO: 251765 - DNA, 25 bp, Mus musculus
atcttgctgtggatcttggtcactt

SEQ ID NO: 251766 - DNA, 25 bp, Mus musculus
atcttgctgtggttcttggtcactt

SEQ ID NO: 251767 - DNA, 25 bp, Mus musculus
atcttgcttaccatttactgaacct

SEQ ID NO: 251768 - DNA, 25 bp, Mus musculus
atcttgcttaccttttactgaacct

SEQ ID NO: 251769 - DNA, 25 bp, Mus musculus
atcttgcttagcctcaaagagttgc

SEQ ID NO: 251770 - DNA, 25 bp, Mus musculus
atcttgcttagcgtcaaagagttgc

SEQ ID NO: 251771 - DNA, 25 bp, Mus musculus
atcttgcttctgagtctagatggta

SEQ ID NO: 251772 - DNA, 25 bp, Mus musculus
atcttgcttctgtgtctagatggta

SEQ ID NO: 251773 - DNA, 25 bp, Mus musculus
atcttgcttgaaaaacctgctttgt

SEQ ID NO: 251774 - DNA, 25 bp, Mus musculus
atcttgcttgaataacctgctttgt

SEQ ID NO: 251775 - DNA, 25 bp, Mus musculus
atcttggaacagaacttcctgcaag

SEQ ID NO: 251776 - DNA, 25 bp, Mus musculus
atcttggaacagcacaggccaggcc

SEQ ID NO: 251777 - DNA, 25 bp, Mus musculus
atcttggaacaggacaggccaggcc

SEQ ID NO: 251778 - DNA, 25 bp, Mus musculus
atcttggaacagtacttcctgcaag

SEQ ID NO: 251779 - DNA, 25 bp, Mus musculus
atcttggaagctctcgtgtgtctga

SEQ ID NO: 251780 - DNA, 25 bp, Mus musculus
atcttggaagctgtcgtgtgtctga

SEQ ID NO: 251781 - DNA, 25 bp, Mus musculus
atcttggacatgaatgcgcgcgtgt

SEQ ID NO: 251782 - DNA, 25 bp, Mus musculus
atcttggacatgtatgcgcgcgtgt

SEQ ID NO: 251783 - DNA, 25 bp, Mus musculus
atcttggaccacaacacgcgcctag

SEQ ID NO: 251784 - DNA, 25 bp, Mus musculus
atcttggaccactacacgcgcctag

SEQ ID NO: 251785 - DNA, 25 bp, Mus musculus
atcttggacctgcagatcgccctgg

SEQ ID NO: 251786 - DNA, 25 bp, Mus musculus
atcttggacctggagatcgccctgg

SEQ ID NO: 251787 - DNA, 25 bp, Mus musculus
atcttggagtaacagcagttctact

SEQ ID NO: 251788 - DNA, 25 bp, Mus musculus
atcttggagtaagagcagttctact

SEQ ID NO: 251789 - DNA, 25 bp, Mus musculus
atcttggatctgatggagctgctgt

SEQ ID NO: 251790 - DNA, 25 bp, Mus musculus
atcttggatctgttggagctgctgt

SEQ ID NO: 251791 - DNA, 25 bp, Mus musculus
atcttggatttcattgctttattca

SEQ ID NO: 251792 - DNA, 25 bp, Mus musculus
atcttggatttctttgctttattca

SEQ ID NO: 251793 - DNA, 25 bp, Mus musculus
atcttggcattcatgattttataga

SEQ ID NO: 251794 - DNA, 25 bp, Mus musculus
atcttggcattcttgattttataga

SEQ ID NO: 251795 - DNA, 25 bp, Mus musculus
atcttggcatttattcctatgaaag

SEQ ID NO: 251796 - DNA, 25 bp, Mus musculus
atcttggcattttttcctatgaaag

SEQ ID NO: 251797 - DNA, 25 bp, Mus musculus
atcttggccaggaccagcagcccag

SEQ ID NO: 251798 - DNA, 25 bp, Mus musculus
atcttggccaggtccagcagcccag

SEQ ID NO: 251799 - DNA, 25 bp, Mus musculus
atcttggcccgtcatacctagcgct

SEQ ID NO: 251800 - DNA, 25 bp, Mus musculus
atcttggcccgtgatacctagcgct

SEQ ID NO: 251801 - DNA, 25 bp, Mus musculus
atcttggccgatcagacctgagaca

SEQ ID NO: 251802 - DNA, 25 bp, Mus musculus
atcttggccgatgagacctgagaca

SEQ ID NO: 251803 - DNA, 25 bp, Mus musculus
atcttggcctccactaacaaagtga

SEQ ID NO: 251804 - DNA, 25 bp, Mus musculus
atcttggcctcctctaacaaagtga

SEQ ID NO: 251805 - DNA, 25 bp, Mus musculus
atcttggcctgaaagcagatttgga

SEQ ID NO: 251806 - DNA, 25 bp, Mus musculus
atcttggcctgatagcagatttgga

SEQ ID NO: 251807 - DNA, 25 bp, Mus musculus
atcttggccttaagcctccttgtat

SEQ ID NO: 251808 - DNA, 25 bp, Mus musculus
atcttggccttatgcctccttgtat

SEQ ID NO: 251809 - DNA, 25 bp, Mus musculus
atcttggccttcatcttcagagaac

SEQ ID NO: 251810 - DNA, 25 bp, Mus musculus
atcttggccttcttcttcagagaac

SEQ ID NO: 251811 - DNA, 25 bp, Mus musculus
atcttggcgaacagtcccttaccgt

SEQ ID NO: 251812 - DNA, 25 bp, Mus musculus
atcttggcgaactgtcccttaccgt

SEQ ID NO: 251813 - DNA, 25 bp, Mus musculus
atcttggctactcaaaggctcctgg

SEQ ID NO: 251814 - DNA, 25 bp, Mus musculus
atcttggctactgaaaggctcctgg

SEQ ID NO: 251815 - DNA, 25 bp, Mus musculus
atcttggctgtcatcattggcatca

SEQ ID NO: 251816 - DNA, 25 bp, Mus musculus
atcttggctgtcttcattggcatca

SEQ ID NO: 251817 - DNA, 25 bp, Mus musculus
atcttgggataaacggcagcacctc

SEQ ID NO: 251818 - DNA, 25 bp, Mus musculus
atcttgggataatcggcagcacctc

SEQ ID NO: 251819 - DNA, 25 bp, Mus musculus
atcttgggcatgaccagtctggagc

SEQ ID NO: 251820 - DNA, 25 bp, Mus musculus
atcttgggcatgtccagtctggagc

SEQ ID NO: 251821 - DNA, 25 bp, Mus musculus
atcttgggcattctgatgtcacctc

SEQ ID NO: 251822 - DNA, 25 bp, Mus musculus
atcttgggcattgtgatgtcacctc

SEQ ID NO: 251823 - DNA, 25 bp, Mus musculus
atcttgggccaacccatttatatta

SEQ ID NO: 251824 - DNA, 25 bp, Mus musculus
atcttgggccaagccatttatatta

SEQ ID NO: 251825 - DNA, 25 bp, Mus musculus
atcttgggctatctttagttcatta

SEQ ID NO: 251826 - DNA, 25 bp, Mus musculus
atcttgggctatgtttagttcatta

SEQ ID NO: 251827 - DNA, 25 bp, Mus musculus
atcttgggtatgcatgaactttctg

SEQ ID NO: 251828 - DNA, 25 bp, Mus musculus
atcttgggtatggatgaactttctg

SEQ ID NO: 251829 - DNA, 25 bp, Mus musculus
atcttgggttagattatatgtgcat

SEQ ID NO: 251830 - DNA, 25 bp, Mus musculus
atcttgggttagtttatatgtgcat

SEQ ID NO: 251831 - DNA, 25 bp, Mus musculus
atcttgggttcacgcaccgctggcc

SEQ ID NO: 251832 - DNA, 25 bp, Mus musculus
atcttgggttcaggcaccgctggcc

SEQ ID NO: 251833 - DNA, 25 bp, Mus musculus
atcttgggttgcatagtatcttgtt

SEQ ID NO: 251834 - DNA, 25 bp, Mus musculus
atcttgggttgcttagtatcttgtt

SEQ ID NO: 251835 - DNA, 25 bp, Mus musculus
atcttggtatctcggtactctttct

SEQ ID NO: 251836 - DNA, 25 bp, Mus musculus
atcttggtatctgggtactctttct

SEQ ID NO: 251837 - DNA, 25 bp, Mus musculus
atcttggtcagcactggagtactgc

SEQ ID NO: 251838 - DNA, 25 bp, Mus musculus
atcttggtcagctctggagtactgc

SEQ ID NO: 251839 - DNA, 25 bp, Mus musculus
atcttggtccataacatactttctg

SEQ ID NO: 251840 - DNA, 25 bp, Mus musculus
atcttggtccattacatactttctg

SEQ ID NO: 251841 - DNA, 25 bp, Mus musculus
atcttggtccctagatcaaacctgg

SEQ ID NO: 251842 - DNA, 25 bp, Mus musculus
atcttggtcccttgatcaaacctgg

SEQ ID NO: 251843 - DNA, 25 bp, Mus musculus
atcttggtcgatcacctcatcggga

SEQ ID NO: 251844 - DNA, 25 bp, Mus musculus
atcttggtcgatgacctcatcggga

SEQ ID NO: 251845 - DNA, 25 bp, Mus musculus
atcttggtctctaaaagttacttag

SEQ ID NO: 251846 - DNA, 25 bp, Mus musculus
atcttggtctcttaaagttacttag

SEQ ID NO: 251847 - DNA, 25 bp, Mus musculus
atcttggtctggaccttagtggcta

SEQ ID NO: 251848 - DNA, 25 bp, Mus musculus
atcttggtctggtccttagtggcta

SEQ ID NO: 251849 - DNA, 25 bp, Mus musculus
atcttggtcttcataaccgtggtca

SEQ ID NO: 251850 - DNA, 25 bp, Mus musculus
atcttggtcttcttaaccgtggtca

SEQ ID NO: 251851 - DNA, 25 bp, Mus musculus
atcttggtctttatctcaggtctga

SEQ ID NO: 251852 - DNA, 25 bp, Mus musculus
atcttggtctttttctcaggtctga

SEQ ID NO: 251853 - DNA, 25 bp, Mus musculus
atcttggtgctcaacctgggtatgg

SEQ ID NO: 251854 - DNA, 25 bp, Mus musculus
atcttggtgctctacctgggtatgg

SEQ ID NO: 251855 - DNA, 25 bp, Mus musculus
atcttggtggatctgtgtcactggt

SEQ ID NO: 251856 - DNA, 25 bp, Mus musculus
atcttggtggatgtgtgtcactggt

SEQ ID NO: 251857 - DNA, 25 bp, Mus musculus
atcttggtgtacatattgtgtttca

SEQ ID NO: 251858 - DNA, 25 bp, Mus musculus
atcttggtgtacttattgtgtttca

SEQ ID NO: 251859 - DNA, 25 bp, Mus musculus
atcttggtgtgcagactgagcctaa

SEQ ID NO: 251860 - DNA, 25 bp, Mus musculus
atcttggtgtgctgactgagcctaa

SEQ ID NO: 251861 - DNA, 25 bp, Mus musculus
atcttggttgtaacaggttatgcac

SEQ ID NO: 251862 - DNA, 25 bp, Mus musculus
atcttggttgtatcaggttatgcac

SEQ ID NO: 251863 - DNA, 25 bp, Mus musculus
atcttggtttgcacatatgtcaggt

SEQ ID NO: 251864 - DNA, 25 bp, Mus musculus
atcttggtttgctcatatgtcaggt

SEQ ID NO: 251865 - DNA, 25 bp, Mus musculus
atcttgtaaacaatttggtcctggt

SEQ ID NO: 251866 - DNA, 25 bp, Mus musculus
atcttgtaaacattttggtcctggt

SEQ ID NO: 251867 - DNA, 25 bp, Mus musculus
atcttgtacatgcaaatgcatcttc

SEQ ID NO: 251868 - DNA, 25 bp, Mus musculus
atcttgtacatggaaatgcatcttc

SEQ ID NO: 251869 - DNA, 25 bp, Mus musculus
atcttgtactcgacgctcagcttgt

SEQ ID NO: 251870 - DNA, 25 bp, Mus musculus
atcttgtactcgtcgctcagcttgt

SEQ ID NO: 251871 - DNA, 25 bp, Mus musculus
atcttgtagaagatttgggcaggta

SEQ ID NO: 251872 - DNA, 25 bp, Mus musculus
atcttgtagaagttttgggcaggta

SEQ ID NO: 251873 - DNA, 25 bp, Mus musculus
atcttgtattttcatctagcctcct

SEQ ID NO: 251874 - DNA, 25 bp, Mus musculus
atcttgtattttgatctagcctcct

SEQ ID NO: 251875 - DNA, 25 bp, Mus musculus
atcttgtcaggaagctactcactgc

SEQ ID NO: 251876 - DNA, 25 bp, Mus musculus
atcttgtcaggatgctactcactgc

SEQ ID NO: 251877 - DNA, 25 bp, Mus musculus
atcttgtccaatacggttgtgcctg

SEQ ID NO: 251878 - DNA, 25 bp, Mus musculus
atcttgtccaattcggttgtgcctg

SEQ ID NO: 251879 - DNA, 25 bp, Mus musculus
atcttgtcccttagaggccccacat

SEQ ID NO: 251880 - DNA, 25 bp, Mus musculus
atcttgtccctttgaggccccacat

SEQ ID NO: 251881 - DNA, 25 bp, Mus musculus
atcttgtccgtgaagatgtattgcc

SEQ ID NO: 251882 - DNA, 25 bp, Mus musculus
atcttgtccgtgtagatgtattgcc

SEQ ID NO: 251883 - DNA, 25 bp, Mus musculus
atcttgtcctgtcctgtgtcaaaca

SEQ ID NO: 251884 - DNA, 25 bp, Mus musculus
atcttgtcctgtgctgtgtcaaaca

SEQ ID NO: 251885 - DNA, 25 bp, Mus musculus
atcttgtccttcaatactgtaccct

SEQ ID NO: 251886 - DNA, 25 bp, Mus musculus
atcttgtccttctatactgtaccct

SEQ ID NO: 251887 - DNA, 25 bp, Mus musculus
atcttgtctgctaactgaactcctg

SEQ ID NO: 251888 - DNA, 25 bp, Mus musculus
atcttgtctgcttactgaactcctg

SEQ ID NO: 251889 - DNA, 25 bp, Mus musculus
atcttgtctttaccggtacatcttg

SEQ ID NO: 251890 - DNA, 25 bp, Mus musculus
atcttgtctttagcggtacatcttg

SEQ ID NO: 251891 - DNA, 25 bp, Mus musculus
atcttgtgcatcagacggtcctggt

SEQ ID NO: 251892 - DNA, 25 bp, Mus musculus
atcttgtgcatcctgtcagtctata

SEQ ID NO: 251893 - DNA, 25 bp, Mus musculus
atcttgtgcatcgtgtcagtctata

SEQ ID NO: 251894 - DNA, 25 bp, Mus musculus
atcttgtgcatctgacggtcctggt

SEQ ID NO: 251895 - DNA, 25 bp, Mus musculus
atcttgtggaaacctgatgcctcag

SEQ ID NO: 251896 - DNA, 25 bp, Mus musculus
atcttgtggaaagctgatgcctcag

SEQ ID NO: 251897 - DNA, 25 bp, Mus musculus
atcttgtggaccaatcattcatgag

SEQ ID NO: 251898 - DNA, 25 bp, Mus musculus
atcttgtggacctatcattcatgag

SEQ ID NO: 251899 - DNA, 25 bp, Mus musculus
atcttgtggatccagttcctgtgga

SEQ ID NO: 251900 - DNA, 25 bp, Mus musculus
atcttgtggatcgagttcctgtgga

SEQ ID NO: 251901 - DNA, 25 bp, Mus musculus
atcttgtggcctcacctgtccttct

SEQ ID NO: 251902 - DNA, 25 bp, Mus musculus
atcttgtggcctgacctgtccttct

SEQ ID NO: 251903 - DNA, 25 bp, Mus musculus
atcttgtgggatctcacagccagtt

SEQ ID NO: 251904 - DNA, 25 bp, Mus musculus
atcttgtgggatgtcacagccagtt

SEQ ID NO: 251905 - DNA, 25 bp, Mus musculus
atcttgtgtatgcttcatgggaccc

SEQ ID NO: 251906 - DNA, 25 bp, Mus musculus
atcttgtgtatggttcatgggaccc

SEQ ID NO: 251907 - DNA, 25 bp, Mus musculus
atcttgtgtcgcagaggcggcgcac

SEQ ID NO: 251908 - DNA, 25 bp, Mus musculus
atcttgtgtcgctgaggcggcgcac

SEQ ID NO: 251909 - DNA, 25 bp, Mus musculus
atcttgttaaagaagggcaggtgag

SEQ ID NO: 251910 - DNA, 25 bp, Mus musculus
atcttgttaaagtagggcaggtgag

SEQ ID NO: 251911 - DNA, 25 bp, Mus musculus
atcttgttacctagtatactacatg

SEQ ID NO: 251912 - DNA, 25 bp, Mus musculus
atcttgttaccttgtatactacatg

SEQ ID NO: 251913 - DNA, 25 bp, Mus musculus
atcttgttactcactgtggttcatc

SEQ ID NO: 251914 - DNA, 25 bp, Mus musculus
atcttgttactctctgtggttcatc

SEQ ID NO: 251915 - DNA, 25 bp, Mus musculus
atcttgttatttagcagatcctctg

SEQ ID NO: 251916 - DNA, 25 bp, Mus musculus
atcttgttattttgcagatcctctg

SEQ ID NO: 251917 - DNA, 25 bp, Mus musculus
atcttgttcagactcagtgtgtgca

SEQ ID NO: 251918 - DNA, 25 bp, Mus musculus
atcttgttcagagtcagtgtgtgca

SEQ ID NO: 251919 - DNA, 25 bp, Mus musculus
atcttgttcttgctccttttggtgg

SEQ ID NO: 251920 - DNA, 25 bp, Mus musculus
atcttgttcttggtccttttggtgg

SEQ ID NO: 251921 - DNA, 25 bp, Mus musculus
atcttgtttacaatccatcagctga

SEQ ID NO: 251922 - DNA, 25 bp, Mus musculus
atcttgtttacattccatcagctga

SEQ ID NO: 251923 - DNA, 25 bp, Mus musculus
atcttgtttcctaatcagccattct

SEQ ID NO: 251924 - DNA, 25 bp, Mus musculus
atcttgtttccttatcagccattct

SEQ ID NO: 251925 - DNA, 25 bp, Mus musculus
atcttgtttcttaaatatgataata

SEQ ID NO: 251926 - DNA, 25 bp, Mus musculus
atcttgtttctttaatatgataata

SEQ ID NO: 251927 - DNA, 25 bp, Mus musculus
atcttgtttgtaatgtcccatttgc

SEQ ID NO: 251928 - DNA, 25 bp, Mus musculus
atcttgtttgtattgtcccatttgc

SEQ ID NO: 251929 - DNA, 25 bp, Mus musculus
atcttgtttgttcgcctccatcttg

SEQ ID NO: 251930 - DNA, 25 bp, Mus musculus
atcttgtttgttggcctccatcttg

SEQ ID NO: 251931 - DNA, 25 bp, Mus musculus
atcttgttttcaattgaccatggtg

SEQ ID NO: 251932 - DNA, 25 bp, Mus musculus
atcttgttttcatttgaccatggtg

SEQ ID NO: 251933 - DNA, 25 bp, Mus musculus
atctttaaacatatgggaccacctg

SEQ ID NO: 251934 - DNA, 25 bp, Mus musculus
atctttaaacatttgggaccacctg

SEQ ID NO: 251935 - DNA, 25 bp, Mus musculus
atctttaaattccagcgaggccagc

SEQ ID NO: 251936 - DNA, 25 bp, Mus musculus
atctttaaattcgagcgaggccagc

SEQ ID NO: 251937 - DNA, 25 bp, Mus musculus
atctttaagattcacgctcgctcaa

SEQ ID NO: 251938 - DNA, 25 bp, Mus musculus
atctttaagattgacgctcgctcaa

SEQ ID NO: 251939 - DNA, 25 bp, Mus musculus
atctttaaggttaagctgttcccag

SEQ ID NO: 251940 - DNA, 25 bp, Mus musculus
atctttaaggtttagctgttcccag

SEQ ID NO: 251941 - DNA, 25 bp, Mus musculus
atctttaagtggatgtggtggctaa

SEQ ID NO: 251942 - DNA, 25 bp, Mus musculus
atctttaagtggttgtggtggctaa

SEQ ID NO: 251943 - DNA, 25 bp, Mus musculus
atctttaatccacgccttgaggcac

SEQ ID NO: 251944 - DNA, 25 bp, Mus musculus
atctttaatccaggccttgaggcac

SEQ ID NO: 251945 - DNA, 25 bp, Mus musculus
atctttaatgctataggatctctta

SEQ ID NO: 251946 - DNA, 25 bp, Mus musculus
atctttaatgctttaggatctctta

SEQ ID NO: 251947 - DNA, 25 bp, Mus musculus
atctttaattcacctgtatactgta

SEQ ID NO: 251948 - DNA, 25 bp, Mus musculus
atctttaattcagctgtatactgta

SEQ ID NO: 251949 - DNA, 25 bp, Mus musculus
atctttaattgtcagcaagtcattg

SEQ ID NO: 251950 - DNA, 25 bp, Mus musculus
atctttaattgtgagcaagtcattg

SEQ ID NO: 251951 - DNA, 25 bp, Mus musculus
atctttacacccatgcatgagttgc

SEQ ID NO: 251952 - DNA, 25 bp, Mus musculus
atctttacacccttgcatgagttgc

SEQ ID NO: 251953 - DNA, 25 bp, Mus musculus
atctttacagccatcagccaatcct

SEQ ID NO: 251954 - DNA, 25 bp, Mus musculus
atctttacagccttcagccaatcct

SEQ ID NO: 251955 - DNA, 25 bp, Mus musculus
atctttacatggctgatacctcaaa

SEQ ID NO: 251956 - DNA, 25 bp, Mus musculus
atctttacatgggtgatacctcaaa

SEQ ID NO: 251957 - DNA, 25 bp, Mus musculus
atctttacatttctggttagcccct

SEQ ID NO: 251958 - DNA, 25 bp, Mus musculus
atctttacatttgtggttagcccct

SEQ ID NO: 251959 - DNA, 25 bp, Mus musculus
atctttaccccacgcagttggtctt

SEQ ID NO: 251960 - DNA, 25 bp, Mus musculus
atctttaccccaggcagttggtctt

SEQ ID NO: 251961 - DNA, 25 bp, Mus musculus
atctttacccctacaggatggctaa

SEQ ID NO: 251962 - DNA, 25 bp, Mus musculus
atctttaccccttcaggatggctaa

SEQ ID NO: 251963 - DNA, 25 bp, Mus musculus
atctttaccgccacgtacatgatat

SEQ ID NO: 251964 - DNA, 25 bp, Mus musculus
atctttaccgcctcgtacatgatat

SEQ ID NO: 251965 - DNA, 25 bp, Mus musculus
atctttactaggatggtggcccaca

SEQ ID NO: 251966 - DNA, 25 bp, Mus musculus
atctttactaggttggtggcccaca

SEQ ID NO: 251967 - DNA, 25 bp, Mus musculus
atctttactcatccttgcctttggc

SEQ ID NO: 251968 - DNA, 25 bp, Mus musculus
atctttactcatgcttgcctttggc

SEQ ID NO: 251969 - DNA, 25 bp, Mus musculus
atctttagatctaacgggaagccgg

SEQ ID NO: 251970 - DNA, 25 bp, Mus musculus
atctttagatcttacgggaagccgg

SEQ ID NO: 251971 - DNA, 25 bp, Mus musculus
atctttagcaatcacactgcccttc

SEQ ID NO: 251972 - DNA, 25 bp, Mus musculus
atctttagcaatgacactgcccttc

SEQ ID NO: 251973 - DNA, 25 bp, Mus musculus
atctttagcatgctggttatttggg

SEQ ID NO: 251974 - DNA, 25 bp, Mus musculus
atctttagcatggtggttatttggg

SEQ ID NO: 251975 - DNA, 25 bp, Mus musculus
atctttagcgacaaattcgcccgac

SEQ ID NO: 251976 - DNA, 25 bp, Mus musculus
atctttagcgactaattcgcccgac

SEQ ID NO: 251977 - DNA, 25 bp, Mus musculus
atctttaggaagatgcgggagttcc

SEQ ID NO: 251978 - DNA, 25 bp, Mus musculus
atctttaggaagttgcgggagttcc

SEQ ID NO: 251979 - DNA, 25 bp, Mus musculus
atctttagtttcaaccatagctcaa

SEQ ID NO: 251980 - DNA, 25 bp, Mus musculus
atctttagtttctaccatagctcaa

SEQ ID NO: 251981 - DNA, 25 bp, Mus musculus
atctttataatacatgtgcccctga

SEQ ID NO: 251982 - DNA, 25 bp, Mus musculus
atctttataatagatgtgcccctga

SEQ ID NO: 251983 - DNA, 25 bp, Mus musculus
atctttataccccacactgagtatt

SEQ ID NO: 251984 - DNA, 25 bp, Mus musculus
atctttatacccgacactgagtatt

SEQ ID NO: 251985 - DNA, 25 bp, Mus musculus
atctttatcaacctggatggttttt

SEQ ID NO: 251986 - DNA, 25 bp, Mus musculus
atctttatcaacgtggatggttttt

SEQ ID NO: 251987 - DNA, 25 bp, Mus musculus
atctttatcaagactatagcgccag

SEQ ID NO: 251988 - DNA, 25 bp, Mus musculus
atctttatcaagtctatagcgccag

SEQ ID NO: 251989 - DNA, 25 bp, Mus musculus
atctttatcagccacagtcagttct

SEQ ID NO: 251990 - DNA, 25 bp, Mus musculus
atctttatcagcgacagtcagttct

SEQ ID NO: 251991 - DNA, 25 bp, Mus musculus
atctttatcatcattgccttgcctc

SEQ ID NO: 251992 - DNA, 25 bp, Mus musculus
atctttatcatctttgccttgcctc

SEQ ID NO: 251993 - DNA, 25 bp, Mus musculus
atctttatctcaacaccttctggac

SEQ ID NO: 251994 - DNA, 25 bp, Mus musculus
atctttatctcatcaccttctggac

SEQ ID NO: 251995 - DNA, 25 bp, Mus musculus
atctttatgaatcggtgctagctga

SEQ ID NO: 251996 - DNA, 25 bp, Mus musculus
atctttatgaatgggtgctagctga

SEQ ID NO: 251997 - DNA, 25 bp, Mus musculus
atctttatgatgaaccctggcactg

SEQ ID NO: 251998 - DNA, 25 bp, Mus musculus
atctttatgatgtaccctggcactg

SEQ ID NO: 251999 - DNA, 25 bp, Mus musculus
atctttatgcaccagcattggcgat

SEQ ID NO: 252000 - DNA, 25 bp, Mus musculus
atctttatgcacgagcattggcgat

SEQ ID NO: 252001 - DNA, 25 bp, Mus musculus
atctttatgctgcaactagacttca

SEQ ID NO: 252002 - DNA, 25 bp, Mus musculus
atctttatgctggaactagacttca

SEQ ID NO: 252003 - DNA, 25 bp, Mus musculus
atctttatgttcagggattagactc

SEQ ID NO: 252004 - DNA, 25 bp, Mus musculus
atctttatgttctgggattagactc

SEQ ID NO: 252005 - DNA, 25 bp, Mus musculus
atctttattcacatctccatgcttt

SEQ ID NO: 252006 - DNA, 25 bp, Mus musculus
atctttattcacttctccatgcttt

SEQ ID NO: 252007 - DNA, 25 bp, Mus musculus
atctttattgaacagcattgccaac

SEQ ID NO: 252008 - DNA, 25 bp, Mus musculus
atctttattgaagagcattgccaac

SEQ ID NO: 252009 - DNA, 25 bp, Mus musculus
atctttattgctcttattacggtca

SEQ ID NO: 252010 - DNA, 25 bp, Mus musculus
atctttattgctgttattacggtca

SEQ ID NO: 252011 - DNA, 25 bp, Mus musculus
atctttcaagtactgtactcagcta

SEQ ID NO: 252012 - DNA, 25 bp, Mus musculus
atctttcaagtagtgtactcagcta

SEQ ID NO: 252013 - DNA, 25 bp, Mus musculus
atctttcacctgagcaaacacccaa

SEQ ID NO: 252014 - DNA, 25 bp, Mus musculus
atctttcacctgtgcaaacacccaa

SEQ ID NO: 252015 - DNA, 25 bp, Mus musculus
atctttcacgatacccaagctttac

SEQ ID NO: 252016 - DNA, 25 bp, Mus musculus
atctttcacgattcccaagctttac

SEQ ID NO: 252017 - DNA, 25 bp, Mus musculus
atctttcacttacactgctctcgag

SEQ ID NO: 252018 - DNA, 25 bp, Mus musculus
atctttcacttagactgctctcgag

SEQ ID NO: 252019 - DNA, 25 bp, Mus musculus
atctttcagaaccagtaggcgtgga

SEQ ID NO: 252020 - DNA, 25 bp, Mus musculus
atctttcagaacgagtaggcgtgga

SEQ ID NO: 252021 - DNA, 25 bp, Mus musculus
atctttcaggagctgccctttgccc

SEQ ID NO: 252022 - DNA, 25 bp, Mus musculus
atctttcaggaggtgccctttgccc

SEQ ID NO: 252023 - DNA, 25 bp, Mus musculus
atctttcagtaccttcctttaatag

SEQ ID NO: 252024 - DNA, 25 bp, Mus musculus
atctttcagtacgttcctttaatag

SEQ ID NO: 252025 - DNA, 25 bp, Mus musculus
atctttcagtgccttcttcttgtaa

SEQ ID NO: 252026 - DNA, 25 bp, Mus musculus
atctttcagtgcgttcttcttgtaa

SEQ ID NO: 252027 - DNA, 25 bp, Mus musculus
atctttcatccaactagcatctatc

SEQ ID NO: 252028 - DNA, 25 bp, Mus musculus
atctttcatccatctagcatctatc

SEQ ID NO: 252029 - DNA, 25 bp, Mus musculus
atctttcatctcctttcctataggt

SEQ ID NO: 252030 - DNA, 25 bp, Mus musculus
atctttcatctcgtttcctataggt

SEQ ID NO: 252031 - DNA, 25 bp, Mus musculus
atctttcatcttctaccatctcttc

SEQ ID NO: 252032 - DNA, 25 bp, Mus musculus
atctttcatcttgtaccatctcttc

SEQ ID NO: 252033 - DNA, 25 bp, Mus musculus
atctttcatttccactgtagacaac

SEQ ID NO: 252034 - DNA, 25 bp, Mus musculus
atctttcatttcgactgtagacaac

SEQ ID NO: 252035 - DNA, 25 bp, Mus musculus
atctttcatttgatggttcagtgta

SEQ ID NO: 252036 - DNA, 25 bp, Mus musculus
atctttcatttgttggttcagtgta

SEQ ID NO: 252037 - DNA, 25 bp, Mus musculus
atctttccaaagatgatgtgccaca

SEQ ID NO: 252038 - DNA, 25 bp, Mus musculus
atctttccaaagttgatgtgccaca

SEQ ID NO: 252039 - DNA, 25 bp, Mus musculus
atctttccaataccactccatctca

SEQ ID NO: 252040 - DNA, 25 bp, Mus musculus
atctttccaatagcactccatctca

SEQ ID NO: 252041 - DNA, 25 bp, Mus musculus
atctttccagacacttatgtaaggg

SEQ ID NO: 252042 - DNA, 25 bp, Mus musculus
atctttccagactcttatgtaaggg

SEQ ID NO: 252043 - DNA, 25 bp, Mus musculus
atctttccagcacttgccaacctgt

SEQ ID NO: 252044 - DNA, 25 bp, Mus musculus
atctttccagcagttgccaacctgt

SEQ ID NO: 252045 - DNA, 25 bp, Mus musculus
atctttccaggcatcttggttctag

SEQ ID NO: 252046 - DNA, 25 bp, Mus musculus
atctttccaggcttcttggttctag

SEQ ID NO: 252047 - DNA, 25 bp, Mus musculus
atctttccaggtctggctctctgag

SEQ ID NO: 252048 - DNA, 25 bp, Mus musculus
atctttccaggtgtggctctctgag

SEQ ID NO: 252049 - DNA, 25 bp, Mus musculus
atctttccatggcaacgggacagag

SEQ ID NO: 252050 - DNA, 25 bp, Mus musculus
atctttccatgggaacgggacagag

SEQ ID NO: 252051 - DNA, 25 bp, Mus musculus
atctttcccagaaatcatatatgaa

SEQ ID NO: 252052 - DNA, 25 bp, Mus musculus
atctttcccagatatcatatatgaa

SEQ ID NO: 252053 - DNA, 25 bp, Mus musculus
atctttccctagagacccgaggcta

SEQ ID NO: 252054 - DNA, 25 bp, Mus musculus
atctttccctagtgacccgaggcta

SEQ ID NO: 252055 - DNA, 25 bp, Mus musculus
atctttccgaatccccgtgaaggta

SEQ ID NO: 252056 - DNA, 25 bp, Mus musculus
atctttccgaatgcccgtgaaggta

SEQ ID NO: 252057 - DNA, 25 bp, Mus musculus
atctttccgagcaagcgtgtgtgga

SEQ ID NO: 252058 - DNA, 25 bp, Mus musculus
atctttccgagctagcgtgtgtgga

SEQ ID NO: 252059 - DNA, 25 bp, Mus musculus
atctttccgctacactgtttcttcg

SEQ ID NO: 252060 - DNA, 25 bp, Mus musculus
atctttccgctagactgtttcttcg

SEQ ID NO: 252061 - DNA, 25 bp, Mus musculus
atctttccggtgacaaaggcttcca

SEQ ID NO: 252062 - DNA, 25 bp, Mus musculus
atctttccggtgtcaaaggcttcca

SEQ ID NO: 252063 - DNA, 25 bp, Mus musculus
atctttcctgctccagatgttgaca

SEQ ID NO: 252064 - DNA, 25 bp, Mus musculus
atctttcctgctgcagatgttgaca

SEQ ID NO: 252065 - DNA, 25 bp, Mus musculus
atctttcctgtgcacaagagccgaa

SEQ ID NO: 252066 - DNA, 25 bp, Mus musculus
atctttcctgtggacaagagccgaa

SEQ ID NO: 252067 - DNA, 25 bp, Mus musculus
atctttccttacctctatgtgccat

SEQ ID NO: 252068 - DNA, 25 bp, Mus musculus
atctttccttacgtctatgtgccat

SEQ ID NO: 252069 - DNA, 25 bp, Mus musculus
atctttcctttaattctcacctcgg

SEQ ID NO: 252070 - DNA, 25 bp, Mus musculus
atctttcctttatttctcacctcgg

SEQ ID NO: 252071 - DNA, 25 bp, Mus musculus
atctttcgtgcgcttacttacaatc

SEQ ID NO: 252072 - DNA, 25 bp, Mus musculus
atctttcgtgcggttacttacaatc

SEQ ID NO: 252073 - DNA, 25 bp, Mus musculus
atctttctatgaactcatgtctcct

SEQ ID NO: 252074 - DNA, 25 bp, Mus musculus
atctttctatgatctcatgtctcct

SEQ ID NO: 252075 - DNA, 25 bp, Mus musculus
atctttctattaaaagtcaactcta

SEQ ID NO: 252076 - DNA, 25 bp, Mus musculus
atctttctattataagtcaactcta

SEQ ID NO: 252077 - DNA, 25 bp, Mus musculus
atctttctatttccagctgttagcc

SEQ ID NO: 252078 - DNA, 25 bp, Mus musculus
atctttctatttgcagctgttagcc

SEQ ID NO: 252079 - DNA, 25 bp, Mus musculus
atctttctcaacagccatgcactga

SEQ ID NO: 252080 - DNA, 25 bp, Mus musculus
atctttctcaactgccatgcactga

SEQ ID NO: 252081 - DNA, 25 bp, Mus musculus
atctttctcaagcacggcatttcta

SEQ ID NO: 252082 - DNA, 25 bp, Mus musculus
atctttctcaaggacggcatttcta

SEQ ID NO: 252083 - DNA, 25 bp, Mus musculus
atctttctcactagctagttttcac

SEQ ID NO: 252084 - DNA, 25 bp, Mus musculus
atctttctcacttgctagttttcac

SEQ ID NO: 252085 - DNA, 25 bp, Mus musculus
atctttctcattaccatgaaggtaa

SEQ ID NO: 252086 - DNA, 25 bp, Mus musculus
atctttctcatttccatgaaggtaa

SEQ ID NO: 252087 - DNA, 25 bp, Mus musculus
atctttctccagaataatggcttct

SEQ ID NO: 252088 - DNA, 25 bp, Mus musculus
atctttctccagtataatggcttct

SEQ ID NO: 252089 - DNA, 25 bp, Mus musculus
atctttctctacagttgctgcatgc

SEQ ID NO: 252090 - DNA, 25 bp, Mus musculus
atctttctctactgttgctgcatgc

SEQ ID NO: 252091 - DNA, 25 bp, Mus musculus
atctttctcttcaacattgtccgca

SEQ ID NO: 252092 - DNA, 25 bp, Mus musculus
atctttctcttctacattgtccgca

SEQ ID NO: 252093 - DNA, 25 bp, Mus musculus
atctttctcttgacatctacgcaga

SEQ ID NO: 252094 - DNA, 25 bp, Mus musculus
atctttctcttgtcatctacgcaga

SEQ ID NO: 252095 - DNA, 25 bp, Mus musculus
atctttctgaacacacgggttttct

SEQ ID NO: 252096 - DNA, 25 bp, Mus musculus
atctttctgaactcacgggttttct

SEQ ID NO: 252097 - DNA, 25 bp, Mus musculus
atctttctgcacacactcaacaatg

SEQ ID NO: 252098 - DNA, 25 bp, Mus musculus
atctttctgcactcactcaacaatg

SEQ ID NO: 252099 - DNA, 25 bp, Mus musculus
atctttctgcagaagcatctggaca

SEQ ID NO: 252100 - DNA, 25 bp, Mus musculus
atctttctgcagtagcatctggaca

SEQ ID NO: 252101 - DNA, 25 bp, Mus musculus
atctttctgccccagtgtgaaggga

SEQ ID NO: 252102 - DNA, 25 bp, Mus musculus
atctttctgcccgagtgtgaaggga

SEQ ID NO: 252103 - DNA, 25 bp, Mus musculus
atctttctgcctctcaccgggtgtg

SEQ ID NO: 252104 - DNA, 25 bp, Mus musculus
atctttctgcctgtcaccgggtgtg

SEQ ID NO: 252105 - DNA, 25 bp, Mus musculus
atctttctggatcttctgtgtctga

SEQ ID NO: 252106 - DNA, 25 bp, Mus musculus
atctttctggatgttctgtgtctga

SEQ ID NO: 252107 - DNA, 25 bp, Mus musculus
atctttctggcaacaggattcctgg

SEQ ID NO: 252108 - DNA, 25 bp, Mus musculus
atctttctggcatcaggattcctgg

SEQ ID NO: 252109 - DNA, 25 bp, Mus musculus
atctttctgggcagctctaccggga

SEQ ID NO: 252110 - DNA, 25 bp, Mus musculus
atctttctgggctgctctaccggga

SEQ ID NO: 252111 - DNA, 25 bp, Mus musculus
atctttcttaacataaggctcttat

SEQ ID NO: 252112 - DNA, 25 bp, Mus musculus
atctttcttaacttaaggctcttat

SEQ ID NO: 252113 - DNA, 25 bp, Mus musculus
atctttcttatcagagtccacactt

SEQ ID NO: 252114 - DNA, 25 bp, Mus musculus
atctttcttatctgagtccacactt

SEQ ID NO: 252115 - DNA, 25 bp, Mus musculus
atctttcttgataccattgctcttt

SEQ ID NO: 252116 - DNA, 25 bp, Mus musculus
atctttcttgattccattgctcttt

SEQ ID NO: 252117 - DNA, 25 bp, Mus musculus
atctttcttgtacctttggaagtgc

SEQ ID NO: 252118 - DNA, 25 bp, Mus musculus
atctttcttgtagctttggaagtgc

SEQ ID NO: 252119 - DNA, 25 bp, Mus musculus
atctttcttgtgaagtgtaggcctc

SEQ ID NO: 252120 - DNA, 25 bp, Mus musculus
atctttcttgtgctacatggctgtg

SEQ ID NO: 252121 - DNA, 25 bp, Mus musculus
atctttcttgtggtacatggctgtg

SEQ ID NO: 252122 - DNA, 25 bp, Mus musculus
atctttcttgtgtagtgtaggcctc

SEQ ID NO: 252123 - DNA, 25 bp, Mus musculus
atctttctttaccatcatagcccca

SEQ ID NO: 252124 - DNA, 25 bp, Mus musculus
atctttctttacgatcatagcccca

SEQ ID NO: 252125 - DNA, 25 bp, Mus musculus
atctttctttcgatatattgtccta

SEQ ID NO: 252126 - DNA, 25 bp, Mus musculus
atctttctttcgttatattgtccta

SEQ ID NO: 252127 - DNA, 25 bp, Mus musculus
atctttcttttaagcaacccatgtg

SEQ ID NO: 252128 - DNA, 25 bp, Mus musculus
atctttcttttaccatgtttcagtt

SEQ ID NO: 252129 - DNA, 25 bp, Mus musculus
atctttcttttagcatgtttcagtt

SEQ ID NO: 252130 - DNA, 25 bp, Mus musculus
atctttcttttatgcaacccatgtg

SEQ ID NO: 252131 - DNA, 25 bp, Mus musculus
atctttcttttgctgctatgacatg

SEQ ID NO: 252132 - DNA, 25 bp, Mus musculus
atctttcttttggtgctatgacatg

SEQ ID NO: 252133 - DNA, 25 bp, Mus musculus
atctttgaaagacggaggtataatt

SEQ ID NO: 252134 - DNA, 25 bp, Mus musculus
atctttgaaagagggaggtataatt

SEQ ID NO: 252135 - DNA, 25 bp, Mus musculus
atctttgaagatccccgtgtactac

SEQ ID NO: 252136 - DNA, 25 bp, Mus musculus
atctttgaagatctgatgatgtcat

SEQ ID NO: 252137 - DNA, 25 bp, Mus musculus
atctttgaagatgcccgtgtactac

SEQ ID NO: 252138 - DNA, 25 bp, Mus musculus
atctttgaagatgtgatgatgtcat

SEQ ID NO: 252139 - DNA, 25 bp, Mus musculus
atctttgaatggcatctcttgccag

SEQ ID NO: 252140 - DNA, 25 bp, Mus musculus
atctttgaatgggatctcttgccag

SEQ ID NO: 252141 - DNA, 25 bp, Mus musculus
atctttgacaatcaactcctggagg

SEQ ID NO: 252142 - DNA, 25 bp, Mus musculus
atctttgacaatgaactcctggagg

SEQ ID NO: 252143 - DNA, 25 bp, Mus musculus
atctttgacaccagggccatcacga

SEQ ID NO: 252144 - DNA, 25 bp, Mus musculus
atctttgacacctgggccatcacga

SEQ ID NO: 252145 - DNA, 25 bp, Mus musculus
atctttgacagtcctaggtatggga

SEQ ID NO: 252146 - DNA, 25 bp, Mus musculus
atctttgacagtgctaggtatggga

SEQ ID NO: 252147 - DNA, 25 bp, Mus musculus
atctttgacgacatttctcattatg

SEQ ID NO: 252148 - DNA, 25 bp, Mus musculus
atctttgacgacttttctcattatg

SEQ ID NO: 252149 - DNA, 25 bp, Mus musculus
atctttgagcccatgttcttttttc

SEQ ID NO: 252150 - DNA, 25 bp, Mus musculus
atctttgagcccttgttcttttttc

SEQ ID NO: 252151 - DNA, 25 bp, Mus musculus
atctttgagcggctcattcacctga

SEQ ID NO: 252152 - DNA, 25 bp, Mus musculus
atctttgagcgggtcattcacctga

SEQ ID NO: 252153 - DNA, 25 bp, Mus musculus
atctttgagtaaatcttctggttgt

SEQ ID NO: 252154 - DNA, 25 bp, Mus musculus
atctttgagtaattcttctggttgt

SEQ ID NO: 252155 - DNA, 25 bp, Mus musculus
atctttgagtggcatcctcttcatg

SEQ ID NO: 252156 - DNA, 25 bp, Mus musculus
atctttgagtgggatcctcttcatg

SEQ ID NO: 252157 - DNA, 25 bp, Mus musculus
atctttgatgccaacttccaagtgt

SEQ ID NO: 252158 - DNA, 25 bp, Mus musculus
atctttgatgcctacttccaagtgt

SEQ ID NO: 252159 - DNA, 25 bp, Mus musculus
atctttgattgcacttctacctcag

SEQ ID NO: 252160 - DNA, 25 bp, Mus musculus
atctttgattgctcttctacctcag

SEQ ID NO: 252161 - DNA, 25 bp, Mus musculus
atctttgattgtctggcatccggcc

SEQ ID NO: 252162 - DNA, 25 bp, Mus musculus
atctttgattgtgtggcatccggcc

SEQ ID NO: 252163 - DNA, 25 bp, Mus musculus
atctttgcagacctgatagtcttga

SEQ ID NO: 252164 - DNA, 25 bp, Mus musculus
atctttgcagacgtgatagtcttga

SEQ ID NO: 252165 - DNA, 25 bp, Mus musculus
atctttgcagataccggatccggca

SEQ ID NO: 252166 - DNA, 25 bp, Mus musculus
atctttgcagattccggatccggca

SEQ ID NO: 252167 - DNA, 25 bp, Mus musculus
atctttgcatctaatctggcatcaa

SEQ ID NO: 252168 - DNA, 25 bp, Mus musculus
atctttgcatcttatctggcatcaa

SEQ ID NO: 252169 - DNA, 25 bp, Mus musculus
atctttgccaaccagtagctcatct

SEQ ID NO: 252170 - DNA, 25 bp, Mus musculus
atctttgccaacgagtagctcatct

SEQ ID NO: 252171 - DNA, 25 bp, Mus musculus
atctttgccattctggagcgtgtca

SEQ ID NO: 252172 - DNA, 25 bp, Mus musculus
atctttgccattgtggagcgtgtca

SEQ ID NO: 252173 - DNA, 25 bp, Mus musculus
atctttgcccatatgcttagctgct

SEQ ID NO: 252174 - DNA, 25 bp, Mus musculus
atctttgcccatttgcttagctgct

SEQ ID NO: 252175 - DNA, 25 bp, Mus musculus
atctttgcccggcacagtacgaggt

SEQ ID NO: 252176 - DNA, 25 bp, Mus musculus
atctttgcccgggacagtacgaggt

SEQ ID NO: 252177 - DNA, 25 bp, Mus musculus
atctttgccgaaaaacatgtgatgg

SEQ ID NO: 252178 - DNA, 25 bp, Mus musculus
atctttgccgaataacatgtgatgg

SEQ ID NO: 252179 - DNA, 25 bp, Mus musculus
atctttgcggaaacagcgtcctcct

SEQ ID NO: 252180 - DNA, 25 bp, Mus musculus
atctttgcggaatcagcgtcctcct

SEQ ID NO: 252181 - DNA, 25 bp, Mus musculus
atctttgctcacattgtttgcttcg

SEQ ID NO: 252182 - DNA, 25 bp, Mus musculus
atctttgctcactttgtttgcttcg

SEQ ID NO: 252183 - DNA, 25 bp, Mus musculus
atctttgctgccatactgtgggaga

SEQ ID NO: 252184 - DNA, 25 bp, Mus musculus
atctttgctgccttactgtgggaga

SEQ ID NO: 252185 - DNA, 25 bp, Mus musculus
atctttgctgggatcctatacctca

SEQ ID NO: 252186 - DNA, 25 bp, Mus musculus
atctttgctgggttcctatacctca

SEQ ID NO: 252187 - DNA, 25 bp, Mus musculus
atctttgctgttaactgagagcggg

SEQ ID NO: 252188 - DNA, 25 bp, Mus musculus
atctttgctgttcaccagatgtaat

SEQ ID NO: 252189 - DNA, 25 bp, Mus musculus
atctttgctgttgaccagatgtaat

SEQ ID NO: 252190 - DNA, 25 bp, Mus musculus
atctttgctgtttactgagagcggg

SEQ ID NO: 252191 - DNA, 25 bp, Mus musculus
atctttggacaaaacttcgctctgg

SEQ ID NO: 252192 - DNA, 25 bp, Mus musculus
atctttggacaatacttcgctctgg

SEQ ID NO: 252193 - DNA, 25 bp, Mus musculus
atctttggacgaattgtctggcaca

SEQ ID NO: 252194 - DNA, 25 bp, Mus musculus
atctttggacgatttgtctggcaca

SEQ ID NO: 252195 - DNA, 25 bp, Mus musculus
atctttggactgagcacggcactgg

SEQ ID NO: 252196 - DNA, 25 bp, Mus musculus
atctttggactgtgcacggcactgg

SEQ ID NO: 252197 - DNA, 25 bp, Mus musculus
atctttggagatcctcctctgagag

SEQ ID NO: 252198 - DNA, 25 bp, Mus musculus
atctttggagatgctcctctgagag

SEQ ID NO: 252199 - DNA, 25 bp, Mus musculus
atctttggagcccagtttgtgctga

SEQ ID NO: 252200 - DNA, 25 bp, Mus musculus
atctttggagccgagtttgtgctga

SEQ ID NO: 252201 - DNA, 25 bp, Mus musculus
atctttggagtcagatcttccccat

SEQ ID NO: 252202 - DNA, 25 bp, Mus musculus
atctttggagtctgatcttccccat

SEQ ID NO: 252203 - DNA, 25 bp, Mus musculus
atctttggagtgattcctctcaaca

SEQ ID NO: 252204 - DNA, 25 bp, Mus musculus
atctttggagtgtttcctctcaaca

SEQ ID NO: 252205 - DNA, 25 bp, Mus musculus
atctttggatacctaccctgtggat

SEQ ID NO: 252206 - DNA, 25 bp, Mus musculus
atctttggatacgtaccctgtggat

SEQ ID NO: 252207 - DNA, 25 bp, Mus musculus
atctttggcctaatagtgtggacac

SEQ ID NO: 252208 - DNA, 25 bp, Mus musculus
atctttggcctattagtgtggacac

SEQ ID NO: 252209 - DNA, 25 bp, Mus musculus
atctttggctgtatgggaacacact

SEQ ID NO: 252210 - DNA, 25 bp, Mus musculus
atctttggctgtctctgtgtgaatc

SEQ ID NO: 252211 - DNA, 25 bp, Mus musculus
atctttggctgtgtctgtgtgaatc

SEQ ID NO: 252212 - DNA, 25 bp, Mus musculus
atctttggctgtttgggaacacact

SEQ ID NO: 252213 - DNA, 25 bp, Mus musculus
atctttggctttcgtgtgccagcat

SEQ ID NO: 252214 - DNA, 25 bp, Mus musculus
atctttggctttggtgtgccagcat

SEQ ID NO: 252215 - DNA, 25 bp, Mus musculus
atctttgggaccaccattccaagaa

SEQ ID NO: 252216 - DNA, 25 bp, Mus musculus
atctttgggacctccattccaagaa

SEQ ID NO: 252217 - DNA, 25 bp, Mus musculus
atctttggtggaattctttctcgag

SEQ ID NO: 252218 - DNA, 25 bp, Mus musculus
atctttggtggatttctttctcgag

SEQ ID NO: 252219 - DNA, 25 bp, Mus musculus
atctttggttacctctggttctaca

SEQ ID NO: 252220 - DNA, 25 bp, Mus musculus
atctttggttacgtctggttctaca

SEQ ID NO: 252221 - DNA, 25 bp, Mus musculus
atctttggtttcacattctcccata

SEQ ID NO: 252222 - DNA, 25 bp, Mus musculus
atctttggtttctcattctcccata

SEQ ID NO: 252223 - DNA, 25 bp, Mus musculus
atctttgtacagattgccaacccct

SEQ ID NO: 252224 - DNA, 25 bp, Mus musculus
atctttgtacagtttgccaacccct

SEQ ID NO: 252225 - DNA, 25 bp, Mus musculus
atctttgtatcccaagttgtttcag

SEQ ID NO: 252226 - DNA, 25 bp, Mus musculus
atctttgtatccgaagttgtttcag

SEQ ID NO: 252227 - DNA, 25 bp, Mus musculus
atctttgtatttcgattcagaaccc

SEQ ID NO: 252228 - DNA, 25 bp, Mus musculus
atctttgtatttggattcagaaccc

SEQ ID NO: 252229 - DNA, 25 bp, Mus musculus
atctttgtcactctgttttgtactc

SEQ ID NO: 252230 - DNA, 25 bp, Mus musculus
atctttgtcactgtgttttgtactc

SEQ ID NO: 252231 - DNA, 25 bp, Mus musculus
atctttgtccggagtgggctaccca

SEQ ID NO: 252232 - DNA, 25 bp, Mus musculus
atctttgtccggtgtgggctaccca

SEQ ID NO: 252233 - DNA, 25 bp, Mus musculus
atctttgtcctgatcgttctgagat

SEQ ID NO: 252234 - DNA, 25 bp, Mus musculus
atctttgtcctgttcgttctgagat

SEQ ID NO: 252235 - DNA, 25 bp, Mus musculus
atctttgtccttagagcttgtttgc

SEQ ID NO: 252236 - DNA, 25 bp, Mus musculus
atctttgtcctttgagcttgtttgc

SEQ ID NO: 252237 - DNA, 25 bp, Mus musculus
atctttgtctcccacaccaagtggg

SEQ ID NO: 252238 - DNA, 25 bp, Mus musculus
atctttgtctccgacaccaagtggg

SEQ ID NO: 252239 - DNA, 25 bp, Mus musculus
atctttgtcttgaggtgtgagctcg

SEQ ID NO: 252240 - DNA, 25 bp, Mus musculus
atctttgtcttgtggtgtgagctcg

SEQ ID NO: 252241 - DNA, 25 bp, Mus musculus
atctttgtctttaagttggtgtgtt

SEQ ID NO: 252242 - DNA, 25 bp, Mus musculus
atctttgtcttttagttggtgtgtt

SEQ ID NO: 252243 - DNA, 25 bp, Mus musculus
atctttgtgcaaccagctcccggac

SEQ ID NO: 252244 - DNA, 25 bp, Mus musculus
atctttgtgcaagcagctcccggac

SEQ ID NO: 252245 - DNA, 25 bp, Mus musculus
atctttgtgcctcaacatactgttg

SEQ ID NO: 252246 - DNA, 25 bp, Mus musculus
atctttgtgcctgaacatactgttg

SEQ ID NO: 252247 - DNA, 25 bp, Mus musculus
atctttgtgctaagatccctctgac

SEQ ID NO: 252248 - DNA, 25 bp, Mus musculus
atctttgtgctatgatccctctgac

SEQ ID NO: 252249 - DNA, 25 bp, Mus musculus
atctttgtgcttcaggctgggaacc

SEQ ID NO: 252250 - DNA, 25 bp, Mus musculus
atctttgtgcttgaggctgggaacc

SEQ ID NO: 252251 - DNA, 25 bp, Mus musculus
atctttgtggatccatgcacctttg

SEQ ID NO: 252252 - DNA, 25 bp, Mus musculus
atctttgtggatgcatgcacctttg

SEQ ID NO: 252253 - DNA, 25 bp, Mus musculus
atctttgtggctaccttgtcagaaa

SEQ ID NO: 252254 - DNA, 25 bp, Mus musculus
atctttgtggcttccttgtcagaaa

SEQ ID NO: 252255 - DNA, 25 bp, Mus musculus
atctttgtgggtctgatctgggcct

SEQ ID NO: 252256 - DNA, 25 bp, Mus musculus
atctttgtgggtgtgatctgggcct

SEQ ID NO: 252257 - DNA, 25 bp, Mus musculus
atctttgtgtctaattggagagtca

SEQ ID NO: 252258 - DNA, 25 bp, Mus musculus
atctttgtgtcttattggagagtca

SEQ ID NO: 252259 - DNA, 25 bp, Mus musculus
atctttgtgtggaacagctgaccaa

SEQ ID NO: 252260 - DNA, 25 bp, Mus musculus
atctttgtgtggtacagctgaccaa

SEQ ID NO: 252261 - DNA, 25 bp, Mus musculus
atctttgtgtttaccaaccagccaa

SEQ ID NO: 252262 - DNA, 25 bp, Mus musculus
atctttgtgttttccaaccagccaa

SEQ ID NO: 252263 - DNA, 25 bp, Mus musculus
atctttgttcttccctgagtattta

SEQ ID NO: 252264 - DNA, 25 bp, Mus musculus
atctttgttcttgcctgagtattta

SEQ ID NO: 252265 - DNA, 25 bp, Mus musculus
atctttgttttcagcgaacctgtaa

SEQ ID NO: 252266 - DNA, 25 bp, Mus musculus
atctttgttttccactccattttga

SEQ ID NO: 252267 - DNA, 25 bp, Mus musculus
atctttgttttcgactccattttga

SEQ ID NO: 252268 - DNA, 25 bp, Mus musculus
atctttgttttctgcgaacctgtaa

SEQ ID NO: 252269 - DNA, 25 bp, Mus musculus
atcttttaaatgactccattcagag

SEQ ID NO: 252270 - DNA, 25 bp, Mus musculus
atcttttaaatgtctccattcagag

SEQ ID NO: 252271 - DNA, 25 bp, Mus musculus
atcttttaacacattgagcttttgg

SEQ ID NO: 252272 - DNA, 25 bp, Mus musculus
atcttttaacactttgagcttttgg

SEQ ID NO: 252273 - DNA, 25 bp, Mus musculus
atcttttaagtcagtggatctgctg

SEQ ID NO: 252274 - DNA, 25 bp, Mus musculus
atcttttaagtctgtggatctgctg

SEQ ID NO: 252275 - DNA, 25 bp, Mus musculus
atcttttacaaacgctgctaatggg

SEQ ID NO: 252276 - DNA, 25 bp, Mus musculus
atcttttacaaaggctgctaatggg

SEQ ID NO: 252277 - DNA, 25 bp, Mus musculus
atcttttacccaatgaagtctgctt

SEQ ID NO: 252278 - DNA, 25 bp, Mus musculus
atcttttacccattgaagtctgctt

SEQ ID NO: 252279 - DNA, 25 bp, Mus musculus
atcttttacctgagtggttgtccag

SEQ ID NO: 252280 - DNA, 25 bp, Mus musculus
atcttttacctgtgtggttgtccag

SEQ ID NO: 252281 - DNA, 25 bp, Mus musculus
atcttttaggcaatgttgctggagc

SEQ ID NO: 252282 - DNA, 25 bp, Mus musculus
atcttttaggcattgttgctggagc

SEQ ID NO: 252283 - DNA, 25 bp, Mus musculus
atcttttatataacgggttgtcatc

SEQ ID NO: 252284 - DNA, 25 bp, Mus musculus
atcttttatatatcgggttgtcatc

SEQ ID NO: 252285 - DNA, 25 bp, Mus musculus
atcttttatttacccctcctgagtg

SEQ ID NO: 252286 - DNA, 25 bp, Mus musculus
atcttttatttagccctcctgagtg

SEQ ID NO: 252287 - DNA, 25 bp, Mus musculus
atcttttcaccacactgcttggatt

SEQ ID NO: 252288 - DNA, 25 bp, Mus musculus
atcttttcaccagactgcttggatt

SEQ ID NO: 252289 - DNA, 25 bp, Mus musculus
atcttttcactgattttcttcagga

SEQ ID NO: 252290 - DNA, 25 bp, Mus musculus
atcttttcactgtttttcttcagga

SEQ ID NO: 252291 - DNA, 25 bp, Mus musculus
atcttttcagcccaaacagtttatt

SEQ ID NO: 252292 - DNA, 25 bp, Mus musculus
atcttttcagccgaaacagtttatt

SEQ ID NO: 252293 - DNA, 25 bp, Mus musculus
atcttttcagctattggatttgcca

SEQ ID NO: 252294 - DNA, 25 bp, Mus musculus
atcttttcagcttttggatttgcca

SEQ ID NO: 252295 - DNA, 25 bp, Mus musculus
atcttttcagtaacctcagccatct

SEQ ID NO: 252296 - DNA, 25 bp, Mus musculus
atcttttcagtatcctcagccatct

SEQ ID NO: 252297 - DNA, 25 bp, Mus musculus
atcttttcatatacagtccacctct

SEQ ID NO: 252298 - DNA, 25 bp, Mus musculus
atcttttcatattcagtccacctct

SEQ ID NO: 252299 - DNA, 25 bp, Mus musculus
atcttttcattactttctgtagttg

SEQ ID NO: 252300 - DNA, 25 bp, Mus musculus
atcttttcattagtttctgtagttg

SEQ ID NO: 252301 - DNA, 25 bp, Mus musculus
atcttttccagcacccctataatgg

SEQ ID NO: 252302 - DNA, 25 bp, Mus musculus
atcttttccagctcccctataatgg

SEQ ID NO: 252303 - DNA, 25 bp, Mus musculus
atcttttccaggcagcttcacagtg

SEQ ID NO: 252304 - DNA, 25 bp, Mus musculus
atcttttccagggagcttcacagtg

SEQ ID NO: 252305 - DNA, 25 bp, Mus musculus
atcttttccccacatattggtcctt

SEQ ID NO: 252306 - DNA, 25 bp, Mus musculus
atcttttccccagatattggtcctt

SEQ ID NO: 252307 - DNA, 25 bp, Mus musculus
atcttttccttaagctctaagttct

SEQ ID NO: 252308 - DNA, 25 bp, Mus musculus
atcttttccttatgctctaagttct

SEQ ID NO: 252309 - DNA, 25 bp, Mus musculus
atcttttcctttctcacccttgtgt

SEQ ID NO: 252310 - DNA, 25 bp, Mus musculus
atcttttcctttgtcacccttgtgt

SEQ ID NO: 252311 - DNA, 25 bp, Mus musculus
atcttttctactcggcacagaagta

SEQ ID NO: 252312 - DNA, 25 bp, Mus musculus
atcttttctactgggcacagaagta

SEQ ID NO: 252313 - DNA, 25 bp, Mus musculus
atcttttctgatcgtttggcggcca

SEQ ID NO: 252314 - DNA, 25 bp, Mus musculus
atcttttctgatctccgcaggcaaa

SEQ ID NO: 252315 - DNA, 25 bp, Mus musculus
atcttttctgatggtttggcggcca

SEQ ID NO: 252316 - DNA, 25 bp, Mus musculus
atcttttctgatgtccgcaggcaaa

SEQ ID NO: 252317 - DNA, 25 bp, Mus musculus
atcttttctggtactttacagtttg

SEQ ID NO: 252318 - DNA, 25 bp, Mus musculus
atcttttctggttctttacagtttg

SEQ ID NO: 252319 - DNA, 25 bp, Mus musculus
atcttttcttaaattgccttgcctt

SEQ ID NO: 252320 - DNA, 25 bp, Mus musculus
atcttttcttaatttgccttgcctt

SEQ ID NO: 252321 - DNA, 25 bp, Mus musculus
atcttttcttcgcatctctgagtct

SEQ ID NO: 252322 - DNA, 25 bp, Mus musculus
atcttttcttcggatctctgagtct

SEQ ID NO: 252323 - DNA, 25 bp, Mus musculus
atcttttcttgcctgatcaggttgc

SEQ ID NO: 252324 - DNA, 25 bp, Mus musculus
atcttttcttgcgtgatcaggttgc

SEQ ID NO: 252325 - DNA, 25 bp, Mus musculus
atcttttctttaattgttgctgggc

SEQ ID NO: 252326 - DNA, 25 bp, Mus musculus
atcttttctttatttgttgctgggc

SEQ ID NO: 252327 - DNA, 25 bp, Mus musculus
atcttttgactgctagcagctcctc

SEQ ID NO: 252328 - DNA, 25 bp, Mus musculus
atcttttgactggtagcagctcctc

SEQ ID NO: 252329 - DNA, 25 bp, Mus musculus
atcttttgagggaaagtcctcctgg

SEQ ID NO: 252330 - DNA, 25 bp, Mus musculus
atcttttgagggtaagtcctcctgg

SEQ ID NO: 252331 - DNA, 25 bp, Mus musculus
atcttttgccaaacttggccgacca

SEQ ID NO: 252332 - DNA, 25 bp, Mus musculus
atcttttgccaaatgcatgcctgcc

SEQ ID NO: 252333 - DNA, 25 bp, Mus musculus
atcttttgccaatcttggccgacca

SEQ ID NO: 252334 - DNA, 25 bp, Mus musculus
atcttttgccaattgcatgcctgcc

SEQ ID NO: 252335 - DNA, 25 bp, Mus musculus
atcttttggaaaccagctactttct

SEQ ID NO: 252336 - DNA, 25 bp, Mus musculus
atcttttggaaagcagctactttct

SEQ ID NO: 252337 - DNA, 25 bp, Mus musculus
atcttttggtcactaccctccaact

SEQ ID NO: 252338 - DNA, 25 bp, Mus musculus
atcttttggtcagtaccctccaact

SEQ ID NO: 252339 - DNA, 25 bp, Mus musculus
atcttttgtatccacctctgtgtct

SEQ ID NO: 252340 - DNA, 25 bp, Mus musculus
atcttttgtatcgacctctgtgtct

SEQ ID NO: 252341 - DNA, 25 bp, Mus musculus
atcttttgtctaaaggtgctgcagt

SEQ ID NO: 252342 - DNA, 25 bp, Mus musculus
atcttttgtctataggtgctgcagt

SEQ ID NO: 252343 - DNA, 25 bp, Mus musculus
atcttttgtgccacaattcctccat

SEQ ID NO: 252344 - DNA, 25 bp, Mus musculus
atcttttgtgcctcaattcctccat

SEQ ID NO: 252345 - DNA, 25 bp, Mus musculus
atctttttaactacaccggcatatc

SEQ ID NO: 252346 - DNA, 25 bp, Mus musculus
atctttttaacttcaccggcatatc

SEQ ID NO: 252347 - DNA, 25 bp, Mus musculus
atctttttagagaaacagctactgt

SEQ ID NO: 252348 - DNA, 25 bp, Mus musculus
atctttttagagtaacagctactgt

SEQ ID NO: 252349 - DNA, 25 bp, Mus musculus
atctttttagtaccatcctctcaac

SEQ ID NO: 252350 - DNA, 25 bp, Mus musculus
atctttttagtagcatcctctcaac

SEQ ID NO: 252351 - DNA, 25 bp, Mus musculus
atctttttatacatcctgtcatttc

SEQ ID NO: 252352 - DNA, 25 bp, Mus musculus
atctttttatacttcctgtcatttc

SEQ ID NO: 252353 - DNA, 25 bp, Mus musculus
atctttttcaaaagccagactgtgg

SEQ ID NO: 252354 - DNA, 25 bp, Mus musculus
atctttttcaaatgccagactgtgg

SEQ ID NO: 252355 - DNA, 25 bp, Mus musculus
atctttttcactattttgtcaacct

SEQ ID NO: 252356 - DNA, 25 bp, Mus musculus
atctttttcacttttttgtcaacct

SEQ ID NO: 252357 - DNA, 25 bp, Mus musculus
atctttttcatccggcttcacgaca

SEQ ID NO: 252358 - DNA, 25 bp, Mus musculus
atctttttcatcgggcttcacgaca

SEQ ID NO: 252359 - DNA, 25 bp, Mus musculus
atctttttcatgctttgctctgtgg

SEQ ID NO: 252360 - DNA, 25 bp, Mus musculus
atctttttcatggtttgctctgtgg

SEQ ID NO: 252361 - DNA, 25 bp, Mus musculus
atctttttgctccattctggtgaag

SEQ ID NO: 252362 - DNA, 25 bp, Mus musculus
atctttttgctccttttccatgttg

SEQ ID NO: 252363 - DNA, 25 bp, Mus musculus
atctttttgctcgattctggtgaag

SEQ ID NO: 252364 - DNA, 25 bp, Mus musculus
atctttttgctcgttttccatgttg

SEQ ID NO: 252365 - DNA, 25 bp, Mus musculus
atctttttggtgcttcctaactcaa

SEQ ID NO: 252366 - DNA, 25 bp, Mus musculus
atctttttggtggttcctaactcaa

SEQ ID NO: 252367 - DNA, 25 bp, Mus musculus
atctttttgtggatcaagtttgagt

SEQ ID NO: 252368 - DNA, 25 bp, Mus musculus
atctttttgtggttcaagtttgagt

SEQ ID NO: 252369 - DNA, 25 bp, Mus musculus
atcttttttatgacatgtgcttgca

SEQ ID NO: 252370 - DNA, 25 bp, Mus musculus
atcttttttatgctcgggctgcctg

SEQ ID NO: 252371 - DNA, 25 bp, Mus musculus
atcttttttatggtcgggctgcctg

SEQ ID NO: 252372 - DNA, 25 bp, Mus musculus
atcttttttatgtcatgtgcttgca

SEQ ID NO: 252373 - DNA, 25 bp, Mus musculus
atcttttttctgacagcgggtcaca

SEQ ID NO: 252374 - DNA, 25 bp, Mus musculus
atcttttttctgtcagcgggtcaca

SEQ ID NO: 252375 - DNA, 25 bp, Mus musculus
atgaaaaaccacacgctgcatctcg

SEQ ID NO: 252376 - DNA, 25 bp, Mus musculus
atgaaaaaccactcgctgcatctcg

SEQ ID NO: 252377 - DNA, 25 bp, Mus musculus
atgaaaaacctcaagtttcttgctt

SEQ ID NO: 252378 - DNA, 25 bp, Mus musculus
atgaaaaacctctagtttcttgctt

SEQ ID NO: 252379 - DNA, 25 bp, Mus musculus
atgaaaaactcacttggacactggg

SEQ ID NO: 252380 - DNA, 25 bp, Mus musculus
atgaaaaactcagttggacactggg

SEQ ID NO: 252381 - DNA, 25 bp, Mus musculus
atgaaaaactctatcacctagcgtt

SEQ ID NO: 252382 - DNA, 25 bp, Mus musculus
atgaaaaactctttcacctagcgtt

SEQ ID NO: 252383 - DNA, 25 bp, Mus musculus
atgaaaaagcccatctcctgtgtcc

SEQ ID NO: 252384 - DNA, 25 bp, Mus musculus
atgaaaaagcccttctcctgtgtcc

SEQ ID NO: 252385 - DNA, 25 bp, Mus musculus
atgaaaaatacacgaggtccaacct

SEQ ID NO: 252386 - DNA, 25 bp, Mus musculus
atgaaaaatacaggaggtccaacct

SEQ ID NO: 252387 - DNA, 25 bp, Mus musculus
atgaaaaattttcgtcacattcttt

SEQ ID NO: 252388 - DNA, 25 bp, Mus musculus
atgaaaaattttggtcacattcttt

SEQ ID NO: 252389 - DNA, 25 bp, Mus musculus
atgaaaacacttcgcatcctcctac

SEQ ID NO: 252390 - DNA, 25 bp, Mus musculus
atgaaaacacttggcatcctcctac

SEQ ID NO: 252391 - DNA, 25 bp, Mus musculus
atgaaaacagagctgcgatcccctc

SEQ ID NO: 252392 - DNA, 25 bp, Mus musculus
atgaaaacagaggtgcgatcccctc

SEQ ID NO: 252393 - DNA, 25 bp, Mus musculus
atgaaaacagttacgctgccacgag

SEQ ID NO: 252394 - DNA, 25 bp, Mus musculus
atgaaaacagtttcgctgccacgag

SEQ ID NO: 252395 - DNA, 25 bp, Mus musculus
atgaaaacatgtcctgcttggccca

SEQ ID NO: 252396 - DNA, 25 bp, Mus musculus
atgaaaacatgtgctgcttggccca

SEQ ID NO: 252397 - DNA, 25 bp, Mus musculus
atgaaaacatttctggccccatgga

SEQ ID NO: 252398 - DNA, 25 bp, Mus musculus
atgaaaacatttgtggccccatgga

SEQ ID NO: 252399 - DNA, 25 bp, Mus musculus
atgaaaacctagactccttcctaga

SEQ ID NO: 252400 - DNA, 25 bp, Mus musculus
atgaaaacctagtctccttcctaga

SEQ ID NO: 252401 - DNA, 25 bp, Mus musculus
atgaaaacggtgcatgcctcccgtg

SEQ ID NO: 252402 - DNA, 25 bp, Mus musculus
atgaaaacggtggatgcctcccgtg

SEQ ID NO: 252403 - DNA, 25 bp, Mus musculus
atgaaaacgtgtcacttggtcaggt

SEQ ID NO: 252404 - DNA, 25 bp, Mus musculus
atgaaaacgtgtgacttggtcaggt

SEQ ID NO: 252405 - DNA, 25 bp, Mus musculus
atgaaaactactagttcttcccatt

SEQ ID NO: 252406 - DNA, 25 bp, Mus musculus
atgaaaactacttgttcttcccatt

SEQ ID NO: 252407 - DNA, 25 bp, Mus musculus
atgaaaactcagctgcacccaatgc

SEQ ID NO: 252408 - DNA, 25 bp, Mus musculus
atgaaaactcaggtgcacccaatgc

SEQ ID NO: 252409 - DNA, 25 bp, Mus musculus
atgaaaactccacctggcacgtggg

SEQ ID NO: 252410 - DNA, 25 bp, Mus musculus
atgaaaactccagctggcacgtggg

SEQ ID NO: 252411 - DNA, 25 bp, Mus musculus
atgaaaactcttaatctgccatggg

SEQ ID NO: 252412 - DNA, 25 bp, Mus musculus
atgaaaactctttatctgccatggg

SEQ ID NO: 252413 - DNA, 25 bp, Mus musculus
atgaaaactgacctccagcaaggga

SEQ ID NO: 252414 - DNA, 25 bp, Mus musculus
atgaaaactgacgtccagcaaggga

SEQ ID NO: 252415 - DNA, 25 bp, Mus musculus
atgaaaactgtacgacacccggcgt

SEQ ID NO: 252416 - DNA, 25 bp, Mus musculus
atgaaaactgtaggacacccggcgt

SEQ ID NO: 252417 - DNA, 25 bp, Mus musculus
atgaaaagacacctcttagcctctc

SEQ ID NO: 252418 - DNA, 25 bp, Mus musculus
atgaaaagacacgtcttagcctctc

SEQ ID NO: 252419 - DNA, 25 bp, Mus musculus
atgaaaagccggaggacgccaagga

SEQ ID NO: 252420 - DNA, 25 bp, Mus musculus
atgaaaagccggtggacgccaagga

SEQ ID NO: 252421 - DNA, 25 bp, Mus musculus
atgaaaaggatcatccgaccccaca

SEQ ID NO: 252422 - DNA, 25 bp, Mus musculus
atgaaaaggatcttccgaccccaca

SEQ ID NO: 252423 - DNA, 25 bp, Mus musculus
atgaaaagtattcctatttcccaga

SEQ ID NO: 252424 - DNA, 25 bp, Mus musculus
atgaaaagtattgctatttcccaga

SEQ ID NO: 252425 - DNA, 25 bp, Mus musculus
atgaaaagtgttccaggcgctctcc

SEQ ID NO: 252426 - DNA, 25 bp, Mus musculus
atgaaaagtgttgcaggcgctctcc

SEQ ID NO: 252427 - DNA, 25 bp, Mus musculus
atgaaaagttttagcacacacctga

SEQ ID NO: 252428 - DNA, 25 bp, Mus musculus
atgaaaagtttttgcacacacctga

SEQ ID NO: 252429 - DNA, 25 bp, Mus musculus
atgaaaatcacacttttttctgtaa

SEQ ID NO: 252430 - DNA, 25 bp, Mus musculus
atgaaaatcacagttttttctgtaa

SEQ ID NO: 252431 - DNA, 25 bp, Mus musculus
atgaaaatcaccactgcctgtgctg

SEQ ID NO: 252432 - DNA, 25 bp, Mus musculus
atgaaaatcacctctgcctgtgctg

SEQ ID NO: 252433 - DNA, 25 bp, Mus musculus
atgaaaatcttcacacaatgtgtat

SEQ ID NO: 252434 - DNA, 25 bp, Mus musculus
atgaaaatcttctcacaatgtgtat

SEQ ID NO: 252435 - DNA, 25 bp, Mus musculus
atgaaaatgagacctattgtagcaa

SEQ ID NO: 252436 - DNA, 25 bp, Mus musculus
atgaaaatgagagctattgtagcaa

SEQ ID NO: 252437 - DNA, 25 bp, Mus musculus
atgaaaatttcgcattgctcttgtt

SEQ ID NO: 252438 - DNA, 25 bp, Mus musculus
atgaaaatttcggattgctcttgtt

SEQ ID NO: 252439 - DNA, 25 bp, Mus musculus
atgaaaattttcagtgaggactacc

SEQ ID NO: 252440 - DNA, 25 bp, Mus musculus
atgaaaattttccatctggattgac

SEQ ID NO: 252441 - DNA, 25 bp, Mus musculus
atgaaaattttcgatctggattgac

SEQ ID NO: 252442 - DNA, 25 bp, Mus musculus
atgaaaattttctgtgaggactacc

SEQ ID NO: 252443 - DNA, 25 bp, Mus musculus
atgaaacacagccacgttgctggac

SEQ ID NO: 252444 - DNA, 25 bp, Mus musculus
atgaaacacagcgacgttgctggac

SEQ ID NO: 252445 - DNA, 25 bp, Mus musculus
atgaaacaggacaggcagacctagt

SEQ ID NO: 252446 - DNA, 25 bp, Mus musculus
atgaaacaggactggcagacctagt

SEQ ID NO: 252447 - DNA, 25 bp, Mus musculus
atgaaacatccaaggccagcttctg

SEQ ID NO: 252448 - DNA, 25 bp, Mus musculus
atgaaacatccatggccagcttctg

SEQ ID NO: 252449 - DNA, 25 bp, Mus musculus
atgaaacattcaaggccccacatgg

SEQ ID NO: 252450 - DNA, 25 bp, Mus musculus
atgaaacattcatggccccacatgg

SEQ ID NO: 252451 - DNA, 25 bp, Mus musculus
atgaaaccaagacagctcctgcctt

SEQ ID NO: 252452 - DNA, 25 bp, Mus musculus
atgaaaccaagagagctcctgcctt

SEQ ID NO: 252453 - DNA, 25 bp, Mus musculus
atgaaaccaagcagtggttgtgggt

SEQ ID NO: 252454 - DNA, 25 bp, Mus musculus
atgaaaccaagctgtggttgtgggt

SEQ ID NO: 252455 - DNA, 25 bp, Mus musculus
atgaaaccatctcataccctatggc

SEQ ID NO: 252456 - DNA, 25 bp, Mus musculus
atgaaaccatctgataccctatggc

SEQ ID NO: 252457 - DNA, 25 bp, Mus musculus
atgaaacccacaactggctagttag

SEQ ID NO: 252458 - DNA, 25 bp, Mus musculus
atgaaacccacactgtgcatttagg

SEQ ID NO: 252459 - DNA, 25 bp, Mus musculus
atgaaacccacagtgtgcatttagg

SEQ ID NO: 252460 - DNA, 25 bp, Mus musculus
atgaaacccacatctggctagttag

SEQ ID NO: 252461 - DNA, 25 bp, Mus musculus
atgaaacccagcagtgagtcacctc

SEQ ID NO: 252462 - DNA, 25 bp, Mus musculus
atgaaacccagctgtgagtcacctc

SEQ ID NO: 252463 - DNA, 25 bp, Mus musculus
atgaaacccggtcccaagaatctag

SEQ ID NO: 252464 - DNA, 25 bp, Mus musculus
atgaaacccggtgccaagaatctag

SEQ ID NO: 252465 - DNA, 25 bp, Mus musculus
atgaaaccctcacatccgagcatct

SEQ ID NO: 252466 - DNA, 25 bp, Mus musculus
atgaaaccctcagatccgagcatct

SEQ ID NO: 252467 - DNA, 25 bp, Mus musculus
atgaaaccgaggaggctgcaagccg

SEQ ID NO: 252468 - DNA, 25 bp, Mus musculus
atgaaaccgaggtggctgcaagccg

SEQ ID NO: 252469 - DNA, 25 bp, Mus musculus
atgaaaccgccacttcacggaacta

SEQ ID NO: 252470 - DNA, 25 bp, Mus musculus
atgaaaccgccagttcacggaacta

SEQ ID NO: 252471 - DNA, 25 bp, Mus musculus
atgaaacctggtcgcccagctctat

SEQ ID NO: 252472 - DNA, 25 bp, Mus musculus
atgaaacctggtggcccagctctat

SEQ ID NO: 252473 - DNA, 25 bp, Mus musculus
atgaaacggaataccctcttgcctg

SEQ ID NO: 252474 - DNA, 25 bp, Mus musculus
atgaaacggaattccctcttgcctg

SEQ ID NO: 252475 - DNA, 25 bp, Mus musculus
atgaaacgtcccagattcttcaacc

SEQ ID NO: 252476 - DNA, 25 bp, Mus musculus
atgaaacgtccctgattcttcaacc

SEQ ID NO: 252477 - DNA, 25 bp, Mus musculus
atgaaacgtctccatatatggatac

SEQ ID NO: 252478 - DNA, 25 bp, Mus musculus
atgaaacgtctcgatatatggatac

SEQ ID NO: 252479 - DNA, 25 bp, Mus musculus
atgaaacgttttcttgcaatctgtt

SEQ ID NO: 252480 - DNA, 25 bp, Mus musculus
atgaaacgttttgttgcaatctgtt

SEQ ID NO: 252481 - DNA, 25 bp, Mus musculus
atgaaactcattctctcaccaaagg

SEQ ID NO: 252482 - DNA, 25 bp, Mus musculus
atgaaactcattgtctcaccaaagg

SEQ ID NO: 252483 - DNA, 25 bp, Mus musculus
atgaaactcccgatgcatgctggca

SEQ ID NO: 252484 - DNA, 25 bp, Mus musculus
atgaaactcccgttgcatgctggca

SEQ ID NO: 252485 - DNA, 25 bp, Mus musculus
atgaaactcgcacacagtggctgtg

SEQ ID NO: 252486 - DNA, 25 bp, Mus musculus
atgaaactcgcagacagtggctgtg

SEQ ID NO: 252487 - DNA, 25 bp, Mus musculus
atgaaactctccagtgttgcctctg

SEQ ID NO: 252488 - DNA, 25 bp, Mus musculus
atgaaactctcctgtgttgcctctg

SEQ ID NO: 252489 - DNA, 25 bp, Mus musculus
atgaaactctcgatacttccatggc

SEQ ID NO: 252490 - DNA, 25 bp, Mus musculus
atgaaactctcgttacttccatggc

SEQ ID NO: 252491 - DNA, 25 bp, Mus musculus
atgaaactctttccagtccttgatt

SEQ ID NO: 252492 - DNA, 25 bp, Mus musculus
atgaaactctttgcagtccttgatt

SEQ ID NO: 252493 - DNA, 25 bp, Mus musculus
atgaaactgacaccattctgtatgt

SEQ ID NO: 252494 - DNA, 25 bp, Mus musculus
atgaaactgacagcattctgtatgt

SEQ ID NO: 252495 - DNA, 25 bp, Mus musculus
atgaaactgatgagaactttggtag

SEQ ID NO: 252496 - DNA, 25 bp, Mus musculus
atgaaactgatgtgaactttggtag

SEQ ID NO: 252497 - DNA, 25 bp, Mus musculus
atgaaactgcctattcacgccgtaa

SEQ ID NO: 252498 - DNA, 25 bp, Mus musculus
atgaaactgccttttcacgccgtaa

SEQ ID NO: 252499 - DNA, 25 bp, Mus musculus
atgaaacttgtaccagtgtcctgtt

SEQ ID NO: 252500 - DNA, 25 bp, Mus musculus
atgaaacttgtagcagtgtcctgtt

SEQ ID NO: 252501 - DNA, 25 bp, Mus musculus
atgaaacttgtgacgggcccaaact

SEQ ID NO: 252502 - DNA, 25 bp, Mus musculus
atgaaacttgtgtcgggcccaaact

SEQ ID NO: 252503 - DNA, 25 bp, Mus musculus
atgaaagaactgagccagcatctga

SEQ ID NO: 252504 - DNA, 25 bp, Mus musculus
atgaaagaactgtgccagcatctga

SEQ ID NO: 252505 - DNA, 25 bp, Mus musculus
atgaaagacattaccaccactggcc

SEQ ID NO: 252506 - DNA, 25 bp, Mus musculus
atgaaagacatttccaccactggcc

SEQ ID NO: 252507 - DNA, 25 bp, Mus musculus
atgaaagagagtccccgcatagcct

SEQ ID NO: 252508 - DNA, 25 bp, Mus musculus
atgaaagagagtgcccgcatagcct

SEQ ID NO: 252509 - DNA, 25 bp, Mus musculus
atgaaagagcctcgcgtagcgccac

SEQ ID NO: 252510 - DNA, 25 bp, Mus musculus
atgaaagagcctggcgtagcgccac

SEQ ID NO: 252511 - DNA, 25 bp, Mus musculus
atgaaagcaactctcctgtcctctg

SEQ ID NO: 252512 - DNA, 25 bp, Mus musculus
atgaaagcaactgtcctgtcctctg

SEQ ID NO: 252513 - DNA, 25 bp, Mus musculus
atgaaagcattcagggcaggaactt

SEQ ID NO: 252514 - DNA, 25 bp, Mus musculus
atgaaagcattctgggcaggaactt

SEQ ID NO: 252515 - DNA, 25 bp, Mus musculus
atgaaagccgatatagactcctaat

SEQ ID NO: 252516 - DNA, 25 bp, Mus musculus
atgaaagccgatttagactcctaat

SEQ ID NO: 252517 - DNA, 25 bp, Mus musculus
atgaaagcgtacagttttccaccca

SEQ ID NO: 252518 - DNA, 25 bp, Mus musculus
atgaaagcgtactgttttccaccca

SEQ ID NO: 252519 - DNA, 25 bp, Mus musculus
atgaaagctctacatgccatccgtg

SEQ ID NO: 252520 - DNA, 25 bp, Mus musculus
atgaaagctctagatgccatccgtg

SEQ ID NO: 252521 - DNA, 25 bp, Mus musculus
atgaaagctgtaagacccggcatac

SEQ ID NO: 252522 - DNA, 25 bp, Mus musculus
atgaaagctgtatgacccggcatac

SEQ ID NO: 252523 - DNA, 25 bp, Mus musculus
atgaaagctgttaagttggccccgt

SEQ ID NO: 252524 - DNA, 25 bp, Mus musculus
atgaaagctgtttagttggccccgt

SEQ ID NO: 252525 - DNA, 25 bp, Mus musculus
atgaaagcttctctctgggcccctg

SEQ ID NO: 252526 - DNA, 25 bp, Mus musculus
atgaaagcttctgtctgggcccctg

SEQ ID NO: 252527 - DNA, 25 bp, Mus musculus
atgaaagcttgccattaagtgtcaa

SEQ ID NO: 252528 - DNA, 25 bp, Mus musculus
atgaaagcttgcgattaagtgtcaa

SEQ ID NO: 252529 - DNA, 25 bp, Mus musculus
atgaaaggaccacgaccagtgagat

SEQ ID NO: 252530 - DNA, 25 bp, Mus musculus
atgaaaggaccaggaccagtgagat

SEQ ID NO: 252531 - DNA, 25 bp, Mus musculus
atgaaaggacctccatcagtgtccc

SEQ ID NO: 252532 - DNA, 25 bp, Mus musculus
atgaaaggacctgcatcagtgtccc

SEQ ID NO: 252533 - DNA, 25 bp, Mus musculus
atgaaaggactcagttgggaagctt

SEQ ID NO: 252534 - DNA, 25 bp, Mus musculus
atgaaaggactctgttgggaagctt

SEQ ID NO: 252535 - DNA, 25 bp, Mus musculus
atgaaaggcgatcgcgctcgcagca

SEQ ID NO: 252536 - DNA, 25 bp, Mus musculus
atgaaaggcgatggcgctcgcagca

SEQ ID NO: 252537 - DNA, 25 bp, Mus musculus
atgaaaggcgctcgcacggacgact

SEQ ID NO: 252538 - DNA, 25 bp, Mus musculus
atgaaaggcgctggcacggacgact

SEQ ID NO: 252539 - DNA, 25 bp, Mus musculus
atgaaagggagcaggccgtgcctaa

SEQ ID NO: 252540 - DNA, 25 bp, Mus musculus
atgaaagggagctggccgtgcctaa

SEQ ID NO: 252541 - DNA, 25 bp, Mus musculus
atgaaagggtttctggctccacgga

SEQ ID NO: 252542 - DNA, 25 bp, Mus musculus
atgaaagggtttgtggctccacgga

SEQ ID NO: 252543 - DNA, 25 bp, Mus musculus
atgaaaggtcatagccctctacata

SEQ ID NO: 252544 - DNA, 25 bp, Mus musculus
atgaaaggtcattgccctctacata

SEQ ID NO: 252545 - DNA, 25 bp, Mus musculus
atgaaaggttatacttcctgggcca

SEQ ID NO: 252546 - DNA, 25 bp, Mus musculus
atgaaaggttattcttcctgggcca

SEQ ID NO: 252547 - DNA, 25 bp, Mus musculus
atgaaaggttccctgctccaacagt

SEQ ID NO: 252548 - DNA, 25 bp, Mus musculus
atgaaaggttccgtgctccaacagt

SEQ ID NO: 252549 - DNA, 25 bp, Mus musculus
atgaaaggttctccgtcctgtggtc

SEQ ID NO: 252550 - DNA, 25 bp, Mus musculus
atgaaaggttctgcgtcctgtggtc

SEQ ID NO: 252551 - DNA, 25 bp, Mus musculus
atgaaagtcaccataatcccagaag

SEQ ID NO: 252552 - DNA, 25 bp, Mus musculus
atgaaagtcaccttaatcccagaag

SEQ ID NO: 252553 - DNA, 25 bp, Mus musculus
atgaaagtcagacctgatctgggcc

SEQ ID NO: 252554 - DNA, 25 bp, Mus musculus
atgaaagtcagagctgatctgggcc

SEQ ID NO: 252555 - DNA, 25 bp, Mus musculus
atgaaagtgacgacagctccagtta

SEQ ID NO: 252556 - DNA, 25 bp, Mus musculus
atgaaagtgacgtcagctccagtta

SEQ ID NO: 252557 - DNA, 25 bp, Mus musculus
atgaaagtggacactcgctcttggc

SEQ ID NO: 252558 - DNA, 25 bp, Mus musculus
atgaaagtggactctcgctcttggc

SEQ ID NO: 252559 - DNA, 25 bp, Mus musculus
atgaaagttcatcgtcgctcaccgc

SEQ ID NO: 252560 - DNA, 25 bp, Mus musculus
atgaaagttcatggtcgctcaccgc

SEQ ID NO: 252561 - DNA, 25 bp, Mus musculus
atgaaagttgatatcttttgctttc

SEQ ID NO: 252562 - DNA, 25 bp, Mus musculus
atgaaagttgatttcttttgctttc

SEQ ID NO: 252563 - DNA, 25 bp, Mus musculus
atgaaagttggaacccattccagtt

SEQ ID NO: 252564 - DNA, 25 bp, Mus musculus
atgaaagttggatcccattccagtt

SEQ ID NO: 252565 - DNA, 25 bp, Mus musculus
atgaaataaacgagcgcggactgtc

SEQ ID NO: 252566 - DNA, 25 bp, Mus musculus
atgaaataaacgtgcgcggactgtc

SEQ ID NO: 252567 - DNA, 25 bp, Mus musculus
atgaaataaattcgcgataagtgga

SEQ ID NO: 252568 - DNA, 25 bp, Mus musculus
atgaaataaattggcgataagtgga

SEQ ID NO: 252569 - DNA, 25 bp, Mus musculus
atgaaatagagcacccctaaaccct

SEQ ID NO: 252570 - DNA, 25 bp, Mus musculus
atgaaatagagctcccctaaaccct

SEQ ID NO: 252571 - DNA, 25 bp, Mus musculus
atgaaatataatctggtggccggcc

SEQ ID NO: 252572 - DNA, 25 bp, Mus musculus
atgaaatataatgtggtggccggcc

SEQ ID NO: 252573 - DNA, 25 bp, Mus musculus
atgaaatatcagcttggccgccaag

SEQ ID NO: 252574 - DNA, 25 bp, Mus musculus
atgaaatatcaggttggccgccaag

SEQ ID NO: 252575 - DNA, 25 bp, Mus musculus
atgaaatattgccagtgccaaggtt

SEQ ID NO: 252576 - DNA, 25 bp, Mus musculus
atgaaatattgcgagtgccaaggtt

SEQ ID NO: 252577 - DNA, 25 bp, Mus musculus
atgaaatcaccgcagacgacaggaa

SEQ ID NO: 252578 - DNA, 25 bp, Mus musculus
atgaaatcaccggagacgacaggaa

SEQ ID NO: 252579 - DNA, 25 bp, Mus musculus
atgaaatcatctactaccttgctgg

SEQ ID NO: 252580 - DNA, 25 bp, Mus musculus
atgaaatcatcttctaccttgctgg

SEQ ID NO: 252581 - DNA, 25 bp, Mus musculus
atgaaatcatggacccaggcggctc

SEQ ID NO: 252582 - DNA, 25 bp, Mus musculus
atgaaatcatggtcccaggcggctc

SEQ ID NO: 252583 - DNA, 25 bp, Mus musculus
atgaaatccaaaacatgttcacact

SEQ ID NO: 252584 - DNA, 25 bp, Mus musculus
atgaaatccaaatcatgttcacact

SEQ ID NO: 252585 - DNA, 25 bp, Mus musculus
atgaaatccataatgtacgctattt

SEQ ID NO: 252586 - DNA, 25 bp, Mus musculus
atgaaatccatattgtacgctattt

SEQ ID NO: 252587 - DNA, 25 bp, Mus musculus
atgaaatccattaagtttgagactt

SEQ ID NO: 252588 - DNA, 25 bp, Mus musculus
atgaaatccatttagtttgagactt

SEQ ID NO: 252589 - DNA, 25 bp, Mus musculus
atgaaatcggcgagcctttacctag

SEQ ID NO: 252590 - DNA, 25 bp, Mus musculus
atgaaatcggcgtgcctttacctag

SEQ ID NO: 252591 - DNA, 25 bp, Mus musculus
atgaaatcttgcctcaggaacagaa

SEQ ID NO: 252592 - DNA, 25 bp, Mus musculus
atgaaatcttgcgtcaggaacagaa

SEQ ID NO: 252593 - DNA, 25 bp, Mus musculus
atgaaatctttcattgttgtatgta

SEQ ID NO: 252594 - DNA, 25 bp, Mus musculus
atgaaatctttctttgttgtatgta

SEQ ID NO: 252595 - DNA, 25 bp, Mus musculus
atgaaatgacttagcctctccaggc

SEQ ID NO: 252596 - DNA, 25 bp, Mus musculus
atgaaatgactttgcctctccaggc

SEQ ID NO: 252597 - DNA, 25 bp, Mus musculus
atgaaatgcatgaactccccacaca

SEQ ID NO: 252598 - DNA, 25 bp, Mus musculus
atgaaatgcatgtactccccacaca

SEQ ID NO: 252599 - DNA, 25 bp, Mus musculus
atgaaatggaggaggagctgcctgt

SEQ ID NO: 252600 - DNA, 25 bp, Mus musculus
atgaaatggaggtggagctgcctgt

SEQ ID NO: 252601 - DNA, 25 bp, Mus musculus
atgaaatggccaatccacctaggta

SEQ ID NO: 252602 - DNA, 25 bp, Mus musculus
atgaaatggccattccacctaggta

SEQ ID NO: 252603 - DNA, 25 bp, Mus musculus
atgaaatgtgcaaggctggctggta

SEQ ID NO: 252604 - DNA, 25 bp, Mus musculus
atgaaatgtgcatggctggctggta

SEQ ID NO: 252605 - DNA, 25 bp, Mus musculus
atgaaatgtggaaatgaccctccct

SEQ ID NO: 252606 - DNA, 25 bp, Mus musculus
atgaaatgtggatatgaccctccct

SEQ ID NO: 252607 - DNA, 25 bp, Mus musculus
atgaaattccagaccttgctaacag

SEQ ID NO: 252608 - DNA, 25 bp, Mus musculus
atgaaattccagtccttgctaacag

SEQ ID NO: 252609 - DNA, 25 bp, Mus musculus
atgaaattcggtctgacggcatgaa

SEQ ID NO: 252610 - DNA, 25 bp, Mus musculus
atgaaattcggtgtgacggcatgaa

SEQ ID NO: 252611 - DNA, 25 bp, Mus musculus
atgaaattctcacttccatcaagcc

SEQ ID NO: 252612 - DNA, 25 bp, Mus musculus
atgaaattctcagttccatcaagcc

SEQ ID NO: 252613 - DNA, 25 bp, Mus musculus
atgaaattctgaccccttgatttaa

SEQ ID NO: 252614 - DNA, 25 bp, Mus musculus
atgaaattctgagcccttgatttaa

SEQ ID NO: 252615 - DNA, 25 bp, Mus musculus
atgaaattcttccacaaccactttg

SEQ ID NO: 252616 - DNA, 25 bp, Mus musculus
atgaaattcttcgacaaccactttg

SEQ ID NO: 252617 - DNA, 25 bp, Mus musculus
atgaaattgtacacctgacgcctgt

SEQ ID NO: 252618 - DNA, 25 bp, Mus musculus
atgaaattgtactcctgacgcctgt

SEQ ID NO: 252619 - DNA, 25 bp, Mus musculus
atgaaatttgccactagtatccctc

SEQ ID NO: 252620 - DNA, 25 bp, Mus musculus
atgaaatttgcctctagtatccctc

SEQ ID NO: 252621 - DNA, 25 bp, Mus musculus
atgaacaaacgaagcctgcagcaga

SEQ ID NO: 252622 - DNA, 25 bp, Mus musculus
atgaacaaacgatgcctgcagcaga

SEQ ID NO: 252623 - DNA, 25 bp, Mus musculus
atgaacaaagagatcgaggcggccc

SEQ ID NO: 252624 - DNA, 25 bp, Mus musculus
atgaacaaagagttcgaggcggccc

SEQ ID NO: 252625 - DNA, 25 bp, Mus musculus
atgaacaagcgtatcccggtgattc

SEQ ID NO: 252626 - DNA, 25 bp, Mus musculus
atgaacaagcgtttcccggtgattc

SEQ ID NO: 252627 - DNA, 25 bp, Mus musculus
atgaacaatataacggtcccctaat

SEQ ID NO: 252628 - DNA, 25 bp, Mus musculus
atgaacaatatatcggtcccctaat

SEQ ID NO: 252629 - DNA, 25 bp, Mus musculus
atgaacacaaaacccggcagtcact

SEQ ID NO: 252630 - DNA, 25 bp, Mus musculus
atgaacacaaaagccggcagtcact

SEQ ID NO: 252631 - DNA, 25 bp, Mus musculus
atgaacacatcacctagcaacagaa

SEQ ID NO: 252632 - DNA, 25 bp, Mus musculus
atgaacacatcagctagcaacagaa

SEQ ID NO: 252633 - DNA, 25 bp, Mus musculus
atgaacacatctagccaacatggcc

SEQ ID NO: 252634 - DNA, 25 bp, Mus musculus
atgaacacatcttgccaacatggcc

SEQ ID NO: 252635 - DNA, 25 bp, Mus musculus
atgaacacattaatcctctcttgag

SEQ ID NO: 252636 - DNA, 25 bp, Mus musculus
atgaacacattattcctctcttgag

SEQ ID NO: 252637 - DNA, 25 bp, Mus musculus
atgaacacatttatgactcctgaga

SEQ ID NO: 252638 - DNA, 25 bp, Mus musculus
atgaacacatttttgactcctgaga

SEQ ID NO: 252639 - DNA, 25 bp, Mus musculus
atgaacaccaggaggaggtaatgat

SEQ ID NO: 252640 - DNA, 25 bp, Mus musculus
atgaacaccaggtggaggtaatgat

SEQ ID NO: 252641 - DNA, 25 bp, Mus musculus
atgaacaccgtgatgtctcatgtcc

SEQ ID NO: 252642 - DNA, 25 bp, Mus musculus
atgaacaccgtgttgtctcatgtcc

SEQ ID NO: 252643 - DNA, 25 bp, Mus musculus
atgaacacgcccacgtgccgatgcg

SEQ ID NO: 252644 - DNA, 25 bp, Mus musculus
atgaacacgccctcgtgccgatgcg

SEQ ID NO: 252645 - DNA, 25 bp, Mus musculus
atgaacacgtagagctcagagaatt

SEQ ID NO: 252646 - DNA, 25 bp, Mus musculus
atgaacacgtagtgctcagagaatt

SEQ ID NO: 252647 - DNA, 25 bp, Mus musculus
atgaacactcctcactgaaagatat

SEQ ID NO: 252648 - DNA, 25 bp, Mus musculus
atgaacactcctgactgaaagatat

SEQ ID NO: 252649 - DNA, 25 bp, Mus musculus
atgaacactgcccagacaaatccgc

SEQ ID NO: 252650 - DNA, 25 bp, Mus musculus
atgaacactgccgagacaaatccgc

SEQ ID NO: 252651 - DNA, 25 bp, Mus musculus
atgaacacttggatgctgctgacgt

SEQ ID NO: 252652 - DNA, 25 bp, Mus musculus
atgaacacttggttgctgctgacgt

SEQ ID NO: 252653 - DNA, 25 bp, Mus musculus
atgaacactttcactcagcattaat

SEQ ID NO: 252654 - DNA, 25 bp, Mus musculus
atgaacactttctctcagcattaat

SEQ ID NO: 252655 - DNA, 25 bp, Mus musculus
atgaacagaatcatacacctcgtac

SEQ ID NO: 252656 - DNA, 25 bp, Mus musculus
atgaacagaatcttacacctcgtac

SEQ ID NO: 252657 - DNA, 25 bp, Mus musculus
atgaacagactacatcgaagattct

SEQ ID NO: 252658 - DNA, 25 bp, Mus musculus
atgaacagactagatcgaagattct

SEQ ID NO: 252659 - DNA, 25 bp, Mus musculus
atgaacagatttcctgctcgtttct

SEQ ID NO: 252660 - DNA, 25 bp, Mus musculus
atgaacagatttgctgctcgtttct

SEQ ID NO: 252661 - DNA, 25 bp, Mus musculus
atgaacagctctcggctctgaaagg

SEQ ID NO: 252662 - DNA, 25 bp, Mus musculus
atgaacagctctgggctctgaaagg

SEQ ID NO: 252663 - DNA, 25 bp, Mus musculus
atgaacagctttcactttggactat

SEQ ID NO: 252664 - DNA, 25 bp, Mus musculus
atgaacagctttgactttggactat

SEQ ID NO: 252665 - DNA, 25 bp, Mus musculus
atgaacagtgctacttactccccta

SEQ ID NO: 252666 - DNA, 25 bp, Mus musculus
atgaacagtgcttcttactccccta

SEQ ID NO: 252667 - DNA, 25 bp, Mus musculus
atgaacagtgggattttgtgcacag

SEQ ID NO: 252668 - DNA, 25 bp, Mus musculus
atgaacagtgggtttttgtgcacag

SEQ ID NO: 252669 - DNA, 25 bp, Mus musculus
atgaacagtgtaagcagccccacta

SEQ ID NO: 252670 - DNA, 25 bp, Mus musculus
atgaacagtgtatgcagccccacta

SEQ ID NO: 252671 - DNA, 25 bp, Mus musculus
atgaacagtgttaagacattgagaa

SEQ ID NO: 252672 - DNA, 25 bp, Mus musculus
atgaacagtgtttagacattgagaa

SEQ ID NO: 252673 - DNA, 25 bp, Mus musculus
atgaacagtttcacctgatattccc

SEQ ID NO: 252674 - DNA, 25 bp, Mus musculus
atgaacagtttctcctgatattccc

SEQ ID NO: 252675 - DNA, 25 bp, Mus musculus
atgaacagttttctgcttcagactg

SEQ ID NO: 252676 - DNA, 25 bp, Mus musculus
atgaacagttttgtgcttcagactg

SEQ ID NO: 252677 - DNA, 25 bp, Mus musculus
atgaacatagagactcccagcagga

SEQ ID NO: 252678 - DNA, 25 bp, Mus musculus
atgaacatagagtctcccagcagga

SEQ ID NO: 252679 - DNA, 25 bp, Mus musculus
atgaacatcaacatctaacccgtct

SEQ ID NO: 252680 - DNA, 25 bp, Mus musculus
atgaacatcaacttctaacccgtct

SEQ ID NO: 252681 - DNA, 25 bp, Mus musculus
atgaacatcacaccttgttccctga

SEQ ID NO: 252682 - DNA, 25 bp, Mus musculus
atgaacatcacagcttgttccctga

SEQ ID NO: 252683 - DNA, 25 bp, Mus musculus
atgaacatcagtcccagacgcttca

SEQ ID NO: 252684 - DNA, 25 bp, Mus musculus
atgaacatcagtgccagacgcttca

SEQ ID NO: 252685 - DNA, 25 bp, Mus musculus
atgaacatcgacatttctgccttct

SEQ ID NO: 252686 - DNA, 25 bp, Mus musculus
atgaacatcgacttttctgccttct

SEQ ID NO: 252687 - DNA, 25 bp, Mus musculus
atgaacatctggatgacacaggccc

SEQ ID NO: 252688 - DNA, 25 bp, Mus musculus
atgaacatctggttgacacaggccc

SEQ ID NO: 252689 - DNA, 25 bp, Mus musculus
atgaacatgcccaggtgagtgccgg

SEQ ID NO: 252690 - DNA, 25 bp, Mus musculus
atgaacatgccctggtgagtgccgg

SEQ ID NO: 252691 - DNA, 25 bp, Mus musculus
atgaacatggcaaaaagacacacgt

SEQ ID NO: 252692 - DNA, 25 bp, Mus musculus
atgaacatggcataaagacacacgt

SEQ ID NO: 252693 - DNA, 25 bp, Mus musculus
atgaacattaacatcaccagtgaat

SEQ ID NO: 252694 - DNA, 25 bp, Mus musculus
atgaacattaacttcaccagtgaat

SEQ ID NO: 252695 - DNA, 25 bp, Mus musculus
atgaacattcgcaccacttgtggct

SEQ ID NO: 252696 - DNA, 25 bp, Mus musculus
atgaacattcgctccacttgtggct

SEQ ID NO: 252697 - DNA, 25 bp, Mus musculus
atgaacatttttcggtgacactcaa

SEQ ID NO: 252698 - DNA, 25 bp, Mus musculus
atgaacatttttgggtgacactcaa

SEQ ID NO: 252699 - DNA, 25 bp, Mus musculus
atgaaccaaaacatctgctgctttt

SEQ ID NO: 252700 - DNA, 25 bp, Mus musculus
atgaaccaaaacttctgctgctttt

SEQ ID NO: 252701 - DNA, 25 bp, Mus musculus
atgaaccacaaaaccaagccacaga

SEQ ID NO: 252702 - DNA, 25 bp, Mus musculus
atgaaccacaaatccaagccacaga

SEQ ID NO: 252703 - DNA, 25 bp, Mus musculus
atgaaccaccggcacattgcgagac

SEQ ID NO: 252704 - DNA, 25 bp, Mus musculus
atgaaccaccgggacattgcgagac

SEQ ID NO: 252705 - DNA, 25 bp, Mus musculus
atgaaccactttcatctgccaacgt

SEQ ID NO: 252706 - DNA, 25 bp, Mus musculus
atgaaccactttgatctgccaacgt

SEQ ID NO: 252707 - DNA, 25 bp, Mus musculus
atgaaccagagcactcgtcttcagg

SEQ ID NO: 252708 - DNA, 25 bp, Mus musculus
atgaaccagagctctcgtcttcagg

SEQ ID NO: 252709 - DNA, 25 bp, Mus musculus
atgaaccagcagaccgattaatttg

SEQ ID NO: 252710 - DNA, 25 bp, Mus musculus
atgaaccagcagtccgattaatttg

SEQ ID NO: 252711 - DNA, 25 bp, Mus musculus
atgaaccagggtaccaggttttcag

SEQ ID NO: 252712 - DNA, 25 bp, Mus musculus
atgaaccagggttccaggttttcag

SEQ ID NO: 252713 - DNA, 25 bp, Mus musculus
atgaaccaggtgatgagtgctaaaa

SEQ ID NO: 252714 - DNA, 25 bp, Mus musculus
atgaaccaggtgttgagtgctaaaa

SEQ ID NO: 252715 - DNA, 25 bp, Mus musculus
atgaaccatgccacagttgtttcct

SEQ ID NO: 252716 - DNA, 25 bp, Mus musculus
atgaaccatgcctcagttgtttcct

SEQ ID NO: 252717 - DNA, 25 bp, Mus musculus
atgaaccattgcatgcctgagggac

SEQ ID NO: 252718 - DNA, 25 bp, Mus musculus
atgaaccattgcttgcctgagggac

SEQ ID NO: 252719 - DNA, 25 bp, Mus musculus
atgaaccatttacctgaccttctct

SEQ ID NO: 252720 - DNA, 25 bp, Mus musculus
atgaaccatttagctgaccttctct

SEQ ID NO: 252721 - DNA, 25 bp, Mus musculus
atgaaccatttgaatgatgagccac

SEQ ID NO: 252722 - DNA, 25 bp, Mus musculus
atgaaccatttgtatgatgagccac

SEQ ID NO: 252723 - DNA, 25 bp, Mus musculus
atgaacccacatactcacggaaagg

SEQ ID NO: 252724 - DNA, 25 bp, Mus musculus
atgaacccacattctcacggaaagg

SEQ ID NO: 252725 - DNA, 25 bp, Mus musculus
atgaacccaccgaggatgacaccct

SEQ ID NO: 252726 - DNA, 25 bp, Mus musculus
atgaacccaccgtggatgacaccct

SEQ ID NO: 252727 - DNA, 25 bp, Mus musculus
atgaacccacgactcctttggtgct

SEQ ID NO: 252728 - DNA, 25 bp, Mus musculus
atgaacccacgagtcctttggtgct

SEQ ID NO: 252729 - DNA, 25 bp, Mus musculus
atgaacccagacaagctgtggtgcc

SEQ ID NO: 252730 - DNA, 25 bp, Mus musculus
atgaacccagactagctgtggtgcc

SEQ ID NO: 252731 - DNA, 25 bp, Mus musculus
atgaacccaggcctggtctccggtg

SEQ ID NO: 252732 - DNA, 25 bp, Mus musculus
atgaacccaggcgtggtctccggtg

SEQ ID NO: 252733 - DNA, 25 bp, Mus musculus
atgaacccagggacaaccgcataat

SEQ ID NO: 252734 - DNA, 25 bp, Mus musculus
atgaacccagggtcaaccgcataat

SEQ ID NO: 252735 - DNA, 25 bp, Mus musculus
atgaacccagttcacacaggccttt

SEQ ID NO: 252736 - DNA, 25 bp, Mus musculus
atgaacccagttgacacaggccttt

SEQ ID NO: 252737 - DNA, 25 bp, Mus musculus
atgaaccctcacatccgtgtaggtc

SEQ ID NO: 252738 - DNA, 25 bp, Mus musculus
atgaaccctcacttccgtgtaggtc

SEQ ID NO: 252739 - DNA, 25 bp, Mus musculus
atgaaccctggtctgaagtagatac

SEQ ID NO: 252740 - DNA, 25 bp, Mus musculus
atgaaccctggtgtgaagtagatac

SEQ ID NO: 252741 - DNA, 25 bp, Mus musculus
atgaacccttctaaggccctcaggt

SEQ ID NO: 252742 - DNA, 25 bp, Mus musculus
atgaacccttcttaggccctcaggt

SEQ ID NO: 252743 - DNA, 25 bp, Mus musculus
atgaaccgccgcagggtctgtacga

SEQ ID NO: 252744 - DNA, 25 bp, Mus musculus
atgaaccgccgctgggtctgtacga

SEQ ID NO: 252745 - DNA, 25 bp, Mus musculus
atgaaccggcgcaactatgagaact

SEQ ID NO: 252746 - DNA, 25 bp, Mus musculus
atgaaccggcgctactatgagaact

SEQ ID NO: 252747 - DNA, 25 bp, Mus musculus
atgaaccggcttacccagtgctgaa

SEQ ID NO: 252748 - DNA, 25 bp, Mus musculus
atgaaccggctttcccagtgctgaa

SEQ ID NO: 252749 - DNA, 25 bp, Mus musculus
atgaaccgggtacgcctgttaatga

SEQ ID NO: 252750 - DNA, 25 bp, Mus musculus
atgaaccgggtaggcctgttaatga

SEQ ID NO: 252751 - DNA, 25 bp, Mus musculus
atgaaccgtgccatctatcgagaat

SEQ ID NO: 252752 - DNA, 25 bp, Mus musculus
atgaaccgtgccttctatcgagaat

SEQ ID NO: 252753 - DNA, 25 bp, Mus musculus
atgaacctaccaaagcggacagcta

SEQ ID NO: 252754 - DNA, 25 bp, Mus musculus
atgaacctaccatagcggacagcta

SEQ ID NO: 252755 - DNA, 25 bp, Mus musculus
atgaacctatctaatactccatctg

SEQ ID NO: 252756 - DNA, 25 bp, Mus musculus
atgaacctatcttatactccatctg

SEQ ID NO: 252757 - DNA, 25 bp, Mus musculus
atgaacctatgtatgcccaatccag

SEQ ID NO: 252758 - DNA, 25 bp, Mus musculus
atgaacctatgtttgcccaatccag

SEQ ID NO: 252759 - DNA, 25 bp, Mus musculus
atgaacctctggataactttgaatc

SEQ ID NO: 252760 - DNA, 25 bp, Mus musculus
atgaacctctggttaactttgaatc

SEQ ID NO: 252761 - DNA, 25 bp, Mus musculus
atgaacctgaggcttcttcctggta

SEQ ID NO: 252762 - DNA, 25 bp, Mus musculus
atgaacctgagggttcttcctggta

SEQ ID NO: 252763 - DNA, 25 bp, Mus musculus
atgaacctgatgatggagcctgtcc

SEQ ID NO: 252764 - DNA, 25 bp, Mus musculus
atgaacctgatgttggagcctgtcc

SEQ ID NO: 252765 - DNA, 25 bp, Mus musculus
atgaacctgattagtcttagactgt

SEQ ID NO: 252766 - DNA, 25 bp, Mus musculus
atgaacctgatttgtcttagactgt

SEQ ID NO: 252767 - DNA, 25 bp, Mus musculus
atgaacctgcagcttaaaatgtact

SEQ ID NO: 252768 - DNA, 25 bp, Mus musculus
atgaacctgcaggttaaaatgtact

SEQ ID NO: 252769 - DNA, 25 bp, Mus musculus
atgaacctgccaaaactttcgaaaa

SEQ ID NO: 252770 - DNA, 25 bp, Mus musculus
atgaacctgccataactttcgaaaa

SEQ ID NO: 252771 - DNA, 25 bp, Mus musculus
atgaacctgcttagttgaattcccc

SEQ ID NO: 252772 - DNA, 25 bp, Mus musculus
atgaacctgcttctagcttagagag

SEQ ID NO: 252773 - DNA, 25 bp, Mus musculus
atgaacctgcttgtagcttagagag

SEQ ID NO: 252774 - DNA, 25 bp, Mus musculus
atgaacctgctttgttgaattcccc

SEQ ID NO: 252775 - DNA, 25 bp, Mus musculus
atgaacctgggcctttgcagctcac

SEQ ID NO: 252776 - DNA, 25 bp, Mus musculus
atgaacctgggcgtttgcagctcac

SEQ ID NO: 252777 - DNA, 25 bp, Mus musculus
atgaacctggtcatgtacagctgag

SEQ ID NO: 252778 - DNA, 25 bp, Mus musculus
atgaacctggtcttgtacagctgag

SEQ ID NO: 252779 - DNA, 25 bp, Mus musculus
atgaacctgtacatccccaaattct

SEQ ID NO: 252780 - DNA, 25 bp, Mus musculus
atgaacctgtacttccccaaattct

SEQ ID NO: 252781 - DNA, 25 bp, Mus musculus
atgaacctgtcaatagccgctaagc

SEQ ID NO: 252782 - DNA, 25 bp, Mus musculus
atgaacctgtcattagccgctaagc

SEQ ID NO: 252783 - DNA, 25 bp, Mus musculus
atgaaccttaccattgcctccagag

SEQ ID NO: 252784 - DNA, 25 bp, Mus musculus
atgaaccttacctttgcctccagag

SEQ ID NO: 252785 - DNA, 25 bp, Mus musculus
atgaaccttactcagaagcgactgg

SEQ ID NO: 252786 - DNA, 25 bp, Mus musculus
atgaaccttactgagaagcgactgg

SEQ ID NO: 252787 - DNA, 25 bp, Mus musculus
atgaaccttccgcatgctaatgaag

SEQ ID NO: 252788 - DNA, 25 bp, Mus musculus
atgaaccttccggatgctaatgaag

SEQ ID NO: 252789 - DNA, 25 bp, Mus musculus
atgaaccttggtcgccgtgtagact

SEQ ID NO: 252790 - DNA, 25 bp, Mus musculus
atgaaccttggtggccgtgtagact

SEQ ID NO: 252791 - DNA, 25 bp, Mus musculus
atgaaccttgtcactctttgaagaa

SEQ ID NO: 252792 - DNA, 25 bp, Mus musculus
atgaaccttgtctctctttgaagaa

SEQ ID NO: 252793 - DNA, 25 bp, Mus musculus
atgaaccttgtgattgacgagtgtg

SEQ ID NO: 252794 - DNA, 25 bp, Mus musculus
atgaaccttgtgtttgacgagtgtg

SEQ ID NO: 252795 - DNA, 25 bp, Mus musculus
atgaacctttcaagggctatcccag

SEQ ID NO: 252796 - DNA, 25 bp, Mus musculus
atgaacctttcatgggctatcccag

SEQ ID NO: 252797 - DNA, 25 bp, Mus musculus
atgaacgaacaccagcttgctagaa

SEQ ID NO: 252798 - DNA, 25 bp, Mus musculus
atgaacgaacacgagcttgctagaa

SEQ ID NO: 252799 - DNA, 25 bp, Mus musculus
atgaacgacacactcttttcccact

SEQ ID NO: 252800 - DNA, 25 bp, Mus musculus
atgaacgacacagtcttttcccact

SEQ ID NO: 252801 - DNA, 25 bp, Mus musculus
atgaacgacttcatgcacggtcccc

SEQ ID NO: 252802 - DNA, 25 bp, Mus musculus
atgaacgacttcttgcacggtcccc

SEQ ID NO: 252803 - DNA, 25 bp, Mus musculus
atgaacgagactctctctttgtcct

SEQ ID NO: 252804 - DNA, 25 bp, Mus musculus
atgaacgagactgtctctttgtcct

SEQ ID NO: 252805 - DNA, 25 bp, Mus musculus
atgaacgaggtgatgtatgctgtat

SEQ ID NO: 252806 - DNA, 25 bp, Mus musculus
atgaacgaggtgttgtatgctgtat

SEQ ID NO: 252807 - DNA, 25 bp, Mus musculus
atgaacgatgccctctacaagttgg

SEQ ID NO: 252808 - DNA, 25 bp, Mus musculus
atgaacgatgccgtctacaagttgg

SEQ ID NO: 252809 - DNA, 25 bp, Mus musculus
atgaacgcaaagctgaagtgagact

SEQ ID NO: 252810 - DNA, 25 bp, Mus musculus
atgaacgcaaaggtgaagtgagact

SEQ ID NO: 252811 - DNA, 25 bp, Mus musculus
atgaacgcagaacccttaggaaacg

SEQ ID NO: 252812 - DNA, 25 bp, Mus musculus
atgaacgcagaagccttaggaaacg

SEQ ID NO: 252813 - DNA, 25 bp, Mus musculus
atgaacggcacacatgtgcctgtgg

SEQ ID NO: 252814 - DNA, 25 bp, Mus musculus
atgaacggcacagatgtgcctgtgg

SEQ ID NO: 252815 - DNA, 25 bp, Mus musculus
atgaacggcctgctctcagctgtgc

SEQ ID NO: 252816 - DNA, 25 bp, Mus musculus
atgaacggcctggtctcagctgtgc

SEQ ID NO: 252817 - DNA, 25 bp, Mus musculus
atgaacggtaacactgcttctgagg

SEQ ID NO: 252818 - DNA, 25 bp, Mus musculus
atgaacggtaactctgcttctgagg

SEQ ID NO: 252819 - DNA, 25 bp, Mus musculus
atgaacggtctaacccaggagctgg

SEQ ID NO: 252820 - DNA, 25 bp, Mus musculus
atgaacggtctatcccaggagctgg

SEQ ID NO: 252821 - DNA, 25 bp, Mus musculus
atgaacgtacgcatgtgtggctcat

SEQ ID NO: 252822 - DNA, 25 bp, Mus musculus
atgaacgtacgcttgtgtggctcat

SEQ ID NO: 252823 - DNA, 25 bp, Mus musculus
atgaacgtagagagctcgtcggtta

SEQ ID NO: 252824 - DNA, 25 bp, Mus musculus
atgaacgtagagtgctcgtcggtta

SEQ ID NO: 252825 - DNA, 25 bp, Mus musculus
atgaacgtaggtccccaggtctctt

SEQ ID NO: 252826 - DNA, 25 bp, Mus musculus
atgaacgtaggtgcccaggtctctt

SEQ ID NO: 252827 - DNA, 25 bp, Mus musculus
atgaacgtccatccttcctgtctga

SEQ ID NO: 252828 - DNA, 25 bp, Mus musculus
atgaacgtccatgcttcctgtctga

SEQ ID NO: 252829 - DNA, 25 bp, Mus musculus
atgaacgtttaaccctgtcagcaag

SEQ ID NO: 252830 - DNA, 25 bp, Mus musculus
atgaacgtttaagcctgtcagcaag

SEQ ID NO: 252831 - DNA, 25 bp, Mus musculus
atgaactacctgataatgaccctaa

SEQ ID NO: 252832 - DNA, 25 bp, Mus musculus
atgaactacctgttaatgaccctaa

SEQ ID NO: 252833 - DNA, 25 bp, Mus musculus
atgaactagcctcgcactttttcca

SEQ ID NO: 252834 - DNA, 25 bp, Mus musculus
atgaactagcctggcactttttcca

SEQ ID NO: 252835 - DNA, 25 bp, Mus musculus
atgaactcaattcacttgctcactc

SEQ ID NO: 252836 - DNA, 25 bp, Mus musculus
atgaactcaattgacttgctcactc

SEQ ID NO: 252837 - DNA, 25 bp, Mus musculus
atgaactcagctctaatttccccag

SEQ ID NO: 252838 - DNA, 25 bp, Mus musculus
atgaactcagctgtaatttccccag

SEQ ID NO: 252839 - DNA, 25 bp, Mus musculus
atgaactcaggtccattctggccaa

SEQ ID NO: 252840 - DNA, 25 bp, Mus musculus
atgaactcaggtgcattctggccaa

SEQ ID NO: 252841 - DNA, 25 bp, Mus musculus
atgaactccatgaacttgctttgat

SEQ ID NO: 252842 - DNA, 25 bp, Mus musculus
atgaactccatgtacttgctttgat

SEQ ID NO: 252843 - DNA, 25 bp, Mus musculus
atgaactcccaacgtggctactcca

SEQ ID NO: 252844 - DNA, 25 bp, Mus musculus
atgaactcccaaggtggctactcca

SEQ ID NO: 252845 - DNA, 25 bp, Mus musculus
atgaactccccgcagaagtcttctc

SEQ ID NO: 252846 - DNA, 25 bp, Mus musculus
atgaactccccggagaagtcttctc

SEQ ID NO: 252847 - DNA, 25 bp, Mus musculus
atgaactcctacaaattgtccttgg

SEQ ID NO: 252848 - DNA, 25 bp, Mus musculus
atgaactcctactaattgtccttgg

SEQ ID NO: 252849 - DNA, 25 bp, Mus musculus
atgaactcctagctgaactctccag

SEQ ID NO: 252850 - DNA, 25 bp, Mus musculus
atgaactcctaggtgaactctccag

SEQ ID NO: 252851 - DNA, 25 bp, Mus musculus
atgaactcgcacaagcgcgtcctgt

SEQ ID NO: 252852 - DNA, 25 bp, Mus musculus
atgaactcgcactagcgcgtcctgt

SEQ ID NO: 252853 - DNA, 25 bp, Mus musculus
atgaactcgggtccaaaacacgtgt

SEQ ID NO: 252854 - DNA, 25 bp, Mus musculus
atgaactcgggtgcaaaacacgtgt

SEQ ID NO: 252855 - DNA, 25 bp, Mus musculus
atgaactctctcagcctatcctgag

SEQ ID NO: 252856 - DNA, 25 bp, Mus musculus
atgaactctctctgcctatcctgag

SEQ ID NO: 252857 - DNA, 25 bp, Mus musculus
atgaactctcttcgacttactgcca

SEQ ID NO: 252858 - DNA, 25 bp, Mus musculus
atgaactctcttggacttactgcca

SEQ ID NO: 252859 - DNA, 25 bp, Mus musculus
atgaactctgggagtgactggcatc

SEQ ID NO: 252860 - DNA, 25 bp, Mus musculus
atgaactctgggtgtgactggcatc

SEQ ID NO: 252861 - DNA, 25 bp, Mus musculus
atgaactcttagctgagcacatgtg

SEQ ID NO: 252862 - DNA, 25 bp, Mus musculus
atgaactcttaggtgagcacatgtg

SEQ ID NO: 252863 - DNA, 25 bp, Mus musculus
atgaactcttcgaggaggccgtgga

SEQ ID NO: 252864 - DNA, 25 bp, Mus musculus
atgaactcttcgtggaggccgtgga

SEQ ID NO: 252865 - DNA, 25 bp, Mus musculus
atgaactcttgaatgagctaccgta

SEQ ID NO: 252866 - DNA, 25 bp, Mus musculus
atgaactcttgattgagctaccgta

SEQ ID NO: 252867 - DNA, 25 bp, Mus musculus
atgaactgaatgctgcttgtcccat

SEQ ID NO: 252868 - DNA, 25 bp, Mus musculus
atgaactgaatggtgcttgtcccat

SEQ ID NO: 252869 - DNA, 25 bp, Mus musculus
atgaactgatctctggaccaatgga

SEQ ID NO: 252870 - DNA, 25 bp, Mus musculus
atgaactgatctgtggaccaatgga

SEQ ID NO: 252871 - DNA, 25 bp, Mus musculus
atgaactgatgcctaaatacgcccc

SEQ ID NO: 252872 - DNA, 25 bp, Mus musculus
atgaactgatgcgtaaatacgcccc

SEQ ID NO: 252873 - DNA, 25 bp, Mus musculus
atgaactgcatcctcagtgtttggg

SEQ ID NO: 252874 - DNA, 25 bp, Mus musculus
atgaactgcatcgtcagtgtttggg

SEQ ID NO: 252875 - DNA, 25 bp, Mus musculus
atgaactgccagaaccgttggccac

SEQ ID NO: 252876 - DNA, 25 bp, Mus musculus
atgaactgccagtaccgttggccac

SEQ ID NO: 252877 - DNA, 25 bp, Mus musculus
atgaactggaccaacacccaaggca

SEQ ID NO: 252878 - DNA, 25 bp, Mus musculus
atgaactggacctacacccaaggca

SEQ ID NO: 252879 - DNA, 25 bp, Mus musculus
atgaactgggtgatgctcttctgcg

SEQ ID NO: 252880 - DNA, 25 bp, Mus musculus
atgaactgggtgttgctcttctgcg

SEQ ID NO: 252881 - DNA, 25 bp, Mus musculus
atgaactgtgacagaagagccggca

SEQ ID NO: 252882 - DNA, 25 bp, Mus musculus
atgaactgtgactgaagagccggca

SEQ ID NO: 252883 - DNA, 25 bp, Mus musculus
atgaacttaaggcttcacccttctt

SEQ ID NO: 252884 - DNA, 25 bp, Mus musculus
atgaacttaagggttcacccttctt

SEQ ID NO: 252885 - DNA, 25 bp, Mus musculus
atgaacttcaggatcctgctggagt

SEQ ID NO: 252886 - DNA, 25 bp, Mus musculus
atgaacttcaggttcctgctggagt

SEQ ID NO: 252887 - DNA, 25 bp, Mus musculus
atgaacttcgttcgctgaactccgt

SEQ ID NO: 252888 - DNA, 25 bp, Mus musculus
atgaacttcgttggctgaactccgt

SEQ ID NO: 252889 - DNA, 25 bp, Mus musculus
atgaacttgaccatcttatccaggg

SEQ ID NO: 252890 - DNA, 25 bp, Mus musculus
atgaacttgaccttcttatccaggg

SEQ ID NO: 252891 - DNA, 25 bp, Mus musculus
atgaacttgcaaacatttgtagcat

SEQ ID NO: 252892 - DNA, 25 bp, Mus musculus
atgaacttgcaatcatttgtagcat

SEQ ID NO: 252893 - DNA, 25 bp, Mus musculus
atgaacttgcatcggctactgcttg

SEQ ID NO: 252894 - DNA, 25 bp, Mus musculus
atgaacttgcatgggctactgcttg

SEQ ID NO: 252895 - DNA, 25 bp, Mus musculus
atgaacttggcaactgtggctttcc

SEQ ID NO: 252896 - DNA, 25 bp, Mus musculus
atgaacttggcatctgtggctttcc

SEQ ID NO: 252897 - DNA, 25 bp, Mus musculus
atgaacttggctaggagtgccctca

SEQ ID NO: 252898 - DNA, 25 bp, Mus musculus
atgaacttggcttggagtgccctca

SEQ ID NO: 252899 - DNA, 25 bp, Mus musculus
atgaacttgggcctggtaatgactt

SEQ ID NO: 252900 - DNA, 25 bp, Mus musculus
atgaacttgggcgtggtaatgactt

SEQ ID NO: 252901 - DNA, 25 bp, Mus musculus
atgaacttgtgccaaactccttctg

SEQ ID NO: 252902 - DNA, 25 bp, Mus musculus
atgaacttgtgcgaaactccttctg

SEQ ID NO: 252903 - DNA, 25 bp, Mus musculus
atgaacttgttcctgcttctttgac

SEQ ID NO: 252904 - DNA, 25 bp, Mus musculus
atgaacttgttcgtgcttctttgac

SEQ ID NO: 252905 - DNA, 25 bp, Mus musculus
atgaactttaggctactccactaag

SEQ ID NO: 252906 - DNA, 25 bp, Mus musculus
atgaactttagggtactccactaag

SEQ ID NO: 252907 - DNA, 25 bp, Mus musculus
atgaactttggcatcctgccgagaa

SEQ ID NO: 252908 - DNA, 25 bp, Mus musculus
atgaactttggcttcctgccgagaa

SEQ ID NO: 252909 - DNA, 25 bp, Mus musculus
atgaagaaaaccagcactacccact

SEQ ID NO: 252910 - DNA, 25 bp, Mus musculus
atgaagaaaacctgcactacccact

SEQ ID NO: 252911 - DNA, 25 bp, Mus musculus
atgaagaaatttcttccctgcccct

SEQ ID NO: 252912 - DNA, 25 bp, Mus musculus
atgaagaaatttgttccctgcccct

SEQ ID NO: 252913 - DNA, 25 bp, Mus musculus
atgaagaacgaacgcacgaaaggtc

SEQ ID NO: 252914 - DNA, 25 bp, Mus musculus
atgaagaacgaaggcacgaaaggtc

SEQ ID NO: 252915 - DNA, 25 bp, Mus musculus
atgaagaagagaagccttcaagaga

SEQ ID NO: 252916 - DNA, 25 bp, Mus musculus
atgaagaagagatgccttcaagaga

SEQ ID NO: 252917 - DNA, 25 bp, Mus musculus
atgaagaagcctctagtccagaccc

SEQ ID NO: 252918 - DNA, 25 bp, Mus musculus
atgaagaagcctgtagtccagaccc

SEQ ID NO: 252919 - DNA, 25 bp, Mus musculus
atgaagaagctcctggcctgtgtga

SEQ ID NO: 252920 - DNA, 25 bp, Mus musculus
atgaagaagctcgtggcctgtgtga

SEQ ID NO: 252921 - DNA, 25 bp, Mus musculus
atgaagaaggttctgtcccgcctgg

SEQ ID NO: 252922 - DNA, 25 bp, Mus musculus
atgaagaaggttgtgtcccgcctgg

SEQ ID NO: 252923 - DNA, 25 bp, Mus musculus
atgaagaagttccacgccgacatgc

SEQ ID NO: 252924 - DNA, 25 bp, Mus musculus
atgaagaagttcgacgccgacatgc

SEQ ID NO: 252925 - DNA, 25 bp, Mus musculus
atgaagaatgatcggctcctcctaa

SEQ ID NO: 252926 - DNA, 25 bp, Mus musculus
atgaagaatgatgggctcctcctaa

SEQ ID NO: 252927 - DNA, 25 bp, Mus musculus
atgaagaatgcccatgtcacagacc

SEQ ID NO: 252928 - DNA, 25 bp, Mus musculus
atgaagaatgccgatgtcacagacc

SEQ ID NO: 252929 - DNA, 25 bp, Mus musculus
atgaagacaaatcccaactcccaca

SEQ ID NO: 252930 - DNA, 25 bp, Mus musculus
atgaagacaaatgccaactcccaca

SEQ ID NO: 252931 - DNA, 25 bp, Mus musculus
atgaagacaagcagtcccggctacg

SEQ ID NO: 252932 - DNA, 25 bp, Mus musculus
atgaagacaagctgtcccggctacg

SEQ ID NO: 252933 - DNA, 25 bp, Mus musculus
atgaagacacctagttgcctactgt

SEQ ID NO: 252934 - DNA, 25 bp, Mus musculus
atgaagacaccttgttgcctactgt

SEQ ID NO: 252935 - DNA, 25 bp, Mus musculus
atgaagacagcaccctccttgacgg

SEQ ID NO: 252936 - DNA, 25 bp, Mus musculus
atgaagacagcagcctccttgacgg

SEQ ID NO: 252937 - DNA, 25 bp, Mus musculus
atgaagacaggtcgcctttctttgt

SEQ ID NO: 252938 - DNA, 25 bp, Mus musculus
atgaagacaggtggcctttctttgt

SEQ ID NO: 252939 - DNA, 25 bp, Mus musculus
atgaagacatcaacagtgttgcctc

SEQ ID NO: 252940 - DNA, 25 bp, Mus musculus
atgaagacatcatcagtgttgcctc

SEQ ID NO: 252941 - DNA, 25 bp, Mus musculus
atgaagaccctcaatgcgcatgaac

SEQ ID NO: 252942 - DNA, 25 bp, Mus musculus
atgaagaccctctatgcgcatgaac

SEQ ID NO: 252943 - DNA, 25 bp, Mus musculus
atgaagacctgcatgacctctgtct

SEQ ID NO: 252944 - DNA, 25 bp, Mus musculus
atgaagacctgcttgacctctgtct

SEQ ID NO: 252945 - DNA, 25 bp, Mus musculus
atgaagacctggacagtagcagcca

SEQ ID NO: 252946 - DNA, 25 bp, Mus musculus
atgaagacctggtcagtagcagcca

SEQ ID NO: 252947 - DNA, 25 bp, Mus musculus
atgaagacgctgagcccgtatcggc

SEQ ID NO: 252948 - DNA, 25 bp, Mus musculus
atgaagacgctgtgcccgtatcggc

SEQ ID NO: 252949 - DNA, 25 bp, Mus musculus
atgaagacggagatactggtgcaga

SEQ ID NO: 252950 - DNA, 25 bp, Mus musculus
atgaagacggagttactggtgcaga

SEQ ID NO: 252951 - DNA, 25 bp, Mus musculus
atgaagacgtggaccaggaggctct

SEQ ID NO: 252952 - DNA, 25 bp, Mus musculus
atgaagacgtggtccaggaggctct

SEQ ID NO: 252953 - DNA, 25 bp, Mus musculus
atgaagagagccacgttgaagtcat

SEQ ID NO: 252954 - DNA, 25 bp, Mus musculus
atgaagagagcctcgttgaagtcat

SEQ ID NO: 252955 - DNA, 25 bp, Mus musculus
atgaagagccataccttttcagaag

SEQ ID NO: 252956 - DNA, 25 bp, Mus musculus
atgaagagccattccttttcagaag

SEQ ID NO: 252957 - DNA, 25 bp, Mus musculus
atgaagagtcaccttaccccagtac

SEQ ID NO: 252958 - DNA, 25 bp, Mus musculus
atgaagagtcacgttaccccagtac

SEQ ID NO: 252959 - DNA, 25 bp, Mus musculus
atgaagagtcttagggctccacgcc

SEQ ID NO: 252960 - DNA, 25 bp, Mus musculus
atgaagagtctttgggctccacgcc

SEQ ID NO: 252961 - DNA, 25 bp, Mus musculus
atgaagagtgcaccgtacatacgga

SEQ ID NO: 252962 - DNA, 25 bp, Mus musculus
atgaagagtgcagcgtacatacgga

SEQ ID NO: 252963 - DNA, 25 bp, Mus musculus
atgaagagtgtcatccctggattcc

SEQ ID NO: 252964 - DNA, 25 bp, Mus musculus
atgaagagtgtcttccctggattcc

SEQ ID NO: 252965 - DNA, 25 bp, Mus musculus
atgaagagttctcagcatgcccctc

SEQ ID NO: 252966 - DNA, 25 bp, Mus musculus
atgaagagttctgagcatgcccctc

SEQ ID NO: 252967 - DNA, 25 bp, Mus musculus
atgaagatcaaactgcgaaggtgtt

SEQ ID NO: 252968 - DNA, 25 bp, Mus musculus
atgaagatcaaagtgcgaaggtgtt

SEQ ID NO: 252969 - DNA, 25 bp, Mus musculus
atgaagatcaccagctctaatgtcc

SEQ ID NO: 252970 - DNA, 25 bp, Mus musculus
atgaagatcacctgctctaatgtcc

SEQ ID NO: 252971 - DNA, 25 bp, Mus musculus
atgaagatcccaattcttcccgtcg

SEQ ID NO: 252972 - DNA, 25 bp, Mus musculus
atgaagatcccatttcttcccgtcg

SEQ ID NO: 252973 - DNA, 25 bp, Mus musculus
atgaagatcctgcaacctgggtcag

SEQ ID NO: 252974 - DNA, 25 bp, Mus musculus
atgaagatcctggaacctgggtcag

SEQ ID NO: 252975 - DNA, 25 bp, Mus musculus
atgaagatctggcttcaaactccca

SEQ ID NO: 252976 - DNA, 25 bp, Mus musculus
atgaagatctgggttcaaactccca

SEQ ID NO: 252977 - DNA, 25 bp, Mus musculus
atgaagatgaggacactgcagagga

SEQ ID NO: 252978 - DNA, 25 bp, Mus musculus
atgaagatgaggtcactgcagagga

SEQ ID NO: 252979 - DNA, 25 bp, Mus musculus
atgaagatgcccagatgccagggaa

SEQ ID NO: 252980 - DNA, 25 bp, Mus musculus
atgaagatgccctgatgccagggaa

SEQ ID NO: 252981 - DNA, 25 bp, Mus musculus
atgaagatgccgaacccatggtcac

SEQ ID NO: 252982 - DNA, 25 bp, Mus musculus
atgaagatgccgtacccatggtcac

SEQ ID NO: 252983 - DNA, 25 bp, Mus musculus
atgaagatgtctctgttgcctctgc

SEQ ID NO: 252984 - DNA, 25 bp, Mus musculus
atgaagatgtctgtgttgcctctgc

SEQ ID NO: 252985 - DNA, 25 bp, Mus musculus
atgaagattctcaacccatgtcctt

SEQ ID NO: 252986 - DNA, 25 bp, Mus musculus
atgaagattctctacccatgtcctt

SEQ ID NO: 252987 - DNA, 25 bp, Mus musculus
atgaagattgatcagcttgtgtatg

SEQ ID NO: 252988 - DNA, 25 bp, Mus musculus
atgaagattgatgagcttgtgtatg

SEQ ID NO: 252989 - DNA, 25 bp, Mus musculus
atgaagcaaaataaggtacccctct

SEQ ID NO: 252990 - DNA, 25 bp, Mus musculus
atgaagcaaaattaggtacccctct

SEQ ID NO: 252991 - DNA, 25 bp, Mus musculus
atgaagcaagacattcctcagaggg

SEQ ID NO: 252992 - DNA, 25 bp, Mus musculus
atgaagcaagactttcctcagaggg

SEQ ID NO: 252993 - DNA, 25 bp, Mus musculus
atgaagcaatgccagatcacatctg

SEQ ID NO: 252994 - DNA, 25 bp, Mus musculus
atgaagcaatgcgagatcacatctg

SEQ ID NO: 252995 - DNA, 25 bp, Mus musculus
atgaagcacaccctgatcactgtct

SEQ ID NO: 252996 - DNA, 25 bp, Mus musculus
atgaagcacaccgtgatcactgtct

SEQ ID NO: 252997 - DNA, 25 bp, Mus musculus
atgaagcaccctacagttctacaga

SEQ ID NO: 252998 - DNA, 25 bp, Mus musculus
atgaagcacccttcagttctacaga

SEQ ID NO: 252999 - DNA, 25 bp, Mus musculus
atgaagcacttccatatctctatcc

SEQ ID NO: 253000 - DNA, 25 bp, Mus musculus
atgaagcacttcgatatctctatcc

SEQ ID NO: 253001 - DNA, 25 bp, Mus musculus
atgaagcacttgatgttgatcgtgt

SEQ ID NO: 253002 - DNA, 25 bp, Mus musculus
atgaagcacttgttgttgatcgtgt

SEQ ID NO: 253003 - DNA, 25 bp, Mus musculus
atgaagcagcctcgtgtgtacacat

SEQ ID NO: 253004 - DNA, 25 bp, Mus musculus
atgaagcagcctggtgtgtacacat

SEQ ID NO: 253005 - DNA, 25 bp, Mus musculus
atgaagcaggaacgcgaggacaaaa

SEQ ID NO: 253006 - DNA, 25 bp, Mus musculus
atgaagcaggaaggcgaggacaaaa

SEQ ID NO: 253007 - DNA, 25 bp, Mus musculus
atgaagcaggctacttctctttcca

SEQ ID NO: 253008 - DNA, 25 bp, Mus musculus
atgaagcaggcttcttctctttcca

SEQ ID NO: 253009 - DNA, 25 bp, Mus musculus
atgaagcagtctcggaaaactagct

SEQ ID NO: 253010 - DNA, 25 bp, Mus musculus
atgaagcagtctgggaaaactagct

SEQ ID NO: 253011 - DNA, 25 bp, Mus musculus
atgaagcatacaaatttctcacttg

SEQ ID NO: 253012 - DNA, 25 bp, Mus musculus
atgaagcatacatatttctcacttg

SEQ ID NO: 253013 - DNA, 25 bp, Mus musculus
atgaagccaagtactgccaacaaag

SEQ ID NO: 253014 - DNA, 25 bp, Mus musculus
atgaagccaagttctgccaacaaag

SEQ ID NO: 253015 - DNA, 25 bp, Mus musculus
atgaagccacagaaccaagcctgac

SEQ ID NO: 253016 - DNA, 25 bp, Mus musculus
atgaagccacagtaccaagcctgac

SEQ ID NO: 253017 - DNA, 25 bp, Mus musculus
atgaagccactaactggtaactagg

SEQ ID NO: 253018 - DNA, 25 bp, Mus musculus
atgaagccactatctggtaactagg

SEQ ID NO: 253019 - DNA, 25 bp, Mus musculus
atgaagccattcctgttttaccaca

SEQ ID NO: 253020 - DNA, 25 bp, Mus musculus
atgaagccattcgtgttttaccaca

SEQ ID NO: 253021 - DNA, 25 bp, Mus musculus
atgaagcccagacatgcacctgaag

SEQ ID NO: 253022 - DNA, 25 bp, Mus musculus
atgaagcccagagatgcacctgaag

SEQ ID NO: 253023 - DNA, 25 bp, Mus musculus
atgaagccccacatgagcaaatcaa

SEQ ID NO: 253024 - DNA, 25 bp, Mus musculus
atgaagccccacttgagcaaatcaa

SEQ ID NO: 253025 - DNA, 25 bp, Mus musculus
atgaagccctagagaaggccctgga

SEQ ID NO: 253026 - DNA, 25 bp, Mus musculus
atgaagccctagtgaaggccctgga

SEQ ID NO: 253027 - DNA, 25 bp, Mus musculus
atgaagccctggagtacacgggata

SEQ ID NO: 253028 - DNA, 25 bp, Mus musculus
atgaagccctggcagccaaagcagg

SEQ ID NO: 253029 - DNA, 25 bp, Mus musculus
atgaagccctgggagccaaagcagg

SEQ ID NO: 253030 - DNA, 25 bp, Mus musculus
atgaagccctggtgtacacgggata

SEQ ID NO: 253031 - DNA, 25 bp, Mus musculus
atgaagcctagacaggcctccaaga

SEQ ID NO: 253032 - DNA, 25 bp, Mus musculus
atgaagcctagagaggcctccaaga

SEQ ID NO: 253033 - DNA, 25 bp, Mus musculus
atgaagcctatacaagacgttgcag

SEQ ID NO: 253034 - DNA, 25 bp, Mus musculus
atgaagcctatagaagacgttgcag

SEQ ID NO: 253035 - DNA, 25 bp, Mus musculus
atgaagcctccaacctaatctgtta

SEQ ID NO: 253036 - DNA, 25 bp, Mus musculus
atgaagcctccatcctaatctgtta

SEQ ID NO: 253037 - DNA, 25 bp, Mus musculus
atgaagccttatcacgggtgcatgc

SEQ ID NO: 253038 - DNA, 25 bp, Mus musculus
atgaagccttatgacgggtgcatgc

SEQ ID NO: 253039 - DNA, 25 bp, Mus musculus
atgaagccttggacagtcagcccag

SEQ ID NO: 253040 - DNA, 25 bp, Mus musculus
atgaagccttggtcagtcagcccag

SEQ ID NO: 253041 - DNA, 25 bp, Mus musculus
atgaagcgactcagctcagggagct

SEQ ID NO: 253042 - DNA, 25 bp, Mus musculus
atgaagcgactctgctcagggagct

SEQ ID NO: 253043 - DNA, 25 bp, Mus musculus
atgaagcgacttaccatggagatag

SEQ ID NO: 253044 - DNA, 25 bp, Mus musculus
atgaagcgactttccatggagatag

SEQ ID NO: 253045 - DNA, 25 bp, Mus musculus
atgaagcgccacatgctgatccaca

SEQ ID NO: 253046 - DNA, 25 bp, Mus musculus
atgaagcgccacttgctgatccaca

SEQ ID NO: 253047 - DNA, 25 bp, Mus musculus
atgaagcgccctcgtctggaagtca

SEQ ID NO: 253048 - DNA, 25 bp, Mus musculus
atgaagcgccctggtctggaagtca

SEQ ID NO: 253049 - DNA, 25 bp, Mus musculus
atgaagcggagacctgcctgatcga

SEQ ID NO: 253050 - DNA, 25 bp, Mus musculus
atgaagcggagagctgcctgatcga

SEQ ID NO: 253051 - DNA, 25 bp, Mus musculus
atgaagcgggcccattttcagttac

SEQ ID NO: 253052 - DNA, 25 bp, Mus musculus
atgaagcgggccgattttcagttac

SEQ ID NO: 253053 - DNA, 25 bp, Mus musculus
atgaagcgggctatggctaactgcc

SEQ ID NO: 253054 - DNA, 25 bp, Mus musculus
atgaagcgggctttggctaactgcc

SEQ ID NO: 253055 - DNA, 25 bp, Mus musculus
atgaagcggtttactctgagatgca

SEQ ID NO: 253056 - DNA, 25 bp, Mus musculus
atgaagcggttttctctgagatgca

SEQ ID NO: 253057 - DNA, 25 bp, Mus musculus
atgaagcgttcacgccaggtgccag

SEQ ID NO: 253058 - DNA, 25 bp, Mus musculus
atgaagcgttcaggccaggtgccag

SEQ ID NO: 253059 - DNA, 25 bp, Mus musculus
atgaagctacttcccaggcaaagcc

SEQ ID NO: 253060 - DNA, 25 bp, Mus musculus
atgaagctacttgccaggcaaagcc

SEQ ID NO: 253061 - DNA, 25 bp, Mus musculus
atgaagctcaccaaggccgtgcggt

SEQ ID NO: 253062 - DNA, 25 bp, Mus musculus
atgaagctcacctaggccgtgcggt

SEQ ID NO: 253063 - DNA, 25 bp, Mus musculus
atgaagctcactctcactagtccag

SEQ ID NO: 253064 - DNA, 25 bp, Mus musculus
atgaagctcactgtcactagtccag

SEQ ID NO: 253065 - DNA, 25 bp, Mus musculus
atgaagctcagcacacgtcctataa

SEQ ID NO: 253066 - DNA, 25 bp, Mus musculus
atgaagctcagctcacgtcctataa

SEQ ID NO: 253067 - DNA, 25 bp, Mus musculus
atgaagctccctccttgatagatag

SEQ ID NO: 253068 - DNA, 25 bp, Mus musculus
atgaagctccctgcttgatagatag

SEQ ID NO: 253069 - DNA, 25 bp, Mus musculus
atgaagctctcccactggaatttct

SEQ ID NO: 253070 - DNA, 25 bp, Mus musculus
atgaagctctccgactggaatttct

SEQ ID NO: 253071 - DNA, 25 bp, Mus musculus
atgaagctctgcagaggtccctcag

SEQ ID NO: 253072 - DNA, 25 bp, Mus musculus
atgaagctctgctgaggtccctcag

SEQ ID NO: 253073 - DNA, 25 bp, Mus musculus
atgaagctctgtcctgtaccaagga

SEQ ID NO: 253074 - DNA, 25 bp, Mus musculus
atgaagctctgtgctgtaccaagga

SEQ ID NO: 253075 - DNA, 25 bp, Mus musculus
atgaagctcttaattatttggtaat

SEQ ID NO: 253076 - DNA, 25 bp, Mus musculus
atgaagctcttatttatttggtaat

SEQ ID NO: 253077 - DNA, 25 bp, Mus musculus
atgaagctcttgacctccgtttgct

SEQ ID NO: 253078 - DNA, 25 bp, Mus musculus
atgaagctcttgtcctccgtttgct

SEQ ID NO: 253079 - DNA, 25 bp, Mus musculus
atgaagctgagtaacttccccggta

SEQ ID NO: 253080 - DNA, 25 bp, Mus musculus
atgaagctgagttacttccccggta

SEQ ID NO: 253081 - DNA, 25 bp, Mus musculus
atgaagctgctaatgtgaaactgag

SEQ ID NO: 253082 - DNA, 25 bp, Mus musculus
atgaagctgctattgtgaaactgag

SEQ ID NO: 253083 - DNA, 25 bp, Mus musculus
atgaagctgctgacgtatgagctga

SEQ ID NO: 253084 - DNA, 25 bp, Mus musculus
atgaagctgctgtcgtatgagctga

SEQ ID NO: 253085 - DNA, 25 bp, Mus musculus
atgaagctgtcgctcaatgcccggg

SEQ ID NO: 253086 - DNA, 25 bp, Mus musculus
atgaagctgtcggtcaatgcccggg

SEQ ID NO: 253087 - DNA, 25 bp, Mus musculus
atgaagctgttccaacccaatcaca

SEQ ID NO: 253088 - DNA, 25 bp, Mus musculus
atgaagctgttcgaacccaatcaca

SEQ ID NO: 253089 - DNA, 25 bp, Mus musculus
atgaagcttcatcgcactagtagaa

SEQ ID NO: 253090 - DNA, 25 bp, Mus musculus
atgaagcttcatggcactagtagaa

SEQ ID NO: 253091 - DNA, 25 bp, Mus musculus
atgaagcttgcaactcagccacaga

SEQ ID NO: 253092 - DNA, 25 bp, Mus musculus
atgaagcttgcatctcagccacaga

SEQ ID NO: 253093 - DNA, 25 bp, Mus musculus
atgaagctttcaatcagtcctggcc

SEQ ID NO: 253094 - DNA, 25 bp, Mus musculus
atgaagctttcattcagtcctggcc

SEQ ID NO: 253095 - DNA, 25 bp, Mus musculus
atgaagctttggatcgactccttac

SEQ ID NO: 253096 - DNA, 25 bp, Mus musculus
atgaagctttggttcgactccttac

SEQ ID NO: 253097 - DNA, 25 bp, Mus musculus
atgaaggaacggcttctcttcctgg

SEQ ID NO: 253098 - DNA, 25 bp, Mus musculus
atgaaggaacgggttctcttcctgg

SEQ ID NO: 253099 - DNA, 25 bp, Mus musculus
atgaaggaagatcgcgcccttttct

SEQ ID NO: 253100 - DNA, 25 bp, Mus musculus
atgaaggaagatggcgcccttttct

SEQ ID NO: 253101 - DNA, 25 bp, Mus musculus
atgaaggaatgtcgcttgctccccg

SEQ ID NO: 253102 - DNA, 25 bp, Mus musculus
atgaaggaatgtggcttgctccccg

SEQ ID NO: 253103 - DNA, 25 bp, Mus musculus
atgaaggaattcattctttcccaca

SEQ ID NO: 253104 - DNA, 25 bp, Mus musculus
atgaaggaattctttctttcccaca

SEQ ID NO: 253105 - DNA, 25 bp, Mus musculus
atgaaggacaaccaccttgttcctt

SEQ ID NO: 253106 - DNA, 25 bp, Mus musculus
atgaaggacaacgaccttgttcctt

SEQ ID NO: 253107 - DNA, 25 bp, Mus musculus
atgaaggacactcaatgcccactga

SEQ ID NO: 253108 - DNA, 25 bp, Mus musculus
atgaaggacactgaatgcccactga

SEQ ID NO: 253109 - DNA, 25 bp, Mus musculus
atgaaggacatcaaactctggtgtt

SEQ ID NO: 253110 - DNA, 25 bp, Mus musculus
atgaaggacatctaactctggtgtt

SEQ ID NO: 253111 - DNA, 25 bp, Mus musculus
atgaaggacatgactcctgccaggg

SEQ ID NO: 253112 - DNA, 25 bp, Mus musculus
atgaaggacatgtctcctgccaggg

SEQ ID NO: 253113 - DNA, 25 bp, Mus musculus
atgaaggacgttcgcacatgcattt

SEQ ID NO: 253114 - DNA, 25 bp, Mus musculus
atgaaggacgttggcacatgcattt

SEQ ID NO: 253115 - DNA, 25 bp, Mus musculus
atgaaggagcgtccactctaatctc

SEQ ID NO: 253116 - DNA, 25 bp, Mus musculus
atgaaggagcgtgcactctaatctc

SEQ ID NO: 253117 - DNA, 25 bp, Mus musculus
atgaaggagctactggtggccacca

SEQ ID NO: 253118 - DNA, 25 bp, Mus musculus
atgaaggagctagtggtggccacca

SEQ ID NO: 253119 - DNA, 25 bp, Mus musculus
atgaaggaggttacagaaacacgga

SEQ ID NO: 253120 - DNA, 25 bp, Mus musculus
atgaaggaggtttcagaaacacgga

SEQ ID NO: 253121 - DNA, 25 bp, Mus musculus
atgaaggagtccatgctcttgcact

SEQ ID NO: 253122 - DNA, 25 bp, Mus musculus
atgaaggagtccttgctcttgcact

SEQ ID NO: 253123 - DNA, 25 bp, Mus musculus
atgaaggatgacaggaacatttttt

SEQ ID NO: 253124 - DNA, 25 bp, Mus musculus
atgaaggatgactggaacatttttt

SEQ ID NO: 253125 - DNA, 25 bp, Mus musculus
atgaaggatttgcacactcgtcttg

SEQ ID NO: 253126 - DNA, 25 bp, Mus musculus
atgaaggatttggacactcgtcttg

SEQ ID NO: 253127 - DNA, 25 bp, Mus musculus
atgaaggcacgccagatcaccaaca

SEQ ID NO: 253128 - DNA, 25 bp, Mus musculus
atgaaggcacgcgagatcaccaaca

SEQ ID NO: 253129 - DNA, 25 bp, Mus musculus
atgaaggcactgaatatggtatttg

SEQ ID NO: 253130 - DNA, 25 bp, Mus musculus
atgaaggcactgcatataactgacc

SEQ ID NO: 253131 - DNA, 25 bp, Mus musculus
atgaaggcactggatataactgacc

SEQ ID NO: 253132 - DNA, 25 bp, Mus musculus
atgaaggcactgtatatggtatttg

SEQ ID NO: 253133 - DNA, 25 bp, Mus musculus
atgaaggcagccctgtaaccagcat

SEQ ID NO: 253134 - DNA, 25 bp, Mus musculus
atgaaggcagccgtgtaaccagcat

SEQ ID NO: 253135 - DNA, 25 bp, Mus musculus
atgaaggcaggacacgtcaccctag

SEQ ID NO: 253136 - DNA, 25 bp, Mus musculus
atgaaggcaggagacgtcaccctag

SEQ ID NO: 253137 - DNA, 25 bp, Mus musculus
atgaaggccaaacttcagggctgga

SEQ ID NO: 253138 - DNA, 25 bp, Mus musculus
atgaaggccaaagttcagggctgga

SEQ ID NO: 253139 - DNA, 25 bp, Mus musculus
atgaaggccagacagctctgcacga

SEQ ID NO: 253140 - DNA, 25 bp, Mus musculus
atgaaggccagagagctctgcacga

SEQ ID NO: 253141 - DNA, 25 bp, Mus musculus
atgaaggcccatcctcaggaccagc

SEQ ID NO: 253142 - DNA, 25 bp, Mus musculus
atgaaggcccatgctcaggaccagc

SEQ ID NO: 253143 - DNA, 25 bp, Mus musculus
atgaaggccctaagggtcctagcgc

SEQ ID NO: 253144 - DNA, 25 bp, Mus musculus
atgaaggccctatgggtcctagcgc

SEQ ID NO: 253145 - DNA, 25 bp, Mus musculus
atgaaggcccttctgacttgtccat

SEQ ID NO: 253146 - DNA, 25 bp, Mus musculus
atgaaggcccttgtgacttgtccat

SEQ ID NO: 253147 - DNA, 25 bp, Mus musculus
atgaaggcctagcagctgtgtttgt

SEQ ID NO: 253148 - DNA, 25 bp, Mus musculus
atgaaggcctaggagctgtgtttgt

SEQ ID NO: 253149 - DNA, 25 bp, Mus musculus
atgaaggcctcactgggtttgtaac

SEQ ID NO: 253150 - DNA, 25 bp, Mus musculus
atgaaggcctcagtgggtttgtaac

SEQ ID NO: 253151 - DNA, 25 bp, Mus musculus
atgaaggccttgagccaagctgcct

SEQ ID NO: 253152 - DNA, 25 bp, Mus musculus
atgaaggccttgtgccaagctgcct

SEQ ID NO: 253153 - DNA, 25 bp, Mus musculus
atgaaggcggtgctgtccccaatcc

SEQ ID NO: 253154 - DNA, 25 bp, Mus musculus
atgaaggcggtggtgtccccaatcc

SEQ ID NO: 253155 - DNA, 25 bp, Mus musculus
atgaaggctcctattgcacattctt

SEQ ID NO: 253156 - DNA, 25 bp, Mus musculus
atgaaggctccttttgcacattctt

SEQ ID NO: 253157 - DNA, 25 bp, Mus musculus
atgaaggctctgacctcagtacatc

SEQ ID NO: 253158 - DNA, 25 bp, Mus musculus
atgaaggctctgtcctcagtacatc

SEQ ID NO: 253159 - DNA, 25 bp, Mus musculus
atgaaggcttccaacacgcccgagg

SEQ ID NO: 253160 - DNA, 25 bp, Mus musculus
atgaaggcttcctacacgcccgagg

SEQ ID NO: 253161 - DNA, 25 bp, Mus musculus
atgaaggctttgagacacctccagg

SEQ ID NO: 253162 - DNA, 25 bp, Mus musculus
atgaaggctttgtgacacctccagg

SEQ ID NO: 253163 - DNA, 25 bp, Mus musculus
atgaagggattcactgctctggcct

SEQ ID NO: 253164 - DNA, 25 bp, Mus musculus
atgaagggattctctgctctggcct

SEQ ID NO: 253165 - DNA, 25 bp, Mus musculus
atgaagggctggaaaatgaattttg

SEQ ID NO: 253166 - DNA, 25 bp, Mus musculus
atgaagggctggtaaatgaattttg

SEQ ID NO: 253167 - DNA, 25 bp, Mus musculus
atgaagggtcgtaccacgtggatga

SEQ ID NO: 253168 - DNA, 25 bp, Mus musculus
atgaagggtcgttccacgtggatga

SEQ ID NO: 253169 - DNA, 25 bp, Mus musculus
atgaagggttctcttttcagctctt

SEQ ID NO: 253170 - DNA, 25 bp, Mus musculus
atgaagggttctgttttcagctctt

SEQ ID NO: 253171 - DNA, 25 bp, Mus musculus
atgaaggtacacatgacattcatgc

SEQ ID NO: 253172 - DNA, 25 bp, Mus musculus
atgaaggtacacttgacattcatgc

SEQ ID NO: 253173 - DNA, 25 bp, Mus musculus
atgaaggtagctagggattctcaaa

SEQ ID NO: 253174 - DNA, 25 bp, Mus musculus
atgaaggtagcttgggattctcaaa

SEQ ID NO: 253175 - DNA, 25 bp, Mus musculus
atgaaggtcattcaaaaccgggcca

SEQ ID NO: 253176 - DNA, 25 bp, Mus musculus
atgaaggtcattgaaaaccgggcca

SEQ ID NO: 253177 - DNA, 25 bp, Mus musculus
atgaaggtgataactccgggccaat

SEQ ID NO: 253178 - DNA, 25 bp, Mus musculus
atgaaggtgatatctccgggccaat

SEQ ID NO: 253179 - DNA, 25 bp, Mus musculus
atgaaggtgatcatctcagttgcag

SEQ ID NO: 253180 - DNA, 25 bp, Mus musculus
atgaaggtgatcttctcagttgcag

SEQ ID NO: 253181 - DNA, 25 bp, Mus musculus
atgaaggtgcggctcatctagcttc

SEQ ID NO: 253182 - DNA, 25 bp, Mus musculus
atgaaggtgcgggtcatctagcttc

SEQ ID NO: 253183 - DNA, 25 bp, Mus musculus
atgaaggtgtatctcctcctgactc

SEQ ID NO: 253184 - DNA, 25 bp, Mus musculus
atgaaggtgtatgtcctcctgactc

SEQ ID NO: 253185 - DNA, 25 bp, Mus musculus
atgaaggtgtctccggacgagctca

SEQ ID NO: 253186 - DNA, 25 bp, Mus musculus
atgaaggtgtctgcggacgagctca

SEQ ID NO: 253187 - DNA, 25 bp, Mus musculus
atgaaggtgtgaacccaagctctcc

SEQ ID NO: 253188 - DNA, 25 bp, Mus musculus
atgaaggtgtgatcccaagctctcc

SEQ ID NO: 253189 - DNA, 25 bp, Mus musculus
atgaaggtgtgtacacgctgctctg

SEQ ID NO: 253190 - DNA, 25 bp, Mus musculus
atgaaggtgtgttcacgctgctctg

SEQ ID NO: 253191 - DNA, 25 bp, Mus musculus
atgaaggtgttgcatccccaagaac

SEQ ID NO: 253192 - DNA, 25 bp, Mus musculus
atgaaggtgttggatccccaagaac

SEQ ID NO: 253193 - DNA, 25 bp, Mus musculus
atgaaggtgtttacgaattccgtga

SEQ ID NO: 253194 - DNA, 25 bp, Mus musculus
atgaaggtgtttcggtatagcccct

SEQ ID NO: 253195 - DNA, 25 bp, Mus musculus
atgaaggtgtttgggtatagcccct

SEQ ID NO: 253196 - DNA, 25 bp, Mus musculus
atgaaggtgttttcgaattccgtga

SEQ ID NO: 253197 - DNA, 25 bp, Mus musculus
atgaaggttcccaaccatctataca

SEQ ID NO: 253198 - DNA, 25 bp, Mus musculus
atgaaggttccctaccatctataca

SEQ ID NO: 253199 - DNA, 25 bp, Mus musculus
atgaaggttgtcagggattacccga

SEQ ID NO: 253200 - DNA, 25 bp, Mus musculus
atgaaggttgtctgggattacccga

SEQ ID NO: 253201 - DNA, 25 bp, Mus musculus
atgaaggttttgctgaaggtacctt

SEQ ID NO: 253202 - DNA, 25 bp, Mus musculus
atgaaggttttggtgaaggtacctt

SEQ ID NO: 253203 - DNA, 25 bp, Mus musculus
atgaagtaagcgatagacctaggaa

SEQ ID NO: 253204 - DNA, 25 bp, Mus musculus
atgaagtaagcgttagacctaggaa

SEQ ID NO: 253205 - DNA, 25 bp, Mus musculus
atgaagtaatggagcctgcttccat

SEQ ID NO: 253206 - DNA, 25 bp, Mus musculus
atgaagtaatggtgcctgcttccat

SEQ ID NO: 253207 - DNA, 25 bp, Mus musculus
atgaagtacaccagctgacagtggc

SEQ ID NO: 253208 - DNA, 25 bp, Mus musculus
atgaagtacacctgctgacagtggc

SEQ ID NO: 253209 - DNA, 25 bp, Mus musculus
atgaagtacagccagcatacgccac

SEQ ID NO: 253210 - DNA, 25 bp, Mus musculus
atgaagtacagcgagcatacgccac

SEQ ID NO: 253211 - DNA, 25 bp, Mus musculus
atgaagtaccagatcctctccagag

SEQ ID NO: 253212 - DNA, 25 bp, Mus musculus
atgaagtaccagttcctctccagag

SEQ ID NO: 253213 - DNA, 25 bp, Mus musculus
atgaagtatcgacaccgtgcagctg

SEQ ID NO: 253214 - DNA, 25 bp, Mus musculus
atgaagtatcgagaccgtgcagctg

SEQ ID NO: 253215 - DNA, 25 bp, Mus musculus
atgaagtattccacatccctgatct

SEQ ID NO: 253216 - DNA, 25 bp, Mus musculus
atgaagtattcctcatccctgatct

SEQ ID NO: 253217 - DNA, 25 bp, Mus musculus
atgaagtcaaggcttttcctaccat

SEQ ID NO: 253218 - DNA, 25 bp, Mus musculus
atgaagtcaagggttttcctaccat

SEQ ID NO: 253219 - DNA, 25 bp, Mus musculus
atgaagtcactactctctgttctta

SEQ ID NO: 253220 - DNA, 25 bp, Mus musculus
atgaagtcactagtctctgttctta

SEQ ID NO: 253221 - DNA, 25 bp, Mus musculus
atgaagtcagaaatggaagataccc

SEQ ID NO: 253222 - DNA, 25 bp, Mus musculus
atgaagtcagaattggaagataccc

SEQ ID NO: 253223 - DNA, 25 bp, Mus musculus
atgaagtcagcacctcactgggcta

SEQ ID NO: 253224 - DNA, 25 bp, Mus musculus
atgaagtcagcagctcactgggcta

SEQ ID NO: 253225 - DNA, 25 bp, Mus musculus
atgaagtcatcacctttgtgccacc

SEQ ID NO: 253226 - DNA, 25 bp, Mus musculus
atgaagtcatcagctttgtgccacc

SEQ ID NO: 253227 - DNA, 25 bp, Mus musculus
atgaagtccaggacaaggcagggca

SEQ ID NO: 253228 - DNA, 25 bp, Mus musculus
atgaagtccaggtcaaggcagggca

SEQ ID NO: 253229 - DNA, 25 bp, Mus musculus
atgaagtccatcagcagctcaatga

SEQ ID NO: 253230 - DNA, 25 bp, Mus musculus
atgaagtccatctgcagctcaatga

SEQ ID NO: 253231 - DNA, 25 bp, Mus musculus
atgaagtcccctctggactacggca

SEQ ID NO: 253232 - DNA, 25 bp, Mus musculus
atgaagtcccctgtggactacggca

SEQ ID NO: 253233 - DNA, 25 bp, Mus musculus
atgaagtccctcaggatcttgagct

SEQ ID NO: 253234 - DNA, 25 bp, Mus musculus
atgaagtccctctggatcttgagct

SEQ ID NO: 253235 - DNA, 25 bp, Mus musculus
atgaagtcgaagctggctcactcct

SEQ ID NO: 253236 - DNA, 25 bp, Mus musculus
atgaagtcgaaggtggctcactcct

SEQ ID NO: 253237 - DNA, 25 bp, Mus musculus
atgaagtctagtacttaagtacctc

SEQ ID NO: 253238 - DNA, 25 bp, Mus musculus
atgaagtctagttcttaagtacctc

SEQ ID NO: 253239 - DNA, 25 bp, Mus musculus
atgaagtctcttctcctgagttttt

SEQ ID NO: 253240 - DNA, 25 bp, Mus musculus
atgaagtctcttgtcctgagttttt

SEQ ID NO: 253241 - DNA, 25 bp, Mus musculus
atgaagtctgatctgggaccgtgcc

SEQ ID NO: 253242 - DNA, 25 bp, Mus musculus
atgaagtctgatgtgggaccgtgcc

SEQ ID NO: 253243 - DNA, 25 bp, Mus musculus
atgaagtctgcaatctactcaagaa

SEQ ID NO: 253244 - DNA, 25 bp, Mus musculus
atgaagtctgcattctactcaagaa

SEQ ID NO: 253245 - DNA, 25 bp, Mus musculus
atgaagtcttcacttcccgtagctc

SEQ ID NO: 253246 - DNA, 25 bp, Mus musculus
atgaagtcttcagttcccgtagctc

SEQ ID NO: 253247 - DNA, 25 bp, Mus musculus
atgaagtcttcgcacttccacgctc

SEQ ID NO: 253248 - DNA, 25 bp, Mus musculus
atgaagtcttcggacttccacgctc

SEQ ID NO: 253249 - DNA, 25 bp, Mus musculus
atgaagtcttggctgcaggcagata

SEQ ID NO: 253250 - DNA, 25 bp, Mus musculus
atgaagtcttgggtgcaggcagata

SEQ ID NO: 253251 - DNA, 25 bp, Mus musculus
atgaagtctttcacagtctctgtga

SEQ ID NO: 253252 - DNA, 25 bp, Mus musculus
atgaagtctttctcagtctctgtga

SEQ ID NO: 253253 - DNA, 25 bp, Mus musculus
atgaagtgaataatcctggacaata

SEQ ID NO: 253254 - DNA, 25 bp, Mus musculus
atgaagtgaatattcctggacaata

SEQ ID NO: 253255 - DNA, 25 bp, Mus musculus
atgaagtgaatgcagtttgcacaga

SEQ ID NO: 253256 - DNA, 25 bp, Mus musculus
atgaagtgaatggagtttgcacaga

SEQ ID NO: 253257 - DNA, 25 bp, Mus musculus
atgaagtgcaacacagaccctggtt

SEQ ID NO: 253258 - DNA, 25 bp, Mus musculus
atgaagtgcaactcagaccctggtt

SEQ ID NO: 253259 - DNA, 25 bp, Mus musculus
atgaagtgccagcttgctcagaagc

SEQ ID NO: 253260 - DNA, 25 bp, Mus musculus
atgaagtgccaggttgctcagaagc

SEQ ID NO: 253261 - DNA, 25 bp, Mus musculus
atgaagtgccttcatctgctcagac

SEQ ID NO: 253262 - DNA, 25 bp, Mus musculus
atgaagtgccttgatctgctcagac

SEQ ID NO: 253263 - DNA, 25 bp, Mus musculus
atgaagtgcgacattggaagatctg

SEQ ID NO: 253264 - DNA, 25 bp, Mus musculus
atgaagtgcgactttggaagatctg

SEQ ID NO: 253265 - DNA, 25 bp, Mus musculus
atgaagtgcttcctctgtaccagtc

SEQ ID NO: 253266 - DNA, 25 bp, Mus musculus
atgaagtgcttcgtctgtaccagtc

SEQ ID NO: 253267 - DNA, 25 bp, Mus musculus
atgaagtggcttcgcgttgacactg

SEQ ID NO: 253268 - DNA, 25 bp, Mus musculus
atgaagtggcttggcgttgacactg

SEQ ID NO: 253269 - DNA, 25 bp, Mus musculus
atgaagtgggttctgcagccacctt

SEQ ID NO: 253270 - DNA, 25 bp, Mus musculus
atgaagtgggttgtgcagccacctt

SEQ ID NO: 253271 - DNA, 25 bp, Mus musculus
atgaagtgtcaaccgccccaggaac

SEQ ID NO: 253272 - DNA, 25 bp, Mus musculus
atgaagtgtcaagcgccccaggaac

SEQ ID NO: 253273 - DNA, 25 bp, Mus musculus
atgaagtgtcctagtgggtggctcc

SEQ ID NO: 253274 - DNA, 25 bp, Mus musculus
atgaagtgtcctcagccccagtgca

SEQ ID NO: 253275 - DNA, 25 bp, Mus musculus
atgaagtgtcctgagccccagtgca

SEQ ID NO: 253276 - DNA, 25 bp, Mus musculus
atgaagtgtccttgtgggtggctcc

SEQ ID NO: 253277 - DNA, 25 bp, Mus musculus
atgaagtgtcttcattgcccttcac

SEQ ID NO: 253278 - DNA, 25 bp, Mus musculus
atgaagtgtcttgattgcccttcac

SEQ ID NO: 253279 - DNA, 25 bp, Mus musculus
atgaagtgtgcgaacgtgtgtgtcc

SEQ ID NO: 253280 - DNA, 25 bp, Mus musculus
atgaagtgtgcgtacgtgtgtgtcc

SEQ ID NO: 253281 - DNA, 25 bp, Mus musculus
atgaagtgttagagggtgaaacccg

SEQ ID NO: 253282 - DNA, 25 bp, Mus musculus
atgaagtgttagtgggtgaaacccg

SEQ ID NO: 253283 - DNA, 25 bp, Mus musculus
atgaagtgttatcctgtgaccagtc

SEQ ID NO: 253284 - DNA, 25 bp, Mus musculus
atgaagtgttatgctgtgaccagtc

SEQ ID NO: 253285 - DNA, 25 bp, Mus musculus
atgaagttatacactgccctcaaga

SEQ ID NO: 253286 - DNA, 25 bp, Mus musculus
atgaagttatactctgccctcaaga

SEQ ID NO: 253287 - DNA, 25 bp, Mus musculus
atgaagttcaatcccttcgtgactt

SEQ ID NO: 253288 - DNA, 25 bp, Mus musculus
atgaagttcaatgccttcgtgactt

SEQ ID NO: 253289 - DNA, 25 bp, Mus musculus
atgaagttccatcacatacagggac

SEQ ID NO: 253290 - DNA, 25 bp, Mus musculus
atgaagttccatgacatacagggac

SEQ ID NO: 253291 - DNA, 25 bp, Mus musculus
atgaagttctgactgtggatcccca

SEQ ID NO: 253292 - DNA, 25 bp, Mus musculus
atgaagttctgagtgtggatcccca

SEQ ID NO: 253293 - DNA, 25 bp, Mus musculus
atgaagttctttacacagcctgaaa

SEQ ID NO: 253294 - DNA, 25 bp, Mus musculus
atgaagttcttttcacagcctgaaa

SEQ ID NO: 253295 - DNA, 25 bp, Mus musculus
atgaagttggttacattccagccct

SEQ ID NO: 253296 - DNA, 25 bp, Mus musculus
atgaagttggtttcattccagccct

SEQ ID NO: 253297 - DNA, 25 bp, Mus musculus
atgaagtttcccattaaccaagaat

SEQ ID NO: 253298 - DNA, 25 bp, Mus musculus
atgaagtttccctttaaccaagaat

SEQ ID NO: 253299 - DNA, 25 bp, Mus musculus
atgaagttttaaagcccacccactt

SEQ ID NO: 253300 - DNA, 25 bp, Mus musculus
atgaagttttaatgcccacccactt

SEQ ID NO: 253301 - DNA, 25 bp, Mus musculus
atgaataaatacatcaccccttatt

SEQ ID NO: 253302 - DNA, 25 bp, Mus musculus
atgaataaatacttcaccccttatt

SEQ ID NO: 253303 - DNA, 25 bp, Mus musculus
atgaataagcaaccccattaccaca

SEQ ID NO: 253304 - DNA, 25 bp, Mus musculus
atgaataagcaagcccattaccaca

SEQ ID NO: 253305 - DNA, 25 bp, Mus musculus
atgaataagcatcgtcccacctaag

SEQ ID NO: 253306 - DNA, 25 bp, Mus musculus
atgaataagcatggtcccacctaag

SEQ ID NO: 253307 - DNA, 25 bp, Mus musculus
atgaatacacttctccattgttggc

SEQ ID NO: 253308 - DNA, 25 bp, Mus musculus
atgaatacacttgtccattgttggc

SEQ ID NO: 253309 - DNA, 25 bp, Mus musculus
atgaatacagccacctcaagtcagc

SEQ ID NO: 253310 - DNA, 25 bp, Mus musculus
atgaatacagcctcctcaagtcagc

SEQ ID NO: 253311 - DNA, 25 bp, Mus musculus
atgaatacatacatggttaccagcc

SEQ ID NO: 253312 - DNA, 25 bp, Mus musculus
atgaatacatacttggttaccagcc

SEQ ID NO: 253313 - DNA, 25 bp, Mus musculus
atgaatacccagatgagctccagtg

SEQ ID NO: 253314 - DNA, 25 bp, Mus musculus
atgaatacccagttgagctccagtg

SEQ ID NO: 253315 - DNA, 25 bp, Mus musculus
atgaataccctcagttggaacccta

SEQ ID NO: 253316 - DNA, 25 bp, Mus musculus
atgaataccctctgttggaacccta

SEQ ID NO: 253317 - DNA, 25 bp, Mus musculus
atgaataccgggagtgccagctgcc

SEQ ID NO: 253318 - DNA, 25 bp, Mus musculus
atgaataccgggtgtgccagctgcc

SEQ ID NO: 253319 - DNA, 25 bp, Mus musculus
atgaataccttaaattgccctgccc

SEQ ID NO: 253320 - DNA, 25 bp, Mus musculus
atgaataccttatattgccctgccc

SEQ ID NO: 253321 - DNA, 25 bp, Mus musculus
atgaatactgacatgggcgtgggcc

SEQ ID NO: 253322 - DNA, 25 bp, Mus musculus
atgaatactgacttgggcgtgggcc

SEQ ID NO: 253323 - DNA, 25 bp, Mus musculus
atgaatagacccaacaagcgcatct

SEQ ID NO: 253324 - DNA, 25 bp, Mus musculus
atgaatagaccctacaagcgcatct

SEQ ID NO: 253325 - DNA, 25 bp, Mus musculus
atgaataggacaatggctccctcag

SEQ ID NO: 253326 - DNA, 25 bp, Mus musculus
atgaataggacattggctccctcag

SEQ ID NO: 253327 - DNA, 25 bp, Mus musculus
atgaatagtcacaggctttgctcag

SEQ ID NO: 253328 - DNA, 25 bp, Mus musculus
atgaatagtcactggctttgctcag

SEQ ID NO: 253329 - DNA, 25 bp, Mus musculus
atgaatatcattataggctactaga

SEQ ID NO: 253330 - DNA, 25 bp, Mus musculus
atgaatatcattttaggctactaga

SEQ ID NO: 253331 - DNA, 25 bp, Mus musculus
atgaatatgtgtcggctaaggaata

SEQ ID NO: 253332 - DNA, 25 bp, Mus musculus
atgaatatgtgtgggctaaggaata

SEQ ID NO: 253333 - DNA, 25 bp, Mus musculus
atgaatattggcagtgggtccccag

SEQ ID NO: 253334 - DNA, 25 bp, Mus musculus
atgaatattggctgtgggtccccag

SEQ ID NO: 253335 - DNA, 25 bp, Mus musculus
atgaatattgtacatctttagcccc

SEQ ID NO: 253336 - DNA, 25 bp, Mus musculus
atgaatattgtagatctttagcccc

SEQ ID NO: 253337 - DNA, 25 bp, Mus musculus
atgaatattgtcacctctatcccta

SEQ ID NO: 253338 - DNA, 25 bp, Mus musculus
atgaatattgtcatagtgctgtgat

SEQ ID NO: 253339 - DNA, 25 bp, Mus musculus
atgaatattgtctcctctatcccta

SEQ ID NO: 253340 - DNA, 25 bp, Mus musculus
atgaatattgtcttagtgctgtgat

SEQ ID NO: 253341 - DNA, 25 bp, Mus musculus
atgaatatttagaccagcacacagt

SEQ ID NO: 253342 - DNA, 25 bp, Mus musculus
atgaatatttagtccagcacacagt

SEQ ID NO: 253343 - DNA, 25 bp, Mus musculus
atgaatatttggatcatacggctga

SEQ ID NO: 253344 - DNA, 25 bp, Mus musculus
atgaatatttggttcatacggctga

SEQ ID NO: 253345 - DNA, 25 bp, Mus musculus
atgaatcaagtgaccatgcaccaaa

SEQ ID NO: 253346 - DNA, 25 bp, Mus musculus
atgaatcaagtgtccatgcaccaaa

SEQ ID NO: 253347 - DNA, 25 bp, Mus musculus
atgaatcaatcacggcgtcaggacc

SEQ ID NO: 253348 - DNA, 25 bp, Mus musculus
atgaatcaatcagggcgtcaggacc

SEQ ID NO: 253349 - DNA, 25 bp, Mus musculus
atgaatcactaacattctttacagg

SEQ ID NO: 253350 - DNA, 25 bp, Mus musculus
atgaatcactaagattctttacagg

SEQ ID NO: 253351 - DNA, 25 bp, Mus musculus
atgaatcagctgagccaaaggcaga

SEQ ID NO: 253352 - DNA, 25 bp, Mus musculus
atgaatcagctgtgccaaaggcaga

SEQ ID NO: 253353 - DNA, 25 bp, Mus musculus
atgaatcagtagaatgtcccaccta

SEQ ID NO: 253354 - DNA, 25 bp, Mus musculus
atgaatcagtagtatgtcccaccta

SEQ ID NO: 253355 - DNA, 25 bp, Mus musculus
atgaatcatcctaatggctccttgt

SEQ ID NO: 253356 - DNA, 25 bp, Mus musculus
atgaatcatccttatggctccttgt

SEQ ID NO: 253357 - DNA, 25 bp, Mus musculus
atgaatcattaaaacatttcctgct

SEQ ID NO: 253358 - DNA, 25 bp, Mus musculus
atgaatcattaatacatttcctgct

SEQ ID NO: 253359 - DNA, 25 bp, Mus musculus
atgaatccaataaaccagacagatg

SEQ ID NO: 253360 - DNA, 25 bp, Mus musculus
atgaatccaatataccagacagatg

SEQ ID NO: 253361 - DNA, 25 bp, Mus musculus
atgaatccacacctagctattgctt

SEQ ID NO: 253362 - DNA, 25 bp, Mus musculus
atgaatccacacgtagctattgctt

SEQ ID NO: 253363 - DNA, 25 bp, Mus musculus
atgaatccacctcaaggccttggct

SEQ ID NO: 253364 - DNA, 25 bp, Mus musculus
atgaatccacctgaaggccttggct

SEQ ID NO: 253365 - DNA, 25 bp, Mus musculus
atgaatcccagacctggtgccatct

SEQ ID NO: 253366 - DNA, 25 bp, Mus musculus
atgaatcccagagctggtgccatct

SEQ ID NO: 253367 - DNA, 25 bp, Mus musculus
atgaatccctcccagaaatggtgga

SEQ ID NO: 253368 - DNA, 25 bp, Mus musculus
atgaatccctccgagaaatggtgga

SEQ ID NO: 253369 - DNA, 25 bp, Mus musculus
atgaatcctaacaaatctccctggg

SEQ ID NO: 253370 - DNA, 25 bp, Mus musculus
atgaatcctaactaatctccctggg

SEQ ID NO: 253371 - DNA, 25 bp, Mus musculus
atgaatcctgagacctgggagcaca

SEQ ID NO: 253372 - DNA, 25 bp, Mus musculus
atgaatcctgagtcctgggagcaca

SEQ ID NO: 253373 - DNA, 25 bp, Mus musculus
atgaatcctgatcctgtgatgacaa

SEQ ID NO: 253374 - DNA, 25 bp, Mus musculus
atgaatcctgatgctgtgatgacaa

SEQ ID NO: 253375 - DNA, 25 bp, Mus musculus
atgaatcgatgaagttctcagtatt

SEQ ID NO: 253376 - DNA, 25 bp, Mus musculus
atgaatcgatgatgttctcagtatt

SEQ ID NO: 253377 - DNA, 25 bp, Mus musculus
atgaatcgcaagattggtccagatc

SEQ ID NO: 253378 - DNA, 25 bp, Mus musculus
atgaatcgcaagtttggtccagatc

SEQ ID NO: 253379 - DNA, 25 bp, Mus musculus
atgaatcgccctacccacgttcaaa

SEQ ID NO: 253380 - DNA, 25 bp, Mus musculus
atgaatcgcccttcccacgttcaaa

SEQ ID NO: 253381 - DNA, 25 bp, Mus musculus
atgaatcggcaaccggcttaacaga

SEQ ID NO: 253382 - DNA, 25 bp, Mus musculus
atgaatcggcaagcggcttaacaga

SEQ ID NO: 253383 - DNA, 25 bp, Mus musculus
atgaatcggcctatgatctggccaa

SEQ ID NO: 253384 - DNA, 25 bp, Mus musculus
atgaatcggcctttgatctggccaa

SEQ ID NO: 253385 - DNA, 25 bp, Mus musculus
atgaatctagtaactgccactggcc

SEQ ID NO: 253386 - DNA, 25 bp, Mus musculus
atgaatctagtatctgccactggcc

SEQ ID NO: 253387 - DNA, 25 bp, Mus musculus
atgaatctcatccaccgtctttaat

SEQ ID NO: 253388 - DNA, 25 bp, Mus musculus
atgaatctcatcgaccgtctttaat

SEQ ID NO: 253389 - DNA, 25 bp, Mus musculus
atgaatctctggctagctgtccttc

SEQ ID NO: 253390 - DNA, 25 bp, Mus musculus
atgaatctctgggtagctgtccttc

SEQ ID NO: 253391 - DNA, 25 bp, Mus musculus
atgaatctgatcattctttcccaaa

SEQ ID NO: 253392 - DNA, 25 bp, Mus musculus
atgaatctgatctttctttcccaaa

SEQ ID NO: 253393 - DNA, 25 bp, Mus musculus
atgaatctggagacgctgtccataa

SEQ ID NO: 253394 - DNA, 25 bp, Mus musculus
atgaatctggagtcgctgtccataa

SEQ ID NO: 253395 - DNA, 25 bp, Mus musculus
atgaatcttccaatctgggactgat

SEQ ID NO: 253396 - DNA, 25 bp, Mus musculus
atgaatcttccattctgggactgat

SEQ ID NO: 253397 - DNA, 25 bp, Mus musculus
atgaatcttcctcagatcccaagaa

SEQ ID NO: 253398 - DNA, 25 bp, Mus musculus
atgaatcttcctgagatcccaagaa

SEQ ID NO: 253399 - DNA, 25 bp, Mus musculus
atgaatcttgcccagcaccacttgg

SEQ ID NO: 253400 - DNA, 25 bp, Mus musculus
atgaatcttgccgagcaccacttgg

SEQ ID NO: 253401 - DNA, 25 bp, Mus musculus
atgaatctttagctatttacctgaa

SEQ ID NO: 253402 - DNA, 25 bp, Mus musculus
atgaatctttaggtatttacctgaa

SEQ ID NO: 253403 - DNA, 25 bp, Mus musculus
atgaatcttttcaacttggaccgtt

SEQ ID NO: 253404 - DNA, 25 bp, Mus musculus
atgaatcttttctacttggaccgtt

SEQ ID NO: 253405 - DNA, 25 bp, Mus musculus
atgaatctttttcaagctctcctcc

SEQ ID NO: 253406 - DNA, 25 bp, Mus musculus
atgaatctttttgaagctctcctcc

SEQ ID NO: 253407 - DNA, 25 bp, Mus musculus
atgaatgaacaccactgcactgcgt

SEQ ID NO: 253408 - DNA, 25 bp, Mus musculus
atgaatgaacacgactgcactgcgt

SEQ ID NO: 253409 - DNA, 25 bp, Mus musculus
atgaatgaagctccacacctgaatt

SEQ ID NO: 253410 - DNA, 25 bp, Mus musculus
atgaatgaagctgcacacctgaatt

SEQ ID NO: 253411 - DNA, 25 bp, Mus musculus
atgaatgaatctactccttcctagg

SEQ ID NO: 253412 - DNA, 25 bp, Mus musculus
atgaatgaatcttctccttcctagg

SEQ ID NO: 253413 - DNA, 25 bp, Mus musculus
atgaatgacagtaccgagaccttct

SEQ ID NO: 253414 - DNA, 25 bp, Mus musculus
atgaatgacagttccgagaccttct

SEQ ID NO: 253415 - DNA, 25 bp, Mus musculus
atgaatgactggaccggcaagagtg

SEQ ID NO: 253416 - DNA, 25 bp, Mus musculus
atgaatgactggtccggcaagagtg

SEQ ID NO: 253417 - DNA, 25 bp, Mus musculus
atgaatgagcttacctcttgctact

SEQ ID NO: 253418 - DNA, 25 bp, Mus musculus
atgaatgagctttcctcttgctact

SEQ ID NO: 253419 - DNA, 25 bp, Mus musculus
atgaatgaggtgaaccccaagaggt

SEQ ID NO: 253420 - DNA, 25 bp, Mus musculus
atgaatgaggtgactgtgccaggca

SEQ ID NO: 253421 - DNA, 25 bp, Mus musculus
atgaatgaggtgtaccccaagaggt

SEQ ID NO: 253422 - DNA, 25 bp, Mus musculus
atgaatgaggtgtctgtgccaggca

SEQ ID NO: 253423 - DNA, 25 bp, Mus musculus
atgaatgagtccactttgacctccc

SEQ ID NO: 253424 - DNA, 25 bp, Mus musculus
atgaatgagtcctctttgacctccc

SEQ ID NO: 253425 - DNA, 25 bp, Mus musculus
atgaatgagtgacccctcctctcat

SEQ ID NO: 253426 - DNA, 25 bp, Mus musculus
atgaatgagtgacccggccacgtgc

SEQ ID NO: 253427 - DNA, 25 bp, Mus musculus
atgaatgagtgagccctcctctcat

SEQ ID NO: 253428 - DNA, 25 bp, Mus musculus
atgaatgagtgagccggccacgtgc

SEQ ID NO: 253429 - DNA, 25 bp, Mus musculus
atgaatgcatcaatcctttatccct

SEQ ID NO: 253430 - DNA, 25 bp, Mus musculus
atgaatgcatcattcctttatccct

SEQ ID NO: 253431 - DNA, 25 bp, Mus musculus
atgaatgccccaacaggttgaaggg

SEQ ID NO: 253432 - DNA, 25 bp, Mus musculus
atgaatgccccatcaggttgaaggg

SEQ ID NO: 253433 - DNA, 25 bp, Mus musculus
atgaatgccgctaacactgtttaca

SEQ ID NO: 253434 - DNA, 25 bp, Mus musculus
atgaatgccgcttacactgtttaca

SEQ ID NO: 253435 - DNA, 25 bp, Mus musculus
atgaatgcctctacaatggtatgca

SEQ ID NO: 253436 - DNA, 25 bp, Mus musculus
atgaatgcctcttcaatggtatgca

SEQ ID NO: 253437 - DNA, 25 bp, Mus musculus
atgaatgctcttatgcttgttgtag

SEQ ID NO: 253438 - DNA, 25 bp, Mus musculus
atgaatgctcttttgcttgttgtag

SEQ ID NO: 253439 - DNA, 25 bp, Mus musculus
atgaatgcttctactgtttgggtct

SEQ ID NO: 253440 - DNA, 25 bp, Mus musculus
atgaatgcttcttctgtttgggtct

SEQ ID NO: 253441 - DNA, 25 bp, Mus musculus
atgaatggaccacaatagatgcttc

SEQ ID NO: 253442 - DNA, 25 bp, Mus musculus
atgaatggaccagaatagatgcttc

SEQ ID NO: 253443 - DNA, 25 bp, Mus musculus
atgaatggcaagctttattagagca

SEQ ID NO: 253444 - DNA, 25 bp, Mus musculus
atgaatggcaaggtttattagagca

SEQ ID NO: 253445 - DNA, 25 bp, Mus musculus
atgaatgggatacatgtctgcatgg

SEQ ID NO: 253446 - DNA, 25 bp, Mus musculus
atgaatgggatagatgtctgcatgg

SEQ ID NO: 253447 - DNA, 25 bp, Mus musculus
atgaatgggtacaggcttgccgact

SEQ ID NO: 253448 - DNA, 25 bp, Mus musculus
atgaatgggtactggcttgccgact

SEQ ID NO: 253449 - DNA, 25 bp, Mus musculus
atgaatgggttccacctttgacacc

SEQ ID NO: 253450 - DNA, 25 bp, Mus musculus
atgaatgggttcgacctttgacacc

SEQ ID NO: 253451 - DNA, 25 bp, Mus musculus
atgaatgtagtcagcagcaatcagg

SEQ ID NO: 253452 - DNA, 25 bp, Mus musculus
atgaatgtagtctgcagcaatcagg

SEQ ID NO: 253453 - DNA, 25 bp, Mus musculus
atgaatgtcacaagtgcttctagga

SEQ ID NO: 253454 - DNA, 25 bp, Mus musculus
atgaatgtcacatgtgcttctagga

SEQ ID NO: 253455 - DNA, 25 bp, Mus musculus
atgaatgtcaggacacagtggcgaa

SEQ ID NO: 253456 - DNA, 25 bp, Mus musculus
atgaatgtcaggtcacagtggcgaa

SEQ ID NO: 253457 - DNA, 25 bp, Mus musculus
atgaatgtctgaagcctccaaaggc

SEQ ID NO: 253458 - DNA, 25 bp, Mus musculus
atgaatgtctgatgcctccaaaggc

SEQ ID NO: 253459 - DNA, 25 bp, Mus musculus
atgaatgtgaccctttggatgaagt

SEQ ID NO: 253460 - DNA, 25 bp, Mus musculus
atgaatgtgaccgtttggatgaagt

SEQ ID NO: 253461 - DNA, 25 bp, Mus musculus
atgaatgtgacgctctctgtctccc

SEQ ID NO: 253462 - DNA, 25 bp, Mus musculus
atgaatgtgacggtctctgtctccc

SEQ ID NO: 253463 - DNA, 25 bp, Mus musculus
atgaatgtgagaatgttcttgctta

SEQ ID NO: 253464 - DNA, 25 bp, Mus musculus
atgaatgtgagattgttcttgctta

SEQ ID NO: 253465 - DNA, 25 bp, Mus musculus
atgaatgtgctcatagcccagctag

SEQ ID NO: 253466 - DNA, 25 bp, Mus musculus
atgaatgtgctcttagcccagctag

SEQ ID NO: 253467 - DNA, 25 bp, Mus musculus
atgaatgtgctgaggctccttcggg

SEQ ID NO: 253468 - DNA, 25 bp, Mus musculus
atgaatgtgctgtggctccttcggg

SEQ ID NO: 253469 - DNA, 25 bp, Mus musculus
atgaatgttaagcatcttcgaccac

SEQ ID NO: 253470 - DNA, 25 bp, Mus musculus
atgaatgttaaggatcttcgaccac

SEQ ID NO: 253471 - DNA, 25 bp, Mus musculus
atgaatgttactcttttatttttag

SEQ ID NO: 253472 - DNA, 25 bp, Mus musculus
atgaatgttactgttttatttttag

SEQ ID NO: 253473 - DNA, 25 bp, Mus musculus
atgaatgttagcacgtggtttgtct

SEQ ID NO: 253474 - DNA, 25 bp, Mus musculus
atgaatgttagctcgtggtttgtct

SEQ ID NO: 253475 - DNA, 25 bp, Mus musculus
atgaatgttgaacccatcatggtca

SEQ ID NO: 253476 - DNA, 25 bp, Mus musculus
atgaatgttgaagccatcatggtca

SEQ ID NO: 253477 - DNA, 25 bp, Mus musculus
atgaatgttgccagcgctgtgtcta

SEQ ID NO: 253478 - DNA, 25 bp, Mus musculus
atgaatgttgcctgcgctgtgtcta

SEQ ID NO: 253479 - DNA, 25 bp, Mus musculus
atgaattaccttattctggaggagg

SEQ ID NO: 253480 - DNA, 25 bp, Mus musculus
atgaattacctttttctggaggagg

SEQ ID NO: 253481 - DNA, 25 bp, Mus musculus
atgaattatgcccacatcagctccc

SEQ ID NO: 253482 - DNA, 25 bp, Mus musculus
atgaattatgccgacatcagctccc

SEQ ID NO: 253483 - DNA, 25 bp, Mus musculus
atgaattcaggaattccacactctt

SEQ ID NO: 253484 - DNA, 25 bp, Mus musculus
atgaattcaggatttccacactctt

SEQ ID NO: 253485 - DNA, 25 bp, Mus musculus
atgaattcagtgacgttcctgcgta

SEQ ID NO: 253486 - DNA, 25 bp, Mus musculus
atgaattcagtgtcgttcctgcgta

SEQ ID NO: 253487 - DNA, 25 bp, Mus musculus
atgaattccagactctgccccttga

SEQ ID NO: 253488 - DNA, 25 bp, Mus musculus
atgaattccagagtctgccccttga

SEQ ID NO: 253489 - DNA, 25 bp, Mus musculus
atgaattccaggaccaatgctagag

SEQ ID NO: 253490 - DNA, 25 bp, Mus musculus
atgaattccaggtccaatgctagag

SEQ ID NO: 253491 - DNA, 25 bp, Mus musculus
atgaattcccaaagccttgtgcacg

SEQ ID NO: 253492 - DNA, 25 bp, Mus musculus
atgaattcccaatgccttgtgcacg

SEQ ID NO: 253493 - DNA, 25 bp, Mus musculus
atgaattccgcactgttgcagctaa

SEQ ID NO: 253494 - DNA, 25 bp, Mus musculus
atgaattccgcagtgttgcagctaa

SEQ ID NO: 253495 - DNA, 25 bp, Mus musculus
atgaattcctggaacttcctgaggc

SEQ ID NO: 253496 - DNA, 25 bp, Mus musculus
atgaattcctggtacttcctgaggc

SEQ ID NO: 253497 - DNA, 25 bp, Mus musculus
atgaattcctttaggcagtcaagac

SEQ ID NO: 253498 - DNA, 25 bp, Mus musculus
atgaattccttttggcagtcaagac

SEQ ID NO: 253499 - DNA, 25 bp, Mus musculus
atgaattcggaactacagtggcaaa

SEQ ID NO: 253500 - DNA, 25 bp, Mus musculus
atgaattcggaagtacagtggcaaa

SEQ ID NO: 253501 - DNA, 25 bp, Mus musculus
atgaattctaacctcaccacactgg

SEQ ID NO: 253502 - DNA, 25 bp, Mus musculus
atgaattctaacgtcaccacactgg

SEQ ID NO: 253503 - DNA, 25 bp, Mus musculus
atgaattctattccctttctgcacc

SEQ ID NO: 253504 - DNA, 25 bp, Mus musculus
atgaattctattgcctttctgcacc

SEQ ID NO: 253505 - DNA, 25 bp, Mus musculus
atgaattctgcaccttctgttactt

SEQ ID NO: 253506 - DNA, 25 bp, Mus musculus
atgaattctgcagcttctgttactt

SEQ ID NO: 253507 - DNA, 25 bp, Mus musculus
atgaattctttgacttctcacaggt

SEQ ID NO: 253508 - DNA, 25 bp, Mus musculus
atgaattctttgtcttctcacaggt

SEQ ID NO: 253509 - DNA, 25 bp, Mus musculus
atgaattgaagtccacgctctgtct

SEQ ID NO: 253510 - DNA, 25 bp, Mus musculus
atgaattgaagtgcacgctctgtct

SEQ ID NO: 253511 - DNA, 25 bp, Mus musculus
atgaattgcagccttgtgtccgaaa

SEQ ID NO: 253512 - DNA, 25 bp, Mus musculus
atgaattgcagcgttgtgtccgaaa

SEQ ID NO: 253513 - DNA, 25 bp, Mus musculus
atgaattgcctaagtgagctttcca

SEQ ID NO: 253514 - DNA, 25 bp, Mus musculus
atgaattgcctatgtgagctttcca

SEQ ID NO: 253515 - DNA, 25 bp, Mus musculus
atgaattgctagaccctcattgtgc

SEQ ID NO: 253516 - DNA, 25 bp, Mus musculus
atgaattgctagtccctcattgtgc

SEQ ID NO: 253517 - DNA, 25 bp, Mus musculus
atgaattggcagaaaatgttagtca

SEQ ID NO: 253518 - DNA, 25 bp, Mus musculus
atgaattggcagtaaatgttagtca

SEQ ID NO: 253519 - DNA, 25 bp, Mus musculus
atgaattgggccctgtcttcctgcc

SEQ ID NO: 253520 - DNA, 25 bp, Mus musculus
atgaattgggccgtgtcttcctgcc

SEQ ID NO: 253521 - DNA, 25 bp, Mus musculus
atgaattgtgttctgtgctatatgt

SEQ ID NO: 253522 - DNA, 25 bp, Mus musculus
atgaattgtgttgtgtgctatatgt

SEQ ID NO: 253523 - DNA, 25 bp, Mus musculus
atgaattgtttcactcacagccctt

SEQ ID NO: 253524 - DNA, 25 bp, Mus musculus
atgaattgtttctctcacagccctt

SEQ ID NO: 253525 - DNA, 25 bp, Mus musculus
atgaatttaaatacagcaaagtctg

SEQ ID NO: 253526 - DNA, 25 bp, Mus musculus
atgaatttaaattcagcaaagtctg

SEQ ID NO: 253527 - DNA, 25 bp, Mus musculus
atgaatttcaaaacaccacgtggag

SEQ ID NO: 253528 - DNA, 25 bp, Mus musculus
atgaatttcaaatcaccacgtggag

SEQ ID NO: 253529 - DNA, 25 bp, Mus musculus
atgaatttcagcactgttccttaaa

SEQ ID NO: 253530 - DNA, 25 bp, Mus musculus
atgaatttcagctctgttccttaaa

SEQ ID NO: 253531 - DNA, 25 bp, Mus musculus
atgaatttccccagcaggagaaatc

SEQ ID NO: 253532 - DNA, 25 bp, Mus musculus
atgaatttccccataagtcaggctt

SEQ ID NO: 253533 - DNA, 25 bp, Mus musculus
atgaatttcccctgcaggagaaatc

SEQ ID NO: 253534 - DNA, 25 bp, Mus musculus
atgaatttccccttaagtcaggctt

SEQ ID NO: 253535 - DNA, 25 bp, Mus musculus
atgaatttgccacgaagccttggtt

SEQ ID NO: 253536 - DNA, 25 bp, Mus musculus
atgaatttgccaggaagccttggtt

SEQ ID NO: 253537 - DNA, 25 bp, Mus musculus
atgaatttgtcaacctcagagggcc

SEQ ID NO: 253538 - DNA, 25 bp, Mus musculus
atgaatttgtcatcctcagagggcc

SEQ ID NO: 253539 - DNA, 25 bp, Mus musculus
atgaatttgtgcaccatgctctgtg

SEQ ID NO: 253540 - DNA, 25 bp, Mus musculus
atgaatttgtgctccatgctctgtg

SEQ ID NO: 253541 - DNA, 25 bp, Mus musculus
atgaatttgttgacaatggtctcaa

SEQ ID NO: 253542 - DNA, 25 bp, Mus musculus
atgaatttgttgtcaatggtctcaa

SEQ ID NO: 253543 - DNA, 25 bp, Mus musculus
atgaattttactactcttgggtggt

SEQ ID NO: 253544 - DNA, 25 bp, Mus musculus
atgaattttacttctcttgggtggt

SEQ ID NO: 253545 - DNA, 25 bp, Mus musculus
atgaattttatcacctctccaaagt

SEQ ID NO: 253546 - DNA, 25 bp, Mus musculus
atgaattttatctcctctccaaagt

SEQ ID NO: 253547 - DNA, 25 bp, Mus musculus
atgaattttatgcacatttggcagg

SEQ ID NO: 253548 - DNA, 25 bp, Mus musculus
atgaattttatggacatttggcagg

SEQ ID NO: 253549 - DNA, 25 bp, Mus musculus
atgaattttcacacagtatccctcc

SEQ ID NO: 253550 - DNA, 25 bp, Mus musculus
atgaattttcactcagtatccctcc

SEQ ID NO: 253551 - DNA, 25 bp, Mus musculus
atgaattttcttcttcttgctctag

SEQ ID NO: 253552 - DNA, 25 bp, Mus musculus
atgaattttcttgttcttgctctag

SEQ ID NO: 253553 - DNA, 25 bp, Mus musculus
atgaattttgctaaagttaactgta

SEQ ID NO: 253554 - DNA, 25 bp, Mus musculus
atgaattttgcttaagttaactgta

SEQ ID NO: 253555 - DNA, 25 bp, Mus musculus
atgacaaaagtcacctcttcagggc

SEQ ID NO: 253556 - DNA, 25 bp, Mus musculus
atgacaaaagtctcctcttcagggc

SEQ ID NO: 253557 - DNA, 25 bp, Mus musculus
atgacaaaatcactgcttccagtag

SEQ ID NO: 253558 - DNA, 25 bp, Mus musculus
atgacaaaatcagtgcttccagtag

SEQ ID NO: 253559 - DNA, 25 bp, Mus musculus
atgacaaacactctggagcactatt

SEQ ID NO: 253560 - DNA, 25 bp, Mus musculus
atgacaaacactgtggagcactatt

SEQ ID NO: 253561 - DNA, 25 bp, Mus musculus
atgacaaaccttacagcactgtgga

SEQ ID NO: 253562 - DNA, 25 bp, Mus musculus
atgacaaacctttcagcactgtgga

SEQ ID NO: 253563 - DNA, 25 bp, Mus musculus
atgacaaagaatacttccaccctcg

SEQ ID NO: 253564 - DNA, 25 bp, Mus musculus
atgacaaagaattcttccaccctcg

SEQ ID NO: 253565 - DNA, 25 bp, Mus musculus
atgacaaagcgtcgttatcctgttt

SEQ ID NO: 253566 - DNA, 25 bp, Mus musculus
atgacaaagcgtggttatcctgttt

SEQ ID NO: 253567 - DNA, 25 bp, Mus musculus
atgacaaagctgcatgccagtccgt

SEQ ID NO: 253568 - DNA, 25 bp, Mus musculus
atgacaaagctggatgccagtccgt

SEQ ID NO: 253569 - DNA, 25 bp, Mus musculus
atgacaaatctactgacaattcaag

SEQ ID NO: 253570 - DNA, 25 bp, Mus musculus
atgacaaatctagtgacaattcaag

SEQ ID NO: 253571 - DNA, 25 bp, Mus musculus
atgacaacaactactcttttacact

SEQ ID NO: 253572 - DNA, 25 bp, Mus musculus
atgacaacaacttctcttttacact

SEQ ID NO: 253573 - DNA, 25 bp, Mus musculus
atgacaacaatcaccaaactgaagt

SEQ ID NO: 253574 - DNA, 25 bp, Mus musculus
atgacaacaatctccaaactgaagt

SEQ ID NO: 253575 - DNA, 25 bp, Mus musculus
atgacaacactacctactctcttat

SEQ ID NO: 253576 - DNA, 25 bp, Mus musculus
atgacaacactagctactctcttat

SEQ ID NO: 253577 - DNA, 25 bp, Mus musculus
atgacaacagagacagctgcctggg

SEQ ID NO: 253578 - DNA, 25 bp, Mus musculus
atgacaacagagtcagctgcctggg

SEQ ID NO: 253579 - DNA, 25 bp, Mus musculus
atgacaacatgcctgtagccacagc

SEQ ID NO: 253580 - DNA, 25 bp, Mus musculus
atgacaacatgcgtgtagccacagc

SEQ ID NO: 253581 - DNA, 25 bp, Mus musculus
atgacaacattgactcctgcttaag

SEQ ID NO: 253582 - DNA, 25 bp, Mus musculus
atgacaacattgtctcctgcttaag

SEQ ID NO: 253583 - DNA, 25 bp, Mus musculus
atgacaaccacgatagagtccccag

SEQ ID NO: 253584 - DNA, 25 bp, Mus musculus
atgacaaccacgttagagtccccag

SEQ ID NO: 253585 - DNA, 25 bp, Mus musculus
atgacaacccagaatacgtatgaga

SEQ ID NO: 253586 - DNA, 25 bp, Mus musculus
atgacaacccagtatacgtatgaga

SEQ ID NO: 253587 - DNA, 25 bp, Mus musculus
atgacaacctcccaaaagcaccgag

SEQ ID NO: 253588 - DNA, 25 bp, Mus musculus
atgacaacctccgaaaagcaccgag

SEQ ID NO: 253589 - DNA, 25 bp, Mus musculus
atgacaacctttaattcttctactc

SEQ ID NO: 253590 - DNA, 25 bp, Mus musculus
atgacaaccttttattcttctactc

SEQ ID NO: 253591 - DNA, 25 bp, Mus musculus
atgacaacgccacatcttgttcctt

SEQ ID NO: 253592 - DNA, 25 bp, Mus musculus
atgacaacgccagatcttgttcctt

SEQ ID NO: 253593 - DNA, 25 bp, Mus musculus
atgacaacggctatcccttccggtg

SEQ ID NO: 253594 - DNA, 25 bp, Mus musculus
atgacaacggctttcccttccggtg

SEQ ID NO: 253595 - DNA, 25 bp, Mus musculus
atgacaactaccaattctttttcct

SEQ ID NO: 253596 - DNA, 25 bp, Mus musculus
atgacaactacctattctttttcct

SEQ ID NO: 253597 - DNA, 25 bp, Mus musculus
atgacaactccaataaatacccagg

SEQ ID NO: 253598 - DNA, 25 bp, Mus musculus
atgacaactccattaaatacccagg

SEQ ID NO: 253599 - DNA, 25 bp, Mus musculus
atgacaactggcaggctttatgcaa

SEQ ID NO: 253600 - DNA, 25 bp, Mus musculus
atgacaactggctggctttatgcaa

SEQ ID NO: 253601 - DNA, 25 bp, Mus musculus
atgacaactgtgctagcccagctaa

SEQ ID NO: 253602 - DNA, 25 bp, Mus musculus
atgacaactgtggtagcccagctaa

SEQ ID NO: 253603 - DNA, 25 bp, Mus musculus
atgacaacttgccacttctgggcac

SEQ ID NO: 253604 - DNA, 25 bp, Mus musculus
atgacaacttgcgacttctgggcac

SEQ ID NO: 253605 - DNA, 25 bp, Mus musculus
atgacaagacaacaagtatcctatg

SEQ ID NO: 253606 - DNA, 25 bp, Mus musculus
atgacaagacaagaagtatcctatg

SEQ ID NO: 253607 - DNA, 25 bp, Mus musculus
atgacaagaccactttctctaattt

SEQ ID NO: 253608 - DNA, 25 bp, Mus musculus
atgacaagaccagtttctctaattt

SEQ ID NO: 253609 - DNA, 25 bp, Mus musculus
atgacaagactcagcccaaactgga

SEQ ID NO: 253610 - DNA, 25 bp, Mus musculus
atgacaagactctgcccaaactgga

SEQ ID NO: 253611 - DNA, 25 bp, Mus musculus
atgacaagatggagactgacaacct

SEQ ID NO: 253612 - DNA, 25 bp, Mus musculus
atgacaagatggtgactgacaacct

SEQ ID NO: 253613 - DNA, 25 bp, Mus musculus
atgacaagcacaagaaaggcgaggg

SEQ ID NO: 253614 - DNA, 25 bp, Mus musculus
atgacaagcacatgaaaggcgaggg

SEQ ID NO: 253615 - DNA, 25 bp, Mus musculus
atgacaagcatgatcctcctgagaa

SEQ ID NO: 253616 - DNA, 25 bp, Mus musculus
atgacaagcatgttcctcctgagaa

SEQ ID NO: 253617 - DNA, 25 bp, Mus musculus
atgacaagctgacggacaaggccaa

SEQ ID NO: 253618 - DNA, 25 bp, Mus musculus
atgacaagctgagggacaaggccaa

SEQ ID NO: 253619 - DNA, 25 bp, Mus musculus
atgacaaggcctatgtgacttccca

SEQ ID NO: 253620 - DNA, 25 bp, Mus musculus
atgacaaggcctttgtgacttccca

SEQ ID NO: 253621 - DNA, 25 bp, Mus musculus
atgacaaggctcattcctgtttgct

SEQ ID NO: 253622 - DNA, 25 bp, Mus musculus
atgacaaggctctttcctgtttgct

SEQ ID NO: 253623 - DNA, 25 bp, Mus musculus
atgacaaggctgcatgggtatttca

SEQ ID NO: 253624 - DNA, 25 bp, Mus musculus
atgacaaggctggatgggtatttca

SEQ ID NO: 253625 - DNA, 25 bp, Mus musculus
atgacaagttatcctgggcggttgt

SEQ ID NO: 253626 - DNA, 25 bp, Mus musculus
atgacaagttatgctgggcggttgt

SEQ ID NO: 253627 - DNA, 25 bp, Mus musculus
atgacaatagccacctcagtttcca

SEQ ID NO: 253628 - DNA, 25 bp, Mus musculus
atgacaatagcctcctcagtttcca

SEQ ID NO: 253629 - DNA, 25 bp, Mus musculus
atgacaatctacaggcccagtcctt

SEQ ID NO: 253630 - DNA, 25 bp, Mus musculus
atgacaatctactggcccagtcctt

SEQ ID NO: 253631 - DNA, 25 bp, Mus musculus
atgacaatctgcagactaccatccc

SEQ ID NO: 253632 - DNA, 25 bp, Mus musculus
atgacaatctgctgactaccatccc

SEQ ID NO: 253633 - DNA, 25 bp, Mus musculus
atgacaatgactactgcctgggctc

SEQ ID NO: 253634 - DNA, 25 bp, Mus musculus
atgacaatgacttctgcctgggctc

SEQ ID NO: 253635 - DNA, 25 bp, Mus musculus
atgacaatgatcagcccatggagga

SEQ ID NO: 253636 - DNA, 25 bp, Mus musculus
atgacaatgatctgcccatggagga

SEQ ID NO: 253637 - DNA, 25 bp, Mus musculus
atgacaatggcaaggctcttccaga

SEQ ID NO: 253638 - DNA, 25 bp, Mus musculus
atgacaatggcatggctcttccaga

SEQ ID NO: 253639 - DNA, 25 bp, Mus musculus
atgacaatggtgactgcctttgcag

SEQ ID NO: 253640 - DNA, 25 bp, Mus musculus
atgacaatggtgtctgcctttgcag

SEQ ID NO: 253641 - DNA, 25 bp, Mus musculus
atgacaatgtcacgagcttcaagtt

SEQ ID NO: 253642 - DNA, 25 bp, Mus musculus
atgacaatgtcaggagcttcaagtt

SEQ ID NO: 253643 - DNA, 25 bp, Mus musculus
atgacaattaagatgccagaacgag

SEQ ID NO: 253644 - DNA, 25 bp, Mus musculus
atgacaattaagttgccagaacgag

SEQ ID NO: 253645 - DNA, 25 bp, Mus musculus
atgacaatttcacgtactatactat

SEQ ID NO: 253646 - DNA, 25 bp, Mus musculus
atgacaatttcaggtactatactat

SEQ ID NO: 253647 - DNA, 25 bp, Mus musculus
atgacacaacacacggagactgact

SEQ ID NO: 253648 - DNA, 25 bp, Mus musculus
atgacacaacactcggagactgact

SEQ ID NO: 253649 - DNA, 25 bp, Mus musculus
atgacacaatttcttcccttctacc

SEQ ID NO: 253650 - DNA, 25 bp, Mus musculus
atgacacaatttgttcccttctacc

SEQ ID NO: 253651 - DNA, 25 bp, Mus musculus
atgacacacacaaacctctattgct

SEQ ID NO: 253652 - DNA, 25 bp, Mus musculus
atgacacacacatacctctattgct

SEQ ID NO: 253653 - DNA, 25 bp, Mus musculus
atgacacacgtgattccgccgggca

SEQ ID NO: 253654 - DNA, 25 bp, Mus musculus
atgacacacgtgtttccgccgggca

SEQ ID NO: 253655 - DNA, 25 bp, Mus musculus
atgacacactacatcaagcacctgt

SEQ ID NO: 253656 - DNA, 25 bp, Mus musculus
atgacacactacttcaagcacctgt

SEQ ID NO: 253657 - DNA, 25 bp, Mus musculus
atgacacactggatcaccttggaag

SEQ ID NO: 253658 - DNA, 25 bp, Mus musculus
atgacacactggttcaccttggaag

SEQ ID NO: 253659 - DNA, 25 bp, Mus musculus
atgacacagcagatgccatcttgaa

SEQ ID NO: 253660 - DNA, 25 bp, Mus musculus
atgacacagcagttgccatcttgaa

SEQ ID NO: 253661 - DNA, 25 bp, Mus musculus
atgacacagctccagagactctgat

SEQ ID NO: 253662 - DNA, 25 bp, Mus musculus
atgacacagctcgagagactctgat

SEQ ID NO: 253663 - DNA, 25 bp, Mus musculus
atgacacagcttctttcaaacctat

SEQ ID NO: 253664 - DNA, 25 bp, Mus musculus
atgacacagcttgtttcaaacctat

SEQ ID NO: 253665 - DNA, 25 bp, Mus musculus
atgacacagggcacttgtggacccc

SEQ ID NO: 253666 - DNA, 25 bp, Mus musculus
atgacacagggctcttgtggacccc

SEQ ID NO: 253667 - DNA, 25 bp, Mus musculus
atgacacaggtgctcatctagttgt

SEQ ID NO: 253668 - DNA, 25 bp, Mus musculus
atgacacaggtggtcatctagttgt

SEQ ID NO: 253669 - DNA, 25 bp, Mus musculus
atgacacatctcacagtaacctggg

SEQ ID NO: 253670 - DNA, 25 bp, Mus musculus
atgacacatctctcagtaacctggg

SEQ ID NO: 253671 - DNA, 25 bp, Mus musculus
atgacacatgtgaaggccagataac

SEQ ID NO: 253672 - DNA, 25 bp, Mus musculus
atgacacatgtgtaggccagataac

SEQ ID NO: 253673 - DNA, 25 bp, Mus musculus
atgacacattgtcctctagattgta

SEQ ID NO: 253674 - DNA, 25 bp, Mus musculus
atgacacattgtgctctagattgta

SEQ ID NO: 253675 - DNA, 25 bp, Mus musculus
atgacaccaaagcactcactgattg

SEQ ID NO: 253676 - DNA, 25 bp, Mus musculus
atgacaccaaaggactcactgattg

SEQ ID NO: 253677 - DNA, 25 bp, Mus musculus
atgacaccaccaacacgggagactg

SEQ ID NO: 253678 - DNA, 25 bp, Mus musculus
atgacaccaccatcacgggagactg

SEQ ID NO: 253679 - DNA, 25 bp, Mus musculus
atgacaccacccatagtgggctggg

SEQ ID NO: 253680 - DNA, 25 bp, Mus musculus
atgacaccacccttagtgggctggg

SEQ ID NO: 253681 - DNA, 25 bp, Mus musculus
atgacaccagggaccttaagcccta

SEQ ID NO: 253682 - DNA, 25 bp, Mus musculus
atgacaccagggtccttaagcccta

SEQ ID NO: 253683 - DNA, 25 bp, Mus musculus
atgacaccatcaagcacccaggagg

SEQ ID NO: 253684 - DNA, 25 bp, Mus musculus
atgacaccatcatgcacccaggagg

SEQ ID NO: 253685 - DNA, 25 bp, Mus musculus
atgacaccatgaaatttgccggcaa

SEQ ID NO: 253686 - DNA, 25 bp, Mus musculus
atgacaccatgatatttgccggcaa

SEQ ID NO: 253687 - DNA, 25 bp, Mus musculus
atgacaccccatacatgtgatatgt

SEQ ID NO: 253688 - DNA, 25 bp, Mus musculus
atgacaccccattcatgtgatatgt

SEQ ID NO: 253689 - DNA, 25 bp, Mus musculus
atgacacccggaaacctgtgactga

SEQ ID NO: 253690 - DNA, 25 bp, Mus musculus
atgacacccggaagcacagaaaaca

SEQ ID NO: 253691 - DNA, 25 bp, Mus musculus
atgacacccggatacctgtgactga

SEQ ID NO: 253692 - DNA, 25 bp, Mus musculus
atgacacccggatgcacagaaaaca

SEQ ID NO: 253693 - DNA, 25 bp, Mus musculus
atgacaccctatcatgacccctatt

SEQ ID NO: 253694 - DNA, 25 bp, Mus musculus
atgacaccctatgatgacccctatt

SEQ ID NO: 253695 - DNA, 25 bp, Mus musculus
atgacaccctgaaagcaggattcta

SEQ ID NO: 253696 - DNA, 25 bp, Mus musculus
atgacaccctgatagcaggattcta

SEQ ID NO: 253697 - DNA, 25 bp, Mus musculus
atgacacctatgagaccaacacacc

SEQ ID NO: 253698 - DNA, 25 bp, Mus musculus
atgacacctatgtgaccaacacacc

SEQ ID NO: 253699 - DNA, 25 bp, Mus musculus
atgacacctcacatgtaagaactga

SEQ ID NO: 253700 - DNA, 25 bp, Mus musculus
atgacacctcacttgtaagaactga

SEQ ID NO: 253701 - DNA, 25 bp, Mus musculus
atgacacctcagactaggccagttt

SEQ ID NO: 253702 - DNA, 25 bp, Mus musculus
atgacacctcagtctaggccagttt

SEQ ID NO: 253703 - DNA, 25 bp, Mus musculus
atgacacctgaaaatgatggcattc

SEQ ID NO: 253704 - DNA, 25 bp, Mus musculus
atgacacctgaatatgatggcattc

SEQ ID NO: 253705 - DNA, 25 bp, Mus musculus
atgacacctgccactgttggctgga

SEQ ID NO: 253706 - DNA, 25 bp, Mus musculus
atgacacctgcctctgttggctgga

SEQ ID NO: 253707 - DNA, 25 bp, Mus musculus
atgacacctggcagatatcttgttt

SEQ ID NO: 253708 - DNA, 25 bp, Mus musculus
atgacacctggcaggtgtgggtttt

SEQ ID NO: 253709 - DNA, 25 bp, Mus musculus
atgacacctggctgatatcttgttt

SEQ ID NO: 253710 - DNA, 25 bp, Mus musculus
atgacacctggctggtgtgggtttt

SEQ ID NO: 253711 - DNA, 25 bp, Mus musculus
atgacacctgtcatcagctgtcagt

SEQ ID NO: 253712 - DNA, 25 bp, Mus musculus
atgacacctgtcttcagctgtcagt

SEQ ID NO: 253713 - DNA, 25 bp, Mus musculus
atgacacctttgaccatgttaccga

SEQ ID NO: 253714 - DNA, 25 bp, Mus musculus
atgacacctttgtccatgttaccga

SEQ ID NO: 253715 - DNA, 25 bp, Mus musculus
atgacacgactcagcctgaggagtt

SEQ ID NO: 253716 - DNA, 25 bp, Mus musculus
atgacacgactctgcctgaggagtt

SEQ ID NO: 253717 - DNA, 25 bp, Mus musculus
atgacacgctatatctacctttttc

SEQ ID NO: 253718 - DNA, 25 bp, Mus musculus
atgacacgctatttctacctttttc

SEQ ID NO: 253719 - DNA, 25 bp, Mus musculus
atgacacgctcaaactacaatagta

SEQ ID NO: 253720 - DNA, 25 bp, Mus musculus
atgacacgctcatactacaatagta

SEQ ID NO: 253721 - DNA, 25 bp, Mus musculus
atgacacggagcacgtgctggcgtt

SEQ ID NO: 253722 - DNA, 25 bp, Mus musculus
atgacacggagctcgtgctggcgtt

SEQ ID NO: 253723 - DNA, 25 bp, Mus musculus
atgacactattcacactgttaggtg

SEQ ID NO: 253724 - DNA, 25 bp, Mus musculus
atgacactattctcactgttaggtg

SEQ ID NO: 253725 - DNA, 25 bp, Mus musculus
atgacactcatgctatcggcatctt

SEQ ID NO: 253726 - DNA, 25 bp, Mus musculus
atgacactcatggtatcggcatctt

SEQ ID NO: 253727 - DNA, 25 bp, Mus musculus
atgacactccatacatagcacgcgt

SEQ ID NO: 253728 - DNA, 25 bp, Mus musculus
atgacactccattcatagcacgcgt

SEQ ID NO: 253729 - DNA, 25 bp, Mus musculus
atgacactcctaaccctgatttttg

SEQ ID NO: 253730 - DNA, 25 bp, Mus musculus
atgacactcctatccctgatttttg

SEQ ID NO: 253731 - DNA, 25 bp, Mus musculus
atgacactcctgagtctttcgatgg

SEQ ID NO: 253732 - DNA, 25 bp, Mus musculus
atgacactcctgtgtctttcgatgg

SEQ ID NO: 253733 - DNA, 25 bp, Mus musculus
atgacactctgaagtacatcctgga

SEQ ID NO: 253734 - DNA, 25 bp, Mus musculus
atgacactctgatgtacatcctgga

SEQ ID NO: 253735 - DNA, 25 bp, Mus musculus
atgacactgcctaacccaggtttaa

SEQ ID NO: 253736 - DNA, 25 bp, Mus musculus
atgacactgccttacccaggtttaa

SEQ ID NO: 253737 - DNA, 25 bp, Mus musculus
atgacactgctgaggtggacatctt

SEQ ID NO: 253738 - DNA, 25 bp, Mus musculus
atgacactgctgtggtggacatctt

SEQ ID NO: 253739 - DNA, 25 bp, Mus musculus
atgacactggagctgctcaacgaga

SEQ ID NO: 253740 - DNA, 25 bp, Mus musculus
atgacactggaggtgctcaacgaga

SEQ ID NO: 253741 - DNA, 25 bp, Mus musculus
atgacactggttaaattacatttaa

SEQ ID NO: 253742 - DNA, 25 bp, Mus musculus
atgacactggtttaattacatttaa

SEQ ID NO: 253743 - DNA, 25 bp, Mus musculus
atgacactgtgaacttcagctctca

SEQ ID NO: 253744 - DNA, 25 bp, Mus musculus
atgacactgtgatcttcagctctca

SEQ ID NO: 253745 - DNA, 25 bp, Mus musculus
atgacacttagtcagttatcctgaa

SEQ ID NO: 253746 - DNA, 25 bp, Mus musculus
atgacacttagtgagttatcctgaa

SEQ ID NO: 253747 - DNA, 25 bp, Mus musculus
atgacacttgtcagccttgaagcat

SEQ ID NO: 253748 - DNA, 25 bp, Mus musculus
atgacacttgtctgccttgaagcat

SEQ ID NO: 253749 - DNA, 25 bp, Mus musculus
atgacacttgttagggcaggcatcc

SEQ ID NO: 253750 - DNA, 25 bp, Mus musculus
atgacacttgtttgggcaggcatcc

SEQ ID NO: 253751 - DNA, 25 bp, Mus musculus
atgacacttttcatgtctgcgtgca

SEQ ID NO: 253752 - DNA, 25 bp, Mus musculus
atgacacttttcttgtctgcgtgca

SEQ ID NO: 253753 - DNA, 25 bp, Mus musculus
atgacactttttctttggaatgcta

SEQ ID NO: 253754 - DNA, 25 bp, Mus musculus
atgacactttttgtttggaatgcta

SEQ ID NO: 253755 - DNA, 25 bp, Mus musculus
atgacagaacccagcactcagtgag

SEQ ID NO: 253756 - DNA, 25 bp, Mus musculus
atgacagaaccctgcactcagtgag

SEQ ID NO: 253757 - DNA, 25 bp, Mus musculus
atgacagaacctatcacaagcagtt

SEQ ID NO: 253758 - DNA, 25 bp, Mus musculus
atgacagaacctttcacaagcagtt

SEQ ID NO: 253759 - DNA, 25 bp, Mus musculus
atgacagaacgcagttcacacctct

SEQ ID NO: 253760 - DNA, 25 bp, Mus musculus
atgacagaacgctgttcacacctct

SEQ ID NO: 253761 - DNA, 25 bp, Mus musculus
atgacagaactcatcgatcacatga

SEQ ID NO: 253762 - DNA, 25 bp, Mus musculus
atgacagaactcttcgatcacatga

SEQ ID NO: 253763 - DNA, 25 bp, Mus musculus
atgacagaagcacggttgcaaacct

SEQ ID NO: 253764 - DNA, 25 bp, Mus musculus
atgacagaagcagggttgcaaacct

SEQ ID NO: 253765 - DNA, 25 bp, Mus musculus
atgacagaagtcagagtctctcgcc

SEQ ID NO: 253766 - DNA, 25 bp, Mus musculus
atgacagaagtctgagtctctcgcc

SEQ ID NO: 253767 - DNA, 25 bp, Mus musculus
atgacagacaagacttccccatgaa

SEQ ID NO: 253768 - DNA, 25 bp, Mus musculus
atgacagacaagtcttccccatgaa

SEQ ID NO: 253769 - DNA, 25 bp, Mus musculus
atgacagacactacctacacattgt

SEQ ID NO: 253770 - DNA, 25 bp, Mus musculus
atgacagacacttcctacacattgt

SEQ ID NO: 253771 - DNA, 25 bp, Mus musculus
atgacagacgaactattgacccatg

SEQ ID NO: 253772 - DNA, 25 bp, Mus musculus
atgacagacgaagtattgacccatg

SEQ ID NO: 253773 - DNA, 25 bp, Mus musculus
atgacagactctcggtttcgggaag

SEQ ID NO: 253774 - DNA, 25 bp, Mus musculus
atgacagactctgggtttcgggaag

SEQ ID NO: 253775 - DNA, 25 bp, Mus musculus
atgacagagctgctgtcctccaggg

SEQ ID NO: 253776 - DNA, 25 bp, Mus musculus
atgacagagctggtgtcctccaggg

SEQ ID NO: 253777 - DNA, 25 bp, Mus musculus
atgacagagtttccttggtttaaga

SEQ ID NO: 253778 - DNA, 25 bp, Mus musculus
atgacagagtttgcttggtttaaga

SEQ ID NO: 253779 - DNA, 25 bp, Mus musculus
atgacagatactcggactgtggagc

SEQ ID NO: 253780 - DNA, 25 bp, Mus musculus
atgacagatactgggactgtggagc

SEQ ID NO: 253781 - DNA, 25 bp, Mus musculus
atgacagatagtatccagagtacgc

SEQ ID NO: 253782 - DNA, 25 bp, Mus musculus
atgacagatagtttccagagtacgc

SEQ ID NO: 253783 - DNA, 25 bp, Mus musculus
atgacagatcggctgtgcccacctc

SEQ ID NO: 253784 - DNA, 25 bp, Mus musculus
atgacagatcgggtgtgcccacctc

SEQ ID NO: 253785 - DNA, 25 bp, Mus musculus
atgacagatgcccacagcctctgca

SEQ ID NO: 253786 - DNA, 25 bp, Mus musculus
atgacagatgccgacagcctctgca

SEQ ID NO: 253787 - DNA, 25 bp, Mus musculus
atgacagcaactccgtgttctgccg

SEQ ID NO: 253788 - DNA, 25 bp, Mus musculus
atgacagcaactgcgtgttctgccg

SEQ ID NO: 253789 - DNA, 25 bp, Mus musculus
atgacagcaagaagcaccctgggtc

SEQ ID NO: 253790 - DNA, 25 bp, Mus musculus
atgacagcaagatgcaccctgggtc

SEQ ID NO: 253791 - DNA, 25 bp, Mus musculus
atgacagcaatgcacatggcagagt

SEQ ID NO: 253792 - DNA, 25 bp, Mus musculus
atgacagcaatggacatggcagagt

SEQ ID NO: 253793 - DNA, 25 bp, Mus musculus
atgacagcacacactcagaactggc

SEQ ID NO: 253794 - DNA, 25 bp, Mus musculus
atgacagcacactctcagaactggc

SEQ ID NO: 253795 - DNA, 25 bp, Mus musculus
atgacagcacatcggcagccagacc

SEQ ID NO: 253796 - DNA, 25 bp, Mus musculus
atgacagcacatgggcagccagacc

SEQ ID NO: 253797 - DNA, 25 bp, Mus musculus
atgacagcagcgacgactcaggaga

SEQ ID NO: 253798 - DNA, 25 bp, Mus musculus
atgacagcagcgtcgactcaggaga

SEQ ID NO: 253799 - DNA, 25 bp, Mus musculus
atgacagcagctcacctaggcctgg

SEQ ID NO: 253800 - DNA, 25 bp, Mus musculus
atgacagcagctgacctaggcctgg

SEQ ID NO: 253801 - DNA, 25 bp, Mus musculus
atgacagcatcaagctcttctctgc

SEQ ID NO: 253802 - DNA, 25 bp, Mus musculus
atgacagcatcatgctcttctctgc

SEQ ID NO: 253803 - DNA, 25 bp, Mus musculus
atgacagcatctaaaccctgtttaa

SEQ ID NO: 253804 - DNA, 25 bp, Mus musculus
atgacagcatcttaaccctgtttaa

SEQ ID NO: 253805 - DNA, 25 bp, Mus musculus
atgacagcattcctgcctttgtatt

SEQ ID NO: 253806 - DNA, 25 bp, Mus musculus
atgacagcattcgtgcctttgtatt

SEQ ID NO: 253807 - DNA, 25 bp, Mus musculus
atgacagccgtaaagcacgaacagg

SEQ ID NO: 253808 - DNA, 25 bp, Mus musculus
atgacagccgtatagcacgaacagg

SEQ ID NO: 253809 - DNA, 25 bp, Mus musculus
atgacagcctcaattccctagatga

SEQ ID NO: 253810 - DNA, 25 bp, Mus musculus
atgacagcctcatttccctagatga

SEQ ID NO: 253811 - DNA, 25 bp, Mus musculus
atgacagcggatcttcttcattctc

SEQ ID NO: 253812 - DNA, 25 bp, Mus musculus
atgacagcggatgttcttcattctc

SEQ ID NO: 253813 - DNA, 25 bp, Mus musculus
atgacagcgtccatacatctcagag

SEQ ID NO: 253814 - DNA, 25 bp, Mus musculus
atgacagcgtccttacatctcagag

SEQ ID NO: 253815 - DNA, 25 bp, Mus musculus
atgacagctccgaagcttctgagga

SEQ ID NO: 253816 - DNA, 25 bp, Mus musculus
atgacagctccgtagcttctgagga

SEQ ID NO: 253817 - DNA, 25 bp, Mus musculus
atgacagctctaaaccaagtgtcca

SEQ ID NO: 253818 - DNA, 25 bp, Mus musculus
atgacagctctataccaagtgtcca

SEQ ID NO: 253819 - DNA, 25 bp, Mus musculus
atgacagctctccttggaaggctga

SEQ ID NO: 253820 - DNA, 25 bp, Mus musculus
atgacagctctcgttggaaggctga

SEQ ID NO: 253821 - DNA, 25 bp, Mus musculus
atgacagctctgaccaggctcggga

SEQ ID NO: 253822 - DNA, 25 bp, Mus musculus
atgacagctctgtccaggctcggga

SEQ ID NO: 253823 - DNA, 25 bp, Mus musculus
atgacagctgacaggtcctgatgca

SEQ ID NO: 253824 - DNA, 25 bp, Mus musculus
atgacagctgactggtcctgatgca

SEQ ID NO: 253825 - DNA, 25 bp, Mus musculus
atgacagctgtgacatcctgctcca

SEQ ID NO: 253826 - DNA, 25 bp, Mus musculus
atgacagctgtgtcatcctgctcca

SEQ ID NO: 253827 - DNA, 25 bp, Mus musculus
atgacagcttcgagggccccaagga

SEQ ID NO: 253828 - DNA, 25 bp, Mus musculus
atgacagcttcgtgggccccaagga

SEQ ID NO: 253829 - DNA, 25 bp, Mus musculus
atgacagctttactagtatatccaa

SEQ ID NO: 253830 - DNA, 25 bp, Mus musculus
atgacagctttagtagtatatccaa

SEQ ID NO: 253831 - DNA, 25 bp, Mus musculus
atgacaggaaaacctctctcacagg

SEQ ID NO: 253832 - DNA, 25 bp, Mus musculus
atgacaggaaaagctctctcacagg

SEQ ID NO: 253833 - DNA, 25 bp, Mus musculus
atgacaggacacagcaagctctggt

SEQ ID NO: 253834 - DNA, 25 bp, Mus musculus
atgacaggacactgcaagctctggt

SEQ ID NO: 253835 - DNA, 25 bp, Mus musculus
atgacaggactcactcgcctgtgct

SEQ ID NO: 253836 - DNA, 25 bp, Mus musculus
atgacaggactctctcgcctgtgct

SEQ ID NO: 253837 - DNA, 25 bp, Mus musculus
atgacaggattcatcctgtctcagc

SEQ ID NO: 253838 - DNA, 25 bp, Mus musculus
atgacaggattcttcctgtctcagc

SEQ ID NO: 253839 - DNA, 25 bp, Mus musculus
atgacaggatttctcaggtggtcca

SEQ ID NO: 253840 - DNA, 25 bp, Mus musculus
atgacaggatttgtcaggtggtcca

SEQ ID NO: 253841 - DNA, 25 bp, Mus musculus
atgacaggctgaagcaggacatttt

SEQ ID NO: 253842 - DNA, 25 bp, Mus musculus
atgacaggctgatgcaggacatttt

SEQ ID NO: 253843 - DNA, 25 bp, Mus musculus
atgacaggctgcagcaagctctcat

SEQ ID NO: 253844 - DNA, 25 bp, Mus musculus
atgacaggctgctgcaagctctcat

SEQ ID NO: 253845 - DNA, 25 bp, Mus musculus
atgacaggctgtaccctgtatgcaa

SEQ ID NO: 253846 - DNA, 25 bp, Mus musculus
atgacaggctgttccctgtatgcaa

SEQ ID NO: 253847 - DNA, 25 bp, Mus musculus
atgacaggcttgataagtggtcggt

SEQ ID NO: 253848 - DNA, 25 bp, Mus musculus
atgacaggcttgttaagtggtcggt

SEQ ID NO: 253849 - DNA, 25 bp, Mus musculus
atgacagggaacaaggtctgacctt

SEQ ID NO: 253850 - DNA, 25 bp, Mus musculus
atgacagggaactaggtctgacctt

SEQ ID NO: 253851 - DNA, 25 bp, Mus musculus
atgacagggagccaaaggcttccct

SEQ ID NO: 253852 - DNA, 25 bp, Mus musculus
atgacagggagcgaaaggcttccct

SEQ ID NO: 253853 - DNA, 25 bp, Mus musculus
atgacagggagtcttggctagctct

SEQ ID NO: 253854 - DNA, 25 bp, Mus musculus
atgacagggagtgttggctagctct

SEQ ID NO: 253855 - DNA, 25 bp, Mus musculus
atgacaggtagactcgatcccagaa

SEQ ID NO: 253856 - DNA, 25 bp, Mus musculus
atgacaggtagagtcgatcccagaa

SEQ ID NO: 253857 - DNA, 25 bp, Mus musculus
atgacaggtctccaggtctgcctaa

SEQ ID NO: 253858 - DNA, 25 bp, Mus musculus
atgacaggtctcgaggtctgcctaa

SEQ ID NO: 253859 - DNA, 25 bp, Mus musculus
atgacaggttccctctgggcttcaa

SEQ ID NO: 253860 - DNA, 25 bp, Mus musculus
atgacaggttccgtctgggcttcaa

SEQ ID NO: 253861 - DNA, 25 bp, Mus musculus
atgacaggtttcattaacccgcagg

SEQ ID NO: 253862 - DNA, 25 bp, Mus musculus
atgacaggtttctttaacccgcagg

SEQ ID NO: 253863 - DNA, 25 bp, Mus musculus
atgacagtaaagcaggctctgattt

SEQ ID NO: 253864 - DNA, 25 bp, Mus musculus
atgacagtaaaggaggctctgattt

SEQ ID NO: 253865 - DNA, 25 bp, Mus musculus
atgacagtaccgctgagaacccggt

SEQ ID NO: 253866 - DNA, 25 bp, Mus musculus
atgacagtaccggtgagaacccggt

SEQ ID NO: 253867 - DNA, 25 bp, Mus musculus
atgacagtagcaccagtatacacta

SEQ ID NO: 253868 - DNA, 25 bp, Mus musculus
atgacagtagcagcagtatacacta

SEQ ID NO: 253869 - DNA, 25 bp, Mus musculus
atgacagtagctcctgtaccacctg

SEQ ID NO: 253870 - DNA, 25 bp, Mus musculus
atgacagtagctgctgtaccacctg

SEQ ID NO: 253871 - DNA, 25 bp, Mus musculus
atgacagtcactagccagtaatcag

SEQ ID NO: 253872 - DNA, 25 bp, Mus musculus
atgacagtcacttgccagtaatcag

SEQ ID NO: 253873 - DNA, 25 bp, Mus musculus
atgacagtccaccagggaggatctt

SEQ ID NO: 253874 - DNA, 25 bp, Mus musculus
atgacagtccacgagggaggatctt

SEQ ID NO: 253875 - DNA, 25 bp, Mus musculus
atgacagtcccaacaatgccatttg

SEQ ID NO: 253876 - DNA, 25 bp, Mus musculus
atgacagtcccatcaatgccatttg

SEQ ID NO: 253877 - DNA, 25 bp, Mus musculus
atgacagtcctgagacagtgactta

SEQ ID NO: 253878 - DNA, 25 bp, Mus musculus
atgacagtcctgtgacagtgactta

SEQ ID NO: 253879 - DNA, 25 bp, Mus musculus
atgacagtctagcagtctcttttgc

SEQ ID NO: 253880 - DNA, 25 bp, Mus musculus
atgacagtctaggagtctcttttgc

SEQ ID NO: 253881 - DNA, 25 bp, Mus musculus
atgacagtctctacggcaggccaaa

SEQ ID NO: 253882 - DNA, 25 bp, Mus musculus
atgacagtctcttcggcaggccaaa

SEQ ID NO: 253883 - DNA, 25 bp, Mus musculus
atgacagtgaccctggtcccttgtg

SEQ ID NO: 253884 - DNA, 25 bp, Mus musculus
atgacagtgaccgtggtcccttgtg

SEQ ID NO: 253885 - DNA, 25 bp, Mus musculus
atgacagtgagtctagcttctcctt

SEQ ID NO: 253886 - DNA, 25 bp, Mus musculus
atgacagtgagtgtagcttctcctt

SEQ ID NO: 253887 - DNA, 25 bp, Mus musculus
atgacagtgatgacagaaccgtggt

SEQ ID NO: 253888 - DNA, 25 bp, Mus musculus
atgacagtgatgtcagaaccgtggt

SEQ ID NO: 253889 - DNA, 25 bp, Mus musculus
atgacagtgccaatgaccgggtgcc

SEQ ID NO: 253890 - DNA, 25 bp, Mus musculus
atgacagtgccattgaccgggtgcc

SEQ ID NO: 253891 - DNA, 25 bp, Mus musculus
atgacagtggcaatgttctctatga

SEQ ID NO: 253892 - DNA, 25 bp, Mus musculus
atgacagtggcattgttctctatga

SEQ ID NO: 253893 - DNA, 25 bp, Mus musculus
atgacagtgtccaagttcccttcta

SEQ ID NO: 253894 - DNA, 25 bp, Mus musculus
atgacagtgtcctagttcccttcta

SEQ ID NO: 253895 - DNA, 25 bp, Mus musculus
atgacagttacaacaggcagataaa

SEQ ID NO: 253896 - DNA, 25 bp, Mus musculus
atgacagttacatcaggcagataaa

SEQ ID NO: 253897 - DNA, 25 bp, Mus musculus
atgacagttaccattctttgtacat

SEQ ID NO: 253898 - DNA, 25 bp, Mus musculus
atgacagttacctttctttgtacat

SEQ ID NO: 253899 - DNA, 25 bp, Mus musculus
atgacagttccactacaactcccgt

SEQ ID NO: 253900 - DNA, 25 bp, Mus musculus
atgacagttccagtacaactcccgt

SEQ ID NO: 253901 - DNA, 25 bp, Mus musculus
atgacataaaacctccagtcctgag

SEQ ID NO: 253902 - DNA, 25 bp, Mus musculus
atgacataaaacgtccagtcctgag

SEQ ID NO: 253903 - DNA, 25 bp, Mus musculus
atgacatactgtcctcttggcttat

SEQ ID NO: 253904 - DNA, 25 bp, Mus musculus
atgacatactgtgctcttggcttat

SEQ ID NO: 253905 - DNA, 25 bp, Mus musculus
atgacatcacaaccatccggctgtt

SEQ ID NO: 253906 - DNA, 25 bp, Mus musculus
atgacatcacaagcatccggctgtt

SEQ ID NO: 253907 - DNA, 25 bp, Mus musculus
atgacatcacggagctggatgtgga

SEQ ID NO: 253908 - DNA, 25 bp, Mus musculus
atgacatcacggtgctggatgtgga

SEQ ID NO: 253909 - DNA, 25 bp, Mus musculus
atgacatcactgacgctgctcattt

SEQ ID NO: 253910 - DNA, 25 bp, Mus musculus
atgacatcactgtcgctgctcattt

SEQ ID NO: 253911 - DNA, 25 bp, Mus musculus
atgacatcataaaggagtttctccc

SEQ ID NO: 253912 - DNA, 25 bp, Mus musculus
atgacatcataatggagtttctccc

SEQ ID NO: 253913 - DNA, 25 bp, Mus musculus
atgacatcatagctctttacccaca

SEQ ID NO: 253914 - DNA, 25 bp, Mus musculus
atgacatcataggtctttacccaca

SEQ ID NO: 253915 - DNA, 25 bp, Mus musculus
atgacatcatcaccatgcgctatgc

SEQ ID NO: 253916 - DNA, 25 bp, Mus musculus
atgacatcatcagcatgcgctatgc

SEQ ID NO: 253917 - DNA, 25 bp, Mus musculus
atgacatcatctcttttgcctctgg

SEQ ID NO: 253918 - DNA, 25 bp, Mus musculus
atgacatcatctgttttgcctctgg

SEQ ID NO: 253919 - DNA, 25 bp, Mus musculus
atgacatcatgcctgcttcatgcaa

SEQ ID NO: 253920 - DNA, 25 bp, Mus musculus
atgacatcatgcgtgcttcatgcaa

SEQ ID NO: 253921 - DNA, 25 bp, Mus musculus
atgacatcattgcagcagccaagcg

SEQ ID NO: 253922 - DNA, 25 bp, Mus musculus
atgacatcattggagcagccaagcg

SEQ ID NO: 253923 - DNA, 25 bp, Mus musculus
atgacatccaccacctgaagattga

SEQ ID NO: 253924 - DNA, 25 bp, Mus musculus
atgacatccacctcctgaagattga

SEQ ID NO: 253925 - DNA, 25 bp, Mus musculus
atgacatccccacagggtcttggag

SEQ ID NO: 253926 - DNA, 25 bp, Mus musculus
atgacatccccagagggtcttggag

SEQ ID NO: 253927 - DNA, 25 bp, Mus musculus
atgacatccttgaggcctcggcaga

SEQ ID NO: 253928 - DNA, 25 bp, Mus musculus
atgacatccttgtggcctcggcaga

SEQ ID NO: 253929 - DNA, 25 bp, Mus musculus
atgacatcgaacctttggccagccg

SEQ ID NO: 253930 - DNA, 25 bp, Mus musculus
atgacatcgaacgtttggccagccg

SEQ ID NO: 253931 - DNA, 25 bp, Mus musculus
atgacatcgacaagaccaagtgtat

SEQ ID NO: 253932 - DNA, 25 bp, Mus musculus
atgacatcgacatgaccaagtgtat

SEQ ID NO: 253933 - DNA, 25 bp, Mus musculus
atgacatcgttacgtcggcagcctg

SEQ ID NO: 253934 - DNA, 25 bp, Mus musculus
atgacatcgttaggtcggcagcctg

SEQ ID NO: 253935 - DNA, 25 bp, Mus musculus
atgacatctacacgtgcagctttga

SEQ ID NO: 253936 - DNA, 25 bp, Mus musculus
atgacatctacaggtgcagctttga

SEQ ID NO: 253937 - DNA, 25 bp, Mus musculus
atgacatctatgaattctccccgga

SEQ ID NO: 253938 - DNA, 25 bp, Mus musculus
atgacatctatgagaaacaatccaa

SEQ ID NO: 253939 - DNA, 25 bp, Mus musculus
atgacatctatgtattctccccgga

SEQ ID NO: 253940 - DNA, 25 bp, Mus musculus
atgacatctatgtgaaacaatccaa

SEQ ID NO: 253941 - DNA, 25 bp, Mus musculus
atgacatctcaccaagcgttctggc

SEQ ID NO: 253942 - DNA, 25 bp, Mus musculus
atgacatctcacgaagcgttctggc

SEQ ID NO: 253943 - DNA, 25 bp, Mus musculus
atgacatctggcaactatccacact

SEQ ID NO: 253944 - DNA, 25 bp, Mus musculus
atgacatctggctactatccacact

SEQ ID NO: 253945 - DNA, 25 bp, Mus musculus
atgacatcttcgaagtgcctgaaag

SEQ ID NO: 253946 - DNA, 25 bp, Mus musculus
atgacatcttcgtagtgcctgaaag

SEQ ID NO: 253947 - DNA, 25 bp, Mus musculus
atgacatcttggcacgagccttcag

SEQ ID NO: 253948 - DNA, 25 bp, Mus musculus
atgacatcttgggacgagccttcag

SEQ ID NO: 253949 - DNA, 25 bp, Mus musculus
atgacatgaaaactaccattcctta

SEQ ID NO: 253950 - DNA, 25 bp, Mus musculus
atgacatgaaaagtaccattcctta

SEQ ID NO: 253951 - DNA, 25 bp, Mus musculus
atgacatgacataacaggaattact

SEQ ID NO: 253952 - DNA, 25 bp, Mus musculus
atgacatgacattacaggaattact

SEQ ID NO: 253953 - DNA, 25 bp, Mus musculus
atgacatgcctactcagtgacaggg

SEQ ID NO: 253954 - DNA, 25 bp, Mus musculus
atgacatgcctagtcagtgacaggg

SEQ ID NO: 253955 - DNA, 25 bp, Mus musculus
atgacatgcggtaccaaaagctgat

SEQ ID NO: 253956 - DNA, 25 bp, Mus musculus
atgacatgcggttccaaaagctgat

SEQ ID NO: 253957 - DNA, 25 bp, Mus musculus
atgacatgcttgcttctgctaaaag

SEQ ID NO: 253958 - DNA, 25 bp, Mus musculus
atgacatgcttggttctgctaaaag

SEQ ID NO: 253959 - DNA, 25 bp, Mus musculus
atgacatggcatcacaggccctctg

SEQ ID NO: 253960 - DNA, 25 bp, Mus musculus
atgacatggcatgacaggccctctg

SEQ ID NO: 253961 - DNA, 25 bp, Mus musculus
atgacatggcctacgatgtatcctg

SEQ ID NO: 253962 - DNA, 25 bp, Mus musculus
atgacatggccttcgatgtatcctg

SEQ ID NO: 253963 - DNA, 25 bp, Mus musculus
atgacatggtgcactaccatccttc

SEQ ID NO: 253964 - DNA, 25 bp, Mus musculus
atgacatggtgctctaccatccttc

SEQ ID NO: 253965 - DNA, 25 bp, Mus musculus
atgacatgtacactgtccagctaga

SEQ ID NO: 253966 - DNA, 25 bp, Mus musculus
atgacatgtacagtgtccagctaga

SEQ ID NO: 253967 - DNA, 25 bp, Mus musculus
atgacatgtagaaggctggtccagc

SEQ ID NO: 253968 - DNA, 25 bp, Mus musculus
atgacatgtagatggctggtccagc

SEQ ID NO: 253969 - DNA, 25 bp, Mus musculus
atgacatgttttacagtacagtggg

SEQ ID NO: 253970 - DNA, 25 bp, Mus musculus
atgacatgtttttcagtacagtggg

SEQ ID NO: 253971 - DNA, 25 bp, Mus musculus
atgacattacacactgatgcctgcc

SEQ ID NO: 253972 - DNA, 25 bp, Mus musculus
atgacattacactctgatgcctgcc

SEQ ID NO: 253973 - DNA, 25 bp, Mus musculus
atgacattacgcaggccaacaaaca

SEQ ID NO: 253974 - DNA, 25 bp, Mus musculus
atgacattacgctggccaacaaaca

SEQ ID NO: 253975 - DNA, 25 bp, Mus musculus
atgacattcctcagattttttggca

SEQ ID NO: 253976 - DNA, 25 bp, Mus musculus
atgacattcctctgattttttggca

SEQ ID NO: 253977 - DNA, 25 bp, Mus musculus
atgacattcggcaggactggaccaa

SEQ ID NO: 253978 - DNA, 25 bp, Mus musculus
atgacattcggctggactggaccaa

SEQ ID NO: 253979 - DNA, 25 bp, Mus musculus
atgacattctcaccatactgcctaa

SEQ ID NO: 253980 - DNA, 25 bp, Mus musculus
atgacattctcagcatactgcctaa

SEQ ID NO: 253981 - DNA, 25 bp, Mus musculus
atgacattcttaccatcctgactgg

SEQ ID NO: 253982 - DNA, 25 bp, Mus musculus
atgacattcttagcatcctgactgg

SEQ ID NO: 253983 - DNA, 25 bp, Mus musculus
atgacattgaagattcgtggtagaa

SEQ ID NO: 253984 - DNA, 25 bp, Mus musculus
atgacattgaagtttcgtggtagaa

SEQ ID NO: 253985 - DNA, 25 bp, Mus musculus
atgacattgagaatctggcccctgt

SEQ ID NO: 253986 - DNA, 25 bp, Mus musculus
atgacattgagattctggcccctgt

SEQ ID NO: 253987 - DNA, 25 bp, Mus musculus
atgacattgccaaggctaccggtga

SEQ ID NO: 253988 - DNA, 25 bp, Mus musculus
atgacattgccatggctaccggtga

SEQ ID NO: 253989 - DNA, 25 bp, Mus musculus
atgacattgggacactccttcctgc

SEQ ID NO: 253990 - DNA, 25 bp, Mus musculus
atgacattgggagactccttcctgc

SEQ ID NO: 253991 - DNA, 25 bp, Mus musculus
atgacattggttattggatttggta

SEQ ID NO: 253992 - DNA, 25 bp, Mus musculus
atgacattggtttttggatttggta

SEQ ID NO: 253993 - DNA, 25 bp, Mus musculus
atgacattgtctctggccacaagaa

SEQ ID NO: 253994 - DNA, 25 bp, Mus musculus
atgacattgtctgtggccacaagaa

SEQ ID NO: 253995 - DNA, 25 bp, Mus musculus
atgacatttacacagcacggcagca

SEQ ID NO: 253996 - DNA, 25 bp, Mus musculus
atgacatttacagagcacggcagca

SEQ ID NO: 253997 - DNA, 25 bp, Mus musculus
atgacatttcagcaattttcctccc

SEQ ID NO: 253998 - DNA, 25 bp, Mus musculus
atgacatttcaggaattttcctccc

SEQ ID NO: 253999 - DNA, 25 bp, Mus musculus
atgacatttcatctgggtggtccag

SEQ ID NO: 254000 - DNA, 25 bp, Mus musculus
atgacatttcatgtgggtggtccag

SEQ ID NO: 254001 - DNA, 25 bp, Mus musculus
atgacatttgatatccctggtgcct

SEQ ID NO: 254002 - DNA, 25 bp, Mus musculus
atgacatttgatttccctggtgcct

SEQ ID NO: 254003 - DNA, 25 bp, Mus musculus
atgacatttgtaatctctgagtagc

SEQ ID NO: 254004 - DNA, 25 bp, Mus musculus
atgacatttgtattctctgagtagc

SEQ ID NO: 254005 - DNA, 25 bp, Mus musculus
atgacattttgcaggttcaatatga

SEQ ID NO: 254006 - DNA, 25 bp, Mus musculus
atgacattttgctggttcaatatga

SEQ ID NO: 254007 - DNA, 25 bp, Mus musculus
atgacattttggcttctaacttgaa

SEQ ID NO: 254008 - DNA, 25 bp, Mus musculus
atgacattttgggttctaacttgaa

SEQ ID NO: 254009 - DNA, 25 bp, Mus musculus
atgaccaaacctacgctggtggacg

SEQ ID NO: 254010 - DNA, 25 bp, Mus musculus
atgaccaaaccttcgctggtggacg

SEQ ID NO: 254011 - DNA, 25 bp, Mus musculus
atgaccaacagcacctcctaatttc

SEQ ID NO: 254012 - DNA, 25 bp, Mus musculus
atgaccaacagctcctcctaatttc

SEQ ID NO: 254013 - DNA, 25 bp, Mus musculus
atgaccaaccaacgcagctcttaga

SEQ ID NO: 254014 - DNA, 25 bp, Mus musculus
atgaccaaccaaggcagctcttaga

SEQ ID NO: 254015 - DNA, 25 bp, Mus musculus
atgaccaagaacctgtccagacttt

SEQ ID NO: 254016 - DNA, 25 bp, Mus musculus
atgaccaagaacgtgtccagacttt

SEQ ID NO: 254017 - DNA, 25 bp, Mus musculus
atgaccaagcccagactcacctgaa

SEQ ID NO: 254018 - DNA, 25 bp, Mus musculus
atgaccaagccctgactcacctgaa

SEQ ID NO: 254019 - DNA, 25 bp, Mus musculus
atgaccaaggtacttcctggactct

SEQ ID NO: 254020 - DNA, 25 bp, Mus musculus
atgaccaaggtagttcctggactct

SEQ ID NO: 254021 - DNA, 25 bp, Mus musculus
atgaccaagttcacttcgttgacaa

SEQ ID NO: 254022 - DNA, 25 bp, Mus musculus
atgaccaagttctcttcgttgacaa

SEQ ID NO: 254023 - DNA, 25 bp, Mus musculus
atgaccaatggacccatatgctggg

SEQ ID NO: 254024 - DNA, 25 bp, Mus musculus
atgaccaatggagccatatgctggg

SEQ ID NO: 254025 - DNA, 25 bp, Mus musculus
atgaccaatgtcatgatgcaccgaa

SEQ ID NO: 254026 - DNA, 25 bp, Mus musculus
atgaccaatgtcttgatgcaccgaa

SEQ ID NO: 254027 - DNA, 25 bp, Mus musculus
atgaccaattacattactttctgaa

SEQ ID NO: 254028 - DNA, 25 bp, Mus musculus
atgaccaattactttactttctgaa

SEQ ID NO: 254029 - DNA, 25 bp, Mus musculus
atgaccaattttaactgtacagaac

SEQ ID NO: 254030 - DNA, 25 bp, Mus musculus
atgaccaatttttactgtacagaac

SEQ ID NO: 254031 - DNA, 25 bp, Mus musculus
atgaccacaaccaaatgaacactgg

SEQ ID NO: 254032 - DNA, 25 bp, Mus musculus
atgaccacaacctaatgaacactgg

SEQ ID NO: 254033 - DNA, 25 bp, Mus musculus
atgaccacaagtacctgcatcgtgt

SEQ ID NO: 254034 - DNA, 25 bp, Mus musculus
atgaccacaagttcctgcatcgtgt

SEQ ID NO: 254035 - DNA, 25 bp, Mus musculus
atgaccacacatctatagtcttaca

SEQ ID NO: 254036 - DNA, 25 bp, Mus musculus
atgaccacacatgtatagtcttaca

SEQ ID NO: 254037 - DNA, 25 bp, Mus musculus
atgaccacactacagtcttggctgt

SEQ ID NO: 254038 - DNA, 25 bp, Mus musculus
atgaccacactagagtcttggctgt

SEQ ID NO: 254039 - DNA, 25 bp, Mus musculus
atgaccacagacaactttcgctttt

SEQ ID NO: 254040 - DNA, 25 bp, Mus musculus
atgaccacagactactttcgctttt

SEQ ID NO: 254041 - DNA, 25 bp, Mus musculus
atgaccacagtcataagagcccagg

SEQ ID NO: 254042 - DNA, 25 bp, Mus musculus
atgaccacagtcttaagagcccagg

SEQ ID NO: 254043 - DNA, 25 bp, Mus musculus
atgaccacatgccttataaatcccc

SEQ ID NO: 254044 - DNA, 25 bp, Mus musculus
atgaccacatgcgttataaatcccc

SEQ ID NO: 254045 - DNA, 25 bp, Mus musculus
atgaccaccaggcaggtgccttact

SEQ ID NO: 254046 - DNA, 25 bp, Mus musculus
atgaccaccagggaggtgccttact

SEQ ID NO: 254047 - DNA, 25 bp, Mus musculus
atgaccacctcccaattctagtgtc

SEQ ID NO: 254048 - DNA, 25 bp, Mus musculus
atgaccacctccgaattctagtgtc

SEQ ID NO: 254049 - DNA, 25 bp, Mus musculus
atgaccacctgtcaccttcaaaatg

SEQ ID NO: 254050 - DNA, 25 bp, Mus musculus
atgaccacctgtgaccttcaaaatg

SEQ ID NO: 254051 - DNA, 25 bp, Mus musculus
atgaccacgacaacatctggacaga

SEQ ID NO: 254052 - DNA, 25 bp, Mus musculus
atgaccacgacatcatctggacaga

SEQ ID NO: 254053 - DNA, 25 bp, Mus musculus
atgaccacgctgacttggaagcaga

SEQ ID NO: 254054 - DNA, 25 bp, Mus musculus
atgaccacgctgtcttggaagcaga

SEQ ID NO: 254055 - DNA, 25 bp, Mus musculus
atgaccacgttcatggaatagccat

SEQ ID NO: 254056 - DNA, 25 bp, Mus musculus
atgaccacgttcttggaatagccat

SEQ ID NO: 254057 - DNA, 25 bp, Mus musculus
atgaccactcatccagtgaccaata

SEQ ID NO: 254058 - DNA, 25 bp, Mus musculus
atgaccactcatgcagtgaccaata

SEQ ID NO: 254059 - DNA, 25 bp, Mus musculus
atgaccactctaatgtgggctgccg

SEQ ID NO: 254060 - DNA, 25 bp, Mus musculus
atgaccactctattgtgggctgccg

SEQ ID NO: 254061 - DNA, 25 bp, Mus musculus
atgaccactgtacggtaaccaggaa

SEQ ID NO: 254062 - DNA, 25 bp, Mus musculus
atgaccactgtagggtaaccaggaa

SEQ ID NO: 254063 - DNA, 25 bp, Mus musculus
atgaccagacagcacccattttggc

SEQ ID NO: 254064 - DNA, 25 bp, Mus musculus
atgaccagacaggacccattttggc

SEQ ID NO: 254065 - DNA, 25 bp, Mus musculus
atgaccagagccaccctatagtttt

SEQ ID NO: 254066 - DNA, 25 bp, Mus musculus
atgaccagagcctccctatagtttt

SEQ ID NO: 254067 - DNA, 25 bp, Mus musculus
atgaccagatgtcatcatctccctg

SEQ ID NO: 254068 - DNA, 25 bp, Mus musculus
atgaccagatgtgatcatctccctg

SEQ ID NO: 254069 - DNA, 25 bp, Mus musculus
atgaccagcaggcattggccacaaa

SEQ ID NO: 254070 - DNA, 25 bp, Mus musculus
atgaccagcagggattggccacaaa

SEQ ID NO: 254071 - DNA, 25 bp, Mus musculus
atgaccagccgaatcgtgggcacaa

SEQ ID NO: 254072 - DNA, 25 bp, Mus musculus
atgaccagccgattcgtgggcacaa

SEQ ID NO: 254073 - DNA, 25 bp, Mus musculus
atgaccagcctgcaatctagccaca

SEQ ID NO: 254074 - DNA, 25 bp, Mus musculus
atgaccagcctggaatctagccaca

SEQ ID NO: 254075 - DNA, 25 bp, Mus musculus
atgaccagcgtaatactgggcaggc

SEQ ID NO: 254076 - DNA, 25 bp, Mus musculus
atgaccagcgtattactgggcaggc

SEQ ID NO: 254077 - DNA, 25 bp, Mus musculus
atgaccagcttcatctccgctagtg

SEQ ID NO: 254078 - DNA, 25 bp, Mus musculus
atgaccagcttcttctccgctagtg

SEQ ID NO: 254079 - DNA, 25 bp, Mus musculus
atgaccagctttatgtgaggaatcc

SEQ ID NO: 254080 - DNA, 25 bp, Mus musculus
atgaccagctttttgtgaggaatcc

SEQ ID NO: 254081 - DNA, 25 bp, Mus musculus
atgaccaggcctcatccttaggatg

SEQ ID NO: 254082 - DNA, 25 bp, Mus musculus
atgaccaggcctgatccttaggatg

SEQ ID NO: 254083 - DNA, 25 bp, Mus musculus
atgaccagggtgcaccttcggaatt

SEQ ID NO: 254084 - DNA, 25 bp, Mus musculus
atgaccagggtggaccttcggaatt

SEQ ID NO: 254085 - DNA, 25 bp, Mus musculus
atgaccaggtcacattccagttgtt

SEQ ID NO: 254086 - DNA, 25 bp, Mus musculus
atgaccaggtcagattccagttgtt

SEQ ID NO: 254087 - DNA, 25 bp, Mus musculus
atgaccaggtctcataccactttaa

SEQ ID NO: 254088 - DNA, 25 bp, Mus musculus
atgaccaggtctgataccactttaa

SEQ ID NO: 254089 - DNA, 25 bp, Mus musculus
atgaccagtggaattcccagcttgg

SEQ ID NO: 254090 - DNA, 25 bp, Mus musculus
atgaccagtggatttcccagcttgg

SEQ ID NO: 254091 - DNA, 25 bp, Mus musculus
atgaccagtgttaagagtccctgtt

SEQ ID NO: 254092 - DNA, 25 bp, Mus musculus
atgaccagtgtttagagtccctgtt

SEQ ID NO: 254093 - DNA, 25 bp, Mus musculus
atgaccagtttactgttccgatcag

SEQ ID NO: 254094 - DNA, 25 bp, Mus musculus
atgaccagtttagtgttccgatcag

SEQ ID NO: 254095 - DNA, 25 bp, Mus musculus
atgaccagttttatactcatgggtg

SEQ ID NO: 254096 - DNA, 25 bp, Mus musculus
atgaccagttttttactcatgggtg

SEQ ID NO: 254097 - DNA, 25 bp, Mus musculus
atgaccataaacaaccctgtgggtg

SEQ ID NO: 254098 - DNA, 25 bp, Mus musculus
atgaccataaactaccctgtgggtg

SEQ ID NO: 254099 - DNA, 25 bp, Mus musculus
atgaccataaggagcttcgtaagcg

SEQ ID NO: 254100 - DNA, 25 bp, Mus musculus
atgaccataaggtgcttcgtaagcg

SEQ ID NO: 254101 - DNA, 25 bp, Mus musculus
atgaccatcaagcacggcagccaga

SEQ ID NO: 254102 - DNA, 25 bp, Mus musculus
atgaccatcaaggacggcagccaga

SEQ ID NO: 254103 - DNA, 25 bp, Mus musculus
atgaccatcaggctacagagtttaa

SEQ ID NO: 254104 - DNA, 25 bp, Mus musculus
atgaccatcaggctattacacaatt

SEQ ID NO: 254105 - DNA, 25 bp, Mus musculus
atgaccatcagggtacagagtttaa

SEQ ID NO: 254106 - DNA, 25 bp, Mus musculus
atgaccatcagggtattacacaatt

SEQ ID NO: 254107 - DNA, 25 bp, Mus musculus
atgaccatcctgataaagacctaag

SEQ ID NO: 254108 - DNA, 25 bp, Mus musculus
atgaccatcctgttaaagacctaag

SEQ ID NO: 254109 - DNA, 25 bp, Mus musculus
atgaccatccttaaagctgcagctg

SEQ ID NO: 254110 - DNA, 25 bp, Mus musculus
atgaccatcctttaagctgcagctg

SEQ ID NO: 254111 - DNA, 25 bp, Mus musculus
atgaccatcttacgacacagtctct

SEQ ID NO: 254112 - DNA, 25 bp, Mus musculus
atgaccatcttaggacacagtctct

SEQ ID NO: 254113 - DNA, 25 bp, Mus musculus
atgaccatgccgaccagcatgggcc

SEQ ID NO: 254114 - DNA, 25 bp, Mus musculus
atgaccatgccgtccagcatgggcc

SEQ ID NO: 254115 - DNA, 25 bp, Mus musculus
atgaccatggcaatgcttatcaagg

SEQ ID NO: 254116 - DNA, 25 bp, Mus musculus
atgaccatggcattgcttatcaagg

SEQ ID NO: 254117 - DNA, 25 bp, Mus musculus
atgaccatggtcaacaccttaatat

SEQ ID NO: 254118 - DNA, 25 bp, Mus musculus
atgaccatggtctacaccttaatat

SEQ ID NO: 254119 - DNA, 25 bp, Mus musculus
atgaccattcaaaaacaaggcaaaa

SEQ ID NO: 254120 - DNA, 25 bp, Mus musculus
atgaccattcaataacaaggcaaaa

SEQ ID NO: 254121 - DNA, 25 bp, Mus musculus
atgaccattctgatacaactgcttt

SEQ ID NO: 254122 - DNA, 25 bp, Mus musculus
atgaccattctgcttttactattcc

SEQ ID NO: 254123 - DNA, 25 bp, Mus musculus
atgaccattctggttttactattcc

SEQ ID NO: 254124 - DNA, 25 bp, Mus musculus
atgaccattctgttacaactgcttt

SEQ ID NO: 254125 - DNA, 25 bp, Mus musculus
atgaccattgccatcgtgctggtgt

SEQ ID NO: 254126 - DNA, 25 bp, Mus musculus
atgaccattgccttcgtgctggtgt

SEQ ID NO: 254127 - DNA, 25 bp, Mus musculus
atgaccatttgactgttcactgact

SEQ ID NO: 254128 - DNA, 25 bp, Mus musculus
atgaccatttgagtgttcactgact

SEQ ID NO: 254129 - DNA, 25 bp, Mus musculus
atgacccaacaaagcctgtatttct

SEQ ID NO: 254130 - DNA, 25 bp, Mus musculus
atgacccaacaatgcctgtatttct

SEQ ID NO: 254131 - DNA, 25 bp, Mus musculus
atgacccaatttaatctggccagga

SEQ ID NO: 254132 - DNA, 25 bp, Mus musculus
atgacccaattttatctggccagga

SEQ ID NO: 254133 - DNA, 25 bp, Mus musculus
atgacccacctgcagttagtttgac

SEQ ID NO: 254134 - DNA, 25 bp, Mus musculus
atgacccacctggagttagtttgac

SEQ ID NO: 254135 - DNA, 25 bp, Mus musculus
atgacccactggagcactcgaatga

SEQ ID NO: 254136 - DNA, 25 bp, Mus musculus
atgacccactggagtttaagtccca

SEQ ID NO: 254137 - DNA, 25 bp, Mus musculus
atgacccactggtgcactcgaatga

SEQ ID NO: 254138 - DNA, 25 bp, Mus musculus
atgacccactggtgtttaagtccca

SEQ ID NO: 254139 - DNA, 25 bp, Mus musculus
atgacccactgtcattgggccacct

SEQ ID NO: 254140 - DNA, 25 bp, Mus musculus
atgacccactgtgattgggccacct

SEQ ID NO: 254141 - DNA, 25 bp, Mus musculus
atgacccagccaaaatgaggtttga

SEQ ID NO: 254142 - DNA, 25 bp, Mus musculus
atgacccagccataatgaggtttga

SEQ ID NO: 254143 - DNA, 25 bp, Mus musculus
atgacccaggtgaactggcttgctc

SEQ ID NO: 254144 - DNA, 25 bp, Mus musculus
atgacccaggtgtactggcttgctc

SEQ ID NO: 254145 - DNA, 25 bp, Mus musculus
atgacccaggttacatctctagaac

SEQ ID NO: 254146 - DNA, 25 bp, Mus musculus
atgacccaggtttcatctctagaac

SEQ ID NO: 254147 - DNA, 25 bp, Mus musculus
atgacccagtatccaacctggcatg

SEQ ID NO: 254148 - DNA, 25 bp, Mus musculus
atgacccagtatgcaacctggcatg

SEQ ID NO: 254149 - DNA, 25 bp, Mus musculus
atgacccatactcagacctatagtt

SEQ ID NO: 254150 - DNA, 25 bp, Mus musculus
atgacccatactgagacctatagtt

SEQ ID NO: 254151 - DNA, 25 bp, Mus musculus
atgacccatgctagagctgtacctg

SEQ ID NO: 254152 - DNA, 25 bp, Mus musculus
atgacccatgcttgagctgtacctg

SEQ ID NO: 254153 - DNA, 25 bp, Mus musculus
atgacccatggactagaagcatcaa

SEQ ID NO: 254154 - DNA, 25 bp, Mus musculus
atgacccatggagtagaagcatcaa

SEQ ID NO: 254155 - DNA, 25 bp, Mus musculus
atgacccattttatatgctgtggaa

SEQ ID NO: 254156 - DNA, 25 bp, Mus musculus
atgacccattttatcctagtgcatg

SEQ ID NO: 254157 - DNA, 25 bp, Mus musculus
atgacccattttttatgctgtggaa

SEQ ID NO: 254158 - DNA, 25 bp, Mus musculus
atgacccattttttcctagtgcatg

SEQ ID NO: 254159 - DNA, 25 bp, Mus musculus
atgaccccaaagcaaccagactttt

SEQ ID NO: 254160 - DNA, 25 bp, Mus musculus
atgaccccaaaggaaccagactttt

SEQ ID NO: 254161 - DNA, 25 bp, Mus musculus
atgaccccaattcagggccatctgc

SEQ ID NO: 254162 - DNA, 25 bp, Mus musculus
atgaccccaattgagggccatctgc

SEQ ID NO: 254163 - DNA, 25 bp, Mus musculus
atgaccccacacaaagtgcactgta

SEQ ID NO: 254164 - DNA, 25 bp, Mus musculus
atgaccccacactaagtgcactgta

SEQ ID NO: 254165 - DNA, 25 bp, Mus musculus
atgaccccacagctgggtgggatat

SEQ ID NO: 254166 - DNA, 25 bp, Mus musculus
atgaccccacaggtgggtgggatat

SEQ ID NO: 254167 - DNA, 25 bp, Mus musculus
atgaccccacatctaataccaaata

SEQ ID NO: 254168 - DNA, 25 bp, Mus musculus
atgaccccacatgtaataccaaata

SEQ ID NO: 254169 - DNA, 25 bp, Mus musculus
atgaccccactgcagacgtgtttgt

SEQ ID NO: 254170 - DNA, 25 bp, Mus musculus
atgaccccactggagacgtgtttgt

SEQ ID NO: 254171 - DNA, 25 bp, Mus musculus
atgaccccagatatccaggacctgg

SEQ ID NO: 254172 - DNA, 25 bp, Mus musculus
atgaccccagatttccaggacctgg

SEQ ID NO: 254173 - DNA, 25 bp, Mus musculus
atgaccccagttcaccaggtagaaa

SEQ ID NO: 254174 - DNA, 25 bp, Mus musculus
atgaccccagttgaccaggtagaaa

SEQ ID NO: 254175 - DNA, 25 bp, Mus musculus
atgaccccatatacaggttccgcag

SEQ ID NO: 254176 - DNA, 25 bp, Mus musculus
atgaccccatattcaggttccgcag

SEQ ID NO: 254177 - DNA, 25 bp, Mus musculus
atgaccccatttctgacctcagttt

SEQ ID NO: 254178 - DNA, 25 bp, Mus musculus
atgaccccatttgtgacctcagttt

SEQ ID NO: 254179 - DNA, 25 bp, Mus musculus
atgacccccaagcatcactgattga

SEQ ID NO: 254180 - DNA, 25 bp, Mus musculus
atgacccccaaggatcactgattga

SEQ ID NO: 254181 - DNA, 25 bp, Mus musculus
atgaccccgtggagctattacccat

SEQ ID NO: 254182 - DNA, 25 bp, Mus musculus
atgaccccgtggtgctattacccat

SEQ ID NO: 254183 - DNA, 25 bp, Mus musculus
atgacccctattatagacgatagaa

SEQ ID NO: 254184 - DNA, 25 bp, Mus musculus
atgacccctattttagacgatagaa

SEQ ID NO: 254185 - DNA, 25 bp, Mus musculus
atgacccctcccatttagatccttg

SEQ ID NO: 254186 - DNA, 25 bp, Mus musculus
atgacccctcccttttagatccttg

SEQ ID NO: 254187 - DNA, 25 bp, Mus musculus
atgacccctcgaaggcaccacagga

SEQ ID NO: 254188 - DNA, 25 bp, Mus musculus
atgacccctcgatggcaccacagga

SEQ ID NO: 254189 - DNA, 25 bp, Mus musculus
atgacccctgcaccagtatgaggta

SEQ ID NO: 254190 - DNA, 25 bp, Mus musculus
atgacccctgcagcagtatgaggta

SEQ ID NO: 254191 - DNA, 25 bp, Mus musculus
atgaccccttcaagtcctaaggaag

SEQ ID NO: 254192 - DNA, 25 bp, Mus musculus
atgaccccttcatgtcctaaggaag

SEQ ID NO: 254193 - DNA, 25 bp, Mus musculus
atgaccccttggcaacattagattt

SEQ ID NO: 254194 - DNA, 25 bp, Mus musculus
atgaccccttgggaacattagattt

SEQ ID NO: 254195 - DNA, 25 bp, Mus musculus
atgacccctttacataatatttgag

SEQ ID NO: 254196 - DNA, 25 bp, Mus musculus
atgacccctttactgatcttacagc

SEQ ID NO: 254197 - DNA, 25 bp, Mus musculus
atgacccctttagataatatttgag

SEQ ID NO: 254198 - DNA, 25 bp, Mus musculus
atgacccctttagtgatcttacagc

SEQ ID NO: 254199 - DNA, 25 bp, Mus musculus
atgacccctttgctggtcgaacagc

SEQ ID NO: 254200 - DNA, 25 bp, Mus musculus
atgacccctttggtggtcgaacagc

SEQ ID NO: 254201 - DNA, 25 bp, Mus musculus
atgacccgacacagggctatgaacc

SEQ ID NO: 254202 - DNA, 25 bp, Mus musculus
atgacccgacactgggctatgaacc

SEQ ID NO: 254203 - DNA, 25 bp, Mus musculus
atgacccgcgggatcatcatattgt

SEQ ID NO: 254204 - DNA, 25 bp, Mus musculus
atgacccgcgggttcatcatattgt

SEQ ID NO: 254205 - DNA, 25 bp, Mus musculus
atgacccggctactagtgaaggaac

SEQ ID NO: 254206 - DNA, 25 bp, Mus musculus
atgacccggctagtagtgaaggaac

SEQ ID NO: 254207 - DNA, 25 bp, Mus musculus
atgacccgggctcaaatgatcctta

SEQ ID NO: 254208 - DNA, 25 bp, Mus musculus
atgacccgggctgaaatgatcctta

SEQ ID NO: 254209 - DNA, 25 bp, Mus musculus
atgaccctaaacactgcttccatgt

SEQ ID NO: 254210 - DNA, 25 bp, Mus musculus
atgaccctaaactctgcttccatgt

SEQ ID NO: 254211 - DNA, 25 bp, Mus musculus
atgaccctaccaagtccaggagaca

SEQ ID NO: 254212 - DNA, 25 bp, Mus musculus
atgaccctaccatgtccaggagaca

SEQ ID NO: 254213 - DNA, 25 bp, Mus musculus
atgaccctagcaaggcttgaaaagc

SEQ ID NO: 254214 - DNA, 25 bp, Mus musculus
atgaccctagcatggcttgaaaagc

SEQ ID NO: 254215 - DNA, 25 bp, Mus musculus
atgaccctaggaaccaagcagtgct

SEQ ID NO: 254216 - DNA, 25 bp, Mus musculus
atgaccctaggatccaagcagtgct

SEQ ID NO: 254217 - DNA, 25 bp, Mus musculus
atgaccctagttcactcagtctcta

SEQ ID NO: 254218 - DNA, 25 bp, Mus musculus
atgaccctagttgactcagtctcta

SEQ ID NO: 254219 - DNA, 25 bp, Mus musculus
atgaccctgcagacacagaagttcc

SEQ ID NO: 254220 - DNA, 25 bp, Mus musculus
atgaccctgcagtcacagaagttcc

SEQ ID NO: 254221 - DNA, 25 bp, Mus musculus
atgaccctgctcctggctggagaga

SEQ ID NO: 254222 - DNA, 25 bp, Mus musculus
atgaccctgctcgtggctggagaga

SEQ ID NO: 254223 - DNA, 25 bp, Mus musculus
atgaccctggaaactattcatggag

SEQ ID NO: 254224 - DNA, 25 bp, Mus musculus
atgaccctggaatctattcatggag

SEQ ID NO: 254225 - DNA, 25 bp, Mus musculus
atgaccctggtacgtaaaccaccat

SEQ ID NO: 254226 - DNA, 25 bp, Mus musculus
atgaccctggtaggtaaaccaccat

SEQ ID NO: 254227 - DNA, 25 bp, Mus musculus
atgaccctgtaactcattggtagag

SEQ ID NO: 254228 - DNA, 25 bp, Mus musculus
atgaccctgtaagtcattggtagag

SEQ ID NO: 254229 - DNA, 25 bp, Mus musculus
atgaccgaactgaacgcatctggcg

SEQ ID NO: 254230 - DNA, 25 bp, Mus musculus
atgaccgaactgtacgcatctggcg

SEQ ID NO: 254231 - DNA, 25 bp, Mus musculus
atgaccgaagcgaggcacaaaatgt

SEQ ID NO: 254232 - DNA, 25 bp, Mus musculus
atgaccgaagcgtggcacaaaatgt

SEQ ID NO: 254233 - DNA, 25 bp, Mus musculus
atgaccgaagtcacctgagatgaat

SEQ ID NO: 254234 - DNA, 25 bp, Mus musculus
atgaccgaagtctcctgagatgaat

SEQ ID NO: 254235 - DNA, 25 bp, Mus musculus
atgaccgacaagcactggcccaagc

SEQ ID NO: 254236 - DNA, 25 bp, Mus musculus
atgaccgacaaggactggcccaagc

SEQ ID NO: 254237 - DNA, 25 bp, Mus musculus
atgaccgaccacctttagaatagaa

SEQ ID NO: 254238 - DNA, 25 bp, Mus musculus
atgaccgaccacgtttagaatagaa

SEQ ID NO: 254239 - DNA, 25 bp, Mus musculus
atgaccgaccccaagtacatcattt

SEQ ID NO: 254240 - DNA, 25 bp, Mus musculus
atgaccgacccctagtacatcattt

SEQ ID NO: 254241 - DNA, 25 bp, Mus musculus
atgaccgacgtgaaatataaccctg

SEQ ID NO: 254242 - DNA, 25 bp, Mus musculus
atgaccgacgtgtaatataaccctg

SEQ ID NO: 254243 - DNA, 25 bp, Mus musculus
atgaccgactatctatctactgacc

SEQ ID NO: 254244 - DNA, 25 bp, Mus musculus
atgaccgactatgtatctactgacc

SEQ ID NO: 254245 - DNA, 25 bp, Mus musculus
atgaccgagaccagctcactaaggt

SEQ ID NO: 254246 - DNA, 25 bp, Mus musculus
atgaccgagacctgctcactaaggt

SEQ ID NO: 254247 - DNA, 25 bp, Mus musculus
atgaccgagagcatcgaggcagact

SEQ ID NO: 254248 - DNA, 25 bp, Mus musculus
atgaccgagagcttcgaggcagact

SEQ ID NO: 254249 - DNA, 25 bp, Mus musculus
atgaccgaggtaccgatttctgcta

SEQ ID NO: 254250 - DNA, 25 bp, Mus musculus
atgaccgaggtagcgatttctgcta

SEQ ID NO: 254251 - DNA, 25 bp, Mus musculus
atgaccgattcgatggtggcttcag

SEQ ID NO: 254252 - DNA, 25 bp, Mus musculus
atgaccgattcgttggtggcttcag

SEQ ID NO: 254253 - DNA, 25 bp, Mus musculus
atgaccgcaatcagtaccgttgtgg

SEQ ID NO: 254254 - DNA, 25 bp, Mus musculus
atgaccgcaatctgtaccgttgtgg

SEQ ID NO: 254255 - DNA, 25 bp, Mus musculus
atgaccgcagcactacttattaacc

SEQ ID NO: 254256 - DNA, 25 bp, Mus musculus
atgaccgcagcagtacttattaacc

SEQ ID NO: 254257 - DNA, 25 bp, Mus musculus
atgaccgcccagagtgagctgaaca

SEQ ID NO: 254258 - DNA, 25 bp, Mus musculus
atgaccgcccagtgtgagctgaaca

SEQ ID NO: 254259 - DNA, 25 bp, Mus musculus
atgaccgcctggatttgcctgtgac

SEQ ID NO: 254260 - DNA, 25 bp, Mus musculus
atgaccgcctggttttgcctgtgac

SEQ ID NO: 254261 - DNA, 25 bp, Mus musculus
atgaccgggataacttgacccttga

SEQ ID NO: 254262 - DNA, 25 bp, Mus musculus
atgaccgggatatcttgacccttga

SEQ ID NO: 254263 - DNA, 25 bp, Mus musculus
atgaccgggcaaacacagggctcct

SEQ ID NO: 254264 - DNA, 25 bp, Mus musculus
atgaccgggcaatcacagggctcct

SEQ ID NO: 254265 - DNA, 25 bp, Mus musculus
atgaccgggctgacgccttgcaggc

SEQ ID NO: 254266 - DNA, 25 bp, Mus musculus
atgaccgggctgtcgccttgcaggc

SEQ ID NO: 254267 - DNA, 25 bp, Mus musculus
atgaccggtaagatcgttcagggcc

SEQ ID NO: 254268 - DNA, 25 bp, Mus musculus
atgaccggtaagttcgttcagggcc

SEQ ID NO: 254269 - DNA, 25 bp, Mus musculus
atgaccggtttccatgatgtattga

SEQ ID NO: 254270 - DNA, 25 bp, Mus musculus
atgaccggtttcgatgatgtattga

SEQ ID NO: 254271 - DNA, 25 bp, Mus musculus
atgaccgtaagcatacttctggtat

SEQ ID NO: 254272 - DNA, 25 bp, Mus musculus
atgaccgtaagcttacttctggtat

SEQ ID NO: 254273 - DNA, 25 bp, Mus musculus
atgaccgtcacaaacatctgggatg

SEQ ID NO: 254274 - DNA, 25 bp, Mus musculus
atgaccgtcacatacatctgggatg

SEQ ID NO: 254275 - DNA, 25 bp, Mus musculus
atgaccgtgaacatgctggctgagg

SEQ ID NO: 254276 - DNA, 25 bp, Mus musculus
atgaccgtgaacttgctggctgagg

SEQ ID NO: 254277 - DNA, 25 bp, Mus musculus
atgaccgtgatgaggtgacccgcgc

SEQ ID NO: 254278 - DNA, 25 bp, Mus musculus
atgaccgtgatgtggtgacccgcgc

SEQ ID NO: 254279 - DNA, 25 bp, Mus musculus
atgaccgtgcggcagctcttcgact

SEQ ID NO: 254280 - DNA, 25 bp, Mus musculus
atgaccgtgcgggagctcttcgact

SEQ ID NO: 254281 - DNA, 25 bp, Mus musculus
atgaccgtgtgccagtaactagttc

SEQ ID NO: 254282 - DNA, 25 bp, Mus musculus
atgaccgtgtgcgagtaactagttc

SEQ ID NO: 254283 - DNA, 25 bp, Mus musculus
atgaccgttctcacattatttatag

SEQ ID NO: 254284 - DNA, 25 bp, Mus musculus
atgaccgttctctcattatttatag

SEQ ID NO: 254285 - DNA, 25 bp, Mus musculus
atgaccgttggaaggcacagccaaa

SEQ ID NO: 254286 - DNA, 25 bp, Mus musculus
atgaccgttggatggcacagccaaa

SEQ ID NO: 254287 - DNA, 25 bp, Mus musculus
atgaccgtttcaatgccattcgcaa

SEQ ID NO: 254288 - DNA, 25 bp, Mus musculus
atgaccgtttcattgccattcgcaa

SEQ ID NO: 254289 - DNA, 25 bp, Mus musculus
atgacctacagtcctgctccttctg

SEQ ID NO: 254290 - DNA, 25 bp, Mus musculus
atgacctacagtgctgctccttctg

SEQ ID NO: 254291 - DNA, 25 bp, Mus musculus
atgacctacgatccgatcctaaggt

SEQ ID NO: 254292 - DNA, 25 bp, Mus musculus
atgacctacgatgcgatcctaaggt

SEQ ID NO: 254293 - DNA, 25 bp, Mus musculus
atgacctacgtcattcaatttggag

SEQ ID NO: 254294 - DNA, 25 bp, Mus musculus
atgacctacgtctttcaatttggag

SEQ ID NO: 254295 - DNA, 25 bp, Mus musculus
atgacctagccaccctttggaatat

SEQ ID NO: 254296 - DNA, 25 bp, Mus musculus
atgacctagccagcctttggaatat

SEQ ID NO: 254297 - DNA, 25 bp, Mus musculus
atgacctaggaacgcggctccctga

SEQ ID NO: 254298 - DNA, 25 bp, Mus musculus
atgacctaggaaggcggctccctga

SEQ ID NO: 254299 - DNA, 25 bp, Mus musculus
atgacctaggctacaagatactgcg

SEQ ID NO: 254300 - DNA, 25 bp, Mus musculus
atgacctaggcttcaagatactgcg

SEQ ID NO: 254301 - DNA, 25 bp, Mus musculus
atgacctagggcatctgctgggaag

SEQ ID NO: 254302 - DNA, 25 bp, Mus musculus
atgacctagggcttctgctgggaag

SEQ ID NO: 254303 - DNA, 25 bp, Mus musculus
atgacctatgtgagtttgatgattt

SEQ ID NO: 254304 - DNA, 25 bp, Mus musculus
atgacctatgtgtgtttgatgattt

SEQ ID NO: 254305 - DNA, 25 bp, Mus musculus
atgacctcaagcaactgattgtcct

SEQ ID NO: 254306 - DNA, 25 bp, Mus musculus
atgacctcaagctactgattgtcct

SEQ ID NO: 254307 - DNA, 25 bp, Mus musculus
atgacctcagacaccagtgaggaag

SEQ ID NO: 254308 - DNA, 25 bp, Mus musculus
atgacctcagactccagtgaggaag

SEQ ID NO: 254309 - DNA, 25 bp, Mus musculus
atgacctcagtgacagatggtggat

SEQ ID NO: 254310 - DNA, 25 bp, Mus musculus
atgacctcagtgatagcaccagcct

SEQ ID NO: 254311 - DNA, 25 bp, Mus musculus
atgacctcagtgtcagatggtggat

SEQ ID NO: 254312 - DNA, 25 bp, Mus musculus
atgacctcagtgttagcaccagcct

SEQ ID NO: 254313 - DNA, 25 bp, Mus musculus
atgacctcatatctgattgagcaac

SEQ ID NO: 254314 - DNA, 25 bp, Mus musculus
atgacctcatatgtgattgagcaac

SEQ ID NO: 254315 - DNA, 25 bp, Mus musculus
atgacctccattaataatctacatg

SEQ ID NO: 254316 - DNA, 25 bp, Mus musculus
atgacctccattctctcaggtggct

SEQ ID NO: 254317 - DNA, 25 bp, Mus musculus
atgacctccattgtctcaggtggct

SEQ ID NO: 254318 - DNA, 25 bp, Mus musculus
atgacctccatttataatctacatg

SEQ ID NO: 254319 - DNA, 25 bp, Mus musculus
atgacctccgtgacatttcttctca

SEQ ID NO: 254320 - DNA, 25 bp, Mus musculus
atgacctccgtgtcatttcttctca

SEQ ID NO: 254321 - DNA, 25 bp, Mus musculus
atgacctcgctgctgtggttgtaca

SEQ ID NO: 254322 - DNA, 25 bp, Mus musculus
atgacctcgctggtgtggttgtaca

SEQ ID NO: 254323 - DNA, 25 bp, Mus musculus
atgacctcggctacttctatggttc

SEQ ID NO: 254324 - DNA, 25 bp, Mus musculus
atgacctcggcttcttctatggttc

SEQ ID NO: 254325 - DNA, 25 bp, Mus musculus
atgacctctcccctgaggagcgaga

SEQ ID NO: 254326 - DNA, 25 bp, Mus musculus
atgacctctcccgtgaggagcgaga

SEQ ID NO: 254327 - DNA, 25 bp, Mus musculus
atgacctcttggcacaagctggaac

SEQ ID NO: 254328 - DNA, 25 bp, Mus musculus
atgacctcttgggacaagctggaac

SEQ ID NO: 254329 - DNA, 25 bp, Mus musculus
atgacctctttaacgcactcattac

SEQ ID NO: 254330 - DNA, 25 bp, Mus musculus
atgacctctttatcgcactcattac

SEQ ID NO: 254331 - DNA, 25 bp, Mus musculus
atgacctctttcaccaaatagggcc

SEQ ID NO: 254332 - DNA, 25 bp, Mus musculus
atgacctctttctccaaatagggcc

SEQ ID NO: 254333 - DNA, 25 bp, Mus musculus
atgacctgaaacacatcccatttgt

SEQ ID NO: 254334 - DNA, 25 bp, Mus musculus
atgacctgaaactcatcccatttgt

SEQ ID NO: 254335 - DNA, 25 bp, Mus musculus
atgacctgaacgacgcgctggacgg

SEQ ID NO: 254336 - DNA, 25 bp, Mus musculus
atgacctgaacgtcgcgctggacgg

SEQ ID NO: 254337 - DNA, 25 bp, Mus musculus
atgacctgaaggacccgtttgatgc

SEQ ID NO: 254338 - DNA, 25 bp, Mus musculus
atgacctgaaggtcccgtttgatgc

SEQ ID NO: 254339 - DNA, 25 bp, Mus musculus
atgacctgacatctaaccgttttca

SEQ ID NO: 254340 - DNA, 25 bp, Mus musculus
atgacctgacatgtaaccgttttca

SEQ ID NO: 254341 - DNA, 25 bp, Mus musculus
atgacctgatacagaaagagctcca

SEQ ID NO: 254342 - DNA, 25 bp, Mus musculus
atgacctgatactgaaagagctcca

SEQ ID NO: 254343 - DNA, 25 bp, Mus musculus
atgacctgatgcagctccgcctcag

SEQ ID NO: 254344 - DNA, 25 bp, Mus musculus
atgacctgatgctgctccgcctcag

SEQ ID NO: 254345 - DNA, 25 bp, Mus musculus
atgacctgcaagaggctcagagact

SEQ ID NO: 254346 - DNA, 25 bp, Mus musculus
atgacctgcaagtggctcagagact

SEQ ID NO: 254347 - DNA, 25 bp, Mus musculus
atgacctgcagtctttctgcgccag

SEQ ID NO: 254348 - DNA, 25 bp, Mus musculus
atgacctgcagtgtttctgcgccag

SEQ ID NO: 254349 - DNA, 25 bp, Mus musculus
atgacctgcatcatatggccctaga

SEQ ID NO: 254350 - DNA, 25 bp, Mus musculus
atgacctgcatcttatggccctaga

SEQ ID NO: 254351 - DNA, 25 bp, Mus musculus
atgacctgcggaacgacctggatag

SEQ ID NO: 254352 - DNA, 25 bp, Mus musculus
atgacctgcggatcgacctggatag

SEQ ID NO: 254353 - DNA, 25 bp, Mus musculus
atgacctgctgcatgcttgaaagct

SEQ ID NO: 254354 - DNA, 25 bp, Mus musculus
atgacctgctgcttgcttgaaagct

SEQ ID NO: 254355 - DNA, 25 bp, Mus musculus
atgacctgctggctcaggcaagtat

SEQ ID NO: 254356 - DNA, 25 bp, Mus musculus
atgacctgctgggtcaggcaagtat

SEQ ID NO: 254357 - DNA, 25 bp, Mus musculus
atgacctggaaactgttcttcagag

SEQ ID NO: 254358 - DNA, 25 bp, Mus musculus
atgacctggaaagtgttcttcagag

SEQ ID NO: 254359 - DNA, 25 bp, Mus musculus
atgacctggaagacgagctctatgc

SEQ ID NO: 254360 - DNA, 25 bp, Mus musculus
atgacctggaagtcgagctctatgc

SEQ ID NO: 254361 - DNA, 25 bp, Mus musculus
atgacctggcgaaagctgagggcaa

SEQ ID NO: 254362 - DNA, 25 bp, Mus musculus
atgacctggcgatagctgagggcaa

SEQ ID NO: 254363 - DNA, 25 bp, Mus musculus
atgacctggcggctgttattctcat

SEQ ID NO: 254364 - DNA, 25 bp, Mus musculus
atgacctggcgggtgttattctcat

SEQ ID NO: 254365 - DNA, 25 bp, Mus musculus
atgacctggtgcaggcactgggact

SEQ ID NO: 254366 - DNA, 25 bp, Mus musculus
atgacctggtgctggcactgggact

SEQ ID NO: 254367 - DNA, 25 bp, Mus musculus
atgacctgtatcacatagtctctgt

SEQ ID NO: 254368 - DNA, 25 bp, Mus musculus
atgacctgtatctcatagtctctgt

SEQ ID NO: 254369 - DNA, 25 bp, Mus musculus
atgacctgtattagatcgccatctg

SEQ ID NO: 254370 - DNA, 25 bp, Mus musculus
atgacctgtatttgatcgccatctg

SEQ ID NO: 254371 - DNA, 25 bp, Mus musculus
atgacctgtcctaaccaagagcaaa

SEQ ID NO: 254372 - DNA, 25 bp, Mus musculus
atgacctgtccttaccaagagcaaa

SEQ ID NO: 254373 - DNA, 25 bp, Mus musculus
atgacctgtctgataaaactgtcta

SEQ ID NO: 254374 - DNA, 25 bp, Mus musculus
atgacctgtctgttaaaactgtcta

SEQ ID NO: 254375 - DNA, 25 bp, Mus musculus
atgacctgtgtgacctatggtttaa

SEQ ID NO: 254376 - DNA, 25 bp, Mus musculus
atgacctgtgtgtcctatggtttaa

SEQ ID NO: 254377 - DNA, 25 bp, Mus musculus
atgacctgttccataaaagctaaat

SEQ ID NO: 254378 - DNA, 25 bp, Mus musculus
atgacctgttccttaaaagctaaat

SEQ ID NO: 254379 - DNA, 25 bp, Mus musculus
atgaccttacatagctctttagaga

SEQ ID NO: 254380 - DNA, 25 bp, Mus musculus
atgaccttacatctctgatcatcta

SEQ ID NO: 254381 - DNA, 25 bp, Mus musculus
atgaccttacatgtctgatcatcta

SEQ ID NO: 254382 - DNA, 25 bp, Mus musculus
atgaccttacattgctctttagaga

SEQ ID NO: 254383 - DNA, 25 bp, Mus musculus
atgaccttacttacagtgaggccgt

SEQ ID NO: 254384 - DNA, 25 bp, Mus musculus
atgaccttactttcagtgaggccgt

SEQ ID NO: 254385 - DNA, 25 bp, Mus musculus
atgaccttatagagcgcatccgggc

SEQ ID NO: 254386 - DNA, 25 bp, Mus musculus
atgaccttatagtgcgcatccgggc

SEQ ID NO: 254387 - DNA, 25 bp, Mus musculus
atgaccttcaaaaataagacctgag

SEQ ID NO: 254388 - DNA, 25 bp, Mus musculus
atgaccttcaaatataagacctgag

SEQ ID NO: 254389 - DNA, 25 bp, Mus musculus
atgaccttccataccagtacaagaa

SEQ ID NO: 254390 - DNA, 25 bp, Mus musculus
atgaccttccattccagtacaagaa

SEQ ID NO: 254391 - DNA, 25 bp, Mus musculus
atgaccttcctaaggacagccaata

SEQ ID NO: 254392 - DNA, 25 bp, Mus musculus
atgaccttcctatggacagccaata

SEQ ID NO: 254393 - DNA, 25 bp, Mus musculus
atgaccttcctgaccaataaggcct

SEQ ID NO: 254394 - DNA, 25 bp, Mus musculus
atgaccttcctgtccaataaggcct

SEQ ID NO: 254395 - DNA, 25 bp, Mus musculus
atgaccttccttcgatatcccaaac

SEQ ID NO: 254396 - DNA, 25 bp, Mus musculus
atgaccttccttggatatcccaaac

SEQ ID NO: 254397 - DNA, 25 bp, Mus musculus
atgaccttctttatgctgtggccaa

SEQ ID NO: 254398 - DNA, 25 bp, Mus musculus
atgaccttctttttgctgtggccaa

SEQ ID NO: 254399 - DNA, 25 bp, Mus musculus
atgaccttgaccatagatcatccac

SEQ ID NO: 254400 - DNA, 25 bp, Mus musculus
atgaccttgaccttagatcatccac

SEQ ID NO: 254401 - DNA, 25 bp, Mus musculus
atgaccttgagaaagtttgcaatga

SEQ ID NO: 254402 - DNA, 25 bp, Mus musculus
atgaccttgagatagtttgcaatga

SEQ ID NO: 254403 - DNA, 25 bp, Mus musculus
atgaccttgattctccatctcaaga

SEQ ID NO: 254404 - DNA, 25 bp, Mus musculus
atgaccttgattgtccatctcaaga

SEQ ID NO: 254405 - DNA, 25 bp, Mus musculus
atgaccttgccaacctcgttgagaa

SEQ ID NO: 254406 - DNA, 25 bp, Mus musculus
atgaccttgccatcctcgttgagaa

SEQ ID NO: 254407 - DNA, 25 bp, Mus musculus
atgaccttgctcagatgtgtagaca

SEQ ID NO: 254408 - DNA, 25 bp, Mus musculus
atgaccttgctctgatgtgtagaca

SEQ ID NO: 254409 - DNA, 25 bp, Mus musculus
atgaccttgtcacccgagagagact

SEQ ID NO: 254410 - DNA, 25 bp, Mus musculus
atgaccttgtcagccgagagagact

SEQ ID NO: 254411 - DNA, 25 bp, Mus musculus
atgaccttgtttcctgctgctgatt

SEQ ID NO: 254412 - DNA, 25 bp, Mus musculus
atgaccttgtttctgcagtaccgga

SEQ ID NO: 254413 - DNA, 25 bp, Mus musculus
atgaccttgtttgctgctgctgatt

SEQ ID NO: 254414 - DNA, 25 bp, Mus musculus
atgaccttgtttgtgcagtaccgga

SEQ ID NO: 254415 - DNA, 25 bp, Mus musculus
atgacctttcaacacatggcattcc

SEQ ID NO: 254416 - DNA, 25 bp, Mus musculus
atgacctttcaagacatggcattcc

SEQ ID NO: 254417 - DNA, 25 bp, Mus musculus
atgacctttctcctaggctggtgtc

SEQ ID NO: 254418 - DNA, 25 bp, Mus musculus
atgacctttctcgtaggctggtgtc

SEQ ID NO: 254419 - DNA, 25 bp, Mus musculus
atgacctttgataggagaagtaccc

SEQ ID NO: 254420 - DNA, 25 bp, Mus musculus
atgacctttgattggagaagtaccc

SEQ ID NO: 254421 - DNA, 25 bp, Mus musculus
atgacctttgtaatgtagattatcc

SEQ ID NO: 254422 - DNA, 25 bp, Mus musculus
atgacctttgtattgtagattatcc

SEQ ID NO: 254423 - DNA, 25 bp, Mus musculus
atgacctttgttatatgaatgcttt

SEQ ID NO: 254424 - DNA, 25 bp, Mus musculus
atgacctttgttttatgaatgcttt

SEQ ID NO: 254425 - DNA, 25 bp, Mus musculus
atgacctttttaaggctttcagcac

SEQ ID NO: 254426 - DNA, 25 bp, Mus musculus
atgacctttttatggctttcagcac

SEQ ID NO: 254427 - DNA, 25 bp, Mus musculus
atgacgaagaatccccagctgagga

SEQ ID NO: 254428 - DNA, 25 bp, Mus musculus
atgacgaagaatgcccagctgagga

SEQ ID NO: 254429 - DNA, 25 bp, Mus musculus
atgacgaagggtccgaccccataga

SEQ ID NO: 254430 - DNA, 25 bp, Mus musculus
atgacgaagggtgcgaccccataga

SEQ ID NO: 254431 - DNA, 25 bp, Mus musculus
atgacgacatcgctgatggttgcat

SEQ ID NO: 254432 - DNA, 25 bp, Mus musculus
atgacgacatcggtgatggttgcat

SEQ ID NO: 254433 - DNA, 25 bp, Mus musculus
atgacgacgacaaagcagcgtccgc

SEQ ID NO: 254434 - DNA, 25 bp, Mus musculus
atgacgacgacatagcagcgtccgc

SEQ ID NO: 254435 - DNA, 25 bp, Mus musculus
atgacgacgcccactacggaggcca

SEQ ID NO: 254436 - DNA, 25 bp, Mus musculus
atgacgacgccctctacggaggcca

SEQ ID NO: 254437 - DNA, 25 bp, Mus musculus
atgacgactcccactggttggatga

SEQ ID NO: 254438 - DNA, 25 bp, Mus musculus
atgacgactccctctggttggatga

SEQ ID NO: 254439 - DNA, 25 bp, Mus musculus
atgacgagactcacatagtcccttt

SEQ ID NO: 254440 - DNA, 25 bp, Mus musculus
atgacgagactctcatagtcccttt

SEQ ID NO: 254441 - DNA, 25 bp, Mus musculus
atgacgaggaatccccgcagcagct

SEQ ID NO: 254442 - DNA, 25 bp, Mus musculus
atgacgaggaatcggaagcccaggg

SEQ ID NO: 254443 - DNA, 25 bp, Mus musculus
atgacgaggaatgcccgcagcagct

SEQ ID NO: 254444 - DNA, 25 bp, Mus musculus
atgacgaggaatgggaagcccaggg

SEQ ID NO: 254445 - DNA, 25 bp, Mus musculus
atgacgaggactcacactgtaaact

SEQ ID NO: 254446 - DNA, 25 bp, Mus musculus
atgacgaggactgacactgtaaact

SEQ ID NO: 254447 - DNA, 25 bp, Mus musculus
atgacgaggagaacgctggccctgt

SEQ ID NO: 254448 - DNA, 25 bp, Mus musculus
atgacgaggagatcgctggccctgt

SEQ ID NO: 254449 - DNA, 25 bp, Mus musculus
atgacgaggtcccacagtgtgccca

SEQ ID NO: 254450 - DNA, 25 bp, Mus musculus
atgacgaggtccgacagtgtgccca

SEQ ID NO: 254451 - DNA, 25 bp, Mus musculus
atgacgaggttgatgtggactttta

SEQ ID NO: 254452 - DNA, 25 bp, Mus musculus
atgacgaggttgttgtggactttta

SEQ ID NO: 254453 - DNA, 25 bp, Mus musculus
atgacgagtacccaggctgctcgcc

SEQ ID NO: 254454 - DNA, 25 bp, Mus musculus
atgacgagtaccgaggctgctcgcc

SEQ ID NO: 254455 - DNA, 25 bp, Mus musculus
atgacgatgaggacgactcccctga

SEQ ID NO: 254456 - DNA, 25 bp, Mus musculus
atgacgatgaggtcgactcccctga

SEQ ID NO: 254457 - DNA, 25 bp, Mus musculus
atgacgatgatgacgggcaacccag

SEQ ID NO: 254458 - DNA, 25 bp, Mus musculus
atgacgatgatgtcgggcaacccag

SEQ ID NO: 254459 - DNA, 25 bp, Mus musculus
atgacgatgtgtatccggcctagca

SEQ ID NO: 254460 - DNA, 25 bp, Mus musculus
atgacgatgtgtcaaggagatcctc

SEQ ID NO: 254461 - DNA, 25 bp, Mus musculus
atgacgatgtgtgaaggagatcctc

SEQ ID NO: 254462 - DNA, 25 bp, Mus musculus
atgacgatgtgtttccggcctagca

SEQ ID NO: 254463 - DNA, 25 bp, Mus musculus
atgacgattagcagcctggtacctg

SEQ ID NO: 254464 - DNA, 25 bp, Mus musculus
atgacgattagctgcctggtacctg

SEQ ID NO: 254465 - DNA, 25 bp, Mus musculus
atgacgcatatcaataggttcctta

SEQ ID NO: 254466 - DNA, 25 bp, Mus musculus
atgacgcatatctataggttcctta

SEQ ID NO: 254467 - DNA, 25 bp, Mus musculus
atgacgcatggcaacagttactaat

SEQ ID NO: 254468 - DNA, 25 bp, Mus musculus
atgacgcatggctacagttactaat

SEQ ID NO: 254469 - DNA, 25 bp, Mus musculus
atgacgccctggacggagatgacga

SEQ ID NO: 254470 - DNA, 25 bp, Mus musculus
atgacgccctggtcggagatgacga

SEQ ID NO: 254471 - DNA, 25 bp, Mus musculus
atgacgccgcccactatagaggcca

SEQ ID NO: 254472 - DNA, 25 bp, Mus musculus
atgacgccgccctctatagaggcca

SEQ ID NO: 254473 - DNA, 25 bp, Mus musculus
atgacgcctctcagtgactactaag

SEQ ID NO: 254474 - DNA, 25 bp, Mus musculus
atgacgcctctctgtgactactaag

SEQ ID NO: 254475 - DNA, 25 bp, Mus musculus
atgacgccttgaagtatgtttgctg

SEQ ID NO: 254476 - DNA, 25 bp, Mus musculus
atgacgccttgatgtatgtttgctg

SEQ ID NO: 254477 - DNA, 25 bp, Mus musculus
atgacgctcagtaatctggccgtgc

SEQ ID NO: 254478 - DNA, 25 bp, Mus musculus
atgacgctcagttatctggccgtgc

SEQ ID NO: 254479 - DNA, 25 bp, Mus musculus
atgacgctcgctacttgaggttaat

SEQ ID NO: 254480 - DNA, 25 bp, Mus musculus
atgacgctcgcttcttgaggttaat

SEQ ID NO: 254481 - DNA, 25 bp, Mus musculus
atgacgctcggaacacaatccttgg

SEQ ID NO: 254482 - DNA, 25 bp, Mus musculus
atgacgctcggatcacaatccttgg

SEQ ID NO: 254483 - DNA, 25 bp, Mus musculus
atgacgctctcaatattcctgtgta

SEQ ID NO: 254484 - DNA, 25 bp, Mus musculus
atgacgctctcattattcctgtgta

SEQ ID NO: 254485 - DNA, 25 bp, Mus musculus
atgacgctgtgcagcagccgtcggt

SEQ ID NO: 254486 - DNA, 25 bp, Mus musculus
atgacgctgtgctgcagccgtcggt

SEQ ID NO: 254487 - DNA, 25 bp, Mus musculus
atgacgcttcaaaccacaattctat

SEQ ID NO: 254488 - DNA, 25 bp, Mus musculus
atgacgcttcaatccacaattctat

SEQ ID NO: 254489 - DNA, 25 bp, Mus musculus
atgacggaccctcatgaggtggcca

SEQ ID NO: 254490 - DNA, 25 bp, Mus musculus
atgacggaccctgatgaggtggcca

SEQ ID NO: 254491 - DNA, 25 bp, Mus musculus
atgacggactgtccacgctcacact

SEQ ID NO: 254492 - DNA, 25 bp, Mus musculus
atgacggactgtgcacgctcacact

SEQ ID NO: 254493 - DNA, 25 bp, Mus musculus
atgacggagctcatgcctgagcgat

SEQ ID NO: 254494 - DNA, 25 bp, Mus musculus
atgacggagctcttgcctgagcgat

SEQ ID NO: 254495 - DNA, 25 bp, Mus musculus
atgacggattgtccactgtccttat

SEQ ID NO: 254496 - DNA, 25 bp, Mus musculus
atgacggattgtgcactgtccttat

SEQ ID NO: 254497 - DNA, 25 bp, Mus musculus
atgacggcaagcagaagagccttat

SEQ ID NO: 254498 - DNA, 25 bp, Mus musculus
atgacggcaagctgaagagccttat

SEQ ID NO: 254499 - DNA, 25 bp, Mus musculus
atgacggcagacacagagctgaatc

SEQ ID NO: 254500 - DNA, 25 bp, Mus musculus
atgacggcagactcagagctgaatc

SEQ ID NO: 254501 - DNA, 25 bp, Mus musculus
atgacggccttgatggccctcgtag

SEQ ID NO: 254502 - DNA, 25 bp, Mus musculus
atgacggccttgttggccctcgtag

SEQ ID NO: 254503 - DNA, 25 bp, Mus musculus
atgacggcgtgtctctgcatgagct

SEQ ID NO: 254504 - DNA, 25 bp, Mus musculus
atgacggcgtgtgtctgcatgagct

SEQ ID NO: 254505 - DNA, 25 bp, Mus musculus
atgacggctttgaactgtggaatgt

SEQ ID NO: 254506 - DNA, 25 bp, Mus musculus
atgacggctttgtactgtggaatgt

SEQ ID NO: 254507 - DNA, 25 bp, Mus musculus
atgacgggaaaaccaagcactctgt

SEQ ID NO: 254508 - DNA, 25 bp, Mus musculus
atgacgggaaaagcaagcactctgt

SEQ ID NO: 254509 - DNA, 25 bp, Mus musculus
atgacgggactcactttaagtggga

SEQ ID NO: 254510 - DNA, 25 bp, Mus musculus
atgacgggactctctttaagtggga

SEQ ID NO: 254511 - DNA, 25 bp, Mus musculus
atgacgggccatcaacacatacggt

SEQ ID NO: 254512 - DNA, 25 bp, Mus musculus
atgacgggccatgaacacatacggt

SEQ ID NO: 254513 - DNA, 25 bp, Mus musculus
atgacgggtctgcaaggttccctca

SEQ ID NO: 254514 - DNA, 25 bp, Mus musculus
atgacgggtctggaaggttccctca

SEQ ID NO: 254515 - DNA, 25 bp, Mus musculus
atgacggtactcagggcgcttgtga

SEQ ID NO: 254516 - DNA, 25 bp, Mus musculus
atgacggtactctgggcgcttgtga

SEQ ID NO: 254517 - DNA, 25 bp, Mus musculus
atgacggtgctcagatcgcgaaagt

SEQ ID NO: 254518 - DNA, 25 bp, Mus musculus
atgacggtgctctgatcgcgaaagt

SEQ ID NO: 254519 - DNA, 25 bp, Mus musculus
atgacggtgttacgacagatcccct

SEQ ID NO: 254520 - DNA, 25 bp, Mus musculus
atgacggtgttaggacagatcccct

SEQ ID NO: 254521 - DNA, 25 bp, Mus musculus
atgacgtaaccacttgacccttcac

SEQ ID NO: 254522 - DNA, 25 bp, Mus musculus
atgacgtaaccagttgacccttcac

SEQ ID NO: 254523 - DNA, 25 bp, Mus musculus
atgacgtcaacccacaatgcagcgc

SEQ ID NO: 254524 - DNA, 25 bp, Mus musculus
atgacgtcaaccgacaatgcagcgc

SEQ ID NO: 254525 - DNA, 25 bp, Mus musculus
atgacgtcagcccttggctacatcg

SEQ ID NO: 254526 - DNA, 25 bp, Mus musculus
atgacgtcagccgttggctacatcg

SEQ ID NO: 254527 - DNA, 25 bp, Mus musculus
atgacgtccgcccaaagtttggcct

SEQ ID NO: 254528 - DNA, 25 bp, Mus musculus
atgacgtccgccgaaagtttggcct

SEQ ID NO: 254529 - DNA, 25 bp, Mus musculus
atgacgtccggtctcctctcacctc

SEQ ID NO: 254530 - DNA, 25 bp, Mus musculus
atgacgtccggtgtcctctcacctc

SEQ ID NO: 254531 - DNA, 25 bp, Mus musculus
atgacgtcggagactacacctgaca

SEQ ID NO: 254532 - DNA, 25 bp, Mus musculus
atgacgtcggagtctacacctgaca

SEQ ID NO: 254533 - DNA, 25 bp, Mus musculus
atgacgtcttaactgaccctcagga

SEQ ID NO: 254534 - DNA, 25 bp, Mus musculus
atgacgtcttaagtgaccctcagga

SEQ ID NO: 254535 - DNA, 25 bp, Mus musculus
atgacgtgaatacccagtcgccata

SEQ ID NO: 254536 - DNA, 25 bp, Mus musculus
atgacgtgaatagccagtcgccata

SEQ ID NO: 254537 - DNA, 25 bp, Mus musculus
atgacgtgactgctgcattctgtgc

SEQ ID NO: 254538 - DNA, 25 bp, Mus musculus
atgacgtgactggtgcattctgtgc

SEQ ID NO: 254539 - DNA, 25 bp, Mus musculus
atgacgtgcagccatgacttccgag

SEQ ID NO: 254540 - DNA, 25 bp, Mus musculus
atgacgtgcagcgatgacttccgag

SEQ ID NO: 254541 - DNA, 25 bp, Mus musculus
atgacgtgcctaatttgtattgctt

SEQ ID NO: 254542 - DNA, 25 bp, Mus musculus
atgacgtgcctattttgtattgctt

SEQ ID NO: 254543 - DNA, 25 bp, Mus musculus
atgacgtgctggatgtgtgtcctac

SEQ ID NO: 254544 - DNA, 25 bp, Mus musculus
atgacgtgctggttgtgtgtcctac

SEQ ID NO: 254545 - DNA, 25 bp, Mus musculus
atgacgtggctaaggctctcatgaa

SEQ ID NO: 254546 - DNA, 25 bp, Mus musculus
atgacgtggctatggctctcatgaa

SEQ ID NO: 254547 - DNA, 25 bp, Mus musculus
atgacgtggctcaaagtggccattt

SEQ ID NO: 254548 - DNA, 25 bp, Mus musculus
atgacgtggctctaagtggccattt

SEQ ID NO: 254549 - DNA, 25 bp, Mus musculus
atgacgtgggccaggatgccttaga

SEQ ID NO: 254550 - DNA, 25 bp, Mus musculus
atgacgtgggcctggatgccttaga

SEQ ID NO: 254551 - DNA, 25 bp, Mus musculus
atgacgtgtcttcatgtctctgatt

SEQ ID NO: 254552 - DNA, 25 bp, Mus musculus
atgacgtgtcttgatgtctctgatt

SEQ ID NO: 254553 - DNA, 25 bp, Mus musculus
atgacgtgttgacttttcccttgac

SEQ ID NO: 254554 - DNA, 25 bp, Mus musculus
atgacgtgttgagttttcccttgac

SEQ ID NO: 254555 - DNA, 25 bp, Mus musculus
atgacgttgtgacaccatgcttggc

SEQ ID NO: 254556 - DNA, 25 bp, Mus musculus
atgacgttgtgagaccatgcttggc

SEQ ID NO: 254557 - DNA, 25 bp, Mus musculus
atgacgttttctcttttacatccaa

SEQ ID NO: 254558 - DNA, 25 bp, Mus musculus
atgacgttttctgttttacatccaa

SEQ ID NO: 254559 - DNA, 25 bp, Mus musculus
atgactaacccaatcaaacacagtt

SEQ ID NO: 254560 - DNA, 25 bp, Mus musculus
atgactaacccattcaaacacagtt

SEQ ID NO: 254561 - DNA, 25 bp, Mus musculus
atgactaacctcagttaatggcccc

SEQ ID NO: 254562 - DNA, 25 bp, Mus musculus
atgactaacctctgttaatggcccc

SEQ ID NO: 254563 - DNA, 25 bp, Mus musculus
atgactaagtaacagcttgctacct

SEQ ID NO: 254564 - DNA, 25 bp, Mus musculus
atgactaagtaagagcttgctacct

SEQ ID NO: 254565 - DNA, 25 bp, Mus musculus
atgactaatgtcagcctccaatgct

SEQ ID NO: 254566 - DNA, 25 bp, Mus musculus
atgactaatgtctgcctccaatgct

SEQ ID NO: 254567 - DNA, 25 bp, Mus musculus
atgactacaagtatcctatcgagga

SEQ ID NO: 254568 - DNA, 25 bp, Mus musculus
atgactacaagtttcctatcgagga

SEQ ID NO: 254569 - DNA, 25 bp, Mus musculus
atgactacacggatgatcccaccat

SEQ ID NO: 254570 - DNA, 25 bp, Mus musculus
atgactacacggttgatcccaccat

SEQ ID NO: 254571 - DNA, 25 bp, Mus musculus
atgactacctggatgttttctgccc

SEQ ID NO: 254572 - DNA, 25 bp, Mus musculus
atgactacctggttgttttctgccc

SEQ ID NO: 254573 - DNA, 25 bp, Mus musculus
atgactacctgtatgacattgctgt

SEQ ID NO: 254574 - DNA, 25 bp, Mus musculus
atgactacctgtttgacattgctgt

SEQ ID NO: 254575 - DNA, 25 bp, Mus musculus
atgactacggctcatgcttccaagg

SEQ ID NO: 254576 - DNA, 25 bp, Mus musculus
atgactacggctgatgcttccaagg

SEQ ID NO: 254577 - DNA, 25 bp, Mus musculus
atgactactaagatctctgaacttc

SEQ ID NO: 254578 - DNA, 25 bp, Mus musculus
atgactactaagttctctgaacttc

SEQ ID NO: 254579 - DNA, 25 bp, Mus musculus
atgactactacacccaacccaggga

SEQ ID NO: 254580 - DNA, 25 bp, Mus musculus
atgactactacagccaacccaggga

SEQ ID NO: 254581 - DNA, 25 bp, Mus musculus
atgactactccaaggtgttgacagg

SEQ ID NO: 254582 - DNA, 25 bp, Mus musculus
atgactactccatggtgttgacagg

SEQ ID NO: 254583 - DNA, 25 bp, Mus musculus
atgactactcctacctattgctata

SEQ ID NO: 254584 - DNA, 25 bp, Mus musculus
atgactactccttcctattgctata

SEQ ID NO: 254585 - DNA, 25 bp, Mus musculus
atgactactgatcagggagatgttt

SEQ ID NO: 254586 - DNA, 25 bp, Mus musculus
atgactactgatgagggagatgttt

SEQ ID NO: 254587 - DNA, 25 bp, Mus musculus
atgactagctgaatttcgattttac

SEQ ID NO: 254588 - DNA, 25 bp, Mus musculus
atgactagctgattttcgattttac

SEQ ID NO: 254589 - DNA, 25 bp, Mus musculus
atgactaggcgtcgacctgcccatg

SEQ ID NO: 254590 - DNA, 25 bp, Mus musculus
atgactaggcgtggacctgcccatg

SEQ ID NO: 254591 - DNA, 25 bp, Mus musculus
atgactaggtctctaaacttggata

SEQ ID NO: 254592 - DNA, 25 bp, Mus musculus
atgactaggtctgtaaacttggata

SEQ ID NO: 254593 - DNA, 25 bp, Mus musculus
atgactagtggcatggatggctaaa

SEQ ID NO: 254594 - DNA, 25 bp, Mus musculus
atgactagtggcttggatggctaaa

SEQ ID NO: 254595 - DNA, 25 bp, Mus musculus
atgactagttttcggtgcattttct

SEQ ID NO: 254596 - DNA, 25 bp, Mus musculus
atgactagttttgggtgcattttct

SEQ ID NO: 254597 - DNA, 25 bp, Mus musculus
atgactatacagcatgtgcccagcc

SEQ ID NO: 254598 - DNA, 25 bp, Mus musculus
atgactatacaggatgtgcccagcc

SEQ ID NO: 254599 - DNA, 25 bp, Mus musculus
atgactatagccatgacatttcagg

SEQ ID NO: 254600 - DNA, 25 bp, Mus musculus
atgactatagccttgacatttcagg

SEQ ID NO: 254601 - DNA, 25 bp, Mus musculus
atgactatatctatcattgccaccc

SEQ ID NO: 254602 - DNA, 25 bp, Mus musculus
atgactatatctttcattgccaccc

SEQ ID NO: 254603 - DNA, 25 bp, Mus musculus
atgactatcaccactggattgacct

SEQ ID NO: 254604 - DNA, 25 bp, Mus musculus
atgactatcacctctggattgacct

SEQ ID NO: 254605 - DNA, 25 bp, Mus musculus
atgactatcggccacgcaagaaaaa

SEQ ID NO: 254606 - DNA, 25 bp, Mus musculus
atgactatcggcgacgcaagaaaaa

SEQ ID NO: 254607 - DNA, 25 bp, Mus musculus
atgactatgaggacagctgccctga

SEQ ID NO: 254608 - DNA, 25 bp, Mus musculus
atgactatgaggtcagctgccctga

SEQ ID NO: 254609 - DNA, 25 bp, Mus musculus
atgactatgcctagcacctgtcctg

SEQ ID NO: 254610 - DNA, 25 bp, Mus musculus
atgactatgccttgcacctgtcctg

SEQ ID NO: 254611 - DNA, 25 bp, Mus musculus
atgactatgctacatgttaattctc

SEQ ID NO: 254612 - DNA, 25 bp, Mus musculus
atgactatgctagatgttaattctc

SEQ ID NO: 254613 - DNA, 25 bp, Mus musculus
atgactatggctcctattgcggtgt

SEQ ID NO: 254614 - DNA, 25 bp, Mus musculus
atgactatggctgctattgcggtgt

SEQ ID NO: 254615 - DNA, 25 bp, Mus musculus
atgactatgtcaaaccctgcagtct

SEQ ID NO: 254616 - DNA, 25 bp, Mus musculus
atgactatgtcataccctgcagtct

SEQ ID NO: 254617 - DNA, 25 bp, Mus musculus
atgactattatacaacttcctggag

SEQ ID NO: 254618 - DNA, 25 bp, Mus musculus
atgactattatagaacttcctggag

SEQ ID NO: 254619 - DNA, 25 bp, Mus musculus
atgactattctgacgacctgctata

SEQ ID NO: 254620 - DNA, 25 bp, Mus musculus
atgactattctgtcgacctgctata

SEQ ID NO: 254621 - DNA, 25 bp, Mus musculus
atgactattcttacataatcattgt

SEQ ID NO: 254622 - DNA, 25 bp, Mus musculus
atgactattctttcataatcattgt

SEQ ID NO: 254623 - DNA, 25 bp, Mus musculus
atgactattggcacctttggcttct

SEQ ID NO: 254624 - DNA, 25 bp, Mus musculus
atgactattggctcctttggcttct

SEQ ID NO: 254625 - DNA, 25 bp, Mus musculus
atgactcaacatctagcctaccaag

SEQ ID NO: 254626 - DNA, 25 bp, Mus musculus
atgactcaacatgtagcctaccaag

SEQ ID NO: 254627 - DNA, 25 bp, Mus musculus
atgactcaactgctagtgtgcttac

SEQ ID NO: 254628 - DNA, 25 bp, Mus musculus
atgactcaactggtagtgtgcttac

SEQ ID NO: 254629 - DNA, 25 bp, Mus musculus
atgactcaagcactccgaagactga

SEQ ID NO: 254630 - DNA, 25 bp, Mus musculus
atgactcaagcagtccgaagactga

SEQ ID NO: 254631 - DNA, 25 bp, Mus musculus
atgactcaaggcatgtgtcgggctc

SEQ ID NO: 254632 - DNA, 25 bp, Mus musculus
atgactcaaggcttgtgtcgggctc

SEQ ID NO: 254633 - DNA, 25 bp, Mus musculus
atgactcaattcagagctgttcccc

SEQ ID NO: 254634 - DNA, 25 bp, Mus musculus
atgactcaattctgagctgttcccc

SEQ ID NO: 254635 - DNA, 25 bp, Mus musculus
atgactcacaagacggtggtattta

SEQ ID NO: 254636 - DNA, 25 bp, Mus musculus
atgactcacaagtcggtggtattta

SEQ ID NO: 254637 - DNA, 25 bp, Mus musculus
atgactcactagcaaggatctccag

SEQ ID NO: 254638 - DNA, 25 bp, Mus musculus
atgactcactaggaaggatctccag

SEQ ID NO: 254639 - DNA, 25 bp, Mus musculus
atgactcagaaacctttggatgcct

SEQ ID NO: 254640 - DNA, 25 bp, Mus musculus
atgactcagaaagctttggatgcct

SEQ ID NO: 254641 - DNA, 25 bp, Mus musculus
atgactcagaacctagggccagcac

SEQ ID NO: 254642 - DNA, 25 bp, Mus musculus
atgactcagaacgtagggccagcac

SEQ ID NO: 254643 - DNA, 25 bp, Mus musculus
atgactcagacaaagacatccaaga

SEQ ID NO: 254644 - DNA, 25 bp, Mus musculus
atgactcagacatagacatccaaga

SEQ ID NO: 254645 - DNA, 25 bp, Mus musculus
atgactcagatcctattcttttgac

SEQ ID NO: 254646 - DNA, 25 bp, Mus musculus
atgactcagatcgtattcttttgac

SEQ ID NO: 254647 - DNA, 25 bp, Mus musculus
atgactcagtggcaccaagcttcat

SEQ ID NO: 254648 - DNA, 25 bp, Mus musculus
atgactcagtgggaccaagcttcat

SEQ ID NO: 254649 - DNA, 25 bp, Mus musculus
atgactcatactaaagttctttagc

SEQ ID NO: 254650 - DNA, 25 bp, Mus musculus
atgactcatactcgacaaaagccct

SEQ ID NO: 254651 - DNA, 25 bp, Mus musculus
atgactcatactggacaaaagccct

SEQ ID NO: 254652 - DNA, 25 bp, Mus musculus
atgactcatacttaagttctttagc

SEQ ID NO: 254653 - DNA, 25 bp, Mus musculus
atgactcatatgacttactctaagc

SEQ ID NO: 254654 - DNA, 25 bp, Mus musculus
atgactcatatgtcttactctaagc

SEQ ID NO: 254655 - DNA, 25 bp, Mus musculus
atgactcatcagatctggagctgca

SEQ ID NO: 254656 - DNA, 25 bp, Mus musculus
atgactcatcagttctggagctgca

SEQ ID NO: 254657 - DNA, 25 bp, Mus musculus
atgactcattgcagtggacatttac

SEQ ID NO: 254658 - DNA, 25 bp, Mus musculus
atgactcattgctgtggacatttac

SEQ ID NO: 254659 - DNA, 25 bp, Mus musculus
atgactcatttcaaagcacttctag

SEQ ID NO: 254660 - DNA, 25 bp, Mus musculus
atgactcatttctaagcacttctag

SEQ ID NO: 254661 - DNA, 25 bp, Mus musculus
atgactccaaacaactcatctgcac

SEQ ID NO: 254662 - DNA, 25 bp, Mus musculus
atgactccaaactactcatctgcac

SEQ ID NO: 254663 - DNA, 25 bp, Mus musculus
atgactccaaatccagcttgtatgt

SEQ ID NO: 254664 - DNA, 25 bp, Mus musculus
atgactccaaatgcagcttgtatgt

SEQ ID NO: 254665 - DNA, 25 bp, Mus musculus
atgactccaacaccagttttagaaa

SEQ ID NO: 254666 - DNA, 25 bp, Mus musculus
atgactccaacagcagttttagaaa

SEQ ID NO: 254667 - DNA, 25 bp, Mus musculus
atgactccaagtcctattgtcacag

SEQ ID NO: 254668 - DNA, 25 bp, Mus musculus
atgactccaagtgctattgtcacag

SEQ ID NO: 254669 - DNA, 25 bp, Mus musculus
atgactccagagcaactgaggctga

SEQ ID NO: 254670 - DNA, 25 bp, Mus musculus
atgactccagaggaactgaggctga

SEQ ID NO: 254671 - DNA, 25 bp, Mus musculus
atgactccagcaaaggacgattctt

SEQ ID NO: 254672 - DNA, 25 bp, Mus musculus
atgactccagcataggacgattctt

SEQ ID NO: 254673 - DNA, 25 bp, Mus musculus
atgactcccagcacaaagggctcaa

SEQ ID NO: 254674 - DNA, 25 bp, Mus musculus
atgactcccagctcaaagggctcaa

SEQ ID NO: 254675 - DNA, 25 bp, Mus musculus
atgactcccctgaagggcgctgttg

SEQ ID NO: 254676 - DNA, 25 bp, Mus musculus
atgactcccctgtagggcgctgttg

SEQ ID NO: 254677 - DNA, 25 bp, Mus musculus
atgactccctccatgtgttgtatgt

SEQ ID NO: 254678 - DNA, 25 bp, Mus musculus
atgactccctccttgtgttgtatgt

SEQ ID NO: 254679 - DNA, 25 bp, Mus musculus
atgactcccttgatgggactttaga

SEQ ID NO: 254680 - DNA, 25 bp, Mus musculus
atgactcccttgttgggactttaga

SEQ ID NO: 254681 - DNA, 25 bp, Mus musculus
atgactccgtaaactctgagcgtga

SEQ ID NO: 254682 - DNA, 25 bp, Mus musculus
atgactccgtaatctctgagcgtga

SEQ ID NO: 254683 - DNA, 25 bp, Mus musculus
atgactccgtcgagcagatgcatga

SEQ ID NO: 254684 - DNA, 25 bp, Mus musculus
atgactccgtcgtgcagatgcatga

SEQ ID NO: 254685 - DNA, 25 bp, Mus musculus
atgactcctaggacccatgggcaga

SEQ ID NO: 254686 - DNA, 25 bp, Mus musculus
atgactcctaggagggtcaggaacc

SEQ ID NO: 254687 - DNA, 25 bp, Mus musculus
atgactcctaggtcccatgggcaga

SEQ ID NO: 254688 - DNA, 25 bp, Mus musculus
atgactcctaggtgggtcaggaacc

SEQ ID NO: 254689 - DNA, 25 bp, Mus musculus
atgactcctattcttgagttatcag

SEQ ID NO: 254690 - DNA, 25 bp, Mus musculus
atgactcctattgttgagttatcag

SEQ ID NO: 254691 - DNA, 25 bp, Mus musculus
atgactcctcccagtcaagcactaa

SEQ ID NO: 254692 - DNA, 25 bp, Mus musculus
atgactcctccctgtcaagcactaa

SEQ ID NO: 254693 - DNA, 25 bp, Mus musculus
atgactcctgaccacactgttgaag

SEQ ID NO: 254694 - DNA, 25 bp, Mus musculus
atgactcctgacgacactgttgaag

SEQ ID NO: 254695 - DNA, 25 bp, Mus musculus
atgactcctgtcatcgaggtatggg

SEQ ID NO: 254696 - DNA, 25 bp, Mus musculus
atgactcctgtcttcgaggtatggg

SEQ ID NO: 254697 - DNA, 25 bp, Mus musculus
atgactccttggatcaagtccagga

SEQ ID NO: 254698 - DNA, 25 bp, Mus musculus
atgactccttggttcaagtccagga

SEQ ID NO: 254699 - DNA, 25 bp, Mus musculus
atgactcgaattacactccgaaacc

SEQ ID NO: 254700 - DNA, 25 bp, Mus musculus
atgactcgaatttcactccgaaacc

SEQ ID NO: 254701 - DNA, 25 bp, Mus musculus
atgactcggtcaagttcgcgcggcg

SEQ ID NO: 254702 - DNA, 25 bp, Mus musculus
atgactcggtcatgttcgcgcggcg

SEQ ID NO: 254703 - DNA, 25 bp, Mus musculus
atgactctaactcctcagacttaag

SEQ ID NO: 254704 - DNA, 25 bp, Mus musculus
atgactctaactgctcagacttaag

SEQ ID NO: 254705 - DNA, 25 bp, Mus musculus
atgactctaagtatgttgtattaat

SEQ ID NO: 254706 - DNA, 25 bp, Mus musculus
atgactctaagtttgttgtattaat

SEQ ID NO: 254707 - DNA, 25 bp, Mus musculus
atgactctaggcattgaaaccgctc

SEQ ID NO: 254708 - DNA, 25 bp, Mus musculus
atgactctaggctttgaaaccgctc

SEQ ID NO: 254709 - DNA, 25 bp, Mus musculus
atgactctatctaagcctctttgga

SEQ ID NO: 254710 - DNA, 25 bp, Mus musculus
atgactctatctatctagttgccca

SEQ ID NO: 254711 - DNA, 25 bp, Mus musculus
atgactctatcttagcctctttgga

SEQ ID NO: 254712 - DNA, 25 bp, Mus musculus
atgactctatctttctagttgccca

SEQ ID NO: 254713 - DNA, 25 bp, Mus musculus
atgactctcatgaactcagcgtcta

SEQ ID NO: 254714 - DNA, 25 bp, Mus musculus
atgactctcatgtactcagcgtcta

SEQ ID NO: 254715 - DNA, 25 bp, Mus musculus
atgactctcattccctctttgtaat

SEQ ID NO: 254716 - DNA, 25 bp, Mus musculus
atgactctcattgcctctttgtaat

SEQ ID NO: 254717 - DNA, 25 bp, Mus musculus
atgactctcgaacatgatgactagg

SEQ ID NO: 254718 - DNA, 25 bp, Mus musculus
atgactctcgaagatgatgactagg

SEQ ID NO: 254719 - DNA, 25 bp, Mus musculus
atgactctcggactgggctcaacgt

SEQ ID NO: 254720 - DNA, 25 bp, Mus musculus
atgactctcggagtgggctcaacgt

SEQ ID NO: 254721 - DNA, 25 bp, Mus musculus
atgactctctgtcagacatccctga

SEQ ID NO: 254722 - DNA, 25 bp, Mus musculus
atgactctctgtgagacatccctga

SEQ ID NO: 254723 - DNA, 25 bp, Mus musculus
atgactctcttgctgagggatgcca

SEQ ID NO: 254724 - DNA, 25 bp, Mus musculus
atgactctcttggtgagggatgcca

SEQ ID NO: 254725 - DNA, 25 bp, Mus musculus
atgactctgaagacagcgcttgctc

SEQ ID NO: 254726 - DNA, 25 bp, Mus musculus
atgactctgaagtcagcgcttgctc

SEQ ID NO: 254727 - DNA, 25 bp, Mus musculus
atgactctgattccagacaccgtcc

SEQ ID NO: 254728 - DNA, 25 bp, Mus musculus
atgactctgattgcagacaccgtcc

SEQ ID NO: 254729 - DNA, 25 bp, Mus musculus
atgactctggagatagcatttctac

SEQ ID NO: 254730 - DNA, 25 bp, Mus musculus
atgactctggagttagcatttctac

SEQ ID NO: 254731 - DNA, 25 bp, Mus musculus
atgactctgtggaggctcagatgcc

SEQ ID NO: 254732 - DNA, 25 bp, Mus musculus
atgactctgtggtggctcagatgcc

SEQ ID NO: 254733 - DNA, 25 bp, Mus musculus
atgactcttcccagcaacttttaag

SEQ ID NO: 254734 - DNA, 25 bp, Mus musculus
atgactcttccctgcaacttttaag

SEQ ID NO: 254735 - DNA, 25 bp, Mus musculus
atgactcttgatcacggtcttaacc

SEQ ID NO: 254736 - DNA, 25 bp, Mus musculus
atgactcttgatgacggtcttaacc

SEQ ID NO: 254737 - DNA, 25 bp, Mus musculus
atgactcttgcacccaactttaaaa

SEQ ID NO: 254738 - DNA, 25 bp, Mus musculus
atgactcttgcagccaactttaaaa

SEQ ID NO: 254739 - DNA, 25 bp, Mus musculus
atgactctttcacgttctacaatgg

SEQ ID NO: 254740 - DNA, 25 bp, Mus musculus
atgactctttcaggttctacaatgg

SEQ ID NO: 254741 - DNA, 25 bp, Mus musculus
atgactgaaaacatgtattgatttc

SEQ ID NO: 254742 - DNA, 25 bp, Mus musculus
atgactgaaaacttgtattgatttc

SEQ ID NO: 254743 - DNA, 25 bp, Mus musculus
atgactgaagaacacacctgacggt

SEQ ID NO: 254744 - DNA, 25 bp, Mus musculus
atgactgaagaagacacctgacggt

SEQ ID NO: 254745 - DNA, 25 bp, Mus musculus
atgactgaagccagccttaaccaat

SEQ ID NO: 254746 - DNA, 25 bp, Mus musculus
atgactgaagcctgccttaaccaat

SEQ ID NO: 254747 - DNA, 25 bp, Mus musculus
atgactgaaggcatatgcatcctca

SEQ ID NO: 254748 - DNA, 25 bp, Mus musculus
atgactgaaggccactccaggattt

SEQ ID NO: 254749 - DNA, 25 bp, Mus musculus
atgactgaaggcgactccaggattt

SEQ ID NO: 254750 - DNA, 25 bp, Mus musculus
atgactgaaggcttatgcatcctca

SEQ ID NO: 254751 - DNA, 25 bp, Mus musculus
atgactgaagttcagcctgtgtggc

SEQ ID NO: 254752 - DNA, 25 bp, Mus musculus
atgactgaagttgagcctgtgtggc

SEQ ID NO: 254753 - DNA, 25 bp, Mus musculus
atgactgacaaaactactaactcgt

SEQ ID NO: 254754 - DNA, 25 bp, Mus musculus
atgactgacaaatctactaactcgt

SEQ ID NO: 254755 - DNA, 25 bp, Mus musculus
atgactgacctgaatgactacttac

SEQ ID NO: 254756 - DNA, 25 bp, Mus musculus
atgactgacctgtatgactacttac

SEQ ID NO: 254757 - DNA, 25 bp, Mus musculus
atgactgacggcacacacttgtaac

SEQ ID NO: 254758 - DNA, 25 bp, Mus musculus
atgactgacggctcacacttgtaac

SEQ ID NO: 254759 - DNA, 25 bp, Mus musculus
atgactgactccaggttcatctgaa

SEQ ID NO: 254760 - DNA, 25 bp, Mus musculus
atgactgactcctggttcatctgaa

SEQ ID NO: 254761 - DNA, 25 bp, Mus musculus
atgactgagcaaccagacatccctg

SEQ ID NO: 254762 - DNA, 25 bp, Mus musculus
atgactgagcaagcagacatccctg

SEQ ID NO: 254763 - DNA, 25 bp, Mus musculus
atgactgagcctacaagctgccaaa

SEQ ID NO: 254764 - DNA, 25 bp, Mus musculus
atgactgagccttcaagctgccaaa

SEQ ID NO: 254765 - DNA, 25 bp, Mus musculus
atgactgagggtcgcctactggtcc

SEQ ID NO: 254766 - DNA, 25 bp, Mus musculus
atgactgagggtggcctactggtcc

SEQ ID NO: 254767 - DNA, 25 bp, Mus musculus
atgactgagttcaagcgtggcctgc

SEQ ID NO: 254768 - DNA, 25 bp, Mus musculus
atgactgagttcatcgggaggcaaa

SEQ ID NO: 254769 - DNA, 25 bp, Mus musculus
atgactgagttctagcgtggcctgc

SEQ ID NO: 254770 - DNA, 25 bp, Mus musculus
atgactgagttcttcgggaggcaaa

SEQ ID NO: 254771 - DNA, 25 bp, Mus musculus
atgactgagtttccaactacgccta

SEQ ID NO: 254772 - DNA, 25 bp, Mus musculus
atgactgagtttgcaactacgccta

SEQ ID NO: 254773 - DNA, 25 bp, Mus musculus
atgactgatgtccaaggcccagcat

SEQ ID NO: 254774 - DNA, 25 bp, Mus musculus
atgactgatgtcgaaggcccagcat

SEQ ID NO: 254775 - DNA, 25 bp, Mus musculus
atgactgatgttaattggcatagca

SEQ ID NO: 254776 - DNA, 25 bp, Mus musculus
atgactgatgtttattggcatagca

SEQ ID NO: 254777 - DNA, 25 bp, Mus musculus
atgactgcaaatcacagcattcctg

SEQ ID NO: 254778 - DNA, 25 bp, Mus musculus
atgactgcaaatgacagcattcctg

SEQ ID NO: 254779 - DNA, 25 bp, Mus musculus
atgactgcaagcagttccttcctgt

SEQ ID NO: 254780 - DNA, 25 bp, Mus musculus
atgactgcaagctgttccttcctgt

SEQ ID NO: 254781 - DNA, 25 bp, Mus musculus
atgactgcaataattccttctcttt

SEQ ID NO: 254782 - DNA, 25 bp, Mus musculus
atgactgcaatatttccttctcttt

SEQ ID NO: 254783 - DNA, 25 bp, Mus musculus
atgactgcaatcctcctctgttgga

SEQ ID NO: 254784 - DNA, 25 bp, Mus musculus
atgactgcaatcgtcctctgttgga

SEQ ID NO: 254785 - DNA, 25 bp, Mus musculus
atgactgcacctacttttttactga

SEQ ID NO: 254786 - DNA, 25 bp, Mus musculus
atgactgcaccttcttttttactga

SEQ ID NO: 254787 - DNA, 25 bp, Mus musculus
atgactgcactcaggcggtttaggg

SEQ ID NO: 254788 - DNA, 25 bp, Mus musculus
atgactgcactctggcggtttaggg

SEQ ID NO: 254789 - DNA, 25 bp, Mus musculus
atgactgcagagacagctgctctgt

SEQ ID NO: 254790 - DNA, 25 bp, Mus musculus
atgactgcagagtcagctgctctgt

SEQ ID NO: 254791 - DNA, 25 bp, Mus musculus
atgactgcagtgcagcagtaattat

SEQ ID NO: 254792 - DNA, 25 bp, Mus musculus
atgactgcagtggagcagtaattat

SEQ ID NO: 254793 - DNA, 25 bp, Mus musculus
atgactgcagttctgtcagcggctc

SEQ ID NO: 254794 - DNA, 25 bp, Mus musculus
atgactgcagttgtgtcagcggctc

SEQ ID NO: 254795 - DNA, 25 bp, Mus musculus
atgactgccaggacatcacagctcg

SEQ ID NO: 254796 - DNA, 25 bp, Mus musculus
atgactgccaggtcatcacagctcg

SEQ ID NO: 254797 - DNA, 25 bp, Mus musculus
atgactgcccaaaccgtgtagtcca

SEQ ID NO: 254798 - DNA, 25 bp, Mus musculus
atgactgcccaatccgtgtagtcca

SEQ ID NO: 254799 - DNA, 25 bp, Mus musculus
atgactgcccctcaatggtccattt

SEQ ID NO: 254800 - DNA, 25 bp, Mus musculus
atgactgcccctgaatggtccattt

SEQ ID NO: 254801 - DNA, 25 bp, Mus musculus
atgactgccctacacttgggagtcc

SEQ ID NO: 254802 - DNA, 25 bp, Mus musculus
atgactgccctagacttgggagtcc

SEQ ID NO: 254803 - DNA, 25 bp, Mus musculus
atgactgccctcagagggacctggc

SEQ ID NO: 254804 - DNA, 25 bp, Mus musculus
atgactgccctctgagggacctggc

SEQ ID NO: 254805 - DNA, 25 bp, Mus musculus
atgactgccgtacttagtggaccct

SEQ ID NO: 254806 - DNA, 25 bp, Mus musculus
atgactgccgtagttagtggaccct

SEQ ID NO: 254807 - DNA, 25 bp, Mus musculus
atgactgcctaaacaccacctggac

SEQ ID NO: 254808 - DNA, 25 bp, Mus musculus
atgactgcctaatcaccacctggac

SEQ ID NO: 254809 - DNA, 25 bp, Mus musculus
atgactgcgatccaggttaccacat

SEQ ID NO: 254810 - DNA, 25 bp, Mus musculus
atgactgcgatcgaggttaccacat

SEQ ID NO: 254811 - DNA, 25 bp, Mus musculus
atgactgcgatgatgtgaaggcccc

SEQ ID NO: 254812 - DNA, 25 bp, Mus musculus
atgactgcgatgttgtgaaggcccc

SEQ ID NO: 254813 - DNA, 25 bp, Mus musculus
atgactgcgctgagagcaacttgca

SEQ ID NO: 254814 - DNA, 25 bp, Mus musculus
atgactgcgctgtgagcaacttgca

SEQ ID NO: 254815 - DNA, 25 bp, Mus musculus
atgactgcggtgcaggccccagcaa

SEQ ID NO: 254816 - DNA, 25 bp, Mus musculus
atgactgcggtggaggccccagcaa

SEQ ID NO: 254817 - DNA, 25 bp, Mus musculus
atgactgcgtgcaccctcttctgca

SEQ ID NO: 254818 - DNA, 25 bp, Mus musculus
atgactgcgtgctccctcttctgca

SEQ ID NO: 254819 - DNA, 25 bp, Mus musculus
atgactgctacacttcagccagagg

SEQ ID NO: 254820 - DNA, 25 bp, Mus musculus
atgactgctacagttcagccagagg

SEQ ID NO: 254821 - DNA, 25 bp, Mus musculus
atgactgctaccaggtcctttaaac

SEQ ID NO: 254822 - DNA, 25 bp, Mus musculus
atgactgctacctggtcctttaaac

SEQ ID NO: 254823 - DNA, 25 bp, Mus musculus
atgactgctgaacggcatccaggat

SEQ ID NO: 254824 - DNA, 25 bp, Mus musculus
atgactgctgaagggcatccaggat

SEQ ID NO: 254825 - DNA, 25 bp, Mus musculus
atgactgctggcagcgcgccgtaga

SEQ ID NO: 254826 - DNA, 25 bp, Mus musculus
atgactgctggctgcgcgccgtaga

SEQ ID NO: 254827 - DNA, 25 bp, Mus musculus
atgactgctgtaccagcatcacttg

SEQ ID NO: 254828 - DNA, 25 bp, Mus musculus
atgactgctgtagcagcatcacttg

SEQ ID NO: 254829 - DNA, 25 bp, Mus musculus
atgactgctgtgctgtcgagagcca

SEQ ID NO: 254830 - DNA, 25 bp, Mus musculus
atgactgctgtggtgtcgagagcca

SEQ ID NO: 254831 - DNA, 25 bp, Mus musculus
atgactgcttctctgctgggtgtag

SEQ ID NO: 254832 - DNA, 25 bp, Mus musculus
atgactgcttctgtgctgggtgtag

SEQ ID NO: 254833 - DNA, 25 bp, Mus musculus
atgactgcttttaattgaaaccaaa

SEQ ID NO: 254834 - DNA, 25 bp, Mus musculus
atgactgcttttcgtgcagtatggg

SEQ ID NO: 254835 - DNA, 25 bp, Mus musculus
atgactgcttttggtgcagtatggg

SEQ ID NO: 254836 - DNA, 25 bp, Mus musculus
atgactgctttttattgaaaccaaa

SEQ ID NO: 254837 - DNA, 25 bp, Mus musculus
atgactggaacgcagggacaccttt

SEQ ID NO: 254838 - DNA, 25 bp, Mus musculus
atgactggaacggagggacaccttt

SEQ ID NO: 254839 - DNA, 25 bp, Mus musculus
atgactggacatagttcttgcagaa

SEQ ID NO: 254840 - DNA, 25 bp, Mus musculus
atgactggacattgttcttgcagaa

SEQ ID NO: 254841 - DNA, 25 bp, Mus musculus
atgactggaccgccaagagtgtgaa

SEQ ID NO: 254842 - DNA, 25 bp, Mus musculus
atgactggaccggcaagagtgtgaa

SEQ ID NO: 254843 - DNA, 25 bp, Mus musculus
atgactggattgatgattgggaacc

SEQ ID NO: 254844 - DNA, 25 bp, Mus musculus
atgactggattgttgattgggaacc

SEQ ID NO: 254845 - DNA, 25 bp, Mus musculus
atgactggcgtgaacatgtctctga

SEQ ID NO: 254846 - DNA, 25 bp, Mus musculus
atgactggcgtgtacatgtctctga

SEQ ID NO: 254847 - DNA, 25 bp, Mus musculus
atgactggctctaggagttgtgcaa

SEQ ID NO: 254848 - DNA, 25 bp, Mus musculus
atgactggctcttggagttgtgcaa

SEQ ID NO: 254849 - DNA, 25 bp, Mus musculus
atgactggctgacgtggcttccttg

SEQ ID NO: 254850 - DNA, 25 bp, Mus musculus
atgactggctgaggtggcttccttg

SEQ ID NO: 254851 - DNA, 25 bp, Mus musculus
atgactgggagcatgcactgtagag

SEQ ID NO: 254852 - DNA, 25 bp, Mus musculus
atgactgggagcttgcactgtagag

SEQ ID NO: 254853 - DNA, 25 bp, Mus musculus
atgactgggcctcaaagccagcata

SEQ ID NO: 254854 - DNA, 25 bp, Mus musculus
atgactgggcctgaaagccagcata

SEQ ID NO: 254855 - DNA, 25 bp, Mus musculus
atgactgggttgactggcattttca

SEQ ID NO: 254856 - DNA, 25 bp, Mus musculus
atgactgggttgtctggcattttca

SEQ ID NO: 254857 - DNA, 25 bp, Mus musculus
atgactggtgtgatgcaatgccatt

SEQ ID NO: 254858 - DNA, 25 bp, Mus musculus
atgactggtgtgttgcaatgccatt

SEQ ID NO: 254859 - DNA, 25 bp, Mus musculus
atgactggttccctacagttgacac

SEQ ID NO: 254860 - DNA, 25 bp, Mus musculus
atgactggttccgtacagttgacac

SEQ ID NO: 254861 - DNA, 25 bp, Mus musculus
atgactgtaccaactccctgtttgt

SEQ ID NO: 254862 - DNA, 25 bp, Mus musculus
atgactgtaccacagagcatctgta

SEQ ID NO: 254863 - DNA, 25 bp, Mus musculus
atgactgtaccagagagcatctgta

SEQ ID NO: 254864 - DNA, 25 bp, Mus musculus
atgactgtaccatctccctgtttgt

SEQ ID NO: 254865 - DNA, 25 bp, Mus musculus
atgactgtattaagcacagcatcta

SEQ ID NO: 254866 - DNA, 25 bp, Mus musculus
atgactgtattatgcacagcatcta

SEQ ID NO: 254867 - DNA, 25 bp, Mus musculus
atgactgtcaacattgccttcagaa

SEQ ID NO: 254868 - DNA, 25 bp, Mus musculus
atgactgtcaactttgccttcagaa

SEQ ID NO: 254869 - DNA, 25 bp, Mus musculus
atgactgtcagcaatggagatcttt

SEQ ID NO: 254870 - DNA, 25 bp, Mus musculus
atgactgtcagctatggagatcttt

SEQ ID NO: 254871 - DNA, 25 bp, Mus musculus
atgactgtcagtcgtaacacaagcc

SEQ ID NO: 254872 - DNA, 25 bp, Mus musculus
atgactgtcagtggtaacacaagcc

SEQ ID NO: 254873 - DNA, 25 bp, Mus musculus
atgactgtcattcagcccattagtt

SEQ ID NO: 254874 - DNA, 25 bp, Mus musculus
atgactgtcattgagcccattagtt

SEQ ID NO: 254875 - DNA, 25 bp, Mus musculus
atgactgtcccgaaggaacctgtga

SEQ ID NO: 254876 - DNA, 25 bp, Mus musculus
atgactgtcccgtaggaacctgtga

SEQ ID NO: 254877 - DNA, 25 bp, Mus musculus
atgactgtccctccaacctggaatc

SEQ ID NO: 254878 - DNA, 25 bp, Mus musculus
atgactgtccctgcaacctggaatc

SEQ ID NO: 254879 - DNA, 25 bp, Mus musculus
atgactgtcgtcactacatccatat

SEQ ID NO: 254880 - DNA, 25 bp, Mus musculus
atgactgtcgtctctacatccatat

SEQ ID NO: 254881 - DNA, 25 bp, Mus musculus
atgactgtcttgcttcatcagtgaa

SEQ ID NO: 254882 - DNA, 25 bp, Mus musculus
atgactgtcttggttcatcagtgaa

SEQ ID NO: 254883 - DNA, 25 bp, Mus musculus
atgactgtgattcactgccctttca

SEQ ID NO: 254884 - DNA, 25 bp, Mus musculus
atgactgtgattgactgccctttca

SEQ ID NO: 254885 - DNA, 25 bp, Mus musculus
atgactgtgccacaccatgcgaatg

SEQ ID NO: 254886 - DNA, 25 bp, Mus musculus
atgactgtgccagaccatgcgaatg

SEQ ID NO: 254887 - DNA, 25 bp, Mus musculus
atgactgtggatagcgtgtccttga

SEQ ID NO: 254888 - DNA, 25 bp, Mus musculus
atgactgtggattgcgtgtccttga

SEQ ID NO: 254889 - DNA, 25 bp, Mus musculus
atgactgtggctagggttcttgtta

SEQ ID NO: 254890 - DNA, 25 bp, Mus musculus
atgactgtggcttgggttcttgtta

SEQ ID NO: 254891 - DNA, 25 bp, Mus musculus
atgactgttatcatcttcatcgtta

SEQ ID NO: 254892 - DNA, 25 bp, Mus musculus
atgactgttatcttcttcatcgtta

SEQ ID NO: 254893 - DNA, 25 bp, Mus musculus
atgactgttccacggctgtcaggat

SEQ ID NO: 254894 - DNA, 25 bp, Mus musculus
atgactgttccagggctgtcaggat

SEQ ID NO: 254895 - DNA, 25 bp, Mus musculus
atgactgttctgatcatctctgaac

SEQ ID NO: 254896 - DNA, 25 bp, Mus musculus
atgactgttctgttcatctctgaac

SEQ ID NO: 254897 - DNA, 25 bp, Mus musculus
atgactgttgtcagcctcttttcac

SEQ ID NO: 254898 - DNA, 25 bp, Mus musculus
atgactgttgtctgcctcttttcac

SEQ ID NO: 254899 - DNA, 25 bp, Mus musculus
atgactgtttgaaagcgttgtttaa

SEQ ID NO: 254900 - DNA, 25 bp, Mus musculus
atgactgtttgatagcgttgtttaa

SEQ ID NO: 254901 - DNA, 25 bp, Mus musculus
atgactgttttcaccttggactccg

SEQ ID NO: 254902 - DNA, 25 bp, Mus musculus
atgactgttttctccttggactccg

SEQ ID NO: 254903 - DNA, 25 bp, Mus musculus
atgacttaacctacatcgcacagaa

SEQ ID NO: 254904 - DNA, 25 bp, Mus musculus
atgacttaaccttcatcgcacagaa

SEQ ID NO: 254905 - DNA, 25 bp, Mus musculus
atgacttacaggacttgaaatttca

SEQ ID NO: 254906 - DNA, 25 bp, Mus musculus
atgacttacaggtcttgaaatttca

SEQ ID NO: 254907 - DNA, 25 bp, Mus musculus
atgacttacctactggagcctttat

SEQ ID NO: 254908 - DNA, 25 bp, Mus musculus
atgacttacctagtggagcctttat

SEQ ID NO: 254909 - DNA, 25 bp, Mus musculus
atgacttaccttaaacaatcgaaat

SEQ ID NO: 254910 - DNA, 25 bp, Mus musculus
atgacttacctttaacaatcgaaat

SEQ ID NO: 254911 - DNA, 25 bp, Mus musculus
atgacttactaacatctaccacagt

SEQ ID NO: 254912 - DNA, 25 bp, Mus musculus
atgacttactaagatctaccacagt

SEQ ID NO: 254913 - DNA, 25 bp, Mus musculus
atgacttactgactcgctgtgcagg

SEQ ID NO: 254914 - DNA, 25 bp, Mus musculus
atgacttactgagtcgctgtgcagg

SEQ ID NO: 254915 - DNA, 25 bp, Mus musculus
atgacttactggattgtacatctga

SEQ ID NO: 254916 - DNA, 25 bp, Mus musculus
atgacttactggtttgtacatctga

SEQ ID NO: 254917 - DNA, 25 bp, Mus musculus
atgacttatgtacaacaccaagcac

SEQ ID NO: 254918 - DNA, 25 bp, Mus musculus
atgacttatgtagaacaccaagcac

SEQ ID NO: 254919 - DNA, 25 bp, Mus musculus
atgacttatgtcagtgctcacacct

SEQ ID NO: 254920 - DNA, 25 bp, Mus musculus
atgacttatgtctgtgctcacacct

SEQ ID NO: 254921 - DNA, 25 bp, Mus musculus
atgacttcaactcgcacaggaagca

SEQ ID NO: 254922 - DNA, 25 bp, Mus musculus
atgacttcaactggcacaggaagca

SEQ ID NO: 254923 - DNA, 25 bp, Mus musculus
atgacttcaagaactcaggcatgaa

SEQ ID NO: 254924 - DNA, 25 bp, Mus musculus
atgacttcaagactggtgtccacgt

SEQ ID NO: 254925 - DNA, 25 bp, Mus musculus
atgacttcaagagtggtgtccacgt

SEQ ID NO: 254926 - DNA, 25 bp, Mus musculus
atgacttcaagatctcaggcatgaa

SEQ ID NO: 254927 - DNA, 25 bp, Mus musculus
atgacttcactaagcatctgtgtaa

SEQ ID NO: 254928 - DNA, 25 bp, Mus musculus
atgacttcactatgcatctgtgtaa

SEQ ID NO: 254929 - DNA, 25 bp, Mus musculus
atgacttcacttcaagctggaagca

SEQ ID NO: 254930 - DNA, 25 bp, Mus musculus
atgacttcacttgaagctggaagca

SEQ ID NO: 254931 - DNA, 25 bp, Mus musculus
atgacttcattaactttccttgcct

SEQ ID NO: 254932 - DNA, 25 bp, Mus musculus
atgacttcattatctttccttgcct

SEQ ID NO: 254933 - DNA, 25 bp, Mus musculus
atgacttccaagatgtttctcagta

SEQ ID NO: 254934 - DNA, 25 bp, Mus musculus
atgacttccaagttgtttctcagta

SEQ ID NO: 254935 - DNA, 25 bp, Mus musculus
atgacttccactcataatcatgcta

SEQ ID NO: 254936 - DNA, 25 bp, Mus musculus
atgacttccactgataatcatgcta

SEQ ID NO: 254937 - DNA, 25 bp, Mus musculus
atgacttcccaccacaaggactgta

SEQ ID NO: 254938 - DNA, 25 bp, Mus musculus
atgacttcccacgacaaggactgta

SEQ ID NO: 254939 - DNA, 25 bp, Mus musculus
atgacttcccgacttaccggagtgt

SEQ ID NO: 254940 - DNA, 25 bp, Mus musculus
atgacttcccgagttaccggagtgt

SEQ ID NO: 254941 - DNA, 25 bp, Mus musculus
atgacttccctaccccaaggtagtt

SEQ ID NO: 254942 - DNA, 25 bp, Mus musculus
atgacttccctacttgaaatatttt

SEQ ID NO: 254943 - DNA, 25 bp, Mus musculus
atgacttccctagcccaaggtagtt

SEQ ID NO: 254944 - DNA, 25 bp, Mus musculus
atgacttccctagttgaaatatttt

SEQ ID NO: 254945 - DNA, 25 bp, Mus musculus
atgacttccggtcgccacaggacga

SEQ ID NO: 254946 - DNA, 25 bp, Mus musculus
atgacttccggtggccacaggacga

SEQ ID NO: 254947 - DNA, 25 bp, Mus musculus
atgacttcctctactcttatgatat

SEQ ID NO: 254948 - DNA, 25 bp, Mus musculus
atgacttcctctcggccctttcatg

SEQ ID NO: 254949 - DNA, 25 bp, Mus musculus
atgacttcctctgggccctttcatg

SEQ ID NO: 254950 - DNA, 25 bp, Mus musculus
atgacttcctcttctcttatgatat

SEQ ID NO: 254951 - DNA, 25 bp, Mus musculus
atgacttccttgctgcctacaagct

SEQ ID NO: 254952 - DNA, 25 bp, Mus musculus
atgacttccttggtgcctacaagct

SEQ ID NO: 254953 - DNA, 25 bp, Mus musculus
atgacttctacacggccactgagag

SEQ ID NO: 254954 - DNA, 25 bp, Mus musculus
atgacttctacagggccactgagag

SEQ ID NO: 254955 - DNA, 25 bp, Mus musculus
atgacttctactacctgggcaatcc

SEQ ID NO: 254956 - DNA, 25 bp, Mus musculus
atgacttctacttcctgggcaatcc

SEQ ID NO: 254957 - DNA, 25 bp, Mus musculus
atgacttctcaacccctgctcatta

SEQ ID NO: 254958 - DNA, 25 bp, Mus musculus
atgacttctcaagccctgctcatta

SEQ ID NO: 254959 - DNA, 25 bp, Mus musculus
atgacttctccaagacatcacatct

SEQ ID NO: 254960 - DNA, 25 bp, Mus musculus
atgacttctccatgacatcacatct

SEQ ID NO: 254961 - DNA, 25 bp, Mus musculus
atgacttctccccatggcaagaagg

SEQ ID NO: 254962 - DNA, 25 bp, Mus musculus
atgacttctcccgatggcaagaagg

SEQ ID NO: 254963 - DNA, 25 bp, Mus musculus
atgacttctcctcggatctggaaaa

SEQ ID NO: 254964 - DNA, 25 bp, Mus musculus
atgacttctcctgggatctggaaaa

SEQ ID NO: 254965 - DNA, 25 bp, Mus musculus
atgacttctctaaccagttacgtgc

SEQ ID NO: 254966 - DNA, 25 bp, Mus musculus
atgacttctctatccagttacgtgc

SEQ ID NO: 254967 - DNA, 25 bp, Mus musculus
atgacttctctcacttacacgtgag

SEQ ID NO: 254968 - DNA, 25 bp, Mus musculus
atgacttctctctcttacacgtgag

SEQ ID NO: 254969 - DNA, 25 bp, Mus musculus
atgacttctctgatcatgtgagctt

SEQ ID NO: 254970 - DNA, 25 bp, Mus musculus
atgacttctctgttcatgtgagctt

SEQ ID NO: 254971 - DNA, 25 bp, Mus musculus
atgacttctggcagctgaaggagct

SEQ ID NO: 254972 - DNA, 25 bp, Mus musculus
atgacttctggctgctgaaggagct

SEQ ID NO: 254973 - DNA, 25 bp, Mus musculus
atgacttcttccaagaggacaacaa

SEQ ID NO: 254974 - DNA, 25 bp, Mus musculus
atgacttcttcctagaggacaacaa

SEQ ID NO: 254975 - DNA, 25 bp, Mus musculus
atgacttctttcaaatggatggatt

SEQ ID NO: 254976 - DNA, 25 bp, Mus musculus
atgacttctttctaatggatggatt

SEQ ID NO: 254977 - DNA, 25 bp, Mus musculus
atgacttgagacaattctgcagcta

SEQ ID NO: 254978 - DNA, 25 bp, Mus musculus
atgacttgagactattctgcagcta

SEQ ID NO: 254979 - DNA, 25 bp, Mus musculus
atgacttgagtaacacattgtccca

SEQ ID NO: 254980 - DNA, 25 bp, Mus musculus
atgacttgagtatcacattgtccca

SEQ ID NO: 254981 - DNA, 25 bp, Mus musculus
atgacttgatatctgaatttcctga

SEQ ID NO: 254982 - DNA, 25 bp, Mus musculus
atgacttgatatgtgaatttcctga

SEQ ID NO: 254983 - DNA, 25 bp, Mus musculus
atgacttgcaacagtccagaactcc

SEQ ID NO: 254984 - DNA, 25 bp, Mus musculus
atgacttgcaactgtccagaactcc

SEQ ID NO: 254985 - DNA, 25 bp, Mus musculus
atgacttgcacaacctgctttctca

SEQ ID NO: 254986 - DNA, 25 bp, Mus musculus
atgacttgcacatcctgctttctca

SEQ ID NO: 254987 - DNA, 25 bp, Mus musculus
atgacttgcctgaccatggagagta

SEQ ID NO: 254988 - DNA, 25 bp, Mus musculus
atgacttgcctgtccatggagagta

SEQ ID NO: 254989 - DNA, 25 bp, Mus musculus
atgacttgctggactccctagttaa

SEQ ID NO: 254990 - DNA, 25 bp, Mus musculus
atgacttgctggtctccctagttaa

SEQ ID NO: 254991 - DNA, 25 bp, Mus musculus
atgacttggatgaggattccttcat

SEQ ID NO: 254992 - DNA, 25 bp, Mus musculus
atgacttggatgtggattccttcat

SEQ ID NO: 254993 - DNA, 25 bp, Mus musculus
atgacttgggtaaatctttgagaaa

SEQ ID NO: 254994 - DNA, 25 bp, Mus musculus
atgacttgggtatatctttgagaaa

SEQ ID NO: 254995 - DNA, 25 bp, Mus musculus
atgacttgtctgatatttccagcta

SEQ ID NO: 254996 - DNA, 25 bp, Mus musculus
atgacttgtctgttatttccagcta

SEQ ID NO: 254997 - DNA, 25 bp, Mus musculus
atgacttgtgacacctggtgcatac

SEQ ID NO: 254998 - DNA, 25 bp, Mus musculus
atgacttgtgactcctggtgcatac

SEQ ID NO: 254999 - DNA, 25 bp, Mus musculus
atgacttgtgctatgcagtccagtc

SEQ ID NO: 255000 - DNA, 25 bp, Mus musculus
atgacttgtgctttgcagtccagtc

SEQ ID NO: 255001 - DNA, 25 bp, Mus musculus
atgactttagctagcaggctaccaa

SEQ ID NO: 255002 - DNA, 25 bp, Mus musculus
atgactttagcttgcaggctaccaa

SEQ ID NO: 255003 - DNA, 25 bp, Mus musculus
atgactttagggacatgcagcaggg

SEQ ID NO: 255004 - DNA, 25 bp, Mus musculus
atgactttagggtcatgcagcaggg

SEQ ID NO: 255005 - DNA, 25 bp, Mus musculus
atgactttatgtatacccacacacc

SEQ ID NO: 255006 - DNA, 25 bp, Mus musculus
atgactttatgtttacccacacacc

SEQ ID NO: 255007 - DNA, 25 bp, Mus musculus
atgactttcaacaaatcggcgtaga

SEQ ID NO: 255008 - DNA, 25 bp, Mus musculus
atgactttcaactaatcggcgtaga

SEQ ID NO: 255009 - DNA, 25 bp, Mus musculus
atgactttcaatacactgacactca

SEQ ID NO: 255010 - DNA, 25 bp, Mus musculus
atgactttcaattcactgacactca

SEQ ID NO: 255011 - DNA, 25 bp, Mus musculus
atgactttcatccatgtgctgtagg

SEQ ID NO: 255012 - DNA, 25 bp, Mus musculus
atgactttcatcgatgtgctgtagg

SEQ ID NO: 255013 - DNA, 25 bp, Mus musculus
atgactttccttatatttccttcct

SEQ ID NO: 255014 - DNA, 25 bp, Mus musculus
atgactttccttttatttccttcct

SEQ ID NO: 255015 - DNA, 25 bp, Mus musculus
atgactttcgccctctgttgctatt

SEQ ID NO: 255016 - DNA, 25 bp, Mus musculus
atgactttcgccgtctgttgctatt

SEQ ID NO: 255017 - DNA, 25 bp, Mus musculus
atgactttctagcacttctgtcgct

SEQ ID NO: 255018 - DNA, 25 bp, Mus musculus
atgactttctaggacttctgtcgct

SEQ ID NO: 255019 - DNA, 25 bp, Mus musculus
atgactttctctatcccttattcat

SEQ ID NO: 255020 - DNA, 25 bp, Mus musculus
atgactttctctttcccttattcat

SEQ ID NO: 255021 - DNA, 25 bp, Mus musculus
atgactttctgcatctcgttggttc

SEQ ID NO: 255022 - DNA, 25 bp, Mus musculus
atgactttctgcttctcgttggttc

SEQ ID NO: 255023 - DNA, 25 bp, Mus musculus
atgactttgaacaacttgaccaggc

SEQ ID NO: 255024 - DNA, 25 bp, Mus musculus
atgactttgaactacttgaccaggc

SEQ ID NO: 255025 - DNA, 25 bp, Mus musculus
atgactttgaagcttttcgtaccag

SEQ ID NO: 255026 - DNA, 25 bp, Mus musculus
atgactttgaaggttttcgtaccag

SEQ ID NO: 255027 - DNA, 25 bp, Mus musculus
atgactttgacgacgcaagcgtgaa

SEQ ID NO: 255028 - DNA, 25 bp, Mus musculus
atgactttgacgtcgcaagcgtgaa

SEQ ID NO: 255029 - DNA, 25 bp, Mus musculus
atgactttgagccactgaggcctgg

SEQ ID NO: 255030 - DNA, 25 bp, Mus musculus
atgactttgagcgactgaggcctgg

SEQ ID NO: 255031 - DNA, 25 bp, Mus musculus
atgactttgaggagggatcccagaa

SEQ ID NO: 255032 - DNA, 25 bp, Mus musculus
atgactttgaggtgggatcccagaa

SEQ ID NO: 255033 - DNA, 25 bp, Mus musculus
atgactttgcctactgcgcgaaaga

SEQ ID NO: 255034 - DNA, 25 bp, Mus musculus
atgactttgccttctgcgcgaaaga

SEQ ID NO: 255035 - DNA, 25 bp, Mus musculus
atgactttggaaacctacagcttgg

SEQ ID NO: 255036 - DNA, 25 bp, Mus musculus
atgactttggaatcctacagcttgg

SEQ ID NO: 255037 - DNA, 25 bp, Mus musculus
atgactttggataatggaattacag

SEQ ID NO: 255038 - DNA, 25 bp, Mus musculus
atgactttggattatggaattacag

SEQ ID NO: 255039 - DNA, 25 bp, Mus musculus
atgactttggccaccaattcccagt

SEQ ID NO: 255040 - DNA, 25 bp, Mus musculus
atgactttggcctccaattcccagt

SEQ ID NO: 255041 - DNA, 25 bp, Mus musculus
atgactttgttgagagtccgatggc

SEQ ID NO: 255042 - DNA, 25 bp, Mus musculus
atgactttgttgtgagtccgatggc

SEQ ID NO: 255043 - DNA, 25 bp, Mus musculus
atgacttttctcatactatgtcccc

SEQ ID NO: 255044 - DNA, 25 bp, Mus musculus
atgacttttctcttactatgtcccc

SEQ ID NO: 255045 - DNA, 25 bp, Mus musculus
atgacttttggacgtgccagcacca

SEQ ID NO: 255046 - DNA, 25 bp, Mus musculus
atgacttttggaggtgccagcacca

SEQ ID NO: 255047 - DNA, 25 bp, Mus musculus
atgactttttacagtgaggtgctgt

SEQ ID NO: 255048 - DNA, 25 bp, Mus musculus
atgactttttactgtgaggtgctgt

SEQ ID NO: 255049 - DNA, 25 bp, Mus musculus
atgactttttgtcggcaggccctgg

SEQ ID NO: 255050 - DNA, 25 bp, Mus musculus
atgactttttgtgggcaggccctgg

SEQ ID NO: 255051 - DNA, 25 bp, Mus musculus
atgagaaaaagacccgtcccttcca

SEQ ID NO: 255052 - DNA, 25 bp, Mus musculus
atgagaaaaagagccgtcccttcca

SEQ ID NO: 255053 - DNA, 25 bp, Mus musculus
atgagaaaaccaccattttcccttt

SEQ ID NO: 255054 - DNA, 25 bp, Mus musculus
atgagaaaaccagcattttcccttt

SEQ ID NO: 255055 - DNA, 25 bp, Mus musculus
atgagaaaattaaggcgcttagtta

SEQ ID NO: 255056 - DNA, 25 bp, Mus musculus
atgagaaaattatggcgcttagtta

SEQ ID NO: 255057 - DNA, 25 bp, Mus musculus
atgagaaaccaacggcaaaggacca

SEQ ID NO: 255058 - DNA, 25 bp, Mus musculus
atgagaaaccaagggcaaaggacca

SEQ ID NO: 255059 - DNA, 25 bp, Mus musculus
atgagaaaccagatggacctgtgga

SEQ ID NO: 255060 - DNA, 25 bp, Mus musculus
atgagaaaccagttggacctgtgga

SEQ ID NO: 255061 - DNA, 25 bp, Mus musculus
atgagaaaccctcagcatgctccag

SEQ ID NO: 255062 - DNA, 25 bp, Mus musculus
atgagaaaccctgagcatgctccag

SEQ ID NO: 255063 - DNA, 25 bp, Mus musculus
atgagaaacctgctgtgtccaaccc

SEQ ID NO: 255064 - DNA, 25 bp, Mus musculus
atgagaaacctggtgtgtccaaccc

SEQ ID NO: 255065 - DNA, 25 bp, Mus musculus
atgagaaagatgaccctccgtgctt

SEQ ID NO: 255066 - DNA, 25 bp, Mus musculus
atgagaaagatgtccctccgtgctt

SEQ ID NO: 255067 - DNA, 25 bp, Mus musculus
atgagaaagcccaagtactccgctt

SEQ ID NO: 255068 - DNA, 25 bp, Mus musculus
atgagaaagccctagtactccgctt

SEQ ID NO: 255069 - DNA, 25 bp, Mus musculus
atgagaaaggtgatgttccctgtaa

SEQ ID NO: 255070 - DNA, 25 bp, Mus musculus
atgagaaaggtgttgttccctgtaa

SEQ ID NO: 255071 - DNA, 25 bp, Mus musculus
atgagaaagtgtacacctctgctct

SEQ ID NO: 255072 - DNA, 25 bp, Mus musculus
atgagaaagtgttcacctctgctct

SEQ ID NO: 255073 - DNA, 25 bp, Mus musculus
atgagaaagttaagcccatcggcgc

SEQ ID NO: 255074 - DNA, 25 bp, Mus musculus
atgagaaagttatgcccatcggcgc

SEQ ID NO: 255075 - DNA, 25 bp, Mus musculus
atgagaacaatcctgtgtgtgctgt

SEQ ID NO: 255076 - DNA, 25 bp, Mus musculus
atgagaacaatcgtgtgtgtgctgt

SEQ ID NO: 255077 - DNA, 25 bp, Mus musculus
atgagaacactgaggctgaattgca

SEQ ID NO: 255078 - DNA, 25 bp, Mus musculus
atgagaacactgtggctgaattgca

SEQ ID NO: 255079 - DNA, 25 bp, Mus musculus
atgagaacagagaggccaagccccg

SEQ ID NO: 255080 - DNA, 25 bp, Mus musculus
atgagaacagagatctttccttttt

SEQ ID NO: 255081 - DNA, 25 bp, Mus musculus
atgagaacagagtggccaagccccg

SEQ ID NO: 255082 - DNA, 25 bp, Mus musculus
atgagaacagagttctttccttttt

SEQ ID NO: 255083 - DNA, 25 bp, Mus musculus
atgagaaccctgagctgttccagct

SEQ ID NO: 255084 - DNA, 25 bp, Mus musculus
atgagaaccctgtgctgttccagct

SEQ ID NO: 255085 - DNA, 25 bp, Mus musculus
atgagaaccggccagccccagagga

SEQ ID NO: 255086 - DNA, 25 bp, Mus musculus
atgagaaccggcgagccccagagga

SEQ ID NO: 255087 - DNA, 25 bp, Mus musculus
atgagaacctgtctttgggcatgtt

SEQ ID NO: 255088 - DNA, 25 bp, Mus musculus
atgagaacctgtgtttgggcatgtt

SEQ ID NO: 255089 - DNA, 25 bp, Mus musculus
atgagaacgaccaggcactgcttaa

SEQ ID NO: 255090 - DNA, 25 bp, Mus musculus
atgagaacgacctggcactgcttaa

SEQ ID NO: 255091 - DNA, 25 bp, Mus musculus
atgagaacgtccagtagtcacggct

SEQ ID NO: 255092 - DNA, 25 bp, Mus musculus
atgagaacgtcctgtagtcacggct

SEQ ID NO: 255093 - DNA, 25 bp, Mus musculus
atgagaactaccagaacggccctgg

SEQ ID NO: 255094 - DNA, 25 bp, Mus musculus
atgagaactacctgaacggccctgg

SEQ ID NO: 255095 - DNA, 25 bp, Mus musculus
atgagaactacgagactcccattga

SEQ ID NO: 255096 - DNA, 25 bp, Mus musculus
atgagaactacgtgactcccattga

SEQ ID NO: 255097 - DNA, 25 bp, Mus musculus
atgagaactccaagccttcctatga

SEQ ID NO: 255098 - DNA, 25 bp, Mus musculus
atgagaactccatgccttcctatga

SEQ ID NO: 255099 - DNA, 25 bp, Mus musculus
atgagaactcgcctctgattggacg

SEQ ID NO: 255100 - DNA, 25 bp, Mus musculus
atgagaactcgcgtctgattggacg

SEQ ID NO: 255101 - DNA, 25 bp, Mus musculus
atgagaactctaacaacctcacggg

SEQ ID NO: 255102 - DNA, 25 bp, Mus musculus
atgagaactctatcaacctcacggg

SEQ ID NO: 255103 - DNA, 25 bp, Mus musculus
atgagaactgtaccaaaccctactt

SEQ ID NO: 255104 - DNA, 25 bp, Mus musculus
atgagaactgtagcaaaccctactt

SEQ ID NO: 255105 - DNA, 25 bp, Mus musculus
atgagaactgtgaaactagatgctt

SEQ ID NO: 255106 - DNA, 25 bp, Mus musculus
atgagaactgtgtaactagatgctt

SEQ ID NO: 255107 - DNA, 25 bp, Mus musculus
atgagaactgttcgacgacaccttt

SEQ ID NO: 255108 - DNA, 25 bp, Mus musculus
atgagaactgttggacgacaccttt

SEQ ID NO: 255109 - DNA, 25 bp, Mus musculus
atgagaagaattccaccctctgtga

SEQ ID NO: 255110 - DNA, 25 bp, Mus musculus
atgagaagaattgcaccctctgtga

SEQ ID NO: 255111 - DNA, 25 bp, Mus musculus
atgagaagacccacaccagggtgat

SEQ ID NO: 255112 - DNA, 25 bp, Mus musculus
atgagaagaccctcaccagggtgat

SEQ ID NO: 255113 - DNA, 25 bp, Mus musculus
atgagaagaggcagactttcacgtc

SEQ ID NO: 255114 - DNA, 25 bp, Mus musculus
atgagaagaggctgactttcacgtc

SEQ ID NO: 255115 - DNA, 25 bp, Mus musculus
atgagaagatagaccaggctctgtc

SEQ ID NO: 255116 - DNA, 25 bp, Mus musculus
atgagaagatagtccaggctctgtc

SEQ ID NO: 255117 - DNA, 25 bp, Mus musculus
atgagaagcacaagacctgtcactg

SEQ ID NO: 255118 - DNA, 25 bp, Mus musculus
atgagaagcacatgacctgtcactg

SEQ ID NO: 255119 - DNA, 25 bp, Mus musculus
atgagaagcacccagatccagcagc

SEQ ID NO: 255120 - DNA, 25 bp, Mus musculus
atgagaagcaccgagatccagcagc

SEQ ID NO: 255121 - DNA, 25 bp, Mus musculus
atgagaagccaacttgctgccgctg

SEQ ID NO: 255122 - DNA, 25 bp, Mus musculus
atgagaagccaagttgctgccgctg

SEQ ID NO: 255123 - DNA, 25 bp, Mus musculus
atgagaagccgtacacagggtttga

SEQ ID NO: 255124 - DNA, 25 bp, Mus musculus
atgagaagccgttcacagggtttga

SEQ ID NO: 255125 - DNA, 25 bp, Mus musculus
atgagaagctgaaggccaaggcacg

SEQ ID NO: 255126 - DNA, 25 bp, Mus musculus
atgagaagctgatggccaaggcacg

SEQ ID NO: 255127 - DNA, 25 bp, Mus musculus
atgagaaggataatgctgcctacag

SEQ ID NO: 255128 - DNA, 25 bp, Mus musculus
atgagaaggatattgctgcctacag

SEQ ID NO: 255129 - DNA, 25 bp, Mus musculus
atgagaaggcctatcatacgccaat

SEQ ID NO: 255130 - DNA, 25 bp, Mus musculus
atgagaaggcctttcatacgccaat

SEQ ID NO: 255131 - DNA, 25 bp, Mus musculus
atgagaaggcgtatttatttttcac

SEQ ID NO: 255132 - DNA, 25 bp, Mus musculus
atgagaaggcgtttttatttttcac

SEQ ID NO: 255133 - DNA, 25 bp, Mus musculus
atgagaaggctcaacatcatataga

SEQ ID NO: 255134 - DNA, 25 bp, Mus musculus
atgagaaggctctacatcatataga

SEQ ID NO: 255135 - DNA, 25 bp, Mus musculus
atgagaaggttgacagctaggccag

SEQ ID NO: 255136 - DNA, 25 bp, Mus musculus
atgagaaggttgtcagctaggccag

SEQ ID NO: 255137 - DNA, 25 bp, Mus musculus
atgagaagttccagatgctctctcc

SEQ ID NO: 255138 - DNA, 25 bp, Mus musculus
atgagaagttcctgatgctctctcc

SEQ ID NO: 255139 - DNA, 25 bp, Mus musculus
atgagaagttttccctccggtggat

SEQ ID NO: 255140 - DNA, 25 bp, Mus musculus
atgagaagttttgcctccggtggat

SEQ ID NO: 255141 - DNA, 25 bp, Mus musculus
atgagaatatacattgttcactgcc

SEQ ID NO: 255142 - DNA, 25 bp, Mus musculus
atgagaatatactttgttcactgcc

SEQ ID NO: 255143 - DNA, 25 bp, Mus musculus
atgagaatatcacaatagcagcaac

SEQ ID NO: 255144 - DNA, 25 bp, Mus musculus
atgagaatatcagaatagcagcaac

SEQ ID NO: 255145 - DNA, 25 bp, Mus musculus
atgagaatcaccagacaatccctgc

SEQ ID NO: 255146 - DNA, 25 bp, Mus musculus
atgagaatcacctgacaatccctgc

SEQ ID NO: 255147 - DNA, 25 bp, Mus musculus
atgagaatcgagctggcccatgcca

SEQ ID NO: 255148 - DNA, 25 bp, Mus musculus
atgagaatcgaggtggcccatgcca

SEQ ID NO: 255149 - DNA, 25 bp, Mus musculus
atgagaatgcttacgggaggttcat

SEQ ID NO: 255150 - DNA, 25 bp, Mus musculus
atgagaatgctttcgggaggttcat

SEQ ID NO: 255151 - DNA, 25 bp, Mus musculus
atgagaatgtctccccaggaattcc

SEQ ID NO: 255152 - DNA, 25 bp, Mus musculus
atgagaatgtctgcccaggaattcc

SEQ ID NO: 255153 - DNA, 25 bp, Mus musculus
atgagaatgtgtcggtatagaccac

SEQ ID NO: 255154 - DNA, 25 bp, Mus musculus
atgagaatgtgtgggtatagaccac

SEQ ID NO: 255155 - DNA, 25 bp, Mus musculus
atgagaatgttgagcccatgtccgt

SEQ ID NO: 255156 - DNA, 25 bp, Mus musculus
atgagaatgttgtgcccatgtccgt

SEQ ID NO: 255157 - DNA, 25 bp, Mus musculus
atgagacaaactactcagcgtaaag

SEQ ID NO: 255158 - DNA, 25 bp, Mus musculus
atgagacaaacttctcagcgtaaag

SEQ ID NO: 255159 - DNA, 25 bp, Mus musculus
atgagacaacaacgatgacgacgat

SEQ ID NO: 255160 - DNA, 25 bp, Mus musculus
atgagacaacaaggatgacgacgat

SEQ ID NO: 255161 - DNA, 25 bp, Mus musculus
atgagacaagcccacaccagatctg

SEQ ID NO: 255162 - DNA, 25 bp, Mus musculus
atgagacaagccgacaccagatctg

SEQ ID NO: 255163 - DNA, 25 bp, Mus musculus
atgagacaagctcacccaggttgtg

SEQ ID NO: 255164 - DNA, 25 bp, Mus musculus
atgagacaagctgacccaggttgtg

SEQ ID NO: 255165 - DNA, 25 bp, Mus musculus
atgagacacagtaagcccagacggg

SEQ ID NO: 255166 - DNA, 25 bp, Mus musculus
atgagacacagttagcccagacggg

SEQ ID NO: 255167 - DNA, 25 bp, Mus musculus
atgagacacctcctcaaacacaggt

SEQ ID NO: 255168 - DNA, 25 bp, Mus musculus
atgagacacctcgtcaaacacaggt

SEQ ID NO: 255169 - DNA, 25 bp, Mus musculus
atgagacactgcaggcctacacgga

SEQ ID NO: 255170 - DNA, 25 bp, Mus musculus
atgagacactgctggcctacacgga

SEQ ID NO: 255171 - DNA, 25 bp, Mus musculus
atgagacacttaattttactatttc

SEQ ID NO: 255172 - DNA, 25 bp, Mus musculus
atgagacacttatttttactatttc

SEQ ID NO: 255173 - DNA, 25 bp, Mus musculus
atgagacagtggagccagtctggct

SEQ ID NO: 255174 - DNA, 25 bp, Mus musculus
atgagacagtggtgccagtctggct

SEQ ID NO: 255175 - DNA, 25 bp, Mus musculus
atgagacagtgtcatcaaccttttc

SEQ ID NO: 255176 - DNA, 25 bp, Mus musculus
atgagacagtgtgatcaaccttttc

SEQ ID NO: 255177 - DNA, 25 bp, Mus musculus
atgagacataccatgcttgcttcca

SEQ ID NO: 255178 - DNA, 25 bp, Mus musculus
atgagacataccttgcttgcttcca

SEQ ID NO: 255179 - DNA, 25 bp, Mus musculus
atgagacatcataacaaatcttgta

SEQ ID NO: 255180 - DNA, 25 bp, Mus musculus
atgagacatcattacaaatcttgta

SEQ ID NO: 255181 - DNA, 25 bp, Mus musculus
atgagacattcccttgactgctaca

SEQ ID NO: 255182 - DNA, 25 bp, Mus musculus
atgagacattccgttgactgctaca

SEQ ID NO: 255183 - DNA, 25 bp, Mus musculus
atgagacatttcagcttagattttt

SEQ ID NO: 255184 - DNA, 25 bp, Mus musculus
atgagacatttctgcttagattttt

SEQ ID NO: 255185 - DNA, 25 bp, Mus musculus
atgagaccaagacggcactgctgag

SEQ ID NO: 255186 - DNA, 25 bp, Mus musculus
atgagaccaagagggcactgctgag

SEQ ID NO: 255187 - DNA, 25 bp, Mus musculus
atgagaccacacaattatcctatgt

SEQ ID NO: 255188 - DNA, 25 bp, Mus musculus
atgagaccacactattatcctatgt

SEQ ID NO: 255189 - DNA, 25 bp, Mus musculus
atgagaccaccaagtaggctgtccc

SEQ ID NO: 255190 - DNA, 25 bp, Mus musculus
atgagaccaccatgtaggctgtccc

SEQ ID NO: 255191 - DNA, 25 bp, Mus musculus
atgagaccagctccatgtgagggac

SEQ ID NO: 255192 - DNA, 25 bp, Mus musculus
atgagaccagctgcatgtgagggac

SEQ ID NO: 255193 - DNA, 25 bp, Mus musculus
atgagaccaggaacttccgagtact

SEQ ID NO: 255194 - DNA, 25 bp, Mus musculus
atgagaccaggaagtccctcctctt

SEQ ID NO: 255195 - DNA, 25 bp, Mus musculus
atgagaccaggatcttccgagtact

SEQ ID NO: 255196 - DNA, 25 bp, Mus musculus
atgagaccaggatgtccctcctctt

SEQ ID NO: 255197 - DNA, 25 bp, Mus musculus
atgagaccatatcagacgcactctt

SEQ ID NO: 255198 - DNA, 25 bp, Mus musculus
atgagaccatatgagacgcactctt

SEQ ID NO: 255199 - DNA, 25 bp, Mus musculus
atgagaccatcaagcttgaagctac

SEQ ID NO: 255200 - DNA, 25 bp, Mus musculus
atgagaccatcatgcttgaagctac

SEQ ID NO: 255201 - DNA, 25 bp, Mus musculus
atgagacccaagaggcagagtttca

SEQ ID NO: 255202 - DNA, 25 bp, Mus musculus
atgagacccaagtggcagagtttca

SEQ ID NO: 255203 - DNA, 25 bp, Mus musculus
atgagacccatcattcttcagcata

SEQ ID NO: 255204 - DNA, 25 bp, Mus musculus
atgagacccatctttcttcagcata

SEQ ID NO: 255205 - DNA, 25 bp, Mus musculus
atgagaccccatcaaccaggaatta

SEQ ID NO: 255206 - DNA, 25 bp, Mus musculus
atgagaccccatcacctgagaggca

SEQ ID NO: 255207 - DNA, 25 bp, Mus musculus
atgagaccccatgaaccaggaatta

SEQ ID NO: 255208 - DNA, 25 bp, Mus musculus
atgagaccccatgacctgagaggca

SEQ ID NO: 255209 - DNA, 25 bp, Mus musculus
atgagaccctcgatctttccagaac

SEQ ID NO: 255210 - DNA, 25 bp, Mus musculus
atgagaccctcgttctttccagaac

SEQ ID NO: 255211 - DNA, 25 bp, Mus musculus
atgagaccctgaaggtgaccggcac

SEQ ID NO: 255212 - DNA, 25 bp, Mus musculus
atgagaccctgatggtgaccggcac

SEQ ID NO: 255213 - DNA, 25 bp, Mus musculus
atgagaccctgtaagcacgctggca

SEQ ID NO: 255214 - DNA, 25 bp, Mus musculus
atgagaccctgttagcacgctggca

SEQ ID NO: 255215 - DNA, 25 bp, Mus musculus
atgagacccttcaagtcctgagcag

SEQ ID NO: 255216 - DNA, 25 bp, Mus musculus
atgagacccttctagtcctgagcag

SEQ ID NO: 255217 - DNA, 25 bp, Mus musculus
atgagaccctttcagtggcattctc

SEQ ID NO: 255218 - DNA, 25 bp, Mus musculus
atgagaccctttgagtggcattctc

SEQ ID NO: 255219 - DNA, 25 bp, Mus musculus
atgagaccgttaaactgggtaggct

SEQ ID NO: 255220 - DNA, 25 bp, Mus musculus
atgagaccgttatactgggtaggct

SEQ ID NO: 255221 - DNA, 25 bp, Mus musculus
atgagacctctaatccgccttccgt

SEQ ID NO: 255222 - DNA, 25 bp, Mus musculus
atgagacctctattccgccttccgt

SEQ ID NO: 255223 - DNA, 25 bp, Mus musculus
atgagacctctcagaaacaaacgaa

SEQ ID NO: 255224 - DNA, 25 bp, Mus musculus
atgagacctctctgaaacaaacgaa

SEQ ID NO: 255225 - DNA, 25 bp, Mus musculus
atgagacctgagaccacagtttgta

SEQ ID NO: 255226 - DNA, 25 bp, Mus musculus
atgagacctgagctgcagactggaa

SEQ ID NO: 255227 - DNA, 25 bp, Mus musculus
atgagacctgaggtgcagactggaa

SEQ ID NO: 255228 - DNA, 25 bp, Mus musculus
atgagacctgagtccacagtttgta

SEQ ID NO: 255229 - DNA, 25 bp, Mus musculus
atgagacctgcccaagcctacaggt

SEQ ID NO: 255230 - DNA, 25 bp, Mus musculus
atgagacctgccgaagcctacaggt

SEQ ID NO: 255231 - DNA, 25 bp, Mus musculus
atgagacctggtctgggcacgtcat

SEQ ID NO: 255232 - DNA, 25 bp, Mus musculus
atgagacctggtgtgggcacgtcat

SEQ ID NO: 255233 - DNA, 25 bp, Mus musculus
atgagaccttcactgcagctagttt

SEQ ID NO: 255234 - DNA, 25 bp, Mus musculus
atgagaccttcagtgcagctagttt

SEQ ID NO: 255235 - DNA, 25 bp, Mus musculus
atgagaccttctaagttgattcccc

SEQ ID NO: 255236 - DNA, 25 bp, Mus musculus
atgagaccttcttagttgattcccc

SEQ ID NO: 255237 - DNA, 25 bp, Mus musculus
atgagacgcacccatgctcaggcca

SEQ ID NO: 255238 - DNA, 25 bp, Mus musculus
atgagacgcaccgatgctcaggcca

SEQ ID NO: 255239 - DNA, 25 bp, Mus musculus
atgagacgccaacgagaagaaagtt

SEQ ID NO: 255240 - DNA, 25 bp, Mus musculus
atgagacgccaaggagaagaaagtt

SEQ ID NO: 255241 - DNA, 25 bp, Mus musculus
atgagacggattactctgtgctgta

SEQ ID NO: 255242 - DNA, 25 bp, Mus musculus
atgagacggatttctctgtgctgta

SEQ ID NO: 255243 - DNA, 25 bp, Mus musculus
atgagacgtgcgatggctgctctta

SEQ ID NO: 255244 - DNA, 25 bp, Mus musculus
atgagacgtgcgttggctgctctta

SEQ ID NO: 255245 - DNA, 25 bp, Mus musculus
atgagactcaagcttcccacagatc

SEQ ID NO: 255246 - DNA, 25 bp, Mus musculus
atgagactcaaggttcccacagatc

SEQ ID NO: 255247 - DNA, 25 bp, Mus musculus
atgagactccataagcttctttccc

SEQ ID NO: 255248 - DNA, 25 bp, Mus musculus
atgagactccattagcttctttccc

SEQ ID NO: 255249 - DNA, 25 bp, Mus musculus
atgagactccctcgcaacatctgag

SEQ ID NO: 255250 - DNA, 25 bp, Mus musculus
atgagactccctggcaacatctgag

SEQ ID NO: 255251 - DNA, 25 bp, Mus musculus
atgagactctgtagtctatcccaga

SEQ ID NO: 255252 - DNA, 25 bp, Mus musculus
atgagactctgtattacccgtatga

SEQ ID NO: 255253 - DNA, 25 bp, Mus musculus
atgagactctgttgtctatcccaga

SEQ ID NO: 255254 - DNA, 25 bp, Mus musculus
atgagactctgttttacccgtatga

SEQ ID NO: 255255 - DNA, 25 bp, Mus musculus
atgagactgaacactgctctcttga

SEQ ID NO: 255256 - DNA, 25 bp, Mus musculus
atgagactgaactctgctctcttga

SEQ ID NO: 255257 - DNA, 25 bp, Mus musculus
atgagactggacacgggtgtcgcac

SEQ ID NO: 255258 - DNA, 25 bp, Mus musculus
atgagactggactcgggtgtcgcac

SEQ ID NO: 255259 - DNA, 25 bp, Mus musculus
atgagactggtgagtcactctctca

SEQ ID NO: 255260 - DNA, 25 bp, Mus musculus
atgagactggtgtgtcactctctca

SEQ ID NO: 255261 - DNA, 25 bp, Mus musculus
atgagactgtgacgtcggaccccag

SEQ ID NO: 255262 - DNA, 25 bp, Mus musculus
atgagactgtgaggtcggaccccag

SEQ ID NO: 255263 - DNA, 25 bp, Mus musculus
atgagacttctcctcctgactttcc

SEQ ID NO: 255264 - DNA, 25 bp, Mus musculus
atgagacttctcgtcctgactttcc

SEQ ID NO: 255265 - DNA, 25 bp, Mus musculus
atgagacttttactgggattcctga

SEQ ID NO: 255266 - DNA, 25 bp, Mus musculus
atgagacttttagtgggattcctga

SEQ ID NO: 255267 - DNA, 25 bp, Mus musculus
atgagacttttgaccctcggagaca

SEQ ID NO: 255268 - DNA, 25 bp, Mus musculus
atgagacttttgtccctcggagaca

SEQ ID NO: 255269 - DNA, 25 bp, Mus musculus
atgagagacaggctcagccaagaaa

SEQ ID NO: 255270 - DNA, 25 bp, Mus musculus
atgagagacagggtcagccaagaaa

SEQ ID NO: 255271 - DNA, 25 bp, Mus musculus
atgagagacattatcttggaacgga

SEQ ID NO: 255272 - DNA, 25 bp, Mus musculus
atgagagacattttcttggaacgga

SEQ ID NO: 255273 - DNA, 25 bp, Mus musculus
atgagagacccaaaatcctgctgcc

SEQ ID NO: 255274 - DNA, 25 bp, Mus musculus
atgagagacccataatcctgctgcc

SEQ ID NO: 255275 - DNA, 25 bp, Mus musculus
atgagagactgaccctttggttcca

SEQ ID NO: 255276 - DNA, 25 bp, Mus musculus
atgagagactgagcctttggttcca

SEQ ID NO: 255277 - DNA, 25 bp, Mus musculus
atgagagacttgacccaggaagctt

SEQ ID NO: 255278 - DNA, 25 bp, Mus musculus
atgagagacttgtcccaggaagctt

SEQ ID NO: 255279 - DNA, 25 bp, Mus musculus
atgagagagattcactggccttgca

SEQ ID NO: 255280 - DNA, 25 bp, Mus musculus
atgagagagattgactggccttgca

SEQ ID NO: 255281 - DNA, 25 bp, Mus musculus
atgagagaggtcacacttcctcgct

SEQ ID NO: 255282 - DNA, 25 bp, Mus musculus
atgagagaggtctcacttcctcgct

SEQ ID NO: 255283 - DNA, 25 bp, Mus musculus
atgagagatcttcatgcattctttg

SEQ ID NO: 255284 - DNA, 25 bp, Mus musculus
atgagagatcttgatgcattctttg

SEQ ID NO: 255285 - DNA, 25 bp, Mus musculus
atgagagattaccagtgcttcccct

SEQ ID NO: 255286 - DNA, 25 bp, Mus musculus
atgagagattacgagtgcttcccct

SEQ ID NO: 255287 - DNA, 25 bp, Mus musculus
atgagagatttccaagcatcccttg

SEQ ID NO: 255288 - DNA, 25 bp, Mus musculus
atgagagatttcgaagcatcccttg

SEQ ID NO: 255289 - DNA, 25 bp, Mus musculus
atgagagcactcaccaggagggcct

SEQ ID NO: 255290 - DNA, 25 bp, Mus musculus
atgagagcactctccaggagggcct

SEQ ID NO: 255291 - DNA, 25 bp, Mus musculus
atgagagcagccaacttggacgacc

SEQ ID NO: 255292 - DNA, 25 bp, Mus musculus
atgagagcagcctacttggacgacc

SEQ ID NO: 255293 - DNA, 25 bp, Mus musculus
atgagagcagcgaggcatttggcat

SEQ ID NO: 255294 - DNA, 25 bp, Mus musculus
atgagagcagcgtggcatttggcat

SEQ ID NO: 255295 - DNA, 25 bp, Mus musculus
atgagagccatcagccaatgggcac

SEQ ID NO: 255296 - DNA, 25 bp, Mus musculus
atgagagccatctgccaatgggcac

SEQ ID NO: 255297 - DNA, 25 bp, Mus musculus
atgagagccctgattgctggcacca

SEQ ID NO: 255298 - DNA, 25 bp, Mus musculus
atgagagccctgtttgctggcacca

SEQ ID NO: 255299 - DNA, 25 bp, Mus musculus
atgagagccgtgaccagttgatgtt

SEQ ID NO: 255300 - DNA, 25 bp, Mus musculus
atgagagccgtgtccagttgatgtt

SEQ ID NO: 255301 - DNA, 25 bp, Mus musculus
atgagagcgatgcttttggagatct

SEQ ID NO: 255302 - DNA, 25 bp, Mus musculus
atgagagcgatggttttggagatct

SEQ ID NO: 255303 - DNA, 25 bp, Mus musculus
atgagagcgctcatacagctcactt

SEQ ID NO: 255304 - DNA, 25 bp, Mus musculus
atgagagcgctcttacagctcactt

SEQ ID NO: 255305 - DNA, 25 bp, Mus musculus
atgagagctcacatgtcatagtcaa

SEQ ID NO: 255306 - DNA, 25 bp, Mus musculus
atgagagctcacttgtcatagtcaa

SEQ ID NO: 255307 - DNA, 25 bp, Mus musculus
atgagagctcctatgtgtactgcag

SEQ ID NO: 255308 - DNA, 25 bp, Mus musculus
atgagagctcctttgtgtactgcag

SEQ ID NO: 255309 - DNA, 25 bp, Mus musculus
atgagagctgctcccaaggatgtgc

SEQ ID NO: 255310 - DNA, 25 bp, Mus musculus
atgagagctgctgccaaggatgtgc

SEQ ID NO: 255311 - DNA, 25 bp, Mus musculus
atgagagcttcacggcctgcagcca

SEQ ID NO: 255312 - DNA, 25 bp, Mus musculus
atgagagcttcagggcctgcagcca

SEQ ID NO: 255313 - DNA, 25 bp, Mus musculus
atgagaggaaacctgacagccatca

SEQ ID NO: 255314 - DNA, 25 bp, Mus musculus
atgagaggaaacgtgacagccatca

SEQ ID NO: 255315 - DNA, 25 bp, Mus musculus
atgagaggaacactaagtgagagca

SEQ ID NO: 255316 - DNA, 25 bp, Mus musculus
atgagaggaacagtaagtgagagca

SEQ ID NO: 255317 - DNA, 25 bp, Mus musculus
atgagaggattgatgtgtatactgt

SEQ ID NO: 255318 - DNA, 25 bp, Mus musculus
atgagaggattgttgtgtatactgt

SEQ ID NO: 255319 - DNA, 25 bp, Mus musculus
atgagaggcagtcagcatccgagct

SEQ ID NO: 255320 - DNA, 25 bp, Mus musculus
atgagaggcagtgagcatccgagct

SEQ ID NO: 255321 - DNA, 25 bp, Mus musculus
atgagaggctgcacgtggccatgct

SEQ ID NO: 255322 - DNA, 25 bp, Mus musculus
atgagaggctgctcgtggccatgct

SEQ ID NO: 255323 - DNA, 25 bp, Mus musculus
atgagagtcatcacatagaagcctg

SEQ ID NO: 255324 - DNA, 25 bp, Mus musculus
atgagagtcatctcatagaagcctg

SEQ ID NO: 255325 - DNA, 25 bp, Mus musculus
atgagagtcctacagggcctgcctg

SEQ ID NO: 255326 - DNA, 25 bp, Mus musculus
atgagagtcctagagggcctgcctg

SEQ ID NO: 255327 - DNA, 25 bp, Mus musculus
atgagagtggagcttcgccccgccc

SEQ ID NO: 255328 - DNA, 25 bp, Mus musculus
atgagagtggaggttcgccccgccc

SEQ ID NO: 255329 - DNA, 25 bp, Mus musculus
atgagagtggtgctcccagtgttca

SEQ ID NO: 255330 - DNA, 25 bp, Mus musculus
atgagagtggtggtcccagtgttca

SEQ ID NO: 255331 - DNA, 25 bp, Mus musculus
atgagataacatcgcgtcagttcct

SEQ ID NO: 255332 - DNA, 25 bp, Mus musculus
atgagataacatggcgtcagttcct

SEQ ID NO: 255333 - DNA, 25 bp, Mus musculus
atgagataccagagaaccttcccaa

SEQ ID NO: 255334 - DNA, 25 bp, Mus musculus
atgagataccagtgaaccttcccaa

SEQ ID NO: 255335 - DNA, 25 bp, Mus musculus
atgagatactgaccccaggtgtgct

SEQ ID NO: 255336 - DNA, 25 bp, Mus musculus
atgagatactgagcccaggtgtgct

SEQ ID NO: 255337 - DNA, 25 bp, Mus musculus
atgagatagcataggctgcccagga

SEQ ID NO: 255338 - DNA, 25 bp, Mus musculus
atgagatagcattggctgcccagga

SEQ ID NO: 255339 - DNA, 25 bp, Mus musculus
atgagatattgaaaatgggccaaga

SEQ ID NO: 255340 - DNA, 25 bp, Mus musculus
atgagatattgataatgggccaaga

SEQ ID NO: 255341 - DNA, 25 bp, Mus musculus
atgagatatttcagcccagctgcaa

SEQ ID NO: 255342 - DNA, 25 bp, Mus musculus
atgagatatttctgcccagctgcaa

SEQ ID NO: 255343 - DNA, 25 bp, Mus musculus
atgagatcatcacgggtttggtatt

SEQ ID NO: 255344 - DNA, 25 bp, Mus musculus
atgagatcatcaggggtttggtatt

SEQ ID NO: 255345 - DNA, 25 bp, Mus musculus
atgagatcatcgatgaccttgccaa

SEQ ID NO: 255346 - DNA, 25 bp, Mus musculus
atgagatcatcgttgaccttgccaa

SEQ ID NO: 255347 - DNA, 25 bp, Mus musculus
atgagatccatgagatgacgttgca

SEQ ID NO: 255348 - DNA, 25 bp, Mus musculus
atgagatccatgtgatgacgttgca

SEQ ID NO: 255349 - DNA, 25 bp, Mus musculus
atgagatccattataccctgcctga

SEQ ID NO: 255350 - DNA, 25 bp, Mus musculus
atgagatccattttaccctgcctga

SEQ ID NO: 255351 - DNA, 25 bp, Mus musculus
atgagatccggacgagaccccagtg

SEQ ID NO: 255352 - DNA, 25 bp, Mus musculus
atgagatccggaggagaccccagtg

SEQ ID NO: 255353 - DNA, 25 bp, Mus musculus
atgagatcctagcatcggtgctggc

SEQ ID NO: 255354 - DNA, 25 bp, Mus musculus
atgagatcctaggatcggtgctggc

SEQ ID NO: 255355 - DNA, 25 bp, Mus musculus
atgagatccttacccactcatggct

SEQ ID NO: 255356 - DNA, 25 bp, Mus musculus
atgagatccttagccactcatggct

SEQ ID NO: 255357 - DNA, 25 bp, Mus musculus
atgagatcgagcagcgagccctgac

SEQ ID NO: 255358 - DNA, 25 bp, Mus musculus
atgagatcgagctgcgagccctgac

SEQ ID NO: 255359 - DNA, 25 bp, Mus musculus
atgagatcgcgtacatcaggacttc

SEQ ID NO: 255360 - DNA, 25 bp, Mus musculus
atgagatcgcgttcatcaggacttc

SEQ ID NO: 255361 - DNA, 25 bp, Mus musculus
atgagatctcccacctagagaccaa

SEQ ID NO: 255362 - DNA, 25 bp, Mus musculus
atgagatctccctcctagagaccaa

SEQ ID NO: 255363 - DNA, 25 bp, Mus musculus
atgagatctctacagctgttccaaa

SEQ ID NO: 255364 - DNA, 25 bp, Mus musculus
atgagatctctagagctgttccaaa

SEQ ID NO: 255365 - DNA, 25 bp, Mus musculus
atgagatctctcacagacctggtct

SEQ ID NO: 255366 - DNA, 25 bp, Mus musculus
atgagatctctctcagacctggtct

SEQ ID NO: 255367 - DNA, 25 bp, Mus musculus
atgagatctgaaactacttgtgaag

SEQ ID NO: 255368 - DNA, 25 bp, Mus musculus
atgagatctgaatctacttgtgaag

SEQ ID NO: 255369 - DNA, 25 bp, Mus musculus
atgagatctgtgcaggtcatcctgg

SEQ ID NO: 255370 - DNA, 25 bp, Mus musculus
atgagatctgtggaggtcatcctgg

SEQ ID NO: 255371 - DNA, 25 bp, Mus musculus
atgagatcttctattcaggcctcca

SEQ ID NO: 255372 - DNA, 25 bp, Mus musculus
atgagatcttcttttcaggcctcca

SEQ ID NO: 255373 - DNA, 25 bp, Mus musculus
atgagatctttgagcaggacctgaa

SEQ ID NO: 255374 - DNA, 25 bp, Mus musculus
atgagatctttgtgcaggacctgaa

SEQ ID NO: 255375 - DNA, 25 bp, Mus musculus
atgagatgagttcagctcccttcag

SEQ ID NO: 255376 - DNA, 25 bp, Mus musculus
atgagatgagttgagctcccttcag

SEQ ID NO: 255377 - DNA, 25 bp, Mus musculus
atgagatgcaatcatctccctgtcc

SEQ ID NO: 255378 - DNA, 25 bp, Mus musculus
atgagatgcaatgatctccctgtcc

SEQ ID NO: 255379 - DNA, 25 bp, Mus musculus
atgagatgcaccctgttctgccagg

SEQ ID NO: 255380 - DNA, 25 bp, Mus musculus
atgagatgcaccgtgttctgccagg

SEQ ID NO: 255381 - DNA, 25 bp, Mus musculus
atgagatgcacgattctgactgatc

SEQ ID NO: 255382 - DNA, 25 bp, Mus musculus
atgagatgcacgtttctgactgatc

SEQ ID NO: 255383 - DNA, 25 bp, Mus musculus
atgagatgcccacggtaccatgctg

SEQ ID NO: 255384 - DNA, 25 bp, Mus musculus
atgagatgcccagggtaccatgctg

SEQ ID NO: 255385 - DNA, 25 bp, Mus musculus
atgagatgcgcccggctgcggagga

SEQ ID NO: 255386 - DNA, 25 bp, Mus musculus
atgagatgcgccgggctgcggagga

SEQ ID NO: 255387 - DNA, 25 bp, Mus musculus
atgagatgctcaagcgctggcgtca

SEQ ID NO: 255388 - DNA, 25 bp, Mus musculus
atgagatgctcatgcgctggcgtca

SEQ ID NO: 255389 - DNA, 25 bp, Mus musculus
atgagatgctgcagggcttcgctgt

SEQ ID NO: 255390 - DNA, 25 bp, Mus musculus
atgagatgctgctgggcttcgctgt

SEQ ID NO: 255391 - DNA, 25 bp, Mus musculus
atgagatgctttcactgactctaag

SEQ ID NO: 255392 - DNA, 25 bp, Mus musculus
atgagatgctttcggcactgtatca

SEQ ID NO: 255393 - DNA, 25 bp, Mus musculus
atgagatgctttgactgactctaag

SEQ ID NO: 255394 - DNA, 25 bp, Mus musculus
atgagatgctttgggcactgtatca

SEQ ID NO: 255395 - DNA, 25 bp, Mus musculus
atgagatggcgccacccagttcggt

SEQ ID NO: 255396 - DNA, 25 bp, Mus musculus
atgagatggcgcgacccagttcggt

SEQ ID NO: 255397 - DNA, 25 bp, Mus musculus
atgagatgtacacactgtttcatat

SEQ ID NO: 255398 - DNA, 25 bp, Mus musculus
atgagatgtacagactgtttcatat

SEQ ID NO: 255399 - DNA, 25 bp, Mus musculus
atgagatgtttaaaggccctctaca

SEQ ID NO: 255400 - DNA, 25 bp, Mus musculus
atgagatgtttataggccctctaca

SEQ ID NO: 255401 - DNA, 25 bp, Mus musculus
atgagattacacatggtccgtgtca

SEQ ID NO: 255402 - DNA, 25 bp, Mus musculus
atgagattacacttggtccgtgtca

SEQ ID NO: 255403 - DNA, 25 bp, Mus musculus
atgagattacatctgttcaccacca

SEQ ID NO: 255404 - DNA, 25 bp, Mus musculus
atgagattacatgtgttcaccacca

SEQ ID NO: 255405 - DNA, 25 bp, Mus musculus
atgagattcactccccgcttctgtg

SEQ ID NO: 255406 - DNA, 25 bp, Mus musculus
atgagattcactgcccgcttctgtg

SEQ ID NO: 255407 - DNA, 25 bp, Mus musculus
atgagattccttatgtctttgcgtc

SEQ ID NO: 255408 - DNA, 25 bp, Mus musculus
atgagattccttttgtctttgcgtc

SEQ ID NO: 255409 - DNA, 25 bp, Mus musculus
atgagattcgcaaactcatcctgcg

SEQ ID NO: 255410 - DNA, 25 bp, Mus musculus
atgagattcgcatactcatcctgcg

SEQ ID NO: 255411 - DNA, 25 bp, Mus musculus
atgagattctcaacgcttcacacta

SEQ ID NO: 255412 - DNA, 25 bp, Mus musculus
atgagattctcatcgcttcacacta

SEQ ID NO: 255413 - DNA, 25 bp, Mus musculus
atgagattgagccggagcctctgct

SEQ ID NO: 255414 - DNA, 25 bp, Mus musculus
atgagattgagcgggagcctctgct

SEQ ID NO: 255415 - DNA, 25 bp, Mus musculus
atgagattgattatctatctgcctg

SEQ ID NO: 255416 - DNA, 25 bp, Mus musculus
atgagattgattttctatctgcctg

SEQ ID NO: 255417 - DNA, 25 bp, Mus musculus
atgagattgcctctgtcaaagctaa

SEQ ID NO: 255418 - DNA, 25 bp, Mus musculus
atgagattgcctgtgtcaaagctaa

SEQ ID NO: 255419 - DNA, 25 bp, Mus musculus
atgagattggcacttaagtacataa

SEQ ID NO: 255420 - DNA, 25 bp, Mus musculus
atgagattggcagttaagtacataa

SEQ ID NO: 255421 - DNA, 25 bp, Mus musculus
atgagatttaaaagggtcccgagcc

SEQ ID NO: 255422 - DNA, 25 bp, Mus musculus
atgagatttaaatgggtcccgagcc

SEQ ID NO: 255423 - DNA, 25 bp, Mus musculus
atgagatttcccaggcttagcttgc

SEQ ID NO: 255424 - DNA, 25 bp, Mus musculus
atgagatttccctggcttagcttgc

SEQ ID NO: 255425 - DNA, 25 bp, Mus musculus
atgagatttgatatggcccttgctg

SEQ ID NO: 255426 - DNA, 25 bp, Mus musculus
atgagatttgatttggcccttgctg

SEQ ID NO: 255427 - DNA, 25 bp, Mus musculus
atgagcaaacgcatggatgtcgcca

SEQ ID NO: 255428 - DNA, 25 bp, Mus musculus
atgagcaaacgcttggatgtcgcca

SEQ ID NO: 255429 - DNA, 25 bp, Mus musculus
atgagcaaactgctgtttccggaca

SEQ ID NO: 255430 - DNA, 25 bp, Mus musculus
atgagcaaactggtgtttccggaca

SEQ ID NO: 255431 - DNA, 25 bp, Mus musculus
atgagcaaatagagcatggttctgt

SEQ ID NO: 255432 - DNA, 25 bp, Mus musculus
atgagcaaatagtgcatggttctgt

SEQ ID NO: 255433 - DNA, 25 bp, Mus musculus
atgagcaaccgcaaggctgagcaga

SEQ ID NO: 255434 - DNA, 25 bp, Mus musculus
atgagcaaccgctaggctgagcaga

SEQ ID NO: 255435 - DNA, 25 bp, Mus musculus
atgagcaacgggacgcttttcgaca

SEQ ID NO: 255436 - DNA, 25 bp, Mus musculus
atgagcaacgggtcgcttttcgaca

SEQ ID NO: 255437 - DNA, 25 bp, Mus musculus
atgagcaactaccaaggctcctctg

SEQ ID NO: 255438 - DNA, 25 bp, Mus musculus
atgagcaactacgaaggctcctctg

SEQ ID NO: 255439 - DNA, 25 bp, Mus musculus
atgagcaactctcttctgaagcact

SEQ ID NO: 255440 - DNA, 25 bp, Mus musculus
atgagcaactctgttctgaagcact

SEQ ID NO: 255441 - DNA, 25 bp, Mus musculus
atgagcaacttaaagcctggcttct

SEQ ID NO: 255442 - DNA, 25 bp, Mus musculus
atgagcaacttatagcctggcttct

SEQ ID NO: 255443 - DNA, 25 bp, Mus musculus
atgagcaactttcatggctgctaac

SEQ ID NO: 255444 - DNA, 25 bp, Mus musculus
atgagcaactttgatggctgctaac

SEQ ID NO: 255445 - DNA, 25 bp, Mus musculus
atgagcaagaaaaatttggtcattc

SEQ ID NO: 255446 - DNA, 25 bp, Mus musculus
atgagcaagaaatatttggtcattc

SEQ ID NO: 255447 - DNA, 25 bp, Mus musculus
atgagcaagagtacctgcgcatcat

SEQ ID NO: 255448 - DNA, 25 bp, Mus musculus
atgagcaagagttcctgcgcatcat

SEQ ID NO: 255449 - DNA, 25 bp, Mus musculus
atgagcaagataatgatcacaaacc

SEQ ID NO: 255450 - DNA, 25 bp, Mus musculus
atgagcaagatattgatcacaaacc

SEQ ID NO: 255451 - DNA, 25 bp, Mus musculus
atgagcaagcccatgatctgacctc

SEQ ID NO: 255452 - DNA, 25 bp, Mus musculus
atgagcaagcccttgatctgacctc

SEQ ID NO: 255453 - DNA, 25 bp, Mus musculus
atgagcaagctcacgcgttctgtgt

SEQ ID NO: 255454 - DNA, 25 bp, Mus musculus
atgagcaagctctcgcgttctgtgt

SEQ ID NO: 255455 - DNA, 25 bp, Mus musculus
atgagcaaggctatcttcacttcca

SEQ ID NO: 255456 - DNA, 25 bp, Mus musculus
atgagcaaggctttcttcacttcca

SEQ ID NO: 255457 - DNA, 25 bp, Mus musculus
atgagcaaggtgagctgtgtcccca

SEQ ID NO: 255458 - DNA, 25 bp, Mus musculus
atgagcaaggtgtgctgtgtcccca

SEQ ID NO: 255459 - DNA, 25 bp, Mus musculus
atgagcaatcttcccatagttggac

SEQ ID NO: 255460 - DNA, 25 bp, Mus musculus
atgagcaatcttgccatagttggac

SEQ ID NO: 255461 - DNA, 25 bp, Mus musculus
atgagcaatgcaatctcctctgagg

SEQ ID NO: 255462 - DNA, 25 bp, Mus musculus
atgagcaatgcattctcctctgagg

SEQ ID NO: 255463 - DNA, 25 bp, Mus musculus
atgagcaatgccaacttcggcttca

SEQ ID NO: 255464 - DNA, 25 bp, Mus musculus
atgagcaatgcctacttcggcttca

SEQ ID NO: 255465 - DNA, 25 bp, Mus musculus
atgagcaatgctccagactccgtgt

SEQ ID NO: 255466 - DNA, 25 bp, Mus musculus
atgagcaatgctgcagactccgtgt

SEQ ID NO: 255467 - DNA, 25 bp, Mus musculus
atgagcaatgggaggtcccgcaagt

SEQ ID NO: 255468 - DNA, 25 bp, Mus musculus
atgagcaatgggtggtcccgcaagt

SEQ ID NO: 255469 - DNA, 25 bp, Mus musculus
atgagcacaagcatggttgtatttt

SEQ ID NO: 255470 - DNA, 25 bp, Mus musculus
atgagcacaagcttggttgtatttt

SEQ ID NO: 255471 - DNA, 25 bp, Mus musculus
atgagcacacagaatgcctggtacc

SEQ ID NO: 255472 - DNA, 25 bp, Mus musculus
atgagcacacagtatgcctggtacc

SEQ ID NO: 255473 - DNA, 25 bp, Mus musculus
atgagcacactcataccttaatata

SEQ ID NO: 255474 - DNA, 25 bp, Mus musculus
atgagcacactcttaccttaatata

SEQ ID NO: 255475 - DNA, 25 bp, Mus musculus
atgagcacagcacggacagccgcag

SEQ ID NO: 255476 - DNA, 25 bp, Mus musculus
atgagcacagcagggacagccgcag

SEQ ID NO: 255477 - DNA, 25 bp, Mus musculus
atgagcacagctaacacgtgtagaa

SEQ ID NO: 255478 - DNA, 25 bp, Mus musculus
atgagcacagcttacacgtgtagaa

SEQ ID NO: 255479 - DNA, 25 bp, Mus musculus
atgagcaccattctccataaatcaa

SEQ ID NO: 255480 - DNA, 25 bp, Mus musculus
atgagcaccattgtccataaatcaa

SEQ ID NO: 255481 - DNA, 25 bp, Mus musculus
atgagcacctgactctaatctgtag

SEQ ID NO: 255482 - DNA, 25 bp, Mus musculus
atgagcacctgagtctaatctgtag

SEQ ID NO: 255483 - DNA, 25 bp, Mus musculus
atgagcacctgtcagcactgtgtag

SEQ ID NO: 255484 - DNA, 25 bp, Mus musculus
atgagcacctgtgagcactgtgtag

SEQ ID NO: 255485 - DNA, 25 bp, Mus musculus
atgagcacggcaacgttcaccgaga

SEQ ID NO: 255486 - DNA, 25 bp, Mus musculus
atgagcacggcatcgttcaccgaga

SEQ ID NO: 255487 - DNA, 25 bp, Mus musculus
atgagcacggttcccagtttgccat

SEQ ID NO: 255488 - DNA, 25 bp, Mus musculus
atgagcacggttgccagtttgccat

SEQ ID NO: 255489 - DNA, 25 bp, Mus musculus
atgagcactacaagcggaactcgcg

SEQ ID NO: 255490 - DNA, 25 bp, Mus musculus
atgagcactacatgcggaactcgcg

SEQ ID NO: 255491 - DNA, 25 bp, Mus musculus
atgagcactaccatcaatgaccacc

SEQ ID NO: 255492 - DNA, 25 bp, Mus musculus
atgagcactaccttcaatgaccacc

SEQ ID NO: 255493 - DNA, 25 bp, Mus musculus
atgagcactcagctatcacacacat

SEQ ID NO: 255494 - DNA, 25 bp, Mus musculus
atgagcactcaggtatcacacacat

SEQ ID NO: 255495 - DNA, 25 bp, Mus musculus
atgagcactcatatgacggcatcct

SEQ ID NO: 255496 - DNA, 25 bp, Mus musculus
atgagcactcatcccgtgcacaggc

SEQ ID NO: 255497 - DNA, 25 bp, Mus musculus
atgagcactcatgccgtgcacaggc

SEQ ID NO: 255498 - DNA, 25 bp, Mus musculus
atgagcactcatttgacggcatcct

SEQ ID NO: 255499 - DNA, 25 bp, Mus musculus
atgagcactctcaaacaatttcgtt

SEQ ID NO: 255500 - DNA, 25 bp, Mus musculus
atgagcactctccagagttagctgg

SEQ ID NO: 255501 - DNA, 25 bp, Mus musculus
atgagcactctcgagagttagctgg

SEQ ID NO: 255502 - DNA, 25 bp, Mus musculus
atgagcactctctaacaatttcgtt

SEQ ID NO: 255503 - DNA, 25 bp, Mus musculus
atgagcactgcacttatgtccattt

SEQ ID NO: 255504 - DNA, 25 bp, Mus musculus
atgagcactgcagttatgtccattt

SEQ ID NO: 255505 - DNA, 25 bp, Mus musculus
atgagcactggacatcacggacttc

SEQ ID NO: 255506 - DNA, 25 bp, Mus musculus
atgagcactggagatcacggacttc

SEQ ID NO: 255507 - DNA, 25 bp, Mus musculus
atgagcactggcagcatctgtatgg

SEQ ID NO: 255508 - DNA, 25 bp, Mus musculus
atgagcactggctgcatctgtatgg

SEQ ID NO: 255509 - DNA, 25 bp, Mus musculus
atgagcactgttcggattcttcgct

SEQ ID NO: 255510 - DNA, 25 bp, Mus musculus
atgagcactgttgggattcttcgct

SEQ ID NO: 255511 - DNA, 25 bp, Mus musculus
atgagcacttctccctggctaaaca

SEQ ID NO: 255512 - DNA, 25 bp, Mus musculus
atgagcacttctgcctggctaaaca

SEQ ID NO: 255513 - DNA, 25 bp, Mus musculus
atgagcagagagatcacctgatagc

SEQ ID NO: 255514 - DNA, 25 bp, Mus musculus
atgagcagagagttcacctgatagc

SEQ ID NO: 255515 - DNA, 25 bp, Mus musculus
atgagcagagccacctactgtcttt

SEQ ID NO: 255516 - DNA, 25 bp, Mus musculus
atgagcagagcctcctactgtcttt

SEQ ID NO: 255517 - DNA, 25 bp, Mus musculus
atgagcagctcgaagccctggagaa

SEQ ID NO: 255518 - DNA, 25 bp, Mus musculus
atgagcagctcgtagccctggagaa

SEQ ID NO: 255519 - DNA, 25 bp, Mus musculus
atgagcagctgcatggaccattctt

SEQ ID NO: 255520 - DNA, 25 bp, Mus musculus
atgagcagctgcttggaccattctt

SEQ ID NO: 255521 - DNA, 25 bp, Mus musculus
atgagcaggcaaatgcccactacct

SEQ ID NO: 255522 - DNA, 25 bp, Mus musculus
atgagcaggcaattgcccactacct

SEQ ID NO: 255523 - DNA, 25 bp, Mus musculus
atgagcaggcacatttagggcagac

SEQ ID NO: 255524 - DNA, 25 bp, Mus musculus
atgagcaggcacttttagggcagac

SEQ ID NO: 255525 - DNA, 25 bp, Mus musculus
atgagcaggctcaggaacagggcat

SEQ ID NO: 255526 - DNA, 25 bp, Mus musculus
atgagcaggctctggaacagggcat

SEQ ID NO: 255527 - DNA, 25 bp, Mus musculus
atgagcagggcccactgtttggact

SEQ ID NO: 255528 - DNA, 25 bp, Mus musculus
atgagcagggccctgacccctttat

SEQ ID NO: 255529 - DNA, 25 bp, Mus musculus
atgagcagggccgactgtttggact

SEQ ID NO: 255530 - DNA, 25 bp, Mus musculus
atgagcagggccgtgacccctttat

SEQ ID NO: 255531 - DNA, 25 bp, Mus musculus
atgagcagtactcggtctcatcctt

SEQ ID NO: 255532 - DNA, 25 bp, Mus musculus
atgagcagtactgggtctcatcctt

SEQ ID NO: 255533 - DNA, 25 bp, Mus musculus
atgagcagtcaacggctctcggtgt

SEQ ID NO: 255534 - DNA, 25 bp, Mus musculus
atgagcagtcaagggctctcggtgt

SEQ ID NO: 255535 - DNA, 25 bp, Mus musculus
atgagcagtcacatctgttgccagc

SEQ ID NO: 255536 - DNA, 25 bp, Mus musculus
atgagcagtcacttctgttgccagc

SEQ ID NO: 255537 - DNA, 25 bp, Mus musculus
atgagcagtgtaaactttcccagcc

SEQ ID NO: 255538 - DNA, 25 bp, Mus musculus
atgagcagtgtacctgaccaattcc

SEQ ID NO: 255539 - DNA, 25 bp, Mus musculus
atgagcagtgtagctgaccaattcc

SEQ ID NO: 255540 - DNA, 25 bp, Mus musculus
atgagcagtgtatactttcccagcc

SEQ ID NO: 255541 - DNA, 25 bp, Mus musculus
atgagcagttacattacggtcaccc

SEQ ID NO: 255542 - DNA, 25 bp, Mus musculus
atgagcagttactttacggtcaccc

SEQ ID NO: 255543 - DNA, 25 bp, Mus musculus
atgagcagttcgacatcctgaggct

SEQ ID NO: 255544 - DNA, 25 bp, Mus musculus
atgagcagttcgtcatcctgaggct

SEQ ID NO: 255545 - DNA, 25 bp, Mus musculus
atgagcataaatccagtcttccgtt

SEQ ID NO: 255546 - DNA, 25 bp, Mus musculus
atgagcataaatgcagtcttccgtt

SEQ ID NO: 255547 - DNA, 25 bp, Mus musculus
atgagcataccaccgtcctattagg

SEQ ID NO: 255548 - DNA, 25 bp, Mus musculus
atgagcataccagcgtcctattagg

SEQ ID NO: 255549 - DNA, 25 bp, Mus musculus
atgagcataggcacaaagacccaga

SEQ ID NO: 255550 - DNA, 25 bp, Mus musculus
atgagcataggctcaaagacccaga

SEQ ID NO: 255551 - DNA, 25 bp, Mus musculus
atgagcatatcactactgtcctttg

SEQ ID NO: 255552 - DNA, 25 bp, Mus musculus
atgagcatatcagtactgtcctttg

SEQ ID NO: 255553 - DNA, 25 bp, Mus musculus
atgagcatcagccatttcctgccct

SEQ ID NO: 255554 - DNA, 25 bp, Mus musculus
atgagcatcagcgatttcctgccct

SEQ ID NO: 255555 - DNA, 25 bp, Mus musculus
atgagcatccctagagtataccact

SEQ ID NO: 255556 - DNA, 25 bp, Mus musculus
atgagcatcccttgagtataccact

SEQ ID NO: 255557 - DNA, 25 bp, Mus musculus
atgagcatcggaccaccggaaactc

SEQ ID NO: 255558 - DNA, 25 bp, Mus musculus
atgagcatcggagcaccggaaactc

SEQ ID NO: 255559 - DNA, 25 bp, Mus musculus
atgagcatctctaaccacctgggaa

SEQ ID NO: 255560 - DNA, 25 bp, Mus musculus
atgagcatctctcgctgatatccgt

SEQ ID NO: 255561 - DNA, 25 bp, Mus musculus
atgagcatctctcttgtggacacgc

SEQ ID NO: 255562 - DNA, 25 bp, Mus musculus
atgagcatctctggctgatatccgt

SEQ ID NO: 255563 - DNA, 25 bp, Mus musculus
atgagcatctctgttgtggacacgc

SEQ ID NO: 255564 - DNA, 25 bp, Mus musculus
atgagcatctcttaccacctgggaa

SEQ ID NO: 255565 - DNA, 25 bp, Mus musculus
atgagcatcttcaataatcactctg

SEQ ID NO: 255566 - DNA, 25 bp, Mus musculus
atgagcatcttcactacagccgctg

SEQ ID NO: 255567 - DNA, 25 bp, Mus musculus
atgagcatcttctataatcactctg

SEQ ID NO: 255568 - DNA, 25 bp, Mus musculus
atgagcatcttctctacagccgctg

SEQ ID NO: 255569 - DNA, 25 bp, Mus musculus
atgagcatgctgaccgcttgcagga

SEQ ID NO: 255570 - DNA, 25 bp, Mus musculus
atgagcatgctgtccgcttgcagga

SEQ ID NO: 255571 - DNA, 25 bp, Mus musculus
atgagcatttcaagagaggacaaaa

SEQ ID NO: 255572 - DNA, 25 bp, Mus musculus
atgagcatttcatgagaggacaaaa

SEQ ID NO: 255573 - DNA, 25 bp, Mus musculus
atgagcatttccctacagaggcctc

SEQ ID NO: 255574 - DNA, 25 bp, Mus musculus
atgagcatttccgtacagaggcctc

SEQ ID NO: 255575 - DNA, 25 bp, Mus musculus
atgagccaaaccctcttgaacacaa

SEQ ID NO: 255576 - DNA, 25 bp, Mus musculus
atgagccaaaccgtcttgaacacaa

SEQ ID NO: 255577 - DNA, 25 bp, Mus musculus
atgagccaaagcatgtttgaggcac

SEQ ID NO: 255578 - DNA, 25 bp, Mus musculus
atgagccaaagcttgtttgaggcac

SEQ ID NO: 255579 - DNA, 25 bp, Mus musculus
atgagccaatataaacttgctttta

SEQ ID NO: 255580 - DNA, 25 bp, Mus musculus
atgagccaatattaacttgctttta

SEQ ID NO: 255581 - DNA, 25 bp, Mus musculus
atgagccacctcacaggttatgaga

SEQ ID NO: 255582 - DNA, 25 bp, Mus musculus
atgagccacctctcaggttatgaga

SEQ ID NO: 255583 - DNA, 25 bp, Mus musculus
atgagccaccttaccatatgagctg

SEQ ID NO: 255584 - DNA, 25 bp, Mus musculus
atgagccacctttccatatgagctg

SEQ ID NO: 255585 - DNA, 25 bp, Mus musculus
atgagccagccaaggtgttacttgc

SEQ ID NO: 255586 - DNA, 25 bp, Mus musculus
atgagccagccatggtgttacttgc

SEQ ID NO: 255587 - DNA, 25 bp, Mus musculus
atgagccagcccctagctggacaga

SEQ ID NO: 255588 - DNA, 25 bp, Mus musculus
atgagccagcccgtagctggacaga

SEQ ID NO: 255589 - DNA, 25 bp, Mus musculus
atgagccaggttcctagccttcctt

SEQ ID NO: 255590 - DNA, 25 bp, Mus musculus
atgagccaggttgctagccttcctt

SEQ ID NO: 255591 - DNA, 25 bp, Mus musculus
atgagccagtaccataccttctctg

SEQ ID NO: 255592 - DNA, 25 bp, Mus musculus
atgagccagtacgataccttctctg

SEQ ID NO: 255593 - DNA, 25 bp, Mus musculus
atgagccagtccaccctgagggcgg

SEQ ID NO: 255594 - DNA, 25 bp, Mus musculus
atgagccagtcctccctgagggcgg

SEQ ID NO: 255595 - DNA, 25 bp, Mus musculus
atgagccagttgagcctagttcttt

SEQ ID NO: 255596 - DNA, 25 bp, Mus musculus
atgagccagttgtgcctagttcttt

SEQ ID NO: 255597 - DNA, 25 bp, Mus musculus
atgagccatcatactgtcaccagcc

SEQ ID NO: 255598 - DNA, 25 bp, Mus musculus
atgagccatcatctgctccaggaga

SEQ ID NO: 255599 - DNA, 25 bp, Mus musculus
atgagccatcatgtgctccaggaga

SEQ ID NO: 255600 - DNA, 25 bp, Mus musculus
atgagccatcattctgtcaccagcc

SEQ ID NO: 255601 - DNA, 25 bp, Mus musculus
atgagccatcccatttttaacctat

SEQ ID NO: 255602 - DNA, 25 bp, Mus musculus
atgagccatcccttttttaacctat

SEQ ID NO: 255603 - DNA, 25 bp, Mus musculus
atgagccatgacagctatgcacgtc

SEQ ID NO: 255604 - DNA, 25 bp, Mus musculus
atgagccatgactgctatgcacgtc

SEQ ID NO: 255605 - DNA, 25 bp, Mus musculus
atgagcccaaatacaaccaggaggt

SEQ ID NO: 255606 - DNA, 25 bp, Mus musculus
atgagcccaaattcaaccaggaggt

SEQ ID NO: 255607 - DNA, 25 bp, Mus musculus
atgagcccaaccctttcagtaaata

SEQ ID NO: 255608 - DNA, 25 bp, Mus musculus
atgagcccaaccgtttcagtaaata

SEQ ID NO: 255609 - DNA, 25 bp, Mus musculus
atgagcccaagcaaggactctgcag

SEQ ID NO: 255610 - DNA, 25 bp, Mus musculus
atgagcccaagctaggactctgcag

SEQ ID NO: 255611 - DNA, 25 bp, Mus musculus
atgagcccacctactgcttgtgtaa

SEQ ID NO: 255612 - DNA, 25 bp, Mus musculus
atgagcccaccttctgcttgtgtaa

SEQ ID NO: 255613 - DNA, 25 bp, Mus musculus
atgagcccactgagctaggatttgc

SEQ ID NO: 255614 - DNA, 25 bp, Mus musculus
atgagcccactgtgctaggatttgc

SEQ ID NO: 255615 - DNA, 25 bp, Mus musculus
atgagcccagcaccgatcggtcagc

SEQ ID NO: 255616 - DNA, 25 bp, Mus musculus
atgagcccagcagcgatcggtcagc

SEQ ID NO: 255617 - DNA, 25 bp, Mus musculus
atgagcccatgtctgcacgcatgca

SEQ ID NO: 255618 - DNA, 25 bp, Mus musculus
atgagcccatgtgtgcacgcatgca

SEQ ID NO: 255619 - DNA, 25 bp, Mus musculus
atgagccccaagaatggtgcatgtt

SEQ ID NO: 255620 - DNA, 25 bp, Mus musculus
atgagccccaagtatggtgcatgtt

SEQ ID NO: 255621 - DNA, 25 bp, Mus musculus
atgagccccacaacctaggaggcag

SEQ ID NO: 255622 - DNA, 25 bp, Mus musculus
atgagccccacatcctaggaggcag

SEQ ID NO: 255623 - DNA, 25 bp, Mus musculus
atgagccccgcacccatgctgaacc

SEQ ID NO: 255624 - DNA, 25 bp, Mus musculus
atgagccccgcagccatgctgaacc

SEQ ID NO: 255625 - DNA, 25 bp, Mus musculus
atgagcccctgaagctttgtcagtt

SEQ ID NO: 255626 - DNA, 25 bp, Mus musculus
atgagcccctgatgctttgtcagtt

SEQ ID NO: 255627 - DNA, 25 bp, Mus musculus
atgagcccctggactggacgcagga

SEQ ID NO: 255628 - DNA, 25 bp, Mus musculus
atgagcccctggtctggacgcagga

SEQ ID NO: 255629 - DNA, 25 bp, Mus musculus
atgagcccgatcctgcggcaggaaa

SEQ ID NO: 255630 - DNA, 25 bp, Mus musculus
atgagcccgatcgtgcggcaggaaa

SEQ ID NO: 255631 - DNA, 25 bp, Mus musculus
atgagcccgggcagcatgcctgtgt

SEQ ID NO: 255632 - DNA, 25 bp, Mus musculus
atgagcccgggctgcatgcctgtgt

SEQ ID NO: 255633 - DNA, 25 bp, Mus musculus
atgagcccgtgaccgtgtcagtgaa

SEQ ID NO: 255634 - DNA, 25 bp, Mus musculus
atgagcccgtgagcgtgtcagtgaa

SEQ ID NO: 255635 - DNA, 25 bp, Mus musculus
atgagccctaatacttgatacagga

SEQ ID NO: 255636 - DNA, 25 bp, Mus musculus
atgagccctaattcttgatacagga

SEQ ID NO: 255637 - DNA, 25 bp, Mus musculus
atgagccctacgctgtaggcatgga

SEQ ID NO: 255638 - DNA, 25 bp, Mus musculus
atgagccctacggtgtaggcatgga

SEQ ID NO: 255639 - DNA, 25 bp, Mus musculus
atgagccctcttaatgtacccatcc

SEQ ID NO: 255640 - DNA, 25 bp, Mus musculus
atgagccctctttatgtacccatcc

SEQ ID NO: 255641 - DNA, 25 bp, Mus musculus
atgagccctggtccaatgaacccct

SEQ ID NO: 255642 - DNA, 25 bp, Mus musculus
atgagccctggtgcaatgaacccct

SEQ ID NO: 255643 - DNA, 25 bp, Mus musculus
atgagccgaggaaacagcttgtttt

SEQ ID NO: 255644 - DNA, 25 bp, Mus musculus
atgagccgaggatacagcttgtttt

SEQ ID NO: 255645 - DNA, 25 bp, Mus musculus
atgagccgatgcaggacaaccaaat

SEQ ID NO: 255646 - DNA, 25 bp, Mus musculus
atgagccgatgctggacaaccaaat

SEQ ID NO: 255647 - DNA, 25 bp, Mus musculus
atgagccggcagcatcacagaatct

SEQ ID NO: 255648 - DNA, 25 bp, Mus musculus
atgagccggcaggatcacagaatct

SEQ ID NO: 255649 - DNA, 25 bp, Mus musculus
atgagccgggttctccatccaggct

SEQ ID NO: 255650 - DNA, 25 bp, Mus musculus
atgagccgggttgtccatccaggct

SEQ ID NO: 255651 - DNA, 25 bp, Mus musculus
atgagccggtgactggacctgcttc

SEQ ID NO: 255652 - DNA, 25 bp, Mus musculus
atgagccggtgagtggacctgcttc

SEQ ID NO: 255653 - DNA, 25 bp, Mus musculus
atgagccgtaacaaatgtggccgta

SEQ ID NO: 255654 - DNA, 25 bp, Mus musculus
atgagccgtaactaatgtggccgta

SEQ ID NO: 255655 - DNA, 25 bp, Mus musculus
atgagccgtatacgtgcagcccgtg

SEQ ID NO: 255656 - DNA, 25 bp, Mus musculus
atgagccgtataggtgcagcccgtg

SEQ ID NO: 255657 - DNA, 25 bp, Mus musculus
atgagccgtcttactgcaaaacacc

SEQ ID NO: 255658 - DNA, 25 bp, Mus musculus
atgagccgtctttctgcaaaacacc

SEQ ID NO: 255659 - DNA, 25 bp, Mus musculus
atgagccgtggacacactgtgctaa

SEQ ID NO: 255660 - DNA, 25 bp, Mus musculus
atgagccgtggagacactgtgctaa

SEQ ID NO: 255661 - DNA, 25 bp, Mus musculus
atgagccgttacctgaggagccctg

SEQ ID NO: 255662 - DNA, 25 bp, Mus musculus
atgagccgttacgtgaggagccctg

SEQ ID NO: 255663 - DNA, 25 bp, Mus musculus
atgagcctaaagacactggcagcgt

SEQ ID NO: 255664 - DNA, 25 bp, Mus musculus
atgagcctaaagtcactggcagcgt

SEQ ID NO: 255665 - DNA, 25 bp, Mus musculus
atgagcctaacacccggtgcagtca

SEQ ID NO: 255666 - DNA, 25 bp, Mus musculus
atgagcctaacagccggtgcagtca

SEQ ID NO: 255667 - DNA, 25 bp, Mus musculus
atgagcctaagcacattccattccc

SEQ ID NO: 255668 - DNA, 25 bp, Mus musculus
atgagcctaagctcattccattccc

SEQ ID NO: 255669 - DNA, 25 bp, Mus musculus
atgagcctaaggcatggttttgtgt

SEQ ID NO: 255670 - DNA, 25 bp, Mus musculus
atgagcctaagggatggttttgtgt

SEQ ID NO: 255671 - DNA, 25 bp, Mus musculus
atgagcctacacacttgagcctaca

SEQ ID NO: 255672 - DNA, 25 bp, Mus musculus
atgagcctacactcttgagcctaca

SEQ ID NO: 255673 - DNA, 25 bp, Mus musculus
atgagcctacatactgcttgtgcca

SEQ ID NO: 255674 - DNA, 25 bp, Mus musculus
atgagcctacattctgcttgtgcca

SEQ ID NO: 255675 - DNA, 25 bp, Mus musculus
atgagcctagaactcctctatcagg

SEQ ID NO: 255676 - DNA, 25 bp, Mus musculus
atgagcctagaagtcctctatcagg

SEQ ID NO: 255677 - DNA, 25 bp, Mus musculus
atgagcctatggctgccattccttt

SEQ ID NO: 255678 - DNA, 25 bp, Mus musculus
atgagcctatgggtgccattccttt

SEQ ID NO: 255679 - DNA, 25 bp, Mus musculus
atgagcctcaggaggccctaggcta

SEQ ID NO: 255680 - DNA, 25 bp, Mus musculus
atgagcctcaggtggccctaggcta

SEQ ID NO: 255681 - DNA, 25 bp, Mus musculus
atgagcctcatgacaccagcttggg

SEQ ID NO: 255682 - DNA, 25 bp, Mus musculus
atgagcctcatgtcaccagcttggg

SEQ ID NO: 255683 - DNA, 25 bp, Mus musculus
atgagcctccaacacaacggcagtt

SEQ ID NO: 255684 - DNA, 25 bp, Mus musculus
atgagcctccaacctatgctcttgg

SEQ ID NO: 255685 - DNA, 25 bp, Mus musculus
atgagcctccaagacaacggcagtt

SEQ ID NO: 255686 - DNA, 25 bp, Mus musculus
atgagcctccaagctatgctcttgg

SEQ ID NO: 255687 - DNA, 25 bp, Mus musculus
atgagcctcctgaagcttctcctgg

SEQ ID NO: 255688 - DNA, 25 bp, Mus musculus
atgagcctcctgatacagtgtcaga

SEQ ID NO: 255689 - DNA, 25 bp, Mus musculus
atgagcctcctgtagcttctcctgg

SEQ ID NO: 255690 - DNA, 25 bp, Mus musculus
atgagcctcctgttacagtgtcaga

SEQ ID NO: 255691 - DNA, 25 bp, Mus musculus
atgagcctcgataagccttcctacc

SEQ ID NO: 255692 - DNA, 25 bp, Mus musculus
atgagcctcgattagccttcctacc

SEQ ID NO: 255693 - DNA, 25 bp, Mus musculus
atgagcctgcaaaccaaattctgaa

SEQ ID NO: 255694 - DNA, 25 bp, Mus musculus
atgagcctgcaacgctgcccttggt

SEQ ID NO: 255695 - DNA, 25 bp, Mus musculus
atgagcctgcaaggctgcccttggt

SEQ ID NO: 255696 - DNA, 25 bp, Mus musculus
atgagcctgcaatccaaattctgaa

SEQ ID NO: 255697 - DNA, 25 bp, Mus musculus
atgagcctgcgaaaacatgaatcaa

SEQ ID NO: 255698 - DNA, 25 bp, Mus musculus
atgagcctgcgataacatgaatcaa

SEQ ID NO: 255699 - DNA, 25 bp, Mus musculus
atgagcctgggcagatattctatag

SEQ ID NO: 255700 - DNA, 25 bp, Mus musculus
atgagcctgggctgatattctatag

SEQ ID NO: 255701 - DNA, 25 bp, Mus musculus
atgagccttaagatctcagatgaga

SEQ ID NO: 255702 - DNA, 25 bp, Mus musculus
atgagccttaagttctcagatgaga

SEQ ID NO: 255703 - DNA, 25 bp, Mus musculus
atgagccttacaattccgatgagga

SEQ ID NO: 255704 - DNA, 25 bp, Mus musculus
atgagccttacatttccgatgagga

SEQ ID NO: 255705 - DNA, 25 bp, Mus musculus
atgagccttgtcaaccaagtaccca

SEQ ID NO: 255706 - DNA, 25 bp, Mus musculus
atgagccttgtctaccaagtaccca

SEQ ID NO: 255707 - DNA, 25 bp, Mus musculus
atgagcgaaatactaaccctgagtt

SEQ ID NO: 255708 - DNA, 25 bp, Mus musculus
atgagcgaaatagtaaccctgagtt

SEQ ID NO: 255709 - DNA, 25 bp, Mus musculus
atgagcgaccttacacctgtgacat

SEQ ID NO: 255710 - DNA, 25 bp, Mus musculus
atgagcgacctttcacctgtgacat

SEQ ID NO: 255711 - DNA, 25 bp, Mus musculus
atgagcgactgaaggctatggacca

SEQ ID NO: 255712 - DNA, 25 bp, Mus musculus
atgagcgactgatggctatggacca

SEQ ID NO: 255713 - DNA, 25 bp, Mus musculus
atgagcgaggtcagcttctttcttt

SEQ ID NO: 255714 - DNA, 25 bp, Mus musculus
atgagcgaggtctgcttctttcttt

SEQ ID NO: 255715 - DNA, 25 bp, Mus musculus
atgagcgagtttacgtatcctgtgt

SEQ ID NO: 255716 - DNA, 25 bp, Mus musculus
atgagcgagttttcgtatcctgtgt

SEQ ID NO: 255717 - DNA, 25 bp, Mus musculus
atgagcgatgccagtttgaaacctt

SEQ ID NO: 255718 - DNA, 25 bp, Mus musculus
atgagcgatgcctgtttgaaacctt

SEQ ID NO: 255719 - DNA, 25 bp, Mus musculus
atgagcgattctcagttttgtattc

SEQ ID NO: 255720 - DNA, 25 bp, Mus musculus
atgagcgattctgagttttgtattc

SEQ ID NO: 255721 - DNA, 25 bp, Mus musculus
atgagcgcatgcaatcaagcctagg

SEQ ID NO: 255722 - DNA, 25 bp, Mus musculus
atgagcgcatgctatcaagcctagg

SEQ ID NO: 255723 - DNA, 25 bp, Mus musculus
atgagcgccggaatacgcgcgcttg

SEQ ID NO: 255724 - DNA, 25 bp, Mus musculus
atgagcgccggattacgcgcgcttg

SEQ ID NO: 255725 - DNA, 25 bp, Mus musculus
atgagcgcctagaacgaggcctgga

SEQ ID NO: 255726 - DNA, 25 bp, Mus musculus
atgagcgcctagtacgaggcctgga

SEQ ID NO: 255727 - DNA, 25 bp, Mus musculus
atgagcgctaagactctaccatgga

SEQ ID NO: 255728 - DNA, 25 bp, Mus musculus
atgagcgctaagtctctaccatgga

SEQ ID NO: 255729 - DNA, 25 bp, Mus musculus
atgagcgctgccagactgcgtgcag

SEQ ID NO: 255730 - DNA, 25 bp, Mus musculus
atgagcgctgcctgactgcgtgcag

SEQ ID NO: 255731 - DNA, 25 bp, Mus musculus
atgagcgcttccagaagcagttcct

SEQ ID NO: 255732 - DNA, 25 bp, Mus musculus
atgagcgcttcctgaagcagttcct

SEQ ID NO: 255733 - DNA, 25 bp, Mus musculus
atgagcggcatgagcactgtgactg

SEQ ID NO: 255734 - DNA, 25 bp, Mus musculus
atgagcggcatgtgcactgtgactg

SEQ ID NO: 255735 - DNA, 25 bp, Mus musculus
atgagcggctcgctgacttcgcatt

SEQ ID NO: 255736 - DNA, 25 bp, Mus musculus
atgagcggctcggtgacttcgcatt

SEQ ID NO: 255737 - DNA, 25 bp, Mus musculus
atgagcgggactcgccatgacctac

SEQ ID NO: 255738 - DNA, 25 bp, Mus musculus
atgagcgggactggccatgacctac

SEQ ID NO: 255739 - DNA, 25 bp, Mus musculus
atgagcgggctgctatcctcaatgt

SEQ ID NO: 255740 - DNA, 25 bp, Mus musculus
atgagcgggctggtatcctcaatgt

SEQ ID NO: 255741 - DNA, 25 bp, Mus musculus
atgagcggtccaaggcccagtggct

SEQ ID NO: 255742 - DNA, 25 bp, Mus musculus
atgagcggtccatggcccagtggct

SEQ ID NO: 255743 - DNA, 25 bp, Mus musculus
atgagcgtcacaccggaagcattaa

SEQ ID NO: 255744 - DNA, 25 bp, Mus musculus
atgagcgtcacagcggaagcattaa

SEQ ID NO: 255745 - DNA, 25 bp, Mus musculus
atgagcgtcagacaaaatgcctaga

SEQ ID NO: 255746 - DNA, 25 bp, Mus musculus
atgagcgtcagagaaaatgcctaga

SEQ ID NO: 255747 - DNA, 25 bp, Mus musculus
atgagcgtctacagcattgaccata

SEQ ID NO: 255748 - DNA, 25 bp, Mus musculus
atgagcgtctactgcattgaccata

SEQ ID NO: 255749 - DNA, 25 bp, Mus musculus
atgagcgtgtgaaagtcccggcctg

SEQ ID NO: 255750 - DNA, 25 bp, Mus musculus
atgagcgtgtgatagtcccggcctg

SEQ ID NO: 255751 - DNA, 25 bp, Mus musculus
atgagctaaaccctgatgacttaag

SEQ ID NO: 255752 - DNA, 25 bp, Mus musculus
atgagctaaaccgtgatgacttaag

SEQ ID NO: 255753 - DNA, 25 bp, Mus musculus
atgagctaataactgggcttttaat

SEQ ID NO: 255754 - DNA, 25 bp, Mus musculus
atgagctaataagtgggcttttaat

SEQ ID NO: 255755 - DNA, 25 bp, Mus musculus
atgagctacagaagctgcggcaccg

SEQ ID NO: 255756 - DNA, 25 bp, Mus musculus
atgagctacagatgctgcggcaccg

SEQ ID NO: 255757 - DNA, 25 bp, Mus musculus
atgagctacatcaactttcttttcc

SEQ ID NO: 255758 - DNA, 25 bp, Mus musculus
atgagctacatctactttcttttcc

SEQ ID NO: 255759 - DNA, 25 bp, Mus musculus
atgagctactatcagagggtggtct

SEQ ID NO: 255760 - DNA, 25 bp, Mus musculus
atgagctactatgagagggtggtct

SEQ ID NO: 255761 - DNA, 25 bp, Mus musculus
atgagctactcaaggaacaatccaa

SEQ ID NO: 255762 - DNA, 25 bp, Mus musculus
atgagctactcatggaacaatccaa

SEQ ID NO: 255763 - DNA, 25 bp, Mus musculus
atgagctagctgatcactaactctt

SEQ ID NO: 255764 - DNA, 25 bp, Mus musculus
atgagctagctgttcactaactctt

SEQ ID NO: 255765 - DNA, 25 bp, Mus musculus
atgagctaggtgctcaggttaactt

SEQ ID NO: 255766 - DNA, 25 bp, Mus musculus
atgagctaggtggtcaggttaactt

SEQ ID NO: 255767 - DNA, 25 bp, Mus musculus
atgagctatgcaatctgttactaga

SEQ ID NO: 255768 - DNA, 25 bp, Mus musculus
atgagctatgcattctgttactaga

SEQ ID NO: 255769 - DNA, 25 bp, Mus musculus
atgagctatgtcaccatcgtggcca

SEQ ID NO: 255770 - DNA, 25 bp, Mus musculus
atgagctatgtctccatcgtggcca

SEQ ID NO: 255771 - DNA, 25 bp, Mus musculus
atgagctcactgaggcagatgtggt

SEQ ID NO: 255772 - DNA, 25 bp, Mus musculus
atgagctcactgctaatggccgagt

SEQ ID NO: 255773 - DNA, 25 bp, Mus musculus
atgagctcactggtaatggccgagt

SEQ ID NO: 255774 - DNA, 25 bp, Mus musculus
atgagctcactgtggcagatgtggt

SEQ ID NO: 255775 - DNA, 25 bp, Mus musculus
atgagctcagaactgcagatcaact

SEQ ID NO: 255776 - DNA, 25 bp, Mus musculus
atgagctcagaagtgcagatcaact

SEQ ID NO: 255777 - DNA, 25 bp, Mus musculus
atgagctcagcgcaggagtcctgcc

SEQ ID NO: 255778 - DNA, 25 bp, Mus musculus
atgagctcagcggaggagtcctgcc

SEQ ID NO: 255779 - DNA, 25 bp, Mus musculus
atgagctcaggtacaagctaaggat

SEQ ID NO: 255780 - DNA, 25 bp, Mus musculus
atgagctcaggttcaagctaaggat

SEQ ID NO: 255781 - DNA, 25 bp, Mus musculus
atgagctccaaacaccttcttggtg

SEQ ID NO: 255782 - DNA, 25 bp, Mus musculus
atgagctccaaagaccttcttggtg

SEQ ID NO: 255783 - DNA, 25 bp, Mus musculus
atgagctccagcatcgacaggatgg

SEQ ID NO: 255784 - DNA, 25 bp, Mus musculus
atgagctccagcttcgacaggatgg

SEQ ID NO: 255785 - DNA, 25 bp, Mus musculus
atgagctccatgaaacccactctgt

SEQ ID NO: 255786 - DNA, 25 bp, Mus musculus
atgagctccatgagccttttggatc

SEQ ID NO: 255787 - DNA, 25 bp, Mus musculus
atgagctccatgtaacccactctgt

SEQ ID NO: 255788 - DNA, 25 bp, Mus musculus
atgagctccatgtgccttttggatc

SEQ ID NO: 255789 - DNA, 25 bp, Mus musculus
atgagctccctgctctgggactgcc

SEQ ID NO: 255790 - DNA, 25 bp, Mus musculus
atgagctccctggtctgggactgcc

SEQ ID NO: 255791 - DNA, 25 bp, Mus musculus
atgagctcccttacgtgggtaaaca

SEQ ID NO: 255792 - DNA, 25 bp, Mus musculus
atgagctccctttcgtgggtaaaca

SEQ ID NO: 255793 - DNA, 25 bp, Mus musculus
atgagctccggaaccaagtccacgt

SEQ ID NO: 255794 - DNA, 25 bp, Mus musculus
atgagctccggatccaagtccacgt

SEQ ID NO: 255795 - DNA, 25 bp, Mus musculus
atgagctcgcccagatctttcacat

SEQ ID NO: 255796 - DNA, 25 bp, Mus musculus
atgagctcgccctgatctttcacat

SEQ ID NO: 255797 - DNA, 25 bp, Mus musculus
atgagctcggaaatccggagcaaat

SEQ ID NO: 255798 - DNA, 25 bp, Mus musculus
atgagctcggaattccggagcaaat

SEQ ID NO: 255799 - DNA, 25 bp, Mus musculus
atgagctcggttctgatgttcggtc

SEQ ID NO: 255800 - DNA, 25 bp, Mus musculus
atgagctcggttgtgatgttcggtc

SEQ ID NO: 255801 - DNA, 25 bp, Mus musculus
atgagctctcaaatcctgggactgg

SEQ ID NO: 255802 - DNA, 25 bp, Mus musculus
atgagctctcaattcctgggactgg

SEQ ID NO: 255803 - DNA, 25 bp, Mus musculus
atgagctctgacatcgaaacgaggt

SEQ ID NO: 255804 - DNA, 25 bp, Mus musculus
atgagctctgacttcgaaacgaggt

SEQ ID NO: 255805 - DNA, 25 bp, Mus musculus
atgagctctggcatatatggcaagt

SEQ ID NO: 255806 - DNA, 25 bp, Mus musculus
atgagctctggcttatatggcaagt

SEQ ID NO: 255807 - DNA, 25 bp, Mus musculus
atgagctctgttcgttccgaatgtg

SEQ ID NO: 255808 - DNA, 25 bp, Mus musculus
atgagctctgttggttccgaatgtg

SEQ ID NO: 255809 - DNA, 25 bp, Mus musculus
atgagctcttaacattccaagcaga

SEQ ID NO: 255810 - DNA, 25 bp, Mus musculus
atgagctcttaagattccaagcaga

SEQ ID NO: 255811 - DNA, 25 bp, Mus musculus
atgagctcttacagccttctttaag

SEQ ID NO: 255812 - DNA, 25 bp, Mus musculus
atgagctcttactgccttctttaag

SEQ ID NO: 255813 - DNA, 25 bp, Mus musculus
atgagctcttgtatgccatggaaat

SEQ ID NO: 255814 - DNA, 25 bp, Mus musculus
atgagctcttgtttgccatggaaat

SEQ ID NO: 255815 - DNA, 25 bp, Mus musculus
atgagctgaaataggtagtcactgt

SEQ ID NO: 255816 - DNA, 25 bp, Mus musculus
atgagctgaaattggtagtcactgt

SEQ ID NO: 255817 - DNA, 25 bp, Mus musculus
atgagctgaaggcatccccaaaagg

SEQ ID NO: 255818 - DNA, 25 bp, Mus musculus
atgagctgaagggatccccaaaagg

SEQ ID NO: 255819 - DNA, 25 bp, Mus musculus
atgagctgagtgaaattgcaagaac

SEQ ID NO: 255820 - DNA, 25 bp, Mus musculus
atgagctgagtgtaattgcaagaac

SEQ ID NO: 255821 - DNA, 25 bp, Mus musculus
atgagctgagttctactttgacccc

SEQ ID NO: 255822 - DNA, 25 bp, Mus musculus
atgagctgagttgtactttgacccc

SEQ ID NO: 255823 - DNA, 25 bp, Mus musculus
atgagctgcacgcaatgccagaaga

SEQ ID NO: 255824 - DNA, 25 bp, Mus musculus
atgagctgcacggaatgccagaaga

SEQ ID NO: 255825 - DNA, 25 bp, Mus musculus
atgagctgccacaagacatctcgct

SEQ ID NO: 255826 - DNA, 25 bp, Mus musculus
atgagctgccaccataggcttcttt

SEQ ID NO: 255827 - DNA, 25 bp, Mus musculus
atgagctgccacgataggcttcttt

SEQ ID NO: 255828 - DNA, 25 bp, Mus musculus
atgagctgccactagacatctcgct

SEQ ID NO: 255829 - DNA, 25 bp, Mus musculus
atgagctgcccaacattaccaatgc

SEQ ID NO: 255830 - DNA, 25 bp, Mus musculus
atgagctgcccatcattaccaatgc

SEQ ID NO: 255831 - DNA, 25 bp, Mus musculus
atgagctgcccgaccgcaagagttg

SEQ ID NO: 255832 - DNA, 25 bp, Mus musculus
atgagctgcccgtccgcaagagttg

SEQ ID NO: 255833 - DNA, 25 bp, Mus musculus
atgagctgcctacctaagcctggta

SEQ ID NO: 255834 - DNA, 25 bp, Mus musculus
atgagctgcctagctaagcctggta

SEQ ID NO: 255835 - DNA, 25 bp, Mus musculus
atgagctgcctgacggccaagtcat

SEQ ID NO: 255836 - DNA, 25 bp, Mus musculus
atgagctgcctgtcggccaagtcat

SEQ ID NO: 255837 - DNA, 25 bp, Mus musculus
atgagctgcggacggagtattacga

SEQ ID NO: 255838 - DNA, 25 bp, Mus musculus
atgagctgcggagggagtattacga

SEQ ID NO: 255839 - DNA, 25 bp, Mus musculus
atgagctgctgcagtgctttctaga

SEQ ID NO: 255840 - DNA, 25 bp, Mus musculus
atgagctgctgctgtgctttctaga

SEQ ID NO: 255841 - DNA, 25 bp, Mus musculus
atgagctggataaattgccaagcct

SEQ ID NO: 255842 - DNA, 25 bp, Mus musculus
atgagctggatatattgccaagcct

SEQ ID NO: 255843 - DNA, 25 bp, Mus musculus
atgagctggcccatatgagccagga

SEQ ID NO: 255844 - DNA, 25 bp, Mus musculus
atgagctggcccttatgagccagga

SEQ ID NO: 255845 - DNA, 25 bp, Mus musculus
atgagctggctcatatgttgaaggg

SEQ ID NO: 255846 - DNA, 25 bp, Mus musculus
atgagctggctcttatgttgaaggg

SEQ ID NO: 255847 - DNA, 25 bp, Mus musculus
atgagctgggtgactcatgaccctc

SEQ ID NO: 255848 - DNA, 25 bp, Mus musculus
atgagctgggtgtctcatgaccctc

SEQ ID NO: 255849 - DNA, 25 bp, Mus musculus
atgagctgtcttaattcatcagtta

SEQ ID NO: 255850 - DNA, 25 bp, Mus musculus
atgagctgtctttattcatcagtta

SEQ ID NO: 255851 - DNA, 25 bp, Mus musculus
atgagctgttgcatttgttgccttt

SEQ ID NO: 255852 - DNA, 25 bp, Mus musculus
atgagctgttgcttttgttgccttt

SEQ ID NO: 255853 - DNA, 25 bp, Mus musculus
atgagctgtttgaaatcaccctggt

SEQ ID NO: 255854 - DNA, 25 bp, Mus musculus
atgagctgtttgcatatacatatat

SEQ ID NO: 255855 - DNA, 25 bp, Mus musculus
atgagctgtttggatatacatatat

SEQ ID NO: 255856 - DNA, 25 bp, Mus musculus
atgagctgtttgtaatcaccctggt

SEQ ID NO: 255857 - DNA, 25 bp, Mus musculus
atgagcttaagtatgcccttcttca

SEQ ID NO: 255858 - DNA, 25 bp, Mus musculus
atgagcttaagtttgcccttcttca

SEQ ID NO: 255859 - DNA, 25 bp, Mus musculus
atgagcttattcataccatgtataa

SEQ ID NO: 255860 - DNA, 25 bp, Mus musculus
atgagcttattcttaccatgtataa

SEQ ID NO: 255861 - DNA, 25 bp, Mus musculus
atgagcttcagtctcagtgcaagga

SEQ ID NO: 255862 - DNA, 25 bp, Mus musculus
atgagcttcagtgtcagtgcaagga

SEQ ID NO: 255863 - DNA, 25 bp, Mus musculus
atgagcttccagattcagccgaggc

SEQ ID NO: 255864 - DNA, 25 bp, Mus musculus
atgagcttccagctgaagacgcgca

SEQ ID NO: 255865 - DNA, 25 bp, Mus musculus
atgagcttccaggtgaagacgcgca

SEQ ID NO: 255866 - DNA, 25 bp, Mus musculus
atgagcttccagtttcagccgaggc

SEQ ID NO: 255867 - DNA, 25 bp, Mus musculus
atgagcttctgtctctgcactgaat

SEQ ID NO: 255868 - DNA, 25 bp, Mus musculus
atgagcttctgtgtctgcactgaat

SEQ ID NO: 255869 - DNA, 25 bp, Mus musculus
atgagcttgctcagttcgggatcat

SEQ ID NO: 255870 - DNA, 25 bp, Mus musculus
atgagcttgctctgttcgggatcat

SEQ ID NO: 255871 - DNA, 25 bp, Mus musculus
atgagcttgcttactgtgatccctt

SEQ ID NO: 255872 - DNA, 25 bp, Mus musculus
atgagcttgctttctgtgatccctt

SEQ ID NO: 255873 - DNA, 25 bp, Mus musculus
atgagcttggccagagcgtcacgga

SEQ ID NO: 255874 - DNA, 25 bp, Mus musculus
atgagcttggcctgagcgtcacgga

SEQ ID NO: 255875 - DNA, 25 bp, Mus musculus
atgagcttggctcagactccattga

SEQ ID NO: 255876 - DNA, 25 bp, Mus musculus
atgagcttggctgagactccattga

SEQ ID NO: 255877 - DNA, 25 bp, Mus musculus
atgagcttgtagacacgattcacct

SEQ ID NO: 255878 - DNA, 25 bp, Mus musculus
atgagcttgtagtcacgattcacct

SEQ ID NO: 255879 - DNA, 25 bp, Mus musculus
atgagcttgtgtcttgcatctctct

SEQ ID NO: 255880 - DNA, 25 bp, Mus musculus
atgagcttgtgtgttgcatctctct

SEQ ID NO: 255881 - DNA, 25 bp, Mus musculus
atgagcttgttcataacctcagctt

SEQ ID NO: 255882 - DNA, 25 bp, Mus musculus
atgagcttgttcttaacctcagctt

SEQ ID NO: 255883 - DNA, 25 bp, Mus musculus
atgagctttactatcgaggccactt

SEQ ID NO: 255884 - DNA, 25 bp, Mus musculus
atgagctttactttcgaggccactt

SEQ ID NO: 255885 - DNA, 25 bp, Mus musculus
atgagctttcccatagcctatactt

SEQ ID NO: 255886 - DNA, 25 bp, Mus musculus
atgagctttcccttagcctatactt

SEQ ID NO: 255887 - DNA, 25 bp, Mus musculus
atgagctttcggatgtttttccaca

SEQ ID NO: 255888 - DNA, 25 bp, Mus musculus
atgagctttcggttgtttttccaca

SEQ ID NO: 255889 - DNA, 25 bp, Mus musculus
atgagctttctgagtgagaggcatc

SEQ ID NO: 255890 - DNA, 25 bp, Mus musculus
atgagctttctgtgtgagaggcatc

SEQ ID NO: 255891 - DNA, 25 bp, Mus musculus
atgagctttcttacagttgtgaggc

SEQ ID NO: 255892 - DNA, 25 bp, Mus musculus
atgagctttctttcagttgtgaggc

SEQ ID NO: 255893 - DNA, 25 bp, Mus musculus
atgagctttgtgaaggaagttcctg

SEQ ID NO: 255894 - DNA, 25 bp, Mus musculus
atgagctttgtgtaggaagttcctg

SEQ ID NO: 255895 - DNA, 25 bp, Mus musculus
atgagcttttatctctctttcccat

SEQ ID NO: 255896 - DNA, 25 bp, Mus musculus
atgagcttttatgtctctttcccat

SEQ ID NO: 255897 - DNA, 25 bp, Mus musculus
atgaggaaaaccagggcacacacag

SEQ ID NO: 255898 - DNA, 25 bp, Mus musculus
atgaggaaaacctgggcacacacag

SEQ ID NO: 255899 - DNA, 25 bp, Mus musculus
atgaggaaactgaccagcccaggaa

SEQ ID NO: 255900 - DNA, 25 bp, Mus musculus
atgaggaaactgtccagcccaggaa

SEQ ID NO: 255901 - DNA, 25 bp, Mus musculus
atgaggaaatcgcatcagtagccga

SEQ ID NO: 255902 - DNA, 25 bp, Mus musculus
atgaggaaatcggatcagtagccga

SEQ ID NO: 255903 - DNA, 25 bp, Mus musculus
atgaggaaccataaaccaccaaatt

SEQ ID NO: 255904 - DNA, 25 bp, Mus musculus
atgaggaaccattaaccaccaaatt

SEQ ID NO: 255905 - DNA, 25 bp, Mus musculus
atgaggaactcgacgctatgatgaa

SEQ ID NO: 255906 - DNA, 25 bp, Mus musculus
atgaggaactcgtcgctatgatgaa

SEQ ID NO: 255907 - DNA, 25 bp, Mus musculus
atgaggaagagcaagtcccacccac

SEQ ID NO: 255908 - DNA, 25 bp, Mus musculus
atgaggaagagctagtcccacccac

SEQ ID NO: 255909 - DNA, 25 bp, Mus musculus
atgaggaataacattccataccaaa

SEQ ID NO: 255910 - DNA, 25 bp, Mus musculus
atgaggaataactttccataccaaa

SEQ ID NO: 255911 - DNA, 25 bp, Mus musculus
atgaggaatgctccatctttcccct

SEQ ID NO: 255912 - DNA, 25 bp, Mus musculus
atgaggaatgctgcatctttcccct

SEQ ID NO: 255913 - DNA, 25 bp, Mus musculus
atgaggacacctcctgatcagcaag

SEQ ID NO: 255914 - DNA, 25 bp, Mus musculus
atgaggacacctgctgatcagcaag

SEQ ID NO: 255915 - DNA, 25 bp, Mus musculus
atgaggacacggacaagcttctggc

SEQ ID NO: 255916 - DNA, 25 bp, Mus musculus
atgaggacacggtcaagcttctggc

SEQ ID NO: 255917 - DNA, 25 bp, Mus musculus
atgaggacagccagccctatgtgtg

SEQ ID NO: 255918 - DNA, 25 bp, Mus musculus
atgaggacagcctgccctatgtgtg

SEQ ID NO: 255919 - DNA, 25 bp, Mus musculus
atgaggacagtcaccaactacttca

SEQ ID NO: 255920 - DNA, 25 bp, Mus musculus
atgaggacagtctccaactacttca

SEQ ID NO: 255921 - DNA, 25 bp, Mus musculus
atgaggacagtgactgtgcctcgct

SEQ ID NO: 255922 - DNA, 25 bp, Mus musculus
atgaggacagtgtctgtgcctcgct

SEQ ID NO: 255923 - DNA, 25 bp, Mus musculus
atgaggacccaactttggatcccca

SEQ ID NO: 255924 - DNA, 25 bp, Mus musculus
atgaggacccaagtttggatcccca

SEQ ID NO: 255925 - DNA, 25 bp, Mus musculus
atgaggacccacatggaccagagag

SEQ ID NO: 255926 - DNA, 25 bp, Mus musculus
atgaggacccacttggaccagagag

SEQ ID NO: 255927 - DNA, 25 bp, Mus musculus
atgaggacccgacttcgtatcccat

SEQ ID NO: 255928 - DNA, 25 bp, Mus musculus
atgaggacccgagttcgtatcccat

SEQ ID NO: 255929 - DNA, 25 bp, Mus musculus
atgaggaccctgatattgccgtctt

SEQ ID NO: 255930 - DNA, 25 bp, Mus musculus
atgaggaccctgttattgccgtctt

SEQ ID NO: 255931 - DNA, 25 bp, Mus musculus
atgaggaccgctatggatttctgtg

SEQ ID NO: 255932 - DNA, 25 bp, Mus musculus
atgaggaccgctttggatttctgtg

SEQ ID NO: 255933 - DNA, 25 bp, Mus musculus
atgaggaccttcaggctgattggag

SEQ ID NO: 255934 - DNA, 25 bp, Mus musculus
atgaggaccttctggctgattggag

SEQ ID NO: 255935 - DNA, 25 bp, Mus musculus
atgaggaccttgagcacatcctcct

SEQ ID NO: 255936 - DNA, 25 bp, Mus musculus
atgaggaccttgtgcacatcctcct

SEQ ID NO: 255937 - DNA, 25 bp, Mus musculus
atgaggacggacatggcgccagaaa

SEQ ID NO: 255938 - DNA, 25 bp, Mus musculus
atgaggacggacttggcgccagaaa

SEQ ID NO: 255939 - DNA, 25 bp, Mus musculus
atgaggactactcggaggtacagat

SEQ ID NO: 255940 - DNA, 25 bp, Mus musculus
atgaggactactgggaggtacagat

SEQ ID NO: 255941 - DNA, 25 bp, Mus musculus
atgaggactcaaagtataagctgtt

SEQ ID NO: 255942 - DNA, 25 bp, Mus musculus
atgaggactcaatgtataagctgtt

SEQ ID NO: 255943 - DNA, 25 bp, Mus musculus
atgaggactcagcagccttgcttct

SEQ ID NO: 255944 - DNA, 25 bp, Mus musculus
atgaggactcaggagccttgcttct

SEQ ID NO: 255945 - DNA, 25 bp, Mus musculus
atgaggactgctctattcaggtatt

SEQ ID NO: 255946 - DNA, 25 bp, Mus musculus
atgaggactgctgtattcaggtatt

SEQ ID NO: 255947 - DNA, 25 bp, Mus musculus
atgaggactgtgacgttatgttaaa

SEQ ID NO: 255948 - DNA, 25 bp, Mus musculus
atgaggactgtgtcgttatgttaaa

SEQ ID NO: 255949 - DNA, 25 bp, Mus musculus
atgaggactttgaagctgcgctaac

SEQ ID NO: 255950 - DNA, 25 bp, Mus musculus
atgaggactttgtagctgcgctaac

SEQ ID NO: 255951 - DNA, 25 bp, Mus musculus
atgaggagagcaacccgatggagac

SEQ ID NO: 255952 - DNA, 25 bp, Mus musculus
atgaggagagcatcccgatggagac

SEQ ID NO: 255953 - DNA, 25 bp, Mus musculus
atgaggagatgaaccgcatgcatga

SEQ ID NO: 255954 - DNA, 25 bp, Mus musculus
atgaggagatgatccgcatgcatga

SEQ ID NO: 255955 - DNA, 25 bp, Mus musculus
atgaggagcacgctgctaaccagca

SEQ ID NO: 255956 - DNA, 25 bp, Mus musculus
atgaggagcacggtgctaaccagca

SEQ ID NO: 255957 - DNA, 25 bp, Mus musculus
atgaggagcccaacgtgaacagagg

SEQ ID NO: 255958 - DNA, 25 bp, Mus musculus
atgaggagcccatcgtgaacagagg

SEQ ID NO: 255959 - DNA, 25 bp, Mus musculus
atgaggagcgggacaccagatccac

SEQ ID NO: 255960 - DNA, 25 bp, Mus musculus
atgaggagcgggtcaccagatccac

SEQ ID NO: 255961 - DNA, 25 bp, Mus musculus
atgaggaggacaaagctcgcttccg

SEQ ID NO: 255962 - DNA, 25 bp, Mus musculus
atgaggaggacatagctcgcttccg

SEQ ID NO: 255963 - DNA, 25 bp, Mus musculus
atgaggaggaccctgttacagccct

SEQ ID NO: 255964 - DNA, 25 bp, Mus musculus
atgaggaggaccgtgttacagccct

SEQ ID NO: 255965 - DNA, 25 bp, Mus musculus
atgaggaggccaagtatcttgtcta

SEQ ID NO: 255966 - DNA, 25 bp, Mus musculus
atgaggaggccatgtatcttgtcta

SEQ ID NO: 255967 - DNA, 25 bp, Mus musculus
atgaggaggcgaaacacccaagtgg

SEQ ID NO: 255968 - DNA, 25 bp, Mus musculus
atgaggaggcgatacacccaagtgg

SEQ ID NO: 255969 - DNA, 25 bp, Mus musculus
atgaggagggtaacgctgcctacca

SEQ ID NO: 255970 - DNA, 25 bp, Mus musculus
atgaggagggtatcgctgcctacca

SEQ ID NO: 255971 - DNA, 25 bp, Mus musculus
atgaggagtataagggctgagcttc

SEQ ID NO: 255972 - DNA, 25 bp, Mus musculus
atgaggagtatatgggctgagcttc

SEQ ID NO: 255973 - DNA, 25 bp, Mus musculus
atgaggagttcacctagtcacaaac

SEQ ID NO: 255974 - DNA, 25 bp, Mus musculus
atgaggagttcagctagtcacaaac

SEQ ID NO: 255975 - DNA, 25 bp, Mus musculus
atgaggatacttcctttagttcaga

SEQ ID NO: 255976 - DNA, 25 bp, Mus musculus
atgaggatacttgctttagttcaga

SEQ ID NO: 255977 - DNA, 25 bp, Mus musculus
atgaggatcagcaacaaggccatgt

SEQ ID NO: 255978 - DNA, 25 bp, Mus musculus
atgaggatcagctacaaggccatgt

SEQ ID NO: 255979 - DNA, 25 bp, Mus musculus
atgaggatgaggattccccaaacaa

SEQ ID NO: 255980 - DNA, 25 bp, Mus musculus
atgaggatgaggtttccccaaacaa

SEQ ID NO: 255981 - DNA, 25 bp, Mus musculus
atgaggatgagtcgcaggctcccta

SEQ ID NO: 255982 - DNA, 25 bp, Mus musculus
atgaggatgagtggcaggctcccta

SEQ ID NO: 255983 - DNA, 25 bp, Mus musculus
atgaggatgatgatacctcggcccc

SEQ ID NO: 255984 - DNA, 25 bp, Mus musculus
atgaggatgatgttacctcggcccc

SEQ ID NO: 255985 - DNA, 25 bp, Mus musculus
atgaggatgccacatccatctgacc

SEQ ID NO: 255986 - DNA, 25 bp, Mus musculus
atgaggatgccagatccatctgacc

SEQ ID NO: 255987 - DNA, 25 bp, Mus musculus
atgaggatgcccaaagccccttgta

SEQ ID NO: 255988 - DNA, 25 bp, Mus musculus
atgaggatgccctaagccccttgta

SEQ ID NO: 255989 - DNA, 25 bp, Mus musculus
atgaggatgctactttgcgctgtgc

SEQ ID NO: 255990 - DNA, 25 bp, Mus musculus
atgaggatgctagtttgcgctgtgc

SEQ ID NO: 255991 - DNA, 25 bp, Mus musculus
atgaggatgcttaggtcctggctct

SEQ ID NO: 255992 - DNA, 25 bp, Mus musculus
atgaggatgctttggtcctggctct

SEQ ID NO: 255993 - DNA, 25 bp, Mus musculus
atgaggatggctacacatggctttc

SEQ ID NO: 255994 - DNA, 25 bp, Mus musculus
atgaggatggcttcacatggctttc

SEQ ID NO: 255995 - DNA, 25 bp, Mus musculus
atgaggatttccaggtcggccaagc

SEQ ID NO: 255996 - DNA, 25 bp, Mus musculus
atgaggatttcctggtcggccaagc

SEQ ID NO: 255997 - DNA, 25 bp, Mus musculus
atgaggattttcaacttagcaacag

SEQ ID NO: 255998 - DNA, 25 bp, Mus musculus
atgaggattttctacttagcaacag

SEQ ID NO: 255999 - DNA, 25 bp, Mus musculus
atgaggcaaagtactgctccatctc

SEQ ID NO: 256000 - DNA, 25 bp, Mus musculus
atgaggcaaagttctgctccatctc

SEQ ID NO: 256001 - DNA, 25 bp, Mus musculus
atgaggcaagagctcttatcactga

SEQ ID NO: 256002 - DNA, 25 bp, Mus musculus
atgaggcaagaggtcttatcactga

SEQ ID NO: 256003 - DNA, 25 bp, Mus musculus
atgaggcaagcaaccccaagatcat

SEQ ID NO: 256004 - DNA, 25 bp, Mus musculus
atgaggcaagcacacattcctcctc

SEQ ID NO: 256005 - DNA, 25 bp, Mus musculus
atgaggcaagcagacattcctcctc

SEQ ID NO: 256006 - DNA, 25 bp, Mus musculus
atgaggcaagcatccccaagatcat

SEQ ID NO: 256007 - DNA, 25 bp, Mus musculus
atgaggcaccgactgcagctttcac

SEQ ID NO: 256008 - DNA, 25 bp, Mus musculus
atgaggcaccgagtgcagctttcac

SEQ ID NO: 256009 - DNA, 25 bp, Mus musculus
atgaggcacctcagtccgggatgaa

SEQ ID NO: 256010 - DNA, 25 bp, Mus musculus
atgaggcacctctgtccgggatgaa

SEQ ID NO: 256011 - DNA, 25 bp, Mus musculus
atgaggcagaccctgtaaccacagc

SEQ ID NO: 256012 - DNA, 25 bp, Mus musculus
atgaggcagaccgtgtaaccacagc

SEQ ID NO: 256013 - DNA, 25 bp, Mus musculus
atgaggcagaggaaccgcctgacct

SEQ ID NO: 256014 - DNA, 25 bp, Mus musculus
atgaggcagaggtaccgcctgacct

SEQ ID NO: 256015 - DNA, 25 bp, Mus musculus
atgaggcagataatgaccccacggc

SEQ ID NO: 256016 - DNA, 25 bp, Mus musculus
atgaggcagatattgaccccacggc

SEQ ID NO: 256017 - DNA, 25 bp, Mus musculus
atgaggcagcacactagacacttaa

SEQ ID NO: 256018 - DNA, 25 bp, Mus musculus
atgaggcagcactctagacacttaa

SEQ ID NO: 256019 - DNA, 25 bp, Mus musculus
atgaggcagtttaatgaactattta

SEQ ID NO: 256020 - DNA, 25 bp, Mus musculus
atgaggcagttttatgaactattta

SEQ ID NO: 256021 - DNA, 25 bp, Mus musculus
atgaggcatccactctctatggcat

SEQ ID NO: 256022 - DNA, 25 bp, Mus musculus
atgaggcatccagtctctatggcat

SEQ ID NO: 256023 - DNA, 25 bp, Mus musculus
atgaggcatccgatttcagtctctt

SEQ ID NO: 256024 - DNA, 25 bp, Mus musculus
atgaggcatccgttttcagtctctt

SEQ ID NO: 256025 - DNA, 25 bp, Mus musculus
atgaggccactaaaactgatccgct

SEQ ID NO: 256026 - DNA, 25 bp, Mus musculus
atgaggccactataactgatccgct

SEQ ID NO: 256027 - DNA, 25 bp, Mus musculus
atgaggccagagctccttatcaacc

SEQ ID NO: 256028 - DNA, 25 bp, Mus musculus
atgaggccagaggtccttatcaacc

SEQ ID NO: 256029 - DNA, 25 bp, Mus musculus
atgaggccaggtagccaaactttgg

SEQ ID NO: 256030 - DNA, 25 bp, Mus musculus
atgaggccaggttgccaaactttgg

SEQ ID NO: 256031 - DNA, 25 bp, Mus musculus
atgaggccatgcctaggcctgttag

SEQ ID NO: 256032 - DNA, 25 bp, Mus musculus
atgaggccatgcgtaggcctgttag

SEQ ID NO: 256033 - DNA, 25 bp, Mus musculus
atgaggcccaagctgtggtctgcaa

SEQ ID NO: 256034 - DNA, 25 bp, Mus musculus
atgaggcccaaggtgtggtctgcaa

SEQ ID NO: 256035 - DNA, 25 bp, Mus musculus
atgaggcccagcaaaggcattccca

SEQ ID NO: 256036 - DNA, 25 bp, Mus musculus
atgaggcccagcagtgtaatccttt

SEQ ID NO: 256037 - DNA, 25 bp, Mus musculus
atgaggcccagctaaggcattccca

SEQ ID NO: 256038 - DNA, 25 bp, Mus musculus
atgaggcccagctgtgtaatccttt

SEQ ID NO: 256039 - DNA, 25 bp, Mus musculus
atgaggcccctcatggagccttcca

SEQ ID NO: 256040 - DNA, 25 bp, Mus musculus
atgaggcccctcttggagccttcca

SEQ ID NO: 256041 - DNA, 25 bp, Mus musculus
atgaggccgatgagtcgccgaagcc

SEQ ID NO: 256042 - DNA, 25 bp, Mus musculus
atgaggccgatgtgtcgccgaagcc

SEQ ID NO: 256043 - DNA, 25 bp, Mus musculus
atgaggccgcatcgaagagagttcc

SEQ ID NO: 256044 - DNA, 25 bp, Mus musculus
atgaggccgcatggaagagagttcc

SEQ ID NO: 256045 - DNA, 25 bp, Mus musculus
atgaggcctcagactctggtgttgg

SEQ ID NO: 256046 - DNA, 25 bp, Mus musculus
atgaggcctcagtctctggtgttgg

SEQ ID NO: 256047 - DNA, 25 bp, Mus musculus
atgaggcctccaattttacaaaatt

SEQ ID NO: 256048 - DNA, 25 bp, Mus musculus
atgaggcctccatttttacaaaatt

SEQ ID NO: 256049 - DNA, 25 bp, Mus musculus
atgaggcctgctcctttggctccat

SEQ ID NO: 256050 - DNA, 25 bp, Mus musculus
atgaggcctgctgctttggctccat

SEQ ID NO: 256051 - DNA, 25 bp, Mus musculus
atgaggcctggcaattgcaatattt

SEQ ID NO: 256052 - DNA, 25 bp, Mus musculus
atgaggcctggctattgcaatattt

SEQ ID NO: 256053 - DNA, 25 bp, Mus musculus
atgaggcctggtcttgaaagccacc

SEQ ID NO: 256054 - DNA, 25 bp, Mus musculus
atgaggcctggtgttgaaagccacc

SEQ ID NO: 256055 - DNA, 25 bp, Mus musculus
atgaggccttctcagggcagcccct

SEQ ID NO: 256056 - DNA, 25 bp, Mus musculus
atgaggccttctgagggcagcccct

SEQ ID NO: 256057 - DNA, 25 bp, Mus musculus
atgaggccttgaaactagcttgttc

SEQ ID NO: 256058 - DNA, 25 bp, Mus musculus
atgaggccttgatactagcttgttc

SEQ ID NO: 256059 - DNA, 25 bp, Mus musculus
atgaggccttggcactcagcatcac

SEQ ID NO: 256060 - DNA, 25 bp, Mus musculus
atgaggccttgggactcagcatcac

SEQ ID NO: 256061 - DNA, 25 bp, Mus musculus
atgaggcctttgactttttgctagc

SEQ ID NO: 256062 - DNA, 25 bp, Mus musculus
atgaggcctttgcaagtcaggccgt

SEQ ID NO: 256063 - DNA, 25 bp, Mus musculus
atgaggcctttggaagtcaggccgt

SEQ ID NO: 256064 - DNA, 25 bp, Mus musculus
atgaggcctttgtctttttgctagc

SEQ ID NO: 256065 - DNA, 25 bp, Mus musculus
atgaggcgacagatgggcccctctt

SEQ ID NO: 256066 - DNA, 25 bp, Mus musculus
atgaggcgacagttgggcccctctt

SEQ ID NO: 256067 - DNA, 25 bp, Mus musculus
atgaggcgagccatgctggttcata

SEQ ID NO: 256068 - DNA, 25 bp, Mus musculus
atgaggcgagccttgctggttcata

SEQ ID NO: 256069 - DNA, 25 bp, Mus musculus
atgaggcgggctcagcaccattaga

SEQ ID NO: 256070 - DNA, 25 bp, Mus musculus
atgaggcgggctgagcaccattaga

SEQ ID NO: 256071 - DNA, 25 bp, Mus musculus
atgaggcgttatacaagctttacag

SEQ ID NO: 256072 - DNA, 25 bp, Mus musculus
atgaggcgttattcaagctttacag

SEQ ID NO: 256073 - DNA, 25 bp, Mus musculus
atgaggctaaacaagtggctttggt

SEQ ID NO: 256074 - DNA, 25 bp, Mus musculus
atgaggctaaactagtggctttggt

SEQ ID NO: 256075 - DNA, 25 bp, Mus musculus
atgaggctaaccaaagctgcacggt

SEQ ID NO: 256076 - DNA, 25 bp, Mus musculus
atgaggctaacctaagctgcacggt

SEQ ID NO: 256077 - DNA, 25 bp, Mus musculus
atgaggctaccacagcactgtcttc

SEQ ID NO: 256078 - DNA, 25 bp, Mus musculus
atgaggctaccagagcactgtcttc

SEQ ID NO: 256079 - DNA, 25 bp, Mus musculus
atgaggctatgcagatggtctctgt

SEQ ID NO: 256080 - DNA, 25 bp, Mus musculus
atgaggctatgctgatggtctctgt

SEQ ID NO: 256081 - DNA, 25 bp, Mus musculus
atgaggctatttaccatgggatccc

SEQ ID NO: 256082 - DNA, 25 bp, Mus musculus
atgaggctattttccatgggatccc

SEQ ID NO: 256083 - DNA, 25 bp, Mus musculus
atgaggctcagcaaactctcaacag

SEQ ID NO: 256084 - DNA, 25 bp, Mus musculus
atgaggctcagctaactctcaacag

SEQ ID NO: 256085 - DNA, 25 bp, Mus musculus
atgaggctctgccagaagcatttgg

SEQ ID NO: 256086 - DNA, 25 bp, Mus musculus
atgaggctctgcgagaagcatttgg

SEQ ID NO: 256087 - DNA, 25 bp, Mus musculus
atgaggctgacccaactgattcttt

SEQ ID NO: 256088 - DNA, 25 bp, Mus musculus
atgaggctgaccgaactgattcttt

SEQ ID NO: 256089 - DNA, 25 bp, Mus musculus
atgaggctgcatctgcctgacagat

SEQ ID NO: 256090 - DNA, 25 bp, Mus musculus
atgaggctgcatgtgcctgacagat

SEQ ID NO: 256091 - DNA, 25 bp, Mus musculus
atgaggctggcaagatcacgtgctt

SEQ ID NO: 256092 - DNA, 25 bp, Mus musculus
atgaggctggcatgatcacgtgctt

SEQ ID NO: 256093 - DNA, 25 bp, Mus musculus
atgaggcttggacggacatctacac

SEQ ID NO: 256094 - DNA, 25 bp, Mus musculus
atgaggcttggagggacatctacac

SEQ ID NO: 256095 - DNA, 25 bp, Mus musculus
atgagggaagctctccctcttagga

SEQ ID NO: 256096 - DNA, 25 bp, Mus musculus
atgagggaagctgtccctcttagga

SEQ ID NO: 256097 - DNA, 25 bp, Mus musculus
atgagggaattactggccccagaac

SEQ ID NO: 256098 - DNA, 25 bp, Mus musculus
atgagggaattagtggccccagaac

SEQ ID NO: 256099 - DNA, 25 bp, Mus musculus
atgagggactctatgggtgtttgta

SEQ ID NO: 256100 - DNA, 25 bp, Mus musculus
atgagggactctttgggtgtttgta

SEQ ID NO: 256101 - DNA, 25 bp, Mus musculus
atgagggactgaatctgctccctgg

SEQ ID NO: 256102 - DNA, 25 bp, Mus musculus
atgagggactgattctgctccctgg

SEQ ID NO: 256103 - DNA, 25 bp, Mus musculus
atgagggagaacagccactggaaga

SEQ ID NO: 256104 - DNA, 25 bp, Mus musculus
atgagggagaactgccactggaaga

SEQ ID NO: 256105 - DNA, 25 bp, Mus musculus
atgagggagcctacgcactagatat

SEQ ID NO: 256106 - DNA, 25 bp, Mus musculus
atgagggagccttcgcactagatat

SEQ ID NO: 256107 - DNA, 25 bp, Mus musculus
atgagggagctacccagcttcctgt

SEQ ID NO: 256108 - DNA, 25 bp, Mus musculus
atgagggagctagccagcttcctgt

SEQ ID NO: 256109 - DNA, 25 bp, Mus musculus
atgagggagtcacggcaccactgtc

SEQ ID NO: 256110 - DNA, 25 bp, Mus musculus
atgagggagtcagggcaccactgtc

SEQ ID NO: 256111 - DNA, 25 bp, Mus musculus
atgagggatcacatcttaagtaata

SEQ ID NO: 256112 - DNA, 25 bp, Mus musculus
atgagggatcacttcttaagtaata

SEQ ID NO: 256113 - DNA, 25 bp, Mus musculus
atgagggatcctctgacccccagat

SEQ ID NO: 256114 - DNA, 25 bp, Mus musculus
atgagggatcctgtgacccccagat

SEQ ID NO: 256115 - DNA, 25 bp, Mus musculus
atgagggatgctccgctctgctgtt

SEQ ID NO: 256116 - DNA, 25 bp, Mus musculus
atgagggatgctgcgctctgctgtt

SEQ ID NO: 256117 - DNA, 25 bp, Mus musculus
atgagggcaacaactttcctaaccc

SEQ ID NO: 256118 - DNA, 25 bp, Mus musculus
atgagggcaacatctttcctaaccc

SEQ ID NO: 256119 - DNA, 25 bp, Mus musculus
atgagggcacccattctagtttgta

SEQ ID NO: 256120 - DNA, 25 bp, Mus musculus
atgagggcaccctttctagtttgta

SEQ ID NO: 256121 - DNA, 25 bp, Mus musculus
atgagggcagccctttagaacttta

SEQ ID NO: 256122 - DNA, 25 bp, Mus musculus
atgagggcagccgtttagaacttta

SEQ ID NO: 256123 - DNA, 25 bp, Mus musculus
atgagggcatctagtttcctagcca

SEQ ID NO: 256124 - DNA, 25 bp, Mus musculus
atgagggcatcttgtttcctagcca

SEQ ID NO: 256125 - DNA, 25 bp, Mus musculus
atgagggccaatcttctgtgacaac

SEQ ID NO: 256126 - DNA, 25 bp, Mus musculus
atgagggccaatgttctgtgacaac

SEQ ID NO: 256127 - DNA, 25 bp, Mus musculus
atgagggccagcacagctcttgttc

SEQ ID NO: 256128 - DNA, 25 bp, Mus musculus
atgagggccagctcagctcttgttc

SEQ ID NO: 256129 - DNA, 25 bp, Mus musculus
atgagggccccacaagacactgctg

SEQ ID NO: 256130 - DNA, 25 bp, Mus musculus
atgagggccccagaagacactgctg

SEQ ID NO: 256131 - DNA, 25 bp, Mus musculus
atgagggcctatcatcgtttcttgg

SEQ ID NO: 256132 - DNA, 25 bp, Mus musculus
atgagggcctatgatcgtttcttgg

SEQ ID NO: 256133 - DNA, 25 bp, Mus musculus
atgagggcgacgactgcactgagta

SEQ ID NO: 256134 - DNA, 25 bp, Mus musculus
atgagggcgacgtctgcactgagta

SEQ ID NO: 256135 - DNA, 25 bp, Mus musculus
atgagggctattacgtacttccggt

SEQ ID NO: 256136 - DNA, 25 bp, Mus musculus
atgagggctatttcgtacttccggt

SEQ ID NO: 256137 - DNA, 25 bp, Mus musculus
atgagggctgccaatgaggtgacca

SEQ ID NO: 256138 - DNA, 25 bp, Mus musculus
atgagggctgcctatgaggtgacca

SEQ ID NO: 256139 - DNA, 25 bp, Mus musculus
atgagggctgctccccgaagagcac

SEQ ID NO: 256140 - DNA, 25 bp, Mus musculus
atgagggctgctgcccgaagagcac

SEQ ID NO: 256141 - DNA, 25 bp, Mus musculus
atgagggcttctatttcacatgtcc

SEQ ID NO: 256142 - DNA, 25 bp, Mus musculus
atgagggcttctttttcacatgtcc

SEQ ID NO: 256143 - DNA, 25 bp, Mus musculus
atgagggcttgtactgcctgctcgg

SEQ ID NO: 256144 - DNA, 25 bp, Mus musculus
atgagggcttgttctgcctgctcgg

SEQ ID NO: 256145 - DNA, 25 bp, Mus musculus
atgagggctttgaccccagtgtact

SEQ ID NO: 256146 - DNA, 25 bp, Mus musculus
atgagggctttgtccccagtgtact

SEQ ID NO: 256147 - DNA, 25 bp, Mus musculus
atgaggggacacctgcgatacctag

SEQ ID NO: 256148 - DNA, 25 bp, Mus musculus
atgaggggacacgtgcgatacctag

SEQ ID NO: 256149 - DNA, 25 bp, Mus musculus
atgagggtagccaaacttcagacct

SEQ ID NO: 256150 - DNA, 25 bp, Mus musculus
atgagggtagcctaacttcagacct

SEQ ID NO: 256151 - DNA, 25 bp, Mus musculus
atgagggtaggtaggcgtcggccgt

SEQ ID NO: 256152 - DNA, 25 bp, Mus musculus
atgagggtaggttggcgtcggccgt

SEQ ID NO: 256153 - DNA, 25 bp, Mus musculus
atgagggtattccagaacctgtcta

SEQ ID NO: 256154 - DNA, 25 bp, Mus musculus
atgagggtattcgagaacctgtcta

SEQ ID NO: 256155 - DNA, 25 bp, Mus musculus
atgagggtcaccctttcaaggccta

SEQ ID NO: 256156 - DNA, 25 bp, Mus musculus
atgagggtcaccgtttcaaggccta

SEQ ID NO: 256157 - DNA, 25 bp, Mus musculus
atgagggtcatgattcctgcgtgaa

SEQ ID NO: 256158 - DNA, 25 bp, Mus musculus
atgagggtcatgtttcctgcgtgaa

SEQ ID NO: 256159 - DNA, 25 bp, Mus musculus
atgagggtccaaaaggcatctgtaa

SEQ ID NO: 256160 - DNA, 25 bp, Mus musculus
atgagggtccaataggcatctgtaa

SEQ ID NO: 256161 - DNA, 25 bp, Mus musculus
atgagggtcctaaagcccatgctca

SEQ ID NO: 256162 - DNA, 25 bp, Mus musculus
atgagggtcctatagcccatgctca

SEQ ID NO: 256163 - DNA, 25 bp, Mus musculus
atgagggtcgctatggtgtctatga

SEQ ID NO: 256164 - DNA, 25 bp, Mus musculus
atgagggtcgctttggtgtctatga

SEQ ID NO: 256165 - DNA, 25 bp, Mus musculus
atgagggtgccactcccaggtgaaa

SEQ ID NO: 256166 - DNA, 25 bp, Mus musculus
atgagggtgccagtcccaggtgaaa

SEQ ID NO: 256167 - DNA, 25 bp, Mus musculus
atgagggttagccagcctcaagcag

SEQ ID NO: 256168 - DNA, 25 bp, Mus musculus
atgagggttagcgagcctcaagcag

SEQ ID NO: 256169 - DNA, 25 bp, Mus musculus
atgagggttcctcaggtccacctta

SEQ ID NO: 256170 - DNA, 25 bp, Mus musculus
atgagggttcctgaggtccacctta

SEQ ID NO: 256171 - DNA, 25 bp, Mus musculus
atgagggtttcacaagacacttgga

SEQ ID NO: 256172 - DNA, 25 bp, Mus musculus
atgagggtttcagaagacacttgga

SEQ ID NO: 256173 - DNA, 25 bp, Mus musculus
atgaggtagcacatgctggtcctgc

SEQ ID NO: 256174 - DNA, 25 bp, Mus musculus
atgaggtagcacttgctggtcctgc

SEQ ID NO: 256175 - DNA, 25 bp, Mus musculus
atgaggtagctcagaaggcaaggac

SEQ ID NO: 256176 - DNA, 25 bp, Mus musculus
atgaggtagctctgaaggcaaggac

SEQ ID NO: 256177 - DNA, 25 bp, Mus musculus
atgaggtaggcacaaatacattccc

SEQ ID NO: 256178 - DNA, 25 bp, Mus musculus
atgaggtaggcagaaatacattccc

SEQ ID NO: 256179 - DNA, 25 bp, Mus musculus
atgaggtaggttacgatgcccttct

SEQ ID NO: 256180 - DNA, 25 bp, Mus musculus
atgaggtaggtttcgatgcccttct

SEQ ID NO: 256181 - DNA, 25 bp, Mus musculus
atgaggtatgcaactcccatgacac

SEQ ID NO: 256182 - DNA, 25 bp, Mus musculus
atgaggtatgcatctcccatgacac

SEQ ID NO: 256183 - DNA, 25 bp, Mus musculus
atgaggtcacctatgagatcttcca

SEQ ID NO: 256184 - DNA, 25 bp, Mus musculus
atgaggtcacctttgagatcttcca

SEQ ID NO: 256185 - DNA, 25 bp, Mus musculus
atgaggtcacttcagatgctgctcc

SEQ ID NO: 256186 - DNA, 25 bp, Mus musculus
atgaggtcacttgagatgctgctcc

SEQ ID NO: 256187 - DNA, 25 bp, Mus musculus
atgaggtcagttctctctcaattaa

SEQ ID NO: 256188 - DNA, 25 bp, Mus musculus
atgaggtcagttgtctctcaattaa

SEQ ID NO: 256189 - DNA, 25 bp, Mus musculus
atgaggtcatcaacatccctgagtc

SEQ ID NO: 256190 - DNA, 25 bp, Mus musculus
atgaggtcatcatcatccctgagtc

SEQ ID NO: 256191 - DNA, 25 bp, Mus musculus
atgaggtcatccctattggtgcagc

SEQ ID NO: 256192 - DNA, 25 bp, Mus musculus
atgaggtcatccgtattggtgcagc

SEQ ID NO: 256193 - DNA, 25 bp, Mus musculus
atgaggtcattgctttttacacaga

SEQ ID NO: 256194 - DNA, 25 bp, Mus musculus
atgaggtcattggtttttacacaga

SEQ ID NO: 256195 - DNA, 25 bp, Mus musculus
atgaggtccagacgcaggcattgct

SEQ ID NO: 256196 - DNA, 25 bp, Mus musculus
atgaggtccagaggcaggcattgct

SEQ ID NO: 256197 - DNA, 25 bp, Mus musculus
atgaggtcctcaccagtcatcatga

SEQ ID NO: 256198 - DNA, 25 bp, Mus musculus
atgaggtcctcagcagtcatcatga

SEQ ID NO: 256199 - DNA, 25 bp, Mus musculus
atgaggtcctctcttggccagcgaa

SEQ ID NO: 256200 - DNA, 25 bp, Mus musculus
atgaggtcctctgttggccagcgaa

SEQ ID NO: 256201 - DNA, 25 bp, Mus musculus
atgaggtccttgcttcttgattcaa

SEQ ID NO: 256202 - DNA, 25 bp, Mus musculus
atgaggtccttggttcttgattcaa

SEQ ID NO: 256203 - DNA, 25 bp, Mus musculus
atgaggtctgccagtattcagcagc

SEQ ID NO: 256204 - DNA, 25 bp, Mus musculus
atgaggtctgcctgtattcagcagc

SEQ ID NO: 256205 - DNA, 25 bp, Mus musculus
atgaggtgacttctgagtctcccgc

SEQ ID NO: 256206 - DNA, 25 bp, Mus musculus
atgaggtgacttgtgagtctcccgc

SEQ ID NO: 256207 - DNA, 25 bp, Mus musculus
atgaggtgagagcatctctgtgtct

SEQ ID NO: 256208 - DNA, 25 bp, Mus musculus
atgaggtgagaggatctctgtgtct

SEQ ID NO: 256209 - DNA, 25 bp, Mus musculus
atgaggtgcaacaagaccccattct

SEQ ID NO: 256210 - DNA, 25 bp, Mus musculus
atgaggtgcaactagaccccattct

SEQ ID NO: 256211 - DNA, 25 bp, Mus musculus
atgaggtgcatcagaatgttaacaa

SEQ ID NO: 256212 - DNA, 25 bp, Mus musculus
atgaggtgcatctgaatgttaacaa

SEQ ID NO: 256213 - DNA, 25 bp, Mus musculus
atgaggtgccctaagctgtgcccag

SEQ ID NO: 256214 - DNA, 25 bp, Mus musculus
atgaggtgcccttagctgtgcccag

SEQ ID NO: 256215 - DNA, 25 bp, Mus musculus
atgaggtgcttcattctgatgggac

SEQ ID NO: 256216 - DNA, 25 bp, Mus musculus
atgaggtgcttctttctgatgggac

SEQ ID NO: 256217 - DNA, 25 bp, Mus musculus
atgaggtggccccagagctgatctc

SEQ ID NO: 256218 - DNA, 25 bp, Mus musculus
atgaggtggcccgagagctgatctc

SEQ ID NO: 256219 - DNA, 25 bp, Mus musculus
atgaggtgggcaagctcttcacaca

SEQ ID NO: 256220 - DNA, 25 bp, Mus musculus
atgaggtgggcatgctcttcacaca

SEQ ID NO: 256221 - DNA, 25 bp, Mus musculus
atgaggtgtcctaggtgagtgcaaa

SEQ ID NO: 256222 - DNA, 25 bp, Mus musculus
atgaggtgtccttggtgagtgcaaa

SEQ ID NO: 256223 - DNA, 25 bp, Mus musculus
atgaggtgtgcaactcaggcctgat

SEQ ID NO: 256224 - DNA, 25 bp, Mus musculus
atgaggtgtgcatctcaggcctgat

SEQ ID NO: 256225 - DNA, 25 bp, Mus musculus
atgaggtgtggcagttaacgccgaa

SEQ ID NO: 256226 - DNA, 25 bp, Mus musculus
atgaggtgtggctgttaacgccgaa

SEQ ID NO: 256227 - DNA, 25 bp, Mus musculus
atgaggtgttccagtgtcgggttgc

SEQ ID NO: 256228 - DNA, 25 bp, Mus musculus
atgaggtgttcctgtgtcgggttgc

SEQ ID NO: 256229 - DNA, 25 bp, Mus musculus
atgaggttactcctctttagcagaa

SEQ ID NO: 256230 - DNA, 25 bp, Mus musculus
atgaggttactcgtctttagcagaa

SEQ ID NO: 256231 - DNA, 25 bp, Mus musculus
atgaggttcgttcggatgtctcact

SEQ ID NO: 256232 - DNA, 25 bp, Mus musculus
atgaggttcgttgggatgtctcact

SEQ ID NO: 256233 - DNA, 25 bp, Mus musculus
atgaggttctcgaccctgaatacca

SEQ ID NO: 256234 - DNA, 25 bp, Mus musculus
atgaggttctcgtccctgaatacca

SEQ ID NO: 256235 - DNA, 25 bp, Mus musculus
atgaggttcttcataaaggcaggct

SEQ ID NO: 256236 - DNA, 25 bp, Mus musculus
atgaggttcttcttaaaggcaggct

SEQ ID NO: 256237 - DNA, 25 bp, Mus musculus
atgaggttgcagaccagggctgaaa

SEQ ID NO: 256238 - DNA, 25 bp, Mus musculus
atgaggttgcagtccagggctgaaa

SEQ ID NO: 256239 - DNA, 25 bp, Mus musculus
atgaggttgcatcagttcacactaa

SEQ ID NO: 256240 - DNA, 25 bp, Mus musculus
atgaggttgcatgagttcacactaa

SEQ ID NO: 256241 - DNA, 25 bp, Mus musculus
atgaggttgccaagagtccattaga

SEQ ID NO: 256242 - DNA, 25 bp, Mus musculus
atgaggttgccactgactcttcaaa

SEQ ID NO: 256243 - DNA, 25 bp, Mus musculus
atgaggttgccagtgactcttcaaa

SEQ ID NO: 256244 - DNA, 25 bp, Mus musculus
atgaggttgccatgagtccattaga

SEQ ID NO: 256245 - DNA, 25 bp, Mus musculus
atgaggttgttgactatgctgccaa

SEQ ID NO: 256246 - DNA, 25 bp, Mus musculus
atgaggttgttgtctatgctgccaa

SEQ ID NO: 256247 - DNA, 25 bp, Mus musculus
atgaggtttccccttcgtagaagtg

SEQ ID NO: 256248 - DNA, 25 bp, Mus musculus
atgaggtttcccgttcgtagaagtg

SEQ ID NO: 256249 - DNA, 25 bp, Mus musculus
atgaggtttttgagtgagcttatgc

SEQ ID NO: 256250 - DNA, 25 bp, Mus musculus
atgaggtttttgtgtgagcttatgc

SEQ ID NO: 256251 - DNA, 25 bp, Mus musculus
atgagtaaacatcggtagctagata

SEQ ID NO: 256252 - DNA, 25 bp, Mus musculus
atgagtaaacatgggtagctagata

SEQ ID NO: 256253 - DNA, 25 bp, Mus musculus
atgagtaacccgacaagcaaggcac

SEQ ID NO: 256254 - DNA, 25 bp, Mus musculus
atgagtaacccgtcaagcaaggcac

SEQ ID NO: 256255 - DNA, 25 bp, Mus musculus
atgagtaatataagtcttgagagct

SEQ ID NO: 256256 - DNA, 25 bp, Mus musculus
atgagtaatatatgtcttgagagct

SEQ ID NO: 256257 - DNA, 25 bp, Mus musculus
atgagtaatcccaacagttacagaa

SEQ ID NO: 256258 - DNA, 25 bp, Mus musculus
atgagtaatccctacagttacagaa

SEQ ID NO: 256259 - DNA, 25 bp, Mus musculus
atgagtaattccactgccttattta

SEQ ID NO: 256260 - DNA, 25 bp, Mus musculus
atgagtaattcctctgccttattta

SEQ ID NO: 256261 - DNA, 25 bp, Mus musculus
atgagtacaacaccgaccccaattt

SEQ ID NO: 256262 - DNA, 25 bp, Mus musculus
atgagtacaacagcgaccccaattt

SEQ ID NO: 256263 - DNA, 25 bp, Mus musculus
atgagtacatgcagcccttcgagga

SEQ ID NO: 256264 - DNA, 25 bp, Mus musculus
atgagtacatgctgcccttcgagga

SEQ ID NO: 256265 - DNA, 25 bp, Mus musculus
atgagtacatttcccaccaccagca

SEQ ID NO: 256266 - DNA, 25 bp, Mus musculus
atgagtacatttgccaccaccagca

SEQ ID NO: 256267 - DNA, 25 bp, Mus musculus
atgagtaccacgaccactgcatcga

SEQ ID NO: 256268 - DNA, 25 bp, Mus musculus
atgagtaccacgtccactgcatcga

SEQ ID NO: 256269 - DNA, 25 bp, Mus musculus
atgagtaccatgacatccggcatgc

SEQ ID NO: 256270 - DNA, 25 bp, Mus musculus
atgagtaccatgtcatccggcatgc

SEQ ID NO: 256271 - DNA, 25 bp, Mus musculus
atgagtacccagagatcctgtccat

SEQ ID NO: 256272 - DNA, 25 bp, Mus musculus
atgagtacccagtgatcctgtccat

SEQ ID NO: 256273 - DNA, 25 bp, Mus musculus
atgagtacctcacgagattgccacc

SEQ ID NO: 256274 - DNA, 25 bp, Mus musculus
atgagtacctcaggagattgccacc

SEQ ID NO: 256275 - DNA, 25 bp, Mus musculus
atgagtactcgactgcatgcgtgta

SEQ ID NO: 256276 - DNA, 25 bp, Mus musculus
atgagtactcgagtgcatgcgtgta

SEQ ID NO: 256277 - DNA, 25 bp, Mus musculus
atgagtagccagcatactcgtgctt

SEQ ID NO: 256278 - DNA, 25 bp, Mus musculus
atgagtagccaggatactcgtgctt

SEQ ID NO: 256279 - DNA, 25 bp, Mus musculus
atgagtagcttcatgctctctatct

SEQ ID NO: 256280 - DNA, 25 bp, Mus musculus
atgagtagcttcttgctctctatct

SEQ ID NO: 256281 - DNA, 25 bp, Mus musculus
atgagtaggagccatctcttccagt

SEQ ID NO: 256282 - DNA, 25 bp, Mus musculus
atgagtaggagcgatctcttccagt

SEQ ID NO: 256283 - DNA, 25 bp, Mus musculus
atgagtaggatcatgcctctcacct

SEQ ID NO: 256284 - DNA, 25 bp, Mus musculus
atgagtaggatcttgcctctcacct

SEQ ID NO: 256285 - DNA, 25 bp, Mus musculus
atgagtataatcaccaacgtgtgca

SEQ ID NO: 256286 - DNA, 25 bp, Mus musculus
atgagtataatctccaacgtgtgca

SEQ ID NO: 256287 - DNA, 25 bp, Mus musculus
atgagtatatgaatcactccttgcc

SEQ ID NO: 256288 - DNA, 25 bp, Mus musculus
atgagtatatgattcactccttgcc

SEQ ID NO: 256289 - DNA, 25 bp, Mus musculus
atgagtatcaatcagcatgcccaga

SEQ ID NO: 256290 - DNA, 25 bp, Mus musculus
atgagtatcaatgagcatgcccaga

SEQ ID NO: 256291 - DNA, 25 bp, Mus musculus
atgagtatgaccatggagttccaca

SEQ ID NO: 256292 - DNA, 25 bp, Mus musculus
atgagtatgaccttggagttccaca

SEQ ID NO: 256293 - DNA, 25 bp, Mus musculus
atgagtatgacgcacacaccaccta

SEQ ID NO: 256294 - DNA, 25 bp, Mus musculus
atgagtatgacggacacaccaccta

SEQ ID NO: 256295 - DNA, 25 bp, Mus musculus
atgagtatggatcctgagctcccgg

SEQ ID NO: 256296 - DNA, 25 bp, Mus musculus
atgagtatggatgctgagctcccgg

SEQ ID NO: 256297 - DNA, 25 bp, Mus musculus
atgagtatgtcgaccagcatggtgc

SEQ ID NO: 256298 - DNA, 25 bp, Mus musculus
atgagtatgtcgtccagcatggtgc

SEQ ID NO: 256299 - DNA, 25 bp, Mus musculus
atgagtatgtctactgtcctgatgt

SEQ ID NO: 256300 - DNA, 25 bp, Mus musculus
atgagtatgtcttctgtcctgatgt

SEQ ID NO: 256301 - DNA, 25 bp, Mus musculus
atgagtattattccctctagaatgc

SEQ ID NO: 256302 - DNA, 25 bp, Mus musculus
atgagtattattgcctctagaatgc

SEQ ID NO: 256303 - DNA, 25 bp, Mus musculus
atgagtattcagacccagccttgcc

SEQ ID NO: 256304 - DNA, 25 bp, Mus musculus
atgagtattcagtcccagccttgcc

SEQ ID NO: 256305 - DNA, 25 bp, Mus musculus
atgagtattcatcttcccagcatcc

SEQ ID NO: 256306 - DNA, 25 bp, Mus musculus
atgagtattcatgttcccagcatcc

SEQ ID NO: 256307 - DNA, 25 bp, Mus musculus
atgagtattctaagtttatcggtgt

SEQ ID NO: 256308 - DNA, 25 bp, Mus musculus
atgagtattctatgtttatcggtgt

SEQ ID NO: 256309 - DNA, 25 bp, Mus musculus
atgagtatttcacctgcataggcgc

SEQ ID NO: 256310 - DNA, 25 bp, Mus musculus
atgagtatttcagctgcataggcgc

SEQ ID NO: 256311 - DNA, 25 bp, Mus musculus
atgagtcaactaacccgtttacagc

SEQ ID NO: 256312 - DNA, 25 bp, Mus musculus
atgagtcaactatcccgtttacagc

SEQ ID NO: 256313 - DNA, 25 bp, Mus musculus
atgagtcaactgctttagctctcct

SEQ ID NO: 256314 - DNA, 25 bp, Mus musculus
atgagtcaactggtttagctctcct

SEQ ID NO: 256315 - DNA, 25 bp, Mus musculus
atgagtcacggcagttggacatctc

SEQ ID NO: 256316 - DNA, 25 bp, Mus musculus
atgagtcacggctgttggacatctc

SEQ ID NO: 256317 - DNA, 25 bp, Mus musculus
atgagtcactgcagacgcttggctg

SEQ ID NO: 256318 - DNA, 25 bp, Mus musculus
atgagtcactgctgacgcttggctg

SEQ ID NO: 256319 - DNA, 25 bp, Mus musculus
atgagtcagagacgcatggttcctg

SEQ ID NO: 256320 - DNA, 25 bp, Mus musculus
atgagtcagagaggcatggttcctg

SEQ ID NO: 256321 - DNA, 25 bp, Mus musculus
atgagtcagccaagcagcccaatgt

SEQ ID NO: 256322 - DNA, 25 bp, Mus musculus
atgagtcagccatgcagcccaatgt

SEQ ID NO: 256323 - DNA, 25 bp, Mus musculus
atgagtcagctgactttgatgtgct

SEQ ID NO: 256324 - DNA, 25 bp, Mus musculus
atgagtcagctgtctttgatgtgct

SEQ ID NO: 256325 - DNA, 25 bp, Mus musculus
atgagtccaaggacatacgtcagac

SEQ ID NO: 256326 - DNA, 25 bp, Mus musculus
atgagtccaaggtcatacgtcagac

SEQ ID NO: 256327 - DNA, 25 bp, Mus musculus
atgagtccacaaccctcaggatgat

SEQ ID NO: 256328 - DNA, 25 bp, Mus musculus
atgagtccacaagcctcaggatgat

SEQ ID NO: 256329 - DNA, 25 bp, Mus musculus
atgagtccacgactttacagagtgc

SEQ ID NO: 256330 - DNA, 25 bp, Mus musculus
atgagtccacgagtttacagagtgc

SEQ ID NO: 256331 - DNA, 25 bp, Mus musculus
atgagtccacttcatcttggtagcc

SEQ ID NO: 256332 - DNA, 25 bp, Mus musculus
atgagtccacttgatcttggtagcc

SEQ ID NO: 256333 - DNA, 25 bp, Mus musculus
atgagtccaggccttacagccatgg

SEQ ID NO: 256334 - DNA, 25 bp, Mus musculus
atgagtccaggcgttacagccatgg

SEQ ID NO: 256335 - DNA, 25 bp, Mus musculus
atgagtccctcgatcgaagccgctc

SEQ ID NO: 256336 - DNA, 25 bp, Mus musculus
atgagtccctcgttcgaagccgctc

SEQ ID NO: 256337 - DNA, 25 bp, Mus musculus
atgagtcctagcagaagttcacttc

SEQ ID NO: 256338 - DNA, 25 bp, Mus musculus
atgagtcctagctgaagttcacttc

SEQ ID NO: 256339 - DNA, 25 bp, Mus musculus
atgagtcctcccatcaagtttgcat

SEQ ID NO: 256340 - DNA, 25 bp, Mus musculus
atgagtcctcccttcaagtttgcat

SEQ ID NO: 256341 - DNA, 25 bp, Mus musculus
atgagtcctgccaggttagttgatt

SEQ ID NO: 256342 - DNA, 25 bp, Mus musculus
atgagtcctgcctggttagttgatt

SEQ ID NO: 256343 - DNA, 25 bp, Mus musculus
atgagtcctggtatatggcctgcac

SEQ ID NO: 256344 - DNA, 25 bp, Mus musculus
atgagtcctggtttatggcctgcac

SEQ ID NO: 256345 - DNA, 25 bp, Mus musculus
atgagtcctgtgagagccttaccgc

SEQ ID NO: 256346 - DNA, 25 bp, Mus musculus
atgagtcctgtgtgagccttaccgc

SEQ ID NO: 256347 - DNA, 25 bp, Mus musculus
atgagtcctgttaggtcctgttcct

SEQ ID NO: 256348 - DNA, 25 bp, Mus musculus
atgagtcctgtttggtcctgttcct

SEQ ID NO: 256349 - DNA, 25 bp, Mus musculus
atgagtccttctctacgctaagtgc

SEQ ID NO: 256350 - DNA, 25 bp, Mus musculus
atgagtccttctgtacgctaagtgc

SEQ ID NO: 256351 - DNA, 25 bp, Mus musculus
atgagtccttttctcacttggtacc

SEQ ID NO: 256352 - DNA, 25 bp, Mus musculus
atgagtccttttgtcacttggtacc

SEQ ID NO: 256353 - DNA, 25 bp, Mus musculus
atgagtcgccgaagcctggactgga

SEQ ID NO: 256354 - DNA, 25 bp, Mus musculus
atgagtcgccgatgcctggactgga

SEQ ID NO: 256355 - DNA, 25 bp, Mus musculus
atgagtctccacagattgacggcgg

SEQ ID NO: 256356 - DNA, 25 bp, Mus musculus
atgagtctccactgattgacggcgg

SEQ ID NO: 256357 - DNA, 25 bp, Mus musculus
atgagtctcgagctcacagtgagca

SEQ ID NO: 256358 - DNA, 25 bp, Mus musculus
atgagtctcgaggtcacagtgagca

SEQ ID NO: 256359 - DNA, 25 bp, Mus musculus
atgagtctgaatactcctcctgtgt

SEQ ID NO: 256360 - DNA, 25 bp, Mus musculus
atgagtctgaattctcctcctgtgt

SEQ ID NO: 256361 - DNA, 25 bp, Mus musculus
atgagtctgacgatcctgaacacaa

SEQ ID NO: 256362 - DNA, 25 bp, Mus musculus
atgagtctgacgttcctgaacacaa

SEQ ID NO: 256363 - DNA, 25 bp, Mus musculus
atgagtctggaaaagcctcttgtaa

SEQ ID NO: 256364 - DNA, 25 bp, Mus musculus
atgagtctggaatagcctcttgtaa

SEQ ID NO: 256365 - DNA, 25 bp, Mus musculus
atgagtcttactatgtatctccaga

SEQ ID NO: 256366 - DNA, 25 bp, Mus musculus
atgagtcttactttgtatctccaga

SEQ ID NO: 256367 - DNA, 25 bp, Mus musculus
atgagtcttcagattccaagtccct

SEQ ID NO: 256368 - DNA, 25 bp, Mus musculus
atgagtcttcagtttccaagtccct

SEQ ID NO: 256369 - DNA, 25 bp, Mus musculus
atgagtcttcttattaatcagtaag

SEQ ID NO: 256370 - DNA, 25 bp, Mus musculus
atgagtcttctttttaatcagtaag

SEQ ID NO: 256371 - DNA, 25 bp, Mus musculus
atgagtcttgcgaattctctccgtg

SEQ ID NO: 256372 - DNA, 25 bp, Mus musculus
atgagtcttgcgtattctctccgtg

SEQ ID NO: 256373 - DNA, 25 bp, Mus musculus
atgagtctttaaagttggtcacagc

SEQ ID NO: 256374 - DNA, 25 bp, Mus musculus
atgagtctttaatgttggtcacagc

SEQ ID NO: 256375 - DNA, 25 bp, Mus musculus
atgagtcttttaagatcccagagga

SEQ ID NO: 256376 - DNA, 25 bp, Mus musculus
atgagtcttttatgatcccagagga

SEQ ID NO: 256377 - DNA, 25 bp, Mus musculus
atgagtgacagaacgggacgtcctt

SEQ ID NO: 256378 - DNA, 25 bp, Mus musculus
atgagtgacagatcgggacgtcctt

SEQ ID NO: 256379 - DNA, 25 bp, Mus musculus
atgagtgaccagcatcggcaggttt

SEQ ID NO: 256380 - DNA, 25 bp, Mus musculus
atgagtgaccaggatcggcaggttt

SEQ ID NO: 256381 - DNA, 25 bp, Mus musculus
atgagtgaccatccgtccgaatgtt

SEQ ID NO: 256382 - DNA, 25 bp, Mus musculus
atgagtgaccatgcgtccgaatgtt

SEQ ID NO: 256383 - DNA, 25 bp, Mus musculus
atgagtgacggcagctccttgtgaa

SEQ ID NO: 256384 - DNA, 25 bp, Mus musculus
atgagtgacggctgctccttgtgaa

SEQ ID NO: 256385 - DNA, 25 bp, Mus musculus
atgagtgactctcatcatctcagcc

SEQ ID NO: 256386 - DNA, 25 bp, Mus musculus
atgagtgactctgatcatctcagcc

SEQ ID NO: 256387 - DNA, 25 bp, Mus musculus
atgagtgactggaacaacccgggag

SEQ ID NO: 256388 - DNA, 25 bp, Mus musculus
atgagtgactggtacaacccgggag

SEQ ID NO: 256389 - DNA, 25 bp, Mus musculus
atgagtgagacgatttgggagcttt

SEQ ID NO: 256390 - DNA, 25 bp, Mus musculus
atgagtgagacgttttgggagcttt

SEQ ID NO: 256391 - DNA, 25 bp, Mus musculus
atgagtgagcgcagtgttgaagaac

SEQ ID NO: 256392 - DNA, 25 bp, Mus musculus
atgagtgagcgctgtgttgaagaac

SEQ ID NO: 256393 - DNA, 25 bp, Mus musculus
atgagtgagcttcacccagcagtta

SEQ ID NO: 256394 - DNA, 25 bp, Mus musculus
atgagtgagcttgacccagcagtta

SEQ ID NO: 256395 - DNA, 25 bp, Mus musculus
atgagtgagtgtaccggctgccaca

SEQ ID NO: 256396 - DNA, 25 bp, Mus musculus
atgagtgagtgttccggctgccaca

SEQ ID NO: 256397 - DNA, 25 bp, Mus musculus
atgagtgatatccttagtctcagga

SEQ ID NO: 256398 - DNA, 25 bp, Mus musculus
atgagtgatatcgttagtctcagga

SEQ ID NO: 256399 - DNA, 25 bp, Mus musculus
atgagtgatcagagcccacatcacc

SEQ ID NO: 256400 - DNA, 25 bp, Mus musculus
atgagtgatcagtgcccacatcacc

SEQ ID NO: 256401 - DNA, 25 bp, Mus musculus
atgagtgatgccacacagcctggcc

SEQ ID NO: 256402 - DNA, 25 bp, Mus musculus
atgagtgatgcctcacagcctggcc

SEQ ID NO: 256403 - DNA, 25 bp, Mus musculus
atgagtgcaataatccatccttggt

SEQ ID NO: 256404 - DNA, 25 bp, Mus musculus
atgagtgcaatattccatccttggt

SEQ ID NO: 256405 - DNA, 25 bp, Mus musculus
atgagtgcacaccagaacatcccat

SEQ ID NO: 256406 - DNA, 25 bp, Mus musculus
atgagtgcacacgagaacatcccat

SEQ ID NO: 256407 - DNA, 25 bp, Mus musculus
atgagtgcagaaccagtcaggcttg

SEQ ID NO: 256408 - DNA, 25 bp, Mus musculus
atgagtgcagaagcagtcaggcttg

SEQ ID NO: 256409 - DNA, 25 bp, Mus musculus
atgagtgccataacctgcagccagg

SEQ ID NO: 256410 - DNA, 25 bp, Mus musculus
atgagtgccatatcctgcagccagg

SEQ ID NO: 256411 - DNA, 25 bp, Mus musculus
atgagtgcccagaagtcactccccg

SEQ ID NO: 256412 - DNA, 25 bp, Mus musculus
atgagtgcccagtagtcactccccg

SEQ ID NO: 256413 - DNA, 25 bp, Mus musculus
atgagtgccctacctgaaactatgc

SEQ ID NO: 256414 - DNA, 25 bp, Mus musculus
atgagtgccctagctgaaactatgc

SEQ ID NO: 256415 - DNA, 25 bp, Mus musculus
atgagtgccgagaactgaaccagcg

SEQ ID NO: 256416 - DNA, 25 bp, Mus musculus
atgagtgccgagtactgaaccagcg

SEQ ID NO: 256417 - DNA, 25 bp, Mus musculus
atgagtgccgctcctgaagggaaaa

SEQ ID NO: 256418 - DNA, 25 bp, Mus musculus
atgagtgccgctgctgaagggaaaa

SEQ ID NO: 256419 - DNA, 25 bp, Mus musculus
atgagtgcctgccattgtccagagc

SEQ ID NO: 256420 - DNA, 25 bp, Mus musculus
atgagtgcctgcgattgtccagagc

SEQ ID NO: 256421 - DNA, 25 bp, Mus musculus
atgagtgctataatgtccaagggct

SEQ ID NO: 256422 - DNA, 25 bp, Mus musculus
atgagtgctatattgtccaagggct

SEQ ID NO: 256423 - DNA, 25 bp, Mus musculus
atgagtgctctaattgctgtatgct

SEQ ID NO: 256424 - DNA, 25 bp, Mus musculus
atgagtgctctatttgctgtatgct

SEQ ID NO: 256425 - DNA, 25 bp, Mus musculus
atgagtgctctcattgctagtgtga

SEQ ID NO: 256426 - DNA, 25 bp, Mus musculus
atgagtgctctctttgctagtgtga

SEQ ID NO: 256427 - DNA, 25 bp, Mus musculus
atgagtgctgaacgctctttccctg

SEQ ID NO: 256428 - DNA, 25 bp, Mus musculus
atgagtgctgaaggctctttccctg

SEQ ID NO: 256429 - DNA, 25 bp, Mus musculus
atgagtgctgggatccttaggaatt

SEQ ID NO: 256430 - DNA, 25 bp, Mus musculus
atgagtgctgggttccttaggaatt

SEQ ID NO: 256431 - DNA, 25 bp, Mus musculus
atgagtggatcccaactgctaagaa

SEQ ID NO: 256432 - DNA, 25 bp, Mus musculus
atgagtggatccgaactgctaagaa

SEQ ID NO: 256433 - DNA, 25 bp, Mus musculus
atgagtggatctcttgccctacggg

SEQ ID NO: 256434 - DNA, 25 bp, Mus musculus
atgagtggatctgttgccctacggg

SEQ ID NO: 256435 - DNA, 25 bp, Mus musculus
atgagtggcaacaaaggttcctgtt

SEQ ID NO: 256436 - DNA, 25 bp, Mus musculus
atgagtggcaactaaggttcctgtt

SEQ ID NO: 256437 - DNA, 25 bp, Mus musculus
atgagtggccaccaagagccttgac

SEQ ID NO: 256438 - DNA, 25 bp, Mus musculus
atgagtggccacgaagagccttgac

SEQ ID NO: 256439 - DNA, 25 bp, Mus musculus
atgagtggcctcagttgacttgttt

SEQ ID NO: 256440 - DNA, 25 bp, Mus musculus
atgagtggcctctgttgacttgttt

SEQ ID NO: 256441 - DNA, 25 bp, Mus musculus
atgagtggctatcgcattctcaaga

SEQ ID NO: 256442 - DNA, 25 bp, Mus musculus
atgagtggctatggcattctcaaga

SEQ ID NO: 256443 - DNA, 25 bp, Mus musculus
atgagtgtcacaacgctggaggaaa

SEQ ID NO: 256444 - DNA, 25 bp, Mus musculus
atgagtgtcacatcgctggaggaaa

SEQ ID NO: 256445 - DNA, 25 bp, Mus musculus
atgagtgtcattatcctccttgtac

SEQ ID NO: 256446 - DNA, 25 bp, Mus musculus
atgagtgtcattttcctccttgtac

SEQ ID NO: 256447 - DNA, 25 bp, Mus musculus
atgagtgtccaccacatcctgattt

SEQ ID NO: 256448 - DNA, 25 bp, Mus musculus
atgagtgtccacgacatcctgattt

SEQ ID NO: 256449 - DNA, 25 bp, Mus musculus
atgagtgtccagagcactctccctt

SEQ ID NO: 256450 - DNA, 25 bp, Mus musculus
atgagtgtccagtgcactctccctt

SEQ ID NO: 256451 - DNA, 25 bp, Mus musculus
atgagtgtccgtatgcattaccttt

SEQ ID NO: 256452 - DNA, 25 bp, Mus musculus
atgagtgtccgtttgcattaccttt

SEQ ID NO: 256453 - DNA, 25 bp, Mus musculus
atgagtgtcctgacagagactcggg

SEQ ID NO: 256454 - DNA, 25 bp, Mus musculus
atgagtgtcctgtcagagactcggg

SEQ ID NO: 256455 - DNA, 25 bp, Mus musculus
atgagtgtcgccacaagactttcca

SEQ ID NO: 256456 - DNA, 25 bp, Mus musculus
atgagtgtcgcctcaagactttcca

SEQ ID NO: 256457 - DNA, 25 bp, Mus musculus
atgagtgtctttcgctcctttctgc

SEQ ID NO: 256458 - DNA, 25 bp, Mus musculus
atgagtgtctttggctcctttctgc

SEQ ID NO: 256459 - DNA, 25 bp, Mus musculus
atgagtgtgaccacaaagccctcgt

SEQ ID NO: 256460 - DNA, 25 bp, Mus musculus
atgagtgtgacctcaaagccctcgt

SEQ ID NO: 256461 - DNA, 25 bp, Mus musculus
atgagtgtgagtacacgggcctcgt

SEQ ID NO: 256462 - DNA, 25 bp, Mus musculus
atgagtgtgagttcacgggcctcgt

SEQ ID NO: 256463 - DNA, 25 bp, Mus musculus
atgagtgtgattccctaatggccaa

SEQ ID NO: 256464 - DNA, 25 bp, Mus musculus
atgagtgtgattcctgtatactttt

SEQ ID NO: 256465 - DNA, 25 bp, Mus musculus
atgagtgtgattgcctaatggccaa

SEQ ID NO: 256466 - DNA, 25 bp, Mus musculus
atgagtgtgattgctgtatactttt

SEQ ID NO: 256467 - DNA, 25 bp, Mus musculus
atgagtgtgcatatgattctgttta

SEQ ID NO: 256468 - DNA, 25 bp, Mus musculus
atgagtgtgcatttgattctgttta

SEQ ID NO: 256469 - DNA, 25 bp, Mus musculus
atgagtgtggacagttcacttcctc

SEQ ID NO: 256470 - DNA, 25 bp, Mus musculus
atgagtgtggactgttcacttcctc

SEQ ID NO: 256471 - DNA, 25 bp, Mus musculus
atgagtgtgggcaggtaccctctgc

SEQ ID NO: 256472 - DNA, 25 bp, Mus musculus
atgagtgtgggctggtaccctctgc

SEQ ID NO: 256473 - DNA, 25 bp, Mus musculus
atgagtgtgtccagaggctcagcag

SEQ ID NO: 256474 - DNA, 25 bp, Mus musculus
atgagtgtgtcctgaggctcagcag

SEQ ID NO: 256475 - DNA, 25 bp, Mus musculus
atgagtgtgtgaccggcatccataa

SEQ ID NO: 256476 - DNA, 25 bp, Mus musculus
atgagtgtgtgagcggcatccataa

SEQ ID NO: 256477 - DNA, 25 bp, Mus musculus
atgagtgttaccagttcagttcatt

SEQ ID NO: 256478 - DNA, 25 bp, Mus musculus
atgagtgttacctgttcagttcatt

SEQ ID NO: 256479 - DNA, 25 bp, Mus musculus
atgagtgttagacaaggcaagcccc

SEQ ID NO: 256480 - DNA, 25 bp, Mus musculus
atgagtgttagagaaggcaagcccc

SEQ ID NO: 256481 - DNA, 25 bp, Mus musculus
atgagtgttattattctgggttgtt

SEQ ID NO: 256482 - DNA, 25 bp, Mus musculus
atgagtgttatttttctgggttgtt

SEQ ID NO: 256483 - DNA, 25 bp, Mus musculus
atgagtgttcacatctgaagctaat

SEQ ID NO: 256484 - DNA, 25 bp, Mus musculus
atgagtgttcacttctgaagctaat

SEQ ID NO: 256485 - DNA, 25 bp, Mus musculus
atgagtgttccaactcgtgacagag

SEQ ID NO: 256486 - DNA, 25 bp, Mus musculus
atgagtgttccatctcgtgacagag

SEQ ID NO: 256487 - DNA, 25 bp, Mus musculus
atgagtgttctaacacccacaattc

SEQ ID NO: 256488 - DNA, 25 bp, Mus musculus
atgagtgttctatcacccacaattc

SEQ ID NO: 256489 - DNA, 25 bp, Mus musculus
atgagtgttgctaccggagctgtga

SEQ ID NO: 256490 - DNA, 25 bp, Mus musculus
atgagtgttgcttccggagctgtga

SEQ ID NO: 256491 - DNA, 25 bp, Mus musculus
atgagttacacactgcagcatctcc

SEQ ID NO: 256492 - DNA, 25 bp, Mus musculus
atgagttacacagtgcagcatctcc

SEQ ID NO: 256493 - DNA, 25 bp, Mus musculus
atgagttacatcagcattccaaaga

SEQ ID NO: 256494 - DNA, 25 bp, Mus musculus
atgagttacatctgcattccaaaga

SEQ ID NO: 256495 - DNA, 25 bp, Mus musculus
atgagttacctcaatccttcaccgt

SEQ ID NO: 256496 - DNA, 25 bp, Mus musculus
atgagttacctctatccttcaccgt

SEQ ID NO: 256497 - DNA, 25 bp, Mus musculus
atgagttacgcaagctgcacagata

SEQ ID NO: 256498 - DNA, 25 bp, Mus musculus
atgagttacgcatgctgcacagata

SEQ ID NO: 256499 - DNA, 25 bp, Mus musculus
atgagttagaagctccagcccctgc

SEQ ID NO: 256500 - DNA, 25 bp, Mus musculus
atgagttagaaggtccagcccctgc

SEQ ID NO: 256501 - DNA, 25 bp, Mus musculus
atgagttagagtctgccatttgaga

SEQ ID NO: 256502 - DNA, 25 bp, Mus musculus
atgagttagagtgtgccatttgaga

SEQ ID NO: 256503 - DNA, 25 bp, Mus musculus
atgagttagtgcatgtgccagactt

SEQ ID NO: 256504 - DNA, 25 bp, Mus musculus
atgagttagtgcttgtgccagactt

SEQ ID NO: 256505 - DNA, 25 bp, Mus musculus
atgagttatgctcggcctcagttat

SEQ ID NO: 256506 - DNA, 25 bp, Mus musculus
atgagttatgctgggcctcagttat

SEQ ID NO: 256507 - DNA, 25 bp, Mus musculus
atgagttattacatagctgtgccta

SEQ ID NO: 256508 - DNA, 25 bp, Mus musculus
atgagttattacttagctgtgccta

SEQ ID NO: 256509 - DNA, 25 bp, Mus musculus
atgagttcaagaaatgtgcccctaa

SEQ ID NO: 256510 - DNA, 25 bp, Mus musculus
atgagttcaagatatgtgcccctaa

SEQ ID NO: 256511 - DNA, 25 bp, Mus musculus
atgagttcacagatcggttccagag

SEQ ID NO: 256512 - DNA, 25 bp, Mus musculus
atgagttcacagttcggttccagag

SEQ ID NO: 256513 - DNA, 25 bp, Mus musculus
atgagttcacctaccgcaggttctt

SEQ ID NO: 256514 - DNA, 25 bp, Mus musculus
atgagttcaccttccgcaggttctt

SEQ ID NO: 256515 - DNA, 25 bp, Mus musculus
atgagttcagcactgcactcccttc

SEQ ID NO: 256516 - DNA, 25 bp, Mus musculus
atgagttcagcactgtctacaagac

SEQ ID NO: 256517 - DNA, 25 bp, Mus musculus
atgagttcagcagtgcactcccttc

SEQ ID NO: 256518 - DNA, 25 bp, Mus musculus
atgagttcagcagtgtctacaagac

SEQ ID NO: 256519 - DNA, 25 bp, Mus musculus
atgagttcaggaactatggcaatgt

SEQ ID NO: 256520 - DNA, 25 bp, Mus musculus
atgagttcaggatctatggcaatgt

SEQ ID NO: 256521 - DNA, 25 bp, Mus musculus
atgagttcagttaaaaagtagtatt

SEQ ID NO: 256522 - DNA, 25 bp, Mus musculus
atgagttcagtttaaaagtagtatt

SEQ ID NO: 256523 - DNA, 25 bp, Mus musculus
atgagttcatacagctctgtcacta

SEQ ID NO: 256524 - DNA, 25 bp, Mus musculus
atgagttcatactgctctgtcacta

SEQ ID NO: 256525 - DNA, 25 bp, Mus musculus
atgagttccaacactctcaggccag

SEQ ID NO: 256526 - DNA, 25 bp, Mus musculus
atgagttccaactctctcaggccag

SEQ ID NO: 256527 - DNA, 25 bp, Mus musculus
atgagttccagcaaaccagacaaga

SEQ ID NO: 256528 - DNA, 25 bp, Mus musculus
atgagttccagctaaccagacaaga

SEQ ID NO: 256529 - DNA, 25 bp, Mus musculus
atgagttcccgaagctggcatccaa

SEQ ID NO: 256530 - DNA, 25 bp, Mus musculus
atgagttcccgatgctggcatccaa

SEQ ID NO: 256531 - DNA, 25 bp, Mus musculus
atgagttccggtccgctgttgccca

SEQ ID NO: 256532 - DNA, 25 bp, Mus musculus
atgagttccggtgcgctgttgccca

SEQ ID NO: 256533 - DNA, 25 bp, Mus musculus
atgagttcctatactgagccactac

SEQ ID NO: 256534 - DNA, 25 bp, Mus musculus
atgagttcctattctgagccactac

SEQ ID NO: 256535 - DNA, 25 bp, Mus musculus
atgagttcctggcacaggtgcttca

SEQ ID NO: 256536 - DNA, 25 bp, Mus musculus
atgagttcctgggacaggtgcttca

SEQ ID NO: 256537 - DNA, 25 bp, Mus musculus
atgagttctacaagtcctatcacct

SEQ ID NO: 256538 - DNA, 25 bp, Mus musculus
atgagttctacatgtcctatcacct

SEQ ID NO: 256539 - DNA, 25 bp, Mus musculus
atgagttctgcccagtctgcatcac

SEQ ID NO: 256540 - DNA, 25 bp, Mus musculus
atgagttctgccgagtctgcatcac

SEQ ID NO: 256541 - DNA, 25 bp, Mus musculus
atgagttcttctcctcacactgccg

SEQ ID NO: 256542 - DNA, 25 bp, Mus musculus
atgagttcttctgctcacactgccg

SEQ ID NO: 256543 - DNA, 25 bp, Mus musculus
atgagttctttcctagttctcacag

SEQ ID NO: 256544 - DNA, 25 bp, Mus musculus
atgagttctttcgtagttctcacag

SEQ ID NO: 256545 - DNA, 25 bp, Mus musculus
atgagttgaaatcccacttttgtga

SEQ ID NO: 256546 - DNA, 25 bp, Mus musculus
atgagttgaaatgccacttttgtga

SEQ ID NO: 256547 - DNA, 25 bp, Mus musculus
atgagttggactcatttccatttct

SEQ ID NO: 256548 - DNA, 25 bp, Mus musculus
atgagttggactgatttccatttct

SEQ ID NO: 256549 - DNA, 25 bp, Mus musculus
atgagttgggtgatcacaggcccca

SEQ ID NO: 256550 - DNA, 25 bp, Mus musculus
atgagttgggtgttcacaggcccca

SEQ ID NO: 256551 - DNA, 25 bp, Mus musculus
atgagttggtacagccagtggcctg

SEQ ID NO: 256552 - DNA, 25 bp, Mus musculus
atgagttggtactgccagtggcctg

SEQ ID NO: 256553 - DNA, 25 bp, Mus musculus
atgagttgtaggagcactgatctgc

SEQ ID NO: 256554 - DNA, 25 bp, Mus musculus
atgagttgtaggtgcactgatctgc

SEQ ID NO: 256555 - DNA, 25 bp, Mus musculus
atgagttgtctgacaccttgccctg

SEQ ID NO: 256556 - DNA, 25 bp, Mus musculus
atgagttgtctgtcaccttgccctg

SEQ ID NO: 256557 - DNA, 25 bp, Mus musculus
atgagttgtgccatgtgtgtgaagc

SEQ ID NO: 256558 - DNA, 25 bp, Mus musculus
atgagttgtgccttgtgtgtgaagc

SEQ ID NO: 256559 - DNA, 25 bp, Mus musculus
atgagtttagagacacttccaagtt

SEQ ID NO: 256560 - DNA, 25 bp, Mus musculus
atgagtttagagtcacttccaagtt

SEQ ID NO: 256561 - DNA, 25 bp, Mus musculus
atgagtttagcgcacaggcactgtc

SEQ ID NO: 256562 - DNA, 25 bp, Mus musculus
atgagtttagcggacaggcactgtc

SEQ ID NO: 256563 - DNA, 25 bp, Mus musculus
atgagtttatccacttgtttgcctt

SEQ ID NO: 256564 - DNA, 25 bp, Mus musculus
atgagtttatcctcttgtttgcctt

SEQ ID NO: 256565 - DNA, 25 bp, Mus musculus
atgagtttcttcaagaggctccgct

SEQ ID NO: 256566 - DNA, 25 bp, Mus musculus
atgagtttcttctagaggctccgct

SEQ ID NO: 256567 - DNA, 25 bp, Mus musculus
atgagtttgcatacctgcttgagaa

SEQ ID NO: 256568 - DNA, 25 bp, Mus musculus
atgagtttgcattcctgcttgagaa

SEQ ID NO: 256569 - DNA, 25 bp, Mus musculus
atgagtttgtccagtgttatgcaca

SEQ ID NO: 256570 - DNA, 25 bp, Mus musculus
atgagtttgtcctgtgttatgcaca

SEQ ID NO: 256571 - DNA, 25 bp, Mus musculus
atgagttttactcctggcacacagg

SEQ ID NO: 256572 - DNA, 25 bp, Mus musculus
atgagttttactgctggcacacagg

SEQ ID NO: 256573 - DNA, 25 bp, Mus musculus
atgagttttatcatctcgattgaat

SEQ ID NO: 256574 - DNA, 25 bp, Mus musculus
atgagttttatcttctcgattgaat

SEQ ID NO: 256575 - DNA, 25 bp, Mus musculus
atgagttttcttctatattttcctt

SEQ ID NO: 256576 - DNA, 25 bp, Mus musculus
atgagttttcttgtatattttcctt

SEQ ID NO: 256577 - DNA, 25 bp, Mus musculus
atgagttttgcactgtaccgcgtag

SEQ ID NO: 256578 - DNA, 25 bp, Mus musculus
atgagttttgcagtgtaccgcgtag

SEQ ID NO: 256579 - DNA, 25 bp, Mus musculus
atgataaaaattctattcatccctt

SEQ ID NO: 256580 - DNA, 25 bp, Mus musculus
atgataaaaattgtattcatccctt

SEQ ID NO: 256581 - DNA, 25 bp, Mus musculus
atgataaacgacacatttctgagaa

SEQ ID NO: 256582 - DNA, 25 bp, Mus musculus
atgataaacgactcatttctgagaa

SEQ ID NO: 256583 - DNA, 25 bp, Mus musculus
atgataaactaacccgctccatccg

SEQ ID NO: 256584 - DNA, 25 bp, Mus musculus
atgataaactaagccgctccatccg

SEQ ID NO: 256585 - DNA, 25 bp, Mus musculus
atgataaactacaccatcaggccct

SEQ ID NO: 256586 - DNA, 25 bp, Mus musculus
atgataaactactccatcaggccct

SEQ ID NO: 256587 - DNA, 25 bp, Mus musculus
atgataaagccgcagcccagttcct

SEQ ID NO: 256588 - DNA, 25 bp, Mus musculus
atgataaagccggagcccagttcct

SEQ ID NO: 256589 - DNA, 25 bp, Mus musculus
atgataacatgccatattatgtgtt

SEQ ID NO: 256590 - DNA, 25 bp, Mus musculus
atgataacatgcgatattatgtgtt

SEQ ID NO: 256591 - DNA, 25 bp, Mus musculus
atgataaccaggacatggtgtctga

SEQ ID NO: 256592 - DNA, 25 bp, Mus musculus
atgataaccaggtcatggtgtctga

SEQ ID NO: 256593 - DNA, 25 bp, Mus musculus
atgataacccttcatagccttggct

SEQ ID NO: 256594 - DNA, 25 bp, Mus musculus
atgataacccttgatagccttggct

SEQ ID NO: 256595 - DNA, 25 bp, Mus musculus
atgataacttgcagttgccctgcct

SEQ ID NO: 256596 - DNA, 25 bp, Mus musculus
atgataacttgctgttgccctgcct

SEQ ID NO: 256597 - DNA, 25 bp, Mus musculus
atgataagcgccagcagagccgcgg

SEQ ID NO: 256598 - DNA, 25 bp, Mus musculus
atgataagcgcctgcagagccgcgg

SEQ ID NO: 256599 - DNA, 25 bp, Mus musculus
atgataagctccaagccaggttgag

SEQ ID NO: 256600 - DNA, 25 bp, Mus musculus
atgataagctcctagccaggttgag

SEQ ID NO: 256601 - DNA, 25 bp, Mus musculus
atgataaggatcacgcccacagcag

SEQ ID NO: 256602 - DNA, 25 bp, Mus musculus
atgataaggatctcgcccacagcag

SEQ ID NO: 256603 - DNA, 25 bp, Mus musculus
atgataagggatacggtccacacta

SEQ ID NO: 256604 - DNA, 25 bp, Mus musculus
atgataagggattcggtccacacta

SEQ ID NO: 256605 - DNA, 25 bp, Mus musculus
atgataatacttaagctgtgtgtgt

SEQ ID NO: 256606 - DNA, 25 bp, Mus musculus
atgataatactttagctgtgtgtgt

SEQ ID NO: 256607 - DNA, 25 bp, Mus musculus
atgataatcttgcactggcaacaaa

SEQ ID NO: 256608 - DNA, 25 bp, Mus musculus
atgataatcttggactggcaacaaa

SEQ ID NO: 256609 - DNA, 25 bp, Mus musculus
atgataatgcggagattaccttgct

SEQ ID NO: 256610 - DNA, 25 bp, Mus musculus
atgataatgcggtgattaccttgct

SEQ ID NO: 256611 - DNA, 25 bp, Mus musculus
atgataatttacctccattccaagt

SEQ ID NO: 256612 - DNA, 25 bp, Mus musculus
atgataatttacgtccattccaagt

SEQ ID NO: 256613 - DNA, 25 bp, Mus musculus
atgatacactcgagaccccaagagc

SEQ ID NO: 256614 - DNA, 25 bp, Mus musculus
atgatacactcgtgaccccaagagc

SEQ ID NO: 256615 - DNA, 25 bp, Mus musculus
atgatacatcccacctcttggtagg

SEQ ID NO: 256616 - DNA, 25 bp, Mus musculus
atgatacatccctcctcttggtagg

SEQ ID NO: 256617 - DNA, 25 bp, Mus musculus
atgatacatgcacttttgcttcccc

SEQ ID NO: 256618 - DNA, 25 bp, Mus musculus
atgatacatgcagttttgcttcccc

SEQ ID NO: 256619 - DNA, 25 bp, Mus musculus
atgataccatgccaaagagcttatt

SEQ ID NO: 256620 - DNA, 25 bp, Mus musculus
atgataccatgcgaaagagcttatt

SEQ ID NO: 256621 - DNA, 25 bp, Mus musculus
atgataccctttatctttccgagtg

SEQ ID NO: 256622 - DNA, 25 bp, Mus musculus
atgataccctttttctttccgagtg

SEQ ID NO: 256623 - DNA, 25 bp, Mus musculus
atgatacgagacacagtccggccta

SEQ ID NO: 256624 - DNA, 25 bp, Mus musculus
atgatacgagactcagtccggccta

SEQ ID NO: 256625 - DNA, 25 bp, Mus musculus
atgatacgatgcaggccatgtgctc

SEQ ID NO: 256626 - DNA, 25 bp, Mus musculus
atgatacgatgctggccatgtgctc

SEQ ID NO: 256627 - DNA, 25 bp, Mus musculus
atgatacgcttgcactatctatccc

SEQ ID NO: 256628 - DNA, 25 bp, Mus musculus
atgatacgcttggactatctatccc

SEQ ID NO: 256629 - DNA, 25 bp, Mus musculus
atgatactacgtactctgggttttc

SEQ ID NO: 256630 - DNA, 25 bp, Mus musculus
atgatactacgttctctgggttttc

SEQ ID NO: 256631 - DNA, 25 bp, Mus musculus
atgatactcactctgttctgtctga

SEQ ID NO: 256632 - DNA, 25 bp, Mus musculus
atgatactcactgtgttctgtctga

SEQ ID NO: 256633 - DNA, 25 bp, Mus musculus
atgatactcagtatgtcctggctcc

SEQ ID NO: 256634 - DNA, 25 bp, Mus musculus
atgatactcagtttgtcctggctcc

SEQ ID NO: 256635 - DNA, 25 bp, Mus musculus
atgatactgatcattgcgttccgtg

SEQ ID NO: 256636 - DNA, 25 bp, Mus musculus
atgatactgatctttgcgttccgtg

SEQ ID NO: 256637 - DNA, 25 bp, Mus musculus
atgatactggctccaagtggcttct

SEQ ID NO: 256638 - DNA, 25 bp, Mus musculus
atgatactggctgcaagtggcttct

SEQ ID NO: 256639 - DNA, 25 bp, Mus musculus
atgatactgggaaatacacttttgt

SEQ ID NO: 256640 - DNA, 25 bp, Mus musculus
atgatactgggatatacacttttgt

SEQ ID NO: 256641 - DNA, 25 bp, Mus musculus
atgatactggttccgagtccgattc

SEQ ID NO: 256642 - DNA, 25 bp, Mus musculus
atgatactggttgcgagtccgattc

SEQ ID NO: 256643 - DNA, 25 bp, Mus musculus
atgatacttcatattgctacttaca

SEQ ID NO: 256644 - DNA, 25 bp, Mus musculus
atgatacttcattttgctacttaca

SEQ ID NO: 256645 - DNA, 25 bp, Mus musculus
atgatactttgtaaactgtctctaa

SEQ ID NO: 256646 - DNA, 25 bp, Mus musculus
atgatactttgttaactgtctctaa

SEQ ID NO: 256647 - DNA, 25 bp, Mus musculus
atgatacttttgctggatatgattt

SEQ ID NO: 256648 - DNA, 25 bp, Mus musculus
atgatacttttggtggatatgattt

SEQ ID NO: 256649 - DNA, 25 bp, Mus musculus
atgatagactcaatgccctgtgcct

SEQ ID NO: 256650 - DNA, 25 bp, Mus musculus
atgatagactcattgccctgtgcct

SEQ ID NO: 256651 - DNA, 25 bp, Mus musculus
atgatagagcggacaccagagtgtg

SEQ ID NO: 256652 - DNA, 25 bp, Mus musculus
atgatagagcggtcaccagagtgtg

SEQ ID NO: 256653 - DNA, 25 bp, Mus musculus
atgatagagggcatctctcccaggt

SEQ ID NO: 256654 - DNA, 25 bp, Mus musculus
atgatagagggcttctctcccaggt

SEQ ID NO: 256655 - DNA, 25 bp, Mus musculus
atgatagaggtacctctccctttca

SEQ ID NO: 256656 - DNA, 25 bp, Mus musculus
atgatagaggtagctctccctttca

SEQ ID NO: 256657 - DNA, 25 bp, Mus musculus
atgatagagtcccaatggctgcccc

SEQ ID NO: 256658 - DNA, 25 bp, Mus musculus
atgatagagtccgaatggctgcccc

SEQ ID NO: 256659 - DNA, 25 bp, Mus musculus
atgatagagttcacggaggactgcc

SEQ ID NO: 256660 - DNA, 25 bp, Mus musculus
atgatagagttctcggaggactgcc

SEQ ID NO: 256661 - DNA, 25 bp, Mus musculus
atgatagcaaccagcctctatttgt

SEQ ID NO: 256662 - DNA, 25 bp, Mus musculus
atgatagcaacctgcctctatttgt

SEQ ID NO: 256663 - DNA, 25 bp, Mus musculus
atgatagcagggacctctcgtccgg

SEQ ID NO: 256664 - DNA, 25 bp, Mus musculus
atgatagcagggtcctctcgtccgg

SEQ ID NO: 256665 - DNA, 25 bp, Mus musculus
atgatagcagttctctttctcaatc

SEQ ID NO: 256666 - DNA, 25 bp, Mus musculus
atgatagcagttgtctttctcaatc

SEQ ID NO: 256667 - DNA, 25 bp, Mus musculus
atgatagccagcatgttcccaagtc

SEQ ID NO: 256668 - DNA, 25 bp, Mus musculus
atgatagccagcttgttcccaagtc

SEQ ID NO: 256669 - DNA, 25 bp, Mus musculus
atgatagccagtcattctcaccgtc

SEQ ID NO: 256670 - DNA, 25 bp, Mus musculus
atgatagccagtgattctcaccgtc

SEQ ID NO: 256671 - DNA, 25 bp, Mus musculus
atgatagcccagccccaggacctta

SEQ ID NO: 256672 - DNA, 25 bp, Mus musculus
atgatagcccaggcccaggacctta

SEQ ID NO: 256673 - DNA, 25 bp, Mus musculus
atgatagcctaccatgcccttcttg

SEQ ID NO: 256674 - DNA, 25 bp, Mus musculus
atgatagcctacgatgcccttcttg

SEQ ID NO: 256675 - DNA, 25 bp, Mus musculus
atgatagcctgaaagtgggcctgtc

SEQ ID NO: 256676 - DNA, 25 bp, Mus musculus
atgatagcctgatagtgggcctgtc

SEQ ID NO: 256677 - DNA, 25 bp, Mus musculus
atgatagcggacagcaaagcagttc

SEQ ID NO: 256678 - DNA, 25 bp, Mus musculus
atgatagcggactgcaaagcagttc

SEQ ID NO: 256679 - DNA, 25 bp, Mus musculus
atgatagctgcacacgtctctactt

SEQ ID NO: 256680 - DNA, 25 bp, Mus musculus
atgatagctgcagacgtctctactt

SEQ ID NO: 256681 - DNA, 25 bp, Mus musculus
atgatagctgtcctccaagtggcca

SEQ ID NO: 256682 - DNA, 25 bp, Mus musculus
atgatagctgtcgtccaagtggcca

SEQ ID NO: 256683 - DNA, 25 bp, Mus musculus
atgatagcttttcggcactgtgtta

SEQ ID NO: 256684 - DNA, 25 bp, Mus musculus
atgatagcttttgggcactgtgtta

SEQ ID NO: 256685 - DNA, 25 bp, Mus musculus
atgataggagtcacacaaccacctg

SEQ ID NO: 256686 - DNA, 25 bp, Mus musculus
atgataggagtctcacaaccacctg

SEQ ID NO: 256687 - DNA, 25 bp, Mus musculus
atgataggccctcccatgcttttgt

SEQ ID NO: 256688 - DNA, 25 bp, Mus musculus
atgataggccctgccatgcttttgt

SEQ ID NO: 256689 - DNA, 25 bp, Mus musculus
atgatagggacaacagacctcctcc

SEQ ID NO: 256690 - DNA, 25 bp, Mus musculus
atgatagggacatcagacctcctcc

SEQ ID NO: 256691 - DNA, 25 bp, Mus musculus
atgataggtgtgagccaacgcccca

SEQ ID NO: 256692 - DNA, 25 bp, Mus musculus
atgataggtgtgtgccaacgcccca

SEQ ID NO: 256693 - DNA, 25 bp, Mus musculus
atgatagtacatctggtgtccaacc

SEQ ID NO: 256694 - DNA, 25 bp, Mus musculus
atgatagtacatgtggtgtccaacc

SEQ ID NO: 256695 - DNA, 25 bp, Mus musculus
atgatagtgatcaccaggcgcactg

SEQ ID NO: 256696 - DNA, 25 bp, Mus musculus
atgatagtgatctccaggcgcactg

SEQ ID NO: 256697 - DNA, 25 bp, Mus musculus
atgatagtgatgctgttgtccttcc

SEQ ID NO: 256698 - DNA, 25 bp, Mus musculus
atgatagtgatggtgttgtccttcc

SEQ ID NO: 256699 - DNA, 25 bp, Mus musculus
atgatagtgtgtcccagaactccaa

SEQ ID NO: 256700 - DNA, 25 bp, Mus musculus
atgatagtgtgtgccagaactccaa

SEQ ID NO: 256701 - DNA, 25 bp, Mus musculus
atgatatacaagatagaaaccctgt

SEQ ID NO: 256702 - DNA, 25 bp, Mus musculus
atgatatacaagttagaaaccctgt

SEQ ID NO: 256703 - DNA, 25 bp, Mus musculus
atgatatacagtctgtacacgcaca

SEQ ID NO: 256704 - DNA, 25 bp, Mus musculus
atgatatacagtgtgtacacgcaca

SEQ ID NO: 256705 - DNA, 25 bp, Mus musculus
atgatatatcccatggtattttgaa

SEQ ID NO: 256706 - DNA, 25 bp, Mus musculus
atgatatatcccttggtattttgaa

SEQ ID NO: 256707 - DNA, 25 bp, Mus musculus
atgatatattctattccttgggtct

SEQ ID NO: 256708 - DNA, 25 bp, Mus musculus
atgatatattcttttccttgggtct

SEQ ID NO: 256709 - DNA, 25 bp, Mus musculus
atgatatcaaacacagcgacctggc

SEQ ID NO: 256710 - DNA, 25 bp, Mus musculus
atgatatcaaactcagcgacctggc

SEQ ID NO: 256711 - DNA, 25 bp, Mus musculus
atgatatcagatatgtgcttcccct

SEQ ID NO: 256712 - DNA, 25 bp, Mus musculus
atgatatcagatttgtgcttcccct

SEQ ID NO: 256713 - DNA, 25 bp, Mus musculus
atgatatccaaacatggagtcgtct

SEQ ID NO: 256714 - DNA, 25 bp, Mus musculus
atgatatccaaagatggagtcgtct

SEQ ID NO: 256715 - DNA, 25 bp, Mus musculus
atgatatcccctactgagaagccta

SEQ ID NO: 256716 - DNA, 25 bp, Mus musculus
atgatatccccttctgagaagccta

SEQ ID NO: 256717 - DNA, 25 bp, Mus musculus
atgatatccttgcagcagtttgttg

SEQ ID NO: 256718 - DNA, 25 bp, Mus musculus
atgatatccttggagcagtttgttg

SEQ ID NO: 256719 - DNA, 25 bp, Mus musculus
atgatatctaccaacctctattttc

SEQ ID NO: 256720 - DNA, 25 bp, Mus musculus
atgatatctacctacctctattttc

SEQ ID NO: 256721 - DNA, 25 bp, Mus musculus
atgatatctgataggtgacccgcaa

SEQ ID NO: 256722 - DNA, 25 bp, Mus musculus
atgatatctgattggtgacccgcaa

SEQ ID NO: 256723 - DNA, 25 bp, Mus musculus
atgatatgaaatccaaaacatgttc

SEQ ID NO: 256724 - DNA, 25 bp, Mus musculus
atgatatgaaatgcaaaacatgttc

SEQ ID NO: 256725 - DNA, 25 bp, Mus musculus
atgatatgcattagatccactgttc

SEQ ID NO: 256726 - DNA, 25 bp, Mus musculus
atgatatgcatttgatccactgttc

SEQ ID NO: 256727 - DNA, 25 bp, Mus musculus
atgatatgccatatacccttggttt

SEQ ID NO: 256728 - DNA, 25 bp, Mus musculus
atgatatgccatttacccttggttt

SEQ ID NO: 256729 - DNA, 25 bp, Mus musculus
atgatatgcttgctattatgaccca

SEQ ID NO: 256730 - DNA, 25 bp, Mus musculus
atgatatgcttggtattatgaccca

SEQ ID NO: 256731 - DNA, 25 bp, Mus musculus
atgatatgggctctctggtgtcatc

SEQ ID NO: 256732 - DNA, 25 bp, Mus musculus
atgatatgggctgtctggtgtcatc

SEQ ID NO: 256733 - DNA, 25 bp, Mus musculus
atgatatgtgtgaccgactctactt

SEQ ID NO: 256734 - DNA, 25 bp, Mus musculus
atgatatgtgtgtccgactctactt

SEQ ID NO: 256735 - DNA, 25 bp, Mus musculus
atgatattcttaatgtccctgctag

SEQ ID NO: 256736 - DNA, 25 bp, Mus musculus
atgatattcttattgtccctgctag

SEQ ID NO: 256737 - DNA, 25 bp, Mus musculus
atgatatttcataactttctgacat

SEQ ID NO: 256738 - DNA, 25 bp, Mus musculus
atgatatttcattactttctgacat

SEQ ID NO: 256739 - DNA, 25 bp, Mus musculus
atgatatttgacctcctggactgga

SEQ ID NO: 256740 - DNA, 25 bp, Mus musculus
atgatatttgacgtcctggactgga

SEQ ID NO: 256741 - DNA, 25 bp, Mus musculus
atgatatttggcagctgtcctccag

SEQ ID NO: 256742 - DNA, 25 bp, Mus musculus
atgatatttggctgctgtcctccag

SEQ ID NO: 256743 - DNA, 25 bp, Mus musculus
atgatatttgggatatttctgtttt

SEQ ID NO: 256744 - DNA, 25 bp, Mus musculus
atgatatttgggttatttctgtttt

SEQ ID NO: 256745 - DNA, 25 bp, Mus musculus
atgatcaaagcaatgatgacgctac

SEQ ID NO: 256746 - DNA, 25 bp, Mus musculus
atgatcaaagcattgatgacgctac

SEQ ID NO: 256747 - DNA, 25 bp, Mus musculus
atgatcaaatgcagcctgccttgca

SEQ ID NO: 256748 - DNA, 25 bp, Mus musculus
atgatcaaatgctgcctgccttgca

SEQ ID NO: 256749 - DNA, 25 bp, Mus musculus
atgatcaagagcagctgactgcgca

SEQ ID NO: 256750 - DNA, 25 bp, Mus musculus
atgatcaagagctgctgactgcgca

SEQ ID NO: 256751 - DNA, 25 bp, Mus musculus
atgatcacagatcgtttctttttcc

SEQ ID NO: 256752 - DNA, 25 bp, Mus musculus
atgatcacagatggtttctttttcc

SEQ ID NO: 256753 - DNA, 25 bp, Mus musculus
atgatcacatttcttaaagtgttaa

SEQ ID NO: 256754 - DNA, 25 bp, Mus musculus
atgatcacatttgttaaagtgttaa

SEQ ID NO: 256755 - DNA, 25 bp, Mus musculus
atgatcacccatcaaaggcgcctgc

SEQ ID NO: 256756 - DNA, 25 bp, Mus musculus
atgatcacccatgaaaggcgcctgc

SEQ ID NO: 256757 - DNA, 25 bp, Mus musculus
atgatcacccttcatcagaaatggg

SEQ ID NO: 256758 - DNA, 25 bp, Mus musculus
atgatcacccttgatcagaaatggg

SEQ ID NO: 256759 - DNA, 25 bp, Mus musculus
atgatcacgaggatctgttggccaa

SEQ ID NO: 256760 - DNA, 25 bp, Mus musculus
atgatcacgaggttctgttggccaa

SEQ ID NO: 256761 - DNA, 25 bp, Mus musculus
atgatcacgcagatggctggcttca

SEQ ID NO: 256762 - DNA, 25 bp, Mus musculus
atgatcacgcagttggctggcttca

SEQ ID NO: 256763 - DNA, 25 bp, Mus musculus
atgatcactatgaccaggcttccaa

SEQ ID NO: 256764 - DNA, 25 bp, Mus musculus
atgatcactatgtccaggcttccaa

SEQ ID NO: 256765 - DNA, 25 bp, Mus musculus
atgatcactcagattcttcctgcta

SEQ ID NO: 256766 - DNA, 25 bp, Mus musculus
atgatcactcagtttcttcctgcta

SEQ ID NO: 256767 - DNA, 25 bp, Mus musculus
atgatcactgtgcacacgccccgga

SEQ ID NO: 256768 - DNA, 25 bp, Mus musculus
atgatcactgtgcattttgttaatg

SEQ ID NO: 256769 - DNA, 25 bp, Mus musculus
atgatcactgtggacacgccccgga

SEQ ID NO: 256770 - DNA, 25 bp, Mus musculus
atgatcactgtggattttgttaatg

SEQ ID NO: 256771 - DNA, 25 bp, Mus musculus
atgatcacttcaaaataccactccc

SEQ ID NO: 256772 - DNA, 25 bp, Mus musculus
atgatcacttcataataccactccc

SEQ ID NO: 256773 - DNA, 25 bp, Mus musculus
atgatcagaattaatttgccccaaa

SEQ ID NO: 256774 - DNA, 25 bp, Mus musculus
atgatcagaatttatttgccccaaa

SEQ ID NO: 256775 - DNA, 25 bp, Mus musculus
atgatcagacgcacctcttggtgaa

SEQ ID NO: 256776 - DNA, 25 bp, Mus musculus
atgatcagacgctcctcttggtgaa

SEQ ID NO: 256777 - DNA, 25 bp, Mus musculus
atgatcagagacaaatgaccattag

SEQ ID NO: 256778 - DNA, 25 bp, Mus musculus
atgatcagagactaatgaccattag

SEQ ID NO: 256779 - DNA, 25 bp, Mus musculus
atgatcagcaccattggcagcagct

SEQ ID NO: 256780 - DNA, 25 bp, Mus musculus
atgatcagcacctttggcagcagct

SEQ ID NO: 256781 - DNA, 25 bp, Mus musculus
atgatcagcgaacacctgggccagc

SEQ ID NO: 256782 - DNA, 25 bp, Mus musculus
atgatcagcgaagacctgggccagc

SEQ ID NO: 256783 - DNA, 25 bp, Mus musculus
atgatcagctgaaacccttgggccc

SEQ ID NO: 256784 - DNA, 25 bp, Mus musculus
atgatcagctgatacccttgggccc

SEQ ID NO: 256785 - DNA, 25 bp, Mus musculus
atgatcaggaccatatcctgcccat

SEQ ID NO: 256786 - DNA, 25 bp, Mus musculus
atgatcaggaccttatcctgcccat

SEQ ID NO: 256787 - DNA, 25 bp, Mus musculus
atgatcataactcccatcctgcgat

SEQ ID NO: 256788 - DNA, 25 bp, Mus musculus
atgatcataactgccatcctgcgat

SEQ ID NO: 256789 - DNA, 25 bp, Mus musculus
atgatcatacataccctttggcgac

SEQ ID NO: 256790 - DNA, 25 bp, Mus musculus
atgatcatacattccctttggcgac

SEQ ID NO: 256791 - DNA, 25 bp, Mus musculus
atgatcatacccactctggctttca

SEQ ID NO: 256792 - DNA, 25 bp, Mus musculus
atgatcataccctctctggctttca

SEQ ID NO: 256793 - DNA, 25 bp, Mus musculus
atgatcatcagcctattcgccacag

SEQ ID NO: 256794 - DNA, 25 bp, Mus musculus
atgatcatcagcgtattcgccacag

SEQ ID NO: 256795 - DNA, 25 bp, Mus musculus
atgatcatctgactggtggttccgc

SEQ ID NO: 256796 - DNA, 25 bp, Mus musculus
atgatcatctgagtggtggttccgc

SEQ ID NO: 256797 - DNA, 25 bp, Mus musculus
atgatcatgcagatccatttcttgg

SEQ ID NO: 256798 - DNA, 25 bp, Mus musculus
atgatcatgcagttccatttcttgg

SEQ ID NO: 256799 - DNA, 25 bp, Mus musculus
atgatcatgcttattctgcttttta

SEQ ID NO: 256800 - DNA, 25 bp, Mus musculus
atgatcatgctttttctgcttttta

SEQ ID NO: 256801 - DNA, 25 bp, Mus musculus
atgatcatggtcacacacggtacag

SEQ ID NO: 256802 - DNA, 25 bp, Mus musculus
atgatcatggtctcacacggtacag

SEQ ID NO: 256803 - DNA, 25 bp, Mus musculus
atgatcattctcctacttgtattta

SEQ ID NO: 256804 - DNA, 25 bp, Mus musculus
atgatcattctcgtacttgtattta

SEQ ID NO: 256805 - DNA, 25 bp, Mus musculus
atgatccacggaaccgacatatcaa

SEQ ID NO: 256806 - DNA, 25 bp, Mus musculus
atgatccacggatccgacatatcaa

SEQ ID NO: 256807 - DNA, 25 bp, Mus musculus
atgatccagaagactcagccaatta

SEQ ID NO: 256808 - DNA, 25 bp, Mus musculus
atgatccagaagtctcagccaatta

SEQ ID NO: 256809 - DNA, 25 bp, Mus musculus
atgatccagaggagtcccagctact

SEQ ID NO: 256810 - DNA, 25 bp, Mus musculus
atgatccagaggctgggccttttcc

SEQ ID NO: 256811 - DNA, 25 bp, Mus musculus
atgatccagagggtgggccttttcc

SEQ ID NO: 256812 - DNA, 25 bp, Mus musculus
atgatccagaggtgtcccagctact

SEQ ID NO: 256813 - DNA, 25 bp, Mus musculus
atgatccagatccaaagatggcttg

SEQ ID NO: 256814 - DNA, 25 bp, Mus musculus
atgatccagatcgaaagatggcttg

SEQ ID NO: 256815 - DNA, 25 bp, Mus musculus
atgatccagcacagagacacacagg

SEQ ID NO: 256816 - DNA, 25 bp, Mus musculus
atgatccagcactgagacacacagg

SEQ ID NO: 256817 - DNA, 25 bp, Mus musculus
atgatccagtatctgctcagtggct

SEQ ID NO: 256818 - DNA, 25 bp, Mus musculus
atgatccagtatgtgctcagtggct

SEQ ID NO: 256819 - DNA, 25 bp, Mus musculus
atgatccatccccaggttgctattg

SEQ ID NO: 256820 - DNA, 25 bp, Mus musculus
atgatccatcccgaggttgctattg

SEQ ID NO: 256821 - DNA, 25 bp, Mus musculus
atgatccattgcctagctgtccata

SEQ ID NO: 256822 - DNA, 25 bp, Mus musculus
atgatccattgcgtagctgtccata

SEQ ID NO: 256823 - DNA, 25 bp, Mus musculus
atgatcccagatagccagcgtcggt

SEQ ID NO: 256824 - DNA, 25 bp, Mus musculus
atgatcccagattgccagcgtcggt

SEQ ID NO: 256825 - DNA, 25 bp, Mus musculus
atgatcccataaatctaaactttga

SEQ ID NO: 256826 - DNA, 25 bp, Mus musculus
atgatcccataattctaaactttga

SEQ ID NO: 256827 - DNA, 25 bp, Mus musculus
atgatcccatttatgtacttctccc

SEQ ID NO: 256828 - DNA, 25 bp, Mus musculus
atgatcccatttttgtacttctccc

SEQ ID NO: 256829 - DNA, 25 bp, Mus musculus
atgatcccgattcttaggtgccaca

SEQ ID NO: 256830 - DNA, 25 bp, Mus musculus
atgatcccgattgttaggtgccaca

SEQ ID NO: 256831 - DNA, 25 bp, Mus musculus
atgatcccgtatcccctggagaagg

SEQ ID NO: 256832 - DNA, 25 bp, Mus musculus
atgatcccgtatgccctggagaagg

SEQ ID NO: 256833 - DNA, 25 bp, Mus musculus
atgatccctctcagtacaaaggcag

SEQ ID NO: 256834 - DNA, 25 bp, Mus musculus
atgatccctctctgtacaaaggcag

SEQ ID NO: 256835 - DNA, 25 bp, Mus musculus
atgatccctctgacaatctagtgaa

SEQ ID NO: 256836 - DNA, 25 bp, Mus musculus
atgatccctctgtcaatctagtgaa

SEQ ID NO: 256837 - DNA, 25 bp, Mus musculus
atgatccctgcaaaggactgttgtc

SEQ ID NO: 256838 - DNA, 25 bp, Mus musculus
atgatccctgcataggactgttgtc

SEQ ID NO: 256839 - DNA, 25 bp, Mus musculus
atgatccctttcacattcattgtga

SEQ ID NO: 256840 - DNA, 25 bp, Mus musculus
atgatccctttctcattcattgtga

SEQ ID NO: 256841 - DNA, 25 bp, Mus musculus
atgatccgaaagatgaagcttcctg

SEQ ID NO: 256842 - DNA, 25 bp, Mus musculus
atgatccgaaagttgaagcttcctg

SEQ ID NO: 256843 - DNA, 25 bp, Mus musculus
atgatccgaataactacctgttttg

SEQ ID NO: 256844 - DNA, 25 bp, Mus musculus
atgatccgaatatctacctgttttg

SEQ ID NO: 256845 - DNA, 25 bp, Mus musculus
atgatccgcaatcggctgctcaggc

SEQ ID NO: 256846 - DNA, 25 bp, Mus musculus
atgatccgcaatgggctgctcaggc

SEQ ID NO: 256847 - DNA, 25 bp, Mus musculus
atgatccgcacccttgcttctgact

SEQ ID NO: 256848 - DNA, 25 bp, Mus musculus
atgatccgcaccgttgcttctgact

SEQ ID NO: 256849 - DNA, 25 bp, Mus musculus
atgatccggaagagctagccattat

SEQ ID NO: 256850 - DNA, 25 bp, Mus musculus
atgatccggaagtgctagccattat

SEQ ID NO: 256851 - DNA, 25 bp, Mus musculus
atgatccggcccatggacttttgaa

SEQ ID NO: 256852 - DNA, 25 bp, Mus musculus
atgatccggcccttggacttttgaa

SEQ ID NO: 256853 - DNA, 25 bp, Mus musculus
atgatcctaactccttgagctcaga

SEQ ID NO: 256854 - DNA, 25 bp, Mus musculus
atgatcctaactgcttgagctcaga

SEQ ID NO: 256855 - DNA, 25 bp, Mus musculus
atgatcctagatagttttcccttca

SEQ ID NO: 256856 - DNA, 25 bp, Mus musculus
atgatcctagattgttttcccttca

SEQ ID NO: 256857 - DNA, 25 bp, Mus musculus
atgatcctagccatacactgagtac

SEQ ID NO: 256858 - DNA, 25 bp, Mus musculus
atgatcctagccttacactgagtac

SEQ ID NO: 256859 - DNA, 25 bp, Mus musculus
atgatcctcaggatggtcctaccgt

SEQ ID NO: 256860 - DNA, 25 bp, Mus musculus
atgatcctcaggttggtcctaccgt

SEQ ID NO: 256861 - DNA, 25 bp, Mus musculus
atgatcctcttacttacatggctcc

SEQ ID NO: 256862 - DNA, 25 bp, Mus musculus
atgatcctcttagttacatggctcc

SEQ ID NO: 256863 - DNA, 25 bp, Mus musculus
atgatcctcttgagagaagtgctat

SEQ ID NO: 256864 - DNA, 25 bp, Mus musculus
atgatcctcttgtgagaagtgctat

SEQ ID NO: 256865 - DNA, 25 bp, Mus musculus
atgatcctgattacacacggtcaca

SEQ ID NO: 256866 - DNA, 25 bp, Mus musculus
atgatcctgatttcacacggtcaca

SEQ ID NO: 256867 - DNA, 25 bp, Mus musculus
atgatcctgcgcctgaagagtgtcc

SEQ ID NO: 256868 - DNA, 25 bp, Mus musculus
atgatcctgcgcgtgaagagtgtcc

SEQ ID NO: 256869 - DNA, 25 bp, Mus musculus
atgatcctggatcctcagcagaagc

SEQ ID NO: 256870 - DNA, 25 bp, Mus musculus
atgatcctggatgctcagcagaagc

SEQ ID NO: 256871 - DNA, 25 bp, Mus musculus
atgatcctggcgcttggtaggtaat

SEQ ID NO: 256872 - DNA, 25 bp, Mus musculus
atgatcctggcggttggtaggtaat

SEQ ID NO: 256873 - DNA, 25 bp, Mus musculus
atgatcctgtacattactgcgcgcg

SEQ ID NO: 256874 - DNA, 25 bp, Mus musculus
atgatcctgtactttactgcgcgcg

SEQ ID NO: 256875 - DNA, 25 bp, Mus musculus
atgatcctgtctccggatatcccta

SEQ ID NO: 256876 - DNA, 25 bp, Mus musculus
atgatcctgtctgcggatatcccta

SEQ ID NO: 256877 - DNA, 25 bp, Mus musculus
atgatccttgatacgggcagtggtg

SEQ ID NO: 256878 - DNA, 25 bp, Mus musculus
atgatccttgattcgggcagtggtg

SEQ ID NO: 256879 - DNA, 25 bp, Mus musculus
atgatccttgtgacttccattctcc

SEQ ID NO: 256880 - DNA, 25 bp, Mus musculus
atgatccttgtgtcttccattctcc

SEQ ID NO: 256881 - DNA, 25 bp, Mus musculus
atgatcctttctagtgaaccacacc

SEQ ID NO: 256882 - DNA, 25 bp, Mus musculus
atgatcctttctatcttgtattact

SEQ ID NO: 256883 - DNA, 25 bp, Mus musculus
atgatcctttcttgtgaaccacacc

SEQ ID NO: 256884 - DNA, 25 bp, Mus musculus
atgatcctttctttcttgtattact

SEQ ID NO: 256885 - DNA, 25 bp, Mus musculus
atgatcgaatcaactgaggtcagaa

SEQ ID NO: 256886 - DNA, 25 bp, Mus musculus
atgatcgaatcatctgaggtcagaa

SEQ ID NO: 256887 - DNA, 25 bp, Mus musculus
atgatcgctgcgctcagcctgggat

SEQ ID NO: 256888 - DNA, 25 bp, Mus musculus
atgatcgctgcggtcagcctgggat

SEQ ID NO: 256889 - DNA, 25 bp, Mus musculus
atgatcgcttgtcacgcaaccgtga

SEQ ID NO: 256890 - DNA, 25 bp, Mus musculus
atgatcgcttgtgacgcaaccgtga

SEQ ID NO: 256891 - DNA, 25 bp, Mus musculus
atgatcgctttgatcctggaggaca

SEQ ID NO: 256892 - DNA, 25 bp, Mus musculus
atgatcgctttgttcctggaggaca

SEQ ID NO: 256893 - DNA, 25 bp, Mus musculus
atgatcggcaaaccagtggagcaca

SEQ ID NO: 256894 - DNA, 25 bp, Mus musculus
atgatcggcaaagcagtggagcaca

SEQ ID NO: 256895 - DNA, 25 bp, Mus musculus
atgatcggcaagcaggcagtcccaa

SEQ ID NO: 256896 - DNA, 25 bp, Mus musculus
atgatcggcaaggaggcagtcccaa

SEQ ID NO: 256897 - DNA, 25 bp, Mus musculus
atgatcgtactgctgacttactcac

SEQ ID NO: 256898 - DNA, 25 bp, Mus musculus
atgatcgtactggtgacttactcac

SEQ ID NO: 256899 - DNA, 25 bp, Mus musculus
atgatcgtcctcatctgagtgacag

SEQ ID NO: 256900 - DNA, 25 bp, Mus musculus
atgatcgtcctcttctgagtgacag

SEQ ID NO: 256901 - DNA, 25 bp, Mus musculus
atgatcgtgggacctttctgctgac

SEQ ID NO: 256902 - DNA, 25 bp, Mus musculus
atgatcgtgggagctttctgctgac

SEQ ID NO: 256903 - DNA, 25 bp, Mus musculus
atgatcgtgggcatcactacgggct

SEQ ID NO: 256904 - DNA, 25 bp, Mus musculus
atgatcgtgggcttcactacgggct

SEQ ID NO: 256905 - DNA, 25 bp, Mus musculus
atgatcgttcatcctcctggtctta

SEQ ID NO: 256906 - DNA, 25 bp, Mus musculus
atgatcgttcatgctcctggtctta

SEQ ID NO: 256907 - DNA, 25 bp, Mus musculus
atgatctaacccacacttattttgc

SEQ ID NO: 256908 - DNA, 25 bp, Mus musculus
atgatctaaccctcacttattttgc

SEQ ID NO: 256909 - DNA, 25 bp, Mus musculus
atgatctactttctggattaagcca

SEQ ID NO: 256910 - DNA, 25 bp, Mus musculus
atgatctactttgtggattaagcca

SEQ ID NO: 256911 - DNA, 25 bp, Mus musculus
atgatctagccaccagaattcctac

SEQ ID NO: 256912 - DNA, 25 bp, Mus musculus
atgatctagccagcagaattcctac

SEQ ID NO: 256913 - DNA, 25 bp, Mus musculus
atgatctaggtacacaagccaaggt

SEQ ID NO: 256914 - DNA, 25 bp, Mus musculus
atgatctaggtagacaagccaaggt

SEQ ID NO: 256915 - DNA, 25 bp, Mus musculus
atgatctatatgcaaggcgcccgaa

SEQ ID NO: 256916 - DNA, 25 bp, Mus musculus
atgatctatatggaaggcgcccgaa

SEQ ID NO: 256917 - DNA, 25 bp, Mus musculus
atgatctatattacttggccccatc

SEQ ID NO: 256918 - DNA, 25 bp, Mus musculus
atgatctatatttcttggccccatc

SEQ ID NO: 256919 - DNA, 25 bp, Mus musculus
atgatctatgagcaacacagtccct

SEQ ID NO: 256920 - DNA, 25 bp, Mus musculus
atgatctatgaggaacacagtccct

SEQ ID NO: 256921 - DNA, 25 bp, Mus musculus
atgatctatgttactgccgaggctt

SEQ ID NO: 256922 - DNA, 25 bp, Mus musculus
atgatctatgtttctgccgaggctt

SEQ ID NO: 256923 - DNA, 25 bp, Mus musculus
atgatctcaagtcgattctacagga

SEQ ID NO: 256924 - DNA, 25 bp, Mus musculus
atgatctcaagtggattctacagga

SEQ ID NO: 256925 - DNA, 25 bp, Mus musculus
atgatctcagccctgatcttgttct

SEQ ID NO: 256926 - DNA, 25 bp, Mus musculus
atgatctcagccgtgatcttgttct

SEQ ID NO: 256927 - DNA, 25 bp, Mus musculus
atgatctcatggagtctttgtcctc

SEQ ID NO: 256928 - DNA, 25 bp, Mus musculus
atgatctcatggtgtctttgtcctc

SEQ ID NO: 256929 - DNA, 25 bp, Mus musculus
atgatctcatttaaagggcccctgt

SEQ ID NO: 256930 - DNA, 25 bp, Mus musculus
atgatctcattttaagggcccctgt

SEQ ID NO: 256931 - DNA, 25 bp, Mus musculus
atgatctccttgagctgtacatggg

SEQ ID NO: 256932 - DNA, 25 bp, Mus musculus
atgatctccttgtgctgtacatggg

SEQ ID NO: 256933 - DNA, 25 bp, Mus musculus
atgatctctcaacatagccttggct

SEQ ID NO: 256934 - DNA, 25 bp, Mus musculus
atgatctctcaagatagccttggct

SEQ ID NO: 256935 - DNA, 25 bp, Mus musculus
atgatctgactactgttttgctgga

SEQ ID NO: 256936 - DNA, 25 bp, Mus musculus
atgatctgactagtgttttgctgga

SEQ ID NO: 256937 - DNA, 25 bp, Mus musculus
atgatctgacttcatccttgctgtc

SEQ ID NO: 256938 - DNA, 25 bp, Mus musculus
atgatctgacttgatccttgctgtc

SEQ ID NO: 256939 - DNA, 25 bp, Mus musculus
atgatctgcattcctgcctggagca

SEQ ID NO: 256940 - DNA, 25 bp, Mus musculus
atgatctgcattgctgcctggagca

SEQ ID NO: 256941 - DNA, 25 bp, Mus musculus
atgatctgctggcataccaacccga

SEQ ID NO: 256942 - DNA, 25 bp, Mus musculus
atgatctgctgggataccaacccga

SEQ ID NO: 256943 - DNA, 25 bp, Mus musculus
atgatctgtactccctgtcaatgta

SEQ ID NO: 256944 - DNA, 25 bp, Mus musculus
atgatctgtactgcctgtcaatgta

SEQ ID NO: 256945 - DNA, 25 bp, Mus musculus
atgatctgtaggctttctcagcccg

SEQ ID NO: 256946 - DNA, 25 bp, Mus musculus
atgatctgtagggtttctcagcccg

SEQ ID NO: 256947 - DNA, 25 bp, Mus musculus
atgatctgtctacaatggctactcc

SEQ ID NO: 256948 - DNA, 25 bp, Mus musculus
atgatctgtctagaatggctactcc

SEQ ID NO: 256949 - DNA, 25 bp, Mus musculus
atgatctgtttaaccaaggacatga

SEQ ID NO: 256950 - DNA, 25 bp, Mus musculus
atgatctgtttatccaaggacatga

SEQ ID NO: 256951 - DNA, 25 bp, Mus musculus
atgatcttaggtctgtcagtactcc

SEQ ID NO: 256952 - DNA, 25 bp, Mus musculus
atgatcttaggtgtgtcagtactcc

SEQ ID NO: 256953 - DNA, 25 bp, Mus musculus
atgatcttcagcatgatcctgtgct

SEQ ID NO: 256954 - DNA, 25 bp, Mus musculus
atgatcttcagcttgatcctgtgct

SEQ ID NO: 256955 - DNA, 25 bp, Mus musculus
atgatcttcatcagatttatcgcta

SEQ ID NO: 256956 - DNA, 25 bp, Mus musculus
atgatcttcatctgatttatcgcta

SEQ ID NO: 256957 - DNA, 25 bp, Mus musculus
atgatcttgaacatttcctcttgtc

SEQ ID NO: 256958 - DNA, 25 bp, Mus musculus
atgatcttgaacttttcctcttgtc

SEQ ID NO: 256959 - DNA, 25 bp, Mus musculus
atgatcttggcacatcctcatttat

SEQ ID NO: 256960 - DNA, 25 bp, Mus musculus
atgatcttggcagatcctcatttat

SEQ ID NO: 256961 - DNA, 25 bp, Mus musculus
atgatcttgttactcactgtggttc

SEQ ID NO: 256962 - DNA, 25 bp, Mus musculus
atgatcttgttagtcactgtggttc

SEQ ID NO: 256963 - DNA, 25 bp, Mus musculus
atgatctttactagagtctcacccc

SEQ ID NO: 256964 - DNA, 25 bp, Mus musculus
atgatctttacttgagtctcacccc

SEQ ID NO: 256965 - DNA, 25 bp, Mus musculus
atgatcttttccagtgataagtgaa

SEQ ID NO: 256966 - DNA, 25 bp, Mus musculus
atgatcttttcctgtgataagtgaa

SEQ ID NO: 256967 - DNA, 25 bp, Mus musculus
atgatgaacacccaccttagcagaa

SEQ ID NO: 256968 - DNA, 25 bp, Mus musculus
atgatgaacaccgaccttagcagaa

SEQ ID NO: 256969 - DNA, 25 bp, Mus musculus
atgatgaaccagctccttactgtag

SEQ ID NO: 256970 - DNA, 25 bp, Mus musculus
atgatgaaccaggtccttactgtag

SEQ ID NO: 256971 - DNA, 25 bp, Mus musculus
atgatgaaccgcatcatgccactga

SEQ ID NO: 256972 - DNA, 25 bp, Mus musculus
atgatgaaccgcttcatgccactga

SEQ ID NO: 256973 - DNA, 25 bp, Mus musculus
atgatgaaccgtcgtggcatgtcag

SEQ ID NO: 256974 - DNA, 25 bp, Mus musculus
atgatgaaccgtggtggcatgtcag

SEQ ID NO: 256975 - DNA, 25 bp, Mus musculus
atgatgaagagcctttgcctggccc

SEQ ID NO: 256976 - DNA, 25 bp, Mus musculus
atgatgaagagcgtttgcctggccc

SEQ ID NO: 256977 - DNA, 25 bp, Mus musculus
atgatgaatcccaccgagaaatggt

SEQ ID NO: 256978 - DNA, 25 bp, Mus musculus
atgatgaatccctccgagaaatggt

SEQ ID NO: 256979 - DNA, 25 bp, Mus musculus
atgatgaatgacatttgagcacctc

SEQ ID NO: 256980 - DNA, 25 bp, Mus musculus
atgatgaatgacttttgagcacctc

SEQ ID NO: 256981 - DNA, 25 bp, Mus musculus
atgatgacactccatacatagcacg

SEQ ID NO: 256982 - DNA, 25 bp, Mus musculus
atgatgacactcgatacatagcacg

SEQ ID NO: 256983 - DNA, 25 bp, Mus musculus
atgatgacagttcctctgattcagg

SEQ ID NO: 256984 - DNA, 25 bp, Mus musculus
atgatgacagttgctctgattcagg

SEQ ID NO: 256985 - DNA, 25 bp, Mus musculus
atgatgacatacacggtcctgcctg

SEQ ID NO: 256986 - DNA, 25 bp, Mus musculus
atgatgacatactcggtcctgcctg

SEQ ID NO: 256987 - DNA, 25 bp, Mus musculus
atgatgaccacaatcaactgtgaga

SEQ ID NO: 256988 - DNA, 25 bp, Mus musculus
atgatgaccacattcaactgtgaga

SEQ ID NO: 256989 - DNA, 25 bp, Mus musculus
atgatgaccagtaaccctgtcctgc

SEQ ID NO: 256990 - DNA, 25 bp, Mus musculus
atgatgaccagttaccctgtcctgc

SEQ ID NO: 256991 - DNA, 25 bp, Mus musculus
atgatgaccatgagggaagcctttc

SEQ ID NO: 256992 - DNA, 25 bp, Mus musculus
atgatgaccatgtgggaagcctttc

SEQ ID NO: 256993 - DNA, 25 bp, Mus musculus
atgatgacccagaacaagagacttt

SEQ ID NO: 256994 - DNA, 25 bp, Mus musculus
atgatgacccagtacaagagacttt

SEQ ID NO: 256995 - DNA, 25 bp, Mus musculus
atgatgaccctgagccttggtagca

SEQ ID NO: 256996 - DNA, 25 bp, Mus musculus
atgatgaccctgtgccttggtagca

SEQ ID NO: 256997 - DNA, 25 bp, Mus musculus
atgatgacgaggaatcggaagccca

SEQ ID NO: 256998 - DNA, 25 bp, Mus musculus
atgatgacgaggtatcggaagccca

SEQ ID NO: 256999 - DNA, 25 bp, Mus musculus
atgatgacgctacaccaagccagac

SEQ ID NO: 257000 - DNA, 25 bp, Mus musculus
atgatgacgctagaccaagccagac

SEQ ID NO: 257001 - DNA, 25 bp, Mus musculus
atgatgacggcacggtgtcctatcc

SEQ ID NO: 257002 - DNA, 25 bp, Mus musculus
atgatgacggcagggtgtcctatcc

SEQ ID NO: 257003 - DNA, 25 bp, Mus musculus
atgatgactgcgaagtgaaggcccg

SEQ ID NO: 257004 - DNA, 25 bp, Mus musculus
atgatgactgcgtagtgaaggcccg

SEQ ID NO: 257005 - DNA, 25 bp, Mus musculus
atgatgactggcatgatcctgtgca

SEQ ID NO: 257006 - DNA, 25 bp, Mus musculus
atgatgactggcttgatcctgtgca

SEQ ID NO: 257007 - DNA, 25 bp, Mus musculus
atgatgactgtgagtttggaggcca

SEQ ID NO: 257008 - DNA, 25 bp, Mus musculus
atgatgactgtgtgtttggaggcca

SEQ ID NO: 257009 - DNA, 25 bp, Mus musculus
atgatgactttgacactccttgggt

SEQ ID NO: 257010 - DNA, 25 bp, Mus musculus
atgatgactttgtcactccttgggt

SEQ ID NO: 257011 - DNA, 25 bp, Mus musculus
atgatgagaatgagctcgtagccca

SEQ ID NO: 257012 - DNA, 25 bp, Mus musculus
atgatgagaatgtgctcgtagccca

SEQ ID NO: 257013 - DNA, 25 bp, Mus musculus
atgatgagacatctggctactacta

SEQ ID NO: 257014 - DNA, 25 bp, Mus musculus
atgatgagacatgtggctactacta

SEQ ID NO: 257015 - DNA, 25 bp, Mus musculus
atgatgaggacgcagcccaggcctc

SEQ ID NO: 257016 - DNA, 25 bp, Mus musculus
atgatgaggacggagcccaggcctc

SEQ ID NO: 257017 - DNA, 25 bp, Mus musculus
atgatgaggctgactcctgttttca

SEQ ID NO: 257018 - DNA, 25 bp, Mus musculus
atgatgaggctgtctcctgttttca

SEQ ID NO: 257019 - DNA, 25 bp, Mus musculus
atgatgagggctacccagctgctga

SEQ ID NO: 257020 - DNA, 25 bp, Mus musculus
atgatgagggctcttgcgccgacca

SEQ ID NO: 257021 - DNA, 25 bp, Mus musculus
atgatgagggctgttgcgccgacca

SEQ ID NO: 257022 - DNA, 25 bp, Mus musculus
atgatgagggcttcccagctgctga

SEQ ID NO: 257023 - DNA, 25 bp, Mus musculus
atgatgaggtctacagtctctttca

SEQ ID NO: 257024 - DNA, 25 bp, Mus musculus
atgatgaggtcttcagtctctttca

SEQ ID NO: 257025 - DNA, 25 bp, Mus musculus
atgatgagtacgaggccttccgcaa

SEQ ID NO: 257026 - DNA, 25 bp, Mus musculus
atgatgagtacgtggccttccgcaa

SEQ ID NO: 257027 - DNA, 25 bp, Mus musculus
atgatgagtactcgcacgcacacgt

SEQ ID NO: 257028 - DNA, 25 bp, Mus musculus
atgatgagtactggcacgcacacgt

SEQ ID NO: 257029 - DNA, 25 bp, Mus musculus
atgatgagtcaaaaccagccctttt

SEQ ID NO: 257030 - DNA, 25 bp, Mus musculus
atgatgagtcaataccagccctttt

SEQ ID NO: 257031 - DNA, 25 bp, Mus musculus
atgatgataaaactcggcccctggt

SEQ ID NO: 257032 - DNA, 25 bp, Mus musculus
atgatgataaaagtcggcccctggt

SEQ ID NO: 257033 - DNA, 25 bp, Mus musculus
atgatgataaccctgcccatctggg

SEQ ID NO: 257034 - DNA, 25 bp, Mus musculus
atgatgataaccgtgcccatctggg

SEQ ID NO: 257035 - DNA, 25 bp, Mus musculus
atgatgatactgctgtgtaatccca

SEQ ID NO: 257036 - DNA, 25 bp, Mus musculus
atgatgatactggtgtgtaatccca

SEQ ID NO: 257037 - DNA, 25 bp, Mus musculus
atgatgatagccagcctgacaagaa

SEQ ID NO: 257038 - DNA, 25 bp, Mus musculus
atgatgatagcctgcctgacaagaa

SEQ ID NO: 257039 - DNA, 25 bp, Mus musculus
atgatgatagttcggtttggaaagc

SEQ ID NO: 257040 - DNA, 25 bp, Mus musculus
atgatgatagttgggtttggaaagc

SEQ ID NO: 257041 - DNA, 25 bp, Mus musculus
atgatgatatttcctagctccgtta

SEQ ID NO: 257042 - DNA, 25 bp, Mus musculus
atgatgatatttgctagctccgtta

SEQ ID NO: 257043 - DNA, 25 bp, Mus musculus
atgatgatccaacgcctggtcattg

SEQ ID NO: 257044 - DNA, 25 bp, Mus musculus
atgatgatccaaggcctggtcattg

SEQ ID NO: 257045 - DNA, 25 bp, Mus musculus
atgatgatcgctcgcatacctaccg

SEQ ID NO: 257046 - DNA, 25 bp, Mus musculus
atgatgatcgctggcatacctaccg

SEQ ID NO: 257047 - DNA, 25 bp, Mus musculus
atgatgatctgtctggagctctgct

SEQ ID NO: 257048 - DNA, 25 bp, Mus musculus
atgatgatctgtgtggagctctgct

SEQ ID NO: 257049 - DNA, 25 bp, Mus musculus
atgatgatgcccaagaggaccctgc

SEQ ID NO: 257050 - DNA, 25 bp, Mus musculus
atgatgatgccctagaggaccctgc

SEQ ID NO: 257051 - DNA, 25 bp, Mus musculus
atgatgatggccacaaataagctac

SEQ ID NO: 257052 - DNA, 25 bp, Mus musculus
atgatgatggcctcaaataagctac

SEQ ID NO: 257053 - DNA, 25 bp, Mus musculus
atgatgatgggcaacgttcacgtag

SEQ ID NO: 257054 - DNA, 25 bp, Mus musculus
atgatgatgggctacgttcacgtag

SEQ ID NO: 257055 - DNA, 25 bp, Mus musculus
atgatgatgtccagtgaggccgccc

SEQ ID NO: 257056 - DNA, 25 bp, Mus musculus
atgatgatgtcctgtgaggccgccc

SEQ ID NO: 257057 - DNA, 25 bp, Mus musculus
atgatgatgttcactatcctgtctg

SEQ ID NO: 257058 - DNA, 25 bp, Mus musculus
atgatgatgttctctatcctgtctg

SEQ ID NO: 257059 - DNA, 25 bp, Mus musculus
atgatgattcgccaacgtgagatgg

SEQ ID NO: 257060 - DNA, 25 bp, Mus musculus
atgatgattcgcgaacgtgagatgg

SEQ ID NO: 257061 - DNA, 25 bp, Mus musculus
atgatgattgcaatggcccctccaa

SEQ ID NO: 257062 - DNA, 25 bp, Mus musculus
atgatgattgcattggcccctccaa

SEQ ID NO: 257063 - DNA, 25 bp, Mus musculus
atgatgcaagccacgggcaaggccc

SEQ ID NO: 257064 - DNA, 25 bp, Mus musculus
atgatgcaagcctcgggcaaggccc

SEQ ID NO: 257065 - DNA, 25 bp, Mus musculus
atgatgcacacacatgatagacaca

SEQ ID NO: 257066 - DNA, 25 bp, Mus musculus
atgatgcacacagatgatagacaca

SEQ ID NO: 257067 - DNA, 25 bp, Mus musculus
atgatgcacactattctgtaacaga

SEQ ID NO: 257068 - DNA, 25 bp, Mus musculus
atgatgcacacttttctgtaacaga

SEQ ID NO: 257069 - DNA, 25 bp, Mus musculus
atgatgcacctaccacataaattat

SEQ ID NO: 257070 - DNA, 25 bp, Mus musculus
atgatgcacctagcacataaattat

SEQ ID NO: 257071 - DNA, 25 bp, Mus musculus
atgatgcagctgcaccagggcacgt

SEQ ID NO: 257072 - DNA, 25 bp, Mus musculus
atgatgcagctggaccagggcacgt

SEQ ID NO: 257073 - DNA, 25 bp, Mus musculus
atgatgcaggaaatttcttcctggg

SEQ ID NO: 257074 - DNA, 25 bp, Mus musculus
atgatgcaggaattttcttcctggg

SEQ ID NO: 257075 - DNA, 25 bp, Mus musculus
atgatgcaggtaacaccatcttctc

SEQ ID NO: 257076 - DNA, 25 bp, Mus musculus
atgatgcaggtatcaccatcttctc

SEQ ID NO: 257077 - DNA, 25 bp, Mus musculus
atgatgcagtccagttttggccacc

SEQ ID NO: 257078 - DNA, 25 bp, Mus musculus
atgatgcagtcctgttttggccacc

SEQ ID NO: 257079 - DNA, 25 bp, Mus musculus
atgatgcataacagacgtgtggtga

SEQ ID NO: 257080 - DNA, 25 bp, Mus musculus
atgatgcataactgacgtgtggtga

SEQ ID NO: 257081 - DNA, 25 bp, Mus musculus
atgatgcatcaaaatatacttctta

SEQ ID NO: 257082 - DNA, 25 bp, Mus musculus
atgatgcatcaatatatacttctta

SEQ ID NO: 257083 - DNA, 25 bp, Mus musculus
atgatgcattttacccacactatgg

SEQ ID NO: 257084 - DNA, 25 bp, Mus musculus
atgatgcatttttcccacactatgg

SEQ ID NO: 257085 - DNA, 25 bp, Mus musculus
atgatgccaactcctcttgctgtat

SEQ ID NO: 257086 - DNA, 25 bp, Mus musculus
atgatgccaactgctcttgctgtat

SEQ ID NO: 257087 - DNA, 25 bp, Mus musculus
atgatgccactgaagtggtcaccct

SEQ ID NO: 257088 - DNA, 25 bp, Mus musculus
atgatgccactgtagtggtcaccct

SEQ ID NO: 257089 - DNA, 25 bp, Mus musculus
atgatgccaggaaatgctcgttagc

SEQ ID NO: 257090 - DNA, 25 bp, Mus musculus
atgatgccaggatatgctcgttagc

SEQ ID NO: 257091 - DNA, 25 bp, Mus musculus
atgatgccagtgctgagaacgccgt

SEQ ID NO: 257092 - DNA, 25 bp, Mus musculus
atgatgccagtggtgagaacgccgt

SEQ ID NO: 257093 - DNA, 25 bp, Mus musculus
atgatgcccagcattgcggtagtgc

SEQ ID NO: 257094 - DNA, 25 bp, Mus musculus
atgatgcccagctttgcggtagtgc

SEQ ID NO: 257095 - DNA, 25 bp, Mus musculus
atgatgccccatctaacaggaacaa

SEQ ID NO: 257096 - DNA, 25 bp, Mus musculus
atgatgccccatgtaacaggaacaa

SEQ ID NO: 257097 - DNA, 25 bp, Mus musculus
atgatgcccctaagatggcaccgtt

SEQ ID NO: 257098 - DNA, 25 bp, Mus musculus
atgatgcccctatgatggcaccgtt

SEQ ID NO: 257099 - DNA, 25 bp, Mus musculus
atgatgcccctgagcccatcattca

SEQ ID NO: 257100 - DNA, 25 bp, Mus musculus
atgatgcccctgtgcccatcattca

SEQ ID NO: 257101 - DNA, 25 bp, Mus musculus
atgatgcccgtcatctttgccaaag

SEQ ID NO: 257102 - DNA, 25 bp, Mus musculus
atgatgcccgtcttctttgccaaag

SEQ ID NO: 257103 - DNA, 25 bp, Mus musculus
atgatgccctacagcactgcaaaat

SEQ ID NO: 257104 - DNA, 25 bp, Mus musculus
atgatgccctactgcactgcaaaat

SEQ ID NO: 257105 - DNA, 25 bp, Mus musculus
atgatgccctagatgttgccaacaa

SEQ ID NO: 257106 - DNA, 25 bp, Mus musculus
atgatgccctagttgttgccaacaa

SEQ ID NO: 257107 - DNA, 25 bp, Mus musculus
atgatgccctcgatcctttggacat

SEQ ID NO: 257108 - DNA, 25 bp, Mus musculus
atgatgccctcgttcctttggacat

SEQ ID NO: 257109 - DNA, 25 bp, Mus musculus
atgatgccctgccttaccacaggca

SEQ ID NO: 257110 - DNA, 25 bp, Mus musculus
atgatgccctgcgttaccacaggca

SEQ ID NO: 257111 - DNA, 25 bp, Mus musculus
atgatgccctgtctgtcatccggaa

SEQ ID NO: 257112 - DNA, 25 bp, Mus musculus
atgatgccctgtgtgtcatccggaa

SEQ ID NO: 257113 - DNA, 25 bp, Mus musculus
atgatgccgaccagttagaggagga

SEQ ID NO: 257114 - DNA, 25 bp, Mus musculus
atgatgccgacctgttagaggagga

SEQ ID NO: 257115 - DNA, 25 bp, Mus musculus
atgatgccggagcttcgctctagga

SEQ ID NO: 257116 - DNA, 25 bp, Mus musculus
atgatgccggaggttcgctctagga

SEQ ID NO: 257117 - DNA, 25 bp, Mus musculus
atgatgcctactatcttcaagacct

SEQ ID NO: 257118 - DNA, 25 bp, Mus musculus
atgatgcctactttcttcaagacct

SEQ ID NO: 257119 - DNA, 25 bp, Mus musculus
atgatgcctgatctttgctgaaccc

SEQ ID NO: 257120 - DNA, 25 bp, Mus musculus
atgatgcctgatgtttgctgaaccc

SEQ ID NO: 257121 - DNA, 25 bp, Mus musculus
atgatgcctgcaatcagctctccta

SEQ ID NO: 257122 - DNA, 25 bp, Mus musculus
atgatgcctgcattcagctctccta

SEQ ID NO: 257123 - DNA, 25 bp, Mus musculus
atgatgccttaccagagtttgcgat

SEQ ID NO: 257124 - DNA, 25 bp, Mus musculus
atgatgccttacgagagtttgcgat

SEQ ID NO: 257125 - DNA, 25 bp, Mus musculus
atgatgccttcgaggtgttcgataa

SEQ ID NO: 257126 - DNA, 25 bp, Mus musculus
atgatgccttcgtggtgttcgataa

SEQ ID NO: 257127 - DNA, 25 bp, Mus musculus
atgatgcctttaactttccttttat

SEQ ID NO: 257128 - DNA, 25 bp, Mus musculus
atgatgcctttatctttccttttat

SEQ ID NO: 257129 - DNA, 25 bp, Mus musculus
atgatgcctttgaggtcttttcctc

SEQ ID NO: 257130 - DNA, 25 bp, Mus musculus
atgatgcctttgtggtcttttcctc

SEQ ID NO: 257131 - DNA, 25 bp, Mus musculus
atgatgcgctcactgccatgcgttc

SEQ ID NO: 257132 - DNA, 25 bp, Mus musculus
atgatgcgctcagtgccatgcgttc

SEQ ID NO: 257133 - DNA, 25 bp, Mus musculus
atgatgcgcttgctggccagcagtc

SEQ ID NO: 257134 - DNA, 25 bp, Mus musculus
atgatgcgcttggtggccagcagtc

SEQ ID NO: 257135 - DNA, 25 bp, Mus musculus
atgatgcggtttacatccgtgcctc

SEQ ID NO: 257136 - DNA, 25 bp, Mus musculus
atgatgcggttttcatccgtgcctc

SEQ ID NO: 257137 - DNA, 25 bp, Mus musculus
atgatgcgtttcagtgtgtccatac

SEQ ID NO: 257138 - DNA, 25 bp, Mus musculus
atgatgcgtttctgtgtgtccatac

SEQ ID NO: 257139 - DNA, 25 bp, Mus musculus
atgatgctaatcatgccgtgtggtc

SEQ ID NO: 257140 - DNA, 25 bp, Mus musculus
atgatgctaatcttgccgtgtggtc

SEQ ID NO: 257141 - DNA, 25 bp, Mus musculus
atgatgctaatgacgacacagccac

SEQ ID NO: 257142 - DNA, 25 bp, Mus musculus
atgatgctaatgtcgacacagccac

SEQ ID NO: 257143 - DNA, 25 bp, Mus musculus
atgatgctagatcagttaccccgaa

SEQ ID NO: 257144 - DNA, 25 bp, Mus musculus
atgatgctagatgagttaccccgaa

SEQ ID NO: 257145 - DNA, 25 bp, Mus musculus
atgatgctatgcctgacaatctgaa

SEQ ID NO: 257146 - DNA, 25 bp, Mus musculus
atgatgctatgcgtgacaatctgaa

SEQ ID NO: 257147 - DNA, 25 bp, Mus musculus
atgatgctccccattaatgcctaca

SEQ ID NO: 257148 - DNA, 25 bp, Mus musculus
atgatgctcccctttaatgcctaca

SEQ ID NO: 257149 - DNA, 25 bp, Mus musculus
atgatgctctcacccaccatggaaa

SEQ ID NO: 257150 - DNA, 25 bp, Mus musculus
atgatgctctcagccaccatggaaa

SEQ ID NO: 257151 - DNA, 25 bp, Mus musculus
atgatgctctggcttacgctatggc

SEQ ID NO: 257152 - DNA, 25 bp, Mus musculus
atgatgctctgggttacgctatggc

SEQ ID NO: 257153 - DNA, 25 bp, Mus musculus
atgatgctgaagacctaccctttaa

SEQ ID NO: 257154 - DNA, 25 bp, Mus musculus
atgatgctgaagtcctaccctttaa

SEQ ID NO: 257155 - DNA, 25 bp, Mus musculus
atgatgctgagaccgacgcgacgcc

SEQ ID NO: 257156 - DNA, 25 bp, Mus musculus
atgatgctgagagcgacgcgacgcc

SEQ ID NO: 257157 - DNA, 25 bp, Mus musculus
atgatgctgagtatgctctgctcat

SEQ ID NO: 257158 - DNA, 25 bp, Mus musculus
atgatgctgagtttgctctgctcat

SEQ ID NO: 257159 - DNA, 25 bp, Mus musculus
atgatgctgatcagtcagccgctgc

SEQ ID NO: 257160 - DNA, 25 bp, Mus musculus
atgatgctgatctgtcagccgctgc

SEQ ID NO: 257161 - DNA, 25 bp, Mus musculus
atgatgctgcagagattcgtctgat

SEQ ID NO: 257162 - DNA, 25 bp, Mus musculus
atgatgctgcagtgattcgtctgat

SEQ ID NO: 257163 - DNA, 25 bp, Mus musculus
atgatgctgcgtcacaccgggatga

SEQ ID NO: 257164 - DNA, 25 bp, Mus musculus
atgatgctgcgtgacaccgggatga

SEQ ID NO: 257165 - DNA, 25 bp, Mus musculus
atgatgctgctaataattctgggat

SEQ ID NO: 257166 - DNA, 25 bp, Mus musculus
atgatgctgctattaattctgggat

SEQ ID NO: 257167 - DNA, 25 bp, Mus musculus
atgatgctgctccagcttctggaaa

SEQ ID NO: 257168 - DNA, 25 bp, Mus musculus
atgatgctgctcgagcttctggaaa

SEQ ID NO: 257169 - DNA, 25 bp, Mus musculus
atgatgctgctgacaaagggacgct

SEQ ID NO: 257170 - DNA, 25 bp, Mus musculus
atgatgctgctgtcaaagggacgct

SEQ ID NO: 257171 - DNA, 25 bp, Mus musculus
atgatgctgggcaggagcagcccct

SEQ ID NO: 257172 - DNA, 25 bp, Mus musculus
atgatgctgggctggagcagcccct

SEQ ID NO: 257173 - DNA, 25 bp, Mus musculus
atgatgcttattcaccactgttggt

SEQ ID NO: 257174 - DNA, 25 bp, Mus musculus
atgatgcttattgaccactgttggt

SEQ ID NO: 257175 - DNA, 25 bp, Mus musculus
atgatgcttctgacactaactgctg

SEQ ID NO: 257176 - DNA, 25 bp, Mus musculus
atgatgcttctgtcactaactgctg

SEQ ID NO: 257177 - DNA, 25 bp, Mus musculus
atgatgcttgggatttgacttttct

SEQ ID NO: 257178 - DNA, 25 bp, Mus musculus
atgatgcttgggttttgacttttct

SEQ ID NO: 257179 - DNA, 25 bp, Mus musculus
atgatggaaactccactgtggtgtc

SEQ ID NO: 257180 - DNA, 25 bp, Mus musculus
atgatggaaactgcactgtggtgtc

SEQ ID NO: 257181 - DNA, 25 bp, Mus musculus
atgatggaaggactgctccaagccc

SEQ ID NO: 257182 - DNA, 25 bp, Mus musculus
atgatggaaggagtgctccaagccc

SEQ ID NO: 257183 - DNA, 25 bp, Mus musculus
atgatggagccccacgacttccgag

SEQ ID NO: 257184 - DNA, 25 bp, Mus musculus
atgatggagcccgacgacttccgag

SEQ ID NO: 257185 - DNA, 25 bp, Mus musculus
atgatggagctgagggaccctctct

SEQ ID NO: 257186 - DNA, 25 bp, Mus musculus
atgatggagctgctccagcccagca

SEQ ID NO: 257187 - DNA, 25 bp, Mus musculus
atgatggagctggtccagcccagca

SEQ ID NO: 257188 - DNA, 25 bp, Mus musculus
atgatggagctgtgggaccctctct

SEQ ID NO: 257189 - DNA, 25 bp, Mus musculus
atgatggaggaaatattgcatcccc

SEQ ID NO: 257190 - DNA, 25 bp, Mus musculus
atgatggaggaattattgcatcccc

SEQ ID NO: 257191 - DNA, 25 bp, Mus musculus
atgatggaggacagccttgttccgc

SEQ ID NO: 257192 - DNA, 25 bp, Mus musculus
atgatggaggactgccttgttccgc

SEQ ID NO: 257193 - DNA, 25 bp, Mus musculus
atgatggatagcacactgtactgat

SEQ ID NO: 257194 - DNA, 25 bp, Mus musculus
atgatggatagctcactgtactgat

SEQ ID NO: 257195 - DNA, 25 bp, Mus musculus
atgatggatcgcatcttggtgtaaa

SEQ ID NO: 257196 - DNA, 25 bp, Mus musculus
atgatggatcgcttcttggtgtaaa

SEQ ID NO: 257197 - DNA, 25 bp, Mus musculus
atgatggatgcccagctgacactgc

SEQ ID NO: 257198 - DNA, 25 bp, Mus musculus
atgatggatgccgagctgacactgc

SEQ ID NO: 257199 - DNA, 25 bp, Mus musculus
atgatggcactcagcactcggaccc

SEQ ID NO: 257200 - DNA, 25 bp, Mus musculus
atgatggcactctgcactcggaccc

SEQ ID NO: 257201 - DNA, 25 bp, Mus musculus
atgatggcatccatgaactcctttc

SEQ ID NO: 257202 - DNA, 25 bp, Mus musculus
atgatggcatccttgaactcctttc

SEQ ID NO: 257203 - DNA, 25 bp, Mus musculus
atgatggccactaaaaacgtaagcc

SEQ ID NO: 257204 - DNA, 25 bp, Mus musculus
atgatggccacttaaaacgtaagcc

SEQ ID NO: 257205 - DNA, 25 bp, Mus musculus
atgatggccatgacaaggagggaac

SEQ ID NO: 257206 - DNA, 25 bp, Mus musculus
atgatggccatgtcaaggagggaac

SEQ ID NO: 257207 - DNA, 25 bp, Mus musculus
atgatggccattatgatgctccgga

SEQ ID NO: 257208 - DNA, 25 bp, Mus musculus
atgatggccattttgatgctccgga

SEQ ID NO: 257209 - DNA, 25 bp, Mus musculus
atgatggcccaacaccacagatgtg

SEQ ID NO: 257210 - DNA, 25 bp, Mus musculus
atgatggcccaagaccacagatgtg

SEQ ID NO: 257211 - DNA, 25 bp, Mus musculus
atgatggcccacaccatctgttcag

SEQ ID NO: 257212 - DNA, 25 bp, Mus musculus
atgatggcccacctgtttaatctca

SEQ ID NO: 257213 - DNA, 25 bp, Mus musculus
atgatggcccacgtgtttaatctca

SEQ ID NO: 257214 - DNA, 25 bp, Mus musculus
atgatggcccactccatctgttcag

SEQ ID NO: 257215 - DNA, 25 bp, Mus musculus
atgatggcccagacctgacagatga

SEQ ID NO: 257216 - DNA, 25 bp, Mus musculus
atgatggcccagtcctgacagatga

SEQ ID NO: 257217 - DNA, 25 bp, Mus musculus
atgatggcccatccagagccagagg

SEQ ID NO: 257218 - DNA, 25 bp, Mus musculus
atgatggcccatgcagagccagagg

SEQ ID NO: 257219 - DNA, 25 bp, Mus musculus
atgatggcctacaagctctaaggtg

SEQ ID NO: 257220 - DNA, 25 bp, Mus musculus
atgatggcctactagctctaaggtg

SEQ ID NO: 257221 - DNA, 25 bp, Mus musculus
atgatggctcagctaatgagagcaa

SEQ ID NO: 257222 - DNA, 25 bp, Mus musculus
atgatggctcaggtaatgagagcaa

SEQ ID NO: 257223 - DNA, 25 bp, Mus musculus
atgatggctccactcagaccttcag

SEQ ID NO: 257224 - DNA, 25 bp, Mus musculus
atgatggctccagtcagaccttcag

SEQ ID NO: 257225 - DNA, 25 bp, Mus musculus
atgatggcttccaacagtcaagtcc

SEQ ID NO: 257226 - DNA, 25 bp, Mus musculus
atgatggcttccagtatgcctgtcc

SEQ ID NO: 257227 - DNA, 25 bp, Mus musculus
atgatggcttcctacagtcaagtcc

SEQ ID NO: 257228 - DNA, 25 bp, Mus musculus
atgatggcttcctgtatgcctgtcc

SEQ ID NO: 257229 - DNA, 25 bp, Mus musculus
atgatggcttgtcccaaccctgcgc

SEQ ID NO: 257230 - DNA, 25 bp, Mus musculus
atgatggcttgtgccaaccctgcgc

SEQ ID NO: 257231 - DNA, 25 bp, Mus musculus
atgatggcttttaggatgtgtacgc

SEQ ID NO: 257232 - DNA, 25 bp, Mus musculus
atgatggctttttggatgtgtacgc

SEQ ID NO: 257233 - DNA, 25 bp, Mus musculus
atgatgggaagaagcctcacttggg

SEQ ID NO: 257234 - DNA, 25 bp, Mus musculus
atgatgggaagatgcctcacttggg

SEQ ID NO: 257235 - DNA, 25 bp, Mus musculus
atgatgggaggcatcctgttggccc

SEQ ID NO: 257236 - DNA, 25 bp, Mus musculus
atgatgggaggcttcctgttggccc

SEQ ID NO: 257237 - DNA, 25 bp, Mus musculus
atgatgggcagcctggaccaccttt

SEQ ID NO: 257238 - DNA, 25 bp, Mus musculus
atgatgggcagcgtggaccaccttt

SEQ ID NO: 257239 - DNA, 25 bp, Mus musculus
atgatgggctagatttctaacctag

SEQ ID NO: 257240 - DNA, 25 bp, Mus musculus
atgatgggctagttttctaacctag

SEQ ID NO: 257241 - DNA, 25 bp, Mus musculus
atgatgggctgcattgtatccccaa

SEQ ID NO: 257242 - DNA, 25 bp, Mus musculus
atgatgggctgctttgtatccccaa

SEQ ID NO: 257243 - DNA, 25 bp, Mus musculus
atgatgggcttcagtgctattgctg

SEQ ID NO: 257244 - DNA, 25 bp, Mus musculus
atgatgggcttcctggactgtgtcc

SEQ ID NO: 257245 - DNA, 25 bp, Mus musculus
atgatgggcttcgtggactgtgtcc

SEQ ID NO: 257246 - DNA, 25 bp, Mus musculus
atgatgggcttctgtgctattgctg

SEQ ID NO: 257247 - DNA, 25 bp, Mus musculus
atgatgggtggcaatgattacggct

SEQ ID NO: 257248 - DNA, 25 bp, Mus musculus
atgatgggtggctatgattacggct

SEQ ID NO: 257249 - DNA, 25 bp, Mus musculus
atgatggtaaccctaactcacttta

SEQ ID NO: 257250 - DNA, 25 bp, Mus musculus
atgatggtaaccgtaactcacttta

SEQ ID NO: 257251 - DNA, 25 bp, Mus musculus
atgatggtagttctgctgggtctcc

SEQ ID NO: 257252 - DNA, 25 bp, Mus musculus
atgatggtagttgtgctgggtctcc

SEQ ID NO: 257253 - DNA, 25 bp, Mus musculus
atgatggtcacaaagtttcagttat

SEQ ID NO: 257254 - DNA, 25 bp, Mus musculus
atgatggtcacatagtttcagttat

SEQ ID NO: 257255 - DNA, 25 bp, Mus musculus
atgatggtctatctgctgccaacag

SEQ ID NO: 257256 - DNA, 25 bp, Mus musculus
atgatggtctatgtgctgccaacag

SEQ ID NO: 257257 - DNA, 25 bp, Mus musculus
atgatggtctctcaagtgatgggct

SEQ ID NO: 257258 - DNA, 25 bp, Mus musculus
atgatggtctctgaagtgatgggct

SEQ ID NO: 257259 - DNA, 25 bp, Mus musculus
atgatggtgaatcaacttatcctgg

SEQ ID NO: 257260 - DNA, 25 bp, Mus musculus
atgatggtgaatgaacttatcctgg

SEQ ID NO: 257261 - DNA, 25 bp, Mus musculus
atgatggtgcgcataagtgttagca

SEQ ID NO: 257262 - DNA, 25 bp, Mus musculus
atgatggtgcgcttaagtgttagca

SEQ ID NO: 257263 - DNA, 25 bp, Mus musculus
atgatggtgctgaccttgcagagga

SEQ ID NO: 257264 - DNA, 25 bp, Mus musculus
atgatggtgctgtccttgcagagga

SEQ ID NO: 257265 - DNA, 25 bp, Mus musculus
atgatggtgggcaacaatctgaaag

SEQ ID NO: 257266 - DNA, 25 bp, Mus musculus
atgatggtgggctacaatctgaaag

SEQ ID NO: 257267 - DNA, 25 bp, Mus musculus
atgatggtggttcaccactgcctat

SEQ ID NO: 257268 - DNA, 25 bp, Mus musculus
atgatggtggttgaccactgcctat

SEQ ID NO: 257269 - DNA, 25 bp, Mus musculus
atgatggtgtcactttccgggtaaa

SEQ ID NO: 257270 - DNA, 25 bp, Mus musculus
atgatggtgtcagtttccgggtaaa

SEQ ID NO: 257271 - DNA, 25 bp, Mus musculus
atgatggtgtggattactgggccaa

SEQ ID NO: 257272 - DNA, 25 bp, Mus musculus
atgatggtgtggtttactgggccaa

SEQ ID NO: 257273 - DNA, 25 bp, Mus musculus
atgatggtttaaaacacacagccct

SEQ ID NO: 257274 - DNA, 25 bp, Mus musculus
atgatggtttaatacacacagccct

SEQ ID NO: 257275 - DNA, 25 bp, Mus musculus
atgatggtttgcaagtcgccaactt

SEQ ID NO: 257276 - DNA, 25 bp, Mus musculus
atgatggtttgcagctgtctgtcaa

SEQ ID NO: 257277 - DNA, 25 bp, Mus musculus
atgatggtttgctagtcgccaactt

SEQ ID NO: 257278 - DNA, 25 bp, Mus musculus
atgatggtttgctgctgtctgtcaa

SEQ ID NO: 257279 - DNA, 25 bp, Mus musculus
atgatggttttacaggccaaggcct

SEQ ID NO: 257280 - DNA, 25 bp, Mus musculus
atgatggttttagaggccaaggcct

SEQ ID NO: 257281 - DNA, 25 bp, Mus musculus
atgatgtaacttcccttccttacgg

SEQ ID NO: 257282 - DNA, 25 bp, Mus musculus
atgatgtaacttgccttccttacgg

SEQ ID NO: 257283 - DNA, 25 bp, Mus musculus
atgatgtaatcaaggcagtgccttg

SEQ ID NO: 257284 - DNA, 25 bp, Mus musculus
atgatgtaatcatggcagtgccttg

SEQ ID NO: 257285 - DNA, 25 bp, Mus musculus
atgatgtacaaccagccttctcttg

SEQ ID NO: 257286 - DNA, 25 bp, Mus musculus
atgatgtacaacgagccttctcttg

SEQ ID NO: 257287 - DNA, 25 bp, Mus musculus
atgatgtactacaccaaagctcaag

SEQ ID NO: 257288 - DNA, 25 bp, Mus musculus
atgatgtactactccaaagctcaag

SEQ ID NO: 257289 - DNA, 25 bp, Mus musculus
atgatgtacttacctcagtgtctga

SEQ ID NO: 257290 - DNA, 25 bp, Mus musculus
atgatgtacttagctcagtgtctga

SEQ ID NO: 257291 - DNA, 25 bp, Mus musculus
atgatgtagccacgacgtgaaggca

SEQ ID NO: 257292 - DNA, 25 bp, Mus musculus
atgatgtagccaggacgtgaaggca

SEQ ID NO: 257293 - DNA, 25 bp, Mus musculus
atgatgtatcacaggcatgcccaga

SEQ ID NO: 257294 - DNA, 25 bp, Mus musculus
atgatgtatcactggcatgcccaga

SEQ ID NO: 257295 - DNA, 25 bp, Mus musculus
atgatgtatccaagctgggccacac

SEQ ID NO: 257296 - DNA, 25 bp, Mus musculus
atgatgtatccatgctgggccacac

SEQ ID NO: 257297 - DNA, 25 bp, Mus musculus
atgatgtattgacccagactggctt

SEQ ID NO: 257298 - DNA, 25 bp, Mus musculus
atgatgtattgagccagactggctt

SEQ ID NO: 257299 - DNA, 25 bp, Mus musculus
atgatgtatttcatcctgcagagaa

SEQ ID NO: 257300 - DNA, 25 bp, Mus musculus
atgatgtatttcttcctgcagagaa

SEQ ID NO: 257301 - DNA, 25 bp, Mus musculus
atgatgtcacagatcctataggctt

SEQ ID NO: 257302 - DNA, 25 bp, Mus musculus
atgatgtcacagttcctataggctt

SEQ ID NO: 257303 - DNA, 25 bp, Mus musculus
atgatgtcagaaacctggcttcccc

SEQ ID NO: 257304 - DNA, 25 bp, Mus musculus
atgatgtcagaatcctggcttcccc

SEQ ID NO: 257305 - DNA, 25 bp, Mus musculus
atgatgtcatatctagcccagctat

SEQ ID NO: 257306 - DNA, 25 bp, Mus musculus
atgatgtcatatgtagcccagctat

SEQ ID NO: 257307 - DNA, 25 bp, Mus musculus
atgatgtcatcaatcatggactgtc

SEQ ID NO: 257308 - DNA, 25 bp, Mus musculus
atgatgtcatcattcatggactgtc

SEQ ID NO: 257309 - DNA, 25 bp, Mus musculus
atgatgtcattactgaagtccacaa

SEQ ID NO: 257310 - DNA, 25 bp, Mus musculus
atgatgtcattagtgaagtccacaa

SEQ ID NO: 257311 - DNA, 25 bp, Mus musculus
atgatgtcattgattcccgaggctc

SEQ ID NO: 257312 - DNA, 25 bp, Mus musculus
atgatgtcattgtttcccgaggctc

SEQ ID NO: 257313 - DNA, 25 bp, Mus musculus
atgatgtccagcacttgcagactgc

SEQ ID NO: 257314 - DNA, 25 bp, Mus musculus
atgatgtccagctcttgcagactgc

SEQ ID NO: 257315 - DNA, 25 bp, Mus musculus
atgatgtccctaaggagcagcccag

SEQ ID NO: 257316 - DNA, 25 bp, Mus musculus
atgatgtccctatggagcagcccag

SEQ ID NO: 257317 - DNA, 25 bp, Mus musculus
atgatgtcctaacccacattgggaa

SEQ ID NO: 257318 - DNA, 25 bp, Mus musculus
atgatgtcctaagccacattgggaa

SEQ ID NO: 257319 - DNA, 25 bp, Mus musculus
atgatgtcctagcagtcaagcccag

SEQ ID NO: 257320 - DNA, 25 bp, Mus musculus
atgatgtcctaggagtcaagcccag

SEQ ID NO: 257321 - DNA, 25 bp, Mus musculus
atgatgtcctgaacgtgcaggccgt

SEQ ID NO: 257322 - DNA, 25 bp, Mus musculus
atgatgtcctgatcgtgcaggccgt

SEQ ID NO: 257323 - DNA, 25 bp, Mus musculus
atgatgtcctgtccaaggtgcccac

SEQ ID NO: 257324 - DNA, 25 bp, Mus musculus
atgatgtcctgtgcaaggtgcccac

SEQ ID NO: 257325 - DNA, 25 bp, Mus musculus
atgatgtcgaagcttcctctgatgc

SEQ ID NO: 257326 - DNA, 25 bp, Mus musculus
atgatgtcgaaggttcctctgatgc

SEQ ID NO: 257327 - DNA, 25 bp, Mus musculus
atgatgtcgtcccaggctatggagc

SEQ ID NO: 257328 - DNA, 25 bp, Mus musculus
atgatgtcgtccgaggctatggagc

SEQ ID NO: 257329 - DNA, 25 bp, Mus musculus
atgatgtctacaaacgtgtgccagt

SEQ ID NO: 257330 - DNA, 25 bp, Mus musculus
atgatgtctacactggcttctgctt

SEQ ID NO: 257331 - DNA, 25 bp, Mus musculus
atgatgtctacagtggcttctgctt

SEQ ID NO: 257332 - DNA, 25 bp, Mus musculus
atgatgtctacatacgtgtgccagt

SEQ ID NO: 257333 - DNA, 25 bp, Mus musculus
atgatgtctatactcttcagctctg

SEQ ID NO: 257334 - DNA, 25 bp, Mus musculus
atgatgtctatagtcttcagctctg

SEQ ID NO: 257335 - DNA, 25 bp, Mus musculus
atgatgtctattcaattgactttac

SEQ ID NO: 257336 - DNA, 25 bp, Mus musculus
atgatgtctattgaattgactttac

SEQ ID NO: 257337 - DNA, 25 bp, Mus musculus
atgatgtgaaccctttacacatgcc

SEQ ID NO: 257338 - DNA, 25 bp, Mus musculus
atgatgtgaaccgtttacacatgcc

SEQ ID NO: 257339 - DNA, 25 bp, Mus musculus
atgatgtgactgagcagtgccccgc

SEQ ID NO: 257340 - DNA, 25 bp, Mus musculus
atgatgtgactgtgcagtgccccgc

SEQ ID NO: 257341 - DNA, 25 bp, Mus musculus
atgatgtgaggcagtcagcagcagt

SEQ ID NO: 257342 - DNA, 25 bp, Mus musculus
atgatgtgaggctgtcagcagcagt

SEQ ID NO: 257343 - DNA, 25 bp, Mus musculus
atgatgtgatcgagcaccccatgga

SEQ ID NO: 257344 - DNA, 25 bp, Mus musculus
atgatgtgatcgtgcaccccatgga

SEQ ID NO: 257345 - DNA, 25 bp, Mus musculus
atgatgtgcacaccctgtcggcagc

SEQ ID NO: 257346 - DNA, 25 bp, Mus musculus
atgatgtgcacagcctgtcggcagc

SEQ ID NO: 257347 - DNA, 25 bp, Mus musculus
atgatgtgcaggactaagcgagatt

SEQ ID NO: 257348 - DNA, 25 bp, Mus musculus
atgatgtgcaggactctactgccta

SEQ ID NO: 257349 - DNA, 25 bp, Mus musculus
atgatgtgcaggtctaagcgagatt

SEQ ID NO: 257350 - DNA, 25 bp, Mus musculus
atgatgtgcaggtctctactgccta

SEQ ID NO: 257351 - DNA, 25 bp, Mus musculus
atgatgtggcacagcagcttcacct

SEQ ID NO: 257352 - DNA, 25 bp, Mus musculus
atgatgtggcactgcagcttcacct

SEQ ID NO: 257353 - DNA, 25 bp, Mus musculus
atgatgtgtcttctgcctttctaaa

SEQ ID NO: 257354 - DNA, 25 bp, Mus musculus
atgatgtgtcttgtgcctttctaaa

SEQ ID NO: 257355 - DNA, 25 bp, Mus musculus
atgatgtgttccagcctgtccatgg

SEQ ID NO: 257356 - DNA, 25 bp, Mus musculus
atgatgtgttcctgcctgtccatgg

SEQ ID NO: 257357 - DNA, 25 bp, Mus musculus
atgatgtgttgtcaaatttgttaat

SEQ ID NO: 257358 - DNA, 25 bp, Mus musculus
atgatgtgttgtgaaatttgttaat

SEQ ID NO: 257359 - DNA, 25 bp, Mus musculus
atgatgttaatcacttgtcttcctg

SEQ ID NO: 257360 - DNA, 25 bp, Mus musculus
atgatgttaatctcttgtcttcctg

SEQ ID NO: 257361 - DNA, 25 bp, Mus musculus
atgatgttacctaggcaccattgga

SEQ ID NO: 257362 - DNA, 25 bp, Mus musculus
atgatgttaccttggcaccattgga

SEQ ID NO: 257363 - DNA, 25 bp, Mus musculus
atgatgttactgcacaagtcaccgc

SEQ ID NO: 257364 - DNA, 25 bp, Mus musculus
atgatgttactggacaagtcaccgc

SEQ ID NO: 257365 - DNA, 25 bp, Mus musculus
atgatgttatcaagccaggcaccgt

SEQ ID NO: 257366 - DNA, 25 bp, Mus musculus
atgatgttatcatgccaggcaccgt

SEQ ID NO: 257367 - DNA, 25 bp, Mus musculus
atgatgttcctacttctttaccctg

SEQ ID NO: 257368 - DNA, 25 bp, Mus musculus
atgatgttcctagttctttaccctg

SEQ ID NO: 257369 - DNA, 25 bp, Mus musculus
atgatgttcgacctccctcagaatt

SEQ ID NO: 257370 - DNA, 25 bp, Mus musculus
atgatgttcgacgtccctcagaatt

SEQ ID NO: 257371 - DNA, 25 bp, Mus musculus
atgatgttctgtacatcttcctttc

SEQ ID NO: 257372 - DNA, 25 bp, Mus musculus
atgatgttctgttcatcttcctttc

SEQ ID NO: 257373 - DNA, 25 bp, Mus musculus
atgatgttctttctttttggtcaac

SEQ ID NO: 257374 - DNA, 25 bp, Mus musculus
atgatgttctttgtttttggtcaac

SEQ ID NO: 257375 - DNA, 25 bp, Mus musculus
atgatgttgaggcacggccccgcca

SEQ ID NO: 257376 - DNA, 25 bp, Mus musculus
atgatgttgagggacggccccgcca

SEQ ID NO: 257377 - DNA, 25 bp, Mus musculus
atgatgttgatgatgctggctgagc

SEQ ID NO: 257378 - DNA, 25 bp, Mus musculus
atgatgttgatgttgctggctgagc

SEQ ID NO: 257379 - DNA, 25 bp, Mus musculus
atgatgttgcttctgtgctttctcc

SEQ ID NO: 257380 - DNA, 25 bp, Mus musculus
atgatgttgcttgtgtgctttctcc

SEQ ID NO: 257381 - DNA, 25 bp, Mus musculus
atgatgtttctaactctggagctct

SEQ ID NO: 257382 - DNA, 25 bp, Mus musculus
atgatgtttctatctctggagctct

SEQ ID NO: 257383 - DNA, 25 bp, Mus musculus
atgatgtttgagacagcccaggctc

SEQ ID NO: 257384 - DNA, 25 bp, Mus musculus
atgatgtttgagtcagcccaggctc

SEQ ID NO: 257385 - DNA, 25 bp, Mus musculus
atgatgtttttgatcggtcccatgc

SEQ ID NO: 257386 - DNA, 25 bp, Mus musculus
atgatgtttttgttcggtcccatgc

SEQ ID NO: 257387 - DNA, 25 bp, Mus musculus
atgattaaatttccttctgtcttag

SEQ ID NO: 257388 - DNA, 25 bp, Mus musculus
atgattaaatttgcttctgtcttag

SEQ ID NO: 257389 - DNA, 25 bp, Mus musculus
atgattaaccctagagtcctacctt

SEQ ID NO: 257390 - DNA, 25 bp, Mus musculus
atgattaacccttgagtcctacctt

SEQ ID NO: 257391 - DNA, 25 bp, Mus musculus
atgattaattctcgaacccttccca

SEQ ID NO: 257392 - DNA, 25 bp, Mus musculus
atgattaattctggaacccttccca

SEQ ID NO: 257393 - DNA, 25 bp, Mus musculus
atgattacaaccatccactggagtt

SEQ ID NO: 257394 - DNA, 25 bp, Mus musculus
atgattacaaccttccactggagtt

SEQ ID NO: 257395 - DNA, 25 bp, Mus musculus
atgattacacaaaaccttttctgga

SEQ ID NO: 257396 - DNA, 25 bp, Mus musculus
atgattacacaataccttttctgga

SEQ ID NO: 257397 - DNA, 25 bp, Mus musculus
atgattacacctattctctggaaac

SEQ ID NO: 257398 - DNA, 25 bp, Mus musculus
atgattacaccttttctctggaaac

SEQ ID NO: 257399 - DNA, 25 bp, Mus musculus
atgattacactgatcacctgtgaat

SEQ ID NO: 257400 - DNA, 25 bp, Mus musculus
atgattacactgttcacctgtgaat

SEQ ID NO: 257401 - DNA, 25 bp, Mus musculus
atgattaccagtcaacttgtcacaa

SEQ ID NO: 257402 - DNA, 25 bp, Mus musculus
atgattaccagtgaacttgtcacaa

SEQ ID NO: 257403 - DNA, 25 bp, Mus musculus
atgattagttgcacctgcatgttct

SEQ ID NO: 257404 - DNA, 25 bp, Mus musculus
atgattagttgctcctgcatgttct

SEQ ID NO: 257405 - DNA, 25 bp, Mus musculus
atgattatcaggaatgcagcacaca

SEQ ID NO: 257406 - DNA, 25 bp, Mus musculus
atgattatcaggtatgcagcacaca

SEQ ID NO: 257407 - DNA, 25 bp, Mus musculus
atgattatcttcaggaacccctctt

SEQ ID NO: 257408 - DNA, 25 bp, Mus musculus
atgattatcttctggaacccctctt

SEQ ID NO: 257409 - DNA, 25 bp, Mus musculus
atgattatgaaaagctttgacggaa

SEQ ID NO: 257410 - DNA, 25 bp, Mus musculus
atgattatgaaatgctttgacggaa

SEQ ID NO: 257411 - DNA, 25 bp, Mus musculus
atgattatgttaagggtcgttttta

SEQ ID NO: 257412 - DNA, 25 bp, Mus musculus
atgattatgttatgggtcgttttta

SEQ ID NO: 257413 - DNA, 25 bp, Mus musculus
atgattattactcctgcttaccctc

SEQ ID NO: 257414 - DNA, 25 bp, Mus musculus
atgattattactgctgcttaccctc

SEQ ID NO: 257415 - DNA, 25 bp, Mus musculus
atgattattttaacgttccgagagc

SEQ ID NO: 257416 - DNA, 25 bp, Mus musculus
atgattattttatcgttccgagagc

SEQ ID NO: 257417 - DNA, 25 bp, Mus musculus
atgattcaatggctcggtcatcctc

SEQ ID NO: 257418 - DNA, 25 bp, Mus musculus
atgattcaatgggtcggtcatcctc

SEQ ID NO: 257419 - DNA, 25 bp, Mus musculus
atgattcaatgtctctgtcctcgga

SEQ ID NO: 257420 - DNA, 25 bp, Mus musculus
atgattcaatgtgtctgtcctcgga

SEQ ID NO: 257421 - DNA, 25 bp, Mus musculus
atgattcacatacggttacagggat

SEQ ID NO: 257422 - DNA, 25 bp, Mus musculus
atgattcacatagggttacagggat

SEQ ID NO: 257423 - DNA, 25 bp, Mus musculus
atgattcactccaataatcccagta

SEQ ID NO: 257424 - DNA, 25 bp, Mus musculus
atgattcactcctataatcccagta

SEQ ID NO: 257425 - DNA, 25 bp, Mus musculus
atgattcagctaagagacaccagaa

SEQ ID NO: 257426 - DNA, 25 bp, Mus musculus
atgattcagctatgagacaccagaa

SEQ ID NO: 257427 - DNA, 25 bp, Mus musculus
atgattcagttcagggtactctatt

SEQ ID NO: 257428 - DNA, 25 bp, Mus musculus
atgattcagttctgggtactctatt

SEQ ID NO: 257429 - DNA, 25 bp, Mus musculus
atgattcatgttcctgtgagggagt

SEQ ID NO: 257430 - DNA, 25 bp, Mus musculus
atgattcatgttgctgtgagggagt

SEQ ID NO: 257431 - DNA, 25 bp, Mus musculus
atgattcatttcaaggatctcctgc

SEQ ID NO: 257432 - DNA, 25 bp, Mus musculus
atgattcatttctaggatctcctgc

SEQ ID NO: 257433 - DNA, 25 bp, Mus musculus
atgattccacttatgctgtcttaca

SEQ ID NO: 257434 - DNA, 25 bp, Mus musculus
atgattccacttttgctgtcttaca

SEQ ID NO: 257435 - DNA, 25 bp, Mus musculus
atgattccagcaacgttagccacag

SEQ ID NO: 257436 - DNA, 25 bp, Mus musculus
atgattccagcatcgttagccacag

SEQ ID NO: 257437 - DNA, 25 bp, Mus musculus
atgattccagtcagcgtttttctct

SEQ ID NO: 257438 - DNA, 25 bp, Mus musculus
atgattccagtctgcgtttttctct

SEQ ID NO: 257439 - DNA, 25 bp, Mus musculus
atgattccatctccatggtatccag

SEQ ID NO: 257440 - DNA, 25 bp, Mus musculus
atgattccatctgcatggtatccag

SEQ ID NO: 257441 - DNA, 25 bp, Mus musculus
atgattcccaacatctgaagatctg

SEQ ID NO: 257442 - DNA, 25 bp, Mus musculus
atgattcccaacttctgaagatctg

SEQ ID NO: 257443 - DNA, 25 bp, Mus musculus
atgattcccaatcctacccagagat

SEQ ID NO: 257444 - DNA, 25 bp, Mus musculus
atgattcccaatgctacccagagat

SEQ ID NO: 257445 - DNA, 25 bp, Mus musculus
atgattccctacacactagaactgc

SEQ ID NO: 257446 - DNA, 25 bp, Mus musculus
atgattccctactcactagaactgc

SEQ ID NO: 257447 - DNA, 25 bp, Mus musculus
atgattccgcgtcgtagtggcacac

SEQ ID NO: 257448 - DNA, 25 bp, Mus musculus
atgattccgcgtggtagtggcacac

SEQ ID NO: 257449 - DNA, 25 bp, Mus musculus
atgattcctaagctacggctctttg

SEQ ID NO: 257450 - DNA, 25 bp, Mus musculus
atgattcctaaggtacggctctttg

SEQ ID NO: 257451 - DNA, 25 bp, Mus musculus
atgattcctatgctcagtccagtgg

SEQ ID NO: 257452 - DNA, 25 bp, Mus musculus
atgattcctatggtcagtccagtgg

SEQ ID NO: 257453 - DNA, 25 bp, Mus musculus
atgattcctcaacccattgtcatgg

SEQ ID NO: 257454 - DNA, 25 bp, Mus musculus
atgattcctcaagccattgtcatgg

SEQ ID NO: 257455 - DNA, 25 bp, Mus musculus
atgattcgacgacttcgtggtgtcc

SEQ ID NO: 257456 - DNA, 25 bp, Mus musculus
atgattcgacgagttcgtggtgtcc

SEQ ID NO: 257457 - DNA, 25 bp, Mus musculus
atgattcgaggcagggatttgaagc

SEQ ID NO: 257458 - DNA, 25 bp, Mus musculus
atgattcgaggctgggatttgaagc

SEQ ID NO: 257459 - DNA, 25 bp, Mus musculus
atgattcgcatcactactgcagtag

SEQ ID NO: 257460 - DNA, 25 bp, Mus musculus
atgattcgcatctctactgcagtag

SEQ ID NO: 257461 - DNA, 25 bp, Mus musculus
atgattcgccgaatgcttgggcctc

SEQ ID NO: 257462 - DNA, 25 bp, Mus musculus
atgattcgccgattgcttgggcctc

SEQ ID NO: 257463 - DNA, 25 bp, Mus musculus
atgattcggacactgacggccgcat

SEQ ID NO: 257464 - DNA, 25 bp, Mus musculus
atgattcggacagtgacggccgcat

SEQ ID NO: 257465 - DNA, 25 bp, Mus musculus
atgattctaatcaccggagggtgct

SEQ ID NO: 257466 - DNA, 25 bp, Mus musculus
atgattctaatctccggagggtgct

SEQ ID NO: 257467 - DNA, 25 bp, Mus musculus
atgattctccggactgactgatcct

SEQ ID NO: 257468 - DNA, 25 bp, Mus musculus
atgattctccggtctgactgatcct

SEQ ID NO: 257469 - DNA, 25 bp, Mus musculus
atgattctctctctgcaccgaggag

SEQ ID NO: 257470 - DNA, 25 bp, Mus musculus
atgattctctctgtgcaccgaggag

SEQ ID NO: 257471 - DNA, 25 bp, Mus musculus
atgattctctggcaccgttacgttt

SEQ ID NO: 257472 - DNA, 25 bp, Mus musculus
atgattctctgggaccgttacgttt

SEQ ID NO: 257473 - DNA, 25 bp, Mus musculus
atgattctctttcaacaatagcagg

SEQ ID NO: 257474 - DNA, 25 bp, Mus musculus
atgattctctttgaacaatagcagg

SEQ ID NO: 257475 - DNA, 25 bp, Mus musculus
atgattctgagaagggacgattaca

SEQ ID NO: 257476 - DNA, 25 bp, Mus musculus
atgattctgagatgggacgattaca

SEQ ID NO: 257477 - DNA, 25 bp, Mus musculus
atgattctggaaagggcaactatat

SEQ ID NO: 257478 - DNA, 25 bp, Mus musculus
atgattctggaatgggcaactatat

SEQ ID NO: 257479 - DNA, 25 bp, Mus musculus
atgattctgtgcaactcaggcatta

SEQ ID NO: 257480 - DNA, 25 bp, Mus musculus
atgattctgtgctactcaggcatta

SEQ ID NO: 257481 - DNA, 25 bp, Mus musculus
atgattcttacaacttttctcacag

SEQ ID NO: 257482 - DNA, 25 bp, Mus musculus
atgattcttacatcttttctcacag

SEQ ID NO: 257483 - DNA, 25 bp, Mus musculus
atgattcttattctcttgcttgagt

SEQ ID NO: 257484 - DNA, 25 bp, Mus musculus
atgattcttattgtcttgcttgagt

SEQ ID NO: 257485 - DNA, 25 bp, Mus musculus
atgattcttctacatgtaatcgcaa

SEQ ID NO: 257486 - DNA, 25 bp, Mus musculus
atgattcttctagatgtaatcgcaa

SEQ ID NO: 257487 - DNA, 25 bp, Mus musculus
atgattcttgctaattagcttttgt

SEQ ID NO: 257488 - DNA, 25 bp, Mus musculus
atgattcttgcttattagcttttgt

SEQ ID NO: 257489 - DNA, 25 bp, Mus musculus
atgattctttagagtccttagacaa

SEQ ID NO: 257490 - DNA, 25 bp, Mus musculus
atgattctttagtgtccttagacaa

SEQ ID NO: 257491 - DNA, 25 bp, Mus musculus
atgattctttcaaccaaacttccca

SEQ ID NO: 257492 - DNA, 25 bp, Mus musculus
atgattctttcatccaaacttccca

SEQ ID NO: 257493 - DNA, 25 bp, Mus musculus
atgattctttggatgtgacacttat

SEQ ID NO: 257494 - DNA, 25 bp, Mus musculus
atgattctttggttgtgacacttat

SEQ ID NO: 257495 - DNA, 25 bp, Mus musculus
atgattgaacttctctgtgcctcag

SEQ ID NO: 257496 - DNA, 25 bp, Mus musculus
atgattgaacttgtctgtgcctcag

SEQ ID NO: 257497 - DNA, 25 bp, Mus musculus
atgattgaccgtcccacttgatgtc

SEQ ID NO: 257498 - DNA, 25 bp, Mus musculus
atgattgaccgtgccacttgatgtc

SEQ ID NO: 257499 - DNA, 25 bp, Mus musculus
atgattgagcccatcttaggcacct

SEQ ID NO: 257500 - DNA, 25 bp, Mus musculus
atgattgagcccttcttaggcacct

SEQ ID NO: 257501 - DNA, 25 bp, Mus musculus
atgattgatgcaatctgacctccgt

SEQ ID NO: 257502 - DNA, 25 bp, Mus musculus
atgattgatgcattctgacctccgt

SEQ ID NO: 257503 - DNA, 25 bp, Mus musculus
atgattgcagtcaagcccaggtcta

SEQ ID NO: 257504 - DNA, 25 bp, Mus musculus
atgattgcagtctagcccaggtcta

SEQ ID NO: 257505 - DNA, 25 bp, Mus musculus
atgattgcatatcaccctcatccta

SEQ ID NO: 257506 - DNA, 25 bp, Mus musculus
atgattgcatatgaccctcatccta

SEQ ID NO: 257507 - DNA, 25 bp, Mus musculus
atgattgccaacacagatctcggtg

SEQ ID NO: 257508 - DNA, 25 bp, Mus musculus
atgattgccaactcagatctcggtg

SEQ ID NO: 257509 - DNA, 25 bp, Mus musculus
atgattgccatcagtgtctctgtca

SEQ ID NO: 257510 - DNA, 25 bp, Mus musculus
atgattgccatctgtgtctctgtca

SEQ ID NO: 257511 - DNA, 25 bp, Mus musculus
atgattgccgacagtggagagtaca

SEQ ID NO: 257512 - DNA, 25 bp, Mus musculus
atgattgccgactgtggagagtaca

SEQ ID NO: 257513 - DNA, 25 bp, Mus musculus
atgattgcctaccatgccctcctgg

SEQ ID NO: 257514 - DNA, 25 bp, Mus musculus
atgattgcctacgatgccctcctgg

SEQ ID NO: 257515 - DNA, 25 bp, Mus musculus
atgattgcctctaccagttaatggg

SEQ ID NO: 257516 - DNA, 25 bp, Mus musculus
atgattgcctcttccagttaatggg

SEQ ID NO: 257517 - DNA, 25 bp, Mus musculus
atgattgcgcttagttctccttaaa

SEQ ID NO: 257518 - DNA, 25 bp, Mus musculus
atgattgcgctttgttctccttaaa

SEQ ID NO: 257519 - DNA, 25 bp, Mus musculus
atgattgctactcttcatgtgcaaa

SEQ ID NO: 257520 - DNA, 25 bp, Mus musculus
atgattgctactgttcatgtgcaaa

SEQ ID NO: 257521 - DNA, 25 bp, Mus musculus
atgattgctgccacttacaacttcg

SEQ ID NO: 257522 - DNA, 25 bp, Mus musculus
atgattgctgcctcttacaacttcg

SEQ ID NO: 257523 - DNA, 25 bp, Mus musculus
atgattgctgtactgttcctgcagg

SEQ ID NO: 257524 - DNA, 25 bp, Mus musculus
atgattgctgtagtgttcctgcagg

SEQ ID NO: 257525 - DNA, 25 bp, Mus musculus
atgattgctttactttcactttaaa

SEQ ID NO: 257526 - DNA, 25 bp, Mus musculus
atgattgctttagtttcactttaaa

SEQ ID NO: 257527 - DNA, 25 bp, Mus musculus
atgattggattaacgctctgttagc

SEQ ID NO: 257528 - DNA, 25 bp, Mus musculus
atgattggattatcgctctgttagc

SEQ ID NO: 257529 - DNA, 25 bp, Mus musculus
atgattggcaccagggcattgatta

SEQ ID NO: 257530 - DNA, 25 bp, Mus musculus
atgattggcacctgggcattgatta

SEQ ID NO: 257531 - DNA, 25 bp, Mus musculus
atgattggcactctgactgcactac

SEQ ID NO: 257532 - DNA, 25 bp, Mus musculus
atgattggcactgtgactgcactac

SEQ ID NO: 257533 - DNA, 25 bp, Mus musculus
atgattgggcaaaacgtggactctc

SEQ ID NO: 257534 - DNA, 25 bp, Mus musculus
atgattgggcaatacgtggactctc

SEQ ID NO: 257535 - DNA, 25 bp, Mus musculus
atgattgggtttcagggactcccag

SEQ ID NO: 257536 - DNA, 25 bp, Mus musculus
atgattgggtttgagggactcccag

SEQ ID NO: 257537 - DNA, 25 bp, Mus musculus
atgattgtactgcagcacacgttga

SEQ ID NO: 257538 - DNA, 25 bp, Mus musculus
atgattgtactggagcacacgttga

SEQ ID NO: 257539 - DNA, 25 bp, Mus musculus
atgattgtcactcgtgcatgggccc

SEQ ID NO: 257540 - DNA, 25 bp, Mus musculus
atgattgtcactggtgcatgggccc

SEQ ID NO: 257541 - DNA, 25 bp, Mus musculus
atgattgtccaaaaagagtctcgat

SEQ ID NO: 257542 - DNA, 25 bp, Mus musculus
atgattgtccaataagagtctcgat

SEQ ID NO: 257543 - DNA, 25 bp, Mus musculus
atgattgtccctcacaaaaaatgcc

SEQ ID NO: 257544 - DNA, 25 bp, Mus musculus
atgattgtccctgacaaaaaatgcc

SEQ ID NO: 257545 - DNA, 25 bp, Mus musculus
atgattgtgaacattgctccacctg

SEQ ID NO: 257546 - DNA, 25 bp, Mus musculus
atgattgtgaactttgctccacctg

SEQ ID NO: 257547 - DNA, 25 bp, Mus musculus
atgattgtgagcagaggtagcctac

SEQ ID NO: 257548 - DNA, 25 bp, Mus musculus
atgattgtgagctgaggtagcctac

SEQ ID NO: 257549 - DNA, 25 bp, Mus musculus
atgattgtgattagtcctctgtggg

SEQ ID NO: 257550 - DNA, 25 bp, Mus musculus
atgattgtgatttgtcctctgtggg

SEQ ID NO: 257551 - DNA, 25 bp, Mus musculus
atgattgtgctgaggtcaccaggtg

SEQ ID NO: 257552 - DNA, 25 bp, Mus musculus
atgattgtgctgtggtcaccaggtg

SEQ ID NO: 257553 - DNA, 25 bp, Mus musculus
atgattgttaccaagtacctacttt

SEQ ID NO: 257554 - DNA, 25 bp, Mus musculus
atgattgttaccatagtgtgagttc

SEQ ID NO: 257555 - DNA, 25 bp, Mus musculus
atgattgttacctagtacctacttt

SEQ ID NO: 257556 - DNA, 25 bp, Mus musculus
atgattgttaccttagtgtgagttc

SEQ ID NO: 257557 - DNA, 25 bp, Mus musculus
atgattgttcctacaacagcatccc

SEQ ID NO: 257558 - DNA, 25 bp, Mus musculus
atgattgttccttcaacagcatccc

SEQ ID NO: 257559 - DNA, 25 bp, Mus musculus
atgattgtttccaggcacagttcga

SEQ ID NO: 257560 - DNA, 25 bp, Mus musculus
atgattgtttcctggcacagttcga

SEQ ID NO: 257561 - DNA, 25 bp, Mus musculus
atgattgtttgtaagcaccctagtt

SEQ ID NO: 257562 - DNA, 25 bp, Mus musculus
atgattgtttgttagcaccctagtt

SEQ ID NO: 257563 - DNA, 25 bp, Mus musculus
atgatttaaactcagcactgctgct

SEQ ID NO: 257564 - DNA, 25 bp, Mus musculus
atgatttaaactgagcactgctgct

SEQ ID NO: 257565 - DNA, 25 bp, Mus musculus
atgatttactttcccagtgactgac

SEQ ID NO: 257566 - DNA, 25 bp, Mus musculus
atgatttactttgccagtgactgac

SEQ ID NO: 257567 - DNA, 25 bp, Mus musculus
atgatttatgacctgatgcgactgt

SEQ ID NO: 257568 - DNA, 25 bp, Mus musculus
atgatttatgacgtgatgcgactgt

SEQ ID NO: 257569 - DNA, 25 bp, Mus musculus
atgatttcagatactagtccctagc

SEQ ID NO: 257570 - DNA, 25 bp, Mus musculus
atgatttcagattctagtccctagc

SEQ ID NO: 257571 - DNA, 25 bp, Mus musculus
atgatttcagccctaatctggtctg

SEQ ID NO: 257572 - DNA, 25 bp, Mus musculus
atgatttcagccgtaatctggtctg

SEQ ID NO: 257573 - DNA, 25 bp, Mus musculus
atgatttccaggctgtcactttcct

SEQ ID NO: 257574 - DNA, 25 bp, Mus musculus
atgatttccagggtgtcactttcct

SEQ ID NO: 257575 - DNA, 25 bp, Mus musculus
atgatttccatccagcagttactta

SEQ ID NO: 257576 - DNA, 25 bp, Mus musculus
atgatttccatcgagcagttactta

SEQ ID NO: 257577 - DNA, 25 bp, Mus musculus
atgatttcccccactataatcctag

SEQ ID NO: 257578 - DNA, 25 bp, Mus musculus
atgatttccccctctataatcctag

SEQ ID NO: 257579 - DNA, 25 bp, Mus musculus
atgatttctatcagtgctgctcagc

SEQ ID NO: 257580 - DNA, 25 bp, Mus musculus
atgatttctatctgtgctgctcagc

SEQ ID NO: 257581 - DNA, 25 bp, Mus musculus
atgatttctcagagtctgcgcccac

SEQ ID NO: 257582 - DNA, 25 bp, Mus musculus
atgatttctcagtgtctgcgcccac

SEQ ID NO: 257583 - DNA, 25 bp, Mus musculus
atgatttctcatagaagtgcttaga

SEQ ID NO: 257584 - DNA, 25 bp, Mus musculus
atgatttctcattgaagtgcttaga

SEQ ID NO: 257585 - DNA, 25 bp, Mus musculus
atgatttctcttaccatgtatcaga

SEQ ID NO: 257586 - DNA, 25 bp, Mus musculus
atgatttctctttccatgtatcaga

SEQ ID NO: 257587 - DNA, 25 bp, Mus musculus
atgatttctgcccactattttgaat

SEQ ID NO: 257588 - DNA, 25 bp, Mus musculus
atgatttctgccgactattttgaat

SEQ ID NO: 257589 - DNA, 25 bp, Mus musculus
atgatttctggtcatttaaactaac

SEQ ID NO: 257590 - DNA, 25 bp, Mus musculus
atgatttctggtgatttaaactaac

SEQ ID NO: 257591 - DNA, 25 bp, Mus musculus
atgatttcttgcatcttctgatgtg

SEQ ID NO: 257592 - DNA, 25 bp, Mus musculus
atgatttcttgcttcttctgatgtg

SEQ ID NO: 257593 - DNA, 25 bp, Mus musculus
atgatttctttaagtggcttccaga

SEQ ID NO: 257594 - DNA, 25 bp, Mus musculus
atgatttctttatgtggcttccaga

SEQ ID NO: 257595 - DNA, 25 bp, Mus musculus
atgatttctttcactggtggtgtgt

SEQ ID NO: 257596 - DNA, 25 bp, Mus musculus
atgatttctttctctggtggtgtgt

SEQ ID NO: 257597 - DNA, 25 bp, Mus musculus
atgatttctttgaaccacatttaga

SEQ ID NO: 257598 - DNA, 25 bp, Mus musculus
atgatttctttgtaccacatttaga

SEQ ID NO: 257599 - DNA, 25 bp, Mus musculus
atgatttgagggaccttcccactca

SEQ ID NO: 257600 - DNA, 25 bp, Mus musculus
atgatttgagggtccttcccactca

SEQ ID NO: 257601 - DNA, 25 bp, Mus musculus
atgatttgagtgcataccctcttcc

SEQ ID NO: 257602 - DNA, 25 bp, Mus musculus
atgatttgagtggataccctcttcc

SEQ ID NO: 257603 - DNA, 25 bp, Mus musculus
atgatttgcctgattccacaggaga

SEQ ID NO: 257604 - DNA, 25 bp, Mus musculus
atgatttgcctgtttccacaggaga

SEQ ID NO: 257605 - DNA, 25 bp, Mus musculus
atgatttgtctgcactcagtttctc

SEQ ID NO: 257606 - DNA, 25 bp, Mus musculus
atgatttgtctggactcagtttctc

SEQ ID NO: 257607 - DNA, 25 bp, Mus musculus
atgatttgtggcacttatgtccaga

SEQ ID NO: 257608 - DNA, 25 bp, Mus musculus
atgatttgtggctcttatgtccaga

SEQ ID NO: 257609 - DNA, 25 bp, Mus musculus
atgattttacaaagtgcctccacca

SEQ ID NO: 257610 - DNA, 25 bp, Mus musculus
atgattttacaatgtgcctccacca

SEQ ID NO: 257611 - DNA, 25 bp, Mus musculus
atgattttagttacacagaagctta

SEQ ID NO: 257612 - DNA, 25 bp, Mus musculus
atgattttagtttcacagaagctta

SEQ ID NO: 257613 - DNA, 25 bp, Mus musculus
atgattttctgtagtgtcccagcca

SEQ ID NO: 257614 - DNA, 25 bp, Mus musculus
atgattttctgttgtgtcccagcca

SEQ ID NO: 257615 - DNA, 25 bp, Mus musculus
atgattttgccaactgggagactta

SEQ ID NO: 257616 - DNA, 25 bp, Mus musculus
atgattttgccatctgggagactta

SEQ ID NO: 257617 - DNA, 25 bp, Mus musculus
atgattttggtgagaacctcccggc

SEQ ID NO: 257618 - DNA, 25 bp, Mus musculus
atgattttggtgtgaacctcccggc

SEQ ID NO: 257619 - DNA, 25 bp, Mus musculus
atgattttgtctacagatgctgtct

SEQ ID NO: 257620 - DNA, 25 bp, Mus musculus
atgattttgtcttcagatgctgtct

SEQ ID NO: 257621 - DNA, 25 bp, Mus musculus
atgattttgtgaccacttcattgta

SEQ ID NO: 257622 - DNA, 25 bp, Mus musculus
atgattttgtgagcacttcattgta

SEQ ID NO: 257623 - DNA, 25 bp, Mus musculus
atgattttgtttcaactgccaaagg

SEQ ID NO: 257624 - DNA, 25 bp, Mus musculus
atgattttgtttgaactgccaaagg

SEQ ID NO: 257625 - DNA, 25 bp, Mus musculus
atgatttttacacaggcatttcccc

SEQ ID NO: 257626 - DNA, 25 bp, Mus musculus
atgatttttacagaggcatttcccc

SEQ ID NO: 257627 - DNA, 25 bp, Mus musculus
atgatttttatcatcgcctgtctgc

SEQ ID NO: 257628 - DNA, 25 bp, Mus musculus
atgatttttatcctgatgggcctct

SEQ ID NO: 257629 - DNA, 25 bp, Mus musculus
atgatttttatcgtgatgggcctct

SEQ ID NO: 257630 - DNA, 25 bp, Mus musculus
atgatttttatcttcgcctgtctgc

SEQ ID NO: 257631 - DNA, 25 bp, Mus musculus
atgatttttccaagtcctggttcct

SEQ ID NO: 257632 - DNA, 25 bp, Mus musculus
atgatttttccatgtcctggttcct

SEQ ID NO: 257633 - DNA, 25 bp, Mus musculus
atgatttttgctaacactgtttgac

SEQ ID NO: 257634 - DNA, 25 bp, Mus musculus
atgatttttgcttacactgtttgac

SEQ ID NO: 257635 - DNA, 25 bp, Mus musculus
atgatttttggtaggtagaggctac

SEQ ID NO: 257636 - DNA, 25 bp, Mus musculus
atgatttttggttggtagaggctac

SEQ ID NO: 257637 - DNA, 25 bp, Mus musculus
atgatttttgtacttgacctaacgt

SEQ ID NO: 257638 - DNA, 25 bp, Mus musculus
atgatttttgtagttgacctaacgt

SEQ ID NO: 257639 - DNA, 25 bp, Mus musculus
atgcaaaaacctaagcagatggtgt

SEQ ID NO: 257640 - DNA, 25 bp, Mus musculus
atgcaaaaaccttagcagatggtgt

SEQ ID NO: 257641 - DNA, 25 bp, Mus musculus
atgcaaaaccagacacctttagaag

SEQ ID NO: 257642 - DNA, 25 bp, Mus musculus
atgcaaaaccagtcacctttagaag

SEQ ID NO: 257643 - DNA, 25 bp, Mus musculus
atgcaaaatgcacaccagccaaaat

SEQ ID NO: 257644 - DNA, 25 bp, Mus musculus
atgcaaaatgcaccagagagctctt

SEQ ID NO: 257645 - DNA, 25 bp, Mus musculus
atgcaaaatgcagaccagccaaaat

SEQ ID NO: 257646 - DNA, 25 bp, Mus musculus
atgcaaaatgcagcagagagctctt

SEQ ID NO: 257647 - DNA, 25 bp, Mus musculus
atgcaaacagacatacggacagcaa

SEQ ID NO: 257648 - DNA, 25 bp, Mus musculus
atgcaaacagacttacggacagcaa

SEQ ID NO: 257649 - DNA, 25 bp, Mus musculus
atgcaaacgtaacctgagctccatc

SEQ ID NO: 257650 - DNA, 25 bp, Mus musculus
atgcaaacgtaagctgagctccatc

SEQ ID NO: 257651 - DNA, 25 bp, Mus musculus
atgcaaactagaatgtgcgctccta

SEQ ID NO: 257652 - DNA, 25 bp, Mus musculus
atgcaaactagattgtgcgctccta

SEQ ID NO: 257653 - DNA, 25 bp, Mus musculus
atgcaaactgccctatccgaagggt

SEQ ID NO: 257654 - DNA, 25 bp, Mus musculus
atgcaaactgccgtatccgaagggt

SEQ ID NO: 257655 - DNA, 25 bp, Mus musculus
atgcaaagaaacctgggattgggaa

SEQ ID NO: 257656 - DNA, 25 bp, Mus musculus
atgcaaagaaacgtgggattgggaa

SEQ ID NO: 257657 - DNA, 25 bp, Mus musculus
atgcaaagacgacgatgtagacaaa

SEQ ID NO: 257658 - DNA, 25 bp, Mus musculus
atgcaaagacgaggatgtagacaaa

SEQ ID NO: 257659 - DNA, 25 bp, Mus musculus
atgcaaagagccatgcgtctggcaa

SEQ ID NO: 257660 - DNA, 25 bp, Mus musculus
atgcaaagagccttgcgtctggcaa

SEQ ID NO: 257661 - DNA, 25 bp, Mus musculus
atgcaaagcgggagctgagcctcac

SEQ ID NO: 257662 - DNA, 25 bp, Mus musculus
atgcaaagcgggtgctgagcctcac

SEQ ID NO: 257663 - DNA, 25 bp, Mus musculus
atgcaaaggcaacggaccaagtttt

SEQ ID NO: 257664 - DNA, 25 bp, Mus musculus
atgcaaaggcaagggaccaagtttt

SEQ ID NO: 257665 - DNA, 25 bp, Mus musculus
atgcaaagtattctgctgccccatg

SEQ ID NO: 257666 - DNA, 25 bp, Mus musculus
atgcaaagtattgtgctgccccatg

SEQ ID NO: 257667 - DNA, 25 bp, Mus musculus
atgcaaagttcgactgggctgatcc

SEQ ID NO: 257668 - DNA, 25 bp, Mus musculus
atgcaaagttcgtctgggctgatcc

SEQ ID NO: 257669 - DNA, 25 bp, Mus musculus
atgcaaagttgcaattcctatgaga

SEQ ID NO: 257670 - DNA, 25 bp, Mus musculus
atgcaaagttgctattcctatgaga

SEQ ID NO: 257671 - DNA, 25 bp, Mus musculus
atgcaaatacaactaaccacccaac

SEQ ID NO: 257672 - DNA, 25 bp, Mus musculus
atgcaaatacaagtaaccacccaac

SEQ ID NO: 257673 - DNA, 25 bp, Mus musculus
atgcaaatgattatctaacttagtg

SEQ ID NO: 257674 - DNA, 25 bp, Mus musculus
atgcaaatgattttctaacttagtg

SEQ ID NO: 257675 - DNA, 25 bp, Mus musculus
atgcaaatggctcgttccacattcc

SEQ ID NO: 257676 - DNA, 25 bp, Mus musculus
atgcaaatggctggttccacattcc

SEQ ID NO: 257677 - DNA, 25 bp, Mus musculus
atgcaaattactaacttctggcggg

SEQ ID NO: 257678 - DNA, 25 bp, Mus musculus
atgcaaattacttacttctggcggg

SEQ ID NO: 257679 - DNA, 25 bp, Mus musculus
atgcaacaaacaccttcacttcttt

SEQ ID NO: 257680 - DNA, 25 bp, Mus musculus
atgcaacaaacagcttcacttcttt

SEQ ID NO: 257681 - DNA, 25 bp, Mus musculus
atgcaacaagctactccttcattgt

SEQ ID NO: 257682 - DNA, 25 bp, Mus musculus
atgcaacaagcttctccttcattgt

SEQ ID NO: 257683 - DNA, 25 bp, Mus musculus
atgcaacaataacgccacatctcat

SEQ ID NO: 257684 - DNA, 25 bp, Mus musculus
atgcaacaataaggccacatctcat

SEQ ID NO: 257685 - DNA, 25 bp, Mus musculus
atgcaacaatgtaagactgacttct

SEQ ID NO: 257686 - DNA, 25 bp, Mus musculus
atgcaacaatgttagactgacttct

SEQ ID NO: 257687 - DNA, 25 bp, Mus musculus
atgcaacacaaaagggatctacttt

SEQ ID NO: 257688 - DNA, 25 bp, Mus musculus
atgcaacacaaatgggatctacttt

SEQ ID NO: 257689 - DNA, 25 bp, Mus musculus
atgcaacacaatatcgctgacccag

SEQ ID NO: 257690 - DNA, 25 bp, Mus musculus
atgcaacacaatttcgctgacccag

SEQ ID NO: 257691 - DNA, 25 bp, Mus musculus
atgcaacacatcaaaccagagaggg

SEQ ID NO: 257692 - DNA, 25 bp, Mus musculus
atgcaacacatctaaccagagaggg

SEQ ID NO: 257693 - DNA, 25 bp, Mus musculus
atgcaacaccatcttcaggttgaaa

SEQ ID NO: 257694 - DNA, 25 bp, Mus musculus
atgcaacaccatgttcaggttgaaa

SEQ ID NO: 257695 - DNA, 25 bp, Mus musculus
atgcaacacgttatgcggagtctgt

SEQ ID NO: 257696 - DNA, 25 bp, Mus musculus
atgcaacacgttttgcggagtctgt

SEQ ID NO: 257697 - DNA, 25 bp, Mus musculus
atgcaacaggttagtctcctacgtc

SEQ ID NO: 257698 - DNA, 25 bp, Mus musculus
atgcaacaggtttgtctcctacgtc

SEQ ID NO: 257699 - DNA, 25 bp, Mus musculus
atgcaacatgcaatggtaggctcat

SEQ ID NO: 257700 - DNA, 25 bp, Mus musculus
atgcaacatgcattggtaggctcat

SEQ ID NO: 257701 - DNA, 25 bp, Mus musculus
atgcaacattgcaagcgctgtggat

SEQ ID NO: 257702 - DNA, 25 bp, Mus musculus
atgcaacattgcctggtcaaccctc

SEQ ID NO: 257703 - DNA, 25 bp, Mus musculus
atgcaacattgcgtggtcaaccctc

SEQ ID NO: 257704 - DNA, 25 bp, Mus musculus
atgcaacattgctagcgctgtggat

SEQ ID NO: 257705 - DNA, 25 bp, Mus musculus
atgcaaccagaaatgtcctcaaggc

SEQ ID NO: 257706 - DNA, 25 bp, Mus musculus
atgcaaccagaattgtcctcaaggc

SEQ ID NO: 257707 - DNA, 25 bp, Mus musculus
atgcaaccccaccataaataaacgt

SEQ ID NO: 257708 - DNA, 25 bp, Mus musculus
atgcaaccccacgataaataaacgt

SEQ ID NO: 257709 - DNA, 25 bp, Mus musculus
atgcaaccccatatctccggaagga

SEQ ID NO: 257710 - DNA, 25 bp, Mus musculus
atgcaaccccatttctccggaagga

SEQ ID NO: 257711 - DNA, 25 bp, Mus musculus
atgcaaccggacacacatgcacaaa

SEQ ID NO: 257712 - DNA, 25 bp, Mus musculus
atgcaaccggactcacatgcacaaa

SEQ ID NO: 257713 - DNA, 25 bp, Mus musculus
atgcaacgatttccccagcagcacc

SEQ ID NO: 257714 - DNA, 25 bp, Mus musculus
atgcaacgatttgcccagcagcacc

SEQ ID NO: 257715 - DNA, 25 bp, Mus musculus
atgcaactaaacacagttagacaca

SEQ ID NO: 257716 - DNA, 25 bp, Mus musculus
atgcaactaaactcagttagacaca

SEQ ID NO: 257717 - DNA, 25 bp, Mus musculus
atgcaactcaacaacagttagctgg

SEQ ID NO: 257718 - DNA, 25 bp, Mus musculus
atgcaactcaactacagttagctgg

SEQ ID NO: 257719 - DNA, 25 bp, Mus musculus
atgcaactcagaacgtttccttgtc

SEQ ID NO: 257720 - DNA, 25 bp, Mus musculus
atgcaactcagatcgtttccttgtc

SEQ ID NO: 257721 - DNA, 25 bp, Mus musculus
atgcaactcttcagtcttctttctt

SEQ ID NO: 257722 - DNA, 25 bp, Mus musculus
atgcaactcttctgtcttctttctt

SEQ ID NO: 257723 - DNA, 25 bp, Mus musculus
atgcaactgaccagtactttactgt

SEQ ID NO: 257724 - DNA, 25 bp, Mus musculus
atgcaactgacctgtactttactgt

SEQ ID NO: 257725 - DNA, 25 bp, Mus musculus
atgcaactgcatcttttgttctcca

SEQ ID NO: 257726 - DNA, 25 bp, Mus musculus
atgcaactgcatgttttgttctcca

SEQ ID NO: 257727 - DNA, 25 bp, Mus musculus
atgcaactggttagtgttgttgact

SEQ ID NO: 257728 - DNA, 25 bp, Mus musculus
atgcaactggtttgtgttgttgact

SEQ ID NO: 257729 - DNA, 25 bp, Mus musculus
atgcaactgtcgcttgctggtgctg

SEQ ID NO: 257730 - DNA, 25 bp, Mus musculus
atgcaactgtcggttgctggtgctg

SEQ ID NO: 257731 - DNA, 25 bp, Mus musculus
atgcaagaaccaaaagcgcttcccg

SEQ ID NO: 257732 - DNA, 25 bp, Mus musculus
atgcaagaaccataagcgcttcccg

SEQ ID NO: 257733 - DNA, 25 bp, Mus musculus
atgcaagacatgcacaagttcccgt

SEQ ID NO: 257734 - DNA, 25 bp, Mus musculus
atgcaagacatggacaagttcccgt

SEQ ID NO: 257735 - DNA, 25 bp, Mus musculus
atgcaagaccccatttcagaggaac

SEQ ID NO: 257736 - DNA, 25 bp, Mus musculus
atgcaagaccccttttcagaggaac

SEQ ID NO: 257737 - DNA, 25 bp, Mus musculus
atgcaagagcatccttcagagttgt

SEQ ID NO: 257738 - DNA, 25 bp, Mus musculus
atgcaagagcatgcttcagagttgt

SEQ ID NO: 257739 - DNA, 25 bp, Mus musculus
atgcaagaggaacctcagccctata

SEQ ID NO: 257740 - DNA, 25 bp, Mus musculus
atgcaagaggaagctcagccctata

SEQ ID NO: 257741 - DNA, 25 bp, Mus musculus
atgcaagaggccattgagggtccag

SEQ ID NO: 257742 - DNA, 25 bp, Mus musculus
atgcaagaggcctttgagggtccag

SEQ ID NO: 257743 - DNA, 25 bp, Mus musculus
atgcaagatgtcctggtccgggcca

SEQ ID NO: 257744 - DNA, 25 bp, Mus musculus
atgcaagatgtcgtggtccgggcca

SEQ ID NO: 257745 - DNA, 25 bp, Mus musculus
atgcaagcaacaacaggccaaccta

SEQ ID NO: 257746 - DNA, 25 bp, Mus musculus
atgcaagcaacatcaggccaaccta

SEQ ID NO: 257747 - DNA, 25 bp, Mus musculus
atgcaagcaactcctatataagtaa

SEQ ID NO: 257748 - DNA, 25 bp, Mus musculus
atgcaagcaactgctatataagtaa

SEQ ID NO: 257749 - DNA, 25 bp, Mus musculus
atgcaagcacacctggctttctgag

SEQ ID NO: 257750 - DNA, 25 bp, Mus musculus
atgcaagcacacgtggctttctgag

SEQ ID NO: 257751 - DNA, 25 bp, Mus musculus
atgcaagcaccaatgtgcctgtttg

SEQ ID NO: 257752 - DNA, 25 bp, Mus musculus
atgcaagcaccattgtgcctgtttg

SEQ ID NO: 257753 - DNA, 25 bp, Mus musculus
atgcaagcactacaccaagctgtac

SEQ ID NO: 257754 - DNA, 25 bp, Mus musculus
atgcaagcactagaccaagctgtac

SEQ ID NO: 257755 - DNA, 25 bp, Mus musculus
atgcaagcatttaaatgctattttc

SEQ ID NO: 257756 - DNA, 25 bp, Mus musculus
atgcaagcattttaatgctattttc

SEQ ID NO: 257757 - DNA, 25 bp, Mus musculus
atgcaagccgcgagaagatcaagtc

SEQ ID NO: 257758 - DNA, 25 bp, Mus musculus
atgcaagccgcgtgaagatcaagtc

SEQ ID NO: 257759 - DNA, 25 bp, Mus musculus
atgcaagcgcggaacaggacagaga

SEQ ID NO: 257760 - DNA, 25 bp, Mus musculus
atgcaagcgcggtacaggacagaga

SEQ ID NO: 257761 - DNA, 25 bp, Mus musculus
atgcaagctctaagttgttaacccc

SEQ ID NO: 257762 - DNA, 25 bp, Mus musculus
atgcaagctctatgttgttaacccc

SEQ ID NO: 257763 - DNA, 25 bp, Mus musculus
atgcaagcttcaatctgccatgtcc

SEQ ID NO: 257764 - DNA, 25 bp, Mus musculus
atgcaagcttcattctgccatgtcc

SEQ ID NO: 257765 - DNA, 25 bp, Mus musculus
atgcaaggaaccatctcctgtgtcc

SEQ ID NO: 257766 - DNA, 25 bp, Mus musculus
atgcaaggaaccttctcctgtgtcc

SEQ ID NO: 257767 - DNA, 25 bp, Mus musculus
atgcaaggaactacggccagaggcc

SEQ ID NO: 257768 - DNA, 25 bp, Mus musculus
atgcaaggaacttcggccagaggcc

SEQ ID NO: 257769 - DNA, 25 bp, Mus musculus
atgcaaggactcctgccctgcactg

SEQ ID NO: 257770 - DNA, 25 bp, Mus musculus
atgcaaggactcgtgccctgcactg

SEQ ID NO: 257771 - DNA, 25 bp, Mus musculus
atgcaaggaggcagcttcatccacc

SEQ ID NO: 257772 - DNA, 25 bp, Mus musculus
atgcaaggaggctgcttcatccacc

SEQ ID NO: 257773 - DNA, 25 bp, Mus musculus
atgcaaggatgtattctcaccgctc

SEQ ID NO: 257774 - DNA, 25 bp, Mus musculus
atgcaaggatgttttctcaccgctc

SEQ ID NO: 257775 - DNA, 25 bp, Mus musculus
atgcaaggcaggcacatgacccatc

SEQ ID NO: 257776 - DNA, 25 bp, Mus musculus
atgcaaggcagggacatgacccatc

SEQ ID NO: 257777 - DNA, 25 bp, Mus musculus
atgcaaggccaacggtagacagaaa

SEQ ID NO: 257778 - DNA, 25 bp, Mus musculus
atgcaaggccaagggtagacagaaa

SEQ ID NO: 257779 - DNA, 25 bp, Mus musculus
atgcaaggcggtctgtcttcaagtc

SEQ ID NO: 257780 - DNA, 25 bp, Mus musculus
atgcaaggcggtgtgtcttcaagtc

SEQ ID NO: 257781 - DNA, 25 bp, Mus musculus
atgcaaggctgacctccgagaacat

SEQ ID NO: 257782 - DNA, 25 bp, Mus musculus
atgcaaggctgagctccgagaacat

SEQ ID NO: 257783 - DNA, 25 bp, Mus musculus
atgcaagggccaactttctcccagc

SEQ ID NO: 257784 - DNA, 25 bp, Mus musculus
atgcaagggccatctttctcccagc

SEQ ID NO: 257785 - DNA, 25 bp, Mus musculus
atgcaaggtaagactcttcagctcc

SEQ ID NO: 257786 - DNA, 25 bp, Mus musculus
atgcaaggtaagtctcttcagctcc

SEQ ID NO: 257787 - DNA, 25 bp, Mus musculus
atgcaaggtatgctgtgttctctgt

SEQ ID NO: 257788 - DNA, 25 bp, Mus musculus
atgcaaggtatggtgtgttctctgt

SEQ ID NO: 257789 - DNA, 25 bp, Mus musculus
atgcaaggtcagaaatgtccgccaa

SEQ ID NO: 257790 - DNA, 25 bp, Mus musculus
atgcaaggtcagtaatgtccgccaa

SEQ ID NO: 257791 - DNA, 25 bp, Mus musculus
atgcaaggtcttactagtttcatgt

SEQ ID NO: 257792 - DNA, 25 bp, Mus musculus
atgcaaggtctttctagtttcatgt

SEQ ID NO: 257793 - DNA, 25 bp, Mus musculus
atgcaaggtgctctgcgggtcactt

SEQ ID NO: 257794 - DNA, 25 bp, Mus musculus
atgcaaggtgctgtgcgggtcactt

SEQ ID NO: 257795 - DNA, 25 bp, Mus musculus
atgcaaggtgtcatcctgaaaagcc

SEQ ID NO: 257796 - DNA, 25 bp, Mus musculus
atgcaaggtgtcttcctgaaaagcc

SEQ ID NO: 257797 - DNA, 25 bp, Mus musculus
atgcaagtagagacatgccacctga

SEQ ID NO: 257798 - DNA, 25 bp, Mus musculus
atgcaagtagagtcatgccacctga

SEQ ID NO: 257799 - DNA, 25 bp, Mus musculus
atgcaagtcacacctagacactttc

SEQ ID NO: 257800 - DNA, 25 bp, Mus musculus
atgcaagtcacacggttggcttcac

SEQ ID NO: 257801 - DNA, 25 bp, Mus musculus
atgcaagtcacagctagacactttc

SEQ ID NO: 257802 - DNA, 25 bp, Mus musculus
atgcaagtcacagggttggcttcac

SEQ ID NO: 257803 - DNA, 25 bp, Mus musculus
atgcaagtccctctccttgaaatga

SEQ ID NO: 257804 - DNA, 25 bp, Mus musculus
atgcaagtccctgtccttgaaatga

SEQ ID NO: 257805 - DNA, 25 bp, Mus musculus
atgcaagtccttcggtgggttctac

SEQ ID NO: 257806 - DNA, 25 bp, Mus musculus
atgcaagtccttgggtgggttctac

SEQ ID NO: 257807 - DNA, 25 bp, Mus musculus
atgcaagtctggatcctatccagga

SEQ ID NO: 257808 - DNA, 25 bp, Mus musculus
atgcaagtctggttcctatccagga

SEQ ID NO: 257809 - DNA, 25 bp, Mus musculus
atgcaagtgatgacatctccctcaa

SEQ ID NO: 257810 - DNA, 25 bp, Mus musculus
atgcaagtgatgaggcttgtgacca

SEQ ID NO: 257811 - DNA, 25 bp, Mus musculus
atgcaagtgatgtcatctccctcaa

SEQ ID NO: 257812 - DNA, 25 bp, Mus musculus
atgcaagtgatgtggcttgtgacca

SEQ ID NO: 257813 - DNA, 25 bp, Mus musculus
atgcaagtgcctcataatttcatga

SEQ ID NO: 257814 - DNA, 25 bp, Mus musculus
atgcaagtgcctgataatttcatga

SEQ ID NO: 257815 - DNA, 25 bp, Mus musculus
atgcaagtggtaactgctaaggaaa

SEQ ID NO: 257816 - DNA, 25 bp, Mus musculus
atgcaagtggtatctgctaaggaaa

SEQ ID NO: 257817 - DNA, 25 bp, Mus musculus
atgcaagtggtccacagttctatat

SEQ ID NO: 257818 - DNA, 25 bp, Mus musculus
atgcaagtggtcgacagttctatat

SEQ ID NO: 257819 - DNA, 25 bp, Mus musculus
atgcaagtgttacaacttcctccgc

SEQ ID NO: 257820 - DNA, 25 bp, Mus musculus
atgcaagtgttagaacttcctccgc

SEQ ID NO: 257821 - DNA, 25 bp, Mus musculus
atgcaagttccgatgtcaccagaat

SEQ ID NO: 257822 - DNA, 25 bp, Mus musculus
atgcaagttccgttgtcaccagaat

SEQ ID NO: 257823 - DNA, 25 bp, Mus musculus
atgcaagttgtgaacaccagctatt

SEQ ID NO: 257824 - DNA, 25 bp, Mus musculus
atgcaagttgtgtacaccagctatt

SEQ ID NO: 257825 - DNA, 25 bp, Mus musculus
atgcaagtttcaaggcactcagtgt

SEQ ID NO: 257826 - DNA, 25 bp, Mus musculus
atgcaagtttcatggcactcagtgt

SEQ ID NO: 257827 - DNA, 25 bp, Mus musculus
atgcaagtttggcttagtccttttt

SEQ ID NO: 257828 - DNA, 25 bp, Mus musculus
atgcaagtttgggttagtccttttt

SEQ ID NO: 257829 - DNA, 25 bp, Mus musculus
atgcaataagagattgtggccatgg

SEQ ID NO: 257830 - DNA, 25 bp, Mus musculus
atgcaataagagtttgtggccatgg

SEQ ID NO: 257831 - DNA, 25 bp, Mus musculus
atgcaataagtgactccggtccctt

SEQ ID NO: 257832 - DNA, 25 bp, Mus musculus
atgcaataagtgtctccggtccctt

SEQ ID NO: 257833 - DNA, 25 bp, Mus musculus
atgcaatactccagatctgtgggcc

SEQ ID NO: 257834 - DNA, 25 bp, Mus musculus
atgcaatactcctgatctgtgggcc

SEQ ID NO: 257835 - DNA, 25 bp, Mus musculus
atgcaatactgtctctcctgtcagt

SEQ ID NO: 257836 - DNA, 25 bp, Mus musculus
atgcaatactgtgtctcctgtcagt

SEQ ID NO: 257837 - DNA, 25 bp, Mus musculus
atgcaatatctacctccagtgtaaa

SEQ ID NO: 257838 - DNA, 25 bp, Mus musculus
atgcaatatctagctccagtgtaaa

SEQ ID NO: 257839 - DNA, 25 bp, Mus musculus
atgcaatcagacatgcctctcagag

SEQ ID NO: 257840 - DNA, 25 bp, Mus musculus
atgcaatcagacttgcctctcagag

SEQ ID NO: 257841 - DNA, 25 bp, Mus musculus
atgcaatcaggcactgagctcagat

SEQ ID NO: 257842 - DNA, 25 bp, Mus musculus
atgcaatcaggctctgagctcagat

SEQ ID NO: 257843 - DNA, 25 bp, Mus musculus
atgcaatcagtgagccttgaattat

SEQ ID NO: 257844 - DNA, 25 bp, Mus musculus
atgcaatcagtgtgccttgaattat

SEQ ID NO: 257845 - DNA, 25 bp, Mus musculus
atgcaatccaaactgacttgtaaag

SEQ ID NO: 257846 - DNA, 25 bp, Mus musculus
atgcaatccaaagtgacttgtaaag

SEQ ID NO: 257847 - DNA, 25 bp, Mus musculus
atgcaatccacacaggtcgcgccgg

SEQ ID NO: 257848 - DNA, 25 bp, Mus musculus
atgcaatccacagaggtcgcgccgg

SEQ ID NO: 257849 - DNA, 25 bp, Mus musculus
atgcaatccatgattccttttaatc

SEQ ID NO: 257850 - DNA, 25 bp, Mus musculus
atgcaatccatgtttccttttaatc

SEQ ID NO: 257851 - DNA, 25 bp, Mus musculus
atgcaatcctctcttcggctttcac

SEQ ID NO: 257852 - DNA, 25 bp, Mus musculus
atgcaatcctctgttcggctttcac

SEQ ID NO: 257853 - DNA, 25 bp, Mus musculus
atgcaatctaaacccagtttccttc

SEQ ID NO: 257854 - DNA, 25 bp, Mus musculus
atgcaatctaaagccagtttccttc

SEQ ID NO: 257855 - DNA, 25 bp, Mus musculus
atgcaatctctcagtgtaggcttcc

SEQ ID NO: 257856 - DNA, 25 bp, Mus musculus
atgcaatctctctgtgtaggcttcc

SEQ ID NO: 257857 - DNA, 25 bp, Mus musculus
atgcaatctgcacggtacaaccatc

SEQ ID NO: 257858 - DNA, 25 bp, Mus musculus
atgcaatctgcagggtacaaccatc

SEQ ID NO: 257859 - DNA, 25 bp, Mus musculus
atgcaatctgtgaaccaatttggac

SEQ ID NO: 257860 - DNA, 25 bp, Mus musculus
atgcaatctgtgtaccaatttggac

SEQ ID NO: 257861 - DNA, 25 bp, Mus musculus
atgcaatctttgatggacttccgtc

SEQ ID NO: 257862 - DNA, 25 bp, Mus musculus
atgcaatctttgttggacttccgtc

SEQ ID NO: 257863 - DNA, 25 bp, Mus musculus
atgcaatgcacgaacaaaggtgttt

SEQ ID NO: 257864 - DNA, 25 bp, Mus musculus
atgcaatgcacgtacaaaggtgttt

SEQ ID NO: 257865 - DNA, 25 bp, Mus musculus
atgcaatgcctactaacagctcctt

SEQ ID NO: 257866 - DNA, 25 bp, Mus musculus
atgcaatgcctagtaacagctcctt

SEQ ID NO: 257867 - DNA, 25 bp, Mus musculus
atgcaatgcctgaatttatcttgaa

SEQ ID NO: 257868 - DNA, 25 bp, Mus musculus
atgcaatgcctgtatttatcttgaa

SEQ ID NO: 257869 - DNA, 25 bp, Mus musculus
atgcaatggagtctgcactgcactt

SEQ ID NO: 257870 - DNA, 25 bp, Mus musculus
atgcaatggagtgtgcactgcactt

SEQ ID NO: 257871 - DNA, 25 bp, Mus musculus
atgcaatggatgaagccctcaggat

SEQ ID NO: 257872 - DNA, 25 bp, Mus musculus
atgcaatggatgtagccctcaggat

SEQ ID NO: 257873 - DNA, 25 bp, Mus musculus
atgcaatggtggactgttttcctca

SEQ ID NO: 257874 - DNA, 25 bp, Mus musculus
atgcaatggtggtctgttttcctca

SEQ ID NO: 257875 - DNA, 25 bp, Mus musculus
atgcaatgtctgagcatatccctcc

SEQ ID NO: 257876 - DNA, 25 bp, Mus musculus
atgcaatgtctgtgcatatccctcc

SEQ ID NO: 257877 - DNA, 25 bp, Mus musculus
atgcaatgtgttacttaggccccta

SEQ ID NO: 257878 - DNA, 25 bp, Mus musculus
atgcaatgtgtttcttaggccccta

SEQ ID NO: 257879 - DNA, 25 bp, Mus musculus
atgcaattacacacagattccttct

SEQ ID NO: 257880 - DNA, 25 bp, Mus musculus
atgcaattacactcagattccttct

SEQ ID NO: 257881 - DNA, 25 bp, Mus musculus
atgcaattactccttccgttgttaa

SEQ ID NO: 257882 - DNA, 25 bp, Mus musculus
atgcaattactcgttccgttgttaa

SEQ ID NO: 257883 - DNA, 25 bp, Mus musculus
atgcaattatgaaggccctgtcacc

SEQ ID NO: 257884 - DNA, 25 bp, Mus musculus
atgcaattatgatggccctgtcacc

SEQ ID NO: 257885 - DNA, 25 bp, Mus musculus
atgcaattcagtcgcttgtggtgga

SEQ ID NO: 257886 - DNA, 25 bp, Mus musculus
atgcaattcagtggcttgtggtgga

SEQ ID NO: 257887 - DNA, 25 bp, Mus musculus
atgcaattccatattcagacttaga

SEQ ID NO: 257888 - DNA, 25 bp, Mus musculus
atgcaattccattttcagacttaga

SEQ ID NO: 257889 - DNA, 25 bp, Mus musculus
atgcaattgcttaacatacttgttt

SEQ ID NO: 257890 - DNA, 25 bp, Mus musculus
atgcaattgctttacatacttgttt

SEQ ID NO: 257891 - DNA, 25 bp, Mus musculus
atgcaatttatgataagtagagcca

SEQ ID NO: 257892 - DNA, 25 bp, Mus musculus
atgcaatttatgttaagtagagcca

SEQ ID NO: 257893 - DNA, 25 bp, Mus musculus
atgcaatttgcaaccttagttgtca

SEQ ID NO: 257894 - DNA, 25 bp, Mus musculus
atgcaatttgcatccttagttgtca

SEQ ID NO: 257895 - DNA, 25 bp, Mus musculus
atgcaatttgctagcaactctcctc

SEQ ID NO: 257896 - DNA, 25 bp, Mus musculus
atgcaatttgcttgcaactctcctc

SEQ ID NO: 257897 - DNA, 25 bp, Mus musculus
atgcacaaaatccactttagagaag

SEQ ID NO: 257898 - DNA, 25 bp, Mus musculus
atgcacaaaatcgactttagagaag

SEQ ID NO: 257899 - DNA, 25 bp, Mus musculus
atgcacaaacctatcgtaagctaaa

SEQ ID NO: 257900 - DNA, 25 bp, Mus musculus
atgcacaaacctttcgtaagctaaa

SEQ ID NO: 257901 - DNA, 25 bp, Mus musculus
atgcacaaactcatcctggagatgc

SEQ ID NO: 257902 - DNA, 25 bp, Mus musculus
atgcacaaactcttcctggagatgc

SEQ ID NO: 257903 - DNA, 25 bp, Mus musculus
atgcacaaaggcctcttctctagga

SEQ ID NO: 257904 - DNA, 25 bp, Mus musculus
atgcacaaaggcgtcttctctagga

SEQ ID NO: 257905 - DNA, 25 bp, Mus musculus
atgcacaaattgctgttcctctcca

SEQ ID NO: 257906 - DNA, 25 bp, Mus musculus
atgcacaaattggtgttcctctcca

SEQ ID NO: 257907 - DNA, 25 bp, Mus musculus
atgcacaatatcatgtctcaatgag

SEQ ID NO: 257908 - DNA, 25 bp, Mus musculus
atgcacaatatcttgtctcaatgag

SEQ ID NO: 257909 - DNA, 25 bp, Mus musculus
atgcacaatctgcagccttttggcg

SEQ ID NO: 257910 - DNA, 25 bp, Mus musculus
atgcacaatctggagccttttggcg

SEQ ID NO: 257911 - DNA, 25 bp, Mus musculus
atgcacacactcacctacggctgga

SEQ ID NO: 257912 - DNA, 25 bp, Mus musculus
atgcacacactctcctacggctgga

SEQ ID NO: 257913 - DNA, 25 bp, Mus musculus
atgcacacagcaaacttcaatgtct

SEQ ID NO: 257914 - DNA, 25 bp, Mus musculus
atgcacacagcatacttcaatgtct

SEQ ID NO: 257915 - DNA, 25 bp, Mus musculus
atgcacacagctcatagtgaccctt

SEQ ID NO: 257916 - DNA, 25 bp, Mus musculus
atgcacacagctgatagtgaccctt

SEQ ID NO: 257917 - DNA, 25 bp, Mus musculus
atgcacacagtgactgatgcgcctg

SEQ ID NO: 257918 - DNA, 25 bp, Mus musculus
atgcacacagtgtctgatgcgcctg

SEQ ID NO: 257919 - DNA, 25 bp, Mus musculus
atgcacacatgcaagacggatgaat

SEQ ID NO: 257920 - DNA, 25 bp, Mus musculus
atgcacacatgctagacggatgaat

SEQ ID NO: 257921 - DNA, 25 bp, Mus musculus
atgcacacccatcccaatgtctgtg

SEQ ID NO: 257922 - DNA, 25 bp, Mus musculus
atgcacacccatgccaatgtctgtg

SEQ ID NO: 257923 - DNA, 25 bp, Mus musculus
atgcacaccgcacacagacatgagc

SEQ ID NO: 257924 - DNA, 25 bp, Mus musculus
atgcacaccgcagacagacatgagc

SEQ ID NO: 257925 - DNA, 25 bp, Mus musculus
atgcacacgcacatgttcttgatct

SEQ ID NO: 257926 - DNA, 25 bp, Mus musculus
atgcacacgcacttgttcttgatct

SEQ ID NO: 257927 - DNA, 25 bp, Mus musculus
atgcacacggtcagtttacacacgc

SEQ ID NO: 257928 - DNA, 25 bp, Mus musculus
atgcacacggtctgtttacacacgc

SEQ ID NO: 257929 - DNA, 25 bp, Mus musculus
atgcacacgtgactcgcctgttggt

SEQ ID NO: 257930 - DNA, 25 bp, Mus musculus
atgcacacgtgagtcgcctgttggt

SEQ ID NO: 257931 - DNA, 25 bp, Mus musculus
atgcacacgtgcattggggctgcca

SEQ ID NO: 257932 - DNA, 25 bp, Mus musculus
atgcacacgtgctttggggctgcca

SEQ ID NO: 257933 - DNA, 25 bp, Mus musculus
atgcacactccactttccatctcac

SEQ ID NO: 257934 - DNA, 25 bp, Mus musculus
atgcacactccagtttccatctcac

SEQ ID NO: 257935 - DNA, 25 bp, Mus musculus
atgcacagacacagttcctgggact

SEQ ID NO: 257936 - DNA, 25 bp, Mus musculus
atgcacagacactgttcctgggact

SEQ ID NO: 257937 - DNA, 25 bp, Mus musculus
atgcacagaggtcgctgcagttctc

SEQ ID NO: 257938 - DNA, 25 bp, Mus musculus
atgcacagaggtggctgcagttctc

SEQ ID NO: 257939 - DNA, 25 bp, Mus musculus
atgcacagagtcctggcttggatcc

SEQ ID NO: 257940 - DNA, 25 bp, Mus musculus
atgcacagagtcgtggcttggatcc

SEQ ID NO: 257941 - DNA, 25 bp, Mus musculus
atgcacagatggatcccagtgttcc

SEQ ID NO: 257942 - DNA, 25 bp, Mus musculus
atgcacagatggttcccagtgttcc

SEQ ID NO: 257943 - DNA, 25 bp, Mus musculus
atgcacagcaaacggcttcggtcaa

SEQ ID NO: 257944 - DNA, 25 bp, Mus musculus
atgcacagcaaagggcttcggtcaa

SEQ ID NO: 257945 - DNA, 25 bp, Mus musculus
atgcacagctacagaggtacatcct

SEQ ID NO: 257946 - DNA, 25 bp, Mus musculus
atgcacagctactgaggtacatcct

SEQ ID NO: 257947 - DNA, 25 bp, Mus musculus
atgcacaggcttcgtgttatgaagc

SEQ ID NO: 257948 - DNA, 25 bp, Mus musculus
atgcacaggcttggtgttatgaagc

SEQ ID NO: 257949 - DNA, 25 bp, Mus musculus
atgcacagggctagtcatcttgcag

SEQ ID NO: 257950 - DNA, 25 bp, Mus musculus
atgcacagggcttgtcatcttgcag

SEQ ID NO: 257951 - DNA, 25 bp, Mus musculus
atgcacagtgcaacgactgcttcca

SEQ ID NO: 257952 - DNA, 25 bp, Mus musculus
atgcacagtgcatcgactgcttcca

SEQ ID NO: 257953 - DNA, 25 bp, Mus musculus
atgcacagtgctcctctgcggagga

SEQ ID NO: 257954 - DNA, 25 bp, Mus musculus
atgcacagtgctgctctgcggagga

SEQ ID NO: 257955 - DNA, 25 bp, Mus musculus
atgcacagttacaccagatctactt

SEQ ID NO: 257956 - DNA, 25 bp, Mus musculus
atgcacagttactccagatctactt

SEQ ID NO: 257957 - DNA, 25 bp, Mus musculus
atgcacagttgtcgagtctttctca

SEQ ID NO: 257958 - DNA, 25 bp, Mus musculus
atgcacagttgtggagtctttctca

SEQ ID NO: 257959 - DNA, 25 bp, Mus musculus
atgcacatatataccgctttcagaa

SEQ ID NO: 257960 - DNA, 25 bp, Mus musculus
atgcacatatattccgctttcagaa

SEQ ID NO: 257961 - DNA, 25 bp, Mus musculus
atgcacatatgtattccatcttact

SEQ ID NO: 257962 - DNA, 25 bp, Mus musculus
atgcacatatgttttccatcttact

SEQ ID NO: 257963 - DNA, 25 bp, Mus musculus
atgcacatcactcggatcaagccgc

SEQ ID NO: 257964 - DNA, 25 bp, Mus musculus
atgcacatcactgggatcaagccgc

SEQ ID NO: 257965 - DNA, 25 bp, Mus musculus
atgcacatcaggctgcgagattctt

SEQ ID NO: 257966 - DNA, 25 bp, Mus musculus
atgcacatcagggtgcgagattctt

SEQ ID NO: 257967 - DNA, 25 bp, Mus musculus
atgcacatcctcactcactctggga

SEQ ID NO: 257968 - DNA, 25 bp, Mus musculus
atgcacatcctctctcactctggga

SEQ ID NO: 257969 - DNA, 25 bp, Mus musculus
atgcacatgaagctgtcccggacta

SEQ ID NO: 257970 - DNA, 25 bp, Mus musculus
atgcacatgaaggtgtcccggacta

SEQ ID NO: 257971 - DNA, 25 bp, Mus musculus
atgcacatgactctgaattcaaagg

SEQ ID NO: 257972 - DNA, 25 bp, Mus musculus
atgcacatgactgtgaattcaaagg

SEQ ID NO: 257973 - DNA, 25 bp, Mus musculus
atgcacatgatgatcggctgttctg

SEQ ID NO: 257974 - DNA, 25 bp, Mus musculus
atgcacatgatgttcggctgttctg

SEQ ID NO: 257975 - DNA, 25 bp, Mus musculus
atgcacatgccaagtgtggaggtca

SEQ ID NO: 257976 - DNA, 25 bp, Mus musculus
atgcacatgccatgtgtggaggtca

SEQ ID NO: 257977 - DNA, 25 bp, Mus musculus
atgcacatggacatccaagccgtgt

SEQ ID NO: 257978 - DNA, 25 bp, Mus musculus
atgcacatggacttccaagccgtgt

SEQ ID NO: 257979 - DNA, 25 bp, Mus musculus
atgcacatggtgctcagctatacat

SEQ ID NO: 257980 - DNA, 25 bp, Mus musculus
atgcacatggtggtcagctatacat

SEQ ID NO: 257981 - DNA, 25 bp, Mus musculus
atgcacattattcttcgtcagtttg

SEQ ID NO: 257982 - DNA, 25 bp, Mus musculus
atgcacattattgttcgtcagtttg

SEQ ID NO: 257983 - DNA, 25 bp, Mus musculus
atgcaccaaactctatcacaacttg

SEQ ID NO: 257984 - DNA, 25 bp, Mus musculus
atgcaccaaactgtatcacaacttg

SEQ ID NO: 257985 - DNA, 25 bp, Mus musculus
atgcaccaccagcatcttactgtat

SEQ ID NO: 257986 - DNA, 25 bp, Mus musculus
atgcaccaccaggatcttactgtat

SEQ ID NO: 257987 - DNA, 25 bp, Mus musculus
atgcaccaccatctctgatttatgt

SEQ ID NO: 257988 - DNA, 25 bp, Mus musculus
atgcaccaccatgtctgatttatgt

SEQ ID NO: 257989 - DNA, 25 bp, Mus musculus
atgcaccacgcgatcccaatgtgta

SEQ ID NO: 257990 - DNA, 25 bp, Mus musculus
atgcaccacgcgttcccaatgtgta

SEQ ID NO: 257991 - DNA, 25 bp, Mus musculus
atgcaccactaaactcagctctgaa

SEQ ID NO: 257992 - DNA, 25 bp, Mus musculus
atgcaccactaacgctgtctgggtt

SEQ ID NO: 257993 - DNA, 25 bp, Mus musculus
atgcaccactaaggctgtctgggtt

SEQ ID NO: 257994 - DNA, 25 bp, Mus musculus
atgcaccactaatctcagctctgaa

SEQ ID NO: 257995 - DNA, 25 bp, Mus musculus
atgcaccagagaccccacctgaggt

SEQ ID NO: 257996 - DNA, 25 bp, Mus musculus
atgcaccagagagcccacctgaggt

SEQ ID NO: 257997 - DNA, 25 bp, Mus musculus
atgcaccagcagaaaacgctacctg

SEQ ID NO: 257998 - DNA, 25 bp, Mus musculus
atgcaccagcagtaaacgctacctg

SEQ ID NO: 257999 - DNA, 25 bp, Mus musculus
atgcaccaggtgaccgatggctctg

SEQ ID NO: 258000 - DNA, 25 bp, Mus musculus
atgcaccaggtgtccgatggctctg

SEQ ID NO: 258001 - DNA, 25 bp, Mus musculus
atgcaccatcaaatagtacttcaag

SEQ ID NO: 258002 - DNA, 25 bp, Mus musculus
atgcaccatcaattagtacttcaag

SEQ ID NO: 258003 - DNA, 25 bp, Mus musculus
atgcaccatcatactcgactgtgag

SEQ ID NO: 258004 - DNA, 25 bp, Mus musculus
atgcaccatcattctcgactgtgag

SEQ ID NO: 258005 - DNA, 25 bp, Mus musculus
atgcaccatgacaagatgccctgag

SEQ ID NO: 258006 - DNA, 25 bp, Mus musculus
atgcaccatgacatcttgttagttc

SEQ ID NO: 258007 - DNA, 25 bp, Mus musculus
atgcaccatgactagatgccctgag

SEQ ID NO: 258008 - DNA, 25 bp, Mus musculus
atgcaccatgacttcttgttagttc

SEQ ID NO: 258009 - DNA, 25 bp, Mus musculus
atgcaccattcacacttgttagagt

SEQ ID NO: 258010 - DNA, 25 bp, Mus musculus
atgcaccattcagacttgttagagt

SEQ ID NO: 258011 - DNA, 25 bp, Mus musculus
atgcacccagtaacctcttgtatga

SEQ ID NO: 258012 - DNA, 25 bp, Mus musculus
atgcacccagtatcctcttgtatga

SEQ ID NO: 258013 - DNA, 25 bp, Mus musculus
atgcacccagttcgcatgcaataat

SEQ ID NO: 258014 - DNA, 25 bp, Mus musculus
atgcacccagttggcatgcaataat

SEQ ID NO: 258015 - DNA, 25 bp, Mus musculus
atgcacccgaggctgatactgctgc

SEQ ID NO: 258016 - DNA, 25 bp, Mus musculus
atgcacccgagggtgatactgctgc

SEQ ID NO: 258017 - DNA, 25 bp, Mus musculus
atgcacccgcagcttaacatctaca

SEQ ID NO: 258018 - DNA, 25 bp, Mus musculus
atgcacccgcaggttaacatctaca

SEQ ID NO: 258019 - DNA, 25 bp, Mus musculus
atgcaccctacgaaggccatgctgt

SEQ ID NO: 258020 - DNA, 25 bp, Mus musculus
atgcaccctacgtaggccatgctgt

SEQ ID NO: 258021 - DNA, 25 bp, Mus musculus
atgcaccctggacatgtgtctttag

SEQ ID NO: 258022 - DNA, 25 bp, Mus musculus
atgcaccctggagatgtgtctttag

SEQ ID NO: 258023 - DNA, 25 bp, Mus musculus
atgcaccgtttaattatcagctggg

SEQ ID NO: 258024 - DNA, 25 bp, Mus musculus
atgcaccgtttatttatcagctggg

SEQ ID NO: 258025 - DNA, 25 bp, Mus musculus
atgcacctagagcatgccactcgat

SEQ ID NO: 258026 - DNA, 25 bp, Mus musculus
atgcacctagaggatgccactcgat

SEQ ID NO: 258027 - DNA, 25 bp, Mus musculus
atgcacctagccaggatggagggat

SEQ ID NO: 258028 - DNA, 25 bp, Mus musculus
atgcacctagcctggatggagggat

SEQ ID NO: 258029 - DNA, 25 bp, Mus musculus
atgcacctcagacagccttcagaaa

SEQ ID NO: 258030 - DNA, 25 bp, Mus musculus
atgcacctcagagagccttcagaaa

SEQ ID NO: 258031 - DNA, 25 bp, Mus musculus
atgcacctgccgagggagtgctgta

SEQ ID NO: 258032 - DNA, 25 bp, Mus musculus
atgcacctgccgtgggagtgctgta

SEQ ID NO: 258033 - DNA, 25 bp, Mus musculus
atgcacctgcctaattagatgtgag

SEQ ID NO: 258034 - DNA, 25 bp, Mus musculus
atgcacctgccttattagatgtgag

SEQ ID NO: 258035 - DNA, 25 bp, Mus musculus
atgcacctgctgctctggtgaaggt

SEQ ID NO: 258036 - DNA, 25 bp, Mus musculus
atgcacctgctggtctggtgaaggt

SEQ ID NO: 258037 - DNA, 25 bp, Mus musculus
atgcacctgggcagctacttgagga

SEQ ID NO: 258038 - DNA, 25 bp, Mus musculus
atgcacctgggctgctacttgagga

SEQ ID NO: 258039 - DNA, 25 bp, Mus musculus
atgcacctgggtctgaattgtaaaa

SEQ ID NO: 258040 - DNA, 25 bp, Mus musculus
atgcacctgggtgtgaattgtaaaa

SEQ ID NO: 258041 - DNA, 25 bp, Mus musculus
atgcacctgtatagtctagccttga

SEQ ID NO: 258042 - DNA, 25 bp, Mus musculus
atgcacctgtattgtctagccttga

SEQ ID NO: 258043 - DNA, 25 bp, Mus musculus
atgcacctgtccaacctgatttttt

SEQ ID NO: 258044 - DNA, 25 bp, Mus musculus
atgcacctgtcctacctgatttttt

SEQ ID NO: 258045 - DNA, 25 bp, Mus musculus
atgcaccttctcatttattcttcac

SEQ ID NO: 258046 - DNA, 25 bp, Mus musculus
atgcaccttctcttttattcttcac

SEQ ID NO: 258047 - DNA, 25 bp, Mus musculus
atgcaccttggtctggagttaaaag

SEQ ID NO: 258048 - DNA, 25 bp, Mus musculus
atgcaccttggtgtggagttaaaag

SEQ ID NO: 258049 - DNA, 25 bp, Mus musculus
atgcacgacattacctcttaaaggg

SEQ ID NO: 258050 - DNA, 25 bp, Mus musculus
atgcacgacatttcctcttaaaggg

SEQ ID NO: 258051 - DNA, 25 bp, Mus musculus
atgcacgactatcctggtgtatgga

SEQ ID NO: 258052 - DNA, 25 bp, Mus musculus
atgcacgactatgctggtgtatgga

SEQ ID NO: 258053 - DNA, 25 bp, Mus musculus
atgcacgaggtcagatttgttcccc

SEQ ID NO: 258054 - DNA, 25 bp, Mus musculus
atgcacgaggtctgatttgttcccc

SEQ ID NO: 258055 - DNA, 25 bp, Mus musculus
atgcacgatggtattctcagctctt

SEQ ID NO: 258056 - DNA, 25 bp, Mus musculus
atgcacgatggttttctcagctctt

SEQ ID NO: 258057 - DNA, 25 bp, Mus musculus
atgcacgcacctcagtatgtgtgtg

SEQ ID NO: 258058 - DNA, 25 bp, Mus musculus
atgcacgcacctgagtatgtgtgtg

SEQ ID NO: 258059 - DNA, 25 bp, Mus musculus
atgcacgcatatcctcacacacaaa

SEQ ID NO: 258060 - DNA, 25 bp, Mus musculus
atgcacgcatatgctcacacacaaa

SEQ ID NO: 258061 - DNA, 25 bp, Mus musculus
atgcacggtgtcctactgaaacaaa

SEQ ID NO: 258062 - DNA, 25 bp, Mus musculus
atgcacggtgtcgtactgaaacaaa

SEQ ID NO: 258063 - DNA, 25 bp, Mus musculus
atgcacgtctttagtttcacttctt

SEQ ID NO: 258064 - DNA, 25 bp, Mus musculus
atgcacgtcttttgtttcacttctt

SEQ ID NO: 258065 - DNA, 25 bp, Mus musculus
atgcacgtgcgaccaaaatctctcg

SEQ ID NO: 258066 - DNA, 25 bp, Mus musculus
atgcacgtgcgagcaaaatctctcg

SEQ ID NO: 258067 - DNA, 25 bp, Mus musculus
atgcactaacccagacctggcagtg

SEQ ID NO: 258068 - DNA, 25 bp, Mus musculus
atgcactaaccctgacctggcagtg

SEQ ID NO: 258069 - DNA, 25 bp, Mus musculus
atgcactaacctattttgatggcta

SEQ ID NO: 258070 - DNA, 25 bp, Mus musculus
atgcactaaccttttttgatggcta

SEQ ID NO: 258071 - DNA, 25 bp, Mus musculus
atgcactaactaccttatatccaag

SEQ ID NO: 258072 - DNA, 25 bp, Mus musculus
atgcactaactagcttatatccaag

SEQ ID NO: 258073 - DNA, 25 bp, Mus musculus
atgcactaactcatcttcctctgcg

SEQ ID NO: 258074 - DNA, 25 bp, Mus musculus
atgcactaactcttcttcctctgcg

SEQ ID NO: 258075 - DNA, 25 bp, Mus musculus
atgcactaatgtccctgagctgtaa

SEQ ID NO: 258076 - DNA, 25 bp, Mus musculus
atgcactaatgtgcctgagctgtaa

SEQ ID NO: 258077 - DNA, 25 bp, Mus musculus
atgcactacactcgtatctgatatc

SEQ ID NO: 258078 - DNA, 25 bp, Mus musculus
atgcactacactggtatctgatatc

SEQ ID NO: 258079 - DNA, 25 bp, Mus musculus
atgcactacctgagggttctggaga

SEQ ID NO: 258080 - DNA, 25 bp, Mus musculus
atgcactacctgtgggttctggaga

SEQ ID NO: 258081 - DNA, 25 bp, Mus musculus
atgcactatcggaagaagaagcaga

SEQ ID NO: 258082 - DNA, 25 bp, Mus musculus
atgcactatcggtagaagaagcaga

SEQ ID NO: 258083 - DNA, 25 bp, Mus musculus
atgcactatctaactgtaccttgac

SEQ ID NO: 258084 - DNA, 25 bp, Mus musculus
atgcactatctatctgtaccttgac

SEQ ID NO: 258085 - DNA, 25 bp, Mus musculus
atgcactcacatacagcattctgtt

SEQ ID NO: 258086 - DNA, 25 bp, Mus musculus
atgcactcacattcagcattctgtt

SEQ ID NO: 258087 - DNA, 25 bp, Mus musculus
atgcactcacggctggtctgggaaa

SEQ ID NO: 258088 - DNA, 25 bp, Mus musculus
atgcactcacgggtggtctgggaaa

SEQ ID NO: 258089 - DNA, 25 bp, Mus musculus
atgcactcactccttctttagaaga

SEQ ID NO: 258090 - DNA, 25 bp, Mus musculus
atgcactcactcgttctttagaaga

SEQ ID NO: 258091 - DNA, 25 bp, Mus musculus
atgcactcagagacagtttctccat

SEQ ID NO: 258092 - DNA, 25 bp, Mus musculus
atgcactcagagtcagtttctccat

SEQ ID NO: 258093 - DNA, 25 bp, Mus musculus
atgcactcatcacggcttcttctat

SEQ ID NO: 258094 - DNA, 25 bp, Mus musculus
atgcactcatcagggcttcttctat

SEQ ID NO: 258095 - DNA, 25 bp, Mus musculus
atgcactccagaaagttgttctcta

SEQ ID NO: 258096 - DNA, 25 bp, Mus musculus
atgcactccagatagttgttctcta

SEQ ID NO: 258097 - DNA, 25 bp, Mus musculus
atgcactcccgcagcttgtaagagt

SEQ ID NO: 258098 - DNA, 25 bp, Mus musculus
atgcactcccgctgcttgtaagagt

SEQ ID NO: 258099 - DNA, 25 bp, Mus musculus
atgcactcgaggatgctgctgccaa

SEQ ID NO: 258100 - DNA, 25 bp, Mus musculus
atgcactcgaggttgctgctgccaa

SEQ ID NO: 258101 - DNA, 25 bp, Mus musculus
atgcactctcatcctgtgtagtgga

SEQ ID NO: 258102 - DNA, 25 bp, Mus musculus
atgcactctcatgctgtgtagtgga

SEQ ID NO: 258103 - DNA, 25 bp, Mus musculus
atgcactctctacgccttggaaaag

SEQ ID NO: 258104 - DNA, 25 bp, Mus musculus
atgcactctctaggccttggaaaag

SEQ ID NO: 258105 - DNA, 25 bp, Mus musculus
atgcactgaaaaacgtcgggttctg

SEQ ID NO: 258106 - DNA, 25 bp, Mus musculus
atgcactgaaaatcgtcgggttctg

SEQ ID NO: 258107 - DNA, 25 bp, Mus musculus
atgcactgaccaatggaggcagcgt

SEQ ID NO: 258108 - DNA, 25 bp, Mus musculus
atgcactgaccattggaggcagcgt

SEQ ID NO: 258109 - DNA, 25 bp, Mus musculus
atgcactgagccctttatagttccg

SEQ ID NO: 258110 - DNA, 25 bp, Mus musculus
atgcactgagccgtttatagttccg

SEQ ID NO: 258111 - DNA, 25 bp, Mus musculus
atgcactgagcgctctgcgaccaga

SEQ ID NO: 258112 - DNA, 25 bp, Mus musculus
atgcactgagcggtctgcgaccaga

SEQ ID NO: 258113 - DNA, 25 bp, Mus musculus
atgcactgatcccattatgtcactg

SEQ ID NO: 258114 - DNA, 25 bp, Mus musculus
atgcactgatccgattatgtcactg

SEQ ID NO: 258115 - DNA, 25 bp, Mus musculus
atgcactgcaacagtaggccgagta

SEQ ID NO: 258116 - DNA, 25 bp, Mus musculus
atgcactgcaactgtaggccgagta

SEQ ID NO: 258117 - DNA, 25 bp, Mus musculus
atgcactgcagcacatggcggagtt

SEQ ID NO: 258118 - DNA, 25 bp, Mus musculus
atgcactgcagctcatggcggagtt

SEQ ID NO: 258119 - DNA, 25 bp, Mus musculus
atgcactgcatcctcaagtggctga

SEQ ID NO: 258120 - DNA, 25 bp, Mus musculus
atgcactgcatcgtcaagtggctga

SEQ ID NO: 258121 - DNA, 25 bp, Mus musculus
atgcactgcccactaatgggtacaa

SEQ ID NO: 258122 - DNA, 25 bp, Mus musculus
atgcactgcccagtaatgggtacaa

SEQ ID NO: 258123 - DNA, 25 bp, Mus musculus
atgcactgcctaacactaggtagca

SEQ ID NO: 258124 - DNA, 25 bp, Mus musculus
atgcactgcctatcactaggtagca

SEQ ID NO: 258125 - DNA, 25 bp, Mus musculus
atgcactgcctcatcagctggtgaa

SEQ ID NO: 258126 - DNA, 25 bp, Mus musculus
atgcactgcctcttcagctggtgaa

SEQ ID NO: 258127 - DNA, 25 bp, Mus musculus
atgcactgcctgacatgaagagtca

SEQ ID NO: 258128 - DNA, 25 bp, Mus musculus
atgcactgcctgtcatgaagagtca

SEQ ID NO: 258129 - DNA, 25 bp, Mus musculus
atgcactggcacaatggtcaccttg

SEQ ID NO: 258130 - DNA, 25 bp, Mus musculus
atgcactggcactatggtcaccttg

SEQ ID NO: 258131 - DNA, 25 bp, Mus musculus
atgcactggctgaatgtctagttca

SEQ ID NO: 258132 - DNA, 25 bp, Mus musculus
atgcactggctgtatgtctagttca

SEQ ID NO: 258133 - DNA, 25 bp, Mus musculus
atgcactgggtaaagcagacacctg

SEQ ID NO: 258134 - DNA, 25 bp, Mus musculus
atgcactgggtatagcagacacctg

SEQ ID NO: 258135 - DNA, 25 bp, Mus musculus
atgcactgtcttaacttttgatatg

SEQ ID NO: 258136 - DNA, 25 bp, Mus musculus
atgcactgtctttacttttgatatg

SEQ ID NO: 258137 - DNA, 25 bp, Mus musculus
atgcactgttaacccctagatccag

SEQ ID NO: 258138 - DNA, 25 bp, Mus musculus
atgcactgttaagccctagatccag

SEQ ID NO: 258139 - DNA, 25 bp, Mus musculus
atgcacttatatcaggacaccacag

SEQ ID NO: 258140 - DNA, 25 bp, Mus musculus
atgcacttatatgaggacaccacag

SEQ ID NO: 258141 - DNA, 25 bp, Mus musculus
atgcacttcatgctggacacactaa

SEQ ID NO: 258142 - DNA, 25 bp, Mus musculus
atgcacttcatggtggacacactaa

SEQ ID NO: 258143 - DNA, 25 bp, Mus musculus
atgcacttggccatcctgggtgaga

SEQ ID NO: 258144 - DNA, 25 bp, Mus musculus
atgcacttggccttcctgggtgaga

SEQ ID NO: 258145 - DNA, 25 bp, Mus musculus
atgcactttgatcaagacgtgaaaa

SEQ ID NO: 258146 - DNA, 25 bp, Mus musculus
atgcactttgatgaagacgtgaaaa

SEQ ID NO: 258147 - DNA, 25 bp, Mus musculus
atgcagaaacggcatccttggaggc

SEQ ID NO: 258148 - DNA, 25 bp, Mus musculus
atgcagaaacgggatccttggaggc

SEQ ID NO: 258149 - DNA, 25 bp, Mus musculus
atgcagaaattcagagctttcgggt

SEQ ID NO: 258150 - DNA, 25 bp, Mus musculus
atgcagaaattctgagctttcgggt

SEQ ID NO: 258151 - DNA, 25 bp, Mus musculus
atgcagaacagtcacagcggagtga

SEQ ID NO: 258152 - DNA, 25 bp, Mus musculus
atgcagaacagtgacagcggagtga

SEQ ID NO: 258153 - DNA, 25 bp, Mus musculus
atgcagaactgcatcatctccatct

SEQ ID NO: 258154 - DNA, 25 bp, Mus musculus
atgcagaactgcttcatctccatct

SEQ ID NO: 258155 - DNA, 25 bp, Mus musculus
atgcagaatatgagaccagaccaga

SEQ ID NO: 258156 - DNA, 25 bp, Mus musculus
atgcagaatatgtgaccagaccaga

SEQ ID NO: 258157 - DNA, 25 bp, Mus musculus
atgcagaatcaaacggcctctactc

SEQ ID NO: 258158 - DNA, 25 bp, Mus musculus
atgcagaatcaatcggcctctactc

SEQ ID NO: 258159 - DNA, 25 bp, Mus musculus
atgcagaatgcgagccttcatctca

SEQ ID NO: 258160 - DNA, 25 bp, Mus musculus
atgcagaatgcgtgccttcatctca

SEQ ID NO: 258161 - DNA, 25 bp, Mus musculus
atgcagaattcaagctacccagtat

SEQ ID NO: 258162 - DNA, 25 bp, Mus musculus
atgcagaattcatgctacccagtat

SEQ ID NO: 258163 - DNA, 25 bp, Mus musculus
atgcagacacagagaccaccgtgat

SEQ ID NO: 258164 - DNA, 25 bp, Mus musculus
atgcagacacagtgaccaccgtgat

SEQ ID NO: 258165 - DNA, 25 bp, Mus musculus
atgcagacaccactgtttcccttct

SEQ ID NO: 258166 - DNA, 25 bp, Mus musculus
atgcagacaccagtgtttcccttct

SEQ ID NO: 258167 - DNA, 25 bp, Mus musculus
atgcagacacccacataaccatgta

SEQ ID NO: 258168 - DNA, 25 bp, Mus musculus
atgcagacaccctcataaccatgta

SEQ ID NO: 258169 - DNA, 25 bp, Mus musculus
atgcagacagatccacactaactag

SEQ ID NO: 258170 - DNA, 25 bp, Mus musculus
atgcagacagatgcacactaactag

SEQ ID NO: 258171 - DNA, 25 bp, Mus musculus
atgcagacagccaacacctggtatc

SEQ ID NO: 258172 - DNA, 25 bp, Mus musculus
atgcagacagccaagctccatggtg

SEQ ID NO: 258173 - DNA, 25 bp, Mus musculus
atgcagacagcctacacctggtatc

SEQ ID NO: 258174 - DNA, 25 bp, Mus musculus
atgcagacagcctagctccatggtg

SEQ ID NO: 258175 - DNA, 25 bp, Mus musculus
atgcagaccctgctctatgagaact

SEQ ID NO: 258176 - DNA, 25 bp, Mus musculus
atgcagaccctggtctatgagaact

SEQ ID NO: 258177 - DNA, 25 bp, Mus musculus
atgcagacctagataccaactcaga

SEQ ID NO: 258178 - DNA, 25 bp, Mus musculus
atgcagacctagttaccaactcaga

SEQ ID NO: 258179 - DNA, 25 bp, Mus musculus
atgcagaccttcctttacaaagaga

SEQ ID NO: 258180 - DNA, 25 bp, Mus musculus
atgcagaccttcgtttacaaagaga

SEQ ID NO: 258181 - DNA, 25 bp, Mus musculus
atgcagacgggcaacaggcgtcgtt

SEQ ID NO: 258182 - DNA, 25 bp, Mus musculus
atgcagacgggctacaggcgtcgtt

SEQ ID NO: 258183 - DNA, 25 bp, Mus musculus
atgcagacgtcccattcaaacggtc

SEQ ID NO: 258184 - DNA, 25 bp, Mus musculus
atgcagacgtccgattcaaacggtc

SEQ ID NO: 258185 - DNA, 25 bp, Mus musculus
atgcagactcaccaaaggacccagt

SEQ ID NO: 258186 - DNA, 25 bp, Mus musculus
atgcagactcacgaaaggacccagt

SEQ ID NO: 258187 - DNA, 25 bp, Mus musculus
atgcagactctgcttgtggttttga

SEQ ID NO: 258188 - DNA, 25 bp, Mus musculus
atgcagactctggttgtggttttga

SEQ ID NO: 258189 - DNA, 25 bp, Mus musculus
atgcagactgcacactgtgaagaaa

SEQ ID NO: 258190 - DNA, 25 bp, Mus musculus
atgcagactgcagactgtgaagaaa

SEQ ID NO: 258191 - DNA, 25 bp, Mus musculus
atgcagactgctcgaaaagccttct

SEQ ID NO: 258192 - DNA, 25 bp, Mus musculus
atgcagactgctggaaaagccttct

SEQ ID NO: 258193 - DNA, 25 bp, Mus musculus
atgcagacttgcatggtttaaccat

SEQ ID NO: 258194 - DNA, 25 bp, Mus musculus
atgcagacttgcttggtttaaccat

SEQ ID NO: 258195 - DNA, 25 bp, Mus musculus
atgcagactttcatattgccccttc

SEQ ID NO: 258196 - DNA, 25 bp, Mus musculus
atgcagactttcttattgccccttc

SEQ ID NO: 258197 - DNA, 25 bp, Mus musculus
atgcagagaaacagctcctctggtg

SEQ ID NO: 258198 - DNA, 25 bp, Mus musculus
atgcagagaaactgctcctctggtg

SEQ ID NO: 258199 - DNA, 25 bp, Mus musculus
atgcagagacaacgacaagacgtcc

SEQ ID NO: 258200 - DNA, 25 bp, Mus musculus
atgcagagacaaggacaagacgtcc

SEQ ID NO: 258201 - DNA, 25 bp, Mus musculus
atgcagagacagcaagcaccctttt

SEQ ID NO: 258202 - DNA, 25 bp, Mus musculus
atgcagagacaggaagcaccctttt

SEQ ID NO: 258203 - DNA, 25 bp, Mus musculus
atgcagagagcaagcccggaacaca

SEQ ID NO: 258204 - DNA, 25 bp, Mus musculus
atgcagagagcatgcccggaacaca

SEQ ID NO: 258205 - DNA, 25 bp, Mus musculus
atgcagagagctatcggtctgtctc

SEQ ID NO: 258206 - DNA, 25 bp, Mus musculus
atgcagagagctttcggtctgtctc

SEQ ID NO: 258207 - DNA, 25 bp, Mus musculus
atgcagagcagacagtctgccctct

SEQ ID NO: 258208 - DNA, 25 bp, Mus musculus
atgcagagcagagagtctgccctct

SEQ ID NO: 258209 - DNA, 25 bp, Mus musculus
atgcagagctgtccccagtaactga

SEQ ID NO: 258210 - DNA, 25 bp, Mus musculus
atgcagagctgtgcccagtaactga

SEQ ID NO: 258211 - DNA, 25 bp, Mus musculus
atgcagagcttgcttcttgttggcc

SEQ ID NO: 258212 - DNA, 25 bp, Mus musculus
atgcagagcttggttcttgttggcc

SEQ ID NO: 258213 - DNA, 25 bp, Mus musculus
atgcagaggccaagccagagtccct

SEQ ID NO: 258214 - DNA, 25 bp, Mus musculus
atgcagaggccatgccagagtccct

SEQ ID NO: 258215 - DNA, 25 bp, Mus musculus
atgcagaggctaaagttgatggctc

SEQ ID NO: 258216 - DNA, 25 bp, Mus musculus
atgcagaggctactctatatagaga

SEQ ID NO: 258217 - DNA, 25 bp, Mus musculus
atgcagaggctagtctatatagaga

SEQ ID NO: 258218 - DNA, 25 bp, Mus musculus
atgcagaggctatagttgatggctc

SEQ ID NO: 258219 - DNA, 25 bp, Mus musculus
atgcagagggacacctggctttaag

SEQ ID NO: 258220 - DNA, 25 bp, Mus musculus
atgcagagggactcctggctttaag

SEQ ID NO: 258221 - DNA, 25 bp, Mus musculus
atgcagagggctaccatccacaact

SEQ ID NO: 258222 - DNA, 25 bp, Mus musculus
atgcagagggcttccatccacaact

SEQ ID NO: 258223 - DNA, 25 bp, Mus musculus
atgcagagtaccaacgggtggcacc

SEQ ID NO: 258224 - DNA, 25 bp, Mus musculus
atgcagagtacctacgggtggcacc

SEQ ID NO: 258225 - DNA, 25 bp, Mus musculus
atgcagagtcctatccctacaggga

SEQ ID NO: 258226 - DNA, 25 bp, Mus musculus
atgcagagtcctttccctacaggga

SEQ ID NO: 258227 - DNA, 25 bp, Mus musculus
atgcagagtgccatggtgtcatcta

SEQ ID NO: 258228 - DNA, 25 bp, Mus musculus
atgcagagtgccttggtgtcatcta

SEQ ID NO: 258229 - DNA, 25 bp, Mus musculus
atgcagagtgctacctgagtgcaca

SEQ ID NO: 258230 - DNA, 25 bp, Mus musculus
atgcagagtgcttcctgagtgcaca

SEQ ID NO: 258231 - DNA, 25 bp, Mus musculus
atgcagatatcaatacctcggtgta

SEQ ID NO: 258232 - DNA, 25 bp, Mus musculus
atgcagatatcattacctcggtgta

SEQ ID NO: 258233 - DNA, 25 bp, Mus musculus
atgcagatccggagttattattaaa

SEQ ID NO: 258234 - DNA, 25 bp, Mus musculus
atgcagatccggtgttattattaaa

SEQ ID NO: 258235 - DNA, 25 bp, Mus musculus
atgcagatcctcaggtagagcagga

SEQ ID NO: 258236 - DNA, 25 bp, Mus musculus
atgcagatcctctggtagagcagga

SEQ ID NO: 258237 - DNA, 25 bp, Mus musculus
atgcagatcgccaggtctcgggaat

SEQ ID NO: 258238 - DNA, 25 bp, Mus musculus
atgcagatcgcctggtctcgggaat

SEQ ID NO: 258239 - DNA, 25 bp, Mus musculus
atgcagatctacagcgccagagtgc

SEQ ID NO: 258240 - DNA, 25 bp, Mus musculus
atgcagatctactgcgccagagtgc

SEQ ID NO: 258241 - DNA, 25 bp, Mus musculus
atgcagatgagtcccctgggcagct

SEQ ID NO: 258242 - DNA, 25 bp, Mus musculus
atgcagatgagtgccctgggcagct

SEQ ID NO: 258243 - DNA, 25 bp, Mus musculus
atgcagatgcacacatataggccac

SEQ ID NO: 258244 - DNA, 25 bp, Mus musculus
atgcagatgcactcatataggccac

SEQ ID NO: 258245 - DNA, 25 bp, Mus musculus
atgcagatggctcttttttgagagc

SEQ ID NO: 258246 - DNA, 25 bp, Mus musculus
atgcagatggctgttttttgagagc

SEQ ID NO: 258247 - DNA, 25 bp, Mus musculus
atgcagattataccacaggctgatt

SEQ ID NO: 258248 - DNA, 25 bp, Mus musculus
atgcagattatagcacaggctgatt

SEQ ID NO: 258249 - DNA, 25 bp, Mus musculus
atgcagatttgcatttggatatccc

SEQ ID NO: 258250 - DNA, 25 bp, Mus musculus
atgcagatttgcttttggatatccc

SEQ ID NO: 258251 - DNA, 25 bp, Mus musculus
atgcagatttttccatcccaggtaa

SEQ ID NO: 258252 - DNA, 25 bp, Mus musculus
atgcagatttttgcatcccaggtaa

SEQ ID NO: 258253 - DNA, 25 bp, Mus musculus
atgcagcaaggtatgcctctgtcca

SEQ ID NO: 258254 - DNA, 25 bp, Mus musculus
atgcagcaaggtttgcctctgtcca

SEQ ID NO: 258255 - DNA, 25 bp, Mus musculus
atgcagcaatatatggatccacggg

SEQ ID NO: 258256 - DNA, 25 bp, Mus musculus
atgcagcaatatttggatccacggg

SEQ ID NO: 258257 - DNA, 25 bp, Mus musculus
atgcagcaatccaggcagccactat

SEQ ID NO: 258258 - DNA, 25 bp, Mus musculus
atgcagcaatcctggcagccactat

SEQ ID NO: 258259 - DNA, 25 bp, Mus musculus
atgcagcaatttactggtccctgct

SEQ ID NO: 258260 - DNA, 25 bp, Mus musculus
atgcagcaattttctggtccctgct

SEQ ID NO: 258261 - DNA, 25 bp, Mus musculus
atgcagcagaaacagggccatttgt

SEQ ID NO: 258262 - DNA, 25 bp, Mus musculus
atgcagcagaaagagggccatttgt

SEQ ID NO: 258263 - DNA, 25 bp, Mus musculus
atgcagcagcatcagtcgcttgcca

SEQ ID NO: 258264 - DNA, 25 bp, Mus musculus
atgcagcagcatgagtcgcttgcca

SEQ ID NO: 258265 - DNA, 25 bp, Mus musculus
atgcagcagcctcgttcgtttatgg

SEQ ID NO: 258266 - DNA, 25 bp, Mus musculus
atgcagcagcctggttcgtttatgg

SEQ ID NO: 258267 - DNA, 25 bp, Mus musculus
atgcagcagcttacgctgagcgctg

SEQ ID NO: 258268 - DNA, 25 bp, Mus musculus
atgcagcagctttcgctgagcgctg

SEQ ID NO: 258269 - DNA, 25 bp, Mus musculus
atgcagcaggagaacatgaagccgc

SEQ ID NO: 258270 - DNA, 25 bp, Mus musculus
atgcagcaggagtacatgaagccgc

SEQ ID NO: 258271 - DNA, 25 bp, Mus musculus
atgcagcaggttatctgcccagctg

SEQ ID NO: 258272 - DNA, 25 bp, Mus musculus
atgcagcaggttttctgcccagctg

SEQ ID NO: 258273 - DNA, 25 bp, Mus musculus
atgcagcagtcgctggagtctgtat

SEQ ID NO: 258274 - DNA, 25 bp, Mus musculus
atgcagcagtcggtggagtctgtat

SEQ ID NO: 258275 - DNA, 25 bp, Mus musculus
atgcagcattgcaacctctgcttgg

SEQ ID NO: 258276 - DNA, 25 bp, Mus musculus
atgcagcattgctacctctgcttgg

SEQ ID NO: 258277 - DNA, 25 bp, Mus musculus
atgcagccacacagtagcaggcgtg

SEQ ID NO: 258278 - DNA, 25 bp, Mus musculus
atgcagccacactgtagcaggcgtg

SEQ ID NO: 258279 - DNA, 25 bp, Mus musculus
atgcagccacccagttttggacttt

SEQ ID NO: 258280 - DNA, 25 bp, Mus musculus
atgcagccaccctgttttggacttt

SEQ ID NO: 258281 - DNA, 25 bp, Mus musculus
atgcagccagccagtcacacgagag

SEQ ID NO: 258282 - DNA, 25 bp, Mus musculus
atgcagccagcctgtcacacgagag

SEQ ID NO: 258283 - DNA, 25 bp, Mus musculus
atgcagccagctagtgtgtgacagg

SEQ ID NO: 258284 - DNA, 25 bp, Mus musculus
atgcagccagcttgtgtgtgacagg

SEQ ID NO: 258285 - DNA, 25 bp, Mus musculus
atgcagccatggatctggacgttac

SEQ ID NO: 258286 - DNA, 25 bp, Mus musculus
atgcagccatggttctggacgttac

SEQ ID NO: 258287 - DNA, 25 bp, Mus musculus
atgcagccctgcagaacctggagca

SEQ ID NO: 258288 - DNA, 25 bp, Mus musculus
atgcagccctgctgaacctggagca

SEQ ID NO: 258289 - DNA, 25 bp, Mus musculus
atgcagccctgtcgtagacatggta

SEQ ID NO: 258290 - DNA, 25 bp, Mus musculus
atgcagccctgtggtagacatggta

SEQ ID NO: 258291 - DNA, 25 bp, Mus musculus
atgcagccggcacgcattcaagcat

SEQ ID NO: 258292 - DNA, 25 bp, Mus musculus
atgcagccggcaggcattcaagcat

SEQ ID NO: 258293 - DNA, 25 bp, Mus musculus
atgcagcctccaagtgagacgtgag

SEQ ID NO: 258294 - DNA, 25 bp, Mus musculus
atgcagcctccatgtgagacgtgag

SEQ ID NO: 258295 - DNA, 25 bp, Mus musculus
atgcagccttaaagggccaaggcag

SEQ ID NO: 258296 - DNA, 25 bp, Mus musculus
atgcagccttaatgggccaaggcag

SEQ ID NO: 258297 - DNA, 25 bp, Mus musculus
atgcagccttctatgaatcctggag

SEQ ID NO: 258298 - DNA, 25 bp, Mus musculus
atgcagccttctttgaatcctggag

SEQ ID NO: 258299 - DNA, 25 bp, Mus musculus
atgcagcggctgaggatggtttctt

SEQ ID NO: 258300 - DNA, 25 bp, Mus musculus
atgcagcggctgtggatggtttctt

SEQ ID NO: 258301 - DNA, 25 bp, Mus musculus
atgcagcgggcccagtggtacccac

SEQ ID NO: 258302 - DNA, 25 bp, Mus musculus
atgcagcgggccgagtggtacccac

SEQ ID NO: 258303 - DNA, 25 bp, Mus musculus
atgcagctagacatgatagactatg

SEQ ID NO: 258304 - DNA, 25 bp, Mus musculus
atgcagctagacttgatagactatg

SEQ ID NO: 258305 - DNA, 25 bp, Mus musculus
atgcagctagtgactgtctctttct

SEQ ID NO: 258306 - DNA, 25 bp, Mus musculus
atgcagctagtgtctgtctctttct

SEQ ID NO: 258307 - DNA, 25 bp, Mus musculus
atgcagctcaagagcacagctgccc

SEQ ID NO: 258308 - DNA, 25 bp, Mus musculus
atgcagctcaagtgcacagctgccc

SEQ ID NO: 258309 - DNA, 25 bp, Mus musculus
atgcagctcagtatggaattttagt

SEQ ID NO: 258310 - DNA, 25 bp, Mus musculus
atgcagctcagtttggaattttagt

SEQ ID NO: 258311 - DNA, 25 bp, Mus musculus
atgcagctcattccgcagcagttgc

SEQ ID NO: 258312 - DNA, 25 bp, Mus musculus
atgcagctcattgcgcagcagttgc

SEQ ID NO: 258313 - DNA, 25 bp, Mus musculus
atgcagctccttcaggatggtgcta

SEQ ID NO: 258314 - DNA, 25 bp, Mus musculus
atgcagctccttgaggatggtgcta

SEQ ID NO: 258315 - DNA, 25 bp, Mus musculus
atgcagctcgttcttcctactttta

SEQ ID NO: 258316 - DNA, 25 bp, Mus musculus
atgcagctcgttgttcctactttta

SEQ ID NO: 258317 - DNA, 25 bp, Mus musculus
atgcagctctagcacctgaggctaa

SEQ ID NO: 258318 - DNA, 25 bp, Mus musculus
atgcagctctaggacctgaggctaa

SEQ ID NO: 258319 - DNA, 25 bp, Mus musculus
atgcagctctcaaactggtcttgta

SEQ ID NO: 258320 - DNA, 25 bp, Mus musculus
atgcagctctcatactggtcttgta

SEQ ID NO: 258321 - DNA, 25 bp, Mus musculus
atgcagctctgcatagggaccgctc

SEQ ID NO: 258322 - DNA, 25 bp, Mus musculus
atgcagctctgcttagggaccgctc

SEQ ID NO: 258323 - DNA, 25 bp, Mus musculus
atgcagctgaacattctgaccagac

SEQ ID NO: 258324 - DNA, 25 bp, Mus musculus
atgcagctgaactttctgaccagac

SEQ ID NO: 258325 - DNA, 25 bp, Mus musculus
atgcagctgaggacccagggtccaa

SEQ ID NO: 258326 - DNA, 25 bp, Mus musculus
atgcagctgaggtcccagggtccaa

SEQ ID NO: 258327 - DNA, 25 bp, Mus musculus
atgcagctgatcctcatgagactat

SEQ ID NO: 258328 - DNA, 25 bp, Mus musculus
atgcagctgatcgtcatgagactat

SEQ ID NO: 258329 - DNA, 25 bp, Mus musculus
atgcagctgtacagcgcccgccaga

SEQ ID NO: 258330 - DNA, 25 bp, Mus musculus
atgcagctgtactgcgcccgccaga

SEQ ID NO: 258331 - DNA, 25 bp, Mus musculus
atgcagctgtggaacaccgcttcga

SEQ ID NO: 258332 - DNA, 25 bp, Mus musculus
atgcagctgtggtacaccgcttcga

SEQ ID NO: 258333 - DNA, 25 bp, Mus musculus
atgcagctgtgtctaagtctgactc

SEQ ID NO: 258334 - DNA, 25 bp, Mus musculus
atgcagctgtgtgtaagtctgactc

SEQ ID NO: 258335 - DNA, 25 bp, Mus musculus
atgcagctgttcctaagcatcgtgt

SEQ ID NO: 258336 - DNA, 25 bp, Mus musculus
atgcagctgttcgtaagcatcgtgt

SEQ ID NO: 258337 - DNA, 25 bp, Mus musculus
atgcagcttcagctcttttatgccg

SEQ ID NO: 258338 - DNA, 25 bp, Mus musculus
atgcagcttcaggtcttttatgccg

SEQ ID NO: 258339 - DNA, 25 bp, Mus musculus
atgcagcttctcacatcagggtatt

SEQ ID NO: 258340 - DNA, 25 bp, Mus musculus
atgcagcttctctcatcagggtatt

SEQ ID NO: 258341 - DNA, 25 bp, Mus musculus
atgcagcttgtcatctggaagatcc

SEQ ID NO: 258342 - DNA, 25 bp, Mus musculus
atgcagcttgtcttctggaagatcc

SEQ ID NO: 258343 - DNA, 25 bp, Mus musculus
atgcagcttttaagttccactataa

SEQ ID NO: 258344 - DNA, 25 bp, Mus musculus
atgcagcttttatgttccactataa

SEQ ID NO: 258345 - DNA, 25 bp, Mus musculus
atgcagcttttcaagttctttccca

SEQ ID NO: 258346 - DNA, 25 bp, Mus musculus
atgcagcttttctagttctttccca

SEQ ID NO: 258347 - DNA, 25 bp, Mus musculus
atgcaggaacatctacagtcaacaa

SEQ ID NO: 258348 - DNA, 25 bp, Mus musculus
atgcaggaacatgtacagtcaacaa

SEQ ID NO: 258349 - DNA, 25 bp, Mus musculus
atgcaggaacggacaaacccaggcc

SEQ ID NO: 258350 - DNA, 25 bp, Mus musculus
atgcaggaacggtcaaacccaggcc

SEQ ID NO: 258351 - DNA, 25 bp, Mus musculus
atgcaggaagagctctgtattcagg

SEQ ID NO: 258352 - DNA, 25 bp, Mus musculus
atgcaggaagaggtctgtattcagg

SEQ ID NO: 258353 - DNA, 25 bp, Mus musculus
atgcaggaatctcgcactttcttag

SEQ ID NO: 258354 - DNA, 25 bp, Mus musculus
atgcaggaatctggcactttcttag

SEQ ID NO: 258355 - DNA, 25 bp, Mus musculus
atgcaggacggcagagttttctgcc

SEQ ID NO: 258356 - DNA, 25 bp, Mus musculus
atgcaggacggctgagttttctgcc

SEQ ID NO: 258357 - DNA, 25 bp, Mus musculus
atgcaggactagagcgtgtctccct

SEQ ID NO: 258358 - DNA, 25 bp, Mus musculus
atgcaggactagtgcgtgtctccct

SEQ ID NO: 258359 - DNA, 25 bp, Mus musculus
atgcaggactggaaaccctgacttt

SEQ ID NO: 258360 - DNA, 25 bp, Mus musculus
atgcaggactggtaaccctgacttt

SEQ ID NO: 258361 - DNA, 25 bp, Mus musculus
atgcaggagctcacctcctgtctat

SEQ ID NO: 258362 - DNA, 25 bp, Mus musculus
atgcaggagctctcctcctgtctat

SEQ ID NO: 258363 - DNA, 25 bp, Mus musculus
atgcaggaggcaacgcccttgtctg

SEQ ID NO: 258364 - DNA, 25 bp, Mus musculus
atgcaggaggcatcgcccttgtctg

SEQ ID NO: 258365 - DNA, 25 bp, Mus musculus
atgcaggaggttagcagccttgcca

SEQ ID NO: 258366 - DNA, 25 bp, Mus musculus
atgcaggaggtttgcagccttgcca

SEQ ID NO: 258367 - DNA, 25 bp, Mus musculus
atgcaggcacaaacttacatgtaaa

SEQ ID NO: 258368 - DNA, 25 bp, Mus musculus
atgcaggcacaatcttacatgtaaa

SEQ ID NO: 258369 - DNA, 25 bp, Mus musculus
atgcaggcacctctgagttgcctcg

SEQ ID NO: 258370 - DNA, 25 bp, Mus musculus
atgcaggcacctgtgagttgcctcg

SEQ ID NO: 258371 - DNA, 25 bp, Mus musculus
atgcaggcaggcattggaggacaga

SEQ ID NO: 258372 - DNA, 25 bp, Mus musculus
atgcaggcaggctttggaggacaga

SEQ ID NO: 258373 - DNA, 25 bp, Mus musculus
atgcaggcagggatgcaggcacaaa

SEQ ID NO: 258374 - DNA, 25 bp, Mus musculus
atgcaggcagggttgcaggcacaaa

SEQ ID NO: 258375 - DNA, 25 bp, Mus musculus
atgcaggccaaaattttatacaata

SEQ ID NO: 258376 - DNA, 25 bp, Mus musculus
atgcaggccaaacccctgccagaat

SEQ ID NO: 258377 - DNA, 25 bp, Mus musculus
atgcaggccaaagccctgccagaat

SEQ ID NO: 258378 - DNA, 25 bp, Mus musculus
atgcaggccaaatttttatacaata

SEQ ID NO: 258379 - DNA, 25 bp, Mus musculus
atgcaggccacaaggaagacccaga

SEQ ID NO: 258380 - DNA, 25 bp, Mus musculus
atgcaggccacatggaagacccaga

SEQ ID NO: 258381 - DNA, 25 bp, Mus musculus
atgcaggccctgacgtggttcactg

SEQ ID NO: 258382 - DNA, 25 bp, Mus musculus
atgcaggccctgtcgtggttcactg

SEQ ID NO: 258383 - DNA, 25 bp, Mus musculus
atgcaggccgtgactcagccagcag

SEQ ID NO: 258384 - DNA, 25 bp, Mus musculus
atgcaggccgtgtctcagccagcag

SEQ ID NO: 258385 - DNA, 25 bp, Mus musculus
atgcaggcctatcgctggatgatcg

SEQ ID NO: 258386 - DNA, 25 bp, Mus musculus
atgcaggcctatggctggatgatcg

SEQ ID NO: 258387 - DNA, 25 bp, Mus musculus
atgcaggcgcacatgcgtggccact

SEQ ID NO: 258388 - DNA, 25 bp, Mus musculus
atgcaggcgcacttgcgtggccact

SEQ ID NO: 258389 - DNA, 25 bp, Mus musculus
atgcaggcgcagaactaaagacagt

SEQ ID NO: 258390 - DNA, 25 bp, Mus musculus
atgcaggcgcagtactaaagacagt

SEQ ID NO: 258391 - DNA, 25 bp, Mus musculus
atgcaggcgctaactggctgtgcca

SEQ ID NO: 258392 - DNA, 25 bp, Mus musculus
atgcaggcgctatctggctgtgcca

SEQ ID NO: 258393 - DNA, 25 bp, Mus musculus
atgcaggcggtacctcttcttcatg

SEQ ID NO: 258394 - DNA, 25 bp, Mus musculus
atgcaggcggtagctcttcttcatg

SEQ ID NO: 258395 - DNA, 25 bp, Mus musculus
atgcaggctcttccatatgggcaaa

SEQ ID NO: 258396 - DNA, 25 bp, Mus musculus
atgcaggctcttgcatatgggcaaa

SEQ ID NO: 258397 - DNA, 25 bp, Mus musculus
atgcaggctgatcagatggctcaat

SEQ ID NO: 258398 - DNA, 25 bp, Mus musculus
atgcaggctgatgagatggctcaat

SEQ ID NO: 258399 - DNA, 25 bp, Mus musculus
atgcaggctgggagcactggacaac

SEQ ID NO: 258400 - DNA, 25 bp, Mus musculus
atgcaggctgggtgcactggacaac

SEQ ID NO: 258401 - DNA, 25 bp, Mus musculus
atgcaggctgttacgtgtgaggctt

SEQ ID NO: 258402 - DNA, 25 bp, Mus musculus
atgcaggctgtttcgtgtgaggctt

SEQ ID NO: 258403 - DNA, 25 bp, Mus musculus
atgcaggctttcctatttctacaac

SEQ ID NO: 258404 - DNA, 25 bp, Mus musculus
atgcaggctttcgtatttctacaac

SEQ ID NO: 258405 - DNA, 25 bp, Mus musculus
atgcagggaatcaggagccctccga

SEQ ID NO: 258406 - DNA, 25 bp, Mus musculus
atgcagggaatctggagccctccga

SEQ ID NO: 258407 - DNA, 25 bp, Mus musculus
atgcagggacatacaggataactaa

SEQ ID NO: 258408 - DNA, 25 bp, Mus musculus
atgcagggacattcaggataactaa

SEQ ID NO: 258409 - DNA, 25 bp, Mus musculus
atgcagggatgtcttggttagccaa

SEQ ID NO: 258410 - DNA, 25 bp, Mus musculus
atgcagggatgtgttggttagccaa

SEQ ID NO: 258411 - DNA, 25 bp, Mus musculus
atgcagggcaatatcactcaaacaa

SEQ ID NO: 258412 - DNA, 25 bp, Mus musculus
atgcagggcaatttcactcaaacaa

SEQ ID NO: 258413 - DNA, 25 bp, Mus musculus
atgcagggccacaggcttccgcgct

SEQ ID NO: 258414 - DNA, 25 bp, Mus musculus
atgcagggccactggcttccgcgct

SEQ ID NO: 258415 - DNA, 25 bp, Mus musculus
atgcagggctagctctctgagtctt

SEQ ID NO: 258416 - DNA, 25 bp, Mus musculus
atgcagggctaggtctctgagtctt

SEQ ID NO: 258417 - DNA, 25 bp, Mus musculus
atgcagggctgcacagtaagtttct

SEQ ID NO: 258418 - DNA, 25 bp, Mus musculus
atgcagggctgctcagtaagtttct

SEQ ID NO: 258419 - DNA, 25 bp, Mus musculus
atgcagggtaggaaatacagtgtcc

SEQ ID NO: 258420 - DNA, 25 bp, Mus musculus
atgcagggtaggtaatacagtgtcc

SEQ ID NO: 258421 - DNA, 25 bp, Mus musculus
atgcagggtatcatggatcctcggc

SEQ ID NO: 258422 - DNA, 25 bp, Mus musculus
atgcagggtatcttggatcctcggc

SEQ ID NO: 258423 - DNA, 25 bp, Mus musculus
atgcaggtaactaatctacatgaag

SEQ ID NO: 258424 - DNA, 25 bp, Mus musculus
atgcaggtaacttatctacatgaag

SEQ ID NO: 258425 - DNA, 25 bp, Mus musculus
atgcaggtacctcgtgttgctttta

SEQ ID NO: 258426 - DNA, 25 bp, Mus musculus
atgcaggtacctggtgttgctttta

SEQ ID NO: 258427 - DNA, 25 bp, Mus musculus
atgcaggtagcacagtctccaggat

SEQ ID NO: 258428 - DNA, 25 bp, Mus musculus
atgcaggtagcagagtctccaggat

SEQ ID NO: 258429 - DNA, 25 bp, Mus musculus
atgcaggtatttaaactctttgtga

SEQ ID NO: 258430 - DNA, 25 bp, Mus musculus
atgcaggtattttaactctttgtga

SEQ ID NO: 258431 - DNA, 25 bp, Mus musculus
atgcaggtcatgataacttgtagaa

SEQ ID NO: 258432 - DNA, 25 bp, Mus musculus
atgcaggtcatgttaacttgtagaa

SEQ ID NO: 258433 - DNA, 25 bp, Mus musculus
atgcaggtccgcctcaggctgtcgt

SEQ ID NO: 258434 - DNA, 25 bp, Mus musculus
atgcaggtccgcgtcaggctgtcgt

SEQ ID NO: 258435 - DNA, 25 bp, Mus musculus
atgcaggtcttgattgggcaaccta

SEQ ID NO: 258436 - DNA, 25 bp, Mus musculus
atgcaggtcttgtttgggcaaccta

SEQ ID NO: 258437 - DNA, 25 bp, Mus musculus
atgcaggtgcctaccgtctcaactg

SEQ ID NO: 258438 - DNA, 25 bp, Mus musculus
atgcaggtgccttccgtctcaactg

SEQ ID NO: 258439 - DNA, 25 bp, Mus musculus
atgcaggtgcggactcaggtgtaat

SEQ ID NO: 258440 - DNA, 25 bp, Mus musculus
atgcaggtgcggtctcaggtgtaat

SEQ ID NO: 258441 - DNA, 25 bp, Mus musculus
atgcaggtgctcaacagctacaaag

SEQ ID NO: 258442 - DNA, 25 bp, Mus musculus
atgcaggtgctctacagctacaaag

SEQ ID NO: 258443 - DNA, 25 bp, Mus musculus
atgcaggtgggcattatcccttctg

SEQ ID NO: 258444 - DNA, 25 bp, Mus musculus
atgcaggtgggctttatcccttctg

SEQ ID NO: 258445 - DNA, 25 bp, Mus musculus
atgcaggtgtagctgctggttctac

SEQ ID NO: 258446 - DNA, 25 bp, Mus musculus
atgcaggtgtaggtgctggttctac

SEQ ID NO: 258447 - DNA, 25 bp, Mus musculus
atgcaggttctacgaggtcgctatt

SEQ ID NO: 258448 - DNA, 25 bp, Mus musculus
atgcaggttctaggaggtcgctatt

SEQ ID NO: 258449 - DNA, 25 bp, Mus musculus
atgcaggttggccttttttgtgaag

SEQ ID NO: 258450 - DNA, 25 bp, Mus musculus
atgcaggttggcgttttttgtgaag

SEQ ID NO: 258451 - DNA, 25 bp, Mus musculus
atgcaggtttagctggtccattctc

SEQ ID NO: 258452 - DNA, 25 bp, Mus musculus
atgcaggtttaggtggtccattctc

SEQ ID NO: 258453 - DNA, 25 bp, Mus musculus
atgcagtaaaacacctaccaggtag

SEQ ID NO: 258454 - DNA, 25 bp, Mus musculus
atgcagtaaaactcctaccaggtag

SEQ ID NO: 258455 - DNA, 25 bp, Mus musculus
atgcagtaaaccaggagggcgcccg

SEQ ID NO: 258456 - DNA, 25 bp, Mus musculus
atgcagtaaacctggagggcgcccg

SEQ ID NO: 258457 - DNA, 25 bp, Mus musculus
atgcagtaatttaggcctttgatgt

SEQ ID NO: 258458 - DNA, 25 bp, Mus musculus
atgcagtaattttggcctttgatgt

SEQ ID NO: 258459 - DNA, 25 bp, Mus musculus
atgcagtacaaaagctgggcctcct

SEQ ID NO: 258460 - DNA, 25 bp, Mus musculus
atgcagtacaaatgctgggcctcct

SEQ ID NO: 258461 - DNA, 25 bp, Mus musculus
atgcagtaggttcccagcctggcga

SEQ ID NO: 258462 - DNA, 25 bp, Mus musculus
atgcagtaggttgccagcctggcga

SEQ ID NO: 258463 - DNA, 25 bp, Mus musculus
atgcagtataagattttcctacata

SEQ ID NO: 258464 - DNA, 25 bp, Mus musculus
atgcagtataagtttttcctacata

SEQ ID NO: 258465 - DNA, 25 bp, Mus musculus
atgcagtatccaagcatgccagcgg

SEQ ID NO: 258466 - DNA, 25 bp, Mus musculus
atgcagtatccatgcatgccagcgg

SEQ ID NO: 258467 - DNA, 25 bp, Mus musculus
atgcagtattctactggatgtatag

SEQ ID NO: 258468 - DNA, 25 bp, Mus musculus
atgcagtattcttctggatgtatag

SEQ ID NO: 258469 - DNA, 25 bp, Mus musculus
atgcagtcaagccagatcacggagt

SEQ ID NO: 258470 - DNA, 25 bp, Mus musculus
atgcagtcaagcgagatcacggagt

SEQ ID NO: 258471 - DNA, 25 bp, Mus musculus
atgcagtcaagtcaacgccggcgca

SEQ ID NO: 258472 - DNA, 25 bp, Mus musculus
atgcagtcaagtgaacgccggcgca

SEQ ID NO: 258473 - DNA, 25 bp, Mus musculus
atgcagtcagaacagacgcgcgtgt

SEQ ID NO: 258474 - DNA, 25 bp, Mus musculus
atgcagtcagaagagacgcgcgtgt

SEQ ID NO: 258475 - DNA, 25 bp, Mus musculus
atgcagtcagcactagggtctgtgc

SEQ ID NO: 258476 - DNA, 25 bp, Mus musculus
atgcagtcagcagtagggtctgtgc

SEQ ID NO: 258477 - DNA, 25 bp, Mus musculus
atgcagtcaggaagctggcgtgcca

SEQ ID NO: 258478 - DNA, 25 bp, Mus musculus
atgcagtcaggatgctggcgtgcca

SEQ ID NO: 258479 - DNA, 25 bp, Mus musculus
atgcagtcattaacgctaacaggga

SEQ ID NO: 258480 - DNA, 25 bp, Mus musculus
atgcagtcattatcgctaacaggga

SEQ ID NO: 258481 - DNA, 25 bp, Mus musculus
atgcagtccagaataagtgctgttt

SEQ ID NO: 258482 - DNA, 25 bp, Mus musculus
atgcagtccagattaagtgctgttt

SEQ ID NO: 258483 - DNA, 25 bp, Mus musculus
atgcagtccatccattcagccatct

SEQ ID NO: 258484 - DNA, 25 bp, Mus musculus
atgcagtccatcgattcagccatct

SEQ ID NO: 258485 - DNA, 25 bp, Mus musculus
atgcagtccattattgtcgccccct

SEQ ID NO: 258486 - DNA, 25 bp, Mus musculus
atgcagtccatttttgtcgccccct

SEQ ID NO: 258487 - DNA, 25 bp, Mus musculus
atgcagtcctctctgatcagattgg

SEQ ID NO: 258488 - DNA, 25 bp, Mus musculus
atgcagtcctctgtgatcagattgg

SEQ ID NO: 258489 - DNA, 25 bp, Mus musculus
atgcagtccttgctgaccaggctat

SEQ ID NO: 258490 - DNA, 25 bp, Mus musculus
atgcagtccttggtgaccaggctat

SEQ ID NO: 258491 - DNA, 25 bp, Mus musculus
atgcagtcttagagccctgagataa

SEQ ID NO: 258492 - DNA, 25 bp, Mus musculus
atgcagtcttagtgccctgagataa

SEQ ID NO: 258493 - DNA, 25 bp, Mus musculus
atgcagtcttttcacaggaatggga

SEQ ID NO: 258494 - DNA, 25 bp, Mus musculus
atgcagtcttttgacaggaatggga

SEQ ID NO: 258495 - DNA, 25 bp, Mus musculus
atgcagtgagaacctctcagggcct

SEQ ID NO: 258496 - DNA, 25 bp, Mus musculus
atgcagtgagaagctctcagggcct

SEQ ID NO: 258497 - DNA, 25 bp, Mus musculus
atgcagtgaggaccactgagtcctt

SEQ ID NO: 258498 - DNA, 25 bp, Mus musculus
atgcagtgaggagcactgagtcctt

SEQ ID NO: 258499 - DNA, 25 bp, Mus musculus
atgcagtgcggcattaccgagtcct

SEQ ID NO: 258500 - DNA, 25 bp, Mus musculus
atgcagtgcggcctatgtctcatta

SEQ ID NO: 258501 - DNA, 25 bp, Mus musculus
atgcagtgcggcgtatgtctcatta

SEQ ID NO: 258502 - DNA, 25 bp, Mus musculus
atgcagtgcggctttaccgagtcct

SEQ ID NO: 258503 - DNA, 25 bp, Mus musculus
atgcagtgctgaatcacagggctca

SEQ ID NO: 258504 - DNA, 25 bp, Mus musculus
atgcagtgctgattcacagggctca

SEQ ID NO: 258505 - DNA, 25 bp, Mus musculus
atgcagtgctgcacaccaggtttca

SEQ ID NO: 258506 - DNA, 25 bp, Mus musculus
atgcagtgctgctcaccaggtttca

SEQ ID NO: 258507 - DNA, 25 bp, Mus musculus
atgcagtgctggactctaacattaa

SEQ ID NO: 258508 - DNA, 25 bp, Mus musculus
atgcagtgctggtctctaacattaa

SEQ ID NO: 258509 - DNA, 25 bp, Mus musculus
atgcagtgctgtatggtgtcactta

SEQ ID NO: 258510 - DNA, 25 bp, Mus musculus
atgcagtgctgtttggtgtcactta

SEQ ID NO: 258511 - DNA, 25 bp, Mus musculus
atgcagtggactcctccgtggagct

SEQ ID NO: 258512 - DNA, 25 bp, Mus musculus
atgcagtggactcggcctcagctga

SEQ ID NO: 258513 - DNA, 25 bp, Mus musculus
atgcagtggactgctccgtggagct

SEQ ID NO: 258514 - DNA, 25 bp, Mus musculus
atgcagtggactgggcctcagctga

SEQ ID NO: 258515 - DNA, 25 bp, Mus musculus
atgcagtggcctctagtattctcct

SEQ ID NO: 258516 - DNA, 25 bp, Mus musculus
atgcagtggcctgtagtattctcct

SEQ ID NO: 258517 - DNA, 25 bp, Mus musculus
atgcagtggcggcacctcgagacca

SEQ ID NO: 258518 - DNA, 25 bp, Mus musculus
atgcagtggcgggacctcgagacca

SEQ ID NO: 258519 - DNA, 25 bp, Mus musculus
atgcagtggctgattactgagtgac

SEQ ID NO: 258520 - DNA, 25 bp, Mus musculus
atgcagtggctgtttactgagtgac

SEQ ID NO: 258521 - DNA, 25 bp, Mus musculus
atgcagtgggcacctggtgaccatc

SEQ ID NO: 258522 - DNA, 25 bp, Mus musculus
atgcagtgggcagctggtgaccatc

SEQ ID NO: 258523 - DNA, 25 bp, Mus musculus
atgcagtggtatcgcagaagacacc

SEQ ID NO: 258524 - DNA, 25 bp, Mus musculus
atgcagtggtatggcagaagacacc

SEQ ID NO: 258525 - DNA, 25 bp, Mus musculus
atgcagtggttcacgtaagtgggaa

SEQ ID NO: 258526 - DNA, 25 bp, Mus musculus
atgcagtggttctcgtaagtgggaa

SEQ ID NO: 258527 - DNA, 25 bp, Mus musculus
atgcagtgtgctcccgcaaggcgaa

SEQ ID NO: 258528 - DNA, 25 bp, Mus musculus
atgcagtgtgctctgctgactatta

SEQ ID NO: 258529 - DNA, 25 bp, Mus musculus
atgcagtgtgctgccgcaaggcgaa

SEQ ID NO: 258530 - DNA, 25 bp, Mus musculus
atgcagtgtgctgtgctgactatta

SEQ ID NO: 258531 - DNA, 25 bp, Mus musculus
atgcagttaaatctggaggtcctct

SEQ ID NO: 258532 - DNA, 25 bp, Mus musculus
atgcagttaaatgtggaggtcctct

SEQ ID NO: 258533 - DNA, 25 bp, Mus musculus
atgcagttactaatcctgtctggaa

SEQ ID NO: 258534 - DNA, 25 bp, Mus musculus
atgcagttactattcctgtctggaa

SEQ ID NO: 258535 - DNA, 25 bp, Mus musculus
atgcagttatttcaggttccttacc

SEQ ID NO: 258536 - DNA, 25 bp, Mus musculus
atgcagttatttgaggttccttacc

SEQ ID NO: 258537 - DNA, 25 bp, Mus musculus
atgcagttcaaccacatcctacaga

SEQ ID NO: 258538 - DNA, 25 bp, Mus musculus
atgcagttcaacgacatcctacaga

SEQ ID NO: 258539 - DNA, 25 bp, Mus musculus
atgcagttcagaattatttcttaag

SEQ ID NO: 258540 - DNA, 25 bp, Mus musculus
atgcagttcagatttatttcttaag

SEQ ID NO: 258541 - DNA, 25 bp, Mus musculus
atgcagttcccgaccagtaagtgct

SEQ ID NO: 258542 - DNA, 25 bp, Mus musculus
atgcagttcccgtccagtaagtgct

SEQ ID NO: 258543 - DNA, 25 bp, Mus musculus
atgcagttccggcactgcaaaagta

SEQ ID NO: 258544 - DNA, 25 bp, Mus musculus
atgcagttccgggactgcaaaagta

SEQ ID NO: 258545 - DNA, 25 bp, Mus musculus
atgcagttctaccttgcgagtgcta

SEQ ID NO: 258546 - DNA, 25 bp, Mus musculus
atgcagttctacgttgcgagtgcta

SEQ ID NO: 258547 - DNA, 25 bp, Mus musculus
atgcagttctatattttgtttttca

SEQ ID NO: 258548 - DNA, 25 bp, Mus musculus
atgcagttctattttttgtttttca

SEQ ID NO: 258549 - DNA, 25 bp, Mus musculus
atgcagttctcactgtgctcgccag

SEQ ID NO: 258550 - DNA, 25 bp, Mus musculus
atgcagttctcagtgtgctcgccag

SEQ ID NO: 258551 - DNA, 25 bp, Mus musculus
atgcagttctgcaaatcccaggtac

SEQ ID NO: 258552 - DNA, 25 bp, Mus musculus
atgcagttctgctaatcccaggtac

SEQ ID NO: 258553 - DNA, 25 bp, Mus musculus
atgcagttcttcatacctagttgag

SEQ ID NO: 258554 - DNA, 25 bp, Mus musculus
atgcagttcttcttacctagttgag

SEQ ID NO: 258555 - DNA, 25 bp, Mus musculus
atgcagttgcatcaccacagacagg

SEQ ID NO: 258556 - DNA, 25 bp, Mus musculus
atgcagttgcatgaccacagacagg

SEQ ID NO: 258557 - DNA, 25 bp, Mus musculus
atgcagttgccgcaacttcccaaag

SEQ ID NO: 258558 - DNA, 25 bp, Mus musculus
atgcagttgccggaacttcccaaag

SEQ ID NO: 258559 - DNA, 25 bp, Mus musculus
atgcagttgtatatgttgtttgtca

SEQ ID NO: 258560 - DNA, 25 bp, Mus musculus
atgcagttgtatttgttgtttgtca

SEQ ID NO: 258561 - DNA, 25 bp, Mus musculus
atgcagtttcggagcagtgttgctt

SEQ ID NO: 258562 - DNA, 25 bp, Mus musculus
atgcagtttcggtgcagtgttgctt

SEQ ID NO: 258563 - DNA, 25 bp, Mus musculus
atgcagtttgctcacttgagctcac

SEQ ID NO: 258564 - DNA, 25 bp, Mus musculus
atgcagtttgctgacttgagctcac

SEQ ID NO: 258565 - DNA, 25 bp, Mus musculus
atgcagttttccataagtgtgtgta

SEQ ID NO: 258566 - DNA, 25 bp, Mus musculus
atgcagttttccttaagtgtgtgta

SEQ ID NO: 258567 - DNA, 25 bp, Mus musculus
atgcataaacatctccttccttccg

SEQ ID NO: 258568 - DNA, 25 bp, Mus musculus
atgcataaacatgtccttccttccg

SEQ ID NO: 258569 - DNA, 25 bp, Mus musculus
atgcataaactcacattcacttgaa

SEQ ID NO: 258570 - DNA, 25 bp, Mus musculus
atgcataaactctcattcacttgaa

SEQ ID NO: 258571 - DNA, 25 bp, Mus musculus
atgcataaattccttaccattccca

SEQ ID NO: 258572 - DNA, 25 bp, Mus musculus
atgcataaattcgttaccattccca

SEQ ID NO: 258573 - DNA, 25 bp, Mus musculus
atgcataatcctcatagctaacaga

SEQ ID NO: 258574 - DNA, 25 bp, Mus musculus
atgcataatcctgatagctaacaga

SEQ ID NO: 258575 - DNA, 25 bp, Mus musculus
atgcatacaacacgcggaggatctt

SEQ ID NO: 258576 - DNA, 25 bp, Mus musculus
atgcatacaacaggcggaggatctt

SEQ ID NO: 258577 - DNA, 25 bp, Mus musculus
atgcatacagctattctaaccttaa

SEQ ID NO: 258578 - DNA, 25 bp, Mus musculus
atgcatacagcttttctaaccttaa

SEQ ID NO: 258579 - DNA, 25 bp, Mus musculus
atgcatacatccattgatccccctc

SEQ ID NO: 258580 - DNA, 25 bp, Mus musculus
atgcatacatcctttgatccccctc

SEQ ID NO: 258581 - DNA, 25 bp, Mus musculus
atgcatacatctcttttcctgacca

SEQ ID NO: 258582 - DNA, 25 bp, Mus musculus
atgcatacatctgttttcctgacca

SEQ ID NO: 258583 - DNA, 25 bp, Mus musculus
atgcataccagcaattagcactgtg

SEQ ID NO: 258584 - DNA, 25 bp, Mus musculus
atgcataccagctattagcactgtg

SEQ ID NO: 258585 - DNA, 25 bp, Mus musculus
atgcatacctagatattgcagcttc

SEQ ID NO: 258586 - DNA, 25 bp, Mus musculus
atgcatacctagttattgcagcttc

SEQ ID NO: 258587 - DNA, 25 bp, Mus musculus
atgcatacctgaccagctctgccag

SEQ ID NO: 258588 - DNA, 25 bp, Mus musculus
atgcatacctgagcagctctgccag

SEQ ID NO: 258589 - DNA, 25 bp, Mus musculus
atgcataccttgaactgtggcagat

SEQ ID NO: 258590 - DNA, 25 bp, Mus musculus
atgcataccttgtactgtggcagat

SEQ ID NO: 258591 - DNA, 25 bp, Mus musculus
atgcatactagacatgggctctatc

SEQ ID NO: 258592 - DNA, 25 bp, Mus musculus
atgcatactagagatgggctctatc

SEQ ID NO: 258593 - DNA, 25 bp, Mus musculus
atgcatactcatatcagcctgtaag

SEQ ID NO: 258594 - DNA, 25 bp, Mus musculus
atgcatactcatttcagcctgtaag

SEQ ID NO: 258595 - DNA, 25 bp, Mus musculus
atgcataggtatcaggcttgacccc

SEQ ID NO: 258596 - DNA, 25 bp, Mus musculus
atgcataggtatgaggcttgacccc

SEQ ID NO: 258597 - DNA, 25 bp, Mus musculus
atgcatagtcatacactgtagatct

SEQ ID NO: 258598 - DNA, 25 bp, Mus musculus
atgcatagtcattcactgtagatct

SEQ ID NO: 258599 - DNA, 25 bp, Mus musculus
atgcatagtctcacagccaagtagt

SEQ ID NO: 258600 - DNA, 25 bp, Mus musculus
atgcatagtctctcagccaagtagt

SEQ ID NO: 258601 - DNA, 25 bp, Mus musculus
atgcatatacacagaagtttccaca

SEQ ID NO: 258602 - DNA, 25 bp, Mus musculus
atgcatatacactgaagtttccaca

SEQ ID NO: 258603 - DNA, 25 bp, Mus musculus
atgcatatactaccatgcctagcaa

SEQ ID NO: 258604 - DNA, 25 bp, Mus musculus
atgcatatactagcatgcctagcaa

SEQ ID NO: 258605 - DNA, 25 bp, Mus musculus
atgcatatatcaacatacttggttc

SEQ ID NO: 258606 - DNA, 25 bp, Mus musculus
atgcatatatcatcatacttggttc

SEQ ID NO: 258607 - DNA, 25 bp, Mus musculus
atgcatatcattcgtggcactccca

SEQ ID NO: 258608 - DNA, 25 bp, Mus musculus
atgcatatcattggtggcactccca

SEQ ID NO: 258609 - DNA, 25 bp, Mus musculus
atgcatatccaactcccaaagctag

SEQ ID NO: 258610 - DNA, 25 bp, Mus musculus
atgcatatccaagtcccaaagctag

SEQ ID NO: 258611 - DNA, 25 bp, Mus musculus
atgcatatccccagtcatgtacatg

SEQ ID NO: 258612 - DNA, 25 bp, Mus musculus
atgcatatcccctgtcatgtacatg

SEQ ID NO: 258613 - DNA, 25 bp, Mus musculus
atgcatatcttaattaggcaaccat

SEQ ID NO: 258614 - DNA, 25 bp, Mus musculus
atgcatatcttatttaggcaaccat

SEQ ID NO: 258615 - DNA, 25 bp, Mus musculus
atgcatatgcataacctgattttct

SEQ ID NO: 258616 - DNA, 25 bp, Mus musculus
atgcatatgcatctcataccatgaa

SEQ ID NO: 258617 - DNA, 25 bp, Mus musculus
atgcatatgcatgtcataccatgaa

SEQ ID NO: 258618 - DNA, 25 bp, Mus musculus
atgcatatgcattacctgattttct

SEQ ID NO: 258619 - DNA, 25 bp, Mus musculus
atgcatatgccccaagtcacacttt

SEQ ID NO: 258620 - DNA, 25 bp, Mus musculus
atgcatatgcccgaagtcacacttt

SEQ ID NO: 258621 - DNA, 25 bp, Mus musculus
atgcatatgccgctgtcaccaaaag

SEQ ID NO: 258622 - DNA, 25 bp, Mus musculus
atgcatatgccggtgtcaccaaaag

SEQ ID NO: 258623 - DNA, 25 bp, Mus musculus
atgcatattacgctggccccataag

SEQ ID NO: 258624 - DNA, 25 bp, Mus musculus
atgcatattacggtggccccataag

SEQ ID NO: 258625 - DNA, 25 bp, Mus musculus
atgcatcaatctaatcttgcgttca

SEQ ID NO: 258626 - DNA, 25 bp, Mus musculus
atgcatcaatcttatcttgcgttca

SEQ ID NO: 258627 - DNA, 25 bp, Mus musculus
atgcatcactttacttgggctttag

SEQ ID NO: 258628 - DNA, 25 bp, Mus musculus
atgcatcacttttcttgggctttag

SEQ ID NO: 258629 - DNA, 25 bp, Mus musculus
atgcatcagcataccattttctcag

SEQ ID NO: 258630 - DNA, 25 bp, Mus musculus
atgcatcagcattccattttctcag

SEQ ID NO: 258631 - DNA, 25 bp, Mus musculus
atgcatcaggaaatattcccaatcc

SEQ ID NO: 258632 - DNA, 25 bp, Mus musculus
atgcatcaggaattattcccaatcc

SEQ ID NO: 258633 - DNA, 25 bp, Mus musculus
atgcatcataagagcctacaccaag

SEQ ID NO: 258634 - DNA, 25 bp, Mus musculus
atgcatcataagtgcctacaccaag

SEQ ID NO: 258635 - DNA, 25 bp, Mus musculus
atgcatcatcaacttctctgccatt

SEQ ID NO: 258636 - DNA, 25 bp, Mus musculus
atgcatcatcaagttctctgccatt

SEQ ID NO: 258637 - DNA, 25 bp, Mus musculus
atgcatcatcgcagagatcttctga

SEQ ID NO: 258638 - DNA, 25 bp, Mus musculus
atgcatcatcgctgagatcttctga

SEQ ID NO: 258639 - DNA, 25 bp, Mus musculus
atgcatcatctgcaccagggaccaa

SEQ ID NO: 258640 - DNA, 25 bp, Mus musculus
atgcatcatctggaccagggaccaa

SEQ ID NO: 258641 - DNA, 25 bp, Mus musculus
atgcatcatgtcagctttcttcttg

SEQ ID NO: 258642 - DNA, 25 bp, Mus musculus
atgcatcatgtctgctttcttcttg

SEQ ID NO: 258643 - DNA, 25 bp, Mus musculus
atgcatcattataccaggccctaga

SEQ ID NO: 258644 - DNA, 25 bp, Mus musculus
atgcatcattattccaggccctaga

SEQ ID NO: 258645 - DNA, 25 bp, Mus musculus
atgcatccaacaatcctttgaacag

SEQ ID NO: 258646 - DNA, 25 bp, Mus musculus
atgcatccaacattcctttgaacag

SEQ ID NO: 258647 - DNA, 25 bp, Mus musculus
atgcatccacggcatctgatatggg

SEQ ID NO: 258648 - DNA, 25 bp, Mus musculus
atgcatccacgggatctgatatggg

SEQ ID NO: 258649 - DNA, 25 bp, Mus musculus
atgcatccagtacacattcagtagg

SEQ ID NO: 258650 - DNA, 25 bp, Mus musculus
atgcatccagtagacattcagtagg

SEQ ID NO: 258651 - DNA, 25 bp, Mus musculus
atgcatccataaccctggaaatcct

SEQ ID NO: 258652 - DNA, 25 bp, Mus musculus
atgcatccataagcctggaaatcct

SEQ ID NO: 258653 - DNA, 25 bp, Mus musculus
atgcatccatgtcctgcttattcag

SEQ ID NO: 258654 - DNA, 25 bp, Mus musculus
atgcatccatgtgctgcttattcag

SEQ ID NO: 258655 - DNA, 25 bp, Mus musculus
atgcatcccatacaaaagccttgag

SEQ ID NO: 258656 - DNA, 25 bp, Mus musculus
atgcatcccatagaaaagccttgag

SEQ ID NO: 258657 - DNA, 25 bp, Mus musculus
atgcatccccagatcagaagcagag

SEQ ID NO: 258658 - DNA, 25 bp, Mus musculus
atgcatccccagttcagaagcagag

SEQ ID NO: 258659 - DNA, 25 bp, Mus musculus
atgcatcccgaccttcaatttttat

SEQ ID NO: 258660 - DNA, 25 bp, Mus musculus
atgcatcccgacgttcaatttttat

SEQ ID NO: 258661 - DNA, 25 bp, Mus musculus
atgcatcccttcagaatcaaccgca

SEQ ID NO: 258662 - DNA, 25 bp, Mus musculus
atgcatcccttctgaatcaaccgca

SEQ ID NO: 258663 - DNA, 25 bp, Mus musculus
atgcatccggacatgtctccacact

SEQ ID NO: 258664 - DNA, 25 bp, Mus musculus
atgcatccggacttgtctccacact

SEQ ID NO: 258665 - DNA, 25 bp, Mus musculus
atgcatccgtaccagcggtgagtgt

SEQ ID NO: 258666 - DNA, 25 bp, Mus musculus
atgcatccgtacgagcggtgagtgt

SEQ ID NO: 258667 - DNA, 25 bp, Mus musculus
atgcatcctcagatagtactcaaga

SEQ ID NO: 258668 - DNA, 25 bp, Mus musculus
atgcatcctcagttagtactcaaga

SEQ ID NO: 258669 - DNA, 25 bp, Mus musculus
atgcatccttatcccacttacgtgt

SEQ ID NO: 258670 - DNA, 25 bp, Mus musculus
atgcatccttatgccacttacgtgt

SEQ ID NO: 258671 - DNA, 25 bp, Mus musculus
atgcatcgacatcctggagcagtct

SEQ ID NO: 258672 - DNA, 25 bp, Mus musculus
atgcatcgacatgctggagcagtct

SEQ ID NO: 258673 - DNA, 25 bp, Mus musculus
atgcatcgcaggaagtatgcccggt

SEQ ID NO: 258674 - DNA, 25 bp, Mus musculus
atgcatcgcaggtagtatgcccggt

SEQ ID NO: 258675 - DNA, 25 bp, Mus musculus
atgcatcgcgagaacgaggctgctt

SEQ ID NO: 258676 - DNA, 25 bp, Mus musculus
atgcatcgcgagtacgaggctgctt

SEQ ID NO: 258677 - DNA, 25 bp, Mus musculus
atgcatcgtacacaagactctcaca

SEQ ID NO: 258678 - DNA, 25 bp, Mus musculus
atgcatcgtacagaagactctcaca

SEQ ID NO: 258679 - DNA, 25 bp, Mus musculus
atgcatcgtcctataccatgtaaca

SEQ ID NO: 258680 - DNA, 25 bp, Mus musculus
atgcatcgtcctttaccatgtaaca

SEQ ID NO: 258681 - DNA, 25 bp, Mus musculus
atgcatctagccctgcacagtataa

SEQ ID NO: 258682 - DNA, 25 bp, Mus musculus
atgcatctagccgtgcacagtataa

SEQ ID NO: 258683 - DNA, 25 bp, Mus musculus
atgcatctagctacacagagacttg

SEQ ID NO: 258684 - DNA, 25 bp, Mus musculus
atgcatctagcttcacagagacttg

SEQ ID NO: 258685 - DNA, 25 bp, Mus musculus
atgcatctatctaagtaccccagtg

SEQ ID NO: 258686 - DNA, 25 bp, Mus musculus
atgcatctatctacttgtccgagaa

SEQ ID NO: 258687 - DNA, 25 bp, Mus musculus
atgcatctatcttagtaccccagtg

SEQ ID NO: 258688 - DNA, 25 bp, Mus musculus
atgcatctatcttcttgtccgagaa

SEQ ID NO: 258689 - DNA, 25 bp, Mus musculus
atgcatctatgacctcattccatgc

SEQ ID NO: 258690 - DNA, 25 bp, Mus musculus
atgcatctatgagctcattccatgc

SEQ ID NO: 258691 - DNA, 25 bp, Mus musculus
atgcatctatggctgacctcttctg

SEQ ID NO: 258692 - DNA, 25 bp, Mus musculus
atgcatctatgggtgacctcttctg

SEQ ID NO: 258693 - DNA, 25 bp, Mus musculus
atgcatctcaggctgctatggacat

SEQ ID NO: 258694 - DNA, 25 bp, Mus musculus
atgcatctcagggtgctatggacat

SEQ ID NO: 258695 - DNA, 25 bp, Mus musculus
atgcatctccttcttttatatattc

SEQ ID NO: 258696 - DNA, 25 bp, Mus musculus
atgcatctccttgttttatatattc

SEQ ID NO: 258697 - DNA, 25 bp, Mus musculus
atgcatctctgcactttttgaaaag

SEQ ID NO: 258698 - DNA, 25 bp, Mus musculus
atgcatctctgctctttttgaaaag

SEQ ID NO: 258699 - DNA, 25 bp, Mus musculus
atgcatctgaaaagccatgctctcc

SEQ ID NO: 258700 - DNA, 25 bp, Mus musculus
atgcatctgaaatgccatgctctcc

SEQ ID NO: 258701 - DNA, 25 bp, Mus musculus
atgcatctgggcagctgtcctgtgc

SEQ ID NO: 258702 - DNA, 25 bp, Mus musculus
atgcatctgggctgctgtcctgtgc

SEQ ID NO: 258703 - DNA, 25 bp, Mus musculus
atgcatctgtccagaaggagtgcga

SEQ ID NO: 258704 - DNA, 25 bp, Mus musculus
atgcatctgtcctgaaggagtgcga

SEQ ID NO: 258705 - DNA, 25 bp, Mus musculus
atgcatctgttcaacgtacgtgcgg

SEQ ID NO: 258706 - DNA, 25 bp, Mus musculus
atgcatctgttctacgtacgtgcgg

SEQ ID NO: 258707 - DNA, 25 bp, Mus musculus
atgcatcttaccattttcaacaacc

SEQ ID NO: 258708 - DNA, 25 bp, Mus musculus
atgcatcttacctttttcaacaacc

SEQ ID NO: 258709 - DNA, 25 bp, Mus musculus
atgcatcttcctaataatttccttg

SEQ ID NO: 258710 - DNA, 25 bp, Mus musculus
atgcatcttccttataatttccttg

SEQ ID NO: 258711 - DNA, 25 bp, Mus musculus
atgcatcttctaaatgccgttcagg

SEQ ID NO: 258712 - DNA, 25 bp, Mus musculus
atgcatcttctatatgccgttcagg

SEQ ID NO: 258713 - DNA, 25 bp, Mus musculus
atgcatcttggaaacaagtacttta

SEQ ID NO: 258714 - DNA, 25 bp, Mus musculus
atgcatcttggatacaagtacttta

SEQ ID NO: 258715 - DNA, 25 bp, Mus musculus
atgcatgaatttccccataagtcag

SEQ ID NO: 258716 - DNA, 25 bp, Mus musculus
atgcatgaatttgcccataagtcag

SEQ ID NO: 258717 - DNA, 25 bp, Mus musculus
atgcatgacacacagtcctttcttc

SEQ ID NO: 258718 - DNA, 25 bp, Mus musculus
atgcatgacacagagtcctttcttc

SEQ ID NO: 258719 - DNA, 25 bp, Mus musculus
atgcatgacaccaatccagtactac

SEQ ID NO: 258720 - DNA, 25 bp, Mus musculus
atgcatgacacctatccagtactac

SEQ ID NO: 258721 - DNA, 25 bp, Mus musculus
atgcatgaccacacgtggcctcatc

SEQ ID NO: 258722 - DNA, 25 bp, Mus musculus
atgcatgaccactcgtggcctcatc

SEQ ID NO: 258723 - DNA, 25 bp, Mus musculus
atgcatgacctcacaagtttggacc

SEQ ID NO: 258724 - DNA, 25 bp, Mus musculus
atgcatgacctctcaagtttggacc

SEQ ID NO: 258725 - DNA, 25 bp, Mus musculus
atgcatgagaaccactgttactgat

SEQ ID NO: 258726 - DNA, 25 bp, Mus musculus
atgcatgagaacgactgttactgat

SEQ ID NO: 258727 - DNA, 25 bp, Mus musculus
atgcatgagcttacctgacatcggt

SEQ ID NO: 258728 - DNA, 25 bp, Mus musculus
atgcatgagctttcctgacatcggt

SEQ ID NO: 258729 - DNA, 25 bp, Mus musculus
atgcatgagtagagtcgctgctgct

SEQ ID NO: 258730 - DNA, 25 bp, Mus musculus
atgcatgagtagtgtcgctgctgct

SEQ ID NO: 258731 - DNA, 25 bp, Mus musculus
atgcatgagttccttcgctgtatga

SEQ ID NO: 258732 - DNA, 25 bp, Mus musculus
atgcatgagttcgttcgctgtatga

SEQ ID NO: 258733 - DNA, 25 bp, Mus musculus
atgcatgatatacaaccgccgcctt

SEQ ID NO: 258734 - DNA, 25 bp, Mus musculus
atgcatgatatagaaccgccgcctt

SEQ ID NO: 258735 - DNA, 25 bp, Mus musculus
atgcatgatcacatacacatgtgaa

SEQ ID NO: 258736 - DNA, 25 bp, Mus musculus
atgcatgatcacttacacatgtgaa

SEQ ID NO: 258737 - DNA, 25 bp, Mus musculus
atgcatgatcgtctatgtacctagg

SEQ ID NO: 258738 - DNA, 25 bp, Mus musculus
atgcatgatcgtgtatgtacctagg

SEQ ID NO: 258739 - DNA, 25 bp, Mus musculus
atgcatgatggcctagctgaagctc

SEQ ID NO: 258740 - DNA, 25 bp, Mus musculus
atgcatgatggcgtagctgaagctc

SEQ ID NO: 258741 - DNA, 25 bp, Mus musculus
atgcatgcaagcctgagcctcgtga

SEQ ID NO: 258742 - DNA, 25 bp, Mus musculus
atgcatgcaagcgtgagcctcgtga

SEQ ID NO: 258743 - DNA, 25 bp, Mus musculus
atgcatgcagctcttgggaaaccca

SEQ ID NO: 258744 - DNA, 25 bp, Mus musculus
atgcatgcagctgttgggaaaccca

SEQ ID NO: 258745 - DNA, 25 bp, Mus musculus
atgcatgcaggccaaacgttcatgt

SEQ ID NO: 258746 - DNA, 25 bp, Mus musculus
atgcatgcaggcgaaacgttcatgt

SEQ ID NO: 258747 - DNA, 25 bp, Mus musculus
atgcatgcatgtccaccagggtgtt

SEQ ID NO: 258748 - DNA, 25 bp, Mus musculus
atgcatgcatgtgcaccagggtgtt

SEQ ID NO: 258749 - DNA, 25 bp, Mus musculus
atgcatgcattcacaagaggtcttg

SEQ ID NO: 258750 - DNA, 25 bp, Mus musculus
atgcatgcattcatactatcctagc

SEQ ID NO: 258751 - DNA, 25 bp, Mus musculus
atgcatgcattctcaagaggtcttg

SEQ ID NO: 258752 - DNA, 25 bp, Mus musculus
atgcatgcattcttactatcctagc

SEQ ID NO: 258753 - DNA, 25 bp, Mus musculus
atgcatgcattgaatttggatcgac

SEQ ID NO: 258754 - DNA, 25 bp, Mus musculus
atgcatgcattgtatttggatcgac

SEQ ID NO: 258755 - DNA, 25 bp, Mus musculus
atgcatgccaagatcttttaattta

SEQ ID NO: 258756 - DNA, 25 bp, Mus musculus
atgcatgccaagttcttttaattta

SEQ ID NO: 258757 - DNA, 25 bp, Mus musculus
atgcatgcctcgagtgctcatctca

SEQ ID NO: 258758 - DNA, 25 bp, Mus musculus
atgcatgcctcgtgtgctcatctca

SEQ ID NO: 258759 - DNA, 25 bp, Mus musculus
atgcatgcctctactaatatacctc

SEQ ID NO: 258760 - DNA, 25 bp, Mus musculus
atgcatgcctcttctaatatacctc

SEQ ID NO: 258761 - DNA, 25 bp, Mus musculus
atgcatgcctggaaacgcagtggac

SEQ ID NO: 258762 - DNA, 25 bp, Mus musculus
atgcatgcctggacctttgctgtgt

SEQ ID NO: 258763 - DNA, 25 bp, Mus musculus
atgcatgcctggagcacccagaagc

SEQ ID NO: 258764 - DNA, 25 bp, Mus musculus
atgcatgcctggtaacgcagtggac

SEQ ID NO: 258765 - DNA, 25 bp, Mus musculus
atgcatgcctggtcctttgctgtgt

SEQ ID NO: 258766 - DNA, 25 bp, Mus musculus
atgcatgcctggtgcacccagaagc

SEQ ID NO: 258767 - DNA, 25 bp, Mus musculus
atgcatgcgcctatgatgtcctcaa

SEQ ID NO: 258768 - DNA, 25 bp, Mus musculus
atgcatgcgcctttgatgtcctcaa

SEQ ID NO: 258769 - DNA, 25 bp, Mus musculus
atgcatgctccgctaccagaagtgt

SEQ ID NO: 258770 - DNA, 25 bp, Mus musculus
atgcatgctccggtaccagaagtgt

SEQ ID NO: 258771 - DNA, 25 bp, Mus musculus
atgcatgctctactcagaagtgagc

SEQ ID NO: 258772 - DNA, 25 bp, Mus musculus
atgcatgctctagtcagaagtgagc

SEQ ID NO: 258773 - DNA, 25 bp, Mus musculus
atgcatgctctgaagatgacctggc

SEQ ID NO: 258774 - DNA, 25 bp, Mus musculus
atgcatgctctgtagatgacctggc

SEQ ID NO: 258775 - DNA, 25 bp, Mus musculus
atgcatgctgcaagtttcttgacaa

SEQ ID NO: 258776 - DNA, 25 bp, Mus musculus
atgcatgctgcatgtttcttgacaa

SEQ ID NO: 258777 - DNA, 25 bp, Mus musculus
atgcatgctgcccaccctaggcaat

SEQ ID NO: 258778 - DNA, 25 bp, Mus musculus
atgcatgctgccgaccctaggcaat

SEQ ID NO: 258779 - DNA, 25 bp, Mus musculus
atgcatgctgtgatagagccccaca

SEQ ID NO: 258780 - DNA, 25 bp, Mus musculus
atgcatgctgtgttagagccccaca

SEQ ID NO: 258781 - DNA, 25 bp, Mus musculus
atgcatgcttatacatcctggccag

SEQ ID NO: 258782 - DNA, 25 bp, Mus musculus
atgcatgcttattcatcctggccag

SEQ ID NO: 258783 - DNA, 25 bp, Mus musculus
atgcatgcttcacgcttctcagttc

SEQ ID NO: 258784 - DNA, 25 bp, Mus musculus
atgcatgcttcaggcttctcagttc

SEQ ID NO: 258785 - DNA, 25 bp, Mus musculus
atgcatgcttcccaaatctttagag

SEQ ID NO: 258786 - DNA, 25 bp, Mus musculus
atgcatgcttccgaaatctttagag

SEQ ID NO: 258787 - DNA, 25 bp, Mus musculus
atgcatgcttgactcagtctctctc

SEQ ID NO: 258788 - DNA, 25 bp, Mus musculus
atgcatgcttgagtcagtctctctc

SEQ ID NO: 258789 - DNA, 25 bp, Mus musculus
atgcatgctttgatttgtcaccctg

SEQ ID NO: 258790 - DNA, 25 bp, Mus musculus
atgcatgctttgttttgtcaccctg

SEQ ID NO: 258791 - DNA, 25 bp, Mus musculus
atgcatggagacaagggctttgaat

SEQ ID NO: 258792 - DNA, 25 bp, Mus musculus
atgcatggagactagggctttgaat

SEQ ID NO: 258793 - DNA, 25 bp, Mus musculus
atgcatggagtcctgagttctggct

SEQ ID NO: 258794 - DNA, 25 bp, Mus musculus
atgcatggagtcgtgagttctggct

SEQ ID NO: 258795 - DNA, 25 bp, Mus musculus
atgcatggcagcaaggtcaccagaa

SEQ ID NO: 258796 - DNA, 25 bp, Mus musculus
atgcatggcagctaggtcaccagaa

SEQ ID NO: 258797 - DNA, 25 bp, Mus musculus
atgcatggccgtccagtgtgagcca

SEQ ID NO: 258798 - DNA, 25 bp, Mus musculus
atgcatggccgtgcagtgtgagcca

SEQ ID NO: 258799 - DNA, 25 bp, Mus musculus
atgcatgggataagctggcccctga

SEQ ID NO: 258800 - DNA, 25 bp, Mus musculus
atgcatgggatatgctggcccctga

SEQ ID NO: 258801 - DNA, 25 bp, Mus musculus
atgcatgggctcacagaagctccta

SEQ ID NO: 258802 - DNA, 25 bp, Mus musculus
atgcatgggctcaggcaactttgga

SEQ ID NO: 258803 - DNA, 25 bp, Mus musculus
atgcatgggctctcagaagctccta

SEQ ID NO: 258804 - DNA, 25 bp, Mus musculus
atgcatgggctctggcaactttgga

SEQ ID NO: 258805 - DNA, 25 bp, Mus musculus
atgcatggtctgaggagagtcagca

SEQ ID NO: 258806 - DNA, 25 bp, Mus musculus
atgcatggtctgtggagagtcagca

SEQ ID NO: 258807 - DNA, 25 bp, Mus musculus
atgcatggtgcaactatgcaggcaa

SEQ ID NO: 258808 - DNA, 25 bp, Mus musculus
atgcatggtgcatctatgcaggcaa

SEQ ID NO: 258809 - DNA, 25 bp, Mus musculus
atgcatgtaccaacaggctgacgct

SEQ ID NO: 258810 - DNA, 25 bp, Mus musculus
atgcatgtaccatcaggctgacgct

SEQ ID NO: 258811 - DNA, 25 bp, Mus musculus
atgcatgtagcaaccgaatcagtga

SEQ ID NO: 258812 - DNA, 25 bp, Mus musculus
atgcatgtagcatccgaatcagtga

SEQ ID NO: 258813 - DNA, 25 bp, Mus musculus
atgcatgtattgactattgtttggg

SEQ ID NO: 258814 - DNA, 25 bp, Mus musculus
atgcatgtattgtctattgtttggg

SEQ ID NO: 258815 - DNA, 25 bp, Mus musculus
atgcatgtcagcacaggcctttagt

SEQ ID NO: 258816 - DNA, 25 bp, Mus musculus
atgcatgtcagctcaggcctttagt

SEQ ID NO: 258817 - DNA, 25 bp, Mus musculus
atgcatgtcagtagcttggttccaa

SEQ ID NO: 258818 - DNA, 25 bp, Mus musculus
atgcatgtcagttgcttggttccaa

SEQ ID NO: 258819 - DNA, 25 bp, Mus musculus
atgcatgtcatcctaacacttagat

SEQ ID NO: 258820 - DNA, 25 bp, Mus musculus
atgcatgtcatcgtaacacttagat

SEQ ID NO: 258821 - DNA, 25 bp, Mus musculus
atgcatgtgactctgatgctccctg

SEQ ID NO: 258822 - DNA, 25 bp, Mus musculus
atgcatgtgactgtgatgctccctg

SEQ ID NO: 258823 - DNA, 25 bp, Mus musculus
atgcatgtgagcatgacacggaata

SEQ ID NO: 258824 - DNA, 25 bp, Mus musculus
atgcatgtgagcttgacacggaata

SEQ ID NO: 258825 - DNA, 25 bp, Mus musculus
atgcatgtgaggatatcagcctgag

SEQ ID NO: 258826 - DNA, 25 bp, Mus musculus
atgcatgtgaggttatcagcctgag

SEQ ID NO: 258827 - DNA, 25 bp, Mus musculus
atgcatgtgcaaattctcctcttca

SEQ ID NO: 258828 - DNA, 25 bp, Mus musculus
atgcatgtgcaatttctcctcttca

SEQ ID NO: 258829 - DNA, 25 bp, Mus musculus
atgcatgtgcacacagttgaaaatg

SEQ ID NO: 258830 - DNA, 25 bp, Mus musculus
atgcatgtgcactcagttgaaaatg

SEQ ID NO: 258831 - DNA, 25 bp, Mus musculus
atgcatgtgcagcactattcaagta

SEQ ID NO: 258832 - DNA, 25 bp, Mus musculus
atgcatgtgcaggactattcaagta

SEQ ID NO: 258833 - DNA, 25 bp, Mus musculus
atgcatgtgcataccaaagagagag

SEQ ID NO: 258834 - DNA, 25 bp, Mus musculus
atgcatgtgcattccaaagagagag

SEQ ID NO: 258835 - DNA, 25 bp, Mus musculus
atgcatgtgctaccatcagtactaa

SEQ ID NO: 258836 - DNA, 25 bp, Mus musculus
atgcatgtgctagcatcagtactaa

SEQ ID NO: 258837 - DNA, 25 bp, Mus musculus
atgcatgtgggtacatatggaaatc

SEQ ID NO: 258838 - DNA, 25 bp, Mus musculus
atgcatgtgggtaggcagccataaa

SEQ ID NO: 258839 - DNA, 25 bp, Mus musculus
atgcatgtgggttcatatggaaatc

SEQ ID NO: 258840 - DNA, 25 bp, Mus musculus
atgcatgtgggttggcagccataaa

SEQ ID NO: 258841 - DNA, 25 bp, Mus musculus
atgcatgtggtacaacttttggttc

SEQ ID NO: 258842 - DNA, 25 bp, Mus musculus
atgcatgtggtacgagctctaggac

SEQ ID NO: 258843 - DNA, 25 bp, Mus musculus
atgcatgtggtagaacttttggttc

SEQ ID NO: 258844 - DNA, 25 bp, Mus musculus
atgcatgtggtaggagctctaggac

SEQ ID NO: 258845 - DNA, 25 bp, Mus musculus
atgcatgtgtaccacgtacatacct

SEQ ID NO: 258846 - DNA, 25 bp, Mus musculus
atgcatgtgtacgacgtacatacct

SEQ ID NO: 258847 - DNA, 25 bp, Mus musculus
atgcatgtgtgaacgaatatagctg

SEQ ID NO: 258848 - DNA, 25 bp, Mus musculus
atgcatgtgtgaatcagcttccctt

SEQ ID NO: 258849 - DNA, 25 bp, Mus musculus
atgcatgtgtgatcgaatatagctg

SEQ ID NO: 258850 - DNA, 25 bp, Mus musculus
atgcatgtgtgattcagcttccctt

SEQ ID NO: 258851 - DNA, 25 bp, Mus musculus
atgcatgttcctacttgaaaccacc

SEQ ID NO: 258852 - DNA, 25 bp, Mus musculus
atgcatgttccttcttgaaaccacc

SEQ ID NO: 258853 - DNA, 25 bp, Mus musculus
atgcatgttctcatgattgtttcca

SEQ ID NO: 258854 - DNA, 25 bp, Mus musculus
atgcatgttctcttgattgtttcca

SEQ ID NO: 258855 - DNA, 25 bp, Mus musculus
atgcatgttctgctatgtgatctaa

SEQ ID NO: 258856 - DNA, 25 bp, Mus musculus
atgcatgttctggtatgtgatctaa

SEQ ID NO: 258857 - DNA, 25 bp, Mus musculus
atgcatgttgttatcagctatgtgt

SEQ ID NO: 258858 - DNA, 25 bp, Mus musculus
atgcatgttgttttcagctatgtgt

SEQ ID NO: 258859 - DNA, 25 bp, Mus musculus
atgcatgtttcaagtgctctcacac

SEQ ID NO: 258860 - DNA, 25 bp, Mus musculus
atgcatgtttcatgtgctctcacac

SEQ ID NO: 258861 - DNA, 25 bp, Mus musculus
atgcattaccatccccgggtcttat

SEQ ID NO: 258862 - DNA, 25 bp, Mus musculus
atgcattaccatgcccgggtcttat

SEQ ID NO: 258863 - DNA, 25 bp, Mus musculus
atgcattacctcattatttcagccc

SEQ ID NO: 258864 - DNA, 25 bp, Mus musculus
atgcattacctctttatttcagccc

SEQ ID NO: 258865 - DNA, 25 bp, Mus musculus
atgcattatatgagaccggattgtc

SEQ ID NO: 258866 - DNA, 25 bp, Mus musculus
atgcattatatgtgaccggattgtc

SEQ ID NO: 258867 - DNA, 25 bp, Mus musculus
atgcattatcctctttgcttgtttg

SEQ ID NO: 258868 - DNA, 25 bp, Mus musculus
atgcattatcctgtttgcttgtttg

SEQ ID NO: 258869 - DNA, 25 bp, Mus musculus
atgcattatgtgaaaatcagcttca

SEQ ID NO: 258870 - DNA, 25 bp, Mus musculus
atgcattatgtgtaaatcagcttca

SEQ ID NO: 258871 - DNA, 25 bp, Mus musculus
atgcattattgccagttttactcta

SEQ ID NO: 258872 - DNA, 25 bp, Mus musculus
atgcattattgcgagttttactcta

SEQ ID NO: 258873 - DNA, 25 bp, Mus musculus
atgcattatttaccctgtctctcgg

SEQ ID NO: 258874 - DNA, 25 bp, Mus musculus
atgcattatttagcctgtctctcgg

SEQ ID NO: 258875 - DNA, 25 bp, Mus musculus
atgcattcaaacagaggcaccagcc

SEQ ID NO: 258876 - DNA, 25 bp, Mus musculus
atgcattcaaactgaggcaccagcc

SEQ ID NO: 258877 - DNA, 25 bp, Mus musculus
atgcattcagaaagagccagccgct

SEQ ID NO: 258878 - DNA, 25 bp, Mus musculus
atgcattcagaatgagccagccgct

SEQ ID NO: 258879 - DNA, 25 bp, Mus musculus
atgcattcagagagctgcttcacca

SEQ ID NO: 258880 - DNA, 25 bp, Mus musculus
atgcattcagagtgctgcttcacca

SEQ ID NO: 258881 - DNA, 25 bp, Mus musculus
atgcattcagccactattaaatttt

SEQ ID NO: 258882 - DNA, 25 bp, Mus musculus
atgcattcagcctctattaaatttt

SEQ ID NO: 258883 - DNA, 25 bp, Mus musculus
atgcattcatccagttggaagcaga

SEQ ID NO: 258884 - DNA, 25 bp, Mus musculus
atgcattcatcctgttggaagcaga

SEQ ID NO: 258885 - DNA, 25 bp, Mus musculus
atgcattccactactaattgtaaat

SEQ ID NO: 258886 - DNA, 25 bp, Mus musculus
atgcattccacttctaattgtaaat

SEQ ID NO: 258887 - DNA, 25 bp, Mus musculus
atgcattccataacggctataaatt

SEQ ID NO: 258888 - DNA, 25 bp, Mus musculus
atgcattccatatcggctataaatt

SEQ ID NO: 258889 - DNA, 25 bp, Mus musculus
atgcattccatgcatgcatgcgcac

SEQ ID NO: 258890 - DNA, 25 bp, Mus musculus
atgcattccatggatgcatgcgcac

SEQ ID NO: 258891 - DNA, 25 bp, Mus musculus
atgcattcccggattctgttcctca

SEQ ID NO: 258892 - DNA, 25 bp, Mus musculus
atgcattcccggtttctgttcctca

SEQ ID NO: 258893 - DNA, 25 bp, Mus musculus
atgcattccctaatgtgtgctttac

SEQ ID NO: 258894 - DNA, 25 bp, Mus musculus
atgcattccctattgtgtgctttac

SEQ ID NO: 258895 - DNA, 25 bp, Mus musculus
atgcattctcccagtgcctatagag

SEQ ID NO: 258896 - DNA, 25 bp, Mus musculus
atgcattctccctgtgcctatagag

SEQ ID NO: 258897 - DNA, 25 bp, Mus musculus
atgcattgaggccagacttaaattg

SEQ ID NO: 258898 - DNA, 25 bp, Mus musculus
atgcattgaggcgagacttaaattg

SEQ ID NO: 258899 - DNA, 25 bp, Mus musculus
atgcattgcccaagtggtctaccac

SEQ ID NO: 258900 - DNA, 25 bp, Mus musculus
atgcattgcccatgtggtctaccac

SEQ ID NO: 258901 - DNA, 25 bp, Mus musculus
atgcattggcaaatcggatgacaaa

SEQ ID NO: 258902 - DNA, 25 bp, Mus musculus
atgcattggcaattcggatgacaaa

SEQ ID NO: 258903 - DNA, 25 bp, Mus musculus
atgcattggctcatcataattagta

SEQ ID NO: 258904 - DNA, 25 bp, Mus musculus
atgcattggctcttcataattagta

SEQ ID NO: 258905 - DNA, 25 bp, Mus musculus
atgcattgtagaaccgtgtcaaccc

SEQ ID NO: 258906 - DNA, 25 bp, Mus musculus
atgcattgtagatccgtgtcaaccc

SEQ ID NO: 258907 - DNA, 25 bp, Mus musculus
atgcatttacaactccatttttaaa

SEQ ID NO: 258908 - DNA, 25 bp, Mus musculus
atgcatttacaagtccatttttaaa

SEQ ID NO: 258909 - DNA, 25 bp, Mus musculus
atgcatttactgatatccccagcta

SEQ ID NO: 258910 - DNA, 25 bp, Mus musculus
atgcatttactgttatccccagcta

SEQ ID NO: 258911 - DNA, 25 bp, Mus musculus
atgcatttaggaccaatcactgtgt

SEQ ID NO: 258912 - DNA, 25 bp, Mus musculus
atgcatttaggagcaatcactgtgt

SEQ ID NO: 258913 - DNA, 25 bp, Mus musculus
atgcatttatcacatattcttcccc

SEQ ID NO: 258914 - DNA, 25 bp, Mus musculus
atgcatttatcagatattcttcccc

SEQ ID NO: 258915 - DNA, 25 bp, Mus musculus
atgcatttatgtcatcattggtaca

SEQ ID NO: 258916 - DNA, 25 bp, Mus musculus
atgcatttatgtgatcattggtaca

SEQ ID NO: 258917 - DNA, 25 bp, Mus musculus
atgcatttcaaaatttggtcccgaa

SEQ ID NO: 258918 - DNA, 25 bp, Mus musculus
atgcatttcaaattttggtcccgaa

SEQ ID NO: 258919 - DNA, 25 bp, Mus musculus
atgcatttcattaaggtggatgtga

SEQ ID NO: 258920 - DNA, 25 bp, Mus musculus
atgcatttcatttaggtggatgtga

SEQ ID NO: 258921 - DNA, 25 bp, Mus musculus
atgcatttcccgaggcagtgaggag

SEQ ID NO: 258922 - DNA, 25 bp, Mus musculus
atgcatttcccgtggcagtgaggag

SEQ ID NO: 258923 - DNA, 25 bp, Mus musculus
atgcatttgcaaaccggagcttagc

SEQ ID NO: 258924 - DNA, 25 bp, Mus musculus
atgcatttgcaatccggagcttagc

SEQ ID NO: 258925 - DNA, 25 bp, Mus musculus
atgcatttgctaactccttgtggcc

SEQ ID NO: 258926 - DNA, 25 bp, Mus musculus
atgcatttgctatctccttgtggcc

SEQ ID NO: 258927 - DNA, 25 bp, Mus musculus
atgcattttactataactcccagag

SEQ ID NO: 258928 - DNA, 25 bp, Mus musculus
atgcattttactttaactcccagag

SEQ ID NO: 258929 - DNA, 25 bp, Mus musculus
atgcatttttgccagcaaggccacg

SEQ ID NO: 258930 - DNA, 25 bp, Mus musculus
atgcatttttgcgagcaaggccacg

SEQ ID NO: 258931 - DNA, 25 bp, Mus musculus
atgcattttttgacttgtgtcagat

SEQ ID NO: 258932 - DNA, 25 bp, Mus musculus
atgcattttttgtcttgtgtcagat

SEQ ID NO: 258933 - DNA, 25 bp, Mus musculus
atgccaaaaactcctcctacactaa

SEQ ID NO: 258934 - DNA, 25 bp, Mus musculus
atgccaaaaactctaggaacttcag

SEQ ID NO: 258935 - DNA, 25 bp, Mus musculus
atgccaaaaactgctcctacactaa

SEQ ID NO: 258936 - DNA, 25 bp, Mus musculus
atgccaaaaactgtaggaacttcag

SEQ ID NO: 258937 - DNA, 25 bp, Mus musculus
atgccaaaagtacagctgtcagatt

SEQ ID NO: 258938 - DNA, 25 bp, Mus musculus
atgccaaaagtagagctgtcagatt

SEQ ID NO: 258939 - DNA, 25 bp, Mus musculus
atgccaaactgcatacgaccgtgta

SEQ ID NO: 258940 - DNA, 25 bp, Mus musculus
atgccaaactgcttacgaccgtgta

SEQ ID NO: 258941 - DNA, 25 bp, Mus musculus
atgccaaacttgaaggagctcctga

SEQ ID NO: 258942 - DNA, 25 bp, Mus musculus
atgccaaacttgtaggagctcctga

SEQ ID NO: 258943 - DNA, 25 bp, Mus musculus
atgccaaagaccatgcagtcagaag

SEQ ID NO: 258944 - DNA, 25 bp, Mus musculus
atgccaaagaccttgcagtcagaag

SEQ ID NO: 258945 - DNA, 25 bp, Mus musculus
atgccaaagctgctccttgttttag

SEQ ID NO: 258946 - DNA, 25 bp, Mus musculus
atgccaaagctggtccttgttttag

SEQ ID NO: 258947 - DNA, 25 bp, Mus musculus
atgccaaattgcagatgtactctgt

SEQ ID NO: 258948 - DNA, 25 bp, Mus musculus
atgccaaattgctgatgtactctgt

SEQ ID NO: 258949 - DNA, 25 bp, Mus musculus
atgccaacaaatacttccgctgtga

SEQ ID NO: 258950 - DNA, 25 bp, Mus musculus
atgccaacaaattcttccgctgtga

SEQ ID NO: 258951 - DNA, 25 bp, Mus musculus
atgccaacaataccctgatgacagg

SEQ ID NO: 258952 - DNA, 25 bp, Mus musculus
atgccaacaatagcctgatgacagg

SEQ ID NO: 258953 - DNA, 25 bp, Mus musculus
atgccaacccatatgctcagtagct

SEQ ID NO: 258954 - DNA, 25 bp, Mus musculus
atgccaacccatttgctcagtagct

SEQ ID NO: 258955 - DNA, 25 bp, Mus musculus
atgccaaccctaatgtctgtatcta

SEQ ID NO: 258956 - DNA, 25 bp, Mus musculus
atgccaaccctattgtctgtatcta

SEQ ID NO: 258957 - DNA, 25 bp, Mus musculus
atgccaacctaacaagactccgagt

SEQ ID NO: 258958 - DNA, 25 bp, Mus musculus
atgccaacctaagaagactccgagt

SEQ ID NO: 258959 - DNA, 25 bp, Mus musculus
atgccaacctgacaggatccaggat

SEQ ID NO: 258960 - DNA, 25 bp, Mus musculus
atgccaacctgagaggatccaggat

SEQ ID NO: 258961 - DNA, 25 bp, Mus musculus
atgccaaccttcctataactctagg

SEQ ID NO: 258962 - DNA, 25 bp, Mus musculus
atgccaaccttcgtataactctagg

SEQ ID NO: 258963 - DNA, 25 bp, Mus musculus
atgccaacggggaatccccaatagg

SEQ ID NO: 258964 - DNA, 25 bp, Mus musculus
atgccaacggggtatccccaatagg

SEQ ID NO: 258965 - DNA, 25 bp, Mus musculus
atgccaactatcagaaacgttttag

SEQ ID NO: 258966 - DNA, 25 bp, Mus musculus
atgccaactatctgaaacgttttag

SEQ ID NO: 258967 - DNA, 25 bp, Mus musculus
atgccaactcccacaaatactatga

SEQ ID NO: 258968 - DNA, 25 bp, Mus musculus
atgccaactccctcaaatactatga

SEQ ID NO: 258969 - DNA, 25 bp, Mus musculus
atgccaactggcacttctgagagag

SEQ ID NO: 258970 - DNA, 25 bp, Mus musculus
atgccaactggctcttctgagagag

SEQ ID NO: 258971 - DNA, 25 bp, Mus musculus
atgccaacttggagtattttatcag

SEQ ID NO: 258972 - DNA, 25 bp, Mus musculus
atgccaacttggtgtattttatcag

SEQ ID NO: 258973 - DNA, 25 bp, Mus musculus
atgccaagaaacaaggatgcctcca

SEQ ID NO: 258974 - DNA, 25 bp, Mus musculus
atgccaagaaactaggatgcctcca

SEQ ID NO: 258975 - DNA, 25 bp, Mus musculus
atgccaagaatgacccaagctgagg

SEQ ID NO: 258976 - DNA, 25 bp, Mus musculus
atgccaagaatgtcccaagctgagg

SEQ ID NO: 258977 - DNA, 25 bp, Mus musculus
atgccaagactaacaaaggaacgta

SEQ ID NO: 258978 - DNA, 25 bp, Mus musculus
atgccaagactatcaaaggaacgta

SEQ ID NO: 258979 - DNA, 25 bp, Mus musculus
atgccaagccagaatgttttttatt

SEQ ID NO: 258980 - DNA, 25 bp, Mus musculus
atgccaagccagtatgttttttatt

SEQ ID NO: 258981 - DNA, 25 bp, Mus musculus
atgccaagcccaccgttttaaactc

SEQ ID NO: 258982 - DNA, 25 bp, Mus musculus
atgccaagcccagcgttttaaactc

SEQ ID NO: 258983 - DNA, 25 bp, Mus musculus
atgccaagccctcggttatgacttg

SEQ ID NO: 258984 - DNA, 25 bp, Mus musculus
atgccaagccctgggttatgacttg

SEQ ID NO: 258985 - DNA, 25 bp, Mus musculus
atgccaagcctcagggacggctcta

SEQ ID NO: 258986 - DNA, 25 bp, Mus musculus
atgccaagcctctgggacggctcta

SEQ ID NO: 258987 - DNA, 25 bp, Mus musculus
atgccaagcctgagtcggatcagcg

SEQ ID NO: 258988 - DNA, 25 bp, Mus musculus
atgccaagcctgtgtcggatcagcg

SEQ ID NO: 258989 - DNA, 25 bp, Mus musculus
atgccaagcgttcctgatggacagg

SEQ ID NO: 258990 - DNA, 25 bp, Mus musculus
atgccaagcgttgctgatggacagg

SEQ ID NO: 258991 - DNA, 25 bp, Mus musculus
atgccaagctgacccggacctcgga

SEQ ID NO: 258992 - DNA, 25 bp, Mus musculus
atgccaagctgagccggacctcgga

SEQ ID NO: 258993 - DNA, 25 bp, Mus musculus
atgccaagcttcaaaattcctttcc

SEQ ID NO: 258994 - DNA, 25 bp, Mus musculus
atgccaagcttctaaattcctttcc

SEQ ID NO: 258995 - DNA, 25 bp, Mus musculus
atgccaaggaagaccctctgctgac

SEQ ID NO: 258996 - DNA, 25 bp, Mus musculus
atgccaaggaagtccctctgctgac

SEQ ID NO: 258997 - DNA, 25 bp, Mus musculus
atgccaaggactctggaggaagcca

SEQ ID NO: 258998 - DNA, 25 bp, Mus musculus
atgccaaggactgtggaggaagcca

SEQ ID NO: 258999 - DNA, 25 bp, Mus musculus
atgccaaggcagagtagtgctcctc

SEQ ID NO: 259000 - DNA, 25 bp, Mus musculus
atgccaaggcagtgtagtgctcctc

SEQ ID NO: 259001 - DNA, 25 bp, Mus musculus
atgccaaggtctctgatctgctctc

SEQ ID NO: 259002 - DNA, 25 bp, Mus musculus
atgccaaggtctgtgatctgctctc

SEQ ID NO: 259003 - DNA, 25 bp, Mus musculus
atgccaagtattctgggcgcctcta

SEQ ID NO: 259004 - DNA, 25 bp, Mus musculus
atgccaagtattgtgggcgcctcta

SEQ ID NO: 259005 - DNA, 25 bp, Mus musculus
atgccaagtccgcagcgcttagaaa

SEQ ID NO: 259006 - DNA, 25 bp, Mus musculus
atgccaagtccggagcgcttagaaa

SEQ ID NO: 259007 - DNA, 25 bp, Mus musculus
atgccaagtggtcccaggctgcacc

SEQ ID NO: 259008 - DNA, 25 bp, Mus musculus
atgccaagtggtgccaggctgcacc

SEQ ID NO: 259009 - DNA, 25 bp, Mus musculus
atgccaagtgttccatgcttgccta

SEQ ID NO: 259010 - DNA, 25 bp, Mus musculus
atgccaagtgttgcatgcttgccta

SEQ ID NO: 259011 - DNA, 25 bp, Mus musculus
atgccaagtttaactgtaatcagct

SEQ ID NO: 259012 - DNA, 25 bp, Mus musculus
atgccaagtttatctgtaatcagct

SEQ ID NO: 259013 - DNA, 25 bp, Mus musculus
atgccaatattcatctctatcgagt

SEQ ID NO: 259014 - DNA, 25 bp, Mus musculus
atgccaatattcttctctatcgagt

SEQ ID NO: 259015 - DNA, 25 bp, Mus musculus
atgccaatctacactccaaagaata

SEQ ID NO: 259016 - DNA, 25 bp, Mus musculus
atgccaatctactctccaaagaata

SEQ ID NO: 259017 - DNA, 25 bp, Mus musculus
atgccaatcttaatcctgactcttt

SEQ ID NO: 259018 - DNA, 25 bp, Mus musculus
atgccaatcttattcctgactcttt

SEQ ID NO: 259019 - DNA, 25 bp, Mus musculus
atgccaatgctgaactctcttgatt

SEQ ID NO: 259020 - DNA, 25 bp, Mus musculus
atgccaatgctgtactctcttgatt

SEQ ID NO: 259021 - DNA, 25 bp, Mus musculus
atgccaatggcaacctcaatgtttc

SEQ ID NO: 259022 - DNA, 25 bp, Mus musculus
atgccaatggcatcctcaatgtttc

SEQ ID NO: 259023 - DNA, 25 bp, Mus musculus
atgccaatggtccatgtcctctggg

SEQ ID NO: 259024 - DNA, 25 bp, Mus musculus
atgccaatggtcgatgtcctctggg

SEQ ID NO: 259025 - DNA, 25 bp, Mus musculus
atgccaatgtaacatgctctctgtt

SEQ ID NO: 259026 - DNA, 25 bp, Mus musculus
atgccaatgtaagatgctctctgtt

SEQ ID NO: 259027 - DNA, 25 bp, Mus musculus
atgccaattggccacagatttagaa

SEQ ID NO: 259028 - DNA, 25 bp, Mus musculus
atgccaattggcgacagatttagaa

SEQ ID NO: 259029 - DNA, 25 bp, Mus musculus
atgccaattttgagtcataaccaat

SEQ ID NO: 259030 - DNA, 25 bp, Mus musculus
atgccaattttgtgtcataaccaat

SEQ ID NO: 259031 - DNA, 25 bp, Mus musculus
atgccacaactcaaactgcttcagt

SEQ ID NO: 259032 - DNA, 25 bp, Mus musculus
atgccacaactctaactgcttcagt

SEQ ID NO: 259033 - DNA, 25 bp, Mus musculus
atgccacaagttctcagtgcttgct

SEQ ID NO: 259034 - DNA, 25 bp, Mus musculus
atgccacaagttgtcagtgcttgct

SEQ ID NO: 259035 - DNA, 25 bp, Mus musculus
atgccacacaagcaacacttaatag

SEQ ID NO: 259036 - DNA, 25 bp, Mus musculus
atgccacacaaggaacacttaatag

SEQ ID NO: 259037 - DNA, 25 bp, Mus musculus
atgccacacaatcacctgatgtttc

SEQ ID NO: 259038 - DNA, 25 bp, Mus musculus
atgccacacaatcgtctacctctaa

SEQ ID NO: 259039 - DNA, 25 bp, Mus musculus
atgccacacaatgacctgatgtttc

SEQ ID NO: 259040 - DNA, 25 bp, Mus musculus
atgccacacaatggtctacctctaa

SEQ ID NO: 259041 - DNA, 25 bp, Mus musculus
atgccacactatccagatgggcctt

SEQ ID NO: 259042 - DNA, 25 bp, Mus musculus
atgccacactatgcagatgggcctt

SEQ ID NO: 259043 - DNA, 25 bp, Mus musculus
atgccacactcactgtcttagtcag

SEQ ID NO: 259044 - DNA, 25 bp, Mus musculus
atgccacactcagtgtcttagtcag

SEQ ID NO: 259045 - DNA, 25 bp, Mus musculus
atgccacagatcatcggtgagcaag

SEQ ID NO: 259046 - DNA, 25 bp, Mus musculus
atgccacagatcttcggtgagcaag

SEQ ID NO: 259047 - DNA, 25 bp, Mus musculus
atgccacagcaccaactatgtctat

SEQ ID NO: 259048 - DNA, 25 bp, Mus musculus
atgccacagcacgaactatgtctat

SEQ ID NO: 259049 - DNA, 25 bp, Mus musculus
atgccacagccaatatgtcttaagt

SEQ ID NO: 259050 - DNA, 25 bp, Mus musculus
atgccacagccattatgtcttaagt

SEQ ID NO: 259051 - DNA, 25 bp, Mus musculus
atgccacagctccaagccaacaaga

SEQ ID NO: 259052 - DNA, 25 bp, Mus musculus
atgccacagctcgaagccaacaaga

SEQ ID NO: 259053 - DNA, 25 bp, Mus musculus
atgccacagctgactttaatgaaca

SEQ ID NO: 259054 - DNA, 25 bp, Mus musculus
atgccacagctgtctttaatgaaca

SEQ ID NO: 259055 - DNA, 25 bp, Mus musculus
atgccacataccagtagtttcagca

SEQ ID NO: 259056 - DNA, 25 bp, Mus musculus
atgccacatacctgtagtttcagca

SEQ ID NO: 259057 - DNA, 25 bp, Mus musculus
atgccacatgagaataggtgccctt

SEQ ID NO: 259058 - DNA, 25 bp, Mus musculus
atgccacatgagtataggtgccctt

SEQ ID NO: 259059 - DNA, 25 bp, Mus musculus
atgccacatgcaaatctggtactat

SEQ ID NO: 259060 - DNA, 25 bp, Mus musculus
atgccacatgcatatctggtactat

SEQ ID NO: 259061 - DNA, 25 bp, Mus musculus
atgccacattcgctatatggttgct

SEQ ID NO: 259062 - DNA, 25 bp, Mus musculus
atgccacattcggtatatggttgct

SEQ ID NO: 259063 - DNA, 25 bp, Mus musculus
atgccaccacacatgggtgctaaga

SEQ ID NO: 259064 - DNA, 25 bp, Mus musculus
atgccaccacacttgggtgctaaga

SEQ ID NO: 259065 - DNA, 25 bp, Mus musculus
atgccacccaaacttctttggcttt

SEQ ID NO: 259066 - DNA, 25 bp, Mus musculus
atgccacccaaagttctttggcttt

SEQ ID NO: 259067 - DNA, 25 bp, Mus musculus
atgccacccacgatgatgatgatct

SEQ ID NO: 259068 - DNA, 25 bp, Mus musculus
atgccacccacgttgatgatgatct

SEQ ID NO: 259069 - DNA, 25 bp, Mus musculus
atgccacccagaactcacttttgag

SEQ ID NO: 259070 - DNA, 25 bp, Mus musculus
atgccacccagatctcacttttgag

SEQ ID NO: 259071 - DNA, 25 bp, Mus musculus
atgccaccctcaccttaattgctat

SEQ ID NO: 259072 - DNA, 25 bp, Mus musculus
atgccaccctcagcttaattgctat

SEQ ID NO: 259073 - DNA, 25 bp, Mus musculus
atgccacctaggagggttggatcct

SEQ ID NO: 259074 - DNA, 25 bp, Mus musculus
atgccacctaggtgggttggatcct

SEQ ID NO: 259075 - DNA, 25 bp, Mus musculus
atgccacctgtacttcctttggagt

SEQ ID NO: 259076 - DNA, 25 bp, Mus musculus
atgccacctgtagttcctttggagt

SEQ ID NO: 259077 - DNA, 25 bp, Mus musculus
atgccacctgtgattgtcgagacgg

SEQ ID NO: 259078 - DNA, 25 bp, Mus musculus
atgccacctgtgtttgtcgagacgg

SEQ ID NO: 259079 - DNA, 25 bp, Mus musculus
atgccacctgttaccctgaaatagg

SEQ ID NO: 259080 - DNA, 25 bp, Mus musculus
atgccacctgtttccctgaaatagg

SEQ ID NO: 259081 - DNA, 25 bp, Mus musculus
atgccacctttgctgttccagaagg

SEQ ID NO: 259082 - DNA, 25 bp, Mus musculus
atgccacctttggtgttccagaagg

SEQ ID NO: 259083 - DNA, 25 bp, Mus musculus
atgccacggcacatccaggaacaaa

SEQ ID NO: 259084 - DNA, 25 bp, Mus musculus
atgccacggcacttccaggaacaaa

SEQ ID NO: 259085 - DNA, 25 bp, Mus musculus
atgccacgggccaatcactaaccgg

SEQ ID NO: 259086 - DNA, 25 bp, Mus musculus
atgccacgggcctatcactaaccgg

SEQ ID NO: 259087 - DNA, 25 bp, Mus musculus
atgccacgtaacagacctggtgtaa

SEQ ID NO: 259088 - DNA, 25 bp, Mus musculus
atgccacgtaactgacctggtgtaa

SEQ ID NO: 259089 - DNA, 25 bp, Mus musculus
atgccacgtcagattttaagggaat

SEQ ID NO: 259090 - DNA, 25 bp, Mus musculus
atgccacgtcagtttttaagggaat

SEQ ID NO: 259091 - DNA, 25 bp, Mus musculus
atgccacgtgggaacaacggctgca

SEQ ID NO: 259092 - DNA, 25 bp, Mus musculus
atgccacgtgggtacaacggctgca

SEQ ID NO: 259093 - DNA, 25 bp, Mus musculus
atgccacgtttgcaaactgggagcc

SEQ ID NO: 259094 - DNA, 25 bp, Mus musculus
atgccacgtttggaaactgggagcc

SEQ ID NO: 259095 - DNA, 25 bp, Mus musculus
atgccactaatcatggcttcttagt

SEQ ID NO: 259096 - DNA, 25 bp, Mus musculus
atgccactaatcttggcttcttagt

SEQ ID NO: 259097 - DNA, 25 bp, Mus musculus
atgccactacgtcgtgtcccgggat

SEQ ID NO: 259098 - DNA, 25 bp, Mus musculus
atgccactacgtggtgtcccgggat

SEQ ID NO: 259099 - DNA, 25 bp, Mus musculus
atgccactcagaatcatcctacagt

SEQ ID NO: 259100 - DNA, 25 bp, Mus musculus
atgccactcagattcatcctacagt

SEQ ID NO: 259101 - DNA, 25 bp, Mus musculus
atgccactccttattgaccaagcat

SEQ ID NO: 259102 - DNA, 25 bp, Mus musculus
atgccactcctttttgaccaagcat

SEQ ID NO: 259103 - DNA, 25 bp, Mus musculus
atgccactgaaacctaaggtcttac

SEQ ID NO: 259104 - DNA, 25 bp, Mus musculus
atgccactgaaagctaaggtcttac

SEQ ID NO: 259105 - DNA, 25 bp, Mus musculus
atgccactgaagatcacccagaaac

SEQ ID NO: 259106 - DNA, 25 bp, Mus musculus
atgccactgaagttcacccagaaac

SEQ ID NO: 259107 - DNA, 25 bp, Mus musculus
atgccactgaatacgttgaaaaaat

SEQ ID NO: 259108 - DNA, 25 bp, Mus musculus
atgccactgaattcgttgaaaaaat

SEQ ID NO: 259109 - DNA, 25 bp, Mus musculus
atgccactgtaaccccacaccgtgg

SEQ ID NO: 259110 - DNA, 25 bp, Mus musculus
atgccactgtaagcccacaccgtgg

SEQ ID NO: 259111 - DNA, 25 bp, Mus musculus
atgccactgtgcctttgactacatt

SEQ ID NO: 259112 - DNA, 25 bp, Mus musculus
atgccactgtgcgtttgactacatt

SEQ ID NO: 259113 - DNA, 25 bp, Mus musculus
atgccactgtgtcccatcgatgaag

SEQ ID NO: 259114 - DNA, 25 bp, Mus musculus
atgccactgtgtgccatcgatgaag

SEQ ID NO: 259115 - DNA, 25 bp, Mus musculus
atgccacttacgagtacttttccat

SEQ ID NO: 259116 - DNA, 25 bp, Mus musculus
atgccacttacgtgtacttttccat

SEQ ID NO: 259117 - DNA, 25 bp, Mus musculus
atgccacttagtcccgaaagctctc

SEQ ID NO: 259118 - DNA, 25 bp, Mus musculus
atgccacttagtgccgaaagctctc

SEQ ID NO: 259119 - DNA, 25 bp, Mus musculus
atgccacttcagactgactttgttt

SEQ ID NO: 259120 - DNA, 25 bp, Mus musculus
atgccacttcagtctgactttgttt

SEQ ID NO: 259121 - DNA, 25 bp, Mus musculus
atgccactttggaggtatggagttc

SEQ ID NO: 259122 - DNA, 25 bp, Mus musculus
atgccactttggtggtatggagttc

SEQ ID NO: 259123 - DNA, 25 bp, Mus musculus
atgccagaaattcgtttccagtccc

SEQ ID NO: 259124 - DNA, 25 bp, Mus musculus
atgccagaaattggtttccagtccc

SEQ ID NO: 259125 - DNA, 25 bp, Mus musculus
atgccagaacatcccgtgagtgtct

SEQ ID NO: 259126 - DNA, 25 bp, Mus musculus
atgccagaacatgccgtgagtgtct

SEQ ID NO: 259127 - DNA, 25 bp, Mus musculus
atgccagaagacaggagaggttctt

SEQ ID NO: 259128 - DNA, 25 bp, Mus musculus
atgccagaagactggagaggttctt

SEQ ID NO: 259129 - DNA, 25 bp, Mus musculus
atgccagaagagctagccggatccc

SEQ ID NO: 259130 - DNA, 25 bp, Mus musculus
atgccagaagaggtagccggatccc

SEQ ID NO: 259131 - DNA, 25 bp, Mus musculus
atgccagaagctattctaatgtgac

SEQ ID NO: 259132 - DNA, 25 bp, Mus musculus
atgccagaagcttttctaatgtgac

SEQ ID NO: 259133 - DNA, 25 bp, Mus musculus
atgccagaattcatggtttactctt

SEQ ID NO: 259134 - DNA, 25 bp, Mus musculus
atgccagaattcttggtttactctt

SEQ ID NO: 259135 - DNA, 25 bp, Mus musculus
atgccagacgctaggttctgaggag

SEQ ID NO: 259136 - DNA, 25 bp, Mus musculus
atgccagacgcttggttctgaggag

SEQ ID NO: 259137 - DNA, 25 bp, Mus musculus
atgccagactccaaggacatcagca

SEQ ID NO: 259138 - DNA, 25 bp, Mus musculus
atgccagactcctaggacatcagca

SEQ ID NO: 259139 - DNA, 25 bp, Mus musculus
atgccagagaaacgaaagccaagat

SEQ ID NO: 259140 - DNA, 25 bp, Mus musculus
atgccagagaaaggaaagccaagat

SEQ ID NO: 259141 - DNA, 25 bp, Mus musculus
atgccagaggatcgcgtcagatccc

SEQ ID NO: 259142 - DNA, 25 bp, Mus musculus
atgccagaggatggcgtcagatccc

SEQ ID NO: 259143 - DNA, 25 bp, Mus musculus
atgccagaggctagtctccactctg

SEQ ID NO: 259144 - DNA, 25 bp, Mus musculus
atgccagaggcttgtctccactctg

SEQ ID NO: 259145 - DNA, 25 bp, Mus musculus
atgccagaggtcacttcagcatctt

SEQ ID NO: 259146 - DNA, 25 bp, Mus musculus
atgccagaggtctcttcagcatctt

SEQ ID NO: 259147 - DNA, 25 bp, Mus musculus
atgccagatacccttgagatactcc

SEQ ID NO: 259148 - DNA, 25 bp, Mus musculus
atgccagataccgttgagatactcc

SEQ ID NO: 259149 - DNA, 25 bp, Mus musculus
atgccagatagacctctcggctcat

SEQ ID NO: 259150 - DNA, 25 bp, Mus musculus
atgccagatagagctctcggctcat

SEQ ID NO: 259151 - DNA, 25 bp, Mus musculus
atgccagatattcctctttacctgt

SEQ ID NO: 259152 - DNA, 25 bp, Mus musculus
atgccagatattgctctttacctgt

SEQ ID NO: 259153 - DNA, 25 bp, Mus musculus
atgccagcaccacctatctgaaaca

SEQ ID NO: 259154 - DNA, 25 bp, Mus musculus
atgccagcaccagctatctgaaaca

SEQ ID NO: 259155 - DNA, 25 bp, Mus musculus
atgccagcagaaatgtccatccaaa

SEQ ID NO: 259156 - DNA, 25 bp, Mus musculus
atgccagcagaattgtccatccaaa

SEQ ID NO: 259157 - DNA, 25 bp, Mus musculus
atgccagcagacaagtcccattctt

SEQ ID NO: 259158 - DNA, 25 bp, Mus musculus
atgccagcagactagtcccattctt

SEQ ID NO: 259159 - DNA, 25 bp, Mus musculus
atgccagcagcaaccgtagatcata

SEQ ID NO: 259160 - DNA, 25 bp, Mus musculus
atgccagcagcatccgtagatcata

SEQ ID NO: 259161 - DNA, 25 bp, Mus musculus
atgccagcagctcatcgggaggaca

SEQ ID NO: 259162 - DNA, 25 bp, Mus musculus
atgccagcagctgatcgggaggaca

SEQ ID NO: 259163 - DNA, 25 bp, Mus musculus
atgccagcaggcactgttttaacta

SEQ ID NO: 259164 - DNA, 25 bp, Mus musculus
atgccagcaggctctgttttaacta

SEQ ID NO: 259165 - DNA, 25 bp, Mus musculus
atgccagcatggaatgattgactct

SEQ ID NO: 259166 - DNA, 25 bp, Mus musculus
atgccagcatggtatgattgactct

SEQ ID NO: 259167 - DNA, 25 bp, Mus musculus
atgccagccaacaacaagtgcctga

SEQ ID NO: 259168 - DNA, 25 bp, Mus musculus
atgccagccaactacaagtgcctga

SEQ ID NO: 259169 - DNA, 25 bp, Mus musculus
atgccagccatgattccttccaatt

SEQ ID NO: 259170 - DNA, 25 bp, Mus musculus
atgccagccatgtttccttccaatt

SEQ ID NO: 259171 - DNA, 25 bp, Mus musculus
atgccagcccaacttctatccaagt

SEQ ID NO: 259172 - DNA, 25 bp, Mus musculus
atgccagcccaagttctatccaagt

SEQ ID NO: 259173 - DNA, 25 bp, Mus musculus
atgccagcccatcaatagtagagct

SEQ ID NO: 259174 - DNA, 25 bp, Mus musculus
atgccagcccatgaatagtagagct

SEQ ID NO: 259175 - DNA, 25 bp, Mus musculus
atgccagcccctcgagagagacagt

SEQ ID NO: 259176 - DNA, 25 bp, Mus musculus
atgccagcccctggagagagacagt

SEQ ID NO: 259177 - DNA, 25 bp, Mus musculus
atgccagccctccaggaagctgatg

SEQ ID NO: 259178 - DNA, 25 bp, Mus musculus
atgccagccctcgaggaagctgatg

SEQ ID NO: 259179 - DNA, 25 bp, Mus musculus
atgccagcctctcagcaggagccaa

SEQ ID NO: 259180 - DNA, 25 bp, Mus musculus
atgccagcctctgagcaggagccaa

SEQ ID NO: 259181 - DNA, 25 bp, Mus musculus
atgccagcgatgacagctttccaga

SEQ ID NO: 259182 - DNA, 25 bp, Mus musculus
atgccagcgatgtcagctttccaga

SEQ ID NO: 259183 - DNA, 25 bp, Mus musculus
atgccagcgtatcgcagccaggcat

SEQ ID NO: 259184 - DNA, 25 bp, Mus musculus
atgccagcgtatggcagccaggcat

SEQ ID NO: 259185 - DNA, 25 bp, Mus musculus
atgccagcgtgtcctgaggtctttt

SEQ ID NO: 259186 - DNA, 25 bp, Mus musculus
atgccagcgtgtgctgaggtctttt

SEQ ID NO: 259187 - DNA, 25 bp, Mus musculus
atgccagctaaaagtttttcctgtt

SEQ ID NO: 259188 - DNA, 25 bp, Mus musculus
atgccagctaaatgtttttcctgtt

SEQ ID NO: 259189 - DNA, 25 bp, Mus musculus
atgccagctaacctgtcactgactg

SEQ ID NO: 259190 - DNA, 25 bp, Mus musculus
atgccagctaacgtgtcactgactg

SEQ ID NO: 259191 - DNA, 25 bp, Mus musculus
atgccagctgctaagctcaaggaac

SEQ ID NO: 259192 - DNA, 25 bp, Mus musculus
atgccagctgcttagctcaaggaac

SEQ ID NO: 259193 - DNA, 25 bp, Mus musculus
atgccagcttacaacgctacacgtt

SEQ ID NO: 259194 - DNA, 25 bp, Mus musculus
atgccagcttactacgctacacgtt

SEQ ID NO: 259195 - DNA, 25 bp, Mus musculus
atgccaggaattctcaataaaattt

SEQ ID NO: 259196 - DNA, 25 bp, Mus musculus
atgccaggaattgtcaataaaattt

SEQ ID NO: 259197 - DNA, 25 bp, Mus musculus
atgccaggacggagacacacatact

SEQ ID NO: 259198 - DNA, 25 bp, Mus musculus
atgccaggacggtgacacacatact

SEQ ID NO: 259199 - DNA, 25 bp, Mus musculus
atgccaggaggcagcttcgagacga

SEQ ID NO: 259200 - DNA, 25 bp, Mus musculus
atgccaggaggctgcttcgagacga

SEQ ID NO: 259201 - DNA, 25 bp, Mus musculus
atgccaggatggactgtactttcaa

SEQ ID NO: 259202 - DNA, 25 bp, Mus musculus
atgccaggatggtctgtactttcaa

SEQ ID NO: 259203 - DNA, 25 bp, Mus musculus
atgccaggattcagtgaaggaagaa

SEQ ID NO: 259204 - DNA, 25 bp, Mus musculus
atgccaggattctgtgaaggaagaa

SEQ ID NO: 259205 - DNA, 25 bp, Mus musculus
atgccaggcagtatgctgggcagcc

SEQ ID NO: 259206 - DNA, 25 bp, Mus musculus
atgccaggcagtttgctgggcagcc

SEQ ID NO: 259207 - DNA, 25 bp, Mus musculus
atgccaggcatcagagacacactct

SEQ ID NO: 259208 - DNA, 25 bp, Mus musculus
atgccaggcatctgagacacactct

SEQ ID NO: 259209 - DNA, 25 bp, Mus musculus
atgccaggcctgacacgtttgacag

SEQ ID NO: 259210 - DNA, 25 bp, Mus musculus
atgccaggcctgtcacgtttgacag

SEQ ID NO: 259211 - DNA, 25 bp, Mus musculus
atgccaggctaaccagactcatgta

SEQ ID NO: 259212 - DNA, 25 bp, Mus musculus
atgccaggctaagcagactcatgta

SEQ ID NO: 259213 - DNA, 25 bp, Mus musculus
atgccagggccacaatggagctcta

SEQ ID NO: 259214 - DNA, 25 bp, Mus musculus
atgccagggccagaatggagctcta

SEQ ID NO: 259215 - DNA, 25 bp, Mus musculus
atgccagggtgtaccctttcaattt

SEQ ID NO: 259216 - DNA, 25 bp, Mus musculus
atgccagggtgttccctttcaattt

SEQ ID NO: 259217 - DNA, 25 bp, Mus musculus
atgccaggtactagttagtccacta

SEQ ID NO: 259218 - DNA, 25 bp, Mus musculus
atgccaggtacttgttagtccacta

SEQ ID NO: 259219 - DNA, 25 bp, Mus musculus
atgccaggtatgatttataccacag

SEQ ID NO: 259220 - DNA, 25 bp, Mus musculus
atgccaggtatgttttataccacag

SEQ ID NO: 259221 - DNA, 25 bp, Mus musculus
atgccaggtctacaggcctatgttg

SEQ ID NO: 259222 - DNA, 25 bp, Mus musculus
atgccaggtctagaggcctatgttg

SEQ ID NO: 259223 - DNA, 25 bp, Mus musculus
atgccaggtgcaagcttagaatccc

SEQ ID NO: 259224 - DNA, 25 bp, Mus musculus
atgccaggtgcacgcaggataccct

SEQ ID NO: 259225 - DNA, 25 bp, Mus musculus
atgccaggtgcaggcaggataccct

SEQ ID NO: 259226 - DNA, 25 bp, Mus musculus
atgccaggtgcatgcttagaatccc

SEQ ID NO: 259227 - DNA, 25 bp, Mus musculus
atgccaggttccatcagggtgaggc

SEQ ID NO: 259228 - DNA, 25 bp, Mus musculus
atgccaggttccttcagggtgaggc

SEQ ID NO: 259229 - DNA, 25 bp, Mus musculus
atgccagtaacccacctttaactgg

SEQ ID NO: 259230 - DNA, 25 bp, Mus musculus
atgccagtaaccgacctttaactgg

SEQ ID NO: 259231 - DNA, 25 bp, Mus musculus
atgccagtacccagaagtcacagag

SEQ ID NO: 259232 - DNA, 25 bp, Mus musculus
atgccagtaccctgaagtcacagag

SEQ ID NO: 259233 - DNA, 25 bp, Mus musculus
atgccagtatcgctgcattggcctt

SEQ ID NO: 259234 - DNA, 25 bp, Mus musculus
atgccagtatcggtgcattggcctt

SEQ ID NO: 259235 - DNA, 25 bp, Mus musculus
atgccagtatgcaggctggagccta

SEQ ID NO: 259236 - DNA, 25 bp, Mus musculus
atgccagtatgctggctggagccta

SEQ ID NO: 259237 - DNA, 25 bp, Mus musculus
atgccagtccatatccacatatttt

SEQ ID NO: 259238 - DNA, 25 bp, Mus musculus
atgccagtccatttccacatatttt

SEQ ID NO: 259239 - DNA, 25 bp, Mus musculus
atgccagtcctgatgatggctggtt

SEQ ID NO: 259240 - DNA, 25 bp, Mus musculus
atgccagtcctgttgatggctggtt

SEQ ID NO: 259241 - DNA, 25 bp, Mus musculus
atgccagtccttactgggttatcac

SEQ ID NO: 259242 - DNA, 25 bp, Mus musculus
atgccagtcctttctgggttatcac

SEQ ID NO: 259243 - DNA, 25 bp, Mus musculus
atgccagtcgccagtgggactgtca

SEQ ID NO: 259244 - DNA, 25 bp, Mus musculus
atgccagtcgcctgtgggactgtca

SEQ ID NO: 259245 - DNA, 25 bp, Mus musculus
atgccagtcgctcatccagatgact

SEQ ID NO: 259246 - DNA, 25 bp, Mus musculus
atgccagtcgctgatccagatgact

SEQ ID NO: 259247 - DNA, 25 bp, Mus musculus
atgccagtctttatcattgcctgta

SEQ ID NO: 259248 - DNA, 25 bp, Mus musculus
atgccagtctttttcattgcctgta

SEQ ID NO: 259249 - DNA, 25 bp, Mus musculus
atgccagtgaaacaacagtaaatct

SEQ ID NO: 259250 - DNA, 25 bp, Mus musculus
atgccagtgaaagaacagtaaatct

SEQ ID NO: 259251 - DNA, 25 bp, Mus musculus
atgccagtgaagcagcaaacttgct

SEQ ID NO: 259252 - DNA, 25 bp, Mus musculus
atgccagtgaaggagcaaacttgct

SEQ ID NO: 259253 - DNA, 25 bp, Mus musculus
atgccagtgatcaacatcgaagacc

SEQ ID NO: 259254 - DNA, 25 bp, Mus musculus
atgccagtgatctacatcgaagacc

SEQ ID NO: 259255 - DNA, 25 bp, Mus musculus
atgccagtgctccacgtctaatggt

SEQ ID NO: 259256 - DNA, 25 bp, Mus musculus
atgccagtgctcgacgtctaatggt

SEQ ID NO: 259257 - DNA, 25 bp, Mus musculus
atgccagtggatatttgagacccct

SEQ ID NO: 259258 - DNA, 25 bp, Mus musculus
atgccagtggatttttgagacccct

SEQ ID NO: 259259 - DNA, 25 bp, Mus musculus
atgccagtggctccgcaagagctta

SEQ ID NO: 259260 - DNA, 25 bp, Mus musculus
atgccagtggctgcgcaagagctta

SEQ ID NO: 259261 - DNA, 25 bp, Mus musculus
atgccagtgggcaagcactgagttg

SEQ ID NO: 259262 - DNA, 25 bp, Mus musculus
atgccagtgggctagcactgagttg

SEQ ID NO: 259263 - DNA, 25 bp, Mus musculus
atgccagtgtgcacgagtaccccgg

SEQ ID NO: 259264 - DNA, 25 bp, Mus musculus
atgccagtgtgctcgagtaccccgg

SEQ ID NO: 259265 - DNA, 25 bp, Mus musculus
atgccagtgtggataccaggctcat

SEQ ID NO: 259266 - DNA, 25 bp, Mus musculus
atgccagtgtggttaccaggctcat

SEQ ID NO: 259267 - DNA, 25 bp, Mus musculus
atgccagttcaaatgaccccgggaa

SEQ ID NO: 259268 - DNA, 25 bp, Mus musculus
atgccagttcaattgaccccgggaa

SEQ ID NO: 259269 - DNA, 25 bp, Mus musculus
atgccagttcgtccagctgacaagc

SEQ ID NO: 259270 - DNA, 25 bp, Mus musculus
atgccagttcgtgcagctgacaagc

SEQ ID NO: 259271 - DNA, 25 bp, Mus musculus
atgccagttctcaaatcttcaagga

SEQ ID NO: 259272 - DNA, 25 bp, Mus musculus
atgccagttctctaatcttcaagga

SEQ ID NO: 259273 - DNA, 25 bp, Mus musculus
atgccagttctgcatatgcgctgta

SEQ ID NO: 259274 - DNA, 25 bp, Mus musculus
atgccagttctggatatgcgctgta

SEQ ID NO: 259275 - DNA, 25 bp, Mus musculus
atgccagttgcacctacttgaccat

SEQ ID NO: 259276 - DNA, 25 bp, Mus musculus
atgccagttgcagctacttgaccat

SEQ ID NO: 259277 - DNA, 25 bp, Mus musculus
atgccagttgccatgatggaaacca

SEQ ID NO: 259278 - DNA, 25 bp, Mus musculus
atgccagttgccttgatggaaacca

SEQ ID NO: 259279 - DNA, 25 bp, Mus musculus
atgccagttgctatccataacacct

SEQ ID NO: 259280 - DNA, 25 bp, Mus musculus
atgccagttgctttccataacacct

SEQ ID NO: 259281 - DNA, 25 bp, Mus musculus
atgccagtttggcacctgtaagaca

SEQ ID NO: 259282 - DNA, 25 bp, Mus musculus
atgccagtttgggacctgtaagaca

SEQ ID NO: 259283 - DNA, 25 bp, Mus musculus
atgccatacaggaactttgggaccc

SEQ ID NO: 259284 - DNA, 25 bp, Mus musculus
atgccatacaggtactttgggaccc

SEQ ID NO: 259285 - DNA, 25 bp, Mus musculus
atgccatacattacagccctttcta

SEQ ID NO: 259286 - DNA, 25 bp, Mus musculus
atgccatacatttcagccctttcta

SEQ ID NO: 259287 - DNA, 25 bp, Mus musculus
atgccatagtatcacgttttcctcc

SEQ ID NO: 259288 - DNA, 25 bp, Mus musculus
atgccatagtatgacgttttcctcc

SEQ ID NO: 259289 - DNA, 25 bp, Mus musculus
atgccatagtgcatgcagcctttgc

SEQ ID NO: 259290 - DNA, 25 bp, Mus musculus
atgccatagtgcttgcagcctttgc

SEQ ID NO: 259291 - DNA, 25 bp, Mus musculus
atgccatatcatctgtgcacactga

SEQ ID NO: 259292 - DNA, 25 bp, Mus musculus
atgccatatcatgtgtgcacactga

SEQ ID NO: 259293 - DNA, 25 bp, Mus musculus
atgccatatgctcatatcacggtga

SEQ ID NO: 259294 - DNA, 25 bp, Mus musculus
atgccatatgctgatatcacggtga

SEQ ID NO: 259295 - DNA, 25 bp, Mus musculus
atgccatatttcataggccccaaga

SEQ ID NO: 259296 - DNA, 25 bp, Mus musculus
atgccatatttcttaggccccaaga

SEQ ID NO: 259297 - DNA, 25 bp, Mus musculus
atgccatcaacaaaggcgaccctat

SEQ ID NO: 259298 - DNA, 25 bp, Mus musculus
atgccatcaacaatcgagccttctg

SEQ ID NO: 259299 - DNA, 25 bp, Mus musculus
atgccatcaacataggcgaccctat

SEQ ID NO: 259300 - DNA, 25 bp, Mus musculus
atgccatcaacattcgagccttctg

SEQ ID NO: 259301 - DNA, 25 bp, Mus musculus
atgccatcaacgagtaggagcccag

SEQ ID NO: 259302 - DNA, 25 bp, Mus musculus
atgccatcaacgtgtaggagcccag

SEQ ID NO: 259303 - DNA, 25 bp, Mus musculus
atgccatcacccctgtcttttgttt

SEQ ID NO: 259304 - DNA, 25 bp, Mus musculus
atgccatcacccgtgtcttttgttt

SEQ ID NO: 259305 - DNA, 25 bp, Mus musculus
atgccatcagcccttggacaaagct

SEQ ID NO: 259306 - DNA, 25 bp, Mus musculus
atgccatcagccgttggacaaagct

SEQ ID NO: 259307 - DNA, 25 bp, Mus musculus
atgccatcaggcaggagctaagtgg

SEQ ID NO: 259308 - DNA, 25 bp, Mus musculus
atgccatcaggctggagctaagtgg

SEQ ID NO: 259309 - DNA, 25 bp, Mus musculus
atgccatcatgtctagccttctgtt

SEQ ID NO: 259310 - DNA, 25 bp, Mus musculus
atgccatcatgtgtagccttctgtt

SEQ ID NO: 259311 - DNA, 25 bp, Mus musculus
atgccatcattcagagccttgtcaa

SEQ ID NO: 259312 - DNA, 25 bp, Mus musculus
atgccatcattctgagccttgtcaa

SEQ ID NO: 259313 - DNA, 25 bp, Mus musculus
atgccatcccaaatgtgtattaaga

SEQ ID NO: 259314 - DNA, 25 bp, Mus musculus
atgccatcccaattgtgtattaaga

SEQ ID NO: 259315 - DNA, 25 bp, Mus musculus
atgccatcccagctgttagggctcc

SEQ ID NO: 259316 - DNA, 25 bp, Mus musculus
atgccatcccaggtgttagggctcc

SEQ ID NO: 259317 - DNA, 25 bp, Mus musculus
atgccatcgcaaaagggtgttcctc

SEQ ID NO: 259318 - DNA, 25 bp, Mus musculus
atgccatcgcaatagggtgttcctc

SEQ ID NO: 259319 - DNA, 25 bp, Mus musculus
atgccatcgtgaccaaggccatcga

SEQ ID NO: 259320 - DNA, 25 bp, Mus musculus
atgccatcgtgagcaaggccatcga

SEQ ID NO: 259321 - DNA, 25 bp, Mus musculus
atgccatctcccctgagaacatcaa

SEQ ID NO: 259322 - DNA, 25 bp, Mus musculus
atgccatctcccgtgagaacatcaa

SEQ ID NO: 259323 - DNA, 25 bp, Mus musculus
atgccatctcttacacatgctaaat

SEQ ID NO: 259324 - DNA, 25 bp, Mus musculus
atgccatctctttcacatgctaaat

SEQ ID NO: 259325 - DNA, 25 bp, Mus musculus
atgccatctgatactgttttcacct

SEQ ID NO: 259326 - DNA, 25 bp, Mus musculus
atgccatctgattctgttttcacct

SEQ ID NO: 259327 - DNA, 25 bp, Mus musculus
atgccatctgccaattttgaggcca

SEQ ID NO: 259328 - DNA, 25 bp, Mus musculus
atgccatctgccagctgatagcggg

SEQ ID NO: 259329 - DNA, 25 bp, Mus musculus
atgccatctgcctattttgaggcca

SEQ ID NO: 259330 - DNA, 25 bp, Mus musculus
atgccatctgcctgctgatagcggg

SEQ ID NO: 259331 - DNA, 25 bp, Mus musculus
atgccatcttacattttcaggtagc

SEQ ID NO: 259332 - DNA, 25 bp, Mus musculus
atgccatcttactttttcaggtagc

SEQ ID NO: 259333 - DNA, 25 bp, Mus musculus
atgccatcttggattcttgagtgtg

SEQ ID NO: 259334 - DNA, 25 bp, Mus musculus
atgccatcttggtttcttgagtgtg

SEQ ID NO: 259335 - DNA, 25 bp, Mus musculus
atgccatgaaaacactccctgtctt

SEQ ID NO: 259336 - DNA, 25 bp, Mus musculus
atgccatgaaaagactccctgtctt

SEQ ID NO: 259337 - DNA, 25 bp, Mus musculus
atgccatgaattacccctgcaggag

SEQ ID NO: 259338 - DNA, 25 bp, Mus musculus
atgccatgaatttcccctgcaggag

SEQ ID NO: 259339 - DNA, 25 bp, Mus musculus
atgccatgatttatccaccgtttca

SEQ ID NO: 259340 - DNA, 25 bp, Mus musculus
atgccatgatttttccaccgtttca

SEQ ID NO: 259341 - DNA, 25 bp, Mus musculus
atgccatgccacacattaagacgta

SEQ ID NO: 259342 - DNA, 25 bp, Mus musculus
atgccatgccactcattaagacgta

SEQ ID NO: 259343 - DNA, 25 bp, Mus musculus
atgccatgccggaatctttaggaac

SEQ ID NO: 259344 - DNA, 25 bp, Mus musculus
atgccatgccggtatctttaggaac

SEQ ID NO: 259345 - DNA, 25 bp, Mus musculus
atgccatgcctgcttagatttccaa

SEQ ID NO: 259346 - DNA, 25 bp, Mus musculus
atgccatgcctggttagatttccaa

SEQ ID NO: 259347 - DNA, 25 bp, Mus musculus
atgccatgctcaccagcaaacacag

SEQ ID NO: 259348 - DNA, 25 bp, Mus musculus
atgccatgctcagcagcaaacacag

SEQ ID NO: 259349 - DNA, 25 bp, Mus musculus
atgccatgcttgaaagtgggtagcc

SEQ ID NO: 259350 - DNA, 25 bp, Mus musculus
atgccatgcttgtaagtgggtagcc

SEQ ID NO: 259351 - DNA, 25 bp, Mus musculus
atgccatggacaaatcactgacttt

SEQ ID NO: 259352 - DNA, 25 bp, Mus musculus
atgccatggacatatcactgacttt

SEQ ID NO: 259353 - DNA, 25 bp, Mus musculus
atgccatggactccaaggccaggaa

SEQ ID NO: 259354 - DNA, 25 bp, Mus musculus
atgccatggactgcaaggccaggaa

SEQ ID NO: 259355 - DNA, 25 bp, Mus musculus
atgccatggcatctatgtgccctca

SEQ ID NO: 259356 - DNA, 25 bp, Mus musculus
atgccatggcatgtatgtgccctca

SEQ ID NO: 259357 - DNA, 25 bp, Mus musculus
atgccatggcttatattctatgcta

SEQ ID NO: 259358 - DNA, 25 bp, Mus musculus
atgccatggcttttattctatgcta

SEQ ID NO: 259359 - DNA, 25 bp, Mus musculus
atgccatgggtgctgtcattgtcct

SEQ ID NO: 259360 - DNA, 25 bp, Mus musculus
atgccatgggtggtgtcattgtcct

SEQ ID NO: 259361 - DNA, 25 bp, Mus musculus
atgccatggtctctccctgtgctat

SEQ ID NO: 259362 - DNA, 25 bp, Mus musculus
atgccatggtctgtccctgtgctat

SEQ ID NO: 259363 - DNA, 25 bp, Mus musculus
atgccatggtgtctccacaaatgta

SEQ ID NO: 259364 - DNA, 25 bp, Mus musculus
atgccatggtgtgtccacaaatgta

SEQ ID NO: 259365 - DNA, 25 bp, Mus musculus
atgccatgtatcatgcatgatgcta

SEQ ID NO: 259366 - DNA, 25 bp, Mus musculus
atgccatgtatcttgcatgatgcta

SEQ ID NO: 259367 - DNA, 25 bp, Mus musculus
atgccatgtgatcctaccttacagt

SEQ ID NO: 259368 - DNA, 25 bp, Mus musculus
atgccatgtgatgctaccttacagt

SEQ ID NO: 259369 - DNA, 25 bp, Mus musculus
atgccatgttagctctcttgtctct

SEQ ID NO: 259370 - DNA, 25 bp, Mus musculus
atgccatgttaggtctcttgtctct

SEQ ID NO: 259371 - DNA, 25 bp, Mus musculus
atgccatgttgtactggagctctgt

SEQ ID NO: 259372 - DNA, 25 bp, Mus musculus
atgccatgttgttctggagctctgt

SEQ ID NO: 259373 - DNA, 25 bp, Mus musculus
atgccattacgtatgttacattgtg

SEQ ID NO: 259374 - DNA, 25 bp, Mus musculus
atgccattacgtttgttacattgtg

SEQ ID NO: 259375 - DNA, 25 bp, Mus musculus
atgccattaggtatccatttcccaa

SEQ ID NO: 259376 - DNA, 25 bp, Mus musculus
atgccattaggtttccatttcccaa

SEQ ID NO: 259377 - DNA, 25 bp, Mus musculus
atgccattattgagcccttgtatca

SEQ ID NO: 259378 - DNA, 25 bp, Mus musculus
atgccattattgtgcccttgtatca

SEQ ID NO: 259379 - DNA, 25 bp, Mus musculus
atgccattcaccaggtcaccaagta

SEQ ID NO: 259380 - DNA, 25 bp, Mus musculus
atgccattcacctggtcaccaagta

SEQ ID NO: 259381 - DNA, 25 bp, Mus musculus
atgccattcgttacatggctaaaca

SEQ ID NO: 259382 - DNA, 25 bp, Mus musculus
atgccattcgtttcatggctaaaca

SEQ ID NO: 259383 - DNA, 25 bp, Mus musculus
atgccattctgacacttgccagtat

SEQ ID NO: 259384 - DNA, 25 bp, Mus musculus
atgccattctgagacttgccagtat

SEQ ID NO: 259385 - DNA, 25 bp, Mus musculus
atgccattcttcatcagtgacaggt

SEQ ID NO: 259386 - DNA, 25 bp, Mus musculus
atgccattcttcttcagtgacaggt

SEQ ID NO: 259387 - DNA, 25 bp, Mus musculus
atgccattcttgaagctcttgcctg

SEQ ID NO: 259388 - DNA, 25 bp, Mus musculus
atgccattcttgtagctcttgcctg

SEQ ID NO: 259389 - DNA, 25 bp, Mus musculus
atgccattgagacctttgggagcac

SEQ ID NO: 259390 - DNA, 25 bp, Mus musculus
atgccattgagagctttgggagcac

SEQ ID NO: 259391 - DNA, 25 bp, Mus musculus
atgccattgcacaggctgcgtgtga

SEQ ID NO: 259392 - DNA, 25 bp, Mus musculus
atgccattgcactggctgcgtgtga

SEQ ID NO: 259393 - DNA, 25 bp, Mus musculus
atgccattgcctactattcctatac

SEQ ID NO: 259394 - DNA, 25 bp, Mus musculus
atgccattgccttctattcctatac

SEQ ID NO: 259395 - DNA, 25 bp, Mus musculus
atgccattgctcataggtcaacatg

SEQ ID NO: 259396 - DNA, 25 bp, Mus musculus
atgccattgctcttaggtcaacatg

SEQ ID NO: 259397 - DNA, 25 bp, Mus musculus
atgccattgggcacatctggtacag

SEQ ID NO: 259398 - DNA, 25 bp, Mus musculus
atgccattgggctcatctggtacag

SEQ ID NO: 259399 - DNA, 25 bp, Mus musculus
atgccattgtgcagaccctagtcaa

SEQ ID NO: 259400 - DNA, 25 bp, Mus musculus
atgccattgtgctgaccctagtcaa

SEQ ID NO: 259401 - DNA, 25 bp, Mus musculus
atgccattgtggagggccccaactt

SEQ ID NO: 259402 - DNA, 25 bp, Mus musculus
atgccattgtggtgggccccaactt

SEQ ID NO: 259403 - DNA, 25 bp, Mus musculus
atgccatttaatcttgtgcctgccc

SEQ ID NO: 259404 - DNA, 25 bp, Mus musculus
atgccatttaatgttgtgcctgccc

SEQ ID NO: 259405 - DNA, 25 bp, Mus musculus
atgccatttatcacttcaatctcag

SEQ ID NO: 259406 - DNA, 25 bp, Mus musculus
atgccatttatctcttcaatctcag

SEQ ID NO: 259407 - DNA, 25 bp, Mus musculus
atgccatttgccctactcgaaattt

SEQ ID NO: 259408 - DNA, 25 bp, Mus musculus
atgccatttgccgtactcgaaattt

SEQ ID NO: 259409 - DNA, 25 bp, Mus musculus
atgccatttggtcacaaacatcttt

SEQ ID NO: 259410 - DNA, 25 bp, Mus musculus
atgccatttggtgacaaacatcttt

SEQ ID NO: 259411 - DNA, 25 bp, Mus musculus
atgccatttgtgataactccaccca

SEQ ID NO: 259412 - DNA, 25 bp, Mus musculus
atgccatttgtgttaactccaccca

SEQ ID NO: 259413 - DNA, 25 bp, Mus musculus
atgccattttgtagatttggagtga

SEQ ID NO: 259414 - DNA, 25 bp, Mus musculus
atgccattttgtattctccatgcca

SEQ ID NO: 259415 - DNA, 25 bp, Mus musculus
atgccattttgttgatttggagtga

SEQ ID NO: 259416 - DNA, 25 bp, Mus musculus
atgccattttgttttctccatgcca

SEQ ID NO: 259417 - DNA, 25 bp, Mus musculus
atgccatttttaagtgttgcccgtg

SEQ ID NO: 259418 - DNA, 25 bp, Mus musculus
atgccatttttatgtgttgcccgtg

SEQ ID NO: 259419 - DNA, 25 bp, Mus musculus
atgcccaaacagactccttatgtaa

SEQ ID NO: 259420 - DNA, 25 bp, Mus musculus
atgcccaaacagtctccttatgtaa

SEQ ID NO: 259421 - DNA, 25 bp, Mus musculus
atgcccaaagctattctgttaaaca

SEQ ID NO: 259422 - DNA, 25 bp, Mus musculus
atgcccaaagcttttctgttaaaca

SEQ ID NO: 259423 - DNA, 25 bp, Mus musculus
atgcccaaatggacgtgttctgagg

SEQ ID NO: 259424 - DNA, 25 bp, Mus musculus
atgcccaaatggtcgtgttctgagg

SEQ ID NO: 259425 - DNA, 25 bp, Mus musculus
atgcccaacctcattaggagctttt

SEQ ID NO: 259426 - DNA, 25 bp, Mus musculus
atgcccaacctctttaggagctttt

SEQ ID NO: 259427 - DNA, 25 bp, Mus musculus
atgcccaagaagctcattgtgctgg

SEQ ID NO: 259428 - DNA, 25 bp, Mus musculus
atgcccaagaaggtcattgtgctgg

SEQ ID NO: 259429 - DNA, 25 bp, Mus musculus
atgcccaaggcaaagtgcagcgcta

SEQ ID NO: 259430 - DNA, 25 bp, Mus musculus
atgcccaaggcaataacaggttatg

SEQ ID NO: 259431 - DNA, 25 bp, Mus musculus
atgcccaaggcacagcgttttataa

SEQ ID NO: 259432 - DNA, 25 bp, Mus musculus
atgcccaaggcagagcgttttataa

SEQ ID NO: 259433 - DNA, 25 bp, Mus musculus
atgcccaaggcatagtgcagcgcta

SEQ ID NO: 259434 - DNA, 25 bp, Mus musculus
atgcccaaggcattaacaggttatg

SEQ ID NO: 259435 - DNA, 25 bp, Mus musculus
atgcccaaggttacgctccggagga

SEQ ID NO: 259436 - DNA, 25 bp, Mus musculus
atgcccaaggttctgtgttctgtcc

SEQ ID NO: 259437 - DNA, 25 bp, Mus musculus
atgcccaaggttgtgtgttctgtcc

SEQ ID NO: 259438 - DNA, 25 bp, Mus musculus
atgcccaaggtttcgctccggagga

SEQ ID NO: 259439 - DNA, 25 bp, Mus musculus
atgcccaagttgacttctgtttcta

SEQ ID NO: 259440 - DNA, 25 bp, Mus musculus
atgcccaagttgatgtagcttctag

SEQ ID NO: 259441 - DNA, 25 bp, Mus musculus
atgcccaagttgtcttctgtttcta

SEQ ID NO: 259442 - DNA, 25 bp, Mus musculus
atgcccaagttgttgtagcttctag

SEQ ID NO: 259443 - DNA, 25 bp, Mus musculus
atgcccaatgtgcttgtgactgttt

SEQ ID NO: 259444 - DNA, 25 bp, Mus musculus
atgcccaatgtggttgtgactgttt

SEQ ID NO: 259445 - DNA, 25 bp, Mus musculus
atgcccacaactctctgtttaaggt

SEQ ID NO: 259446 - DNA, 25 bp, Mus musculus
atgcccacaactgtctgtttaaggt

SEQ ID NO: 259447 - DNA, 25 bp, Mus musculus
atgcccacacagacaagccttaaag

SEQ ID NO: 259448 - DNA, 25 bp, Mus musculus
atgcccacacagtcaagccttaaag

SEQ ID NO: 259449 - DNA, 25 bp, Mus musculus
atgcccacactcattgttcagttct

SEQ ID NO: 259450 - DNA, 25 bp, Mus musculus
atgcccacactctttgttcagttct

SEQ ID NO: 259451 - DNA, 25 bp, Mus musculus
atgcccacaggtctattgtgcgggc

SEQ ID NO: 259452 - DNA, 25 bp, Mus musculus
atgcccacaggtgtattgtgcgggc

SEQ ID NO: 259453 - DNA, 25 bp, Mus musculus
atgcccaccaaaaggcttctgtaga

SEQ ID NO: 259454 - DNA, 25 bp, Mus musculus
atgcccaccaaactcatcagtgtag

SEQ ID NO: 259455 - DNA, 25 bp, Mus musculus
atgcccaccaaagtcatcagtgtag

SEQ ID NO: 259456 - DNA, 25 bp, Mus musculus
atgcccaccaaatggcttctgtaga

SEQ ID NO: 259457 - DNA, 25 bp, Mus musculus
atgcccaccagacttttacctggat

SEQ ID NO: 259458 - DNA, 25 bp, Mus musculus
atgcccaccagagttttacctggat

SEQ ID NO: 259459 - DNA, 25 bp, Mus musculus
atgcccaccatccttgctgtgatag

SEQ ID NO: 259460 - DNA, 25 bp, Mus musculus
atgcccaccatcgttgctgtgatag

SEQ ID NO: 259461 - DNA, 25 bp, Mus musculus
atgcccacccaacatttagacagat

SEQ ID NO: 259462 - DNA, 25 bp, Mus musculus
atgcccacccaagatttagacagat

SEQ ID NO: 259463 - DNA, 25 bp, Mus musculus
atgcccacctcacctgtagttgtac

SEQ ID NO: 259464 - DNA, 25 bp, Mus musculus
atgcccacctcagctgtagttgtac

SEQ ID NO: 259465 - DNA, 25 bp, Mus musculus
atgcccacctgtctgcagctttgga

SEQ ID NO: 259466 - DNA, 25 bp, Mus musculus
atgcccacctgtgtgcagctttgga

SEQ ID NO: 259467 - DNA, 25 bp, Mus musculus
atgcccacgatgagcatgctggtct

SEQ ID NO: 259468 - DNA, 25 bp, Mus musculus
atgcccacgatgtgcatgctggtct

SEQ ID NO: 259469 - DNA, 25 bp, Mus musculus
atgcccacgcaactttatagaactt

SEQ ID NO: 259470 - DNA, 25 bp, Mus musculus
atgcccacgcaagtttatagaactt

SEQ ID NO: 259471 - DNA, 25 bp, Mus musculus
atgcccacggctctgtcctaaagga

SEQ ID NO: 259472 - DNA, 25 bp, Mus musculus
atgcccacggctgtgtcctaaagga

SEQ ID NO: 259473 - DNA, 25 bp, Mus musculus
atgcccactaaaattcacctggatc

SEQ ID NO: 259474 - DNA, 25 bp, Mus musculus
atgcccactaaatttcacctggatc

SEQ ID NO: 259475 - DNA, 25 bp, Mus musculus
atgcccactagacctactgggttaa

SEQ ID NO: 259476 - DNA, 25 bp, Mus musculus
atgcccactagagctactgggttaa

SEQ ID NO: 259477 - DNA, 25 bp, Mus musculus
atgcccactcagaatactctctgaa

SEQ ID NO: 259478 - DNA, 25 bp, Mus musculus
atgcccactcagtatactctctgaa

SEQ ID NO: 259479 - DNA, 25 bp, Mus musculus
atgcccagaaggaagagccctacct

SEQ ID NO: 259480 - DNA, 25 bp, Mus musculus
atgcccagaaggtagagccctacct

SEQ ID NO: 259481 - DNA, 25 bp, Mus musculus
atgcccagacaacctcgacttataa

SEQ ID NO: 259482 - DNA, 25 bp, Mus musculus
atgcccagacaagctcgacttataa

SEQ ID NO: 259483 - DNA, 25 bp, Mus musculus
atgcccagacataaacatatccatg

SEQ ID NO: 259484 - DNA, 25 bp, Mus musculus
atgcccagacattaacatatccatg

SEQ ID NO: 259485 - DNA, 25 bp, Mus musculus
atgcccagacctactgtgcgcagtg

SEQ ID NO: 259486 - DNA, 25 bp, Mus musculus
atgcccagaccttctgtgcgcagtg

SEQ ID NO: 259487 - DNA, 25 bp, Mus musculus
atgcccagagatcatgtgcctgcct

SEQ ID NO: 259488 - DNA, 25 bp, Mus musculus
atgcccagagatgatgtgcctgcct

SEQ ID NO: 259489 - DNA, 25 bp, Mus musculus
atgcccagagcccacgtgcttgtgg

SEQ ID NO: 259490 - DNA, 25 bp, Mus musculus
atgcccagagccgacgtgcttgtgg

SEQ ID NO: 259491 - DNA, 25 bp, Mus musculus
atgcccagagctacctatatcatag

SEQ ID NO: 259492 - DNA, 25 bp, Mus musculus
atgcccagagcttcctatatcatag

SEQ ID NO: 259493 - DNA, 25 bp, Mus musculus
atgcccagaggtagcccacagtgtt

SEQ ID NO: 259494 - DNA, 25 bp, Mus musculus
atgcccagaggttgcccacagtgtt

SEQ ID NO: 259495 - DNA, 25 bp, Mus musculus
atgcccagcaccagaggaaccttca

SEQ ID NO: 259496 - DNA, 25 bp, Mus musculus
atgcccagcacctgaggaaccttca

SEQ ID NO: 259497 - DNA, 25 bp, Mus musculus
atgcccagcattcaatgtcatgtaa

SEQ ID NO: 259498 - DNA, 25 bp, Mus musculus
atgcccagcattgaatgtcatgtaa

SEQ ID NO: 259499 - DNA, 25 bp, Mus musculus
atgcccagcggtacgtggccaacac

SEQ ID NO: 259500 - DNA, 25 bp, Mus musculus
atgcccagcggttcgtggccaacac

SEQ ID NO: 259501 - DNA, 25 bp, Mus musculus
atgcccagctaacggatgacctgct

SEQ ID NO: 259502 - DNA, 25 bp, Mus musculus
atgcccagctaagggatgacctgct

SEQ ID NO: 259503 - DNA, 25 bp, Mus musculus
atgcccagcttcaaagttatgtttt

SEQ ID NO: 259504 - DNA, 25 bp, Mus musculus
atgcccagcttctaagttatgtttt

SEQ ID NO: 259505 - DNA, 25 bp, Mus musculus
atgcccagcttgatggacagactga

SEQ ID NO: 259506 - DNA, 25 bp, Mus musculus
atgcccagcttgttggacagactga

SEQ ID NO: 259507 - DNA, 25 bp, Mus musculus
atgcccaggcagctcgagaattcat

SEQ ID NO: 259508 - DNA, 25 bp, Mus musculus
atgcccaggcaggtcgagaattcat

SEQ ID NO: 259509 - DNA, 25 bp, Mus musculus
atgcccagggcacatattcaggtat

SEQ ID NO: 259510 - DNA, 25 bp, Mus musculus
atgcccagggcagatattcaggtat

SEQ ID NO: 259511 - DNA, 25 bp, Mus musculus
atgcccaggttcagtaaataaacaa

SEQ ID NO: 259512 - DNA, 25 bp, Mus musculus
atgcccaggttctgtaaataaacaa

SEQ ID NO: 259513 - DNA, 25 bp, Mus musculus
atgcccagtaagaacatcagtctct

SEQ ID NO: 259514 - DNA, 25 bp, Mus musculus
atgcccagtaagtacatcagtctct

SEQ ID NO: 259515 - DNA, 25 bp, Mus musculus
atgcccagtaggaaagtcttctctc

SEQ ID NO: 259516 - DNA, 25 bp, Mus musculus
atgcccagtaggtaagtcttctctc

SEQ ID NO: 259517 - DNA, 25 bp, Mus musculus
atgcccagtcgacccagtgtagaag

SEQ ID NO: 259518 - DNA, 25 bp, Mus musculus
atgcccagtcgagccagtgtagaag

SEQ ID NO: 259519 - DNA, 25 bp, Mus musculus
atgcccagtgaacatgtcacacagc

SEQ ID NO: 259520 - DNA, 25 bp, Mus musculus
atgcccagtgaagatgtcacacagc

SEQ ID NO: 259521 - DNA, 25 bp, Mus musculus
atgcccagtggtctttatcttcttt

SEQ ID NO: 259522 - DNA, 25 bp, Mus musculus
atgcccagtggtgtttatcttcttt

SEQ ID NO: 259523 - DNA, 25 bp, Mus musculus
atgcccagtgtgccccagtttgtgt

SEQ ID NO: 259524 - DNA, 25 bp, Mus musculus
atgcccagtgtggcccagtttgtgt

SEQ ID NO: 259525 - DNA, 25 bp, Mus musculus
atgcccagttcacttgtcctgtggg

SEQ ID NO: 259526 - DNA, 25 bp, Mus musculus
atgcccagttcagttgtcctgtggg

SEQ ID NO: 259527 - DNA, 25 bp, Mus musculus
atgcccagtttaatgagtcatacgt

SEQ ID NO: 259528 - DNA, 25 bp, Mus musculus
atgcccagtttattgagtcatacgt

SEQ ID NO: 259529 - DNA, 25 bp, Mus musculus
atgcccataggtctccaatactcga

SEQ ID NO: 259530 - DNA, 25 bp, Mus musculus
atgcccataggtgtccaatactcga

SEQ ID NO: 259531 - DNA, 25 bp, Mus musculus
atgcccatatgaaatattgctagct

SEQ ID NO: 259532 - DNA, 25 bp, Mus musculus
atgcccatatgatatattgctagct

SEQ ID NO: 259533 - DNA, 25 bp, Mus musculus
atgcccatatgcctgtataagctat

SEQ ID NO: 259534 - DNA, 25 bp, Mus musculus
atgcccatatgcgtgtataagctat

SEQ ID NO: 259535 - DNA, 25 bp, Mus musculus
atgcccatctaccaatgaatgctga

SEQ ID NO: 259536 - DNA, 25 bp, Mus musculus
atgcccatctacgaatgaatgctga

SEQ ID NO: 259537 - DNA, 25 bp, Mus musculus
atgcccatctgtccgagactttgat

SEQ ID NO: 259538 - DNA, 25 bp, Mus musculus
atgcccatctgtgcgagactttgat

SEQ ID NO: 259539 - DNA, 25 bp, Mus musculus
atgcccatctttcagtggcctacta

SEQ ID NO: 259540 - DNA, 25 bp, Mus musculus
atgcccatctttgagtggcctacta

SEQ ID NO: 259541 - DNA, 25 bp, Mus musculus
atgcccatgacacccagtacctttg

SEQ ID NO: 259542 - DNA, 25 bp, Mus musculus
atgcccatgacagccagtacctttg

SEQ ID NO: 259543 - DNA, 25 bp, Mus musculus
atgcccatgatgattgtccatagct

SEQ ID NO: 259544 - DNA, 25 bp, Mus musculus
atgcccatgatgtttgtccatagct

SEQ ID NO: 259545 - DNA, 25 bp, Mus musculus
atgcccatgccacacatattttgtg

SEQ ID NO: 259546 - DNA, 25 bp, Mus musculus
atgcccatgccagacatattttgtg

SEQ ID NO: 259547 - DNA, 25 bp, Mus musculus
atgcccatgctgatcaaggctacat

SEQ ID NO: 259548 - DNA, 25 bp, Mus musculus
atgcccatgctgttcaaggctacat

SEQ ID NO: 259549 - DNA, 25 bp, Mus musculus
atgcccatggcccagtagtacttag

SEQ ID NO: 259550 - DNA, 25 bp, Mus musculus
atgcccatggccgagtagtacttag

SEQ ID NO: 259551 - DNA, 25 bp, Mus musculus
atgcccatgggcaaatctgctggaa

SEQ ID NO: 259552 - DNA, 25 bp, Mus musculus
atgcccatgggctaatctgctggaa

SEQ ID NO: 259553 - DNA, 25 bp, Mus musculus
atgcccatggtcagatctctgatta

SEQ ID NO: 259554 - DNA, 25 bp, Mus musculus
atgcccatggtctgatctctgatta

SEQ ID NO: 259555 - DNA, 25 bp, Mus musculus
atgcccatgtcaattgttgctgttt

SEQ ID NO: 259556 - DNA, 25 bp, Mus musculus
atgcccatgtcatttgttgctgttt

SEQ ID NO: 259557 - DNA, 25 bp, Mus musculus
atgcccatgtccaacacatgttgtg

SEQ ID NO: 259558 - DNA, 25 bp, Mus musculus
atgcccatgtcctacacatgttgtg

SEQ ID NO: 259559 - DNA, 25 bp, Mus musculus
atgcccatgtctatcattgctatct

SEQ ID NO: 259560 - DNA, 25 bp, Mus musculus
atgcccatgtctttcattgctatct

SEQ ID NO: 259561 - DNA, 25 bp, Mus musculus
atgcccattaccactacttatgttt

SEQ ID NO: 259562 - DNA, 25 bp, Mus musculus
atgcccattacctctacttatgttt

SEQ ID NO: 259563 - DNA, 25 bp, Mus musculus
atgcccattcttattacatcacagc

SEQ ID NO: 259564 - DNA, 25 bp, Mus musculus
atgcccattctttttacatcacagc

SEQ ID NO: 259565 - DNA, 25 bp, Mus musculus
atgcccattggccaattctggaggg

SEQ ID NO: 259566 - DNA, 25 bp, Mus musculus
atgcccattggcgaattctggaggg

SEQ ID NO: 259567 - DNA, 25 bp, Mus musculus
atgcccattggtattgccagtcaaa

SEQ ID NO: 259568 - DNA, 25 bp, Mus musculus
atgcccattggttttgccagtcaaa

SEQ ID NO: 259569 - DNA, 25 bp, Mus musculus
atgcccattgtgagtgttcgaagct

SEQ ID NO: 259570 - DNA, 25 bp, Mus musculus
atgcccattgtgtgtgttcgaagct

SEQ ID NO: 259571 - DNA, 25 bp, Mus musculus
atgcccatttgcacagctgcccagg

SEQ ID NO: 259572 - DNA, 25 bp, Mus musculus
atgcccatttgcagaaggtaatcca

SEQ ID NO: 259573 - DNA, 25 bp, Mus musculus
atgcccatttgcctctttgttataa

SEQ ID NO: 259574 - DNA, 25 bp, Mus musculus
atgcccatttgcgtctttgttataa

SEQ ID NO: 259575 - DNA, 25 bp, Mus musculus
atgcccatttgctcagctgcccagg

SEQ ID NO: 259576 - DNA, 25 bp, Mus musculus
atgcccatttgctgaaggtaatcca

SEQ ID NO: 259577 - DNA, 25 bp, Mus musculus
atgcccattttgaggcaatgctgtg

SEQ ID NO: 259578 - DNA, 25 bp, Mus musculus
atgcccattttgatcccaagcctca

SEQ ID NO: 259579 - DNA, 25 bp, Mus musculus
atgcccattttgtggcaatgctgtg

SEQ ID NO: 259580 - DNA, 25 bp, Mus musculus
atgcccattttgttcccaagcctca

SEQ ID NO: 259581 - DNA, 25 bp, Mus musculus
atgccccaaaggatgtctacacgtt

SEQ ID NO: 259582 - DNA, 25 bp, Mus musculus
atgccccaaaggttgtctacacgtt

SEQ ID NO: 259583 - DNA, 25 bp, Mus musculus
atgccccaaataagctggctagcta

SEQ ID NO: 259584 - DNA, 25 bp, Mus musculus
atgccccaaatatgctggctagcta

SEQ ID NO: 259585 - DNA, 25 bp, Mus musculus
atgccccaacccaggcgggagaaag

SEQ ID NO: 259586 - DNA, 25 bp, Mus musculus
atgccccaaccctggcgggagaaag

SEQ ID NO: 259587 - DNA, 25 bp, Mus musculus
atgccccaatgtcggtcattccgga

SEQ ID NO: 259588 - DNA, 25 bp, Mus musculus
atgccccaatgtgggtcattccgga

SEQ ID NO: 259589 - DNA, 25 bp, Mus musculus
atgccccacaggatatcgaagacaa

SEQ ID NO: 259590 - DNA, 25 bp, Mus musculus
atgccccacaggttatcgaagacaa

SEQ ID NO: 259591 - DNA, 25 bp, Mus musculus
atgccccaccaacctgggattccat

SEQ ID NO: 259592 - DNA, 25 bp, Mus musculus
atgccccaccaagctgggattccat

SEQ ID NO: 259593 - DNA, 25 bp, Mus musculus
atgccccactggatttcggtgtgct

SEQ ID NO: 259594 - DNA, 25 bp, Mus musculus
atgccccactggttttcggtgtgct

SEQ ID NO: 259595 - DNA, 25 bp, Mus musculus
atgccccagcatcgtttaatacaga

SEQ ID NO: 259596 - DNA, 25 bp, Mus musculus
atgccccagcatggtttaatacaga

SEQ ID NO: 259597 - DNA, 25 bp, Mus musculus
atgccccagcctctactattgagat

SEQ ID NO: 259598 - DNA, 25 bp, Mus musculus
atgccccagcctgtactattgagat

SEQ ID NO: 259599 - DNA, 25 bp, Mus musculus
atgccccaggcaagttctcttagag

SEQ ID NO: 259600 - DNA, 25 bp, Mus musculus
atgccccaggcatgttctcttagag

SEQ ID NO: 259601 - DNA, 25 bp, Mus musculus
atgccccagtggaacctagacatgt

SEQ ID NO: 259602 - DNA, 25 bp, Mus musculus
atgccccagtggagttgttaatgaa

SEQ ID NO: 259603 - DNA, 25 bp, Mus musculus
atgccccagtggtacctagacatgt

SEQ ID NO: 259604 - DNA, 25 bp, Mus musculus
atgccccagtggtgttgttaatgaa

SEQ ID NO: 259605 - DNA, 25 bp, Mus musculus
atgccccagttaatgcctgtctata

SEQ ID NO: 259606 - DNA, 25 bp, Mus musculus
atgccccagttattgcctgtctata

SEQ ID NO: 259607 - DNA, 25 bp, Mus musculus
atgccccatactagtgtttcagttg

SEQ ID NO: 259608 - DNA, 25 bp, Mus musculus
atgccccatacttgtgtttcagttg

SEQ ID NO: 259609 - DNA, 25 bp, Mus musculus
atgccccatggcaggaggctcctga

SEQ ID NO: 259610 - DNA, 25 bp, Mus musculus
atgccccatggctggaggctcctga

SEQ ID NO: 259611 - DNA, 25 bp, Mus musculus
atgccccatgtgaattcagcttcaa

SEQ ID NO: 259612 - DNA, 25 bp, Mus musculus
atgccccatgtgtattcagcttcaa

SEQ ID NO: 259613 - DNA, 25 bp, Mus musculus
atgccccctcagaacatgcctgaag

SEQ ID NO: 259614 - DNA, 25 bp, Mus musculus
atgccccctcagtacatgcctgaag

SEQ ID NO: 259615 - DNA, 25 bp, Mus musculus
atgccccgaagtaccagggcaaggc

SEQ ID NO: 259616 - DNA, 25 bp, Mus musculus
atgccccgaagttccagggcaaggc

SEQ ID NO: 259617 - DNA, 25 bp, Mus musculus
atgccccgggagaagccggtcgcct

SEQ ID NO: 259618 - DNA, 25 bp, Mus musculus
atgccccgggagtagccggtcgcct

SEQ ID NO: 259619 - DNA, 25 bp, Mus musculus
atgccccggtatagcctgtttggaa

SEQ ID NO: 259620 - DNA, 25 bp, Mus musculus
atgccccggtattgcctgtttggaa

SEQ ID NO: 259621 - DNA, 25 bp, Mus musculus
atgccccgtgagcaactacacaaag

SEQ ID NO: 259622 - DNA, 25 bp, Mus musculus
atgccccgtgaggaactacacaaag

SEQ ID NO: 259623 - DNA, 25 bp, Mus musculus
atgccccgtttgagccagtgtttga

SEQ ID NO: 259624 - DNA, 25 bp, Mus musculus
atgccccgtttgtgccagtgtttga

SEQ ID NO: 259625 - DNA, 25 bp, Mus musculus
atgcccctacaactggagttgctga

SEQ ID NO: 259626 - DNA, 25 bp, Mus musculus
atgcccctacaagtggagttgctga

SEQ ID NO: 259627 - DNA, 25 bp, Mus musculus
atgcccctatgaacttactggttaa

SEQ ID NO: 259628 - DNA, 25 bp, Mus musculus
atgcccctatgatcttactggttaa

SEQ ID NO: 259629 - DNA, 25 bp, Mus musculus
atgcccctctaacggaccttattgt

SEQ ID NO: 259630 - DNA, 25 bp, Mus musculus
atgcccctctaagggaccttattgt

SEQ ID NO: 259631 - DNA, 25 bp, Mus musculus
atgcccctgagaagccaattcttga

SEQ ID NO: 259632 - DNA, 25 bp, Mus musculus
atgcccctgagatgccaattcttga

SEQ ID NO: 259633 - DNA, 25 bp, Mus musculus
atgcccctggccatgggatcatgta

SEQ ID NO: 259634 - DNA, 25 bp, Mus musculus
atgcccctggccttgggatcatgta

SEQ ID NO: 259635 - DNA, 25 bp, Mus musculus
atgcccctgggaacacttgtgtaaa

SEQ ID NO: 259636 - DNA, 25 bp, Mus musculus
atgcccctgggatcacttgtgtaaa

SEQ ID NO: 259637 - DNA, 25 bp, Mus musculus
atgcccctgtacatgtggacttgca

SEQ ID NO: 259638 - DNA, 25 bp, Mus musculus
atgcccctgtacttgtggacttgca

SEQ ID NO: 259639 - DNA, 25 bp, Mus musculus
atgccccttacccatcatcaggaga

SEQ ID NO: 259640 - DNA, 25 bp, Mus musculus
atgccccttaccgatcatcaggaga

SEQ ID NO: 259641 - DNA, 25 bp, Mus musculus
atgccccttatgcttgtgtgcatgt

SEQ ID NO: 259642 - DNA, 25 bp, Mus musculus
atgccccttatggttgtgtgcatgt

SEQ ID NO: 259643 - DNA, 25 bp, Mus musculus
atgccccttcgtctgtacaaggttg

SEQ ID NO: 259644 - DNA, 25 bp, Mus musculus
atgccccttcgtgtgtacaaggttg

SEQ ID NO: 259645 - DNA, 25 bp, Mus musculus
atgccccttgctcggtttggactga

SEQ ID NO: 259646 - DNA, 25 bp, Mus musculus
atgccccttgctgggtttggactga

SEQ ID NO: 259647 - DNA, 25 bp, Mus musculus
atgccccttggcattagtgtggcct

SEQ ID NO: 259648 - DNA, 25 bp, Mus musculus
atgccccttggctttagtgtggcct

SEQ ID NO: 259649 - DNA, 25 bp, Mus musculus
atgccccttgtccaagctgcataag

SEQ ID NO: 259650 - DNA, 25 bp, Mus musculus
atgccccttgtcgaagctgcataag

SEQ ID NO: 259651 - DNA, 25 bp, Mus musculus
atgccccttgtgaagtatactgaaa

SEQ ID NO: 259652 - DNA, 25 bp, Mus musculus
atgccccttgtgtagtatactgaaa

SEQ ID NO: 259653 - DNA, 25 bp, Mus musculus
atgccccttgttaacatgtactata

SEQ ID NO: 259654 - DNA, 25 bp, Mus musculus
atgccccttgtttacatgtactata

SEQ ID NO: 259655 - DNA, 25 bp, Mus musculus
atgcccctttaaacacagtttcagg

SEQ ID NO: 259656 - DNA, 25 bp, Mus musculus
atgcccctttaatcacagtttcagg

SEQ ID NO: 259657 - DNA, 25 bp, Mus musculus
atgcccctttataagacattacggc

SEQ ID NO: 259658 - DNA, 25 bp, Mus musculus
atgcccctttattagacattacggc

SEQ ID NO: 259659 - DNA, 25 bp, Mus musculus
atgcccctttgcaggccatctacaa

SEQ ID NO: 259660 - DNA, 25 bp, Mus musculus
atgcccctttgctggccatctacaa

SEQ ID NO: 259661 - DNA, 25 bp, Mus musculus
atgccccttttgcactgagttttca

SEQ ID NO: 259662 - DNA, 25 bp, Mus musculus
atgccccttttggactgagttttca

SEQ ID NO: 259663 - DNA, 25 bp, Mus musculus
atgcccgacgatcaagtgtgccaca

SEQ ID NO: 259664 - DNA, 25 bp, Mus musculus
atgcccgacgatgaagtgtgccaca

SEQ ID NO: 259665 - DNA, 25 bp, Mus musculus
atgcccgagagacatgtacgacctg

SEQ ID NO: 259666 - DNA, 25 bp, Mus musculus
atgcccgagagagatgtacgacctg

SEQ ID NO: 259667 - DNA, 25 bp, Mus musculus
atgcccgagatgcagttggtgccca

SEQ ID NO: 259668 - DNA, 25 bp, Mus musculus
atgcccgagatggagttggtgccca

SEQ ID NO: 259669 - DNA, 25 bp, Mus musculus
atgcccgagcccctgtgaaatatga

SEQ ID NO: 259670 - DNA, 25 bp, Mus musculus
atgcccgagcccgtgtgaaatatga

SEQ ID NO: 259671 - DNA, 25 bp, Mus musculus
atgcccgaggccctaatgcatgtgt

SEQ ID NO: 259672 - DNA, 25 bp, Mus musculus
atgcccgaggccgtaatgcatgtgt

SEQ ID NO: 259673 - DNA, 25 bp, Mus musculus
atgcccgagggcacattctcaagac

SEQ ID NO: 259674 - DNA, 25 bp, Mus musculus
atgcccgagggctcattctcaagac

SEQ ID NO: 259675 - DNA, 25 bp, Mus musculus
atgcccgatttgaagcttcctactt

SEQ ID NO: 259676 - DNA, 25 bp, Mus musculus
atgcccgatttgtagcttcctactt

SEQ ID NO: 259677 - DNA, 25 bp, Mus musculus
atgcccgccatgatcttttagtttt

SEQ ID NO: 259678 - DNA, 25 bp, Mus musculus
atgcccgccatgttcttttagtttt

SEQ ID NO: 259679 - DNA, 25 bp, Mus musculus
atgcccgcctctctagtttggaaga

SEQ ID NO: 259680 - DNA, 25 bp, Mus musculus
atgcccgcctctgtagtttggaaga

SEQ ID NO: 259681 - DNA, 25 bp, Mus musculus
atgcccgcctgaaggctttgcagga

SEQ ID NO: 259682 - DNA, 25 bp, Mus musculus
atgcccgcctgatggctttgcagga

SEQ ID NO: 259683 - DNA, 25 bp, Mus musculus
atgcccgcggccagcaagatgaaaa

SEQ ID NO: 259684 - DNA, 25 bp, Mus musculus
atgcccgcggcctgcaagatgaaaa

SEQ ID NO: 259685 - DNA, 25 bp, Mus musculus
atgcccgctaccatggatgaggtgc

SEQ ID NO: 259686 - DNA, 25 bp, Mus musculus
atgcccgctaccttggatgaggtgc

SEQ ID NO: 259687 - DNA, 25 bp, Mus musculus
atgcccgctgagaggtagggtcaac

SEQ ID NO: 259688 - DNA, 25 bp, Mus musculus
atgcccgctgagtggtagggtcaac

SEQ ID NO: 259689 - DNA, 25 bp, Mus musculus
atgcccgctgggatccggatcagaa

SEQ ID NO: 259690 - DNA, 25 bp, Mus musculus
atgcccgctgggttccggatcagaa

SEQ ID NO: 259691 - DNA, 25 bp, Mus musculus
atgcccgcttggattctggagttat

SEQ ID NO: 259692 - DNA, 25 bp, Mus musculus
atgcccgcttggtttctggagttat

SEQ ID NO: 259693 - DNA, 25 bp, Mus musculus
atgcccggaagtccttgggccgctt

SEQ ID NO: 259694 - DNA, 25 bp, Mus musculus
atgcccggaagtgcttgggccgctt

SEQ ID NO: 259695 - DNA, 25 bp, Mus musculus
atgcccggcagaaggttgttgtcac

SEQ ID NO: 259696 - DNA, 25 bp, Mus musculus
atgcccggcagatggttgttgtcac

SEQ ID NO: 259697 - DNA, 25 bp, Mus musculus
atgcccggcaggagcagacacacga

SEQ ID NO: 259698 - DNA, 25 bp, Mus musculus
atgcccggcaggatgcacagtgcat

SEQ ID NO: 259699 - DNA, 25 bp, Mus musculus
atgcccggcaggtgcagacacacga

SEQ ID NO: 259700 - DNA, 25 bp, Mus musculus
atgcccggcaggttgcacagtgcat

SEQ ID NO: 259701 - DNA, 25 bp, Mus musculus
atgcccggcctcacaatgtaggatg

SEQ ID NO: 259702 - DNA, 25 bp, Mus musculus
atgcccggcctctcaatgtaggatg

SEQ ID NO: 259703 - DNA, 25 bp, Mus musculus
atgcccggcgctctaacatgtcagg

SEQ ID NO: 259704 - DNA, 25 bp, Mus musculus
atgcccggcgctgtaacatgtcagg

SEQ ID NO: 259705 - DNA, 25 bp, Mus musculus
atgcccggctcaacaaggagttttg

SEQ ID NO: 259706 - DNA, 25 bp, Mus musculus
atgcccggctcatcaaggagttttg

SEQ ID NO: 259707 - DNA, 25 bp, Mus musculus
atgcccggctgacaattttctgata

SEQ ID NO: 259708 - DNA, 25 bp, Mus musculus
atgcccggctgagaattttctgata

SEQ ID NO: 259709 - DNA, 25 bp, Mus musculus
atgcccggctgcacttgagtctggg

SEQ ID NO: 259710 - DNA, 25 bp, Mus musculus
atgcccggctgctcttgagtctggg

SEQ ID NO: 259711 - DNA, 25 bp, Mus musculus
atgcccgggaatcgctgtactaact

SEQ ID NO: 259712 - DNA, 25 bp, Mus musculus
atgcccgggaatggctgtactaact

SEQ ID NO: 259713 - DNA, 25 bp, Mus musculus
atgcccgggactaagcactttttct

SEQ ID NO: 259714 - DNA, 25 bp, Mus musculus
atgcccgggacttagcactttttct

SEQ ID NO: 259715 - DNA, 25 bp, Mus musculus
atgcccgggcgacgaccgaagcaca

SEQ ID NO: 259716 - DNA, 25 bp, Mus musculus
atgcccgggcgaggaccgaagcaca

SEQ ID NO: 259717 - DNA, 25 bp, Mus musculus
atgcccgggttactgcctatgtaaa

SEQ ID NO: 259718 - DNA, 25 bp, Mus musculus
atgcccgggttagtgcctatgtaaa

SEQ ID NO: 259719 - DNA, 25 bp, Mus musculus
atgcccgtagttcgaagtcttttgc

SEQ ID NO: 259720 - DNA, 25 bp, Mus musculus
atgcccgtagttggaagtcttttgc

SEQ ID NO: 259721 - DNA, 25 bp, Mus musculus
atgcccgtcaccagaatggtgccat

SEQ ID NO: 259722 - DNA, 25 bp, Mus musculus
atgcccgtcacctgaatggtgccat

SEQ ID NO: 259723 - DNA, 25 bp, Mus musculus
atgcccgtcatgcatacctagctat

SEQ ID NO: 259724 - DNA, 25 bp, Mus musculus
atgcccgtcatggatacctagctat

SEQ ID NO: 259725 - DNA, 25 bp, Mus musculus
atgcccgtctgtctgtgcggcactt

SEQ ID NO: 259726 - DNA, 25 bp, Mus musculus
atgcccgtctgtgtgtgcggcactt

SEQ ID NO: 259727 - DNA, 25 bp, Mus musculus
atgcccgtgagcctgtcattggagc

SEQ ID NO: 259728 - DNA, 25 bp, Mus musculus
atgcccgtgagcgtgtcattggagc

SEQ ID NO: 259729 - DNA, 25 bp, Mus musculus
atgcccgtggagcaacctgcaatgt

SEQ ID NO: 259730 - DNA, 25 bp, Mus musculus
atgcccgtggaggaacctgcaatgt

SEQ ID NO: 259731 - DNA, 25 bp, Mus musculus
atgcccgtggtgcagccaggcctac

SEQ ID NO: 259732 - DNA, 25 bp, Mus musculus
atgcccgtggtggagccaggcctac

SEQ ID NO: 259733 - DNA, 25 bp, Mus musculus
atgcccgtgtagacatagtgtactc

SEQ ID NO: 259734 - DNA, 25 bp, Mus musculus
atgcccgtgtagtcatagtgtactc

SEQ ID NO: 259735 - DNA, 25 bp, Mus musculus
atgcccgtgtggcttacatggcccc

SEQ ID NO: 259736 - DNA, 25 bp, Mus musculus
atgcccgtgtgggttacatggcccc

SEQ ID NO: 259737 - DNA, 25 bp, Mus musculus
atgcccgtgtgtcttgtgtataatt

SEQ ID NO: 259738 - DNA, 25 bp, Mus musculus
atgcccgtgtgtgttgtgtataatt

SEQ ID NO: 259739 - DNA, 25 bp, Mus musculus
atgcccgttgaaaatatgcctgccc

SEQ ID NO: 259740 - DNA, 25 bp, Mus musculus
atgcccgttgaatatatgcctgccc

SEQ ID NO: 259741 - DNA, 25 bp, Mus musculus
atgccctaaaccactatcaagagaa

SEQ ID NO: 259742 - DNA, 25 bp, Mus musculus
atgccctaaacctctatcaagagaa

SEQ ID NO: 259743 - DNA, 25 bp, Mus musculus
atgccctacacaactatctgggtgc

SEQ ID NO: 259744 - DNA, 25 bp, Mus musculus
atgccctacacatctatctgggtgc

SEQ ID NO: 259745 - DNA, 25 bp, Mus musculus
atgccctactccctgtgggtgaaaa

SEQ ID NO: 259746 - DNA, 25 bp, Mus musculus
atgccctactccgtgtgggtgaaaa

SEQ ID NO: 259747 - DNA, 25 bp, Mus musculus
atgccctacttgagagtgtcccttg

SEQ ID NO: 259748 - DNA, 25 bp, Mus musculus
atgccctacttgtgagtgtcccttg

SEQ ID NO: 259749 - DNA, 25 bp, Mus musculus
atgccctagagaagtgtcatctgaa

SEQ ID NO: 259750 - DNA, 25 bp, Mus musculus
atgccctagagatgtgtcatctgaa

SEQ ID NO: 259751 - DNA, 25 bp, Mus musculus
atgccctaggcacttactcctgtaa

SEQ ID NO: 259752 - DNA, 25 bp, Mus musculus
atgccctaggcagttactcctgtaa

SEQ ID NO: 259753 - DNA, 25 bp, Mus musculus
atgccctaggctcagtcccttgaaa

SEQ ID NO: 259754 - DNA, 25 bp, Mus musculus
atgccctaggctgagtcccttgaaa

SEQ ID NO: 259755 - DNA, 25 bp, Mus musculus
atgccctatctgaaccatgagtgtc

SEQ ID NO: 259756 - DNA, 25 bp, Mus musculus
atgccctatctgtaccatgagtgtc

SEQ ID NO: 259757 - DNA, 25 bp, Mus musculus
atgccctcaacgaagccaaacagat

SEQ ID NO: 259758 - DNA, 25 bp, Mus musculus
atgccctcaacgtagccaaacagat

SEQ ID NO: 259759 - DNA, 25 bp, Mus musculus
atgccctcaactctcatgctgtgct

SEQ ID NO: 259760 - DNA, 25 bp, Mus musculus
atgccctcaactgtcatgctgtgct

SEQ ID NO: 259761 - DNA, 25 bp, Mus musculus
atgccctcagctctggtcaggtgac

SEQ ID NO: 259762 - DNA, 25 bp, Mus musculus
atgccctcagctgtggtcaggtgac

SEQ ID NO: 259763 - DNA, 25 bp, Mus musculus
atgccctcaggaaagcactggctat

SEQ ID NO: 259764 - DNA, 25 bp, Mus musculus
atgccctcaggaaaggtgaccccaa

SEQ ID NO: 259765 - DNA, 25 bp, Mus musculus
atgccctcaggatagcactggctat

SEQ ID NO: 259766 - DNA, 25 bp, Mus musculus
atgccctcaggataggtgaccccaa

SEQ ID NO: 259767 - DNA, 25 bp, Mus musculus
atgccctcatacaccctagaggagg

SEQ ID NO: 259768 - DNA, 25 bp, Mus musculus
atgccctcatactccctagaggagg

SEQ ID NO: 259769 - DNA, 25 bp, Mus musculus
atgccctcattaaagcagctggtgt

SEQ ID NO: 259770 - DNA, 25 bp, Mus musculus
atgccctcattatagcagctggtgt

SEQ ID NO: 259771 - DNA, 25 bp, Mus musculus
atgccctccatcatactgaagctaa

SEQ ID NO: 259772 - DNA, 25 bp, Mus musculus
atgccctccatcttactgaagctaa

SEQ ID NO: 259773 - DNA, 25 bp, Mus musculus
atgccctccattcagccctaaggga

SEQ ID NO: 259774 - DNA, 25 bp, Mus musculus
atgccctccattgagccctaaggga

SEQ ID NO: 259775 - DNA, 25 bp, Mus musculus
atgccctccctactgtgtagttgaa

SEQ ID NO: 259776 - DNA, 25 bp, Mus musculus
atgccctccctagtgtgtagttgaa

SEQ ID NO: 259777 - DNA, 25 bp, Mus musculus
atgccctctagaactttgccgaaaa

SEQ ID NO: 259778 - DNA, 25 bp, Mus musculus
atgccctctagatctttgccgaaaa

SEQ ID NO: 259779 - DNA, 25 bp, Mus musculus
atgccctctgagaaatcttggattt

SEQ ID NO: 259780 - DNA, 25 bp, Mus musculus
atgccctctgagtaatcttggattt

SEQ ID NO: 259781 - DNA, 25 bp, Mus musculus
atgccctctgctctttgtattctca

SEQ ID NO: 259782 - DNA, 25 bp, Mus musculus
atgccctctgctgtttgtattctca

SEQ ID NO: 259783 - DNA, 25 bp, Mus musculus
atgccctctggtcctttcagtaagg

SEQ ID NO: 259784 - DNA, 25 bp, Mus musculus
atgccctctggtgctttcagtaagg

SEQ ID NO: 259785 - DNA, 25 bp, Mus musculus
atgccctctgttcgccaatgacaat

SEQ ID NO: 259786 - DNA, 25 bp, Mus musculus
atgccctctgttggccaatgacaat

SEQ ID NO: 259787 - DNA, 25 bp, Mus musculus
atgccctctttccttgcaaagtttg

SEQ ID NO: 259788 - DNA, 25 bp, Mus musculus
atgccctctttcgttgcaaagtttg

SEQ ID NO: 259789 - DNA, 25 bp, Mus musculus
atgccctgagagaggctgactcctg

SEQ ID NO: 259790 - DNA, 25 bp, Mus musculus
atgccctgagagtggctgactcctg

SEQ ID NO: 259791 - DNA, 25 bp, Mus musculus
atgccctgatgacgaaaatccaaac

SEQ ID NO: 259792 - DNA, 25 bp, Mus musculus
atgccctgatgaggaaaatccaaac

SEQ ID NO: 259793 - DNA, 25 bp, Mus musculus
atgccctgcatcagctcagtgtgcc

SEQ ID NO: 259794 - DNA, 25 bp, Mus musculus
atgccctgcatccagagacagtttg

SEQ ID NO: 259795 - DNA, 25 bp, Mus musculus
atgccctgcatcgagagacagtttg

SEQ ID NO: 259796 - DNA, 25 bp, Mus musculus
atgccctgcatctgctcagtgtgcc

SEQ ID NO: 259797 - DNA, 25 bp, Mus musculus
atgccctgccctacttgatgcaaaa

SEQ ID NO: 259798 - DNA, 25 bp, Mus musculus
atgccctgcccttcttgatgcaaaa

SEQ ID NO: 259799 - DNA, 25 bp, Mus musculus
atgccctgctacacagtgacaacac

SEQ ID NO: 259800 - DNA, 25 bp, Mus musculus
atgccctgctactcagtgacaacac

SEQ ID NO: 259801 - DNA, 25 bp, Mus musculus
atgccctgcttcagagggtactctg

SEQ ID NO: 259802 - DNA, 25 bp, Mus musculus
atgccctgcttctgagggtactctg

SEQ ID NO: 259803 - DNA, 25 bp, Mus musculus
atgccctggctcaagggaattccta

SEQ ID NO: 259804 - DNA, 25 bp, Mus musculus
atgccctggctctagggaattccta

SEQ ID NO: 259805 - DNA, 25 bp, Mus musculus
atgccctggtatactacacatttat

SEQ ID NO: 259806 - DNA, 25 bp, Mus musculus
atgccctggtattctacacatttat

SEQ ID NO: 259807 - DNA, 25 bp, Mus musculus
atgccctggtctcggtgatttcgaa

SEQ ID NO: 259808 - DNA, 25 bp, Mus musculus
atgccctggtctgggtgatttcgaa

SEQ ID NO: 259809 - DNA, 25 bp, Mus musculus
atgccctggtgtattgtctggatcc

SEQ ID NO: 259810 - DNA, 25 bp, Mus musculus
atgccctggtgttttgtctggatcc

SEQ ID NO: 259811 - DNA, 25 bp, Mus musculus
atgccctgtcttcctcaatgataca

SEQ ID NO: 259812 - DNA, 25 bp, Mus musculus
atgccctgtcttgctcaatgataca

SEQ ID NO: 259813 - DNA, 25 bp, Mus musculus
atgccctgtgaaagtcgaaaccttt

SEQ ID NO: 259814 - DNA, 25 bp, Mus musculus
atgccctgtgaatgtcgaaaccttt

SEQ ID NO: 259815 - DNA, 25 bp, Mus musculus
atgccctgtgtgacggagtcatgaa

SEQ ID NO: 259816 - DNA, 25 bp, Mus musculus
atgccctgtgtgtcggagtcatgaa

SEQ ID NO: 259817 - DNA, 25 bp, Mus musculus
atgcccttatctctccttacaggta

SEQ ID NO: 259818 - DNA, 25 bp, Mus musculus
atgcccttatctgtccttacaggta

SEQ ID NO: 259819 - DNA, 25 bp, Mus musculus
atgcccttatttattcctaggatga

SEQ ID NO: 259820 - DNA, 25 bp, Mus musculus
atgcccttattttttcctaggatga

SEQ ID NO: 259821 - DNA, 25 bp, Mus musculus
atgcccttcaaaagcatgcagctca

SEQ ID NO: 259822 - DNA, 25 bp, Mus musculus
atgcccttcaaatgcatgcagctca

SEQ ID NO: 259823 - DNA, 25 bp, Mus musculus
atgcccttcactaccgtatcagaac

SEQ ID NO: 259824 - DNA, 25 bp, Mus musculus
atgcccttcacttccgtatcagaac

SEQ ID NO: 259825 - DNA, 25 bp, Mus musculus
atgcccttcatcacaggtctcagag

SEQ ID NO: 259826 - DNA, 25 bp, Mus musculus
atgcccttcatcctttggagttgaa

SEQ ID NO: 259827 - DNA, 25 bp, Mus musculus
atgcccttcatcgtttggagttgaa

SEQ ID NO: 259828 - DNA, 25 bp, Mus musculus
atgcccttcatctcaggtctcagag

SEQ ID NO: 259829 - DNA, 25 bp, Mus musculus
atgcccttcctacatggtttcttct

SEQ ID NO: 259830 - DNA, 25 bp, Mus musculus
atgcccttcctagatggtttcttct

SEQ ID NO: 259831 - DNA, 25 bp, Mus musculus
atgcccttcctcatttggaacagaa

SEQ ID NO: 259832 - DNA, 25 bp, Mus musculus
atgcccttcctcttttggaacagaa

SEQ ID NO: 259833 - DNA, 25 bp, Mus musculus
atgcccttcctgcaatatgtggctt

SEQ ID NO: 259834 - DNA, 25 bp, Mus musculus
atgcccttcctggaatatgtggctt

SEQ ID NO: 259835 - DNA, 25 bp, Mus musculus
atgcccttcgaccactcggacattg

SEQ ID NO: 259836 - DNA, 25 bp, Mus musculus
atgcccttcgacgactcggacattg

SEQ ID NO: 259837 - DNA, 25 bp, Mus musculus
atgcccttgaaaaaggagactccaa

SEQ ID NO: 259838 - DNA, 25 bp, Mus musculus
atgcccttgaaataggagactccaa

SEQ ID NO: 259839 - DNA, 25 bp, Mus musculus
atgcccttgaacattctgagccaga

SEQ ID NO: 259840 - DNA, 25 bp, Mus musculus
atgcccttgaactttctgagccaga

SEQ ID NO: 259841 - DNA, 25 bp, Mus musculus
atgcccttgaagcaaaccacgtcca

SEQ ID NO: 259842 - DNA, 25 bp, Mus musculus
atgcccttgaaggaaaccacgtcca

SEQ ID NO: 259843 - DNA, 25 bp, Mus musculus
atgcccttgcctcgtaatgtcatcc

SEQ ID NO: 259844 - DNA, 25 bp, Mus musculus
atgcccttgcctggtaatgtcatcc

SEQ ID NO: 259845 - DNA, 25 bp, Mus musculus
atgcccttggcaagtgctatgtaag

SEQ ID NO: 259846 - DNA, 25 bp, Mus musculus
atgcccttggcatgtgctatgtaag

SEQ ID NO: 259847 - DNA, 25 bp, Mus musculus
atgcccttgggaatcctgcgagata

SEQ ID NO: 259848 - DNA, 25 bp, Mus musculus
atgcccttgggattcctgcgagata

SEQ ID NO: 259849 - DNA, 25 bp, Mus musculus
atgccctttactctgcttttgcact

SEQ ID NO: 259850 - DNA, 25 bp, Mus musculus
atgccctttactgtgcttttgcact

SEQ ID NO: 259851 - DNA, 25 bp, Mus musculus
atgccctttctaagggtcagataaa

SEQ ID NO: 259852 - DNA, 25 bp, Mus musculus
atgccctttctatgggtcagataaa

SEQ ID NO: 259853 - DNA, 25 bp, Mus musculus
atgccctttctcctcaatcagagtg

SEQ ID NO: 259854 - DNA, 25 bp, Mus musculus
atgccctttctcgtcaatcagagtg

SEQ ID NO: 259855 - DNA, 25 bp, Mus musculus
atgccctttgacatttttcttccaa

SEQ ID NO: 259856 - DNA, 25 bp, Mus musculus
atgccctttgacttttttcttccaa

SEQ ID NO: 259857 - DNA, 25 bp, Mus musculus
atgccctttggactacttactggct

SEQ ID NO: 259858 - DNA, 25 bp, Mus musculus
atgccctttggagtacttactggct

SEQ ID NO: 259859 - DNA, 25 bp, Mus musculus
atgccgaatgtgatcccgaggagat

SEQ ID NO: 259860 - DNA, 25 bp, Mus musculus
atgccgaatgtgttcccgaggagat

SEQ ID NO: 259861 - DNA, 25 bp, Mus musculus
atgccgacaacaaccgtggtacttt

SEQ ID NO: 259862 - DNA, 25 bp, Mus musculus
atgccgacaacatccgtggtacttt

SEQ ID NO: 259863 - DNA, 25 bp, Mus musculus
atgccgacagggagactaaggttct

SEQ ID NO: 259864 - DNA, 25 bp, Mus musculus
atgccgacagggtgactaaggttct

SEQ ID NO: 259865 - DNA, 25 bp, Mus musculus
atgccgagcagaagacagtctcctc

SEQ ID NO: 259866 - DNA, 25 bp, Mus musculus
atgccgagcagatgacagtctcctc

SEQ ID NO: 259867 - DNA, 25 bp, Mus musculus
atgccgagctgtcccagcctggatg

SEQ ID NO: 259868 - DNA, 25 bp, Mus musculus
atgccgagctgtctgtttagtgcaa

SEQ ID NO: 259869 - DNA, 25 bp, Mus musculus
atgccgagctgtgccagcctggatg

SEQ ID NO: 259870 - DNA, 25 bp, Mus musculus
atgccgagctgtgtgtttagtgcaa

SEQ ID NO: 259871 - DNA, 25 bp, Mus musculus
atgccgatctggaagaccccatagc

SEQ ID NO: 259872 - DNA, 25 bp, Mus musculus
atgccgatctggtagaccccatagc

SEQ ID NO: 259873 - DNA, 25 bp, Mus musculus
atgccgattgatactgcaccacact

SEQ ID NO: 259874 - DNA, 25 bp, Mus musculus
atgccgattgattctgcaccacact

SEQ ID NO: 259875 - DNA, 25 bp, Mus musculus
atgccgattgtcagctttgaccctc

SEQ ID NO: 259876 - DNA, 25 bp, Mus musculus
atgccgattgtctgctttgaccctc

SEQ ID NO: 259877 - DNA, 25 bp, Mus musculus
atgccgatttgactgctgctattta

SEQ ID NO: 259878 - DNA, 25 bp, Mus musculus
atgccgatttgagtgctgctattta

SEQ ID NO: 259879 - DNA, 25 bp, Mus musculus
atgccgcaaccacactcaaggtgag

SEQ ID NO: 259880 - DNA, 25 bp, Mus musculus
atgccgcaaccagactcaaggtgag

SEQ ID NO: 259881 - DNA, 25 bp, Mus musculus
atgccgcaagtcaattctttcctaa

SEQ ID NO: 259882 - DNA, 25 bp, Mus musculus
atgccgcaagtctattctttcctaa

SEQ ID NO: 259883 - DNA, 25 bp, Mus musculus
atgccgcacgagacaacggtggaac

SEQ ID NO: 259884 - DNA, 25 bp, Mus musculus
atgccgcacgagtcaacggtggaac

SEQ ID NO: 259885 - DNA, 25 bp, Mus musculus
atgccgcactcaacatggtggacaa

SEQ ID NO: 259886 - DNA, 25 bp, Mus musculus
atgccgcactcatcatggtggacaa

SEQ ID NO: 259887 - DNA, 25 bp, Mus musculus
atgccgcagggcaattcgggcgtct

SEQ ID NO: 259888 - DNA, 25 bp, Mus musculus
atgccgcagggctattcgggcgtct

SEQ ID NO: 259889 - DNA, 25 bp, Mus musculus
atgccgcagtatcttcttagcctag

SEQ ID NO: 259890 - DNA, 25 bp, Mus musculus
atgccgcagtatgttcttagcctag

SEQ ID NO: 259891 - DNA, 25 bp, Mus musculus
atgccgcccaagatggttgctaatc

SEQ ID NO: 259892 - DNA, 25 bp, Mus musculus
atgccgcccaagttggttgctaatc

SEQ ID NO: 259893 - DNA, 25 bp, Mus musculus
atgccgccctccatgagctggtgag

SEQ ID NO: 259894 - DNA, 25 bp, Mus musculus
atgccgccctccttgagctggtgag

SEQ ID NO: 259895 - DNA, 25 bp, Mus musculus
atgccgccgatgacgaagatggcca

SEQ ID NO: 259896 - DNA, 25 bp, Mus musculus
atgccgccgatgtcgaagatggcca

SEQ ID NO: 259897 - DNA, 25 bp, Mus musculus
atgccgcctgtgacgtgcagaaagt

SEQ ID NO: 259898 - DNA, 25 bp, Mus musculus
atgccgcctgtgtcgtgcagaaagt

SEQ ID NO: 259899 - DNA, 25 bp, Mus musculus
atgccgcgcacgacactagcgtgag

SEQ ID NO: 259900 - DNA, 25 bp, Mus musculus
atgccgcgcacgtcactagcgtgag

SEQ ID NO: 259901 - DNA, 25 bp, Mus musculus
atgccgcggcaaaatttagactttc

SEQ ID NO: 259902 - DNA, 25 bp, Mus musculus
atgccgcggcaatatttagactttc

SEQ ID NO: 259903 - DNA, 25 bp, Mus musculus
atgccgcgggtgaccgaaatatcga

SEQ ID NO: 259904 - DNA, 25 bp, Mus musculus
atgccgcgggtgtccgaaatatcga

SEQ ID NO: 259905 - DNA, 25 bp, Mus musculus
atgccgctagcaaagaccagtctta

SEQ ID NO: 259906 - DNA, 25 bp, Mus musculus
atgccgctagcatagaccagtctta

SEQ ID NO: 259907 - DNA, 25 bp, Mus musculus
atgccgctcacacgggcctcacggg

SEQ ID NO: 259908 - DNA, 25 bp, Mus musculus
atgccgctcacaggggcctcacggg

SEQ ID NO: 259909 - DNA, 25 bp, Mus musculus
atgccgctccatctagctggtcgaa

SEQ ID NO: 259910 - DNA, 25 bp, Mus musculus
atgccgctccatgtagctggtcgaa

SEQ ID NO: 259911 - DNA, 25 bp, Mus musculus
atgccgctgcatactttgagagtcc

SEQ ID NO: 259912 - DNA, 25 bp, Mus musculus
atgccgctgcattctttgagagtcc

SEQ ID NO: 259913 - DNA, 25 bp, Mus musculus
atgccgctggaaccttgccatggtt

SEQ ID NO: 259914 - DNA, 25 bp, Mus musculus
atgccgctggaagcttgccatggtt

SEQ ID NO: 259915 - DNA, 25 bp, Mus musculus
atgccgctggctaccagaagatcta

SEQ ID NO: 259916 - DNA, 25 bp, Mus musculus
atgccgctggcttccagaagatcta

SEQ ID NO: 259917 - DNA, 25 bp, Mus musculus
atgccgctgttgctcattgatggaa

SEQ ID NO: 259918 - DNA, 25 bp, Mus musculus
atgccgctgttggtcattgatggaa

SEQ ID NO: 259919 - DNA, 25 bp, Mus musculus
atgccggaaagacaattctgcactg

SEQ ID NO: 259920 - DNA, 25 bp, Mus musculus
atgccggaaagagaattctgcactg

SEQ ID NO: 259921 - DNA, 25 bp, Mus musculus
atgccggaaagcattctcccgtaat

SEQ ID NO: 259922 - DNA, 25 bp, Mus musculus
atgccggaaagctttctcccgtaat

SEQ ID NO: 259923 - DNA, 25 bp, Mus musculus
atgccggacaaaacatcctgcagga

SEQ ID NO: 259924 - DNA, 25 bp, Mus musculus
atgccggacaaatcatcctgcagga

SEQ ID NO: 259925 - DNA, 25 bp, Mus musculus
atgccggatcccattgatgattgct

SEQ ID NO: 259926 - DNA, 25 bp, Mus musculus
atgccggatccctttgatgattgct

SEQ ID NO: 259927 - DNA, 25 bp, Mus musculus
atgccggatctcaggttttggctcc

SEQ ID NO: 259928 - DNA, 25 bp, Mus musculus
atgccggatctctggttttggctcc

SEQ ID NO: 259929 - DNA, 25 bp, Mus musculus
atgccggcatatacagcagctgtca

SEQ ID NO: 259930 - DNA, 25 bp, Mus musculus
atgccggcatattcagcagctgtca

SEQ ID NO: 259931 - DNA, 25 bp, Mus musculus
atgccggccactccagggaggaaaa

SEQ ID NO: 259932 - DNA, 25 bp, Mus musculus
atgccggccactgcagggaggaaaa

SEQ ID NO: 259933 - DNA, 25 bp, Mus musculus
atgccggctctgacgtcacaggagt

SEQ ID NO: 259934 - DNA, 25 bp, Mus musculus
atgccggctctgtcgtcacaggagt

SEQ ID NO: 259935 - DNA, 25 bp, Mus musculus
atgccggggaggatgcgcaaaacca

SEQ ID NO: 259936 - DNA, 25 bp, Mus musculus
atgccggggaggttgcgcaaaacca

SEQ ID NO: 259937 - DNA, 25 bp, Mus musculus
atgccgggggacagacctaagggtg

SEQ ID NO: 259938 - DNA, 25 bp, Mus musculus
atgccgggggactgacctaagggtg

SEQ ID NO: 259939 - DNA, 25 bp, Mus musculus
atgccgggtgctcaacattgtcaat

SEQ ID NO: 259940 - DNA, 25 bp, Mus musculus
atgccgggtgctgaacattgtcaat

SEQ ID NO: 259941 - DNA, 25 bp, Mus musculus
atgccgggtgtcaggcatttctggc

SEQ ID NO: 259942 - DNA, 25 bp, Mus musculus
atgccgggtgtctggcatttctggc

SEQ ID NO: 259943 - DNA, 25 bp, Mus musculus
atgccggtacccatctttaactgct

SEQ ID NO: 259944 - DNA, 25 bp, Mus musculus
atgccggtacccttctttaactgct

SEQ ID NO: 259945 - DNA, 25 bp, Mus musculus
atgccggtcttgaacttacaatctg

SEQ ID NO: 259946 - DNA, 25 bp, Mus musculus
atgccggtcttgtacttacaatctg

SEQ ID NO: 259947 - DNA, 25 bp, Mus musculus
atgccggtgaacctgcaaaacaggc

SEQ ID NO: 259948 - DNA, 25 bp, Mus musculus
atgccggtgaacgtgcaaaacaggc

SEQ ID NO: 259949 - DNA, 25 bp, Mus musculus
atgccggtgaagcacatctatttcc

SEQ ID NO: 259950 - DNA, 25 bp, Mus musculus
atgccggtgaaggacatctatttcc

SEQ ID NO: 259951 - DNA, 25 bp, Mus musculus
atgccggtgtccactcaccttgggt

SEQ ID NO: 259952 - DNA, 25 bp, Mus musculus
atgccggtgtcctctcaccttgggt

SEQ ID NO: 259953 - DNA, 25 bp, Mus musculus
atgccggttactcaagagctctgtt

SEQ ID NO: 259954 - DNA, 25 bp, Mus musculus
atgccggttactgaagagctctgtt

SEQ ID NO: 259955 - DNA, 25 bp, Mus musculus
atgccggttctgacactcttgtaga

SEQ ID NO: 259956 - DNA, 25 bp, Mus musculus
atgccggttctgtcactcttgtaga

SEQ ID NO: 259957 - DNA, 25 bp, Mus musculus
atgccgtctggaagcgctccaggag

SEQ ID NO: 259958 - DNA, 25 bp, Mus musculus
atgccgtctggatgcgctccaggag

SEQ ID NO: 259959 - DNA, 25 bp, Mus musculus
atgccgtcttgcaagacaacttctg

SEQ ID NO: 259960 - DNA, 25 bp, Mus musculus
atgccgtcttgctagacaacttctg

SEQ ID NO: 259961 - DNA, 25 bp, Mus musculus
atgccgtgcagcagaagccctcgtc

SEQ ID NO: 259962 - DNA, 25 bp, Mus musculus
atgccgtgcagctgaagccctcgtc

SEQ ID NO: 259963 - DNA, 25 bp, Mus musculus
atgccgtgccatatgctagagacca

SEQ ID NO: 259964 - DNA, 25 bp, Mus musculus
atgccgtgccatttgctagagacca

SEQ ID NO: 259965 - DNA, 25 bp, Mus musculus
atgccgtgcccgaggtaaaatacga

SEQ ID NO: 259966 - DNA, 25 bp, Mus musculus
atgccgtgcccgtggtaaaatacga

SEQ ID NO: 259967 - DNA, 25 bp, Mus musculus
atgccgtggatcagaagggactgtc

SEQ ID NO: 259968 - DNA, 25 bp, Mus musculus
atgccgtggatctgaagggactgtc

SEQ ID NO: 259969 - DNA, 25 bp, Mus musculus
atgccgtgggcaacattgtcaacaa

SEQ ID NO: 259970 - DNA, 25 bp, Mus musculus
atgccgtgggcatcattgtcaacaa

SEQ ID NO: 259971 - DNA, 25 bp, Mus musculus
atgccgtgtccgagggcaccaaggc

SEQ ID NO: 259972 - DNA, 25 bp, Mus musculus
atgccgtgtccgtgggcaccaaggc

SEQ ID NO: 259973 - DNA, 25 bp, Mus musculus
atgccgttaggaagtctctgcaaac

SEQ ID NO: 259974 - DNA, 25 bp, Mus musculus
atgccgttaggatgtctctgcaaac

SEQ ID NO: 259975 - DNA, 25 bp, Mus musculus
atgccgttctacaggaggcctctga

SEQ ID NO: 259976 - DNA, 25 bp, Mus musculus
atgccgttctactggaggcctctga

SEQ ID NO: 259977 - DNA, 25 bp, Mus musculus
atgcctaaaaccacctgattcacag

SEQ ID NO: 259978 - DNA, 25 bp, Mus musculus
atgcctaaaacctcctgattcacag

SEQ ID NO: 259979 - DNA, 25 bp, Mus musculus
atgcctaaaatgatctactggcttt

SEQ ID NO: 259980 - DNA, 25 bp, Mus musculus
atgcctaaaatgttctactggcttt

SEQ ID NO: 259981 - DNA, 25 bp, Mus musculus
atgcctaaagataccgccgctaata

SEQ ID NO: 259982 - DNA, 25 bp, Mus musculus
atgcctaaagattccgccgctaata

SEQ ID NO: 259983 - DNA, 25 bp, Mus musculus
atgcctaaaggcatctagggtttaa

SEQ ID NO: 259984 - DNA, 25 bp, Mus musculus
atgcctaaaggcttctagggtttaa

SEQ ID NO: 259985 - DNA, 25 bp, Mus musculus
atgcctaaattacgatgctttttta

SEQ ID NO: 259986 - DNA, 25 bp, Mus musculus
atgcctaaattaggatgctttttta

SEQ ID NO: 259987 - DNA, 25 bp, Mus musculus
atgcctaacactagagcagctccag

SEQ ID NO: 259988 - DNA, 25 bp, Mus musculus
atgcctaacacttgagcagctccag

SEQ ID NO: 259989 - DNA, 25 bp, Mus musculus
atgcctaacgcaagctgactttcaa

SEQ ID NO: 259990 - DNA, 25 bp, Mus musculus
atgcctaacgcatgctgactttcaa

SEQ ID NO: 259991 - DNA, 25 bp, Mus musculus
atgcctaacttgctccaggctggga

SEQ ID NO: 259992 - DNA, 25 bp, Mus musculus
atgcctaacttggtccaggctggga

SEQ ID NO: 259993 - DNA, 25 bp, Mus musculus
atgcctaataggactttgtgcaagg

SEQ ID NO: 259994 - DNA, 25 bp, Mus musculus
atgcctaataggtctttgtgcaagg

SEQ ID NO: 259995 - DNA, 25 bp, Mus musculus
atgcctaatcatcatgcccttttaa

SEQ ID NO: 259996 - DNA, 25 bp, Mus musculus
atgcctaatcatgatgcccttttaa

SEQ ID NO: 259997 - DNA, 25 bp, Mus musculus
atgcctaatcttcgcctcacatagt

SEQ ID NO: 259998 - DNA, 25 bp, Mus musculus
atgcctaatcttggcctcacatagt

SEQ ID NO: 259999 - DNA, 25 bp, Mus musculus
atgcctaatttcaagaaagtgccag

SEQ ID NO: 260000 - DNA, 25 bp, Mus musculus
atgcctaatttctagaaagtgccag

SEQ ID NO: 260001 - DNA, 25 bp, Mus musculus
atgcctacaatgatcctttgtctgc

SEQ ID NO: 260002 - DNA, 25 bp, Mus musculus
atgcctacaatgcacacacagccta

SEQ ID NO: 260003 - DNA, 25 bp, Mus musculus
atgcctacaatggacacacagccta

SEQ ID NO: 260004 - DNA, 25 bp, Mus musculus
atgcctacaatgttcctttgtctgc

SEQ ID NO: 260005 - DNA, 25 bp, Mus musculus
atgcctacaattcagtacctagaag

SEQ ID NO: 260006 - DNA, 25 bp, Mus musculus
atgcctacaattgagtacctagaag

SEQ ID NO: 260007 - DNA, 25 bp, Mus musculus
atgcctacactcctaataaaactgt

SEQ ID NO: 260008 - DNA, 25 bp, Mus musculus
atgcctacactcgtaataaaactgt

SEQ ID NO: 260009 - DNA, 25 bp, Mus musculus
atgcctacagacagtgggacctgcc

SEQ ID NO: 260010 - DNA, 25 bp, Mus musculus
atgcctacagactgtgggacctgcc

SEQ ID NO: 260011 - DNA, 25 bp, Mus musculus
atgcctacagctagatttaccgatg

SEQ ID NO: 260012 - DNA, 25 bp, Mus musculus
atgcctacagctcctattgttacta

SEQ ID NO: 260013 - DNA, 25 bp, Mus musculus
atgcctacagctgctattgttacta

SEQ ID NO: 260014 - DNA, 25 bp, Mus musculus
atgcctacagcttgatttaccgatg

SEQ ID NO: 260015 - DNA, 25 bp, Mus musculus
atgcctacatgtcccttgttcagaa

SEQ ID NO: 260016 - DNA, 25 bp, Mus musculus
atgcctacatgtgccttgttcagaa

SEQ ID NO: 260017 - DNA, 25 bp, Mus musculus
atgcctacattgaggatcttgtcag

SEQ ID NO: 260018 - DNA, 25 bp, Mus musculus
atgcctacattgtggatcttgtcag

SEQ ID NO: 260019 - DNA, 25 bp, Mus musculus
atgcctacccgacaggattgctaag

SEQ ID NO: 260020 - DNA, 25 bp, Mus musculus
atgcctacccgagaggattgctaag

SEQ ID NO: 260021 - DNA, 25 bp, Mus musculus
atgcctaccgagaaaacgtgttcaa

SEQ ID NO: 260022 - DNA, 25 bp, Mus musculus
atgcctaccgagtaaacgtgttcaa

SEQ ID NO: 260023 - DNA, 25 bp, Mus musculus
atgcctacctatcgacgctctttca

SEQ ID NO: 260024 - DNA, 25 bp, Mus musculus
atgcctacctatggacgctctttca

SEQ ID NO: 260025 - DNA, 25 bp, Mus musculus
atgcctacgaaacctgttagcctca

SEQ ID NO: 260026 - DNA, 25 bp, Mus musculus
atgcctacgaaagctgttagcctca

SEQ ID NO: 260027 - DNA, 25 bp, Mus musculus
atgcctacgaacacttcaccaagat

SEQ ID NO: 260028 - DNA, 25 bp, Mus musculus
atgcctacgaactcttcaccaagat

SEQ ID NO: 260029 - DNA, 25 bp, Mus musculus
atgcctacgatccgcgccgggaatt

SEQ ID NO: 260030 - DNA, 25 bp, Mus musculus
atgcctacgatcggcgccgggaatt

SEQ ID NO: 260031 - DNA, 25 bp, Mus musculus
atgcctacgtgcatctagggcacac

SEQ ID NO: 260032 - DNA, 25 bp, Mus musculus
atgcctacgtgcttctagggcacac

SEQ ID NO: 260033 - DNA, 25 bp, Mus musculus
atgcctactttgctcagtaccacga

SEQ ID NO: 260034 - DNA, 25 bp, Mus musculus
atgcctactttggtcagtaccacga

SEQ ID NO: 260035 - DNA, 25 bp, Mus musculus
atgcctagactactttttcattgaa

SEQ ID NO: 260036 - DNA, 25 bp, Mus musculus
atgcctagactagtttttcattgaa

SEQ ID NO: 260037 - DNA, 25 bp, Mus musculus
atgcctagactgagggttggctact

SEQ ID NO: 260038 - DNA, 25 bp, Mus musculus
atgcctagactgtgggttggctact

SEQ ID NO: 260039 - DNA, 25 bp, Mus musculus
atgcctagagatcctgttggtgtct

SEQ ID NO: 260040 - DNA, 25 bp, Mus musculus
atgcctagagatgctgttggtgtct

SEQ ID NO: 260041 - DNA, 25 bp, Mus musculus
atgcctaggtgacaggtcgctgctc

SEQ ID NO: 260042 - DNA, 25 bp, Mus musculus
atgcctaggtgagaggtcgctgctc

SEQ ID NO: 260043 - DNA, 25 bp, Mus musculus
atgcctagtatcacagtcttcccac

SEQ ID NO: 260044 - DNA, 25 bp, Mus musculus
atgcctagtatctcagtcttcccac

SEQ ID NO: 260045 - DNA, 25 bp, Mus musculus
atgcctataacccaacacagtggat

SEQ ID NO: 260046 - DNA, 25 bp, Mus musculus
atgcctataaccgaacacagtggat

SEQ ID NO: 260047 - DNA, 25 bp, Mus musculus
atgcctatacaaatgattgcctgat

SEQ ID NO: 260048 - DNA, 25 bp, Mus musculus
atgcctatacaattgattgcctgat

SEQ ID NO: 260049 - DNA, 25 bp, Mus musculus
atgcctatatcccaggtactcagga

SEQ ID NO: 260050 - DNA, 25 bp, Mus musculus
atgcctatatccgaggtactcagga

SEQ ID NO: 260051 - DNA, 25 bp, Mus musculus
atgcctatattcatcctgaacagat

SEQ ID NO: 260052 - DNA, 25 bp, Mus musculus
atgcctatattcttcctgaacagat

SEQ ID NO: 260053 - DNA, 25 bp, Mus musculus
atgcctatcaggaaggtagccccat

SEQ ID NO: 260054 - DNA, 25 bp, Mus musculus
atgcctatcaggtaggtagccccat

SEQ ID NO: 260055 - DNA, 25 bp, Mus musculus
atgcctatcataatgagcgtctcat

SEQ ID NO: 260056 - DNA, 25 bp, Mus musculus
atgcctatcatattgagcgtctcat

SEQ ID NO: 260057 - DNA, 25 bp, Mus musculus
atgcctatccacatcagtattctct

SEQ ID NO: 260058 - DNA, 25 bp, Mus musculus
atgcctatccacttcagtattctct

SEQ ID NO: 260059 - DNA, 25 bp, Mus musculus
atgcctatcctgattctcacctctg

SEQ ID NO: 260060 - DNA, 25 bp, Mus musculus
atgcctatcctgtttctcacctctg

SEQ ID NO: 260061 - DNA, 25 bp, Mus musculus
atgcctatgcacatgatttctataa

SEQ ID NO: 260062 - DNA, 25 bp, Mus musculus
atgcctatgcacttgatttctataa

SEQ ID NO: 260063 - DNA, 25 bp, Mus musculus
atgcctatgctcctgaaaattcttc

SEQ ID NO: 260064 - DNA, 25 bp, Mus musculus
atgcctatgctcgtgaaaattcttc

SEQ ID NO: 260065 - DNA, 25 bp, Mus musculus
atgcctatggataactgagttgctg

SEQ ID NO: 260066 - DNA, 25 bp, Mus musculus
atgcctatggattactgagttgctg

SEQ ID NO: 260067 - DNA, 25 bp, Mus musculus
atgcctatggctattttgacatttg

SEQ ID NO: 260068 - DNA, 25 bp, Mus musculus
atgcctatggcttttttgacatttg

SEQ ID NO: 260069 - DNA, 25 bp, Mus musculus
atgcctatgggaatccaaggttggc

SEQ ID NO: 260070 - DNA, 25 bp, Mus musculus
atgcctatgggattccaaggttggc

SEQ ID NO: 260071 - DNA, 25 bp, Mus musculus
atgcctatgttcagaagtctgaaga

SEQ ID NO: 260072 - DNA, 25 bp, Mus musculus
atgcctatgttctgaagtctgaaga

SEQ ID NO: 260073 - DNA, 25 bp, Mus musculus
atgcctattctgaactgtccttcag

SEQ ID NO: 260074 - DNA, 25 bp, Mus musculus
atgcctattctgtactgtccttcag

SEQ ID NO: 260075 - DNA, 25 bp, Mus musculus
atgcctatttctacgatggtctgga

SEQ ID NO: 260076 - DNA, 25 bp, Mus musculus
atgcctatttcttcgatggtctgga

SEQ ID NO: 260077 - DNA, 25 bp, Mus musculus
atgcctatttgtattactccctcaa

SEQ ID NO: 260078 - DNA, 25 bp, Mus musculus
atgcctatttgttttactccctcaa

SEQ ID NO: 260079 - DNA, 25 bp, Mus musculus
atgcctcaaccgatgtttcactgta

SEQ ID NO: 260080 - DNA, 25 bp, Mus musculus
atgcctcaaccgttgtttcactgta

SEQ ID NO: 260081 - DNA, 25 bp, Mus musculus
atgcctcaagcaaatctgctagttt

SEQ ID NO: 260082 - DNA, 25 bp, Mus musculus
atgcctcaagcatatctgctagttt

SEQ ID NO: 260083 - DNA, 25 bp, Mus musculus
atgcctcacttcatcatttctcagt

SEQ ID NO: 260084 - DNA, 25 bp, Mus musculus
atgcctcacttcttcatttctcagt

SEQ ID NO: 260085 - DNA, 25 bp, Mus musculus
atgcctcagataattaacccgtaag

SEQ ID NO: 260086 - DNA, 25 bp, Mus musculus
atgcctcagatatttaacccgtaag

SEQ ID NO: 260087 - DNA, 25 bp, Mus musculus
atgcctcagattcttccaacagatc

SEQ ID NO: 260088 - DNA, 25 bp, Mus musculus
atgcctcagattgttccaacagatc

SEQ ID NO: 260089 - DNA, 25 bp, Mus musculus
atgcctcaggctccattgaagtaca

SEQ ID NO: 260090 - DNA, 25 bp, Mus musculus
atgcctcaggctgcattgaagtaca

SEQ ID NO: 260091 - DNA, 25 bp, Mus musculus
atgcctcatgatacaataaaaccac

SEQ ID NO: 260092 - DNA, 25 bp, Mus musculus
atgcctcatgattcaataaaaccac

SEQ ID NO: 260093 - DNA, 25 bp, Mus musculus
atgcctcatgtcctactatttcagt

SEQ ID NO: 260094 - DNA, 25 bp, Mus musculus
atgcctcatgtcgtactatttcagt

SEQ ID NO: 260095 - DNA, 25 bp, Mus musculus
atgcctccaccaatcggaagcgtgt

SEQ ID NO: 260096 - DNA, 25 bp, Mus musculus
atgcctccaccattcggaagcgtgt

SEQ ID NO: 260097 - DNA, 25 bp, Mus musculus
atgcctccactgatcagtgctggaa

SEQ ID NO: 260098 - DNA, 25 bp, Mus musculus
atgcctccactgttcagtgctggaa

SEQ ID NO: 260099 - DNA, 25 bp, Mus musculus
atgcctccaggtctaaccacaaaca

SEQ ID NO: 260100 - DNA, 25 bp, Mus musculus
atgcctccaggtgtaaccacaaaca

SEQ ID NO: 260101 - DNA, 25 bp, Mus musculus
atgcctccatagcaacaactgatgt

SEQ ID NO: 260102 - DNA, 25 bp, Mus musculus
atgcctccataggaacaactgatgt

SEQ ID NO: 260103 - DNA, 25 bp, Mus musculus
atgcctcccaaacacgacaagaaga

SEQ ID NO: 260104 - DNA, 25 bp, Mus musculus
atgcctcccaaagacgacaagaaga

SEQ ID NO: 260105 - DNA, 25 bp, Mus musculus
atgcctccccttaggccgaagaatt

SEQ ID NO: 260106 - DNA, 25 bp, Mus musculus
atgcctcccctttggccgaagaatt

SEQ ID NO: 260107 - DNA, 25 bp, Mus musculus
atgcctcccgtgagggctgctggca

SEQ ID NO: 260108 - DNA, 25 bp, Mus musculus
atgcctcccgtgtgggctgctggca

SEQ ID NO: 260109 - DNA, 25 bp, Mus musculus
atgcctccgtaacatcaggctgagg

SEQ ID NO: 260110 - DNA, 25 bp, Mus musculus
atgcctccgtaagatcaggctgagg

SEQ ID NO: 260111 - DNA, 25 bp, Mus musculus
atgcctccgtgcctagagggacaag

SEQ ID NO: 260112 - DNA, 25 bp, Mus musculus
atgcctccgtgcgtagagggacaag

SEQ ID NO: 260113 - DNA, 25 bp, Mus musculus
atgcctccgtgtatttgtatttttt

SEQ ID NO: 260114 - DNA, 25 bp, Mus musculus
atgcctccgtgtttttgtatttttt

SEQ ID NO: 260115 - DNA, 25 bp, Mus musculus
atgcctcctagcaggccatggaaat

SEQ ID NO: 260116 - DNA, 25 bp, Mus musculus
atgcctcctagctggccatggaaat

SEQ ID NO: 260117 - DNA, 25 bp, Mus musculus
atgcctcctccacaaataaacgtaa

SEQ ID NO: 260118 - DNA, 25 bp, Mus musculus
atgcctcctccagaaataaacgtaa

SEQ ID NO: 260119 - DNA, 25 bp, Mus musculus
atgcctcctgtcattgtaacctcaa

SEQ ID NO: 260120 - DNA, 25 bp, Mus musculus
atgcctcctgtctttgtaacctcaa

SEQ ID NO: 260121 - DNA, 25 bp, Mus musculus
atgcctcggaatccaggcttcgtgc

SEQ ID NO: 260122 - DNA, 25 bp, Mus musculus
atgcctcggaatgcaggcttcgtgc

SEQ ID NO: 260123 - DNA, 25 bp, Mus musculus
atgcctcgggcacaggatatgtact

SEQ ID NO: 260124 - DNA, 25 bp, Mus musculus
atgcctcgggcactcttcaatatta

SEQ ID NO: 260125 - DNA, 25 bp, Mus musculus
atgcctcgggcagaggatatgtact

SEQ ID NO: 260126 - DNA, 25 bp, Mus musculus
atgcctcgggcagtcttcaatatta

SEQ ID NO: 260127 - DNA, 25 bp, Mus musculus
atgcctcgtgctacaggagggccag

SEQ ID NO: 260128 - DNA, 25 bp, Mus musculus
atgcctcgtgcttcaggagggccag

SEQ ID NO: 260129 - DNA, 25 bp, Mus musculus
atgcctcgtgggatgggtgctttca

SEQ ID NO: 260130 - DNA, 25 bp, Mus musculus
atgcctcgtgggttgggtgctttca

SEQ ID NO: 260131 - DNA, 25 bp, Mus musculus
atgcctctaagacactatgactcca

SEQ ID NO: 260132 - DNA, 25 bp, Mus musculus
atgcctctaagagactatgactcca

SEQ ID NO: 260133 - DNA, 25 bp, Mus musculus
atgcctctaaggaaattttactatg

SEQ ID NO: 260134 - DNA, 25 bp, Mus musculus
atgcctctaaggtaattttactatg

SEQ ID NO: 260135 - DNA, 25 bp, Mus musculus
atgcctctattcagcagagtctaga

SEQ ID NO: 260136 - DNA, 25 bp, Mus musculus
atgcctctattctgcagagtctaga

SEQ ID NO: 260137 - DNA, 25 bp, Mus musculus
atgcctctcagtagtacagctaacc

SEQ ID NO: 260138 - DNA, 25 bp, Mus musculus
atgcctctcagttgtacagctaacc

SEQ ID NO: 260139 - DNA, 25 bp, Mus musculus
atgcctctcatcattctcttggtgt

SEQ ID NO: 260140 - DNA, 25 bp, Mus musculus
atgcctctcatctttctcttggtgt

SEQ ID NO: 260141 - DNA, 25 bp, Mus musculus
atgcctctcctgatatttctgatag

SEQ ID NO: 260142 - DNA, 25 bp, Mus musculus
atgcctctcctgttatttctgatag

SEQ ID NO: 260143 - DNA, 25 bp, Mus musculus
atgcctctccttagtcaatcataat

SEQ ID NO: 260144 - DNA, 25 bp, Mus musculus
atgcctctcctttgtcaatcataat

SEQ ID NO: 260145 - DNA, 25 bp, Mus musculus
atgcctctctgaatgaaactgccac

SEQ ID NO: 260146 - DNA, 25 bp, Mus musculus
atgcctctctgattgaaactgccac

SEQ ID NO: 260147 - DNA, 25 bp, Mus musculus
atgcctctctggcaccatattgagg

SEQ ID NO: 260148 - DNA, 25 bp, Mus musculus
atgcctctctgggaccatattgagg

SEQ ID NO: 260149 - DNA, 25 bp, Mus musculus
atgcctctcttcattttactcttga

SEQ ID NO: 260150 - DNA, 25 bp, Mus musculus
atgcctctcttctttttactcttga

SEQ ID NO: 260151 - DNA, 25 bp, Mus musculus
atgcctctcttgcagcaaatgatga

SEQ ID NO: 260152 - DNA, 25 bp, Mus musculus
atgcctctcttggagcaaatgatga

SEQ ID NO: 260153 - DNA, 25 bp, Mus musculus
atgcctctgaagcatcagcctgact

SEQ ID NO: 260154 - DNA, 25 bp, Mus musculus
atgcctctgaaggatcagcctgact

SEQ ID NO: 260155 - DNA, 25 bp, Mus musculus
atgcctctgactacttcaagtccaa

SEQ ID NO: 260156 - DNA, 25 bp, Mus musculus
atgcctctgactccctttgaagcat

SEQ ID NO: 260157 - DNA, 25 bp, Mus musculus
atgcctctgactgcctttgaagcat

SEQ ID NO: 260158 - DNA, 25 bp, Mus musculus
atgcctctgacttcttcaagtccaa

SEQ ID NO: 260159 - DNA, 25 bp, Mus musculus
atgcctctgccaaagaatactcagt

SEQ ID NO: 260160 - DNA, 25 bp, Mus musculus
atgcctctgccatagaatactcagt

SEQ ID NO: 260161 - DNA, 25 bp, Mus musculus
atgcctctggccaaaatgttgccta

SEQ ID NO: 260162 - DNA, 25 bp, Mus musculus
atgcctctggcctaaatgttgccta

SEQ ID NO: 260163 - DNA, 25 bp, Mus musculus
atgcctctggcgatgactcctgtta

SEQ ID NO: 260164 - DNA, 25 bp, Mus musculus
atgcctctggcgttgactcctgtta

SEQ ID NO: 260165 - DNA, 25 bp, Mus musculus
atgcctctggtgacagttttcttgt

SEQ ID NO: 260166 - DNA, 25 bp, Mus musculus
atgcctctggtgtcagttttcttgt

SEQ ID NO: 260167 - DNA, 25 bp, Mus musculus
atgcctctgtttattcagtaccacc

SEQ ID NO: 260168 - DNA, 25 bp, Mus musculus
atgcctctgttttttcagtaccacc

SEQ ID NO: 260169 - DNA, 25 bp, Mus musculus
atgcctcttaagcagcactgtggaa

SEQ ID NO: 260170 - DNA, 25 bp, Mus musculus
atgcctcttaaggagcactgtggaa

SEQ ID NO: 260171 - DNA, 25 bp, Mus musculus
atgcctcttagcaaatcccctgtgg

SEQ ID NO: 260172 - DNA, 25 bp, Mus musculus
atgcctcttagctaatcccctgtgg

SEQ ID NO: 260173 - DNA, 25 bp, Mus musculus
atgcctcttcctcgtattaaggccc

SEQ ID NO: 260174 - DNA, 25 bp, Mus musculus
atgcctcttcctggtattaaggccc

SEQ ID NO: 260175 - DNA, 25 bp, Mus musculus
atgcctcttgccacagggaaatgtt

SEQ ID NO: 260176 - DNA, 25 bp, Mus musculus
atgcctcttgccagtgtgtctcaga

SEQ ID NO: 260177 - DNA, 25 bp, Mus musculus
atgcctcttgcctcagggaaatgtt

SEQ ID NO: 260178 - DNA, 25 bp, Mus musculus
atgcctcttgcctgtgtgtctcaga

SEQ ID NO: 260179 - DNA, 25 bp, Mus musculus
atgcctcttggcacataccatgatg

SEQ ID NO: 260180 - DNA, 25 bp, Mus musculus
atgcctcttggctcataccatgatg

SEQ ID NO: 260181 - DNA, 25 bp, Mus musculus
atgcctcttgtcagtttccacactt

SEQ ID NO: 260182 - DNA, 25 bp, Mus musculus
atgcctcttgtctgtttccacactt

SEQ ID NO: 260183 - DNA, 25 bp, Mus musculus
atgcctgaaacgacggccctgggag

SEQ ID NO: 260184 - DNA, 25 bp, Mus musculus
atgcctgaaacgtcggccctgggag

SEQ ID NO: 260185 - DNA, 25 bp, Mus musculus
atgcctgaatacacgttttccatgc

SEQ ID NO: 260186 - DNA, 25 bp, Mus musculus
atgcctgaatacatcagtgtgctct

SEQ ID NO: 260187 - DNA, 25 bp, Mus musculus
atgcctgaatactcgttttccatgc

SEQ ID NO: 260188 - DNA, 25 bp, Mus musculus
atgcctgaatacttcagtgtgctct

SEQ ID NO: 260189 - DNA, 25 bp, Mus musculus
atgcctgaattccaggagctcagtg

SEQ ID NO: 260190 - DNA, 25 bp, Mus musculus
atgcctgaattcgaggagctcagtg

SEQ ID NO: 260191 - DNA, 25 bp, Mus musculus
atgcctgacagcatattttctgtga

SEQ ID NO: 260192 - DNA, 25 bp, Mus musculus
atgcctgacagcttattttctgtga

SEQ ID NO: 260193 - DNA, 25 bp, Mus musculus
atgcctgacattatccttcctttca

SEQ ID NO: 260194 - DNA, 25 bp, Mus musculus
atgcctgacattttccttcctttca

SEQ ID NO: 260195 - DNA, 25 bp, Mus musculus
atgcctgactccacaaggtagtaac

SEQ ID NO: 260196 - DNA, 25 bp, Mus musculus
atgcctgactcctcaaggtagtaac

SEQ ID NO: 260197 - DNA, 25 bp, Mus musculus
atgcctgactttcgttatttccctg

SEQ ID NO: 260198 - DNA, 25 bp, Mus musculus
atgcctgactttggttatttccctg

SEQ ID NO: 260199 - DNA, 25 bp, Mus musculus
atgcctgagctactctgtaccagat

SEQ ID NO: 260200 - DNA, 25 bp, Mus musculus
atgcctgagctagtctgtaccagat

SEQ ID NO: 260201 - DNA, 25 bp, Mus musculus
atgcctgaggctatctttactctta

SEQ ID NO: 260202 - DNA, 25 bp, Mus musculus
atgcctgaggctctctagtcagaca

SEQ ID NO: 260203 - DNA, 25 bp, Mus musculus
atgcctgaggctgtctagtcagaca

SEQ ID NO: 260204 - DNA, 25 bp, Mus musculus
atgcctgaggctttctttactctta

SEQ ID NO: 260205 - DNA, 25 bp, Mus musculus
atgcctgagggcacctgaatgagtg

SEQ ID NO: 260206 - DNA, 25 bp, Mus musculus
atgcctgagggctcctgaatgagtg

SEQ ID NO: 260207 - DNA, 25 bp, Mus musculus
atgcctgaggtcattgtgaaacttc

SEQ ID NO: 260208 - DNA, 25 bp, Mus musculus
atgcctgaggtctttgtgaaacttc

SEQ ID NO: 260209 - DNA, 25 bp, Mus musculus
atgcctgagtgcaacatccgtggca

SEQ ID NO: 260210 - DNA, 25 bp, Mus musculus
atgcctgagtgctacatccgtggca

SEQ ID NO: 260211 - DNA, 25 bp, Mus musculus
atgcctgagttgcaagtgaggtcac

SEQ ID NO: 260212 - DNA, 25 bp, Mus musculus
atgcctgagttggaagtgaggtcac

SEQ ID NO: 260213 - DNA, 25 bp, Mus musculus
atgcctgatacccatttaacctgtt

SEQ ID NO: 260214 - DNA, 25 bp, Mus musculus
atgcctgataccgatttaacctgtt

SEQ ID NO: 260215 - DNA, 25 bp, Mus musculus
atgcctgatatgatgcctgtgtgaa

SEQ ID NO: 260216 - DNA, 25 bp, Mus musculus
atgcctgatatgttgcctgtgtgaa

SEQ ID NO: 260217 - DNA, 25 bp, Mus musculus
atgcctgatcacatcactgatcacg

SEQ ID NO: 260218 - DNA, 25 bp, Mus musculus
atgcctgatcacttcactgatcacg

SEQ ID NO: 260219 - DNA, 25 bp, Mus musculus
atgcctgatccaaaaacttcacgtg

SEQ ID NO: 260220 - DNA, 25 bp, Mus musculus
atgcctgatccataaacttcacgtg

SEQ ID NO: 260221 - DNA, 25 bp, Mus musculus
atgcctgatgctccagaagactctg

SEQ ID NO: 260222 - DNA, 25 bp, Mus musculus
atgcctgatgctgcagaagactctg

SEQ ID NO: 260223 - DNA, 25 bp, Mus musculus
atgcctgatgttcctgtcatacagc

SEQ ID NO: 260224 - DNA, 25 bp, Mus musculus
atgcctgatgttcgatttctttgaa

SEQ ID NO: 260225 - DNA, 25 bp, Mus musculus
atgcctgatgttgctgtcatacagc

SEQ ID NO: 260226 - DNA, 25 bp, Mus musculus
atgcctgatgttggatttctttgaa

SEQ ID NO: 260227 - DNA, 25 bp, Mus musculus
atgcctgattccaaaaccaccagca

SEQ ID NO: 260228 - DNA, 25 bp, Mus musculus
atgcctgattcctaaaccaccagca

SEQ ID NO: 260229 - DNA, 25 bp, Mus musculus
atgcctgcaattacgctttacaacc

SEQ ID NO: 260230 - DNA, 25 bp, Mus musculus
atgcctgcaattccagatgtgtacc

SEQ ID NO: 260231 - DNA, 25 bp, Mus musculus
atgcctgcaattgcagatgtgtacc

SEQ ID NO: 260232 - DNA, 25 bp, Mus musculus
atgcctgcaatttcgctttacaacc

SEQ ID NO: 260233 - DNA, 25 bp, Mus musculus
atgcctgcacaaataagcctgttca

SEQ ID NO: 260234 - DNA, 25 bp, Mus musculus
atgcctgcacaattaagcctgttca

SEQ ID NO: 260235 - DNA, 25 bp, Mus musculus
atgcctgcacccatgagagacctga

SEQ ID NO: 260236 - DNA, 25 bp, Mus musculus
atgcctgcacccttgagagacctga

SEQ ID NO: 260237 - DNA, 25 bp, Mus musculus
atgcctgcactaaacacatatactg

SEQ ID NO: 260238 - DNA, 25 bp, Mus musculus
atgcctgcactatacacatatactg

SEQ ID NO: 260239 - DNA, 25 bp, Mus musculus
atgcctgcatagatgggagcccagg

SEQ ID NO: 260240 - DNA, 25 bp, Mus musculus
atgcctgcatagttgggagcccagg

SEQ ID NO: 260241 - DNA, 25 bp, Mus musculus
atgcctgcatccagaagcacaaagg

SEQ ID NO: 260242 - DNA, 25 bp, Mus musculus
atgcctgcatcctgaagcacaaagg

SEQ ID NO: 260243 - DNA, 25 bp, Mus musculus
atgcctgcattcaattttattttga

SEQ ID NO: 260244 - DNA, 25 bp, Mus musculus
atgcctgcattctattttattttga

SEQ ID NO: 260245 - DNA, 25 bp, Mus musculus
atgcctgcatttaatctgtgcctct

SEQ ID NO: 260246 - DNA, 25 bp, Mus musculus
atgcctgcattttatctgtgcctct

SEQ ID NO: 260247 - DNA, 25 bp, Mus musculus
atgcctgccagaaatatgagatcca

SEQ ID NO: 260248 - DNA, 25 bp, Mus musculus
atgcctgccagatatatgagatcca

SEQ ID NO: 260249 - DNA, 25 bp, Mus musculus
atgcctgccaggacagttcgtgggt

SEQ ID NO: 260250 - DNA, 25 bp, Mus musculus
atgcctgccaggtcagttcgtgggt

SEQ ID NO: 260251 - DNA, 25 bp, Mus musculus
atgcctgcccacaaaagataccttg

SEQ ID NO: 260252 - DNA, 25 bp, Mus musculus
atgcctgcccactaaagataccttg

SEQ ID NO: 260253 - DNA, 25 bp, Mus musculus
atgcctgcccagatagtgcagtggt

SEQ ID NO: 260254 - DNA, 25 bp, Mus musculus
atgcctgcccagttagtgcagtggt

SEQ ID NO: 260255 - DNA, 25 bp, Mus musculus
atgcctgccccactggaatgttcaa

SEQ ID NO: 260256 - DNA, 25 bp, Mus musculus
atgcctgccccagtggaatgttcaa

SEQ ID NO: 260257 - DNA, 25 bp, Mus musculus
atgcctgccttgaagacattacaga

SEQ ID NO: 260258 - DNA, 25 bp, Mus musculus
atgcctgccttgtagacattacaga

SEQ ID NO: 260259 - DNA, 25 bp, Mus musculus
atgcctgcgaggcagccaatcagta

SEQ ID NO: 260260 - DNA, 25 bp, Mus musculus
atgcctgcgagggagccaatcagta

SEQ ID NO: 260261 - DNA, 25 bp, Mus musculus
atgcctgcgatcatgatgcccagga

SEQ ID NO: 260262 - DNA, 25 bp, Mus musculus
atgcctgcgatcttgatgcccagga

SEQ ID NO: 260263 - DNA, 25 bp, Mus musculus
atgcctgctcccctacagtagggtt

SEQ ID NO: 260264 - DNA, 25 bp, Mus musculus
atgcctgctcccgtacagtagggtt

SEQ ID NO: 260265 - DNA, 25 bp, Mus musculus
atgcctgctcctcggacggctgtga

SEQ ID NO: 260266 - DNA, 25 bp, Mus musculus
atgcctgctcctgggacggctgtga

SEQ ID NO: 260267 - DNA, 25 bp, Mus musculus
atgcctgctctcaccattcagaggg

SEQ ID NO: 260268 - DNA, 25 bp, Mus musculus
atgcctgctctctccattcagaggg

SEQ ID NO: 260269 - DNA, 25 bp, Mus musculus
atgcctgctctgagcaaatgctccc

SEQ ID NO: 260270 - DNA, 25 bp, Mus musculus
atgcctgctctgaggttgtatgtca

SEQ ID NO: 260271 - DNA, 25 bp, Mus musculus
atgcctgctctgtgcaaatgctccc

SEQ ID NO: 260272 - DNA, 25 bp, Mus musculus
atgcctgctctgtggttgtatgtca

SEQ ID NO: 260273 - DNA, 25 bp, Mus musculus
atgcctgctcttagtatttgctgcc

SEQ ID NO: 260274 - DNA, 25 bp, Mus musculus
atgcctgctctttgtatttgctgcc

SEQ ID NO: 260275 - DNA, 25 bp, Mus musculus
atgcctgctgccatctttctagaaa

SEQ ID NO: 260276 - DNA, 25 bp, Mus musculus
atgcctgctgccttctttctagaaa

SEQ ID NO: 260277 - DNA, 25 bp, Mus musculus
atgcctgctggcagttagagtacaa

SEQ ID NO: 260278 - DNA, 25 bp, Mus musculus
atgcctgctggctgttagagtacaa

SEQ ID NO: 260279 - DNA, 25 bp, Mus musculus
atgcctgcttagacactgccatact

SEQ ID NO: 260280 - DNA, 25 bp, Mus musculus
atgcctgcttagcttagtcctcacc

SEQ ID NO: 260281 - DNA, 25 bp, Mus musculus
atgcctgcttaggttagtcctcacc

SEQ ID NO: 260282 - DNA, 25 bp, Mus musculus
atgcctgcttagtcactgccatact

SEQ ID NO: 260283 - DNA, 25 bp, Mus musculus
atgcctgcttctatgcatggttagt

SEQ ID NO: 260284 - DNA, 25 bp, Mus musculus
atgcctgcttctcgactcatgagca

SEQ ID NO: 260285 - DNA, 25 bp, Mus musculus
atgcctgcttctggactcatgagca

SEQ ID NO: 260286 - DNA, 25 bp, Mus musculus
atgcctgcttctttgcatggttagt

SEQ ID NO: 260287 - DNA, 25 bp, Mus musculus
atgcctggaaacagaacttgaacaa

SEQ ID NO: 260288 - DNA, 25 bp, Mus musculus
atgcctggaaactgaacttgaacaa

SEQ ID NO: 260289 - DNA, 25 bp, Mus musculus
atgcctggaactacgaacatggtgc

SEQ ID NO: 260290 - DNA, 25 bp, Mus musculus
atgcctggaacttcgaacatggtgc

SEQ ID NO: 260291 - DNA, 25 bp, Mus musculus
atgcctggaagacatgcgtgacgtt

SEQ ID NO: 260292 - DNA, 25 bp, Mus musculus
atgcctggaagagatgcgtgacgtt

SEQ ID NO: 260293 - DNA, 25 bp, Mus musculus
atgcctggacatcttgttgacgctt

SEQ ID NO: 260294 - DNA, 25 bp, Mus musculus
atgcctggacatgttgttgacgctt

SEQ ID NO: 260295 - DNA, 25 bp, Mus musculus
atgcctggaccaaacattcctgtga

SEQ ID NO: 260296 - DNA, 25 bp, Mus musculus
atgcctggaccaatagcaaccatgt

SEQ ID NO: 260297 - DNA, 25 bp, Mus musculus
atgcctggaccatacattcctgtga

SEQ ID NO: 260298 - DNA, 25 bp, Mus musculus
atgcctggaccattagcaaccatgt

SEQ ID NO: 260299 - DNA, 25 bp, Mus musculus
atgcctggacttactgcatcagtaa

SEQ ID NO: 260300 - DNA, 25 bp, Mus musculus
atgcctggacttaggtgttgttatt

SEQ ID NO: 260301 - DNA, 25 bp, Mus musculus
atgcctggactttctgcatcagtaa

SEQ ID NO: 260302 - DNA, 25 bp, Mus musculus
atgcctggactttggtgttgttatt

SEQ ID NO: 260303 - DNA, 25 bp, Mus musculus
atgcctggatgtacctctgtgcgtt

SEQ ID NO: 260304 - DNA, 25 bp, Mus musculus
atgcctggatgttcctctgtgcgtt

SEQ ID NO: 260305 - DNA, 25 bp, Mus musculus
atgcctggatttctccactttttga

SEQ ID NO: 260306 - DNA, 25 bp, Mus musculus
atgcctggatttgtccactttttga

SEQ ID NO: 260307 - DNA, 25 bp, Mus musculus
atgcctggcaacagtactacagcaa

SEQ ID NO: 260308 - DNA, 25 bp, Mus musculus
atgcctggcaactgtactacagcaa

SEQ ID NO: 260309 - DNA, 25 bp, Mus musculus
atgcctggcacacagctgtagatgt

SEQ ID NO: 260310 - DNA, 25 bp, Mus musculus
atgcctggcacagagctgtagatgt

SEQ ID NO: 260311 - DNA, 25 bp, Mus musculus
atgcctggcactccccttgggaaag

SEQ ID NO: 260312 - DNA, 25 bp, Mus musculus
atgcctggcactgcccttgggaaag

SEQ ID NO: 260313 - DNA, 25 bp, Mus musculus
atgcctggcataactgtgcctcaat

SEQ ID NO: 260314 - DNA, 25 bp, Mus musculus
atgcctggcatatctgtgcctcaat

SEQ ID NO: 260315 - DNA, 25 bp, Mus musculus
atgcctggcctgcattaaaatggac

SEQ ID NO: 260316 - DNA, 25 bp, Mus musculus
atgcctggcctggattaaaatggac

SEQ ID NO: 260317 - DNA, 25 bp, Mus musculus
atgcctggcgcacgtataagccaaa

SEQ ID NO: 260318 - DNA, 25 bp, Mus musculus
atgcctggcgcaggtataagccaaa

SEQ ID NO: 260319 - DNA, 25 bp, Mus musculus
atgcctggctaacatatctgccttt

SEQ ID NO: 260320 - DNA, 25 bp, Mus musculus
atgcctggctaagatatctgccttt

SEQ ID NO: 260321 - DNA, 25 bp, Mus musculus
atgcctggcttcaacggtgtttgtt

SEQ ID NO: 260322 - DNA, 25 bp, Mus musculus
atgcctggcttcactgaattcttaa

SEQ ID NO: 260323 - DNA, 25 bp, Mus musculus
atgcctggcttcagaaggtatctct

SEQ ID NO: 260324 - DNA, 25 bp, Mus musculus
atgcctggcttcatgtaacttcttc

SEQ ID NO: 260325 - DNA, 25 bp, Mus musculus
atgcctggcttctacggtgtttgtt

SEQ ID NO: 260326 - DNA, 25 bp, Mus musculus
atgcctggcttctctgaattcttaa

SEQ ID NO: 260327 - DNA, 25 bp, Mus musculus
atgcctggcttctgaaggtatctct

SEQ ID NO: 260328 - DNA, 25 bp, Mus musculus
atgcctggcttcttgtaacttcttc

SEQ ID NO: 260329 - DNA, 25 bp, Mus musculus
atgcctgggattatggcttaaaatg

SEQ ID NO: 260330 - DNA, 25 bp, Mus musculus
atgcctgggattttggcttaaaatg

SEQ ID NO: 260331 - DNA, 25 bp, Mus musculus
atgcctgggcatcaccgtgtcatag

SEQ ID NO: 260332 - DNA, 25 bp, Mus musculus
atgcctgggcatgaccgtgtcatag

SEQ ID NO: 260333 - DNA, 25 bp, Mus musculus
atgcctgggtctagtaatatctcta

SEQ ID NO: 260334 - DNA, 25 bp, Mus musculus
atgcctgggtcttgtaatatctcta

SEQ ID NO: 260335 - DNA, 25 bp, Mus musculus
atgcctgggtgcctttttcaccctt

SEQ ID NO: 260336 - DNA, 25 bp, Mus musculus
atgcctgggtgcgtttttcaccctt

SEQ ID NO: 260337 - DNA, 25 bp, Mus musculus
atgcctgggtgtattgattagtcaa

SEQ ID NO: 260338 - DNA, 25 bp, Mus musculus
atgcctgggtgttttgattagtcaa

SEQ ID NO: 260339 - DNA, 25 bp, Mus musculus
atgcctggtacactttcattcccaa

SEQ ID NO: 260340 - DNA, 25 bp, Mus musculus
atgcctggtacagtttcattcccaa

SEQ ID NO: 260341 - DNA, 25 bp, Mus musculus
atgcctggtgccaggttcgaagcaa

SEQ ID NO: 260342 - DNA, 25 bp, Mus musculus
atgcctggtgcctggttcgaagcaa

SEQ ID NO: 260343 - DNA, 25 bp, Mus musculus
atgcctggtggaaccgcattcattc

SEQ ID NO: 260344 - DNA, 25 bp, Mus musculus
atgcctggtggatccgcattcattc

SEQ ID NO: 260345 - DNA, 25 bp, Mus musculus
atgcctggtgtaagcagagccactc

SEQ ID NO: 260346 - DNA, 25 bp, Mus musculus
atgcctggtgtatgcagagccactc

SEQ ID NO: 260347 - DNA, 25 bp, Mus musculus
atgcctggtgttagcctacatcagt

SEQ ID NO: 260348 - DNA, 25 bp, Mus musculus
atgcctggtgtttgcctacatcagt

SEQ ID NO: 260349 - DNA, 25 bp, Mus musculus
atgcctgtaattccaatgctggagt

SEQ ID NO: 260350 - DNA, 25 bp, Mus musculus
atgcctgtaattgcaatgctggagt

SEQ ID NO: 260351 - DNA, 25 bp, Mus musculus
atgcctgtacaaaaccacttagcca

SEQ ID NO: 260352 - DNA, 25 bp, Mus musculus
atgcctgtacaataccacttagcca

SEQ ID NO: 260353 - DNA, 25 bp, Mus musculus
atgcctgtactgatatcttttgttg

SEQ ID NO: 260354 - DNA, 25 bp, Mus musculus
atgcctgtactgttatcttttgttg

SEQ ID NO: 260355 - DNA, 25 bp, Mus musculus
atgcctgtagatctggacatcttga

SEQ ID NO: 260356 - DNA, 25 bp, Mus musculus
atgcctgtagatgtggacatcttga

SEQ ID NO: 260357 - DNA, 25 bp, Mus musculus
atgcctgtattgactgcacttggga

SEQ ID NO: 260358 - DNA, 25 bp, Mus musculus
atgcctgtattgtctgcacttggga

SEQ ID NO: 260359 - DNA, 25 bp, Mus musculus
atgcctgtcatccttcccgtttgat

SEQ ID NO: 260360 - DNA, 25 bp, Mus musculus
atgcctgtcatcgttcccgtttgat

SEQ ID NO: 260361 - DNA, 25 bp, Mus musculus
atgcctgtccccaatgactgaacgg

SEQ ID NO: 260362 - DNA, 25 bp, Mus musculus
atgcctgtcccctatgactgaacgg

SEQ ID NO: 260363 - DNA, 25 bp, Mus musculus
atgcctgtcctaaaaacatgcttgg

SEQ ID NO: 260364 - DNA, 25 bp, Mus musculus
atgcctgtcctataaacatgcttgg

SEQ ID NO: 260365 - DNA, 25 bp, Mus musculus
atgcctgtcctccatggagatgcag

SEQ ID NO: 260366 - DNA, 25 bp, Mus musculus
atgcctgtcctcgatggagatgcag

SEQ ID NO: 260367 - DNA, 25 bp, Mus musculus
atgcctgtccttctgattatttttt

SEQ ID NO: 260368 - DNA, 25 bp, Mus musculus
atgcctgtccttgtgattatttttt

SEQ ID NO: 260369 - DNA, 25 bp, Mus musculus
atgcctgtctacagttctgtcgatt

SEQ ID NO: 260370 - DNA, 25 bp, Mus musculus
atgcctgtctactgttctgtcgatt

SEQ ID NO: 260371 - DNA, 25 bp, Mus musculus
atgcctgtgaacctagtgtctggga

SEQ ID NO: 260372 - DNA, 25 bp, Mus musculus
atgcctgtgaacgtagtgtctggga

SEQ ID NO: 260373 - DNA, 25 bp, Mus musculus
atgcctgtgaatactacctccagca

SEQ ID NO: 260374 - DNA, 25 bp, Mus musculus
atgcctgtgaattctacctccagca

SEQ ID NO: 260375 - DNA, 25 bp, Mus musculus
atgcctgtgatcctacaactcagaa

SEQ ID NO: 260376 - DNA, 25 bp, Mus musculus
atgcctgtgatcgtacaactcagaa

SEQ ID NO: 260377 - DNA, 25 bp, Mus musculus
atgcctgtgatgatcctcaaggcca

SEQ ID NO: 260378 - DNA, 25 bp, Mus musculus
atgcctgtgatgatgtaagcggata

SEQ ID NO: 260379 - DNA, 25 bp, Mus musculus
atgcctgtgatgttcctcaaggcca

SEQ ID NO: 260380 - DNA, 25 bp, Mus musculus
atgcctgtgatgttgtaagcggata

SEQ ID NO: 260381 - DNA, 25 bp, Mus musculus
atgcctgtgattactcatacttgtt

SEQ ID NO: 260382 - DNA, 25 bp, Mus musculus
atgcctgtgatttctcatacttgtt

SEQ ID NO: 260383 - DNA, 25 bp, Mus musculus
atgcctgtgcacaagcatgtgtgtg

SEQ ID NO: 260384 - DNA, 25 bp, Mus musculus
atgcctgtgcactagcatgtgtgtg

SEQ ID NO: 260385 - DNA, 25 bp, Mus musculus
atgcctgtgcctataatgaagcgtt

SEQ ID NO: 260386 - DNA, 25 bp, Mus musculus
atgcctgtgcctatgtgtttggtaa

SEQ ID NO: 260387 - DNA, 25 bp, Mus musculus
atgcctgtgcctttaatgaagcgtt

SEQ ID NO: 260388 - DNA, 25 bp, Mus musculus
atgcctgtgcctttgtgtttggtaa

SEQ ID NO: 260389 - DNA, 25 bp, Mus musculus
atgcctgtggatccgaatgagccta

SEQ ID NO: 260390 - DNA, 25 bp, Mus musculus
atgcctgtggatgcgaatgagccta

SEQ ID NO: 260391 - DNA, 25 bp, Mus musculus
atgcctgtgggcagtggtgctcaca

SEQ ID NO: 260392 - DNA, 25 bp, Mus musculus
atgcctgtgggctgtggtgctcaca

SEQ ID NO: 260393 - DNA, 25 bp, Mus musculus
atgcctgtggtcagtctgatgtagc

SEQ ID NO: 260394 - DNA, 25 bp, Mus musculus
atgcctgtggtcctgtcacaagagg

SEQ ID NO: 260395 - DNA, 25 bp, Mus musculus
atgcctgtggtcgtgtcacaagagg

SEQ ID NO: 260396 - DNA, 25 bp, Mus musculus
atgcctgtggtctgtctgatgtagc

SEQ ID NO: 260397 - DNA, 25 bp, Mus musculus
atgcctgtgtatctgcgccaaaaca

SEQ ID NO: 260398 - DNA, 25 bp, Mus musculus
atgcctgtgtatgtgcgccaaaaca

SEQ ID NO: 260399 - DNA, 25 bp, Mus musculus
atgcctgtgtctaatgtgccttcct

SEQ ID NO: 260400 - DNA, 25 bp, Mus musculus
atgcctgtgtcttatgtgccttcct

SEQ ID NO: 260401 - DNA, 25 bp, Mus musculus
atgcctgtgtgcatacccaactaaa

SEQ ID NO: 260402 - DNA, 25 bp, Mus musculus
atgcctgtgtgcttacccaactaaa

SEQ ID NO: 260403 - DNA, 25 bp, Mus musculus
atgcctgtgttcacattagccgcca

SEQ ID NO: 260404 - DNA, 25 bp, Mus musculus
atgcctgtgttctcattagccgcca

SEQ ID NO: 260405 - DNA, 25 bp, Mus musculus
atgcctgtgtttcgcattgccacac

SEQ ID NO: 260406 - DNA, 25 bp, Mus musculus
atgcctgtgtttggcattgccacac

SEQ ID NO: 260407 - DNA, 25 bp, Mus musculus
atgcctgttaagcatcacttctcca

SEQ ID NO: 260408 - DNA, 25 bp, Mus musculus
atgcctgttaaggatcacttctcca

SEQ ID NO: 260409 - DNA, 25 bp, Mus musculus
atgcctgttcccagaggcatggaaa

SEQ ID NO: 260410 - DNA, 25 bp, Mus musculus
atgcctgttccctgaggcatggaaa

SEQ ID NO: 260411 - DNA, 25 bp, Mus musculus
atgcctgttccgagaggatggctgt

SEQ ID NO: 260412 - DNA, 25 bp, Mus musculus
atgcctgttccgtgaggatggctgt

SEQ ID NO: 260413 - DNA, 25 bp, Mus musculus
atgcctgttgctatgtactatgttg

SEQ ID NO: 260414 - DNA, 25 bp, Mus musculus
atgcctgttgctttgtactatgttg

SEQ ID NO: 260415 - DNA, 25 bp, Mus musculus
atgccttaaagtatctttgaccctg

SEQ ID NO: 260416 - DNA, 25 bp, Mus musculus
atgccttaaagtcctggagctgcca

SEQ ID NO: 260417 - DNA, 25 bp, Mus musculus
atgccttaaagtgctggagctgcca

SEQ ID NO: 260418 - DNA, 25 bp, Mus musculus
atgccttaaagtttctttgaccctg

SEQ ID NO: 260419 - DNA, 25 bp, Mus musculus
atgccttaaatcattcctctcttac

SEQ ID NO: 260420 - DNA, 25 bp, Mus musculus
atgccttaaatctttcctctcttac

SEQ ID NO: 260421 - DNA, 25 bp, Mus musculus
atgccttacctccttctaatgggta

SEQ ID NO: 260422 - DNA, 25 bp, Mus musculus
atgccttacctcgttctaatgggta

SEQ ID NO: 260423 - DNA, 25 bp, Mus musculus
atgccttagaagacagtaggatgat

SEQ ID NO: 260424 - DNA, 25 bp, Mus musculus
atgccttagaagtcagtaggatgat

SEQ ID NO: 260425 - DNA, 25 bp, Mus musculus
atgccttagactccagcatttctgg

SEQ ID NO: 260426 - DNA, 25 bp, Mus musculus
atgccttagactgcagcatttctgg

SEQ ID NO: 260427 - DNA, 25 bp, Mus musculus
atgccttagaggctatgtggttcca

SEQ ID NO: 260428 - DNA, 25 bp, Mus musculus
atgccttagagggtatgtggttcca

SEQ ID NO: 260429 - DNA, 25 bp, Mus musculus
atgccttagcctattgagtagctgt

SEQ ID NO: 260430 - DNA, 25 bp, Mus musculus
atgccttagccttttgagtagctgt

SEQ ID NO: 260431 - DNA, 25 bp, Mus musculus
atgccttagttcagcaatttgccac

SEQ ID NO: 260432 - DNA, 25 bp, Mus musculus
atgccttagttctgcaatttgccac

SEQ ID NO: 260433 - DNA, 25 bp, Mus musculus
atgccttcaaaactcatctgtcttc

SEQ ID NO: 260434 - DNA, 25 bp, Mus musculus
atgccttcaaaagtcatctgtcttc

SEQ ID NO: 260435 - DNA, 25 bp, Mus musculus
atgccttcacacagataacggtagt

SEQ ID NO: 260436 - DNA, 25 bp, Mus musculus
atgccttcacactgataacggtagt

SEQ ID NO: 260437 - DNA, 25 bp, Mus musculus
atgccttcatgccagtcacattttt

SEQ ID NO: 260438 - DNA, 25 bp, Mus musculus
atgccttcatgcgagtcacattttt

SEQ ID NO: 260439 - DNA, 25 bp, Mus musculus
atgccttcattcatacaagctttac

SEQ ID NO: 260440 - DNA, 25 bp, Mus musculus
atgccttcattcttacaagctttac

SEQ ID NO: 260441 - DNA, 25 bp, Mus musculus
atgccttccatactccaattcttag

SEQ ID NO: 260442 - DNA, 25 bp, Mus musculus
atgccttccatagtccaattcttag

SEQ ID NO: 260443 - DNA, 25 bp, Mus musculus
atgccttccgggactttgcggagaa

SEQ ID NO: 260444 - DNA, 25 bp, Mus musculus
atgccttccgggtctttgcggagaa

SEQ ID NO: 260445 - DNA, 25 bp, Mus musculus
atgccttccgtacgtaaccgacagt

SEQ ID NO: 260446 - DNA, 25 bp, Mus musculus
atgccttccgtaggtaaccgacagt

SEQ ID NO: 260447 - DNA, 25 bp, Mus musculus
atgccttccgtgaggtcagcacgag

SEQ ID NO: 260448 - DNA, 25 bp, Mus musculus
atgccttccgtgtggtcagcacgag

SEQ ID NO: 260449 - DNA, 25 bp, Mus musculus
atgccttcctaaatctttctggtct

SEQ ID NO: 260450 - DNA, 25 bp, Mus musculus
atgccttcctaattctttctggtct

SEQ ID NO: 260451 - DNA, 25 bp, Mus musculus
atgccttcctgccatgatggactcg

SEQ ID NO: 260452 - DNA, 25 bp, Mus musculus
atgccttcctgcgatgatggactcg

SEQ ID NO: 260453 - DNA, 25 bp, Mus musculus
atgccttcctttagcttcaagtgta

SEQ ID NO: 260454 - DNA, 25 bp, Mus musculus
atgccttccttttgcttcaagtgta

SEQ ID NO: 260455 - DNA, 25 bp, Mus musculus
atgccttcgagtcaagtcagtattc

SEQ ID NO: 260456 - DNA, 25 bp, Mus musculus
atgccttcgagtgaagtcagtattc

SEQ ID NO: 260457 - DNA, 25 bp, Mus musculus
atgccttcgctcctttgtggaatgg

SEQ ID NO: 260458 - DNA, 25 bp, Mus musculus
atgccttcgctcgtttgtggaatgg

SEQ ID NO: 260459 - DNA, 25 bp, Mus musculus
atgccttcgtcgaatacagacaaat

SEQ ID NO: 260460 - DNA, 25 bp, Mus musculus
atgccttcgtcgtatacagacaaat

SEQ ID NO: 260461 - DNA, 25 bp, Mus musculus
atgccttctcaaacgccatgcagtt

SEQ ID NO: 260462 - DNA, 25 bp, Mus musculus
atgccttctcaatcgccatgcagtt

SEQ ID NO: 260463 - DNA, 25 bp, Mus musculus
atgccttctcacaggactcattgta

SEQ ID NO: 260464 - DNA, 25 bp, Mus musculus
atgccttctcactggactcattgta

SEQ ID NO: 260465 - DNA, 25 bp, Mus musculus
atgccttctcccagtttgtaatggg

SEQ ID NO: 260466 - DNA, 25 bp, Mus musculus
atgccttctccctgtttgtaatggg

SEQ ID NO: 260467 - DNA, 25 bp, Mus musculus
atgccttctgaaccctctgggaaag

SEQ ID NO: 260468 - DNA, 25 bp, Mus musculus
atgccttctgaagcctctgggaaag

SEQ ID NO: 260469 - DNA, 25 bp, Mus musculus
atgccttctgcaacctaacttgagg

SEQ ID NO: 260470 - DNA, 25 bp, Mus musculus
atgccttctgcacaattcgataaag

SEQ ID NO: 260471 - DNA, 25 bp, Mus musculus
atgccttctgcagaattcgataaag

SEQ ID NO: 260472 - DNA, 25 bp, Mus musculus
atgccttctgcatcctaacttgagg

SEQ ID NO: 260473 - DNA, 25 bp, Mus musculus
atgccttctgccatctgaggttgga

SEQ ID NO: 260474 - DNA, 25 bp, Mus musculus
atgccttctgccttctgaggttgga

SEQ ID NO: 260475 - DNA, 25 bp, Mus musculus
atgccttctgtacacagttccatac

SEQ ID NO: 260476 - DNA, 25 bp, Mus musculus
atgccttctgtagacagttccatac

SEQ ID NO: 260477 - DNA, 25 bp, Mus musculus
atgccttgaaacacaacgccaaaca

SEQ ID NO: 260478 - DNA, 25 bp, Mus musculus
atgccttgaaactcaacgccaaaca

SEQ ID NO: 260479 - DNA, 25 bp, Mus musculus
atgccttgaatgcttatgtacagaa

SEQ ID NO: 260480 - DNA, 25 bp, Mus musculus
atgccttgaatggttatgtacagaa

SEQ ID NO: 260481 - DNA, 25 bp, Mus musculus
atgccttgaattagagttcctctga

SEQ ID NO: 260482 - DNA, 25 bp, Mus musculus
atgccttgaatttgagttcctctga

SEQ ID NO: 260483 - DNA, 25 bp, Mus musculus
atgccttgaggactatttctggttt

SEQ ID NO: 260484 - DNA, 25 bp, Mus musculus
atgccttgaggagtatttctggttt

SEQ ID NO: 260485 - DNA, 25 bp, Mus musculus
atgccttgcggtacttgtatgtgct

SEQ ID NO: 260486 - DNA, 25 bp, Mus musculus
atgccttgcggttcttgtatgtgct

SEQ ID NO: 260487 - DNA, 25 bp, Mus musculus
atgccttgctacaggaatggacctc

SEQ ID NO: 260488 - DNA, 25 bp, Mus musculus
atgccttgctactggaatggacctc

SEQ ID NO: 260489 - DNA, 25 bp, Mus musculus
atgccttgctccagttccattgcta

SEQ ID NO: 260490 - DNA, 25 bp, Mus musculus
atgccttgctcctgttccattgcta

SEQ ID NO: 260491 - DNA, 25 bp, Mus musculus
atgccttgtattctgtgatttgatt

SEQ ID NO: 260492 - DNA, 25 bp, Mus musculus
atgccttgtattgtgtgatttgatt

SEQ ID NO: 260493 - DNA, 25 bp, Mus musculus
atgccttgtcttagcttaactctac

SEQ ID NO: 260494 - DNA, 25 bp, Mus musculus
atgccttgtctttgcttaactctac

SEQ ID NO: 260495 - DNA, 25 bp, Mus musculus
atgccttgtgagatggatgaatgtt

SEQ ID NO: 260496 - DNA, 25 bp, Mus musculus
atgccttgtgagttggatgaatgtt

SEQ ID NO: 260497 - DNA, 25 bp, Mus musculus
atgccttgtttcatcatgacattat

SEQ ID NO: 260498 - DNA, 25 bp, Mus musculus
atgccttgtttcttcatgacattat

SEQ ID NO: 260499 - DNA, 25 bp, Mus musculus
atgcctttacccagttgacttgagc

SEQ ID NO: 260500 - DNA, 25 bp, Mus musculus
atgcctttaccctgttgacttgagc

SEQ ID NO: 260501 - DNA, 25 bp, Mus musculus
atgcctttagatctgagctaacagt

SEQ ID NO: 260502 - DNA, 25 bp, Mus musculus
atgcctttagatgtgagctaacagt

SEQ ID NO: 260503 - DNA, 25 bp, Mus musculus
atgcctttagctcagactaatttaa

SEQ ID NO: 260504 - DNA, 25 bp, Mus musculus
atgcctttagctgagactaatttaa

SEQ ID NO: 260505 - DNA, 25 bp, Mus musculus
atgcctttatgtcatgtctgtaaca

SEQ ID NO: 260506 - DNA, 25 bp, Mus musculus
atgcctttatgtgatgtctgtaaca

SEQ ID NO: 260507 - DNA, 25 bp, Mus musculus
atgcctttatttacatcaccatcac

SEQ ID NO: 260508 - DNA, 25 bp, Mus musculus
atgcctttattttcatcaccatcac

SEQ ID NO: 260509 - DNA, 25 bp, Mus musculus
atgcctttcaggatggtgtcttcca

SEQ ID NO: 260510 - DNA, 25 bp, Mus musculus
atgcctttcaggttggtgtcttcca

SEQ ID NO: 260511 - DNA, 25 bp, Mus musculus
atgcctttctctcctattaagtgtg

SEQ ID NO: 260512 - DNA, 25 bp, Mus musculus
atgcctttctctgctattaagtgtg

SEQ ID NO: 260513 - DNA, 25 bp, Mus musculus
atgcctttctttcgcctgattggaa

SEQ ID NO: 260514 - DNA, 25 bp, Mus musculus
atgcctttctttggcctgattggaa

SEQ ID NO: 260515 - DNA, 25 bp, Mus musculus
atgcctttgatgagcatctgaacgc

SEQ ID NO: 260516 - DNA, 25 bp, Mus musculus
atgcctttgatgtgcatctgaacgc

SEQ ID NO: 260517 - DNA, 25 bp, Mus musculus
atgcctttgcgaaacatcttcaaaa

SEQ ID NO: 260518 - DNA, 25 bp, Mus musculus
atgcctttgcgatacatcttcaaaa

SEQ ID NO: 260519 - DNA, 25 bp, Mus musculus
atgcctttgctccattcatttctgt

SEQ ID NO: 260520 - DNA, 25 bp, Mus musculus
atgcctttgctcgattcatttctgt

SEQ ID NO: 260521 - DNA, 25 bp, Mus musculus
atgcctttgggcaaagtccatcgta

SEQ ID NO: 260522 - DNA, 25 bp, Mus musculus
atgcctttgggctaagtccatcgta

SEQ ID NO: 260523 - DNA, 25 bp, Mus musculus
atgcctttgtaactgtggttaccgt

SEQ ID NO: 260524 - DNA, 25 bp, Mus musculus
atgcctttgtaagtgtggttaccgt

SEQ ID NO: 260525 - DNA, 25 bp, Mus musculus
atgcctttgtctccaacgagctaga

SEQ ID NO: 260526 - DNA, 25 bp, Mus musculus
atgcctttgtctgcaacgagctaga

SEQ ID NO: 260527 - DNA, 25 bp, Mus musculus
atgccttttaaaatgtctcctctag

SEQ ID NO: 260528 - DNA, 25 bp, Mus musculus
atgccttttaaattgtctcctctag

SEQ ID NO: 260529 - DNA, 25 bp, Mus musculus
atgccttttaagaatggtgtttgac

SEQ ID NO: 260530 - DNA, 25 bp, Mus musculus
atgccttttaagtatggtgtttgac

SEQ ID NO: 260531 - DNA, 25 bp, Mus musculus
atgccttttctacttagctctcact

SEQ ID NO: 260532 - DNA, 25 bp, Mus musculus
atgccttttctagttagctctcact

SEQ ID NO: 260533 - DNA, 25 bp, Mus musculus
atgcctttttgtagtagcttctgtg

SEQ ID NO: 260534 - DNA, 25 bp, Mus musculus
atgcctttttgttgtagcttctgtg

SEQ ID NO: 260535 - DNA, 25 bp, Mus musculus
atgccttttttaaaccgcgtgtgct

SEQ ID NO: 260536 - DNA, 25 bp, Mus musculus
atgccttttttaatctaccagccta

SEQ ID NO: 260537 - DNA, 25 bp, Mus musculus
atgccttttttataccgcgtgtgct

SEQ ID NO: 260538 - DNA, 25 bp, Mus musculus
atgccttttttattctaccagccta

SEQ ID NO: 260539 - DNA, 25 bp, Mus musculus
atgcgaaaactgagacgtatccttt

SEQ ID NO: 260540 - DNA, 25 bp, Mus musculus
atgcgaaaactgtgacgtatccttt

SEQ ID NO: 260541 - DNA, 25 bp, Mus musculus
atgcgaaatgcaatctgtccactca

SEQ ID NO: 260542 - DNA, 25 bp, Mus musculus
atgcgaaatgcattctgtccactca

SEQ ID NO: 260543 - DNA, 25 bp, Mus musculus
atgcgaaggcacacaggaacttcct

SEQ ID NO: 260544 - DNA, 25 bp, Mus musculus
atgcgaaggcactcaggaacttcct

SEQ ID NO: 260545 - DNA, 25 bp, Mus musculus
atgcgaatacaacttcacggccctc

SEQ ID NO: 260546 - DNA, 25 bp, Mus musculus
atgcgaatacaagttcacggccctc

SEQ ID NO: 260547 - DNA, 25 bp, Mus musculus
atgcgacactccaaacagacacatg

SEQ ID NO: 260548 - DNA, 25 bp, Mus musculus
atgcgacactcctaacagacacatg

SEQ ID NO: 260549 - DNA, 25 bp, Mus musculus
atgcgacatattccacaactgttag

SEQ ID NO: 260550 - DNA, 25 bp, Mus musculus
atgcgacatattgcacaactgttag

SEQ ID NO: 260551 - DNA, 25 bp, Mus musculus
atgcgacatcttcccttaagtccgg

SEQ ID NO: 260552 - DNA, 25 bp, Mus musculus
atgcgacatcttgccttaagtccgg

SEQ ID NO: 260553 - DNA, 25 bp, Mus musculus
atgcgacgggccagctggatgtcct

SEQ ID NO: 260554 - DNA, 25 bp, Mus musculus
atgcgacgggcctgctggatgtcct

SEQ ID NO: 260555 - DNA, 25 bp, Mus musculus
atgcgacgtggacgtgttcaacatc

SEQ ID NO: 260556 - DNA, 25 bp, Mus musculus
atgcgacgtggaggtgttcaacatc

SEQ ID NO: 260557 - DNA, 25 bp, Mus musculus
atgcgactaataatccagtactggg

SEQ ID NO: 260558 - DNA, 25 bp, Mus musculus
atgcgactaatattccagtactggg

SEQ ID NO: 260559 - DNA, 25 bp, Mus musculus
atgcgactatctccatccttagtat

SEQ ID NO: 260560 - DNA, 25 bp, Mus musculus
atgcgactatctgcatccttagtat

SEQ ID NO: 260561 - DNA, 25 bp, Mus musculus
atgcgactccccagccttaaattaa

SEQ ID NO: 260562 - DNA, 25 bp, Mus musculus
atgcgactcccctgccttaaattaa

SEQ ID NO: 260563 - DNA, 25 bp, Mus musculus
atgcgactgactcgccaggtgtgaa

SEQ ID NO: 260564 - DNA, 25 bp, Mus musculus
atgcgactgactggccaggtgtgaa

SEQ ID NO: 260565 - DNA, 25 bp, Mus musculus
atgcgactttgactggtaccttttg

SEQ ID NO: 260566 - DNA, 25 bp, Mus musculus
atgcgactttgagtggtaccttttg

SEQ ID NO: 260567 - DNA, 25 bp, Mus musculus
atgcgagaacaaatccccttcggag

SEQ ID NO: 260568 - DNA, 25 bp, Mus musculus
atgcgagaacaattccccttcggag

SEQ ID NO: 260569 - DNA, 25 bp, Mus musculus
atgcgagaccagatttaaagagact

SEQ ID NO: 260570 - DNA, 25 bp, Mus musculus
atgcgagaccagttttaaagagact

SEQ ID NO: 260571 - DNA, 25 bp, Mus musculus
atgcgagagccaatcagtaggaacg

SEQ ID NO: 260572 - DNA, 25 bp, Mus musculus
atgcgagagccattcagtaggaacg

SEQ ID NO: 260573 - DNA, 25 bp, Mus musculus
atgcgagcaaagcattctcatcagt

SEQ ID NO: 260574 - DNA, 25 bp, Mus musculus
atgcgagcaaaggattctcatcagt

SEQ ID NO: 260575 - DNA, 25 bp, Mus musculus
atgcgagccatgacacttgtcagca

SEQ ID NO: 260576 - DNA, 25 bp, Mus musculus
atgcgagccatgtcacttgtcagca

SEQ ID NO: 260577 - DNA, 25 bp, Mus musculus
atgcgaggaaacctattcatcaggg

SEQ ID NO: 260578 - DNA, 25 bp, Mus musculus
atgcgaggaaacgtattcatcaggg

SEQ ID NO: 260579 - DNA, 25 bp, Mus musculus
atgcgaggacttcatttgcaactgt

SEQ ID NO: 260580 - DNA, 25 bp, Mus musculus
atgcgaggacttgatttgcaactgt

SEQ ID NO: 260581 - DNA, 25 bp, Mus musculus
atgcgaggataacttttacactttt

SEQ ID NO: 260582 - DNA, 25 bp, Mus musculus
atgcgaggataagttttacactttt

SEQ ID NO: 260583 - DNA, 25 bp, Mus musculus
atgcgaggttctcgccctattaaaa

SEQ ID NO: 260584 - DNA, 25 bp, Mus musculus
atgcgaggttctggccctattaaaa

SEQ ID NO: 260585 - DNA, 25 bp, Mus musculus
atgcgagtcatgatatccagaagtt

SEQ ID NO: 260586 - DNA, 25 bp, Mus musculus
atgcgagtcatgttatccagaagtt

SEQ ID NO: 260587 - DNA, 25 bp, Mus musculus
atgcgagtgactacttgccatctgc

SEQ ID NO: 260588 - DNA, 25 bp, Mus musculus
atgcgagtgacttcttgccatctgc

SEQ ID NO: 260589 - DNA, 25 bp, Mus musculus
atgcgagtgcagatcctcaaggact

SEQ ID NO: 260590 - DNA, 25 bp, Mus musculus
atgcgagtgcagttcctcaaggact

SEQ ID NO: 260591 - DNA, 25 bp, Mus musculus
atgcgagtgccaaataggtctttac

SEQ ID NO: 260592 - DNA, 25 bp, Mus musculus
atgcgagtgccatataggtctttac

SEQ ID NO: 260593 - DNA, 25 bp, Mus musculus
atgcgagtgtacagtgggcctagcc

SEQ ID NO: 260594 - DNA, 25 bp, Mus musculus
atgcgagtgtactgtgggcctagcc

SEQ ID NO: 260595 - DNA, 25 bp, Mus musculus
atgcgagttcccctgaggagtatgc

SEQ ID NO: 260596 - DNA, 25 bp, Mus musculus
atgcgagttcccgtgaggagtatgc

SEQ ID NO: 260597 - DNA, 25 bp, Mus musculus
atgcgatatgagacggagctactga

SEQ ID NO: 260598 - DNA, 25 bp, Mus musculus
atgcgatatgagtcggagctactga

SEQ ID NO: 260599 - DNA, 25 bp, Mus musculus
atgcgatattcgagatgggccctag

SEQ ID NO: 260600 - DNA, 25 bp, Mus musculus
atgcgatattcgtgatgggccctag

SEQ ID NO: 260601 - DNA, 25 bp, Mus musculus
atgcgatcaggtctttggatggcaa

SEQ ID NO: 260602 - DNA, 25 bp, Mus musculus
atgcgatcaggtgtttggatggcaa

SEQ ID NO: 260603 - DNA, 25 bp, Mus musculus
atgcgatgctgcaaagctcaccgtg

SEQ ID NO: 260604 - DNA, 25 bp, Mus musculus
atgcgatgctgctaagctcaccgtg

SEQ ID NO: 260605 - DNA, 25 bp, Mus musculus
atgcgatggtctccaggtggccaca

SEQ ID NO: 260606 - DNA, 25 bp, Mus musculus
atgcgatggtctgcaggtggccaca

SEQ ID NO: 260607 - DNA, 25 bp, Mus musculus
atgcgatggttcactgactctcact

SEQ ID NO: 260608 - DNA, 25 bp, Mus musculus
atgcgatggttctctgactctcact

SEQ ID NO: 260609 - DNA, 25 bp, Mus musculus
atgcgattgagtccattttccctta

SEQ ID NO: 260610 - DNA, 25 bp, Mus musculus
atgcgattgagtgcattttccctta

SEQ ID NO: 260611 - DNA, 25 bp, Mus musculus
atgcgcaatgatcaccaagcctcag

SEQ ID NO: 260612 - DNA, 25 bp, Mus musculus
atgcgcaatgatgaccaagcctcag

SEQ ID NO: 260613 - DNA, 25 bp, Mus musculus
atgcgcacacataggcctgagcgtg

SEQ ID NO: 260614 - DNA, 25 bp, Mus musculus
atgcgcacacattggcctgagcgtg

SEQ ID NO: 260615 - DNA, 25 bp, Mus musculus
atgcgcacatcaaattcctttctaa

SEQ ID NO: 260616 - DNA, 25 bp, Mus musculus
atgcgcacatcatattcctttctaa

SEQ ID NO: 260617 - DNA, 25 bp, Mus musculus
atgcgcaccatgcagccgtaccgga

SEQ ID NO: 260618 - DNA, 25 bp, Mus musculus
atgcgcaccatggagccgtaccgga

SEQ ID NO: 260619 - DNA, 25 bp, Mus musculus
atgcgcagacctacatcgctctgtg

SEQ ID NO: 260620 - DNA, 25 bp, Mus musculus
atgcgcagaccttcatcgctctgtg

SEQ ID NO: 260621 - DNA, 25 bp, Mus musculus
atgcgcagcagaaccagtgttatgt

SEQ ID NO: 260622 - DNA, 25 bp, Mus musculus
atgcgcagcagatccagtgttatgt

SEQ ID NO: 260623 - DNA, 25 bp, Mus musculus
atgcgcagcagccacagacatgcca

SEQ ID NO: 260624 - DNA, 25 bp, Mus musculus
atgcgcagcagcgacagacatgcca

SEQ ID NO: 260625 - DNA, 25 bp, Mus musculus
atgcgcagcgttcgacgttagctca

SEQ ID NO: 260626 - DNA, 25 bp, Mus musculus
atgcgcagcgttggacgttagctca

SEQ ID NO: 260627 - DNA, 25 bp, Mus musculus
atgcgcagggcaagtgcacacacgc

SEQ ID NO: 260628 - DNA, 25 bp, Mus musculus
atgcgcagggcatgtgcacacacgc

SEQ ID NO: 260629 - DNA, 25 bp, Mus musculus
atgcgcaggtagaccagttccaggc

SEQ ID NO: 260630 - DNA, 25 bp, Mus musculus
atgcgcaggtagtccagttccaggc

SEQ ID NO: 260631 - DNA, 25 bp, Mus musculus
atgcgcagtgataactcagggcccc

SEQ ID NO: 260632 - DNA, 25 bp, Mus musculus
atgcgcagtgattactcagggcccc

SEQ ID NO: 260633 - DNA, 25 bp, Mus musculus
atgcgcatctgccaggtgaacaaga

SEQ ID NO: 260634 - DNA, 25 bp, Mus musculus
atgcgcatctgcgaggtgaacaaga

SEQ ID NO: 260635 - DNA, 25 bp, Mus musculus
atgcgcatgaataattttcttccat

SEQ ID NO: 260636 - DNA, 25 bp, Mus musculus
atgcgcatgaattattttcttccat

SEQ ID NO: 260637 - DNA, 25 bp, Mus musculus
atgcgccaatgaagctaatgacgac

SEQ ID NO: 260638 - DNA, 25 bp, Mus musculus
atgcgccaatgatgctaatgacgac

SEQ ID NO: 260639 - DNA, 25 bp, Mus musculus
atgcgccaccaccaatgctagtggc

SEQ ID NO: 260640 - DNA, 25 bp, Mus musculus
atgcgccaccacgaatgctagtggc

SEQ ID NO: 260641 - DNA, 25 bp, Mus musculus
atgcgccagggtcgtcagcccagat

SEQ ID NO: 260642 - DNA, 25 bp, Mus musculus
atgcgccagggtggtcagcccagat

SEQ ID NO: 260643 - DNA, 25 bp, Mus musculus
atgcgcccatctatttgattacctc

SEQ ID NO: 260644 - DNA, 25 bp, Mus musculus
atgcgcccatctttttgattacctc

SEQ ID NO: 260645 - DNA, 25 bp, Mus musculus
atgcgccctaggcaatggttgttct

SEQ ID NO: 260646 - DNA, 25 bp, Mus musculus
atgcgccctagggaatggttgttct

SEQ ID NO: 260647 - DNA, 25 bp, Mus musculus
atgcgccctctcacattcggaggaa

SEQ ID NO: 260648 - DNA, 25 bp, Mus musculus
atgcgccctctctcattcggaggaa

SEQ ID NO: 260649 - DNA, 25 bp, Mus musculus
atgcgccctggaaacctggccccag

SEQ ID NO: 260650 - DNA, 25 bp, Mus musculus
atgcgccctggatacctggccccag

SEQ ID NO: 260651 - DNA, 25 bp, Mus musculus
atgcgcctaaggaactctgctcctg

SEQ ID NO: 260652 - DNA, 25 bp, Mus musculus
atgcgcctaaggtactctgctcctg

SEQ ID NO: 260653 - DNA, 25 bp, Mus musculus
atgcgcctcttgataagcgtctgag

SEQ ID NO: 260654 - DNA, 25 bp, Mus musculus
atgcgcctcttgttaagcgtctgag

SEQ ID NO: 260655 - DNA, 25 bp, Mus musculus
atgcgccttgtcatactaaacgtgt

SEQ ID NO: 260656 - DNA, 25 bp, Mus musculus
atgcgccttgtcttactaaacgtgt

SEQ ID NO: 260657 - DNA, 25 bp, Mus musculus
atgcgcgaccagctctagaccctga

SEQ ID NO: 260658 - DNA, 25 bp, Mus musculus
atgcgcgaccaggtctagaccctga

SEQ ID NO: 260659 - DNA, 25 bp, Mus musculus
atgcgcgatgcgaagctctttgttc

SEQ ID NO: 260660 - DNA, 25 bp, Mus musculus
atgcgcgatgcgtagctctttgttc

SEQ ID NO: 260661 - DNA, 25 bp, Mus musculus
atgcgcgcgcgaagaccaacgaggc

SEQ ID NO: 260662 - DNA, 25 bp, Mus musculus
atgcgcgcgcgatgaccaacgaggc

SEQ ID NO: 260663 - DNA, 25 bp, Mus musculus
atgcgcggactcatcggctgttgca

SEQ ID NO: 260664 - DNA, 25 bp, Mus musculus
atgcgcggactcttcggctgttgca

SEQ ID NO: 260665 - DNA, 25 bp, Mus musculus
atgcgcgttcttatcactggtttat

SEQ ID NO: 260666 - DNA, 25 bp, Mus musculus
atgcgcgttcttttcactggtttat

SEQ ID NO: 260667 - DNA, 25 bp, Mus musculus
atgcgctaatggctcgtcttgggat

SEQ ID NO: 260668 - DNA, 25 bp, Mus musculus
atgcgctaatgggtcgtcttgggat

SEQ ID NO: 260669 - DNA, 25 bp, Mus musculus
atgcgctcacgtaatacctggttat

SEQ ID NO: 260670 - DNA, 25 bp, Mus musculus
atgcgctcacgttatacctggttat

SEQ ID NO: 260671 - DNA, 25 bp, Mus musculus
atgcgctcatctagttttgacttca

SEQ ID NO: 260672 - DNA, 25 bp, Mus musculus
atgcgctcatcttgttttgacttca

SEQ ID NO: 260673 - DNA, 25 bp, Mus musculus
atgcgctcattcctaagaactcatc

SEQ ID NO: 260674 - DNA, 25 bp, Mus musculus
atgcgctcattcgtaagaactcatc

SEQ ID NO: 260675 - DNA, 25 bp, Mus musculus
atgcgctccatcaccactagaggga

SEQ ID NO: 260676 - DNA, 25 bp, Mus musculus
atgcgctccatctccactagaggga

SEQ ID NO: 260677 - DNA, 25 bp, Mus musculus
atgcgctcctctcattgagggcagt

SEQ ID NO: 260678 - DNA, 25 bp, Mus musculus
atgcgctcctctgattgagggcagt

SEQ ID NO: 260679 - DNA, 25 bp, Mus musculus
atgcgctcgacactctcagtgatat

SEQ ID NO: 260680 - DNA, 25 bp, Mus musculus
atgcgctcgacagtctcagtgatat

SEQ ID NO: 260681 - DNA, 25 bp, Mus musculus
atgcgctcggagaccttgaggttac

SEQ ID NO: 260682 - DNA, 25 bp, Mus musculus
atgcgctcggagtccttgaggttac

SEQ ID NO: 260683 - DNA, 25 bp, Mus musculus
atgcgctctactcaaggtcgccaga

SEQ ID NO: 260684 - DNA, 25 bp, Mus musculus
atgcgctctactgaaggtcgccaga

SEQ ID NO: 260685 - DNA, 25 bp, Mus musculus
atgcgctctattccccatgggatat

SEQ ID NO: 260686 - DNA, 25 bp, Mus musculus
atgcgctctattgcccatgggatat

SEQ ID NO: 260687 - DNA, 25 bp, Mus musculus
atgcgctgagacaggcgtacaggtt

SEQ ID NO: 260688 - DNA, 25 bp, Mus musculus
atgcgctgagactggcgtacaggtt

SEQ ID NO: 260689 - DNA, 25 bp, Mus musculus
atgcgctgcagccagtgttcatgga

SEQ ID NO: 260690 - DNA, 25 bp, Mus musculus
atgcgctgcagcgagtgttcatgga

SEQ ID NO: 260691 - DNA, 25 bp, Mus musculus
atgcgctgctgcctggagtacagtt

SEQ ID NO: 260692 - DNA, 25 bp, Mus musculus
atgcgctgctgcgtggagtacagtt

SEQ ID NO: 260693 - DNA, 25 bp, Mus musculus
atgcgctggaccaagaggagagttc

SEQ ID NO: 260694 - DNA, 25 bp, Mus musculus
atgcgctggacctagaggagagttc

SEQ ID NO: 260695 - DNA, 25 bp, Mus musculus
atgcgctgggagcacgttctgatcc

SEQ ID NO: 260696 - DNA, 25 bp, Mus musculus
atgcgctgggaggacgttctgatcc

SEQ ID NO: 260697 - DNA, 25 bp, Mus musculus
atgcgctggtgcagcgtccttatga

SEQ ID NO: 260698 - DNA, 25 bp, Mus musculus
atgcgctggtgctgcgtccttatga

SEQ ID NO: 260699 - DNA, 25 bp, Mus musculus
atgcgctgtaagattcctattgaaa

SEQ ID NO: 260700 - DNA, 25 bp, Mus musculus
atgcgctgtaagtttcctattgaaa

SEQ ID NO: 260701 - DNA, 25 bp, Mus musculus
atgcgctgtgtacctgctacactgt

SEQ ID NO: 260702 - DNA, 25 bp, Mus musculus
atgcgctgtgtagctgctacactgt

SEQ ID NO: 260703 - DNA, 25 bp, Mus musculus
atgcgcttaacccatttaccataat

SEQ ID NO: 260704 - DNA, 25 bp, Mus musculus
atgcgcttaaccgatttaccataat

SEQ ID NO: 260705 - DNA, 25 bp, Mus musculus
atgcgcttagccagtcgagcccact

SEQ ID NO: 260706 - DNA, 25 bp, Mus musculus
atgcgcttagcctgtcgagcccact

SEQ ID NO: 260707 - DNA, 25 bp, Mus musculus
atgcgcttatcccgcctctgcgtgg

SEQ ID NO: 260708 - DNA, 25 bp, Mus musculus
atgcgcttatccggcctctgcgtgg

SEQ ID NO: 260709 - DNA, 25 bp, Mus musculus
atgcgcttttagcatcaaaagaaaa

SEQ ID NO: 260710 - DNA, 25 bp, Mus musculus
atgcgcttttaggatcaaaagaaaa

SEQ ID NO: 260711 - DNA, 25 bp, Mus musculus
atgcggacaccaaagcttttagctt

SEQ ID NO: 260712 - DNA, 25 bp, Mus musculus
atgcggacaccatagcttttagctt

SEQ ID NO: 260713 - DNA, 25 bp, Mus musculus
atgcggagacaacaggaccagtact

SEQ ID NO: 260714 - DNA, 25 bp, Mus musculus
atgcggagacaagaggaccagtact

SEQ ID NO: 260715 - DNA, 25 bp, Mus musculus
atgcggagacacagactttcatctg

SEQ ID NO: 260716 - DNA, 25 bp, Mus musculus
atgcggagacactgactttcatctg

SEQ ID NO: 260717 - DNA, 25 bp, Mus musculus
atgcggagagccagccatgaagata

SEQ ID NO: 260718 - DNA, 25 bp, Mus musculus
atgcggagagcctgccatgaagata

SEQ ID NO: 260719 - DNA, 25 bp, Mus musculus
atgcggagccgaactttgacgagga

SEQ ID NO: 260720 - DNA, 25 bp, Mus musculus
atgcggagccgatctttgacgagga

SEQ ID NO: 260721 - DNA, 25 bp, Mus musculus
atgcggatgatcacaagagttacta

SEQ ID NO: 260722 - DNA, 25 bp, Mus musculus
atgcggatgatctcaagagttacta

SEQ ID NO: 260723 - DNA, 25 bp, Mus musculus
atgcggatttctaattcctcacggc

SEQ ID NO: 260724 - DNA, 25 bp, Mus musculus
atgcggatttcttattcctcacggc

SEQ ID NO: 260725 - DNA, 25 bp, Mus musculus
atgcggcaaaaccagtcatcgaact

SEQ ID NO: 260726 - DNA, 25 bp, Mus musculus
atgcggcaaaacgagtcatcgaact

SEQ ID NO: 260727 - DNA, 25 bp, Mus musculus
atgcggcaatggaacgtcaactggg

SEQ ID NO: 260728 - DNA, 25 bp, Mus musculus
atgcggcaatggtacgtcaactggg

SEQ ID NO: 260729 - DNA, 25 bp, Mus musculus
atgcggcagccacacatacacatca

SEQ ID NO: 260730 - DNA, 25 bp, Mus musculus
atgcggcagccagacatacacatca

SEQ ID NO: 260731 - DNA, 25 bp, Mus musculus
atgcggcaggcactcagtctatttg

SEQ ID NO: 260732 - DNA, 25 bp, Mus musculus
atgcggcaggcagtcagtctatttg

SEQ ID NO: 260733 - DNA, 25 bp, Mus musculus
atgcggcaggtgcaacttgcccagt

SEQ ID NO: 260734 - DNA, 25 bp, Mus musculus
atgcggcaggtggaacttgcccagt

SEQ ID NO: 260735 - DNA, 25 bp, Mus musculus
atgcggcatgcaatgttcctaccat

SEQ ID NO: 260736 - DNA, 25 bp, Mus musculus
atgcggcatgcattgttcctaccat

SEQ ID NO: 260737 - DNA, 25 bp, Mus musculus
atgcggccaagtaggctgtgaccgt

SEQ ID NO: 260738 - DNA, 25 bp, Mus musculus
atgcggccaagttggctgtgaccgt

SEQ ID NO: 260739 - DNA, 25 bp, Mus musculus
atgcggcccacgaagtctttagaga

SEQ ID NO: 260740 - DNA, 25 bp, Mus musculus
atgcggcccacgtagtctttagaga

SEQ ID NO: 260741 - DNA, 25 bp, Mus musculus
atgcggccccataactaacaaacaa

SEQ ID NO: 260742 - DNA, 25 bp, Mus musculus
atgcggccccattactaacaaacaa

SEQ ID NO: 260743 - DNA, 25 bp, Mus musculus
atgcggccttcactattcagtgtat

SEQ ID NO: 260744 - DNA, 25 bp, Mus musculus
atgcggccttcagtattcagtgtat

SEQ ID NO: 260745 - DNA, 25 bp, Mus musculus
atgcggcgcgttatgtgccactgga

SEQ ID NO: 260746 - DNA, 25 bp, Mus musculus
atgcggcgcgttttgtgccactgga

SEQ ID NO: 260747 - DNA, 25 bp, Mus musculus
atgcggcgtctccttctgcttaatg

SEQ ID NO: 260748 - DNA, 25 bp, Mus musculus
atgcggcgtctcgttctgcttaatg

SEQ ID NO: 260749 - DNA, 25 bp, Mus musculus
atgcggctccaccaaattacttctg

SEQ ID NO: 260750 - DNA, 25 bp, Mus musculus
atgcggctccacgaaattacttctg

SEQ ID NO: 260751 - DNA, 25 bp, Mus musculus
atgcggctgggcacagctgtgctct

SEQ ID NO: 260752 - DNA, 25 bp, Mus musculus
atgcggctgggctcagctgtgctct

SEQ ID NO: 260753 - DNA, 25 bp, Mus musculus
atgcggcttttgctcagtctagtat

SEQ ID NO: 260754 - DNA, 25 bp, Mus musculus
atgcggcttttggtcagtctagtat

SEQ ID NO: 260755 - DNA, 25 bp, Mus musculus
atgcgggaaaacacgggctccagtg

SEQ ID NO: 260756 - DNA, 25 bp, Mus musculus
atgcgggaaaactcgggctccagtg

SEQ ID NO: 260757 - DNA, 25 bp, Mus musculus
atgcgggaaaatcctatgaccatac

SEQ ID NO: 260758 - DNA, 25 bp, Mus musculus
atgcgggaaaatgctatgaccatac

SEQ ID NO: 260759 - DNA, 25 bp, Mus musculus
atgcgggaaaggctttcggtctctt

SEQ ID NO: 260760 - DNA, 25 bp, Mus musculus
atgcgggaaagggtttcggtctctt

SEQ ID NO: 260761 - DNA, 25 bp, Mus musculus
atgcgggaccccagattggaacttt

SEQ ID NO: 260762 - DNA, 25 bp, Mus musculus
atgcgggacccctgattggaacttt

SEQ ID NO: 260763 - DNA, 25 bp, Mus musculus
atgcgggaccgtatgaaagtgttgc

SEQ ID NO: 260764 - DNA, 25 bp, Mus musculus
atgcgggaccgtttgaaagtgttgc

SEQ ID NO: 260765 - DNA, 25 bp, Mus musculus
atgcgggactaccagcaagccggct

SEQ ID NO: 260766 - DNA, 25 bp, Mus musculus
atgcgggactacgagcaagccggct

SEQ ID NO: 260767 - DNA, 25 bp, Mus musculus
atgcgggactatatccagaagcacc

SEQ ID NO: 260768 - DNA, 25 bp, Mus musculus
atgcgggactatttccagaagcacc

SEQ ID NO: 260769 - DNA, 25 bp, Mus musculus
atgcgggagccacttccaggcgaat

SEQ ID NO: 260770 - DNA, 25 bp, Mus musculus
atgcgggagccagttccaggcgaat

SEQ ID NO: 260771 - DNA, 25 bp, Mus musculus
atgcgggcaaagaatttcgaggaac

SEQ ID NO: 260772 - DNA, 25 bp, Mus musculus
atgcgggcaaagtatttcgaggaac

SEQ ID NO: 260773 - DNA, 25 bp, Mus musculus
atgcgggccactcttgatagacaaa

SEQ ID NO: 260774 - DNA, 25 bp, Mus musculus
atgcgggccactgttgatagacaaa

SEQ ID NO: 260775 - DNA, 25 bp, Mus musculus
atgcgggcccgacacaatgtgtatc

SEQ ID NO: 260776 - DNA, 25 bp, Mus musculus
atgcgggcccgagacaatgtgtatc

SEQ ID NO: 260777 - DNA, 25 bp, Mus musculus
atgcgggccttgacagcgcggcaca

SEQ ID NO: 260778 - DNA, 25 bp, Mus musculus
atgcgggccttgtcagcgcggcaca

SEQ ID NO: 260779 - DNA, 25 bp, Mus musculus
atgcgggctcataaccaaacaggtt

SEQ ID NO: 260780 - DNA, 25 bp, Mus musculus
atgcgggctcattaccaaacaggtt

SEQ ID NO: 260781 - DNA, 25 bp, Mus musculus
atgcgggtgtggaatgctcctgact

SEQ ID NO: 260782 - DNA, 25 bp, Mus musculus
atgcgggtgtggtatgctcctgact

SEQ ID NO: 260783 - DNA, 25 bp, Mus musculus
atgcgggtttacaccaaggatacgt

SEQ ID NO: 260784 - DNA, 25 bp, Mus musculus
atgcgggtttactccaaggatacgt

SEQ ID NO: 260785 - DNA, 25 bp, Mus musculus
atgcggtacataaacggaactcgtc

SEQ ID NO: 260786 - DNA, 25 bp, Mus musculus
atgcggtacatatacggaactcgtc

SEQ ID NO: 260787 - DNA, 25 bp, Mus musculus
atgcggtagctgctggctctcatgc

SEQ ID NO: 260788 - DNA, 25 bp, Mus musculus
atgcggtagctggtggctctcatgc

SEQ ID NO: 260789 - DNA, 25 bp, Mus musculus
atgcggtcacatccacctttaagat

SEQ ID NO: 260790 - DNA, 25 bp, Mus musculus
atgcggtcacatgcacctttaagat

SEQ ID NO: 260791 - DNA, 25 bp, Mus musculus
atgcggtccaggatacagtgtctcc

SEQ ID NO: 260792 - DNA, 25 bp, Mus musculus
atgcggtccaggttacagtgtctcc

SEQ ID NO: 260793 - DNA, 25 bp, Mus musculus
atgcggtgagacaagctactctccg

SEQ ID NO: 260794 - DNA, 25 bp, Mus musculus
atgcggtgagactagctactctccg

SEQ ID NO: 260795 - DNA, 25 bp, Mus musculus
atgcggtgccatagccgagcagagc

SEQ ID NO: 260796 - DNA, 25 bp, Mus musculus
atgcggtgccattgccgagcagagc

SEQ ID NO: 260797 - DNA, 25 bp, Mus musculus
atgcggtgccgacttctttgggttt

SEQ ID NO: 260798 - DNA, 25 bp, Mus musculus
atgcggtgccgagttctttgggttt

SEQ ID NO: 260799 - DNA, 25 bp, Mus musculus
atgcggtgcctgcaagacttggcct

SEQ ID NO: 260800 - DNA, 25 bp, Mus musculus
atgcggtgcctggaagacttggcct

SEQ ID NO: 260801 - DNA, 25 bp, Mus musculus
atgcggtgggcaagcactttgacct

SEQ ID NO: 260802 - DNA, 25 bp, Mus musculus
atgcggtgggcatgcactttgacct

SEQ ID NO: 260803 - DNA, 25 bp, Mus musculus
atgcggttaattagaagtgctgttt

SEQ ID NO: 260804 - DNA, 25 bp, Mus musculus
atgcggttaatttgaagtgctgttt

SEQ ID NO: 260805 - DNA, 25 bp, Mus musculus
atgcggttataccagtgggctgaac

SEQ ID NO: 260806 - DNA, 25 bp, Mus musculus
atgcggttatacgagtgggctgaac

SEQ ID NO: 260807 - DNA, 25 bp, Mus musculus
atgcggtttcttcagctggaatgcc

SEQ ID NO: 260808 - DNA, 25 bp, Mus musculus
atgcggtttcttgagctggaatgcc

SEQ ID NO: 260809 - DNA, 25 bp, Mus musculus
atgcgtaaccagatccttccagatg

SEQ ID NO: 260810 - DNA, 25 bp, Mus musculus
atgcgtaaccagttccttccagatg

SEQ ID NO: 260811 - DNA, 25 bp, Mus musculus
atgcgtacacttcgccttgcaggct

SEQ ID NO: 260812 - DNA, 25 bp, Mus musculus
atgcgtacacttggccttgcaggct

SEQ ID NO: 260813 - DNA, 25 bp, Mus musculus
atgcgtaccactctcgctgcatcga

SEQ ID NO: 260814 - DNA, 25 bp, Mus musculus
atgcgtaccactgtcgctgcatcga

SEQ ID NO: 260815 - DNA, 25 bp, Mus musculus
atgcgtacgttccactcaacagatc

SEQ ID NO: 260816 - DNA, 25 bp, Mus musculus
atgcgtacgttcgactcaacagatc

SEQ ID NO: 260817 - DNA, 25 bp, Mus musculus
atgcgtactggcaggttacccgtgg

SEQ ID NO: 260818 - DNA, 25 bp, Mus musculus
atgcgtactggctggttacccgtgg

SEQ ID NO: 260819 - DNA, 25 bp, Mus musculus
atgcgtactgtcaacagctttgagg

SEQ ID NO: 260820 - DNA, 25 bp, Mus musculus
atgcgtactgtctacagctttgagg

SEQ ID NO: 260821 - DNA, 25 bp, Mus musculus
atgcgtataacacacagccacagcg

SEQ ID NO: 260822 - DNA, 25 bp, Mus musculus
atgcgtataacagacagccacagcg

SEQ ID NO: 260823 - DNA, 25 bp, Mus musculus
atgcgtatcaacagcagactcgcct

SEQ ID NO: 260824 - DNA, 25 bp, Mus musculus
atgcgtatcaactgcagactcgcct

SEQ ID NO: 260825 - DNA, 25 bp, Mus musculus
atgcgtatccttagcttgtattttg

SEQ ID NO: 260826 - DNA, 25 bp, Mus musculus
atgcgtatcctttgcttgtattttg

SEQ ID NO: 260827 - DNA, 25 bp, Mus musculus
atgcgtatggccaggccttacagct

SEQ ID NO: 260828 - DNA, 25 bp, Mus musculus
atgcgtatggcctggccttacagct

SEQ ID NO: 260829 - DNA, 25 bp, Mus musculus
atgcgtatggctcacttctggctca

SEQ ID NO: 260830 - DNA, 25 bp, Mus musculus
atgcgtatggctgacttctggctca

SEQ ID NO: 260831 - DNA, 25 bp, Mus musculus
atgcgtattgcccacgccgcagtat

SEQ ID NO: 260832 - DNA, 25 bp, Mus musculus
atgcgtattgccgacgccgcagtat

SEQ ID NO: 260833 - DNA, 25 bp, Mus musculus
atgcgtatttatagcttacatgtgt

SEQ ID NO: 260834 - DNA, 25 bp, Mus musculus
atgcgtatttattgcttacatgtgt

SEQ ID NO: 260835 - DNA, 25 bp, Mus musculus
atgcgtcagcacaggcttgatggca

SEQ ID NO: 260836 - DNA, 25 bp, Mus musculus
atgcgtcagcactggcttgatggca

SEQ ID NO: 260837 - DNA, 25 bp, Mus musculus
atgcgtcctgggagttgaatgttgc

SEQ ID NO: 260838 - DNA, 25 bp, Mus musculus
atgcgtcctgggtgttgaatgttgc

SEQ ID NO: 260839 - DNA, 25 bp, Mus musculus
atgcgtcgcaagcaggaagaacaca

SEQ ID NO: 260840 - DNA, 25 bp, Mus musculus
atgcgtcgcaaggaggaagaacaca

SEQ ID NO: 260841 - DNA, 25 bp, Mus musculus
atgcgtctcatacgctcccagaaca

SEQ ID NO: 260842 - DNA, 25 bp, Mus musculus
atgcgtctcataggctcccagaaca

SEQ ID NO: 260843 - DNA, 25 bp, Mus musculus
atgcgtctcctcagtaggtctgcga

SEQ ID NO: 260844 - DNA, 25 bp, Mus musculus
atgcgtctcctctgtaggtctgcga

SEQ ID NO: 260845 - DNA, 25 bp, Mus musculus
atgcgtctgggcagtggaagctcac

SEQ ID NO: 260846 - DNA, 25 bp, Mus musculus
atgcgtctgggctgtggaagctcac

SEQ ID NO: 260847 - DNA, 25 bp, Mus musculus
atgcgtctgtcaatttgcctttaac

SEQ ID NO: 260848 - DNA, 25 bp, Mus musculus
atgcgtctgtcattttgcctttaac

SEQ ID NO: 260849 - DNA, 25 bp, Mus musculus
atgcgtcttcagaacgtgattcttg

SEQ ID NO: 260850 - DNA, 25 bp, Mus musculus
atgcgtcttcagtacgtgattcttg

SEQ ID NO: 260851 - DNA, 25 bp, Mus musculus
atgcgtcttcttcccagcaccaatg

SEQ ID NO: 260852 - DNA, 25 bp, Mus musculus
atgcgtcttcttgccagcaccaatg

SEQ ID NO: 260853 - DNA, 25 bp, Mus musculus
atgcgtgaggatctggtctcctcca

SEQ ID NO: 260854 - DNA, 25 bp, Mus musculus
atgcgtgaggatgtggtctcctcca

SEQ ID NO: 260855 - DNA, 25 bp, Mus musculus
atgcgtgagtcaactcctcagggtt

SEQ ID NO: 260856 - DNA, 25 bp, Mus musculus
atgcgtgagtcatctcctcagggtt

SEQ ID NO: 260857 - DNA, 25 bp, Mus musculus
atgcgtgagtgcacagaactgttct

SEQ ID NO: 260858 - DNA, 25 bp, Mus musculus
atgcgtgagtgctcagaactgttct

SEQ ID NO: 260859 - DNA, 25 bp, Mus musculus
atgcgtgcacctacacatattcaaa

SEQ ID NO: 260860 - DNA, 25 bp, Mus musculus
atgcgtgcaccttcacatattcaaa

SEQ ID NO: 260861 - DNA, 25 bp, Mus musculus
atgcgtgcacttaccagcaggcgcg

SEQ ID NO: 260862 - DNA, 25 bp, Mus musculus
atgcgtgcactttccagcaggcgcg

SEQ ID NO: 260863 - DNA, 25 bp, Mus musculus
atgcgtgcagcaaatgcacctttag

SEQ ID NO: 260864 - DNA, 25 bp, Mus musculus
atgcgtgcagcatatgcacctttag

SEQ ID NO: 260865 - DNA, 25 bp, Mus musculus
atgcgtgcatgtctaggccccaagt

SEQ ID NO: 260866 - DNA, 25 bp, Mus musculus
atgcgtgcatgtgtaggccccaagt

SEQ ID NO: 260867 - DNA, 25 bp, Mus musculus
atgcgtgcccgacgtgatggaccct

SEQ ID NO: 260868 - DNA, 25 bp, Mus musculus
atgcgtgcccgaggtgatggaccct

SEQ ID NO: 260869 - DNA, 25 bp, Mus musculus
atgcgtgcccgcctggacgagttta

SEQ ID NO: 260870 - DNA, 25 bp, Mus musculus
atgcgtgcccgcgtggacgagttta

SEQ ID NO: 260871 - DNA, 25 bp, Mus musculus
atgcgtgcctttaaaatcagtgtac

SEQ ID NO: 260872 - DNA, 25 bp, Mus musculus
atgcgtgccttttaaatcagtgtac

SEQ ID NO: 260873 - DNA, 25 bp, Mus musculus
atgcgtgctttaaaactcggcgttt

SEQ ID NO: 260874 - DNA, 25 bp, Mus musculus
atgcgtgctttataactcggcgttt

SEQ ID NO: 260875 - DNA, 25 bp, Mus musculus
atgcgtggcgagcactttaccaaca

SEQ ID NO: 260876 - DNA, 25 bp, Mus musculus
atgcgtggcgaggactttaccaaca

SEQ ID NO: 260877 - DNA, 25 bp, Mus musculus
atgcgtggtcctagtgagcgagtcc

SEQ ID NO: 260878 - DNA, 25 bp, Mus musculus
atgcgtggtccttgtgagcgagtcc

SEQ ID NO: 260879 - DNA, 25 bp, Mus musculus
atgcgtggttatcgcttgactcttc

SEQ ID NO: 260880 - DNA, 25 bp, Mus musculus
atgcgtggttatggcttgactcttc

SEQ ID NO: 260881 - DNA, 25 bp, Mus musculus
atgcgtggtttgacgagcgctgatc

SEQ ID NO: 260882 - DNA, 25 bp, Mus musculus
atgcgtggtttgtcgagcgctgatc

SEQ ID NO: 260883 - DNA, 25 bp, Mus musculus
atgcgtgtaagaccccagtgagata

SEQ ID NO: 260884 - DNA, 25 bp, Mus musculus
atgcgtgtaagagcccagtgagata

SEQ ID NO: 260885 - DNA, 25 bp, Mus musculus
atgcgtgtcattattatctaacttg

SEQ ID NO: 260886 - DNA, 25 bp, Mus musculus
atgcgtgtcatttttatctaacttg

SEQ ID NO: 260887 - DNA, 25 bp, Mus musculus
atgcgtgtccccagcagaacacctt

SEQ ID NO: 260888 - DNA, 25 bp, Mus musculus
atgcgtgtcccctgcagaacacctt

SEQ ID NO: 260889 - DNA, 25 bp, Mus musculus
atgcgtgtctaaaatctaagttctt

SEQ ID NO: 260890 - DNA, 25 bp, Mus musculus
atgcgtgtctaatatctaagttctt

SEQ ID NO: 260891 - DNA, 25 bp, Mus musculus
atgcgtgtctgcctcgaggactcgt

SEQ ID NO: 260892 - DNA, 25 bp, Mus musculus
atgcgtgtctgcgtcgaggactcgt

SEQ ID NO: 260893 - DNA, 25 bp, Mus musculus
atgcgtgtgcatcgttacagggtta

SEQ ID NO: 260894 - DNA, 25 bp, Mus musculus
atgcgtgtgcatggttacagggtta

SEQ ID NO: 260895 - DNA, 25 bp, Mus musculus
atgcgtgtggcccacatgcctactg

SEQ ID NO: 260896 - DNA, 25 bp, Mus musculus
atgcgtgtggccgacatgcctactg

SEQ ID NO: 260897 - DNA, 25 bp, Mus musculus
atgcgttactaccatgtatttcggg

SEQ ID NO: 260898 - DNA, 25 bp, Mus musculus
atgcgttactacgatgtatttcggg

SEQ ID NO: 260899 - DNA, 25 bp, Mus musculus
atgcgttcacttcagactttggtac

SEQ ID NO: 260900 - DNA, 25 bp, Mus musculus
atgcgttcacttgagactttggtac

SEQ ID NO: 260901 - DNA, 25 bp, Mus musculus
atgcgttcatgtctctttcctcttc

SEQ ID NO: 260902 - DNA, 25 bp, Mus musculus
atgcgttcatgtgtctttcctcttc

SEQ ID NO: 260903 - DNA, 25 bp, Mus musculus
atgcgttcgttcattttgaggacag

SEQ ID NO: 260904 - DNA, 25 bp, Mus musculus
atgcgttcgttctttttgaggacag

SEQ ID NO: 260905 - DNA, 25 bp, Mus musculus
atgcgttctgtacatttccttccca

SEQ ID NO: 260906 - DNA, 25 bp, Mus musculus
atgcgttctgtagatttccttccca

SEQ ID NO: 260907 - DNA, 25 bp, Mus musculus
atgcgttcttgtcgaactggtgcca

SEQ ID NO: 260908 - DNA, 25 bp, Mus musculus
atgcgttcttgtggaactggtgcca

SEQ ID NO: 260909 - DNA, 25 bp, Mus musculus
atgcgttgccaactttgattgaatg

SEQ ID NO: 260910 - DNA, 25 bp, Mus musculus
atgcgttgccaagtttgattgaatg

SEQ ID NO: 260911 - DNA, 25 bp, Mus musculus
atgcgttgtcccagtcagtggcttt

SEQ ID NO: 260912 - DNA, 25 bp, Mus musculus
atgcgttgtccctgtcagtggcttt

SEQ ID NO: 260913 - DNA, 25 bp, Mus musculus
atgcgtttccctctcttacaaggtt

SEQ ID NO: 260914 - DNA, 25 bp, Mus musculus
atgcgtttccctgtcttacaaggtt

SEQ ID NO: 260915 - DNA, 25 bp, Mus musculus
atgcgtttgcaccttttgttgggaa

SEQ ID NO: 260916 - DNA, 25 bp, Mus musculus
atgcgtttgcacgttttgttgggaa

SEQ ID NO: 260917 - DNA, 25 bp, Mus musculus
atgcgtttgccacgccccgtgctgg

SEQ ID NO: 260918 - DNA, 25 bp, Mus musculus
atgcgtttgccaggccccgtgctgg

SEQ ID NO: 260919 - DNA, 25 bp, Mus musculus
atgcgtttgctaagccataggcctt

SEQ ID NO: 260920 - DNA, 25 bp, Mus musculus
atgcgtttgctatgccataggcctt

SEQ ID NO: 260921 - DNA, 25 bp, Mus musculus
atgcgtttggttctagttggacagc

SEQ ID NO: 260922 - DNA, 25 bp, Mus musculus
atgcgtttggttgtagttggacagc

SEQ ID NO: 260923 - DNA, 25 bp, Mus musculus
atgcgttttgagcttgaggctctaa

SEQ ID NO: 260924 - DNA, 25 bp, Mus musculus
atgcgttttgaggttgaggctctaa

SEQ ID NO: 260925 - DNA, 25 bp, Mus musculus
atgcgttttgatcactgatagacca

SEQ ID NO: 260926 - DNA, 25 bp, Mus musculus
atgcgttttgatgactgatagacca

SEQ ID NO: 260927 - DNA, 25 bp, Mus musculus
atgctaaaaaatccctttcctcctg

SEQ ID NO: 260928 - DNA, 25 bp, Mus musculus
atgctaaaaaatgcctttcctcctg

SEQ ID NO: 260929 - DNA, 25 bp, Mus musculus
atgctaaagaccctgctcatgagcc

SEQ ID NO: 260930 - DNA, 25 bp, Mus musculus
atgctaaagaccgtgctcatgagcc

SEQ ID NO: 260931 - DNA, 25 bp, Mus musculus
atgctaaagagactgctctgcaaaa

SEQ ID NO: 260932 - DNA, 25 bp, Mus musculus
atgctaaagagagtgctctgcaaaa

SEQ ID NO: 260933 - DNA, 25 bp, Mus musculus
atgctaaagccccatgagtcttcac

SEQ ID NO: 260934 - DNA, 25 bp, Mus musculus
atgctaaagcccgatgagtcttcac

SEQ ID NO: 260935 - DNA, 25 bp, Mus musculus
atgctaaatctgctacctgaaggtc

SEQ ID NO: 260936 - DNA, 25 bp, Mus musculus
atgctaaatctggtacctgaaggtc

SEQ ID NO: 260937 - DNA, 25 bp, Mus musculus
atgctaacagcaagcctctgacggc

SEQ ID NO: 260938 - DNA, 25 bp, Mus musculus
atgctaacagcatgcctctgacggc

SEQ ID NO: 260939 - DNA, 25 bp, Mus musculus
atgctaacagctcacttgcagtgga

SEQ ID NO: 260940 - DNA, 25 bp, Mus musculus
atgctaacagctgacttgcagtgga

SEQ ID NO: 260941 - DNA, 25 bp, Mus musculus
atgctaacatgcaatgattcatctt

SEQ ID NO: 260942 - DNA, 25 bp, Mus musculus
atgctaacatgctatgattcatctt

SEQ ID NO: 260943 - DNA, 25 bp, Mus musculus
atgctaacattcagccacacacaca

SEQ ID NO: 260944 - DNA, 25 bp, Mus musculus
atgctaacattctgccacacacaca

SEQ ID NO: 260945 - DNA, 25 bp, Mus musculus
atgctaaccggcactctgacaagat

SEQ ID NO: 260946 - DNA, 25 bp, Mus musculus
atgctaaccggctctctgacaagat

SEQ ID NO: 260947 - DNA, 25 bp, Mus musculus
atgctaaccgggagagtgtagccca

SEQ ID NO: 260948 - DNA, 25 bp, Mus musculus
atgctaaccgggtgagtgtagccca

SEQ ID NO: 260949 - DNA, 25 bp, Mus musculus
atgctaacctgccaagcagcggtgg

SEQ ID NO: 260950 - DNA, 25 bp, Mus musculus
atgctaacctgcgaagcagcggtgg

SEQ ID NO: 260951 - DNA, 25 bp, Mus musculus
atgctaacggtgaaagcccccaact

SEQ ID NO: 260952 - DNA, 25 bp, Mus musculus
atgctaacggtgtaagcccccaact

SEQ ID NO: 260953 - DNA, 25 bp, Mus musculus
atgctaactggaaggtttcaccctc

SEQ ID NO: 260954 - DNA, 25 bp, Mus musculus
atgctaactggatggtttcaccctc

SEQ ID NO: 260955 - DNA, 25 bp, Mus musculus
atgctaactgtcatgctttgagtgg

SEQ ID NO: 260956 - DNA, 25 bp, Mus musculus
atgctaactgtcttgctttgagtgg

SEQ ID NO: 260957 - DNA, 25 bp, Mus musculus
atgctaactttaaaagctgctatat

SEQ ID NO: 260958 - DNA, 25 bp, Mus musculus
atgctaactttataagctgctatat

SEQ ID NO: 260959 - DNA, 25 bp, Mus musculus
atgctaagaagcaaccaccttggag

SEQ ID NO: 260960 - DNA, 25 bp, Mus musculus
atgctaagaagctaccaccttggag

SEQ ID NO: 260961 - DNA, 25 bp, Mus musculus
atgctaagcttgcacagactttggg

SEQ ID NO: 260962 - DNA, 25 bp, Mus musculus
atgctaagcttggacagactttggg

SEQ ID NO: 260963 - DNA, 25 bp, Mus musculus
atgctaaggcagcacctgtgcctct

SEQ ID NO: 260964 - DNA, 25 bp, Mus musculus
atgctaaggcaggacctgtgcctct

SEQ ID NO: 260965 - DNA, 25 bp, Mus musculus
atgctaagggctcgcccagattatt

SEQ ID NO: 260966 - DNA, 25 bp, Mus musculus
atgctaagggctggcccagattatt

SEQ ID NO: 260967 - DNA, 25 bp, Mus musculus
atgctaagtacacacacgctctttt

SEQ ID NO: 260968 - DNA, 25 bp, Mus musculus
atgctaagtacagacacgctctttt

SEQ ID NO: 260969 - DNA, 25 bp, Mus musculus
atgctaagtgtaattgtgttcccaa

SEQ ID NO: 260970 - DNA, 25 bp, Mus musculus
atgctaagtgtatttgtgttcccaa

SEQ ID NO: 260971 - DNA, 25 bp, Mus musculus
atgctaagttaccagcttgtcttgt

SEQ ID NO: 260972 - DNA, 25 bp, Mus musculus
atgctaagttacgagcttgtcttgt

SEQ ID NO: 260973 - DNA, 25 bp, Mus musculus
atgctaatatatactcacctgtgag

SEQ ID NO: 260974 - DNA, 25 bp, Mus musculus
atgctaatatattctcacctgtgag

SEQ ID NO: 260975 - DNA, 25 bp, Mus musculus
atgctaatcatgaccttcacaccaa

SEQ ID NO: 260976 - DNA, 25 bp, Mus musculus
atgctaatcatgtccttcacaccaa

SEQ ID NO: 260977 - DNA, 25 bp, Mus musculus
atgctaatcgataatccccactcat

SEQ ID NO: 260978 - DNA, 25 bp, Mus musculus
atgctaatcgattatccccactcat

SEQ ID NO: 260979 - DNA, 25 bp, Mus musculus
atgctaatgacactttgttttcctt

SEQ ID NO: 260980 - DNA, 25 bp, Mus musculus
atgctaatgacagtttgttttcctt

SEQ ID NO: 260981 - DNA, 25 bp, Mus musculus
atgctaatggccaaactaacttcaa

SEQ ID NO: 260982 - DNA, 25 bp, Mus musculus
atgctaatggcctaactaacttcaa

SEQ ID NO: 260983 - DNA, 25 bp, Mus musculus
atgctaattaggcttttcttaactg

SEQ ID NO: 260984 - DNA, 25 bp, Mus musculus
atgctaattagggttttcttaactg

SEQ ID NO: 260985 - DNA, 25 bp, Mus musculus
atgctacaacccaggtctagcctgt

SEQ ID NO: 260986 - DNA, 25 bp, Mus musculus
atgctacaaccctggtctagcctgt

SEQ ID NO: 260987 - DNA, 25 bp, Mus musculus
atgctacaatggagtccccgctgaa

SEQ ID NO: 260988 - DNA, 25 bp, Mus musculus
atgctacaatggtgtccccgctgaa

SEQ ID NO: 260989 - DNA, 25 bp, Mus musculus
atgctacacatgcactgggccccta

SEQ ID NO: 260990 - DNA, 25 bp, Mus musculus
atgctacacatggactgggccccta

SEQ ID NO: 260991 - DNA, 25 bp, Mus musculus
atgctacactgacaagaaacctggc

SEQ ID NO: 260992 - DNA, 25 bp, Mus musculus
atgctacactgagaagaaacctggc

SEQ ID NO: 260993 - DNA, 25 bp, Mus musculus
atgctacactttccacaacaattac

SEQ ID NO: 260994 - DNA, 25 bp, Mus musculus
atgctacactttgcacaacaattac

SEQ ID NO: 260995 - DNA, 25 bp, Mus musculus
atgctacagcatcccaataaagctt

SEQ ID NO: 260996 - DNA, 25 bp, Mus musculus
atgctacagcatgccaataaagctt

SEQ ID NO: 260997 - DNA, 25 bp, Mus musculus
atgctacaggccaacaagacctatg

SEQ ID NO: 260998 - DNA, 25 bp, Mus musculus
atgctacaggccctctctttttaaa

SEQ ID NO: 260999 - DNA, 25 bp, Mus musculus
atgctacaggccgtctctttttaaa

SEQ ID NO: 261000 - DNA, 25 bp, Mus musculus
atgctacaggcctacaagacctatg

SEQ ID NO: 261001 - DNA, 25 bp, Mus musculus
atgctacagttccttgcttcctgga

SEQ ID NO: 261002 - DNA, 25 bp, Mus musculus
atgctacagttcgttgcttcctgga

SEQ ID NO: 261003 - DNA, 25 bp, Mus musculus
atgctacatacaaccgtgcagcagg

SEQ ID NO: 261004 - DNA, 25 bp, Mus musculus
atgctacatacatccgtgcagcagg

SEQ ID NO: 261005 - DNA, 25 bp, Mus musculus
atgctaccaaacactcgggcagagg

SEQ ID NO: 261006 - DNA, 25 bp, Mus musculus
atgctaccaaactctcgggcagagg

SEQ ID NO: 261007 - DNA, 25 bp, Mus musculus
atgctaccaatgaagacaaactgtc

SEQ ID NO: 261008 - DNA, 25 bp, Mus musculus
atgctaccaatgtagacaaactgtc

SEQ ID NO: 261009 - DNA, 25 bp, Mus musculus
atgctaccactgattccaaccggtg

SEQ ID NO: 261010 - DNA, 25 bp, Mus musculus
atgctaccactgcattcccagggag

SEQ ID NO: 261011 - DNA, 25 bp, Mus musculus
atgctaccactggattcccagggag

SEQ ID NO: 261012 - DNA, 25 bp, Mus musculus
atgctaccactgtttccaaccggtg

SEQ ID NO: 261013 - DNA, 25 bp, Mus musculus
atgctaccagctacttactttttaa

SEQ ID NO: 261014 - DNA, 25 bp, Mus musculus
atgctaccagcttcttactttttaa

SEQ ID NO: 261015 - DNA, 25 bp, Mus musculus
atgctacccagaccacaagtgtgct

SEQ ID NO: 261016 - DNA, 25 bp, Mus musculus
atgctacccagagcacaagtgtgct

SEQ ID NO: 261017 - DNA, 25 bp, Mus musculus
atgctaccgccgacggttctgaggt

SEQ ID NO: 261018 - DNA, 25 bp, Mus musculus
atgctaccgccgtcggttctgaggt

SEQ ID NO: 261019 - DNA, 25 bp, Mus musculus
atgctacctcggctctgagattgaa

SEQ ID NO: 261020 - DNA, 25 bp, Mus musculus
atgctacctcgggtctgagattgaa

SEQ ID NO: 261021 - DNA, 25 bp, Mus musculus
atgctacctgaaagcttctccgagg

SEQ ID NO: 261022 - DNA, 25 bp, Mus musculus
atgctacctgaatgcttctccgagg

SEQ ID NO: 261023 - DNA, 25 bp, Mus musculus
atgctaccttgcatctcatgcgggt

SEQ ID NO: 261024 - DNA, 25 bp, Mus musculus
atgctaccttgcttctcatgcgggt

SEQ ID NO: 261025 - DNA, 25 bp, Mus musculus
atgctacctttaccaggtgttcgca

SEQ ID NO: 261026 - DNA, 25 bp, Mus musculus
atgctacctttacctgagcctacat

SEQ ID NO: 261027 - DNA, 25 bp, Mus musculus
atgctacctttagcaggtgttcgca

SEQ ID NO: 261028 - DNA, 25 bp, Mus musculus
atgctacctttagctgagcctacat

SEQ ID NO: 261029 - DNA, 25 bp, Mus musculus
atgctacgtgatcagatgccctggt

SEQ ID NO: 261030 - DNA, 25 bp, Mus musculus
atgctacgtgatgagatgccctggt

SEQ ID NO: 261031 - DNA, 25 bp, Mus musculus
atgctactaagcattcttgccctgg

SEQ ID NO: 261032 - DNA, 25 bp, Mus musculus
atgctactaagctttcttgccctgg

SEQ ID NO: 261033 - DNA, 25 bp, Mus musculus
atgctactatctactacagtgacat

SEQ ID NO: 261034 - DNA, 25 bp, Mus musculus
atgctactatcttctacagtgacat

SEQ ID NO: 261035 - DNA, 25 bp, Mus musculus
atgctactcatactgctattgttta

SEQ ID NO: 261036 - DNA, 25 bp, Mus musculus
atgctactcatagtgctattgttta

SEQ ID NO: 261037 - DNA, 25 bp, Mus musculus
atgctactctctaaagtggcccatg

SEQ ID NO: 261038 - DNA, 25 bp, Mus musculus
atgctactctcttaagtggcccatg

SEQ ID NO: 261039 - DNA, 25 bp, Mus musculus
atgctactgagcctatgatgtcgtt

SEQ ID NO: 261040 - DNA, 25 bp, Mus musculus
atgctactgagcgtatgatgtcgtt

SEQ ID NO: 261041 - DNA, 25 bp, Mus musculus
atgctactggcaagtggtgcccagg

SEQ ID NO: 261042 - DNA, 25 bp, Mus musculus
atgctactggcatgtggtgcccagg

SEQ ID NO: 261043 - DNA, 25 bp, Mus musculus
atgctacttctgacaagtgcttcac

SEQ ID NO: 261044 - DNA, 25 bp, Mus musculus
atgctacttctgtcaagtgcttcac

SEQ ID NO: 261045 - DNA, 25 bp, Mus musculus
atgctactttagagaatgcttccag

SEQ ID NO: 261046 - DNA, 25 bp, Mus musculus
atgctactttagtgaatgcttccag

SEQ ID NO: 261047 - DNA, 25 bp, Mus musculus
atgctacttttaacagtgtttggga

SEQ ID NO: 261048 - DNA, 25 bp, Mus musculus
atgctacttttatcagtgtttggga

SEQ ID NO: 261049 - DNA, 25 bp, Mus musculus
atgctagaaattctgcaggccattt

SEQ ID NO: 261050 - DNA, 25 bp, Mus musculus
atgctagaaattgtgcaggccattt

SEQ ID NO: 261051 - DNA, 25 bp, Mus musculus
atgctagaaggcaatcgctgctacc

SEQ ID NO: 261052 - DNA, 25 bp, Mus musculus
atgctagaaggctatcgctgctacc

SEQ ID NO: 261053 - DNA, 25 bp, Mus musculus
atgctagaatggaaaagtctctcat

SEQ ID NO: 261054 - DNA, 25 bp, Mus musculus
atgctagaatggtaaagtctctcat

SEQ ID NO: 261055 - DNA, 25 bp, Mus musculus
atgctagactagacgcatctgacag

SEQ ID NO: 261056 - DNA, 25 bp, Mus musculus
atgctagactagtcgcatctgacag

SEQ ID NO: 261057 - DNA, 25 bp, Mus musculus
atgctagagagtactacccattcaa

SEQ ID NO: 261058 - DNA, 25 bp, Mus musculus
atgctagagagttctacccattcaa

SEQ ID NO: 261059 - DNA, 25 bp, Mus musculus
atgctagagtgacatcgcttgcctt

SEQ ID NO: 261060 - DNA, 25 bp, Mus musculus
atgctagagtgagatcgcttgcctt

SEQ ID NO: 261061 - DNA, 25 bp, Mus musculus
atgctagattgcattcctgactgtt

SEQ ID NO: 261062 - DNA, 25 bp, Mus musculus
atgctagattgctttcctgactgtt

SEQ ID NO: 261063 - DNA, 25 bp, Mus musculus
atgctagcacaactactttacggac

SEQ ID NO: 261064 - DNA, 25 bp, Mus musculus
atgctagcacaagtactttacggac

SEQ ID NO: 261065 - DNA, 25 bp, Mus musculus
atgctagcatagatgccaacatcag

SEQ ID NO: 261066 - DNA, 25 bp, Mus musculus
atgctagcatagttgccaacatcag

SEQ ID NO: 261067 - DNA, 25 bp, Mus musculus
atgctagcatgcaggacccgacggc

SEQ ID NO: 261068 - DNA, 25 bp, Mus musculus
atgctagcatgctggacccgacggc

SEQ ID NO: 261069 - DNA, 25 bp, Mus musculus
atgctagcctgaaccgggctctacg

SEQ ID NO: 261070 - DNA, 25 bp, Mus musculus
atgctagcctgatccgggctctacg

SEQ ID NO: 261071 - DNA, 25 bp, Mus musculus
atgctagctaacctagtttctttgc

SEQ ID NO: 261072 - DNA, 25 bp, Mus musculus
atgctagctaacgtagtttctttgc

SEQ ID NO: 261073 - DNA, 25 bp, Mus musculus
atgctagctcctcagagttcacagc

SEQ ID NO: 261074 - DNA, 25 bp, Mus musculus
atgctagctcctgagagttcacagc

SEQ ID NO: 261075 - DNA, 25 bp, Mus musculus
atgctagctctgaagggttccttaa

SEQ ID NO: 261076 - DNA, 25 bp, Mus musculus
atgctagctctgtagggttccttaa

SEQ ID NO: 261077 - DNA, 25 bp, Mus musculus
atgctagctgcaacactctgactgt

SEQ ID NO: 261078 - DNA, 25 bp, Mus musculus
atgctagctgcatcactctgactgt

SEQ ID NO: 261079 - DNA, 25 bp, Mus musculus
atgctagctgccagtcctaggttgg

SEQ ID NO: 261080 - DNA, 25 bp, Mus musculus
atgctagctgcctgtcctaggttgg

SEQ ID NO: 261081 - DNA, 25 bp, Mus musculus
atgctagctggtccccaagcttttg

SEQ ID NO: 261082 - DNA, 25 bp, Mus musculus
atgctagctggtgcccaagcttttg

SEQ ID NO: 261083 - DNA, 25 bp, Mus musculus
atgctagctttgaggatggtattac

SEQ ID NO: 261084 - DNA, 25 bp, Mus musculus
atgctagctttgtggatggtattac

SEQ ID NO: 261085 - DNA, 25 bp, Mus musculus
atgctaggacacaaagatggacttc

SEQ ID NO: 261086 - DNA, 25 bp, Mus musculus
atgctaggacactaagatggacttc

SEQ ID NO: 261087 - DNA, 25 bp, Mus musculus
atgctaggagcacacatgatcaaag

SEQ ID NO: 261088 - DNA, 25 bp, Mus musculus
atgctaggagcagacatgatcaaag

SEQ ID NO: 261089 - DNA, 25 bp, Mus musculus
atgctaggattacacagggaaaccc

SEQ ID NO: 261090 - DNA, 25 bp, Mus musculus
atgctaggattagacagggaaaccc

SEQ ID NO: 261091 - DNA, 25 bp, Mus musculus
atgctaggcacaagcattctttact

SEQ ID NO: 261092 - DNA, 25 bp, Mus musculus
atgctaggcacatgcattctttact

SEQ ID NO: 261093 - DNA, 25 bp, Mus musculus
atgctaggcagcactcaatgaccag

SEQ ID NO: 261094 - DNA, 25 bp, Mus musculus
atgctaggcagctctcaatgaccag

SEQ ID NO: 261095 - DNA, 25 bp, Mus musculus
atgctaggcatgctgggagtcctct

SEQ ID NO: 261096 - DNA, 25 bp, Mus musculus
atgctaggcatggtgggagtcctct

SEQ ID NO: 261097 - DNA, 25 bp, Mus musculus
atgctaggccgtctacatgaggtgt

SEQ ID NO: 261098 - DNA, 25 bp, Mus musculus
atgctaggccgtgtacatgaggtgt

SEQ ID NO: 261099 - DNA, 25 bp, Mus musculus
atgctaggctacatggcgggttcat

SEQ ID NO: 261100 - DNA, 25 bp, Mus musculus
atgctaggctacttggcgggttcat

SEQ ID NO: 261101 - DNA, 25 bp, Mus musculus
atgctaggcttcaacttaactggac

SEQ ID NO: 261102 - DNA, 25 bp, Mus musculus
atgctaggcttctacttaactggac

SEQ ID NO: 261103 - DNA, 25 bp, Mus musculus
atgctaggtcatctcctaggctcac

SEQ ID NO: 261104 - DNA, 25 bp, Mus musculus
atgctaggtcatgtcctaggctcac

SEQ ID NO: 261105 - DNA, 25 bp, Mus musculus
atgctaggtcttctaacctctctca

SEQ ID NO: 261106 - DNA, 25 bp, Mus musculus
atgctaggtcttgtaacctctctca

SEQ ID NO: 261107 - DNA, 25 bp, Mus musculus
atgctagtacaaattcaagggtcag

SEQ ID NO: 261108 - DNA, 25 bp, Mus musculus
atgctagtacaatttcaagggtcag

SEQ ID NO: 261109 - DNA, 25 bp, Mus musculus
atgctagtccataccggtttaacat

SEQ ID NO: 261110 - DNA, 25 bp, Mus musculus
atgctagtccattccggtttaacat

SEQ ID NO: 261111 - DNA, 25 bp, Mus musculus
atgctagtctatcatcctgccaaac

SEQ ID NO: 261112 - DNA, 25 bp, Mus musculus
atgctagtctatgatcctgccaaac

SEQ ID NO: 261113 - DNA, 25 bp, Mus musculus
atgctagtctgtacccctgtgtgac

SEQ ID NO: 261114 - DNA, 25 bp, Mus musculus
atgctagtctgttcccctgtgtgac

SEQ ID NO: 261115 - DNA, 25 bp, Mus musculus
atgctagtgtctccttgctttagat

SEQ ID NO: 261116 - DNA, 25 bp, Mus musculus
atgctagtgtctgcttgctttagat

SEQ ID NO: 261117 - DNA, 25 bp, Mus musculus
atgctagttctacgtcaacccgagc

SEQ ID NO: 261118 - DNA, 25 bp, Mus musculus
atgctagttctaggtcaacccgagc

SEQ ID NO: 261119 - DNA, 25 bp, Mus musculus
atgctagtttaacctgcctgtttcc

SEQ ID NO: 261120 - DNA, 25 bp, Mus musculus
atgctagtttaagctgcctgtttcc

SEQ ID NO: 261121 - DNA, 25 bp, Mus musculus
atgctataacttatcactcatctat

SEQ ID NO: 261122 - DNA, 25 bp, Mus musculus
atgctataacttttcactcatctat

SEQ ID NO: 261123 - DNA, 25 bp, Mus musculus
atgctatacgttaattctgaatcag

SEQ ID NO: 261124 - DNA, 25 bp, Mus musculus
atgctatacgtttattctgaatcag

SEQ ID NO: 261125 - DNA, 25 bp, Mus musculus
atgctatatggaaccttccctgtat

SEQ ID NO: 261126 - DNA, 25 bp, Mus musculus
atgctatatggatccttccctgtat

SEQ ID NO: 261127 - DNA, 25 bp, Mus musculus
atgctatatgtaaggcttctttgaa

SEQ ID NO: 261128 - DNA, 25 bp, Mus musculus
atgctatatgtatggcttctttgaa

SEQ ID NO: 261129 - DNA, 25 bp, Mus musculus
atgctatattctctaagtctctgag

SEQ ID NO: 261130 - DNA, 25 bp, Mus musculus
atgctatattctgtaagtctctgag

SEQ ID NO: 261131 - DNA, 25 bp, Mus musculus
atgctatcattgcactcgaacctac

SEQ ID NO: 261132 - DNA, 25 bp, Mus musculus
atgctatcattggactcgaacctac

SEQ ID NO: 261133 - DNA, 25 bp, Mus musculus
atgctatccgtcatggttcataaga

SEQ ID NO: 261134 - DNA, 25 bp, Mus musculus
atgctatccgtcttggttcataaga

SEQ ID NO: 261135 - DNA, 25 bp, Mus musculus
atgctatcttgtcaataaactgttc

SEQ ID NO: 261136 - DNA, 25 bp, Mus musculus
atgctatcttgtgaataaactgttc

SEQ ID NO: 261137 - DNA, 25 bp, Mus musculus
atgctatgaaagaactctgtcaccg

SEQ ID NO: 261138 - DNA, 25 bp, Mus musculus
atgctatgaaagtactctgtcaccg

SEQ ID NO: 261139 - DNA, 25 bp, Mus musculus
atgctatgagaacccatgccccatg

SEQ ID NO: 261140 - DNA, 25 bp, Mus musculus
atgctatgagaagccatgccccatg

SEQ ID NO: 261141 - DNA, 25 bp, Mus musculus
atgctatgaggaatacaagatactt

SEQ ID NO: 261142 - DNA, 25 bp, Mus musculus
atgctatgaggattacaagatactt

SEQ ID NO: 261143 - DNA, 25 bp, Mus musculus
atgctatgcagcctgtgtaaaaatc

SEQ ID NO: 261144 - DNA, 25 bp, Mus musculus
atgctatgcagcgtgtgtaaaaatc

SEQ ID NO: 261145 - DNA, 25 bp, Mus musculus
atgctatgcctccagcagatggact

SEQ ID NO: 261146 - DNA, 25 bp, Mus musculus
atgctatgcctcgagcagatggact

SEQ ID NO: 261147 - DNA, 25 bp, Mus musculus
atgctatgctcaagttctaggcagc

SEQ ID NO: 261148 - DNA, 25 bp, Mus musculus
atgctatgctcatgttctaggcagc

SEQ ID NO: 261149 - DNA, 25 bp, Mus musculus
atgctatggcatatcatggaggtca

SEQ ID NO: 261150 - DNA, 25 bp, Mus musculus
atgctatggcatttcatggaggtca

SEQ ID NO: 261151 - DNA, 25 bp, Mus musculus
atgctatggtggctgtttcgttcaa

SEQ ID NO: 261152 - DNA, 25 bp, Mus musculus
atgctatggtgggtgtttcgttcaa

SEQ ID NO: 261153 - DNA, 25 bp, Mus musculus
atgctatgtcgcaggcaaacgccaa

SEQ ID NO: 261154 - DNA, 25 bp, Mus musculus
atgctatgtcgctggcaaacgccaa

SEQ ID NO: 261155 - DNA, 25 bp, Mus musculus
atgctatgtctgagactgggtttga

SEQ ID NO: 261156 - DNA, 25 bp, Mus musculus
atgctatgtctgtgactgggtttga

SEQ ID NO: 261157 - DNA, 25 bp, Mus musculus
atgctatgttgtcctcatcttcatt

SEQ ID NO: 261158 - DNA, 25 bp, Mus musculus
atgctatgttgtgctcatcttcatt

SEQ ID NO: 261159 - DNA, 25 bp, Mus musculus
atgctattatgtctggagggtctac

SEQ ID NO: 261160 - DNA, 25 bp, Mus musculus
atgctattatgtgtggagggtctac

SEQ ID NO: 261161 - DNA, 25 bp, Mus musculus
atgctattcatactgacaccaacgg

SEQ ID NO: 261162 - DNA, 25 bp, Mus musculus
atgctattcatagtgacaccaacgg

SEQ ID NO: 261163 - DNA, 25 bp, Mus musculus
atgctattcctcaaccaggttttgg

SEQ ID NO: 261164 - DNA, 25 bp, Mus musculus
atgctattcctctaccaggttttgg

SEQ ID NO: 261165 - DNA, 25 bp, Mus musculus
atgctattcttcatcatggaacata

SEQ ID NO: 261166 - DNA, 25 bp, Mus musculus
atgctattcttcttcatggaacata

SEQ ID NO: 261167 - DNA, 25 bp, Mus musculus
atgctattgcttactggatctctcc

SEQ ID NO: 261168 - DNA, 25 bp, Mus musculus
atgctattgctttctggatctctcc

SEQ ID NO: 261169 - DNA, 25 bp, Mus musculus
atgctattgggaccactactgtgct

SEQ ID NO: 261170 - DNA, 25 bp, Mus musculus
atgctattgggacctgtacatgttc

SEQ ID NO: 261171 - DNA, 25 bp, Mus musculus
atgctattgggagcactactgtgct

SEQ ID NO: 261172 - DNA, 25 bp, Mus musculus
atgctattgggagctgtacatgttc

SEQ ID NO: 261173 - DNA, 25 bp, Mus musculus
atgctattgtacatagaagcccagt

SEQ ID NO: 261174 - DNA, 25 bp, Mus musculus
atgctattgtacttagaagcccagt

SEQ ID NO: 261175 - DNA, 25 bp, Mus musculus
atgctatttgatccaccattaccac

SEQ ID NO: 261176 - DNA, 25 bp, Mus musculus
atgctatttgatgcaccattaccac

SEQ ID NO: 261177 - DNA, 25 bp, Mus musculus
atgctcaaacagaacggcccagacg

SEQ ID NO: 261178 - DNA, 25 bp, Mus musculus
atgctcaaacagtacggcccagacg

SEQ ID NO: 261179 - DNA, 25 bp, Mus musculus
atgctcaaattgagggtatttttct

SEQ ID NO: 261180 - DNA, 25 bp, Mus musculus
atgctcaaattgtgggtatttttct

SEQ ID NO: 261181 - DNA, 25 bp, Mus musculus
atgctcaacatcagaccatatctgg

SEQ ID NO: 261182 - DNA, 25 bp, Mus musculus
atgctcaacatctgaccatatctgg

SEQ ID NO: 261183 - DNA, 25 bp, Mus musculus
atgctcaacctcattttgtcctgat

SEQ ID NO: 261184 - DNA, 25 bp, Mus musculus
atgctcaacctctttttgtcctgat

SEQ ID NO: 261185 - DNA, 25 bp, Mus musculus
atgctcaaggcaatcagtccatttc

SEQ ID NO: 261186 - DNA, 25 bp, Mus musculus
atgctcaaggcattcagtccatttc

SEQ ID NO: 261187 - DNA, 25 bp, Mus musculus
atgctcaaggtgacgggcagtgcca

SEQ ID NO: 261188 - DNA, 25 bp, Mus musculus
atgctcaaggtgtcgggcagtgcca

SEQ ID NO: 261189 - DNA, 25 bp, Mus musculus
atgctcaagtccctcgtgtagaatg

SEQ ID NO: 261190 - DNA, 25 bp, Mus musculus
atgctcaagtccgtcgtgtagaatg

SEQ ID NO: 261191 - DNA, 25 bp, Mus musculus
atgctcaagtggctttatgggtccc

SEQ ID NO: 261192 - DNA, 25 bp, Mus musculus
atgctcaagtgggtttatgggtccc

SEQ ID NO: 261193 - DNA, 25 bp, Mus musculus
atgctcaattctcagggcaacacct

SEQ ID NO: 261194 - DNA, 25 bp, Mus musculus
atgctcaattctgagggcaacacct

SEQ ID NO: 261195 - DNA, 25 bp, Mus musculus
atgctcaatttccaccttgagcaac

SEQ ID NO: 261196 - DNA, 25 bp, Mus musculus
atgctcaatttcgaccttgagcaac

SEQ ID NO: 261197 - DNA, 25 bp, Mus musculus
atgctcacaaacatcatctgcctaa

SEQ ID NO: 261198 - DNA, 25 bp, Mus musculus
atgctcacaaacttcatctgcctaa

SEQ ID NO: 261199 - DNA, 25 bp, Mus musculus
atgctcacactcctcgactgttgag

SEQ ID NO: 261200 - DNA, 25 bp, Mus musculus
atgctcacactcgtcgactgttgag

SEQ ID NO: 261201 - DNA, 25 bp, Mus musculus
atgctcacagtactttgaggcttta

SEQ ID NO: 261202 - DNA, 25 bp, Mus musculus
atgctcacagtagtttgaggcttta

SEQ ID NO: 261203 - DNA, 25 bp, Mus musculus
atgctcacagtcatcttgttctcat

SEQ ID NO: 261204 - DNA, 25 bp, Mus musculus
atgctcacagtcttcttgttctcat

SEQ ID NO: 261205 - DNA, 25 bp, Mus musculus
atgctcaccaaaagcggacacctgt

SEQ ID NO: 261206 - DNA, 25 bp, Mus musculus
atgctcaccaaatgcggacacctgt

SEQ ID NO: 261207 - DNA, 25 bp, Mus musculus
atgctcaccacaactctgctttggt

SEQ ID NO: 261208 - DNA, 25 bp, Mus musculus
atgctcaccacatctctgctttggt

SEQ ID NO: 261209 - DNA, 25 bp, Mus musculus
atgctcaccagacaatcatctcttc

SEQ ID NO: 261210 - DNA, 25 bp, Mus musculus
atgctcaccagagaatcatctcttc

SEQ ID NO: 261211 - DNA, 25 bp, Mus musculus
atgctcaccagcaaacaggcgggca

SEQ ID NO: 261212 - DNA, 25 bp, Mus musculus
atgctcaccagctaacaggcgggca

SEQ ID NO: 261213 - DNA, 25 bp, Mus musculus
atgctcaccgcactgtgcagttgac

SEQ ID NO: 261214 - DNA, 25 bp, Mus musculus
atgctcaccgcagtgtgcagttgac

SEQ ID NO: 261215 - DNA, 25 bp, Mus musculus
atgctcaccttgaagcagcttttga

SEQ ID NO: 261216 - DNA, 25 bp, Mus musculus
atgctcaccttgtagcagcttttga

SEQ ID NO: 261217 - DNA, 25 bp, Mus musculus
atgctcacgtttactagaggaacta

SEQ ID NO: 261218 - DNA, 25 bp, Mus musculus
atgctcacgttttctagaggaacta

SEQ ID NO: 261219 - DNA, 25 bp, Mus musculus
atgctcactccccaagctttatgga

SEQ ID NO: 261220 - DNA, 25 bp, Mus musculus
atgctcactcccgaagctttatgga

SEQ ID NO: 261221 - DNA, 25 bp, Mus musculus
atgctcactctacaaggccagcttt

SEQ ID NO: 261222 - DNA, 25 bp, Mus musculus
atgctcactctagaaggccagcttt

SEQ ID NO: 261223 - DNA, 25 bp, Mus musculus
atgctcactgataggcaggatcagt

SEQ ID NO: 261224 - DNA, 25 bp, Mus musculus
atgctcactgattggcaggatcagt

SEQ ID NO: 261225 - DNA, 25 bp, Mus musculus
atgctcacttcaagcatgcagcaaa

SEQ ID NO: 261226 - DNA, 25 bp, Mus musculus
atgctcacttcatgcatgcagcaaa

SEQ ID NO: 261227 - DNA, 25 bp, Mus musculus
atgctcacttccagagagctacctt

SEQ ID NO: 261228 - DNA, 25 bp, Mus musculus
atgctcacttcctgagagctacctt

SEQ ID NO: 261229 - DNA, 25 bp, Mus musculus
atgctcacttgtctggttctagaag

SEQ ID NO: 261230 - DNA, 25 bp, Mus musculus
atgctcacttgtgtggttctagaag

SEQ ID NO: 261231 - DNA, 25 bp, Mus musculus
atgctcacttttctgctaagtcttt

SEQ ID NO: 261232 - DNA, 25 bp, Mus musculus
atgctcacttttgtgctaagtcttt

SEQ ID NO: 261233 - DNA, 25 bp, Mus musculus
atgctcagaagcagggtaatcccca

SEQ ID NO: 261234 - DNA, 25 bp, Mus musculus
atgctcagaagcatctctgcatgtt

SEQ ID NO: 261235 - DNA, 25 bp, Mus musculus
atgctcagaagctgggtaatcccca

SEQ ID NO: 261236 - DNA, 25 bp, Mus musculus
atgctcagaagcttctctgcatgtt

SEQ ID NO: 261237 - DNA, 25 bp, Mus musculus
atgctcagataactgcctttccttc

SEQ ID NO: 261238 - DNA, 25 bp, Mus musculus
atgctcagataagtgcctttccttc

SEQ ID NO: 261239 - DNA, 25 bp, Mus musculus
atgctcagatagcttgtccgctgtc

SEQ ID NO: 261240 - DNA, 25 bp, Mus musculus
atgctcagataggttgtccgctgtc

SEQ ID NO: 261241 - DNA, 25 bp, Mus musculus
atgctcagatccacgtgtccgaagg

SEQ ID NO: 261242 - DNA, 25 bp, Mus musculus
atgctcagatcctcgtgtccgaagg

SEQ ID NO: 261243 - DNA, 25 bp, Mus musculus
atgctcagcaacacactagtgaaat

SEQ ID NO: 261244 - DNA, 25 bp, Mus musculus
atgctcagcaactcactagtgaaat

SEQ ID NO: 261245 - DNA, 25 bp, Mus musculus
atgctcagcaatattctggtggatc

SEQ ID NO: 261246 - DNA, 25 bp, Mus musculus
atgctcagcaattttctggtggatc

SEQ ID NO: 261247 - DNA, 25 bp, Mus musculus
atgctcagctgtataagcgttcctt

SEQ ID NO: 261248 - DNA, 25 bp, Mus musculus
atgctcagctgtttaagcgttcctt

SEQ ID NO: 261249 - DNA, 25 bp, Mus musculus
atgctcaggagcctttggactgtca

SEQ ID NO: 261250 - DNA, 25 bp, Mus musculus
atgctcaggagcgtttggactgtca

SEQ ID NO: 261251 - DNA, 25 bp, Mus musculus
atgctcaggcatccttggcttattt

SEQ ID NO: 261252 - DNA, 25 bp, Mus musculus
atgctcaggcatgcttggcttattt

SEQ ID NO: 261253 - DNA, 25 bp, Mus musculus
atgctcagggaaacacttgctgatt

SEQ ID NO: 261254 - DNA, 25 bp, Mus musculus
atgctcagggaatcacttgctgatt

SEQ ID NO: 261255 - DNA, 25 bp, Mus musculus
atgctcagggttcatggtggtctcc

SEQ ID NO: 261256 - DNA, 25 bp, Mus musculus
atgctcagggttgatggtggtctcc

SEQ ID NO: 261257 - DNA, 25 bp, Mus musculus
atgctcaggttcaagccaggtgcct

SEQ ID NO: 261258 - DNA, 25 bp, Mus musculus
atgctcaggttctagccaggtgcct

SEQ ID NO: 261259 - DNA, 25 bp, Mus musculus
atgctcagtccgcttccttagacag

SEQ ID NO: 261260 - DNA, 25 bp, Mus musculus
atgctcagtccggttccttagacag

SEQ ID NO: 261261 - DNA, 25 bp, Mus musculus
atgctcagtggcaagcctagcgtcg

SEQ ID NO: 261262 - DNA, 25 bp, Mus musculus
atgctcagtggctagcctagcgtcg

SEQ ID NO: 261263 - DNA, 25 bp, Mus musculus
atgctcagttgtctggctcttcctt

SEQ ID NO: 261264 - DNA, 25 bp, Mus musculus
atgctcagttgtgtggctcttcctt

SEQ ID NO: 261265 - DNA, 25 bp, Mus musculus
atgctcatagaaccctcagtgttat

SEQ ID NO: 261266 - DNA, 25 bp, Mus musculus
atgctcatagaagcctcagtgttat

SEQ ID NO: 261267 - DNA, 25 bp, Mus musculus
atgctcatcaataatgtaggttctc

SEQ ID NO: 261268 - DNA, 25 bp, Mus musculus
atgctcatcaattatgtaggttctc

SEQ ID NO: 261269 - DNA, 25 bp, Mus musculus
atgctcatccatcccaggctgctgg

SEQ ID NO: 261270 - DNA, 25 bp, Mus musculus
atgctcatccatgccaggctgctgg

SEQ ID NO: 261271 - DNA, 25 bp, Mus musculus
atgctcatcccgcaactgaaggaga

SEQ ID NO: 261272 - DNA, 25 bp, Mus musculus
atgctcatcccggaactgaaggaga

SEQ ID NO: 261273 - DNA, 25 bp, Mus musculus
atgctcatccggcagggtatcagag

SEQ ID NO: 261274 - DNA, 25 bp, Mus musculus
atgctcatccgggagggtatcagag

SEQ ID NO: 261275 - DNA, 25 bp, Mus musculus
atgctcatcctcatcaacctggtgt

SEQ ID NO: 261276 - DNA, 25 bp, Mus musculus
atgctcatcctcttcaacctggtgt

SEQ ID NO: 261277 - DNA, 25 bp, Mus musculus
atgctcatcgaccatcgtcaaggga

SEQ ID NO: 261278 - DNA, 25 bp, Mus musculus
atgctcatcgacgatcgtcaaggga

SEQ ID NO: 261279 - DNA, 25 bp, Mus musculus
atgctcatcgatctggcttctccaa

SEQ ID NO: 261280 - DNA, 25 bp, Mus musculus
atgctcatcgatgtggcttctccaa

SEQ ID NO: 261281 - DNA, 25 bp, Mus musculus
atgctcatctgtctatgccagctgg

SEQ ID NO: 261282 - DNA, 25 bp, Mus musculus
atgctcatctgtgtatgccagctgg

SEQ ID NO: 261283 - DNA, 25 bp, Mus musculus
atgctcatgactctgtcacttaggg

SEQ ID NO: 261284 - DNA, 25 bp, Mus musculus
atgctcatgactgtgtcacttaggg

SEQ ID NO: 261285 - DNA, 25 bp, Mus musculus
atgctcatgagtctccttgtggccc

SEQ ID NO: 261286 - DNA, 25 bp, Mus musculus
atgctcatgagtgtccttgtggccc

SEQ ID NO: 261287 - DNA, 25 bp, Mus musculus
atgctcatgcgaagctcgatgctca

SEQ ID NO: 261288 - DNA, 25 bp, Mus musculus
atgctcatgcgatgctcgatgctca

SEQ ID NO: 261289 - DNA, 25 bp, Mus musculus
atgctcatggcccaacttaatagaa

SEQ ID NO: 261290 - DNA, 25 bp, Mus musculus
atgctcatggccgaacttaatagaa

SEQ ID NO: 261291 - DNA, 25 bp, Mus musculus
atgctcattcgactgcagaactcag

SEQ ID NO: 261292 - DNA, 25 bp, Mus musculus
atgctcattcgagtgcagaactcag

SEQ ID NO: 261293 - DNA, 25 bp, Mus musculus
atgctcattgataccatgtatgtac

SEQ ID NO: 261294 - DNA, 25 bp, Mus musculus
atgctcattgattccatgtatgtac

SEQ ID NO: 261295 - DNA, 25 bp, Mus musculus
atgctcattgccctcatgagtgaga

SEQ ID NO: 261296 - DNA, 25 bp, Mus musculus
atgctcattgccgtcatgagtgaga

SEQ ID NO: 261297 - DNA, 25 bp, Mus musculus
atgctcatttcaatcagtcaaggaa

SEQ ID NO: 261298 - DNA, 25 bp, Mus musculus
atgctcatttcattcagtcaaggaa

SEQ ID NO: 261299 - DNA, 25 bp, Mus musculus
atgctccaaaaactcaggcctgtga

SEQ ID NO: 261300 - DNA, 25 bp, Mus musculus
atgctccaaaaagtcaggcctgtga

SEQ ID NO: 261301 - DNA, 25 bp, Mus musculus
atgctccaaaagaagcgcttgctca

SEQ ID NO: 261302 - DNA, 25 bp, Mus musculus
atgctccaaaagtagcgcttgctca

SEQ ID NO: 261303 - DNA, 25 bp, Mus musculus
atgctccaagcaagatcacaacaca

SEQ ID NO: 261304 - DNA, 25 bp, Mus musculus
atgctccaagcatgatcacaacaca

SEQ ID NO: 261305 - DNA, 25 bp, Mus musculus
atgctccaagccctctgtacagtta

SEQ ID NO: 261306 - DNA, 25 bp, Mus musculus
atgctccaagccgtctgtacagtta

SEQ ID NO: 261307 - DNA, 25 bp, Mus musculus
atgctccaagtgctgaacctgtgtg

SEQ ID NO: 261308 - DNA, 25 bp, Mus musculus
atgctccaagtggtgaacctgtgtg

SEQ ID NO: 261309 - DNA, 25 bp, Mus musculus
atgctccacagacgccaggtaatta

SEQ ID NO: 261310 - DNA, 25 bp, Mus musculus
atgctccacagaggccaggtaatta

SEQ ID NO: 261311 - DNA, 25 bp, Mus musculus
atgctccacagcacatttggtcaga

SEQ ID NO: 261312 - DNA, 25 bp, Mus musculus
atgctccacagcactaattgctcag

SEQ ID NO: 261313 - DNA, 25 bp, Mus musculus
atgctccacagctcatttggtcaga

SEQ ID NO: 261314 - DNA, 25 bp, Mus musculus
atgctccacagctctaattgctcag

SEQ ID NO: 261315 - DNA, 25 bp, Mus musculus
atgctccactgcagctgtgagacgg

SEQ ID NO: 261316 - DNA, 25 bp, Mus musculus
atgctccactgctgctgtgagacgg

SEQ ID NO: 261317 - DNA, 25 bp, Mus musculus
atgctccagaataccattcccgcta

SEQ ID NO: 261318 - DNA, 25 bp, Mus musculus
atgctccagaatatcttgcaacgtg

SEQ ID NO: 261319 - DNA, 25 bp, Mus musculus
atgctccagaattccattcccgcta

SEQ ID NO: 261320 - DNA, 25 bp, Mus musculus
atgctccagaatttcttgcaacgtg

SEQ ID NO: 261321 - DNA, 25 bp, Mus musculus
atgctccagacaatttctcatttgt

SEQ ID NO: 261322 - DNA, 25 bp, Mus musculus
atgctccagacattttctcatttgt

SEQ ID NO: 261323 - DNA, 25 bp, Mus musculus
atgctccagaccatatatgtgttga

SEQ ID NO: 261324 - DNA, 25 bp, Mus musculus
atgctccagaccttatatgtgttga

SEQ ID NO: 261325 - DNA, 25 bp, Mus musculus
atgctccagccaatggcctctaaag

SEQ ID NO: 261326 - DNA, 25 bp, Mus musculus
atgctccagccattggcctctaaag

SEQ ID NO: 261327 - DNA, 25 bp, Mus musculus
atgctccaggccataggaacgggaa

SEQ ID NO: 261328 - DNA, 25 bp, Mus musculus
atgctccaggccttaggaacgggaa

SEQ ID NO: 261329 - DNA, 25 bp, Mus musculus
atgctccagggcagtctcaatgaga

SEQ ID NO: 261330 - DNA, 25 bp, Mus musculus
atgctccagggctgtctcaatgaga

SEQ ID NO: 261331 - DNA, 25 bp, Mus musculus
atgctccaggtacccttcagttgag

SEQ ID NO: 261332 - DNA, 25 bp, Mus musculus
atgctccaggtagccttcagttgag

SEQ ID NO: 261333 - DNA, 25 bp, Mus musculus
atgctccagtctcccatgtgattga

SEQ ID NO: 261334 - DNA, 25 bp, Mus musculus
atgctccagtctgccatgtgattga

SEQ ID NO: 261335 - DNA, 25 bp, Mus musculus
atgctccatactactgccttttgat

SEQ ID NO: 261336 - DNA, 25 bp, Mus musculus
atgctccatacttctgccttttgat

SEQ ID NO: 261337 - DNA, 25 bp, Mus musculus
atgctccatagaatagaccctgccc

SEQ ID NO: 261338 - DNA, 25 bp, Mus musculus
atgctccatagattagaccctgccc

SEQ ID NO: 261339 - DNA, 25 bp, Mus musculus
atgctccatatgatcacctcattta

SEQ ID NO: 261340 - DNA, 25 bp, Mus musculus
atgctccatatgctgccggccgtgg

SEQ ID NO: 261341 - DNA, 25 bp, Mus musculus
atgctccatatggtgccggccgtgg

SEQ ID NO: 261342 - DNA, 25 bp, Mus musculus
atgctccatatgttcacctcattta

SEQ ID NO: 261343 - DNA, 25 bp, Mus musculus
atgctccatcaaacaccttggcaaa

SEQ ID NO: 261344 - DNA, 25 bp, Mus musculus
atgctccatcaatcaccttggcaaa

SEQ ID NO: 261345 - DNA, 25 bp, Mus musculus
atgctccatcagagcttgcttggtt

SEQ ID NO: 261346 - DNA, 25 bp, Mus musculus
atgctccatcagtgcttgcttggtt

SEQ ID NO: 261347 - DNA, 25 bp, Mus musculus
atgctccatgtcagaatttcgtcca

SEQ ID NO: 261348 - DNA, 25 bp, Mus musculus
atgctccatgtctgaatttcgtcca

SEQ ID NO: 261349 - DNA, 25 bp, Mus musculus
atgctcccaaaacctaattattcag

SEQ ID NO: 261350 - DNA, 25 bp, Mus musculus
atgctcccaaaagctaattattcag

SEQ ID NO: 261351 - DNA, 25 bp, Mus musculus
atgctcccaggaaggccatgaatgt

SEQ ID NO: 261352 - DNA, 25 bp, Mus musculus
atgctcccaggatggccatgaatgt

SEQ ID NO: 261353 - DNA, 25 bp, Mus musculus
atgctcccataccttgtcaactact

SEQ ID NO: 261354 - DNA, 25 bp, Mus musculus
atgctcccatacgttgtcaactact

SEQ ID NO: 261355 - DNA, 25 bp, Mus musculus
atgctccctaaaacttgtgctttgt

SEQ ID NO: 261356 - DNA, 25 bp, Mus musculus
atgctccctaaatcttgtgctttgt

SEQ ID NO: 261357 - DNA, 25 bp, Mus musculus
atgctccctacgattatcctatagt

SEQ ID NO: 261358 - DNA, 25 bp, Mus musculus
atgctccctacgtttatcctatagt

SEQ ID NO: 261359 - DNA, 25 bp, Mus musculus
atgctccgtatgatcctggacaagt

SEQ ID NO: 261360 - DNA, 25 bp, Mus musculus
atgctccgtatgttcctggacaagt

SEQ ID NO: 261361 - DNA, 25 bp, Mus musculus
atgctccgtttgcttcagactgtga

SEQ ID NO: 261362 - DNA, 25 bp, Mus musculus
atgctccgtttggttcagactgtga

SEQ ID NO: 261363 - DNA, 25 bp, Mus musculus
atgctcctaattcttacctctatga

SEQ ID NO: 261364 - DNA, 25 bp, Mus musculus
atgctcctaattgttacctctatga

SEQ ID NO: 261365 - DNA, 25 bp, Mus musculus
atgctcctacagctcaatttcttct

SEQ ID NO: 261366 - DNA, 25 bp, Mus musculus
atgctcctacaggtcaatttcttct

SEQ ID NO: 261367 - DNA, 25 bp, Mus musculus
atgctcctacatcaaccactaaata

SEQ ID NO: 261368 - DNA, 25 bp, Mus musculus
atgctcctacatgaaccactaaata

SEQ ID NO: 261369 - DNA, 25 bp, Mus musculus
atgctcctaccccagggtcagaaga

SEQ ID NO: 261370 - DNA, 25 bp, Mus musculus
atgctcctacccgagggtcagaaga

SEQ ID NO: 261371 - DNA, 25 bp, Mus musculus
atgctcctactgaatcatctggtgg

SEQ ID NO: 261372 - DNA, 25 bp, Mus musculus
atgctcctactgtatcatctggtgg

SEQ ID NO: 261373 - DNA, 25 bp, Mus musculus
atgctcctagcaacgtcatgacact

SEQ ID NO: 261374 - DNA, 25 bp, Mus musculus
atgctcctagcatcgtcatgacact

SEQ ID NO: 261375 - DNA, 25 bp, Mus musculus
atgctcctatagagacccttactag

SEQ ID NO: 261376 - DNA, 25 bp, Mus musculus
atgctcctatagtgacccttactag

SEQ ID NO: 261377 - DNA, 25 bp, Mus musculus
atgctcctcagaccccatagatgtg

SEQ ID NO: 261378 - DNA, 25 bp, Mus musculus
atgctcctcagagcccatagatgtg

SEQ ID NO: 261379 - DNA, 25 bp, Mus musculus
atgctcctcattctcacagctgtgg

SEQ ID NO: 261380 - DNA, 25 bp, Mus musculus
atgctcctcattgtcacagctgtgg

SEQ ID NO: 261381 - DNA, 25 bp, Mus musculus
atgctcctccacacggatcagtgaa

SEQ ID NO: 261382 - DNA, 25 bp, Mus musculus
atgctcctccactcggatcagtgaa

SEQ ID NO: 261383 - DNA, 25 bp, Mus musculus
atgctcctccatcttaagagctggg

SEQ ID NO: 261384 - DNA, 25 bp, Mus musculus
atgctcctccatgttaagagctggg

SEQ ID NO: 261385 - DNA, 25 bp, Mus musculus
atgctcctcgccaagctaatgatga

SEQ ID NO: 261386 - DNA, 25 bp, Mus musculus
atgctcctcgcctagctaatgatga

SEQ ID NO: 261387 - DNA, 25 bp, Mus musculus
atgctcctcgctcgcacagaagatg

SEQ ID NO: 261388 - DNA, 25 bp, Mus musculus
atgctcctcgctggcacagaagatg

SEQ ID NO: 261389 - DNA, 25 bp, Mus musculus
atgctcctctgtactctgagggaac

SEQ ID NO: 261390 - DNA, 25 bp, Mus musculus
atgctcctctgttctctgagggaac

SEQ ID NO: 261391 - DNA, 25 bp, Mus musculus
atgctcctgcacagatgcatttgga

SEQ ID NO: 261392 - DNA, 25 bp, Mus musculus
atgctcctgcactgatgcatttgga

SEQ ID NO: 261393 - DNA, 25 bp, Mus musculus
atgctcctgcgacagctggcatgcc

SEQ ID NO: 261394 - DNA, 25 bp, Mus musculus
atgctcctgcgagagctggcatgcc

SEQ ID NO: 261395 - DNA, 25 bp, Mus musculus
atgctcctggatactgctcctacta

SEQ ID NO: 261396 - DNA, 25 bp, Mus musculus
atgctcctggattctgctcctacta

SEQ ID NO: 261397 - DNA, 25 bp, Mus musculus
atgctcctggtcatacatctgctgt

SEQ ID NO: 261398 - DNA, 25 bp, Mus musculus
atgctcctggtcttacatctgctgt

SEQ ID NO: 261399 - DNA, 25 bp, Mus musculus
atgctcctgtacacctcggagaaga

SEQ ID NO: 261400 - DNA, 25 bp, Mus musculus
atgctcctgtactcctcggagaaga

SEQ ID NO: 261401 - DNA, 25 bp, Mus musculus
atgctccttaaaagtcccacacatg

SEQ ID NO: 261402 - DNA, 25 bp, Mus musculus
atgctccttaaatgtcccacacatg

SEQ ID NO: 261403 - DNA, 25 bp, Mus musculus
atgctccttacaagttcctggattg

SEQ ID NO: 261404 - DNA, 25 bp, Mus musculus
atgctccttacatgttcctggattg

SEQ ID NO: 261405 - DNA, 25 bp, Mus musculus
atgctccttcatccattgaactgaa

SEQ ID NO: 261406 - DNA, 25 bp, Mus musculus
atgctccttcatgcattgaactgaa

SEQ ID NO: 261407 - DNA, 25 bp, Mus musculus
atgctccttcgaacctctggaaagt

SEQ ID NO: 261408 - DNA, 25 bp, Mus musculus
atgctccttcgatcctctggaaagt

SEQ ID NO: 261409 - DNA, 25 bp, Mus musculus
atgctccttgccaattgggacctga

SEQ ID NO: 261410 - DNA, 25 bp, Mus musculus
atgctccttgccattggtcttattc

SEQ ID NO: 261411 - DNA, 25 bp, Mus musculus
atgctccttgcctattgggacctga

SEQ ID NO: 261412 - DNA, 25 bp, Mus musculus
atgctccttgcctttggtcttattc

SEQ ID NO: 261413 - DNA, 25 bp, Mus musculus
atgctcgagaaacagtatgtgctac

SEQ ID NO: 261414 - DNA, 25 bp, Mus musculus
atgctcgagaaagagtatgtgctac

SEQ ID NO: 261415 - DNA, 25 bp, Mus musculus
atgctcgaggcacaaccggtggcca

SEQ ID NO: 261416 - DNA, 25 bp, Mus musculus
atgctcgaggcagaaccggtggcca

SEQ ID NO: 261417 - DNA, 25 bp, Mus musculus
atgctcgaggtgattcccgagggca

SEQ ID NO: 261418 - DNA, 25 bp, Mus musculus
atgctcgaggtgtttcccgagggca

SEQ ID NO: 261419 - DNA, 25 bp, Mus musculus
atgctcgagtgtacgttgtggctaa

SEQ ID NO: 261420 - DNA, 25 bp, Mus musculus
atgctcgagtgttcgttgtggctaa

SEQ ID NO: 261421 - DNA, 25 bp, Mus musculus
atgctcgccatcaaagtccagtgga

SEQ ID NO: 261422 - DNA, 25 bp, Mus musculus
atgctcgccatctaagtccagtgga

SEQ ID NO: 261423 - DNA, 25 bp, Mus musculus
atgctcgcctcaactgggtaaacat

SEQ ID NO: 261424 - DNA, 25 bp, Mus musculus
atgctcgcctcatctgggtaaacat

SEQ ID NO: 261425 - DNA, 25 bp, Mus musculus
atgctcgcttgcctagctttatgaa

SEQ ID NO: 261426 - DNA, 25 bp, Mus musculus
atgctcgcttgcgtagctttatgaa

SEQ ID NO: 261427 - DNA, 25 bp, Mus musculus
atgctcgctttcagcatcatcttag

SEQ ID NO: 261428 - DNA, 25 bp, Mus musculus
atgctcgctttctgcatcatcttag

SEQ ID NO: 261429 - DNA, 25 bp, Mus musculus
atgctcggccatctacactgtaaat

SEQ ID NO: 261430 - DNA, 25 bp, Mus musculus
atgctcggccatgtacactgtaaat

SEQ ID NO: 261431 - DNA, 25 bp, Mus musculus
atgctcggcttgaccaacacagtga

SEQ ID NO: 261432 - DNA, 25 bp, Mus musculus
atgctcggcttgtccaacacagtga

SEQ ID NO: 261433 - DNA, 25 bp, Mus musculus
atgctcgggcttctctgattcatac

SEQ ID NO: 261434 - DNA, 25 bp, Mus musculus
atgctcgggcttgtctgattcatac

SEQ ID NO: 261435 - DNA, 25 bp, Mus musculus
atgctcggtagcagcacagtgcgca

SEQ ID NO: 261436 - DNA, 25 bp, Mus musculus
atgctcggtagctgcacagtgcgca

SEQ ID NO: 261437 - DNA, 25 bp, Mus musculus
atgctcgtactaatcggtaccctga

SEQ ID NO: 261438 - DNA, 25 bp, Mus musculus
atgctcgtactattcggtaccctga

SEQ ID NO: 261439 - DNA, 25 bp, Mus musculus
atgctcgtctctcgatttttggatc

SEQ ID NO: 261440 - DNA, 25 bp, Mus musculus
atgctcgtctctggatttttggatc

SEQ ID NO: 261441 - DNA, 25 bp, Mus musculus
atgctcgtgctcacgcgatgcactc

SEQ ID NO: 261442 - DNA, 25 bp, Mus musculus
atgctcgtgctctcgcgatgcactc

SEQ ID NO: 261443 - DNA, 25 bp, Mus musculus
atgctcgtgggtaaacatctcacaa

SEQ ID NO: 261444 - DNA, 25 bp, Mus musculus
atgctcgtgggttaacatctcacaa

SEQ ID NO: 261445 - DNA, 25 bp, Mus musculus
atgctcgttcccctgagagtggtga

SEQ ID NO: 261446 - DNA, 25 bp, Mus musculus
atgctcgttcccgtgagagtggtga

SEQ ID NO: 261447 - DNA, 25 bp, Mus musculus
atgctctaacacaaggctgggtctt

SEQ ID NO: 261448 - DNA, 25 bp, Mus musculus
atgctctaacactaggctgggtctt

SEQ ID NO: 261449 - DNA, 25 bp, Mus musculus
atgctctaacagacatggcttaaca

SEQ ID NO: 261450 - DNA, 25 bp, Mus musculus
atgctctaacagtcatggcttaaca

SEQ ID NO: 261451 - DNA, 25 bp, Mus musculus
atgctctaagttcttaacacatagt

SEQ ID NO: 261452 - DNA, 25 bp, Mus musculus
atgctctaagttgttaacacatagt

SEQ ID NO: 261453 - DNA, 25 bp, Mus musculus
atgctctaattcatgctaccaggac

SEQ ID NO: 261454 - DNA, 25 bp, Mus musculus
atgctctaattcttgctaccaggac

SEQ ID NO: 261455 - DNA, 25 bp, Mus musculus
atgctctaggcaaatctactcgcgg

SEQ ID NO: 261456 - DNA, 25 bp, Mus musculus
atgctctaggcatatctactcgcgg

SEQ ID NO: 261457 - DNA, 25 bp, Mus musculus
atgctctagggcctctggatctccc

SEQ ID NO: 261458 - DNA, 25 bp, Mus musculus
atgctctagggcgtctggatctccc

SEQ ID NO: 261459 - DNA, 25 bp, Mus musculus
atgctctaggtcagctgtcttagaa

SEQ ID NO: 261460 - DNA, 25 bp, Mus musculus
atgctctaggtctgctgtcttagaa

SEQ ID NO: 261461 - DNA, 25 bp, Mus musculus
atgctctaggttatcagtaaggaga

SEQ ID NO: 261462 - DNA, 25 bp, Mus musculus
atgctctaggttttcagtaaggaga

SEQ ID NO: 261463 - DNA, 25 bp, Mus musculus
atgctctagtcgactgaattaaagt

SEQ ID NO: 261464 - DNA, 25 bp, Mus musculus
atgctctagtcgtctgaattaaagt

SEQ ID NO: 261465 - DNA, 25 bp, Mus musculus
atgctctatgcacttcttctgtaaa

SEQ ID NO: 261466 - DNA, 25 bp, Mus musculus
atgctctatgcagttcttctgtaaa

SEQ ID NO: 261467 - DNA, 25 bp, Mus musculus
atgctctcaatcctttcacggtgga

SEQ ID NO: 261468 - DNA, 25 bp, Mus musculus
atgctctcaatcgtttcacggtgga

SEQ ID NO: 261469 - DNA, 25 bp, Mus musculus
atgctctcattgctccgagtaaaca

SEQ ID NO: 261470 - DNA, 25 bp, Mus musculus
atgctctcattggtccgagtaaaca

SEQ ID NO: 261471 - DNA, 25 bp, Mus musculus
atgctctccacaagacagatctagg

SEQ ID NO: 261472 - DNA, 25 bp, Mus musculus
atgctctccacatgacagatctagg

SEQ ID NO: 261473 - DNA, 25 bp, Mus musculus
atgctctcccagaatgaattccctt

SEQ ID NO: 261474 - DNA, 25 bp, Mus musculus
atgctctcccagtatgaattccctt

SEQ ID NO: 261475 - DNA, 25 bp, Mus musculus
atgctctcccctacaatcgtgagaa

SEQ ID NO: 261476 - DNA, 25 bp, Mus musculus
atgctctccccttcaatcgtgagaa

SEQ ID NO: 261477 - DNA, 25 bp, Mus musculus
atgctctcccttcaagacctactaa

SEQ ID NO: 261478 - DNA, 25 bp, Mus musculus
atgctctcccttgaagacctactaa

SEQ ID NO: 261479 - DNA, 25 bp, Mus musculus
atgctctccgcacatgtgttctggc

SEQ ID NO: 261480 - DNA, 25 bp, Mus musculus
atgctctccgcagatgtgttctggc

SEQ ID NO: 261481 - DNA, 25 bp, Mus musculus
atgctctcctctcttgacaaagaga

SEQ ID NO: 261482 - DNA, 25 bp, Mus musculus
atgctctcctctgttgacaaagaga

SEQ ID NO: 261483 - DNA, 25 bp, Mus musculus
atgctctctaaccttgacttccaga

SEQ ID NO: 261484 - DNA, 25 bp, Mus musculus
atgctctctaacgttgacttccaga

SEQ ID NO: 261485 - DNA, 25 bp, Mus musculus
atgctctctagtcaggtgatcctct

SEQ ID NO: 261486 - DNA, 25 bp, Mus musculus
atgctctctagtgaggtgatcctct

SEQ ID NO: 261487 - DNA, 25 bp, Mus musculus
atgctctcttcaactcttacaaagg

SEQ ID NO: 261488 - DNA, 25 bp, Mus musculus
atgctctcttcatctcttacaaagg

SEQ ID NO: 261489 - DNA, 25 bp, Mus musculus
atgctctgactccatcgtgaagtgg

SEQ ID NO: 261490 - DNA, 25 bp, Mus musculus
atgctctgactcgatcgtgaagtgg

SEQ ID NO: 261491 - DNA, 25 bp, Mus musculus
atgctctgatggatcattcatgtca

SEQ ID NO: 261492 - DNA, 25 bp, Mus musculus
atgctctgatggttcattcatgtca

SEQ ID NO: 261493 - DNA, 25 bp, Mus musculus
atgctctgattcagtactcctctat

SEQ ID NO: 261494 - DNA, 25 bp, Mus musculus
atgctctgattctgtactcctctat

SEQ ID NO: 261495 - DNA, 25 bp, Mus musculus
atgctctgccccaaaaaatattttg

SEQ ID NO: 261496 - DNA, 25 bp, Mus musculus
atgctctgcccctaaaaatattttg

SEQ ID NO: 261497 - DNA, 25 bp, Mus musculus
atgctctgctacaccttttggaatt

SEQ ID NO: 261498 - DNA, 25 bp, Mus musculus
atgctctgctactccttttggaatt

SEQ ID NO: 261499 - DNA, 25 bp, Mus musculus
atgctctgctctactgggtctgttt

SEQ ID NO: 261500 - DNA, 25 bp, Mus musculus
atgctctgctcttctgggtctgttt

SEQ ID NO: 261501 - DNA, 25 bp, Mus musculus
atgctctggattccgtatgcctttc

SEQ ID NO: 261502 - DNA, 25 bp, Mus musculus
atgctctggattgcgtatgcctttc

SEQ ID NO: 261503 - DNA, 25 bp, Mus musculus
atgctctggcttcgtgtgcgtgcaa

SEQ ID NO: 261504 - DNA, 25 bp, Mus musculus
atgctctggcttggtgtgcgtgcaa

SEQ ID NO: 261505 - DNA, 25 bp, Mus musculus
atgctctgggaacgacagtcatact

SEQ ID NO: 261506 - DNA, 25 bp, Mus musculus
atgctctgggaaggacagtcatact

SEQ ID NO: 261507 - DNA, 25 bp, Mus musculus
atgctctgggagagtcatgatgaca

SEQ ID NO: 261508 - DNA, 25 bp, Mus musculus
atgctctgggagtgtcatgatgaca

SEQ ID NO: 261509 - DNA, 25 bp, Mus musculus
atgctctgtaagctatgtactcttt

SEQ ID NO: 261510 - DNA, 25 bp, Mus musculus
atgctctgtaaggtatgtactcttt

SEQ ID NO: 261511 - DNA, 25 bp, Mus musculus
atgctctgtcaacccctgaataaat

SEQ ID NO: 261512 - DNA, 25 bp, Mus musculus
atgctctgtcaagccctgaataaat

SEQ ID NO: 261513 - DNA, 25 bp, Mus musculus
atgctcttaactccattctttggca

SEQ ID NO: 261514 - DNA, 25 bp, Mus musculus
atgctcttaactgcattctttggca

SEQ ID NO: 261515 - DNA, 25 bp, Mus musculus
atgctcttacagactgcctgggatt

SEQ ID NO: 261516 - DNA, 25 bp, Mus musculus
atgctcttacagtctgcctgggatt

SEQ ID NO: 261517 - DNA, 25 bp, Mus musculus
atgctcttagacacacatcacacgt

SEQ ID NO: 261518 - DNA, 25 bp, Mus musculus
atgctcttagactcacatcacacgt

SEQ ID NO: 261519 - DNA, 25 bp, Mus musculus
atgctcttagatccatgggcatggt

SEQ ID NO: 261520 - DNA, 25 bp, Mus musculus
atgctcttagatgcatgggcatggt

SEQ ID NO: 261521 - DNA, 25 bp, Mus musculus
atgctcttaggcaccaatcaaagct

SEQ ID NO: 261522 - DNA, 25 bp, Mus musculus
atgctcttaggctccaatcaaagct

SEQ ID NO: 261523 - DNA, 25 bp, Mus musculus
atgctcttatttaccttaacgctga

SEQ ID NO: 261524 - DNA, 25 bp, Mus musculus
atgctcttattttccttaacgctga

SEQ ID NO: 261525 - DNA, 25 bp, Mus musculus
atgctcttcaggagccacacctaat

SEQ ID NO: 261526 - DNA, 25 bp, Mus musculus
atgctcttcaggtgccacacctaat

SEQ ID NO: 261527 - DNA, 25 bp, Mus musculus
atgctcttcagtacgtgtgtggacc

SEQ ID NO: 261528 - DNA, 25 bp, Mus musculus
atgctcttcagttcgtgtgtggacc

SEQ ID NO: 261529 - DNA, 25 bp, Mus musculus
atgctcttccaacggctgtggaaat

SEQ ID NO: 261530 - DNA, 25 bp, Mus musculus
atgctcttccaagggctgtggaaat

SEQ ID NO: 261531 - DNA, 25 bp, Mus musculus
atgctcttcctacggcaggagaagc

SEQ ID NO: 261532 - DNA, 25 bp, Mus musculus
atgctcttcctagggcaggagaagc

SEQ ID NO: 261533 - DNA, 25 bp, Mus musculus
atgctcttctggaattggagaccgc

SEQ ID NO: 261534 - DNA, 25 bp, Mus musculus
atgctcttctggtattggagaccgc

SEQ ID NO: 261535 - DNA, 25 bp, Mus musculus
atgctcttgagtcctacctatgaaa

SEQ ID NO: 261536 - DNA, 25 bp, Mus musculus
atgctcttgagtgctacctatgaaa

SEQ ID NO: 261537 - DNA, 25 bp, Mus musculus
atgctcttgattcctgatcctgaga

SEQ ID NO: 261538 - DNA, 25 bp, Mus musculus
atgctcttgattgctgatcctgaga

SEQ ID NO: 261539 - DNA, 25 bp, Mus musculus
atgctcttgctcagctgggtggcta

SEQ ID NO: 261540 - DNA, 25 bp, Mus musculus
atgctcttgctctgctgggtggcta

SEQ ID NO: 261541 - DNA, 25 bp, Mus musculus
atgctcttgctgaactcgcaaaatg

SEQ ID NO: 261542 - DNA, 25 bp, Mus musculus
atgctcttgctgtactcgcaaaatg

SEQ ID NO: 261543 - DNA, 25 bp, Mus musculus
atgctcttgcttatttactgtcgcc

SEQ ID NO: 261544 - DNA, 25 bp, Mus musculus
atgctcttgcttttttactgtcgcc

SEQ ID NO: 261545 - DNA, 25 bp, Mus musculus
atgctcttggcacactctacgcatg

SEQ ID NO: 261546 - DNA, 25 bp, Mus musculus
atgctcttggcagactctacgcatg

SEQ ID NO: 261547 - DNA, 25 bp, Mus musculus
atgctcttgggcacctacctgatga

SEQ ID NO: 261548 - DNA, 25 bp, Mus musculus
atgctcttgggctcctacctgatga

SEQ ID NO: 261549 - DNA, 25 bp, Mus musculus
atgctcttgtcgcaacccactgaaa

SEQ ID NO: 261550 - DNA, 25 bp, Mus musculus
atgctcttgtcggaacccactgaaa

SEQ ID NO: 261551 - DNA, 25 bp, Mus musculus
atgctctttatgcacagtcctggga

SEQ ID NO: 261552 - DNA, 25 bp, Mus musculus
atgctctttatggacagtcctggga

SEQ ID NO: 261553 - DNA, 25 bp, Mus musculus
atgctctttgttccattttatctca

SEQ ID NO: 261554 - DNA, 25 bp, Mus musculus
atgctctttgttgcattttatctca

SEQ ID NO: 261555 - DNA, 25 bp, Mus musculus
atgctcttttctatctgtccagatc

SEQ ID NO: 261556 - DNA, 25 bp, Mus musculus
atgctcttttctttctgtccagatc

SEQ ID NO: 261557 - DNA, 25 bp, Mus musculus
atgctgaaagcaagtggccccttgt

SEQ ID NO: 261558 - DNA, 25 bp, Mus musculus
atgctgaaagcatgtggccccttgt

SEQ ID NO: 261559 - DNA, 25 bp, Mus musculus
atgctgaaagctcagctacctgacc

SEQ ID NO: 261560 - DNA, 25 bp, Mus musculus
atgctgaaagctgagctacctgacc

SEQ ID NO: 261561 - DNA, 25 bp, Mus musculus
atgctgaaattcatgagccattcca

SEQ ID NO: 261562 - DNA, 25 bp, Mus musculus
atgctgaaattcttgagccattcca

SEQ ID NO: 261563 - DNA, 25 bp, Mus musculus
atgctgaacaggcacaccatagttt

SEQ ID NO: 261564 - DNA, 25 bp, Mus musculus
atgctgaacagggacaccatagttt

SEQ ID NO: 261565 - DNA, 25 bp, Mus musculus
atgctgaaccacatgtagacttgat

SEQ ID NO: 261566 - DNA, 25 bp, Mus musculus
atgctgaaccacctctatgcactct

SEQ ID NO: 261567 - DNA, 25 bp, Mus musculus
atgctgaaccacgtctatgcactct

SEQ ID NO: 261568 - DNA, 25 bp, Mus musculus
atgctgaaccacttgtagacttgat

SEQ ID NO: 261569 - DNA, 25 bp, Mus musculus
atgctgaacccactaagtgcatgta

SEQ ID NO: 261570 - DNA, 25 bp, Mus musculus
atgctgaacccagtaagtgcatgta

SEQ ID NO: 261571 - DNA, 25 bp, Mus musculus
atgctgaaccctcaattcaggccca

SEQ ID NO: 261572 - DNA, 25 bp, Mus musculus
atgctgaaccctgaattcaggccca

SEQ ID NO: 261573 - DNA, 25 bp, Mus musculus
atgctgaacctgaattacattgctc

SEQ ID NO: 261574 - DNA, 25 bp, Mus musculus
atgctgaacctgtattacattgctc

SEQ ID NO: 261575 - DNA, 25 bp, Mus musculus
atgctgaactgaactgaggtgcctc

SEQ ID NO: 261576 - DNA, 25 bp, Mus musculus
atgctgaactgatctgaggtgcctc

SEQ ID NO: 261577 - DNA, 25 bp, Mus musculus
atgctgaacttacactgctggtaca

SEQ ID NO: 261578 - DNA, 25 bp, Mus musculus
atgctgaacttagactgctggtaca

SEQ ID NO: 261579 - DNA, 25 bp, Mus musculus
atgctgaacttcattgagtcaacat

SEQ ID NO: 261580 - DNA, 25 bp, Mus musculus
atgctgaacttcattggctgttggg

SEQ ID NO: 261581 - DNA, 25 bp, Mus musculus
atgctgaacttctttgagtcaacat

SEQ ID NO: 261582 - DNA, 25 bp, Mus musculus
atgctgaacttctttggctgttggg

SEQ ID NO: 261583 - DNA, 25 bp, Mus musculus
atgctgaagatgctcagcctggctc

SEQ ID NO: 261584 - DNA, 25 bp, Mus musculus
atgctgaagatggtcagcctggctc

SEQ ID NO: 261585 - DNA, 25 bp, Mus musculus
atgctgaagcgcattccgcagagca

SEQ ID NO: 261586 - DNA, 25 bp, Mus musculus
atgctgaagcgctttccgcagagca

SEQ ID NO: 261587 - DNA, 25 bp, Mus musculus
atgctgaagtggaaaaaccccgcca

SEQ ID NO: 261588 - DNA, 25 bp, Mus musculus
atgctgaagtggtaaaaccccgcca

SEQ ID NO: 261589 - DNA, 25 bp, Mus musculus
atgctgaagtgtcgcttcctgctgt

SEQ ID NO: 261590 - DNA, 25 bp, Mus musculus
atgctgaagtgtggcttcctgctgt

SEQ ID NO: 261591 - DNA, 25 bp, Mus musculus
atgctgaataagacatgccttccta

SEQ ID NO: 261592 - DNA, 25 bp, Mus musculus
atgctgaataagtcatgccttccta

SEQ ID NO: 261593 - DNA, 25 bp, Mus musculus
atgctgaatagacccaccttgtgag

SEQ ID NO: 261594 - DNA, 25 bp, Mus musculus
atgctgaatagagccaccttgtgag

SEQ ID NO: 261595 - DNA, 25 bp, Mus musculus
atgctgaatcttagctgtacatgct

SEQ ID NO: 261596 - DNA, 25 bp, Mus musculus
atgctgaatctttgctgtacatgct

SEQ ID NO: 261597 - DNA, 25 bp, Mus musculus
atgctgaatgatcagagaattccag

SEQ ID NO: 261598 - DNA, 25 bp, Mus musculus
atgctgaatgatgagagaattccag

SEQ ID NO: 261599 - DNA, 25 bp, Mus musculus
atgctgacaagaaagctcaccagag

SEQ ID NO: 261600 - DNA, 25 bp, Mus musculus
atgctgacaagatagctcaccagag

SEQ ID NO: 261601 - DNA, 25 bp, Mus musculus
atgctgacagatccccttgaacttg

SEQ ID NO: 261602 - DNA, 25 bp, Mus musculus
atgctgacagatgcccttgaacttg

SEQ ID NO: 261603 - DNA, 25 bp, Mus musculus
atgctgacagcaacgcaaggctttc

SEQ ID NO: 261604 - DNA, 25 bp, Mus musculus
atgctgacagcatcgcaaggctttc

SEQ ID NO: 261605 - DNA, 25 bp, Mus musculus
atgctgacagctctttctttacctc

SEQ ID NO: 261606 - DNA, 25 bp, Mus musculus
atgctgacagctgtttctttacctc

SEQ ID NO: 261607 - DNA, 25 bp, Mus musculus
atgctgacagtcctgtcttctacca

SEQ ID NO: 261608 - DNA, 25 bp, Mus musculus
atgctgacagtcgtgtcttctacca

SEQ ID NO: 261609 - DNA, 25 bp, Mus musculus
atgctgacagttcagctactgctta

SEQ ID NO: 261610 - DNA, 25 bp, Mus musculus
atgctgacagttctgtgtctccgac

SEQ ID NO: 261611 - DNA, 25 bp, Mus musculus
atgctgacagttgagctactgctta

SEQ ID NO: 261612 - DNA, 25 bp, Mus musculus
atgctgacagttgtgtgtctccgac

SEQ ID NO: 261613 - DNA, 25 bp, Mus musculus
atgctgaccactacctttcagatca

SEQ ID NO: 261614 - DNA, 25 bp, Mus musculus
atgctgaccacttcctttcagatca

SEQ ID NO: 261615 - DNA, 25 bp, Mus musculus
atgctgaccgtaacatgtggagcct

SEQ ID NO: 261616 - DNA, 25 bp, Mus musculus
atgctgaccgtatcatgtggagcct

SEQ ID NO: 261617 - DNA, 25 bp, Mus musculus
atgctgaccgtcctgctttgattgt

SEQ ID NO: 261618 - DNA, 25 bp, Mus musculus
atgctgaccgtcgtgctttgattgt

SEQ ID NO: 261619 - DNA, 25 bp, Mus musculus
atgctgacctacacttctcgaatcg

SEQ ID NO: 261620 - DNA, 25 bp, Mus musculus
atgctgacctactcttctcgaatcg

SEQ ID NO: 261621 - DNA, 25 bp, Mus musculus
atgctgacctcaaacgcacagggat

SEQ ID NO: 261622 - DNA, 25 bp, Mus musculus
atgctgacctcaactcacaagagat

SEQ ID NO: 261623 - DNA, 25 bp, Mus musculus
atgctgacctcatacgcacagggat

SEQ ID NO: 261624 - DNA, 25 bp, Mus musculus
atgctgacctcatctcacaagagat

SEQ ID NO: 261625 - DNA, 25 bp, Mus musculus
atgctgacctgaaaatgctcccact

SEQ ID NO: 261626 - DNA, 25 bp, Mus musculus
atgctgacctgataatgctcccact

SEQ ID NO: 261627 - DNA, 25 bp, Mus musculus
atgctgacctggaccctgcttccca

SEQ ID NO: 261628 - DNA, 25 bp, Mus musculus
atgctgacctggtccctgcttccca

SEQ ID NO: 261629 - DNA, 25 bp, Mus musculus
atgctgacgttcatgcttttggcgc

SEQ ID NO: 261630 - DNA, 25 bp, Mus musculus
atgctgacgttcttgcttttggcgc

SEQ ID NO: 261631 - DNA, 25 bp, Mus musculus
atgctgacgtttccactggcacttg

SEQ ID NO: 261632 - DNA, 25 bp, Mus musculus
atgctgacgtttgcactggcacttg

SEQ ID NO: 261633 - DNA, 25 bp, Mus musculus
atgctgactcacagcccagatatgg

SEQ ID NO: 261634 - DNA, 25 bp, Mus musculus
atgctgactcactgcccagatatgg

SEQ ID NO: 261635 - DNA, 25 bp, Mus musculus
atgctgactcctctagattgctcat

SEQ ID NO: 261636 - DNA, 25 bp, Mus musculus
atgctgactcctgtagattgctcat

SEQ ID NO: 261637 - DNA, 25 bp, Mus musculus
atgctgactgcaaagatgttccaat

SEQ ID NO: 261638 - DNA, 25 bp, Mus musculus
atgctgactgcatagatgttccaat

SEQ ID NO: 261639 - DNA, 25 bp, Mus musculus
atgctgacttcactaactgcccttg

SEQ ID NO: 261640 - DNA, 25 bp, Mus musculus
atgctgacttcagtaactgcccttg

SEQ ID NO: 261641 - DNA, 25 bp, Mus musculus
atgctgacttctaatacaactctag

SEQ ID NO: 261642 - DNA, 25 bp, Mus musculus
atgctgacttctagagatgtccttt

SEQ ID NO: 261643 - DNA, 25 bp, Mus musculus
atgctgacttcttatacaactctag

SEQ ID NO: 261644 - DNA, 25 bp, Mus musculus
atgctgacttcttgagatgtccttt

SEQ ID NO: 261645 - DNA, 25 bp, Mus musculus
atgctgacttgtacgagctgggctc

SEQ ID NO: 261646 - DNA, 25 bp, Mus musculus
atgctgacttgttcgagctgggctc

SEQ ID NO: 261647 - DNA, 25 bp, Mus musculus
atgctgagaaacagtacctgcggtc

SEQ ID NO: 261648 - DNA, 25 bp, Mus musculus
atgctgagaaactgtacctgcggtc

SEQ ID NO: 261649 - DNA, 25 bp, Mus musculus
atgctgagaactcactctgggacct

SEQ ID NO: 261650 - DNA, 25 bp, Mus musculus
atgctgagaactgactctgggacct

SEQ ID NO: 261651 - DNA, 25 bp, Mus musculus
atgctgagaatacgcagggttccct

SEQ ID NO: 261652 - DNA, 25 bp, Mus musculus
atgctgagaataggcagggttccct

SEQ ID NO: 261653 - DNA, 25 bp, Mus musculus
atgctgagacagcactgcagccagt

SEQ ID NO: 261654 - DNA, 25 bp, Mus musculus
atgctgagacaggactgcagccagt

SEQ ID NO: 261655 - DNA, 25 bp, Mus musculus
atgctgagagtaacgctgaacttaa

SEQ ID NO: 261656 - DNA, 25 bp, Mus musculus
atgctgagagtatcgctgaacttaa

SEQ ID NO: 261657 - DNA, 25 bp, Mus musculus
atgctgagatgcaggtcctgtccta

SEQ ID NO: 261658 - DNA, 25 bp, Mus musculus
atgctgagatgctggtcctgtccta

SEQ ID NO: 261659 - DNA, 25 bp, Mus musculus
atgctgagcatgatccctggcaacc

SEQ ID NO: 261660 - DNA, 25 bp, Mus musculus
atgctgagcatgttccctggcaacc

SEQ ID NO: 261661 - DNA, 25 bp, Mus musculus
atgctgagcctaaagtctagatcag

SEQ ID NO: 261662 - DNA, 25 bp, Mus musculus
atgctgagcctatagtctagatcag

SEQ ID NO: 261663 - DNA, 25 bp, Mus musculus
atgctgagcggtaagggtcccagac

SEQ ID NO: 261664 - DNA, 25 bp, Mus musculus
atgctgagcggttagggtcccagac

SEQ ID NO: 261665 - DNA, 25 bp, Mus musculus
atgctgagctcgaccgggttgtgac

SEQ ID NO: 261666 - DNA, 25 bp, Mus musculus
atgctgagctcgctgctcgtgcgct

SEQ ID NO: 261667 - DNA, 25 bp, Mus musculus
atgctgagctcggtgctcgtgcgct

SEQ ID NO: 261668 - DNA, 25 bp, Mus musculus
atgctgagctcgtccgggttgtgac

SEQ ID NO: 261669 - DNA, 25 bp, Mus musculus
atgctgaggttcagaactctgaccc

SEQ ID NO: 261670 - DNA, 25 bp, Mus musculus
atgctgaggttctgaactctgaccc

SEQ ID NO: 261671 - DNA, 25 bp, Mus musculus
atgctgagtaccagacatgtctatc

SEQ ID NO: 261672 - DNA, 25 bp, Mus musculus
atgctgagtacctgacatgtctatc

SEQ ID NO: 261673 - DNA, 25 bp, Mus musculus
atgctgagtccactgtgctggagcc

SEQ ID NO: 261674 - DNA, 25 bp, Mus musculus
atgctgagtccagtgtgctggagcc

SEQ ID NO: 261675 - DNA, 25 bp, Mus musculus
atgctgagtgttagcttacggaact

SEQ ID NO: 261676 - DNA, 25 bp, Mus musculus
atgctgagtgtttgcttacggaact

SEQ ID NO: 261677 - DNA, 25 bp, Mus musculus
atgctgatagacagtactgctcttc

SEQ ID NO: 261678 - DNA, 25 bp, Mus musculus
atgctgatagactgtactgctcttc

SEQ ID NO: 261679 - DNA, 25 bp, Mus musculus
atgctgatagtcacatgattaacat

SEQ ID NO: 261680 - DNA, 25 bp, Mus musculus
atgctgatagtctcatgattaacat

SEQ ID NO: 261681 - DNA, 25 bp, Mus musculus
atgctgatcctactaatattgccaa

SEQ ID NO: 261682 - DNA, 25 bp, Mus musculus
atgctgatcctagtaatattgccaa

SEQ ID NO: 261683 - DNA, 25 bp, Mus musculus
atgctgatcctcaatctgaccaata

SEQ ID NO: 261684 - DNA, 25 bp, Mus musculus
atgctgatcctctatctgaccaata

SEQ ID NO: 261685 - DNA, 25 bp, Mus musculus
atgctgatctaaagagcctcacctt

SEQ ID NO: 261686 - DNA, 25 bp, Mus musculus
atgctgatctaatgagcctcacctt

SEQ ID NO: 261687 - DNA, 25 bp, Mus musculus
atgctgatctagctggctgctgagt

SEQ ID NO: 261688 - DNA, 25 bp, Mus musculus
atgctgatctaggtggctgctgagt

SEQ ID NO: 261689 - DNA, 25 bp, Mus musculus
atgctgatctgactggctctgctca

SEQ ID NO: 261690 - DNA, 25 bp, Mus musculus
atgctgatctgagtggctctgctca

SEQ ID NO: 261691 - DNA, 25 bp, Mus musculus
atgctgatgatgaccccgccgccgg

SEQ ID NO: 261692 - DNA, 25 bp, Mus musculus
atgctgatgatgtccccgccgccgg

SEQ ID NO: 261693 - DNA, 25 bp, Mus musculus
atgctgatgccactgtatccagtta

SEQ ID NO: 261694 - DNA, 25 bp, Mus musculus
atgctgatgccagtgtatccagtta

SEQ ID NO: 261695 - DNA, 25 bp, Mus musculus
atgctgatgcctcaccatggagaaa

SEQ ID NO: 261696 - DNA, 25 bp, Mus musculus
atgctgatgcctgaccatggagaaa

SEQ ID NO: 261697 - DNA, 25 bp, Mus musculus
atgctgatgctcacaaagacctgta

SEQ ID NO: 261698 - DNA, 25 bp, Mus musculus
atgctgatgctctcaaagacctgta

SEQ ID NO: 261699 - DNA, 25 bp, Mus musculus
atgctgatgcttcctgccattagta

SEQ ID NO: 261700 - DNA, 25 bp, Mus musculus
atgctgatgcttgctgccattagta

SEQ ID NO: 261701 - DNA, 25 bp, Mus musculus
atgctgatgttgctattttgtggaa

SEQ ID NO: 261702 - DNA, 25 bp, Mus musculus
atgctgatgttgctctctgtggtgt

SEQ ID NO: 261703 - DNA, 25 bp, Mus musculus
atgctgatgttggtattttgtggaa

SEQ ID NO: 261704 - DNA, 25 bp, Mus musculus
atgctgatgttggtctctgtggtgt

SEQ ID NO: 261705 - DNA, 25 bp, Mus musculus
atgctgattgtaaagggtaacatca

SEQ ID NO: 261706 - DNA, 25 bp, Mus musculus
atgctgattgtatagggtaacatca

SEQ ID NO: 261707 - DNA, 25 bp, Mus musculus
atgctgattgtcatcgtttaaatta

SEQ ID NO: 261708 - DNA, 25 bp, Mus musculus
atgctgattgtcttcgtttaaatta

SEQ ID NO: 261709 - DNA, 25 bp, Mus musculus
atgctgattttcattcttccggctg

SEQ ID NO: 261710 - DNA, 25 bp, Mus musculus
atgctgattttctttcttccggctg

SEQ ID NO: 261711 - DNA, 25 bp, Mus musculus
atgctgcaactgatgttccttctca

SEQ ID NO: 261712 - DNA, 25 bp, Mus musculus
atgctgcaactgttgttccttctca

SEQ ID NO: 261713 - DNA, 25 bp, Mus musculus
atgctgcaacttcaaggatgggcac

SEQ ID NO: 261714 - DNA, 25 bp, Mus musculus
atgctgcaacttgaaggatgggcac

SEQ ID NO: 261715 - DNA, 25 bp, Mus musculus
atgctgcaagctctacgagccctga

SEQ ID NO: 261716 - DNA, 25 bp, Mus musculus
atgctgcaagctgtacgagccctga

SEQ ID NO: 261717 - DNA, 25 bp, Mus musculus
atgctgcacacccttctggtgacag

SEQ ID NO: 261718 - DNA, 25 bp, Mus musculus
atgctgcacaccgttctggtgacag

SEQ ID NO: 261719 - DNA, 25 bp, Mus musculus
atgctgcacagccaggtgatgatat

SEQ ID NO: 261720 - DNA, 25 bp, Mus musculus
atgctgcacagcgaggtgatgatat

SEQ ID NO: 261721 - DNA, 25 bp, Mus musculus
atgctgcacgcaacttgagctagct

SEQ ID NO: 261722 - DNA, 25 bp, Mus musculus
atgctgcacgcatcttgagctagct

SEQ ID NO: 261723 - DNA, 25 bp, Mus musculus
atgctgcagaccctggccaagaaca

SEQ ID NO: 261724 - DNA, 25 bp, Mus musculus
atgctgcagaccgtggccaagaaca

SEQ ID NO: 261725 - DNA, 25 bp, Mus musculus
atgctgcagactatttgagttccca

SEQ ID NO: 261726 - DNA, 25 bp, Mus musculus
atgctgcagactttttgagttccca

SEQ ID NO: 261727 - DNA, 25 bp, Mus musculus
atgctgcagttgctgcttcccgagc

SEQ ID NO: 261728 - DNA, 25 bp, Mus musculus
atgctgcagttggtgcttcccgagc

SEQ ID NO: 261729 - DNA, 25 bp, Mus musculus
atgctgcatatcctgaaccccgagg

SEQ ID NO: 261730 - DNA, 25 bp, Mus musculus
atgctgcatatcctttccttgcata

SEQ ID NO: 261731 - DNA, 25 bp, Mus musculus
atgctgcatatcgtgaaccccgagg

SEQ ID NO: 261732 - DNA, 25 bp, Mus musculus
atgctgcatatcgtttccttgcata

SEQ ID NO: 261733 - DNA, 25 bp, Mus musculus
atgctgcatgacaggatcctccaag

SEQ ID NO: 261734 - DNA, 25 bp, Mus musculus
atgctgcatgactggatcctccaag

SEQ ID NO: 261735 - DNA, 25 bp, Mus musculus
atgctgcatgctatcagtgttttga

SEQ ID NO: 261736 - DNA, 25 bp, Mus musculus
atgctgcatgctttcagtgttttga

SEQ ID NO: 261737 - DNA, 25 bp, Mus musculus
atgctgcatgtcctataaagatttc

SEQ ID NO: 261738 - DNA, 25 bp, Mus musculus
atgctgcatgtcgtataaagatttc

SEQ ID NO: 261739 - DNA, 25 bp, Mus musculus
atgctgcatgttatggaagacctca

SEQ ID NO: 261740 - DNA, 25 bp, Mus musculus
atgctgcatgttttggaagacctca

SEQ ID NO: 261741 - DNA, 25 bp, Mus musculus
atgctgccaagaccagggccaatgt

SEQ ID NO: 261742 - DNA, 25 bp, Mus musculus
atgctgccaagagcagggccaatgt

SEQ ID NO: 261743 - DNA, 25 bp, Mus musculus
atgctgccatccatcatacagagag

SEQ ID NO: 261744 - DNA, 25 bp, Mus musculus
atgctgccatccttcatacagagag

SEQ ID NO: 261745 - DNA, 25 bp, Mus musculus
atgctgccatgtaatctgccatgat

SEQ ID NO: 261746 - DNA, 25 bp, Mus musculus
atgctgccatgttatctgccatgat

SEQ ID NO: 261747 - DNA, 25 bp, Mus musculus
atgctgccattcatgtcttttcctt

SEQ ID NO: 261748 - DNA, 25 bp, Mus musculus
atgctgccattcttgtcttttcctt

SEQ ID NO: 261749 - DNA, 25 bp, Mus musculus
atgctgcccaaaaacctgcacagaa

SEQ ID NO: 261750 - DNA, 25 bp, Mus musculus
atgctgcccaaatacctgcacagaa

SEQ ID NO: 261751 - DNA, 25 bp, Mus musculus
atgctgcccaggaactcattaggta

SEQ ID NO: 261752 - DNA, 25 bp, Mus musculus
atgctgcccaggtactcattaggta

SEQ ID NO: 261753 - DNA, 25 bp, Mus musculus
atgctgccccacaagaccaagagag

SEQ ID NO: 261754 - DNA, 25 bp, Mus musculus
atgctgccccactagaccaagagag

SEQ ID NO: 261755 - DNA, 25 bp, Mus musculus
atgctgccctggcacccaagtggta

SEQ ID NO: 261756 - DNA, 25 bp, Mus musculus
atgctgccctgggacccaagtggta

SEQ ID NO: 261757 - DNA, 25 bp, Mus musculus
atgctgccgtgtcgaatgcccagga

SEQ ID NO: 261758 - DNA, 25 bp, Mus musculus
atgctgccgtgtggaatgcccagga

SEQ ID NO: 261759 - DNA, 25 bp, Mus musculus
atgctgcctataatacttctacccg

SEQ ID NO: 261760 - DNA, 25 bp, Mus musculus
atgctgcctatattacttctacccg

SEQ ID NO: 261761 - DNA, 25 bp, Mus musculus
atgctgcctcagatgacctgttgga

SEQ ID NO: 261762 - DNA, 25 bp, Mus musculus
atgctgcctcagttgacctgttgga

SEQ ID NO: 261763 - DNA, 25 bp, Mus musculus
atgctgcctctcacaagtttattat

SEQ ID NO: 261764 - DNA, 25 bp, Mus musculus
atgctgcctctcattatcatagtta

SEQ ID NO: 261765 - DNA, 25 bp, Mus musculus
atgctgcctctctcaagtttattat

SEQ ID NO: 261766 - DNA, 25 bp, Mus musculus
atgctgcctctctttatcatagtta

SEQ ID NO: 261767 - DNA, 25 bp, Mus musculus
atgctgccttctaatttcataggac

SEQ ID NO: 261768 - DNA, 25 bp, Mus musculus
atgctgccttcttatttcataggac

SEQ ID NO: 261769 - DNA, 25 bp, Mus musculus
atgctgcgaagaacaagctccgggt

SEQ ID NO: 261770 - DNA, 25 bp, Mus musculus
atgctgcgaagatcaagctccgggt

SEQ ID NO: 261771 - DNA, 25 bp, Mus musculus
atgctgcgaaggacaaacccataga

SEQ ID NO: 261772 - DNA, 25 bp, Mus musculus
atgctgcgaaggtcaaacccataga

SEQ ID NO: 261773 - DNA, 25 bp, Mus musculus
atgctgcgactcctacaaagtgctt

SEQ ID NO: 261774 - DNA, 25 bp, Mus musculus
atgctgcgactcgtacaaagtgctt

SEQ ID NO: 261775 - DNA, 25 bp, Mus musculus
atgctgcgcaagctgagctgccgct

SEQ ID NO: 261776 - DNA, 25 bp, Mus musculus
atgctgcgcaaggtgagctgccgct

SEQ ID NO: 261777 - DNA, 25 bp, Mus musculus
atgctgcgcagcctgagcgggaagc

SEQ ID NO: 261778 - DNA, 25 bp, Mus musculus
atgctgcgcagcgtgagcgggaagc

SEQ ID NO: 261779 - DNA, 25 bp, Mus musculus
atgctgcgcgtaattggagctctgc

SEQ ID NO: 261780 - DNA, 25 bp, Mus musculus
atgctgcgcgtatttggagctctgc

SEQ ID NO: 261781 - DNA, 25 bp, Mus musculus
atgctgcggattctggagccataca

SEQ ID NO: 261782 - DNA, 25 bp, Mus musculus
atgctgcggattgtggagccataca

SEQ ID NO: 261783 - DNA, 25 bp, Mus musculus
atgctgcgtgttcgacacatttcct

SEQ ID NO: 261784 - DNA, 25 bp, Mus musculus
atgctgcgtgttggacacatttcct

SEQ ID NO: 261785 - DNA, 25 bp, Mus musculus
atgctgctacccaccaagagctgga

SEQ ID NO: 261786 - DNA, 25 bp, Mus musculus
atgctgctaccctccaagagctgga

SEQ ID NO: 261787 - DNA, 25 bp, Mus musculus
atgctgctcacaatcacggattttc

SEQ ID NO: 261788 - DNA, 25 bp, Mus musculus
atgctgctcacattcacggattttc

SEQ ID NO: 261789 - DNA, 25 bp, Mus musculus
atgctgctcagtcttgagaggctca

SEQ ID NO: 261790 - DNA, 25 bp, Mus musculus
atgctgctcagtgttgagaggctca

SEQ ID NO: 261791 - DNA, 25 bp, Mus musculus
atgctgctcccaagtcctcaagatt

SEQ ID NO: 261792 - DNA, 25 bp, Mus musculus
atgctgctcccatgtcctcaagatt

SEQ ID NO: 261793 - DNA, 25 bp, Mus musculus
atgctgctcccgcactctttggtgg

SEQ ID NO: 261794 - DNA, 25 bp, Mus musculus
atgctgctcccggactctttggtgg

SEQ ID NO: 261795 - DNA, 25 bp, Mus musculus
atgctgctcgtcaaagatctgttgc

SEQ ID NO: 261796 - DNA, 25 bp, Mus musculus
atgctgctcgtctaagatctgttgc

SEQ ID NO: 261797 - DNA, 25 bp, Mus musculus
atgctgctctctatttggtttatga

SEQ ID NO: 261798 - DNA, 25 bp, Mus musculus
atgctgctctctttttggtttatga

SEQ ID NO: 261799 - DNA, 25 bp, Mus musculus
atgctgctcttcagactttctgaac

SEQ ID NO: 261800 - DNA, 25 bp, Mus musculus
atgctgctcttctgactttctgaac

SEQ ID NO: 261801 - DNA, 25 bp, Mus musculus
atgctgctgactcggatagatctga

SEQ ID NO: 261802 - DNA, 25 bp, Mus musculus
atgctgctgactgggatagatctga

SEQ ID NO: 261803 - DNA, 25 bp, Mus musculus
atgctgctgataacactgccatttt

SEQ ID NO: 261804 - DNA, 25 bp, Mus musculus
atgctgctgatatcactgccatttt

SEQ ID NO: 261805 - DNA, 25 bp, Mus musculus
atgctgctgatgaggatgctcgaaa

SEQ ID NO: 261806 - DNA, 25 bp, Mus musculus
atgctgctgatgtggatgctcgaaa

SEQ ID NO: 261807 - DNA, 25 bp, Mus musculus
atgctgctgcccagtggaaggcccc

SEQ ID NO: 261808 - DNA, 25 bp, Mus musculus
atgctgctgccctgtggaaggcccc

SEQ ID NO: 261809 - DNA, 25 bp, Mus musculus
atgctgctgccgatgaaggccgaaa

SEQ ID NO: 261810 - DNA, 25 bp, Mus musculus
atgctgctgccgttgaaggccgaaa

SEQ ID NO: 261811 - DNA, 25 bp, Mus musculus
atgctgctgctcaatgtcgtctaca

SEQ ID NO: 261812 - DNA, 25 bp, Mus musculus
atgctgctgctcacattcataagaa

SEQ ID NO: 261813 - DNA, 25 bp, Mus musculus
atgctgctgctctatgtcgtctaca

SEQ ID NO: 261814 - DNA, 25 bp, Mus musculus
atgctgctgctctcattcataagaa

SEQ ID NO: 261815 - DNA, 25 bp, Mus musculus
atgctgctgggtacagagtctcttc

SEQ ID NO: 261816 - DNA, 25 bp, Mus musculus
atgctgctgggttcagagtctcttc

SEQ ID NO: 261817 - DNA, 25 bp, Mus musculus
atgctgctggtaaagcacttccctc

SEQ ID NO: 261818 - DNA, 25 bp, Mus musculus
atgctgctggtatagcacttccctc

SEQ ID NO: 261819 - DNA, 25 bp, Mus musculus
atgctgctgtacctaaatcccttca

SEQ ID NO: 261820 - DNA, 25 bp, Mus musculus
atgctgctgtacgtaaatcccttca

SEQ ID NO: 261821 - DNA, 25 bp, Mus musculus
atgctgctgtccagtagggcccatg

SEQ ID NO: 261822 - DNA, 25 bp, Mus musculus
atgctgctgtcctgtagggcccatg

SEQ ID NO: 261823 - DNA, 25 bp, Mus musculus
atgctgctgtgaagctgctgtgatg

SEQ ID NO: 261824 - DNA, 25 bp, Mus musculus
atgctgctgtgacatagcctgttcc

SEQ ID NO: 261825 - DNA, 25 bp, Mus musculus
atgctgctgtgagatagcctgttcc

SEQ ID NO: 261826 - DNA, 25 bp, Mus musculus
atgctgctgtgatgctgctgtgatg

SEQ ID NO: 261827 - DNA, 25 bp, Mus musculus
atgctgctgtgcctacatcatgaaa

SEQ ID NO: 261828 - DNA, 25 bp, Mus musculus
atgctgctgtgcgtacatcatgaaa

SEQ ID NO: 261829 - DNA, 25 bp, Mus musculus
atgctgctgtggcagacaccaccat

SEQ ID NO: 261830 - DNA, 25 bp, Mus musculus
atgctgctgtgggagacaccaccat

SEQ ID NO: 261831 - DNA, 25 bp, Mus musculus
atgctgctgttcatagtctcagtta

SEQ ID NO: 261832 - DNA, 25 bp, Mus musculus
atgctgctgttcttagtctcagtta

SEQ ID NO: 261833 - DNA, 25 bp, Mus musculus
atgctgcttccacttctggttcaca

SEQ ID NO: 261834 - DNA, 25 bp, Mus musculus
atgctgcttccagttctggttcaca

SEQ ID NO: 261835 - DNA, 25 bp, Mus musculus
atgctgcttgcaagtctgagctcat

SEQ ID NO: 261836 - DNA, 25 bp, Mus musculus
atgctgcttgcatgtctgagctcat

SEQ ID NO: 261837 - DNA, 25 bp, Mus musculus
atgctgctttcacaggatttgcctt

SEQ ID NO: 261838 - DNA, 25 bp, Mus musculus
atgctgctttcagaggatttgcctt

SEQ ID NO: 261839 - DNA, 25 bp, Mus musculus
atgctggaacacctgagttcgctgc

SEQ ID NO: 261840 - DNA, 25 bp, Mus musculus
atgctggaacacgtgagttcgctgc

SEQ ID NO: 261841 - DNA, 25 bp, Mus musculus
atgctggaacgaccggcacaggcct

SEQ ID NO: 261842 - DNA, 25 bp, Mus musculus
atgctggaacgagcggcacaggcct

SEQ ID NO: 261843 - DNA, 25 bp, Mus musculus
atgctggaactactctgtcgtcttt

SEQ ID NO: 261844 - DNA, 25 bp, Mus musculus
atgctggaactagtctgtcgtcttt

SEQ ID NO: 261845 - DNA, 25 bp, Mus musculus
atgctggaatccaccttctaggtac

SEQ ID NO: 261846 - DNA, 25 bp, Mus musculus
atgctggaatcctccttctaggtac

SEQ ID NO: 261847 - DNA, 25 bp, Mus musculus
atgctggaatgtaagcccttgctag

SEQ ID NO: 261848 - DNA, 25 bp, Mus musculus
atgctggaatgttagcccttgctag

SEQ ID NO: 261849 - DNA, 25 bp, Mus musculus
atgctggaattgaacccggatcctc

SEQ ID NO: 261850 - DNA, 25 bp, Mus musculus
atgctggaattgtacccggatcctc

SEQ ID NO: 261851 - DNA, 25 bp, Mus musculus
atgctggacaccaaaggatcttccc

SEQ ID NO: 261852 - DNA, 25 bp, Mus musculus
atgctggacacctaaggatcttccc

SEQ ID NO: 261853 - DNA, 25 bp, Mus musculus
atgctggacagcaactctttggaac

SEQ ID NO: 261854 - DNA, 25 bp, Mus musculus
atgctggacagctactctttggaac

SEQ ID NO: 261855 - DNA, 25 bp, Mus musculus
atgctggacagtcgtctgttgtgac

SEQ ID NO: 261856 - DNA, 25 bp, Mus musculus
atgctggacagtggtctgttgtgac

SEQ ID NO: 261857 - DNA, 25 bp, Mus musculus
atgctggactgcattgtgaacaccg

SEQ ID NO: 261858 - DNA, 25 bp, Mus musculus
atgctggactgctttgtgaacaccg

SEQ ID NO: 261859 - DNA, 25 bp, Mus musculus
atgctggagagtcacaatggcctgt

SEQ ID NO: 261860 - DNA, 25 bp, Mus musculus
atgctggagagtgacaatggcctgt

SEQ ID NO: 261861 - DNA, 25 bp, Mus musculus
atgctggagattaaccacctgggct

SEQ ID NO: 261862 - DNA, 25 bp, Mus musculus
atgctggagatttaccacctgggct

SEQ ID NO: 261863 - DNA, 25 bp, Mus musculus
atgctggagtgccaactgccgacat

SEQ ID NO: 261864 - DNA, 25 bp, Mus musculus
atgctggagtgcgaactgccgacat

SEQ ID NO: 261865 - DNA, 25 bp, Mus musculus
atgctggatcccacggaggcatttc

SEQ ID NO: 261866 - DNA, 25 bp, Mus musculus
atgctggatccctcggaggcatttc

SEQ ID NO: 261867 - DNA, 25 bp, Mus musculus
atgctggatgccctcaggttcactg

SEQ ID NO: 261868 - DNA, 25 bp, Mus musculus
atgctggatgccgtcaggttcactg

SEQ ID NO: 261869 - DNA, 25 bp, Mus musculus
atgctggatttgaccaccaacttca

SEQ ID NO: 261870 - DNA, 25 bp, Mus musculus
atgctggatttgtccaccaacttca

SEQ ID NO: 261871 - DNA, 25 bp, Mus musculus
atgctggattttcacgtatctccct

SEQ ID NO: 261872 - DNA, 25 bp, Mus musculus
atgctggattttgacgtatctccct

SEQ ID NO: 261873 - DNA, 25 bp, Mus musculus
atgctggcaagtacttgacccctga

SEQ ID NO: 261874 - DNA, 25 bp, Mus musculus
atgctggcaagttcttgacccctga

SEQ ID NO: 261875 - DNA, 25 bp, Mus musculus
atgctggcacatcattttgctggaa

SEQ ID NO: 261876 - DNA, 25 bp, Mus musculus
atgctggcacatccacctgaaggga

SEQ ID NO: 261877 - DNA, 25 bp, Mus musculus
atgctggcacatgattttgctggaa

SEQ ID NO: 261878 - DNA, 25 bp, Mus musculus
atgctggcacatgcacctgaaggga

SEQ ID NO: 261879 - DNA, 25 bp, Mus musculus
atgctggcactgacctgggcgctcg

SEQ ID NO: 261880 - DNA, 25 bp, Mus musculus
atgctggcactgtcctgggcgctcg

SEQ ID NO: 261881 - DNA, 25 bp, Mus musculus
atgctggcccaaagttttcatctta

SEQ ID NO: 261882 - DNA, 25 bp, Mus musculus
atgctggcccaatgttttcatctta

SEQ ID NO: 261883 - DNA, 25 bp, Mus musculus
atgctggccccgaggacaaggaccc

SEQ ID NO: 261884 - DNA, 25 bp, Mus musculus
atgctggccccgtggacaaggaccc

SEQ ID NO: 261885 - DNA, 25 bp, Mus musculus
atgctggcgaggaacggcagttccc

SEQ ID NO: 261886 - DNA, 25 bp, Mus musculus
atgctggcgaggtacggcagttccc

SEQ ID NO: 261887 - DNA, 25 bp, Mus musculus
atgctggctaccagttcctttggaa

SEQ ID NO: 261888 - DNA, 25 bp, Mus musculus
atgctggctacctgttcctttggaa

SEQ ID NO: 261889 - DNA, 25 bp, Mus musculus
atgctggctgctatgactctgaaga

SEQ ID NO: 261890 - DNA, 25 bp, Mus musculus
atgctggctgctttgactctgaaga

SEQ ID NO: 261891 - DNA, 25 bp, Mus musculus
atgctggctgtgaggcagtgcagac

SEQ ID NO: 261892 - DNA, 25 bp, Mus musculus
atgctggctgtgtggcagtgcagac

SEQ ID NO: 261893 - DNA, 25 bp, Mus musculus
atgctggcttgtatctccgagtgtc

SEQ ID NO: 261894 - DNA, 25 bp, Mus musculus
atgctggcttgtttctccgagtgtc

SEQ ID NO: 261895 - DNA, 25 bp, Mus musculus
atgctggctttcatcctgactcagt

SEQ ID NO: 261896 - DNA, 25 bp, Mus musculus
atgctggctttcatggttttaggtc

SEQ ID NO: 261897 - DNA, 25 bp, Mus musculus
atgctggctttcttcctgactcagt

SEQ ID NO: 261898 - DNA, 25 bp, Mus musculus
atgctggctttcttggttttaggtc

SEQ ID NO: 261899 - DNA, 25 bp, Mus musculus
atgctgggaaagatctgacttcctc

SEQ ID NO: 261900 - DNA, 25 bp, Mus musculus
atgctgggaaagctttgacctcctc

SEQ ID NO: 261901 - DNA, 25 bp, Mus musculus
atgctgggaaaggtttgacctcctc

SEQ ID NO: 261902 - DNA, 25 bp, Mus musculus
atgctgggaaagttctgacttcctc

SEQ ID NO: 261903 - DNA, 25 bp, Mus musculus
atgctgggaataccacctgtccaat

SEQ ID NO: 261904 - DNA, 25 bp, Mus musculus
atgctgggaatagcacctgtccaat

SEQ ID NO: 261905 - DNA, 25 bp, Mus musculus
atgctgggaattcctccgagaacca

SEQ ID NO: 261906 - DNA, 25 bp, Mus musculus
atgctgggaattgctccgagaacca

SEQ ID NO: 261907 - DNA, 25 bp, Mus musculus
atgctgggactcacatctgggtctt

SEQ ID NO: 261908 - DNA, 25 bp, Mus musculus
atgctgggactctcatctgggtctt

SEQ ID NO: 261909 - DNA, 25 bp, Mus musculus
atgctgggactgagctacacttctg

SEQ ID NO: 261910 - DNA, 25 bp, Mus musculus
atgctgggactgtgctacacttctg

SEQ ID NO: 261911 - DNA, 25 bp, Mus musculus
atgctgggagaacacacccttgccc

SEQ ID NO: 261912 - DNA, 25 bp, Mus musculus
atgctgggagaagacacccttgccc

SEQ ID NO: 261913 - DNA, 25 bp, Mus musculus
atgctgggagttcggacacattttt

SEQ ID NO: 261914 - DNA, 25 bp, Mus musculus
atgctgggagttgggacacattttt

SEQ ID NO: 261915 - DNA, 25 bp, Mus musculus
atgctgggatacctatgcgggactt

SEQ ID NO: 261916 - DNA, 25 bp, Mus musculus
atgctgggatacgtatgcgggactt

SEQ ID NO: 261917 - DNA, 25 bp, Mus musculus
atgctgggatgcaccctgcccatgt

SEQ ID NO: 261918 - DNA, 25 bp, Mus musculus
atgctgggatgctccctgcccatgt

SEQ ID NO: 261919 - DNA, 25 bp, Mus musculus
atgctgggcaaaagagcccttccca

SEQ ID NO: 261920 - DNA, 25 bp, Mus musculus
atgctgggcaaatgagcccttccca

SEQ ID NO: 261921 - DNA, 25 bp, Mus musculus
atgctgggccctacatttgatctgg

SEQ ID NO: 261922 - DNA, 25 bp, Mus musculus
atgctgggcccttcatttgatctgg

SEQ ID NO: 261923 - DNA, 25 bp, Mus musculus
atgctgggctacatcacagttctgg

SEQ ID NO: 261924 - DNA, 25 bp, Mus musculus
atgctgggctacttcacagttctgg

SEQ ID NO: 261925 - DNA, 25 bp, Mus musculus
atgctgggcttcaatgggatccaac

SEQ ID NO: 261926 - DNA, 25 bp, Mus musculus
atgctgggcttccaagagcatgcca

SEQ ID NO: 261927 - DNA, 25 bp, Mus musculus
atgctgggcttcgaagagcatgcca

SEQ ID NO: 261928 - DNA, 25 bp, Mus musculus
atgctgggcttctatgggatccaac

SEQ ID NO: 261929 - DNA, 25 bp, Mus musculus
atgctgggtactactgaggtgtcaa

SEQ ID NO: 261930 - DNA, 25 bp, Mus musculus
atgctgggtacttctgaggtgtcaa

SEQ ID NO: 261931 - DNA, 25 bp, Mus musculus
atgctgggtccaaagtgacttcaat

SEQ ID NO: 261932 - DNA, 25 bp, Mus musculus
atgctgggtccatagtgacttcaat

SEQ ID NO: 261933 - DNA, 25 bp, Mus musculus
atgctgggtctcaactagacacaac

SEQ ID NO: 261934 - DNA, 25 bp, Mus musculus
atgctgggtctctactagacacaac

SEQ ID NO: 261935 - DNA, 25 bp, Mus musculus
atgctgggtgcaaactatggtgtta

SEQ ID NO: 261936 - DNA, 25 bp, Mus musculus
atgctgggtgcatactatggtgtta

SEQ ID NO: 261937 - DNA, 25 bp, Mus musculus
atgctgggttggagcacagtgattt

SEQ ID NO: 261938 - DNA, 25 bp, Mus musculus
atgctgggttggtgcacagtgattt

SEQ ID NO: 261939 - DNA, 25 bp, Mus musculus
atgctggtacgaacctcagatgcca

SEQ ID NO: 261940 - DNA, 25 bp, Mus musculus
atgctggtacgatcctcagatgcca

SEQ ID NO: 261941 - DNA, 25 bp, Mus musculus
atgctggtacttcctgccagtggtg

SEQ ID NO: 261942 - DNA, 25 bp, Mus musculus
atgctggtacttgctgccagtggtg

SEQ ID NO: 261943 - DNA, 25 bp, Mus musculus
atgctggtagctcagtagccccttt

SEQ ID NO: 261944 - DNA, 25 bp, Mus musculus
atgctggtagctcgactcaaaggtc

SEQ ID NO: 261945 - DNA, 25 bp, Mus musculus
atgctggtagctgagtagccccttt

SEQ ID NO: 261946 - DNA, 25 bp, Mus musculus
atgctggtagctggactcaaaggtc

SEQ ID NO: 261947 - DNA, 25 bp, Mus musculus
atgctggtatttccccatgaccatg

SEQ ID NO: 261948 - DNA, 25 bp, Mus musculus
atgctggtatttgcccatgaccatg

SEQ ID NO: 261949 - DNA, 25 bp, Mus musculus
atgctggtcagcaagctggacaggt

SEQ ID NO: 261950 - DNA, 25 bp, Mus musculus
atgctggtcagctagctggacaggt

SEQ ID NO: 261951 - DNA, 25 bp, Mus musculus
atgctggtcattcacaacccctgtt

SEQ ID NO: 261952 - DNA, 25 bp, Mus musculus
atgctggtcattgacaacccctgtt

SEQ ID NO: 261953 - DNA, 25 bp, Mus musculus
atgctggtccgaacggcttttcgag

SEQ ID NO: 261954 - DNA, 25 bp, Mus musculus
atgctggtccgatcggcttttcgag

SEQ ID NO: 261955 - DNA, 25 bp, Mus musculus
atgctggtctcaatagcgcttggca

SEQ ID NO: 261956 - DNA, 25 bp, Mus musculus
atgctggtctcattagcgcttggca

SEQ ID NO: 261957 - DNA, 25 bp, Mus musculus
atgctggtgaccaacttctggatgt

SEQ ID NO: 261958 - DNA, 25 bp, Mus musculus
atgctggtgacctacttctggatgt

SEQ ID NO: 261959 - DNA, 25 bp, Mus musculus
atgctggtgacgaagatgttggaaa

SEQ ID NO: 261960 - DNA, 25 bp, Mus musculus
atgctggtgacgtagatgttggaaa

SEQ ID NO: 261961 - DNA, 25 bp, Mus musculus
atgctggtgcccacagctgtatgca

SEQ ID NO: 261962 - DNA, 25 bp, Mus musculus
atgctggtgccctcagctgtatgca

SEQ ID NO: 261963 - DNA, 25 bp, Mus musculus
atgctggtggagatctgctggaaac

SEQ ID NO: 261964 - DNA, 25 bp, Mus musculus
atgctggtggagttctgctggaaac

SEQ ID NO: 261965 - DNA, 25 bp, Mus musculus
atgctggtggcaaacattccctgga

SEQ ID NO: 261966 - DNA, 25 bp, Mus musculus
atgctggtggcatacattccctgga

SEQ ID NO: 261967 - DNA, 25 bp, Mus musculus
atgctggttcagcatcatcgtcttt

SEQ ID NO: 261968 - DNA, 25 bp, Mus musculus
atgctggttcaggatcatcgtcttt

SEQ ID NO: 261969 - DNA, 25 bp, Mus musculus
atgctggttgtcagcaagcttgtgc

SEQ ID NO: 261970 - DNA, 25 bp, Mus musculus
atgctggttgtctgcaagcttgtgc

SEQ ID NO: 261971 - DNA, 25 bp, Mus musculus
atgctggtttgaagtctccctactg

SEQ ID NO: 261972 - DNA, 25 bp, Mus musculus
atgctggtttgatgtctccctactg

SEQ ID NO: 261973 - DNA, 25 bp, Mus musculus
atgctgtaaaacactatggcttttt

SEQ ID NO: 261974 - DNA, 25 bp, Mus musculus
atgctgtaaaactctatggcttttt

SEQ ID NO: 261975 - DNA, 25 bp, Mus musculus
atgctgtaacaaatcccagtgtggt

SEQ ID NO: 261976 - DNA, 25 bp, Mus musculus
atgctgtaacaattcccagtgtggt

SEQ ID NO: 261977 - DNA, 25 bp, Mus musculus
atgctgtaagccagcagatcctgtt

SEQ ID NO: 261978 - DNA, 25 bp, Mus musculus
atgctgtaagcctgcagatcctgtt

SEQ ID NO: 261979 - DNA, 25 bp, Mus musculus
atgctgtaagctccctcatatcatc

SEQ ID NO: 261980 - DNA, 25 bp, Mus musculus
atgctgtaagctgcctcatatcatc

SEQ ID NO: 261981 - DNA, 25 bp, Mus musculus
atgctgtaattaacatcacttaaaa

SEQ ID NO: 261982 - DNA, 25 bp, Mus musculus
atgctgtaattatcatcacttaaaa

SEQ ID NO: 261983 - DNA, 25 bp, Mus musculus
atgctgtaatttatagcccaagatt

SEQ ID NO: 261984 - DNA, 25 bp, Mus musculus
atgctgtaatttttagcccaagatt

SEQ ID NO: 261985 - DNA, 25 bp, Mus musculus
atgctgtacccaacccggatttaaa

SEQ ID NO: 261986 - DNA, 25 bp, Mus musculus
atgctgtacccatcccggatttaaa

SEQ ID NO: 261987 - DNA, 25 bp, Mus musculus
atgctgtactcaatggaatgattcc

SEQ ID NO: 261988 - DNA, 25 bp, Mus musculus
atgctgtactcattggaatgattcc

SEQ ID NO: 261989 - DNA, 25 bp, Mus musculus
atgctgtactctctgaaaattcaaa

SEQ ID NO: 261990 - DNA, 25 bp, Mus musculus
atgctgtactctgtgaaaattcaaa

SEQ ID NO: 261991 - DNA, 25 bp, Mus musculus
atgctgtagaagagtctgtcattgc

SEQ ID NO: 261992 - DNA, 25 bp, Mus musculus
atgctgtagaagtgtctgtcattgc

SEQ ID NO: 261993 - DNA, 25 bp, Mus musculus
atgctgtagtcaagggacctcctgg

SEQ ID NO: 261994 - DNA, 25 bp, Mus musculus
atgctgtagtcatgggacctcctgg

SEQ ID NO: 261995 - DNA, 25 bp, Mus musculus
atgctgtagtcgagttttggctgta

SEQ ID NO: 261996 - DNA, 25 bp, Mus musculus
atgctgtagtcgtgttttggctgta

SEQ ID NO: 261997 - DNA, 25 bp, Mus musculus
atgctgtatacacaaccctttatcg

SEQ ID NO: 261998 - DNA, 25 bp, Mus musculus
atgctgtatacagaaccctttatcg

SEQ ID NO: 261999 - DNA, 25 bp, Mus musculus
atgctgtatcctccgagcgctagag

SEQ ID NO: 262000 - DNA, 25 bp, Mus musculus
atgctgtatcctgcgagcgctagag

SEQ ID NO: 262001 - DNA, 25 bp, Mus musculus
atgctgtatctgaatcctccatgat

SEQ ID NO: 262002 - DNA, 25 bp, Mus musculus
atgctgtatctgtatcctccatgat

SEQ ID NO: 262003 - DNA, 25 bp, Mus musculus
atgctgtattataatcccttgtgtc

SEQ ID NO: 262004 - DNA, 25 bp, Mus musculus
atgctgtattattatcccttgtgtc

SEQ ID NO: 262005 - DNA, 25 bp, Mus musculus
atgctgtattccatttgctgtatat

SEQ ID NO: 262006 - DNA, 25 bp, Mus musculus
atgctgtattccttttgctgtatat

SEQ ID NO: 262007 - DNA, 25 bp, Mus musculus
atgctgtcacatagaatctgaggtt

SEQ ID NO: 262008 - DNA, 25 bp, Mus musculus
atgctgtcacattgaatctgaggtt

SEQ ID NO: 262009 - DNA, 25 bp, Mus musculus
atgctgtcacccatggagagcaaaa

SEQ ID NO: 262010 - DNA, 25 bp, Mus musculus
atgctgtcacccttggagagcaaaa

SEQ ID NO: 262011 - DNA, 25 bp, Mus musculus
atgctgtcactcacattcagtagct

SEQ ID NO: 262012 - DNA, 25 bp, Mus musculus
atgctgtcactcataagtttctttt

SEQ ID NO: 262013 - DNA, 25 bp, Mus musculus
atgctgtcactctcattcagtagct

SEQ ID NO: 262014 - DNA, 25 bp, Mus musculus
atgctgtcactcttaagtttctttt

SEQ ID NO: 262015 - DNA, 25 bp, Mus musculus
atgctgtcagcacgcttcagtggca

SEQ ID NO: 262016 - DNA, 25 bp, Mus musculus
atgctgtcagcaggcttcagtggca

SEQ ID NO: 262017 - DNA, 25 bp, Mus musculus
atgctgtccatgatagcccatcttc

SEQ ID NO: 262018 - DNA, 25 bp, Mus musculus
atgctgtccatgttagcccatcttc

SEQ ID NO: 262019 - DNA, 25 bp, Mus musculus
atgctgtccccactggatgtcctgt

SEQ ID NO: 262020 - DNA, 25 bp, Mus musculus
atgctgtccccagtggatgtcctgt

SEQ ID NO: 262021 - DNA, 25 bp, Mus musculus
atgctgtcctggccgtgtgtctcct

SEQ ID NO: 262022 - DNA, 25 bp, Mus musculus
atgctgtcctgggcgtgtgtctcct

SEQ ID NO: 262023 - DNA, 25 bp, Mus musculus
atgctgtcctgtctagatgccaact

SEQ ID NO: 262024 - DNA, 25 bp, Mus musculus
atgctgtcctgtgtagatgccaact

SEQ ID NO: 262025 - DNA, 25 bp, Mus musculus
atgctgtcgcagattgcagttggta

SEQ ID NO: 262026 - DNA, 25 bp, Mus musculus
atgctgtcgcagtttgcagttggta

SEQ ID NO: 262027 - DNA, 25 bp, Mus musculus
atgctgtcgtggcttctgaagttgt

SEQ ID NO: 262028 - DNA, 25 bp, Mus musculus
atgctgtcgtgggttctgaagttgt

SEQ ID NO: 262029 - DNA, 25 bp, Mus musculus
atgctgtctagtccagcctgaccaa

SEQ ID NO: 262030 - DNA, 25 bp, Mus musculus
atgctgtctagtgcagcctgaccaa

SEQ ID NO: 262031 - DNA, 25 bp, Mus musculus
atgctgtctctaatgcaaggccaca

SEQ ID NO: 262032 - DNA, 25 bp, Mus musculus
atgctgtctctattgcaaggccaca

SEQ ID NO: 262033 - DNA, 25 bp, Mus musculus
atgctgtctgaaaatcagggcttaa

SEQ ID NO: 262034 - DNA, 25 bp, Mus musculus
atgctgtctgaatatcagggcttaa

SEQ ID NO: 262035 - DNA, 25 bp, Mus musculus
atgctgtctgccagttgtcaatcgg

SEQ ID NO: 262036 - DNA, 25 bp, Mus musculus
atgctgtctgcctgttgtcaatcgg

SEQ ID NO: 262037 - DNA, 25 bp, Mus musculus
atgctgtctggcattggctccaatg

SEQ ID NO: 262038 - DNA, 25 bp, Mus musculus
atgctgtctggctttggctccaatg

SEQ ID NO: 262039 - DNA, 25 bp, Mus musculus
atgctgtctggtaccccactttggg

SEQ ID NO: 262040 - DNA, 25 bp, Mus musculus
atgctgtctggttccccactttggg

SEQ ID NO: 262041 - DNA, 25 bp, Mus musculus
atgctgtctgtaccattcatagcaa

SEQ ID NO: 262042 - DNA, 25 bp, Mus musculus
atgctgtctgtacggagtgcagtct

SEQ ID NO: 262043 - DNA, 25 bp, Mus musculus
atgctgtctgtagcattcatagcaa

SEQ ID NO: 262044 - DNA, 25 bp, Mus musculus
atgctgtctgtagggagtgcagtct

SEQ ID NO: 262045 - DNA, 25 bp, Mus musculus
atgctgtctgtgatgtacctcccat

SEQ ID NO: 262046 - DNA, 25 bp, Mus musculus
atgctgtctgtgttgtacctcccat

SEQ ID NO: 262047 - DNA, 25 bp, Mus musculus
atgctgtcttcacgcaccatctgca

SEQ ID NO: 262048 - DNA, 25 bp, Mus musculus
atgctgtcttcaggcaccatctgca

SEQ ID NO: 262049 - DNA, 25 bp, Mus musculus
atgctgtcttggactcactgaccca

SEQ ID NO: 262050 - DNA, 25 bp, Mus musculus
atgctgtcttggtctcactgaccca

SEQ ID NO: 262051 - DNA, 25 bp, Mus musculus
atgctgtgaacaactttcctcatca

SEQ ID NO: 262052 - DNA, 25 bp, Mus musculus
atgctgtgaacatctttcctcatca

SEQ ID NO: 262053 - DNA, 25 bp, Mus musculus
atgctgtgacagaaaaggctgctct

SEQ ID NO: 262054 - DNA, 25 bp, Mus musculus
atgctgtgacagctgcatgcggctc

SEQ ID NO: 262055 - DNA, 25 bp, Mus musculus
atgctgtgacaggtgcatgcggctc

SEQ ID NO: 262056 - DNA, 25 bp, Mus musculus
atgctgtgacagtaaaggctgctct

SEQ ID NO: 262057 - DNA, 25 bp, Mus musculus
atgctgtgactacagcgcactttct

SEQ ID NO: 262058 - DNA, 25 bp, Mus musculus
atgctgtgactagagcgcactttct

SEQ ID NO: 262059 - DNA, 25 bp, Mus musculus
atgctgtgattacgtccccttatgg

SEQ ID NO: 262060 - DNA, 25 bp, Mus musculus
atgctgtgattaggtccccttatgg

SEQ ID NO: 262061 - DNA, 25 bp, Mus musculus
atgctgtgcactcattcagtggaat

SEQ ID NO: 262062 - DNA, 25 bp, Mus musculus
atgctgtgcactgattcagtggaat

SEQ ID NO: 262063 - DNA, 25 bp, Mus musculus
atgctgtgcattattcaagctacat

SEQ ID NO: 262064 - DNA, 25 bp, Mus musculus
atgctgtgcatttttcaagctacat

SEQ ID NO: 262065 - DNA, 25 bp, Mus musculus
atgctgtgctccaatagttgctata

SEQ ID NO: 262066 - DNA, 25 bp, Mus musculus
atgctgtgctcctatagttgctata

SEQ ID NO: 262067 - DNA, 25 bp, Mus musculus
atgctgtgctgtagtgaaccatgaa

SEQ ID NO: 262068 - DNA, 25 bp, Mus musculus
atgctgtgctgttgtgaaccatgaa

SEQ ID NO: 262069 - DNA, 25 bp, Mus musculus
atgctgtggataccctatttgtgcc

SEQ ID NO: 262070 - DNA, 25 bp, Mus musculus
atgctgtggatagcctatttgtgcc

SEQ ID NO: 262071 - DNA, 25 bp, Mus musculus
atgctgtggcatacgtttcccagaa

SEQ ID NO: 262072 - DNA, 25 bp, Mus musculus
atgctgtggcattcgtttcccagaa

SEQ ID NO: 262073 - DNA, 25 bp, Mus musculus
atgctgtggttcaggtttcacaaaa

SEQ ID NO: 262074 - DNA, 25 bp, Mus musculus
atgctgtggttctggtttcacaaaa

SEQ ID NO: 262075 - DNA, 25 bp, Mus musculus
atgctgtgtaaacacctggcctcgc

SEQ ID NO: 262076 - DNA, 25 bp, Mus musculus
atgctgtgtaaagacctggcctcgc

SEQ ID NO: 262077 - DNA, 25 bp, Mus musculus
atgctgtgtcaaaaaacctctcctt

SEQ ID NO: 262078 - DNA, 25 bp, Mus musculus
atgctgtgtcaataaacctctcctt

SEQ ID NO: 262079 - DNA, 25 bp, Mus musculus
atgctgtgtgagagggcatttcccc

SEQ ID NO: 262080 - DNA, 25 bp, Mus musculus
atgctgtgtgagtgggcatttcccc

SEQ ID NO: 262081 - DNA, 25 bp, Mus musculus
atgctgtgtgctcggctagctaaga

SEQ ID NO: 262082 - DNA, 25 bp, Mus musculus
atgctgtgtgctgggctagctaaga

SEQ ID NO: 262083 - DNA, 25 bp, Mus musculus
atgctgtgtggtacccatagtgttc

SEQ ID NO: 262084 - DNA, 25 bp, Mus musculus
atgctgtgtggttcccatagtgttc

SEQ ID NO: 262085 - DNA, 25 bp, Mus musculus
atgctgtgttctcattcccaccagc

SEQ ID NO: 262086 - DNA, 25 bp, Mus musculus
atgctgtgttctgattcccaccagc

SEQ ID NO: 262087 - DNA, 25 bp, Mus musculus
atgctgtgttggctaaacttgaacc

SEQ ID NO: 262088 - DNA, 25 bp, Mus musculus
atgctgtgttgggtaaacttgaacc

SEQ ID NO: 262089 - DNA, 25 bp, Mus musculus
atgctgttaacgatacatcccggag

SEQ ID NO: 262090 - DNA, 25 bp, Mus musculus
atgctgttaacgttacatcccggag

SEQ ID NO: 262091 - DNA, 25 bp, Mus musculus
atgctgttaagtattcctatctgta

SEQ ID NO: 262092 - DNA, 25 bp, Mus musculus
atgctgttaagttttcctatctgta

SEQ ID NO: 262093 - DNA, 25 bp, Mus musculus
atgctgttaatcaacgttatcatgt

SEQ ID NO: 262094 - DNA, 25 bp, Mus musculus
atgctgttaatctacgttatcatgt

SEQ ID NO: 262095 - DNA, 25 bp, Mus musculus
atgctgttagtcctctggcccaaag

SEQ ID NO: 262096 - DNA, 25 bp, Mus musculus
atgctgttagtcgtctggcccaaag

SEQ ID NO: 262097 - DNA, 25 bp, Mus musculus
atgctgttcacactagcccatagat

SEQ ID NO: 262098 - DNA, 25 bp, Mus musculus
atgctgttcacagtagcccatagat

SEQ ID NO: 262099 - DNA, 25 bp, Mus musculus
atgctgttcccacgttggttggaaa

SEQ ID NO: 262100 - DNA, 25 bp, Mus musculus
atgctgttcccaggttggttggaaa

SEQ ID NO: 262101 - DNA, 25 bp, Mus musculus
atgctgttctcaaagacgggtcggt

SEQ ID NO: 262102 - DNA, 25 bp, Mus musculus
atgctgttctcatagacgggtcggt

SEQ ID NO: 262103 - DNA, 25 bp, Mus musculus
atgctgttctgaaggatggactgac

SEQ ID NO: 262104 - DNA, 25 bp, Mus musculus
atgctgttctgatggatggactgac

SEQ ID NO: 262105 - DNA, 25 bp, Mus musculus
atgctgttctttcctttgagcggga

SEQ ID NO: 262106 - DNA, 25 bp, Mus musculus
atgctgttctttgctttgagcggga

SEQ ID NO: 262107 - DNA, 25 bp, Mus musculus
atgctgttgatcaggagcctggcct

SEQ ID NO: 262108 - DNA, 25 bp, Mus musculus
atgctgttgatctggagcctggcct

SEQ ID NO: 262109 - DNA, 25 bp, Mus musculus
atgctgttgatgctgcagctctcct

SEQ ID NO: 262110 - DNA, 25 bp, Mus musculus
atgctgttgatggtgcagctctcct

SEQ ID NO: 262111 - DNA, 25 bp, Mus musculus
atgctgttgcagatattcgtatatg

SEQ ID NO: 262112 - DNA, 25 bp, Mus musculus
atgctgttgcagttattcgtatatg

SEQ ID NO: 262113 - DNA, 25 bp, Mus musculus
atgctgttgctacctcttaggctta

SEQ ID NO: 262114 - DNA, 25 bp, Mus musculus
atgctgttgctagctcttaggctta

SEQ ID NO: 262115 - DNA, 25 bp, Mus musculus
atgctgttgggaacagagtcgccct

SEQ ID NO: 262116 - DNA, 25 bp, Mus musculus
atgctgttgggatcagagtcgccct

SEQ ID NO: 262117 - DNA, 25 bp, Mus musculus
atgctgttggtactcctaccccatc

SEQ ID NO: 262118 - DNA, 25 bp, Mus musculus
atgctgttggtagtcctaccccatc

SEQ ID NO: 262119 - DNA, 25 bp, Mus musculus
atgctgttggttctctatctggcta

SEQ ID NO: 262120 - DNA, 25 bp, Mus musculus
atgctgttggttgtctatctggcta

SEQ ID NO: 262121 - DNA, 25 bp, Mus musculus
atgctgttgtctctccatctatgga

SEQ ID NO: 262122 - DNA, 25 bp, Mus musculus
atgctgttgtctgtccatctatgga

SEQ ID NO: 262123 - DNA, 25 bp, Mus musculus
atgctgtttagcaatgggacagtgc

SEQ ID NO: 262124 - DNA, 25 bp, Mus musculus
atgctgtttagctatgggacagtgc

SEQ ID NO: 262125 - DNA, 25 bp, Mus musculus
atgctgtttccacgttgctgtgtaa

SEQ ID NO: 262126 - DNA, 25 bp, Mus musculus
atgctgtttccaggttgctgtgtaa

SEQ ID NO: 262127 - DNA, 25 bp, Mus musculus
atgctgtttcccatttgtatgtgaa

SEQ ID NO: 262128 - DNA, 25 bp, Mus musculus
atgctgtttcccttttgtatgtgaa

SEQ ID NO: 262129 - DNA, 25 bp, Mus musculus
atgctgtttcttaccggtgatcaaa

SEQ ID NO: 262130 - DNA, 25 bp, Mus musculus
atgctgtttctttccggtgatcaaa

SEQ ID NO: 262131 - DNA, 25 bp, Mus musculus
atgctgttttcaatgagctcaaaag

SEQ ID NO: 262132 - DNA, 25 bp, Mus musculus
atgctgttttcattgagctcaaaag

SEQ ID NO: 262133 - DNA, 25 bp, Mus musculus
atgcttaaatgactgcagggctctt

SEQ ID NO: 262134 - DNA, 25 bp, Mus musculus
atgcttaaatgagtgcagggctctt

SEQ ID NO: 262135 - DNA, 25 bp, Mus musculus
atgcttaaccctatcttgtgcccgg

SEQ ID NO: 262136 - DNA, 25 bp, Mus musculus
atgcttaaccctttcttgtgcccgg

SEQ ID NO: 262137 - DNA, 25 bp, Mus musculus
atgcttaaccggagatacctgtccc

SEQ ID NO: 262138 - DNA, 25 bp, Mus musculus
atgcttaaccggtgatacctgtccc

SEQ ID NO: 262139 - DNA, 25 bp, Mus musculus
atgcttaagactccattgcagcctc

SEQ ID NO: 262140 - DNA, 25 bp, Mus musculus
atgcttaagactgcattgcagcctc

SEQ ID NO: 262141 - DNA, 25 bp, Mus musculus
atgcttaaggatattcattctttct

SEQ ID NO: 262142 - DNA, 25 bp, Mus musculus
atgcttaaggattttcattctttct

SEQ ID NO: 262143 - DNA, 25 bp, Mus musculus
atgcttaatctgagcccaagttttg

SEQ ID NO: 262144 - DNA, 25 bp, Mus musculus
atgcttaatctgtgcccaagttttg

SEQ ID NO: 262145 - DNA, 25 bp, Mus musculus
atgcttaatggtacatccagccctg

SEQ ID NO: 262146 - DNA, 25 bp, Mus musculus
atgcttaatggttcatccagccctg

SEQ ID NO: 262147 - DNA, 25 bp, Mus musculus
atgcttacaatcagtcgggtctctc

SEQ ID NO: 262148 - DNA, 25 bp, Mus musculus
atgcttacaatctgtcgggtctctc

SEQ ID NO: 262149 - DNA, 25 bp, Mus musculus
atgcttacacttatccaaacggttg

SEQ ID NO: 262150 - DNA, 25 bp, Mus musculus
atgcttacacttatgccctatgctc

SEQ ID NO: 262151 - DNA, 25 bp, Mus musculus
atgcttacacttttccaaacggttg

SEQ ID NO: 262152 - DNA, 25 bp, Mus musculus
atgcttacacttttgccctatgctc

SEQ ID NO: 262153 - DNA, 25 bp, Mus musculus
atgcttacagtaagctccctgctgc

SEQ ID NO: 262154 - DNA, 25 bp, Mus musculus
atgcttacagtatgctccctgctgc

SEQ ID NO: 262155 - DNA, 25 bp, Mus musculus
atgcttacagttcaaacctttggga

SEQ ID NO: 262156 - DNA, 25 bp, Mus musculus
atgcttacagttgaaacctttggga

SEQ ID NO: 262157 - DNA, 25 bp, Mus musculus
atgcttacatgcataaatctggata

SEQ ID NO: 262158 - DNA, 25 bp, Mus musculus
atgcttacatgcttaaatctggata

SEQ ID NO: 262159 - DNA, 25 bp, Mus musculus
atgcttaccatacaaggctggtgac

SEQ ID NO: 262160 - DNA, 25 bp, Mus musculus
atgcttaccatagaaggctggtgac

SEQ ID NO: 262161 - DNA, 25 bp, Mus musculus
atgcttaccctacttagcactgcaa

SEQ ID NO: 262162 - DNA, 25 bp, Mus musculus
atgcttaccctagttagcactgcaa

SEQ ID NO: 262163 - DNA, 25 bp, Mus musculus
atgcttaccctgcactcttcaaaga

SEQ ID NO: 262164 - DNA, 25 bp, Mus musculus
atgcttaccctggactcttcaaaga

SEQ ID NO: 262165 - DNA, 25 bp, Mus musculus
atgcttacctttcccgtaactatag

SEQ ID NO: 262166 - DNA, 25 bp, Mus musculus
atgcttacctttgccgtaactatag

SEQ ID NO: 262167 - DNA, 25 bp, Mus musculus
atgcttactgacacatatattctaa

SEQ ID NO: 262168 - DNA, 25 bp, Mus musculus
atgcttactgactcatatattctaa

SEQ ID NO: 262169 - DNA, 25 bp, Mus musculus
atgcttagaaacataccattaattt

SEQ ID NO: 262170 - DNA, 25 bp, Mus musculus
atgcttagaaacttaccattaattt

SEQ ID NO: 262171 - DNA, 25 bp, Mus musculus
atgcttagactaacttttgttttga

SEQ ID NO: 262172 - DNA, 25 bp, Mus musculus
atgcttagactacaggcttcttggg

SEQ ID NO: 262173 - DNA, 25 bp, Mus musculus
atgcttagactagaggcttcttggg

SEQ ID NO: 262174 - DNA, 25 bp, Mus musculus
atgcttagactatcttttgttttga

SEQ ID NO: 262175 - DNA, 25 bp, Mus musculus
atgcttagcagaccacccataccat

SEQ ID NO: 262176 - DNA, 25 bp, Mus musculus
atgcttagcagagcacccataccat

SEQ ID NO: 262177 - DNA, 25 bp, Mus musculus
atgcttagcatcatactttcttggg

SEQ ID NO: 262178 - DNA, 25 bp, Mus musculus
atgcttagcatcttactttcttggg

SEQ ID NO: 262179 - DNA, 25 bp, Mus musculus
atgcttagctagcatgtgcaagacc

SEQ ID NO: 262180 - DNA, 25 bp, Mus musculus
atgcttagctaggatgtgcaagacc

SEQ ID NO: 262181 - DNA, 25 bp, Mus musculus
atgcttaggagccagcacgggcttc

SEQ ID NO: 262182 - DNA, 25 bp, Mus musculus
atgcttaggagcgagcacgggcttc

SEQ ID NO: 262183 - DNA, 25 bp, Mus musculus
atgcttagggtaaggctgtcctcca

SEQ ID NO: 262184 - DNA, 25 bp, Mus musculus
atgcttagggtaattctgtgatcca

SEQ ID NO: 262185 - DNA, 25 bp, Mus musculus
atgcttagggtatggctgtcctcca

SEQ ID NO: 262186 - DNA, 25 bp, Mus musculus
atgcttagggtatttctgtgatcca

SEQ ID NO: 262187 - DNA, 25 bp, Mus musculus
atgcttagtgcaaatccggacttgt

SEQ ID NO: 262188 - DNA, 25 bp, Mus musculus
atgcttagtgcatatccggacttgt

SEQ ID NO: 262189 - DNA, 25 bp, Mus musculus
atgcttagtgtgaaccacagttctg

SEQ ID NO: 262190 - DNA, 25 bp, Mus musculus
atgcttagtgtgtaccacagttctg

SEQ ID NO: 262191 - DNA, 25 bp, Mus musculus
atgcttagttatagcttctagtggc

SEQ ID NO: 262192 - DNA, 25 bp, Mus musculus
atgcttagttattgcttctagtggc

SEQ ID NO: 262193 - DNA, 25 bp, Mus musculus
atgcttataccaagatgctgcgaac

SEQ ID NO: 262194 - DNA, 25 bp, Mus musculus
atgcttataccatgatgctgcgaac

SEQ ID NO: 262195 - DNA, 25 bp, Mus musculus
atgcttatatccagtgctttcttca

SEQ ID NO: 262196 - DNA, 25 bp, Mus musculus
atgcttatatcctgtgctttcttca

SEQ ID NO: 262197 - DNA, 25 bp, Mus musculus
atgcttatcaccatcaaggacctaa

SEQ ID NO: 262198 - DNA, 25 bp, Mus musculus
atgcttatcaccttcaaggacctaa

SEQ ID NO: 262199 - DNA, 25 bp, Mus musculus
atgcttatcagaatggcgcctttca

SEQ ID NO: 262200 - DNA, 25 bp, Mus musculus
atgcttatcagattggcgcctttca

SEQ ID NO: 262201 - DNA, 25 bp, Mus musculus
atgcttatgaatcaagtcattgttg

SEQ ID NO: 262202 - DNA, 25 bp, Mus musculus
atgcttatgaatgaagtcattgttg

SEQ ID NO: 262203 - DNA, 25 bp, Mus musculus
atgcttatgctcctctcggtggtat

SEQ ID NO: 262204 - DNA, 25 bp, Mus musculus
atgcttatgctcgtctcggtggtat

SEQ ID NO: 262205 - DNA, 25 bp, Mus musculus
atgcttatgtcaatagtgcctcaca

SEQ ID NO: 262206 - DNA, 25 bp, Mus musculus
atgcttatgtcattagtgcctcaca

SEQ ID NO: 262207 - DNA, 25 bp, Mus musculus
atgcttatgtccacactcgcacgtg

SEQ ID NO: 262208 - DNA, 25 bp, Mus musculus
atgcttatgtcctcactcgcacgtg

SEQ ID NO: 262209 - DNA, 25 bp, Mus musculus
atgcttattctcaacaagggtccat

SEQ ID NO: 262210 - DNA, 25 bp, Mus musculus
atgcttattctctacaagggtccat

SEQ ID NO: 262211 - DNA, 25 bp, Mus musculus
atgcttattgatcggacgtttgact

SEQ ID NO: 262212 - DNA, 25 bp, Mus musculus
atgcttattgatgggacgtttgact

SEQ ID NO: 262213 - DNA, 25 bp, Mus musculus
atgcttatttaaacttggacactga

SEQ ID NO: 262214 - DNA, 25 bp, Mus musculus
atgcttatttaatcttggacactga

SEQ ID NO: 262215 - DNA, 25 bp, Mus musculus
atgcttatttgcacaaacatggagg

SEQ ID NO: 262216 - DNA, 25 bp, Mus musculus
atgcttatttgcacatttcacaatg

SEQ ID NO: 262217 - DNA, 25 bp, Mus musculus
atgcttatttgctcaaacatggagg

SEQ ID NO: 262218 - DNA, 25 bp, Mus musculus
atgcttatttgctcatttcacaatg

SEQ ID NO: 262219 - DNA, 25 bp, Mus musculus
atgcttcaattgacgccttaactac

SEQ ID NO: 262220 - DNA, 25 bp, Mus musculus
atgcttcaattgtcgccttaactac

SEQ ID NO: 262221 - DNA, 25 bp, Mus musculus
atgcttcactcacgcagactgcttt

SEQ ID NO: 262222 - DNA, 25 bp, Mus musculus
atgcttcactcaggcagactgcttt

SEQ ID NO: 262223 - DNA, 25 bp, Mus musculus
atgcttcactggacaacaccaggag

SEQ ID NO: 262224 - DNA, 25 bp, Mus musculus
atgcttcactggtcaacaccaggag

SEQ ID NO: 262225 - DNA, 25 bp, Mus musculus
atgcttcagatacaggcactcgctg

SEQ ID NO: 262226 - DNA, 25 bp, Mus musculus
atgcttcagatagaggcactcgctg

SEQ ID NO: 262227 - DNA, 25 bp, Mus musculus
atgcttcagcatctctctataattt

SEQ ID NO: 262228 - DNA, 25 bp, Mus musculus
atgcttcagcatgtctctataattt

SEQ ID NO: 262229 - DNA, 25 bp, Mus musculus
atgcttcagctacttgtgttttacc

SEQ ID NO: 262230 - DNA, 25 bp, Mus musculus
atgcttcagctagttgtgttttacc

SEQ ID NO: 262231 - DNA, 25 bp, Mus musculus
atgcttcagggaattttctccggtc

SEQ ID NO: 262232 - DNA, 25 bp, Mus musculus
atgcttcagggatttttctccggtc

SEQ ID NO: 262233 - DNA, 25 bp, Mus musculus
atgcttcaggttagtttgaaatcca

SEQ ID NO: 262234 - DNA, 25 bp, Mus musculus
atgcttcaggtttgtttgaaatcca

SEQ ID NO: 262235 - DNA, 25 bp, Mus musculus
atgcttcagtgtcaatagcttgtca

SEQ ID NO: 262236 - DNA, 25 bp, Mus musculus
atgcttcagtgtgaatagcttgtca

SEQ ID NO: 262237 - DNA, 25 bp, Mus musculus
atgcttcatagacctcttctagttc

SEQ ID NO: 262238 - DNA, 25 bp, Mus musculus
atgcttcatagagctcttctagttc

SEQ ID NO: 262239 - DNA, 25 bp, Mus musculus
atgcttcatagcacattgttaacag

SEQ ID NO: 262240 - DNA, 25 bp, Mus musculus
atgcttcatagctcattgttaacag

SEQ ID NO: 262241 - DNA, 25 bp, Mus musculus
atgcttcatgttacctgagtgaccg

SEQ ID NO: 262242 - DNA, 25 bp, Mus musculus
atgcttcatgtttcctgagtgaccg

SEQ ID NO: 262243 - DNA, 25 bp, Mus musculus
atgcttcatttgactgctcaggtct

SEQ ID NO: 262244 - DNA, 25 bp, Mus musculus
atgcttcatttgtctgctcaggtct

SEQ ID NO: 262245 - DNA, 25 bp, Mus musculus
atgcttccaaagactggctcccagt

SEQ ID NO: 262246 - DNA, 25 bp, Mus musculus
atgcttccaaagtctggctcccagt

SEQ ID NO: 262247 - DNA, 25 bp, Mus musculus
atgcttccacagaatccctgctgtt

SEQ ID NO: 262248 - DNA, 25 bp, Mus musculus
atgcttccacagtatccctgctgtt

SEQ ID NO: 262249 - DNA, 25 bp, Mus musculus
atgcttccagccaactgtgtgctca

SEQ ID NO: 262250 - DNA, 25 bp, Mus musculus
atgcttccagcctactgtgtgctca

SEQ ID NO: 262251 - DNA, 25 bp, Mus musculus
atgcttccaggtctgtcgagaccat

SEQ ID NO: 262252 - DNA, 25 bp, Mus musculus
atgcttccaggtgtgtcgagaccat

SEQ ID NO: 262253 - DNA, 25 bp, Mus musculus
atgcttccagtcagatacctaaaga

SEQ ID NO: 262254 - DNA, 25 bp, Mus musculus
atgcttccagtctgatacctaaaga

SEQ ID NO: 262255 - DNA, 25 bp, Mus musculus
atgcttcccaaccttgagccggaag

SEQ ID NO: 262256 - DNA, 25 bp, Mus musculus
atgcttcccaacgttgagccggaag

SEQ ID NO: 262257 - DNA, 25 bp, Mus musculus
atgcttcccatgcagtctcacggag

SEQ ID NO: 262258 - DNA, 25 bp, Mus musculus
atgcttcccatggagtctcacggag

SEQ ID NO: 262259 - DNA, 25 bp, Mus musculus
atgcttccctctcagttttttgttg

SEQ ID NO: 262260 - DNA, 25 bp, Mus musculus
atgcttccctctgagttttttgttg

SEQ ID NO: 262261 - DNA, 25 bp, Mus musculus
atgcttcctaagaacgtgctcacta

SEQ ID NO: 262262 - DNA, 25 bp, Mus musculus
atgcttcctaagtacgtgctcacta

SEQ ID NO: 262263 - DNA, 25 bp, Mus musculus
atgcttcctcctccaaatagctggg

SEQ ID NO: 262264 - DNA, 25 bp, Mus musculus
atgcttcctcctgcaaatagctggg

SEQ ID NO: 262265 - DNA, 25 bp, Mus musculus
atgcttcctctgcagacattggtca

SEQ ID NO: 262266 - DNA, 25 bp, Mus musculus
atgcttcctctggagacattggtca

SEQ ID NO: 262267 - DNA, 25 bp, Mus musculus
atgcttcctgccaagtcgctaatgg

SEQ ID NO: 262268 - DNA, 25 bp, Mus musculus
atgcttcctgcctagtcgctaatgg

SEQ ID NO: 262269 - DNA, 25 bp, Mus musculus
atgcttcctgtcctgtgagtgtcac

SEQ ID NO: 262270 - DNA, 25 bp, Mus musculus
atgcttcctgtcgtgtgagtgtcac

SEQ ID NO: 262271 - DNA, 25 bp, Mus musculus
atgcttccttctatactggacattc

SEQ ID NO: 262272 - DNA, 25 bp, Mus musculus
atgcttccttctttactggacattc

SEQ ID NO: 262273 - DNA, 25 bp, Mus musculus
atgcttcctttaacttttgctctct

SEQ ID NO: 262274 - DNA, 25 bp, Mus musculus
atgcttcctttatcttttgctctct

SEQ ID NO: 262275 - DNA, 25 bp, Mus musculus
atgcttcctttgagaggtgtgccaa

SEQ ID NO: 262276 - DNA, 25 bp, Mus musculus
atgcttcctttgtgaggtgtgccaa

SEQ ID NO: 262277 - DNA, 25 bp, Mus musculus
atgcttcggaagacattttctaaac

SEQ ID NO: 262278 - DNA, 25 bp, Mus musculus
atgcttcggaagtcattttctaaac

SEQ ID NO: 262279 - DNA, 25 bp, Mus musculus
atgcttctaagtccgtacgtaatga

SEQ ID NO: 262280 - DNA, 25 bp, Mus musculus
atgcttctaagtgcgtacgtaatga

SEQ ID NO: 262281 - DNA, 25 bp, Mus musculus
atgcttctataaatggaggccactt

SEQ ID NO: 262282 - DNA, 25 bp, Mus musculus
atgcttctataattggaggccactt

SEQ ID NO: 262283 - DNA, 25 bp, Mus musculus
atgcttctcctcactgggatgtctg

SEQ ID NO: 262284 - DNA, 25 bp, Mus musculus
atgcttctcctctctgggatgtctg

SEQ ID NO: 262285 - DNA, 25 bp, Mus musculus
atgcttctcctgagctattggatca

SEQ ID NO: 262286 - DNA, 25 bp, Mus musculus
atgcttctcctgtgctattggatca

SEQ ID NO: 262287 - DNA, 25 bp, Mus musculus
atgcttctctgacgccccggaaaag

SEQ ID NO: 262288 - DNA, 25 bp, Mus musculus
atgcttctctgaggccccggaaaag

SEQ ID NO: 262289 - DNA, 25 bp, Mus musculus
atgcttctgcacatggctattgttg

SEQ ID NO: 262290 - DNA, 25 bp, Mus musculus
atgcttctgcacttggctattgttg

SEQ ID NO: 262291 - DNA, 25 bp, Mus musculus
atgcttctgcagagtccttcaggca

SEQ ID NO: 262292 - DNA, 25 bp, Mus musculus
atgcttctgcagtgtccttcaggca

SEQ ID NO: 262293 - DNA, 25 bp, Mus musculus
atgcttctgggtaagggcactcgga

SEQ ID NO: 262294 - DNA, 25 bp, Mus musculus
atgcttctgggttagggcactcgga

SEQ ID NO: 262295 - DNA, 25 bp, Mus musculus
atgcttctgtgaatgactctaatgc

SEQ ID NO: 262296 - DNA, 25 bp, Mus musculus
atgcttctgtgattgactctaatgc

SEQ ID NO: 262297 - DNA, 25 bp, Mus musculus
atgcttctgttcctctgtgtcttta

SEQ ID NO: 262298 - DNA, 25 bp, Mus musculus
atgcttctgttcgtctgtgtcttta

SEQ ID NO: 262299 - DNA, 25 bp, Mus musculus
atgcttcttactcaagtccccaggg

SEQ ID NO: 262300 - DNA, 25 bp, Mus musculus
atgcttcttactgaagtccccaggg

SEQ ID NO: 262301 - DNA, 25 bp, Mus musculus
atgcttcttgaaacactatactaac

SEQ ID NO: 262302 - DNA, 25 bp, Mus musculus
atgcttcttgaatcactatactaac

SEQ ID NO: 262303 - DNA, 25 bp, Mus musculus
atgcttcttggtcttacatctttgc

SEQ ID NO: 262304 - DNA, 25 bp, Mus musculus
atgcttcttggtgttacatctttgc

SEQ ID NO: 262305 - DNA, 25 bp, Mus musculus
atgcttcttgtgaaattgtgtacct

SEQ ID NO: 262306 - DNA, 25 bp, Mus musculus
atgcttcttgtgtaattgtgtacct

SEQ ID NO: 262307 - DNA, 25 bp, Mus musculus
atgcttgaaaacatgtgttctcgga

SEQ ID NO: 262308 - DNA, 25 bp, Mus musculus
atgcttgaaaacttgtgttctcgga

SEQ ID NO: 262309 - DNA, 25 bp, Mus musculus
atgcttgaaactcgagcctggtgtc

SEQ ID NO: 262310 - DNA, 25 bp, Mus musculus
atgcttgaaactggagcctggtgtc

SEQ ID NO: 262311 - DNA, 25 bp, Mus musculus
atgcttgaaagaaggtaggccatca

SEQ ID NO: 262312 - DNA, 25 bp, Mus musculus
atgcttgaaagatggtaggccatca

SEQ ID NO: 262313 - DNA, 25 bp, Mus musculus
atgcttgaagctcgcaggctgcaaa

SEQ ID NO: 262314 - DNA, 25 bp, Mus musculus
atgcttgaagctggcaggctgcaaa

SEQ ID NO: 262315 - DNA, 25 bp, Mus musculus
atgcttgacacccatggctgaaatg

SEQ ID NO: 262316 - DNA, 25 bp, Mus musculus
atgcttgacaccgatggctgaaatg

SEQ ID NO: 262317 - DNA, 25 bp, Mus musculus
atgcttgacactcctggagcacaga

SEQ ID NO: 262318 - DNA, 25 bp, Mus musculus
atgcttgacactgctggagcacaga

SEQ ID NO: 262319 - DNA, 25 bp, Mus musculus
atgcttgaccccaggaaggaggagc

SEQ ID NO: 262320 - DNA, 25 bp, Mus musculus
atgcttgacccctggaaggaggagc

SEQ ID NO: 262321 - DNA, 25 bp, Mus musculus
atgcttgagaacagttcttgctgcc

SEQ ID NO: 262322 - DNA, 25 bp, Mus musculus
atgcttgagaactgttcttgctgcc

SEQ ID NO: 262323 - DNA, 25 bp, Mus musculus
atgcttgaggccaagcctggtgatc

SEQ ID NO: 262324 - DNA, 25 bp, Mus musculus
atgcttgaggccaccttactaggaa

SEQ ID NO: 262325 - DNA, 25 bp, Mus musculus
atgcttgaggcctagcctggtgatc

SEQ ID NO: 262326 - DNA, 25 bp, Mus musculus
atgcttgaggcctccttactaggaa

SEQ ID NO: 262327 - DNA, 25 bp, Mus musculus
atgcttgagttgaatttgtggctta

SEQ ID NO: 262328 - DNA, 25 bp, Mus musculus
atgcttgagttgtatttgtggctta

SEQ ID NO: 262329 - DNA, 25 bp, Mus musculus
atgcttgatcctaattatgtttttg

SEQ ID NO: 262330 - DNA, 25 bp, Mus musculus
atgcttgatccttattatgtttttg

SEQ ID NO: 262331 - DNA, 25 bp, Mus musculus
atgcttgatggtcactttcccttta

SEQ ID NO: 262332 - DNA, 25 bp, Mus musculus
atgcttgatggtgactttcccttta

SEQ ID NO: 262333 - DNA, 25 bp, Mus musculus
atgcttgcaagccaccgtgtgtgct

SEQ ID NO: 262334 - DNA, 25 bp, Mus musculus
atgcttgcaagcgaccgtgtgtgct

SEQ ID NO: 262335 - DNA, 25 bp, Mus musculus
atgcttgcaaggaggaaccctctga

SEQ ID NO: 262336 - DNA, 25 bp, Mus musculus
atgcttgcaaggtggaaccctctga

SEQ ID NO: 262337 - DNA, 25 bp, Mus musculus
atgcttgcacccagaaattttccaa

SEQ ID NO: 262338 - DNA, 25 bp, Mus musculus
atgcttgcacccatggtgtactaac

SEQ ID NO: 262339 - DNA, 25 bp, Mus musculus
atgcttgcaccctgaaattttccaa

SEQ ID NO: 262340 - DNA, 25 bp, Mus musculus
atgcttgcacccttggtgtactaac

SEQ ID NO: 262341 - DNA, 25 bp, Mus musculus
atgcttgcactcatcactcgatgtg

SEQ ID NO: 262342 - DNA, 25 bp, Mus musculus
atgcttgcactcttcactcgatgtg

SEQ ID NO: 262343 - DNA, 25 bp, Mus musculus
atgcttgcacttaacctgatgggct

SEQ ID NO: 262344 - DNA, 25 bp, Mus musculus
atgcttgcactttacctgatgggct

SEQ ID NO: 262345 - DNA, 25 bp, Mus musculus
atgcttgcagcacatgtccattaaa

SEQ ID NO: 262346 - DNA, 25 bp, Mus musculus
atgcttgcagcagatgtccattaaa

SEQ ID NO: 262347 - DNA, 25 bp, Mus musculus
atgcttgcagttaacccaccacttt

SEQ ID NO: 262348 - DNA, 25 bp, Mus musculus
atgcttgcagtttacccaccacttt

SEQ ID NO: 262349 - DNA, 25 bp, Mus musculus
atgcttgcatgacccagattttcag

SEQ ID NO: 262350 - DNA, 25 bp, Mus musculus
atgcttgcatgagccagattttcag

SEQ ID NO: 262351 - DNA, 25 bp, Mus musculus
atgcttgccaaaaccattgagcctg

SEQ ID NO: 262352 - DNA, 25 bp, Mus musculus
atgcttgccaaatccattgagcctg

SEQ ID NO: 262353 - DNA, 25 bp, Mus musculus
atgcttgccaagaaacatttgccgt

SEQ ID NO: 262354 - DNA, 25 bp, Mus musculus
atgcttgccaagtaacatttgccgt

SEQ ID NO: 262355 - DNA, 25 bp, Mus musculus
atgcttgccactcaaatgcccaagg

SEQ ID NO: 262356 - DNA, 25 bp, Mus musculus
atgcttgccactgaaatgcccaagg

SEQ ID NO: 262357 - DNA, 25 bp, Mus musculus
atgcttgcctggaccttactgtgac

SEQ ID NO: 262358 - DNA, 25 bp, Mus musculus
atgcttgcctggtccttactgtgac

SEQ ID NO: 262359 - DNA, 25 bp, Mus musculus
atgcttgccttcctgagacttgtaa

SEQ ID NO: 262360 - DNA, 25 bp, Mus musculus
atgcttgccttcgtgagacttgtaa

SEQ ID NO: 262361 - DNA, 25 bp, Mus musculus
atgcttgcgacgactgtggacctgt

SEQ ID NO: 262362 - DNA, 25 bp, Mus musculus
atgcttgcgacgtctgtggacctgt

SEQ ID NO: 262363 - DNA, 25 bp, Mus musculus
atgcttgcgcccatggtgtactaac

SEQ ID NO: 262364 - DNA, 25 bp, Mus musculus
atgcttgcgcccttggtgtactaac

SEQ ID NO: 262365 - DNA, 25 bp, Mus musculus
atgcttgcgtgcagtatagggagct

SEQ ID NO: 262366 - DNA, 25 bp, Mus musculus
atgcttgcgtgctgtatagggagct

SEQ ID NO: 262367 - DNA, 25 bp, Mus musculus
atgcttgctactcacctgaatcaga

SEQ ID NO: 262368 - DNA, 25 bp, Mus musculus
atgcttgctactgacctgaatcaga

SEQ ID NO: 262369 - DNA, 25 bp, Mus musculus
atgcttgctagtatttgatcctgga

SEQ ID NO: 262370 - DNA, 25 bp, Mus musculus
atgcttgctagtttttgatcctgga

SEQ ID NO: 262371 - DNA, 25 bp, Mus musculus
atgcttgctccacttgattgctgca

SEQ ID NO: 262372 - DNA, 25 bp, Mus musculus
atgcttgctccagttgattgctgca

SEQ ID NO: 262373 - DNA, 25 bp, Mus musculus
atgcttgctctgcttcacaaattaa

SEQ ID NO: 262374 - DNA, 25 bp, Mus musculus
atgcttgctctggttcacaaattaa

SEQ ID NO: 262375 - DNA, 25 bp, Mus musculus
atgcttgctgaaaagcctgaagcct

SEQ ID NO: 262376 - DNA, 25 bp, Mus musculus
atgcttgctgaatagcctgaagcct

SEQ ID NO: 262377 - DNA, 25 bp, Mus musculus
atgcttgctgttaagttatagacca

SEQ ID NO: 262378 - DNA, 25 bp, Mus musculus
atgcttgctgttagacctggaaacc

SEQ ID NO: 262379 - DNA, 25 bp, Mus musculus
atgcttgctgtttagttatagacca

SEQ ID NO: 262380 - DNA, 25 bp, Mus musculus
atgcttgctgtttgacctggaaacc

SEQ ID NO: 262381 - DNA, 25 bp, Mus musculus
atgcttgcttaccacaagggcacat

SEQ ID NO: 262382 - DNA, 25 bp, Mus musculus
atgcttgcttacgacaagggcacat

SEQ ID NO: 262383 - DNA, 25 bp, Mus musculus
atgcttgctttcatgcacggaactc

SEQ ID NO: 262384 - DNA, 25 bp, Mus musculus
atgcttgctttcttgcacggaactc

SEQ ID NO: 262385 - DNA, 25 bp, Mus musculus
atgcttggacacacgttggttgctc

SEQ ID NO: 262386 - DNA, 25 bp, Mus musculus
atgcttggacactcgttggttgctc

SEQ ID NO: 262387 - DNA, 25 bp, Mus musculus
atgcttggacccagacggaatcctc

SEQ ID NO: 262388 - DNA, 25 bp, Mus musculus
atgcttggaccctgacggaatcctc

SEQ ID NO: 262389 - DNA, 25 bp, Mus musculus
atgcttggagtgacgattctgctgg

SEQ ID NO: 262390 - DNA, 25 bp, Mus musculus
atgcttggagtgtcgattctgctgg

SEQ ID NO: 262391 - DNA, 25 bp, Mus musculus
atgcttggatgcagagaatggccag

SEQ ID NO: 262392 - DNA, 25 bp, Mus musculus
atgcttggatgctgagaatggccag

SEQ ID NO: 262393 - DNA, 25 bp, Mus musculus
atgcttggccacatgacagttgata

SEQ ID NO: 262394 - DNA, 25 bp, Mus musculus
atgcttggccacttgacagttgata

SEQ ID NO: 262395 - DNA, 25 bp, Mus musculus
atgcttggccagagggttcttcgtt

SEQ ID NO: 262396 - DNA, 25 bp, Mus musculus
atgcttggccagtgggttcttcgtt

SEQ ID NO: 262397 - DNA, 25 bp, Mus musculus
atgcttggccctcaaatgctacaga

SEQ ID NO: 262398 - DNA, 25 bp, Mus musculus
atgcttggccctgaaatgctacaga

SEQ ID NO: 262399 - DNA, 25 bp, Mus musculus
atgcttggcgtcaggttaacgtctc

SEQ ID NO: 262400 - DNA, 25 bp, Mus musculus
atgcttggcgtctggttaacgtctc

SEQ ID NO: 262401 - DNA, 25 bp, Mus musculus
atgcttggcttaatgatgtatacta

SEQ ID NO: 262402 - DNA, 25 bp, Mus musculus
atgcttggcttattgatgtatacta

SEQ ID NO: 262403 - DNA, 25 bp, Mus musculus
atgcttgggataaagcaccccggga

SEQ ID NO: 262404 - DNA, 25 bp, Mus musculus
atgcttgggatatagcaccccggga

SEQ ID NO: 262405 - DNA, 25 bp, Mus musculus
atgcttgggattaggactcattcaa

SEQ ID NO: 262406 - DNA, 25 bp, Mus musculus
atgcttgggatttggactcattcaa

SEQ ID NO: 262407 - DNA, 25 bp, Mus musculus
atgcttggtcttcctacacatgaac

SEQ ID NO: 262408 - DNA, 25 bp, Mus musculus
atgcttggtcttgctacacatgaac

SEQ ID NO: 262409 - DNA, 25 bp, Mus musculus
atgcttggttatcaccatcatggag

SEQ ID NO: 262410 - DNA, 25 bp, Mus musculus
atgcttggttatgaccatcatggag

SEQ ID NO: 262411 - DNA, 25 bp, Mus musculus
atgcttggttcccagttggaggcct

SEQ ID NO: 262412 - DNA, 25 bp, Mus musculus
atgcttggttccgagttggaggcct

SEQ ID NO: 262413 - DNA, 25 bp, Mus musculus
atgcttgtaattctatcgctcagga

SEQ ID NO: 262414 - DNA, 25 bp, Mus musculus
atgcttgtaattgtatcgctcagga

SEQ ID NO: 262415 - DNA, 25 bp, Mus musculus
atgcttgtacataactgcgtcccag

SEQ ID NO: 262416 - DNA, 25 bp, Mus musculus
atgcttgtacattactgcgtcccag

SEQ ID NO: 262417 - DNA, 25 bp, Mus musculus
atgcttgtaccaaggcacttgtgca

SEQ ID NO: 262418 - DNA, 25 bp, Mus musculus
atgcttgtaccatggcacttgtgca

SEQ ID NO: 262419 - DNA, 25 bp, Mus musculus
atgcttgtagatctttttgctccag

SEQ ID NO: 262420 - DNA, 25 bp, Mus musculus
atgcttgtagatgtttttgctccag

SEQ ID NO: 262421 - DNA, 25 bp, Mus musculus
atgcttgtagtaaactgatgttctc

SEQ ID NO: 262422 - DNA, 25 bp, Mus musculus
atgcttgtagtatactgatgttctc

SEQ ID NO: 262423 - DNA, 25 bp, Mus musculus
atgcttgtatcaacagaattcttaa

SEQ ID NO: 262424 - DNA, 25 bp, Mus musculus
atgcttgtatcatcagaattcttaa

SEQ ID NO: 262425 - DNA, 25 bp, Mus musculus
atgcttgtatctatgccttatgaat

SEQ ID NO: 262426 - DNA, 25 bp, Mus musculus
atgcttgtatctttgccttatgaat

SEQ ID NO: 262427 - DNA, 25 bp, Mus musculus
atgcttgtatttcctatatcactgc

SEQ ID NO: 262428 - DNA, 25 bp, Mus musculus
atgcttgtatttgctatatcactgc

SEQ ID NO: 262429 - DNA, 25 bp, Mus musculus
atgcttgtcacaacccgattattca

SEQ ID NO: 262430 - DNA, 25 bp, Mus musculus
atgcttgtcacatcccgattattca

SEQ ID NO: 262431 - DNA, 25 bp, Mus musculus
atgcttgtcagtcgttacagttact

SEQ ID NO: 262432 - DNA, 25 bp, Mus musculus
atgcttgtcagtggttacagttact

SEQ ID NO: 262433 - DNA, 25 bp, Mus musculus
atgcttgtcatcacagcactgggag

SEQ ID NO: 262434 - DNA, 25 bp, Mus musculus
atgcttgtcatctcagcactgggag

SEQ ID NO: 262435 - DNA, 25 bp, Mus musculus
atgcttgtcatgattcctttctcta

SEQ ID NO: 262436 - DNA, 25 bp, Mus musculus
atgcttgtcatgtttcctttctcta

SEQ ID NO: 262437 - DNA, 25 bp, Mus musculus
atgcttgtccctctacgattcatgt

SEQ ID NO: 262438 - DNA, 25 bp, Mus musculus
atgcttgtccctgtacgattcatgt

SEQ ID NO: 262439 - DNA, 25 bp, Mus musculus
atgcttgtctcaaagattaagccat

SEQ ID NO: 262440 - DNA, 25 bp, Mus musculus
atgcttgtctcatagattaagccat

SEQ ID NO: 262441 - DNA, 25 bp, Mus musculus
atgcttgtctgtacacggaaaggac

SEQ ID NO: 262442 - DNA, 25 bp, Mus musculus
atgcttgtctgttcacggaaaggac

SEQ ID NO: 262443 - DNA, 25 bp, Mus musculus
atgcttgtgacacggagtgactcta

SEQ ID NO: 262444 - DNA, 25 bp, Mus musculus
atgcttgtgacagggagtgactcta

SEQ ID NO: 262445 - DNA, 25 bp, Mus musculus
atgcttgtgcaacagggatctgaat

SEQ ID NO: 262446 - DNA, 25 bp, Mus musculus
atgcttgtgcaagagggatctgaat

SEQ ID NO: 262447 - DNA, 25 bp, Mus musculus
atgcttgtgcctcagctgtcaaaag

SEQ ID NO: 262448 - DNA, 25 bp, Mus musculus
atgcttgtgcctgagctgtcaaaag

SEQ ID NO: 262449 - DNA, 25 bp, Mus musculus
atgcttgtgcttaatctttggattt

SEQ ID NO: 262450 - DNA, 25 bp, Mus musculus
atgcttgtgctttatctttggattt

SEQ ID NO: 262451 - DNA, 25 bp, Mus musculus
atgcttgttaatacttgagtcctga

SEQ ID NO: 262452 - DNA, 25 bp, Mus musculus
atgcttgttaatctttatgcaccag

SEQ ID NO: 262453 - DNA, 25 bp, Mus musculus
atgcttgttaatgtttatgcaccag

SEQ ID NO: 262454 - DNA, 25 bp, Mus musculus
atgcttgttaattcttgagtcctga

SEQ ID NO: 262455 - DNA, 25 bp, Mus musculus
atgcttgttacacgctattttctat

SEQ ID NO: 262456 - DNA, 25 bp, Mus musculus
atgcttgttacaggctattttctat

SEQ ID NO: 262457 - DNA, 25 bp, Mus musculus
atgcttgttaccaggttttctcacc

SEQ ID NO: 262458 - DNA, 25 bp, Mus musculus
atgcttgttacctggttttctcacc

SEQ ID NO: 262459 - DNA, 25 bp, Mus musculus
atgcttgttcctctaactacacaaa

SEQ ID NO: 262460 - DNA, 25 bp, Mus musculus
atgcttgttcctgtaactacacaaa

SEQ ID NO: 262461 - DNA, 25 bp, Mus musculus
atgcttgttgatagcctccttgtaa

SEQ ID NO: 262462 - DNA, 25 bp, Mus musculus
atgcttgttgattgcctccttgtaa

SEQ ID NO: 262463 - DNA, 25 bp, Mus musculus
atgcttgtttctagctctcacaata

SEQ ID NO: 262464 - DNA, 25 bp, Mus musculus
atgcttgtttcttgctctcacaata

SEQ ID NO: 262465 - DNA, 25 bp, Mus musculus
atgctttaatcaccgaggatgcaag

SEQ ID NO: 262466 - DNA, 25 bp, Mus musculus
atgctttaatcagcgaggatgcaag

SEQ ID NO: 262467 - DNA, 25 bp, Mus musculus
atgctttaatctagttacaccccac

SEQ ID NO: 262468 - DNA, 25 bp, Mus musculus
atgctttaatcttgttacaccccac

SEQ ID NO: 262469 - DNA, 25 bp, Mus musculus
atgctttaccctcagcttcccaaaa

SEQ ID NO: 262470 - DNA, 25 bp, Mus musculus
atgctttaccctgagcttcccaaaa

SEQ ID NO: 262471 - DNA, 25 bp, Mus musculus
atgctttacctcaggctggagcacc

SEQ ID NO: 262472 - DNA, 25 bp, Mus musculus
atgctttacctctggctggagcacc

SEQ ID NO: 262473 - DNA, 25 bp, Mus musculus
atgctttagcagaagtcattgtggg

SEQ ID NO: 262474 - DNA, 25 bp, Mus musculus
atgctttagcagtagtcattgtggg

SEQ ID NO: 262475 - DNA, 25 bp, Mus musculus
atgctttagctaattgagcctccat

SEQ ID NO: 262476 - DNA, 25 bp, Mus musculus
atgctttagctatttgagcctccat

SEQ ID NO: 262477 - DNA, 25 bp, Mus musculus
atgctttaggtcagcttgtgtttaa

SEQ ID NO: 262478 - DNA, 25 bp, Mus musculus
atgctttaggtctgcttgtgtttaa

SEQ ID NO: 262479 - DNA, 25 bp, Mus musculus
atgctttatcctcggagttgggctc

SEQ ID NO: 262480 - DNA, 25 bp, Mus musculus
atgctttatcctgggagttgggctc

SEQ ID NO: 262481 - DNA, 25 bp, Mus musculus
atgctttatcttaggccagcactgg

SEQ ID NO: 262482 - DNA, 25 bp, Mus musculus
atgctttatctttggccagcactgg

SEQ ID NO: 262483 - DNA, 25 bp, Mus musculus
atgctttatgcaactattctgtaca

SEQ ID NO: 262484 - DNA, 25 bp, Mus musculus
atgctttatgcatctattctgtaca

SEQ ID NO: 262485 - DNA, 25 bp, Mus musculus
atgctttatgccatgatattcctct

SEQ ID NO: 262486 - DNA, 25 bp, Mus musculus
atgctttatgccttgatattcctct

SEQ ID NO: 262487 - DNA, 25 bp, Mus musculus
atgctttattggaatcctagaggga

SEQ ID NO: 262488 - DNA, 25 bp, Mus musculus
atgctttattggagatagttccata

SEQ ID NO: 262489 - DNA, 25 bp, Mus musculus
atgctttattggtatcctagaggga

SEQ ID NO: 262490 - DNA, 25 bp, Mus musculus
atgctttattggtgatagttccata

SEQ ID NO: 262491 - DNA, 25 bp, Mus musculus
atgctttattgtctacctctccata

SEQ ID NO: 262492 - DNA, 25 bp, Mus musculus
atgctttattgtgtacctctccata

SEQ ID NO: 262493 - DNA, 25 bp, Mus musculus
atgctttcaataacggtggctacac

SEQ ID NO: 262494 - DNA, 25 bp, Mus musculus
atgctttcaatatcggtggctacac

SEQ ID NO: 262495 - DNA, 25 bp, Mus musculus
atgctttcacagatctatcatttga

SEQ ID NO: 262496 - DNA, 25 bp, Mus musculus
atgctttcacagttctatcatttga

SEQ ID NO: 262497 - DNA, 25 bp, Mus musculus
atgctttcataaacttcacaggccc

SEQ ID NO: 262498 - DNA, 25 bp, Mus musculus
atgctttcataatcttcacaggccc

SEQ ID NO: 262499 - DNA, 25 bp, Mus musculus
atgctttcatgcagtatgtttaaaa

SEQ ID NO: 262500 - DNA, 25 bp, Mus musculus
atgctttcatgctgtatgtttaaaa

SEQ ID NO: 262501 - DNA, 25 bp, Mus musculus
atgctttcatttctcatgaggtcac

SEQ ID NO: 262502 - DNA, 25 bp, Mus musculus
atgctttcatttgtcatgaggtcac

SEQ ID NO: 262503 - DNA, 25 bp, Mus musculus
atgctttccaaactttcccatgaga

SEQ ID NO: 262504 - DNA, 25 bp, Mus musculus
atgctttccaaagtttcccatgaga

SEQ ID NO: 262505 - DNA, 25 bp, Mus musculus
atgctttccagacgcaccatctaaa

SEQ ID NO: 262506 - DNA, 25 bp, Mus musculus
atgctttccagaggcaccatctaaa

SEQ ID NO: 262507 - DNA, 25 bp, Mus musculus
atgctttccaggcactgggttccaa

SEQ ID NO: 262508 - DNA, 25 bp, Mus musculus
atgctttccagggactgggttccaa

SEQ ID NO: 262509 - DNA, 25 bp, Mus musculus
atgctttccagtatgttatctctca

SEQ ID NO: 262510 - DNA, 25 bp, Mus musculus
atgctttccagtttgttatctctca

SEQ ID NO: 262511 - DNA, 25 bp, Mus musculus
atgctttcctagactcttggctttt

SEQ ID NO: 262512 - DNA, 25 bp, Mus musculus
atgctttcctagtctcttggctttt

SEQ ID NO: 262513 - DNA, 25 bp, Mus musculus
atgctttccttccaagcttgtttgc

SEQ ID NO: 262514 - DNA, 25 bp, Mus musculus
atgctttccttcgaagcttgtttgc

SEQ ID NO: 262515 - DNA, 25 bp, Mus musculus
atgctttcggccatgattgtaacca

SEQ ID NO: 262516 - DNA, 25 bp, Mus musculus
atgctttcggccttgattgtaacca

SEQ ID NO: 262517 - DNA, 25 bp, Mus musculus
atgctttctaccatagttcatgctt

SEQ ID NO: 262518 - DNA, 25 bp, Mus musculus
atgctttctaccttagttcatgctt

SEQ ID NO: 262519 - DNA, 25 bp, Mus musculus
atgctttctatcatgcgttgactgt

SEQ ID NO: 262520 - DNA, 25 bp, Mus musculus
atgctttctatcttgcgttgactgt

SEQ ID NO: 262521 - DNA, 25 bp, Mus musculus
atgctttctcctactatctgtacat

SEQ ID NO: 262522 - DNA, 25 bp, Mus musculus
atgctttctccttctatctgtacat

SEQ ID NO: 262523 - DNA, 25 bp, Mus musculus
atgctttctctcataacacacactg

SEQ ID NO: 262524 - DNA, 25 bp, Mus musculus
atgctttctctcttaacacacactg

SEQ ID NO: 262525 - DNA, 25 bp, Mus musculus
atgctttctctgatttcaggactag

SEQ ID NO: 262526 - DNA, 25 bp, Mus musculus
atgctttctctgttttcaggactag

SEQ ID NO: 262527 - DNA, 25 bp, Mus musculus
atgctttctgctattactgtttgtg

SEQ ID NO: 262528 - DNA, 25 bp, Mus musculus
atgctttctgcttttactgtttgtg

SEQ ID NO: 262529 - DNA, 25 bp, Mus musculus
atgctttcttagaccatgcaggatc

SEQ ID NO: 262530 - DNA, 25 bp, Mus musculus
atgctttcttagtccatgcaggatc

SEQ ID NO: 262531 - DNA, 25 bp, Mus musculus
atgctttgagctccaggactaccta

SEQ ID NO: 262532 - DNA, 25 bp, Mus musculus
atgctttgagctgcaggactaccta

SEQ ID NO: 262533 - DNA, 25 bp, Mus musculus
atgctttgcagcagagtgaccacag

SEQ ID NO: 262534 - DNA, 25 bp, Mus musculus
atgctttgcagctgagtgaccacag

SEQ ID NO: 262535 - DNA, 25 bp, Mus musculus
atgctttgcattacctatgtgattg

SEQ ID NO: 262536 - DNA, 25 bp, Mus musculus
atgctttgcatttcctatgtgattg

SEQ ID NO: 262537 - DNA, 25 bp, Mus musculus
atgctttgccaaaggtcaccctaca

SEQ ID NO: 262538 - DNA, 25 bp, Mus musculus
atgctttgccaatggtcaccctaca

SEQ ID NO: 262539 - DNA, 25 bp, Mus musculus
atgctttgcctgcaacgaatgcaca

SEQ ID NO: 262540 - DNA, 25 bp, Mus musculus
atgctttgcctggaacgaatgcaca

SEQ ID NO: 262541 - DNA, 25 bp, Mus musculus
atgctttgctgacttttgtctacct

SEQ ID NO: 262542 - DNA, 25 bp, Mus musculus
atgctttgctgagttttgtctacct

SEQ ID NO: 262543 - DNA, 25 bp, Mus musculus
atgctttgggtactagagctagcca

SEQ ID NO: 262544 - DNA, 25 bp, Mus musculus
atgctttgggtagtagagctagcca

SEQ ID NO: 262545 - DNA, 25 bp, Mus musculus
atgctttgggtcagctaatattata

SEQ ID NO: 262546 - DNA, 25 bp, Mus musculus
atgctttgggtctgctaatattata

SEQ ID NO: 262547 - DNA, 25 bp, Mus musculus
atgctttgttgcaatttctgcttcc

SEQ ID NO: 262548 - DNA, 25 bp, Mus musculus
atgctttgttgctatttctgcttcc

SEQ ID NO: 262549 - DNA, 25 bp, Mus musculus
atgcttttaacgactctggaagcac

SEQ ID NO: 262550 - DNA, 25 bp, Mus musculus
atgcttttaacgtctctggaagcac

SEQ ID NO: 262551 - DNA, 25 bp, Mus musculus
atgcttttaactactatggaccaga

SEQ ID NO: 262552 - DNA, 25 bp, Mus musculus
atgcttttaacttctatggaccaga

SEQ ID NO: 262553 - DNA, 25 bp, Mus musculus
atgcttttactgctcccaagttttg

SEQ ID NO: 262554 - DNA, 25 bp, Mus musculus
atgcttttactggtcccaagttttg

SEQ ID NO: 262555 - DNA, 25 bp, Mus musculus
atgcttttaggaaccacagtgctct

SEQ ID NO: 262556 - DNA, 25 bp, Mus musculus
atgcttttaggatccacagtgctct

SEQ ID NO: 262557 - DNA, 25 bp, Mus musculus
atgcttttagtactgctttgctgat

SEQ ID NO: 262558 - DNA, 25 bp, Mus musculus
atgcttttagtagtgctttgctgat

SEQ ID NO: 262559 - DNA, 25 bp, Mus musculus
atgcttttatgtctggctttctgta

SEQ ID NO: 262560 - DNA, 25 bp, Mus musculus
atgcttttatgtgtggctttctgta

SEQ ID NO: 262561 - DNA, 25 bp, Mus musculus
atgcttttcaaactgtgctccacag

SEQ ID NO: 262562 - DNA, 25 bp, Mus musculus
atgcttttcaaagtgtgctccacag

SEQ ID NO: 262563 - DNA, 25 bp, Mus musculus
atgcttttcagacgtcagtgggttg

SEQ ID NO: 262564 - DNA, 25 bp, Mus musculus
atgcttttcagaggtcagtgggttg

SEQ ID NO: 262565 - DNA, 25 bp, Mus musculus
atgcttttcctcaccttggtatttc

SEQ ID NO: 262566 - DNA, 25 bp, Mus musculus
atgcttttcctcacttaatccggac

SEQ ID NO: 262567 - DNA, 25 bp, Mus musculus
atgcttttcctctccttggtatttc

SEQ ID NO: 262568 - DNA, 25 bp, Mus musculus
atgcttttcctctcttaatccggac

SEQ ID NO: 262569 - DNA, 25 bp, Mus musculus
atgcttttctacacctagttcccat

SEQ ID NO: 262570 - DNA, 25 bp, Mus musculus
atgcttttctacactacctgaatgg

SEQ ID NO: 262571 - DNA, 25 bp, Mus musculus
atgcttttctactcctagttcccat

SEQ ID NO: 262572 - DNA, 25 bp, Mus musculus
atgcttttctactctacctgaatgg

SEQ ID NO: 262573 - DNA, 25 bp, Mus musculus
atgcttttctccagctgctggttag

SEQ ID NO: 262574 - DNA, 25 bp, Mus musculus
atgcttttctcctgctgctggttag

SEQ ID NO: 262575 - DNA, 25 bp, Mus musculus
atgcttttctgtaagttactccttg

SEQ ID NO: 262576 - DNA, 25 bp, Mus musculus
atgcttttctgtagagtgacccttg

SEQ ID NO: 262577 - DNA, 25 bp, Mus musculus
atgcttttctgttagttactccttg

SEQ ID NO: 262578 - DNA, 25 bp, Mus musculus
atgcttttctgttgagtgacccttg

SEQ ID NO: 262579 - DNA, 25 bp, Mus musculus
atgcttttctttctgttgaccacct

SEQ ID NO: 262580 - DNA, 25 bp, Mus musculus
atgcttttctttgtgttgaccacct

SEQ ID NO: 262581 - DNA, 25 bp, Mus musculus
atgcttttgagcattcagggtttcc

SEQ ID NO: 262582 - DNA, 25 bp, Mus musculus
atgcttttgagctttcagggtttcc

SEQ ID NO: 262583 - DNA, 25 bp, Mus musculus
atgcttttgcatatgtttgagggat

SEQ ID NO: 262584 - DNA, 25 bp, Mus musculus
atgcttttgcatttgtttgagggat

SEQ ID NO: 262585 - DNA, 25 bp, Mus musculus
atgcttttgctacgtggcttcagta

SEQ ID NO: 262586 - DNA, 25 bp, Mus musculus
atgcttttgctaggtggcttcagta

SEQ ID NO: 262587 - DNA, 25 bp, Mus musculus
atgcttttgcttaataacgtgggac

SEQ ID NO: 262588 - DNA, 25 bp, Mus musculus
atgcttttgctttataacgtgggac

SEQ ID NO: 262589 - DNA, 25 bp, Mus musculus
atgcttttggctcgtgtccagagac

SEQ ID NO: 262590 - DNA, 25 bp, Mus musculus
atgcttttggctggtgtccagagac

SEQ ID NO: 262591 - DNA, 25 bp, Mus musculus
atgcttttgggtacctagcggagct

SEQ ID NO: 262592 - DNA, 25 bp, Mus musculus
atgcttttgggttcctagcggagct

SEQ ID NO: 262593 - DNA, 25 bp, Mus musculus
atgctttttaatagcgtgtgcttgt

SEQ ID NO: 262594 - DNA, 25 bp, Mus musculus
atgctttttaattgcgtgtgcttgt

SEQ ID NO: 262595 - DNA, 25 bp, Mus musculus
atgctttttacacaagtccctagag

SEQ ID NO: 262596 - DNA, 25 bp, Mus musculus
atgctttttacagaagtccctagag

SEQ ID NO: 262597 - DNA, 25 bp, Mus musculus
atgctttttcttaaccctgactcat

SEQ ID NO: 262598 - DNA, 25 bp, Mus musculus
atgctttttctttaccctgactcat

SEQ ID NO: 262599 - DNA, 25 bp, Mus musculus
atgctttttgagagctggctgctaa

SEQ ID NO: 262600 - DNA, 25 bp, Mus musculus
atgctttttgagtgctggctgctaa

SEQ ID NO: 262601 - DNA, 25 bp, Mus musculus
atgctttttgtcacccgatgatggg

SEQ ID NO: 262602 - DNA, 25 bp, Mus musculus
atgctttttgtctcccgatgatggg

SEQ ID NO: 262603 - DNA, 25 bp, Mus musculus
atgcttttttgcagtctggccattg

SEQ ID NO: 262604 - DNA, 25 bp, Mus musculus
atgcttttttgctgtctggccattg

SEQ ID NO: 262605 - DNA, 25 bp, Mus musculus
atggaaaaagctacttgctggactt

SEQ ID NO: 262606 - DNA, 25 bp, Mus musculus
atggaaaaagcttcttgctggactt

SEQ ID NO: 262607 - DNA, 25 bp, Mus musculus
atggaaaaagttcctgtggatgttt

SEQ ID NO: 262608 - DNA, 25 bp, Mus musculus
atggaaaaagttgctgtggatgttt

SEQ ID NO: 262609 - DNA, 25 bp, Mus musculus
atggaaaaatcaagctgagcagcaa

SEQ ID NO: 262610 - DNA, 25 bp, Mus musculus
atggaaaaatcatgctgagcagcaa

SEQ ID NO: 262611 - DNA, 25 bp, Mus musculus
atggaaaactcaatcttctcgtcac

SEQ ID NO: 262612 - DNA, 25 bp, Mus musculus
atggaaaactcattcttctcgtcac

SEQ ID NO: 262613 - DNA, 25 bp, Mus musculus
atggaaaactctcatttcttttagt

SEQ ID NO: 262614 - DNA, 25 bp, Mus musculus
atggaaaactctgatttcttttagt

SEQ ID NO: 262615 - DNA, 25 bp, Mus musculus
atggaaaatagccatcgctgccagg

SEQ ID NO: 262616 - DNA, 25 bp, Mus musculus
atggaaaatagcgatcgctgccagg

SEQ ID NO: 262617 - DNA, 25 bp, Mus musculus
atggaaaatcccagcggttctgtat

SEQ ID NO: 262618 - DNA, 25 bp, Mus musculus
atggaaaatccctgcggttctgtat

SEQ ID NO: 262619 - DNA, 25 bp, Mus musculus
atggaaaatgacagcagtggcccct

SEQ ID NO: 262620 - DNA, 25 bp, Mus musculus
atggaaaatgactgcagtggcccct

SEQ ID NO: 262621 - DNA, 25 bp, Mus musculus
atggaaaatttcaggccttgcccct

SEQ ID NO: 262622 - DNA, 25 bp, Mus musculus
atggaaaatttctggccttgcccct

SEQ ID NO: 262623 - DNA, 25 bp, Mus musculus
atggaaacaacgaggcctgcatctt

SEQ ID NO: 262624 - DNA, 25 bp, Mus musculus
atggaaacaacgtggcctgcatctt

SEQ ID NO: 262625 - DNA, 25 bp, Mus musculus
atggaaacaccgcaagccttctgtc

SEQ ID NO: 262626 - DNA, 25 bp, Mus musculus
atggaaacaccggaagccttctgtc

SEQ ID NO: 262627 - DNA, 25 bp, Mus musculus
atggaaacattccttgtcatagtag

SEQ ID NO: 262628 - DNA, 25 bp, Mus musculus
atggaaacattcgttgtcatagtag

SEQ ID NO: 262629 - DNA, 25 bp, Mus musculus
atggaaaccagacccttgcagctct

SEQ ID NO: 262630 - DNA, 25 bp, Mus musculus
atggaaaccagactttctcctactc

SEQ ID NO: 262631 - DNA, 25 bp, Mus musculus
atggaaaccagagccttgcagctct

SEQ ID NO: 262632 - DNA, 25 bp, Mus musculus
atggaaaccagagtttctcctactc

SEQ ID NO: 262633 - DNA, 25 bp, Mus musculus
atggaaaccattatattgcgacaga

SEQ ID NO: 262634 - DNA, 25 bp, Mus musculus
atggaaaccattttattgcgacaga

SEQ ID NO: 262635 - DNA, 25 bp, Mus musculus
atggaaacccttactgctggggcct

SEQ ID NO: 262636 - DNA, 25 bp, Mus musculus
atggaaaccctttctgctggggcct

SEQ ID NO: 262637 - DNA, 25 bp, Mus musculus
atggaaacctctatgcacactttaa

SEQ ID NO: 262638 - DNA, 25 bp, Mus musculus
atggaaacctctcactatacacact

SEQ ID NO: 262639 - DNA, 25 bp, Mus musculus
atggaaacctctgactatacacact

SEQ ID NO: 262640 - DNA, 25 bp, Mus musculus
atggaaacctctttgcacactttaa

SEQ ID NO: 262641 - DNA, 25 bp, Mus musculus
atggaaacctggatacccttgctct

SEQ ID NO: 262642 - DNA, 25 bp, Mus musculus
atggaaacctggttacccttgctct

SEQ ID NO: 262643 - DNA, 25 bp, Mus musculus
atggaaacctttctatttgacgtgt

SEQ ID NO: 262644 - DNA, 25 bp, Mus musculus
atggaaacctttgtatttgacgtgt

SEQ ID NO: 262645 - DNA, 25 bp, Mus musculus
atggaaacgcggaggccagctctga

SEQ ID NO: 262646 - DNA, 25 bp, Mus musculus
atggaaacgcggatgtcagggcaac

SEQ ID NO: 262647 - DNA, 25 bp, Mus musculus
atggaaacgcggtggccagctctga

SEQ ID NO: 262648 - DNA, 25 bp, Mus musculus
atggaaacgcggttgtcagggcaac

SEQ ID NO: 262649 - DNA, 25 bp, Mus musculus
atggaaacgtgaaccctgatagctt

SEQ ID NO: 262650 - DNA, 25 bp, Mus musculus
atggaaacgtgatccctgatagctt

SEQ ID NO: 262651 - DNA, 25 bp, Mus musculus
atggaaactatcagtatgaggtgaa

SEQ ID NO: 262652 - DNA, 25 bp, Mus musculus
atggaaactatctgtatgaggtgaa

SEQ ID NO: 262653 - DNA, 25 bp, Mus musculus
atggaaactccactgtcttcatgca

SEQ ID NO: 262654 - DNA, 25 bp, Mus musculus
atggaaactccagtgtcttcatgca

SEQ ID NO: 262655 - DNA, 25 bp, Mus musculus
atggaaacttccactacagaatttg

SEQ ID NO: 262656 - DNA, 25 bp, Mus musculus
atggaaacttcctctacagaatttg

SEQ ID NO: 262657 - DNA, 25 bp, Mus musculus
atggaaagacgcctctcatggtcgc

SEQ ID NO: 262658 - DNA, 25 bp, Mus musculus
atggaaagacgcgtctcatggtcgc

SEQ ID NO: 262659 - DNA, 25 bp, Mus musculus
atggaaagatttcctccctgtatgt

SEQ ID NO: 262660 - DNA, 25 bp, Mus musculus
atggaaagatttgctccctgtatgt

SEQ ID NO: 262661 - DNA, 25 bp, Mus musculus
atggaaagccagagggtatctccca

SEQ ID NO: 262662 - DNA, 25 bp, Mus musculus
atggaaagccagtgggtatctccca

SEQ ID NO: 262663 - DNA, 25 bp, Mus musculus
atggaaagcctcagtggatatgccc

SEQ ID NO: 262664 - DNA, 25 bp, Mus musculus
atggaaagcctctgtggatatgccc

SEQ ID NO: 262665 - DNA, 25 bp, Mus musculus
atggaaagccttactcagtcacacc

SEQ ID NO: 262666 - DNA, 25 bp, Mus musculus
atggaaagcctttctcagtcacacc

SEQ ID NO: 262667 - DNA, 25 bp, Mus musculus
atggaaagctatcagccctgggctc

SEQ ID NO: 262668 - DNA, 25 bp, Mus musculus
atggaaagctatgagccctgggctc

SEQ ID NO: 262669 - DNA, 25 bp, Mus musculus
atggaaaggcagcttcttccccaca

SEQ ID NO: 262670 - DNA, 25 bp, Mus musculus
atggaaaggcaggttcttccccaca

SEQ ID NO: 262671 - DNA, 25 bp, Mus musculus
atggaaagggacctggttccatctc

SEQ ID NO: 262672 - DNA, 25 bp, Mus musculus
atggaaagggacgtggttccatctc

SEQ ID NO: 262673 - DNA, 25 bp, Mus musculus
atggaaataataccctacagatgag

SEQ ID NO: 262674 - DNA, 25 bp, Mus musculus
atggaaataatagcctacagatgag

SEQ ID NO: 262675 - DNA, 25 bp, Mus musculus
atggaaatacgtaccttcctggcct

SEQ ID NO: 262676 - DNA, 25 bp, Mus musculus
atggaaatacgttccttcctggcct

SEQ ID NO: 262677 - DNA, 25 bp, Mus musculus
atggaaatacttcccactgccagtg

SEQ ID NO: 262678 - DNA, 25 bp, Mus musculus
atggaaatacttgccactgccagtg

SEQ ID NO: 262679 - DNA, 25 bp, Mus musculus
atggaaatcattacctgggccctca

SEQ ID NO: 262680 - DNA, 25 bp, Mus musculus
atggaaatcatttcctgggccctca

SEQ ID NO: 262681 - DNA, 25 bp, Mus musculus
atggaaatccaaagtattacttaat

SEQ ID NO: 262682 - DNA, 25 bp, Mus musculus
atggaaatccaatgtattacttaat

SEQ ID NO: 262683 - DNA, 25 bp, Mus musculus
atggaaatccagcaaagtgcataac

SEQ ID NO: 262684 - DNA, 25 bp, Mus musculus
atggaaatccaggaaagtgcataac

SEQ ID NO: 262685 - DNA, 25 bp, Mus musculus
atggaaatccatctaatgatagatg

SEQ ID NO: 262686 - DNA, 25 bp, Mus musculus
atggaaatccatgtaatgatagatg

SEQ ID NO: 262687 - DNA, 25 bp, Mus musculus
atggaaatccctcgcggaggagtac

SEQ ID NO: 262688 - DNA, 25 bp, Mus musculus
atggaaatccctggcggaggagtac

SEQ ID NO: 262689 - DNA, 25 bp, Mus musculus
atggaaatcttcctgggtccagctt

SEQ ID NO: 262690 - DNA, 25 bp, Mus musculus
atggaaatcttcgtgggtccagctt

SEQ ID NO: 262691 - DNA, 25 bp, Mus musculus
atggaaatgctgaggtttaaccgta

SEQ ID NO: 262692 - DNA, 25 bp, Mus musculus
atggaaatgctgtggtttaaccgta

SEQ ID NO: 262693 - DNA, 25 bp, Mus musculus
atggaaatggcacacagcctctgct

SEQ ID NO: 262694 - DNA, 25 bp, Mus musculus
atggaaatggcacttacctctcctg

SEQ ID NO: 262695 - DNA, 25 bp, Mus musculus
atggaaatggcagacagcctctgct

SEQ ID NO: 262696 - DNA, 25 bp, Mus musculus
atggaaatggcagttacctctcctg

SEQ ID NO: 262697 - DNA, 25 bp, Mus musculus
atggaaattcttcaagccctggcag

SEQ ID NO: 262698 - DNA, 25 bp, Mus musculus
atggaaattcttgaagccctggcag

SEQ ID NO: 262699 - DNA, 25 bp, Mus musculus
atggaacaaccaaccttacttgcct

SEQ ID NO: 262700 - DNA, 25 bp, Mus musculus
atggaacaaccatccttacttgcct

SEQ ID NO: 262701 - DNA, 25 bp, Mus musculus
atggaacaagagaccctagtccctt

SEQ ID NO: 262702 - DNA, 25 bp, Mus musculus
atggaacaagagtccctagtccctt

SEQ ID NO: 262703 - DNA, 25 bp, Mus musculus
atggaacaataaaaccagatgcagg

SEQ ID NO: 262704 - DNA, 25 bp, Mus musculus
atggaacaataataccagatgcagg

SEQ ID NO: 262705 - DNA, 25 bp, Mus musculus
atggaacaatatcactgcaggtccc

SEQ ID NO: 262706 - DNA, 25 bp, Mus musculus
atggaacaatatgactgcaggtccc

SEQ ID NO: 262707 - DNA, 25 bp, Mus musculus
atggaacacagcacctagggcctca

SEQ ID NO: 262708 - DNA, 25 bp, Mus musculus
atggaacacagctcctagggcctca

SEQ ID NO: 262709 - DNA, 25 bp, Mus musculus
atggaacacgccagaattgcacctg

SEQ ID NO: 262710 - DNA, 25 bp, Mus musculus
atggaacacgcctgaattgcacctg

SEQ ID NO: 262711 - DNA, 25 bp, Mus musculus
atggaacactacaacctgagggaac

SEQ ID NO: 262712 - DNA, 25 bp, Mus musculus
atggaacactactacctgagggaac

SEQ ID NO: 262713 - DNA, 25 bp, Mus musculus
atggaacactgaatcttttcatctg

SEQ ID NO: 262714 - DNA, 25 bp, Mus musculus
atggaacactgattcttttcatctg

SEQ ID NO: 262715 - DNA, 25 bp, Mus musculus
atggaacagcccatagaattcatca

SEQ ID NO: 262716 - DNA, 25 bp, Mus musculus
atggaacagcccttagaattcatca

SEQ ID NO: 262717 - DNA, 25 bp, Mus musculus
atggaacatcacatacagtgggtga

SEQ ID NO: 262718 - DNA, 25 bp, Mus musculus
atggaacatcacttacagtgggtga

SEQ ID NO: 262719 - DNA, 25 bp, Mus musculus
atggaacatccaatctcttgctcag

SEQ ID NO: 262720 - DNA, 25 bp, Mus musculus
atggaacatccattctcttgctcag

SEQ ID NO: 262721 - DNA, 25 bp, Mus musculus
atggaacattccataccctgtcctg

SEQ ID NO: 262722 - DNA, 25 bp, Mus musculus
atggaacattccttaccctgtcctg

SEQ ID NO: 262723 - DNA, 25 bp, Mus musculus
atggaacatttcctgtgagcacaga

SEQ ID NO: 262724 - DNA, 25 bp, Mus musculus
atggaacatttcgtgtgagcacaga

SEQ ID NO: 262725 - DNA, 25 bp, Mus musculus
atggaaccaagtacgctgccatcga

SEQ ID NO: 262726 - DNA, 25 bp, Mus musculus
atggaaccaagttcgctgccatcga

SEQ ID NO: 262727 - DNA, 25 bp, Mus musculus
atggaaccaggtctttgctctcctt

SEQ ID NO: 262728 - DNA, 25 bp, Mus musculus
atggaaccaggtgtttgctctcctt

SEQ ID NO: 262729 - DNA, 25 bp, Mus musculus
atggaaccatcaccttcatgtacct

SEQ ID NO: 262730 - DNA, 25 bp, Mus musculus
atggaaccatcagcttcatgtacct

SEQ ID NO: 262731 - DNA, 25 bp, Mus musculus
atggaaccatgtatgtatacctcat

SEQ ID NO: 262732 - DNA, 25 bp, Mus musculus
atggaaccatgtttgtatacctcat

SEQ ID NO: 262733 - DNA, 25 bp, Mus musculus
atggaacccatactgtctacggata

SEQ ID NO: 262734 - DNA, 25 bp, Mus musculus
atggaacccatagtgtctacggata

SEQ ID NO: 262735 - DNA, 25 bp, Mus musculus
atggaacccattctgtgctgataac

SEQ ID NO: 262736 - DNA, 25 bp, Mus musculus
atggaacccattgtgtgctgataac

SEQ ID NO: 262737 - DNA, 25 bp, Mus musculus
atggaaccctataaacattcaagta

SEQ ID NO: 262738 - DNA, 25 bp, Mus musculus
atggaaccctattaacattcaagta

SEQ ID NO: 262739 - DNA, 25 bp, Mus musculus
atggaaccgaaacctttgtaaatgt

SEQ ID NO: 262740 - DNA, 25 bp, Mus musculus
atggaaccgaaagctttgtaaatgt

SEQ ID NO: 262741 - DNA, 25 bp, Mus musculus
atggaacctatccataccgtggacc

SEQ ID NO: 262742 - DNA, 25 bp, Mus musculus
atggaacctatcgataccgtggacc

SEQ ID NO: 262743 - DNA, 25 bp, Mus musculus
atggaacctattaattctctcagac

SEQ ID NO: 262744 - DNA, 25 bp, Mus musculus
atggaacctatttattctctcagac

SEQ ID NO: 262745 - DNA, 25 bp, Mus musculus
atggaacctccaacaagactagatc

SEQ ID NO: 262746 - DNA, 25 bp, Mus musculus
atggaacctccatcaagactagatc

SEQ ID NO: 262747 - DNA, 25 bp, Mus musculus
atggaacctcggctatggcccattc

SEQ ID NO: 262748 - DNA, 25 bp, Mus musculus
atggaacctcgggtatggcccattc

SEQ ID NO: 262749 - DNA, 25 bp, Mus musculus
atggaacctcttatcaaagcaggag

SEQ ID NO: 262750 - DNA, 25 bp, Mus musculus
atggaacctcttttcaaagcaggag

SEQ ID NO: 262751 - DNA, 25 bp, Mus musculus
atggaacctgtaccatcagatggga

SEQ ID NO: 262752 - DNA, 25 bp, Mus musculus
atggaacctgtagcatcagatggga

SEQ ID NO: 262753 - DNA, 25 bp, Mus musculus
atggaacctgtgcagcttggagctt

SEQ ID NO: 262754 - DNA, 25 bp, Mus musculus
atggaacctgtggagcttggagctt

SEQ ID NO: 262755 - DNA, 25 bp, Mus musculus
atggaaccttaactgggagctgccg

SEQ ID NO: 262756 - DNA, 25 bp, Mus musculus
atggaaccttaagtgggagctgccg

SEQ ID NO: 262757 - DNA, 25 bp, Mus musculus
atggaacctttgctgcaggaggcta

SEQ ID NO: 262758 - DNA, 25 bp, Mus musculus
atggaacctttggtgcaggaggcta

SEQ ID NO: 262759 - DNA, 25 bp, Mus musculus
atggaacgcacccagatgctcttct

SEQ ID NO: 262760 - DNA, 25 bp, Mus musculus
atggaacgcaccgagatgctcttct

SEQ ID NO: 262761 - DNA, 25 bp, Mus musculus
atggaacgcgtgattgatgttttac

SEQ ID NO: 262762 - DNA, 25 bp, Mus musculus
atggaacgcgtgtttgatgttttac

SEQ ID NO: 262763 - DNA, 25 bp, Mus musculus
atggaacggagactctttggtcgaa

SEQ ID NO: 262764 - DNA, 25 bp, Mus musculus
atggaacggagagtctttggtcgaa

SEQ ID NO: 262765 - DNA, 25 bp, Mus musculus
atggaactaaagcattagcttagct

SEQ ID NO: 262766 - DNA, 25 bp, Mus musculus
atggaactaaaggattagcttagct

SEQ ID NO: 262767 - DNA, 25 bp, Mus musculus
atggaactacagctgaggcggcaca

SEQ ID NO: 262768 - DNA, 25 bp, Mus musculus
atggaactacaggtgaggcggcaca

SEQ ID NO: 262769 - DNA, 25 bp, Mus musculus
atggaactacttcagcactcacaga

SEQ ID NO: 262770 - DNA, 25 bp, Mus musculus
atggaactacttgagcactcacaga

SEQ ID NO: 262771 - DNA, 25 bp, Mus musculus
atggaactaggcccgatttgacgaa

SEQ ID NO: 262772 - DNA, 25 bp, Mus musculus
atggaactaggcgcgatttgacgaa

SEQ ID NO: 262773 - DNA, 25 bp, Mus musculus
atggaactcagtagcatacgcctca

SEQ ID NO: 262774 - DNA, 25 bp, Mus musculus
atggaactcagttgcatacgcctca

SEQ ID NO: 262775 - DNA, 25 bp, Mus musculus
atggaactcctccttcagggcgtga

SEQ ID NO: 262776 - DNA, 25 bp, Mus musculus
atggaactcctcgttcagggcgtga

SEQ ID NO: 262777 - DNA, 25 bp, Mus musculus
atggaactctgcaagatggcagcaa

SEQ ID NO: 262778 - DNA, 25 bp, Mus musculus
atggaactctgctagatggcagcaa

SEQ ID NO: 262779 - DNA, 25 bp, Mus musculus
atggaactgattccagcctggcacc

SEQ ID NO: 262780 - DNA, 25 bp, Mus musculus
atggaactgattgcagcctggcacc

SEQ ID NO: 262781 - DNA, 25 bp, Mus musculus
atggaactgtatcttcccctgtcat

SEQ ID NO: 262782 - DNA, 25 bp, Mus musculus
atggaactgtatgttcccctgtcat

SEQ ID NO: 262783 - DNA, 25 bp, Mus musculus
atggaactgtggaccagtaccttcc

SEQ ID NO: 262784 - DNA, 25 bp, Mus musculus
atggaactgtggtccagtaccttcc

SEQ ID NO: 262785 - DNA, 25 bp, Mus musculus
atggaacttaaacccttgtcaaaca

SEQ ID NO: 262786 - DNA, 25 bp, Mus musculus
atggaacttaaactctgttgacaag

SEQ ID NO: 262787 - DNA, 25 bp, Mus musculus
atggaacttaaagccttgtcaaaca

SEQ ID NO: 262788 - DNA, 25 bp, Mus musculus
atggaacttaaagtctgttgacaag

SEQ ID NO: 262789 - DNA, 25 bp, Mus musculus
atggaacttacaactggatcagctg

SEQ ID NO: 262790 - DNA, 25 bp, Mus musculus
atggaacttacatctggatcagctg

SEQ ID NO: 262791 - DNA, 25 bp, Mus musculus
atggaacttcaacaccgtaggcact

SEQ ID NO: 262792 - DNA, 25 bp, Mus musculus
atggaacttcaagaccgtaggcact

SEQ ID NO: 262793 - DNA, 25 bp, Mus musculus
atggaacttcatacaaaacttacaa

SEQ ID NO: 262794 - DNA, 25 bp, Mus musculus
atggaacttcattcaaaacttacaa

SEQ ID NO: 262795 - DNA, 25 bp, Mus musculus
atggaactttccacgggcattatgt

SEQ ID NO: 262796 - DNA, 25 bp, Mus musculus
atggaactttcctcgggcattatgt

SEQ ID NO: 262797 - DNA, 25 bp, Mus musculus
atggaactttctaacactgcaggaa

SEQ ID NO: 262798 - DNA, 25 bp, Mus musculus
atggaactttctcaggtgtgcctac

SEQ ID NO: 262799 - DNA, 25 bp, Mus musculus
atggaactttctgaggtgtgcctac

SEQ ID NO: 262800 - DNA, 25 bp, Mus musculus
atggaactttcttacactgcaggaa

SEQ ID NO: 262801 - DNA, 25 bp, Mus musculus
atggaagacagtcatttttgttggt

SEQ ID NO: 262802 - DNA, 25 bp, Mus musculus
atggaagacagtgatttttgttggt

SEQ ID NO: 262803 - DNA, 25 bp, Mus musculus
atggaagactctcacctccttgaat

SEQ ID NO: 262804 - DNA, 25 bp, Mus musculus
atggaagactctgacctccttgaat

SEQ ID NO: 262805 - DNA, 25 bp, Mus musculus
atggaagagaatatgagcagacccc

SEQ ID NO: 262806 - DNA, 25 bp, Mus musculus
atggaagagaatttgagcagacccc

SEQ ID NO: 262807 - DNA, 25 bp, Mus musculus
atggaagagacacccagcatcctgc

SEQ ID NO: 262808 - DNA, 25 bp, Mus musculus
atggaagagacagccagcatcctgc

SEQ ID NO: 262809 - DNA, 25 bp, Mus musculus
atggaagagccaatttggtcagctc

SEQ ID NO: 262810 - DNA, 25 bp, Mus musculus
atggaagagccattttggtcagctc

SEQ ID NO: 262811 - DNA, 25 bp, Mus musculus
atggaagaggctcaagtcaccgttc

SEQ ID NO: 262812 - DNA, 25 bp, Mus musculus
atggaagaggctgaagtcaccgttc

SEQ ID NO: 262813 - DNA, 25 bp, Mus musculus
atggaagaggtcagtccgtgcttgc

SEQ ID NO: 262814 - DNA, 25 bp, Mus musculus
atggaagaggtctgtccgtgcttgc

SEQ ID NO: 262815 - DNA, 25 bp, Mus musculus
atggaagaggtgatcccagctccgt

SEQ ID NO: 262816 - DNA, 25 bp, Mus musculus
atggaagaggtgttcccagctccgt

SEQ ID NO: 262817 - DNA, 25 bp, Mus musculus
atggaagagtgcagtctccgctgct

SEQ ID NO: 262818 - DNA, 25 bp, Mus musculus
atggaagagtgctgtctccgctgct

SEQ ID NO: 262819 - DNA, 25 bp, Mus musculus
atggaagagttcacttgctctcacc

SEQ ID NO: 262820 - DNA, 25 bp, Mus musculus
atggaagagttctcttgctctcacc

SEQ ID NO: 262821 - DNA, 25 bp, Mus musculus
atggaagatacacagcctgcacctt

SEQ ID NO: 262822 - DNA, 25 bp, Mus musculus
atggaagatacagagcctgcacctt

SEQ ID NO: 262823 - DNA, 25 bp, Mus musculus
atggaagatttcatagctacctctt

SEQ ID NO: 262824 - DNA, 25 bp, Mus musculus
atggaagatttcttagctacctctt

SEQ ID NO: 262825 - DNA, 25 bp, Mus musculus
atggaagcaccactccagttgcagc

SEQ ID NO: 262826 - DNA, 25 bp, Mus musculus
atggaagcaccagtccagttgcagc

SEQ ID NO: 262827 - DNA, 25 bp, Mus musculus
atggaagcaccgaacacttcccacg

SEQ ID NO: 262828 - DNA, 25 bp, Mus musculus
atggaagcaccgtacacttcccacg

SEQ ID NO: 262829 - DNA, 25 bp, Mus musculus
atggaagcagacagatgtccgtaag

SEQ ID NO: 262830 - DNA, 25 bp, Mus musculus
atggaagcagactgatgtccgtaag

SEQ ID NO: 262831 - DNA, 25 bp, Mus musculus
atggaagcagagatctttgccaggc

SEQ ID NO: 262832 - DNA, 25 bp, Mus musculus
atggaagcagagttctttgccaggc

SEQ ID NO: 262833 - DNA, 25 bp, Mus musculus
atggaagcatctcttcagctcctac

SEQ ID NO: 262834 - DNA, 25 bp, Mus musculus
atggaagcatctgttcagctcctac

SEQ ID NO: 262835 - DNA, 25 bp, Mus musculus
atggaagccaacatcgacaggataa

SEQ ID NO: 262836 - DNA, 25 bp, Mus musculus
atggaagccaacttcgacaggataa

SEQ ID NO: 262837 - DNA, 25 bp, Mus musculus
atggaagccaggacaggaaacaact

SEQ ID NO: 262838 - DNA, 25 bp, Mus musculus
atggaagccaggtcaggaaacaact

SEQ ID NO: 262839 - DNA, 25 bp, Mus musculus
atggaagcccttattgacatggttt

SEQ ID NO: 262840 - DNA, 25 bp, Mus musculus
atggaagccctttttgacatggttt

SEQ ID NO: 262841 - DNA, 25 bp, Mus musculus
atggaagccgtgcatttccgtgtgc

SEQ ID NO: 262842 - DNA, 25 bp, Mus musculus
atggaagccgtggatttccgtgtgc

SEQ ID NO: 262843 - DNA, 25 bp, Mus musculus
atggaagcctgcatgcgtgttcaac

SEQ ID NO: 262844 - DNA, 25 bp, Mus musculus
atggaagcctgcttgcgtgttcaac

SEQ ID NO: 262845 - DNA, 25 bp, Mus musculus
atggaagctcataagtacggacact

SEQ ID NO: 262846 - DNA, 25 bp, Mus musculus
atggaagctcattagtacggacact

SEQ ID NO: 262847 - DNA, 25 bp, Mus musculus
atggaagctccccatatcatcgtgg

SEQ ID NO: 262848 - DNA, 25 bp, Mus musculus
atggaagctcccgatatcatcgtgg

SEQ ID NO: 262849 - DNA, 25 bp, Mus musculus
atggaagctgccagtatctctgaca

SEQ ID NO: 262850 - DNA, 25 bp, Mus musculus
atggaagctgcctgtatctctgaca

SEQ ID NO: 262851 - DNA, 25 bp, Mus musculus
atggaaggactcaagctactacatg

SEQ ID NO: 262852 - DNA, 25 bp, Mus musculus
atggaaggactctagctactacatg

SEQ ID NO: 262853 - DNA, 25 bp, Mus musculus
atggaaggagctcggccttacacca

SEQ ID NO: 262854 - DNA, 25 bp, Mus musculus
atggaaggagctgggccttacacca

SEQ ID NO: 262855 - DNA, 25 bp, Mus musculus
atggaaggagttcgacctcgcctcc

SEQ ID NO: 262856 - DNA, 25 bp, Mus musculus
atggaaggagttggacctcgcctcc

SEQ ID NO: 262857 - DNA, 25 bp, Mus musculus
atggaaggatcgcaaaccctgaccc

SEQ ID NO: 262858 - DNA, 25 bp, Mus musculus
atggaaggatcggaaaccctgaccc

SEQ ID NO: 262859 - DNA, 25 bp, Mus musculus
atggaaggctagactgtcaggccct

SEQ ID NO: 262860 - DNA, 25 bp, Mus musculus
atggaaggctagtctgtcaggccct

SEQ ID NO: 262861 - DNA, 25 bp, Mus musculus
atggaagggccgctactatcctctg

SEQ ID NO: 262862 - DNA, 25 bp, Mus musculus
atggaagggccggtactatcctctg

SEQ ID NO: 262863 - DNA, 25 bp, Mus musculus
atggaaggtcacaacgttcacgctg

SEQ ID NO: 262864 - DNA, 25 bp, Mus musculus
atggaaggtcactacgttcacgctg

SEQ ID NO: 262865 - DNA, 25 bp, Mus musculus
atggaaggtgctaggccccacacac

SEQ ID NO: 262866 - DNA, 25 bp, Mus musculus
atggaaggtgcttggccccacacac

SEQ ID NO: 262867 - DNA, 25 bp, Mus musculus
atggaaggtgttcctcccagggctt

SEQ ID NO: 262868 - DNA, 25 bp, Mus musculus
atggaaggtgttgctcccagggctt

SEQ ID NO: 262869 - DNA, 25 bp, Mus musculus
atggaaggttatcttatgtgtcaac

SEQ ID NO: 262870 - DNA, 25 bp, Mus musculus
atggaaggttatgttatgtgtcaac

SEQ ID NO: 262871 - DNA, 25 bp, Mus musculus
atggaaggtttgaggcagcctctca

SEQ ID NO: 262872 - DNA, 25 bp, Mus musculus
atggaaggtttgtggcagcctctca

SEQ ID NO: 262873 - DNA, 25 bp, Mus musculus
atggaagtattcagcctattgtcgc

SEQ ID NO: 262874 - DNA, 25 bp, Mus musculus
atggaagtattctgcctattgtcgc

SEQ ID NO: 262875 - DNA, 25 bp, Mus musculus
atggaagtcatacatgcagaaacgg

SEQ ID NO: 262876 - DNA, 25 bp, Mus musculus
atggaagtcatagatgcagaaacgg

SEQ ID NO: 262877 - DNA, 25 bp, Mus musculus
atggaagtcccaattctgtggccac

SEQ ID NO: 262878 - DNA, 25 bp, Mus musculus
atggaagtcccatttctgtggccac

SEQ ID NO: 262879 - DNA, 25 bp, Mus musculus
atggaagtgcatccctatgtgaagc

SEQ ID NO: 262880 - DNA, 25 bp, Mus musculus
atggaagtgcatgcctatgtgaagc

SEQ ID NO: 262881 - DNA, 25 bp, Mus musculus
atggaagtgccgcacctgtgactat

SEQ ID NO: 262882 - DNA, 25 bp, Mus musculus
atggaagtgccggacctgtgactat

SEQ ID NO: 262883 - DNA, 25 bp, Mus musculus
atggaagtgctcatctagcgtcgtc

SEQ ID NO: 262884 - DNA, 25 bp, Mus musculus
atggaagtgctcatttccttcatcc

SEQ ID NO: 262885 - DNA, 25 bp, Mus musculus
atggaagtgctcttctagcgtcgtc

SEQ ID NO: 262886 - DNA, 25 bp, Mus musculus
atggaagtgctcttttccttcatcc

SEQ ID NO: 262887 - DNA, 25 bp, Mus musculus
atggaagtgttaattttactgtact

SEQ ID NO: 262888 - DNA, 25 bp, Mus musculus
atggaagtgttatttttactgtact

SEQ ID NO: 262889 - DNA, 25 bp, Mus musculus
atggaagtgttgcttatctcacccc

SEQ ID NO: 262890 - DNA, 25 bp, Mus musculus
atggaagtgttggttatctcacccc

SEQ ID NO: 262891 - DNA, 25 bp, Mus musculus
atggaagttccaccactggcagtgt

SEQ ID NO: 262892 - DNA, 25 bp, Mus musculus
atggaagttccagcactggcagtgt

SEQ ID NO: 262893 - DNA, 25 bp, Mus musculus
atggaagttgcccttagctccttat

SEQ ID NO: 262894 - DNA, 25 bp, Mus musculus
atggaagttgccgttagctccttat

SEQ ID NO: 262895 - DNA, 25 bp, Mus musculus
atggaatatcgcacagacctgccac

SEQ ID NO: 262896 - DNA, 25 bp, Mus musculus
atggaatatcgctcagacctgccac

SEQ ID NO: 262897 - DNA, 25 bp, Mus musculus
atggaatcacttacatcctcttgaa

SEQ ID NO: 262898 - DNA, 25 bp, Mus musculus
atggaatcactttcatcctcttgaa

SEQ ID NO: 262899 - DNA, 25 bp, Mus musculus
atggaatcagttataccctgtgcag

SEQ ID NO: 262900 - DNA, 25 bp, Mus musculus
atggaatcagttttaccctgtgcag

SEQ ID NO: 262901 - DNA, 25 bp, Mus musculus
atggaatcatggatgctgccaattt

SEQ ID NO: 262902 - DNA, 25 bp, Mus musculus
atggaatcatggttgctgccaattt

SEQ ID NO: 262903 - DNA, 25 bp, Mus musculus
atggaatccataattgcctctcctg

SEQ ID NO: 262904 - DNA, 25 bp, Mus musculus
atggaatccatatttgcctctcctg

SEQ ID NO: 262905 - DNA, 25 bp, Mus musculus
atggaatccccaaattgacaccagg

SEQ ID NO: 262906 - DNA, 25 bp, Mus musculus
atggaatccccatattgacaccagg

SEQ ID NO: 262907 - DNA, 25 bp, Mus musculus
atggaatccgatcaaaaccctctga

SEQ ID NO: 262908 - DNA, 25 bp, Mus musculus
atggaatccgatgaaaaccctctga

SEQ ID NO: 262909 - DNA, 25 bp, Mus musculus
atggaatcgtgaattcaccctccct

SEQ ID NO: 262910 - DNA, 25 bp, Mus musculus
atggaatcgtgatttcaccctccct

SEQ ID NO: 262911 - DNA, 25 bp, Mus musculus
atggaatctcctatcatctgtcgat

SEQ ID NO: 262912 - DNA, 25 bp, Mus musculus
atggaatctcctttcatctgtcgat

SEQ ID NO: 262913 - DNA, 25 bp, Mus musculus
atggaatctgctaccggtgccccat

SEQ ID NO: 262914 - DNA, 25 bp, Mus musculus
atggaatctgcttccggtgccccat

SEQ ID NO: 262915 - DNA, 25 bp, Mus musculus
atggaatgacctagtgccaggctct

SEQ ID NO: 262916 - DNA, 25 bp, Mus musculus
atggaatgaccttgtgccaggctct

SEQ ID NO: 262917 - DNA, 25 bp, Mus musculus
atggaatgagacattcctcctgctt

SEQ ID NO: 262918 - DNA, 25 bp, Mus musculus
atggaatgagactttcctcctgctt

SEQ ID NO: 262919 - DNA, 25 bp, Mus musculus
atggaatgatctctgcggtaactgt

SEQ ID NO: 262920 - DNA, 25 bp, Mus musculus
atggaatgatctgtgcggtaactgt

SEQ ID NO: 262921 - DNA, 25 bp, Mus musculus
atggaatgcaacaaatcctttaccc

SEQ ID NO: 262922 - DNA, 25 bp, Mus musculus
atggaatgcaactaatcctttaccc

SEQ ID NO: 262923 - DNA, 25 bp, Mus musculus
atggaatgcaggcacttcgccttat

SEQ ID NO: 262924 - DNA, 25 bp, Mus musculus
atggaatgcagggacttcgccttat

SEQ ID NO: 262925 - DNA, 25 bp, Mus musculus
atggaatgcatgcaccgggcctctg

SEQ ID NO: 262926 - DNA, 25 bp, Mus musculus
atggaatgcatggaccgggcctctg

SEQ ID NO: 262927 - DNA, 25 bp, Mus musculus
atggaatgcccaccaggccgagtct

SEQ ID NO: 262928 - DNA, 25 bp, Mus musculus
atggaatgcccagcaggccgagtct

SEQ ID NO: 262929 - DNA, 25 bp, Mus musculus
atggaatgccctaacatttgccttc

SEQ ID NO: 262930 - DNA, 25 bp, Mus musculus
atggaatgcccttacatttgccttc

SEQ ID NO: 262931 - DNA, 25 bp, Mus musculus
atggaatggaagacccacctgtctc

SEQ ID NO: 262932 - DNA, 25 bp, Mus musculus
atggaatggaagtcccacctgtctc

SEQ ID NO: 262933 - DNA, 25 bp, Mus musculus
atggaatggccgaggctacaggctc

SEQ ID NO: 262934 - DNA, 25 bp, Mus musculus
atggaatggccgtggctacaggctc

SEQ ID NO: 262935 - DNA, 25 bp, Mus musculus
atggaatgtattatagcctagcaga

SEQ ID NO: 262936 - DNA, 25 bp, Mus musculus
atggaatgtattttagcctagcaga

SEQ ID NO: 262937 - DNA, 25 bp, Mus musculus
atggaatgtccacggcctcgtgcct

SEQ ID NO: 262938 - DNA, 25 bp, Mus musculus
atggaatgtccagggcctcgtgcct

SEQ ID NO: 262939 - DNA, 25 bp, Mus musculus
atggaatgtctcaggctattggcct

SEQ ID NO: 262940 - DNA, 25 bp, Mus musculus
atggaatgtctctggctattggcct

SEQ ID NO: 262941 - DNA, 25 bp, Mus musculus
atggaattagtacagcccttcccgg

SEQ ID NO: 262942 - DNA, 25 bp, Mus musculus
atggaattagtagagcccttcccgg

SEQ ID NO: 262943 - DNA, 25 bp, Mus musculus
atggaattagttactcccctgatgc

SEQ ID NO: 262944 - DNA, 25 bp, Mus musculus
atggaattagtttctcccctgatgc

SEQ ID NO: 262945 - DNA, 25 bp, Mus musculus
atggaattatagagtcccttggtaa

SEQ ID NO: 262946 - DNA, 25 bp, Mus musculus
atggaattatagtgtcccttggtaa

SEQ ID NO: 262947 - DNA, 25 bp, Mus musculus
atggaattcaggcactcctcgctgg

SEQ ID NO: 262948 - DNA, 25 bp, Mus musculus
atggaattcagggactcctcgctgg

SEQ ID NO: 262949 - DNA, 25 bp, Mus musculus
atggaattccatactgggagatcat

SEQ ID NO: 262950 - DNA, 25 bp, Mus musculus
atggaattccattctgggagatcat

SEQ ID NO: 262951 - DNA, 25 bp, Mus musculus
atggaattccccaagcttgctgtaa

SEQ ID NO: 262952 - DNA, 25 bp, Mus musculus
atggaattcccctagcttgctgtaa

SEQ ID NO: 262953 - DNA, 25 bp, Mus musculus
atggaattcctaccctcaacagttt

SEQ ID NO: 262954 - DNA, 25 bp, Mus musculus
atggaattcctagcctcaacagttt

SEQ ID NO: 262955 - DNA, 25 bp, Mus musculus
atggaattcttactgtgctggctaa

SEQ ID NO: 262956 - DNA, 25 bp, Mus musculus
atggaattcttagtgtgctggctaa

SEQ ID NO: 262957 - DNA, 25 bp, Mus musculus
atggaattcttgcaggtcctcactg

SEQ ID NO: 262958 - DNA, 25 bp, Mus musculus
atggaattcttggaggtcctcactg

SEQ ID NO: 262959 - DNA, 25 bp, Mus musculus
atggaattgatcattccaaagtcag

SEQ ID NO: 262960 - DNA, 25 bp, Mus musculus
atggaattgatctttccaaagtcag

SEQ ID NO: 262961 - DNA, 25 bp, Mus musculus
atggaattgattagcattgaacaca

SEQ ID NO: 262962 - DNA, 25 bp, Mus musculus
atggaattgatttgcattgaacaca

SEQ ID NO: 262963 - DNA, 25 bp, Mus musculus
atggaattgggtcgcatttcttcta

SEQ ID NO: 262964 - DNA, 25 bp, Mus musculus
atggaattgggtggcatttcttcta

SEQ ID NO: 262965 - DNA, 25 bp, Mus musculus
atggaattggtgcacctctagaaac

SEQ ID NO: 262966 - DNA, 25 bp, Mus musculus
atggaattggtggacctctagaaac

SEQ ID NO: 262967 - DNA, 25 bp, Mus musculus
atggaattgttaagcctggatcatg

SEQ ID NO: 262968 - DNA, 25 bp, Mus musculus
atggaattgttatgcctggatcatg

SEQ ID NO: 262969 - DNA, 25 bp, Mus musculus
atggaattgttcacatgatttgaaa

SEQ ID NO: 262970 - DNA, 25 bp, Mus musculus
atggaattgttctcatgatttgaaa

SEQ ID NO: 262971 - DNA, 25 bp, Mus musculus
atggaatttactatggccttttgaa

SEQ ID NO: 262972 - DNA, 25 bp, Mus musculus
atggaatttactttggccttttgaa

SEQ ID NO: 262973 - DNA, 25 bp, Mus musculus
atggaatttccaagtataatgacgg

SEQ ID NO: 262974 - DNA, 25 bp, Mus musculus
atggaatttccatgtataatgacgg

SEQ ID NO: 262975 - DNA, 25 bp, Mus musculus
atggaatttctactgccacccacag

SEQ ID NO: 262976 - DNA, 25 bp, Mus musculus
atggaatttctagtgccacccacag

SEQ ID NO: 262977 - DNA, 25 bp, Mus musculus
atggacaaaccccacctgttgtgtg

SEQ ID NO: 262978 - DNA, 25 bp, Mus musculus
atggacaaacccgacctgttgtgtg

SEQ ID NO: 262979 - DNA, 25 bp, Mus musculus
atggacaacgtcaaagtatactact

SEQ ID NO: 262980 - DNA, 25 bp, Mus musculus
atggacaacgtcctgtacagactga

SEQ ID NO: 262981 - DNA, 25 bp, Mus musculus
atggacaacgtcgtgtacagactga

SEQ ID NO: 262982 - DNA, 25 bp, Mus musculus
atggacaacgtctaagtatactact

SEQ ID NO: 262983 - DNA, 25 bp, Mus musculus
atggacaactaaagccctctgaaag

SEQ ID NO: 262984 - DNA, 25 bp, Mus musculus
atggacaactaatgccctctgaaag

SEQ ID NO: 262985 - DNA, 25 bp, Mus musculus
atggacaactgccaccttatgagtc

SEQ ID NO: 262986 - DNA, 25 bp, Mus musculus
atggacaactgcgaccttatgagtc

SEQ ID NO: 262987 - DNA, 25 bp, Mus musculus
atggacaagacgaagaggcctaaga

SEQ ID NO: 262988 - DNA, 25 bp, Mus musculus
atggacaagacgtagaggcctaaga

SEQ ID NO: 262989 - DNA, 25 bp, Mus musculus
atggacaagtttcgcttccggttgc

SEQ ID NO: 262990 - DNA, 25 bp, Mus musculus
atggacaagtttggcttccggttgc

SEQ ID NO: 262991 - DNA, 25 bp, Mus musculus
atggacaatagaagctgccctgcta

SEQ ID NO: 262992 - DNA, 25 bp, Mus musculus
atggacaatagatgctgccctgcta

SEQ ID NO: 262993 - DNA, 25 bp, Mus musculus
atggacacaagtcctggccagggct

SEQ ID NO: 262994 - DNA, 25 bp, Mus musculus
atggacacaagtgctggccagggct

SEQ ID NO: 262995 - DNA, 25 bp, Mus musculus
atggacacacaccacagggaagatg

SEQ ID NO: 262996 - DNA, 25 bp, Mus musculus
atggacacacacgacagggaagatg

SEQ ID NO: 262997 - DNA, 25 bp, Mus musculus
atggacacacatcgaactttttgcc

SEQ ID NO: 262998 - DNA, 25 bp, Mus musculus
atggacacacatggaactttttgcc

SEQ ID NO: 262999 - DNA, 25 bp, Mus musculus
atggacacagataagctgaatattt

SEQ ID NO: 263000 - DNA, 25 bp, Mus musculus
atggacacagattagctgaatattt

SEQ ID NO: 263001 - DNA, 25 bp, Mus musculus
atggacacattgactttctgacccc

SEQ ID NO: 263002 - DNA, 25 bp, Mus musculus
atggacacattgtctttctgacccc

SEQ ID NO: 263003 - DNA, 25 bp, Mus musculus
atggacaccaaacactaacttaaag

SEQ ID NO: 263004 - DNA, 25 bp, Mus musculus
atggacaccaaagactaacttaaag

SEQ ID NO: 263005 - DNA, 25 bp, Mus musculus
atggacaccctgagttcagagatgc

SEQ ID NO: 263006 - DNA, 25 bp, Mus musculus
atggacaccctgtgttcagagatgc

SEQ ID NO: 263007 - DNA, 25 bp, Mus musculus
atggacaccgagattccaggcgttg

SEQ ID NO: 263008 - DNA, 25 bp, Mus musculus
atggacaccgagtttccaggcgttg

SEQ ID NO: 263009 - DNA, 25 bp, Mus musculus
atggacacctttctggattctgcgt

SEQ ID NO: 263010 - DNA, 25 bp, Mus musculus
atggacacctttgtggattctgcgt

SEQ ID NO: 263011 - DNA, 25 bp, Mus musculus
atggacacgtggatggcccagccag

SEQ ID NO: 263012 - DNA, 25 bp, Mus musculus
atggacacgtggttggcccagccag

SEQ ID NO: 263013 - DNA, 25 bp, Mus musculus
atggacactcctctgagggcatttt

SEQ ID NO: 263014 - DNA, 25 bp, Mus musculus
atggacactcctgtgagggcatttt

SEQ ID NO: 263015 - DNA, 25 bp, Mus musculus
atggacactcttcctgactgcacag

SEQ ID NO: 263016 - DNA, 25 bp, Mus musculus
atggacactcttgctgactgcacag

SEQ ID NO: 263017 - DNA, 25 bp, Mus musculus
atggacactgtactcattgttctgt

SEQ ID NO: 263018 - DNA, 25 bp, Mus musculus
atggacactgtagtcattgttctgt

SEQ ID NO: 263019 - DNA, 25 bp, Mus musculus
atggacactgtgcatcatgtgtagt

SEQ ID NO: 263020 - DNA, 25 bp, Mus musculus
atggacactgtggatcatgtgtagt

SEQ ID NO: 263021 - DNA, 25 bp, Mus musculus
atggacacttctcacgagataaagt

SEQ ID NO: 263022 - DNA, 25 bp, Mus musculus
atggacacttctgacgagataaagt

SEQ ID NO: 263023 - DNA, 25 bp, Mus musculus
atggacagaatcacacatctccttc

SEQ ID NO: 263024 - DNA, 25 bp, Mus musculus
atggacagaatctcacatctccttc

SEQ ID NO: 263025 - DNA, 25 bp, Mus musculus
atggacagacacaacccttaaggaa

SEQ ID NO: 263026 - DNA, 25 bp, Mus musculus
atggacagacactacccttaaggaa

SEQ ID NO: 263027 - DNA, 25 bp, Mus musculus
atggacagacatccggattaaacat

SEQ ID NO: 263028 - DNA, 25 bp, Mus musculus
atggacagacatgcggattaaacat

SEQ ID NO: 263029 - DNA, 25 bp, Mus musculus
atggacagaccaaggaccttccgaa

SEQ ID NO: 263030 - DNA, 25 bp, Mus musculus
atggacagaccatggaccttccgaa

SEQ ID NO: 263031 - DNA, 25 bp, Mus musculus
atggacagacgccaagcaggcctca

SEQ ID NO: 263032 - DNA, 25 bp, Mus musculus
atggacagacgcgaagcaggcctca

SEQ ID NO: 263033 - DNA, 25 bp, Mus musculus
atggacagatccatgtgagccccgg

SEQ ID NO: 263034 - DNA, 25 bp, Mus musculus
atggacagatccttgtgagccccgg

SEQ ID NO: 263035 - DNA, 25 bp, Mus musculus
atggacagccaaagtgttcagccgc

SEQ ID NO: 263036 - DNA, 25 bp, Mus musculus
atggacagccaatgtgttcagccgc

SEQ ID NO: 263037 - DNA, 25 bp, Mus musculus
atggacagccatcacctgagaaagt

SEQ ID NO: 263038 - DNA, 25 bp, Mus musculus
atggacagccatgacctgagaaagt

SEQ ID NO: 263039 - DNA, 25 bp, Mus musculus
atggacagcccacacccagtgatta

SEQ ID NO: 263040 - DNA, 25 bp, Mus musculus
atggacagcccagacccagtgatta

SEQ ID NO: 263041 - DNA, 25 bp, Mus musculus
atggacagccccaaattgccactca

SEQ ID NO: 263042 - DNA, 25 bp, Mus musculus
atggacagcccctaattgccactca

SEQ ID NO: 263043 - DNA, 25 bp, Mus musculus
atggacagccgaaccatgcagagct

SEQ ID NO: 263044 - DNA, 25 bp, Mus musculus
atggacagccgatccatgcagagct

SEQ ID NO: 263045 - DNA, 25 bp, Mus musculus
atggacagctagaggcggtgcctcc

SEQ ID NO: 263046 - DNA, 25 bp, Mus musculus
atggacagctagtggcggtgcctcc

SEQ ID NO: 263047 - DNA, 25 bp, Mus musculus
atggacagctgcagttcactcaagc

SEQ ID NO: 263048 - DNA, 25 bp, Mus musculus
atggacagctgctgttcactcaagc

SEQ ID NO: 263049 - DNA, 25 bp, Mus musculus
atggacaggcaacaagtagtcttta

SEQ ID NO: 263050 - DNA, 25 bp, Mus musculus
atggacaggcaagaagtagtcttta

SEQ ID NO: 263051 - DNA, 25 bp, Mus musculus
atggacaggctgaagctactctggt

SEQ ID NO: 263052 - DNA, 25 bp, Mus musculus
atggacaggctgtagctactctggt

SEQ ID NO: 263053 - DNA, 25 bp, Mus musculus
atggacagtcagaggatccctcacg

SEQ ID NO: 263054 - DNA, 25 bp, Mus musculus
atggacagtcagtggatccctcacg

SEQ ID NO: 263055 - DNA, 25 bp, Mus musculus
atggacagtgtacccatgcttgatc

SEQ ID NO: 263056 - DNA, 25 bp, Mus musculus
atggacagtgtagccatgcttgatc

SEQ ID NO: 263057 - DNA, 25 bp, Mus musculus
atggacagtttacttcctcttcttg

SEQ ID NO: 263058 - DNA, 25 bp, Mus musculus
atggacagtttagttcctcttcttg

SEQ ID NO: 263059 - DNA, 25 bp, Mus musculus
atggacatagcaaggtcatgattta

SEQ ID NO: 263060 - DNA, 25 bp, Mus musculus
atggacatagcatggtcatgattta

SEQ ID NO: 263061 - DNA, 25 bp, Mus musculus
atggacatagccactttcaagaggc

SEQ ID NO: 263062 - DNA, 25 bp, Mus musculus
atggacatagcctctttcaagaggc

SEQ ID NO: 263063 - DNA, 25 bp, Mus musculus
atggacatatgtaccccatgctcca

SEQ ID NO: 263064 - DNA, 25 bp, Mus musculus
atggacatatgttccccatgctcca

SEQ ID NO: 263065 - DNA, 25 bp, Mus musculus
atggacatcatcacccacatcttga

SEQ ID NO: 263066 - DNA, 25 bp, Mus musculus
atggacatcatctcccacatcttga

SEQ ID NO: 263067 - DNA, 25 bp, Mus musculus
atggacatccaacccgtgtcctgcg

SEQ ID NO: 263068 - DNA, 25 bp, Mus musculus
atggacatccaagccgtgtcctgcg

SEQ ID NO: 263069 - DNA, 25 bp, Mus musculus
atggacatgagacgcatcttcctgg

SEQ ID NO: 263070 - DNA, 25 bp, Mus musculus
atggacatgagaggcatcttcctgg

SEQ ID NO: 263071 - DNA, 25 bp, Mus musculus
atggacatgatgatgcgcgctcagt

SEQ ID NO: 263072 - DNA, 25 bp, Mus musculus
atggacatgatgttgcgcgctcagt

SEQ ID NO: 263073 - DNA, 25 bp, Mus musculus
atggacatgcacaccataatgcaca

SEQ ID NO: 263074 - DNA, 25 bp, Mus musculus
atggacatgcactccataatgcaca

SEQ ID NO: 263075 - DNA, 25 bp, Mus musculus
atggacatgcttatattcaatgatt

SEQ ID NO: 263076 - DNA, 25 bp, Mus musculus
atggacatgcttttattcaatgatt

SEQ ID NO: 263077 - DNA, 25 bp, Mus musculus
atggacatggaacctggcgcccaat

SEQ ID NO: 263078 - DNA, 25 bp, Mus musculus
atggacatggaagctggcgcccaat

SEQ ID NO: 263079 - DNA, 25 bp, Mus musculus
atggacatggtccaggcttcccatg

SEQ ID NO: 263080 - DNA, 25 bp, Mus musculus
atggacatggtcgaggcttcccatg

SEQ ID NO: 263081 - DNA, 25 bp, Mus musculus
atggacatgttcacccagcactgag

SEQ ID NO: 263082 - DNA, 25 bp, Mus musculus
atggacatgttctcccagcactgag

SEQ ID NO: 263083 - DNA, 25 bp, Mus musculus
atggacattgccaacaggagcaaat

SEQ ID NO: 263084 - DNA, 25 bp, Mus musculus
atggacattgcctacaggagcaaat

SEQ ID NO: 263085 - DNA, 25 bp, Mus musculus
atggacatttgtaagcacattggct

SEQ ID NO: 263086 - DNA, 25 bp, Mus musculus
atggacatttgttagcacattggct

SEQ ID NO: 263087 - DNA, 25 bp, Mus musculus
atggaccaaacactgagagctgcct

SEQ ID NO: 263088 - DNA, 25 bp, Mus musculus
atggaccaaacagtgagagctgcct

SEQ ID NO: 263089 - DNA, 25 bp, Mus musculus
atggaccaagccatcaaactgcgag

SEQ ID NO: 263090 - DNA, 25 bp, Mus musculus
atggaccaagccttcaaactgcgag

SEQ ID NO: 263091 - DNA, 25 bp, Mus musculus
atggaccaagttatccttctgtctc

SEQ ID NO: 263092 - DNA, 25 bp, Mus musculus
atggaccaagttttccttctgtctc

SEQ ID NO: 263093 - DNA, 25 bp, Mus musculus
atggaccaataaatactccccgtgc

SEQ ID NO: 263094 - DNA, 25 bp, Mus musculus
atggaccaataattactccccgtgc

SEQ ID NO: 263095 - DNA, 25 bp, Mus musculus
atggaccaatggagtgagacttcat

SEQ ID NO: 263096 - DNA, 25 bp, Mus musculus
atggaccaatggtgtgagacttcat

SEQ ID NO: 263097 - DNA, 25 bp, Mus musculus
atggaccacaaacctaggtgcatat

SEQ ID NO: 263098 - DNA, 25 bp, Mus musculus
atggaccacaaagctaggtgcatat

SEQ ID NO: 263099 - DNA, 25 bp, Mus musculus
atggaccacataatgctgcccacat

SEQ ID NO: 263100 - DNA, 25 bp, Mus musculus
atggaccacatattgctgcccacat

SEQ ID NO: 263101 - DNA, 25 bp, Mus musculus
atggaccacgaacctaatgcgcttg

SEQ ID NO: 263102 - DNA, 25 bp, Mus musculus
atggaccacgaagctaatgcgcttg

SEQ ID NO: 263103 - DNA, 25 bp, Mus musculus
atggaccacggacgtctttcaagga

SEQ ID NO: 263104 - DNA, 25 bp, Mus musculus
atggaccacggaggtctttcaagga

SEQ ID NO: 263105 - DNA, 25 bp, Mus musculus
atggaccactgtatcttgcttgtac

SEQ ID NO: 263106 - DNA, 25 bp, Mus musculus
atggaccactgtttcttgcttgtac

SEQ ID NO: 263107 - DNA, 25 bp, Mus musculus
atggaccagagaatcatcaccttaa

SEQ ID NO: 263108 - DNA, 25 bp, Mus musculus
atggaccagagattcatcaccttaa

SEQ ID NO: 263109 - DNA, 25 bp, Mus musculus
atggaccagcacagaggcatgactc

SEQ ID NO: 263110 - DNA, 25 bp, Mus musculus
atggaccagcactgaggcatgactc

SEQ ID NO: 263111 - DNA, 25 bp, Mus musculus
atggaccagcgtcgcggtgtctcca

SEQ ID NO: 263112 - DNA, 25 bp, Mus musculus
atggaccagcgtggcggtgtctcca

SEQ ID NO: 263113 - DNA, 25 bp, Mus musculus
atggaccaggctaatctatcaggct

SEQ ID NO: 263114 - DNA, 25 bp, Mus musculus
atggaccaggcttatctatcaggct

SEQ ID NO: 263115 - DNA, 25 bp, Mus musculus
atggaccatataaaccacttagagt

SEQ ID NO: 263116 - DNA, 25 bp, Mus musculus
atggaccatatataccacttagagt

SEQ ID NO: 263117 - DNA, 25 bp, Mus musculus
atggaccatgagaccctatttcaga

SEQ ID NO: 263118 - DNA, 25 bp, Mus musculus
atggaccatgagtccctatttcaga

SEQ ID NO: 263119 - DNA, 25 bp, Mus musculus
atggacccaaatactgcagcatttc

SEQ ID NO: 263120 - DNA, 25 bp, Mus musculus
atggacccaaattctgcagcatttc

SEQ ID NO: 263121 - DNA, 25 bp, Mus musculus
atggacccaacaatgatgcctttca

SEQ ID NO: 263122 - DNA, 25 bp, Mus musculus
atggacccaacattgatgcctttca

SEQ ID NO: 263123 - DNA, 25 bp, Mus musculus
atggacccacgacttcttcatcaca

SEQ ID NO: 263124 - DNA, 25 bp, Mus musculus
atggacccacgagttcttcatcaca

SEQ ID NO: 263125 - DNA, 25 bp, Mus musculus
atggacccactgcacaaggtgctgt

SEQ ID NO: 263126 - DNA, 25 bp, Mus musculus
atggacccactggacaaggtgctgt

SEQ ID NO: 263127 - DNA, 25 bp, Mus musculus
atggacccaggcagcttgctggtca

SEQ ID NO: 263128 - DNA, 25 bp, Mus musculus
atggacccaggctgcttgctggtca

SEQ ID NO: 263129 - DNA, 25 bp, Mus musculus
atggaccccaaaccactacatacag

SEQ ID NO: 263130 - DNA, 25 bp, Mus musculus
atggaccccaaagcactacatacag

SEQ ID NO: 263131 - DNA, 25 bp, Mus musculus
atggaccccaaccacatgctgaggg

SEQ ID NO: 263132 - DNA, 25 bp, Mus musculus
atggaccccaacgacatgctgaggg

SEQ ID NO: 263133 - DNA, 25 bp, Mus musculus
atggacccctccaggaagctggctg

SEQ ID NO: 263134 - DNA, 25 bp, Mus musculus
atggacccctcctggaagctggctg

SEQ ID NO: 263135 - DNA, 25 bp, Mus musculus
atggaccctgaaaggaaactgagga

SEQ ID NO: 263136 - DNA, 25 bp, Mus musculus
atggaccctgaaatctctgaacaag

SEQ ID NO: 263137 - DNA, 25 bp, Mus musculus
atggaccctgaacagttatttgaac

SEQ ID NO: 263138 - DNA, 25 bp, Mus musculus
atggaccctgaagagttatttgaac

SEQ ID NO: 263139 - DNA, 25 bp, Mus musculus
atggaccctgaatggaaactgagga

SEQ ID NO: 263140 - DNA, 25 bp, Mus musculus
atggaccctgaattctctgaacaag

SEQ ID NO: 263141 - DNA, 25 bp, Mus musculus
atggaccctggaaggtgactgcgca

SEQ ID NO: 263142 - DNA, 25 bp, Mus musculus
atggaccctggatggtgactgcgca

SEQ ID NO: 263143 - DNA, 25 bp, Mus musculus
atggacccttttccagacgacttga

SEQ ID NO: 263144 - DNA, 25 bp, Mus musculus
atggacccttttgcagacgacttga

SEQ ID NO: 263145 - DNA, 25 bp, Mus musculus
atggaccgagtaaccccgcagtgag

SEQ ID NO: 263146 - DNA, 25 bp, Mus musculus
atggaccgagtatccccgcagtgag

SEQ ID NO: 263147 - DNA, 25 bp, Mus musculus
atggaccggagaaccctggagccac

SEQ ID NO: 263148 - DNA, 25 bp, Mus musculus
atggaccggagatccctggagccac

SEQ ID NO: 263149 - DNA, 25 bp, Mus musculus
atggaccgttgaagcacacgtgtga

SEQ ID NO: 263150 - DNA, 25 bp, Mus musculus
atggaccgttgatgcacacgtgtga

SEQ ID NO: 263151 - DNA, 25 bp, Mus musculus
atggacctaagccacagtgtgcact

SEQ ID NO: 263152 - DNA, 25 bp, Mus musculus
atggacctaagcgacagtgtgcact

SEQ ID NO: 263153 - DNA, 25 bp, Mus musculus
atggacctactgcaaaagataatta

SEQ ID NO: 263154 - DNA, 25 bp, Mus musculus
atggacctactggaaaagataatta

SEQ ID NO: 263155 - DNA, 25 bp, Mus musculus
atggacctagctaaaggcgatttta

SEQ ID NO: 263156 - DNA, 25 bp, Mus musculus
atggacctagcttaaggcgatttta

SEQ ID NO: 263157 - DNA, 25 bp, Mus musculus
atggacctatcaccgtgaccatcaa

SEQ ID NO: 263158 - DNA, 25 bp, Mus musculus
atggacctatcagcgtgaccatcaa

SEQ ID NO: 263159 - DNA, 25 bp, Mus musculus
atggacctcaaacccttgttgctgg

SEQ ID NO: 263160 - DNA, 25 bp, Mus musculus
atggacctcaaagccttgttgctgg

SEQ ID NO: 263161 - DNA, 25 bp, Mus musculus
atggacctcaagaagactgctcctt

SEQ ID NO: 263162 - DNA, 25 bp, Mus musculus
atggacctcaagtagactgctcctt

SEQ ID NO: 263163 - DNA, 25 bp, Mus musculus
atggacctcagcacggtcaaaagga

SEQ ID NO: 263164 - DNA, 25 bp, Mus musculus
atggacctcagctcggtcaaaagga

SEQ ID NO: 263165 - DNA, 25 bp, Mus musculus
atggacctccacatcagactcggag

SEQ ID NO: 263166 - DNA, 25 bp, Mus musculus
atggacctccacttcagactcggag

SEQ ID NO: 263167 - DNA, 25 bp, Mus musculus
atggacctcctacaatgaagacaag

SEQ ID NO: 263168 - DNA, 25 bp, Mus musculus
atggacctcctagaatgaagacaag

SEQ ID NO: 263169 - DNA, 25 bp, Mus musculus
atggacctcgttatttgctgtttgt

SEQ ID NO: 263170 - DNA, 25 bp, Mus musculus
atggacctcgttttttgctgtttgt

SEQ ID NO: 263171 - DNA, 25 bp, Mus musculus
atggacctctagctggaaagatcta

SEQ ID NO: 263172 - DNA, 25 bp, Mus musculus
atggacctctaggtggaaagatcta

SEQ ID NO: 263173 - DNA, 25 bp, Mus musculus
atggacctctgccagacaagctgca

SEQ ID NO: 263174 - DNA, 25 bp, Mus musculus
atggacctctgcgagacaagctgca

SEQ ID NO: 263175 - DNA, 25 bp, Mus musculus
atggacctgattcgtagtagaactg

SEQ ID NO: 263176 - DNA, 25 bp, Mus musculus
atggacctgattggtagtagaactg

SEQ ID NO: 263177 - DNA, 25 bp, Mus musculus
atggacctgcagagggcatctcgaa

SEQ ID NO: 263178 - DNA, 25 bp, Mus musculus
atggacctgcagtgggcatctcgaa

SEQ ID NO: 263179 - DNA, 25 bp, Mus musculus
atggacctggaacactgtgcactct

SEQ ID NO: 263180 - DNA, 25 bp, Mus musculus
atggacctggaagactgtgcactct

SEQ ID NO: 263181 - DNA, 25 bp, Mus musculus
atggacctgtacatcacgctgacca

SEQ ID NO: 263182 - DNA, 25 bp, Mus musculus
atggacctgtacttcacgctgacca

SEQ ID NO: 263183 - DNA, 25 bp, Mus musculus
atggacctgtgcagttcaggcatct

SEQ ID NO: 263184 - DNA, 25 bp, Mus musculus
atggacctgtgctgttcaggcatct

SEQ ID NO: 263185 - DNA, 25 bp, Mus musculus
atggaccttagtctatgacatcaga

SEQ ID NO: 263186 - DNA, 25 bp, Mus musculus
atggaccttagtgtatgacatcaga

SEQ ID NO: 263187 - DNA, 25 bp, Mus musculus
atggaccttgtcaatagtaacgaaa

SEQ ID NO: 263188 - DNA, 25 bp, Mus musculus
atggaccttgtctatagtaacgaaa

SEQ ID NO: 263189 - DNA, 25 bp, Mus musculus
atggacctttggacagacttagttt

SEQ ID NO: 263190 - DNA, 25 bp, Mus musculus
atggacctttggtcagacttagttt

SEQ ID NO: 263191 - DNA, 25 bp, Mus musculus
atggaccttttgagatgtaattatt

SEQ ID NO: 263192 - DNA, 25 bp, Mus musculus
atggaccttttgtgatgtaattatt

SEQ ID NO: 263193 - DNA, 25 bp, Mus musculus
atggacgacaatcgcacctacgagt

SEQ ID NO: 263194 - DNA, 25 bp, Mus musculus
atggacgacaatggcacctacgagt

SEQ ID NO: 263195 - DNA, 25 bp, Mus musculus
atggacgacacacagaccccagagc

SEQ ID NO: 263196 - DNA, 25 bp, Mus musculus
atggacgacacagagaccccagagc

SEQ ID NO: 263197 - DNA, 25 bp, Mus musculus
atggacgacatgacgcccaggctga

SEQ ID NO: 263198 - DNA, 25 bp, Mus musculus
atggacgacatgtcgcccaggctga

SEQ ID NO: 263199 - DNA, 25 bp, Mus musculus
atggacgacctgctgacctcatatg

SEQ ID NO: 263200 - DNA, 25 bp, Mus musculus
atggacgacctggtgacctcatatg

SEQ ID NO: 263201 - DNA, 25 bp, Mus musculus
atggacgaggacatacccgatgacg

SEQ ID NO: 263202 - DNA, 25 bp, Mus musculus
atggacgaggacttacccgatgacg

SEQ ID NO: 263203 - DNA, 25 bp, Mus musculus
atggacgcacgtaggcccaaaaaca

SEQ ID NO: 263204 - DNA, 25 bp, Mus musculus
atggacgcacgttggcccaaaaaca

SEQ ID NO: 263205 - DNA, 25 bp, Mus musculus
atggacgccccacaaggaccacggg

SEQ ID NO: 263206 - DNA, 25 bp, Mus musculus
atggacgccccagaaggaccacggg

SEQ ID NO: 263207 - DNA, 25 bp, Mus musculus
atggacgcctgactcatttcctggg

SEQ ID NO: 263208 - DNA, 25 bp, Mus musculus
atggacgcctgagtcatttcctggg

SEQ ID NO: 263209 - DNA, 25 bp, Mus musculus
atggacgcgagccacaagctgcact

SEQ ID NO: 263210 - DNA, 25 bp, Mus musculus
atggacgcgagcgacaagctgcact

SEQ ID NO: 263211 - DNA, 25 bp, Mus musculus
atggacgcgatcagtcatgacctcc

SEQ ID NO: 263212 - DNA, 25 bp, Mus musculus
atggacgcgatctgtcatgacctcc

SEQ ID NO: 263213 - DNA, 25 bp, Mus musculus
atggacgctgcgagaatcctcagaa

SEQ ID NO: 263214 - DNA, 25 bp, Mus musculus
atggacgctgcgtgaatcctcagaa

SEQ ID NO: 263215 - DNA, 25 bp, Mus musculus
atggacgctggaagactgtcaaccg

SEQ ID NO: 263216 - DNA, 25 bp, Mus musculus
atggacgctggatgactgtcaaccg

SEQ ID NO: 263217 - DNA, 25 bp, Mus musculus
atggacggagtgcattctccttgaa

SEQ ID NO: 263218 - DNA, 25 bp, Mus musculus
atggacggagtggattctccttgaa

SEQ ID NO: 263219 - DNA, 25 bp, Mus musculus
atggacggcatactctttcaggctc

SEQ ID NO: 263220 - DNA, 25 bp, Mus musculus
atggacggcatagtctttcaggctc

SEQ ID NO: 263221 - DNA, 25 bp, Mus musculus
atggacgggtgcagtctactggcct

SEQ ID NO: 263222 - DNA, 25 bp, Mus musculus
atggacgggtgctgtctactggcct

SEQ ID NO: 263223 - DNA, 25 bp, Mus musculus
atggacgtaactacaaaggccttgg

SEQ ID NO: 263224 - DNA, 25 bp, Mus musculus
atggacgtaacttcaaaggccttgg

SEQ ID NO: 263225 - DNA, 25 bp, Mus musculus
atggacgtcaacactgctctacaag

SEQ ID NO: 263226 - DNA, 25 bp, Mus musculus
atggacgtcaactctgctctacaag

SEQ ID NO: 263227 - DNA, 25 bp, Mus musculus
atggacgtcctcctctgcaacgggc

SEQ ID NO: 263228 - DNA, 25 bp, Mus musculus
atggacgtcctcgtctgcaacgggc

SEQ ID NO: 263229 - DNA, 25 bp, Mus musculus
atggacgtggtcaacgcgctcaagc

SEQ ID NO: 263230 - DNA, 25 bp, Mus musculus
atggacgtggtctacgcgctcaagc

SEQ ID NO: 263231 - DNA, 25 bp, Mus musculus
atggacgtgtttctcatgatccggc

SEQ ID NO: 263232 - DNA, 25 bp, Mus musculus
atggacgtgtttgtcatgatccggc

SEQ ID NO: 263233 - DNA, 25 bp, Mus musculus
atggacgttgtcatgctcagctgag

SEQ ID NO: 263234 - DNA, 25 bp, Mus musculus
atggacgttgtcttgctcagctgag

SEQ ID NO: 263235 - DNA, 25 bp, Mus musculus
atggactaagtgaggcagccgctca

SEQ ID NO: 263236 - DNA, 25 bp, Mus musculus
atggactaagtgtggcagccgctca

SEQ ID NO: 263237 - DNA, 25 bp, Mus musculus
atggactaatgcagtgttcgacatt

SEQ ID NO: 263238 - DNA, 25 bp, Mus musculus
atggactaatgctgtgttcgacatt

SEQ ID NO: 263239 - DNA, 25 bp, Mus musculus
atggactacgagcacccacgtcata

SEQ ID NO: 263240 - DNA, 25 bp, Mus musculus
atggactacgaggacccacgtcata

SEQ ID NO: 263241 - DNA, 25 bp, Mus musculus
atggactatcataagcctccttcaa

SEQ ID NO: 263242 - DNA, 25 bp, Mus musculus
atggactatcattagcctccttcaa

SEQ ID NO: 263243 - DNA, 25 bp, Mus musculus
atggactatgacaagggcaagcctt

SEQ ID NO: 263244 - DNA, 25 bp, Mus musculus
atggactatgactagggcaagcctt

SEQ ID NO: 263245 - DNA, 25 bp, Mus musculus
atggactatgcacagctctacctat

SEQ ID NO: 263246 - DNA, 25 bp, Mus musculus
atggactatgcagagctctacctat

SEQ ID NO: 263247 - DNA, 25 bp, Mus musculus
atggactcaaagattcaggaggcca

SEQ ID NO: 263248 - DNA, 25 bp, Mus musculus
atggactcaaagtttcaggaggcca

SEQ ID NO: 263249 - DNA, 25 bp, Mus musculus
atggactcaaccatcaaggccccat

SEQ ID NO: 263250 - DNA, 25 bp, Mus musculus
atggactcaaccttcaaggccccat

SEQ ID NO: 263251 - DNA, 25 bp, Mus musculus
atggactcaccaatggaattgtaat

SEQ ID NO: 263252 - DNA, 25 bp, Mus musculus
atggactcaccattggaattgtaat

SEQ ID NO: 263253 - DNA, 25 bp, Mus musculus
atggactcactgatgcccctctggg

SEQ ID NO: 263254 - DNA, 25 bp, Mus musculus
atggactcactgttgcccctctggg

SEQ ID NO: 263255 - DNA, 25 bp, Mus musculus
atggactcagccaggaatctatgga

SEQ ID NO: 263256 - DNA, 25 bp, Mus musculus
atggactcagcctggaatctatgga

SEQ ID NO: 263257 - DNA, 25 bp, Mus musculus
atggactcagctcgatatgttttac

SEQ ID NO: 263258 - DNA, 25 bp, Mus musculus
atggactcagctggatatgttttac

SEQ ID NO: 263259 - DNA, 25 bp, Mus musculus
atggactcatctattggttgcgtgc

SEQ ID NO: 263260 - DNA, 25 bp, Mus musculus
atggactcatcttttggttgcgtgc

SEQ ID NO: 263261 - DNA, 25 bp, Mus musculus
atggactccaaacacattgcactca

SEQ ID NO: 263262 - DNA, 25 bp, Mus musculus
atggactccaaagacattgcactca

SEQ ID NO: 263263 - DNA, 25 bp, Mus musculus
atggactccaggcaatttgaacaaa

SEQ ID NO: 263264 - DNA, 25 bp, Mus musculus
atggactccagggaatttgaacaaa

SEQ ID NO: 263265 - DNA, 25 bp, Mus musculus
atggactcccatccttttttgatat

SEQ ID NO: 263266 - DNA, 25 bp, Mus musculus
atggactcccatgcttttttgatat

SEQ ID NO: 263267 - DNA, 25 bp, Mus musculus
atggactcctaccacattgtgttgg

SEQ ID NO: 263268 - DNA, 25 bp, Mus musculus
atggactcctacgacattgtgttgg

SEQ ID NO: 263269 - DNA, 25 bp, Mus musculus
atggactcctctcgaaacttagcca

SEQ ID NO: 263270 - DNA, 25 bp, Mus musculus
atggactcctctggaaacttagcca

SEQ ID NO: 263271 - DNA, 25 bp, Mus musculus
atggactccttcctcagattaactt

SEQ ID NO: 263272 - DNA, 25 bp, Mus musculus
atggactccttcgtcagattaactt

SEQ ID NO: 263273 - DNA, 25 bp, Mus musculus
atggactctcctaacataacatgtt

SEQ ID NO: 263274 - DNA, 25 bp, Mus musculus
atggactctccttacataacatgtt

SEQ ID NO: 263275 - DNA, 25 bp, Mus musculus
atggactctgatcttaactccccac

SEQ ID NO: 263276 - DNA, 25 bp, Mus musculus
atggactctgatgttaactccccac

SEQ ID NO: 263277 - DNA, 25 bp, Mus musculus
atggactctgtaccttcgtcatctg

SEQ ID NO: 263278 - DNA, 25 bp, Mus musculus
atggactctgtagcttcgtcatctg

SEQ ID NO: 263279 - DNA, 25 bp, Mus musculus
atggactcttcaagtcaacttctac

SEQ ID NO: 263280 - DNA, 25 bp, Mus musculus
atggactcttcatgtcaacttctac

SEQ ID NO: 263281 - DNA, 25 bp, Mus musculus
atggactctttacacattccctcat

SEQ ID NO: 263282 - DNA, 25 bp, Mus musculus
atggactctttagacattccctcat

SEQ ID NO: 263283 - DNA, 25 bp, Mus musculus
atggactgaaagctcggccccagga

SEQ ID NO: 263284 - DNA, 25 bp, Mus musculus
atggactgaaaggtcggccccagga

SEQ ID NO: 263285 - DNA, 25 bp, Mus musculus
atggactgaagaactgggaagttaa

SEQ ID NO: 263286 - DNA, 25 bp, Mus musculus
atggactgaagatctgggaagttaa

SEQ ID NO: 263287 - DNA, 25 bp, Mus musculus
atggactgaccgcaaatccgtatct

SEQ ID NO: 263288 - DNA, 25 bp, Mus musculus
atggactgaccggaaatccgtatct

SEQ ID NO: 263289 - DNA, 25 bp, Mus musculus
atggactgactgcagatcacgagaa

SEQ ID NO: 263290 - DNA, 25 bp, Mus musculus
atggactgactggagatcacgagaa

SEQ ID NO: 263291 - DNA, 25 bp, Mus musculus
atggactgatgaacttacgactcaa

SEQ ID NO: 263292 - DNA, 25 bp, Mus musculus
atggactgatgatcttacgactcaa

SEQ ID NO: 263293 - DNA, 25 bp, Mus musculus
atggactgcagcacgcttggattgc

SEQ ID NO: 263294 - DNA, 25 bp, Mus musculus
atggactgcagctcgcttggattgc

SEQ ID NO: 263295 - DNA, 25 bp, Mus musculus
atggactgcatgcacttattcagca

SEQ ID NO: 263296 - DNA, 25 bp, Mus musculus
atggactgcatggacttattcagca

SEQ ID NO: 263297 - DNA, 25 bp, Mus musculus
atggactggagacctggcagctttt

SEQ ID NO: 263298 - DNA, 25 bp, Mus musculus
atggactggagagctggcagctttt

SEQ ID NO: 263299 - DNA, 25 bp, Mus musculus
atggactgggagactccttcagcca

SEQ ID NO: 263300 - DNA, 25 bp, Mus musculus
atggactgggagtctccttcagcca

SEQ ID NO: 263301 - DNA, 25 bp, Mus musculus
atggactgggtcactctaggactgc

SEQ ID NO: 263302 - DNA, 25 bp, Mus musculus
atggactgggtctctctaggactgc

SEQ ID NO: 263303 - DNA, 25 bp, Mus musculus
atggactgtatcattacatacgatg

SEQ ID NO: 263304 - DNA, 25 bp, Mus musculus
atggactgtatctttacatacgatg

SEQ ID NO: 263305 - DNA, 25 bp, Mus musculus
atggactgtattaagtgcgcttgaa

SEQ ID NO: 263306 - DNA, 25 bp, Mus musculus
atggactgtatttagtgcgcttgaa

SEQ ID NO: 263307 - DNA, 25 bp, Mus musculus
atggactgtcatcctctatgcctgg

SEQ ID NO: 263308 - DNA, 25 bp, Mus musculus
atggactgtcatgctctatgcctgg

SEQ ID NO: 263309 - DNA, 25 bp, Mus musculus
atggactgtgtgctccagttttgtt

SEQ ID NO: 263310 - DNA, 25 bp, Mus musculus
atggactgtgtggtccagttttgtt

SEQ ID NO: 263311 - DNA, 25 bp, Mus musculus
atggacttagccatgtatgctgcta

SEQ ID NO: 263312 - DNA, 25 bp, Mus musculus
atggacttagccttgtatgctgcta

SEQ ID NO: 263313 - DNA, 25 bp, Mus musculus
atggacttcaagactcgcagggtct

SEQ ID NO: 263314 - DNA, 25 bp, Mus musculus
atggacttcaagtctcgcagggtct

SEQ ID NO: 263315 - DNA, 25 bp, Mus musculus
atggacttcacgcttttctacagag

SEQ ID NO: 263316 - DNA, 25 bp, Mus musculus
atggacttcacggttttctacagag

SEQ ID NO: 263317 - DNA, 25 bp, Mus musculus
atggacttcagtaagctcttcagcg

SEQ ID NO: 263318 - DNA, 25 bp, Mus musculus
atggacttcagttagctcttcagcg

SEQ ID NO: 263319 - DNA, 25 bp, Mus musculus
atggacttcatacatgctctaagaa

SEQ ID NO: 263320 - DNA, 25 bp, Mus musculus
atggacttcatagatgctctaagaa

SEQ ID NO: 263321 - DNA, 25 bp, Mus musculus
atggacttcattagctgagctccct

SEQ ID NO: 263322 - DNA, 25 bp, Mus musculus
atggacttcatttgctgagctccct

SEQ ID NO: 263323 - DNA, 25 bp, Mus musculus
atggacttccacctggcgtggcttc

SEQ ID NO: 263324 - DNA, 25 bp, Mus musculus
atggacttccacgtggcgtggcttc

SEQ ID NO: 263325 - DNA, 25 bp, Mus musculus
atggacttctatcttcttcttgttt

SEQ ID NO: 263326 - DNA, 25 bp, Mus musculus
atggacttctatgttcttcttgttt

SEQ ID NO: 263327 - DNA, 25 bp, Mus musculus
atggacttctctcgacagtcagcac

SEQ ID NO: 263328 - DNA, 25 bp, Mus musculus
atggacttctctggacagtcagcac

SEQ ID NO: 263329 - DNA, 25 bp, Mus musculus
atggacttctgaactaaagagtatt

SEQ ID NO: 263330 - DNA, 25 bp, Mus musculus
atggacttctgatctaaagagtatt

SEQ ID NO: 263331 - DNA, 25 bp, Mus musculus
atggacttctggcaaacgcgctcac

SEQ ID NO: 263332 - DNA, 25 bp, Mus musculus
atggacttctgggaaacgcgctcac

SEQ ID NO: 263333 - DNA, 25 bp, Mus musculus
atggacttcttcatgtctccatgct

SEQ ID NO: 263334 - DNA, 25 bp, Mus musculus
atggacttcttcttgtctccatgct

SEQ ID NO: 263335 - DNA, 25 bp, Mus musculus
atggacttgaatacctatggtgaca

SEQ ID NO: 263336 - DNA, 25 bp, Mus musculus
atggacttgaattcctatggtgaca

SEQ ID NO: 263337 - DNA, 25 bp, Mus musculus
atggacttgagaatggctgcaggaa

SEQ ID NO: 263338 - DNA, 25 bp, Mus musculus
atggacttgagattggctgcaggaa

SEQ ID NO: 263339 - DNA, 25 bp, Mus musculus
atggacttgcggacactctgtgctt

SEQ ID NO: 263340 - DNA, 25 bp, Mus musculus
atggacttgcggtcactctgtgctt

SEQ ID NO: 263341 - DNA, 25 bp, Mus musculus
atggacttggcaaacctgcggagct

SEQ ID NO: 263342 - DNA, 25 bp, Mus musculus
atggacttggcatacctgcggagct

SEQ ID NO: 263343 - DNA, 25 bp, Mus musculus
atggacttggctcatcttgtcaaag

SEQ ID NO: 263344 - DNA, 25 bp, Mus musculus
atggacttggctgatcttgtcaaag

SEQ ID NO: 263345 - DNA, 25 bp, Mus musculus
atggacttgtttctgtggttcagca

SEQ ID NO: 263346 - DNA, 25 bp, Mus musculus
atggacttgtttgtgtggttcagca

SEQ ID NO: 263347 - DNA, 25 bp, Mus musculus
atggactttaccactgagaaatcaa

SEQ ID NO: 263348 - DNA, 25 bp, Mus musculus
atggactttacctctgagaaatcaa

SEQ ID NO: 263349 - DNA, 25 bp, Mus musculus
atggactttggtatagggctagact

SEQ ID NO: 263350 - DNA, 25 bp, Mus musculus
atggactttggtttagggctagact

SEQ ID NO: 263351 - DNA, 25 bp, Mus musculus
atggactttgtaaggcatgctaaaa

SEQ ID NO: 263352 - DNA, 25 bp, Mus musculus
atggactttgtatggcatgctaaaa

SEQ ID NO: 263353 - DNA, 25 bp, Mus musculus
atggagaaaaccctgctggaagcag

SEQ ID NO: 263354 - DNA, 25 bp, Mus musculus
atggagaaaaccgtgctggaagcag

SEQ ID NO: 263355 - DNA, 25 bp, Mus musculus
atggagaaacatccctgtgctacag

SEQ ID NO: 263356 - DNA, 25 bp, Mus musculus
atggagaaacatgcctgtgctacag

SEQ ID NO: 263357 - DNA, 25 bp, Mus musculus
atggagaaaccgacacaaagctttt

SEQ ID NO: 263358 - DNA, 25 bp, Mus musculus
atggagaaaccgtcacaaagctttt

SEQ ID NO: 263359 - DNA, 25 bp, Mus musculus
atggagaaagcaaggccccttgccg

SEQ ID NO: 263360 - DNA, 25 bp, Mus musculus
atggagaaagcatggccccttgccg

SEQ ID NO: 263361 - DNA, 25 bp, Mus musculus
atggagaaagtgatcccctgactct

SEQ ID NO: 263362 - DNA, 25 bp, Mus musculus
atggagaaagtgttcccctgactct

SEQ ID NO: 263363 - DNA, 25 bp, Mus musculus
atggagaaccttaacacgggcattt

SEQ ID NO: 263364 - DNA, 25 bp, Mus musculus
atggagaacctttacacgggcattt

SEQ ID NO: 263365 - DNA, 25 bp, Mus musculus
atggagaacgcgatgtggcctttgc

SEQ ID NO: 263366 - DNA, 25 bp, Mus musculus
atggagaacgcgttgtggcctttgc

SEQ ID NO: 263367 - DNA, 25 bp, Mus musculus
atggagaactccctttaccagcagc

SEQ ID NO: 263368 - DNA, 25 bp, Mus musculus
atggagaactccgtttaccagcagc

SEQ ID NO: 263369 - DNA, 25 bp, Mus musculus
atggagaactgacacccttagagac

SEQ ID NO: 263370 - DNA, 25 bp, Mus musculus
atggagaactgagacccttagagac

SEQ ID NO: 263371 - DNA, 25 bp, Mus musculus
atggagaaggacacttaccctcgct

SEQ ID NO: 263372 - DNA, 25 bp, Mus musculus
atggagaaggactcttaccctcgct

SEQ ID NO: 263373 - DNA, 25 bp, Mus musculus
atggagaatgtgaccagagttcggc

SEQ ID NO: 263374 - DNA, 25 bp, Mus musculus
atggagaatgtgtccagagttcggc

SEQ ID NO: 263375 - DNA, 25 bp, Mus musculus
atggagacacccacattgtggtcaa

SEQ ID NO: 263376 - DNA, 25 bp, Mus musculus
atggagacaccctcattgtggtcaa

SEQ ID NO: 263377 - DNA, 25 bp, Mus musculus
atggagacactccaaggagcctctc

SEQ ID NO: 263378 - DNA, 25 bp, Mus musculus
atggagacactcgaaggagcctctc

SEQ ID NO: 263379 - DNA, 25 bp, Mus musculus
atggagacaggaatgtcccaaccct

SEQ ID NO: 263380 - DNA, 25 bp, Mus musculus
atggagacaggattgtcccaaccct

SEQ ID NO: 263381 - DNA, 25 bp, Mus musculus
atggagaccaacatctgcagaacct

SEQ ID NO: 263382 - DNA, 25 bp, Mus musculus
atggagaccaacttctgcagaacct

SEQ ID NO: 263383 - DNA, 25 bp, Mus musculus
atggagaccacaaagcagcgacaag

SEQ ID NO: 263384 - DNA, 25 bp, Mus musculus
atggagaccacatagcagcgacaag

SEQ ID NO: 263385 - DNA, 25 bp, Mus musculus
atggagaccaccagtgccagttgct

SEQ ID NO: 263386 - DNA, 25 bp, Mus musculus
atggagaccacctgtgccagttgct

SEQ ID NO: 263387 - DNA, 25 bp, Mus musculus
atggagaccactccatgacttccga

SEQ ID NO: 263388 - DNA, 25 bp, Mus musculus
atggagaccactgcatgacttccga

SEQ ID NO: 263389 - DNA, 25 bp, Mus musculus
atggagaccagcagtcggaggacat

SEQ ID NO: 263390 - DNA, 25 bp, Mus musculus
atggagaccagctgtcggaggacat

SEQ ID NO: 263391 - DNA, 25 bp, Mus musculus
atggagacctcgctggccagtagtc

SEQ ID NO: 263392 - DNA, 25 bp, Mus musculus
atggagacctcggtggccagtagtc

SEQ ID NO: 263393 - DNA, 25 bp, Mus musculus
atggagacgcccatccagcgcgaaa

SEQ ID NO: 263394 - DNA, 25 bp, Mus musculus
atggagacgcccttccagcgcgaaa

SEQ ID NO: 263395 - DNA, 25 bp, Mus musculus
atggagactagcaacgcggtacaca

SEQ ID NO: 263396 - DNA, 25 bp, Mus musculus
atggagactagctacgcggtacaca

SEQ ID NO: 263397 - DNA, 25 bp, Mus musculus
atggagactatcctgctgtggctca

SEQ ID NO: 263398 - DNA, 25 bp, Mus musculus
atggagactatcgtgctgtggctca

SEQ ID NO: 263399 - DNA, 25 bp, Mus musculus
atggagactccacggccggtcgtaa

SEQ ID NO: 263400 - DNA, 25 bp, Mus musculus
atggagactccagggccggtcgtaa

SEQ ID NO: 263401 - DNA, 25 bp, Mus musculus
atggagactctcaagggctttgcgt

SEQ ID NO: 263402 - DNA, 25 bp, Mus musculus
atggagactctcatttgctcctgaa

SEQ ID NO: 263403 - DNA, 25 bp, Mus musculus
atggagactctctagggctttgcgt

SEQ ID NO: 263404 - DNA, 25 bp, Mus musculus
atggagactctcttttgctcctgaa

SEQ ID NO: 263405 - DNA, 25 bp, Mus musculus
atggagactgcaaccggatcactga

SEQ ID NO: 263406 - DNA, 25 bp, Mus musculus
atggagactgcatccggatcactga

SEQ ID NO: 263407 - DNA, 25 bp, Mus musculus
atggagactgtaatgttgtttcctc

SEQ ID NO: 263408 - DNA, 25 bp, Mus musculus
atggagactgtattgttgtttcctc

SEQ ID NO: 263409 - DNA, 25 bp, Mus musculus
atggagactgtgcagcagctacctc

SEQ ID NO: 263410 - DNA, 25 bp, Mus musculus
atggagactgtggagcagctacctc

SEQ ID NO: 263411 - DNA, 25 bp, Mus musculus
atggagacttccaggaggtcccaga

SEQ ID NO: 263412 - DNA, 25 bp, Mus musculus
atggagacttcctggaggtcccaga

SEQ ID NO: 263413 - DNA, 25 bp, Mus musculus
atggagagaactactcagaagctac

SEQ ID NO: 263414 - DNA, 25 bp, Mus musculus
atggagagaactcccttggtggtaa

SEQ ID NO: 263415 - DNA, 25 bp, Mus musculus
atggagagaactgccttggtggtaa

SEQ ID NO: 263416 - DNA, 25 bp, Mus musculus
atggagagaacttctcagaagctac

SEQ ID NO: 263417 - DNA, 25 bp, Mus musculus
atggagagaccccaggtacacctgt

SEQ ID NO: 263418 - DNA, 25 bp, Mus musculus
atggagagacccgaggtacacctgt

SEQ ID NO: 263419 - DNA, 25 bp, Mus musculus
atggagagagcacgacccctggtct

SEQ ID NO: 263420 - DNA, 25 bp, Mus musculus
atggagagagcaggacccctggtct

SEQ ID NO: 263421 - DNA, 25 bp, Mus musculus
atggagagcattaagcataagcctt

SEQ ID NO: 263422 - DNA, 25 bp, Mus musculus
atggagagcatttagcataagcctt

SEQ ID NO: 263423 - DNA, 25 bp, Mus musculus
atggagagcctgaggcagttcacaa

SEQ ID NO: 263424 - DNA, 25 bp, Mus musculus
atggagagcctgtggcagttcacaa

SEQ ID NO: 263425 - DNA, 25 bp, Mus musculus
atggagagccttcttgtccaactag

SEQ ID NO: 263426 - DNA, 25 bp, Mus musculus
atggagagccttgttgtccaactag

SEQ ID NO: 263427 - DNA, 25 bp, Mus musculus
atggagagctccacacattttgcta

SEQ ID NO: 263428 - DNA, 25 bp, Mus musculus
atggagagctccactcacgcagaga

SEQ ID NO: 263429 - DNA, 25 bp, Mus musculus
atggagagctcctcacattttgcta

SEQ ID NO: 263430 - DNA, 25 bp, Mus musculus
atggagagctcctctcacgcagaga

SEQ ID NO: 263431 - DNA, 25 bp, Mus musculus
atggagagcttcactgggtaccagt

SEQ ID NO: 263432 - DNA, 25 bp, Mus musculus
atggagagcttctctgggtaccagt

SEQ ID NO: 263433 - DNA, 25 bp, Mus musculus
atggagaggagacagtccatcttct

SEQ ID NO: 263434 - DNA, 25 bp, Mus musculus
atggagaggagagagtccatcttct

SEQ ID NO: 263435 - DNA, 25 bp, Mus musculus
atggagaggagccttcgggcagaga

SEQ ID NO: 263436 - DNA, 25 bp, Mus musculus
atggagaggagcgttcgggcagaga

SEQ ID NO: 263437 - DNA, 25 bp, Mus musculus
atggagaggcccatcccaaagtatt

SEQ ID NO: 263438 - DNA, 25 bp, Mus musculus
atggagaggcccttcccaaagtatt

SEQ ID NO: 263439 - DNA, 25 bp, Mus musculus
atggagaggttcacagccaccaaga

SEQ ID NO: 263440 - DNA, 25 bp, Mus musculus
atggagaggttctcagccaccaaga

SEQ ID NO: 263441 - DNA, 25 bp, Mus musculus
atggagatccatactcatcctcaca

SEQ ID NO: 263442 - DNA, 25 bp, Mus musculus
atggagatccattctcatcctcaca

SEQ ID NO: 263443 - DNA, 25 bp, Mus musculus
atggagatccctactgggtgaacct

SEQ ID NO: 263444 - DNA, 25 bp, Mus musculus
atggagatcccttctgggtgaacct

SEQ ID NO: 263445 - DNA, 25 bp, Mus musculus
atggagatcctcatcattcatcgga

SEQ ID NO: 263446 - DNA, 25 bp, Mus musculus
atggagatcctcttcattcatcgga

SEQ ID NO: 263447 - DNA, 25 bp, Mus musculus
atggagatctagctgctgaggctat

SEQ ID NO: 263448 - DNA, 25 bp, Mus musculus
atggagatctaggtgctgaggctat

SEQ ID NO: 263449 - DNA, 25 bp, Mus musculus
atggagatctctctttatcaaaagc

SEQ ID NO: 263450 - DNA, 25 bp, Mus musculus
atggagatctctgtttatcaaaagc

SEQ ID NO: 263451 - DNA, 25 bp, Mus musculus
atggagatctgacccctgggtgtcc

SEQ ID NO: 263452 - DNA, 25 bp, Mus musculus
atggagatctgagccctgggtgtcc

SEQ ID NO: 263453 - DNA, 25 bp, Mus musculus
atggagatgactatcccttgcggga

SEQ ID NO: 263454 - DNA, 25 bp, Mus musculus
atggagatgactttcccttgcggga

SEQ ID NO: 263455 - DNA, 25 bp, Mus musculus
atggagattaatacccacatcacac

SEQ ID NO: 263456 - DNA, 25 bp, Mus musculus
atggagattaattcccacatcacac

SEQ ID NO: 263457 - DNA, 25 bp, Mus musculus
atggagattatgattcccagacctc

SEQ ID NO: 263458 - DNA, 25 bp, Mus musculus
atggagattatgtttcccagacctc

SEQ ID NO: 263459 - DNA, 25 bp, Mus musculus
atggagattcgaattccgtgtcaga

SEQ ID NO: 263460 - DNA, 25 bp, Mus musculus
atggagattcgatttccgtgtcaga

SEQ ID NO: 263461 - DNA, 25 bp, Mus musculus
atggagattgcaaggctgcgtgctc

SEQ ID NO: 263462 - DNA, 25 bp, Mus musculus
atggagattgcatggctgcgtgctc

SEQ ID NO: 263463 - DNA, 25 bp, Mus musculus
atggagattgttccaggacctacgt

SEQ ID NO: 263464 - DNA, 25 bp, Mus musculus
atggagattgttgcaggacctacgt

SEQ ID NO: 263465 - DNA, 25 bp, Mus musculus
atggagatttctctgtacccgagtt

SEQ ID NO: 263466 - DNA, 25 bp, Mus musculus
atggagatttctgtgtacccgagtt

SEQ ID NO: 263467 - DNA, 25 bp, Mus musculus
atggagattttaaaggttcagacaa

SEQ ID NO: 263468 - DNA, 25 bp, Mus musculus
atggagattttataggttcagacaa

SEQ ID NO: 263469 - DNA, 25 bp, Mus musculus
atggagcaaagtctgtagtctgaaa

SEQ ID NO: 263470 - DNA, 25 bp, Mus musculus
atggagcaaagtgtgtagtctgaaa

SEQ ID NO: 263471 - DNA, 25 bp, Mus musculus
atggagcaactgacccatgatgctg

SEQ ID NO: 263472 - DNA, 25 bp, Mus musculus
atggagcaactgtcccatgatgctg

SEQ ID NO: 263473 - DNA, 25 bp, Mus musculus
atggagcaatctcgcagtgcagtgg

SEQ ID NO: 263474 - DNA, 25 bp, Mus musculus
atggagcaatctggcagtgcagtgg

SEQ ID NO: 263475 - DNA, 25 bp, Mus musculus
atggagcacaccaggaggacccatt

SEQ ID NO: 263476 - DNA, 25 bp, Mus musculus
atggagcacacccaggctgtggact

SEQ ID NO: 263477 - DNA, 25 bp, Mus musculus
atggagcacaccgaggctgtggact

SEQ ID NO: 263478 - DNA, 25 bp, Mus musculus
atggagcacacctggaggacccatt

SEQ ID NO: 263479 - DNA, 25 bp, Mus musculus
atggagcacagtagtcatccctgca

SEQ ID NO: 263480 - DNA, 25 bp, Mus musculus
atggagcacagttgtcatccctgca

SEQ ID NO: 263481 - DNA, 25 bp, Mus musculus
atggagcaccacatggcatgggact

SEQ ID NO: 263482 - DNA, 25 bp, Mus musculus
atggagcaccacttggcatgggact

SEQ ID NO: 263483 - DNA, 25 bp, Mus musculus
atggagcaccataggcttgtgacaa

SEQ ID NO: 263484 - DNA, 25 bp, Mus musculus
atggagcaccattggcttgtgacaa

SEQ ID NO: 263485 - DNA, 25 bp, Mus musculus
atggagcaccgaccttcatgaccag

SEQ ID NO: 263486 - DNA, 25 bp, Mus musculus
atggagcaccgagcttcatgaccag

SEQ ID NO: 263487 - DNA, 25 bp, Mus musculus
atggagcacgagcatcactgagctt

SEQ ID NO: 263488 - DNA, 25 bp, Mus musculus
atggagcacgaggatcactgagctt

SEQ ID NO: 263489 - DNA, 25 bp, Mus musculus
atggagcacgccatggaaaccatga

SEQ ID NO: 263490 - DNA, 25 bp, Mus musculus
atggagcacgccttggaaaccatga

SEQ ID NO: 263491 - DNA, 25 bp, Mus musculus
atggagcactgtatggagcacggca

SEQ ID NO: 263492 - DNA, 25 bp, Mus musculus
atggagcactgtttggagcacggca

SEQ ID NO: 263493 - DNA, 25 bp, Mus musculus
atggagcagcccctgcagaatggac

SEQ ID NO: 263494 - DNA, 25 bp, Mus musculus
atggagcagcccgtgcagaatggac

SEQ ID NO: 263495 - DNA, 25 bp, Mus musculus
atggagcagcttcacaaggaaagtc

SEQ ID NO: 263496 - DNA, 25 bp, Mus musculus
atggagcagcttgacaaggaaagtc

SEQ ID NO: 263497 - DNA, 25 bp, Mus musculus
atggagcagggaagattgcccagta

SEQ ID NO: 263498 - DNA, 25 bp, Mus musculus
atggagcagggatgattgcccagta

SEQ ID NO: 263499 - DNA, 25 bp, Mus musculus
atggagcagtcaactggcactgggc

SEQ ID NO: 263500 - DNA, 25 bp, Mus musculus
atggagcagtcatctggcactgggc

SEQ ID NO: 263501 - DNA, 25 bp, Mus musculus
atggagcatatcagacttggacagt

SEQ ID NO: 263502 - DNA, 25 bp, Mus musculus
atggagcatatctgacttggacagt

SEQ ID NO: 263503 - DNA, 25 bp, Mus musculus
atggagcattgaagaaagctgggct

SEQ ID NO: 263504 - DNA, 25 bp, Mus musculus
atggagcattgatgaaagctgggct

SEQ ID NO: 263505 - DNA, 25 bp, Mus musculus
atggagcattgcagccggtaaacct

SEQ ID NO: 263506 - DNA, 25 bp, Mus musculus
atggagcattgctgccggtaaacct

SEQ ID NO: 263507 - DNA, 25 bp, Mus musculus
atggagccacaccacgtgaacggat

SEQ ID NO: 263508 - DNA, 25 bp, Mus musculus
atggagccacacctcaggtcaggct

SEQ ID NO: 263509 - DNA, 25 bp, Mus musculus
atggagccacacgacgtgaacggat

SEQ ID NO: 263510 - DNA, 25 bp, Mus musculus
atggagccacacgtcaggtcaggct

SEQ ID NO: 263511 - DNA, 25 bp, Mus musculus
atggagccactcacacgattctcaa

SEQ ID NO: 263512 - DNA, 25 bp, Mus musculus
atggagccactctcacgattctcaa

SEQ ID NO: 263513 - DNA, 25 bp, Mus musculus
atggagccactgacctcagacaggg

SEQ ID NO: 263514 - DNA, 25 bp, Mus musculus
atggagccactgtcctcagacaggg

SEQ ID NO: 263515 - DNA, 25 bp, Mus musculus
atggagccacttagcaggaacacac

SEQ ID NO: 263516 - DNA, 25 bp, Mus musculus
atggagccacttcacgaggaaatct

SEQ ID NO: 263517 - DNA, 25 bp, Mus musculus
atggagccacttgacgaggaaatct

SEQ ID NO: 263518 - DNA, 25 bp, Mus musculus
atggagccactttgcaggaacacac

SEQ ID NO: 263519 - DNA, 25 bp, Mus musculus
atggagccatggatagatccccagc

SEQ ID NO: 263520 - DNA, 25 bp, Mus musculus
atggagccatggttagatccccagc

SEQ ID NO: 263521 - DNA, 25 bp, Mus musculus
atggagccatttcggccttgccatt

SEQ ID NO: 263522 - DNA, 25 bp, Mus musculus
atggagccatttgggccttgccatt

SEQ ID NO: 263523 - DNA, 25 bp, Mus musculus
atggagcccaaacaagctgtactac

SEQ ID NO: 263524 - DNA, 25 bp, Mus musculus
atggagcccaaagaagctgtactac

SEQ ID NO: 263525 - DNA, 25 bp, Mus musculus
atggagcccagcatccaggaggtct

SEQ ID NO: 263526 - DNA, 25 bp, Mus musculus
atggagcccagcttccaggaggtct

SEQ ID NO: 263527 - DNA, 25 bp, Mus musculus
atggagcccagtccccgggacgtta

SEQ ID NO: 263528 - DNA, 25 bp, Mus musculus
atggagcccagtgcccgggacgtta

SEQ ID NO: 263529 - DNA, 25 bp, Mus musculus
atggagcccatacacatagcatatg

SEQ ID NO: 263530 - DNA, 25 bp, Mus musculus
atggagcccatagacatagcatatg

SEQ ID NO: 263531 - DNA, 25 bp, Mus musculus
atggagccccaccacatgaatggat

SEQ ID NO: 263532 - DNA, 25 bp, Mus musculus
atggagccccacgacatgaatggat

SEQ ID NO: 263533 - DNA, 25 bp, Mus musculus
atggagccccagcataagtctgcgc

SEQ ID NO: 263534 - DNA, 25 bp, Mus musculus
atggagccccaggataagtctgcgc

SEQ ID NO: 263535 - DNA, 25 bp, Mus musculus
atggagccccttcggctgagcacca

SEQ ID NO: 263536 - DNA, 25 bp, Mus musculus
atggagccccttgggctgagcacca

SEQ ID NO: 263537 - DNA, 25 bp, Mus musculus
atggagcccttaactactctagcta

SEQ ID NO: 263538 - DNA, 25 bp, Mus musculus
atggagcccttatctactctagcta

SEQ ID NO: 263539 - DNA, 25 bp, Mus musculus
atggagccgggcacaccaagcaact

SEQ ID NO: 263540 - DNA, 25 bp, Mus musculus
atggagccgggctcaccaagcaact

SEQ ID NO: 263541 - DNA, 25 bp, Mus musculus
atggagcctccaatcagagccatgt

SEQ ID NO: 263542 - DNA, 25 bp, Mus musculus
atggagcctccattcagagccatgt

SEQ ID NO: 263543 - DNA, 25 bp, Mus musculus
atggagcctcctctttgccttcaga

SEQ ID NO: 263544 - DNA, 25 bp, Mus musculus
atggagcctcctgtttgccttcaga

SEQ ID NO: 263545 - DNA, 25 bp, Mus musculus
atggagcctgaaatggtcacctctt

SEQ ID NO: 263546 - DNA, 25 bp, Mus musculus
atggagcctgaattggtcacctctt

SEQ ID NO: 263547 - DNA, 25 bp, Mus musculus
atggagcctgatacttatgcctgga

SEQ ID NO: 263548 - DNA, 25 bp, Mus musculus
atggagcctgattcttatgcctgga

SEQ ID NO: 263549 - DNA, 25 bp, Mus musculus
atggagccttcactctggcaagtcc

SEQ ID NO: 263550 - DNA, 25 bp, Mus musculus
atggagccttcagtctggcaagtcc

SEQ ID NO: 263551 - DNA, 25 bp, Mus musculus
atggagccttccacctggcagccgg

SEQ ID NO: 263552 - DNA, 25 bp, Mus musculus
atggagccttcctcctggcagccgg

SEQ ID NO: 263553 - DNA, 25 bp, Mus musculus
atggagccttgaatggcctcaacag

SEQ ID NO: 263554 - DNA, 25 bp, Mus musculus
atggagccttgattggcctcaacag

SEQ ID NO: 263555 - DNA, 25 bp, Mus musculus
atggagccttttcctctgaggtgga

SEQ ID NO: 263556 - DNA, 25 bp, Mus musculus
atggagccttttgctctgaggtgga

SEQ ID NO: 263557 - DNA, 25 bp, Mus musculus
atggagcgacaaaatatgcctgtca

SEQ ID NO: 263558 - DNA, 25 bp, Mus musculus
atggagcgacaatatatgcctgtca

SEQ ID NO: 263559 - DNA, 25 bp, Mus musculus
atggagcgccaacgccgtgacatta

SEQ ID NO: 263560 - DNA, 25 bp, Mus musculus
atggagcgccaaggccgtgacatta

SEQ ID NO: 263561 - DNA, 25 bp, Mus musculus
atggagcgcctgagttcaagccagc

SEQ ID NO: 263562 - DNA, 25 bp, Mus musculus
atggagcgcctgtgttcaagccagc

SEQ ID NO: 263563 - DNA, 25 bp, Mus musculus
atggagcggatcataggacccatcc

SEQ ID NO: 263564 - DNA, 25 bp, Mus musculus
atggagcggatcttaggacccatcc

SEQ ID NO: 263565 - DNA, 25 bp, Mus musculus
atggagcgtttgcattgcctgtccc

SEQ ID NO: 263566 - DNA, 25 bp, Mus musculus
atggagcgtttggattgcctgtccc

SEQ ID NO: 263567 - DNA, 25 bp, Mus musculus
atggagctacttcattatgtcgcag

SEQ ID NO: 263568 - DNA, 25 bp, Mus musculus
atggagctacttgattatgtcgcag

SEQ ID NO: 263569 - DNA, 25 bp, Mus musculus
atggagctatggacgttaatttgac

SEQ ID NO: 263570 - DNA, 25 bp, Mus musculus
atggagctatggtcgttaatttgac

SEQ ID NO: 263571 - DNA, 25 bp, Mus musculus
atggagctattccatcctgaccggc

SEQ ID NO: 263572 - DNA, 25 bp, Mus musculus
atggagctattcgatcctgaccggc

SEQ ID NO: 263573 - DNA, 25 bp, Mus musculus
atggagctcaaccttcgacctgttg

SEQ ID NO: 263574 - DNA, 25 bp, Mus musculus
atggagctcaacgttcgacctgttg

SEQ ID NO: 263575 - DNA, 25 bp, Mus musculus
atggagctcctgatgatgggcctcc

SEQ ID NO: 263576 - DNA, 25 bp, Mus musculus
atggagctcctgttgatgggcctcc

SEQ ID NO: 263577 - DNA, 25 bp, Mus musculus
atggagctctctatggatcgcctca

SEQ ID NO: 263578 - DNA, 25 bp, Mus musculus
atggagctctctttggatcgcctca

SEQ ID NO: 263579 - DNA, 25 bp, Mus musculus
atggagctgatcaggttcccactta

SEQ ID NO: 263580 - DNA, 25 bp, Mus musculus
atggagctgatctggttcccactta

SEQ ID NO: 263581 - DNA, 25 bp, Mus musculus
atggagctgcaaaggccctgggaat

SEQ ID NO: 263582 - DNA, 25 bp, Mus musculus
atggagctgcaatggccctgggaat

SEQ ID NO: 263583 - DNA, 25 bp, Mus musculus
atggagctgcagacctaccgttatc

SEQ ID NO: 263584 - DNA, 25 bp, Mus musculus
atggagctgcagtcctaccgttatc

SEQ ID NO: 263585 - DNA, 25 bp, Mus musculus
atggagctgccaaggacagacccgg

SEQ ID NO: 263586 - DNA, 25 bp, Mus musculus
atggagctgccatggacagacccgg

SEQ ID NO: 263587 - DNA, 25 bp, Mus musculus
atggagctgggcacacaacatgcac

SEQ ID NO: 263588 - DNA, 25 bp, Mus musculus
atggagctgggctcacaacatgcac

SEQ ID NO: 263589 - DNA, 25 bp, Mus musculus
atggagctgtcaagtgacccggcag

SEQ ID NO: 263590 - DNA, 25 bp, Mus musculus
atggagctgtcaatgcggcgatgca

SEQ ID NO: 263591 - DNA, 25 bp, Mus musculus
atggagctgtcatgtgacccggcag

SEQ ID NO: 263592 - DNA, 25 bp, Mus musculus
atggagctgtcattgcggcgatgca

SEQ ID NO: 263593 - DNA, 25 bp, Mus musculus
atggagcttcatcagttacaggaca

SEQ ID NO: 263594 - DNA, 25 bp, Mus musculus
atggagcttcatgagttacaggaca

SEQ ID NO: 263595 - DNA, 25 bp, Mus musculus
atggagcttctcagcctaagcgttt

SEQ ID NO: 263596 - DNA, 25 bp, Mus musculus
atggagcttctctgcctaagcgttt

SEQ ID NO: 263597 - DNA, 25 bp, Mus musculus
atggagcttgctacgttcctaaatc

SEQ ID NO: 263598 - DNA, 25 bp, Mus musculus
atggagcttgcttcgttcctaaatc

SEQ ID NO: 263599 - DNA, 25 bp, Mus musculus
atggagcttggtaacctagtgttct

SEQ ID NO: 263600 - DNA, 25 bp, Mus musculus
atggagcttggtatgtaccagccct

SEQ ID NO: 263601 - DNA, 25 bp, Mus musculus
atggagcttggttacctagtgttct

SEQ ID NO: 263602 - DNA, 25 bp, Mus musculus
atggagcttggtttgtaccagccct

SEQ ID NO: 263603 - DNA, 25 bp, Mus musculus
atggagctttctaccactctttttg

SEQ ID NO: 263604 - DNA, 25 bp, Mus musculus
atggagctttcttccactctttttg

SEQ ID NO: 263605 - DNA, 25 bp, Mus musculus
atggagcttttcacaggtcatccag

SEQ ID NO: 263606 - DNA, 25 bp, Mus musculus
atggagcttttctcaggtcatccag

SEQ ID NO: 263607 - DNA, 25 bp, Mus musculus
atggaggaaatgcttacaactaatt

SEQ ID NO: 263608 - DNA, 25 bp, Mus musculus
atggaggaaatggttacaactaatt

SEQ ID NO: 263609 - DNA, 25 bp, Mus musculus
atggaggaacagacacctgctttaa

SEQ ID NO: 263610 - DNA, 25 bp, Mus musculus
atggaggaacagtcacctgctttaa

SEQ ID NO: 263611 - DNA, 25 bp, Mus musculus
atggaggaaccactgctgcatttaa

SEQ ID NO: 263612 - DNA, 25 bp, Mus musculus
atggaggaaccagtgctgcatttaa

SEQ ID NO: 263613 - DNA, 25 bp, Mus musculus
atggaggaatctctgacaacattac

SEQ ID NO: 263614 - DNA, 25 bp, Mus musculus
atggaggaatctgtgacaacattac

SEQ ID NO: 263615 - DNA, 25 bp, Mus musculus
atggaggacagaaagagccctggtt

SEQ ID NO: 263616 - DNA, 25 bp, Mus musculus
atggaggacagatagagccctggtt

SEQ ID NO: 263617 - DNA, 25 bp, Mus musculus
atggaggaccaaacctgctgtgtga

SEQ ID NO: 263618 - DNA, 25 bp, Mus musculus
atggaggaccaatcctgctgtgtga

SEQ ID NO: 263619 - DNA, 25 bp, Mus musculus
atggaggaccctctaaggctcaacc

SEQ ID NO: 263620 - DNA, 25 bp, Mus musculus
atggaggaccctgtaaggctcaacc

SEQ ID NO: 263621 - DNA, 25 bp, Mus musculus
atggaggaccgcaaggctgctaaaa

SEQ ID NO: 263622 - DNA, 25 bp, Mus musculus
atggaggaccgctaggctgctaaaa

SEQ ID NO: 263623 - DNA, 25 bp, Mus musculus
atggaggacctaagctctcgattcc

SEQ ID NO: 263624 - DNA, 25 bp, Mus musculus
atggaggacctatgctctcgattcc

SEQ ID NO: 263625 - DNA, 25 bp, Mus musculus
atggaggacctgaacgccatggccg

SEQ ID NO: 263626 - DNA, 25 bp, Mus musculus
atggaggacctgtacgccatggccg

SEQ ID NO: 263627 - DNA, 25 bp, Mus musculus
atggaggaccttcccgggtcttctg

SEQ ID NO: 263628 - DNA, 25 bp, Mus musculus
atggaggaccttgccgggtcttctg

SEQ ID NO: 263629 - DNA, 25 bp, Mus musculus
atggaggacgagatctacctgcggc

SEQ ID NO: 263630 - DNA, 25 bp, Mus musculus
atggaggacgagttctacctgcggc

SEQ ID NO: 263631 - DNA, 25 bp, Mus musculus
atggaggacgcccttttcttaacag

SEQ ID NO: 263632 - DNA, 25 bp, Mus musculus
atggaggacgccgttttcttaacag

SEQ ID NO: 263633 - DNA, 25 bp, Mus musculus
atggaggactatcagcatttcgttc

SEQ ID NO: 263634 - DNA, 25 bp, Mus musculus
atggaggactatgagcatttcgttc

SEQ ID NO: 263635 - DNA, 25 bp, Mus musculus
atggaggaggagatacgcctggcca

SEQ ID NO: 263636 - DNA, 25 bp, Mus musculus
atggaggaggagttacgcctggcca

SEQ ID NO: 263637 - DNA, 25 bp, Mus musculus
atggaggaggttctacactgaccca

SEQ ID NO: 263638 - DNA, 25 bp, Mus musculus
atggaggaggttgtacactgaccca

SEQ ID NO: 263639 - DNA, 25 bp, Mus musculus
atggaggatcctactggtgtcgtgc

SEQ ID NO: 263640 - DNA, 25 bp, Mus musculus
atggaggatccttctggtgtcgtgc

SEQ ID NO: 263641 - DNA, 25 bp, Mus musculus
atggaggattacctcttctttctcc

SEQ ID NO: 263642 - DNA, 25 bp, Mus musculus
atggaggattacgtcttctttctcc

SEQ ID NO: 263643 - DNA, 25 bp, Mus musculus
atggaggcagcacgtcagtaattca

SEQ ID NO: 263644 - DNA, 25 bp, Mus musculus
atggaggcagcaggtcagtaattca

SEQ ID NO: 263645 - DNA, 25 bp, Mus musculus
atggaggcagctctcctcagctcag

SEQ ID NO: 263646 - DNA, 25 bp, Mus musculus
atggaggcagctgtcctcagctcag

SEQ ID NO: 263647 - DNA, 25 bp, Mus musculus
atggaggcatcgctactgagcccca

SEQ ID NO: 263648 - DNA, 25 bp, Mus musculus
atggaggcatcggtactgagcccca

SEQ ID NO: 263649 - DNA, 25 bp, Mus musculus
atggaggcatctcagaatctcatct

SEQ ID NO: 263650 - DNA, 25 bp, Mus musculus
atggaggcatctgagaatctcatct

SEQ ID NO: 263651 - DNA, 25 bp, Mus musculus
atggaggccagtcgttgtcgtcccc

SEQ ID NO: 263652 - DNA, 25 bp, Mus musculus
atggaggccagtggttgtcgtcccc

SEQ ID NO: 263653 - DNA, 25 bp, Mus musculus
atggaggccatacgcccgagttgca

SEQ ID NO: 263654 - DNA, 25 bp, Mus musculus
atggaggccataggcccgagttgca

SEQ ID NO: 263655 - DNA, 25 bp, Mus musculus
atggaggccatgatcccgtgactca

SEQ ID NO: 263656 - DNA, 25 bp, Mus musculus
atggaggccatgttcccgtgactca

SEQ ID NO: 263657 - DNA, 25 bp, Mus musculus
atggaggcccacctctcttgccagt

SEQ ID NO: 263658 - DNA, 25 bp, Mus musculus
atggaggcccacgtctcttgccagt

SEQ ID NO: 263659 - DNA, 25 bp, Mus musculus
atggaggcctaacgatgccggcaaa

SEQ ID NO: 263660 - DNA, 25 bp, Mus musculus
atggaggcctaaggatgccggcaaa

SEQ ID NO: 263661 - DNA, 25 bp, Mus musculus
atggaggcctccacagacttcctac

SEQ ID NO: 263662 - DNA, 25 bp, Mus musculus
atggaggcctcctcagacttcctac

SEQ ID NO: 263663 - DNA, 25 bp, Mus musculus
atggaggcctgcagtcatttacgtg

SEQ ID NO: 263664 - DNA, 25 bp, Mus musculus
atggaggcctgctgtcatttacgtg

SEQ ID NO: 263665 - DNA, 25 bp, Mus musculus
atggaggcctgtaactcagagtctc

SEQ ID NO: 263666 - DNA, 25 bp, Mus musculus
atggaggcctgttactcagagtctc

SEQ ID NO: 263667 - DNA, 25 bp, Mus musculus
atggaggcgagaaccccgagagctt

SEQ ID NO: 263668 - DNA, 25 bp, Mus musculus
atggaggcgagatccccgagagctt

SEQ ID NO: 263669 - DNA, 25 bp, Mus musculus
atggaggcggccagcgtgtgcgtgg

SEQ ID NO: 263670 - DNA, 25 bp, Mus musculus
atggaggcggcctgcgtgtgcgtgg

SEQ ID NO: 263671 - DNA, 25 bp, Mus musculus
atggaggctcatagtcagcgtccgt

SEQ ID NO: 263672 - DNA, 25 bp, Mus musculus
atggaggctcatcctgtcgtgatca

SEQ ID NO: 263673 - DNA, 25 bp, Mus musculus
atggaggctcatgctgtcgtgatca

SEQ ID NO: 263674 - DNA, 25 bp, Mus musculus
atggaggctcattgtcagcgtccgt

SEQ ID NO: 263675 - DNA, 25 bp, Mus musculus
atggaggctcctctagatgaggccc

SEQ ID NO: 263676 - DNA, 25 bp, Mus musculus
atggaggctcctgtagatgaggccc

SEQ ID NO: 263677 - DNA, 25 bp, Mus musculus
atggaggctggtacttgggcatcct

SEQ ID NO: 263678 - DNA, 25 bp, Mus musculus
atggaggctggttcttgggcatcct

SEQ ID NO: 263679 - DNA, 25 bp, Mus musculus
atggaggctgttcggttcttgcaat

SEQ ID NO: 263680 - DNA, 25 bp, Mus musculus
atggaggctgttgggttcttgcaat

SEQ ID NO: 263681 - DNA, 25 bp, Mus musculus
atggaggcttgcaagggaacctgct

SEQ ID NO: 263682 - DNA, 25 bp, Mus musculus
atggaggcttgctagggaacctgct

SEQ ID NO: 263683 - DNA, 25 bp, Mus musculus
atggagggacatcggctttccagac

SEQ ID NO: 263684 - DNA, 25 bp, Mus musculus
atggagggacatgggctttccagac

SEQ ID NO: 263685 - DNA, 25 bp, Mus musculus
atggagggaccaagccagtttcaaa

SEQ ID NO: 263686 - DNA, 25 bp, Mus musculus
atggagggaccatgccagtttcaaa

SEQ ID NO: 263687 - DNA, 25 bp, Mus musculus
atggagggtacaattctgtggcatt

SEQ ID NO: 263688 - DNA, 25 bp, Mus musculus
atggagggtacatttctgtggcatt

SEQ ID NO: 263689 - DNA, 25 bp, Mus musculus
atggagggtgctcgctcttaaccac

SEQ ID NO: 263690 - DNA, 25 bp, Mus musculus
atggagggtgctggctcttaaccac

SEQ ID NO: 263691 - DNA, 25 bp, Mus musculus
atggaggtcagcactccttaggaga

SEQ ID NO: 263692 - DNA, 25 bp, Mus musculus
atggaggtcagctctccttaggaga

SEQ ID NO: 263693 - DNA, 25 bp, Mus musculus
atggaggtccctccagccaccttga

SEQ ID NO: 263694 - DNA, 25 bp, Mus musculus
atggaggtccctgcagccaccttga

SEQ ID NO: 263695 - DNA, 25 bp, Mus musculus
atggaggtctcacatgtctgccgtc

SEQ ID NO: 263696 - DNA, 25 bp, Mus musculus
atggaggtctcagatgtctgccgtc

SEQ ID NO: 263697 - DNA, 25 bp, Mus musculus
atggaggtctgcaagttgcctcggc

SEQ ID NO: 263698 - DNA, 25 bp, Mus musculus
atggaggtctgctagttgcctcggc

SEQ ID NO: 263699 - DNA, 25 bp, Mus musculus
atggaggtcttcaccactcactgag

SEQ ID NO: 263700 - DNA, 25 bp, Mus musculus
atggaggtcttctccactcactgag

SEQ ID NO: 263701 - DNA, 25 bp, Mus musculus
atggaggtgcctactacagacactt

SEQ ID NO: 263702 - DNA, 25 bp, Mus musculus
atggaggtgccttctacagacactt

SEQ ID NO: 263703 - DNA, 25 bp, Mus musculus
atggaggtggctcgaccctcatcca

SEQ ID NO: 263704 - DNA, 25 bp, Mus musculus
atggaggtggctggaccctcatcca

SEQ ID NO: 263705 - DNA, 25 bp, Mus musculus
atggaggttcgcctggcatcaccct

SEQ ID NO: 263706 - DNA, 25 bp, Mus musculus
atggaggttcgcgtggcatcaccct

SEQ ID NO: 263707 - DNA, 25 bp, Mus musculus
atggaggttctcactgtagggatta

SEQ ID NO: 263708 - DNA, 25 bp, Mus musculus
atggaggttctctctgtagggatta

SEQ ID NO: 263709 - DNA, 25 bp, Mus musculus
atggaggttgcaaacagatggcgaa

SEQ ID NO: 263710 - DNA, 25 bp, Mus musculus
atggaggttgcatacagatggcgaa

SEQ ID NO: 263711 - DNA, 25 bp, Mus musculus
atggaggttggcactgtcagttgct

SEQ ID NO: 263712 - DNA, 25 bp, Mus musculus
atggaggttggctctgtcagttgct

SEQ ID NO: 263713 - DNA, 25 bp, Mus musculus
atggagtaaaccaaattctgccctt

SEQ ID NO: 263714 - DNA, 25 bp, Mus musculus
atggagtaaacctaattctgccctt

SEQ ID NO: 263715 - DNA, 25 bp, Mus musculus
atggagtaacaaccttgcttgtatc

SEQ ID NO: 263716 - DNA, 25 bp, Mus musculus
atggagtaacaagcttgcttgtatc

SEQ ID NO: 263717 - DNA, 25 bp, Mus musculus
atggagtaacgcagctgctcactgt

SEQ ID NO: 263718 - DNA, 25 bp, Mus musculus
atggagtaacgctgctgctcactgt

SEQ ID NO: 263719 - DNA, 25 bp, Mus musculus
atggagtaagcaagaagttcagagc

SEQ ID NO: 263720 - DNA, 25 bp, Mus musculus
atggagtaagcatgaagttcagagc

SEQ ID NO: 263721 - DNA, 25 bp, Mus musculus
atggagtaccagagtgctttatatt

SEQ ID NO: 263722 - DNA, 25 bp, Mus musculus
atggagtaccagtgtgctttatatt

SEQ ID NO: 263723 - DNA, 25 bp, Mus musculus
atggagtacccgaactgtgtcattt

SEQ ID NO: 263724 - DNA, 25 bp, Mus musculus
atggagtacccgtactgtgtcattt

SEQ ID NO: 263725 - DNA, 25 bp, Mus musculus
atggagtagctcacaggccagctgt

SEQ ID NO: 263726 - DNA, 25 bp, Mus musculus
atggagtagctctcaggccagctgt

SEQ ID NO: 263727 - DNA, 25 bp, Mus musculus
atggagtatggcctaacccgggact

SEQ ID NO: 263728 - DNA, 25 bp, Mus musculus
atggagtatggcgtaacccgggact

SEQ ID NO: 263729 - DNA, 25 bp, Mus musculus
atggagtatggtaacccagacccat

SEQ ID NO: 263730 - DNA, 25 bp, Mus musculus
atggagtatggttacccagacccat

SEQ ID NO: 263731 - DNA, 25 bp, Mus musculus
atggagtattctccccaagctgtca

SEQ ID NO: 263732 - DNA, 25 bp, Mus musculus
atggagtattctgcccaagctgtca

SEQ ID NO: 263733 - DNA, 25 bp, Mus musculus
atggagtcaaacacccaggttcctc

SEQ ID NO: 263734 - DNA, 25 bp, Mus musculus
atggagtcaaactcccaggttcctc

SEQ ID NO: 263735 - DNA, 25 bp, Mus musculus
atggagtcacatcacaccgtatgtt

SEQ ID NO: 263736 - DNA, 25 bp, Mus musculus
atggagtcacatgacaccgtatgtt

SEQ ID NO: 263737 - DNA, 25 bp, Mus musculus
atggagtcactcatgcgctgcatct

SEQ ID NO: 263738 - DNA, 25 bp, Mus musculus
atggagtcactcttgcgctgcatct

SEQ ID NO: 263739 - DNA, 25 bp, Mus musculus
atggagtcatcccaccaatatacac

SEQ ID NO: 263740 - DNA, 25 bp, Mus musculus
atggagtcatccgaccaatatacac

SEQ ID NO: 263741 - DNA, 25 bp, Mus musculus
atggagtccaaaatcatcagtgaga

SEQ ID NO: 263742 - DNA, 25 bp, Mus musculus
atggagtccaaattcatcagtgaga

SEQ ID NO: 263743 - DNA, 25 bp, Mus musculus
atggagtccatcattcaggacttgg

SEQ ID NO: 263744 - DNA, 25 bp, Mus musculus
atggagtccatctttcaggacttgg

SEQ ID NO: 263745 - DNA, 25 bp, Mus musculus
atggagtccggcctgacgtcagcaa

SEQ ID NO: 263746 - DNA, 25 bp, Mus musculus
atggagtccggcgtgacgtcagcaa

SEQ ID NO: 263747 - DNA, 25 bp, Mus musculus
atggagtcctacagtgttcgtgctt

SEQ ID NO: 263748 - DNA, 25 bp, Mus musculus
atggagtcctactgtgttcgtgctt

SEQ ID NO: 263749 - DNA, 25 bp, Mus musculus
atggagtcctgaagacgtccaccat

SEQ ID NO: 263750 - DNA, 25 bp, Mus musculus
atggagtcctgatgacgtccaccat

SEQ ID NO: 263751 - DNA, 25 bp, Mus musculus
atggagtcctgtcgcttcatttaaa

SEQ ID NO: 263752 - DNA, 25 bp, Mus musculus
atggagtcctgtggcttcatttaaa

SEQ ID NO: 263753 - DNA, 25 bp, Mus musculus
atggagtctcacattgacctttacc

SEQ ID NO: 263754 - DNA, 25 bp, Mus musculus
atggagtctcactttgacctttacc

SEQ ID NO: 263755 - DNA, 25 bp, Mus musculus
atggagtctgtcaagcacaacaaaa

SEQ ID NO: 263756 - DNA, 25 bp, Mus musculus
atggagtctgtctagcacaacaaaa

SEQ ID NO: 263757 - DNA, 25 bp, Mus musculus
atggagtctttgcacgtgtatgaaa

SEQ ID NO: 263758 - DNA, 25 bp, Mus musculus
atggagtctttggacgtgtatgaaa

SEQ ID NO: 263759 - DNA, 25 bp, Mus musculus
atggagtgagccaggaatccctgca

SEQ ID NO: 263760 - DNA, 25 bp, Mus musculus
atggagtgagcctggaatccctgca

SEQ ID NO: 263761 - DNA, 25 bp, Mus musculus
atggagtgagctctttggacccagt

SEQ ID NO: 263762 - DNA, 25 bp, Mus musculus
atggagtgagctgtttggacccagt

SEQ ID NO: 263763 - DNA, 25 bp, Mus musculus
atggagtgagtgcttctgcctctga

SEQ ID NO: 263764 - DNA, 25 bp, Mus musculus
atggagtgagtggttctgcctctga

SEQ ID NO: 263765 - DNA, 25 bp, Mus musculus
atggagtgatgtctaccacctccca

SEQ ID NO: 263766 - DNA, 25 bp, Mus musculus
atggagtgatgtgtaccacctccca

SEQ ID NO: 263767 - DNA, 25 bp, Mus musculus
atggagtgcctcatgtacgtgtgtg

SEQ ID NO: 263768 - DNA, 25 bp, Mus musculus
atggagtgcctcttgtacgtgtgtg

SEQ ID NO: 263769 - DNA, 25 bp, Mus musculus
atggagtgcgccagggtcccaaaca

SEQ ID NO: 263770 - DNA, 25 bp, Mus musculus
atggagtgcgcctgggtcccaaaca

SEQ ID NO: 263771 - DNA, 25 bp, Mus musculus
atggagtgctacagcccgtttccgt

SEQ ID NO: 263772 - DNA, 25 bp, Mus musculus
atggagtgctactgcccgtttccgt

SEQ ID NO: 263773 - DNA, 25 bp, Mus musculus
atggagtggatcacggccaaactga

SEQ ID NO: 263774 - DNA, 25 bp, Mus musculus
atggagtggatctcggccaaactga

SEQ ID NO: 263775 - DNA, 25 bp, Mus musculus
atggagtggtccagaagttctgtgt

SEQ ID NO: 263776 - DNA, 25 bp, Mus musculus
atggagtggtccataatgcctgcat

SEQ ID NO: 263777 - DNA, 25 bp, Mus musculus
atggagtggtcctgaagttctgtgt

SEQ ID NO: 263778 - DNA, 25 bp, Mus musculus
atggagtggtccttaatgcctgcat

SEQ ID NO: 263779 - DNA, 25 bp, Mus musculus
atggagtgtaaaattctttgaaagc

SEQ ID NO: 263780 - DNA, 25 bp, Mus musculus
atggagtgtaaatttctttgaaagc

SEQ ID NO: 263781 - DNA, 25 bp, Mus musculus
atggagtgtgaccacgtgcagatca

SEQ ID NO: 263782 - DNA, 25 bp, Mus musculus
atggagtgtgacgacgtgcagatca

SEQ ID NO: 263783 - DNA, 25 bp, Mus musculus
atggagtgttccacgctgccgaaaa

SEQ ID NO: 263784 - DNA, 25 bp, Mus musculus
atggagtgttccactagctcagcta

SEQ ID NO: 263785 - DNA, 25 bp, Mus musculus
atggagtgttcccacgcgtttaacg

SEQ ID NO: 263786 - DNA, 25 bp, Mus musculus
atggagtgttccgacgcgtttaacg

SEQ ID NO: 263787 - DNA, 25 bp, Mus musculus
atggagtgttcctcgctgccgaaaa

SEQ ID NO: 263788 - DNA, 25 bp, Mus musculus
atggagtgttcctctagctcagcta

SEQ ID NO: 263789 - DNA, 25 bp, Mus musculus
atggagttaccaaccccacatgtat

SEQ ID NO: 263790 - DNA, 25 bp, Mus musculus
atggagttaccatccccacatgtat

SEQ ID NO: 263791 - DNA, 25 bp, Mus musculus
atggagttaggacaagccacacaac

SEQ ID NO: 263792 - DNA, 25 bp, Mus musculus
atggagttaggagaagccacacaac

SEQ ID NO: 263793 - DNA, 25 bp, Mus musculus
atggagttcaacacactcttctacc

SEQ ID NO: 263794 - DNA, 25 bp, Mus musculus
atggagttcaactcactcttctacc

SEQ ID NO: 263795 - DNA, 25 bp, Mus musculus
atggagttcactatgtctgtcgggt

SEQ ID NO: 263796 - DNA, 25 bp, Mus musculus
atggagttcactttgtctgtcgggt

SEQ ID NO: 263797 - DNA, 25 bp, Mus musculus
atggagttgaatcgaatgcccacca

SEQ ID NO: 263798 - DNA, 25 bp, Mus musculus
atggagttgaatggaatgcccacca

SEQ ID NO: 263799 - DNA, 25 bp, Mus musculus
atggagttgaccagtgcctatatgt

SEQ ID NO: 263800 - DNA, 25 bp, Mus musculus
atggagttgacctgtgcctatatgt

SEQ ID NO: 263801 - DNA, 25 bp, Mus musculus
atggagttgagcatccctagattat

SEQ ID NO: 263802 - DNA, 25 bp, Mus musculus
atggagttgagcttccctagattat

SEQ ID NO: 263803 - DNA, 25 bp, Mus musculus
atggagttgcttaattcgggctcgt

SEQ ID NO: 263804 - DNA, 25 bp, Mus musculus
atggagttgctttattcgggctcgt

SEQ ID NO: 263805 - DNA, 25 bp, Mus musculus
atggagtttcagacctgggctttac

SEQ ID NO: 263806 - DNA, 25 bp, Mus musculus
atggagtttcagtcctgggctttac

SEQ ID NO: 263807 - DNA, 25 bp, Mus musculus
atggagtttccacgacacaggctgc

SEQ ID NO: 263808 - DNA, 25 bp, Mus musculus
atggagtttccaggacacaggctgc

SEQ ID NO: 263809 - DNA, 25 bp, Mus musculus
atggagtttgatatcggtcctctgc

SEQ ID NO: 263810 - DNA, 25 bp, Mus musculus
atggagtttgatttcggtcctctgc

SEQ ID NO: 263811 - DNA, 25 bp, Mus musculus
atggagtttgcccatgggtccaccc

SEQ ID NO: 263812 - DNA, 25 bp, Mus musculus
atggagtttgccgatgggtccaccc

SEQ ID NO: 263813 - DNA, 25 bp, Mus musculus
atggataacagactgtcccttccct

SEQ ID NO: 263814 - DNA, 25 bp, Mus musculus
atggataacagagtgtcccttccct

SEQ ID NO: 263815 - DNA, 25 bp, Mus musculus
atggataagcatctacctgtatatt

SEQ ID NO: 263816 - DNA, 25 bp, Mus musculus
atggataagcatgtacctgtatatt

SEQ ID NO: 263817 - DNA, 25 bp, Mus musculus
atggatacacaactggttcaccacc

SEQ ID NO: 263818 - DNA, 25 bp, Mus musculus
atggatacacaagtggttcaccacc

SEQ ID NO: 263819 - DNA, 25 bp, Mus musculus
atggatacacggctcctccaagacc

SEQ ID NO: 263820 - DNA, 25 bp, Mus musculus
atggatacacgggtcctccaagacc

SEQ ID NO: 263821 - DNA, 25 bp, Mus musculus
atggatacagcaacacacggattct

SEQ ID NO: 263822 - DNA, 25 bp, Mus musculus
atggatacagcatcacacggattct

SEQ ID NO: 263823 - DNA, 25 bp, Mus musculus
atggatacattcaggacccaacctc

SEQ ID NO: 263824 - DNA, 25 bp, Mus musculus
atggatacattctggacccaacctc

SEQ ID NO: 263825 - DNA, 25 bp, Mus musculus
atggatacccaaagcaaattactta

SEQ ID NO: 263826 - DNA, 25 bp, Mus musculus
atggatacccaatgcaaattactta

SEQ ID NO: 263827 - DNA, 25 bp, Mus musculus
atggataccctgctaagttgtggcc

SEQ ID NO: 263828 - DNA, 25 bp, Mus musculus
atggataccctggtaagttgtggcc

SEQ ID NO: 263829 - DNA, 25 bp, Mus musculus
atggataccgtgaccctggagcatc

SEQ ID NO: 263830 - DNA, 25 bp, Mus musculus
atggataccgtgtccctggagcatc

SEQ ID NO: 263831 - DNA, 25 bp, Mus musculus
atggatacctagcactgtggtggcc

SEQ ID NO: 263832 - DNA, 25 bp, Mus musculus
atggatacctaggactgtggtggcc

SEQ ID NO: 263833 - DNA, 25 bp, Mus musculus
atggatactgcccaagctgccagat

SEQ ID NO: 263834 - DNA, 25 bp, Mus musculus
atggatactgccgaagctgccagat

SEQ ID NO: 263835 - DNA, 25 bp, Mus musculus
atggatactgtaacttaagcacttc

SEQ ID NO: 263836 - DNA, 25 bp, Mus musculus
atggatactgtatcttaagcacttc

SEQ ID NO: 263837 - DNA, 25 bp, Mus musculus
atggatacttccctaagtggtgccc

SEQ ID NO: 263838 - DNA, 25 bp, Mus musculus
atggatacttccgtaagtggtgccc

SEQ ID NO: 263839 - DNA, 25 bp, Mus musculus
atggatagacatactggcagctagt

SEQ ID NO: 263840 - DNA, 25 bp, Mus musculus
atggatagacattctggcagctagt

SEQ ID NO: 263841 - DNA, 25 bp, Mus musculus
atggatagatacctcctttctgttt

SEQ ID NO: 263842 - DNA, 25 bp, Mus musculus
atggatagatacgtcctttctgttt

SEQ ID NO: 263843 - DNA, 25 bp, Mus musculus
atggatagccatcacaggagtaagc

SEQ ID NO: 263844 - DNA, 25 bp, Mus musculus
atggatagccatgacaggagtaagc

SEQ ID NO: 263845 - DNA, 25 bp, Mus musculus
atggatatacttaacgcaggtcgaa

SEQ ID NO: 263846 - DNA, 25 bp, Mus musculus
atggatatactttacgcaggtcgaa

SEQ ID NO: 263847 - DNA, 25 bp, Mus musculus
atggatatatccatgctctctagat

SEQ ID NO: 263848 - DNA, 25 bp, Mus musculus
atggatatatccttgctctctagat

SEQ ID NO: 263849 - DNA, 25 bp, Mus musculus
atggatatcaacctctgccttggca

SEQ ID NO: 263850 - DNA, 25 bp, Mus musculus
atggatatcaacgtctgccttggca

SEQ ID NO: 263851 - DNA, 25 bp, Mus musculus
atggatatcattctgttcatacaga

SEQ ID NO: 263852 - DNA, 25 bp, Mus musculus
atggatatcattgtgttcatacaga

SEQ ID NO: 263853 - DNA, 25 bp, Mus musculus
atggatatccctcgcctaaacctga

SEQ ID NO: 263854 - DNA, 25 bp, Mus musculus
atggatatccctggcctaaacctga

SEQ ID NO: 263855 - DNA, 25 bp, Mus musculus
atggatatgcctcagctggtttgcc

SEQ ID NO: 263856 - DNA, 25 bp, Mus musculus
atggatatgcctgagctggtttgcc

SEQ ID NO: 263857 - DNA, 25 bp, Mus musculus
atggatatgtccaagttactggcat

SEQ ID NO: 263858 - DNA, 25 bp, Mus musculus
atggatatgtcctagttactggcat

SEQ ID NO: 263859 - DNA, 25 bp, Mus musculus
atggatatgtggctgggccctttcc

SEQ ID NO: 263860 - DNA, 25 bp, Mus musculus
atggatatgtgggtgggccctttcc

SEQ ID NO: 263861 - DNA, 25 bp, Mus musculus
atggatatttccatcagtagactgt

SEQ ID NO: 263862 - DNA, 25 bp, Mus musculus
atggatatttccttcagtagactgt

SEQ ID NO: 263863 - DNA, 25 bp, Mus musculus
atggatatttttaaacttggagaga

SEQ ID NO: 263864 - DNA, 25 bp, Mus musculus
atggatattttttaacttggagaga

SEQ ID NO: 263865 - DNA, 25 bp, Mus musculus
atggatcaagatagaggttcctgga

SEQ ID NO: 263866 - DNA, 25 bp, Mus musculus
atggatcaagattgaggttcctgga

SEQ ID NO: 263867 - DNA, 25 bp, Mus musculus
atggatcacactcttgtgctgcagc

SEQ ID NO: 263868 - DNA, 25 bp, Mus musculus
atggatcacactgttgtgctgcagc

SEQ ID NO: 263869 - DNA, 25 bp, Mus musculus
atggatcacagcatttttctccttt

SEQ ID NO: 263870 - DNA, 25 bp, Mus musculus
atggatcacagcttttttctccttt

SEQ ID NO: 263871 - DNA, 25 bp, Mus musculus
atggatcaccctccaaatcattaat

SEQ ID NO: 263872 - DNA, 25 bp, Mus musculus
atggatcaccctgcaaatcattaat

SEQ ID NO: 263873 - DNA, 25 bp, Mus musculus
atggatcagcttccgtattcagtct

SEQ ID NO: 263874 - DNA, 25 bp, Mus musculus
atggatcagcttgcgtattcagtct

SEQ ID NO: 263875 - DNA, 25 bp, Mus musculus
atggatcagggaacgaggcccagaa

SEQ ID NO: 263876 - DNA, 25 bp, Mus musculus
atggatcagggatcgaggcccagaa

SEQ ID NO: 263877 - DNA, 25 bp, Mus musculus
atggatcaggttctcagcgtcagcc

SEQ ID NO: 263878 - DNA, 25 bp, Mus musculus
atggatcaggttgtcagcgtcagcc

SEQ ID NO: 263879 - DNA, 25 bp, Mus musculus
atggatcatgctactcattgcgaaa

SEQ ID NO: 263880 - DNA, 25 bp, Mus musculus
atggatcatgcttctcattgcgaaa

SEQ ID NO: 263881 - DNA, 25 bp, Mus musculus
atggatccaagacaagacaaagccc

SEQ ID NO: 263882 - DNA, 25 bp, Mus musculus
atggatccaagactgggcaacacct

SEQ ID NO: 263883 - DNA, 25 bp, Mus musculus
atggatccaagagaagacaaagccc

SEQ ID NO: 263884 - DNA, 25 bp, Mus musculus
atggatccaagagtgggcaacacct

SEQ ID NO: 263885 - DNA, 25 bp, Mus musculus
atggatccacatcgttgcctgcttt

SEQ ID NO: 263886 - DNA, 25 bp, Mus musculus
atggatccacatggttgcctgcttt

SEQ ID NO: 263887 - DNA, 25 bp, Mus musculus
atggatccaccacctgaaacgaggt

SEQ ID NO: 263888 - DNA, 25 bp, Mus musculus
atggatccaccagctgaaacgaggt

SEQ ID NO: 263889 - DNA, 25 bp, Mus musculus
atggatccacctccccggaaagaaa

SEQ ID NO: 263890 - DNA, 25 bp, Mus musculus
atggatccacctgcccggaaagaaa

SEQ ID NO: 263891 - DNA, 25 bp, Mus musculus
atggatccagacaccttctcttggt

SEQ ID NO: 263892 - DNA, 25 bp, Mus musculus
atggatccagactccttctcttggt

SEQ ID NO: 263893 - DNA, 25 bp, Mus musculus
atggatccagccaaccatgaggcaa

SEQ ID NO: 263894 - DNA, 25 bp, Mus musculus
atggatccagcctaccatgaggcaa

SEQ ID NO: 263895 - DNA, 25 bp, Mus musculus
atggatccattgaaatgtatgctaa

SEQ ID NO: 263896 - DNA, 25 bp, Mus musculus
atggatccattgtaatgtatgctaa

SEQ ID NO: 263897 - DNA, 25 bp, Mus musculus
atggatcccaaaaccggcgcatcca

SEQ ID NO: 263898 - DNA, 25 bp, Mus musculus
atggatcccaaatccggcgcatcca

SEQ ID NO: 263899 - DNA, 25 bp, Mus musculus
atggatcccactcatgccaagtatc

SEQ ID NO: 263900 - DNA, 25 bp, Mus musculus
atggatcccactgatgccaagtatc

SEQ ID NO: 263901 - DNA, 25 bp, Mus musculus
atggatcccaggctgactgcaaaca

SEQ ID NO: 263902 - DNA, 25 bp, Mus musculus
atggatcccagggtgactgcaaaca

SEQ ID NO: 263903 - DNA, 25 bp, Mus musculus
atggatcccataatccctaatgaag

SEQ ID NO: 263904 - DNA, 25 bp, Mus musculus
atggatcccatacgcccatagggca

SEQ ID NO: 263905 - DNA, 25 bp, Mus musculus
atggatcccataggcccatagggca

SEQ ID NO: 263906 - DNA, 25 bp, Mus musculus
atggatcccatattccctaatgaag

SEQ ID NO: 263907 - DNA, 25 bp, Mus musculus
atggatccccacagtactgagcaga

SEQ ID NO: 263908 - DNA, 25 bp, Mus musculus
atggatccccactgtactgagcaga

SEQ ID NO: 263909 - DNA, 25 bp, Mus musculus
atggatccggctcacagggtacacg

SEQ ID NO: 263910 - DNA, 25 bp, Mus musculus
atggatccggctgacagggtacacg

SEQ ID NO: 263911 - DNA, 25 bp, Mus musculus
atggatcctgcaccacatcagagct

SEQ ID NO: 263912 - DNA, 25 bp, Mus musculus
atggatcctgcagcacatcagagct

SEQ ID NO: 263913 - DNA, 25 bp, Mus musculus
atggatcgaagtctcaggttcttct

SEQ ID NO: 263914 - DNA, 25 bp, Mus musculus
atggatcgaagtgtcaggttcttct

SEQ ID NO: 263915 - DNA, 25 bp, Mus musculus
atggatcgcccgcaatttctatgat

SEQ ID NO: 263916 - DNA, 25 bp, Mus musculus
atggatcgcccggaatttctatgat

SEQ ID NO: 263917 - DNA, 25 bp, Mus musculus
atggatcggcacaccgcttcgaggt

SEQ ID NO: 263918 - DNA, 25 bp, Mus musculus
atggatcggcactccgcttcgaggt

SEQ ID NO: 263919 - DNA, 25 bp, Mus musculus
atggatcggttcagccacgtgcttg

SEQ ID NO: 263920 - DNA, 25 bp, Mus musculus
atggatcggttctgccacgtgcttg

SEQ ID NO: 263921 - DNA, 25 bp, Mus musculus
atggatctagctagtggcttcacca

SEQ ID NO: 263922 - DNA, 25 bp, Mus musculus
atggatctagcttgtggcttcacca

SEQ ID NO: 263923 - DNA, 25 bp, Mus musculus
atggatctccagaaatctcctgcat

SEQ ID NO: 263924 - DNA, 25 bp, Mus musculus
atggatctccagtaatctcctgcat

SEQ ID NO: 263925 - DNA, 25 bp, Mus musculus
atggatctgaccacggagtgtgcta

SEQ ID NO: 263926 - DNA, 25 bp, Mus musculus
atggatctgacctcggagtgtgcta

SEQ ID NO: 263927 - DNA, 25 bp, Mus musculus
atggatctgcctaactaccatggct

SEQ ID NO: 263928 - DNA, 25 bp, Mus musculus
atggatctgccttactaccatggct

SEQ ID NO: 263929 - DNA, 25 bp, Mus musculus
atggatctgtgaacatttgattccc

SEQ ID NO: 263930 - DNA, 25 bp, Mus musculus
atggatctgtgatcatttgattccc

SEQ ID NO: 263931 - DNA, 25 bp, Mus musculus
atggatctgtggacatttcctctgc

SEQ ID NO: 263932 - DNA, 25 bp, Mus musculus
atggatctgtggtcatttcctctgc

SEQ ID NO: 263933 - DNA, 25 bp, Mus musculus
atggatcttacccatggtctgtgtg

SEQ ID NO: 263934 - DNA, 25 bp, Mus musculus
atggatcttaccgatggtctgtgtg

SEQ ID NO: 263935 - DNA, 25 bp, Mus musculus
atggatgaagctctacttcaagatc

SEQ ID NO: 263936 - DNA, 25 bp, Mus musculus
atggatgaagctgtacttcaagatc

SEQ ID NO: 263937 - DNA, 25 bp, Mus musculus
atggatgaagtcatttcctcttact

SEQ ID NO: 263938 - DNA, 25 bp, Mus musculus
atggatgaagtccttcttggtcccc

SEQ ID NO: 263939 - DNA, 25 bp, Mus musculus
atggatgaagtcgttcttggtcccc

SEQ ID NO: 263940 - DNA, 25 bp, Mus musculus
atggatgaagtcttttcctcttact

SEQ ID NO: 263941 - DNA, 25 bp, Mus musculus
atggatgacatgaagctgctggaac

SEQ ID NO: 263942 - DNA, 25 bp, Mus musculus
atggatgacatgtagctgctggaac

SEQ ID NO: 263943 - DNA, 25 bp, Mus musculus
atggatgacccacactttgaaagtg

SEQ ID NO: 263944 - DNA, 25 bp, Mus musculus
atggatgacccagactttgaaagtg

SEQ ID NO: 263945 - DNA, 25 bp, Mus musculus
atggatgacgatcacgtccccagct

SEQ ID NO: 263946 - DNA, 25 bp, Mus musculus
atggatgacgatgacgtccccagct

SEQ ID NO: 263947 - DNA, 25 bp, Mus musculus
atggatgactagatccttcctctga

SEQ ID NO: 263948 - DNA, 25 bp, Mus musculus
atggatgactagttccttcctctga

SEQ ID NO: 263949 - DNA, 25 bp, Mus musculus
atggatgacttgacctgtgacctca

SEQ ID NO: 263950 - DNA, 25 bp, Mus musculus
atggatgacttgtcctgtgacctca

SEQ ID NO: 263951 - DNA, 25 bp, Mus musculus
atggatgagggccagacccgtttca

SEQ ID NO: 263952 - DNA, 25 bp, Mus musculus
atggatgagggcgagacccgtttca

SEQ ID NO: 263953 - DNA, 25 bp, Mus musculus
atggatgatccacaattcagaatag

SEQ ID NO: 263954 - DNA, 25 bp, Mus musculus
atggatgatccagaattcagaatag

SEQ ID NO: 263955 - DNA, 25 bp, Mus musculus
atggatgatggcctagtaaatgata

SEQ ID NO: 263956 - DNA, 25 bp, Mus musculus
atggatgatggcgtagtaaatgata

SEQ ID NO: 263957 - DNA, 25 bp, Mus musculus
atggatgattatccctctgagcacc

SEQ ID NO: 263958 - DNA, 25 bp, Mus musculus
atggatgattatgcctctgagcacc

SEQ ID NO: 263959 - DNA, 25 bp, Mus musculus
atggatgattcaagttgctgtgagg

SEQ ID NO: 263960 - DNA, 25 bp, Mus musculus
atggatgattcatgttgctgtgagg

SEQ ID NO: 263961 - DNA, 25 bp, Mus musculus
atggatgcacatcatggccccaggc

SEQ ID NO: 263962 - DNA, 25 bp, Mus musculus
atggatgcacatgatggccccaggc

SEQ ID NO: 263963 - DNA, 25 bp, Mus musculus
atggatgcatccctaatggttggag

SEQ ID NO: 263964 - DNA, 25 bp, Mus musculus
atggatgcatccgtaatggttggag

SEQ ID NO: 263965 - DNA, 25 bp, Mus musculus
atggatgcatttactcactgactag

SEQ ID NO: 263966 - DNA, 25 bp, Mus musculus
atggatgcattttctcactgactag

SEQ ID NO: 263967 - DNA, 25 bp, Mus musculus
atggatgccaagaaacccctgtact

SEQ ID NO: 263968 - DNA, 25 bp, Mus musculus
atggatgccaagtaacccctgtact

SEQ ID NO: 263969 - DNA, 25 bp, Mus musculus
atggatgccaggaacctggtcctcg

SEQ ID NO: 263970 - DNA, 25 bp, Mus musculus
atggatgccaggtacctggtcctcg

SEQ ID NO: 263971 - DNA, 25 bp, Mus musculus
atggatgccctactgtcttctcaaa

SEQ ID NO: 263972 - DNA, 25 bp, Mus musculus
atggatgccctagtgtcttctcaaa

SEQ ID NO: 263973 - DNA, 25 bp, Mus musculus
atggatgcccttcatgttttattgc

SEQ ID NO: 263974 - DNA, 25 bp, Mus musculus
atggatgcccttgatgttttattgc

SEQ ID NO: 263975 - DNA, 25 bp, Mus musculus
atggatgcgcatctggattaactta

SEQ ID NO: 263976 - DNA, 25 bp, Mus musculus
atggatgcgcatgtggattaactta

SEQ ID NO: 263977 - DNA, 25 bp, Mus musculus
atggatgcgctacagctggacttcc

SEQ ID NO: 263978 - DNA, 25 bp, Mus musculus
atggatgcgctagagctggacttcc

SEQ ID NO: 263979 - DNA, 25 bp, Mus musculus
atggatgcgtctagatactatgtta

SEQ ID NO: 263980 - DNA, 25 bp, Mus musculus
atggatgcgtcttgatactatgtta

SEQ ID NO: 263981 - DNA, 25 bp, Mus musculus
atggatgctattcttcttaattcta

SEQ ID NO: 263982 - DNA, 25 bp, Mus musculus
atggatgctattgttcttaattcta

SEQ ID NO: 263983 - DNA, 25 bp, Mus musculus
atggatgctctacagacttgctcct

SEQ ID NO: 263984 - DNA, 25 bp, Mus musculus
atggatgctctacataatgccagca

SEQ ID NO: 263985 - DNA, 25 bp, Mus musculus
atggatgctctagagacttgctcct

SEQ ID NO: 263986 - DNA, 25 bp, Mus musculus
atggatgctctagataatgccagca

SEQ ID NO: 263987 - DNA, 25 bp, Mus musculus
atggatgctgcaccctaaacatggc

SEQ ID NO: 263988 - DNA, 25 bp, Mus musculus
atggatgctgcagcctaaacatggc

SEQ ID NO: 263989 - DNA, 25 bp, Mus musculus
atggatgctttcacacgacctggaa

SEQ ID NO: 263990 - DNA, 25 bp, Mus musculus
atggatgctttctcacgacctggaa

SEQ ID NO: 263991 - DNA, 25 bp, Mus musculus
atggatggaccacagtacgacgtta

SEQ ID NO: 263992 - DNA, 25 bp, Mus musculus
atggatggaccagagtacgacgtta

SEQ ID NO: 263993 - DNA, 25 bp, Mus musculus
atggatggacccctcttatgtatgc

SEQ ID NO: 263994 - DNA, 25 bp, Mus musculus
atggatggacccgtcttatgtatgc

SEQ ID NO: 263995 - DNA, 25 bp, Mus musculus
atggatggcacacccctttacgagg

SEQ ID NO: 263996 - DNA, 25 bp, Mus musculus
atggatggcacagccctttacgagg

SEQ ID NO: 263997 - DNA, 25 bp, Mus musculus
atggatggcctcctcaagcggatgc

SEQ ID NO: 263998 - DNA, 25 bp, Mus musculus
atggatggcctcgtcaagcggatgc

SEQ ID NO: 263999 - DNA, 25 bp, Mus musculus
atggatggctccaaactagcatgca

SEQ ID NO: 264000 - DNA, 25 bp, Mus musculus
atggatggctcctaactagcatgca

SEQ ID NO: 264001 - DNA, 25 bp, Mus musculus
atggatgggactcgcacagcagcct

SEQ ID NO: 264002 - DNA, 25 bp, Mus musculus
atggatgggactggcacagcagcct

SEQ ID NO: 264003 - DNA, 25 bp, Mus musculus
atggatgggctgataccagtcttta

SEQ ID NO: 264004 - DNA, 25 bp, Mus musculus
atggatgggctgttaccagtcttta

SEQ ID NO: 264005 - DNA, 25 bp, Mus musculus
atggatgggtcccagacctatctca

SEQ ID NO: 264006 - DNA, 25 bp, Mus musculus
atggatgggtccgagacctatctca

SEQ ID NO: 264007 - DNA, 25 bp, Mus musculus
atggatggtcatatgcctttgctgc

SEQ ID NO: 264008 - DNA, 25 bp, Mus musculus
atggatggtcatttgcctttgctgc

SEQ ID NO: 264009 - DNA, 25 bp, Mus musculus
atggatggtgaaccttcattcttta

SEQ ID NO: 264010 - DNA, 25 bp, Mus musculus
atggatggtgaagcttcattcttta

SEQ ID NO: 264011 - DNA, 25 bp, Mus musculus
atggatgtagacacagactgttgct

SEQ ID NO: 264012 - DNA, 25 bp, Mus musculus
atggatgtagactcagactgttgct

SEQ ID NO: 264013 - DNA, 25 bp, Mus musculus
atggatgtaggtcatggttgtttca

SEQ ID NO: 264014 - DNA, 25 bp, Mus musculus
atggatgtaggtgatggttgtttca

SEQ ID NO: 264015 - DNA, 25 bp, Mus musculus
atggatgtattaccaggcctgcacc

SEQ ID NO: 264016 - DNA, 25 bp, Mus musculus
atggatgtattagcaggcctgcacc

SEQ ID NO: 264017 - DNA, 25 bp, Mus musculus
atggatgtcataatgtgccaccatg

SEQ ID NO: 264018 - DNA, 25 bp, Mus musculus
atggatgtcatattgtgccaccatg

SEQ ID NO: 264019 - DNA, 25 bp, Mus musculus
atggatgtcatgatgttcccagcaa

SEQ ID NO: 264020 - DNA, 25 bp, Mus musculus
atggatgtcatgttgttcccagcaa

SEQ ID NO: 264021 - DNA, 25 bp, Mus musculus
atggatgtcgacacacagaacccta

SEQ ID NO: 264022 - DNA, 25 bp, Mus musculus
atggatgtcgactcacagaacccta

SEQ ID NO: 264023 - DNA, 25 bp, Mus musculus
atggatgtctcgatttcagggattc

SEQ ID NO: 264024 - DNA, 25 bp, Mus musculus
atggatgtctcgttttcagggattc

SEQ ID NO: 264025 - DNA, 25 bp, Mus musculus
atggatgtgctcaatgtctcatggg

SEQ ID NO: 264026 - DNA, 25 bp, Mus musculus
atggatgtgctctatgtctcatggg

SEQ ID NO: 264027 - DNA, 25 bp, Mus musculus
atggatgtgctgacggtggcatttt

SEQ ID NO: 264028 - DNA, 25 bp, Mus musculus
atggatgtgctgtcggtggcatttt

SEQ ID NO: 264029 - DNA, 25 bp, Mus musculus
atggatgtggtaaacatgtatgcag

SEQ ID NO: 264030 - DNA, 25 bp, Mus musculus
atggatgtggtatacatgtatgcag

SEQ ID NO: 264031 - DNA, 25 bp, Mus musculus
atggatgtgtcacagttcctgtccc

SEQ ID NO: 264032 - DNA, 25 bp, Mus musculus
atggatgtgtcagagttcctgtccc

SEQ ID NO: 264033 - DNA, 25 bp, Mus musculus
atggatgtgtccctgcggatgtacc

SEQ ID NO: 264034 - DNA, 25 bp, Mus musculus
atggatgtgtccgtgcggatgtacc

SEQ ID NO: 264035 - DNA, 25 bp, Mus musculus
atggatgtgtgcctccggcatttcc

SEQ ID NO: 264036 - DNA, 25 bp, Mus musculus
atggatgtgtgcgtccggcatttcc

SEQ ID NO: 264037 - DNA, 25 bp, Mus musculus
atggatgttactcctaaccagccac

SEQ ID NO: 264038 - DNA, 25 bp, Mus musculus
atggatgttactgctaaccagccac

SEQ ID NO: 264039 - DNA, 25 bp, Mus musculus
atggatgttcatatggagtttgcct

SEQ ID NO: 264040 - DNA, 25 bp, Mus musculus
atggatgttcatttggagtttgcct

SEQ ID NO: 264041 - DNA, 25 bp, Mus musculus
atggatgttccaacaccaacaaatc

SEQ ID NO: 264042 - DNA, 25 bp, Mus musculus
atggatgttccatcaccaacaaatc

SEQ ID NO: 264043 - DNA, 25 bp, Mus musculus
atggatgttgatatacaatggtaaa

SEQ ID NO: 264044 - DNA, 25 bp, Mus musculus
atggatgttgatttacaatggtaaa

SEQ ID NO: 264045 - DNA, 25 bp, Mus musculus
atggatgttgtaacaagggcttgtc

SEQ ID NO: 264046 - DNA, 25 bp, Mus musculus
atggatgttgtatcaagggcttgtc

SEQ ID NO: 264047 - DNA, 25 bp, Mus musculus
atggatgtttccctttagattctag

SEQ ID NO: 264048 - DNA, 25 bp, Mus musculus
atggatgtttccgtttagattctag

SEQ ID NO: 264049 - DNA, 25 bp, Mus musculus
atggatgtttctatcatttcatgta

SEQ ID NO: 264050 - DNA, 25 bp, Mus musculus
atggatgtttctttcatttcatgta

SEQ ID NO: 264051 - DNA, 25 bp, Mus musculus
atggatgttttcctccggttctcag

SEQ ID NO: 264052 - DNA, 25 bp, Mus musculus
atggatgttttcgtccggttctcag

SEQ ID NO: 264053 - DNA, 25 bp, Mus musculus
atggattaaatgagctgccctgccc

SEQ ID NO: 264054 - DNA, 25 bp, Mus musculus
atggattaaatgtgctgccctgccc

SEQ ID NO: 264055 - DNA, 25 bp, Mus musculus
atggattaccatagacttggccctc

SEQ ID NO: 264056 - DNA, 25 bp, Mus musculus
atggattaccattgacttggccctc

SEQ ID NO: 264057 - DNA, 25 bp, Mus musculus
atggattagcctctgctcaagccac

SEQ ID NO: 264058 - DNA, 25 bp, Mus musculus
atggattagcctgtgctcaagccac

SEQ ID NO: 264059 - DNA, 25 bp, Mus musculus
atggattcagaaatccctttccctc

SEQ ID NO: 264060 - DNA, 25 bp, Mus musculus
atggattcagaattccctttccctc

SEQ ID NO: 264061 - DNA, 25 bp, Mus musculus
atggattcagcactcctacgttgcc

SEQ ID NO: 264062 - DNA, 25 bp, Mus musculus
atggattcagcagtcctacgttgcc

SEQ ID NO: 264063 - DNA, 25 bp, Mus musculus
atggattcatacagcaggtctttct

SEQ ID NO: 264064 - DNA, 25 bp, Mus musculus
atggattcatactgcaggtctttct

SEQ ID NO: 264065 - DNA, 25 bp, Mus musculus
atggattcctgactcgtcctatgga

SEQ ID NO: 264066 - DNA, 25 bp, Mus musculus
atggattcctgagtcgtcctatgga

SEQ ID NO: 264067 - DNA, 25 bp, Mus musculus
atggattcgccactatcctggtgca

SEQ ID NO: 264068 - DNA, 25 bp, Mus musculus
atggattcgccagtatcctggtgca

SEQ ID NO: 264069 - DNA, 25 bp, Mus musculus
atggattctagtctctattctgtta

SEQ ID NO: 264070 - DNA, 25 bp, Mus musculus
atggattctagtgtctattctgtta

SEQ ID NO: 264071 - DNA, 25 bp, Mus musculus
atggattctcagatgttcgaagcta

SEQ ID NO: 264072 - DNA, 25 bp, Mus musculus
atggattctcagttgttcgaagcta

SEQ ID NO: 264073 - DNA, 25 bp, Mus musculus
atggattctccaccttctactgaaa

SEQ ID NO: 264074 - DNA, 25 bp, Mus musculus
atggattctccactttcttgagttg

SEQ ID NO: 264075 - DNA, 25 bp, Mus musculus
atggattctccagcttctactgaaa

SEQ ID NO: 264076 - DNA, 25 bp, Mus musculus
atggattctccagtttcttgagttg

SEQ ID NO: 264077 - DNA, 25 bp, Mus musculus
atggattctgtaaagttgtcctctg

SEQ ID NO: 264078 - DNA, 25 bp, Mus musculus
atggattctgtatagttgtcctctg

SEQ ID NO: 264079 - DNA, 25 bp, Mus musculus
atggattctttgctagccacatgcg

SEQ ID NO: 264080 - DNA, 25 bp, Mus musculus
atggattctttggtagccacatgcg

SEQ ID NO: 264081 - DNA, 25 bp, Mus musculus
atggattgaacccttacgcctgcag

SEQ ID NO: 264082 - DNA, 25 bp, Mus musculus
atggattgaaccgttacgcctgcag

SEQ ID NO: 264083 - DNA, 25 bp, Mus musculus
atggattgaccacagttaagcttct

SEQ ID NO: 264084 - DNA, 25 bp, Mus musculus
atggattgaccagagttaagcttct

SEQ ID NO: 264085 - DNA, 25 bp, Mus musculus
atggattgctagatcggccttttct

SEQ ID NO: 264086 - DNA, 25 bp, Mus musculus
atggattgctagttcggccttttct

SEQ ID NO: 264087 - DNA, 25 bp, Mus musculus
atggattggacaagtcaccaatggg

SEQ ID NO: 264088 - DNA, 25 bp, Mus musculus
atggattggacatgtcaccaatggg

SEQ ID NO: 264089 - DNA, 25 bp, Mus musculus
atggattggcatcaagtcttgagaa

SEQ ID NO: 264090 - DNA, 25 bp, Mus musculus
atggattggcatgaagtcttgagaa

SEQ ID NO: 264091 - DNA, 25 bp, Mus musculus
atggattgttttaggatggagcttc

SEQ ID NO: 264092 - DNA, 25 bp, Mus musculus
atggattgttttatctatgtgggta

SEQ ID NO: 264093 - DNA, 25 bp, Mus musculus
atggattgtttttggatggagcttc

SEQ ID NO: 264094 - DNA, 25 bp, Mus musculus
atggattgttttttctatgtgggta

SEQ ID NO: 264095 - DNA, 25 bp, Mus musculus
atggatttcagtacatttggcacag

SEQ ID NO: 264096 - DNA, 25 bp, Mus musculus
atggatttcagttcatttggcacag

SEQ ID NO: 264097 - DNA, 25 bp, Mus musculus
atggatttccgtctctggtgtagct

SEQ ID NO: 264098 - DNA, 25 bp, Mus musculus
atggatttccgtgtctggtgtagct

SEQ ID NO: 264099 - DNA, 25 bp, Mus musculus
atggatttccttacgaatggcacta

SEQ ID NO: 264100 - DNA, 25 bp, Mus musculus
atggatttccttagcataacccctt

SEQ ID NO: 264101 - DNA, 25 bp, Mus musculus
atggatttcctttcgaatggcacta

SEQ ID NO: 264102 - DNA, 25 bp, Mus musculus
atggatttcctttgcataacccctt

SEQ ID NO: 264103 - DNA, 25 bp, Mus musculus
atggatttctagcagttgtcttagc

SEQ ID NO: 264104 - DNA, 25 bp, Mus musculus
atggatttctaggagttgtcttagc

SEQ ID NO: 264105 - DNA, 25 bp, Mus musculus
atggatttgaggcaacaccaggttc

SEQ ID NO: 264106 - DNA, 25 bp, Mus musculus
atggatttgagggaacaccaggttc

SEQ ID NO: 264107 - DNA, 25 bp, Mus musculus
atggatttgcttactctggacgttt

SEQ ID NO: 264108 - DNA, 25 bp, Mus musculus
atggatttgctttctctggacgttt

SEQ ID NO: 264109 - DNA, 25 bp, Mus musculus
atggatttgtaacagcccaattcac

SEQ ID NO: 264110 - DNA, 25 bp, Mus musculus
atggatttgtaagagcccaattcac

SEQ ID NO: 264111 - DNA, 25 bp, Mus musculus
atggatttgtagcactttggttttt

SEQ ID NO: 264112 - DNA, 25 bp, Mus musculus
atggatttgtaggactttggttttt

SEQ ID NO: 264113 - DNA, 25 bp, Mus musculus
atggatttgtgcatctcactggtgc

SEQ ID NO: 264114 - DNA, 25 bp, Mus musculus
atggatttgtgcttctcactggtgc

SEQ ID NO: 264115 - DNA, 25 bp, Mus musculus
atggatttgtgtacctgtctaccac

SEQ ID NO: 264116 - DNA, 25 bp, Mus musculus
atggatttgtgttcctgtctaccac

SEQ ID NO: 264117 - DNA, 25 bp, Mus musculus
atggattttccaacatgtatgttca

SEQ ID NO: 264118 - DNA, 25 bp, Mus musculus
atggattttccatcatgtatgttca

SEQ ID NO: 264119 - DNA, 25 bp, Mus musculus
atggatttttatacacttttcagac

SEQ ID NO: 264120 - DNA, 25 bp, Mus musculus
atggatttttattcacttttcagac

SEQ ID NO: 264121 - DNA, 25 bp, Mus musculus
atggcaaaaccaaagcacttctaac

SEQ ID NO: 264122 - DNA, 25 bp, Mus musculus
atggcaaaaccacagctgagaacgt

SEQ ID NO: 264123 - DNA, 25 bp, Mus musculus
atggcaaaaccagagctgagaacgt

SEQ ID NO: 264124 - DNA, 25 bp, Mus musculus
atggcaaaaccatagcacttctaac

SEQ ID NO: 264125 - DNA, 25 bp, Mus musculus
atggcaaaacctcgtcatctcggta

SEQ ID NO: 264126 - DNA, 25 bp, Mus musculus
atggcaaaacctggtcatctcggta

SEQ ID NO: 264127 - DNA, 25 bp, Mus musculus
atggcaaacaacctccaacaggtct

SEQ ID NO: 264128 - DNA, 25 bp, Mus musculus
atggcaaacaacgtccaacaggtct

SEQ ID NO: 264129 - DNA, 25 bp, Mus musculus
atggcaaacactcagcttctttagc

SEQ ID NO: 264130 - DNA, 25 bp, Mus musculus
atggcaaacactgagcttctttagc

SEQ ID NO: 264131 - DNA, 25 bp, Mus musculus
atggcaaaggcaattcgcaacctct

SEQ ID NO: 264132 - DNA, 25 bp, Mus musculus
atggcaaaggcatttcgcaacctct

SEQ ID NO: 264133 - DNA, 25 bp, Mus musculus
atggcaaagtcaatggctcccacga

SEQ ID NO: 264134 - DNA, 25 bp, Mus musculus
atggcaaagtcattggctcccacga

SEQ ID NO: 264135 - DNA, 25 bp, Mus musculus
atggcaaatcagacccggccgtttt

SEQ ID NO: 264136 - DNA, 25 bp, Mus musculus
atggcaaatcagtcccggccgtttt

SEQ ID NO: 264137 - DNA, 25 bp, Mus musculus
atggcaaatccaagtgcattaagag

SEQ ID NO: 264138 - DNA, 25 bp, Mus musculus
atggcaaatccatgtgcattaagag

SEQ ID NO: 264139 - DNA, 25 bp, Mus musculus
atggcaaatgcgcacttttatgttg

SEQ ID NO: 264140 - DNA, 25 bp, Mus musculus
atggcaaatgcggacttttatgttg

SEQ ID NO: 264141 - DNA, 25 bp, Mus musculus
atggcaaatgctatcacccgttcaa

SEQ ID NO: 264142 - DNA, 25 bp, Mus musculus
atggcaaatgctctcacacttgaaa

SEQ ID NO: 264143 - DNA, 25 bp, Mus musculus
atggcaaatgctgtcacacttgaaa

SEQ ID NO: 264144 - DNA, 25 bp, Mus musculus
atggcaaatgctttcacccgttcaa

SEQ ID NO: 264145 - DNA, 25 bp, Mus musculus
atggcaacaaacctgggacctcaga

SEQ ID NO: 264146 - DNA, 25 bp, Mus musculus
atggcaacaaacgtgggacctcaga

SEQ ID NO: 264147 - DNA, 25 bp, Mus musculus
atggcaacactgacagtttgcctgg

SEQ ID NO: 264148 - DNA, 25 bp, Mus musculus
atggcaacactgtcagtttgcctgg

SEQ ID NO: 264149 - DNA, 25 bp, Mus musculus
atggcaacagatctctagtctcgtc

SEQ ID NO: 264150 - DNA, 25 bp, Mus musculus
atggcaacagatgtctagtctcgtc

SEQ ID NO: 264151 - DNA, 25 bp, Mus musculus
atggcaacagctatgccactcggct

SEQ ID NO: 264152 - DNA, 25 bp, Mus musculus
atggcaacagctctcattttaaatg

SEQ ID NO: 264153 - DNA, 25 bp, Mus musculus
atggcaacagctgtcattttaaatg

SEQ ID NO: 264154 - DNA, 25 bp, Mus musculus
atggcaacagctttgccactcggct

SEQ ID NO: 264155 - DNA, 25 bp, Mus musculus
atggcaaccaagctgtatcgcacga

SEQ ID NO: 264156 - DNA, 25 bp, Mus musculus
atggcaaccaaggtgtatcgcacga

SEQ ID NO: 264157 - DNA, 25 bp, Mus musculus
atggcaaccagtatcaagatgcgct

SEQ ID NO: 264158 - DNA, 25 bp, Mus musculus
atggcaaccagtttcaagatgcgct

SEQ ID NO: 264159 - DNA, 25 bp, Mus musculus
atggcaacccatatacattcctctt

SEQ ID NO: 264160 - DNA, 25 bp, Mus musculus
atggcaacccatttacattcctctt

SEQ ID NO: 264161 - DNA, 25 bp, Mus musculus
atggcaacccgaattctagtttcct

SEQ ID NO: 264162 - DNA, 25 bp, Mus musculus
atggcaacccgatttctagtttcct

SEQ ID NO: 264163 - DNA, 25 bp, Mus musculus
atggcaacctcaacttcttgatgtg

SEQ ID NO: 264164 - DNA, 25 bp, Mus musculus
atggcaacctcatcttcttgatgtg

SEQ ID NO: 264165 - DNA, 25 bp, Mus musculus
atggcaacctgaatgtcacctactt

SEQ ID NO: 264166 - DNA, 25 bp, Mus musculus
atggcaacctgacagtgctacacgg

SEQ ID NO: 264167 - DNA, 25 bp, Mus musculus
atggcaacctgagagtgctacacgg

SEQ ID NO: 264168 - DNA, 25 bp, Mus musculus
atggcaacctgattgtcacctactt

SEQ ID NO: 264169 - DNA, 25 bp, Mus musculus
atggcaacgccactcattgtagtca

SEQ ID NO: 264170 - DNA, 25 bp, Mus musculus
atggcaacgccagtcattgtagtca

SEQ ID NO: 264171 - DNA, 25 bp, Mus musculus
atggcaactaagaagcatggctatt

SEQ ID NO: 264172 - DNA, 25 bp, Mus musculus
atggcaactaagtagcatggctatt

SEQ ID NO: 264173 - DNA, 25 bp, Mus musculus
atggcaactaccaacactgttttac

SEQ ID NO: 264174 - DNA, 25 bp, Mus musculus
atggcaactacctacactgttttac

SEQ ID NO: 264175 - DNA, 25 bp, Mus musculus
atggcaactatccagatcccttctg

SEQ ID NO: 264176 - DNA, 25 bp, Mus musculus
atggcaactatcgagatcccttctg

SEQ ID NO: 264177 - DNA, 25 bp, Mus musculus
atggcaactccaatgctatcaggcc

SEQ ID NO: 264178 - DNA, 25 bp, Mus musculus
atggcaactccattgctatcaggcc

SEQ ID NO: 264179 - DNA, 25 bp, Mus musculus
atggcaactcttatctagcatgaac

SEQ ID NO: 264180 - DNA, 25 bp, Mus musculus
atggcaactcttttctagcatgaac

SEQ ID NO: 264181 - DNA, 25 bp, Mus musculus
atggcaactgggaactgccgtgtct

SEQ ID NO: 264182 - DNA, 25 bp, Mus musculus
atggcaactgggtactgccgtgtct

SEQ ID NO: 264183 - DNA, 25 bp, Mus musculus
atggcaagaaacatatctgtacatg

SEQ ID NO: 264184 - DNA, 25 bp, Mus musculus
atggcaagaaacttatctgtacatg

SEQ ID NO: 264185 - DNA, 25 bp, Mus musculus
atggcaagaaagcacagccccacta

SEQ ID NO: 264186 - DNA, 25 bp, Mus musculus
atggcaagaaaggacagccccacta

SEQ ID NO: 264187 - DNA, 25 bp, Mus musculus
atggcaagaacacccttcctagacc

SEQ ID NO: 264188 - DNA, 25 bp, Mus musculus
atggcaagaacagccttcctagacc

SEQ ID NO: 264189 - DNA, 25 bp, Mus musculus
atggcaagaaccattatctgctgtg

SEQ ID NO: 264190 - DNA, 25 bp, Mus musculus
atggcaagaacctttatctgctgtg

SEQ ID NO: 264191 - DNA, 25 bp, Mus musculus
atggcaagaaggcaccagcccaacc

SEQ ID NO: 264192 - DNA, 25 bp, Mus musculus
atggcaagaagggaccagcccaacc

SEQ ID NO: 264193 - DNA, 25 bp, Mus musculus
atggcaagaattcacaaccctggta

SEQ ID NO: 264194 - DNA, 25 bp, Mus musculus
atggcaagaattgacaaccctggta

SEQ ID NO: 264195 - DNA, 25 bp, Mus musculus
atggcaagacatctcagaagtcgta

SEQ ID NO: 264196 - DNA, 25 bp, Mus musculus
atggcaagacatgtcagaagtcgta

SEQ ID NO: 264197 - DNA, 25 bp, Mus musculus
atggcaagaccaaggactacgctga

SEQ ID NO: 264198 - DNA, 25 bp, Mus musculus
atggcaagaccatggactacgctga

SEQ ID NO: 264199 - DNA, 25 bp, Mus musculus
atggcaagacccatggaggaggccc

SEQ ID NO: 264200 - DNA, 25 bp, Mus musculus
atggcaagacccttggaggaggccc

SEQ ID NO: 264201 - DNA, 25 bp, Mus musculus
atggcaagagatccagccctgagac

SEQ ID NO: 264202 - DNA, 25 bp, Mus musculus
atggcaagagatgcagccctgagac

SEQ ID NO: 264203 - DNA, 25 bp, Mus musculus
atggcaagagcaccccaagggtcag

SEQ ID NO: 264204 - DNA, 25 bp, Mus musculus
atggcaagagcagcccaagggtcag

SEQ ID NO: 264205 - DNA, 25 bp, Mus musculus
atggcaagatcacaaacccacacac

SEQ ID NO: 264206 - DNA, 25 bp, Mus musculus
atggcaagatcagaaacccacacac

SEQ ID NO: 264207 - DNA, 25 bp, Mus musculus
atggcaagatgcacattaccctctg

SEQ ID NO: 264208 - DNA, 25 bp, Mus musculus
atggcaagatgctcattaccctctg

SEQ ID NO: 264209 - DNA, 25 bp, Mus musculus
atggcaagcccaatggcgcctatga

SEQ ID NO: 264210 - DNA, 25 bp, Mus musculus
atggcaagcccattggcgcctatga

SEQ ID NO: 264211 - DNA, 25 bp, Mus musculus
atggcaagctctctccacatggaat

SEQ ID NO: 264212 - DNA, 25 bp, Mus musculus
atggcaagctctgtccacatggaat

SEQ ID NO: 264213 - DNA, 25 bp, Mus musculus
atggcaaggatgctgagctccctgt

SEQ ID NO: 264214 - DNA, 25 bp, Mus musculus
atggcaaggatggtgagctccctgt

SEQ ID NO: 264215 - DNA, 25 bp, Mus musculus
atggcaaggcaaacatttatctttt

SEQ ID NO: 264216 - DNA, 25 bp, Mus musculus
atggcaaggcaatcatttatctttt

SEQ ID NO: 264217 - DNA, 25 bp, Mus musculus
atggcaaggcagcaaaccgtccctc

SEQ ID NO: 264218 - DNA, 25 bp, Mus musculus
atggcaaggcaggaaaccgtccctc

SEQ ID NO: 264219 - DNA, 25 bp, Mus musculus
atggcaaggctaatgaacagtcatg

SEQ ID NO: 264220 - DNA, 25 bp, Mus musculus
atggcaaggctattgaacagtcatg

SEQ ID NO: 264221 - DNA, 25 bp, Mus musculus
atggcaaggctcatgaacagttcct

SEQ ID NO: 264222 - DNA, 25 bp, Mus musculus
atggcaaggctcttgaacagttcct

SEQ ID NO: 264223 - DNA, 25 bp, Mus musculus
atggcaagggagacactggacgtac

SEQ ID NO: 264224 - DNA, 25 bp, Mus musculus
atggcaagggagtcactggacgtac

SEQ ID NO: 264225 - DNA, 25 bp, Mus musculus
atggcaagtagaacccctacacaaa

SEQ ID NO: 264226 - DNA, 25 bp, Mus musculus
atggcaagtagatcccctacacaaa

SEQ ID NO: 264227 - DNA, 25 bp, Mus musculus
atggcaagtcatacgggtgggtcct

SEQ ID NO: 264228 - DNA, 25 bp, Mus musculus
atggcaagtcattcgggtgggtcct

SEQ ID NO: 264229 - DNA, 25 bp, Mus musculus
atggcaagtctgacccattcagcag

SEQ ID NO: 264230 - DNA, 25 bp, Mus musculus
atggcaagtctgtcccattcagcag

SEQ ID NO: 264231 - DNA, 25 bp, Mus musculus
atggcaagtgtaaccttgtgtgggt

SEQ ID NO: 264232 - DNA, 25 bp, Mus musculus
atggcaagtgtatccttgtgtgggt

SEQ ID NO: 264233 - DNA, 25 bp, Mus musculus
atggcaataaccattgggcctcaag

SEQ ID NO: 264234 - DNA, 25 bp, Mus musculus
atggcaataacctttgggcctcaag

SEQ ID NO: 264235 - DNA, 25 bp, Mus musculus
atggcaatagtcatccattgttcaa

SEQ ID NO: 264236 - DNA, 25 bp, Mus musculus
atggcaatagtcttccattgttcaa

SEQ ID NO: 264237 - DNA, 25 bp, Mus musculus
atggcaatatttccgctcgctgttg

SEQ ID NO: 264238 - DNA, 25 bp, Mus musculus
atggcaatatttgcgctcgctgttg

SEQ ID NO: 264239 - DNA, 25 bp, Mus musculus
atggcaatcattcttcctcagtttt

SEQ ID NO: 264240 - DNA, 25 bp, Mus musculus
atggcaatcattgttcctcagtttt

SEQ ID NO: 264241 - DNA, 25 bp, Mus musculus
atggcaatcgccattcagagaacca

SEQ ID NO: 264242 - DNA, 25 bp, Mus musculus
atggcaatcgcctttcagagaacca

SEQ ID NO: 264243 - DNA, 25 bp, Mus musculus
atggcaatctctacttctcgggagc

SEQ ID NO: 264244 - DNA, 25 bp, Mus musculus
atggcaatctcttcttctcgggagc

SEQ ID NO: 264245 - DNA, 25 bp, Mus musculus
atggcaatctttactctacgtagct

SEQ ID NO: 264246 - DNA, 25 bp, Mus musculus
atggcaatcttttctctacgtagct

SEQ ID NO: 264247 - DNA, 25 bp, Mus musculus
atggcaatgactacctttgctttta

SEQ ID NO: 264248 - DNA, 25 bp, Mus musculus
atggcaatgacttcctttgctttta

SEQ ID NO: 264249 - DNA, 25 bp, Mus musculus
atggcaatgggcaaaagacaaggag

SEQ ID NO: 264250 - DNA, 25 bp, Mus musculus
atggcaatgggctaaagacaaggag

SEQ ID NO: 264251 - DNA, 25 bp, Mus musculus
atggcaatgtgtaccttgttcccaa

SEQ ID NO: 264252 - DNA, 25 bp, Mus musculus
atggcaatgtgttccttgttcccaa

SEQ ID NO: 264253 - DNA, 25 bp, Mus musculus
atggcaatgttgaggctctacccta

SEQ ID NO: 264254 - DNA, 25 bp, Mus musculus
atggcaatgttgtggctctacccta

SEQ ID NO: 264255 - DNA, 25 bp, Mus musculus
atggcaattgagacccttttcgatc

SEQ ID NO: 264256 - DNA, 25 bp, Mus musculus
atggcaattgagtcccttttcgatc

SEQ ID NO: 264257 - DNA, 25 bp, Mus musculus
atggcaattgtgcagttactagtct

SEQ ID NO: 264258 - DNA, 25 bp, Mus musculus
atggcaattgtggagttactagtct

SEQ ID NO: 264259 - DNA, 25 bp, Mus musculus
atggcaattttaccaaaagcaattt

SEQ ID NO: 264260 - DNA, 25 bp, Mus musculus
atggcaattttagcaaaagcaattt

SEQ ID NO: 264261 - DNA, 25 bp, Mus musculus
atggcacaaaggactcagaggtaac

SEQ ID NO: 264262 - DNA, 25 bp, Mus musculus
atggcacaaaggtctcagaggtaac

SEQ ID NO: 264263 - DNA, 25 bp, Mus musculus
atggcacaaatgaggttttatcttt

SEQ ID NO: 264264 - DNA, 25 bp, Mus musculus
atggcacaaatgtggttttatcttt

SEQ ID NO: 264265 - DNA, 25 bp, Mus musculus
atggcacaaccgaccatgtgggcat

SEQ ID NO: 264266 - DNA, 25 bp, Mus musculus
atggcacaaccgtccatgtgggcat

SEQ ID NO: 264267 - DNA, 25 bp, Mus musculus
atggcacaagctctgcagccttagg

SEQ ID NO: 264268 - DNA, 25 bp, Mus musculus
atggcacaagctgtgcagccttagg

SEQ ID NO: 264269 - DNA, 25 bp, Mus musculus
atggcacacgtacttttgcctgtat

SEQ ID NO: 264270 - DNA, 25 bp, Mus musculus
atggcacacgtagttttgcctgtat

SEQ ID NO: 264271 - DNA, 25 bp, Mus musculus
atggcacactgtcgctccaaggaag

SEQ ID NO: 264272 - DNA, 25 bp, Mus musculus
atggcacactgtggctccaaggaag

SEQ ID NO: 264273 - DNA, 25 bp, Mus musculus
atggcacagaacctgcagtacccgg

SEQ ID NO: 264274 - DNA, 25 bp, Mus musculus
atggcacagaacgtgcagtacccgg

SEQ ID NO: 264275 - DNA, 25 bp, Mus musculus
atggcacagactatgacccacagca

SEQ ID NO: 264276 - DNA, 25 bp, Mus musculus
atggcacagactttgacccacagca

SEQ ID NO: 264277 - DNA, 25 bp, Mus musculus
atggcacagcagatgtgttcagcct

SEQ ID NO: 264278 - DNA, 25 bp, Mus musculus
atggcacagcagttgtgttcagcct

SEQ ID NO: 264279 - DNA, 25 bp, Mus musculus
atggcacagggcatgtggttcttga

SEQ ID NO: 264280 - DNA, 25 bp, Mus musculus
atggcacagggcttgtggttcttga

SEQ ID NO: 264281 - DNA, 25 bp, Mus musculus
atggcacaggtgatagcaggctact

SEQ ID NO: 264282 - DNA, 25 bp, Mus musculus
atggcacaggtgttagcaggctact

SEQ ID NO: 264283 - DNA, 25 bp, Mus musculus
atggcacagtgtcgagtgactatgt

SEQ ID NO: 264284 - DNA, 25 bp, Mus musculus
atggcacagtgtggagtgactatgt

SEQ ID NO: 264285 - DNA, 25 bp, Mus musculus
atggcacatgagctggacactgcta

SEQ ID NO: 264286 - DNA, 25 bp, Mus musculus
atggcacatgaggtggacactgcta

SEQ ID NO: 264287 - DNA, 25 bp, Mus musculus
atggcacatggtacctggtgggaat

SEQ ID NO: 264288 - DNA, 25 bp, Mus musculus
atggcacatggttcctggtgggaat

SEQ ID NO: 264289 - DNA, 25 bp, Mus musculus
atggcaccaaaccacctgagggaat

SEQ ID NO: 264290 - DNA, 25 bp, Mus musculus
atggcaccaaacgacctgagggaat

SEQ ID NO: 264291 - DNA, 25 bp, Mus musculus
atggcaccacccctgtgtgtgaaga

SEQ ID NO: 264292 - DNA, 25 bp, Mus musculus
atggcaccacccgtgtgtgtgaaga

SEQ ID NO: 264293 - DNA, 25 bp, Mus musculus
atggcaccagctaagccctaaaaat

SEQ ID NO: 264294 - DNA, 25 bp, Mus musculus
atggcaccagcttagccctaaaaat

SEQ ID NO: 264295 - DNA, 25 bp, Mus musculus
atggcaccatgcacctttgggactg

SEQ ID NO: 264296 - DNA, 25 bp, Mus musculus
atggcaccatgctcctttgggactg

SEQ ID NO: 264297 - DNA, 25 bp, Mus musculus
atggcacccagacagtcaggatggt

SEQ ID NO: 264298 - DNA, 25 bp, Mus musculus
atggcacccagagagtcaggatggt

SEQ ID NO: 264299 - DNA, 25 bp, Mus musculus
atggcaccccaaaagcaagatcctg

SEQ ID NO: 264300 - DNA, 25 bp, Mus musculus
atggcaccccaatagcaagatcctg

SEQ ID NO: 264301 - DNA, 25 bp, Mus musculus
atggcaccctcaatttcacatgggt

SEQ ID NO: 264302 - DNA, 25 bp, Mus musculus
atggcaccctcattttcacatgggt

SEQ ID NO: 264303 - DNA, 25 bp, Mus musculus
atggcaccctgcattgtgcatttac

SEQ ID NO: 264304 - DNA, 25 bp, Mus musculus
atggcaccctgctttgtgcatttac

SEQ ID NO: 264305 - DNA, 25 bp, Mus musculus
atggcaccgtgaagagcattccttt

SEQ ID NO: 264306 - DNA, 25 bp, Mus musculus
atggcaccgtgatgagcattccttt

SEQ ID NO: 264307 - DNA, 25 bp, Mus musculus
atggcacctatcatttcagattcaa

SEQ ID NO: 264308 - DNA, 25 bp, Mus musculus
atggcacctatcttttcagattcaa

SEQ ID NO: 264309 - DNA, 25 bp, Mus musculus
atggcacctccacagtaagtattgt

SEQ ID NO: 264310 - DNA, 25 bp, Mus musculus
atggcacctccagagtaagtattgt

SEQ ID NO: 264311 - DNA, 25 bp, Mus musculus
atggcacctccgcatgtccacatgt

SEQ ID NO: 264312 - DNA, 25 bp, Mus musculus
atggcacctccggatgtccacatgt

SEQ ID NO: 264313 - DNA, 25 bp, Mus musculus
atggcacgaaggactctactgcggg

SEQ ID NO: 264314 - DNA, 25 bp, Mus musculus
atggcacgaaggtctctactgcggg

SEQ ID NO: 264315 - DNA, 25 bp, Mus musculus
atggcacgcccaacaacattgacat

SEQ ID NO: 264316 - DNA, 25 bp, Mus musculus
atggcacgcccatcaacattgacat

SEQ ID NO: 264317 - DNA, 25 bp, Mus musculus
atggcacgcggtacaaaggaaaact

SEQ ID NO: 264318 - DNA, 25 bp, Mus musculus
atggcacgcggttcaaaggaaaact

SEQ ID NO: 264319 - DNA, 25 bp, Mus musculus
atggcacggtctcggcgagacaacc

SEQ ID NO: 264320 - DNA, 25 bp, Mus musculus
atggcacggtctgggcgagacaacc

SEQ ID NO: 264321 - DNA, 25 bp, Mus musculus
atggcacgtatgaggtgttggtcct

SEQ ID NO: 264322 - DNA, 25 bp, Mus musculus
atggcacgtatgtggtgttggtcct

SEQ ID NO: 264323 - DNA, 25 bp, Mus musculus
atggcacgtcatacaggcatgtgga

SEQ ID NO: 264324 - DNA, 25 bp, Mus musculus
atggcacgtcattcaggcatgtgga

SEQ ID NO: 264325 - DNA, 25 bp, Mus musculus
atggcacgtcctctgaacggagtct

SEQ ID NO: 264326 - DNA, 25 bp, Mus musculus
atggcacgtcctgtgaacggagtct

SEQ ID NO: 264327 - DNA, 25 bp, Mus musculus
atggcacgttagaggccacattgcc

SEQ ID NO: 264328 - DNA, 25 bp, Mus musculus
atggcacgttagtggccacattgcc

SEQ ID NO: 264329 - DNA, 25 bp, Mus musculus
atggcactaagtatggtttcctcag

SEQ ID NO: 264330 - DNA, 25 bp, Mus musculus
atggcactaagtttggtttcctcag

SEQ ID NO: 264331 - DNA, 25 bp, Mus musculus
atggcactaccccaaggcttttcct

SEQ ID NO: 264332 - DNA, 25 bp, Mus musculus
atggcactacccgaaggcttttcct

SEQ ID NO: 264333 - DNA, 25 bp, Mus musculus
atggcactatccattgctgtgctga

SEQ ID NO: 264334 - DNA, 25 bp, Mus musculus
atggcactatcctttgctgtgctga

SEQ ID NO: 264335 - DNA, 25 bp, Mus musculus
atggcactatgaatccgcgtggtag

SEQ ID NO: 264336 - DNA, 25 bp, Mus musculus
atggcactatgattccgcgtggtag

SEQ ID NO: 264337 - DNA, 25 bp, Mus musculus
atggcactattcatcatttttatgt

SEQ ID NO: 264338 - DNA, 25 bp, Mus musculus
atggcactattcttcatttttatgt

SEQ ID NO: 264339 - DNA, 25 bp, Mus musculus
atggcactcacaccgcgaaagtcat

SEQ ID NO: 264340 - DNA, 25 bp, Mus musculus
atggcactcacagcgcgaaagtcat

SEQ ID NO: 264341 - DNA, 25 bp, Mus musculus
atggcactccagcttctctgaatgg

SEQ ID NO: 264342 - DNA, 25 bp, Mus musculus
atggcactccaggttctctgaatgg

SEQ ID NO: 264343 - DNA, 25 bp, Mus musculus
atggcactcgctagggagaatcgac

SEQ ID NO: 264344 - DNA, 25 bp, Mus musculus
atggcactcgcttgggagaatcgac

SEQ ID NO: 264345 - DNA, 25 bp, Mus musculus
atggcactgcatcatgccttggaat

SEQ ID NO: 264346 - DNA, 25 bp, Mus musculus
atggcactgcatgatgccttggaat

SEQ ID NO: 264347 - DNA, 25 bp, Mus musculus
atggcactgcccatcagtcatgaaa

SEQ ID NO: 264348 - DNA, 25 bp, Mus musculus
atggcactgcccatgtagtgtccca

SEQ ID NO: 264349 - DNA, 25 bp, Mus musculus
atggcactgcccttcagtcatgaaa

SEQ ID NO: 264350 - DNA, 25 bp, Mus musculus
atggcactgcccttgtagtgtccca

SEQ ID NO: 264351 - DNA, 25 bp, Mus musculus
atggcactggctaggcaacagtatt

SEQ ID NO: 264352 - DNA, 25 bp, Mus musculus
atggcactggcttggcaacagtatt

SEQ ID NO: 264353 - DNA, 25 bp, Mus musculus
atggcactgtccctgtgtgacctgt

SEQ ID NO: 264354 - DNA, 25 bp, Mus musculus
atggcactgtccgtgtgtgacctgt

SEQ ID NO: 264355 - DNA, 25 bp, Mus musculus
atggcactgtggaactcttcttgag

SEQ ID NO: 264356 - DNA, 25 bp, Mus musculus
atggcactgtggtactcttcttgag

SEQ ID NO: 264357 - DNA, 25 bp, Mus musculus
atggcacttgccctgaagtcatcaa

SEQ ID NO: 264358 - DNA, 25 bp, Mus musculus
atggcacttgccgtgaagtcatcaa

SEQ ID NO: 264359 - DNA, 25 bp, Mus musculus
atggcacttggtcctaaagaatcag

SEQ ID NO: 264360 - DNA, 25 bp, Mus musculus
atggcacttggtgctaaagaatcag

SEQ ID NO: 264361 - DNA, 25 bp, Mus musculus
atggcagaacctcaccctgaggaca

SEQ ID NO: 264362 - DNA, 25 bp, Mus musculus
atggcagaacctgaccctgaggaca

SEQ ID NO: 264363 - DNA, 25 bp, Mus musculus
atggcagaacgtcgtgatgagcccc

SEQ ID NO: 264364 - DNA, 25 bp, Mus musculus
atggcagaacgtggtgatgagcccc

SEQ ID NO: 264365 - DNA, 25 bp, Mus musculus
atggcagaagatctggccctgacct

SEQ ID NO: 264366 - DNA, 25 bp, Mus musculus
atggcagaagatgtggccctgacct

SEQ ID NO: 264367 - DNA, 25 bp, Mus musculus
atggcagaagtgaagtcgatgttcc

SEQ ID NO: 264368 - DNA, 25 bp, Mus musculus
atggcagaagtgattgttcctccaa

SEQ ID NO: 264369 - DNA, 25 bp, Mus musculus
atggcagaagtgtagtcgatgttcc

SEQ ID NO: 264370 - DNA, 25 bp, Mus musculus
atggcagaagtgtttgttcctccaa

SEQ ID NO: 264371 - DNA, 25 bp, Mus musculus
atggcagacaacatgagcatcggaa

SEQ ID NO: 264372 - DNA, 25 bp, Mus musculus
atggcagacaacttgagcatcggaa

SEQ ID NO: 264373 - DNA, 25 bp, Mus musculus
atggcagacctccaagcgaagctcg

SEQ ID NO: 264374 - DNA, 25 bp, Mus musculus
atggcagacctcgaagcgaagctcg

SEQ ID NO: 264375 - DNA, 25 bp, Mus musculus
atggcagactacagtcagctcgaag

SEQ ID NO: 264376 - DNA, 25 bp, Mus musculus
atggcagactactgtcagctcgaag

SEQ ID NO: 264377 - DNA, 25 bp, Mus musculus
atggcagagaaacttcctgcctcca

SEQ ID NO: 264378 - DNA, 25 bp, Mus musculus
atggcagagaaagttcctgcctcca

SEQ ID NO: 264379 - DNA, 25 bp, Mus musculus
atggcagagacaacttgaccgcggc

SEQ ID NO: 264380 - DNA, 25 bp, Mus musculus
atggcagagacaccgcatacgtggc

SEQ ID NO: 264381 - DNA, 25 bp, Mus musculus
atggcagagacagcgcatacgtggc

SEQ ID NO: 264382 - DNA, 25 bp, Mus musculus
atggcagagacatcttgaccgcggc

SEQ ID NO: 264383 - DNA, 25 bp, Mus musculus
atggcagagcacacggcttggtcat

SEQ ID NO: 264384 - DNA, 25 bp, Mus musculus
atggcagagcactcggcttggtcat

SEQ ID NO: 264385 - DNA, 25 bp, Mus musculus
atggcagagcgaaggcagcacctga

SEQ ID NO: 264386 - DNA, 25 bp, Mus musculus
atggcagagcgatggcagcacctga

SEQ ID NO: 264387 - DNA, 25 bp, Mus musculus
atggcagagtcacacctcatctcag

SEQ ID NO: 264388 - DNA, 25 bp, Mus musculus
atggcagagtcagacctcatctcag

SEQ ID NO: 264389 - DNA, 25 bp, Mus musculus
atggcagagtggagtccgagactaa

SEQ ID NO: 264390 - DNA, 25 bp, Mus musculus
atggcagagtggtgtccgagactaa

SEQ ID NO: 264391 - DNA, 25 bp, Mus musculus
atggcagataccaatggcagcacaa

SEQ ID NO: 264392 - DNA, 25 bp, Mus musculus
atggcagatacctatggcagcacaa

SEQ ID NO: 264393 - DNA, 25 bp, Mus musculus
atggcagatcacaactgtctatgta

SEQ ID NO: 264394 - DNA, 25 bp, Mus musculus
atggcagatcactactgtctatgta

SEQ ID NO: 264395 - DNA, 25 bp, Mus musculus
atggcagatctgattggaaatgttt

SEQ ID NO: 264396 - DNA, 25 bp, Mus musculus
atggcagatctgtttggaaatgttt

SEQ ID NO: 264397 - DNA, 25 bp, Mus musculus
atggcagatcttcttacagccctct

SEQ ID NO: 264398 - DNA, 25 bp, Mus musculus
atggcagatcttgttacagccctct

SEQ ID NO: 264399 - DNA, 25 bp, Mus musculus
atggcagatgtcattctgtcaccat

SEQ ID NO: 264400 - DNA, 25 bp, Mus musculus
atggcagatgtctttctgtcaccat

SEQ ID NO: 264401 - DNA, 25 bp, Mus musculus
atggcagcacacatatgtctcccta

SEQ ID NO: 264402 - DNA, 25 bp, Mus musculus
atggcagcacacttatgtctcccta

SEQ ID NO: 264403 - DNA, 25 bp, Mus musculus
atggcagcacatcgctgtaacccca

SEQ ID NO: 264404 - DNA, 25 bp, Mus musculus
atggcagcacatggctgtaacccca

SEQ ID NO: 264405 - DNA, 25 bp, Mus musculus
atggcagcagttaactaaagctttg

SEQ ID NO: 264406 - DNA, 25 bp, Mus musculus
atggcagcagttcgcagccagcagt

SEQ ID NO: 264407 - DNA, 25 bp, Mus musculus
atggcagcagttggcagccagcagt

SEQ ID NO: 264408 - DNA, 25 bp, Mus musculus
atggcagcagtttactaaagctttg

SEQ ID NO: 264409 - DNA, 25 bp, Mus musculus
atggcagcatcgattcatggcaaaa

SEQ ID NO: 264410 - DNA, 25 bp, Mus musculus
atggcagcatcgtttcatggcaaaa

SEQ ID NO: 264411 - DNA, 25 bp, Mus musculus
atggcagcatgtagcctagtcagcc

SEQ ID NO: 264412 - DNA, 25 bp, Mus musculus
atggcagcatgttgcctagtcagcc

SEQ ID NO: 264413 - DNA, 25 bp, Mus musculus
atggcagccaacaacccagttccaa

SEQ ID NO: 264414 - DNA, 25 bp, Mus musculus
atggcagccaactacccagttccaa

SEQ ID NO: 264415 - DNA, 25 bp, Mus musculus
atggcagccacgattcccagcggca

SEQ ID NO: 264416 - DNA, 25 bp, Mus musculus
atggcagccacgtttcccagcggca

SEQ ID NO: 264417 - DNA, 25 bp, Mus musculus
atggcagccatgagactagtgtccg

SEQ ID NO: 264418 - DNA, 25 bp, Mus musculus
atggcagccatgcaagaatcccctt

SEQ ID NO: 264419 - DNA, 25 bp, Mus musculus
atggcagccatggaagaatcccctt

SEQ ID NO: 264420 - DNA, 25 bp, Mus musculus
atggcagccatgtgactagtgtccg

SEQ ID NO: 264421 - DNA, 25 bp, Mus musculus
atggcagcccagaaacatgaactct

SEQ ID NO: 264422 - DNA, 25 bp, Mus musculus
atggcagcccagtaacatgaactct

SEQ ID NO: 264423 - DNA, 25 bp, Mus musculus
atggcagccctcagtgcaagatgca

SEQ ID NO: 264424 - DNA, 25 bp, Mus musculus
atggcagccctctgtgcaagatgca

SEQ ID NO: 264425 - DNA, 25 bp, Mus musculus
atggcagccgggacccgcccgacag

SEQ ID NO: 264426 - DNA, 25 bp, Mus musculus
atggcagccgggtcccgcccgacag

SEQ ID NO: 264427 - DNA, 25 bp, Mus musculus
atggcagcctagaggtgacaggtca

SEQ ID NO: 264428 - DNA, 25 bp, Mus musculus
atggcagcctagtggtgacaggtca

SEQ ID NO: 264429 - DNA, 25 bp, Mus musculus
atggcagcctcacaattcggtaacc

SEQ ID NO: 264430 - DNA, 25 bp, Mus musculus
atggcagcctcagaattcggtaacc

SEQ ID NO: 264431 - DNA, 25 bp, Mus musculus
atggcagcctgtaatgcgctcctgg

SEQ ID NO: 264432 - DNA, 25 bp, Mus musculus
atggcagcctgttatgcgctcctgg

SEQ ID NO: 264433 - DNA, 25 bp, Mus musculus
atggcagccttaaatacttatctat

SEQ ID NO: 264434 - DNA, 25 bp, Mus musculus
atggcagccttatatacttatctat

SEQ ID NO: 264435 - DNA, 25 bp, Mus musculus
atggcagcgtcactgacggactcct

SEQ ID NO: 264436 - DNA, 25 bp, Mus musculus
atggcagcgtcagtgacggactcct

SEQ ID NO: 264437 - DNA, 25 bp, Mus musculus
atggcagctcacatccatcagtaat

SEQ ID NO: 264438 - DNA, 25 bp, Mus musculus
atggcagctcacttccatcagtaat

SEQ ID NO: 264439 - DNA, 25 bp, Mus musculus
atggcagctgagagcatggcctctg

SEQ ID NO: 264440 - DNA, 25 bp, Mus musculus
atggcagctgagcttaacccctatc

SEQ ID NO: 264441 - DNA, 25 bp, Mus musculus
atggcagctgaggttaacccctatc

SEQ ID NO: 264442 - DNA, 25 bp, Mus musculus
atggcagctgagtgcatggcctctg

SEQ ID NO: 264443 - DNA, 25 bp, Mus musculus
atggcagcttacatccctgactgta

SEQ ID NO: 264444 - DNA, 25 bp, Mus musculus
atggcagcttacttccctgactgta

SEQ ID NO: 264445 - DNA, 25 bp, Mus musculus
atggcagcttctacatacgaattaa

SEQ ID NO: 264446 - DNA, 25 bp, Mus musculus
atggcagcttcttcatacgaattaa

SEQ ID NO: 264447 - DNA, 25 bp, Mus musculus
atggcaggacatacactcctggtca

SEQ ID NO: 264448 - DNA, 25 bp, Mus musculus
atggcaggacattcactcctggtca

SEQ ID NO: 264449 - DNA, 25 bp, Mus musculus
atggcaggacctctgtatccatgcc

SEQ ID NO: 264450 - DNA, 25 bp, Mus musculus
atggcaggacctgtgtatccatgcc

SEQ ID NO: 264451 - DNA, 25 bp, Mus musculus
atggcaggccctatgccaaattgag

SEQ ID NO: 264452 - DNA, 25 bp, Mus musculus
atggcaggccctttgccaaattgag

SEQ ID NO: 264453 - DNA, 25 bp, Mus musculus
atggcaggcgacatctactccgtat

SEQ ID NO: 264454 - DNA, 25 bp, Mus musculus
atggcaggcgacttctactccgtat

SEQ ID NO: 264455 - DNA, 25 bp, Mus musculus
atggcaggcgcaaactcgattttct

SEQ ID NO: 264456 - DNA, 25 bp, Mus musculus
atggcaggcgcatactcgattttct

SEQ ID NO: 264457 - DNA, 25 bp, Mus musculus
atggcaggcgccagggtcttctaag

SEQ ID NO: 264458 - DNA, 25 bp, Mus musculus
atggcaggcgcctgggtcttctaag

SEQ ID NO: 264459 - DNA, 25 bp, Mus musculus
atggcaggctcactttaatccctca

SEQ ID NO: 264460 - DNA, 25 bp, Mus musculus
atggcaggctcagtttaatccctca

SEQ ID NO: 264461 - DNA, 25 bp, Mus musculus
atggcaggctctcatggtaaccttt

SEQ ID NO: 264462 - DNA, 25 bp, Mus musculus
atggcaggctctgatggtaaccttt

SEQ ID NO: 264463 - DNA, 25 bp, Mus musculus
atggcaggctttccctttataagca

SEQ ID NO: 264464 - DNA, 25 bp, Mus musculus
atggcaggctttgcctttataagca

SEQ ID NO: 264465 - DNA, 25 bp, Mus musculus
atggcaggtaccactaccaatttaa

SEQ ID NO: 264466 - DNA, 25 bp, Mus musculus
atggcaggtacctctaccaatttaa

SEQ ID NO: 264467 - DNA, 25 bp, Mus musculus
atggcaggtgcacagaagtctctga

SEQ ID NO: 264468 - DNA, 25 bp, Mus musculus
atggcaggtgcagagaagtctctga

SEQ ID NO: 264469 - DNA, 25 bp, Mus musculus
atggcaggttcaccggaaagtgatc

SEQ ID NO: 264470 - DNA, 25 bp, Mus musculus
atggcaggttcagcggaaagtgatc

SEQ ID NO: 264471 - DNA, 25 bp, Mus musculus
atggcagtaaacacatccctcatgc

SEQ ID NO: 264472 - DNA, 25 bp, Mus musculus
atggcagtaaactcatccctcatgc

SEQ ID NO: 264473 - DNA, 25 bp, Mus musculus
atggcagtacaacctgggcaccttc

SEQ ID NO: 264474 - DNA, 25 bp, Mus musculus
atggcagtacaagctgggcaccttc

SEQ ID NO: 264475 - DNA, 25 bp, Mus musculus
atggcagtactcatgttccccttga

SEQ ID NO: 264476 - DNA, 25 bp, Mus musculus
atggcagtactcttgttccccttga

SEQ ID NO: 264477 - DNA, 25 bp, Mus musculus
atggcagtcagcacaagacctgcat

SEQ ID NO: 264478 - DNA, 25 bp, Mus musculus
atggcagtcagctcaagacctgcat

SEQ ID NO: 264479 - DNA, 25 bp, Mus musculus
atggcagtcatgctttcttctgcct

SEQ ID NO: 264480 - DNA, 25 bp, Mus musculus
atggcagtcatggtttcttctgcct

SEQ ID NO: 264481 - DNA, 25 bp, Mus musculus
atggcagtccgcagcatcatggttg

SEQ ID NO: 264482 - DNA, 25 bp, Mus musculus
atggcagtccgctgcatcatggttg

SEQ ID NO: 264483 - DNA, 25 bp, Mus musculus
atggcagtctgcactcctcgggtga

SEQ ID NO: 264484 - DNA, 25 bp, Mus musculus
atggcagtctgcatatatccttctg

SEQ ID NO: 264485 - DNA, 25 bp, Mus musculus
atggcagtctgctctcctcgggtga

SEQ ID NO: 264486 - DNA, 25 bp, Mus musculus
atggcagtctgcttatatccttctg

SEQ ID NO: 264487 - DNA, 25 bp, Mus musculus
atggcagtctggcaactaaccctaa

SEQ ID NO: 264488 - DNA, 25 bp, Mus musculus
atggcagtctgggaactaaccctaa

SEQ ID NO: 264489 - DNA, 25 bp, Mus musculus
atggcagtgaaacgacggtctacaa

SEQ ID NO: 264490 - DNA, 25 bp, Mus musculus
atggcagtgaaaggacggtctacaa

SEQ ID NO: 264491 - DNA, 25 bp, Mus musculus
atggcagtgatacttttaaacttag

SEQ ID NO: 264492 - DNA, 25 bp, Mus musculus
atggcagtgatagttttaaacttag

SEQ ID NO: 264493 - DNA, 25 bp, Mus musculus
atggcagtgcccatgcatgccggca

SEQ ID NO: 264494 - DNA, 25 bp, Mus musculus
atggcagtgcccattggtacacact

SEQ ID NO: 264495 - DNA, 25 bp, Mus musculus
atggcagtgcccttgcatgccggca

SEQ ID NO: 264496 - DNA, 25 bp, Mus musculus
atggcagtgccctttggtacacact

SEQ ID NO: 264497 - DNA, 25 bp, Mus musculus
atggcagtgcctcacgaatcatctc

SEQ ID NO: 264498 - DNA, 25 bp, Mus musculus
atggcagtgcctgacgaatcatctc

SEQ ID NO: 264499 - DNA, 25 bp, Mus musculus
atggcagtgtgtattcaagcagtac

SEQ ID NO: 264500 - DNA, 25 bp, Mus musculus
atggcagtgtgttttcaagcagtac

SEQ ID NO: 264501 - DNA, 25 bp, Mus musculus
atggcagtgtttccactctgggaat

SEQ ID NO: 264502 - DNA, 25 bp, Mus musculus
atggcagtgtttgcactctgggaat

SEQ ID NO: 264503 - DNA, 25 bp, Mus musculus
atggcagttctgagcctgtgagcat

SEQ ID NO: 264504 - DNA, 25 bp, Mus musculus
atggcagttctgtgcctgtgagcat

SEQ ID NO: 264505 - DNA, 25 bp, Mus musculus
atggcagttgttctagttttcctat

SEQ ID NO: 264506 - DNA, 25 bp, Mus musculus
atggcagttgttgtagttttcctat

SEQ ID NO: 264507 - DNA, 25 bp, Mus musculus
atggcatacgccaacacgcttctgc

SEQ ID NO: 264508 - DNA, 25 bp, Mus musculus
atggcatacgcctacacgcttctgc

SEQ ID NO: 264509 - DNA, 25 bp, Mus musculus
atggcatactcaatgctccaagcct

SEQ ID NO: 264510 - DNA, 25 bp, Mus musculus
atggcatactcattgctccaagcct

SEQ ID NO: 264511 - DNA, 25 bp, Mus musculus
atggcatactgaaatattgctagaa

SEQ ID NO: 264512 - DNA, 25 bp, Mus musculus
atggcatactgatatattgctagaa

SEQ ID NO: 264513 - DNA, 25 bp, Mus musculus
atggcatagaacatagcattcctcc

SEQ ID NO: 264514 - DNA, 25 bp, Mus musculus
atggcatagaacttagcattcctcc

SEQ ID NO: 264515 - DNA, 25 bp, Mus musculus
atggcatagctgagcgttgtcactc

SEQ ID NO: 264516 - DNA, 25 bp, Mus musculus
atggcatagctgtgcgttgtcactc

SEQ ID NO: 264517 - DNA, 25 bp, Mus musculus
atggcatagtttctccagcaaggac

SEQ ID NO: 264518 - DNA, 25 bp, Mus musculus
atggcatagtttgtccagcaaggac

SEQ ID NO: 264519 - DNA, 25 bp, Mus musculus
atggcatatccactaagctccacct

SEQ ID NO: 264520 - DNA, 25 bp, Mus musculus
atggcatatccagtaagctccacct

SEQ ID NO: 264521 - DNA, 25 bp, Mus musculus
atggcatatgccatattattccctt

SEQ ID NO: 264522 - DNA, 25 bp, Mus musculus
atggcatatgccttattattccctt

SEQ ID NO: 264523 - DNA, 25 bp, Mus musculus
atggcatattcgaacgtgaccgttt

SEQ ID NO: 264524 - DNA, 25 bp, Mus musculus
atggcatattcgtacgtgaccgttt

SEQ ID NO: 264525 - DNA, 25 bp, Mus musculus
atggcatcaagaacagcggcaggga

SEQ ID NO: 264526 - DNA, 25 bp, Mus musculus
atggcatcaagatcagcggcaggga

SEQ ID NO: 264527 - DNA, 25 bp, Mus musculus
atggcatcacttcttgatctttctg

SEQ ID NO: 264528 - DNA, 25 bp, Mus musculus
atggcatcacttgttgatctttctg

SEQ ID NO: 264529 - DNA, 25 bp, Mus musculus
atggcatcaggcatgagcaccagca

SEQ ID NO: 264530 - DNA, 25 bp, Mus musculus
atggcatcaggcttgagcaccagca

SEQ ID NO: 264531 - DNA, 25 bp, Mus musculus
atggcatcatcccagacgtttatga

SEQ ID NO: 264532 - DNA, 25 bp, Mus musculus
atggcatcatccgagacgtttatga

SEQ ID NO: 264533 - DNA, 25 bp, Mus musculus
atggcatcattgattctttgttaat

SEQ ID NO: 264534 - DNA, 25 bp, Mus musculus
atggcatcattgtttctttgttaat

SEQ ID NO: 264535 - DNA, 25 bp, Mus musculus
atggcatcatttagtcagatccctg

SEQ ID NO: 264536 - DNA, 25 bp, Mus musculus
atggcatcattttgtcagatccctg

SEQ ID NO: 264537 - DNA, 25 bp, Mus musculus
atggcatccagcactacattgcaat

SEQ ID NO: 264538 - DNA, 25 bp, Mus musculus
atggcatccagctctacattgcaat

SEQ ID NO: 264539 - DNA, 25 bp, Mus musculus
atggcatcccctcctttgttagaaa

SEQ ID NO: 264540 - DNA, 25 bp, Mus musculus
atggcatcccctgctttgttagaaa

SEQ ID NO: 264541 - DNA, 25 bp, Mus musculus
atggcatcctctcgtcagtagaagt

SEQ ID NO: 264542 - DNA, 25 bp, Mus musculus
atggcatcctctggtcagtagaagt

SEQ ID NO: 264543 - DNA, 25 bp, Mus musculus
atggcatcctggaacccacagtgag

SEQ ID NO: 264544 - DNA, 25 bp, Mus musculus
atggcatcctggtacccacagtgag

SEQ ID NO: 264545 - DNA, 25 bp, Mus musculus
atggcatccttaacttggaggcgcc

SEQ ID NO: 264546 - DNA, 25 bp, Mus musculus
atggcatccttaattcacagaggag

SEQ ID NO: 264547 - DNA, 25 bp, Mus musculus
atggcatccttatcttggaggcgcc

SEQ ID NO: 264548 - DNA, 25 bp, Mus musculus
atggcatccttatttcacagaggag

SEQ ID NO: 264549 - DNA, 25 bp, Mus musculus
atggcatcgagacgctttctctgtc

SEQ ID NO: 264550 - DNA, 25 bp, Mus musculus
atggcatcgagaggctttctctgtc

SEQ ID NO: 264551 - DNA, 25 bp, Mus musculus
atggcatcgagtactggattgtccg

SEQ ID NO: 264552 - DNA, 25 bp, Mus musculus
atggcatcgagttctggattgtccg

SEQ ID NO: 264553 - DNA, 25 bp, Mus musculus
atggcatcgctgaggttggcatttt

SEQ ID NO: 264554 - DNA, 25 bp, Mus musculus
atggcatcgctgtggttggcatttt

SEQ ID NO: 264555 - DNA, 25 bp, Mus musculus
atggcatctccaagtaagctgtcac

SEQ ID NO: 264556 - DNA, 25 bp, Mus musculus
atggcatctccatgtaagctgtcac

SEQ ID NO: 264557 - DNA, 25 bp, Mus musculus
atggcatctgagatttgcttgagaa

SEQ ID NO: 264558 - DNA, 25 bp, Mus musculus
atggcatctgagttttgcttgagaa

SEQ ID NO: 264559 - DNA, 25 bp, Mus musculus
atggcatctgcactctgctgacaag

SEQ ID NO: 264560 - DNA, 25 bp, Mus musculus
atggcatctgcagtctgctgacaag

SEQ ID NO: 264561 - DNA, 25 bp, Mus musculus
atggcatctgccagtgtatgttgca

SEQ ID NO: 264562 - DNA, 25 bp, Mus musculus
atggcatctgcctgtgtatgttgca

SEQ ID NO: 264563 - DNA, 25 bp, Mus musculus
atggcatctgtgagactgctgctga

SEQ ID NO: 264564 - DNA, 25 bp, Mus musculus
atggcatctgtgtgactgctgctga

SEQ ID NO: 264565 - DNA, 25 bp, Mus musculus
atggcatcttgcagtgctgtggttt

SEQ ID NO: 264566 - DNA, 25 bp, Mus musculus
atggcatcttgctgtgctgtggttt

SEQ ID NO: 264567 - DNA, 25 bp, Mus musculus
atggcatctttccttacctctatgt

SEQ ID NO: 264568 - DNA, 25 bp, Mus musculus
atggcatctttcgttacctctatgt

SEQ ID NO: 264569 - DNA, 25 bp, Mus musculus
atggcatgacacatctaactcagac

SEQ ID NO: 264570 - DNA, 25 bp, Mus musculus
atggcatgacacttctaactcagac

SEQ ID NO: 264571 - DNA, 25 bp, Mus musculus
atggcatgagcaaccaggctctgtt

SEQ ID NO: 264572 - DNA, 25 bp, Mus musculus
atggcatgagcatccaggctctgtt

SEQ ID NO: 264573 - DNA, 25 bp, Mus musculus
atggcatgagtaagttgtgaaggct

SEQ ID NO: 264574 - DNA, 25 bp, Mus musculus
atggcatgagtatgttgtgaaggct

SEQ ID NO: 264575 - DNA, 25 bp, Mus musculus
atggcatgcactagctagcggtcta

SEQ ID NO: 264576 - DNA, 25 bp, Mus musculus
atggcatgcacttgctagcggtcta

SEQ ID NO: 264577 - DNA, 25 bp, Mus musculus
atggcatgctctatctcaagttcag

SEQ ID NO: 264578 - DNA, 25 bp, Mus musculus
atggcatgctctttctcaagttcag

SEQ ID NO: 264579 - DNA, 25 bp, Mus musculus
atggcatggcagcttgatatccaca

SEQ ID NO: 264580 - DNA, 25 bp, Mus musculus
atggcatggcaggttgatatccaca

SEQ ID NO: 264581 - DNA, 25 bp, Mus musculus
atggcatggctgcatcttctggtca

SEQ ID NO: 264582 - DNA, 25 bp, Mus musculus
atggcatggctggatcttctggtca

SEQ ID NO: 264583 - DNA, 25 bp, Mus musculus
atggcatggtcccattgtaggcctg

SEQ ID NO: 264584 - DNA, 25 bp, Mus musculus
atggcatggtccgattgtaggcctg

SEQ ID NO: 264585 - DNA, 25 bp, Mus musculus
atggcatggtgcacgtctactgaaa

SEQ ID NO: 264586 - DNA, 25 bp, Mus musculus
atggcatggtgctcgtctactgaaa

SEQ ID NO: 264587 - DNA, 25 bp, Mus musculus
atggcatggtgtattcttggttatc

SEQ ID NO: 264588 - DNA, 25 bp, Mus musculus
atggcatggtgttttcttggttatc

SEQ ID NO: 264589 - DNA, 25 bp, Mus musculus
atggcatgtcttcacctaggcccag

SEQ ID NO: 264590 - DNA, 25 bp, Mus musculus
atggcatgtcttgacctaggcccag

SEQ ID NO: 264591 - DNA, 25 bp, Mus musculus
atggcatgttctacaagcttctgtg

SEQ ID NO: 264592 - DNA, 25 bp, Mus musculus
atggcatgttcttcaagcttctgtg

SEQ ID NO: 264593 - DNA, 25 bp, Mus musculus
atggcatgttttcagtgctacatct

SEQ ID NO: 264594 - DNA, 25 bp, Mus musculus
atggcatgttttgagtgctacatct

SEQ ID NO: 264595 - DNA, 25 bp, Mus musculus
atggcattactcagcactctagcca

SEQ ID NO: 264596 - DNA, 25 bp, Mus musculus
atggcattactctgcactctagcca

SEQ ID NO: 264597 - DNA, 25 bp, Mus musculus
atggcattagtgactctctcatcaa

SEQ ID NO: 264598 - DNA, 25 bp, Mus musculus
atggcattagtgtctctctcatcaa

SEQ ID NO: 264599 - DNA, 25 bp, Mus musculus
atggcattcatactccacgaacaga

SEQ ID NO: 264600 - DNA, 25 bp, Mus musculus
atggcattcatagtccacgaacaga

SEQ ID NO: 264601 - DNA, 25 bp, Mus musculus
atggcattcattatcctggcagagg

SEQ ID NO: 264602 - DNA, 25 bp, Mus musculus
atggcattcattttcctggcagagg

SEQ ID NO: 264603 - DNA, 25 bp, Mus musculus
atggcattccaactgagctgtgctc

SEQ ID NO: 264604 - DNA, 25 bp, Mus musculus
atggcattccaagtgagctgtgctc

SEQ ID NO: 264605 - DNA, 25 bp, Mus musculus
atggcattcctcatcaactggattg

SEQ ID NO: 264606 - DNA, 25 bp, Mus musculus
atggcattcctcttcaactggattg

SEQ ID NO: 264607 - DNA, 25 bp, Mus musculus
atggcattcttcatcaccttcatgg

SEQ ID NO: 264608 - DNA, 25 bp, Mus musculus
atggcattcttcttcaccttcatgg

SEQ ID NO: 264609 - DNA, 25 bp, Mus musculus
atggcattcttgctactgtgctgtg

SEQ ID NO: 264610 - DNA, 25 bp, Mus musculus
atggcattcttggtactgtgctgtg

SEQ ID NO: 264611 - DNA, 25 bp, Mus musculus
atggcattgcggaaggacggcttca

SEQ ID NO: 264612 - DNA, 25 bp, Mus musculus
atggcattgcggtaggacggcttca

SEQ ID NO: 264613 - DNA, 25 bp, Mus musculus
atggcattgggcaaacccggccagt

SEQ ID NO: 264614 - DNA, 25 bp, Mus musculus
atggcattgggcattgtggcttaca

SEQ ID NO: 264615 - DNA, 25 bp, Mus musculus
atggcattgggctaacccggccagt

SEQ ID NO: 264616 - DNA, 25 bp, Mus musculus
atggcattgggctttgtggcttaca

SEQ ID NO: 264617 - DNA, 25 bp, Mus musculus
atggcattgttaccaactgggacga

SEQ ID NO: 264618 - DNA, 25 bp, Mus musculus
atggcattgttagcaactgggacga

SEQ ID NO: 264619 - DNA, 25 bp, Mus musculus
atggcattgttcagtcgtggagcgt

SEQ ID NO: 264620 - DNA, 25 bp, Mus musculus
atggcattgttctgtcgtggagcgt

SEQ ID NO: 264621 - DNA, 25 bp, Mus musculus
atggcatttagtctagttgaagaaa

SEQ ID NO: 264622 - DNA, 25 bp, Mus musculus
atggcatttagtgtagttgaagaaa

SEQ ID NO: 264623 - DNA, 25 bp, Mus musculus
atggcatttcaacgtggctttgtca

SEQ ID NO: 264624 - DNA, 25 bp, Mus musculus
atggcatttcaaggtggctttgtca

SEQ ID NO: 264625 - DNA, 25 bp, Mus musculus
atggcatttctaaaagcaccctacc

SEQ ID NO: 264626 - DNA, 25 bp, Mus musculus
atggcatttctataagcaccctacc

SEQ ID NO: 264627 - DNA, 25 bp, Mus musculus
atggcatttctgaagttgcacaaga

SEQ ID NO: 264628 - DNA, 25 bp, Mus musculus
atggcatttctgtagttgcacaaga

SEQ ID NO: 264629 - DNA, 25 bp, Mus musculus
atggcatttgaaactcagcactggt

SEQ ID NO: 264630 - DNA, 25 bp, Mus musculus
atggcatttgaatctcagcactggt

SEQ ID NO: 264631 - DNA, 25 bp, Mus musculus
atggcatttgctactgagccaccct

SEQ ID NO: 264632 - DNA, 25 bp, Mus musculus
atggcatttgcttctgagccaccct

SEQ ID NO: 264633 - DNA, 25 bp, Mus musculus
atggcatttggaaactccttgacaa

SEQ ID NO: 264634 - DNA, 25 bp, Mus musculus
atggcatttggatactccttgacaa

SEQ ID NO: 264635 - DNA, 25 bp, Mus musculus
atggcattttacatgactgcaagta

SEQ ID NO: 264636 - DNA, 25 bp, Mus musculus
atggcattttacttgactgcaagta

SEQ ID NO: 264637 - DNA, 25 bp, Mus musculus
atggcattttggaatgtccctgcat

SEQ ID NO: 264638 - DNA, 25 bp, Mus musculus
atggcattttggtatgtccctgcat

SEQ ID NO: 264639 - DNA, 25 bp, Mus musculus
atggcatttttaatttcctgtgtac

SEQ ID NO: 264640 - DNA, 25 bp, Mus musculus
atggcatttttattttcctgtgtac

SEQ ID NO: 264641 - DNA, 25 bp, Mus musculus
atggccaaactgcagtaccagcgac

SEQ ID NO: 264642 - DNA, 25 bp, Mus musculus
atggccaaactggagtaccagcgac

SEQ ID NO: 264643 - DNA, 25 bp, Mus musculus
atggccaaacttaagctatgcacct

SEQ ID NO: 264644 - DNA, 25 bp, Mus musculus
atggccaaactttagctatgcacct

SEQ ID NO: 264645 - DNA, 25 bp, Mus musculus
atggccaaagccagtacaatgaata

SEQ ID NO: 264646 - DNA, 25 bp, Mus musculus
atggccaaagcctgtacaatgaata

SEQ ID NO: 264647 - DNA, 25 bp, Mus musculus
atggccaaagtgaccagattacttg

SEQ ID NO: 264648 - DNA, 25 bp, Mus musculus
atggccaaagtgtccagattacttg

SEQ ID NO: 264649 - DNA, 25 bp, Mus musculus
atggccaaatatccctctggtgaga

SEQ ID NO: 264650 - DNA, 25 bp, Mus musculus
atggccaaatatgcctctggtgaga

SEQ ID NO: 264651 - DNA, 25 bp, Mus musculus
atggccaacactatttatgctcacg

SEQ ID NO: 264652 - DNA, 25 bp, Mus musculus
atggccaacactttttatgctcacg

SEQ ID NO: 264653 - DNA, 25 bp, Mus musculus
atggccaacatgctgctcatcggtt

SEQ ID NO: 264654 - DNA, 25 bp, Mus musculus
atggccaacatggtgctcatcggtt

SEQ ID NO: 264655 - DNA, 25 bp, Mus musculus
atggccaacggcatgaacgctgtca

SEQ ID NO: 264656 - DNA, 25 bp, Mus musculus
atggccaacggcttgaacgctgtca

SEQ ID NO: 264657 - DNA, 25 bp, Mus musculus
atggccaagcaaccttctgatgtaa

SEQ ID NO: 264658 - DNA, 25 bp, Mus musculus
atggccaagcaagcttctgatgtaa

SEQ ID NO: 264659 - DNA, 25 bp, Mus musculus
atggccaaggtgacactggagcatc

SEQ ID NO: 264660 - DNA, 25 bp, Mus musculus
atggccaaggtgtcactggagcatc

SEQ ID NO: 264661 - DNA, 25 bp, Mus musculus
atggccaagtgtctcaaagctgtca

SEQ ID NO: 264662 - DNA, 25 bp, Mus musculus
atggccaagtgtgtcaaagctgtca

SEQ ID NO: 264663 - DNA, 25 bp, Mus musculus
atggccaagttaactctccagactt

SEQ ID NO: 264664 - DNA, 25 bp, Mus musculus
atggccaagttatctctccagactt

SEQ ID NO: 264665 - DNA, 25 bp, Mus musculus
atggccaagttcatccgtaacttcg

SEQ ID NO: 264666 - DNA, 25 bp, Mus musculus
atggccaagttcttccgtaacttcg

SEQ ID NO: 264667 - DNA, 25 bp, Mus musculus
atggccaatcatcctgactgagcac

SEQ ID NO: 264668 - DNA, 25 bp, Mus musculus
atggccaatcatgctgactgagcac

SEQ ID NO: 264669 - DNA, 25 bp, Mus musculus
atggccaatggcacagcaggtacta

SEQ ID NO: 264670 - DNA, 25 bp, Mus musculus
atggccaatggctcagcaggtacta

SEQ ID NO: 264671 - DNA, 25 bp, Mus musculus
atggccacaaagctctctagaagtt

SEQ ID NO: 264672 - DNA, 25 bp, Mus musculus
atggccacaaaggtctctagaagtt

SEQ ID NO: 264673 - DNA, 25 bp, Mus musculus
atggccacaattacagtctacttat

SEQ ID NO: 264674 - DNA, 25 bp, Mus musculus
atggccacaatttcagtctacttat

SEQ ID NO: 264675 - DNA, 25 bp, Mus musculus
atggccacacggatggcacggcatg

SEQ ID NO: 264676 - DNA, 25 bp, Mus musculus
atggccacacggttggcacggcatg

SEQ ID NO: 264677 - DNA, 25 bp, Mus musculus
atggccacagttacatactaagcaa

SEQ ID NO: 264678 - DNA, 25 bp, Mus musculus
atggccacagtttcatactaagcaa

SEQ ID NO: 264679 - DNA, 25 bp, Mus musculus
atggccacatccaaactccaaattt

SEQ ID NO: 264680 - DNA, 25 bp, Mus musculus
atggccacatcctaactccaaattt

SEQ ID NO: 264681 - DNA, 25 bp, Mus musculus
atggccacattccagaaagctcacc

SEQ ID NO: 264682 - DNA, 25 bp, Mus musculus
atggccacattcgagaaagctcacc

SEQ ID NO: 264683 - DNA, 25 bp, Mus musculus
atggccaccaatctgacgcttgata

SEQ ID NO: 264684 - DNA, 25 bp, Mus musculus
atggccaccaatgtgacgcttgata

SEQ ID NO: 264685 - DNA, 25 bp, Mus musculus
atggccaccaggcatttagctgtgt

SEQ ID NO: 264686 - DNA, 25 bp, Mus musculus
atggccaccagggatttagctgtgt

SEQ ID NO: 264687 - DNA, 25 bp, Mus musculus
atggccacccagattggcattctgg

SEQ ID NO: 264688 - DNA, 25 bp, Mus musculus
atggccacccagtttggcattctgg

SEQ ID NO: 264689 - DNA, 25 bp, Mus musculus
atggccacccggcaatccaggaagc

SEQ ID NO: 264690 - DNA, 25 bp, Mus musculus
atggccacccgggaatccaggaagc

SEQ ID NO: 264691 - DNA, 25 bp, Mus musculus
atggccaccgccaagcaaaggcttg

SEQ ID NO: 264692 - DNA, 25 bp, Mus musculus
atggccaccgcctagcaaaggcttg

SEQ ID NO: 264693 - DNA, 25 bp, Mus musculus
atggccacctacatgatctatgcac

SEQ ID NO: 264694 - DNA, 25 bp, Mus musculus
atggccacctacttgatctatgcac

SEQ ID NO: 264695 - DNA, 25 bp, Mus musculus
atggccacctcaagtctaagctgga

SEQ ID NO: 264696 - DNA, 25 bp, Mus musculus
atggccacctcatgtctaagctgga

SEQ ID NO: 264697 - DNA, 25 bp, Mus musculus
atggccacctccctagccgaagtga

SEQ ID NO: 264698 - DNA, 25 bp, Mus musculus
atggccacctccgtagccgaagtga

SEQ ID NO: 264699 - DNA, 25 bp, Mus musculus
atggccacgcgcacgtgtgtatcgc

SEQ ID NO: 264700 - DNA, 25 bp, Mus musculus
atggccacgcgctcgtgtgtatcgc

SEQ ID NO: 264701 - DNA, 25 bp, Mus musculus
atggccacgcttatccaagtgaaga

SEQ ID NO: 264702 - DNA, 25 bp, Mus musculus
atggccacgcttttccaagtgaaga

SEQ ID NO: 264703 - DNA, 25 bp, Mus musculus
atggccacggctcatgtgactgaga

SEQ ID NO: 264704 - DNA, 25 bp, Mus musculus
atggccacggctgatgtgactgaga

SEQ ID NO: 264705 - DNA, 25 bp, Mus musculus
atggccacggttagcgtcactgaag

SEQ ID NO: 264706 - DNA, 25 bp, Mus musculus
atggccacggtttgcgtcactgaag

SEQ ID NO: 264707 - DNA, 25 bp, Mus musculus
atggccacgtggctgaaagcatcct

SEQ ID NO: 264708 - DNA, 25 bp, Mus musculus
atggccacgtgggtgaaagcatcct

SEQ ID NO: 264709 - DNA, 25 bp, Mus musculus
atggccactacaataccagagcttc

SEQ ID NO: 264710 - DNA, 25 bp, Mus musculus
atggccactacattaccagagcttc

SEQ ID NO: 264711 - DNA, 25 bp, Mus musculus
atggccactcccattagcagctatt

SEQ ID NO: 264712 - DNA, 25 bp, Mus musculus
atggccactccctttagcagctatt

SEQ ID NO: 264713 - DNA, 25 bp, Mus musculus
atggccactgaaaaactgcatcttt

SEQ ID NO: 264714 - DNA, 25 bp, Mus musculus
atggccactgaataactgcatcttt

SEQ ID NO: 264715 - DNA, 25 bp, Mus musculus
atggccactgctcttgtaaccttta

SEQ ID NO: 264716 - DNA, 25 bp, Mus musculus
atggccactgctgttgtaaccttta

SEQ ID NO: 264717 - DNA, 25 bp, Mus musculus
atggccactttcactccgttctagt

SEQ ID NO: 264718 - DNA, 25 bp, Mus musculus
atggccactttctctccgttctagt

SEQ ID NO: 264719 - DNA, 25 bp, Mus musculus
atggccactttgcttcacctgtgta

SEQ ID NO: 264720 - DNA, 25 bp, Mus musculus
atggccactttggttcacctgtgta

SEQ ID NO: 264721 - DNA, 25 bp, Mus musculus
atggccagagacagaattacccttc

SEQ ID NO: 264722 - DNA, 25 bp, Mus musculus
atggccagagacatgtagctttaga

SEQ ID NO: 264723 - DNA, 25 bp, Mus musculus
atggccagagactgaattacccttc

SEQ ID NO: 264724 - DNA, 25 bp, Mus musculus
atggccagagacttgtagctttaga

SEQ ID NO: 264725 - DNA, 25 bp, Mus musculus
atggccagagctattgtgcagcttc

SEQ ID NO: 264726 - DNA, 25 bp, Mus musculus
atggccagagcttttgtgcagcttc

SEQ ID NO: 264727 - DNA, 25 bp, Mus musculus
atggccagagtcattttctagttag

SEQ ID NO: 264728 - DNA, 25 bp, Mus musculus
atggccagagtctttttctagttag

SEQ ID NO: 264729 - DNA, 25 bp, Mus musculus
atggccagatatcactaatttcttc

SEQ ID NO: 264730 - DNA, 25 bp, Mus musculus
atggccagatatgactaatttcttc

SEQ ID NO: 264731 - DNA, 25 bp, Mus musculus
atggccagatccaagccttagggtt

SEQ ID NO: 264732 - DNA, 25 bp, Mus musculus
atggccagatcctagccttagggtt

SEQ ID NO: 264733 - DNA, 25 bp, Mus musculus
atggccagattactgcatcactgct

SEQ ID NO: 264734 - DNA, 25 bp, Mus musculus
atggccagattagtgcatcactgct

SEQ ID NO: 264735 - DNA, 25 bp, Mus musculus
atggccagattcatacagaccctgc

SEQ ID NO: 264736 - DNA, 25 bp, Mus musculus
atggccagattcttacagaccctgc

SEQ ID NO: 264737 - DNA, 25 bp, Mus musculus
atggccagcagtacctttcagggaa

SEQ ID NO: 264738 - DNA, 25 bp, Mus musculus
atggccagcagttcctttcagggaa

SEQ ID NO: 264739 - DNA, 25 bp, Mus musculus
atggccagccggacgagctctgaga

SEQ ID NO: 264740 - DNA, 25 bp, Mus musculus
atggccagccggtcgagctctgaga

SEQ ID NO: 264741 - DNA, 25 bp, Mus musculus
atggccagcgtgagccgacaccaag

SEQ ID NO: 264742 - DNA, 25 bp, Mus musculus
atggccagcgtgtgccgacaccaag

SEQ ID NO: 264743 - DNA, 25 bp, Mus musculus
atggccagctcacccgtggtgaact

SEQ ID NO: 264744 - DNA, 25 bp, Mus musculus
atggccagctcagccgtggtgaact

SEQ ID NO: 264745 - DNA, 25 bp, Mus musculus
atggccagctgtcagcaggatggcc

SEQ ID NO: 264746 - DNA, 25 bp, Mus musculus
atggccagctgtgagcaggatggcc

SEQ ID NO: 264747 - DNA, 25 bp, Mus musculus
atggccaggaatagcaccagcccag

SEQ ID NO: 264748 - DNA, 25 bp, Mus musculus
atggccaggaatcagatgaccgttt

SEQ ID NO: 264749 - DNA, 25 bp, Mus musculus
atggccaggaatgagatgaccgttt

SEQ ID NO: 264750 - DNA, 25 bp, Mus musculus
atggccaggaattgcaccagcccag

SEQ ID NO: 264751 - DNA, 25 bp, Mus musculus
atggccaggactctctgatgatgcc

SEQ ID NO: 264752 - DNA, 25 bp, Mus musculus
atggccaggactgtctgatgatgcc

SEQ ID NO: 264753 - DNA, 25 bp, Mus musculus
atggccaggcctaacagcttatgga

SEQ ID NO: 264754 - DNA, 25 bp, Mus musculus
atggccaggcctaccagactcggtt

SEQ ID NO: 264755 - DNA, 25 bp, Mus musculus
atggccaggccttacagcttatgga

SEQ ID NO: 264756 - DNA, 25 bp, Mus musculus
atggccaggccttccagactcggtt

SEQ ID NO: 264757 - DNA, 25 bp, Mus musculus
atggccaggtctacatggtgaggtt

SEQ ID NO: 264758 - DNA, 25 bp, Mus musculus
atggccaggtcttcatggtgaggtt

SEQ ID NO: 264759 - DNA, 25 bp, Mus musculus
atggccagtatacgctctgtggttt

SEQ ID NO: 264760 - DNA, 25 bp, Mus musculus
atggccagtataggctctgtggttt

SEQ ID NO: 264761 - DNA, 25 bp, Mus musculus
atggccagtcagaagcctctcagga

SEQ ID NO: 264762 - DNA, 25 bp, Mus musculus
atggccagtcagtagcctctcagga

SEQ ID NO: 264763 - DNA, 25 bp, Mus musculus
atggccagtccacagtcagggcttg

SEQ ID NO: 264764 - DNA, 25 bp, Mus musculus
atggccagtccagagtcagggcttg

SEQ ID NO: 264765 - DNA, 25 bp, Mus musculus
atggccagtgcacaagctccacagg

SEQ ID NO: 264766 - DNA, 25 bp, Mus musculus
atggccagtgcagaagctccacagg

SEQ ID NO: 264767 - DNA, 25 bp, Mus musculus
atggccagttaccaggacacttgat

SEQ ID NO: 264768 - DNA, 25 bp, Mus musculus
atggccagttacgaggacacttgat

SEQ ID NO: 264769 - DNA, 25 bp, Mus musculus
atggccagttcaactaaagtcacag

SEQ ID NO: 264770 - DNA, 25 bp, Mus musculus
atggccagttcatctaaagtcacag

SEQ ID NO: 264771 - DNA, 25 bp, Mus musculus
atggccatagcgactgtgggatatt

SEQ ID NO: 264772 - DNA, 25 bp, Mus musculus
atggccatagcgtctgtgggatatt

SEQ ID NO: 264773 - DNA, 25 bp, Mus musculus
atggccatctacaagaagtcacagc

SEQ ID NO: 264774 - DNA, 25 bp, Mus musculus
atggccatctactagaagtcacagc

SEQ ID NO: 264775 - DNA, 25 bp, Mus musculus
atggccatctgaattgctggacttt

SEQ ID NO: 264776 - DNA, 25 bp, Mus musculus
atggccatctgacaacaacaacagc

SEQ ID NO: 264777 - DNA, 25 bp, Mus musculus
atggccatctgagaacaacaacagc

SEQ ID NO: 264778 - DNA, 25 bp, Mus musculus
atggccatctgatttgctggacttt

SEQ ID NO: 264779 - DNA, 25 bp, Mus musculus
atggccatgaccctggctggagaaa

SEQ ID NO: 264780 - DNA, 25 bp, Mus musculus
atggccatgaccgtggctggagaaa

SEQ ID NO: 264781 - DNA, 25 bp, Mus musculus
atggccatgacgattcagatcctcc

SEQ ID NO: 264782 - DNA, 25 bp, Mus musculus
atggccatgacgtttcagatcctcc

SEQ ID NO: 264783 - DNA, 25 bp, Mus musculus
atggccatgagcaatttcctaacgc

SEQ ID NO: 264784 - DNA, 25 bp, Mus musculus
atggccatgagctatttcctaacgc

SEQ ID NO: 264785 - DNA, 25 bp, Mus musculus
atggccatgcagaaggttacctaat

SEQ ID NO: 264786 - DNA, 25 bp, Mus musculus
atggccatgcagtaggttacctaat

SEQ ID NO: 264787 - DNA, 25 bp, Mus musculus
atggccatgccaaggacactcaaga

SEQ ID NO: 264788 - DNA, 25 bp, Mus musculus
atggccatgccatggacactcaaga

SEQ ID NO: 264789 - DNA, 25 bp, Mus musculus
atggccatgcggataagtccaggaa

SEQ ID NO: 264790 - DNA, 25 bp, Mus musculus
atggccatgcggttaagtccaggaa

SEQ ID NO: 264791 - DNA, 25 bp, Mus musculus
atggccatggccaggataccagcgg

SEQ ID NO: 264792 - DNA, 25 bp, Mus musculus
atggccatggcctggataccagcgg

SEQ ID NO: 264793 - DNA, 25 bp, Mus musculus
atggccatggctaggatgaccacac

SEQ ID NO: 264794 - DNA, 25 bp, Mus musculus
atggccatggctatgcatcggcagc

SEQ ID NO: 264795 - DNA, 25 bp, Mus musculus
atggccatggcttggatgaccacac

SEQ ID NO: 264796 - DNA, 25 bp, Mus musculus
atggccatggctttgcatcggcagc

SEQ ID NO: 264797 - DNA, 25 bp, Mus musculus
atggccatgggaatgcattgttatc

SEQ ID NO: 264798 - DNA, 25 bp, Mus musculus
atggccatgggattgcattgttatc

SEQ ID NO: 264799 - DNA, 25 bp, Mus musculus
atggccatgtcgcatctggtcaggt

SEQ ID NO: 264800 - DNA, 25 bp, Mus musculus
atggccatgtcggatctggtcaggt

SEQ ID NO: 264801 - DNA, 25 bp, Mus musculus
atggccatgtctctcaacccgataa

SEQ ID NO: 264802 - DNA, 25 bp, Mus musculus
atggccatgtctgtcaacccgataa

SEQ ID NO: 264803 - DNA, 25 bp, Mus musculus
atggccatgttgaggttgcagactc

SEQ ID NO: 264804 - DNA, 25 bp, Mus musculus
atggccatgttgtggttgcagactc

SEQ ID NO: 264805 - DNA, 25 bp, Mus musculus
atggccatgtttagttctgttctgc

SEQ ID NO: 264806 - DNA, 25 bp, Mus musculus
atggccatgttttgttctgttctgc

SEQ ID NO: 264807 - DNA, 25 bp, Mus musculus
atggccattccaattacggtcctta

SEQ ID NO: 264808 - DNA, 25 bp, Mus musculus
atggccattccatttacggtcctta

SEQ ID NO: 264809 - DNA, 25 bp, Mus musculus
atggccattcgaccttccaaagtta

SEQ ID NO: 264810 - DNA, 25 bp, Mus musculus
atggccattcgagcttccaaagtta

SEQ ID NO: 264811 - DNA, 25 bp, Mus musculus
atggccattgccctctggaataaca

SEQ ID NO: 264812 - DNA, 25 bp, Mus musculus
atggccattgccgtctggaataaca

SEQ ID NO: 264813 - DNA, 25 bp, Mus musculus
atggcccaaaggaggctggcttcaa

SEQ ID NO: 264814 - DNA, 25 bp, Mus musculus
atggcccaaaggtggctggcttcaa

SEQ ID NO: 264815 - DNA, 25 bp, Mus musculus
atggcccaaggtagttgtcacttcc

SEQ ID NO: 264816 - DNA, 25 bp, Mus musculus
atggcccaaggttgttgtcacttcc

SEQ ID NO: 264817 - DNA, 25 bp, Mus musculus
atggcccaagtcatagctgcctatg

SEQ ID NO: 264818 - DNA, 25 bp, Mus musculus
atggcccaagtcttagctgcctatg

SEQ ID NO: 264819 - DNA, 25 bp, Mus musculus
atggcccaatggagccagtttgcac

SEQ ID NO: 264820 - DNA, 25 bp, Mus musculus
atggcccaatggtgccagtttgcac

SEQ ID NO: 264821 - DNA, 25 bp, Mus musculus
atggcccacaagcagatctactact

SEQ ID NO: 264822 - DNA, 25 bp, Mus musculus
atggcccacaaggagatctactact

SEQ ID NO: 264823 - DNA, 25 bp, Mus musculus
atggcccacacaaaatggacccaat

SEQ ID NO: 264824 - DNA, 25 bp, Mus musculus
atggcccacacataatggacccaat

SEQ ID NO: 264825 - DNA, 25 bp, Mus musculus
atggcccacagcatgcttgagagag

SEQ ID NO: 264826 - DNA, 25 bp, Mus musculus
atggcccacagcttgcttgagagag

SEQ ID NO: 264827 - DNA, 25 bp, Mus musculus
atggcccacattagatcctcagaac

SEQ ID NO: 264828 - DNA, 25 bp, Mus musculus
atggcccacatttgatcctcagaac

SEQ ID NO: 264829 - DNA, 25 bp, Mus musculus
atggcccactggagtaacaagtagg

SEQ ID NO: 264830 - DNA, 25 bp, Mus musculus
atggcccactggtgtaacaagtagg

SEQ ID NO: 264831 - DNA, 25 bp, Mus musculus
atggcccactttcactgagcacaga

SEQ ID NO: 264832 - DNA, 25 bp, Mus musculus
atggcccactttgactgagcacaga

SEQ ID NO: 264833 - DNA, 25 bp, Mus musculus
atggcccagcctagacagagatgac

SEQ ID NO: 264834 - DNA, 25 bp, Mus musculus
atggcccagcctagagtgggcagcc

SEQ ID NO: 264835 - DNA, 25 bp, Mus musculus
atggcccagccttgacagagatgac

SEQ ID NO: 264836 - DNA, 25 bp, Mus musculus
atggcccagccttgagtgggcagcc

SEQ ID NO: 264837 - DNA, 25 bp, Mus musculus
atggcccaggctcttcaagaataca

SEQ ID NO: 264838 - DNA, 25 bp, Mus musculus
atggcccaggctgttcaagaataca

SEQ ID NO: 264839 - DNA, 25 bp, Mus musculus
atggcccagttgcatgcatggcagc

SEQ ID NO: 264840 - DNA, 25 bp, Mus musculus
atggcccagttggatgcatggcagc

SEQ ID NO: 264841 - DNA, 25 bp, Mus musculus
atggcccatccaccagcaagagaat

SEQ ID NO: 264842 - DNA, 25 bp, Mus musculus
atggcccatccagcagcaagagaat

SEQ ID NO: 264843 - DNA, 25 bp, Mus musculus
atggcccatctgagttgtccaggga

SEQ ID NO: 264844 - DNA, 25 bp, Mus musculus
atggcccatctgcagatcaccactg

SEQ ID NO: 264845 - DNA, 25 bp, Mus musculus
atggcccatctggagatcaccactg

SEQ ID NO: 264846 - DNA, 25 bp, Mus musculus
atggcccatctgtgttgtccaggga

SEQ ID NO: 264847 - DNA, 25 bp, Mus musculus
atggcccatgaaatgttgcatatct

SEQ ID NO: 264848 - DNA, 25 bp, Mus musculus
atggcccatgaattgttgcatatct

SEQ ID NO: 264849 - DNA, 25 bp, Mus musculus
atggcccatggcactatccaaggag

SEQ ID NO: 264850 - DNA, 25 bp, Mus musculus
atggcccatggctctatccaaggag

SEQ ID NO: 264851 - DNA, 25 bp, Mus musculus
atggcccatgtaaatgtaggatcct

SEQ ID NO: 264852 - DNA, 25 bp, Mus musculus
atggcccatgtatatgtaggatcct

SEQ ID NO: 264853 - DNA, 25 bp, Mus musculus
atggccccacataaggatgttatga

SEQ ID NO: 264854 - DNA, 25 bp, Mus musculus
atggccccacattaggatgttatga

SEQ ID NO: 264855 - DNA, 25 bp, Mus musculus
atggccccaggacgtacccagatat

SEQ ID NO: 264856 - DNA, 25 bp, Mus musculus
atggccccaggaggtacccagatat

SEQ ID NO: 264857 - DNA, 25 bp, Mus musculus
atggccccatgcctcttacaggatg

SEQ ID NO: 264858 - DNA, 25 bp, Mus musculus
atggccccatgcgtcttacaggatg

SEQ ID NO: 264859 - DNA, 25 bp, Mus musculus
atggccccatggctagaggtgccca

SEQ ID NO: 264860 - DNA, 25 bp, Mus musculus
atggccccatgggtagaggtgccca

SEQ ID NO: 264861 - DNA, 25 bp, Mus musculus
atggccccattgacaatggcctgaa

SEQ ID NO: 264862 - DNA, 25 bp, Mus musculus
atggccccattgctcagaactctga

SEQ ID NO: 264863 - DNA, 25 bp, Mus musculus
atggccccattggtcagaactctga

SEQ ID NO: 264864 - DNA, 25 bp, Mus musculus
atggccccattgtcaatggcctgaa

SEQ ID NO: 264865 - DNA, 25 bp, Mus musculus
atggccccatttcatttaagcacgg

SEQ ID NO: 264866 - DNA, 25 bp, Mus musculus
atggccccatttgatttaagcacgg

SEQ ID NO: 264867 - DNA, 25 bp, Mus musculus
atggccccccaaaaaactcatgtgt

SEQ ID NO: 264868 - DNA, 25 bp, Mus musculus
atggccccccaataaactcatgtgt

SEQ ID NO: 264869 - DNA, 25 bp, Mus musculus
atggcccctacaatgctgcaacaca

SEQ ID NO: 264870 - DNA, 25 bp, Mus musculus
atggcccctacattgctgcaacaca

SEQ ID NO: 264871 - DNA, 25 bp, Mus musculus
atggcccctagtagttttgtgtgga

SEQ ID NO: 264872 - DNA, 25 bp, Mus musculus
atggcccctagttgttttgtgtgga

SEQ ID NO: 264873 - DNA, 25 bp, Mus musculus
atggcccctctaattatctggctaa

SEQ ID NO: 264874 - DNA, 25 bp, Mus musculus
atggcccctctatttatctggctaa

SEQ ID NO: 264875 - DNA, 25 bp, Mus musculus
atggcccctgatcgatttttattgg

SEQ ID NO: 264876 - DNA, 25 bp, Mus musculus
atggcccctgatggatttttattgg

SEQ ID NO: 264877 - DNA, 25 bp, Mus musculus
atggcccctgtgaggtgaagatcaa

SEQ ID NO: 264878 - DNA, 25 bp, Mus musculus
atggcccctgtgtggtgaagatcaa

SEQ ID NO: 264879 - DNA, 25 bp, Mus musculus
atggccccttttacaagtagatctg

SEQ ID NO: 264880 - DNA, 25 bp, Mus musculus
atggcccctttttcaagtagatctg

SEQ ID NO: 264881 - DNA, 25 bp, Mus musculus
atggcccgagagattggttccgtca

SEQ ID NO: 264882 - DNA, 25 bp, Mus musculus
atggcccgagagtttggttccgtca

SEQ ID NO: 264883 - DNA, 25 bp, Mus musculus
atggcccgcagtcagggtaccaaaa

SEQ ID NO: 264884 - DNA, 25 bp, Mus musculus
atggcccgcagtgagggtaccaaaa

SEQ ID NO: 264885 - DNA, 25 bp, Mus musculus
atggcccgggatcagaagaattact

SEQ ID NO: 264886 - DNA, 25 bp, Mus musculus
atggcccgggatgagaagaattact

SEQ ID NO: 264887 - DNA, 25 bp, Mus musculus
atggccctaatgctgctggtattat

SEQ ID NO: 264888 - DNA, 25 bp, Mus musculus
atggccctaatggtgctggtattat

SEQ ID NO: 264889 - DNA, 25 bp, Mus musculus
atggccctagacactggtaggcaag

SEQ ID NO: 264890 - DNA, 25 bp, Mus musculus
atggccctagactctggtaggcaag

SEQ ID NO: 264891 - DNA, 25 bp, Mus musculus
atggccctagtgacaatttcaccgg

SEQ ID NO: 264892 - DNA, 25 bp, Mus musculus
atggccctagtgtcaatttcaccgg

SEQ ID NO: 264893 - DNA, 25 bp, Mus musculus
atggccctatgcaattgtgttgtaa

SEQ ID NO: 264894 - DNA, 25 bp, Mus musculus
atggccctatgctattgtgttgtaa

SEQ ID NO: 264895 - DNA, 25 bp, Mus musculus
atggccctcaagagccgagcctgcc

SEQ ID NO: 264896 - DNA, 25 bp, Mus musculus
atggccctcaagtgccgagcctgcc

SEQ ID NO: 264897 - DNA, 25 bp, Mus musculus
atggccctcggactagagtcactca

SEQ ID NO: 264898 - DNA, 25 bp, Mus musculus
atggccctcggagtagagtcactca

SEQ ID NO: 264899 - DNA, 25 bp, Mus musculus
atggccctctctacagactaatgtc

SEQ ID NO: 264900 - DNA, 25 bp, Mus musculus
atggccctctcttcagactaatgtc

SEQ ID NO: 264901 - DNA, 25 bp, Mus musculus
atggccctctgtcctttaaaggctg

SEQ ID NO: 264902 - DNA, 25 bp, Mus musculus
atggccctctgtgctttaaaggctg

SEQ ID NO: 264903 - DNA, 25 bp, Mus musculus
atggccctgacccatgagttatggt

SEQ ID NO: 264904 - DNA, 25 bp, Mus musculus
atggccctgaccgatgagttatggt

SEQ ID NO: 264905 - DNA, 25 bp, Mus musculus
atggccctgaggcatacttctctac

SEQ ID NO: 264906 - DNA, 25 bp, Mus musculus
atggccctgagggatacttctctac

SEQ ID NO: 264907 - DNA, 25 bp, Mus musculus
atggccctgcagatcctctgggagg

SEQ ID NO: 264908 - DNA, 25 bp, Mus musculus
atggccctgcagttcctctgggagg

SEQ ID NO: 264909 - DNA, 25 bp, Mus musculus
atggccctggccatgtcatcgtgtt

SEQ ID NO: 264910 - DNA, 25 bp, Mus musculus
atggccctggccttgtcatcgtgtt

SEQ ID NO: 264911 - DNA, 25 bp, Mus musculus
atggccctgggtattaccagtccag

SEQ ID NO: 264912 - DNA, 25 bp, Mus musculus
atggccctgggttttaccagtccag

SEQ ID NO: 264913 - DNA, 25 bp, Mus musculus
atggccctgtggacacagagctgaa

SEQ ID NO: 264914 - DNA, 25 bp, Mus musculus
atggccctgtggcagatcttctgaa

SEQ ID NO: 264915 - DNA, 25 bp, Mus musculus
atggccctgtgggagatcttctgaa

SEQ ID NO: 264916 - DNA, 25 bp, Mus musculus
atggccctgtggtcacagagctgaa

SEQ ID NO: 264917 - DNA, 25 bp, Mus musculus
atggccctgttgctgcacttcctac

SEQ ID NO: 264918 - DNA, 25 bp, Mus musculus
atggccctgttggtgcacttcctac

SEQ ID NO: 264919 - DNA, 25 bp, Mus musculus
atggcccttcctagcaggcctggag

SEQ ID NO: 264920 - DNA, 25 bp, Mus musculus
atggcccttccttgcaggcctggag

SEQ ID NO: 264921 - DNA, 25 bp, Mus musculus
atggcccttctaaaatcctgtggat

SEQ ID NO: 264922 - DNA, 25 bp, Mus musculus
atggcccttctataatcctgtggat

SEQ ID NO: 264923 - DNA, 25 bp, Mus musculus
atggcccttgggagttatgctatgg

SEQ ID NO: 264924 - DNA, 25 bp, Mus musculus
atggcccttgggtgttatgctatgg

SEQ ID NO: 264925 - DNA, 25 bp, Mus musculus
atggccctttcaatggattgtcgat

SEQ ID NO: 264926 - DNA, 25 bp, Mus musculus
atggccctttcattggattgtcgat

SEQ ID NO: 264927 - DNA, 25 bp, Mus musculus
atggccctttctatatgagctggat

SEQ ID NO: 264928 - DNA, 25 bp, Mus musculus
atggccctttctttatgagctggat

SEQ ID NO: 264929 - DNA, 25 bp, Mus musculus
atggccgacaccagtggttactaca

SEQ ID NO: 264930 - DNA, 25 bp, Mus musculus
atggccgacacctgtggttactaca

SEQ ID NO: 264931 - DNA, 25 bp, Mus musculus
atggccgacttaatggttttgtgaa

SEQ ID NO: 264932 - DNA, 25 bp, Mus musculus
atggccgacttattggttttgtgaa

SEQ ID NO: 264933 - DNA, 25 bp, Mus musculus
atggccgaggagacaagttcttcta

SEQ ID NO: 264934 - DNA, 25 bp, Mus musculus
atggccgaggagtcaagttcttcta

SEQ ID NO: 264935 - DNA, 25 bp, Mus musculus
atggccgagttcctcaaggtcaagg

SEQ ID NO: 264936 - DNA, 25 bp, Mus musculus
atggccgagttcgtcaaggtcaagg

SEQ ID NO: 264937 - DNA, 25 bp, Mus musculus
atggccgcacccactctgattacaa

SEQ ID NO: 264938 - DNA, 25 bp, Mus musculus
atggccgcaccctctctgattacaa

SEQ ID NO: 264939 - DNA, 25 bp, Mus musculus
atggccgcacttcactgtctgcttt

SEQ ID NO: 264940 - DNA, 25 bp, Mus musculus
atggccgcacttgactgtctgcttt

SEQ ID NO: 264941 - DNA, 25 bp, Mus musculus
atggccgcagctagcatgggacatc

SEQ ID NO: 264942 - DNA, 25 bp, Mus musculus
atggccgcagcttgcatgggacatc

SEQ ID NO: 264943 - DNA, 25 bp, Mus musculus
atggccgcatttctcttaggttaaa

SEQ ID NO: 264944 - DNA, 25 bp, Mus musculus
atggccgcatttgtcttaggttaaa

SEQ ID NO: 264945 - DNA, 25 bp, Mus musculus
atggccgccaacagcatatatctaa

SEQ ID NO: 264946 - DNA, 25 bp, Mus musculus
atggccgccaactgcatatatctaa

SEQ ID NO: 264947 - DNA, 25 bp, Mus musculus
atggccgcccttactgggctttggg

SEQ ID NO: 264948 - DNA, 25 bp, Mus musculus
atggccgcccttcaggtaattgaga

SEQ ID NO: 264949 - DNA, 25 bp, Mus musculus
atggccgcccttgaggtaattgaga

SEQ ID NO: 264950 - DNA, 25 bp, Mus musculus
atggccgccctttctgggctttggg

SEQ ID NO: 264951 - DNA, 25 bp, Mus musculus
atggccgccgggaagttgtgcctcc

SEQ ID NO: 264952 - DNA, 25 bp, Mus musculus
atggccgccgggtagttgtgcctcc

SEQ ID NO: 264953 - DNA, 25 bp, Mus musculus
atggccgcggtgactcagctacaga

SEQ ID NO: 264954 - DNA, 25 bp, Mus musculus
atggccgcggtgtctcagctacaga

SEQ ID NO: 264955 - DNA, 25 bp, Mus musculus
atggccgctggaatgacgacgtctg

SEQ ID NO: 264956 - DNA, 25 bp, Mus musculus
atggccgctggattgacgacgtctg

SEQ ID NO: 264957 - DNA, 25 bp, Mus musculus
atggccgctgtgagcaaagcctgcg

SEQ ID NO: 264958 - DNA, 25 bp, Mus musculus
atggccgctgtgtgcaaagcctgcg

SEQ ID NO: 264959 - DNA, 25 bp, Mus musculus
atggccgcttgtcagctgtgtgacc

SEQ ID NO: 264960 - DNA, 25 bp, Mus musculus
atggccgcttgtgagctgtgtgacc

SEQ ID NO: 264961 - DNA, 25 bp, Mus musculus
atggccggatttcctttctcctgtt

SEQ ID NO: 264962 - DNA, 25 bp, Mus musculus
atggccggatttgctttctcctgtt

SEQ ID NO: 264963 - DNA, 25 bp, Mus musculus
atggccggcaaacccagaggccaca

SEQ ID NO: 264964 - DNA, 25 bp, Mus musculus
atggccggcaaagccagaggccaca

SEQ ID NO: 264965 - DNA, 25 bp, Mus musculus
atggccggcatgaagctcaggttta

SEQ ID NO: 264966 - DNA, 25 bp, Mus musculus
atggccggcatgtagctcaggttta

SEQ ID NO: 264967 - DNA, 25 bp, Mus musculus
atggccggccgaactgagtcttgag

SEQ ID NO: 264968 - DNA, 25 bp, Mus musculus
atggccggccgatctgagtcttgag

SEQ ID NO: 264969 - DNA, 25 bp, Mus musculus
atggccggctaaagccccgttactg

SEQ ID NO: 264970 - DNA, 25 bp, Mus musculus
atggccggctaatgccccgttactg

SEQ ID NO: 264971 - DNA, 25 bp, Mus musculus
atggccggctgaccaaagctgagat

SEQ ID NO: 264972 - DNA, 25 bp, Mus musculus
atggccggctgagcaaagctgagat

SEQ ID NO: 264973 - DNA, 25 bp, Mus musculus
atggccgtaactcatttgtctgtaa

SEQ ID NO: 264974 - DNA, 25 bp, Mus musculus
atggccgtaactgatttgtctgtaa

SEQ ID NO: 264975 - DNA, 25 bp, Mus musculus
atggccgtacaaactgtcagcatcg

SEQ ID NO: 264976 - DNA, 25 bp, Mus musculus
atggccgtacaatctgtcagcatcg

SEQ ID NO: 264977 - DNA, 25 bp, Mus musculus
atggccgtcaccatcacccttaaaa

SEQ ID NO: 264978 - DNA, 25 bp, Mus musculus
atggccgtcaccttcacccttaaaa

SEQ ID NO: 264979 - DNA, 25 bp, Mus musculus
atggccgtccgtaccttgtgaccag

SEQ ID NO: 264980 - DNA, 25 bp, Mus musculus
atggccgtccgttccttgtgaccag

SEQ ID NO: 264981 - DNA, 25 bp, Mus musculus
atggccgtgcagagtgagccagcca

SEQ ID NO: 264982 - DNA, 25 bp, Mus musculus
atggccgtgcagtgtgagccagcca

SEQ ID NO: 264983 - DNA, 25 bp, Mus musculus
atggccgtgccgatagacacacaca

SEQ ID NO: 264984 - DNA, 25 bp, Mus musculus
atggccgtgccgttagacacacaca

SEQ ID NO: 264985 - DNA, 25 bp, Mus musculus
atggccgtggagaagctctccgacg

SEQ ID NO: 264986 - DNA, 25 bp, Mus musculus
atggccgtggagtagctctccgacg

SEQ ID NO: 264987 - DNA, 25 bp, Mus musculus
atggccgtgtaactgctcgggcata

SEQ ID NO: 264988 - DNA, 25 bp, Mus musculus
atggccgtgtaagtgctcgggcata

SEQ ID NO: 264989 - DNA, 25 bp, Mus musculus
atggccgttctcacggtggccgtaa

SEQ ID NO: 264990 - DNA, 25 bp, Mus musculus
atggccgttctctcggtggccgtaa

SEQ ID NO: 264991 - DNA, 25 bp, Mus musculus
atggcctaaatgacatccgtttgta

SEQ ID NO: 264992 - DNA, 25 bp, Mus musculus
atggcctaaatgtcatccgtttgta

SEQ ID NO: 264993 - DNA, 25 bp, Mus musculus
atggcctaacagcttaacagctgtc

SEQ ID NO: 264994 - DNA, 25 bp, Mus musculus
atggcctaacaggttaacagctgtc

SEQ ID NO: 264995 - DNA, 25 bp, Mus musculus
atggcctaagttcctctcttgttct

SEQ ID NO: 264996 - DNA, 25 bp, Mus musculus
atggcctaagttcgtgtttcacgtt

SEQ ID NO: 264997 - DNA, 25 bp, Mus musculus
atggcctaagttgctctcttgttct

SEQ ID NO: 264998 - DNA, 25 bp, Mus musculus
atggcctaagttggtgtttcacgtt

SEQ ID NO: 264999 - DNA, 25 bp, Mus musculus
atggcctaatagcttggtgaaatga

SEQ ID NO: 265000 - DNA, 25 bp, Mus musculus
atggcctaataggttggtgaaatga

SEQ ID NO: 265001 - DNA, 25 bp, Mus musculus
atggcctaattgaccagcattgggt

SEQ ID NO: 265002 - DNA, 25 bp, Mus musculus
atggcctaattgtccagcattgggt

SEQ ID NO: 265003 - DNA, 25 bp, Mus musculus
atggcctaatttagaaggtctccaa

SEQ ID NO: 265004 - DNA, 25 bp, Mus musculus
atggcctaattttgaaggtctccaa

SEQ ID NO: 265005 - DNA, 25 bp, Mus musculus
atggcctacagtatgtgtcggtacc

SEQ ID NO: 265006 - DNA, 25 bp, Mus musculus
atggcctacagtttgtgtcggtacc

SEQ ID NO: 265007 - DNA, 25 bp, Mus musculus
atggcctacatgctaggacccgcaa

SEQ ID NO: 265008 - DNA, 25 bp, Mus musculus
atggcctacatggtaggacccgcaa

SEQ ID NO: 265009 - DNA, 25 bp, Mus musculus
atggcctagaggctactcagaaatt

SEQ ID NO: 265010 - DNA, 25 bp, Mus musculus
atggcctagagggtactcagaaatt

SEQ ID NO: 265011 - DNA, 25 bp, Mus musculus
atggcctagcatctcagctgcagtc

SEQ ID NO: 265012 - DNA, 25 bp, Mus musculus
atggcctagcatgtcagctgcagtc

SEQ ID NO: 265013 - DNA, 25 bp, Mus musculus
atggcctaggacactgcttacaagc

SEQ ID NO: 265014 - DNA, 25 bp, Mus musculus
atggcctaggactctgcttacaagc

SEQ ID NO: 265015 - DNA, 25 bp, Mus musculus
atggcctatggcaggtactgagcag

SEQ ID NO: 265016 - DNA, 25 bp, Mus musculus
atggcctatggctggtactgagcag

SEQ ID NO: 265017 - DNA, 25 bp, Mus musculus
atggcctatttcatgactggtcctg

SEQ ID NO: 265018 - DNA, 25 bp, Mus musculus
atggcctatttcttgactggtcctg

SEQ ID NO: 265019 - DNA, 25 bp, Mus musculus
atggcctcaactactctgggatgat

SEQ ID NO: 265020 - DNA, 25 bp, Mus musculus
atggcctcaacttctctgggatgat

SEQ ID NO: 265021 - DNA, 25 bp, Mus musculus
atggcctcaagtacatctgtgtgta

SEQ ID NO: 265022 - DNA, 25 bp, Mus musculus
atggcctcaagttcatctgtgtgta

SEQ ID NO: 265023 - DNA, 25 bp, Mus musculus
atggcctcacacattctccagtcag

SEQ ID NO: 265024 - DNA, 25 bp, Mus musculus
atggcctcacactttctccagtcag

SEQ ID NO: 265025 - DNA, 25 bp, Mus musculus
atggcctcaccgaggtctgagtacc

SEQ ID NO: 265026 - DNA, 25 bp, Mus musculus
atggcctcaccgtggtctgagtacc

SEQ ID NO: 265027 - DNA, 25 bp, Mus musculus
atggcctcactaaccctgggtagtt

SEQ ID NO: 265028 - DNA, 25 bp, Mus musculus
atggcctcactatccctgggtagtt

SEQ ID NO: 265029 - DNA, 25 bp, Mus musculus
atggcctcacttctcatgttgactt

SEQ ID NO: 265030 - DNA, 25 bp, Mus musculus
atggcctcacttgtcatgttgactt

SEQ ID NO: 265031 - DNA, 25 bp, Mus musculus
atggcctcagaaaccgacaggtctt

SEQ ID NO: 265032 - DNA, 25 bp, Mus musculus
atggcctcagaatccgacaggtctt

SEQ ID NO: 265033 - DNA, 25 bp, Mus musculus
atggcctcagcgctgtaaccggaaa

SEQ ID NO: 265034 - DNA, 25 bp, Mus musculus
atggcctcagcggtgtaaccggaaa

SEQ ID NO: 265035 - DNA, 25 bp, Mus musculus
atggcctcatcacttgcattcactg

SEQ ID NO: 265036 - DNA, 25 bp, Mus musculus
atggcctcatcagttgcattcactg

SEQ ID NO: 265037 - DNA, 25 bp, Mus musculus
atggcctcattcactttaattctgt

SEQ ID NO: 265038 - DNA, 25 bp, Mus musculus
atggcctcattctctttaattctgt

SEQ ID NO: 265039 - DNA, 25 bp, Mus musculus
atggcctccaacctaggtgctccaa

SEQ ID NO: 265040 - DNA, 25 bp, Mus musculus
atggcctccaacgtaggtgctccaa

SEQ ID NO: 265041 - DNA, 25 bp, Mus musculus
atggcctccagcagttgcactgagg

SEQ ID NO: 265042 - DNA, 25 bp, Mus musculus
atggcctccagctgttgcactgagg

SEQ ID NO: 265043 - DNA, 25 bp, Mus musculus
atggcctccaggatgtagaactact

SEQ ID NO: 265044 - DNA, 25 bp, Mus musculus
atggcctccaggttgtagaactact

SEQ ID NO: 265045 - DNA, 25 bp, Mus musculus
atggcctccagtagtgtattagctc

SEQ ID NO: 265046 - DNA, 25 bp, Mus musculus
atggcctccagttgtgtattagctc

SEQ ID NO: 265047 - DNA, 25 bp, Mus musculus
atggcctccatgaggatataccgct

SEQ ID NO: 265048 - DNA, 25 bp, Mus musculus
atggcctccatgtggatataccgct

SEQ ID NO: 265049 - DNA, 25 bp, Mus musculus
atggcctccctcaatgggaaaccaa

SEQ ID NO: 265050 - DNA, 25 bp, Mus musculus
atggcctccctcagaagtcaacagt

SEQ ID NO: 265051 - DNA, 25 bp, Mus musculus
atggcctccctctatgggaaaccaa

SEQ ID NO: 265052 - DNA, 25 bp, Mus musculus
atggcctccctctgaagtcaacagt

SEQ ID NO: 265053 - DNA, 25 bp, Mus musculus
atggcctccctgaaggagtcaagac

SEQ ID NO: 265054 - DNA, 25 bp, Mus musculus
atggcctccctgtaggagtcaagac

SEQ ID NO: 265055 - DNA, 25 bp, Mus musculus
atggcctcctccattgagtgtgttt

SEQ ID NO: 265056 - DNA, 25 bp, Mus musculus
atggcctcctcctttgagtgtgttt

SEQ ID NO: 265057 - DNA, 25 bp, Mus musculus
atggcctcgccccttaggagcaagt

SEQ ID NO: 265058 - DNA, 25 bp, Mus musculus
atggcctcgcccgttaggagcaagt

SEQ ID NO: 265059 - DNA, 25 bp, Mus musculus
atggcctcgtacaggaagtccttcc

SEQ ID NO: 265060 - DNA, 25 bp, Mus musculus
atggcctcgtactggaagtccttcc

SEQ ID NO: 265061 - DNA, 25 bp, Mus musculus
atggcctctactagaaagtggacta

SEQ ID NO: 265062 - DNA, 25 bp, Mus musculus
atggcctctacttgaaagtggacta

SEQ ID NO: 265063 - DNA, 25 bp, Mus musculus
atggcctctgacctagcttttttca

SEQ ID NO: 265064 - DNA, 25 bp, Mus musculus
atggcctctgacgtagcttttttca

SEQ ID NO: 265065 - DNA, 25 bp, Mus musculus
atggcctctgccatctttaatcaaa

SEQ ID NO: 265066 - DNA, 25 bp, Mus musculus
atggcctctgccttctttaatcaaa

SEQ ID NO: 265067 - DNA, 25 bp, Mus musculus
atggcctctggtcacatcatggacc

SEQ ID NO: 265068 - DNA, 25 bp, Mus musculus
atggcctctggtgacatcatggacc

SEQ ID NO: 265069 - DNA, 25 bp, Mus musculus
atggcctcttaccttcctgctgttg

SEQ ID NO: 265070 - DNA, 25 bp, Mus musculus
atggcctcttacgttcctgctgttg

SEQ ID NO: 265071 - DNA, 25 bp, Mus musculus
atggcctcttctactatgcatacaa

SEQ ID NO: 265072 - DNA, 25 bp, Mus musculus
atggcctcttcttctatgcatacaa

SEQ ID NO: 265073 - DNA, 25 bp, Mus musculus
atggcctgaacacttctgtaacaaa

SEQ ID NO: 265074 - DNA, 25 bp, Mus musculus
atggcctgaacagttctgtaacaaa

SEQ ID NO: 265075 - DNA, 25 bp, Mus musculus
atggcctgacagcagttctgtgccc

SEQ ID NO: 265076 - DNA, 25 bp, Mus musculus
atggcctgacaggagttctgtgccc

SEQ ID NO: 265077 - DNA, 25 bp, Mus musculus
atggcctgaccccagtgaatacatt

SEQ ID NO: 265078 - DNA, 25 bp, Mus musculus
atggcctgacccgagtgaatacatt

SEQ ID NO: 265079 - DNA, 25 bp, Mus musculus
atggcctgagcactgggaatgccta

SEQ ID NO: 265080 - DNA, 25 bp, Mus musculus
atggcctgagcagtgggaatgccta

SEQ ID NO: 265081 - DNA, 25 bp, Mus musculus
atggcctgaggtaagcacactgata

SEQ ID NO: 265082 - DNA, 25 bp, Mus musculus
atggcctgaggttagcacactgata

SEQ ID NO: 265083 - DNA, 25 bp, Mus musculus
atggcctgataaaccccttttgcgg

SEQ ID NO: 265084 - DNA, 25 bp, Mus musculus
atggcctgataatccccttttgcgg

SEQ ID NO: 265085 - DNA, 25 bp, Mus musculus
atggcctgatctctgacttcaagtt

SEQ ID NO: 265086 - DNA, 25 bp, Mus musculus
atggcctgatctgtgacttcaagtt

SEQ ID NO: 265087 - DNA, 25 bp, Mus musculus
atggcctgatggattattggcgtca

SEQ ID NO: 265088 - DNA, 25 bp, Mus musculus
atggcctgatggtttattggcgtca

SEQ ID NO: 265089 - DNA, 25 bp, Mus musculus
atggcctgcatgaacaagggcggct

SEQ ID NO: 265090 - DNA, 25 bp, Mus musculus
atggcctgcatgtacaagggcggct

SEQ ID NO: 265091 - DNA, 25 bp, Mus musculus
atggcctgccctaggacagagccgg

SEQ ID NO: 265092 - DNA, 25 bp, Mus musculus
atggcctgcccttggacagagccgg

SEQ ID NO: 265093 - DNA, 25 bp, Mus musculus
atggcctgcgagacctttcaatatg

SEQ ID NO: 265094 - DNA, 25 bp, Mus musculus
atggcctgcgagtcctttcaatatg

SEQ ID NO: 265095 - DNA, 25 bp, Mus musculus
atggcctgctgcatgttgtaccggg

SEQ ID NO: 265096 - DNA, 25 bp, Mus musculus
atggcctgctgcttgttgtaccggg

SEQ ID NO: 265097 - DNA, 25 bp, Mus musculus
atggcctggaacatggctcctgctg

SEQ ID NO: 265098 - DNA, 25 bp, Mus musculus
atggcctggaacttggctcctgctg

SEQ ID NO: 265099 - DNA, 25 bp, Mus musculus
atggcctggacaactttgacacgca

SEQ ID NO: 265100 - DNA, 25 bp, Mus musculus
atggcctggacatctttgacacgca

SEQ ID NO: 265101 - DNA, 25 bp, Mus musculus
atggcctggagtcaagtgactgatc

SEQ ID NO: 265102 - DNA, 25 bp, Mus musculus
atggcctggagtgaagtgactgatc

SEQ ID NO: 265103 - DNA, 25 bp, Mus musculus
atggcctggattacacttatactct

SEQ ID NO: 265104 - DNA, 25 bp, Mus musculus
atggcctggattctgatcccttgtt

SEQ ID NO: 265105 - DNA, 25 bp, Mus musculus
atggcctggattgtgatcccttgtt

SEQ ID NO: 265106 - DNA, 25 bp, Mus musculus
atggcctggatttcacttatactct

SEQ ID NO: 265107 - DNA, 25 bp, Mus musculus
atggcctggcacatctggctgctgt

SEQ ID NO: 265108 - DNA, 25 bp, Mus musculus
atggcctggcacttctggctgctgt

SEQ ID NO: 265109 - DNA, 25 bp, Mus musculus
atggcctggcccaaggcatgtaaat

SEQ ID NO: 265110 - DNA, 25 bp, Mus musculus
atggcctggccccagctgcgtaaag

SEQ ID NO: 265111 - DNA, 25 bp, Mus musculus
atggcctggcccgagctgcgtaaag

SEQ ID NO: 265112 - DNA, 25 bp, Mus musculus
atggcctggccctaggcatgtaaat

SEQ ID NO: 265113 - DNA, 25 bp, Mus musculus
atggcctggctaccctagataactg

SEQ ID NO: 265114 - DNA, 25 bp, Mus musculus
atggcctggctagcctagataactg

SEQ ID NO: 265115 - DNA, 25 bp, Mus musculus
atggcctgggtgcaacttgtatgtc

SEQ ID NO: 265116 - DNA, 25 bp, Mus musculus
atggcctgggtggaacttgtatgtc

SEQ ID NO: 265117 - DNA, 25 bp, Mus musculus
atggcctgtcatactcgaagtcttt

SEQ ID NO: 265118 - DNA, 25 bp, Mus musculus
atggcctgtcattctcgaagtcttt

SEQ ID NO: 265119 - DNA, 25 bp, Mus musculus
atggcctgtccaacgatggttacgt

SEQ ID NO: 265120 - DNA, 25 bp, Mus musculus
atggcctgtccatcgatggttacgt

SEQ ID NO: 265121 - DNA, 25 bp, Mus musculus
atggcctgtgatccttccattggat

SEQ ID NO: 265122 - DNA, 25 bp, Mus musculus
atggcctgtgatgcttccattggat

SEQ ID NO: 265123 - DNA, 25 bp, Mus musculus
atggcctgttaaatatacaccagca

SEQ ID NO: 265124 - DNA, 25 bp, Mus musculus
atggcctgttaattatacaccagca

SEQ ID NO: 265125 - DNA, 25 bp, Mus musculus
atggccttaaatccagagatcctcc

SEQ ID NO: 265126 - DNA, 25 bp, Mus musculus
atggccttaaatgcagagatcctcc

SEQ ID NO: 265127 - DNA, 25 bp, Mus musculus
atggccttagaaaaactctgttggc

SEQ ID NO: 265128 - DNA, 25 bp, Mus musculus
atggccttagaataactctgttggc

SEQ ID NO: 265129 - DNA, 25 bp, Mus musculus
atggccttcagcaaggacatctcca

SEQ ID NO: 265130 - DNA, 25 bp, Mus musculus
atggccttcagctaggacatctcca

SEQ ID NO: 265131 - DNA, 25 bp, Mus musculus
atggccttcagtcttggttgcctct

SEQ ID NO: 265132 - DNA, 25 bp, Mus musculus
atggccttcagtgttggttgcctct

SEQ ID NO: 265133 - DNA, 25 bp, Mus musculus
atggccttccctcaatagggtgggt

SEQ ID NO: 265134 - DNA, 25 bp, Mus musculus
atggccttccctgaatagggtgggt

SEQ ID NO: 265135 - DNA, 25 bp, Mus musculus
atggccttcctgagatcatgtctac

SEQ ID NO: 265136 - DNA, 25 bp, Mus musculus
atggccttcctgatgaatgacaccc

SEQ ID NO: 265137 - DNA, 25 bp, Mus musculus
atggccttcctgtgatcatgtctac

SEQ ID NO: 265138 - DNA, 25 bp, Mus musculus
atggccttcctgttgaatgacaccc

SEQ ID NO: 265139 - DNA, 25 bp, Mus musculus
atggccttcgatcgtggcagaactc

SEQ ID NO: 265140 - DNA, 25 bp, Mus musculus
atggccttcgatggtggcagaactc

SEQ ID NO: 265141 - DNA, 25 bp, Mus musculus
atggccttctacacgggattgtcac

SEQ ID NO: 265142 - DNA, 25 bp, Mus musculus
atggccttctactcgggattgtcac

SEQ ID NO: 265143 - DNA, 25 bp, Mus musculus
atggccttctagcaagaaccccaga

SEQ ID NO: 265144 - DNA, 25 bp, Mus musculus
atggccttctaggaagaaccccaga

SEQ ID NO: 265145 - DNA, 25 bp, Mus musculus
atggccttggcaccatgacagccaa

SEQ ID NO: 265146 - DNA, 25 bp, Mus musculus
atggccttggcagcatgacagccaa

SEQ ID NO: 265147 - DNA, 25 bp, Mus musculus
atggccttggccactaaacagcaac

SEQ ID NO: 265148 - DNA, 25 bp, Mus musculus
atggccttggcccaggagcagttgc

SEQ ID NO: 265149 - DNA, 25 bp, Mus musculus
atggccttggccgaggagcagttgc

SEQ ID NO: 265150 - DNA, 25 bp, Mus musculus
atggccttggcctctaaacagcaac

SEQ ID NO: 265151 - DNA, 25 bp, Mus musculus
atggccttgggcagtgttgcagtta

SEQ ID NO: 265152 - DNA, 25 bp, Mus musculus
atggccttgggctgtgttgcagtta

SEQ ID NO: 265153 - DNA, 25 bp, Mus musculus
atggccttggttctggctcatccta

SEQ ID NO: 265154 - DNA, 25 bp, Mus musculus
atggccttggttgtggctcatccta

SEQ ID NO: 265155 - DNA, 25 bp, Mus musculus
atggccttgtaaatttccatccttc

SEQ ID NO: 265156 - DNA, 25 bp, Mus musculus
atggccttgtaattttccatccttc

SEQ ID NO: 265157 - DNA, 25 bp, Mus musculus
atggccttgtgaatttcttagaaac

SEQ ID NO: 265158 - DNA, 25 bp, Mus musculus
atggccttgtgattttcttagaaac

SEQ ID NO: 265159 - DNA, 25 bp, Mus musculus
atggccttgttgaacccagactacg

SEQ ID NO: 265160 - DNA, 25 bp, Mus musculus
atggccttgttgtacccagactacg

SEQ ID NO: 265161 - DNA, 25 bp, Mus musculus
atggcctttcatcctagcactgagg

SEQ ID NO: 265162 - DNA, 25 bp, Mus musculus
atggcctttcatgctagcactgagg

SEQ ID NO: 265163 - DNA, 25 bp, Mus musculus
atggcctttcctacataattggtat

SEQ ID NO: 265164 - DNA, 25 bp, Mus musculus
atggcctttccttcataattggtat

SEQ ID NO: 265165 - DNA, 25 bp, Mus musculus
atggcctttgagcagcaagctttca

SEQ ID NO: 265166 - DNA, 25 bp, Mus musculus
atggcctttgaggagcaagctttca

SEQ ID NO: 265167 - DNA, 25 bp, Mus musculus
atggcctttggaccttgcaagccgt

SEQ ID NO: 265168 - DNA, 25 bp, Mus musculus
atggcctttggagcttgcaagccgt

SEQ ID NO: 265169 - DNA, 25 bp, Mus musculus
atggcctttggtcccaattgtgaaa

SEQ ID NO: 265170 - DNA, 25 bp, Mus musculus
atggcctttggtgccaattgtgaaa

SEQ ID NO: 265171 - DNA, 25 bp, Mus musculus
atggcctttgtaattgtgtccttgt

SEQ ID NO: 265172 - DNA, 25 bp, Mus musculus
atggcctttgtatttgtgtccttgt

SEQ ID NO: 265173 - DNA, 25 bp, Mus musculus
atggccttttgaatactgcactata

SEQ ID NO: 265174 - DNA, 25 bp, Mus musculus
atggccttttgattactgcactata

SEQ ID NO: 265175 - DNA, 25 bp, Mus musculus
atggccttttggagagtcgttccca

SEQ ID NO: 265176 - DNA, 25 bp, Mus musculus
atggccttttggtgagtcgttccca

SEQ ID NO: 265177 - DNA, 25 bp, Mus musculus
atggcgaacaatattactagacttt

SEQ ID NO: 265178 - DNA, 25 bp, Mus musculus
atggcgaacaattttactagacttt

SEQ ID NO: 265179 - DNA, 25 bp, Mus musculus
atggcgacacggcttacgcgacaac

SEQ ID NO: 265180 - DNA, 25 bp, Mus musculus
atggcgacacgggttacgcgacaac

SEQ ID NO: 265181 - DNA, 25 bp, Mus musculus
atggcgacactcagaagagctctac

SEQ ID NO: 265182 - DNA, 25 bp, Mus musculus
atggcgacactctgaagagctctac

SEQ ID NO: 265183 - DNA, 25 bp, Mus musculus
atggcgacatgtaggtctgtggact

SEQ ID NO: 265184 - DNA, 25 bp, Mus musculus
atggcgacatgttggtctgtggact

SEQ ID NO: 265185 - DNA, 25 bp, Mus musculus
atggcgaccctgagctttttgagcg

SEQ ID NO: 265186 - DNA, 25 bp, Mus musculus
atggcgaccctgtgctttttgagcg

SEQ ID NO: 265187 - DNA, 25 bp, Mus musculus
atggcgaccgacctgcttgctggct

SEQ ID NO: 265188 - DNA, 25 bp, Mus musculus
atggcgaccgacgtgcttgctggct

SEQ ID NO: 265189 - DNA, 25 bp, Mus musculus
atggcgacgcctccaagtttgccga

SEQ ID NO: 265190 - DNA, 25 bp, Mus musculus
atggcgacgcctgcaagtttgccga

SEQ ID NO: 265191 - DNA, 25 bp, Mus musculus
atggcgactgacctggagctgacaa

SEQ ID NO: 265192 - DNA, 25 bp, Mus musculus
atggcgactgacgtggagctgacaa

SEQ ID NO: 265193 - DNA, 25 bp, Mus musculus
atggcgactgcacaagaactacctc

SEQ ID NO: 265194 - DNA, 25 bp, Mus musculus
atggcgactgcagaagaactacctc

SEQ ID NO: 265195 - DNA, 25 bp, Mus musculus
atggcgacttggacggctatgccgc

SEQ ID NO: 265196 - DNA, 25 bp, Mus musculus
atggcgacttggtcggctatgccgc

SEQ ID NO: 265197 - DNA, 25 bp, Mus musculus
atggcgagacgcagagagccctccc

SEQ ID NO: 265198 - DNA, 25 bp, Mus musculus
atggcgagacgctgagagccctccc

SEQ ID NO: 265199 - DNA, 25 bp, Mus musculus
atggcgagcttccagagcatgctaa

SEQ ID NO: 265200 - DNA, 25 bp, Mus musculus
atggcgagcttcgagagcatgctaa

SEQ ID NO: 265201 - DNA, 25 bp, Mus musculus
atggcgaggaccctgtgccttcaag

SEQ ID NO: 265202 - DNA, 25 bp, Mus musculus
atggcgaggaccgtgtgccttcaag

SEQ ID NO: 265203 - DNA, 25 bp, Mus musculus
atggcgatccaaccaagattgcttg

SEQ ID NO: 265204 - DNA, 25 bp, Mus musculus
atggcgatccaagcaagattgcttg

SEQ ID NO: 265205 - DNA, 25 bp, Mus musculus
atggcgatcgttctggatactgctg

SEQ ID NO: 265206 - DNA, 25 bp, Mus musculus
atggcgatcgttgtggatactgctg

SEQ ID NO: 265207 - DNA, 25 bp, Mus musculus
atggcgatgccactgtttctttagt

SEQ ID NO: 265208 - DNA, 25 bp, Mus musculus
atggcgatgccagtgtttctttagt

SEQ ID NO: 265209 - DNA, 25 bp, Mus musculus
atggcgatttgtcaaccgtatccag

SEQ ID NO: 265210 - DNA, 25 bp, Mus musculus
atggcgatttgtgaaccgtatccag

SEQ ID NO: 265211 - DNA, 25 bp, Mus musculus
atggcgattttgctgacatcctcca

SEQ ID NO: 265212 - DNA, 25 bp, Mus musculus
atggcgattttggtgacatcctcca

SEQ ID NO: 265213 - DNA, 25 bp, Mus musculus
atggcgcaacagcagtccgtctctt

SEQ ID NO: 265214 - DNA, 25 bp, Mus musculus
atggcgcaacaggagtccgtctctt

SEQ ID NO: 265215 - DNA, 25 bp, Mus musculus
atggcgcagaatacatctcttcgag

SEQ ID NO: 265216 - DNA, 25 bp, Mus musculus
atggcgcagaattcatctcttcgag

SEQ ID NO: 265217 - DNA, 25 bp, Mus musculus
atggcgcagtacatcgattagcagc

SEQ ID NO: 265218 - DNA, 25 bp, Mus musculus
atggcgcagtacttcgattagcagc

SEQ ID NO: 265219 - DNA, 25 bp, Mus musculus
atggcgcagtcgctgtcccagtgca

SEQ ID NO: 265220 - DNA, 25 bp, Mus musculus
atggcgcagtcggtgtcccagtgca

SEQ ID NO: 265221 - DNA, 25 bp, Mus musculus
atggcgcatgttcaagtaccggtct

SEQ ID NO: 265222 - DNA, 25 bp, Mus musculus
atggcgcatgttgaagtaccggtct

SEQ ID NO: 265223 - DNA, 25 bp, Mus musculus
atggcgccattgctggcatcgtgat

SEQ ID NO: 265224 - DNA, 25 bp, Mus musculus
atggcgccattggtggcatcgtgat

SEQ ID NO: 265225 - DNA, 25 bp, Mus musculus
atggcgccctgaagtcacaaggtac

SEQ ID NO: 265226 - DNA, 25 bp, Mus musculus
atggcgccctgatgtcacaaggtac

SEQ ID NO: 265227 - DNA, 25 bp, Mus musculus
atggcgccgaggaatatgccccact

SEQ ID NO: 265228 - DNA, 25 bp, Mus musculus
atggcgccgaggtatatgccccact

SEQ ID NO: 265229 - DNA, 25 bp, Mus musculus
atggcgcctacaatctcttctgctt

SEQ ID NO: 265230 - DNA, 25 bp, Mus musculus
atggcgcctacattctcttctgctt

SEQ ID NO: 265231 - DNA, 25 bp, Mus musculus
atggcgcctgggactgtgactaagt

SEQ ID NO: 265232 - DNA, 25 bp, Mus musculus
atggcgcctgggtctgtgactaagt

SEQ ID NO: 265233 - DNA, 25 bp, Mus musculus
atggcgcctgtgactccgggtcaag

SEQ ID NO: 265234 - DNA, 25 bp, Mus musculus
atggcgcctgtgtctccgggtcaag

SEQ ID NO: 265235 - DNA, 25 bp, Mus musculus
atggcgcgtgcgcataagccctctg

SEQ ID NO: 265236 - DNA, 25 bp, Mus musculus
atggcgcgtgcggataagccctctg

SEQ ID NO: 265237 - DNA, 25 bp, Mus musculus
atggcgctgatccacttccagaacc

SEQ ID NO: 265238 - DNA, 25 bp, Mus musculus
atggcgctgatcgacttccagaacc

SEQ ID NO: 265239 - DNA, 25 bp, Mus musculus
atggcgctggcccattcactgcaat

SEQ ID NO: 265240 - DNA, 25 bp, Mus musculus
atggcgctggccgattcactgcaat

SEQ ID NO: 265241 - DNA, 25 bp, Mus musculus
atggcgctgtagctcaaagactgga

SEQ ID NO: 265242 - DNA, 25 bp, Mus musculus
atggcgctgtaggtcaaagactgga

SEQ ID NO: 265243 - DNA, 25 bp, Mus musculus
atggcgctgtcaattcacctttaat

SEQ ID NO: 265244 - DNA, 25 bp, Mus musculus
atggcgctgtcatttcacctttaat

SEQ ID NO: 265245 - DNA, 25 bp, Mus musculus
atggcgcttcccagcacagacatgt

SEQ ID NO: 265246 - DNA, 25 bp, Mus musculus
atggcgcttccctgcacagacatgt

SEQ ID NO: 265247 - DNA, 25 bp, Mus musculus
atggcgcttgcactgttctctgcag

SEQ ID NO: 265248 - DNA, 25 bp, Mus musculus
atggcgcttgcagtgttctctgcag

SEQ ID NO: 265249 - DNA, 25 bp, Mus musculus
atggcggaaattcttcacacagtgt

SEQ ID NO: 265250 - DNA, 25 bp, Mus musculus
atggcggaaattgttcacacagtgt

SEQ ID NO: 265251 - DNA, 25 bp, Mus musculus
atggcggagctgctccaaccttcaa

SEQ ID NO: 265252 - DNA, 25 bp, Mus musculus
atggcggagctggtccaaccttcaa

SEQ ID NO: 265253 - DNA, 25 bp, Mus musculus
atggcggaggaacctgtcttcagct

SEQ ID NO: 265254 - DNA, 25 bp, Mus musculus
atggcggaggaagctgtcttcagct

SEQ ID NO: 265255 - DNA, 25 bp, Mus musculus
atggcggatccacacctgttggaag

SEQ ID NO: 265256 - DNA, 25 bp, Mus musculus
atggcggatccagacctgttggaag

SEQ ID NO: 265257 - DNA, 25 bp, Mus musculus
atggcggatctgcaagggtccacca

SEQ ID NO: 265258 - DNA, 25 bp, Mus musculus
atggcggatctggaagggtccacca

SEQ ID NO: 265259 - DNA, 25 bp, Mus musculus
atggcggcaccgaatcctcagggac

SEQ ID NO: 265260 - DNA, 25 bp, Mus musculus
atggcggcaccgtatcctcagggac

SEQ ID NO: 265261 - DNA, 25 bp, Mus musculus
atggcggccacacgcttaaatgcca

SEQ ID NO: 265262 - DNA, 25 bp, Mus musculus
atggcggccacaggcttaaatgcca

SEQ ID NO: 265263 - DNA, 25 bp, Mus musculus
atggcggccgcgacagctaccgcag

SEQ ID NO: 265264 - DNA, 25 bp, Mus musculus
atggcggccgcgtcagctaccgcag

SEQ ID NO: 265265 - DNA, 25 bp, Mus musculus
atggcggccgggagtgcggccttcg

SEQ ID NO: 265266 - DNA, 25 bp, Mus musculus
atggcggccgggtgtgcggccttcg

SEQ ID NO: 265267 - DNA, 25 bp, Mus musculus
atggcggcgccgagacagatcacgt

SEQ ID NO: 265268 - DNA, 25 bp, Mus musculus
atggcggcgccgtgacagatcacgt

SEQ ID NO: 265269 - DNA, 25 bp, Mus musculus
atggcggcggttctctagtatattc

SEQ ID NO: 265270 - DNA, 25 bp, Mus musculus
atggcggcggttgtctagtatattc

SEQ ID NO: 265271 - DNA, 25 bp, Mus musculus
atggcggctatgattatactgggta

SEQ ID NO: 265272 - DNA, 25 bp, Mus musculus
atggcggctatgtttatactgggta

SEQ ID NO: 265273 - DNA, 25 bp, Mus musculus
atggcggctcctcgacttcactttc

SEQ ID NO: 265274 - DNA, 25 bp, Mus musculus
atggcggctcctggacttcactttc

SEQ ID NO: 265275 - DNA, 25 bp, Mus musculus
atggcgggaatcatcaggtcactct

SEQ ID NO: 265276 - DNA, 25 bp, Mus musculus
atggcgggaatcttcaggtcactct

SEQ ID NO: 265277 - DNA, 25 bp, Mus musculus
atggcgggtatgagcactctctgaa

SEQ ID NO: 265278 - DNA, 25 bp, Mus musculus
atggcgggtatgtgcactctctgaa

SEQ ID NO: 265279 - DNA, 25 bp, Mus musculus
atggcggtgagaatagcttctgtct

SEQ ID NO: 265280 - DNA, 25 bp, Mus musculus
atggcggtgagattagcttctgtct

SEQ ID NO: 265281 - DNA, 25 bp, Mus musculus
atggcggtggagacgcgcgttaccc

SEQ ID NO: 265282 - DNA, 25 bp, Mus musculus
atggcggtggagtcgcgcgttaccc

SEQ ID NO: 265283 - DNA, 25 bp, Mus musculus
atggcggttcgcagccctccatgac

SEQ ID NO: 265284 - DNA, 25 bp, Mus musculus
atggcggttcgctgccctccatgac

SEQ ID NO: 265285 - DNA, 25 bp, Mus musculus
atggcgtacaagaggtgaagcagct

SEQ ID NO: 265286 - DNA, 25 bp, Mus musculus
atggcgtacaagtggtgaagcagct

SEQ ID NO: 265287 - DNA, 25 bp, Mus musculus
atggcgtaggatcttttgtatgaac

SEQ ID NO: 265288 - DNA, 25 bp, Mus musculus
atggcgtaggatgttttgtatgaac

SEQ ID NO: 265289 - DNA, 25 bp, Mus musculus
atggcgtaggctccgtgatgtcacc

SEQ ID NO: 265290 - DNA, 25 bp, Mus musculus
atggcgtaggctgcgtgatgtcacc

SEQ ID NO: 265291 - DNA, 25 bp, Mus musculus
atggcgtagtcccagagctggtctt

SEQ ID NO: 265292 - DNA, 25 bp, Mus musculus
atggcgtagtccgagagctggtctt

SEQ ID NO: 265293 - DNA, 25 bp, Mus musculus
atggcgtatgtccaagatagcttct

SEQ ID NO: 265294 - DNA, 25 bp, Mus musculus
atggcgtatgtcgaagatagcttct

SEQ ID NO: 265295 - DNA, 25 bp, Mus musculus
atggcgtcagccatcagtcaggtgc

SEQ ID NO: 265296 - DNA, 25 bp, Mus musculus
atggcgtcagccttcagtcaggtgc

SEQ ID NO: 265297 - DNA, 25 bp, Mus musculus
atggcgtcagttcctaaatgtttta

SEQ ID NO: 265298 - DNA, 25 bp, Mus musculus
atggcgtcagttgctaaatgtttta

SEQ ID NO: 265299 - DNA, 25 bp, Mus musculus
atggcgtccaatccgtgcagagaag

SEQ ID NO: 265300 - DNA, 25 bp, Mus musculus
atggcgtccaatgcgtgcagagaag

SEQ ID NO: 265301 - DNA, 25 bp, Mus musculus
atggcgtccactacttctgttggtg

SEQ ID NO: 265302 - DNA, 25 bp, Mus musculus
atggcgtccacttcttctgttggtg

SEQ ID NO: 265303 - DNA, 25 bp, Mus musculus
atggcgtcccttactgttaccagga

SEQ ID NO: 265304 - DNA, 25 bp, Mus musculus
atggcgtccctttctgttaccagga

SEQ ID NO: 265305 - DNA, 25 bp, Mus musculus
atggcgtcctgcatgcttgttattg

SEQ ID NO: 265306 - DNA, 25 bp, Mus musculus
atggcgtcctgcttgcttgttattg

SEQ ID NO: 265307 - DNA, 25 bp, Mus musculus
atggcgtcttccaaggatgctgcta

SEQ ID NO: 265308 - DNA, 25 bp, Mus musculus
atggcgtcttcctaggatgctgcta

SEQ ID NO: 265309 - DNA, 25 bp, Mus musculus
atggcgtgaccacctttgtttctgc

SEQ ID NO: 265310 - DNA, 25 bp, Mus musculus
atggcgtgaccagctttgtttctgc

SEQ ID NO: 265311 - DNA, 25 bp, Mus musculus
atggcgtgagccaccaattgtgaaa

SEQ ID NO: 265312 - DNA, 25 bp, Mus musculus
atggcgtgagcctccaattgtgaaa

SEQ ID NO: 265313 - DNA, 25 bp, Mus musculus
atggcgtgcagcaaacaacctacct

SEQ ID NO: 265314 - DNA, 25 bp, Mus musculus
atggcgtgcagctaacaacctacct

SEQ ID NO: 265315 - DNA, 25 bp, Mus musculus
atggcgtgctaacccagtgcctcag

SEQ ID NO: 265316 - DNA, 25 bp, Mus musculus
atggcgtgctaagccagtgcctcag

SEQ ID NO: 265317 - DNA, 25 bp, Mus musculus
atggcgtgctcaattcagcatcagg

SEQ ID NO: 265318 - DNA, 25 bp, Mus musculus
atggcgtgctcaccattaagctggg

SEQ ID NO: 265319 - DNA, 25 bp, Mus musculus
atggcgtgctcagcattaagctggg

SEQ ID NO: 265320 - DNA, 25 bp, Mus musculus
atggcgtgctcatttcagcatcagg

SEQ ID NO: 265321 - DNA, 25 bp, Mus musculus
atggcgtgtaggcttcatccactgc

SEQ ID NO: 265322 - DNA, 25 bp, Mus musculus
atggcgtgtagggttcatccactgc

SEQ ID NO: 265323 - DNA, 25 bp, Mus musculus
atggcgtgtgctagcttgtgcagta

SEQ ID NO: 265324 - DNA, 25 bp, Mus musculus
atggcgtgtgcttgcttgtgcagta

SEQ ID NO: 265325 - DNA, 25 bp, Mus musculus
atggcgttatggacctgcccggctg

SEQ ID NO: 265326 - DNA, 25 bp, Mus musculus
atggcgttatggtcctgcccggctg

SEQ ID NO: 265327 - DNA, 25 bp, Mus musculus
atggcgttccacatgacagcctggt

SEQ ID NO: 265328 - DNA, 25 bp, Mus musculus
atggcgttccacttgacagcctggt

SEQ ID NO: 265329 - DNA, 25 bp, Mus musculus
atggcgttcctgatcccaggactga

SEQ ID NO: 265330 - DNA, 25 bp, Mus musculus
atggcgttcctgttcccaggactga

SEQ ID NO: 265331 - DNA, 25 bp, Mus musculus
atggcgttctacataccgaccaggg

SEQ ID NO: 265332 - DNA, 25 bp, Mus musculus
atggcgttctacttaccgaccaggg

SEQ ID NO: 265333 - DNA, 25 bp, Mus musculus
atggcgtttcttcatagacttctac

SEQ ID NO: 265334 - DNA, 25 bp, Mus musculus
atggcgtttcttgatagacttctac

SEQ ID NO: 265335 - DNA, 25 bp, Mus musculus
atggcgttttgcctgcagagaacct

SEQ ID NO: 265336 - DNA, 25 bp, Mus musculus
atggcgttttgcgtgcagagaacct

SEQ ID NO: 265337 - DNA, 25 bp, Mus musculus
atggcgtttttcagttccctagatc

SEQ ID NO: 265338 - DNA, 25 bp, Mus musculus
atggcgtttttctgttccctagatc

SEQ ID NO: 265339 - DNA, 25 bp, Mus musculus
atggctaaaatcacataaacctttg

SEQ ID NO: 265340 - DNA, 25 bp, Mus musculus
atggctaaaatctcataaacctttg

SEQ ID NO: 265341 - DNA, 25 bp, Mus musculus
atggctaaacgcaccaagaaggtcg

SEQ ID NO: 265342 - DNA, 25 bp, Mus musculus
atggctaaacgctccaagaaggtcg

SEQ ID NO: 265343 - DNA, 25 bp, Mus musculus
atggctaaatagcactgacacgatg

SEQ ID NO: 265344 - DNA, 25 bp, Mus musculus
atggctaaataggactgacacgatg

SEQ ID NO: 265345 - DNA, 25 bp, Mus musculus
atggctaactccatctgcatattcc

SEQ ID NO: 265346 - DNA, 25 bp, Mus musculus
atggctaactccttctgcatattcc

SEQ ID NO: 265347 - DNA, 25 bp, Mus musculus
atggctaaggaaacttgccctgttt

SEQ ID NO: 265348 - DNA, 25 bp, Mus musculus
atggctaaggaatcttgccctgttt

SEQ ID NO: 265349 - DNA, 25 bp, Mus musculus
atggctaattaaattctgctacaga

SEQ ID NO: 265350 - DNA, 25 bp, Mus musculus
atggctaattaatttctgctacaga

SEQ ID NO: 265351 - DNA, 25 bp, Mus musculus
atggctacacctctgttatcagagg

SEQ ID NO: 265352 - DNA, 25 bp, Mus musculus
atggctacacctgtgttatcagagg

SEQ ID NO: 265353 - DNA, 25 bp, Mus musculus
atggctacactaaccagggctggta

SEQ ID NO: 265354 - DNA, 25 bp, Mus musculus
atggctacactatccagggctggta

SEQ ID NO: 265355 - DNA, 25 bp, Mus musculus
atggctacagctcagagactgtcta

SEQ ID NO: 265356 - DNA, 25 bp, Mus musculus
atggctacagctgagagactgtcta

SEQ ID NO: 265357 - DNA, 25 bp, Mus musculus
atggctacaggaacacggtctacaa

SEQ ID NO: 265358 - DNA, 25 bp, Mus musculus
atggctacaggatcacggtctacaa

SEQ ID NO: 265359 - DNA, 25 bp, Mus musculus
atggctacatctctcggtgcttcac

SEQ ID NO: 265360 - DNA, 25 bp, Mus musculus
atggctacatctgtcggtgcttcac

SEQ ID NO: 265361 - DNA, 25 bp, Mus musculus
atggctacattaactgtgtgttaac

SEQ ID NO: 265362 - DNA, 25 bp, Mus musculus
atggctacattatctgtgtgttaac

SEQ ID NO: 265363 - DNA, 25 bp, Mus musculus
atggctaccaacattttgatctgtg

SEQ ID NO: 265364 - DNA, 25 bp, Mus musculus
atggctaccaactttttgatctgtg

SEQ ID NO: 265365 - DNA, 25 bp, Mus musculus
atggctaccactctaggtcaggtaa

SEQ ID NO: 265366 - DNA, 25 bp, Mus musculus
atggctaccactgtaggtcaggtaa

SEQ ID NO: 265367 - DNA, 25 bp, Mus musculus
atggctaccaggatgactaccgtca

SEQ ID NO: 265368 - DNA, 25 bp, Mus musculus
atggctaccaggttgactaccgtca

SEQ ID NO: 265369 - DNA, 25 bp, Mus musculus
atggctaccatactcatgaactcat

SEQ ID NO: 265370 - DNA, 25 bp, Mus musculus
atggctaccatagtcatgaactcat

SEQ ID NO: 265371 - DNA, 25 bp, Mus musculus
atggctaccatgatccctgagtcta

SEQ ID NO: 265372 - DNA, 25 bp, Mus musculus
atggctaccatgttccctgagtcta

SEQ ID NO: 265373 - DNA, 25 bp, Mus musculus
atggctacccagacactgatagtac

SEQ ID NO: 265374 - DNA, 25 bp, Mus musculus
atggctacccagtcactgatagtac

SEQ ID NO: 265375 - DNA, 25 bp, Mus musculus
atggctaccgaaaaaatgaaggcta

SEQ ID NO: 265376 - DNA, 25 bp, Mus musculus
atggctaccgaataaatgaaggcta

SEQ ID NO: 265377 - DNA, 25 bp, Mus musculus
atggctacctctcagactccaaaga

SEQ ID NO: 265378 - DNA, 25 bp, Mus musculus
atggctacctctgagactccaaaga

SEQ ID NO: 265379 - DNA, 25 bp, Mus musculus
atggctacctgtccatacagcaggc

SEQ ID NO: 265380 - DNA, 25 bp, Mus musculus
atggctacctgtgcatacagcaggc

SEQ ID NO: 265381 - DNA, 25 bp, Mus musculus
atggctacgccactttcttgagatt

SEQ ID NO: 265382 - DNA, 25 bp, Mus musculus
atggctacgccagtttcttgagatt

SEQ ID NO: 265383 - DNA, 25 bp, Mus musculus
atggctacgccgctacatcaagtgg

SEQ ID NO: 265384 - DNA, 25 bp, Mus musculus
atggctacgccggtacatcaagtgg

SEQ ID NO: 265385 - DNA, 25 bp, Mus musculus
atggctactagtaattgcttctcct

SEQ ID NO: 265386 - DNA, 25 bp, Mus musculus
atggctactagttattgcttctcct

SEQ ID NO: 265387 - DNA, 25 bp, Mus musculus
atggctactcccagcaagcaggtca

SEQ ID NO: 265388 - DNA, 25 bp, Mus musculus
atggctactccctgcaagcaggtca

SEQ ID NO: 265389 - DNA, 25 bp, Mus musculus
atggctacttgcaaaaatccttgag

SEQ ID NO: 265390 - DNA, 25 bp, Mus musculus
atggctacttgctaaaatccttgag

SEQ ID NO: 265391 - DNA, 25 bp, Mus musculus
atggctactttcatctctggaaggc

SEQ ID NO: 265392 - DNA, 25 bp, Mus musculus
atggctactttcttctctggaaggc

SEQ ID NO: 265393 - DNA, 25 bp, Mus musculus
atggctagaaacctctcagagctac

SEQ ID NO: 265394 - DNA, 25 bp, Mus musculus
atggctagaaacgtctcagagctac

SEQ ID NO: 265395 - DNA, 25 bp, Mus musculus
atggctagagcaactctccaacttg

SEQ ID NO: 265396 - DNA, 25 bp, Mus musculus
atggctagagcatctctccaacttg

SEQ ID NO: 265397 - DNA, 25 bp, Mus musculus
atggctagagttcagggcactccag

SEQ ID NO: 265398 - DNA, 25 bp, Mus musculus
atggctagagttgagggcactccag

SEQ ID NO: 265399 - DNA, 25 bp, Mus musculus
atggctagatgcagtggtaaacacc

SEQ ID NO: 265400 - DNA, 25 bp, Mus musculus
atggctagatgctgtggtaaacacc

SEQ ID NO: 265401 - DNA, 25 bp, Mus musculus
atggctagcctgatacattagactg

SEQ ID NO: 265402 - DNA, 25 bp, Mus musculus
atggctagcctgttacattagactg

SEQ ID NO: 265403 - DNA, 25 bp, Mus musculus
atggctaggagcacagctatcctca

SEQ ID NO: 265404 - DNA, 25 bp, Mus musculus
atggctaggagctcagctatcctca

SEQ ID NO: 265405 - DNA, 25 bp, Mus musculus
atggctaggcagacaggccctcggc

SEQ ID NO: 265406 - DNA, 25 bp, Mus musculus
atggctaggcagtcaggccctcggc

SEQ ID NO: 265407 - DNA, 25 bp, Mus musculus
atggctaggcatcttgggcttccca

SEQ ID NO: 265408 - DNA, 25 bp, Mus musculus
atggctaggcatgttgggcttccca

SEQ ID NO: 265409 - DNA, 25 bp, Mus musculus
atggctaggtgaagaccggctctcc

SEQ ID NO: 265410 - DNA, 25 bp, Mus musculus
atggctaggtgatgaccggctctcc

SEQ ID NO: 265411 - DNA, 25 bp, Mus musculus
atggctagtattattccactggact

SEQ ID NO: 265412 - DNA, 25 bp, Mus musculus
atggctagtatttttccactggact

SEQ ID NO: 265413 - DNA, 25 bp, Mus musculus
atggctagtcacatcttctgactca

SEQ ID NO: 265414 - DNA, 25 bp, Mus musculus
atggctagtcacttcttctgactca

SEQ ID NO: 265415 - DNA, 25 bp, Mus musculus
atggctagttccagacttggtctac

SEQ ID NO: 265416 - DNA, 25 bp, Mus musculus
atggctagttcctgacttggtctac

SEQ ID NO: 265417 - DNA, 25 bp, Mus musculus
atggctataatcaagagctctactt

SEQ ID NO: 265418 - DNA, 25 bp, Mus musculus
atggctataatctagagctctactt

SEQ ID NO: 265419 - DNA, 25 bp, Mus musculus
atggctatagatctttggactggaa

SEQ ID NO: 265420 - DNA, 25 bp, Mus musculus
atggctatagatgtttggactggaa

SEQ ID NO: 265421 - DNA, 25 bp, Mus musculus
atggctatattaccgctgccgagct

SEQ ID NO: 265422 - DNA, 25 bp, Mus musculus
atggctatattagcgctgccgagct

SEQ ID NO: 265423 - DNA, 25 bp, Mus musculus
atggctatcattcatgcctgctgct

SEQ ID NO: 265424 - DNA, 25 bp, Mus musculus
atggctatcattgatgcctgctgct

SEQ ID NO: 265425 - DNA, 25 bp, Mus musculus
atggctatcctgattgcaacttgac

SEQ ID NO: 265426 - DNA, 25 bp, Mus musculus
atggctatcctgtttgcaacttgac

SEQ ID NO: 265427 - DNA, 25 bp, Mus musculus
atggctatcgttcgtattgtccttg

SEQ ID NO: 265428 - DNA, 25 bp, Mus musculus
atggctatcgttggtattgtccttg

SEQ ID NO: 265429 - DNA, 25 bp, Mus musculus
atggctatgaaaatcctgtggacat

SEQ ID NO: 265430 - DNA, 25 bp, Mus musculus
atggctatgaaattcctgtggacat

SEQ ID NO: 265431 - DNA, 25 bp, Mus musculus
atggctatgattacttaaccctaaa

SEQ ID NO: 265432 - DNA, 25 bp, Mus musculus
atggctatgatttcttaaccctaaa

SEQ ID NO: 265433 - DNA, 25 bp, Mus musculus
atggctatgccaatactggttataa

SEQ ID NO: 265434 - DNA, 25 bp, Mus musculus
atggctatgccattactggttataa

SEQ ID NO: 265435 - DNA, 25 bp, Mus musculus
atggctatggccagtctctcttctc

SEQ ID NO: 265436 - DNA, 25 bp, Mus musculus
atggctatggcctgtctctcttctc

SEQ ID NO: 265437 - DNA, 25 bp, Mus musculus
atggctatgggcaccatcccaggaa

SEQ ID NO: 265438 - DNA, 25 bp, Mus musculus
atggctatgggctccatcccaggaa

SEQ ID NO: 265439 - DNA, 25 bp, Mus musculus
atggctcaacttccctggacttggg

SEQ ID NO: 265440 - DNA, 25 bp, Mus musculus
atggctcaacttgcctggacttggg

SEQ ID NO: 265441 - DNA, 25 bp, Mus musculus
atggctcacacgaaaatacacatgt

SEQ ID NO: 265442 - DNA, 25 bp, Mus musculus
atggctcacacgtaaatacacatgt

SEQ ID NO: 265443 - DNA, 25 bp, Mus musculus
atggctcacactcttagtcacatat

SEQ ID NO: 265444 - DNA, 25 bp, Mus musculus
atggctcacactgttagtcacatat

SEQ ID NO: 265445 - DNA, 25 bp, Mus musculus
atggctcaccccatagagcaagttc

SEQ ID NO: 265446 - DNA, 25 bp, Mus musculus
atggctcaccccttagagcaagttc

SEQ ID NO: 265447 - DNA, 25 bp, Mus musculus
atggctcaccttacactaatcaaga

SEQ ID NO: 265448 - DNA, 25 bp, Mus musculus
atggctcacctttcactaatcaaga

SEQ ID NO: 265449 - DNA, 25 bp, Mus musculus
atggctcactgccaagctatgggca

SEQ ID NO: 265450 - DNA, 25 bp, Mus musculus
atggctcactgcgaagctatgggca

SEQ ID NO: 265451 - DNA, 25 bp, Mus musculus
atggctcactgtagtgagtcgccaa

SEQ ID NO: 265452 - DNA, 25 bp, Mus musculus
atggctcactgttgtgagtcgccaa

SEQ ID NO: 265453 - DNA, 25 bp, Mus musculus
atggctcagaagcacacgattggct

SEQ ID NO: 265454 - DNA, 25 bp, Mus musculus
atggctcagaaggacacgattggct

SEQ ID NO: 265455 - DNA, 25 bp, Mus musculus
atggctcagagacctagactccttg

SEQ ID NO: 265456 - DNA, 25 bp, Mus musculus
atggctcagagagctagactccttg

SEQ ID NO: 265457 - DNA, 25 bp, Mus musculus
atggctcagatcacaccttgttggt

SEQ ID NO: 265458 - DNA, 25 bp, Mus musculus
atggctcagatctcaccttgttggt

SEQ ID NO: 265459 - DNA, 25 bp, Mus musculus
atggctcagccaaaccttaagatgg

SEQ ID NO: 265460 - DNA, 25 bp, Mus musculus
atggctcagccataccttaagatgg

SEQ ID NO: 265461 - DNA, 25 bp, Mus musculus
atggctcagctaaagtactctgcag

SEQ ID NO: 265462 - DNA, 25 bp, Mus musculus
atggctcagctatagtactctgcag

SEQ ID NO: 265463 - DNA, 25 bp, Mus musculus
atggctcaggagctccttggcaaca

SEQ ID NO: 265464 - DNA, 25 bp, Mus musculus
atggctcaggaggtccttggcaaca

SEQ ID NO: 265465 - DNA, 25 bp, Mus musculus
atggctcagtacacagggaccgaat

SEQ ID NO: 265466 - DNA, 25 bp, Mus musculus
atggctcagtactcagggaccgaat

SEQ ID NO: 265467 - DNA, 25 bp, Mus musculus
atggctcagtcaccttaaattagtc

SEQ ID NO: 265468 - DNA, 25 bp, Mus musculus
atggctcagtcagcttaaattagtc

SEQ ID NO: 265469 - DNA, 25 bp, Mus musculus
atggctcagtgtacacaagcatata

SEQ ID NO: 265470 - DNA, 25 bp, Mus musculus
atggctcagtgttcacaagcatata

SEQ ID NO: 265471 - DNA, 25 bp, Mus musculus
atggctcattagcatctattgtgac

SEQ ID NO: 265472 - DNA, 25 bp, Mus musculus
atggctcattaggatctattgtgac

SEQ ID NO: 265473 - DNA, 25 bp, Mus musculus
atggctcattccaaagcactgttgc

SEQ ID NO: 265474 - DNA, 25 bp, Mus musculus
atggctcattccaatctgtgtaact

SEQ ID NO: 265475 - DNA, 25 bp, Mus musculus
atggctcattcctaagcactgttgc

SEQ ID NO: 265476 - DNA, 25 bp, Mus musculus
atggctcattcctatctgtgtaact

SEQ ID NO: 265477 - DNA, 25 bp, Mus musculus
atggctcattgaactccgggtttaa

SEQ ID NO: 265478 - DNA, 25 bp, Mus musculus
atggctcattgatctccgggtttaa

SEQ ID NO: 265479 - DNA, 25 bp, Mus musculus
atggctccaattccccaatgcagaa

SEQ ID NO: 265480 - DNA, 25 bp, Mus musculus
atggctccaattgcccaatgcagaa

SEQ ID NO: 265481 - DNA, 25 bp, Mus musculus
atggctccactgctccaagagaact

SEQ ID NO: 265482 - DNA, 25 bp, Mus musculus
atggctccactggtccaagagaact

SEQ ID NO: 265483 - DNA, 25 bp, Mus musculus
atggctccagatcgtcttaagcgga

SEQ ID NO: 265484 - DNA, 25 bp, Mus musculus
atggctccagatggtcttaagcgga

SEQ ID NO: 265485 - DNA, 25 bp, Mus musculus
atggctccaggccactctcgaggct

SEQ ID NO: 265486 - DNA, 25 bp, Mus musculus
atggctccaggcgactctcgaggct

SEQ ID NO: 265487 - DNA, 25 bp, Mus musculus
atggctccagggattctttatggtt

SEQ ID NO: 265488 - DNA, 25 bp, Mus musculus
atggctccagggtttctttatggtt

SEQ ID NO: 265489 - DNA, 25 bp, Mus musculus
atggctccaggtatggctgtggatg

SEQ ID NO: 265490 - DNA, 25 bp, Mus musculus
atggctccaggtttggctgtggatg

SEQ ID NO: 265491 - DNA, 25 bp, Mus musculus
atggctccatcaacctgcgtatgag

SEQ ID NO: 265492 - DNA, 25 bp, Mus musculus
atggctccatcatcctgcgtatgag

SEQ ID NO: 265493 - DNA, 25 bp, Mus musculus
atggctccatgtaatgtgctattct

SEQ ID NO: 265494 - DNA, 25 bp, Mus musculus
atggctccatgttatgtgctattct

SEQ ID NO: 265495 - DNA, 25 bp, Mus musculus
atggctccattgagcccctagagga

SEQ ID NO: 265496 - DNA, 25 bp, Mus musculus
atggctccattgcagccgatactgc

SEQ ID NO: 265497 - DNA, 25 bp, Mus musculus
atggctccattgctaaactgcttgc

SEQ ID NO: 265498 - DNA, 25 bp, Mus musculus
atggctccattggagccgatactgc

SEQ ID NO: 265499 - DNA, 25 bp, Mus musculus
atggctccattggtaaactgcttgc

SEQ ID NO: 265500 - DNA, 25 bp, Mus musculus
atggctccattgtgcccctagagga

SEQ ID NO: 265501 - DNA, 25 bp, Mus musculus
atggctcccactatgatgtccggat

SEQ ID NO: 265502 - DNA, 25 bp, Mus musculus
atggctcccactttgatgtccggat

SEQ ID NO: 265503 - DNA, 25 bp, Mus musculus
atggctccccagagatggctaggta

SEQ ID NO: 265504 - DNA, 25 bp, Mus musculus
atggctccccagtgatggctaggta

SEQ ID NO: 265505 - DNA, 25 bp, Mus musculus
atggctcccttgagcaaatggaaca

SEQ ID NO: 265506 - DNA, 25 bp, Mus musculus
atggctcccttgtgcaaatggaaca

SEQ ID NO: 265507 - DNA, 25 bp, Mus musculus
atggctccgagccattcctctgtga

SEQ ID NO: 265508 - DNA, 25 bp, Mus musculus
atggctccgagcgattcctctgtga

SEQ ID NO: 265509 - DNA, 25 bp, Mus musculus
atggctccgtaaattccaggaggga

SEQ ID NO: 265510 - DNA, 25 bp, Mus musculus
atggctccgtaatttccaggaggga

SEQ ID NO: 265511 - DNA, 25 bp, Mus musculus
atggctccgtcactgaagggcacac

SEQ ID NO: 265512 - DNA, 25 bp, Mus musculus
atggctccgtcagtgaagggcacac

SEQ ID NO: 265513 - DNA, 25 bp, Mus musculus
atggctcctatcacatgttcatcaa

SEQ ID NO: 265514 - DNA, 25 bp, Mus musculus
atggctcctatctcatgttcatcaa

SEQ ID NO: 265515 - DNA, 25 bp, Mus musculus
atggctcctcacagtactttactgt

SEQ ID NO: 265516 - DNA, 25 bp, Mus musculus
atggctcctcactgtactttactgt

SEQ ID NO: 265517 - DNA, 25 bp, Mus musculus
atggctcctcatatgcactgtaaga

SEQ ID NO: 265518 - DNA, 25 bp, Mus musculus
atggctcctcatttgcactgtaaga

SEQ ID NO: 265519 - DNA, 25 bp, Mus musculus
atggctcctccacctggtatgagac

SEQ ID NO: 265520 - DNA, 25 bp, Mus musculus
atggctcctccagctggtatgagac

SEQ ID NO: 265521 - DNA, 25 bp, Mus musculus
atggctcctcccctggtaaagcaat

SEQ ID NO: 265522 - DNA, 25 bp, Mus musculus
atggctcctcccgtggtaaagcaat

SEQ ID NO: 265523 - DNA, 25 bp, Mus musculus
atggctcctctccaagcaactcgaa

SEQ ID NO: 265524 - DNA, 25 bp, Mus musculus
atggctcctctcgaagcaactcgaa

SEQ ID NO: 265525 - DNA, 25 bp, Mus musculus
atggctcctgaaacatgccccaaat

SEQ ID NO: 265526 - DNA, 25 bp, Mus musculus
atggctcctgaatcatgccccaaat

SEQ ID NO: 265527 - DNA, 25 bp, Mus musculus
atggctcctgaccatgagaactcta

SEQ ID NO: 265528 - DNA, 25 bp, Mus musculus
atggctcctgacgatgagaactcta

SEQ ID NO: 265529 - DNA, 25 bp, Mus musculus
atggctcctggtacatatctcacag

SEQ ID NO: 265530 - DNA, 25 bp, Mus musculus
atggctcctggttcatatctcacag

SEQ ID NO: 265531 - DNA, 25 bp, Mus musculus
atggctccttccctagagagaaaca

SEQ ID NO: 265532 - DNA, 25 bp, Mus musculus
atggctccttccgtagagagaaaca

SEQ ID NO: 265533 - DNA, 25 bp, Mus musculus
atggctcgcagcctactggacctgg

SEQ ID NO: 265534 - DNA, 25 bp, Mus musculus
atggctcgcagcgtactggacctgg

SEQ ID NO: 265535 - DNA, 25 bp, Mus musculus
atggctcgcttcctgttagtagttg

SEQ ID NO: 265536 - DNA, 25 bp, Mus musculus
atggctcgcttcgtgttagtagttg

SEQ ID NO: 265537 - DNA, 25 bp, Mus musculus
atggctcggagcatgtttgacactg

SEQ ID NO: 265538 - DNA, 25 bp, Mus musculus
atggctcggagcttgtttgacactg

SEQ ID NO: 265539 - DNA, 25 bp, Mus musculus
atggctcggcatattctatggttac

SEQ ID NO: 265540 - DNA, 25 bp, Mus musculus
atggctcggcattttctatggttac

SEQ ID NO: 265541 - DNA, 25 bp, Mus musculus
atggctcgggacactaattctggaa

SEQ ID NO: 265542 - DNA, 25 bp, Mus musculus
atggctcgggactctaattctggaa

SEQ ID NO: 265543 - DNA, 25 bp, Mus musculus
atggctcggtggctgcttaaaacgc

SEQ ID NO: 265544 - DNA, 25 bp, Mus musculus
atggctcggtgggtgcttaaaacgc

SEQ ID NO: 265545 - DNA, 25 bp, Mus musculus
atggctcggtgtctaatattatgac

SEQ ID NO: 265546 - DNA, 25 bp, Mus musculus
atggctcggtgtgtaatattatgac

SEQ ID NO: 265547 - DNA, 25 bp, Mus musculus
atggctctaagtcagttccagcaga

SEQ ID NO: 265548 - DNA, 25 bp, Mus musculus
atggctctaagtccatcggcctaag

SEQ ID NO: 265549 - DNA, 25 bp, Mus musculus
atggctctaagtgagttccagcaga

SEQ ID NO: 265550 - DNA, 25 bp, Mus musculus
atggctctaagtgcatcggcctaag

SEQ ID NO: 265551 - DNA, 25 bp, Mus musculus
atggctctaccccaggagggcctat

SEQ ID NO: 265552 - DNA, 25 bp, Mus musculus
atggctctacccgaggagggcctat

SEQ ID NO: 265553 - DNA, 25 bp, Mus musculus
atggctctacggatctttctatgta

SEQ ID NO: 265554 - DNA, 25 bp, Mus musculus
atggctctacggttctttctatgta

SEQ ID NO: 265555 - DNA, 25 bp, Mus musculus
atggctctagatatttctggctcta

SEQ ID NO: 265556 - DNA, 25 bp, Mus musculus
atggctctagatttttctggctcta

SEQ ID NO: 265557 - DNA, 25 bp, Mus musculus
atggctctatctctgcttcagatac

SEQ ID NO: 265558 - DNA, 25 bp, Mus musculus
atggctctatctgtgcttcagatac

SEQ ID NO: 265559 - DNA, 25 bp, Mus musculus
atggctctatggactcataccttag

SEQ ID NO: 265560 - DNA, 25 bp, Mus musculus
atggctctatggtctcataccttag

SEQ ID NO: 265561 - DNA, 25 bp, Mus musculus
atggctctctagctccatccttggg

SEQ ID NO: 265562 - DNA, 25 bp, Mus musculus
atggctctctaggtccatccttggg

SEQ ID NO: 265563 - DNA, 25 bp, Mus musculus
atggctctctcgaggttcagcatgg

SEQ ID NO: 265564 - DNA, 25 bp, Mus musculus
atggctctctcgtggttcagcatgg

SEQ ID NO: 265565 - DNA, 25 bp, Mus musculus
atggctctgactcttattataaggt

SEQ ID NO: 265566 - DNA, 25 bp, Mus musculus
atggctctgactgttattataaggt

SEQ ID NO: 265567 - DNA, 25 bp, Mus musculus
atggctctgataatggaaccggtga

SEQ ID NO: 265568 - DNA, 25 bp, Mus musculus
atggctctgatattggaaccggtga

SEQ ID NO: 265569 - DNA, 25 bp, Mus musculus
atggctctgcagctgtctttctctg

SEQ ID NO: 265570 - DNA, 25 bp, Mus musculus
atggctctgcaggtgtctttctctg

SEQ ID NO: 265571 - DNA, 25 bp, Mus musculus
atggctctggacagtacatatggca

SEQ ID NO: 265572 - DNA, 25 bp, Mus musculus
atggctctggactgtacatatggca

SEQ ID NO: 265573 - DNA, 25 bp, Mus musculus
atggctctggccatacttacggaag

SEQ ID NO: 265574 - DNA, 25 bp, Mus musculus
atggctctggccttacttacggaag

SEQ ID NO: 265575 - DNA, 25 bp, Mus musculus
atggctctgtagcactagtgctaac

SEQ ID NO: 265576 - DNA, 25 bp, Mus musculus
atggctctgtaggactagtgctaac

SEQ ID NO: 265577 - DNA, 25 bp, Mus musculus
atggctctgtcacccagtctgggca

SEQ ID NO: 265578 - DNA, 25 bp, Mus musculus
atggctctgtcagccagtctgggca

SEQ ID NO: 265579 - DNA, 25 bp, Mus musculus
atggctctgtccctcagacagctgg

SEQ ID NO: 265580 - DNA, 25 bp, Mus musculus
atggctctgtccgtcagacagctgg

SEQ ID NO: 265581 - DNA, 25 bp, Mus musculus
atggctctgtctaaaaactgtgtag

SEQ ID NO: 265582 - DNA, 25 bp, Mus musculus
atggctctgtcttaaaactgtgtag

SEQ ID NO: 265583 - DNA, 25 bp, Mus musculus
atggctctgtgcaccagttactaaa

SEQ ID NO: 265584 - DNA, 25 bp, Mus musculus
atggctctgtgcctggacataaaaa

SEQ ID NO: 265585 - DNA, 25 bp, Mus musculus
atggctctgtgcgtggacataaaaa

SEQ ID NO: 265586 - DNA, 25 bp, Mus musculus
atggctctgtgctccagttactaaa

SEQ ID NO: 265587 - DNA, 25 bp, Mus musculus
atggctctgttcacagtgacccaaa

SEQ ID NO: 265588 - DNA, 25 bp, Mus musculus
atggctctgttctcagtgacccaaa

SEQ ID NO: 265589 - DNA, 25 bp, Mus musculus
atggctctgtttaagatctgtgctt

SEQ ID NO: 265590 - DNA, 25 bp, Mus musculus
atggctctgttttagatctgtgctt

SEQ ID NO: 265591 - DNA, 25 bp, Mus musculus
atggctcttaagacccctcttctct

SEQ ID NO: 265592 - DNA, 25 bp, Mus musculus
atggctcttaagtcccctcttctct

SEQ ID NO: 265593 - DNA, 25 bp, Mus musculus
atggctcttactacagatctggctg

SEQ ID NO: 265594 - DNA, 25 bp, Mus musculus
atggctcttacttcagatctggctg

SEQ ID NO: 265595 - DNA, 25 bp, Mus musculus
atggctcttcttaactaacatccct

SEQ ID NO: 265596 - DNA, 25 bp, Mus musculus
atggctcttcttaagagctgacgga

SEQ ID NO: 265597 - DNA, 25 bp, Mus musculus
atggctcttctttactaacatccct

SEQ ID NO: 265598 - DNA, 25 bp, Mus musculus
atggctcttctttagagctgacgga

SEQ ID NO: 265599 - DNA, 25 bp, Mus musculus
atggctcttgctctggagtacctga

SEQ ID NO: 265600 - DNA, 25 bp, Mus musculus
atggctcttgctgtggagtacctga

SEQ ID NO: 265601 - DNA, 25 bp, Mus musculus
atggctgaaaacatggagggtctcg

SEQ ID NO: 265602 - DNA, 25 bp, Mus musculus
atggctgaaaacttggagggtctcg

SEQ ID NO: 265603 - DNA, 25 bp, Mus musculus
atggctgaaatacatgcccgcctga

SEQ ID NO: 265604 - DNA, 25 bp, Mus musculus
atggctgaaatagatgcccgcctga

SEQ ID NO: 265605 - DNA, 25 bp, Mus musculus
atggctgaactcagacaactgtctc

SEQ ID NO: 265606 - DNA, 25 bp, Mus musculus
atggctgaactctgacaactgtctc

SEQ ID NO: 265607 - DNA, 25 bp, Mus musculus
atggctgaagaaattccatcagctc

SEQ ID NO: 265608 - DNA, 25 bp, Mus musculus
atggctgaagaatttccatcagctc

SEQ ID NO: 265609 - DNA, 25 bp, Mus musculus
atggctgaagggactttttctctga

SEQ ID NO: 265610 - DNA, 25 bp, Mus musculus
atggctgaagggtctttttctctga

SEQ ID NO: 265611 - DNA, 25 bp, Mus musculus
atggctgaagtacaggcctggaaac

SEQ ID NO: 265612 - DNA, 25 bp, Mus musculus
atggctgaagtagaggcctggaaac

SEQ ID NO: 265613 - DNA, 25 bp, Mus musculus
atggctgacaatccaagccctgatt

SEQ ID NO: 265614 - DNA, 25 bp, Mus musculus
atggctgacaatgcaagccctgatt

SEQ ID NO: 265615 - DNA, 25 bp, Mus musculus
atggctgacactaacgctgtggtgc

SEQ ID NO: 265616 - DNA, 25 bp, Mus musculus
atggctgacacttacgctgtggtgc

SEQ ID NO: 265617 - DNA, 25 bp, Mus musculus
atggctgacagtctgtgcgtccttc

SEQ ID NO: 265618 - DNA, 25 bp, Mus musculus
atggctgacagtgtgtgcgtccttc

SEQ ID NO: 265619 - DNA, 25 bp, Mus musculus
atggctgaccctcaggtgcagcaga

SEQ ID NO: 265620 - DNA, 25 bp, Mus musculus
atggctgaccctgaggtgcagcaga

SEQ ID NO: 265621 - DNA, 25 bp, Mus musculus
atggctgacgagagcattttgtaca

SEQ ID NO: 265622 - DNA, 25 bp, Mus musculus
atggctgacgagtgcattttgtaca

SEQ ID NO: 265623 - DNA, 25 bp, Mus musculus
atggctgactataactatgatgtga

SEQ ID NO: 265624 - DNA, 25 bp, Mus musculus
atggctgactatcttcacaatctct

SEQ ID NO: 265625 - DNA, 25 bp, Mus musculus
atggctgactatgttcacaatctct

SEQ ID NO: 265626 - DNA, 25 bp, Mus musculus
atggctgactattactatgatgtga

SEQ ID NO: 265627 - DNA, 25 bp, Mus musculus
atggctgactcactttcttgaccat

SEQ ID NO: 265628 - DNA, 25 bp, Mus musculus
atggctgactcagtttcttgaccat

SEQ ID NO: 265629 - DNA, 25 bp, Mus musculus
atggctgagacccacagggacacca

SEQ ID NO: 265630 - DNA, 25 bp, Mus musculus
atggctgagaccgacagggacacca

SEQ ID NO: 265631 - DNA, 25 bp, Mus musculus
atggctgagctgatgaccggaagaa

SEQ ID NO: 265632 - DNA, 25 bp, Mus musculus
atggctgagctgttgaccggaagaa

SEQ ID NO: 265633 - DNA, 25 bp, Mus musculus
atggctgaggacattctgtatcccg

SEQ ID NO: 265634 - DNA, 25 bp, Mus musculus
atggctgaggactttctgtatcccg

SEQ ID NO: 265635 - DNA, 25 bp, Mus musculus
atggctgagggaagcctcttgccac

SEQ ID NO: 265636 - DNA, 25 bp, Mus musculus
atggctgagggatgcctcttgccac

SEQ ID NO: 265637 - DNA, 25 bp, Mus musculus
atggctgagggcatccatttgtccc

SEQ ID NO: 265638 - DNA, 25 bp, Mus musculus
atggctgagggcttccatttgtccc

SEQ ID NO: 265639 - DNA, 25 bp, Mus musculus
atggctgagttcactgtggcccgtg

SEQ ID NO: 265640 - DNA, 25 bp, Mus musculus
atggctgagttctctgtggcccgtg

SEQ ID NO: 265641 - DNA, 25 bp, Mus musculus
atggctgatccacagcgagcatcca

SEQ ID NO: 265642 - DNA, 25 bp, Mus musculus
atggctgatccagagcgagcatcca

SEQ ID NO: 265643 - DNA, 25 bp, Mus musculus
atggctgatcccagggactaacttt

SEQ ID NO: 265644 - DNA, 25 bp, Mus musculus
atggctgatccctgggactaacttt

SEQ ID NO: 265645 - DNA, 25 bp, Mus musculus
atggctgattggcttttccaggtaa

SEQ ID NO: 265646 - DNA, 25 bp, Mus musculus
atggctgattgggttttccaggtaa

SEQ ID NO: 265647 - DNA, 25 bp, Mus musculus
atggctgcaagtctcagggcaccac

SEQ ID NO: 265648 - DNA, 25 bp, Mus musculus
atggctgcaagtgtcagggcaccac

SEQ ID NO: 265649 - DNA, 25 bp, Mus musculus
atggctgcacatcaatcattttctt

SEQ ID NO: 265650 - DNA, 25 bp, Mus musculus
atggctgcacatgaatcattttctt

SEQ ID NO: 265651 - DNA, 25 bp, Mus musculus
atggctgcactgacaggatggctgc

SEQ ID NO: 265652 - DNA, 25 bp, Mus musculus
atggctgcactgtcaggatggctgc

SEQ ID NO: 265653 - DNA, 25 bp, Mus musculus
atggctgcagaacccctaagtcgag

SEQ ID NO: 265654 - DNA, 25 bp, Mus musculus
atggctgcagaagccctaagtcgag

SEQ ID NO: 265655 - DNA, 25 bp, Mus musculus
atggctgcatagctcattgtgcttt

SEQ ID NO: 265656 - DNA, 25 bp, Mus musculus
atggctgcataggtcattgtgcttt

SEQ ID NO: 265657 - DNA, 25 bp, Mus musculus
atggctgcatctactggtcagcttc

SEQ ID NO: 265658 - DNA, 25 bp, Mus musculus
atggctgcatcttctggtcagcttc

SEQ ID NO: 265659 - DNA, 25 bp, Mus musculus
atggctgcatggaagtctttcttat

SEQ ID NO: 265660 - DNA, 25 bp, Mus musculus
atggctgcatggtagtctttcttat

SEQ ID NO: 265661 - DNA, 25 bp, Mus musculus
atggctgcattgatcacggcaagac

SEQ ID NO: 265662 - DNA, 25 bp, Mus musculus
atggctgcattgttcacggcaagac

SEQ ID NO: 265663 - DNA, 25 bp, Mus musculus
atggctgcatttcccaagaagcaga

SEQ ID NO: 265664 - DNA, 25 bp, Mus musculus
atggctgcatttgccaagaagcaga

SEQ ID NO: 265665 - DNA, 25 bp, Mus musculus
atggctgccagcctgatgcatttcc

SEQ ID NO: 265666 - DNA, 25 bp, Mus musculus
atggctgccagcgtgatgcatttcc

SEQ ID NO: 265667 - DNA, 25 bp, Mus musculus
atggctgccatcaaatattgtctaa

SEQ ID NO: 265668 - DNA, 25 bp, Mus musculus
atggctgccatctaatattgtctaa

SEQ ID NO: 265669 - DNA, 25 bp, Mus musculus
atggctgccatgcttacctgagcaa

SEQ ID NO: 265670 - DNA, 25 bp, Mus musculus
atggctgccatggttacctgagcaa

SEQ ID NO: 265671 - DNA, 25 bp, Mus musculus
atggctgccattctgtattggagtt

SEQ ID NO: 265672 - DNA, 25 bp, Mus musculus
atggctgccattgtgtattggagtt

SEQ ID NO: 265673 - DNA, 25 bp, Mus musculus
atggctgccccaaaactgaagttgt

SEQ ID NO: 265674 - DNA, 25 bp, Mus musculus
atggctgccccataactgaagttgt

SEQ ID NO: 265675 - DNA, 25 bp, Mus musculus
atggctgcccttagacgagttctgg

SEQ ID NO: 265676 - DNA, 25 bp, Mus musculus
atggctgccctttgacgagttctgg

SEQ ID NO: 265677 - DNA, 25 bp, Mus musculus
atggctgccgccaatgtgtcaatca

SEQ ID NO: 265678 - DNA, 25 bp, Mus musculus
atggctgccgcctatgtgtcaatca

SEQ ID NO: 265679 - DNA, 25 bp, Mus musculus
atggctgccgtgatgctggtcattt

SEQ ID NO: 265680 - DNA, 25 bp, Mus musculus
atggctgccgtgatggtggtcctat

SEQ ID NO: 265681 - DNA, 25 bp, Mus musculus
atggctgccgtgttgctggtcattt

SEQ ID NO: 265682 - DNA, 25 bp, Mus musculus
atggctgccgtgttggtggtcctat

SEQ ID NO: 265683 - DNA, 25 bp, Mus musculus
atggctgcctgacgaaaggagatct

SEQ ID NO: 265684 - DNA, 25 bp, Mus musculus
atggctgcctgaggaaaggagatct

SEQ ID NO: 265685 - DNA, 25 bp, Mus musculus
atggctgccttcagtgacttcggag

SEQ ID NO: 265686 - DNA, 25 bp, Mus musculus
atggctgccttctgtgacttcggag

SEQ ID NO: 265687 - DNA, 25 bp, Mus musculus
atggctgcctttaattcaagtttga

SEQ ID NO: 265688 - DNA, 25 bp, Mus musculus
atggctgcctttcgcaatagctgcc

SEQ ID NO: 265689 - DNA, 25 bp, Mus musculus
atggctgcctttggcaatagctgcc

SEQ ID NO: 265690 - DNA, 25 bp, Mus musculus
atggctgccttttattcaagtttga

SEQ ID NO: 265691 - DNA, 25 bp, Mus musculus
atggctgcggaaccatgtacagctc

SEQ ID NO: 265692 - DNA, 25 bp, Mus musculus
atggctgcggaagcatgtacagctc

SEQ ID NO: 265693 - DNA, 25 bp, Mus musculus
atggctgcggatatccaccagatgt

SEQ ID NO: 265694 - DNA, 25 bp, Mus musculus
atggctgcggatttccaccagatgt

SEQ ID NO: 265695 - DNA, 25 bp, Mus musculus
atggctgctaacaccatgtacagtt

SEQ ID NO: 265696 - DNA, 25 bp, Mus musculus
atggctgctaacacctgatgtaggt

SEQ ID NO: 265697 - DNA, 25 bp, Mus musculus
atggctgctaactccatgtacagtt

SEQ ID NO: 265698 - DNA, 25 bp, Mus musculus
atggctgctaactcctgatgtaggt

SEQ ID NO: 265699 - DNA, 25 bp, Mus musculus
atggctgctagaaggaggatcttgc

SEQ ID NO: 265700 - DNA, 25 bp, Mus musculus
atggctgctagatggaggatcttgc

SEQ ID NO: 265701 - DNA, 25 bp, Mus musculus
atggctgctatgactgcccaggaat

SEQ ID NO: 265702 - DNA, 25 bp, Mus musculus
atggctgctatgtctgcccaggaat

SEQ ID NO: 265703 - DNA, 25 bp, Mus musculus
atggctgctccaacaagggaaacag

SEQ ID NO: 265704 - DNA, 25 bp, Mus musculus
atggctgctccaatgggacatggtc

SEQ ID NO: 265705 - DNA, 25 bp, Mus musculus
atggctgctccatcaagggaaacag

SEQ ID NO: 265706 - DNA, 25 bp, Mus musculus
atggctgctccattgggacatggtc

SEQ ID NO: 265707 - DNA, 25 bp, Mus musculus
atggctgctctcctgagaagtttca

SEQ ID NO: 265708 - DNA, 25 bp, Mus musculus
atggctgctctcgtgagaagtttca

SEQ ID NO: 265709 - DNA, 25 bp, Mus musculus
atggctgctgccacgtagctatgga

SEQ ID NO: 265710 - DNA, 25 bp, Mus musculus
atggctgctgcctcgtagctatgga

SEQ ID NO: 265711 - DNA, 25 bp, Mus musculus
atggctgctgctagtgttgataata

SEQ ID NO: 265712 - DNA, 25 bp, Mus musculus
atggctgctgctctaaaagatgcag

SEQ ID NO: 265713 - DNA, 25 bp, Mus musculus
atggctgctgctgtaaaagatgcag

SEQ ID NO: 265714 - DNA, 25 bp, Mus musculus
atggctgctgcttgtgttgataata

SEQ ID NO: 265715 - DNA, 25 bp, Mus musculus
atggctgctgtgaaactggctcctg

SEQ ID NO: 265716 - DNA, 25 bp, Mus musculus
atggctgctgtgaagcgcttctctc

SEQ ID NO: 265717 - DNA, 25 bp, Mus musculus
atggctgctgtgtaactggctcctg

SEQ ID NO: 265718 - DNA, 25 bp, Mus musculus
atggctgctgtgtagcgcttctctc

SEQ ID NO: 265719 - DNA, 25 bp, Mus musculus
atggctgcttcgaggacatctccag

SEQ ID NO: 265720 - DNA, 25 bp, Mus musculus
atggctgcttcgtggacatctccag

SEQ ID NO: 265721 - DNA, 25 bp, Mus musculus
atggctggaagcaaaaccctgtggt

SEQ ID NO: 265722 - DNA, 25 bp, Mus musculus
atggctggaagccaccattgcctct

SEQ ID NO: 265723 - DNA, 25 bp, Mus musculus
atggctggaagcgaccattgcctct

SEQ ID NO: 265724 - DNA, 25 bp, Mus musculus
atggctggaagctaaaccctgtggt

SEQ ID NO: 265725 - DNA, 25 bp, Mus musculus
atggctggagttagttgatccatac

SEQ ID NO: 265726 - DNA, 25 bp, Mus musculus
atggctggagtttgttgatccatac

SEQ ID NO: 265727 - DNA, 25 bp, Mus musculus
atggctggatcgacactgctatcaa

SEQ ID NO: 265728 - DNA, 25 bp, Mus musculus
atggctggatcgtcactgctatcaa

SEQ ID NO: 265729 - DNA, 25 bp, Mus musculus
atggctggcagacgcaccagtgcat

SEQ ID NO: 265730 - DNA, 25 bp, Mus musculus
atggctggcagaggcaccagtgcat

SEQ ID NO: 265731 - DNA, 25 bp, Mus musculus
atggctggcatgatcaactgcataa

SEQ ID NO: 265732 - DNA, 25 bp, Mus musculus
atggctggcatgttcaactgcataa

SEQ ID NO: 265733 - DNA, 25 bp, Mus musculus
atggctggccacagattgtactcag

SEQ ID NO: 265734 - DNA, 25 bp, Mus musculus
atggctggccacagggctctctctt

SEQ ID NO: 265735 - DNA, 25 bp, Mus musculus
atggctggccactgattgtactcag

SEQ ID NO: 265736 - DNA, 25 bp, Mus musculus
atggctggccactgggctctctctt

SEQ ID NO: 265737 - DNA, 25 bp, Mus musculus
atggctggccgcaatggacagagaa

SEQ ID NO: 265738 - DNA, 25 bp, Mus musculus
atggctggccgctatggacagagaa

SEQ ID NO: 265739 - DNA, 25 bp, Mus musculus
atggctggcctgagagtgtctagca

SEQ ID NO: 265740 - DNA, 25 bp, Mus musculus
atggctggcctgtgagtgtctagca

SEQ ID NO: 265741 - DNA, 25 bp, Mus musculus
atggctggcgcgagctggccaaacc

SEQ ID NO: 265742 - DNA, 25 bp, Mus musculus
atggctggcgcgtgctggccaaacc

SEQ ID NO: 265743 - DNA, 25 bp, Mus musculus
atggctggcggtatgttggcccatc

SEQ ID NO: 265744 - DNA, 25 bp, Mus musculus
atggctggcggtttgttggcccatc

SEQ ID NO: 265745 - DNA, 25 bp, Mus musculus
atggctggctaccagagacagtgct

SEQ ID NO: 265746 - DNA, 25 bp, Mus musculus
atggctggctacgagagacagtgct

SEQ ID NO: 265747 - DNA, 25 bp, Mus musculus
atggctggctgcaagcatgtcacat

SEQ ID NO: 265748 - DNA, 25 bp, Mus musculus
atggctggctgctagcatgtcacat

SEQ ID NO: 265749 - DNA, 25 bp, Mus musculus
atggctggctggatagacattagca

SEQ ID NO: 265750 - DNA, 25 bp, Mus musculus
atggctggctggttagacattagca

SEQ ID NO: 265751 - DNA, 25 bp, Mus musculus
atggctgggaatacaggctctagta

SEQ ID NO: 265752 - DNA, 25 bp, Mus musculus
atggctgggaattcaggctctagta

SEQ ID NO: 265753 - DNA, 25 bp, Mus musculus
atggctgggaccctgctggtacaat

SEQ ID NO: 265754 - DNA, 25 bp, Mus musculus
atggctgggaccgtgctggtacaat

SEQ ID NO: 265755 - DNA, 25 bp, Mus musculus
atggctgggagcagcacttatctgt

SEQ ID NO: 265756 - DNA, 25 bp, Mus musculus
atggctgggagctgcacttatctgt

SEQ ID NO: 265757 - DNA, 25 bp, Mus musculus
atggctgggcatatatgttcctcct

SEQ ID NO: 265758 - DNA, 25 bp, Mus musculus
atggctgggcatttatgttcctcct

SEQ ID NO: 265759 - DNA, 25 bp, Mus musculus
atggctgggcctctcaaagctagag

SEQ ID NO: 265760 - DNA, 25 bp, Mus musculus
atggctgggcctgtcaaagctagag

SEQ ID NO: 265761 - DNA, 25 bp, Mus musculus
atggctgggtagagaccgctgtcaa

SEQ ID NO: 265762 - DNA, 25 bp, Mus musculus
atggctgggtagtgaccgctgtcaa

SEQ ID NO: 265763 - DNA, 25 bp, Mus musculus
atggctgggtccagctatctgggaa

SEQ ID NO: 265764 - DNA, 25 bp, Mus musculus
atggctgggtcctgctatctgggaa

SEQ ID NO: 265765 - DNA, 25 bp, Mus musculus
atggctggtcaacaggactccaacg

SEQ ID NO: 265766 - DNA, 25 bp, Mus musculus
atggctggtcaagaggactccaacg

SEQ ID NO: 265767 - DNA, 25 bp, Mus musculus
atggctggtgaaacctgtaagtttc

SEQ ID NO: 265768 - DNA, 25 bp, Mus musculus
atggctggtgaatcctgtaagtttc

SEQ ID NO: 265769 - DNA, 25 bp, Mus musculus
atggctggtgcccatgatcaggcaa

SEQ ID NO: 265770 - DNA, 25 bp, Mus musculus
atggctggtgccgatgatcaggcaa

SEQ ID NO: 265771 - DNA, 25 bp, Mus musculus
atggctggtggtagtaaaggatctt

SEQ ID NO: 265772 - DNA, 25 bp, Mus musculus
atggctggtggttgtaaaggatctt

SEQ ID NO: 265773 - DNA, 25 bp, Mus musculus
atggctggttcaagcggcaggacac

SEQ ID NO: 265774 - DNA, 25 bp, Mus musculus
atggctggttcatgcggcaggacac

SEQ ID NO: 265775 - DNA, 25 bp, Mus musculus
atggctggttggaaaaccatggtta

SEQ ID NO: 265776 - DNA, 25 bp, Mus musculus
atggctggttggtaaaccatggtta

SEQ ID NO: 265777 - DNA, 25 bp, Mus musculus
atggctgtactacaacccaatgact

SEQ ID NO: 265778 - DNA, 25 bp, Mus musculus
atggctgtactagaacccaatgact

SEQ ID NO: 265779 - DNA, 25 bp, Mus musculus
atggctgtagctatctagcccagga

SEQ ID NO: 265780 - DNA, 25 bp, Mus musculus
atggctgtagctttctagcccagga

SEQ ID NO: 265781 - DNA, 25 bp, Mus musculus
atggctgtatccaggatcactgtgg

SEQ ID NO: 265782 - DNA, 25 bp, Mus musculus
atggctgtatcctggatcactgtgg

SEQ ID NO: 265783 - DNA, 25 bp, Mus musculus
atggctgtatgcaagctactactta

SEQ ID NO: 265784 - DNA, 25 bp, Mus musculus
atggctgtatgctagctactactta

SEQ ID NO: 265785 - DNA, 25 bp, Mus musculus
atggctgtcacacggcagagagact

SEQ ID NO: 265786 - DNA, 25 bp, Mus musculus
atggctgtcacagggcagagagact

SEQ ID NO: 265787 - DNA, 25 bp, Mus musculus
atggctgtcagcatctgttaacgat

SEQ ID NO: 265788 - DNA, 25 bp, Mus musculus
atggctgtcagcttctgttaacgat

SEQ ID NO: 265789 - DNA, 25 bp, Mus musculus
atggctgtcaggcaatcttttcttc

SEQ ID NO: 265790 - DNA, 25 bp, Mus musculus
atggctgtcagggaatcttttcttc

SEQ ID NO: 265791 - DNA, 25 bp, Mus musculus
atggctgtcatcagagaacacctcg

SEQ ID NO: 265792 - DNA, 25 bp, Mus musculus
atggctgtcatctgagaacacctcg

SEQ ID NO: 265793 - DNA, 25 bp, Mus musculus
atggctgtcatgagtactgtctgtt

SEQ ID NO: 265794 - DNA, 25 bp, Mus musculus
atggctgtcatgtgtactgtctgtt

SEQ ID NO: 265795 - DNA, 25 bp, Mus musculus
atggctgtccagaagttgggccttc

SEQ ID NO: 265796 - DNA, 25 bp, Mus musculus
atggctgtccagcattttgtggcag

SEQ ID NO: 265797 - DNA, 25 bp, Mus musculus
atggctgtccaggattttgtggcag

SEQ ID NO: 265798 - DNA, 25 bp, Mus musculus
atggctgtccagtagttgggccttc

SEQ ID NO: 265799 - DNA, 25 bp, Mus musculus
atggctgtctctctctagtaatgtc

SEQ ID NO: 265800 - DNA, 25 bp, Mus musculus
atggctgtctctgtctagtaatgtc

SEQ ID NO: 265801 - DNA, 25 bp, Mus musculus
atggctgtctgtcctgagtaatgtg

SEQ ID NO: 265802 - DNA, 25 bp, Mus musculus
atggctgtctgtgctgagtaatgtg

SEQ ID NO: 265803 - DNA, 25 bp, Mus musculus
atggctgtgagcactacgctggcct

SEQ ID NO: 265804 - DNA, 25 bp, Mus musculus
atggctgtgagcactgacagctgca

SEQ ID NO: 265805 - DNA, 25 bp, Mus musculus
atggctgtgagcagttttacatcca

SEQ ID NO: 265806 - DNA, 25 bp, Mus musculus
atggctgtgagctctacgctggcct

SEQ ID NO: 265807 - DNA, 25 bp, Mus musculus
atggctgtgagctctgacagctgca

SEQ ID NO: 265808 - DNA, 25 bp, Mus musculus
atggctgtgagctgttttacatcca

SEQ ID NO: 265809 - DNA, 25 bp, Mus musculus
atggctgtgatcaggtctttgtctg

SEQ ID NO: 265810 - DNA, 25 bp, Mus musculus
atggctgtgatcatatcatgcctga

SEQ ID NO: 265811 - DNA, 25 bp, Mus musculus
atggctgtgatctggtctttgtctg

SEQ ID NO: 265812 - DNA, 25 bp, Mus musculus
atggctgtgatcttatcatgcctga

SEQ ID NO: 265813 - DNA, 25 bp, Mus musculus
atggctgtgatgacgtcaggaactc

SEQ ID NO: 265814 - DNA, 25 bp, Mus musculus
atggctgtgatgtcgtcaggaactc

SEQ ID NO: 265815 - DNA, 25 bp, Mus musculus
atggctgtgattacaggttcccgcc

SEQ ID NO: 265816 - DNA, 25 bp, Mus musculus
atggctgtgatttcaggttcccgcc

SEQ ID NO: 265817 - DNA, 25 bp, Mus musculus
atggctgtgccaagacaaagagaca

SEQ ID NO: 265818 - DNA, 25 bp, Mus musculus
atggctgtgccatgacaaagagaca

SEQ ID NO: 265819 - DNA, 25 bp, Mus musculus
atggctgtgccccacatgattttgt

SEQ ID NO: 265820 - DNA, 25 bp, Mus musculus
atggctgtgcccgacatgattttgt

SEQ ID NO: 265821 - DNA, 25 bp, Mus musculus
atggctgtgctgatagccctttgaa

SEQ ID NO: 265822 - DNA, 25 bp, Mus musculus
atggctgtgctgttagccctttgaa

SEQ ID NO: 265823 - DNA, 25 bp, Mus musculus
atggctgtggacacttcaggcgaca

SEQ ID NO: 265824 - DNA, 25 bp, Mus musculus
atggctgtggactcttcaggcgaca

SEQ ID NO: 265825 - DNA, 25 bp, Mus musculus
atggctgtgtagaaatacttgtaat

SEQ ID NO: 265826 - DNA, 25 bp, Mus musculus
atggctgtgtagtaatacttgtaat

SEQ ID NO: 265827 - DNA, 25 bp, Mus musculus
atggctgtgtgcaatcctggctctc

SEQ ID NO: 265828 - DNA, 25 bp, Mus musculus
atggctgtgtgcacgcccagaccta

SEQ ID NO: 265829 - DNA, 25 bp, Mus musculus
atggctgtgtgctatcctggctctc

SEQ ID NO: 265830 - DNA, 25 bp, Mus musculus
atggctgtgtgctcgcccagaccta

SEQ ID NO: 265831 - DNA, 25 bp, Mus musculus
atggctgttaccaactgagtcatag

SEQ ID NO: 265832 - DNA, 25 bp, Mus musculus
atggctgttacctactgagtcatag

SEQ ID NO: 265833 - DNA, 25 bp, Mus musculus
atggctgttactatcaatggactga

SEQ ID NO: 265834 - DNA, 25 bp, Mus musculus
atggctgttactttcaatggactga

SEQ ID NO: 265835 - DNA, 25 bp, Mus musculus
atggctgttcatactgtacccagta

SEQ ID NO: 265836 - DNA, 25 bp, Mus musculus
atggctgttcattctgtacccagta

SEQ ID NO: 265837 - DNA, 25 bp, Mus musculus
atggctgttgatcgtaccctggctg

SEQ ID NO: 265838 - DNA, 25 bp, Mus musculus
atggctgttgatggtaccctggctg

SEQ ID NO: 265839 - DNA, 25 bp, Mus musculus
atggctgttgcactcaagcaaatta

SEQ ID NO: 265840 - DNA, 25 bp, Mus musculus
atggctgttgcagtcaagcaaatta

SEQ ID NO: 265841 - DNA, 25 bp, Mus musculus
atggctgttggcagtaacattccac

SEQ ID NO: 265842 - DNA, 25 bp, Mus musculus
atggctgttggctgtaacattccac

SEQ ID NO: 265843 - DNA, 25 bp, Mus musculus
atggctgtttggaggaaccaccgct

SEQ ID NO: 265844 - DNA, 25 bp, Mus musculus
atggctgtttggtggaaccaccgct

SEQ ID NO: 265845 - DNA, 25 bp, Mus musculus
atggctgtttttagagagctgatgt

SEQ ID NO: 265846 - DNA, 25 bp, Mus musculus
atggctgttttttgagagctgatgt

SEQ ID NO: 265847 - DNA, 25 bp, Mus musculus
atggcttaaatgaagcatccttaca

SEQ ID NO: 265848 - DNA, 25 bp, Mus musculus
atggcttaaatgtagcatccttaca

SEQ ID NO: 265849 - DNA, 25 bp, Mus musculus
atggcttaagaacacatgatgtctc

SEQ ID NO: 265850 - DNA, 25 bp, Mus musculus
atggcttaagaagacatgatgtctc

SEQ ID NO: 265851 - DNA, 25 bp, Mus musculus
atggcttaagatctttttattaaat

SEQ ID NO: 265852 - DNA, 25 bp, Mus musculus
atggcttaagatgtttttattaaat

SEQ ID NO: 265853 - DNA, 25 bp, Mus musculus
atggcttaagcacagccttttccca

SEQ ID NO: 265854 - DNA, 25 bp, Mus musculus
atggcttaagcagagccttttccca

SEQ ID NO: 265855 - DNA, 25 bp, Mus musculus
atggcttaatgtagcagttctgtgt

SEQ ID NO: 265856 - DNA, 25 bp, Mus musculus
atggcttaatgttgcagttctgtgt

SEQ ID NO: 265857 - DNA, 25 bp, Mus musculus
atggcttacattctcgagagcaaag

SEQ ID NO: 265858 - DNA, 25 bp, Mus musculus
atggcttacattgtcgagagcaaag

SEQ ID NO: 265859 - DNA, 25 bp, Mus musculus
atggcttaccgaccagggcctaaga

SEQ ID NO: 265860 - DNA, 25 bp, Mus musculus
atggcttaccgagcagggcctaaga

SEQ ID NO: 265861 - DNA, 25 bp, Mus musculus
atggcttagaaacggtcagcccaca

SEQ ID NO: 265862 - DNA, 25 bp, Mus musculus
atggcttagaaagggtcagcccaca

SEQ ID NO: 265863 - DNA, 25 bp, Mus musculus
atggcttagtgtataagaccctgag

SEQ ID NO: 265864 - DNA, 25 bp, Mus musculus
atggcttagtgtttaagaccctgag

SEQ ID NO: 265865 - DNA, 25 bp, Mus musculus
atggcttatctgagcacttttgtgt

SEQ ID NO: 265866 - DNA, 25 bp, Mus musculus
atggcttatctgtgcacttttgtgt

SEQ ID NO: 265867 - DNA, 25 bp, Mus musculus
atggcttatcttctgtactgtggta

SEQ ID NO: 265868 - DNA, 25 bp, Mus musculus
atggcttatcttgtgtactgtggta

SEQ ID NO: 265869 - DNA, 25 bp, Mus musculus
atggcttatgctcgagcccgctttg

SEQ ID NO: 265870 - DNA, 25 bp, Mus musculus
atggcttatgctggagcccgctttg

SEQ ID NO: 265871 - DNA, 25 bp, Mus musculus
atggcttcacagatatattgctagt

SEQ ID NO: 265872 - DNA, 25 bp, Mus musculus
atggcttcacagttatattgctagt

SEQ ID NO: 265873 - DNA, 25 bp, Mus musculus
atggcttcaccacggctactctggg

SEQ ID NO: 265874 - DNA, 25 bp, Mus musculus
atggcttcaccagggctactctggg

SEQ ID NO: 265875 - DNA, 25 bp, Mus musculus
atggcttcacggataaggttcttcg

SEQ ID NO: 265876 - DNA, 25 bp, Mus musculus
atggcttcacggttaaggttcttcg

SEQ ID NO: 265877 - DNA, 25 bp, Mus musculus
atggcttcactaacgtgcgtgactt

SEQ ID NO: 265878 - DNA, 25 bp, Mus musculus
atggcttcactatcgtgcgtgactt

SEQ ID NO: 265879 - DNA, 25 bp, Mus musculus
atggcttcacttacagcacacgaga

SEQ ID NO: 265880 - DNA, 25 bp, Mus musculus
atggcttcactttcagcacacgaga

SEQ ID NO: 265881 - DNA, 25 bp, Mus musculus
atggcttcagggacatgtatttctt

SEQ ID NO: 265882 - DNA, 25 bp, Mus musculus
atggcttcagggtcatgtatttctt

SEQ ID NO: 265883 - DNA, 25 bp, Mus musculus
atggcttcagttagcatcagttacc

SEQ ID NO: 265884 - DNA, 25 bp, Mus musculus
atggcttcagtttgcatcagttacc

SEQ ID NO: 265885 - DNA, 25 bp, Mus musculus
atggcttcatgtcgaaattcatcta

SEQ ID NO: 265886 - DNA, 25 bp, Mus musculus
atggcttcatgtggaaattcatcta

SEQ ID NO: 265887 - DNA, 25 bp, Mus musculus
atggcttcattaccctcttcaaggg

SEQ ID NO: 265888 - DNA, 25 bp, Mus musculus
atggcttcattagcctcttcaaggg

SEQ ID NO: 265889 - DNA, 25 bp, Mus musculus
atggcttcattgaaaaaccacacgg

SEQ ID NO: 265890 - DNA, 25 bp, Mus musculus
atggcttcattgtaaaaccacacgg

SEQ ID NO: 265891 - DNA, 25 bp, Mus musculus
atggcttcatttcctggacagagcc

SEQ ID NO: 265892 - DNA, 25 bp, Mus musculus
atggcttcatttgctggacagagcc

SEQ ID NO: 265893 - DNA, 25 bp, Mus musculus
atggcttccactagtaaatatgcta

SEQ ID NO: 265894 - DNA, 25 bp, Mus musculus
atggcttccacttgtaaatatgcta

SEQ ID NO: 265895 - DNA, 25 bp, Mus musculus
atggcttccagacatctgtgcttga

SEQ ID NO: 265896 - DNA, 25 bp, Mus musculus
atggcttccagagatctgtgcttga

SEQ ID NO: 265897 - DNA, 25 bp, Mus musculus
atggcttcccatctgggtgagccca

SEQ ID NO: 265898 - DNA, 25 bp, Mus musculus
atggcttcccatgtgggtgagccca

SEQ ID NO: 265899 - DNA, 25 bp, Mus musculus
atggcttcccggcatttgcatactt

SEQ ID NO: 265900 - DNA, 25 bp, Mus musculus
atggcttcccgggatttgcatactt

SEQ ID NO: 265901 - DNA, 25 bp, Mus musculus
atggcttcccgtattgattgcagtg

SEQ ID NO: 265902 - DNA, 25 bp, Mus musculus
atggcttcccgttttgattgcagtg

SEQ ID NO: 265903 - DNA, 25 bp, Mus musculus
atggcttcccttatcatagctggat

SEQ ID NO: 265904 - DNA, 25 bp, Mus musculus
atggcttcccttttcatagctggat

SEQ ID NO: 265905 - DNA, 25 bp, Mus musculus
atggcttcctacatcggcacaagat

SEQ ID NO: 265906 - DNA, 25 bp, Mus musculus
atggcttcctacctctgttagaata

SEQ ID NO: 265907 - DNA, 25 bp, Mus musculus
atggcttcctacgtctgttagaata

SEQ ID NO: 265908 - DNA, 25 bp, Mus musculus
atggcttcctacttcggcacaagat

SEQ ID NO: 265909 - DNA, 25 bp, Mus musculus
atggcttcctggacacttttaagag

SEQ ID NO: 265910 - DNA, 25 bp, Mus musculus
atggcttcctggtcacttttaagag

SEQ ID NO: 265911 - DNA, 25 bp, Mus musculus
atggcttccttcatcactcaaaggc

SEQ ID NO: 265912 - DNA, 25 bp, Mus musculus
atggcttccttcttcactcaaaggc

SEQ ID NO: 265913 - DNA, 25 bp, Mus musculus
atggcttcgccgctaagagcaccgg

SEQ ID NO: 265914 - DNA, 25 bp, Mus musculus
atggcttcgccggtaagagcaccgg

SEQ ID NO: 265915 - DNA, 25 bp, Mus musculus
atggcttcgcctccgattgaagatg

SEQ ID NO: 265916 - DNA, 25 bp, Mus musculus
atggcttcgcctgcgattgaagatg

SEQ ID NO: 265917 - DNA, 25 bp, Mus musculus
atggcttctagtacaatctgttcag

SEQ ID NO: 265918 - DNA, 25 bp, Mus musculus
atggcttctagtacacatggaacaa

SEQ ID NO: 265919 - DNA, 25 bp, Mus musculus
atggcttctagtagtgtggttttac

SEQ ID NO: 265920 - DNA, 25 bp, Mus musculus
atggcttctagttcaatctgttcag

SEQ ID NO: 265921 - DNA, 25 bp, Mus musculus
atggcttctagttcacatggaacaa

SEQ ID NO: 265922 - DNA, 25 bp, Mus musculus
atggcttctagttgtgtggttttac

SEQ ID NO: 265923 - DNA, 25 bp, Mus musculus
atggcttctcaccttaggcatgcag

SEQ ID NO: 265924 - DNA, 25 bp, Mus musculus
atggcttctcacgttaggcatgcag

SEQ ID NO: 265925 - DNA, 25 bp, Mus musculus
atggcttctcatcttacttaccaag

SEQ ID NO: 265926 - DNA, 25 bp, Mus musculus
atggcttctcatgttacttaccaag

SEQ ID NO: 265927 - DNA, 25 bp, Mus musculus
atggcttctcctactggatcagacc

SEQ ID NO: 265928 - DNA, 25 bp, Mus musculus
atggcttctccttctggatcagacc

SEQ ID NO: 265929 - DNA, 25 bp, Mus musculus
atggcttctgacaagcgtgttgcct

SEQ ID NO: 265930 - DNA, 25 bp, Mus musculus
atggcttctgactagcgtgttgcct

SEQ ID NO: 265931 - DNA, 25 bp, Mus musculus
atggcttctggacctacgagaacag

SEQ ID NO: 265932 - DNA, 25 bp, Mus musculus
atggcttctggagctacgagaacag

SEQ ID NO: 265933 - DNA, 25 bp, Mus musculus
atggcttctgtcacggacctggaga

SEQ ID NO: 265934 - DNA, 25 bp, Mus musculus
atggcttctgtctcggacctggaga

SEQ ID NO: 265935 - DNA, 25 bp, Mus musculus
atggcttcttagcatcttctagtcc

SEQ ID NO: 265936 - DNA, 25 bp, Mus musculus
atggcttcttaggatcttctagtcc

SEQ ID NO: 265937 - DNA, 25 bp, Mus musculus
atggcttcttctatcctgggtaacc

SEQ ID NO: 265938 - DNA, 25 bp, Mus musculus
atggcttcttctatcttctgtggaa

SEQ ID NO: 265939 - DNA, 25 bp, Mus musculus
atggcttcttctttcctgggtaacc

SEQ ID NO: 265940 - DNA, 25 bp, Mus musculus
atggcttcttctttcttctgtggaa

SEQ ID NO: 265941 - DNA, 25 bp, Mus musculus
atggcttctttaacccattgcttgg

SEQ ID NO: 265942 - DNA, 25 bp, Mus musculus
atggcttctttaaggctgacgtctc

SEQ ID NO: 265943 - DNA, 25 bp, Mus musculus
atggcttctttatcccattgcttgg

SEQ ID NO: 265944 - DNA, 25 bp, Mus musculus
atggcttctttatggctgacgtctc

SEQ ID NO: 265945 - DNA, 25 bp, Mus musculus
atggcttgaaacactggccgtcacc

SEQ ID NO: 265946 - DNA, 25 bp, Mus musculus
atggcttgaaactctggccgtcacc

SEQ ID NO: 265947 - DNA, 25 bp, Mus musculus
atggcttgagacactagaatgatac

SEQ ID NO: 265948 - DNA, 25 bp, Mus musculus
atggcttgagactctagaatgatac

SEQ ID NO: 265949 - DNA, 25 bp, Mus musculus
atggcttgagatcacttgcttgcaa

SEQ ID NO: 265950 - DNA, 25 bp, Mus musculus
atggcttgagatgacttgcttgcaa

SEQ ID NO: 265951 - DNA, 25 bp, Mus musculus
atggcttgaggtattccaagaagcg

SEQ ID NO: 265952 - DNA, 25 bp, Mus musculus
atggcttgaggttttccaagaagcg

SEQ ID NO: 265953 - DNA, 25 bp, Mus musculus
atggcttgcaaaatactaaactggg

SEQ ID NO: 265954 - DNA, 25 bp, Mus musculus
atggcttgcaaattactaaactggg

SEQ ID NO: 265955 - DNA, 25 bp, Mus musculus
atggcttgcagcctggcaggcataa

SEQ ID NO: 265956 - DNA, 25 bp, Mus musculus
atggcttgcagcgtggcaggcataa

SEQ ID NO: 265957 - DNA, 25 bp, Mus musculus
atggcttgcctcaatggtcctgaga

SEQ ID NO: 265958 - DNA, 25 bp, Mus musculus
atggcttgcctctatggtcctgaga

SEQ ID NO: 265959 - DNA, 25 bp, Mus musculus
atggcttgctgcctattgtaccaca

SEQ ID NO: 265960 - DNA, 25 bp, Mus musculus
atggcttgctgcgtattgtaccaca

SEQ ID NO: 265961 - DNA, 25 bp, Mus musculus
atggcttgctggacagaattatgca

SEQ ID NO: 265962 - DNA, 25 bp, Mus musculus
atggcttgctggtcagaattatgca

SEQ ID NO: 265963 - DNA, 25 bp, Mus musculus
atggcttggagtctaggccgtactc

SEQ ID NO: 265964 - DNA, 25 bp, Mus musculus
atggcttggagtgtaggccgtactc

SEQ ID NO: 265965 - DNA, 25 bp, Mus musculus
atggcttgggagagcattctcatgg

SEQ ID NO: 265966 - DNA, 25 bp, Mus musculus
atggcttgggagtgcattctcatgg

SEQ ID NO: 265967 - DNA, 25 bp, Mus musculus
atggcttgggtcagaatcccagtac

SEQ ID NO: 265968 - DNA, 25 bp, Mus musculus
atggcttgggtctgaatcccagtac

SEQ ID NO: 265969 - DNA, 25 bp, Mus musculus
atggcttggttcacccagattctat

SEQ ID NO: 265970 - DNA, 25 bp, Mus musculus
atggcttggttctcccagattctat

SEQ ID NO: 265971 - DNA, 25 bp, Mus musculus
atggcttggtttaccatgcttccta

SEQ ID NO: 265972 - DNA, 25 bp, Mus musculus
atggcttggttttccatgcttccta

SEQ ID NO: 265973 - DNA, 25 bp, Mus musculus
atggcttgtcacagcataatagtaa

SEQ ID NO: 265974 - DNA, 25 bp, Mus musculus
atggcttgtcactgcataatagtaa

SEQ ID NO: 265975 - DNA, 25 bp, Mus musculus
atggcttgtcagctcttggtaacaa

SEQ ID NO: 265976 - DNA, 25 bp, Mus musculus
atggcttgtcaggtcttggtaacaa

SEQ ID NO: 265977 - DNA, 25 bp, Mus musculus
atggcttgtgatcctgatgtcctag

SEQ ID NO: 265978 - DNA, 25 bp, Mus musculus
atggcttgtgatgctgatgtcctag

SEQ ID NO: 265979 - DNA, 25 bp, Mus musculus
atggcttgtgcaatttgaaaccagc

SEQ ID NO: 265980 - DNA, 25 bp, Mus musculus
atggcttgtgcattttgaaaccagc

SEQ ID NO: 265981 - DNA, 25 bp, Mus musculus
atggcttgtgctatgataagcccag

SEQ ID NO: 265982 - DNA, 25 bp, Mus musculus
atggcttgtgctcgccagtgtgcca

SEQ ID NO: 265983 - DNA, 25 bp, Mus musculus
atggcttgtgctggccagtgtgcca

SEQ ID NO: 265984 - DNA, 25 bp, Mus musculus
atggcttgtgctttgataagcccag

SEQ ID NO: 265985 - DNA, 25 bp, Mus musculus
atggcttgtgggatgttgccaccaa

SEQ ID NO: 265986 - DNA, 25 bp, Mus musculus
atggcttgtgggttgttgccaccaa

SEQ ID NO: 265987 - DNA, 25 bp, Mus musculus
atggcttgtgtgagatgccgtgtgt

SEQ ID NO: 265988 - DNA, 25 bp, Mus musculus
atggcttgtgtgtgatgccgtgtgt

SEQ ID NO: 265989 - DNA, 25 bp, Mus musculus
atggctttaaagatttgagaacaac

SEQ ID NO: 265990 - DNA, 25 bp, Mus musculus
atggctttaaagttttgagaacaac

SEQ ID NO: 265991 - DNA, 25 bp, Mus musculus
atggctttaatgcagcagacctgag

SEQ ID NO: 265992 - DNA, 25 bp, Mus musculus
atggctttaatggagcagacctgag

SEQ ID NO: 265993 - DNA, 25 bp, Mus musculus
atggctttacttcataagcttagag

SEQ ID NO: 265994 - DNA, 25 bp, Mus musculus
atggctttacttgataagcttagag

SEQ ID NO: 265995 - DNA, 25 bp, Mus musculus
atggctttagaccagcgctgaaaga

SEQ ID NO: 265996 - DNA, 25 bp, Mus musculus
atggctttagacgagcgctgaaaga

SEQ ID NO: 265997 - DNA, 25 bp, Mus musculus
atggctttagagcagtcaccgtcag

SEQ ID NO: 265998 - DNA, 25 bp, Mus musculus
atggctttagaggagtcaccgtcag

SEQ ID NO: 265999 - DNA, 25 bp, Mus musculus
atggctttagccagggttatacaac

SEQ ID NO: 266000 - DNA, 25 bp, Mus musculus
atggctttagcctgggttatacaac

SEQ ID NO: 266001 - DNA, 25 bp, Mus musculus
atggctttatgacggctcttaaatt

SEQ ID NO: 266002 - DNA, 25 bp, Mus musculus
atggctttatgagggctcttaaatt

SEQ ID NO: 266003 - DNA, 25 bp, Mus musculus
atggctttatgcaccgctggaggta

SEQ ID NO: 266004 - DNA, 25 bp, Mus musculus
atggctttatgctccgctggaggta

SEQ ID NO: 266005 - DNA, 25 bp, Mus musculus
atggctttcagcactctcagagtta

SEQ ID NO: 266006 - DNA, 25 bp, Mus musculus
atggctttcagctctctcagagtta

SEQ ID NO: 266007 - DNA, 25 bp, Mus musculus
atggctttcatgatcagccgcgaaa

SEQ ID NO: 266008 - DNA, 25 bp, Mus musculus
atggctttcatgttcagccgcgaaa

SEQ ID NO: 266009 - DNA, 25 bp, Mus musculus
atggctttcctcagggtgtagggca

SEQ ID NO: 266010 - DNA, 25 bp, Mus musculus
atggctttcctctgggtgtagggca

SEQ ID NO: 266011 - DNA, 25 bp, Mus musculus
atggctttcgggatccctttgagtg

SEQ ID NO: 266012 - DNA, 25 bp, Mus musculus
atggctttcgggttccctttgagtg

SEQ ID NO: 266013 - DNA, 25 bp, Mus musculus
atggctttcgtgaaatttctgtttt

SEQ ID NO: 266014 - DNA, 25 bp, Mus musculus
atggctttcgtgtaatttctgtttt

SEQ ID NO: 266015 - DNA, 25 bp, Mus musculus
atggctttgaggaggcctgcacttc

SEQ ID NO: 266016 - DNA, 25 bp, Mus musculus
atggctttgaggtggcctgcacttc

SEQ ID NO: 266017 - DNA, 25 bp, Mus musculus
atggctttgatcatggttacctgag

SEQ ID NO: 266018 - DNA, 25 bp, Mus musculus
atggctttgatcttggttacctgag

SEQ ID NO: 266019 - DNA, 25 bp, Mus musculus
atggctttgcagatgacttgttaca

SEQ ID NO: 266020 - DNA, 25 bp, Mus musculus
atggctttgcagttgacttgttaca

SEQ ID NO: 266021 - DNA, 25 bp, Mus musculus
atggctttgccaaaacagttaagta

SEQ ID NO: 266022 - DNA, 25 bp, Mus musculus
atggctttgccataacagttaagta

SEQ ID NO: 266023 - DNA, 25 bp, Mus musculus
atggctttgcctatgtgttgcctcc

SEQ ID NO: 266024 - DNA, 25 bp, Mus musculus
atggctttgcctttgtgttgcctcc

SEQ ID NO: 266025 - DNA, 25 bp, Mus musculus
atggctttgcttccagattctgggc

SEQ ID NO: 266026 - DNA, 25 bp, Mus musculus
atggctttgcttgcagattctgggc

SEQ ID NO: 266027 - DNA, 25 bp, Mus musculus
atggctttggctcctcttgaatatc

SEQ ID NO: 266028 - DNA, 25 bp, Mus musculus
atggctttggctgctcttgaatatc

SEQ ID NO: 266029 - DNA, 25 bp, Mus musculus
atggctttggtaatatgggcttgaa

SEQ ID NO: 266030 - DNA, 25 bp, Mus musculus
atggctttggtattatgggcttgaa

SEQ ID NO: 266031 - DNA, 25 bp, Mus musculus
atggctttgtgcctgaaccaccagc

SEQ ID NO: 266032 - DNA, 25 bp, Mus musculus
atggctttgtgcgtgaaccaccagc

SEQ ID NO: 266033 - DNA, 25 bp, Mus musculus
atggctttgtggactgctcttcaat

SEQ ID NO: 266034 - DNA, 25 bp, Mus musculus
atggctttgtggtctgctcttcaat

SEQ ID NO: 266035 - DNA, 25 bp, Mus musculus
atggcttttccactgggcaagatac

SEQ ID NO: 266036 - DNA, 25 bp, Mus musculus
atggcttttccagtgggcaagatac

SEQ ID NO: 266037 - DNA, 25 bp, Mus musculus
atggcttttctcattgctagaagga

SEQ ID NO: 266038 - DNA, 25 bp, Mus musculus
atggcttttctctttgctagaagga

SEQ ID NO: 266039 - DNA, 25 bp, Mus musculus
atggcttttgcaatccttgtttgtg

SEQ ID NO: 266040 - DNA, 25 bp, Mus musculus
atggcttttgcattccttgtttgtg

SEQ ID NO: 266041 - DNA, 25 bp, Mus musculus
atggcttttgccatgtgcctagcag

SEQ ID NO: 266042 - DNA, 25 bp, Mus musculus
atggcttttgccttgtgcctagcag

SEQ ID NO: 266043 - DNA, 25 bp, Mus musculus
atggcttttgctagctggcttggtc

SEQ ID NO: 266044 - DNA, 25 bp, Mus musculus
atggcttttgcttgctggcttggtc

SEQ ID NO: 266045 - DNA, 25 bp, Mus musculus
atggcttttggcaagaaccttcatt

SEQ ID NO: 266046 - DNA, 25 bp, Mus musculus
atggcttttggctagaaccttcatt

SEQ ID NO: 266047 - DNA, 25 bp, Mus musculus
atggcttttgttcttgaccacctaa

SEQ ID NO: 266048 - DNA, 25 bp, Mus musculus
atggcttttgttgttgaccacctaa

SEQ ID NO: 266049 - DNA, 25 bp, Mus musculus
atggctttttggcttttagctctgc

SEQ ID NO: 266050 - DNA, 25 bp, Mus musculus
atggctttttgggttttagctctgc

SEQ ID NO: 266051 - DNA, 25 bp, Mus musculus
atgggaaaaattctacctggtacat

SEQ ID NO: 266052 - DNA, 25 bp, Mus musculus
atgggaaaaattgtacctggtacat

SEQ ID NO: 266053 - DNA, 25 bp, Mus musculus
atgggaaaagccaggctctcatcaa

SEQ ID NO: 266054 - DNA, 25 bp, Mus musculus
atgggaaaagcctggctctcatcaa

SEQ ID NO: 266055 - DNA, 25 bp, Mus musculus
atgggaaaatctacgcgcaggaagc

SEQ ID NO: 266056 - DNA, 25 bp, Mus musculus
atgggaaaatcttcgcgcaggaagc

SEQ ID NO: 266057 - DNA, 25 bp, Mus musculus
atgggaaacagcacatcgtcgtttt

SEQ ID NO: 266058 - DNA, 25 bp, Mus musculus
atgggaaacagcaggatggtctctc

SEQ ID NO: 266059 - DNA, 25 bp, Mus musculus
atgggaaacagctcatcgtcgtttt

SEQ ID NO: 266060 - DNA, 25 bp, Mus musculus
atgggaaacagctggatggtctctc

SEQ ID NO: 266061 - DNA, 25 bp, Mus musculus
atgggaaacgtaagtggcacacaga

SEQ ID NO: 266062 - DNA, 25 bp, Mus musculus
atgggaaacgtatgtggcacacaga

SEQ ID NO: 266063 - DNA, 25 bp, Mus musculus
atgggaaagcctcctgccaaaccag

SEQ ID NO: 266064 - DNA, 25 bp, Mus musculus
atgggaaagcctgctgccaaaccag

SEQ ID NO: 266065 - DNA, 25 bp, Mus musculus
atgggaaagggcatctgcactcctt

SEQ ID NO: 266066 - DNA, 25 bp, Mus musculus
atgggaaagggcttctgcactcctt

SEQ ID NO: 266067 - DNA, 25 bp, Mus musculus
atgggaaataatagctcatttgaag

SEQ ID NO: 266068 - DNA, 25 bp, Mus musculus
atgggaaataattgctcatttgaag

SEQ ID NO: 266069 - DNA, 25 bp, Mus musculus
atgggaaatggtcccgatcctttca

SEQ ID NO: 266070 - DNA, 25 bp, Mus musculus
atgggaaatggtgccgatcctttca

SEQ ID NO: 266071 - DNA, 25 bp, Mus musculus
atgggaaattgaagcagtgcataac

SEQ ID NO: 266072 - DNA, 25 bp, Mus musculus
atgggaaattgatgcagtgcataac

SEQ ID NO: 266073 - DNA, 25 bp, Mus musculus
atgggaacaacaattctgctacaaa

SEQ ID NO: 266074 - DNA, 25 bp, Mus musculus
atgggaacaacatttctgctacaaa

SEQ ID NO: 266075 - DNA, 25 bp, Mus musculus
atgggaacaatgagcccttgcctct

SEQ ID NO: 266076 - DNA, 25 bp, Mus musculus
atgggaacaatgtgcccttgcctct

SEQ ID NO: 266077 - DNA, 25 bp, Mus musculus
atgggaacacgcctggagctgtcct

SEQ ID NO: 266078 - DNA, 25 bp, Mus musculus
atgggaacacgcgtggagctgtcct

SEQ ID NO: 266079 - DNA, 25 bp, Mus musculus
atgggaacatgtaagcccgcatacc

SEQ ID NO: 266080 - DNA, 25 bp, Mus musculus
atgggaacatgttagcccgcatacc

SEQ ID NO: 266081 - DNA, 25 bp, Mus musculus
atgggaacattcaaaaggaggcggt

SEQ ID NO: 266082 - DNA, 25 bp, Mus musculus
atgggaacattctaaaggaggcggt

SEQ ID NO: 266083 - DNA, 25 bp, Mus musculus
atgggaaccaaccacaggtcctctg

SEQ ID NO: 266084 - DNA, 25 bp, Mus musculus
atgggaaccaacgacaggtcctctg

SEQ ID NO: 266085 - DNA, 25 bp, Mus musculus
atgggaacccggaacatcaccaaag

SEQ ID NO: 266086 - DNA, 25 bp, Mus musculus
atgggaacccggtacatcaccaaag

SEQ ID NO: 266087 - DNA, 25 bp, Mus musculus
atgggaaccctgaagtcatgcggac

SEQ ID NO: 266088 - DNA, 25 bp, Mus musculus
atgggaaccctgtagtcatgcggac

SEQ ID NO: 266089 - DNA, 25 bp, Mus musculus
atgggaacctcacctgccaaaccag

SEQ ID NO: 266090 - DNA, 25 bp, Mus musculus
atgggaacctcagctgccaaaccag

SEQ ID NO: 266091 - DNA, 25 bp, Mus musculus
atgggaacggtcacattttgcctaa

SEQ ID NO: 266092 - DNA, 25 bp, Mus musculus
atgggaacggtctcattttgcctaa

SEQ ID NO: 266093 - DNA, 25 bp, Mus musculus
atgggaactaacatgcttgggctga

SEQ ID NO: 266094 - DNA, 25 bp, Mus musculus
atgggaactaaccatcgcccgtcct

SEQ ID NO: 266095 - DNA, 25 bp, Mus musculus
atgggaactaacgatcgcccgtcct

SEQ ID NO: 266096 - DNA, 25 bp, Mus musculus
atgggaactaacttgcttgggctga

SEQ ID NO: 266097 - DNA, 25 bp, Mus musculus
atgggaactcgaatcctctttaaga

SEQ ID NO: 266098 - DNA, 25 bp, Mus musculus
atgggaactcgattcctctttaaga

SEQ ID NO: 266099 - DNA, 25 bp, Mus musculus
atgggaactcgtctggatagccctg

SEQ ID NO: 266100 - DNA, 25 bp, Mus musculus
atgggaactcgtgtggatagccctg

SEQ ID NO: 266101 - DNA, 25 bp, Mus musculus
atgggaagacaaccacatcacccac

SEQ ID NO: 266102 - DNA, 25 bp, Mus musculus
atgggaagacaagcacatcacccac

SEQ ID NO: 266103 - DNA, 25 bp, Mus musculus
atgggaagcaatatacccctaactg

SEQ ID NO: 266104 - DNA, 25 bp, Mus musculus
atgggaagcaatttacccctaactg

SEQ ID NO: 266105 - DNA, 25 bp, Mus musculus
atgggaagcattagcaagggccaga

SEQ ID NO: 266106 - DNA, 25 bp, Mus musculus
atgggaagcatttgcaagggccaga

SEQ ID NO: 266107 - DNA, 25 bp, Mus musculus
atgggaagccacatcagaccaccgg

SEQ ID NO: 266108 - DNA, 25 bp, Mus musculus
atgggaagccacttcagaccaccgg

SEQ ID NO: 266109 - DNA, 25 bp, Mus musculus
atgggaagcgacatgcgtactgagc

SEQ ID NO: 266110 - DNA, 25 bp, Mus musculus
atgggaagcgacttgcgtactgagc

SEQ ID NO: 266111 - DNA, 25 bp, Mus musculus
atgggaagctacagtgccatggcca

SEQ ID NO: 266112 - DNA, 25 bp, Mus musculus
atgggaagctactgtgccatggcca

SEQ ID NO: 266113 - DNA, 25 bp, Mus musculus
atgggaagggccacatcaggcctca

SEQ ID NO: 266114 - DNA, 25 bp, Mus musculus
atgggaagggcctcatcaggcctca

SEQ ID NO: 266115 - DNA, 25 bp, Mus musculus
atgggaagttctccacctgctgcca

SEQ ID NO: 266116 - DNA, 25 bp, Mus musculus
atgggaagttctgcacctgctgcca

SEQ ID NO: 266117 - DNA, 25 bp, Mus musculus
atgggaatccaacctttatcggaga

SEQ ID NO: 266118 - DNA, 25 bp, Mus musculus
atgggaatccaagctttatcggaga

SEQ ID NO: 266119 - DNA, 25 bp, Mus musculus
atgggaatccctagctttcatggtt

SEQ ID NO: 266120 - DNA, 25 bp, Mus musculus
atgggaatcccttgctttcatggtt

SEQ ID NO: 266121 - DNA, 25 bp, Mus musculus
atgggaatgattaacctcttaaata

SEQ ID NO: 266122 - DNA, 25 bp, Mus musculus
atgggaatgatttacctcttaaata

SEQ ID NO: 266123 - DNA, 25 bp, Mus musculus
atgggaatgcccattagacttaata

SEQ ID NO: 266124 - DNA, 25 bp, Mus musculus
atgggaatgccctttagacttaata

SEQ ID NO: 266125 - DNA, 25 bp, Mus musculus
atgggaatgcttccgtatccaggaa

SEQ ID NO: 266126 - DNA, 25 bp, Mus musculus
atgggaatgcttgcgtatccaggaa

SEQ ID NO: 266127 - DNA, 25 bp, Mus musculus
atgggaattgggaagcctctgaccc

SEQ ID NO: 266128 - DNA, 25 bp, Mus musculus
atgggaattgggtagcctctgaccc

SEQ ID NO: 266129 - DNA, 25 bp, Mus musculus
atgggacaccctaattgtacctgag

SEQ ID NO: 266130 - DNA, 25 bp, Mus musculus
atgggacacccttattgtacctgag

SEQ ID NO: 266131 - DNA, 25 bp, Mus musculus
atgggacacctgatgtacattccgg

SEQ ID NO: 266132 - DNA, 25 bp, Mus musculus
atgggacacctgttgtacattccgg

SEQ ID NO: 266133 - DNA, 25 bp, Mus musculus
atgggacacgcaagacatttgaggt

SEQ ID NO: 266134 - DNA, 25 bp, Mus musculus
atgggacacgcatgacatttgaggt

SEQ ID NO: 266135 - DNA, 25 bp, Mus musculus
atgggacagggcaggatttcttccc

SEQ ID NO: 266136 - DNA, 25 bp, Mus musculus
atgggacagggctggatttcttccc

SEQ ID NO: 266137 - DNA, 25 bp, Mus musculus
atgggacagtagatccctcatactc

SEQ ID NO: 266138 - DNA, 25 bp, Mus musculus
atgggacagtagttccctcatactc

SEQ ID NO: 266139 - DNA, 25 bp, Mus musculus
atgggacagtatacccgcttgcctt

SEQ ID NO: 266140 - DNA, 25 bp, Mus musculus
atgggacagtattcccgcttgcctt

SEQ ID NO: 266141 - DNA, 25 bp, Mus musculus
atgggacagtcaccgagagagacaa

SEQ ID NO: 266142 - DNA, 25 bp, Mus musculus
atgggacagtcagcgagagagacaa

SEQ ID NO: 266143 - DNA, 25 bp, Mus musculus
atgggacatcccacattgactgtgt

SEQ ID NO: 266144 - DNA, 25 bp, Mus musculus
atgggacatccctcattgactgtgt

SEQ ID NO: 266145 - DNA, 25 bp, Mus musculus
atgggacattacagggccacatcta

SEQ ID NO: 266146 - DNA, 25 bp, Mus musculus
atgggacattactgggccacatcta

SEQ ID NO: 266147 - DNA, 25 bp, Mus musculus
atgggacattccatagcgcctctga

SEQ ID NO: 266148 - DNA, 25 bp, Mus musculus
atgggacattccttagcgcctctga

SEQ ID NO: 266149 - DNA, 25 bp, Mus musculus
atgggacatttccaagaccttgatg

SEQ ID NO: 266150 - DNA, 25 bp, Mus musculus
atgggacatttcgaagaccttgatg

SEQ ID NO: 266151 - DNA, 25 bp, Mus musculus
atgggacatttgagacagtgaagag

SEQ ID NO: 266152 - DNA, 25 bp, Mus musculus
atgggacatttgtgacagtgaagag

SEQ ID NO: 266153 - DNA, 25 bp, Mus musculus
atgggaccagatagagcaggctcac

SEQ ID NO: 266154 - DNA, 25 bp, Mus musculus
atgggaccagattgagcaggctcac

SEQ ID NO: 266155 - DNA, 25 bp, Mus musculus
atgggaccagccagatcggtttatg

SEQ ID NO: 266156 - DNA, 25 bp, Mus musculus
atgggaccagcctgatcggtttatg

SEQ ID NO: 266157 - DNA, 25 bp, Mus musculus
atgggaccagcgcaacagacacagg

SEQ ID NO: 266158 - DNA, 25 bp, Mus musculus
atgggaccagcggaacagacacagg

SEQ ID NO: 266159 - DNA, 25 bp, Mus musculus
atgggaccagctacacccctggaag

SEQ ID NO: 266160 - DNA, 25 bp, Mus musculus
atgggaccagcttcacccctggaag

SEQ ID NO: 266161 - DNA, 25 bp, Mus musculus
atgggaccaggaccatcctcctgtt

SEQ ID NO: 266162 - DNA, 25 bp, Mus musculus
atgggaccaggagcatcctcctgtt

SEQ ID NO: 266163 - DNA, 25 bp, Mus musculus
atgggaccaggccatcactgaaggc

SEQ ID NO: 266164 - DNA, 25 bp, Mus musculus
atgggaccaggcgatcactgaaggc

SEQ ID NO: 266165 - DNA, 25 bp, Mus musculus
atgggaccatcactggacctggtca

SEQ ID NO: 266166 - DNA, 25 bp, Mus musculus
atgggaccatcagtggacctggtca

SEQ ID NO: 266167 - DNA, 25 bp, Mus musculus
atgggaccattaaccttttaacaag

SEQ ID NO: 266168 - DNA, 25 bp, Mus musculus
atgggaccattatccttttaacaag

SEQ ID NO: 266169 - DNA, 25 bp, Mus musculus
atgggacccagcctaagctcagcag

SEQ ID NO: 266170 - DNA, 25 bp, Mus musculus
atgggacccagcgtaagctcagcag

SEQ ID NO: 266171 - DNA, 25 bp, Mus musculus
atgggaccccaaaatgttaccacct

SEQ ID NO: 266172 - DNA, 25 bp, Mus musculus
atgggaccccaatatgttaccacct

SEQ ID NO: 266173 - DNA, 25 bp, Mus musculus
atgggaccccacacctccagaaggt

SEQ ID NO: 266174 - DNA, 25 bp, Mus musculus
atgggaccccactcctccagaaggt

SEQ ID NO: 266175 - DNA, 25 bp, Mus musculus
atgggaccgatcaaaaacatcattt

SEQ ID NO: 266176 - DNA, 25 bp, Mus musculus
atgggaccgatctaaaacatcattt

SEQ ID NO: 266177 - DNA, 25 bp, Mus musculus
atgggaccgccgacatgcacatcat

SEQ ID NO: 266178 - DNA, 25 bp, Mus musculus
atgggaccgccgtcatgcacatcat

SEQ ID NO: 266179 - DNA, 25 bp, Mus musculus
atgggacctaaaactgtatcgctga

SEQ ID NO: 266180 - DNA, 25 bp, Mus musculus
atgggacctaaatctgtatcgctga

SEQ ID NO: 266181 - DNA, 25 bp, Mus musculus
atgggacctatgaaatagtattctc

SEQ ID NO: 266182 - DNA, 25 bp, Mus musculus
atgggacctatgtaatagtattctc

SEQ ID NO: 266183 - DNA, 25 bp, Mus musculus
atgggacctattacatcctattcgc

SEQ ID NO: 266184 - DNA, 25 bp, Mus musculus
atgggacctatttcatcctattcgc

SEQ ID NO: 266185 - DNA, 25 bp, Mus musculus
atgggacctcacacagcctgggtat

SEQ ID NO: 266186 - DNA, 25 bp, Mus musculus
atgggacctcactcagcctgggtat

SEQ ID NO: 266187 - DNA, 25 bp, Mus musculus
atgggacctcatcgctcatttgttt

SEQ ID NO: 266188 - DNA, 25 bp, Mus musculus
atgggacctcatggctcatttgttt

SEQ ID NO: 266189 - DNA, 25 bp, Mus musculus
atgggacctgcgcaggacctttttt

SEQ ID NO: 266190 - DNA, 25 bp, Mus musculus
atgggacctgcggaggacctttttt

SEQ ID NO: 266191 - DNA, 25 bp, Mus musculus
atgggacgacttccttgttcctgag

SEQ ID NO: 266192 - DNA, 25 bp, Mus musculus
atgggacgacttgcttgttcctgag

SEQ ID NO: 266193 - DNA, 25 bp, Mus musculus
atgggacgcaccagcacagagcact

SEQ ID NO: 266194 - DNA, 25 bp, Mus musculus
atgggacgcacctgcacagagcact

SEQ ID NO: 266195 - DNA, 25 bp, Mus musculus
atgggacgcttacttgaggaaaatc

SEQ ID NO: 266196 - DNA, 25 bp, Mus musculus
atgggacgcttagttgaggaaaatc

SEQ ID NO: 266197 - DNA, 25 bp, Mus musculus
atgggacgcttcagtacctttctcc

SEQ ID NO: 266198 - DNA, 25 bp, Mus musculus
atgggacgcttctgtacctttctcc

SEQ ID NO: 266199 - DNA, 25 bp, Mus musculus
atgggacggcctcatgctgtcatgc

SEQ ID NO: 266200 - DNA, 25 bp, Mus musculus
atgggacggcctgatgctgtcatgc

SEQ ID NO: 266201 - DNA, 25 bp, Mus musculus
atgggacggctaacgtaatggttgt

SEQ ID NO: 266202 - DNA, 25 bp, Mus musculus
atgggacggctatcgtaatggttgt

SEQ ID NO: 266203 - DNA, 25 bp, Mus musculus
atgggacgtctcagactggcaatga

SEQ ID NO: 266204 - DNA, 25 bp, Mus musculus
atgggacgtctctgactggcaatga

SEQ ID NO: 266205 - DNA, 25 bp, Mus musculus
atgggactaaacaactatgggctaa

SEQ ID NO: 266206 - DNA, 25 bp, Mus musculus
atgggactaaactactatgggctaa

SEQ ID NO: 266207 - DNA, 25 bp, Mus musculus
atgggactagagctttcttggacaa

SEQ ID NO: 266208 - DNA, 25 bp, Mus musculus
atgggactagaggtttcttggacaa

SEQ ID NO: 266209 - DNA, 25 bp, Mus musculus
atgggactcactcagccctgtgaat

SEQ ID NO: 266210 - DNA, 25 bp, Mus musculus
atgggactcactgagccctgtgaat

SEQ ID NO: 266211 - DNA, 25 bp, Mus musculus
atgggactccgccttgcaggaaagc

SEQ ID NO: 266212 - DNA, 25 bp, Mus musculus
atgggactccgcgttgcaggaaagc

SEQ ID NO: 266213 - DNA, 25 bp, Mus musculus
atgggactcctccagtttggctctt

SEQ ID NO: 266214 - DNA, 25 bp, Mus musculus
atgggactcctcgagtttggctctt

SEQ ID NO: 266215 - DNA, 25 bp, Mus musculus
atgggactgaacatcagaaccctat

SEQ ID NO: 266216 - DNA, 25 bp, Mus musculus
atgggactgaacttcagaaccctat

SEQ ID NO: 266217 - DNA, 25 bp, Mus musculus
atgggactgaagatatggctcggca

SEQ ID NO: 266218 - DNA, 25 bp, Mus musculus
atgggactgaagttatggctcggca

SEQ ID NO: 266219 - DNA, 25 bp, Mus musculus
atgggactgatgattgaggttttgt

SEQ ID NO: 266220 - DNA, 25 bp, Mus musculus
atgggactgatgtttgaggttttgt

SEQ ID NO: 266221 - DNA, 25 bp, Mus musculus
atgggactggcacttcgccaagcgc

SEQ ID NO: 266222 - DNA, 25 bp, Mus musculus
atgggactggcagttcgccaagcgc

SEQ ID NO: 266223 - DNA, 25 bp, Mus musculus
atgggactgtccatttgtggtgaga

SEQ ID NO: 266224 - DNA, 25 bp, Mus musculus
atgggactgtccttttgtggtgaga

SEQ ID NO: 266225 - DNA, 25 bp, Mus musculus
atgggactgtgaccattctttttct

SEQ ID NO: 266226 - DNA, 25 bp, Mus musculus
atgggactgtgagcattctttttct

SEQ ID NO: 266227 - DNA, 25 bp, Mus musculus
atgggacttagtatctatcttctta

SEQ ID NO: 266228 - DNA, 25 bp, Mus musculus
atgggacttagtttctatcttctta

SEQ ID NO: 266229 - DNA, 25 bp, Mus musculus
atgggacttataactctctaagaga

SEQ ID NO: 266230 - DNA, 25 bp, Mus musculus
atgggacttatatctctctaagaga

SEQ ID NO: 266231 - DNA, 25 bp, Mus musculus
atgggacttctaattaagcacagac

SEQ ID NO: 266232 - DNA, 25 bp, Mus musculus
atgggacttctatttaagcacagac

SEQ ID NO: 266233 - DNA, 25 bp, Mus musculus
atgggacttctgctcatcttattct

SEQ ID NO: 266234 - DNA, 25 bp, Mus musculus
atgggacttctggtcatcttattct

SEQ ID NO: 266235 - DNA, 25 bp, Mus musculus
atgggacttgtgaacctttgggcta

SEQ ID NO: 266236 - DNA, 25 bp, Mus musculus
atgggacttgtgtacctttgggcta

SEQ ID NO: 266237 - DNA, 25 bp, Mus musculus
atgggagaaatcagctgcctcctcc

SEQ ID NO: 266238 - DNA, 25 bp, Mus musculus
atgggagaaatctgctgcctcctcc

SEQ ID NO: 266239 - DNA, 25 bp, Mus musculus
atgggagaacccctccagatggaga

SEQ ID NO: 266240 - DNA, 25 bp, Mus musculus
atgggagaacccctgcttcgtgtgt

SEQ ID NO: 266241 - DNA, 25 bp, Mus musculus
atgggagaacccgtccagatggaga

SEQ ID NO: 266242 - DNA, 25 bp, Mus musculus
atgggagaacccgtgcttcgtgtgt

SEQ ID NO: 266243 - DNA, 25 bp, Mus musculus
atgggagaagagaagcctgctacta

SEQ ID NO: 266244 - DNA, 25 bp, Mus musculus
atgggagaagagtagcctgctacta

SEQ ID NO: 266245 - DNA, 25 bp, Mus musculus
atgggagaatacctcgctgaacccc

SEQ ID NO: 266246 - DNA, 25 bp, Mus musculus
atgggagaatacgtcgctgaacccc

SEQ ID NO: 266247 - DNA, 25 bp, Mus musculus
atgggagacaaacccaggccatgtc

SEQ ID NO: 266248 - DNA, 25 bp, Mus musculus
atgggagacaaagccaggccatgtc

SEQ ID NO: 266249 - DNA, 25 bp, Mus musculus
atgggagaccataaatcactacaga

SEQ ID NO: 266250 - DNA, 25 bp, Mus musculus
atgggagaccattaatcactacaga

SEQ ID NO: 266251 - DNA, 25 bp, Mus musculus
atgggagacctgctcattgatgaca

SEQ ID NO: 266252 - DNA, 25 bp, Mus musculus
atgggagacctggtcattgatgaca

SEQ ID NO: 266253 - DNA, 25 bp, Mus musculus
atgggagacgaaaactgaacccagt

SEQ ID NO: 266254 - DNA, 25 bp, Mus musculus
atgggagacgaatactgaacccagt

SEQ ID NO: 266255 - DNA, 25 bp, Mus musculus
atgggagactctcttgacaagctgc

SEQ ID NO: 266256 - DNA, 25 bp, Mus musculus
atgggagactctgttgacaagctgc

SEQ ID NO: 266257 - DNA, 25 bp, Mus musculus
atgggagactgcattgcactggccc

SEQ ID NO: 266258 - DNA, 25 bp, Mus musculus
atgggagactgctttgcactggccc

SEQ ID NO: 266259 - DNA, 25 bp, Mus musculus
atgggagacttcaatgctggctgca

SEQ ID NO: 266260 - DNA, 25 bp, Mus musculus
atgggagacttctatgctggctgca

SEQ ID NO: 266261 - DNA, 25 bp, Mus musculus
atgggagagagcacctgcagatcct

SEQ ID NO: 266262 - DNA, 25 bp, Mus musculus
atgggagagagctcctgcagatcct

SEQ ID NO: 266263 - DNA, 25 bp, Mus musculus
atgggagagccaccatctcactgag

SEQ ID NO: 266264 - DNA, 25 bp, Mus musculus
atgggagagccagcatctcactgag

SEQ ID NO: 266265 - DNA, 25 bp, Mus musculus
atgggagagctgacgtgagtccttc

SEQ ID NO: 266266 - DNA, 25 bp, Mus musculus
atgggagagctgtcgtgagtccttc

SEQ ID NO: 266267 - DNA, 25 bp, Mus musculus
atgggagagttcatgcctgccaaac

SEQ ID NO: 266268 - DNA, 25 bp, Mus musculus
atgggagagttcttgcctgccaaac

SEQ ID NO: 266269 - DNA, 25 bp, Mus musculus
atgggagatcacatcctattctaaa

SEQ ID NO: 266270 - DNA, 25 bp, Mus musculus
atgggagatcacttcctattctaaa

SEQ ID NO: 266271 - DNA, 25 bp, Mus musculus
atgggagatgtcctctcggctgtat

SEQ ID NO: 266272 - DNA, 25 bp, Mus musculus
atgggagatgtcgtctcggctgtat

SEQ ID NO: 266273 - DNA, 25 bp, Mus musculus
atgggagcagagatgctagctctac

SEQ ID NO: 266274 - DNA, 25 bp, Mus musculus
atgggagcagagttgctagctctac

SEQ ID NO: 266275 - DNA, 25 bp, Mus musculus
atgggagcatccaaggtcactggct

SEQ ID NO: 266276 - DNA, 25 bp, Mus musculus
atgggagcatcctaggtcactggct

SEQ ID NO: 266277 - DNA, 25 bp, Mus musculus
atgggagccagactgaaaacagtgc

SEQ ID NO: 266278 - DNA, 25 bp, Mus musculus
atgggagccagagtgaaaacagtgc

SEQ ID NO: 266279 - DNA, 25 bp, Mus musculus
atgggagcccaacctttgaaacaat

SEQ ID NO: 266280 - DNA, 25 bp, Mus musculus
atgggagcccaagctttgaaacaat

SEQ ID NO: 266281 - DNA, 25 bp, Mus musculus
atgggagcccagcactagagcttgc

SEQ ID NO: 266282 - DNA, 25 bp, Mus musculus
atgggagcccaggactagagcttgc

SEQ ID NO: 266283 - DNA, 25 bp, Mus musculus
atgggagcctacctcattgccagtg

SEQ ID NO: 266284 - DNA, 25 bp, Mus musculus
atgggagcctacgtcattgccagtg

SEQ ID NO: 266285 - DNA, 25 bp, Mus musculus
atgggagcctgtatctccagttcta

SEQ ID NO: 266286 - DNA, 25 bp, Mus musculus
atgggagcctgtttctccagttcta

SEQ ID NO: 266287 - DNA, 25 bp, Mus musculus
atgggagcctttacgcttgctccat

SEQ ID NO: 266288 - DNA, 25 bp, Mus musculus
atgggagccttttcgcttgctccat

SEQ ID NO: 266289 - DNA, 25 bp, Mus musculus
atgggagctatcctctagaactgtc

SEQ ID NO: 266290 - DNA, 25 bp, Mus musculus
atgggagctatcgtctagaactgtc

SEQ ID NO: 266291 - DNA, 25 bp, Mus musculus
atgggagctcaacgcttggactgaa

SEQ ID NO: 266292 - DNA, 25 bp, Mus musculus
atgggagctcaaggcttggactgaa

SEQ ID NO: 266293 - DNA, 25 bp, Mus musculus
atgggagctcctcgttcctggaatg

SEQ ID NO: 266294 - DNA, 25 bp, Mus musculus
atgggagctcctggttcctggaatg

SEQ ID NO: 266295 - DNA, 25 bp, Mus musculus
atgggagctgctccggtctttgaat

SEQ ID NO: 266296 - DNA, 25 bp, Mus musculus
atgggagctgctgcggtctttgaat

SEQ ID NO: 266297 - DNA, 25 bp, Mus musculus
atgggagcttccaggtggtcacctt

SEQ ID NO: 266298 - DNA, 25 bp, Mus musculus
atgggagcttccatcaatatgactt

SEQ ID NO: 266299 - DNA, 25 bp, Mus musculus
atgggagcttcctggtggtcacctt

SEQ ID NO: 266300 - DNA, 25 bp, Mus musculus
atgggagcttccttcaatatgactt

SEQ ID NO: 266301 - DNA, 25 bp, Mus musculus
atgggaggagcaagccttagcctaa

SEQ ID NO: 266302 - DNA, 25 bp, Mus musculus
atgggaggagcatgccttagcctaa

SEQ ID NO: 266303 - DNA, 25 bp, Mus musculus
atgggaggagccactctccaaattg

SEQ ID NO: 266304 - DNA, 25 bp, Mus musculus
atgggaggagcctctctccaaattg

SEQ ID NO: 266305 - DNA, 25 bp, Mus musculus
atgggaggatatccatcagccattt

SEQ ID NO: 266306 - DNA, 25 bp, Mus musculus
atgggaggatatgcatcagccattt

SEQ ID NO: 266307 - DNA, 25 bp, Mus musculus
atgggaggcagcatccagtactggc

SEQ ID NO: 266308 - DNA, 25 bp, Mus musculus
atgggaggcagcttccagtactggc

SEQ ID NO: 266309 - DNA, 25 bp, Mus musculus
atgggaggcatacctggtgctcaac

SEQ ID NO: 266310 - DNA, 25 bp, Mus musculus
atgggaggcatagctggtgctcaac

SEQ ID NO: 266311 - DNA, 25 bp, Mus musculus
atgggaggccacaatacagcctact

SEQ ID NO: 266312 - DNA, 25 bp, Mus musculus
atgggaggccactatacagcctact

SEQ ID NO: 266313 - DNA, 25 bp, Mus musculus
atgggaggcctccttagcttagcta

SEQ ID NO: 266314 - DNA, 25 bp, Mus musculus
atgggaggcctcgttagcttagcta

SEQ ID NO: 266315 - DNA, 25 bp, Mus musculus
atgggaggctacatgcactggatat

SEQ ID NO: 266316 - DNA, 25 bp, Mus musculus
atgggaggctacttgcactggatat

SEQ ID NO: 266317 - DNA, 25 bp, Mus musculus
atgggaggctagcacccaagttcta

SEQ ID NO: 266318 - DNA, 25 bp, Mus musculus
atgggaggctaggacccaagttcta

SEQ ID NO: 266319 - DNA, 25 bp, Mus musculus
atgggaggctttcttctgctgttac

SEQ ID NO: 266320 - DNA, 25 bp, Mus musculus
atgggaggctttgttctgctgttac

SEQ ID NO: 266321 - DNA, 25 bp, Mus musculus
atgggagggtcgatccagcaagcca

SEQ ID NO: 266322 - DNA, 25 bp, Mus musculus
atgggagggtcgttccagcaagcca

SEQ ID NO: 266323 - DNA, 25 bp, Mus musculus
atgggagggtctcgactttctgctc

SEQ ID NO: 266324 - DNA, 25 bp, Mus musculus
atgggagggtctggactttctgctc

SEQ ID NO: 266325 - DNA, 25 bp, Mus musculus
atgggagggttcacaaacaggacac

SEQ ID NO: 266326 - DNA, 25 bp, Mus musculus
atgggagggttctcaaacaggacac

SEQ ID NO: 266327 - DNA, 25 bp, Mus musculus
atgggaggtatcaaaggacttttca

SEQ ID NO: 266328 - DNA, 25 bp, Mus musculus
atgggaggtatctaaggacttttca

SEQ ID NO: 266329 - DNA, 25 bp, Mus musculus
atgggaggtcatctaggaagtcttc

SEQ ID NO: 266330 - DNA, 25 bp, Mus musculus
atgggaggtcatgtaggaagtcttc

SEQ ID NO: 266331 - DNA, 25 bp, Mus musculus
atgggaggtctcaccggccacagtg

SEQ ID NO: 266332 - DNA, 25 bp, Mus musculus
atgggaggtctctccggccacagtg

SEQ ID NO: 266333 - DNA, 25 bp, Mus musculus
atgggaggtgctctagcctagccac

SEQ ID NO: 266334 - DNA, 25 bp, Mus musculus
atgggaggtgctgtagcctagccac

SEQ ID NO: 266335 - DNA, 25 bp, Mus musculus
atgggaggtgtaactttcacacgaa

SEQ ID NO: 266336 - DNA, 25 bp, Mus musculus
atgggaggtgtatctttcacacgaa

SEQ ID NO: 266337 - DNA, 25 bp, Mus musculus
atgggagtaaccagcctcggagcaa

SEQ ID NO: 266338 - DNA, 25 bp, Mus musculus
atgggagtaacctgcctcggagcaa

SEQ ID NO: 266339 - DNA, 25 bp, Mus musculus
atgggagtatccagggcaccccaga

SEQ ID NO: 266340 - DNA, 25 bp, Mus musculus
atgggagtatcctgggcaccccaga

SEQ ID NO: 266341 - DNA, 25 bp, Mus musculus
atgggagtcaccaccctcaatggga

SEQ ID NO: 266342 - DNA, 25 bp, Mus musculus
atgggagtcacctccctcaatggga

SEQ ID NO: 266343 - DNA, 25 bp, Mus musculus
atgggagtcactatttattattgct

SEQ ID NO: 266344 - DNA, 25 bp, Mus musculus
atgggagtcactttttattattgct

SEQ ID NO: 266345 - DNA, 25 bp, Mus musculus
atgggagtcctgacagacaagggca

SEQ ID NO: 266346 - DNA, 25 bp, Mus musculus
atgggagtcctgtcagacaagggca

SEQ ID NO: 266347 - DNA, 25 bp, Mus musculus
atgggagtcgcaatgtgtgttcaga

SEQ ID NO: 266348 - DNA, 25 bp, Mus musculus
atgggagtcgcattgtgtgttcaga

SEQ ID NO: 266349 - DNA, 25 bp, Mus musculus
atgggagtctctacatgtctccctc

SEQ ID NO: 266350 - DNA, 25 bp, Mus musculus
atgggagtctctacgctacaaggaa

SEQ ID NO: 266351 - DNA, 25 bp, Mus musculus
atgggagtctcttcatgtctccctc

SEQ ID NO: 266352 - DNA, 25 bp, Mus musculus
atgggagtctcttcgctacaaggaa

SEQ ID NO: 266353 - DNA, 25 bp, Mus musculus
atgggagtggtgacctgctcaaata

SEQ ID NO: 266354 - DNA, 25 bp, Mus musculus
atgggagtggtgtcctgctcaaata

SEQ ID NO: 266355 - DNA, 25 bp, Mus musculus
atgggagtgtagactgtctccttgg

SEQ ID NO: 266356 - DNA, 25 bp, Mus musculus
atgggagtgtagtctgtctccttgg

SEQ ID NO: 266357 - DNA, 25 bp, Mus musculus
atgggagttactacgctgtcattgc

SEQ ID NO: 266358 - DNA, 25 bp, Mus musculus
atgggagttacttcgctgtcattgc

SEQ ID NO: 266359 - DNA, 25 bp, Mus musculus
atgggagttcccagggcaacatggc

SEQ ID NO: 266360 - DNA, 25 bp, Mus musculus
atgggagttccctgggcaacatggc

SEQ ID NO: 266361 - DNA, 25 bp, Mus musculus
atgggagttgtactccatcccctgg

SEQ ID NO: 266362 - DNA, 25 bp, Mus musculus
atgggagttgtagtccatcccctgg

SEQ ID NO: 266363 - DNA, 25 bp, Mus musculus
atgggatacagacttcctcactggg

SEQ ID NO: 266364 - DNA, 25 bp, Mus musculus
atgggatacagagttcctcactggg

SEQ ID NO: 266365 - DNA, 25 bp, Mus musculus
atgggataccacaccatgtgtttag

SEQ ID NO: 266366 - DNA, 25 bp, Mus musculus
atgggataccactccatgtgtttag

SEQ ID NO: 266367 - DNA, 25 bp, Mus musculus
atgggatacgtgagccagcacacat

SEQ ID NO: 266368 - DNA, 25 bp, Mus musculus
atgggatacgtgtgccagcacacat

SEQ ID NO: 266369 - DNA, 25 bp, Mus musculus
atgggatacgttctcggtttgttat

SEQ ID NO: 266370 - DNA, 25 bp, Mus musculus
atgggatacgttgtcggtttgttat

SEQ ID NO: 266371 - DNA, 25 bp, Mus musculus
atgggatacttccttccatagcctt

SEQ ID NO: 266372 - DNA, 25 bp, Mus musculus
atgggatacttcgttccatagcctt

SEQ ID NO: 266373 - DNA, 25 bp, Mus musculus
atgggatatcagcttcttgttcagt

SEQ ID NO: 266374 - DNA, 25 bp, Mus musculus
atgggatatcaggttcttgttcagt

SEQ ID NO: 266375 - DNA, 25 bp, Mus musculus
atgggatcaactacatcatgagcaa

SEQ ID NO: 266376 - DNA, 25 bp, Mus musculus
atgggatcaacttcatcatgagcaa

SEQ ID NO: 266377 - DNA, 25 bp, Mus musculus
atgggatcactgcagtctacccgta

SEQ ID NO: 266378 - DNA, 25 bp, Mus musculus
atgggatcactggagtctacccgta

SEQ ID NO: 266379 - DNA, 25 bp, Mus musculus
atgggatcatacatgtgccctccag

SEQ ID NO: 266380 - DNA, 25 bp, Mus musculus
atgggatcatacttgtgccctccag

SEQ ID NO: 266381 - DNA, 25 bp, Mus musculus
atgggatccagaagacaatattctt

SEQ ID NO: 266382 - DNA, 25 bp, Mus musculus
atgggatccagatgacaatattctt

SEQ ID NO: 266383 - DNA, 25 bp, Mus musculus
atgggatccagtactacgagcggct

SEQ ID NO: 266384 - DNA, 25 bp, Mus musculus
atgggatccagttctacgagcggct

SEQ ID NO: 266385 - DNA, 25 bp, Mus musculus
atgggatccattacttagagatacc

SEQ ID NO: 266386 - DNA, 25 bp, Mus musculus
atgggatccatttcttagagatacc

SEQ ID NO: 266387 - DNA, 25 bp, Mus musculus
atgggatcctgtctttcagctccaa

SEQ ID NO: 266388 - DNA, 25 bp, Mus musculus
atgggatcctgtgtttcagctccaa

SEQ ID NO: 266389 - DNA, 25 bp, Mus musculus
atgggatcgaacacaccaagagcta

SEQ ID NO: 266390 - DNA, 25 bp, Mus musculus
atgggatcgaactcaccaagagcta

SEQ ID NO: 266391 - DNA, 25 bp, Mus musculus
atgggatcgggtctgacctttgaac

SEQ ID NO: 266392 - DNA, 25 bp, Mus musculus
atgggatcgggtgtgacctttgaac

SEQ ID NO: 266393 - DNA, 25 bp, Mus musculus
atgggatcgtccagcccttctctgt

SEQ ID NO: 266394 - DNA, 25 bp, Mus musculus
atgggatcgtcctgcccttctctgt

SEQ ID NO: 266395 - DNA, 25 bp, Mus musculus
atgggatctataccttccatctgtc

SEQ ID NO: 266396 - DNA, 25 bp, Mus musculus
atgggatctatagcttccatctgtc

SEQ ID NO: 266397 - DNA, 25 bp, Mus musculus
atgggatctcccaattttcaggttt

SEQ ID NO: 266398 - DNA, 25 bp, Mus musculus
atgggatctccctattttcaggttt

SEQ ID NO: 266399 - DNA, 25 bp, Mus musculus
atgggatctcggcaacagcttgcta

SEQ ID NO: 266400 - DNA, 25 bp, Mus musculus
atgggatctcgggaacagcttgcta

SEQ ID NO: 266401 - DNA, 25 bp, Mus musculus
atgggatcttatcccagtcctccag

SEQ ID NO: 266402 - DNA, 25 bp, Mus musculus
atgggatcttatgccagtcctccag

SEQ ID NO: 266403 - DNA, 25 bp, Mus musculus
atgggatgcaatctccatgttactg

SEQ ID NO: 266404 - DNA, 25 bp, Mus musculus
atgggatgcaatgtccatgttactg

SEQ ID NO: 266405 - DNA, 25 bp, Mus musculus
atgggatgccagcaagccacttata

SEQ ID NO: 266406 - DNA, 25 bp, Mus musculus
atgggatgccaggaagccacttata

SEQ ID NO: 266407 - DNA, 25 bp, Mus musculus
atgggatgccccactttataagctc

SEQ ID NO: 266408 - DNA, 25 bp, Mus musculus
atgggatgcccctctttataagctc

SEQ ID NO: 266409 - DNA, 25 bp, Mus musculus
atgggatggacacccgaccggccat

SEQ ID NO: 266410 - DNA, 25 bp, Mus musculus
atgggatggacagccgaccggccat

SEQ ID NO: 266411 - DNA, 25 bp, Mus musculus
atgggatggctaatcctaggactaa

SEQ ID NO: 266412 - DNA, 25 bp, Mus musculus
atgggatggctattcctaggactaa

SEQ ID NO: 266413 - DNA, 25 bp, Mus musculus
atgggatggctccattaagaccctc

SEQ ID NO: 266414 - DNA, 25 bp, Mus musculus
atgggatggctcgattaagaccctc

SEQ ID NO: 266415 - DNA, 25 bp, Mus musculus
atgggatggtccctaggccaggcct

SEQ ID NO: 266416 - DNA, 25 bp, Mus musculus
atgggatggtccgtaggccaggcct

SEQ ID NO: 266417 - DNA, 25 bp, Mus musculus
atgggatgtgctaagctgtggctca

SEQ ID NO: 266418 - DNA, 25 bp, Mus musculus
atgggatgtgcttagctgtggctca

SEQ ID NO: 266419 - DNA, 25 bp, Mus musculus
atgggattaaagatggtgtagaccg

SEQ ID NO: 266420 - DNA, 25 bp, Mus musculus
atgggattaaagttggtgtagaccg

SEQ ID NO: 266421 - DNA, 25 bp, Mus musculus
atgggattaactattttatcagact

SEQ ID NO: 266422 - DNA, 25 bp, Mus musculus
atgggattaacttttttatcagact

SEQ ID NO: 266423 - DNA, 25 bp, Mus musculus
atgggattcactccactcataggcc

SEQ ID NO: 266424 - DNA, 25 bp, Mus musculus
atgggattcactgcactcataggcc

SEQ ID NO: 266425 - DNA, 25 bp, Mus musculus
atgggattcaggcactgccactcag

SEQ ID NO: 266426 - DNA, 25 bp, Mus musculus
atgggattcagggactgccactcag

SEQ ID NO: 266427 - DNA, 25 bp, Mus musculus
atgggattcataagcttaactcagg

SEQ ID NO: 266428 - DNA, 25 bp, Mus musculus
atgggattcatatgcttaactcagg

SEQ ID NO: 266429 - DNA, 25 bp, Mus musculus
atgggattcatgaccgagcctatgt

SEQ ID NO: 266430 - DNA, 25 bp, Mus musculus
atgggattcatgtccgagcctatgt

SEQ ID NO: 266431 - DNA, 25 bp, Mus musculus
atgggattccatacactggttgtac

SEQ ID NO: 266432 - DNA, 25 bp, Mus musculus
atgggattccattcactggttgtac

SEQ ID NO: 266433 - DNA, 25 bp, Mus musculus
atgggattccctacagtgaacacag

SEQ ID NO: 266434 - DNA, 25 bp, Mus musculus
atgggattcccttcagtgaacacag

SEQ ID NO: 266435 - DNA, 25 bp, Mus musculus
atgggattcctgcaaagttcatgtg

SEQ ID NO: 266436 - DNA, 25 bp, Mus musculus
atgggattcctggaaagttcatgtg

SEQ ID NO: 266437 - DNA, 25 bp, Mus musculus
atgggattcggcaccatctctcgag

SEQ ID NO: 266438 - DNA, 25 bp, Mus musculus
atgggattcggctccatctctcgag

SEQ ID NO: 266439 - DNA, 25 bp, Mus musculus
atgggattctctccagctatgttgc

SEQ ID NO: 266440 - DNA, 25 bp, Mus musculus
atgggattctctgcagctatgttgc

SEQ ID NO: 266441 - DNA, 25 bp, Mus musculus
atgggattctgcagggttcgcagcc

SEQ ID NO: 266442 - DNA, 25 bp, Mus musculus
atgggattctgctgggttcgcagcc

SEQ ID NO: 266443 - DNA, 25 bp, Mus musculus
atgggattggcacccttagtccaca

SEQ ID NO: 266444 - DNA, 25 bp, Mus musculus
atgggattggcagccttagtccaca

SEQ ID NO: 266445 - DNA, 25 bp, Mus musculus
atgggattggttccctcttttggtg

SEQ ID NO: 266446 - DNA, 25 bp, Mus musculus
atgggattggttgcctcttttggtg

SEQ ID NO: 266447 - DNA, 25 bp, Mus musculus
atgggatttactagttgggctttga

SEQ ID NO: 266448 - DNA, 25 bp, Mus musculus
atgggatttacttgttgggctttga

SEQ ID NO: 266449 - DNA, 25 bp, Mus musculus
atgggatttcaccaggatccaccta

SEQ ID NO: 266450 - DNA, 25 bp, Mus musculus
atgggatttcacgaggatccaccta

SEQ ID NO: 266451 - DNA, 25 bp, Mus musculus
atgggcaaacaacgctcccgacaac

SEQ ID NO: 266452 - DNA, 25 bp, Mus musculus
atgggcaaacaaggctcccgacaac

SEQ ID NO: 266453 - DNA, 25 bp, Mus musculus
atgggcaacaatccagtctcgccct

SEQ ID NO: 266454 - DNA, 25 bp, Mus musculus
atgggcaacaatgcagtctcgccct

SEQ ID NO: 266455 - DNA, 25 bp, Mus musculus
atgggcaacatgaccgacatacaca

SEQ ID NO: 266456 - DNA, 25 bp, Mus musculus
atgggcaacatgtccgacatacaca

SEQ ID NO: 266457 - DNA, 25 bp, Mus musculus
atgggcaaccctactgctcttgttg

SEQ ID NO: 266458 - DNA, 25 bp, Mus musculus
atgggcaaccctctaacttctccat

SEQ ID NO: 266459 - DNA, 25 bp, Mus musculus
atgggcaaccctgtaacttctccat

SEQ ID NO: 266460 - DNA, 25 bp, Mus musculus
atgggcaacccttctgctcttgttg

SEQ ID NO: 266461 - DNA, 25 bp, Mus musculus
atgggcaaccttctggagtaagtgt

SEQ ID NO: 266462 - DNA, 25 bp, Mus musculus
atgggcaaccttgtggagtaagtgt

SEQ ID NO: 266463 - DNA, 25 bp, Mus musculus
atgggcaacttaaaaagatcctctc

SEQ ID NO: 266464 - DNA, 25 bp, Mus musculus
atgggcaacttataaagatcctctc

SEQ ID NO: 266465 - DNA, 25 bp, Mus musculus
atgggcaagagcctcttctggcttc

SEQ ID NO: 266466 - DNA, 25 bp, Mus musculus
atgggcaagagcgtcttctggcttc

SEQ ID NO: 266467 - DNA, 25 bp, Mus musculus
atgggcaagcatcaggagctcacaa

SEQ ID NO: 266468 - DNA, 25 bp, Mus musculus
atgggcaagcatgaggagctcacaa

SEQ ID NO: 266469 - DNA, 25 bp, Mus musculus
atgggcaagccaatgagtggatctt

SEQ ID NO: 266470 - DNA, 25 bp, Mus musculus
atgggcaagccattgagtggatctt

SEQ ID NO: 266471 - DNA, 25 bp, Mus musculus
atgggcaaggacctcttcagcacag

SEQ ID NO: 266472 - DNA, 25 bp, Mus musculus
atgggcaaggacgtcttcagcacag

SEQ ID NO: 266473 - DNA, 25 bp, Mus musculus
atgggcaatgttcagagggtctctc

SEQ ID NO: 266474 - DNA, 25 bp, Mus musculus
atgggcaatgttgagagggtctctc

SEQ ID NO: 266475 - DNA, 25 bp, Mus musculus
atgggcacactcatgacatttttaa

SEQ ID NO: 266476 - DNA, 25 bp, Mus musculus
atgggcacactcttgacatttttaa

SEQ ID NO: 266477 - DNA, 25 bp, Mus musculus
atgggcacatgcaatacctcacatg

SEQ ID NO: 266478 - DNA, 25 bp, Mus musculus
atgggcacatgctatacctcacatg

SEQ ID NO: 266479 - DNA, 25 bp, Mus musculus
atgggcaccagaagcagggccctga

SEQ ID NO: 266480 - DNA, 25 bp, Mus musculus
atgggcaccagatgcagggccctga

SEQ ID NO: 266481 - DNA, 25 bp, Mus musculus
atgggcaccatcactgccattattt

SEQ ID NO: 266482 - DNA, 25 bp, Mus musculus
atgggcaccatctctgccattattt

SEQ ID NO: 266483 - DNA, 25 bp, Mus musculus
atgggcacccagctatgcacaaggc

SEQ ID NO: 266484 - DNA, 25 bp, Mus musculus
atgggcacccaggtatgcacaaggc

SEQ ID NO: 266485 - DNA, 25 bp, Mus musculus
atgggcaccccgagttgcaatcggc

SEQ ID NO: 266486 - DNA, 25 bp, Mus musculus
atgggcaccccgtgttgcaatcggc

SEQ ID NO: 266487 - DNA, 25 bp, Mus musculus
atgggcacccgccaaaaggcctggg

SEQ ID NO: 266488 - DNA, 25 bp, Mus musculus
atgggcacccgcgaaaaggcctggg

SEQ ID NO: 266489 - DNA, 25 bp, Mus musculus
atgggcacccttagccataaagcct

SEQ ID NO: 266490 - DNA, 25 bp, Mus musculus
atgggcaccctttgccataaagcct

SEQ ID NO: 266491 - DNA, 25 bp, Mus musculus
atgggcacctgtcgccttatgagtg

SEQ ID NO: 266492 - DNA, 25 bp, Mus musculus
atgggcacctgtggccttatgagtg

SEQ ID NO: 266493 - DNA, 25 bp, Mus musculus
atgggcacggaaactgtttgcaagt

SEQ ID NO: 266494 - DNA, 25 bp, Mus musculus
atgggcacggaatctgtttgcaagt

SEQ ID NO: 266495 - DNA, 25 bp, Mus musculus
atgggcactaagactgaagctttat

SEQ ID NO: 266496 - DNA, 25 bp, Mus musculus
atgggcactaagtctgaagctttat

SEQ ID NO: 266497 - DNA, 25 bp, Mus musculus
atgggcactacccttgatttatggg

SEQ ID NO: 266498 - DNA, 25 bp, Mus musculus
atgggcactaccgttgatttatggg

SEQ ID NO: 266499 - DNA, 25 bp, Mus musculus
atgggcactactataggactccggc

SEQ ID NO: 266500 - DNA, 25 bp, Mus musculus
atgggcactactttaggactccggc

SEQ ID NO: 266501 - DNA, 25 bp, Mus musculus
atgggcactcagacaaggctgcctg

SEQ ID NO: 266502 - DNA, 25 bp, Mus musculus
atgggcactcagtcaaggctgcctg

SEQ ID NO: 266503 - DNA, 25 bp, Mus musculus
atgggcactgagacaatgcccctgg

SEQ ID NO: 266504 - DNA, 25 bp, Mus musculus
atgggcactgagtcaatgcccctgg

SEQ ID NO: 266505 - DNA, 25 bp, Mus musculus
atgggcactgccagaaaggtccacg

SEQ ID NO: 266506 - DNA, 25 bp, Mus musculus
atgggcactgcctgaaaggtccacg

SEQ ID NO: 266507 - DNA, 25 bp, Mus musculus
atgggcactggcacagggtccatga

SEQ ID NO: 266508 - DNA, 25 bp, Mus musculus
atgggcactggctcagggtccatga

SEQ ID NO: 266509 - DNA, 25 bp, Mus musculus
atgggcacttctacatttgtctgaa

SEQ ID NO: 266510 - DNA, 25 bp, Mus musculus
atgggcacttctctgtacccgggct

SEQ ID NO: 266511 - DNA, 25 bp, Mus musculus
atgggcacttctgtgtacccgggct

SEQ ID NO: 266512 - DNA, 25 bp, Mus musculus
atgggcacttcttcatttgtctgaa

SEQ ID NO: 266513 - DNA, 25 bp, Mus musculus
atgggcagaacaacagtggctcctt

SEQ ID NO: 266514 - DNA, 25 bp, Mus musculus
atgggcagaacatcagtggctcctt

SEQ ID NO: 266515 - DNA, 25 bp, Mus musculus
atgggcagaacgagcatcctgtctt

SEQ ID NO: 266516 - DNA, 25 bp, Mus musculus
atgggcagaacgtgcatcctgtctt

SEQ ID NO: 266517 - DNA, 25 bp, Mus musculus
atgggcagacttacctcaacaccat

SEQ ID NO: 266518 - DNA, 25 bp, Mus musculus
atgggcagactttcctcaacaccat

SEQ ID NO: 266519 - DNA, 25 bp, Mus musculus
atgggcagagaaccttttcccacca

SEQ ID NO: 266520 - DNA, 25 bp, Mus musculus
atgggcagagaagcttttcccacca

SEQ ID NO: 266521 - DNA, 25 bp, Mus musculus
atgggcagagctagggtgctatccc

SEQ ID NO: 266522 - DNA, 25 bp, Mus musculus
atgggcagagcttgggtgctatccc

SEQ ID NO: 266523 - DNA, 25 bp, Mus musculus
atgggcagaggcacttcggcttcca

SEQ ID NO: 266524 - DNA, 25 bp, Mus musculus
atgggcagaggctcttcggcttcca

SEQ ID NO: 266525 - DNA, 25 bp, Mus musculus
atgggcagatccctccagaggcccg

SEQ ID NO: 266526 - DNA, 25 bp, Mus musculus
atgggcagatccgtccagaggcccg

SEQ ID NO: 266527 - DNA, 25 bp, Mus musculus
atgggcagcactatttctggtcagc

SEQ ID NO: 266528 - DNA, 25 bp, Mus musculus
atgggcagcactttttctggtcagc

SEQ ID NO: 266529 - DNA, 25 bp, Mus musculus
atgggcaggactaattgggctcaat

SEQ ID NO: 266530 - DNA, 25 bp, Mus musculus
atgggcaggacttattgggctcaat

SEQ ID NO: 266531 - DNA, 25 bp, Mus musculus
atgggcaggcctcgcttaggcaaca

SEQ ID NO: 266532 - DNA, 25 bp, Mus musculus
atgggcaggcctggcttaggcaaca

SEQ ID NO: 266533 - DNA, 25 bp, Mus musculus
atgggcagtactacattcagtgttc

SEQ ID NO: 266534 - DNA, 25 bp, Mus musculus
atgggcagtacttcattcagtgttc

SEQ ID NO: 266535 - DNA, 25 bp, Mus musculus
atgggcagtccaagttgtctcaagg

SEQ ID NO: 266536 - DNA, 25 bp, Mus musculus
atgggcagtccatgttgtctcaagg

SEQ ID NO: 266537 - DNA, 25 bp, Mus musculus
atgggcagtcctactgctgtgagca

SEQ ID NO: 266538 - DNA, 25 bp, Mus musculus
atgggcagtccttctgctgtgagca

SEQ ID NO: 266539 - DNA, 25 bp, Mus musculus
atgggcagtgtacttctgttatcac

SEQ ID NO: 266540 - DNA, 25 bp, Mus musculus
atgggcagtgtagttctgttatcac

SEQ ID NO: 266541 - DNA, 25 bp, Mus musculus
atgggcagttacatgcatacttcaa

SEQ ID NO: 266542 - DNA, 25 bp, Mus musculus
atgggcagttacttgcatacttcaa

SEQ ID NO: 266543 - DNA, 25 bp, Mus musculus
atgggcagttgcaggctacacacaa

SEQ ID NO: 266544 - DNA, 25 bp, Mus musculus
atgggcagttgctggctacacacaa

SEQ ID NO: 266545 - DNA, 25 bp, Mus musculus
atgggcagtttcaagcatcctttac

SEQ ID NO: 266546 - DNA, 25 bp, Mus musculus
atgggcagtttctagcatcctttac

SEQ ID NO: 266547 - DNA, 25 bp, Mus musculus
atgggcataagactagtacctagct

SEQ ID NO: 266548 - DNA, 25 bp, Mus musculus
atgggcataagagtagtacctagct

SEQ ID NO: 266549 - DNA, 25 bp, Mus musculus
atgggcatacccagttctgaaggca

SEQ ID NO: 266550 - DNA, 25 bp, Mus musculus
atgggcataccctgttctgaaggca

SEQ ID NO: 266551 - DNA, 25 bp, Mus musculus
atgggcatatatctgccactgtgca

SEQ ID NO: 266552 - DNA, 25 bp, Mus musculus
atgggcatatatgtgccactgtgca

SEQ ID NO: 266553 - DNA, 25 bp, Mus musculus
atgggcatatttaaccttacaattg

SEQ ID NO: 266554 - DNA, 25 bp, Mus musculus
atgggcatattttaccttacaattg

SEQ ID NO: 266555 - DNA, 25 bp, Mus musculus
atgggcatcaagactcacagaattt

SEQ ID NO: 266556 - DNA, 25 bp, Mus musculus
atgggcatcaagtctcacagaattt

SEQ ID NO: 266557 - DNA, 25 bp, Mus musculus
atgggcatcacaatgtctgcttcct

SEQ ID NO: 266558 - DNA, 25 bp, Mus musculus
atgggcatcacattgtctgcttcct

SEQ ID NO: 266559 - DNA, 25 bp, Mus musculus
atgggcatccctagagcacaataag

SEQ ID NO: 266560 - DNA, 25 bp, Mus musculus
atgggcatcccttgagcacaataag

SEQ ID NO: 266561 - DNA, 25 bp, Mus musculus
atgggcatcttgacttcttactgaa

SEQ ID NO: 266562 - DNA, 25 bp, Mus musculus
atgggcatcttgtcttcttactgaa

SEQ ID NO: 266563 - DNA, 25 bp, Mus musculus
atgggcatgagtataggtatctgac

SEQ ID NO: 266564 - DNA, 25 bp, Mus musculus
atgggcatgagtttaggtatctgac

SEQ ID NO: 266565 - DNA, 25 bp, Mus musculus
atgggcatgcctaacttgaaagtct

SEQ ID NO: 266566 - DNA, 25 bp, Mus musculus
atgggcatgccttacttgaaagtct

SEQ ID NO: 266567 - DNA, 25 bp, Mus musculus
atgggcatgctacagcccttcagaa

SEQ ID NO: 266568 - DNA, 25 bp, Mus musculus
atgggcatgctagagcccttcagaa

SEQ ID NO: 266569 - DNA, 25 bp, Mus musculus
atgggcatggacagacttccactca

SEQ ID NO: 266570 - DNA, 25 bp, Mus musculus
atgggcatggactgacttccactca

SEQ ID NO: 266571 - DNA, 25 bp, Mus musculus
atgggcatggctcgcccatagtgtt

SEQ ID NO: 266572 - DNA, 25 bp, Mus musculus
atgggcatggctggcccatagtgtt

SEQ ID NO: 266573 - DNA, 25 bp, Mus musculus
atgggcatgggccacctgctcaatg

SEQ ID NO: 266574 - DNA, 25 bp, Mus musculus
atgggcatgggcgacctgctcaatg

SEQ ID NO: 266575 - DNA, 25 bp, Mus musculus
atgggcatggtgctcagtccgccaa

SEQ ID NO: 266576 - DNA, 25 bp, Mus musculus
atgggcatggtggtcagtccgccaa

SEQ ID NO: 266577 - DNA, 25 bp, Mus musculus
atgggcattatcacatcagacttat

SEQ ID NO: 266578 - DNA, 25 bp, Mus musculus
atgggcattatctcatcagacttat

SEQ ID NO: 266579 - DNA, 25 bp, Mus musculus
atgggcattcagacatgtgcttcgt

SEQ ID NO: 266580 - DNA, 25 bp, Mus musculus
atgggcattcagatctcagcagagt

SEQ ID NO: 266581 - DNA, 25 bp, Mus musculus
atgggcattcagtcatgtgcttcgt

SEQ ID NO: 266582 - DNA, 25 bp, Mus musculus
atgggcattcagttctcagcagagt

SEQ ID NO: 266583 - DNA, 25 bp, Mus musculus
atgggcattcgactttggccatctt

SEQ ID NO: 266584 - DNA, 25 bp, Mus musculus
atgggcattcgagtttggccatctt

SEQ ID NO: 266585 - DNA, 25 bp, Mus musculus
atgggcattctgcacgaggcactgt

SEQ ID NO: 266586 - DNA, 25 bp, Mus musculus
atgggcattctggacgaggcactgt

SEQ ID NO: 266587 - DNA, 25 bp, Mus musculus
atgggcatttagacctttgttagta

SEQ ID NO: 266588 - DNA, 25 bp, Mus musculus
atgggcatttagtcctttgttagta

SEQ ID NO: 266589 - DNA, 25 bp, Mus musculus
atgggccaacatatgtgacaactgt

SEQ ID NO: 266590 - DNA, 25 bp, Mus musculus
atgggccaacatttgtgacaactgt

SEQ ID NO: 266591 - DNA, 25 bp, Mus musculus
atgggccaaccaaactctgctaaat

SEQ ID NO: 266592 - DNA, 25 bp, Mus musculus
atgggccaaccatactctgctaaat

SEQ ID NO: 266593 - DNA, 25 bp, Mus musculus
atgggccaactacagcagtaaacaa

SEQ ID NO: 266594 - DNA, 25 bp, Mus musculus
atgggccaactagagcagtaaacaa

SEQ ID NO: 266595 - DNA, 25 bp, Mus musculus
atgggccaactcacaaaacaattta

SEQ ID NO: 266596 - DNA, 25 bp, Mus musculus
atgggccaactctcaaaacaattta

SEQ ID NO: 266597 - DNA, 25 bp, Mus musculus
atgggccaagaaaatattaaagtgt

SEQ ID NO: 266598 - DNA, 25 bp, Mus musculus
atgggccaagaatatattaaagtgt

SEQ ID NO: 266599 - DNA, 25 bp, Mus musculus
atgggccaaggaaacccactgggta

SEQ ID NO: 266600 - DNA, 25 bp, Mus musculus
atgggccaaggatacccactgggta

SEQ ID NO: 266601 - DNA, 25 bp, Mus musculus
atgggccaatgtccctggagcagtc

SEQ ID NO: 266602 - DNA, 25 bp, Mus musculus
atgggccaatgtgcctggagcagtc

SEQ ID NO: 266603 - DNA, 25 bp, Mus musculus
atgggccaccacaaccagtttatgt

SEQ ID NO: 266604 - DNA, 25 bp, Mus musculus
atgggccaccactaccagtttatgt

SEQ ID NO: 266605 - DNA, 25 bp, Mus musculus
atgggccaccagatacaggagtgca

SEQ ID NO: 266606 - DNA, 25 bp, Mus musculus
atgggccaccagttacaggagtgca

SEQ ID NO: 266607 - DNA, 25 bp, Mus musculus
atgggccacccactgacctgagtga

SEQ ID NO: 266608 - DNA, 25 bp, Mus musculus
atgggccacccagtgacctgagtga

SEQ ID NO: 266609 - DNA, 25 bp, Mus musculus
atgggccacctgctaaggacggcaa

SEQ ID NO: 266610 - DNA, 25 bp, Mus musculus
atgggccacctggtaaggacggcaa

SEQ ID NO: 266611 - DNA, 25 bp, Mus musculus
atgggccacggtcttttgtgacaga

SEQ ID NO: 266612 - DNA, 25 bp, Mus musculus
atgggccacggtgttttgtgacaga

SEQ ID NO: 266613 - DNA, 25 bp, Mus musculus
atgggccagagaccctgttttattg

SEQ ID NO: 266614 - DNA, 25 bp, Mus musculus
atgggccagagagcctgttttattg

SEQ ID NO: 266615 - DNA, 25 bp, Mus musculus
atgggccagagtcgtcctttggttc

SEQ ID NO: 266616 - DNA, 25 bp, Mus musculus
atgggccagagtggtcctttggttc

SEQ ID NO: 266617 - DNA, 25 bp, Mus musculus
atgggccagccaatacactctaggg

SEQ ID NO: 266618 - DNA, 25 bp, Mus musculus
atgggccagccattacactctaggg

SEQ ID NO: 266619 - DNA, 25 bp, Mus musculus
atgggccaggagcatcccctggata

SEQ ID NO: 266620 - DNA, 25 bp, Mus musculus
atgggccaggaggatcccctggata

SEQ ID NO: 266621 - DNA, 25 bp, Mus musculus
atgggccaggctctcttcacgagga

SEQ ID NO: 266622 - DNA, 25 bp, Mus musculus
atgggccaggctgtcttcacgagga

SEQ ID NO: 266623 - DNA, 25 bp, Mus musculus
atgggccagggcattgaccgacact

SEQ ID NO: 266624 - DNA, 25 bp, Mus musculus
atgggccagggctttgaccgacact

SEQ ID NO: 266625 - DNA, 25 bp, Mus musculus
atgggccagtcactgttgagtcctt

SEQ ID NO: 266626 - DNA, 25 bp, Mus musculus
atgggccagtcagtgttgagtcctt

SEQ ID NO: 266627 - DNA, 25 bp, Mus musculus
atgggccagtggcttaacatttcac

SEQ ID NO: 266628 - DNA, 25 bp, Mus musculus
atgggccagtgggttaacatttcac

SEQ ID NO: 266629 - DNA, 25 bp, Mus musculus
atgggccatctgacatttgtgtgct

SEQ ID NO: 266630 - DNA, 25 bp, Mus musculus
atgggccatctgtcatttgtgtgct

SEQ ID NO: 266631 - DNA, 25 bp, Mus musculus
atgggccatcttcttttcagtgagg

SEQ ID NO: 266632 - DNA, 25 bp, Mus musculus
atgggccatcttgttttcagtgagg

SEQ ID NO: 266633 - DNA, 25 bp, Mus musculus
atgggcccacgactgtctctgagaa

SEQ ID NO: 266634 - DNA, 25 bp, Mus musculus
atgggcccacgagtgtctctgagaa

SEQ ID NO: 266635 - DNA, 25 bp, Mus musculus
atgggcccacgcacaagtcaagaga

SEQ ID NO: 266636 - DNA, 25 bp, Mus musculus
atgggcccacgctcaagtcaagaga

SEQ ID NO: 266637 - DNA, 25 bp, Mus musculus
atgggcccacgtacctcagtacaag

SEQ ID NO: 266638 - DNA, 25 bp, Mus musculus
atgggcccacgttcctcagtacaag

SEQ ID NO: 266639 - DNA, 25 bp, Mus musculus
atgggcccaggaacaagttatccat

SEQ ID NO: 266640 - DNA, 25 bp, Mus musculus
atgggcccaggatcaagttatccat

SEQ ID NO: 266641 - DNA, 25 bp, Mus musculus
atgggcccattcaggttcccataag

SEQ ID NO: 266642 - DNA, 25 bp, Mus musculus
atgggcccattctggttcccataag

SEQ ID NO: 266643 - DNA, 25 bp, Mus musculus
atgggccccaaaataactgccagag

SEQ ID NO: 266644 - DNA, 25 bp, Mus musculus
atgggccccaaattaactgccagag

SEQ ID NO: 266645 - DNA, 25 bp, Mus musculus
atgggccccatgactaggaatcctg

SEQ ID NO: 266646 - DNA, 25 bp, Mus musculus
atgggccccatgtctaggaatcctg

SEQ ID NO: 266647 - DNA, 25 bp, Mus musculus
atgggcccctgacatactctccagg

SEQ ID NO: 266648 - DNA, 25 bp, Mus musculus
atgggcccctgagatactctccagg

SEQ ID NO: 266649 - DNA, 25 bp, Mus musculus
atgggcccgtgcactgaatactcag

SEQ ID NO: 266650 - DNA, 25 bp, Mus musculus
atgggcccgtgctctgaatactcag

SEQ ID NO: 266651 - DNA, 25 bp, Mus musculus
atgggccctaaactcctggcggaga

SEQ ID NO: 266652 - DNA, 25 bp, Mus musculus
atgggccctaaagtcctggcggaga

SEQ ID NO: 266653 - DNA, 25 bp, Mus musculus
atgggccctactagaatttctctga

SEQ ID NO: 266654 - DNA, 25 bp, Mus musculus
atgggccctacttgaatttctctga

SEQ ID NO: 266655 - DNA, 25 bp, Mus musculus
atgggccctatcatacgtgcaaata

SEQ ID NO: 266656 - DNA, 25 bp, Mus musculus
atgggccctatcttacgtgcaaata

SEQ ID NO: 266657 - DNA, 25 bp, Mus musculus
atgggcccttatatgagatctacac

SEQ ID NO: 266658 - DNA, 25 bp, Mus musculus
atgggcccttatttgagatctacac

SEQ ID NO: 266659 - DNA, 25 bp, Mus musculus
atgggccgaatgaagctgttgcaac

SEQ ID NO: 266660 - DNA, 25 bp, Mus musculus
atgggccgaatgtagctgttgcaac

SEQ ID NO: 266661 - DNA, 25 bp, Mus musculus
atgggccgagcccacgcctttagca

SEQ ID NO: 266662 - DNA, 25 bp, Mus musculus
atgggccgagccgacgcctttagca

SEQ ID NO: 266663 - DNA, 25 bp, Mus musculus
atgggccgattcaacaaggccatgt

SEQ ID NO: 266664 - DNA, 25 bp, Mus musculus
atgggccgattctacaaggccatgt

SEQ ID NO: 266665 - DNA, 25 bp, Mus musculus
atgggccgatttaggagttcctaca

SEQ ID NO: 266666 - DNA, 25 bp, Mus musculus
atgggccgattttggagttcctaca

SEQ ID NO: 266667 - DNA, 25 bp, Mus musculus
atgggccgctcactctttcaggact

SEQ ID NO: 266668 - DNA, 25 bp, Mus musculus
atgggccgctcagtctttcaggact

SEQ ID NO: 266669 - DNA, 25 bp, Mus musculus
atgggccgtcggaccctgaacctgg

SEQ ID NO: 266670 - DNA, 25 bp, Mus musculus
atgggccgtcggtccctgaacctgg

SEQ ID NO: 266671 - DNA, 25 bp, Mus musculus
atgggcctaacgacctctgagctgc

SEQ ID NO: 266672 - DNA, 25 bp, Mus musculus
atgggcctaacgtcctctgagctgc

SEQ ID NO: 266673 - DNA, 25 bp, Mus musculus
atgggcctcaaactgtgatcttcct

SEQ ID NO: 266674 - DNA, 25 bp, Mus musculus
atgggcctcaaagtgtgatcttcct

SEQ ID NO: 266675 - DNA, 25 bp, Mus musculus
atgggcctcaccagtcaggccaagg

SEQ ID NO: 266676 - DNA, 25 bp, Mus musculus
atgggcctcacctgtcaggccaagg

SEQ ID NO: 266677 - DNA, 25 bp, Mus musculus
atgggcctcactccagagtcctggc

SEQ ID NO: 266678 - DNA, 25 bp, Mus musculus
atgggcctcactgcagagtcctggc

SEQ ID NO: 266679 - DNA, 25 bp, Mus musculus
atgggcctcctgcactagacggaaa

SEQ ID NO: 266680 - DNA, 25 bp, Mus musculus
atgggcctcctggactagacggaaa

SEQ ID NO: 266681 - DNA, 25 bp, Mus musculus
atgggcctgaatactatgcagtgac

SEQ ID NO: 266682 - DNA, 25 bp, Mus musculus
atgggcctgaattctatgcagtgac

SEQ ID NO: 266683 - DNA, 25 bp, Mus musculus
atgggcctgattacccctggagtgt

SEQ ID NO: 266684 - DNA, 25 bp, Mus musculus
atgggcctgatttcccctggagtgt

SEQ ID NO: 266685 - DNA, 25 bp, Mus musculus
atgggcctgcacaatgttgccttca

SEQ ID NO: 266686 - DNA, 25 bp, Mus musculus
atgggcctgcactatgttgccttca

SEQ ID NO: 266687 - DNA, 25 bp, Mus musculus
atgggcctgcctacacctccaagta

SEQ ID NO: 266688 - DNA, 25 bp, Mus musculus
atgggcctgccttcacctccaagta

SEQ ID NO: 266689 - DNA, 25 bp, Mus musculus
atgggcctggatctttgccctgcct

SEQ ID NO: 266690 - DNA, 25 bp, Mus musculus
atgggcctggatgtttgccctgcct

SEQ ID NO: 266691 - DNA, 25 bp, Mus musculus
atgggcctggctaaccagacctttt

SEQ ID NO: 266692 - DNA, 25 bp, Mus musculus
atgggcctggcttaccagacctttt

SEQ ID NO: 266693 - DNA, 25 bp, Mus musculus
atgggcctgggcagcaaagcaactg

SEQ ID NO: 266694 - DNA, 25 bp, Mus musculus
atgggcctgggctgcaaagcaactg

SEQ ID NO: 266695 - DNA, 25 bp, Mus musculus
atgggcctgtgaacctctgcagaaa

SEQ ID NO: 266696 - DNA, 25 bp, Mus musculus
atgggcctgtgatcctctgcagaaa

SEQ ID NO: 266697 - DNA, 25 bp, Mus musculus
atgggcctgtgtattatttcatacc

SEQ ID NO: 266698 - DNA, 25 bp, Mus musculus
atgggcctgtgttttatttcatacc

SEQ ID NO: 266699 - DNA, 25 bp, Mus musculus
atgggccttaaaatccctgtagaag

SEQ ID NO: 266700 - DNA, 25 bp, Mus musculus
atgggccttaaattccctgtagaag

SEQ ID NO: 266701 - DNA, 25 bp, Mus musculus
atgggccttaggaactcttgtggtg

SEQ ID NO: 266702 - DNA, 25 bp, Mus musculus
atgggccttaggtactcttgtggtg

SEQ ID NO: 266703 - DNA, 25 bp, Mus musculus
atgggccttatgaggtagattttta

SEQ ID NO: 266704 - DNA, 25 bp, Mus musculus
atgggccttatgtggtagattttta

SEQ ID NO: 266705 - DNA, 25 bp, Mus musculus
atgggccttcctaatgagacctaat

SEQ ID NO: 266706 - DNA, 25 bp, Mus musculus
atgggccttcctacatggctgggaa

SEQ ID NO: 266707 - DNA, 25 bp, Mus musculus
atgggccttccttatgagacctaat

SEQ ID NO: 266708 - DNA, 25 bp, Mus musculus
atgggccttccttcatggctgggaa

SEQ ID NO: 266709 - DNA, 25 bp, Mus musculus
atgggcgagcacatacactacggcg

SEQ ID NO: 266710 - DNA, 25 bp, Mus musculus
atgggcgagcacttacactacggcg

SEQ ID NO: 266711 - DNA, 25 bp, Mus musculus
atgggcgagggcagaaactccttag

SEQ ID NO: 266712 - DNA, 25 bp, Mus musculus
atgggcgagggctgaaactccttag

SEQ ID NO: 266713 - DNA, 25 bp, Mus musculus
atgggcgagtagaatctgaaaataa

SEQ ID NO: 266714 - DNA, 25 bp, Mus musculus
atgggcgagtagtatctgaaaataa

SEQ ID NO: 266715 - DNA, 25 bp, Mus musculus
atgggcgatttcaccactttagagt

SEQ ID NO: 266716 - DNA, 25 bp, Mus musculus
atgggcgatttctccactttagagt

SEQ ID NO: 266717 - DNA, 25 bp, Mus musculus
atgggcgcaggccatttggtatctc

SEQ ID NO: 266718 - DNA, 25 bp, Mus musculus
atgggcgcaggcgatttggtatctc

SEQ ID NO: 266719 - DNA, 25 bp, Mus musculus
atgggcgccatgagtattctgcacg

SEQ ID NO: 266720 - DNA, 25 bp, Mus musculus
atgggcgccatgtgtattctgcacg

SEQ ID NO: 266721 - DNA, 25 bp, Mus musculus
atgggcgcggtcaaggatcatctgc

SEQ ID NO: 266722 - DNA, 25 bp, Mus musculus
atgggcgcggtctaggatcatctgc

SEQ ID NO: 266723 - DNA, 25 bp, Mus musculus
atgggcgctactagactgtggctgc

SEQ ID NO: 266724 - DNA, 25 bp, Mus musculus
atgggcgctacttgactgtggctgc

SEQ ID NO: 266725 - DNA, 25 bp, Mus musculus
atgggcgctcgcagaatggaaacag

SEQ ID NO: 266726 - DNA, 25 bp, Mus musculus
atgggcgctcgctgaatggaaacag

SEQ ID NO: 266727 - DNA, 25 bp, Mus musculus
atgggcggatgtacataggccacat

SEQ ID NO: 266728 - DNA, 25 bp, Mus musculus
atgggcggatgttcataggccacat

SEQ ID NO: 266729 - DNA, 25 bp, Mus musculus
atgggcggcctactggatctccaaa

SEQ ID NO: 266730 - DNA, 25 bp, Mus musculus
atgggcggcctagtggatctccaaa

SEQ ID NO: 266731 - DNA, 25 bp, Mus musculus
atgggcgggagcattactggacaca

SEQ ID NO: 266732 - DNA, 25 bp, Mus musculus
atgggcgggagctttactggacaca

SEQ ID NO: 266733 - DNA, 25 bp, Mus musculus
atgggcgtcacaacactgtctggta

SEQ ID NO: 266734 - DNA, 25 bp, Mus musculus
atgggcgtcacatcactgtctggta

SEQ ID NO: 266735 - DNA, 25 bp, Mus musculus
atgggcgtccacacaagccttgaac

SEQ ID NO: 266736 - DNA, 25 bp, Mus musculus
atgggcgtccactcaagccttgaac

SEQ ID NO: 266737 - DNA, 25 bp, Mus musculus
atgggcgtcgccagaggaaccagaa

SEQ ID NO: 266738 - DNA, 25 bp, Mus musculus
atgggcgtcgcctgaggaaccagaa

SEQ ID NO: 266739 - DNA, 25 bp, Mus musculus
atgggcgtgccaccttgtagctgat

SEQ ID NO: 266740 - DNA, 25 bp, Mus musculus
atgggcgtgccagcttgtagctgat

SEQ ID NO: 266741 - DNA, 25 bp, Mus musculus
atgggcgtgtgcaatgccagtaccg

SEQ ID NO: 266742 - DNA, 25 bp, Mus musculus
atgggcgtgtgctatgccagtaccg

SEQ ID NO: 266743 - DNA, 25 bp, Mus musculus
atgggcgttcctatgcctaagcctt

SEQ ID NO: 266744 - DNA, 25 bp, Mus musculus
atgggcgttcctttgcctaagcctt

SEQ ID NO: 266745 - DNA, 25 bp, Mus musculus
atgggcgtttgtcgtattgttcctt

SEQ ID NO: 266746 - DNA, 25 bp, Mus musculus
atgggcgtttgtggtattgttcctt

SEQ ID NO: 266747 - DNA, 25 bp, Mus musculus
atgggcgttttcagcaatgcaccaa

SEQ ID NO: 266748 - DNA, 25 bp, Mus musculus
atgggcgttttctgcaatgcaccaa

SEQ ID NO: 266749 - DNA, 25 bp, Mus musculus
atgggctaaataagcttgattcaag

SEQ ID NO: 266750 - DNA, 25 bp, Mus musculus
atgggctaaatatgcttgattcaag

SEQ ID NO: 266751 - DNA, 25 bp, Mus musculus
atgggctaacgcaggacttgtgact

SEQ ID NO: 266752 - DNA, 25 bp, Mus musculus
atgggctaacgctggacttgtgact

SEQ ID NO: 266753 - DNA, 25 bp, Mus musculus
atgggctaagacacaagttgagttc

SEQ ID NO: 266754 - DNA, 25 bp, Mus musculus
atgggctaagactcaagttgagttc

SEQ ID NO: 266755 - DNA, 25 bp, Mus musculus
atgggctacacactgtgctcattca

SEQ ID NO: 266756 - DNA, 25 bp, Mus musculus
atgggctacacagtgtgctcattca

SEQ ID NO: 266757 - DNA, 25 bp, Mus musculus
atgggctactggactaccagggcaa

SEQ ID NO: 266758 - DNA, 25 bp, Mus musculus
atgggctactggtctaccagggcaa

SEQ ID NO: 266759 - DNA, 25 bp, Mus musculus
atgggctactttctcttgctcagtt

SEQ ID NO: 266760 - DNA, 25 bp, Mus musculus
atgggctactttgtcttgctcagtt

SEQ ID NO: 266761 - DNA, 25 bp, Mus musculus
atgggctagaggagagacctttgca

SEQ ID NO: 266762 - DNA, 25 bp, Mus musculus
atgggctagaggtgagacctttgca

SEQ ID NO: 266763 - DNA, 25 bp, Mus musculus
atgggctataggaagagtgtacccc

SEQ ID NO: 266764 - DNA, 25 bp, Mus musculus
atgggctataggtagagtgtacccc

SEQ ID NO: 266765 - DNA, 25 bp, Mus musculus
atgggctatctcaagttgcataact

SEQ ID NO: 266766 - DNA, 25 bp, Mus musculus
atgggctatctctagttgcataact

SEQ ID NO: 266767 - DNA, 25 bp, Mus musculus
atgggctatctgagctccgcctgaa

SEQ ID NO: 266768 - DNA, 25 bp, Mus musculus
atgggctatctgtgctccgcctgaa

SEQ ID NO: 266769 - DNA, 25 bp, Mus musculus
atgggctatttgaaggtctgttttc

SEQ ID NO: 266770 - DNA, 25 bp, Mus musculus
atgggctatttgtaggtctgttttc

SEQ ID NO: 266771 - DNA, 25 bp, Mus musculus
atgggctcaaagatgctcttctgtg

SEQ ID NO: 266772 - DNA, 25 bp, Mus musculus
atgggctcaaagttgctcttctgtg

SEQ ID NO: 266773 - DNA, 25 bp, Mus musculus
atgggctcaattacccctagagact

SEQ ID NO: 266774 - DNA, 25 bp, Mus musculus
atgggctcaatttcccctagagact

SEQ ID NO: 266775 - DNA, 25 bp, Mus musculus
atgggctcagctatttactaaatca

SEQ ID NO: 266776 - DNA, 25 bp, Mus musculus
atgggctcagctttttactaaatca

SEQ ID NO: 266777 - DNA, 25 bp, Mus musculus
atgggctcaggtccttatcccagga

SEQ ID NO: 266778 - DNA, 25 bp, Mus musculus
atgggctcaggtgcttatcccagga

SEQ ID NO: 266779 - DNA, 25 bp, Mus musculus
atgggctccaaacccaaggcctgaa

SEQ ID NO: 266780 - DNA, 25 bp, Mus musculus
atgggctccaaagccaaggcctgaa

SEQ ID NO: 266781 - DNA, 25 bp, Mus musculus
atgggctccaatcttctggaccagc

SEQ ID NO: 266782 - DNA, 25 bp, Mus musculus
atgggctccaatgttctggaccagc

SEQ ID NO: 266783 - DNA, 25 bp, Mus musculus
atgggctccacacgaattctgcgat

SEQ ID NO: 266784 - DNA, 25 bp, Mus musculus
atgggctccacaggaattctgcgat

SEQ ID NO: 266785 - DNA, 25 bp, Mus musculus
atgggctccatcaagctgtgaaggc

SEQ ID NO: 266786 - DNA, 25 bp, Mus musculus
atgggctccatctagctgtgaaggc

SEQ ID NO: 266787 - DNA, 25 bp, Mus musculus
atgggctcccaaatacatgtaatta

SEQ ID NO: 266788 - DNA, 25 bp, Mus musculus
atgggctcccaattacatgtaatta

SEQ ID NO: 266789 - DNA, 25 bp, Mus musculus
atgggctcccggaacatgatgggaa

SEQ ID NO: 266790 - DNA, 25 bp, Mus musculus
atgggctcccggaagaatccagacg

SEQ ID NO: 266791 - DNA, 25 bp, Mus musculus
atgggctcccggtacatgatgggaa

SEQ ID NO: 266792 - DNA, 25 bp, Mus musculus
atgggctcccggtagaatccagacg

SEQ ID NO: 266793 - DNA, 25 bp, Mus musculus
atgggctccctgaatgtatccgtga

SEQ ID NO: 266794 - DNA, 25 bp, Mus musculus
atgggctccctgtatgtatccgtga

SEQ ID NO: 266795 - DNA, 25 bp, Mus musculus
atgggctcctttctgaacaacatac

SEQ ID NO: 266796 - DNA, 25 bp, Mus musculus
atgggctcctttgtgaacaacatac

SEQ ID NO: 266797 - DNA, 25 bp, Mus musculus
atgggctcgcctcacgagatcacga

SEQ ID NO: 266798 - DNA, 25 bp, Mus musculus
atgggctcgcctgacgagatcacga

SEQ ID NO: 266799 - DNA, 25 bp, Mus musculus
atgggctctagccttcttgaagttg

SEQ ID NO: 266800 - DNA, 25 bp, Mus musculus
atgggctctagcgttcttgaagttg

SEQ ID NO: 266801 - DNA, 25 bp, Mus musculus
atgggctctgaaaccggaccaccaa

SEQ ID NO: 266802 - DNA, 25 bp, Mus musculus
atgggctctgaatccggaccaccaa

SEQ ID NO: 266803 - DNA, 25 bp, Mus musculus
atgggctctgtgagggaccctgtcc

SEQ ID NO: 266804 - DNA, 25 bp, Mus musculus
atgggctctgtgtgggaccctgtcc

SEQ ID NO: 266805 - DNA, 25 bp, Mus musculus
atgggctctgttctttgtgatgctc

SEQ ID NO: 266806 - DNA, 25 bp, Mus musculus
atgggctctgttgtttgtgatgctc

SEQ ID NO: 266807 - DNA, 25 bp, Mus musculus
atgggctctttcatacgtctgaagc

SEQ ID NO: 266808 - DNA, 25 bp, Mus musculus
atgggctctttcttacgtctgaagc

SEQ ID NO: 266809 - DNA, 25 bp, Mus musculus
atgggctgaccaactcagcgtggaa

SEQ ID NO: 266810 - DNA, 25 bp, Mus musculus
atgggctgaccatctcagcgtggaa

SEQ ID NO: 266811 - DNA, 25 bp, Mus musculus
atgggctgactcaaccagtggagaa

SEQ ID NO: 266812 - DNA, 25 bp, Mus musculus
atgggctgactctaccagtggagaa

SEQ ID NO: 266813 - DNA, 25 bp, Mus musculus
atgggctgagacacctcgaacagat

SEQ ID NO: 266814 - DNA, 25 bp, Mus musculus
atgggctgagactcctcgaacagat

SEQ ID NO: 266815 - DNA, 25 bp, Mus musculus
atgggctgagagctttgacgtcttc

SEQ ID NO: 266816 - DNA, 25 bp, Mus musculus
atgggctgagaggtttgacgtcttc

SEQ ID NO: 266817 - DNA, 25 bp, Mus musculus
atgggctgcaccatattgagatctg

SEQ ID NO: 266818 - DNA, 25 bp, Mus musculus
atgggctgcaccttattgagatctg

SEQ ID NO: 266819 - DNA, 25 bp, Mus musculus
atgggctgcactctctcagaaactg

SEQ ID NO: 266820 - DNA, 25 bp, Mus musculus
atgggctgcactgtctcagaaactg

SEQ ID NO: 266821 - DNA, 25 bp, Mus musculus
atgggctgcatcatcagccccaaag

SEQ ID NO: 266822 - DNA, 25 bp, Mus musculus
atgggctgcatcttcagccccaaag

SEQ ID NO: 266823 - DNA, 25 bp, Mus musculus
atgggctgccaaacttgaaaagaca

SEQ ID NO: 266824 - DNA, 25 bp, Mus musculus
atgggctgccaatcttgaaaagaca

SEQ ID NO: 266825 - DNA, 25 bp, Mus musculus
atgggctgcccacgcgatatcctgt

SEQ ID NO: 266826 - DNA, 25 bp, Mus musculus
atgggctgcccaggcgatatcctgt

SEQ ID NO: 266827 - DNA, 25 bp, Mus musculus
atgggctgccccaagtatcctgtga

SEQ ID NO: 266828 - DNA, 25 bp, Mus musculus
atgggctgcccctagtatcctgtga

SEQ ID NO: 266829 - DNA, 25 bp, Mus musculus
atgggctgctagactcttgcgggta

SEQ ID NO: 266830 - DNA, 25 bp, Mus musculus
atgggctgctagtctcttgcgggta

SEQ ID NO: 266831 - DNA, 25 bp, Mus musculus
atgggctgctggacacggagctcaa

SEQ ID NO: 266832 - DNA, 25 bp, Mus musculus
atgggctgctggcacatgtaccgtc

SEQ ID NO: 266833 - DNA, 25 bp, Mus musculus
atgggctgctgggacatgtaccgtc

SEQ ID NO: 266834 - DNA, 25 bp, Mus musculus
atgggctgctggtcacggagctcaa

SEQ ID NO: 266835 - DNA, 25 bp, Mus musculus
atgggctggaacatgggtctcattc

SEQ ID NO: 266836 - DNA, 25 bp, Mus musculus
atgggctggaacttgggtctcattc

SEQ ID NO: 266837 - DNA, 25 bp, Mus musculus
atgggctggacaagtagctcagtca

SEQ ID NO: 266838 - DNA, 25 bp, Mus musculus
atgggctggacatgtagctcagtca

SEQ ID NO: 266839 - DNA, 25 bp, Mus musculus
atgggctggaccaggatttttcagt

SEQ ID NO: 266840 - DNA, 25 bp, Mus musculus
atgggctggacctggatttttcagt

SEQ ID NO: 266841 - DNA, 25 bp, Mus musculus
atgggctggtcgaacctggtcttct

SEQ ID NO: 266842 - DNA, 25 bp, Mus musculus
atgggctggtcgtacctggtcttct

SEQ ID NO: 266843 - DNA, 25 bp, Mus musculus
atgggctgtaatctcgccaggaagc

SEQ ID NO: 266844 - DNA, 25 bp, Mus musculus
atgggctgtaatgtcgccaggaagc

SEQ ID NO: 266845 - DNA, 25 bp, Mus musculus
atgggctgtcgcagccgagctatca

SEQ ID NO: 266846 - DNA, 25 bp, Mus musculus
atgggctgtcgctgccgagctatca

SEQ ID NO: 266847 - DNA, 25 bp, Mus musculus
atgggctgtgacacacacctcagca

SEQ ID NO: 266848 - DNA, 25 bp, Mus musculus
atgggctgtgactcacacctcagca

SEQ ID NO: 266849 - DNA, 25 bp, Mus musculus
atgggctgtgttccgagtcacactc

SEQ ID NO: 266850 - DNA, 25 bp, Mus musculus
atgggctgtgttgcgagtcacactc

SEQ ID NO: 266851 - DNA, 25 bp, Mus musculus
atgggcttaaccaaggccacgtgtc

SEQ ID NO: 266852 - DNA, 25 bp, Mus musculus
atgggcttaacctaggccacgtgtc

SEQ ID NO: 266853 - DNA, 25 bp, Mus musculus
atgggcttagccactgctagggcac

SEQ ID NO: 266854 - DNA, 25 bp, Mus musculus
atgggcttagcctctgctagggcac

SEQ ID NO: 266855 - DNA, 25 bp, Mus musculus
atgggcttagctatctcctctggct

SEQ ID NO: 266856 - DNA, 25 bp, Mus musculus
atgggcttagctttctcctctggct

SEQ ID NO: 266857 - DNA, 25 bp, Mus musculus
atgggcttatttaccacatgtttaa

SEQ ID NO: 266858 - DNA, 25 bp, Mus musculus
atgggcttattttccacatgtttaa

SEQ ID NO: 266859 - DNA, 25 bp, Mus musculus
atgggcttcaacactttgtcactgg

SEQ ID NO: 266860 - DNA, 25 bp, Mus musculus
atgggcttcaactctttgtcactgg

SEQ ID NO: 266861 - DNA, 25 bp, Mus musculus
atgggcttccctccggtggatatct

SEQ ID NO: 266862 - DNA, 25 bp, Mus musculus
atgggcttccctgcggtggatatct

SEQ ID NO: 266863 - DNA, 25 bp, Mus musculus
atgggcttccggactgctgtgtgat

SEQ ID NO: 266864 - DNA, 25 bp, Mus musculus
atgggcttccggtctgctgtgtgat

SEQ ID NO: 266865 - DNA, 25 bp, Mus musculus
atgggcttcctgcatgaagtgtctc

SEQ ID NO: 266866 - DNA, 25 bp, Mus musculus
atgggcttcctggatgaagtgtctc

SEQ ID NO: 266867 - DNA, 25 bp, Mus musculus
atgggcttcttacttgctgctacat

SEQ ID NO: 266868 - DNA, 25 bp, Mus musculus
atgggcttcttagttgctgctacat

SEQ ID NO: 266869 - DNA, 25 bp, Mus musculus
atgggcttcttgcttccaggagttg

SEQ ID NO: 266870 - DNA, 25 bp, Mus musculus
atgggcttcttggttccaggagttg

SEQ ID NO: 266871 - DNA, 25 bp, Mus musculus
atgggcttctttcactgcctccgag

SEQ ID NO: 266872 - DNA, 25 bp, Mus musculus
atgggcttctttgactgcctccgag

SEQ ID NO: 266873 - DNA, 25 bp, Mus musculus
atgggcttgaatatgaccagatgag

SEQ ID NO: 266874 - DNA, 25 bp, Mus musculus
atgggcttgaatatggtataactac

SEQ ID NO: 266875 - DNA, 25 bp, Mus musculus
atgggcttgaatttgaccagatgag

SEQ ID NO: 266876 - DNA, 25 bp, Mus musculus
atgggcttgaatttggtataactac

SEQ ID NO: 266877 - DNA, 25 bp, Mus musculus
atgggcttgcacagaactcatggtt

SEQ ID NO: 266878 - DNA, 25 bp, Mus musculus
atgggcttgcactgaactcatggtt

SEQ ID NO: 266879 - DNA, 25 bp, Mus musculus
atgggcttgcagacaaaccaaccgg

SEQ ID NO: 266880 - DNA, 25 bp, Mus musculus
atgggcttgcagtcaaaccaaccgg

SEQ ID NO: 266881 - DNA, 25 bp, Mus musculus
atgggcttggaaactgtcacactgg

SEQ ID NO: 266882 - DNA, 25 bp, Mus musculus
atgggcttggaatctgtcacactgg

SEQ ID NO: 266883 - DNA, 25 bp, Mus musculus
atgggctttaacactggtggcagcc

SEQ ID NO: 266884 - DNA, 25 bp, Mus musculus
atgggctttaactctggtggcagcc

SEQ ID NO: 266885 - DNA, 25 bp, Mus musculus
atgggctttaatacttctcccttgc

SEQ ID NO: 266886 - DNA, 25 bp, Mus musculus
atgggctttaattcttctcccttgc

SEQ ID NO: 266887 - DNA, 25 bp, Mus musculus
atgggctttcagcactgtgtcctga

SEQ ID NO: 266888 - DNA, 25 bp, Mus musculus
atgggctttcaggactgtgtcctga

SEQ ID NO: 266889 - DNA, 25 bp, Mus musculus
atggggagtctgcacagttctgctt

SEQ ID NO: 266890 - DNA, 25 bp, Mus musculus
atggggagtctggacagttctgctt

SEQ ID NO: 266891 - DNA, 25 bp, Mus musculus
atggggccctatcccatgtggcaaa

SEQ ID NO: 266892 - DNA, 25 bp, Mus musculus
atggggccctatgccatgtggcaaa

SEQ ID NO: 266893 - DNA, 25 bp, Mus musculus
atgggggaatccagagctgctgcta

SEQ ID NO: 266894 - DNA, 25 bp, Mus musculus
atgggggaatcctgagctgctgcta

SEQ ID NO: 266895 - DNA, 25 bp, Mus musculus
atggggtcactaaacgcagagatga

SEQ ID NO: 266896 - DNA, 25 bp, Mus musculus
atggggtcactatacgcagagatga

SEQ ID NO: 266897 - DNA, 25 bp, Mus musculus
atgggtaaaagtcctgcctagggct

SEQ ID NO: 266898 - DNA, 25 bp, Mus musculus
atgggtaaaagtgctgcctagggct

SEQ ID NO: 266899 - DNA, 25 bp, Mus musculus
atgggtaaactgactgctggtatga

SEQ ID NO: 266900 - DNA, 25 bp, Mus musculus
atgggtaaactgtctgctggtatga

SEQ ID NO: 266901 - DNA, 25 bp, Mus musculus
atgggtaacagcactgccatgggcc

SEQ ID NO: 266902 - DNA, 25 bp, Mus musculus
atgggtaacagctctgccatgggcc

SEQ ID NO: 266903 - DNA, 25 bp, Mus musculus
atgggtaagaatatccgctcctact

SEQ ID NO: 266904 - DNA, 25 bp, Mus musculus
atgggtaagaatttccgctcctact

SEQ ID NO: 266905 - DNA, 25 bp, Mus musculus
atgggtaagtgcagtaccaccatat

SEQ ID NO: 266906 - DNA, 25 bp, Mus musculus
atgggtaagtgctgtaccaccatat

SEQ ID NO: 266907 - DNA, 25 bp, Mus musculus
atgggtaattcccatgctcactctc

SEQ ID NO: 266908 - DNA, 25 bp, Mus musculus
atgggtaattccgatgctcactctc

SEQ ID NO: 266909 - DNA, 25 bp, Mus musculus
atgggtacagaaagccttctcctgg

SEQ ID NO: 266910 - DNA, 25 bp, Mus musculus
atgggtacagaatgccttctcctgg

SEQ ID NO: 266911 - DNA, 25 bp, Mus musculus
atgggtacagccaaagaataaatct

SEQ ID NO: 266912 - DNA, 25 bp, Mus musculus
atgggtacagcctaagaataaatct

SEQ ID NO: 266913 - DNA, 25 bp, Mus musculus
atgggtacatgtcggcttctctggc

SEQ ID NO: 266914 - DNA, 25 bp, Mus musculus
atgggtacatgtgggcttctctggc

SEQ ID NO: 266915 - DNA, 25 bp, Mus musculus
atgggtaccccgaggctgataacac

SEQ ID NO: 266916 - DNA, 25 bp, Mus musculus
atgggtaccccgtggctgataacac

SEQ ID NO: 266917 - DNA, 25 bp, Mus musculus
atgggtacctggagctgtctgcaga

SEQ ID NO: 266918 - DNA, 25 bp, Mus musculus
atgggtacctggtgctgtctgcaga

SEQ ID NO: 266919 - DNA, 25 bp, Mus musculus
atgggtactcagaggcccttgtgtc

SEQ ID NO: 266920 - DNA, 25 bp, Mus musculus
atgggtactcagtggcccttgtgtc

SEQ ID NO: 266921 - DNA, 25 bp, Mus musculus
atgggtactgcgcatggccgttctc

SEQ ID NO: 266922 - DNA, 25 bp, Mus musculus
atgggtactgcggatggccgttctc

SEQ ID NO: 266923 - DNA, 25 bp, Mus musculus
atgggtactgtacgtcacacgcact

SEQ ID NO: 266924 - DNA, 25 bp, Mus musculus
atgggtactgtaggtcacacgcact

SEQ ID NO: 266925 - DNA, 25 bp, Mus musculus
atgggtacttgacctcagtggcaca

SEQ ID NO: 266926 - DNA, 25 bp, Mus musculus
atgggtacttgagctcagtggcaca

SEQ ID NO: 266927 - DNA, 25 bp, Mus musculus
atgggtagaaccacatggcttggtc

SEQ ID NO: 266928 - DNA, 25 bp, Mus musculus
atgggtagaacctcatggcttggtc

SEQ ID NO: 266929 - DNA, 25 bp, Mus musculus
atgggtagacctcaggaccactctc

SEQ ID NO: 266930 - DNA, 25 bp, Mus musculus
atgggtagacctgaggaccactctc

SEQ ID NO: 266931 - DNA, 25 bp, Mus musculus
atgggtagcctcctacagcctgagg

SEQ ID NO: 266932 - DNA, 25 bp, Mus musculus
atgggtagcctcgtacagcctgagg

SEQ ID NO: 266933 - DNA, 25 bp, Mus musculus
atgggtaggagccttgcactgcaca

SEQ ID NO: 266934 - DNA, 25 bp, Mus musculus
atgggtaggagcgttgcactgcaca

SEQ ID NO: 266935 - DNA, 25 bp, Mus musculus
atgggtaggcacaactggttcccct

SEQ ID NO: 266936 - DNA, 25 bp, Mus musculus
atgggtaggcactactggttcccct

SEQ ID NO: 266937 - DNA, 25 bp, Mus musculus
atgggtaggcgacggccagggtcca

SEQ ID NO: 266938 - DNA, 25 bp, Mus musculus
atgggtaggcgagggccagggtcca

SEQ ID NO: 266939 - DNA, 25 bp, Mus musculus
atgggtagtgatactgtgcttgtta

SEQ ID NO: 266940 - DNA, 25 bp, Mus musculus
atgggtagtgatagcctttctccgc

SEQ ID NO: 266941 - DNA, 25 bp, Mus musculus
atgggtagtgattctgtgcttgtta

SEQ ID NO: 266942 - DNA, 25 bp, Mus musculus
atgggtagtgattgcctttctccgc

SEQ ID NO: 266943 - DNA, 25 bp, Mus musculus
atgggtatactcaagaaggcagttc

SEQ ID NO: 266944 - DNA, 25 bp, Mus musculus
atgggtatactctagaaggcagttc

SEQ ID NO: 266945 - DNA, 25 bp, Mus musculus
atgggtatatgacgctatttcccac

SEQ ID NO: 266946 - DNA, 25 bp, Mus musculus
atgggtatatgaggctatttcccac

SEQ ID NO: 266947 - DNA, 25 bp, Mus musculus
atgggtatcaacacttacggcagcc

SEQ ID NO: 266948 - DNA, 25 bp, Mus musculus
atgggtatcaactcttacggcagcc

SEQ ID NO: 266949 - DNA, 25 bp, Mus musculus
atgggtatccggagtggcattgctc

SEQ ID NO: 266950 - DNA, 25 bp, Mus musculus
atgggtatccggtgtggcattgctc

SEQ ID NO: 266951 - DNA, 25 bp, Mus musculus
atgggtatcttgctatgtatctgat

SEQ ID NO: 266952 - DNA, 25 bp, Mus musculus
atgggtatcttggtatgtatctgat

SEQ ID NO: 266953 - DNA, 25 bp, Mus musculus
atgggtatgcttactagggacacgg

SEQ ID NO: 266954 - DNA, 25 bp, Mus musculus
atgggtatgcttcagtcttggacgt

SEQ ID NO: 266955 - DNA, 25 bp, Mus musculus
atgggtatgcttgagtcttggacgt

SEQ ID NO: 266956 - DNA, 25 bp, Mus musculus
atgggtatgctttctagggacacgg

SEQ ID NO: 266957 - DNA, 25 bp, Mus musculus
atgggtatggagatcagtccttatc

SEQ ID NO: 266958 - DNA, 25 bp, Mus musculus
atgggtatggagttcagtccttatc

SEQ ID NO: 266959 - DNA, 25 bp, Mus musculus
atgggtatggtgactggactcctca

SEQ ID NO: 266960 - DNA, 25 bp, Mus musculus
atgggtatggtgtctggactcctca

SEQ ID NO: 266961 - DNA, 25 bp, Mus musculus
atgggtattggtccagtccctgcta

SEQ ID NO: 266962 - DNA, 25 bp, Mus musculus
atgggtattggtgcagtccctgcta

SEQ ID NO: 266963 - DNA, 25 bp, Mus musculus
atgggtcaaaatcaacagagctcaa

SEQ ID NO: 266964 - DNA, 25 bp, Mus musculus
atgggtcaaaatgaacagagctcaa

SEQ ID NO: 266965 - DNA, 25 bp, Mus musculus
atgggtcaagctacgtaaactgtat

SEQ ID NO: 266966 - DNA, 25 bp, Mus musculus
atgggtcaagcttcgtaaactgtat

SEQ ID NO: 266967 - DNA, 25 bp, Mus musculus
atgggtcacactatgacgcctctgg

SEQ ID NO: 266968 - DNA, 25 bp, Mus musculus
atgggtcacactttgacgcctctgg

SEQ ID NO: 266969 - DNA, 25 bp, Mus musculus
atgggtcacagtaggttgtccaggc

SEQ ID NO: 266970 - DNA, 25 bp, Mus musculus
atgggtcacagttggttgtccaggc

SEQ ID NO: 266971 - DNA, 25 bp, Mus musculus
atgggtcacatcaatactctcagca

SEQ ID NO: 266972 - DNA, 25 bp, Mus musculus
atgggtcacatctatactctcagca

SEQ ID NO: 266973 - DNA, 25 bp, Mus musculus
atgggtcacccaatcatcgtgcagt

SEQ ID NO: 266974 - DNA, 25 bp, Mus musculus
atgggtcacccattcatcgtgcagt

SEQ ID NO: 266975 - DNA, 25 bp, Mus musculus
atgggtcacctcaagtgaaggcact

SEQ ID NO: 266976 - DNA, 25 bp, Mus musculus
atgggtcacctctagtgaaggcact

SEQ ID NO: 266977 - DNA, 25 bp, Mus musculus
atgggtcacctgacatggctcctat

SEQ ID NO: 266978 - DNA, 25 bp, Mus musculus
atgggtcacctgtcatggctcctat

SEQ ID NO: 266979 - DNA, 25 bp, Mus musculus
atgggtcactggctcaccaggaacc

SEQ ID NO: 266980 - DNA, 25 bp, Mus musculus
atgggtcactgggtcaccaggaacc

SEQ ID NO: 266981 - DNA, 25 bp, Mus musculus
atgggtcactgtctcagttttcctg

SEQ ID NO: 266982 - DNA, 25 bp, Mus musculus
atgggtcactgtgtcagttttcctg

SEQ ID NO: 266983 - DNA, 25 bp, Mus musculus
atgggtcacttgcatatcttcgcta

SEQ ID NO: 266984 - DNA, 25 bp, Mus musculus
atgggtcacttggatatcttcgcta

SEQ ID NO: 266985 - DNA, 25 bp, Mus musculus
atgggtcagcccatcattgtgacga

SEQ ID NO: 266986 - DNA, 25 bp, Mus musculus
atgggtcagcccttcattgtgacga

SEQ ID NO: 266987 - DNA, 25 bp, Mus musculus
atgggtcaggtaactctgtgttctt

SEQ ID NO: 266988 - DNA, 25 bp, Mus musculus
atgggtcaggtatctctgtgttctt

SEQ ID NO: 266989 - DNA, 25 bp, Mus musculus
atgggtcagtggaagagaccttgcc

SEQ ID NO: 266990 - DNA, 25 bp, Mus musculus
atgggtcagtggtagagaccttgcc

SEQ ID NO: 266991 - DNA, 25 bp, Mus musculus
atgggtcatatgaggccagctccag

SEQ ID NO: 266992 - DNA, 25 bp, Mus musculus
atgggtcatatgtggccagctccag

SEQ ID NO: 266993 - DNA, 25 bp, Mus musculus
atgggtcatgataaggtgataaacc

SEQ ID NO: 266994 - DNA, 25 bp, Mus musculus
atgggtcatgattaggtgataaacc

SEQ ID NO: 266995 - DNA, 25 bp, Mus musculus
atgggtccaaacaaatctctccttt

SEQ ID NO: 266996 - DNA, 25 bp, Mus musculus
atgggtccaaactaatctctccttt

SEQ ID NO: 266997 - DNA, 25 bp, Mus musculus
atgggtccaactcacctgcgctgga

SEQ ID NO: 266998 - DNA, 25 bp, Mus musculus
atgggtccaactgacctgcgctgga

SEQ ID NO: 266999 - DNA, 25 bp, Mus musculus
atgggtccaatcctgcaagctcaag

SEQ ID NO: 267000 - DNA, 25 bp, Mus musculus
atgggtccaatcgtgcaagctcaag

SEQ ID NO: 267001 - DNA, 25 bp, Mus musculus
atgggtccacgcagccagagaagtc

SEQ ID NO: 267002 - DNA, 25 bp, Mus musculus
atgggtccacgctgccagagaagtc

SEQ ID NO: 267003 - DNA, 25 bp, Mus musculus
atgggtccagatcacagcacagagc

SEQ ID NO: 267004 - DNA, 25 bp, Mus musculus
atgggtccagatgacagcacagagc

SEQ ID NO: 267005 - DNA, 25 bp, Mus musculus
atgggtccagccacaattacgggct

SEQ ID NO: 267006 - DNA, 25 bp, Mus musculus
atgggtccagcctcaattacgggct

SEQ ID NO: 267007 - DNA, 25 bp, Mus musculus
atgggtccattgatacccagggcag

SEQ ID NO: 267008 - DNA, 25 bp, Mus musculus
atgggtccattgttacccagggcag

SEQ ID NO: 267009 - DNA, 25 bp, Mus musculus
atgggtcccagcatcacaaaaacag

SEQ ID NO: 267010 - DNA, 25 bp, Mus musculus
atgggtcccagcttcacaaaaacag

SEQ ID NO: 267011 - DNA, 25 bp, Mus musculus
atgggtcccctaccaaaacaggtgg

SEQ ID NO: 267012 - DNA, 25 bp, Mus musculus
atgggtcccctagcaaaacaggtgg

SEQ ID NO: 267013 - DNA, 25 bp, Mus musculus
atgggtccccttcaggtccttgaca

SEQ ID NO: 267014 - DNA, 25 bp, Mus musculus
atgggtccccttgaggtccttgaca

SEQ ID NO: 267015 - DNA, 25 bp, Mus musculus
atgggtccgaatattttcaagccat

SEQ ID NO: 267016 - DNA, 25 bp, Mus musculus
atgggtccgaattttttcaagccat

SEQ ID NO: 267017 - DNA, 25 bp, Mus musculus
atgggtccggtgagctgagaaactc

SEQ ID NO: 267018 - DNA, 25 bp, Mus musculus
atgggtccggtgtgctgagaaactc

SEQ ID NO: 267019 - DNA, 25 bp, Mus musculus
atgggtcctggacgaaccgttgtca

SEQ ID NO: 267020 - DNA, 25 bp, Mus musculus
atgggtcctggaggaaccgttgtca

SEQ ID NO: 267021 - DNA, 25 bp, Mus musculus
atgggtcctgttcaggtatgcacac

SEQ ID NO: 267022 - DNA, 25 bp, Mus musculus
atgggtcctgttgaggtatgcacac

SEQ ID NO: 267023 - DNA, 25 bp, Mus musculus
atgggtcgagatccgggcttctttc

SEQ ID NO: 267024 - DNA, 25 bp, Mus musculus
atgggtcgagatgcgggcttctttc

SEQ ID NO: 267025 - DNA, 25 bp, Mus musculus
atgggtcgcgcgcaacagattccac

SEQ ID NO: 267026 - DNA, 25 bp, Mus musculus
atgggtcgcgcggaacagattccac

SEQ ID NO: 267027 - DNA, 25 bp, Mus musculus
atgggtcgcggcagttaccgttggg

SEQ ID NO: 267028 - DNA, 25 bp, Mus musculus
atgggtcgcggctgttaccgttggg

SEQ ID NO: 267029 - DNA, 25 bp, Mus musculus
atgggtcggaatatattgtccacct

SEQ ID NO: 267030 - DNA, 25 bp, Mus musculus
atgggtcggaatttattgtccacct

SEQ ID NO: 267031 - DNA, 25 bp, Mus musculus
atgggtcggtctcatatccattcct

SEQ ID NO: 267032 - DNA, 25 bp, Mus musculus
atgggtcggtctgatatccattcct

SEQ ID NO: 267033 - DNA, 25 bp, Mus musculus
atgggtctaagtctacagtggctgt

SEQ ID NO: 267034 - DNA, 25 bp, Mus musculus
atgggtctaagtgtacagtggctgt

SEQ ID NO: 267035 - DNA, 25 bp, Mus musculus
atgggtctcatgcatacaacactgg

SEQ ID NO: 267036 - DNA, 25 bp, Mus musculus
atgggtctcatggatacaacactgg

SEQ ID NO: 267037 - DNA, 25 bp, Mus musculus
atgggtctccctctttacacttagc

SEQ ID NO: 267038 - DNA, 25 bp, Mus musculus
atgggtctccctgtttacacttagc

SEQ ID NO: 267039 - DNA, 25 bp, Mus musculus
atgggtctcgctaggctaaacttaa

SEQ ID NO: 267040 - DNA, 25 bp, Mus musculus
atgggtctcgcttggctaaacttaa

SEQ ID NO: 267041 - DNA, 25 bp, Mus musculus
atgggtctcgtccacgaattccgac

SEQ ID NO: 267042 - DNA, 25 bp, Mus musculus
atgggtctcgtcgacgaattccgac

SEQ ID NO: 267043 - DNA, 25 bp, Mus musculus
atgggtctcttaacccttgcttaag

SEQ ID NO: 267044 - DNA, 25 bp, Mus musculus
atgggtctcttatcccttgcttaag

SEQ ID NO: 267045 - DNA, 25 bp, Mus musculus
atgggtctgacactgttgtcatgac

SEQ ID NO: 267046 - DNA, 25 bp, Mus musculus
atgggtctgacagtgttgtcatgac

SEQ ID NO: 267047 - DNA, 25 bp, Mus musculus
atgggtctggcaaaggcgcagcttt

SEQ ID NO: 267048 - DNA, 25 bp, Mus musculus
atgggtctggcataggcgcagcttt

SEQ ID NO: 267049 - DNA, 25 bp, Mus musculus
atgggtctgtcccagccagcagatt

SEQ ID NO: 267050 - DNA, 25 bp, Mus musculus
atgggtctgtccgagccagcagatt

SEQ ID NO: 267051 - DNA, 25 bp, Mus musculus
atgggtctgtctaagtaacttttct

SEQ ID NO: 267052 - DNA, 25 bp, Mus musculus
atgggtctgtcttagtaacttttct

SEQ ID NO: 267053 - DNA, 25 bp, Mus musculus
atgggtctgtgtccccacgaactag

SEQ ID NO: 267054 - DNA, 25 bp, Mus musculus
atgggtctgtgtccctggtaacatg

SEQ ID NO: 267055 - DNA, 25 bp, Mus musculus
atgggtctgtgtgcccacgaactag

SEQ ID NO: 267056 - DNA, 25 bp, Mus musculus
atgggtctgtgtgcctggtaacatg

SEQ ID NO: 267057 - DNA, 25 bp, Mus musculus
atgggtcttccaactcagagctgac

SEQ ID NO: 267058 - DNA, 25 bp, Mus musculus
atgggtcttccaatcataagccaac

SEQ ID NO: 267059 - DNA, 25 bp, Mus musculus
atgggtcttccatctcagagctgac

SEQ ID NO: 267060 - DNA, 25 bp, Mus musculus
atgggtcttccattcataagccaac

SEQ ID NO: 267061 - DNA, 25 bp, Mus musculus
atgggtctttggatgtgtttctagc

SEQ ID NO: 267062 - DNA, 25 bp, Mus musculus
atgggtctttggttgtgtttctagc

SEQ ID NO: 267063 - DNA, 25 bp, Mus musculus
atgggtgaactgagccatcctgtag

SEQ ID NO: 267064 - DNA, 25 bp, Mus musculus
atgggtgaactgtgccatcctgtag

SEQ ID NO: 267065 - DNA, 25 bp, Mus musculus
atgggtgaagacaaaggcccttgtg

SEQ ID NO: 267066 - DNA, 25 bp, Mus musculus
atgggtgaagactaaggcccttgtg

SEQ ID NO: 267067 - DNA, 25 bp, Mus musculus
atgggtgacccactgcatttagcag

SEQ ID NO: 267068 - DNA, 25 bp, Mus musculus
atgggtgacccagtgcatttagcag

SEQ ID NO: 267069 - DNA, 25 bp, Mus musculus
atgggtgacgagacagcctgcatcg

SEQ ID NO: 267070 - DNA, 25 bp, Mus musculus
atgggtgacgagtcagcctgcatcg

SEQ ID NO: 267071 - DNA, 25 bp, Mus musculus
atgggtgactctaaccaaaggactt

SEQ ID NO: 267072 - DNA, 25 bp, Mus musculus
atgggtgactcttaccaaaggactt

SEQ ID NO: 267073 - DNA, 25 bp, Mus musculus
atgggtgcatatctgttactaaaac

SEQ ID NO: 267074 - DNA, 25 bp, Mus musculus
atgggtgcatatgtgttactaaaac

SEQ ID NO: 267075 - DNA, 25 bp, Mus musculus
atgggtgccgggaggagtccattta

SEQ ID NO: 267076 - DNA, 25 bp, Mus musculus
atgggtgccgggtggagtccattta

SEQ ID NO: 267077 - DNA, 25 bp, Mus musculus
atgggtgctattattctttctctgt

SEQ ID NO: 267078 - DNA, 25 bp, Mus musculus
atgggtgctatttttctttctctgt

SEQ ID NO: 267079 - DNA, 25 bp, Mus musculus
atgggtgctgggacacaaccctttg

SEQ ID NO: 267080 - DNA, 25 bp, Mus musculus
atgggtgctgggtcacaaccctttg

SEQ ID NO: 267081 - DNA, 25 bp, Mus musculus
atgggtgctgtcacgacccacacct

SEQ ID NO: 267082 - DNA, 25 bp, Mus musculus
atgggtgctgtctcgacccacacct

SEQ ID NO: 267083 - DNA, 25 bp, Mus musculus
atgggtgctgttagtgggacatcta

SEQ ID NO: 267084 - DNA, 25 bp, Mus musculus
atgggtgctgtttgtgggacatcta

SEQ ID NO: 267085 - DNA, 25 bp, Mus musculus
atgggtgcttacataccagtgcctt

SEQ ID NO: 267086 - DNA, 25 bp, Mus musculus
atgggtgcttacttaccagtgcctt

SEQ ID NO: 267087 - DNA, 25 bp, Mus musculus
atgggtgcttctctctgtcgccagg

SEQ ID NO: 267088 - DNA, 25 bp, Mus musculus
atgggtgcttctgtctgtcgccagg

SEQ ID NO: 267089 - DNA, 25 bp, Mus musculus
atgggtgcttggaagagtgatcaaa

SEQ ID NO: 267090 - DNA, 25 bp, Mus musculus
atgggtgcttggtagagtgatcaaa

SEQ ID NO: 267091 - DNA, 25 bp, Mus musculus
atgggtggaagcactcctgttctga

SEQ ID NO: 267092 - DNA, 25 bp, Mus musculus
atgggtggaagctctcctgttctga

SEQ ID NO: 267093 - DNA, 25 bp, Mus musculus
atgggtggatttcgtgctcagcctc

SEQ ID NO: 267094 - DNA, 25 bp, Mus musculus
atgggtggatttggtgctcagcctc

SEQ ID NO: 267095 - DNA, 25 bp, Mus musculus
atgggtggcatcaactttacgaatt

SEQ ID NO: 267096 - DNA, 25 bp, Mus musculus
atgggtggcatctactttacgaatt

SEQ ID NO: 267097 - DNA, 25 bp, Mus musculus
atgggtggccagctttctcattaaa

SEQ ID NO: 267098 - DNA, 25 bp, Mus musculus
atgggtggccaggtttctcattaaa

SEQ ID NO: 267099 - DNA, 25 bp, Mus musculus
atgggtggctacacggacatcgtga

SEQ ID NO: 267100 - DNA, 25 bp, Mus musculus
atgggtggctactcggacatcgtga

SEQ ID NO: 267101 - DNA, 25 bp, Mus musculus
atgggtggctcgcatatatccaaaa

SEQ ID NO: 267102 - DNA, 25 bp, Mus musculus
atgggtggctcggatatatccaaaa

SEQ ID NO: 267103 - DNA, 25 bp, Mus musculus
atgggtggctgcaggaatcccttac

SEQ ID NO: 267104 - DNA, 25 bp, Mus musculus
atgggtggctgctggaatcccttac

SEQ ID NO: 267105 - DNA, 25 bp, Mus musculus
atgggtggctgtcgcattcgcccct

SEQ ID NO: 267106 - DNA, 25 bp, Mus musculus
atgggtggctgtggcattcgcccct

SEQ ID NO: 267107 - DNA, 25 bp, Mus musculus
atgggtggctttaagcatctgtccc

SEQ ID NO: 267108 - DNA, 25 bp, Mus musculus
atgggtggctttatcacttaaatat

SEQ ID NO: 267109 - DNA, 25 bp, Mus musculus
atgggtggcttttagcatctgtccc

SEQ ID NO: 267110 - DNA, 25 bp, Mus musculus
atgggtggctttttcacttaaatat

SEQ ID NO: 267111 - DNA, 25 bp, Mus musculus
atgggtgggatcagttgcattcccc

SEQ ID NO: 267112 - DNA, 25 bp, Mus musculus
atgggtgggatctgttgcattcccc

SEQ ID NO: 267113 - DNA, 25 bp, Mus musculus
atgggtgggccacaacatcactcaa

SEQ ID NO: 267114 - DNA, 25 bp, Mus musculus
atgggtgggccagaacatcactcaa

SEQ ID NO: 267115 - DNA, 25 bp, Mus musculus
atgggtggtctgctctcggtccttc

SEQ ID NO: 267116 - DNA, 25 bp, Mus musculus
atgggtggtctggtctcggtccttc

SEQ ID NO: 267117 - DNA, 25 bp, Mus musculus
atgggtggtggtattccttgaaatc

SEQ ID NO: 267118 - DNA, 25 bp, Mus musculus
atgggtggtggttttccttgaaatc

SEQ ID NO: 267119 - DNA, 25 bp, Mus musculus
atgggtggtgtcattcttctggcag

SEQ ID NO: 267120 - DNA, 25 bp, Mus musculus
atgggtggtgtctttcttctggcag

SEQ ID NO: 267121 - DNA, 25 bp, Mus musculus
atgggtggtgttcagcttcgacaaa

SEQ ID NO: 267122 - DNA, 25 bp, Mus musculus
atgggtggtgttgagcttcgacaaa

SEQ ID NO: 267123 - DNA, 25 bp, Mus musculus
atgggtgtacatcctgctgcgccag

SEQ ID NO: 267124 - DNA, 25 bp, Mus musculus
atgggtgtacatgctgctgcgccag

SEQ ID NO: 267125 - DNA, 25 bp, Mus musculus
atgggtgtagacatccctccagtga

SEQ ID NO: 267126 - DNA, 25 bp, Mus musculus
atgggtgtagacttccctccagtga

SEQ ID NO: 267127 - DNA, 25 bp, Mus musculus
atgggtgtagagacccacgcccgga

SEQ ID NO: 267128 - DNA, 25 bp, Mus musculus
atgggtgtagagtcccacgcccgga

SEQ ID NO: 267129 - DNA, 25 bp, Mus musculus
atgggtgtatctatccactcaagca

SEQ ID NO: 267130 - DNA, 25 bp, Mus musculus
atgggtgtatctttccactcaagca

SEQ ID NO: 267131 - DNA, 25 bp, Mus musculus
atgggtgtcatgatgcatctgggta

SEQ ID NO: 267132 - DNA, 25 bp, Mus musculus
atgggtgtcatgttgcatctgggta

SEQ ID NO: 267133 - DNA, 25 bp, Mus musculus
atgggtgtctggcattgaacttctt

SEQ ID NO: 267134 - DNA, 25 bp, Mus musculus
atgggtgtctgggattgaacttctt

SEQ ID NO: 267135 - DNA, 25 bp, Mus musculus
atgggtgtcttactgtgcttagctc

SEQ ID NO: 267136 - DNA, 25 bp, Mus musculus
atgggtgtcttagtgtgcttagctc

SEQ ID NO: 267137 - DNA, 25 bp, Mus musculus
atgggtgtgacaatggaaggtccac

SEQ ID NO: 267138 - DNA, 25 bp, Mus musculus
atgggtgtgacattggaaggtccac

SEQ ID NO: 267139 - DNA, 25 bp, Mus musculus
atgggtgtgagcatccatctggaaa

SEQ ID NO: 267140 - DNA, 25 bp, Mus musculus
atgggtgtgagcttccatctggaaa

SEQ ID NO: 267141 - DNA, 25 bp, Mus musculus
atgggtgtggctcccaccataccaa

SEQ ID NO: 267142 - DNA, 25 bp, Mus musculus
atgggtgtggctgccaccataccaa

SEQ ID NO: 267143 - DNA, 25 bp, Mus musculus
atgggtgtgtccatttccaaagagt

SEQ ID NO: 267144 - DNA, 25 bp, Mus musculus
atgggtgtgtccttttccaaagagt

SEQ ID NO: 267145 - DNA, 25 bp, Mus musculus
atgggtgttctccaactttgtggaa

SEQ ID NO: 267146 - DNA, 25 bp, Mus musculus
atgggtgttctcgaactttgtggaa

SEQ ID NO: 267147 - DNA, 25 bp, Mus musculus
atgggtgttgtgagtaccactgctc

SEQ ID NO: 267148 - DNA, 25 bp, Mus musculus
atgggtgttgtgtgtaccactgctc

SEQ ID NO: 267149 - DNA, 25 bp, Mus musculus
atgggtgtttcaagtgctgttgtgt

SEQ ID NO: 267150 - DNA, 25 bp, Mus musculus
atgggtgtttcatgtgctgttgtgt

SEQ ID NO: 267151 - DNA, 25 bp, Mus musculus
atgggttaacggacatctgcggcaa

SEQ ID NO: 267152 - DNA, 25 bp, Mus musculus
atgggttaacggtcatctgcggcaa

SEQ ID NO: 267153 - DNA, 25 bp, Mus musculus
atgggttaagcacagcctgtgccaa

SEQ ID NO: 267154 - DNA, 25 bp, Mus musculus
atgggttaagcagagcctgtgccaa

SEQ ID NO: 267155 - DNA, 25 bp, Mus musculus
atgggttaccctatagaaaaatgat

SEQ ID NO: 267156 - DNA, 25 bp, Mus musculus
atgggttaccctttagaaaaatgat

SEQ ID NO: 267157 - DNA, 25 bp, Mus musculus
atgggttactctatgactgccttct

SEQ ID NO: 267158 - DNA, 25 bp, Mus musculus
atgggttactctttgactgccttct

SEQ ID NO: 267159 - DNA, 25 bp, Mus musculus
atgggttagctcattgtgacgtgaa

SEQ ID NO: 267160 - DNA, 25 bp, Mus musculus
atgggttagctctttgtgacgtgaa

SEQ ID NO: 267161 - DNA, 25 bp, Mus musculus
atgggttatgttcaatgtctgtgtt

SEQ ID NO: 267162 - DNA, 25 bp, Mus musculus
atgggttatgttgaatgtctgtgtt

SEQ ID NO: 267163 - DNA, 25 bp, Mus musculus
atgggttcacacatgggttgtcttt

SEQ ID NO: 267164 - DNA, 25 bp, Mus musculus
atgggttcacacttgggttgtcttt

SEQ ID NO: 267165 - DNA, 25 bp, Mus musculus
atgggttcagatctttgttgcttac

SEQ ID NO: 267166 - DNA, 25 bp, Mus musculus
atgggttcagatgtttgttgcttac

SEQ ID NO: 267167 - DNA, 25 bp, Mus musculus
atgggttcagtactgcattttgcac

SEQ ID NO: 267168 - DNA, 25 bp, Mus musculus
atgggttcagtagtgcattttgcac

SEQ ID NO: 267169 - DNA, 25 bp, Mus musculus
atgggttcatctatcctctcaaaag

SEQ ID NO: 267170 - DNA, 25 bp, Mus musculus
atgggttcatctttcctctcaaaag

SEQ ID NO: 267171 - DNA, 25 bp, Mus musculus
atgggttccaagcaagctgtccaga

SEQ ID NO: 267172 - DNA, 25 bp, Mus musculus
atgggttccaaggaagctgtccaga

SEQ ID NO: 267173 - DNA, 25 bp, Mus musculus
atgggttccccacaaatcaacgaga

SEQ ID NO: 267174 - DNA, 25 bp, Mus musculus
atgggttccccagaaatcaacgaga

SEQ ID NO: 267175 - DNA, 25 bp, Mus musculus
atgggttccctccagcctggagtac

SEQ ID NO: 267176 - DNA, 25 bp, Mus musculus
atgggttccctcgagcctggagtac

SEQ ID NO: 267177 - DNA, 25 bp, Mus musculus
atgggttcctttctacttctctcaa

SEQ ID NO: 267178 - DNA, 25 bp, Mus musculus
atgggttcctttgtacttctctcaa

SEQ ID NO: 267179 - DNA, 25 bp, Mus musculus
atgggttcggcaatctaagatgtct

SEQ ID NO: 267180 - DNA, 25 bp, Mus musculus
atgggttcggcattctaagatgtct

SEQ ID NO: 267181 - DNA, 25 bp, Mus musculus
atgggttctggaaatcaagaagcca

SEQ ID NO: 267182 - DNA, 25 bp, Mus musculus
atgggttctggatatcaagaagcca

SEQ ID NO: 267183 - DNA, 25 bp, Mus musculus
atgggttcttggaaatcctggatgg

SEQ ID NO: 267184 - DNA, 25 bp, Mus musculus
atgggttcttggtaatcctggatgg

SEQ ID NO: 267185 - DNA, 25 bp, Mus musculus
atgggttgacccagccactaatgga

SEQ ID NO: 267186 - DNA, 25 bp, Mus musculus
atgggttgaccctgccactaatgga

SEQ ID NO: 267187 - DNA, 25 bp, Mus musculus
atgggttgacggaccacacttggtc

SEQ ID NO: 267188 - DNA, 25 bp, Mus musculus
atgggttgacggtccacacttggtc

SEQ ID NO: 267189 - DNA, 25 bp, Mus musculus
atgggttgactcatgaggctccaca

SEQ ID NO: 267190 - DNA, 25 bp, Mus musculus
atgggttgactcttgaggctccaca

SEQ ID NO: 267191 - DNA, 25 bp, Mus musculus
atgggttgcactcttggtgactcca

SEQ ID NO: 267192 - DNA, 25 bp, Mus musculus
atgggttgcactgttggtgactcca

SEQ ID NO: 267193 - DNA, 25 bp, Mus musculus
atgggttgccacattctgttcaaaa

SEQ ID NO: 267194 - DNA, 25 bp, Mus musculus
atgggttgccactttctgttcaaaa

SEQ ID NO: 267195 - DNA, 25 bp, Mus musculus
atgggttggattactgcaggtttgc

SEQ ID NO: 267196 - DNA, 25 bp, Mus musculus
atgggttggatttctgcaggtttgc

SEQ ID NO: 267197 - DNA, 25 bp, Mus musculus
atgggttgggccacgagttcctgaa

SEQ ID NO: 267198 - DNA, 25 bp, Mus musculus
atgggttgggcctcgagttcctgaa

SEQ ID NO: 267199 - DNA, 25 bp, Mus musculus
atgggttgtacaagctgaagagcag

SEQ ID NO: 267200 - DNA, 25 bp, Mus musculus
atgggttgtacatgctgaagagcag

SEQ ID NO: 267201 - DNA, 25 bp, Mus musculus
atgggttgtttcaggcttttcaggg

SEQ ID NO: 267202 - DNA, 25 bp, Mus musculus
atgggttgtttcaggcttttgagga

SEQ ID NO: 267203 - DNA, 25 bp, Mus musculus
atgggttgtttctggcttttcaggg

SEQ ID NO: 267204 - DNA, 25 bp, Mus musculus
atgggttgtttctggcttttgagga

SEQ ID NO: 267205 - DNA, 25 bp, Mus musculus
atgggtttaatcacagcataatcct

SEQ ID NO: 267206 - DNA, 25 bp, Mus musculus
atgggtttaatctcagcataatcct

SEQ ID NO: 267207 - DNA, 25 bp, Mus musculus
atgggtttaatgacactggtctaga

SEQ ID NO: 267208 - DNA, 25 bp, Mus musculus
atgggtttaatgtcactggtctaga

SEQ ID NO: 267209 - DNA, 25 bp, Mus musculus
atgggtttcaagacactacacagac

SEQ ID NO: 267210 - DNA, 25 bp, Mus musculus
atgggtttcaagtcactacacagac

SEQ ID NO: 267211 - DNA, 25 bp, Mus musculus
atgggtttcagacggcattctatta

SEQ ID NO: 267212 - DNA, 25 bp, Mus musculus
atgggtttcagagggcattctatta

SEQ ID NO: 267213 - DNA, 25 bp, Mus musculus
atgggtttcctgactgccgtgactc

SEQ ID NO: 267214 - DNA, 25 bp, Mus musculus
atgggtttcctgtctgccgtgactc

SEQ ID NO: 267215 - DNA, 25 bp, Mus musculus
atgggtttctggcttccatggtcac

SEQ ID NO: 267216 - DNA, 25 bp, Mus musculus
atgggtttctgggttccatggtcac

SEQ ID NO: 267217 - DNA, 25 bp, Mus musculus
atgggtttgagtagcatttggctat

SEQ ID NO: 267218 - DNA, 25 bp, Mus musculus
atgggtttgagttgcatttggctat

SEQ ID NO: 267219 - DNA, 25 bp, Mus musculus
atgggtttgctaaactggctgtgct

SEQ ID NO: 267220 - DNA, 25 bp, Mus musculus
atgggtttgctatactggctgtgct

SEQ ID NO: 267221 - DNA, 25 bp, Mus musculus
atgggtttggttattatcagatgca

SEQ ID NO: 267222 - DNA, 25 bp, Mus musculus
atgggtttggtttttatcagatgca

SEQ ID NO: 267223 - DNA, 25 bp, Mus musculus
atgggttttaagcaatcgtttctcg

SEQ ID NO: 267224 - DNA, 25 bp, Mus musculus
atgggttttaaggaatcgtttctcg

SEQ ID NO: 267225 - DNA, 25 bp, Mus musculus
atgggttttgcacgttcagcttaaa

SEQ ID NO: 267226 - DNA, 25 bp, Mus musculus
atgggttttgcaggttcagcttaaa

SEQ ID NO: 267227 - DNA, 25 bp, Mus musculus
atgggttttgctacaaacagaatcg

SEQ ID NO: 267228 - DNA, 25 bp, Mus musculus
atgggttttgcttcaaacagaatcg

SEQ ID NO: 267229 - DNA, 25 bp, Mus musculus
atgggttttgtaattgtgtctaatg

SEQ ID NO: 267230 - DNA, 25 bp, Mus musculus
atgggttttgtatttgtgtctaatg

SEQ ID NO: 267231 - DNA, 25 bp, Mus musculus
atgggtttttacatctctttctccg

SEQ ID NO: 267232 - DNA, 25 bp, Mus musculus
atgggtttttacttctctttctccg

SEQ ID NO: 267233 - DNA, 25 bp, Mus musculus
atgggtttttgaacaggagcactgt

SEQ ID NO: 267234 - DNA, 25 bp, Mus musculus
atgggtttttgatcaggagcactgt

SEQ ID NO: 267235 - DNA, 25 bp, Mus musculus
atggtaaaactaccccactacccag

SEQ ID NO: 267236 - DNA, 25 bp, Mus musculus
atggtaaaactagcccactacccag

SEQ ID NO: 267237 - DNA, 25 bp, Mus musculus
atggtaaaattccttctgaagaaag

SEQ ID NO: 267238 - DNA, 25 bp, Mus musculus
atggtaaaattcgttctgaagaaag

SEQ ID NO: 267239 - DNA, 25 bp, Mus musculus
atggtaaagacaaacaggagcagac

SEQ ID NO: 267240 - DNA, 25 bp, Mus musculus
atggtaaagacatacaggagcagac

SEQ ID NO: 267241 - DNA, 25 bp, Mus musculus
atggtaaagcccatgtatccccagt

SEQ ID NO: 267242 - DNA, 25 bp, Mus musculus
atggtaaagcccttgtatccccagt

SEQ ID NO: 267243 - DNA, 25 bp, Mus musculus
atggtaaccacactgggcccggaca

SEQ ID NO: 267244 - DNA, 25 bp, Mus musculus
atggtaaccacagtgggcccggaca

SEQ ID NO: 267245 - DNA, 25 bp, Mus musculus
atggtaaccagtctggcctgtcaac

SEQ ID NO: 267246 - DNA, 25 bp, Mus musculus
atggtaaccagtgtggcctgtcaac

SEQ ID NO: 267247 - DNA, 25 bp, Mus musculus
atggtaaccctcacatccaggattg

SEQ ID NO: 267248 - DNA, 25 bp, Mus musculus
atggtaaccctctcatccaggattg

SEQ ID NO: 267249 - DNA, 25 bp, Mus musculus
atggtaaccggacgcgccaacctgg

SEQ ID NO: 267250 - DNA, 25 bp, Mus musculus
atggtaaccggaggcgccaacctgg

SEQ ID NO: 267251 - DNA, 25 bp, Mus musculus
atggtaacgctcatcttcaaggagt

SEQ ID NO: 267252 - DNA, 25 bp, Mus musculus
atggtaacgctcttcttcaaggagt

SEQ ID NO: 267253 - DNA, 25 bp, Mus musculus
atggtaagaagactcctggcccaca

SEQ ID NO: 267254 - DNA, 25 bp, Mus musculus
atggtaagaagagtcctggcccaca

SEQ ID NO: 267255 - DNA, 25 bp, Mus musculus
atggtaagcatcctcatgccattgc

SEQ ID NO: 267256 - DNA, 25 bp, Mus musculus
atggtaagcatcgtcatgccattgc

SEQ ID NO: 267257 - DNA, 25 bp, Mus musculus
atggtaagcgagaaggtcccacctc

SEQ ID NO: 267258 - DNA, 25 bp, Mus musculus
atggtaagcgagtaggtcccacctc

SEQ ID NO: 267259 - DNA, 25 bp, Mus musculus
atggtaagctatatttatctgttca

SEQ ID NO: 267260 - DNA, 25 bp, Mus musculus
atggtaagctatttttatctgttca

SEQ ID NO: 267261 - DNA, 25 bp, Mus musculus
atggtaaggctcagggactgtatct

SEQ ID NO: 267262 - DNA, 25 bp, Mus musculus
atggtaaggctctgggactgtatct

SEQ ID NO: 267263 - DNA, 25 bp, Mus musculus
atggtaatacctcggatacatatac

SEQ ID NO: 267264 - DNA, 25 bp, Mus musculus
atggtaatacctgggatacatatac

SEQ ID NO: 267265 - DNA, 25 bp, Mus musculus
atggtaatatacactgtctggtgtg

SEQ ID NO: 267266 - DNA, 25 bp, Mus musculus
atggtaatatactctgtctggtgtg

SEQ ID NO: 267267 - DNA, 25 bp, Mus musculus
atggtaatgaaaccccataatctca

SEQ ID NO: 267268 - DNA, 25 bp, Mus musculus
atggtaatgaaagcccataatctca

SEQ ID NO: 267269 - DNA, 25 bp, Mus musculus
atggtaatgaccattttgttcaaat

SEQ ID NO: 267270 - DNA, 25 bp, Mus musculus
atggtaatgacctttttgttcaaat

SEQ ID NO: 267271 - DNA, 25 bp, Mus musculus
atggtaatgaggctcagtagttttc

SEQ ID NO: 267272 - DNA, 25 bp, Mus musculus
atggtaatgagggtcagtagttttc

SEQ ID NO: 267273 - DNA, 25 bp, Mus musculus
atggtaatggcacatcctcaagtta

SEQ ID NO: 267274 - DNA, 25 bp, Mus musculus
atggtaatggcagatcctcaagtta

SEQ ID NO: 267275 - DNA, 25 bp, Mus musculus
atggtaatgtctatctggaccctgc

SEQ ID NO: 267276 - DNA, 25 bp, Mus musculus
atggtaatgtctttctggaccctgc

SEQ ID NO: 267277 - DNA, 25 bp, Mus musculus
atggtaatgttgactgtagtgtgcc

SEQ ID NO: 267278 - DNA, 25 bp, Mus musculus
atggtaatgttgtctgtagtgtgcc

SEQ ID NO: 267279 - DNA, 25 bp, Mus musculus
atggtacaccgacgcatcaagggta

SEQ ID NO: 267280 - DNA, 25 bp, Mus musculus
atggtacaccgaggcatcaagggta

SEQ ID NO: 267281 - DNA, 25 bp, Mus musculus
atggtacactgcacttctgtggatt

SEQ ID NO: 267282 - DNA, 25 bp, Mus musculus
atggtacactgctcttctgtggatt

SEQ ID NO: 267283 - DNA, 25 bp, Mus musculus
atggtacagacaccctatggcatca

SEQ ID NO: 267284 - DNA, 25 bp, Mus musculus
atggtacagacagcctatggcatca

SEQ ID NO: 267285 - DNA, 25 bp, Mus musculus
atggtacagcagacttgtccttcag

SEQ ID NO: 267286 - DNA, 25 bp, Mus musculus
atggtacagcagtcttgtccttcag

SEQ ID NO: 267287 - DNA, 25 bp, Mus musculus
atggtacagggcacagttacctgag

SEQ ID NO: 267288 - DNA, 25 bp, Mus musculus
atggtacagggctcagttacctgag

SEQ ID NO: 267289 - DNA, 25 bp, Mus musculus
atggtacatccacccctgcagtcgg

SEQ ID NO: 267290 - DNA, 25 bp, Mus musculus
atggtacatccagccctgcagtcgg

SEQ ID NO: 267291 - DNA, 25 bp, Mus musculus
atggtacatccccagtaggtatctt

SEQ ID NO: 267292 - DNA, 25 bp, Mus musculus
atggtacatcccgagtaggtatctt

SEQ ID NO: 267293 - DNA, 25 bp, Mus musculus
atggtacatggcaccctaagagtga

SEQ ID NO: 267294 - DNA, 25 bp, Mus musculus
atggtacatggctccctaagagtga

SEQ ID NO: 267295 - DNA, 25 bp, Mus musculus
atggtaccacatcactgcagttgca

SEQ ID NO: 267296 - DNA, 25 bp, Mus musculus
atggtaccacatgactgcagttgca

SEQ ID NO: 267297 - DNA, 25 bp, Mus musculus
atggtacccacacttgaggcagctt

SEQ ID NO: 267298 - DNA, 25 bp, Mus musculus
atggtacccacagttgaggcagctt

SEQ ID NO: 267299 - DNA, 25 bp, Mus musculus
atggtacccagacccgcaggacgga

SEQ ID NO: 267300 - DNA, 25 bp, Mus musculus
atggtacccagagccgcaggacgga

SEQ ID NO: 267301 - DNA, 25 bp, Mus musculus
atggtacccagcaccactaagtggg

SEQ ID NO: 267302 - DNA, 25 bp, Mus musculus
atggtacccagctccactaagtggg

SEQ ID NO: 267303 - DNA, 25 bp, Mus musculus
atggtacccagtagctgaacttcac

SEQ ID NO: 267304 - DNA, 25 bp, Mus musculus
atggtacccagttgctgaacttcac

SEQ ID NO: 267305 - DNA, 25 bp, Mus musculus
atggtacctcatagggttggagacc

SEQ ID NO: 267306 - DNA, 25 bp, Mus musculus
atggtacctcattgggttggagacc

SEQ ID NO: 267307 - DNA, 25 bp, Mus musculus
atggtacctccaagtagcataacaa

SEQ ID NO: 267308 - DNA, 25 bp, Mus musculus
atggtacctccatgtagcataacaa

SEQ ID NO: 267309 - DNA, 25 bp, Mus musculus
atggtaccttaaacaaagtttctga

SEQ ID NO: 267310 - DNA, 25 bp, Mus musculus
atggtaccttaatcaaagtttctga

SEQ ID NO: 267311 - DNA, 25 bp, Mus musculus
atggtactacagatctactttatta

SEQ ID NO: 267312 - DNA, 25 bp, Mus musculus
atggtactacagttctactttatta

SEQ ID NO: 267313 - DNA, 25 bp, Mus musculus
atggtactatgtctatcccctaata

SEQ ID NO: 267314 - DNA, 25 bp, Mus musculus
atggtactatgtgtatcccctaata

SEQ ID NO: 267315 - DNA, 25 bp, Mus musculus
atggtactcaggaaatcatcccgct

SEQ ID NO: 267316 - DNA, 25 bp, Mus musculus
atggtactcaggtaatcatcccgct

SEQ ID NO: 267317 - DNA, 25 bp, Mus musculus
atggtactcccaaactgacaatttt

SEQ ID NO: 267318 - DNA, 25 bp, Mus musculus
atggtactcccatactgacaatttt

SEQ ID NO: 267319 - DNA, 25 bp, Mus musculus
atggtactccctcagcatggaccct

SEQ ID NO: 267320 - DNA, 25 bp, Mus musculus
atggtactccctgagcatggaccct

SEQ ID NO: 267321 - DNA, 25 bp, Mus musculus
atggtactgactataccttccggag

SEQ ID NO: 267322 - DNA, 25 bp, Mus musculus
atggtactgactttaccttccggag

SEQ ID NO: 267323 - DNA, 25 bp, Mus musculus
atggtactgagtactctctgagtag

SEQ ID NO: 267324 - DNA, 25 bp, Mus musculus
atggtactgagttctctctgagtag

SEQ ID NO: 267325 - DNA, 25 bp, Mus musculus
atggtactgtgtccggtgctattta

SEQ ID NO: 267326 - DNA, 25 bp, Mus musculus
atggtactgtgtgcggtgctattta

SEQ ID NO: 267327 - DNA, 25 bp, Mus musculus
atggtacttggcagcttcataactt

SEQ ID NO: 267328 - DNA, 25 bp, Mus musculus
atggtacttggctgcttcataactt

SEQ ID NO: 267329 - DNA, 25 bp, Mus musculus
atggtactttacctctagtcctgtc

SEQ ID NO: 267330 - DNA, 25 bp, Mus musculus
atggtactttacgtctagtcctgtc

SEQ ID NO: 267331 - DNA, 25 bp, Mus musculus
atggtactttgtccgatttctggaa

SEQ ID NO: 267332 - DNA, 25 bp, Mus musculus
atggtactttgtgcgatttctggaa

SEQ ID NO: 267333 - DNA, 25 bp, Mus musculus
atggtagaacacatgtttaaatgct

SEQ ID NO: 267334 - DNA, 25 bp, Mus musculus
atggtagaacacttgtttaaatgct

SEQ ID NO: 267335 - DNA, 25 bp, Mus musculus
atggtagaccaactggccaactgtg

SEQ ID NO: 267336 - DNA, 25 bp, Mus musculus
atggtagaccaagtggccaactgtg

SEQ ID NO: 267337 - DNA, 25 bp, Mus musculus
atggtagactttactcaaactgaag

SEQ ID NO: 267338 - DNA, 25 bp, Mus musculus
atggtagacttttctcaaactgaag

SEQ ID NO: 267339 - DNA, 25 bp, Mus musculus
atggtagagactagctgctcctaac

SEQ ID NO: 267340 - DNA, 25 bp, Mus musculus
atggtagagacttgctgctcctaac

SEQ ID NO: 267341 - DNA, 25 bp, Mus musculus
atggtagataaacaatcttggtgat

SEQ ID NO: 267342 - DNA, 25 bp, Mus musculus
atggtagataaagaatcttggtgat

SEQ ID NO: 267343 - DNA, 25 bp, Mus musculus
atggtagatatcactttctgtctct

SEQ ID NO: 267344 - DNA, 25 bp, Mus musculus
atggtagatatctctttctgtctct

SEQ ID NO: 267345 - DNA, 25 bp, Mus musculus
atggtagatctcagccatccatttc

SEQ ID NO: 267346 - DNA, 25 bp, Mus musculus
atggtagatctctgccatccatttc

SEQ ID NO: 267347 - DNA, 25 bp, Mus musculus
atggtagattcactgactccaaagc

SEQ ID NO: 267348 - DNA, 25 bp, Mus musculus
atggtagattcagtgactccaaagc

SEQ ID NO: 267349 - DNA, 25 bp, Mus musculus
atggtagcattaacctcactcttaa

SEQ ID NO: 267350 - DNA, 25 bp, Mus musculus
atggtagcattatcctcactcttaa

SEQ ID NO: 267351 - DNA, 25 bp, Mus musculus
atggtagcatttcggccctataggt

SEQ ID NO: 267352 - DNA, 25 bp, Mus musculus
atggtagcatttgggccctataggt

SEQ ID NO: 267353 - DNA, 25 bp, Mus musculus
atggtagccagtcctattgaggcat

SEQ ID NO: 267354 - DNA, 25 bp, Mus musculus
atggtagccagtgctattgaggcat

SEQ ID NO: 267355 - DNA, 25 bp, Mus musculus
atggtagcccagaggtcccatcagt

SEQ ID NO: 267356 - DNA, 25 bp, Mus musculus
atggtagcccagtggtcccatcagt

SEQ ID NO: 267357 - DNA, 25 bp, Mus musculus
atggtagccctcataagcatgcaca

SEQ ID NO: 267358 - DNA, 25 bp, Mus musculus
atggtagccctcttaagcatgcaca

SEQ ID NO: 267359 - DNA, 25 bp, Mus musculus
atggtagccgctcccgtgacttact

SEQ ID NO: 267360 - DNA, 25 bp, Mus musculus
atggtagccgctgccgtgacttact

SEQ ID NO: 267361 - DNA, 25 bp, Mus musculus
atggtagcctcaatgatgttcagta

SEQ ID NO: 267362 - DNA, 25 bp, Mus musculus
atggtagcctcattgatgttcagta

SEQ ID NO: 267363 - DNA, 25 bp, Mus musculus
atggtagcctgcaaaaggactgtag

SEQ ID NO: 267364 - DNA, 25 bp, Mus musculus
atggtagcctgctaaaggactgtag

SEQ ID NO: 267365 - DNA, 25 bp, Mus musculus
atggtagcgccaactccttggtggt

SEQ ID NO: 267366 - DNA, 25 bp, Mus musculus
atggtagcgccatctccttggtggt

SEQ ID NO: 267367 - DNA, 25 bp, Mus musculus
atggtagctccgagggctcagacca

SEQ ID NO: 267368 - DNA, 25 bp, Mus musculus
atggtagctccgtgggctcagacca

SEQ ID NO: 267369 - DNA, 25 bp, Mus musculus
atggtagctgcaactggcacttagc

SEQ ID NO: 267370 - DNA, 25 bp, Mus musculus
atggtagctgcatctggcacttagc

SEQ ID NO: 267371 - DNA, 25 bp, Mus musculus
atggtaggcctgctcagagtccctc

SEQ ID NO: 267372 - DNA, 25 bp, Mus musculus
atggtaggcctggtcagagtccctc

SEQ ID NO: 267373 - DNA, 25 bp, Mus musculus
atggtagggtctattattggccttg

SEQ ID NO: 267374 - DNA, 25 bp, Mus musculus
atggtagggtcttttattggccttg

SEQ ID NO: 267375 - DNA, 25 bp, Mus musculus
atggtaggtccacgacagaggctca

SEQ ID NO: 267376 - DNA, 25 bp, Mus musculus
atggtaggtccaggacagaggctca

SEQ ID NO: 267377 - DNA, 25 bp, Mus musculus
atggtagtaagcctcagtgtcgtaa

SEQ ID NO: 267378 - DNA, 25 bp, Mus musculus
atggtagtaagcgtcagtgtcgtaa

SEQ ID NO: 267379 - DNA, 25 bp, Mus musculus
atggtagtcatcaccatcatccaat

SEQ ID NO: 267380 - DNA, 25 bp, Mus musculus
atggtagtcatctccatcatccaat

SEQ ID NO: 267381 - DNA, 25 bp, Mus musculus
atggtagtgacaagccaggttgagc

SEQ ID NO: 267382 - DNA, 25 bp, Mus musculus
atggtagtgacaatccttacggatg

SEQ ID NO: 267383 - DNA, 25 bp, Mus musculus
atggtagtgacatgccaggttgagc

SEQ ID NO: 267384 - DNA, 25 bp, Mus musculus
atggtagtgacattccttacggatg

SEQ ID NO: 267385 - DNA, 25 bp, Mus musculus
atggtagtgatgatttattgactat

SEQ ID NO: 267386 - DNA, 25 bp, Mus musculus
atggtagtgatgttttattgactat

SEQ ID NO: 267387 - DNA, 25 bp, Mus musculus
atggtagtttcacaggctcttgcct

SEQ ID NO: 267388 - DNA, 25 bp, Mus musculus
atggtagtttcagaggctcttgcct

SEQ ID NO: 267389 - DNA, 25 bp, Mus musculus
atggtatacagactccttttgaaag

SEQ ID NO: 267390 - DNA, 25 bp, Mus musculus
atggtatacagagtccttttgaaag

SEQ ID NO: 267391 - DNA, 25 bp, Mus musculus
atggtatatcaaccttgtcattcat

SEQ ID NO: 267392 - DNA, 25 bp, Mus musculus
atggtatatcaagcttgtcattcat

SEQ ID NO: 267393 - DNA, 25 bp, Mus musculus
atggtatatcttaggaagcttctac

SEQ ID NO: 267394 - DNA, 25 bp, Mus musculus
atggtatatctttggaagcttctac

SEQ ID NO: 267395 - DNA, 25 bp, Mus musculus
atggtatatggcacagactccccag

SEQ ID NO: 267396 - DNA, 25 bp, Mus musculus
atggtatatggctcagactccccag

SEQ ID NO: 267397 - DNA, 25 bp, Mus musculus
atggtatcacttagggagtagccta

SEQ ID NO: 267398 - DNA, 25 bp, Mus musculus
atggtatcactttgggagtagccta

SEQ ID NO: 267399 - DNA, 25 bp, Mus musculus
atggtatcctacagagcatttgcgc

SEQ ID NO: 267400 - DNA, 25 bp, Mus musculus
atggtatcctactgagcatttgcgc

SEQ ID NO: 267401 - DNA, 25 bp, Mus musculus
atggtatcctagaactcctggacac

SEQ ID NO: 267402 - DNA, 25 bp, Mus musculus
atggtatcctagtactcctggacac

SEQ ID NO: 267403 - DNA, 25 bp, Mus musculus
atggtatcctcacagcttaccggtg

SEQ ID NO: 267404 - DNA, 25 bp, Mus musculus
atggtatcctcagagcttaccggtg

SEQ ID NO: 267405 - DNA, 25 bp, Mus musculus
atggtatcttggctccagcgggcca

SEQ ID NO: 267406 - DNA, 25 bp, Mus musculus
atggtatcttgggtccagcgggcca

SEQ ID NO: 267407 - DNA, 25 bp, Mus musculus
atggtatgaattctattgtaatgct

SEQ ID NO: 267408 - DNA, 25 bp, Mus musculus
atggtatgaattgtattgtaatgct

SEQ ID NO: 267409 - DNA, 25 bp, Mus musculus
atggtatgacctctccttaaaaaat

SEQ ID NO: 267410 - DNA, 25 bp, Mus musculus
atggtatgacctgtccttaaaaaat

SEQ ID NO: 267411 - DNA, 25 bp, Mus musculus
atggtatgcactcaacaaacacagg

SEQ ID NO: 267412 - DNA, 25 bp, Mus musculus
atggtatgcactgaacaaacacagg

SEQ ID NO: 267413 - DNA, 25 bp, Mus musculus
atggtatgccctcgtgtacaatatt

SEQ ID NO: 267414 - DNA, 25 bp, Mus musculus
atggtatgccctggtgtacaatatt

SEQ ID NO: 267415 - DNA, 25 bp, Mus musculus
atggtatgcctgattgtgcaccacg

SEQ ID NO: 267416 - DNA, 25 bp, Mus musculus
atggtatgcctgtttgtgcaccacg

SEQ ID NO: 267417 - DNA, 25 bp, Mus musculus
atggtatgtaaactgcagctaacgg

SEQ ID NO: 267418 - DNA, 25 bp, Mus musculus
atggtatgtaaagtgcagctaacgg

SEQ ID NO: 267419 - DNA, 25 bp, Mus musculus
atggtatgttctcttacttccttcc

SEQ ID NO: 267420 - DNA, 25 bp, Mus musculus
atggtatgttctgttacttccttcc

SEQ ID NO: 267421 - DNA, 25 bp, Mus musculus
atggtattattcatcgttcccgcta

SEQ ID NO: 267422 - DNA, 25 bp, Mus musculus
atggtattattcttcgttcccgcta

SEQ ID NO: 267423 - DNA, 25 bp, Mus musculus
atggtattcggaactcttttcttgc

SEQ ID NO: 267424 - DNA, 25 bp, Mus musculus
atggtattcggatctcttttcttgc

SEQ ID NO: 267425 - DNA, 25 bp, Mus musculus
atggtattgtttcatggcatagttg

SEQ ID NO: 267426 - DNA, 25 bp, Mus musculus
atggtattgtttgatggcatagttg

SEQ ID NO: 267427 - DNA, 25 bp, Mus musculus
atggtatttgctcccaaaccgagta

SEQ ID NO: 267428 - DNA, 25 bp, Mus musculus
atggtatttgctgccaaaccgagta

SEQ ID NO: 267429 - DNA, 25 bp, Mus musculus
atggtatttgtcctctgggttctta

SEQ ID NO: 267430 - DNA, 25 bp, Mus musculus
atggtatttgtcgtctgggttctta

SEQ ID NO: 267431 - DNA, 25 bp, Mus musculus
atggtattttgccaggcatcacctc

SEQ ID NO: 267432 - DNA, 25 bp, Mus musculus
atggtattttgcgaggcatcacctc

SEQ ID NO: 267433 - DNA, 25 bp, Mus musculus
atggtatttttgaatctcctgcata

SEQ ID NO: 267434 - DNA, 25 bp, Mus musculus
atggtatttttgtatctcctgcata

SEQ ID NO: 267435 - DNA, 25 bp, Mus musculus
atggtcaaacttcccgtgtcctgtg

SEQ ID NO: 267436 - DNA, 25 bp, Mus musculus
atggtcaaacttgccgtgtcctgtg

SEQ ID NO: 267437 - DNA, 25 bp, Mus musculus
atggtcaacaggactccccaagagg

SEQ ID NO: 267438 - DNA, 25 bp, Mus musculus
atggtcaacaggtctccccaagagg

SEQ ID NO: 267439 - DNA, 25 bp, Mus musculus
atggtcaacatgagtcttgggaagc

SEQ ID NO: 267440 - DNA, 25 bp, Mus musculus
atggtcaacatgtgtcttgggaagc

SEQ ID NO: 267441 - DNA, 25 bp, Mus musculus
atggtcaactagaagtccccactct

SEQ ID NO: 267442 - DNA, 25 bp, Mus musculus
atggtcaactagtagtccccactct

SEQ ID NO: 267443 - DNA, 25 bp, Mus musculus
atggtcaagggtccctgtgacccca

SEQ ID NO: 267444 - DNA, 25 bp, Mus musculus
atggtcaagggtgcctgtgacccca

SEQ ID NO: 267445 - DNA, 25 bp, Mus musculus
atggtcacaacaattggttattgaa

SEQ ID NO: 267446 - DNA, 25 bp, Mus musculus
atggtcacaacatttggttattgaa

SEQ ID NO: 267447 - DNA, 25 bp, Mus musculus
atggtcacaacgcaactcagtcaat

SEQ ID NO: 267448 - DNA, 25 bp, Mus musculus
atggtcacaacggaactcagtcaat

SEQ ID NO: 267449 - DNA, 25 bp, Mus musculus
atggtcacacacagatgcttacccg

SEQ ID NO: 267450 - DNA, 25 bp, Mus musculus
atggtcacacactgatgcttacccg

SEQ ID NO: 267451 - DNA, 25 bp, Mus musculus
atggtcacacatatgaagccacaga

SEQ ID NO: 267452 - DNA, 25 bp, Mus musculus
atggtcacacatttgaagccacaga

SEQ ID NO: 267453 - DNA, 25 bp, Mus musculus
atggtcacagctccctgcaggtagg

SEQ ID NO: 267454 - DNA, 25 bp, Mus musculus
atggtcacagctgcctgcaggtagg

SEQ ID NO: 267455 - DNA, 25 bp, Mus musculus
atggtcacaggaacgctgcaagcag

SEQ ID NO: 267456 - DNA, 25 bp, Mus musculus
atggtcacaggatcgctgcaagcag

SEQ ID NO: 267457 - DNA, 25 bp, Mus musculus
atggtcaccaccacttctggtatgt

SEQ ID NO: 267458 - DNA, 25 bp, Mus musculus
atggtcaccacctcttctggtatgt

SEQ ID NO: 267459 - DNA, 25 bp, Mus musculus
atggtcaccccactatgcttttttg

SEQ ID NO: 267460 - DNA, 25 bp, Mus musculus
atggtcaccccagtatgcttttttg

SEQ ID NO: 267461 - DNA, 25 bp, Mus musculus
atggtcacccttcatgagactggac

SEQ ID NO: 267462 - DNA, 25 bp, Mus musculus
atggtcacccttgatgagactggac

SEQ ID NO: 267463 - DNA, 25 bp, Mus musculus
atggtcaccgagcacatttgttctt

SEQ ID NO: 267464 - DNA, 25 bp, Mus musculus
atggtcaccgaggacatttgttctt

SEQ ID NO: 267465 - DNA, 25 bp, Mus musculus
atggtcaccgccatgggttagagag

SEQ ID NO: 267466 - DNA, 25 bp, Mus musculus
atggtcaccgccttgggttagagag

SEQ ID NO: 267467 - DNA, 25 bp, Mus musculus
atggtcacctccaagggtcagctat

SEQ ID NO: 267468 - DNA, 25 bp, Mus musculus
atggtcacctcctagggtcagctat

SEQ ID NO: 267469 - DNA, 25 bp, Mus musculus
atggtcacctcgacttctaaagaca

SEQ ID NO: 267470 - DNA, 25 bp, Mus musculus
atggtcacctcgtcttctaaagaca

SEQ ID NO: 267471 - DNA, 25 bp, Mus musculus
atggtcacctgcctcatggaaatgc

SEQ ID NO: 267472 - DNA, 25 bp, Mus musculus
atggtcacctgcgtcatggaaatgc

SEQ ID NO: 267473 - DNA, 25 bp, Mus musculus
atggtcacctggcatctgtcagaaa

SEQ ID NO: 267474 - DNA, 25 bp, Mus musculus
atggtcacctgggatctgtcagaaa

SEQ ID NO: 267475 - DNA, 25 bp, Mus musculus
atggtcacggatcgcttctttagta

SEQ ID NO: 267476 - DNA, 25 bp, Mus musculus
atggtcacggatggcttctttagta

SEQ ID NO: 267477 - DNA, 25 bp, Mus musculus
atggtcacgtgcctgctttcattgt

SEQ ID NO: 267478 - DNA, 25 bp, Mus musculus
atggtcacgtgcgtgctttcattgt

SEQ ID NO: 267479 - DNA, 25 bp, Mus musculus
atggtcactgcacgacttggcccac

SEQ ID NO: 267480 - DNA, 25 bp, Mus musculus
atggtcactgcaggacttggcccac

SEQ ID NO: 267481 - DNA, 25 bp, Mus musculus
atggtcactgctcttatctgcaagg

SEQ ID NO: 267482 - DNA, 25 bp, Mus musculus
atggtcactgctgttatctgcaagg

SEQ ID NO: 267483 - DNA, 25 bp, Mus musculus
atggtcactgtccagtagctctgtg

SEQ ID NO: 267484 - DNA, 25 bp, Mus musculus
atggtcactgtcgagtagctctgtg

SEQ ID NO: 267485 - DNA, 25 bp, Mus musculus
atggtcagaaccagactccctgtgg

SEQ ID NO: 267486 - DNA, 25 bp, Mus musculus
atggtcagaacctgactccctgtgg

SEQ ID NO: 267487 - DNA, 25 bp, Mus musculus
atggtcagaccaagcactagtgctc

SEQ ID NO: 267488 - DNA, 25 bp, Mus musculus
atggtcagaccatgcactagtgctc

SEQ ID NO: 267489 - DNA, 25 bp, Mus musculus
atggtcagaggccctcccgagcaag

SEQ ID NO: 267490 - DNA, 25 bp, Mus musculus
atggtcagaggcgctcccgagcaag

SEQ ID NO: 267491 - DNA, 25 bp, Mus musculus
atggtcagcagcaacccgacactga

SEQ ID NO: 267492 - DNA, 25 bp, Mus musculus
atggtcagcagctacccgacactga

SEQ ID NO: 267493 - DNA, 25 bp, Mus musculus
atggtcagccggcaaagcagcagaa

SEQ ID NO: 267494 - DNA, 25 bp, Mus musculus
atggtcagccgggaaagcagcagaa

SEQ ID NO: 267495 - DNA, 25 bp, Mus musculus
atggtcagctcacaccctggtagat

SEQ ID NO: 267496 - DNA, 25 bp, Mus musculus
atggtcagctcagaccctggtagat

SEQ ID NO: 267497 - DNA, 25 bp, Mus musculus
atggtcaggagtcttaggaacccca

SEQ ID NO: 267498 - DNA, 25 bp, Mus musculus
atggtcaggagtgttaggaacccca

SEQ ID NO: 267499 - DNA, 25 bp, Mus musculus
atggtcaggcatcttatgaaatact

SEQ ID NO: 267500 - DNA, 25 bp, Mus musculus
atggtcaggcatgttatgaaatact

SEQ ID NO: 267501 - DNA, 25 bp, Mus musculus
atggtcaggctgcagatggatccca

SEQ ID NO: 267502 - DNA, 25 bp, Mus musculus
atggtcaggctggagatggatccca

SEQ ID NO: 267503 - DNA, 25 bp, Mus musculus
atggtcaggttcatacctcatgcct

SEQ ID NO: 267504 - DNA, 25 bp, Mus musculus
atggtcaggttcttacctcatgcct

SEQ ID NO: 267505 - DNA, 25 bp, Mus musculus
atggtcagtatccagctgacctagc

SEQ ID NO: 267506 - DNA, 25 bp, Mus musculus
atggtcagtatcgagctgacctagc

SEQ ID NO: 267507 - DNA, 25 bp, Mus musculus
atggtcataagcaacctcctgatct

SEQ ID NO: 267508 - DNA, 25 bp, Mus musculus
atggtcataagctacctcctgatct

SEQ ID NO: 267509 - DNA, 25 bp, Mus musculus
atggtcatatttcattgcacgaata

SEQ ID NO: 267510 - DNA, 25 bp, Mus musculus
atggtcatatttgattgcacgaata

SEQ ID NO: 267511 - DNA, 25 bp, Mus musculus
atggtcatcaccatctccatgaata

SEQ ID NO: 267512 - DNA, 25 bp, Mus musculus
atggtcatcaccttctccatgaata

SEQ ID NO: 267513 - DNA, 25 bp, Mus musculus
atggtcatcctcaatttcagtgcac

SEQ ID NO: 267514 - DNA, 25 bp, Mus musculus
atggtcatcctctatttcagtgcac

SEQ ID NO: 267515 - DNA, 25 bp, Mus musculus
atggtcatctgcaccattttctaca

SEQ ID NO: 267516 - DNA, 25 bp, Mus musculus
atggtcatctgctccattttctaca

SEQ ID NO: 267517 - DNA, 25 bp, Mus musculus
atggtcatctttatgctttgttttc

SEQ ID NO: 267518 - DNA, 25 bp, Mus musculus
atggtcatctttttgctttgttttc

SEQ ID NO: 267519 - DNA, 25 bp, Mus musculus
atggtcatgatcacctttgcataaa

SEQ ID NO: 267520 - DNA, 25 bp, Mus musculus
atggtcatgatctcctttgcataaa

SEQ ID NO: 267521 - DNA, 25 bp, Mus musculus
atggtcatgctgccgcaggatgatc

SEQ ID NO: 267522 - DNA, 25 bp, Mus musculus
atggtcatgctggcgcaggatgatc

SEQ ID NO: 267523 - DNA, 25 bp, Mus musculus
atggtcatggacaataacctggaac

SEQ ID NO: 267524 - DNA, 25 bp, Mus musculus
atggtcatggactataacctggaac

SEQ ID NO: 267525 - DNA, 25 bp, Mus musculus
atggtcatggctcggagctcccatc

SEQ ID NO: 267526 - DNA, 25 bp, Mus musculus
atggtcatggctgggagctcccatc

SEQ ID NO: 267527 - DNA, 25 bp, Mus musculus
atggtcattattatcatgttactga

SEQ ID NO: 267528 - DNA, 25 bp, Mus musculus
atggtcattattttcatgttactga

SEQ ID NO: 267529 - DNA, 25 bp, Mus musculus
atggtcattccgcagccctgttgag

SEQ ID NO: 267530 - DNA, 25 bp, Mus musculus
atggtcattccggagccctgttgag

SEQ ID NO: 267531 - DNA, 25 bp, Mus musculus
atggtccaaacaatcgcggtttcca

SEQ ID NO: 267532 - DNA, 25 bp, Mus musculus
atggtccaaacaattcttctctctt

SEQ ID NO: 267533 - DNA, 25 bp, Mus musculus
atggtccaaacattcgcggtttcca

SEQ ID NO: 267534 - DNA, 25 bp, Mus musculus
atggtccaaacatttcttctctctt

SEQ ID NO: 267535 - DNA, 25 bp, Mus musculus
atggtccaacttccagtattcctta

SEQ ID NO: 267536 - DNA, 25 bp, Mus musculus
atggtccaacttgcagtattcctta

SEQ ID NO: 267537 - DNA, 25 bp, Mus musculus
atggtccaaggcaacatatgtgttc

SEQ ID NO: 267538 - DNA, 25 bp, Mus musculus
atggtccaaggctacatatgtgttc

SEQ ID NO: 267539 - DNA, 25 bp, Mus musculus
atggtccaagtcactgttgatagca

SEQ ID NO: 267540 - DNA, 25 bp, Mus musculus
atggtccaagtctctgttgatagca

SEQ ID NO: 267541 - DNA, 25 bp, Mus musculus
atggtccacaggctgagcatgcata

SEQ ID NO: 267542 - DNA, 25 bp, Mus musculus
atggtccacagggtgagcatgcata

SEQ ID NO: 267543 - DNA, 25 bp, Mus musculus
atggtccaccttaacgatctggaga

SEQ ID NO: 267544 - DNA, 25 bp, Mus musculus
atggtccacctttacgatctggaga

SEQ ID NO: 267545 - DNA, 25 bp, Mus musculus
atggtccacgcgcagaaggttttgt

SEQ ID NO: 267546 - DNA, 25 bp, Mus musculus
atggtccacgcggagaaggttttgt

SEQ ID NO: 267547 - DNA, 25 bp, Mus musculus
atggtccacgtcagaaaactcactc

SEQ ID NO: 267548 - DNA, 25 bp, Mus musculus
atggtccacgtctgaaaactcactc

SEQ ID NO: 267549 - DNA, 25 bp, Mus musculus
atggtccagcgcattagcctcaggc

SEQ ID NO: 267550 - DNA, 25 bp, Mus musculus
atggtccagcgctttagcctcaggc

SEQ ID NO: 267551 - DNA, 25 bp, Mus musculus
atggtccagcgtcgaggcttaagat

SEQ ID NO: 267552 - DNA, 25 bp, Mus musculus
atggtccagcgtggaggcttaagat

SEQ ID NO: 267553 - DNA, 25 bp, Mus musculus
atggtccagctcagagtgccactga

SEQ ID NO: 267554 - DNA, 25 bp, Mus musculus
atggtccagctctgagtgccactga

SEQ ID NO: 267555 - DNA, 25 bp, Mus musculus
atggtccagcttcataacggctcta

SEQ ID NO: 267556 - DNA, 25 bp, Mus musculus
atggtccagcttgataacggctcta

SEQ ID NO: 267557 - DNA, 25 bp, Mus musculus
atggtccaggatagcacagctgtga

SEQ ID NO: 267558 - DNA, 25 bp, Mus musculus
atggtccaggattgcacagctgtga

SEQ ID NO: 267559 - DNA, 25 bp, Mus musculus
atggtccaggctataggtcctaact

SEQ ID NO: 267560 - DNA, 25 bp, Mus musculus
atggtccaggctttaggtcctaact

SEQ ID NO: 267561 - DNA, 25 bp, Mus musculus
atggtccatccacacaggcaagaaa

SEQ ID NO: 267562 - DNA, 25 bp, Mus musculus
atggtccatccagacaggcaagaaa

SEQ ID NO: 267563 - DNA, 25 bp, Mus musculus
atggtccatcctatagaagtcttag

SEQ ID NO: 267564 - DNA, 25 bp, Mus musculus
atggtccatcctttagaagtcttag

SEQ ID NO: 267565 - DNA, 25 bp, Mus musculus
atggtccatcgtagagggaacccga

SEQ ID NO: 267566 - DNA, 25 bp, Mus musculus
atggtccatcgttgagggaacccga

SEQ ID NO: 267567 - DNA, 25 bp, Mus musculus
atggtccatctgagtttacggcttg

SEQ ID NO: 267568 - DNA, 25 bp, Mus musculus
atggtccatctgtgtttacggcttg

SEQ ID NO: 267569 - DNA, 25 bp, Mus musculus
atggtccatgaacctgtgagggcaa

SEQ ID NO: 267570 - DNA, 25 bp, Mus musculus
atggtccatgaagctgtgagggcaa

SEQ ID NO: 267571 - DNA, 25 bp, Mus musculus
atggtccatggccattctattggat

SEQ ID NO: 267572 - DNA, 25 bp, Mus musculus
atggtccatggcgattctattggat

SEQ ID NO: 267573 - DNA, 25 bp, Mus musculus
atggtccattatcatctgcctggct

SEQ ID NO: 267574 - DNA, 25 bp, Mus musculus
atggtccattatgatctgcctggct

SEQ ID NO: 267575 - DNA, 25 bp, Mus musculus
atggtccatttcatgtgatctatta

SEQ ID NO: 267576 - DNA, 25 bp, Mus musculus
atggtccatttcttgtgatctatta

SEQ ID NO: 267577 - DNA, 25 bp, Mus musculus
atggtcccacagagcctattttgat

SEQ ID NO: 267578 - DNA, 25 bp, Mus musculus
atggtcccacagtgcctattttgat

SEQ ID NO: 267579 - DNA, 25 bp, Mus musculus
atggtcccatcgctttgattgtcaa

SEQ ID NO: 267580 - DNA, 25 bp, Mus musculus
atggtcccatcggtttgattgtcaa

SEQ ID NO: 267581 - DNA, 25 bp, Mus musculus
atggtccccactaataaatgcactt

SEQ ID NO: 267582 - DNA, 25 bp, Mus musculus
atggtccccacttataaatgcactt

SEQ ID NO: 267583 - DNA, 25 bp, Mus musculus
atggtccccagaaatagctaaaaca

SEQ ID NO: 267584 - DNA, 25 bp, Mus musculus
atggtccccagatatagctaaaaca

SEQ ID NO: 267585 - DNA, 25 bp, Mus musculus
atggtccccatacggctctccatat

SEQ ID NO: 267586 - DNA, 25 bp, Mus musculus
atggtccccatagggctctccatat

SEQ ID NO: 267587 - DNA, 25 bp, Mus musculus
atggtccccatgcttcactggacaa

SEQ ID NO: 267588 - DNA, 25 bp, Mus musculus
atggtccccatgcttttgtaatctt

SEQ ID NO: 267589 - DNA, 25 bp, Mus musculus
atggtccccatggttcactggacaa

SEQ ID NO: 267590 - DNA, 25 bp, Mus musculus
atggtccccatggttttgtaatctt

SEQ ID NO: 267591 - DNA, 25 bp, Mus musculus
atggtcccctgccttgcccaaaggg

SEQ ID NO: 267592 - DNA, 25 bp, Mus musculus
atggtcccctgcgttgcccaaaggg

SEQ ID NO: 267593 - DNA, 25 bp, Mus musculus
atggtcccctgtcaaacttgctgtc

SEQ ID NO: 267594 - DNA, 25 bp, Mus musculus
atggtcccctgtgaaacttgctgtc

SEQ ID NO: 267595 - DNA, 25 bp, Mus musculus
atggtccctctgactttaaactttg

SEQ ID NO: 267596 - DNA, 25 bp, Mus musculus
atggtccctctgtctttaaactttg

SEQ ID NO: 267597 - DNA, 25 bp, Mus musculus
atggtccctgcgctcgaagtcaaag

SEQ ID NO: 267598 - DNA, 25 bp, Mus musculus
atggtccctgcggtcgaagtcaaag

SEQ ID NO: 267599 - DNA, 25 bp, Mus musculus
atggtccctgctaggtgctactgta

SEQ ID NO: 267600 - DNA, 25 bp, Mus musculus
atggtccctgcttggtgctactgta

SEQ ID NO: 267601 - DNA, 25 bp, Mus musculus
atggtccctgttctgcttatgagaa

SEQ ID NO: 267602 - DNA, 25 bp, Mus musculus
atggtccctgttgtgcttatgagaa

SEQ ID NO: 267603 - DNA, 25 bp, Mus musculus
atggtccgagtactgccggctgctt

SEQ ID NO: 267604 - DNA, 25 bp, Mus musculus
atggtccgagtagtgccggctgctt

SEQ ID NO: 267605 - DNA, 25 bp, Mus musculus
atggtccggatgaagccatctgtaa

SEQ ID NO: 267606 - DNA, 25 bp, Mus musculus
atggtccggatgtagccatctgtaa

SEQ ID NO: 267607 - DNA, 25 bp, Mus musculus
atggtccgggctccagttttgaaga

SEQ ID NO: 267608 - DNA, 25 bp, Mus musculus
atggtccgggctgcagttttgaaga

SEQ ID NO: 267609 - DNA, 25 bp, Mus musculus
atggtccgtgttctcatctgtattg

SEQ ID NO: 267610 - DNA, 25 bp, Mus musculus
atggtccgtgttgtcatctgtattg

SEQ ID NO: 267611 - DNA, 25 bp, Mus musculus
atggtcctagctacatgttgtctac

SEQ ID NO: 267612 - DNA, 25 bp, Mus musculus
atggtcctagcttcatgttgtctac

SEQ ID NO: 267613 - DNA, 25 bp, Mus musculus
atggtcctaggcctggtcttaagca

SEQ ID NO: 267614 - DNA, 25 bp, Mus musculus
atggtcctaggcgtggtcttaagca

SEQ ID NO: 267615 - DNA, 25 bp, Mus musculus
atggtcctcatgctcacgtgctgca

SEQ ID NO: 267616 - DNA, 25 bp, Mus musculus
atggtcctcatggtcacgtgctgca

SEQ ID NO: 267617 - DNA, 25 bp, Mus musculus
atggtcctcctcaatggaaacccag

SEQ ID NO: 267618 - DNA, 25 bp, Mus musculus
atggtcctcctctatggaaacccag

SEQ ID NO: 267619 - DNA, 25 bp, Mus musculus
atggtcctctaccacattcctgaca

SEQ ID NO: 267620 - DNA, 25 bp, Mus musculus
atggtcctctacgacattcctgaca

SEQ ID NO: 267621 - DNA, 25 bp, Mus musculus
atggtcctcttgaccagctgtgcag

SEQ ID NO: 267622 - DNA, 25 bp, Mus musculus
atggtcctcttgtccagctgtgcag

SEQ ID NO: 267623 - DNA, 25 bp, Mus musculus
atggtcctgcctcaacttagcctag

SEQ ID NO: 267624 - DNA, 25 bp, Mus musculus
atggtcctgcctgaacttagcctag

SEQ ID NO: 267625 - DNA, 25 bp, Mus musculus
atggtcctgctaacagagatgcaac

SEQ ID NO: 267626 - DNA, 25 bp, Mus musculus
atggtcctgctatcagagatgcaac

SEQ ID NO: 267627 - DNA, 25 bp, Mus musculus
atggtcctgggtccccagttgtgca

SEQ ID NO: 267628 - DNA, 25 bp, Mus musculus
atggtcctgggtgcccagttgtgca

SEQ ID NO: 267629 - DNA, 25 bp, Mus musculus
atggtcctgtatacattgcccatac

SEQ ID NO: 267630 - DNA, 25 bp, Mus musculus
atggtcctgtattcattgcccatac

SEQ ID NO: 267631 - DNA, 25 bp, Mus musculus
atggtccttggcaggccactgcttc

SEQ ID NO: 267632 - DNA, 25 bp, Mus musculus
atggtccttggctggccactgcttc

SEQ ID NO: 267633 - DNA, 25 bp, Mus musculus
atggtcctttccagagaagttgagg

SEQ ID NO: 267634 - DNA, 25 bp, Mus musculus
atggtcctttcctgagaagttgagg

SEQ ID NO: 267635 - DNA, 25 bp, Mus musculus
atggtcctttctcgcctagagctgg

SEQ ID NO: 267636 - DNA, 25 bp, Mus musculus
atggtcctttctggcctagagctgg

SEQ ID NO: 267637 - DNA, 25 bp, Mus musculus
atggtcgaccgaaggccagagacag

SEQ ID NO: 267638 - DNA, 25 bp, Mus musculus
atggtcgaccgatggccagagacag

SEQ ID NO: 267639 - DNA, 25 bp, Mus musculus
atggtcgacgagaaggcctggaaca

SEQ ID NO: 267640 - DNA, 25 bp, Mus musculus
atggtcgacgagtaggcctggaaca

SEQ ID NO: 267641 - DNA, 25 bp, Mus musculus
atggtcgatcttcctcaagctagaa

SEQ ID NO: 267642 - DNA, 25 bp, Mus musculus
atggtcgatcttgctcaagctagaa

SEQ ID NO: 267643 - DNA, 25 bp, Mus musculus
atggtcgccaccactaccacagttg

SEQ ID NO: 267644 - DNA, 25 bp, Mus musculus
atggtcgccacctctaccacagttg

SEQ ID NO: 267645 - DNA, 25 bp, Mus musculus
atggtcgctgtgaggctccgaatca

SEQ ID NO: 267646 - DNA, 25 bp, Mus musculus
atggtcgctgtgtggctccgaatca

SEQ ID NO: 267647 - DNA, 25 bp, Mus musculus
atggtcggacttctggtaggcctta

SEQ ID NO: 267648 - DNA, 25 bp, Mus musculus
atggtcggacttgtggtaggcctta

SEQ ID NO: 267649 - DNA, 25 bp, Mus musculus
atggtcgggatgaaagtctctcttc

SEQ ID NO: 267650 - DNA, 25 bp, Mus musculus
atggtcgggatgtaagtctctcttc

SEQ ID NO: 267651 - DNA, 25 bp, Mus musculus
atggtcgtctggacacagaggctgc

SEQ ID NO: 267652 - DNA, 25 bp, Mus musculus
atggtcgtctggtcacagaggctgc

SEQ ID NO: 267653 - DNA, 25 bp, Mus musculus
atggtcgtggaaacttgtggctgca

SEQ ID NO: 267654 - DNA, 25 bp, Mus musculus
atggtcgtggaatcttgtggctgca

SEQ ID NO: 267655 - DNA, 25 bp, Mus musculus
atggtctaagctactggatctcttc

SEQ ID NO: 267656 - DNA, 25 bp, Mus musculus
atggtctaagcttctggatctcttc

SEQ ID NO: 267657 - DNA, 25 bp, Mus musculus
atggtctacagtactctatatgtga

SEQ ID NO: 267658 - DNA, 25 bp, Mus musculus
atggtctacagttctctatatgtga

SEQ ID NO: 267659 - DNA, 25 bp, Mus musculus
atggtctagcccattacaggcacga

SEQ ID NO: 267660 - DNA, 25 bp, Mus musculus
atggtctagccctttacaggcacga

SEQ ID NO: 267661 - DNA, 25 bp, Mus musculus
atggtctaggatactgcagattttc

SEQ ID NO: 267662 - DNA, 25 bp, Mus musculus
atggtctaggattctgcagattttc

SEQ ID NO: 267663 - DNA, 25 bp, Mus musculus
atggtctagtgcagtgagtctcctt

SEQ ID NO: 267664 - DNA, 25 bp, Mus musculus
atggtctagtgctgtgagtctcctt

SEQ ID NO: 267665 - DNA, 25 bp, Mus musculus
atggtctatgtgctgtttatctgtt

SEQ ID NO: 267666 - DNA, 25 bp, Mus musculus
atggtctatgtggtgtttatctgtt

SEQ ID NO: 267667 - DNA, 25 bp, Mus musculus
atggtctcaacacgttttcattccc

SEQ ID NO: 267668 - DNA, 25 bp, Mus musculus
atggtctcaacacttgccacacttt

SEQ ID NO: 267669 - DNA, 25 bp, Mus musculus
atggtctcaacaggttttcattccc

SEQ ID NO: 267670 - DNA, 25 bp, Mus musculus
atggtctcaacagttgccacacttt

SEQ ID NO: 267671 - DNA, 25 bp, Mus musculus
atggtctcaaccattttctctgtgt

SEQ ID NO: 267672 - DNA, 25 bp, Mus musculus
atggtctcaacctttttctctgtgt

SEQ ID NO: 267673 - DNA, 25 bp, Mus musculus
atggtctcaactcccatctgaggtg

SEQ ID NO: 267674 - DNA, 25 bp, Mus musculus
atggtctcaactgccatctgaggtg

SEQ ID NO: 267675 - DNA, 25 bp, Mus musculus
atggtctcacatagactgagtcagc

SEQ ID NO: 267676 - DNA, 25 bp, Mus musculus
atggtctcacattgactgagtcagc

SEQ ID NO: 267677 - DNA, 25 bp, Mus musculus
atggtctcaccaaagctgcctgcat

SEQ ID NO: 267678 - DNA, 25 bp, Mus musculus
atggtctcaccatagctgcctgcat

SEQ ID NO: 267679 - DNA, 25 bp, Mus musculus
atggtctcagacaggaaacccctgg

SEQ ID NO: 267680 - DNA, 25 bp, Mus musculus
atggtctcagactggaaacccctgg

SEQ ID NO: 267681 - DNA, 25 bp, Mus musculus
atggtctcatgaactcattgactga

SEQ ID NO: 267682 - DNA, 25 bp, Mus musculus
atggtctcatgatctcattgactga

SEQ ID NO: 267683 - DNA, 25 bp, Mus musculus
atggtctcatgtcgaacaaattgaa

SEQ ID NO: 267684 - DNA, 25 bp, Mus musculus
atggtctcatgtggaacaaattgaa

SEQ ID NO: 267685 - DNA, 25 bp, Mus musculus
atggtctccatgacagtcaagtcgc

SEQ ID NO: 267686 - DNA, 25 bp, Mus musculus
atggtctccatgtcagtcaagtcgc

SEQ ID NO: 267687 - DNA, 25 bp, Mus musculus
atggtctcccagacagttctcagag

SEQ ID NO: 267688 - DNA, 25 bp, Mus musculus
atggtctcccagtcagttctcagag

SEQ ID NO: 267689 - DNA, 25 bp, Mus musculus
atggtctcccttctgctcaatctca

SEQ ID NO: 267690 - DNA, 25 bp, Mus musculus
atggtctcccttctgtcatgcttgg

SEQ ID NO: 267691 - DNA, 25 bp, Mus musculus
atggtctcccttgtgctcaatctca

SEQ ID NO: 267692 - DNA, 25 bp, Mus musculus
atggtctcccttgtgtcatgcttgg

SEQ ID NO: 267693 - DNA, 25 bp, Mus musculus
atggtctccgagacaagtagtggac

SEQ ID NO: 267694 - DNA, 25 bp, Mus musculus
atggtctccgagtcaagtagtggac

SEQ ID NO: 267695 - DNA, 25 bp, Mus musculus
atggtctcgttccaggtgctaggac

SEQ ID NO: 267696 - DNA, 25 bp, Mus musculus
atggtctcgttcgaggtgctaggac

SEQ ID NO: 267697 - DNA, 25 bp, Mus musculus
atggtctctaccatcttctttagaa

SEQ ID NO: 267698 - DNA, 25 bp, Mus musculus
atggtctctaccttcttctttagaa

SEQ ID NO: 267699 - DNA, 25 bp, Mus musculus
atggtctctatcctcagggtgctat

SEQ ID NO: 267700 - DNA, 25 bp, Mus musculus
atggtctctatcgtcagggtgctat

SEQ ID NO: 267701 - DNA, 25 bp, Mus musculus
atggtctctgcaagttggtacctca

SEQ ID NO: 267702 - DNA, 25 bp, Mus musculus
atggtctctgcatgttggtacctca

SEQ ID NO: 267703 - DNA, 25 bp, Mus musculus
atggtctctggacagccccaggaaa

SEQ ID NO: 267704 - DNA, 25 bp, Mus musculus
atggtctctggagagccccaggaaa

SEQ ID NO: 267705 - DNA, 25 bp, Mus musculus
atggtctgacagatccaagcaagat

SEQ ID NO: 267706 - DNA, 25 bp, Mus musculus
atggtctgacagttccaagcaagat

SEQ ID NO: 267707 - DNA, 25 bp, Mus musculus
atggtctgattcatttatacttatt

SEQ ID NO: 267708 - DNA, 25 bp, Mus musculus
atggtctgattcttttatacttatt

SEQ ID NO: 267709 - DNA, 25 bp, Mus musculus
atggtctgctcccaagccggtgcaa

SEQ ID NO: 267710 - DNA, 25 bp, Mus musculus
atggtctgctccgaagccggtgcaa

SEQ ID NO: 267711 - DNA, 25 bp, Mus musculus
atggtctggagaatcacgccaggat

SEQ ID NO: 267712 - DNA, 25 bp, Mus musculus
atggtctggagattcacgccaggat

SEQ ID NO: 267713 - DNA, 25 bp, Mus musculus
atggtctggcatcagctttaactgg

SEQ ID NO: 267714 - DNA, 25 bp, Mus musculus
atggtctggcatgagctttaactgg

SEQ ID NO: 267715 - DNA, 25 bp, Mus musculus
atggtctgggacctcaagtacaaga

SEQ ID NO: 267716 - DNA, 25 bp, Mus musculus
atggtctgggacgtcaagtacaaga

SEQ ID NO: 267717 - DNA, 25 bp, Mus musculus
atggtctgtgctcgcttcctagagg

SEQ ID NO: 267718 - DNA, 25 bp, Mus musculus
atggtctgtgctggcttcctagagg

SEQ ID NO: 267719 - DNA, 25 bp, Mus musculus
atggtctgtgtcaggcatcagtcct

SEQ ID NO: 267720 - DNA, 25 bp, Mus musculus
atggtctgtgtctggcatcagtcct

SEQ ID NO: 267721 - DNA, 25 bp, Mus musculus
atggtctgttcgatgctgggatcaa

SEQ ID NO: 267722 - DNA, 25 bp, Mus musculus
atggtctgttcgttgctgggatcaa

SEQ ID NO: 267723 - DNA, 25 bp, Mus musculus
atggtcttaaatccactgtggtggt

SEQ ID NO: 267724 - DNA, 25 bp, Mus musculus
atggtcttaaatgcactgtggtggt

SEQ ID NO: 267725 - DNA, 25 bp, Mus musculus
atggtcttaccacccacgggtaatt

SEQ ID NO: 267726 - DNA, 25 bp, Mus musculus
atggtcttaccagccacgggtaatt

SEQ ID NO: 267727 - DNA, 25 bp, Mus musculus
atggtcttagttcggtagcattcta

SEQ ID NO: 267728 - DNA, 25 bp, Mus musculus
atggtcttagttgggtagcattcta

SEQ ID NO: 267729 - DNA, 25 bp, Mus musculus
atggtcttcacaatgcattcgtcga

SEQ ID NO: 267730 - DNA, 25 bp, Mus musculus
atggtcttcacattgcattcgtcga

SEQ ID NO: 267731 - DNA, 25 bp, Mus musculus
atggtcttccatcgtcctcgtagca

SEQ ID NO: 267732 - DNA, 25 bp, Mus musculus
atggtcttccatggtcctcgtagca

SEQ ID NO: 267733 - DNA, 25 bp, Mus musculus
atggtcttccctcaggactttgtac

SEQ ID NO: 267734 - DNA, 25 bp, Mus musculus
atggtcttccctgaggactttgtac

SEQ ID NO: 267735 - DNA, 25 bp, Mus musculus
atggtcttcttcatgtgccactgcc

SEQ ID NO: 267736 - DNA, 25 bp, Mus musculus
atggtcttcttcttgtgccactgcc

SEQ ID NO: 267737 - DNA, 25 bp, Mus musculus
atggtcttgcccaggttcttgatga

SEQ ID NO: 267738 - DNA, 25 bp, Mus musculus
atggtcttgccctggttcttgatga

SEQ ID NO: 267739 - DNA, 25 bp, Mus musculus
atggtcttgggcaccctgttcattg

SEQ ID NO: 267740 - DNA, 25 bp, Mus musculus
atggtcttgggcctgtttacacttt

SEQ ID NO: 267741 - DNA, 25 bp, Mus musculus
atggtcttgggcgtgtttacacttt

SEQ ID NO: 267742 - DNA, 25 bp, Mus musculus
atggtcttgggctccctgttcattg

SEQ ID NO: 267743 - DNA, 25 bp, Mus musculus
atggtcttgtctcgcattctgtgta

SEQ ID NO: 267744 - DNA, 25 bp, Mus musculus
atggtcttgtctggcattctgtgta

SEQ ID NO: 267745 - DNA, 25 bp, Mus musculus
atggtctttatgagtacttcgcagc

SEQ ID NO: 267746 - DNA, 25 bp, Mus musculus
atggtctttatgtgtacttcgcagc

SEQ ID NO: 267747 - DNA, 25 bp, Mus musculus
atggtctttcagaggaagcacgtca

SEQ ID NO: 267748 - DNA, 25 bp, Mus musculus
atggtctttcagtggaagcacgtca

SEQ ID NO: 267749 - DNA, 25 bp, Mus musculus
atggtctttgagaacatgcgccacg

SEQ ID NO: 267750 - DNA, 25 bp, Mus musculus
atggtctttgagtacatgcgccacg

SEQ ID NO: 267751 - DNA, 25 bp, Mus musculus
atggtctttgtcaggtcacgggcca

SEQ ID NO: 267752 - DNA, 25 bp, Mus musculus
atggtctttgtctggtcacgggcca

SEQ ID NO: 267753 - DNA, 25 bp, Mus musculus
atggtcttttgaacagcttagctac

SEQ ID NO: 267754 - DNA, 25 bp, Mus musculus
atggtcttttgatcagcttagctac

SEQ ID NO: 267755 - DNA, 25 bp, Mus musculus
atggtgaaacctattcagatcccaa

SEQ ID NO: 267756 - DNA, 25 bp, Mus musculus
atggtgaaaccttttcagatcccaa

SEQ ID NO: 267757 - DNA, 25 bp, Mus musculus
atggtgaaactcaactgccccaagt

SEQ ID NO: 267758 - DNA, 25 bp, Mus musculus
atggtgaaactctactgccccaagt

SEQ ID NO: 267759 - DNA, 25 bp, Mus musculus
atggtgaaatccatgccacagcttt

SEQ ID NO: 267760 - DNA, 25 bp, Mus musculus
atggtgaaatccttgccacagcttt

SEQ ID NO: 267761 - DNA, 25 bp, Mus musculus
atggtgaacatacggaactcaggac

SEQ ID NO: 267762 - DNA, 25 bp, Mus musculus
atggtgaacatagggaactcaggac

SEQ ID NO: 267763 - DNA, 25 bp, Mus musculus
atggtgaaccacatcttctgtgaca

SEQ ID NO: 267764 - DNA, 25 bp, Mus musculus
atggtgaaccacttcttctgtgaca

SEQ ID NO: 267765 - DNA, 25 bp, Mus musculus
atggtgaactcaaggtttgcctcca

SEQ ID NO: 267766 - DNA, 25 bp, Mus musculus
atggtgaactcatggtttgcctcca

SEQ ID NO: 267767 - DNA, 25 bp, Mus musculus
atggtgaagatgatcctgactacaa

SEQ ID NO: 267768 - DNA, 25 bp, Mus musculus
atggtgaagatgttcctgactacaa

SEQ ID NO: 267769 - DNA, 25 bp, Mus musculus
atggtgaatagcatgctcccttcca

SEQ ID NO: 267770 - DNA, 25 bp, Mus musculus
atggtgaatagcttgctcccttcca

SEQ ID NO: 267771 - DNA, 25 bp, Mus musculus
atggtgaatgggcagctatcttgcc

SEQ ID NO: 267772 - DNA, 25 bp, Mus musculus
atggtgaatggggagctatcttgcc

SEQ ID NO: 267773 - DNA, 25 bp, Mus musculus
atggtgaatgtccacctcatcactc

SEQ ID NO: 267774 - DNA, 25 bp, Mus musculus
atggtgaatgtcgacctcatcactc

SEQ ID NO: 267775 - DNA, 25 bp, Mus musculus
atggtgacaaacacggctggcaaca

SEQ ID NO: 267776 - DNA, 25 bp, Mus musculus
atggtgacaaactcggctggcaaca

SEQ ID NO: 267777 - DNA, 25 bp, Mus musculus
atggtgacacataccccaatttggg

SEQ ID NO: 267778 - DNA, 25 bp, Mus musculus
atggtgacacatctctaaaatccca

SEQ ID NO: 267779 - DNA, 25 bp, Mus musculus
atggtgacacatgtctaaaatccca

SEQ ID NO: 267780 - DNA, 25 bp, Mus musculus
atggtgacacattccccaatttggg

SEQ ID NO: 267781 - DNA, 25 bp, Mus musculus
atggtgacaccgagtaatcccagca

SEQ ID NO: 267782 - DNA, 25 bp, Mus musculus
atggtgacaccgtgtaatcccagca

SEQ ID NO: 267783 - DNA, 25 bp, Mus musculus
atggtgacacgtcagtatcttttta

SEQ ID NO: 267784 - DNA, 25 bp, Mus musculus
atggtgacacgtgagtatcttttta

SEQ ID NO: 267785 - DNA, 25 bp, Mus musculus
atggtgacactcaggcgtggaccca

SEQ ID NO: 267786 - DNA, 25 bp, Mus musculus
atggtgacactctggcgtggaccca

SEQ ID NO: 267787 - DNA, 25 bp, Mus musculus
atggtgacatcacagctgtgcccat

SEQ ID NO: 267788 - DNA, 25 bp, Mus musculus
atggtgacatcagagctgtgcccat

SEQ ID NO: 267789 - DNA, 25 bp, Mus musculus
atggtgacattcctttatttccagc

SEQ ID NO: 267790 - DNA, 25 bp, Mus musculus
atggtgacattcgtttatttccagc

SEQ ID NO: 267791 - DNA, 25 bp, Mus musculus
atggtgaccaacacgctcttctatg

SEQ ID NO: 267792 - DNA, 25 bp, Mus musculus
atggtgaccaactcgctcttctatg

SEQ ID NO: 267793 - DNA, 25 bp, Mus musculus
atggtgaccaccctaaagaaaatag

SEQ ID NO: 267794 - DNA, 25 bp, Mus musculus
atggtgaccaccgtaaagaaaatag

SEQ ID NO: 267795 - DNA, 25 bp, Mus musculus
atggtgaccatccatgacgtgccag

SEQ ID NO: 267796 - DNA, 25 bp, Mus musculus
atggtgaccatcgatgacgtgccag

SEQ ID NO: 267797 - DNA, 25 bp, Mus musculus
atggtgacctaccacatcatcaagg

SEQ ID NO: 267798 - DNA, 25 bp, Mus musculus
atggtgacctacgacatcatcaagg

SEQ ID NO: 267799 - DNA, 25 bp, Mus musculus
atggtgacctagagcggttctcaga

SEQ ID NO: 267800 - DNA, 25 bp, Mus musculus
atggtgacctagtgcggttctcaga

SEQ ID NO: 267801 - DNA, 25 bp, Mus musculus
atggtgacctctataagcctctgta

SEQ ID NO: 267802 - DNA, 25 bp, Mus musculus
atggtgacctctttaagcctctgta

SEQ ID NO: 267803 - DNA, 25 bp, Mus musculus
atggtgaccttcacccctggagatg

SEQ ID NO: 267804 - DNA, 25 bp, Mus musculus
atggtgaccttctcccctggagatg

SEQ ID NO: 267805 - DNA, 25 bp, Mus musculus
atggtgacctttctaggcctctgaa

SEQ ID NO: 267806 - DNA, 25 bp, Mus musculus
atggtgacctttgtaggcctctgaa

SEQ ID NO: 267807 - DNA, 25 bp, Mus musculus
atggtgacgaaaagacatcctaaac

SEQ ID NO: 267808 - DNA, 25 bp, Mus musculus
atggtgacgaaatgacatcctaaac

SEQ ID NO: 267809 - DNA, 25 bp, Mus musculus
atggtgacgattatcccaggatcat

SEQ ID NO: 267810 - DNA, 25 bp, Mus musculus
atggtgacgattttcccaggatcat

SEQ ID NO: 267811 - DNA, 25 bp, Mus musculus
atggtgacggccaagtggactttga

SEQ ID NO: 267812 - DNA, 25 bp, Mus musculus
atggtgacggcctagtggactttga

SEQ ID NO: 267813 - DNA, 25 bp, Mus musculus
atggtgacgtccagtgcaatgtcct

SEQ ID NO: 267814 - DNA, 25 bp, Mus musculus
atggtgacgtcctgtgcaatgtcct

SEQ ID NO: 267815 - DNA, 25 bp, Mus musculus
atggtgactaatcaatcgcccttaa

SEQ ID NO: 267816 - DNA, 25 bp, Mus musculus
atggtgactaatgaatcgcccttaa

SEQ ID NO: 267817 - DNA, 25 bp, Mus musculus
atggtgactaccctgaattcttccg

SEQ ID NO: 267818 - DNA, 25 bp, Mus musculus
atggtgactaccgtgaattcttccg

SEQ ID NO: 267819 - DNA, 25 bp, Mus musculus
atggtgactcacaaggcgctgaggc

SEQ ID NO: 267820 - DNA, 25 bp, Mus musculus
atggtgactcactaggcgctgaggc

SEQ ID NO: 267821 - DNA, 25 bp, Mus musculus
atggtgactcatcctggtgatcgta

SEQ ID NO: 267822 - DNA, 25 bp, Mus musculus
atggtgactcatgctggtgatcgta

SEQ ID NO: 267823 - DNA, 25 bp, Mus musculus
atggtgactccaactaattcccaac

SEQ ID NO: 267824 - DNA, 25 bp, Mus musculus
atggtgactccatctaattcccaac

SEQ ID NO: 267825 - DNA, 25 bp, Mus musculus
atggtgactgagatgacggaccctt

SEQ ID NO: 267826 - DNA, 25 bp, Mus musculus
atggtgactgagttgacggaccctt

SEQ ID NO: 267827 - DNA, 25 bp, Mus musculus
atggtgactgccacatcgccttgct

SEQ ID NO: 267828 - DNA, 25 bp, Mus musculus
atggtgactgccagatccgtgcatc

SEQ ID NO: 267829 - DNA, 25 bp, Mus musculus
atggtgactgcctcatcgccttgct

SEQ ID NO: 267830 - DNA, 25 bp, Mus musculus
atggtgactgcctgatccgtgcatc

SEQ ID NO: 267831 - DNA, 25 bp, Mus musculus
atggtgactgctcaagatcccttaa

SEQ ID NO: 267832 - DNA, 25 bp, Mus musculus
atggtgactgctgaagatcccttaa

SEQ ID NO: 267833 - DNA, 25 bp, Mus musculus
atggtgactgtgaacagctgtgcac

SEQ ID NO: 267834 - DNA, 25 bp, Mus musculus
atggtgactgtgtacagctgtgcac

SEQ ID NO: 267835 - DNA, 25 bp, Mus musculus
atggtgacttctacattgccaacga

SEQ ID NO: 267836 - DNA, 25 bp, Mus musculus
atggtgacttcttcattgccaacga

SEQ ID NO: 267837 - DNA, 25 bp, Mus musculus
atggtgagacccagagatgagttga

SEQ ID NO: 267838 - DNA, 25 bp, Mus musculus
atggtgagaccctgagatgagttga

SEQ ID NO: 267839 - DNA, 25 bp, Mus musculus
atggtgagacctcagcatcctgcta

SEQ ID NO: 267840 - DNA, 25 bp, Mus musculus
atggtgagacctgagcatcctgcta

SEQ ID NO: 267841 - DNA, 25 bp, Mus musculus
atggtgagatagataacctctgatc

SEQ ID NO: 267842 - DNA, 25 bp, Mus musculus
atggtgagatagttaacctctgatc

SEQ ID NO: 267843 - DNA, 25 bp, Mus musculus
atggtgagcctcaccctacggtaaa

SEQ ID NO: 267844 - DNA, 25 bp, Mus musculus
atggtgagcctctccctacggtaaa

SEQ ID NO: 267845 - DNA, 25 bp, Mus musculus
atggtgagcgacataggttctcccc

SEQ ID NO: 267846 - DNA, 25 bp, Mus musculus
atggtgagcgacttaggttctcccc

SEQ ID NO: 267847 - DNA, 25 bp, Mus musculus
atggtgagcttcaggttcattgaga

SEQ ID NO: 267848 - DNA, 25 bp, Mus musculus
atggtgagcttctggttcattgaga

SEQ ID NO: 267849 - DNA, 25 bp, Mus musculus
atggtgaggacgagcccggacaaat

SEQ ID NO: 267850 - DNA, 25 bp, Mus musculus
atggtgaggacgtgcccggacaaat

SEQ ID NO: 267851 - DNA, 25 bp, Mus musculus
atggtgaggccaatgcctggtacac

SEQ ID NO: 267852 - DNA, 25 bp, Mus musculus
atggtgaggccattgcctggtacac

SEQ ID NO: 267853 - DNA, 25 bp, Mus musculus
atggtgaggctgatgggctccccta

SEQ ID NO: 267854 - DNA, 25 bp, Mus musculus
atggtgaggctgttgggctccccta

SEQ ID NO: 267855 - DNA, 25 bp, Mus musculus
atggtgagggtacccagctttactt

SEQ ID NO: 267856 - DNA, 25 bp, Mus musculus
atggtgagggtagccagctttactt

SEQ ID NO: 267857 - DNA, 25 bp, Mus musculus
atggtgagtcctagacttcatctgt

SEQ ID NO: 267858 - DNA, 25 bp, Mus musculus
atggtgagtccttgacttcatctgt

SEQ ID NO: 267859 - DNA, 25 bp, Mus musculus
atggtgagttagaatgacattttac

SEQ ID NO: 267860 - DNA, 25 bp, Mus musculus
atggtgagttagtatgacattttac

SEQ ID NO: 267861 - DNA, 25 bp, Mus musculus
atggtgagttctcttatacatctac

SEQ ID NO: 267862 - DNA, 25 bp, Mus musculus
atggtgagttctgttatacatctac

SEQ ID NO: 267863 - DNA, 25 bp, Mus musculus
atggtgataacgaacctccagcctg

SEQ ID NO: 267864 - DNA, 25 bp, Mus musculus
atggtgataacgtacctccagcctg

SEQ ID NO: 267865 - DNA, 25 bp, Mus musculus
atggtgatcatgagactctagggat

SEQ ID NO: 267866 - DNA, 25 bp, Mus musculus
atggtgatcatgtgactctagggat

SEQ ID NO: 267867 - DNA, 25 bp, Mus musculus
atggtgatccacattggcctgcacg

SEQ ID NO: 267868 - DNA, 25 bp, Mus musculus
atggtgatccacctcatgtaagacg

SEQ ID NO: 267869 - DNA, 25 bp, Mus musculus
atggtgatccacgtcatgtaagacg

SEQ ID NO: 267870 - DNA, 25 bp, Mus musculus
atggtgatccactttggcctgcacg

SEQ ID NO: 267871 - DNA, 25 bp, Mus musculus
atggtgatcgcccacctttggtttt

SEQ ID NO: 267872 - DNA, 25 bp, Mus musculus
atggtgatcgccgacctttggtttt

SEQ ID NO: 267873 - DNA, 25 bp, Mus musculus
atggtgatgagacacccttccttgt

SEQ ID NO: 267874 - DNA, 25 bp, Mus musculus
atggtgatgagagacccttccttgt

SEQ ID NO: 267875 - DNA, 25 bp, Mus musculus
atggtgatgagtaacgcaagctgca

SEQ ID NO: 267876 - DNA, 25 bp, Mus musculus
atggtgatgagttacgcaagctgca

SEQ ID NO: 267877 - DNA, 25 bp, Mus musculus
atggtgatgataccttgagctggaa

SEQ ID NO: 267878 - DNA, 25 bp, Mus musculus
atggtgatgatagcttgagctggaa

SEQ ID NO: 267879 - DNA, 25 bp, Mus musculus
atggtgatgcatcacttggatatga

SEQ ID NO: 267880 - DNA, 25 bp, Mus musculus
atggtgatgcatgacttggatatga

SEQ ID NO: 267881 - DNA, 25 bp, Mus musculus
atggtgatgctacattttcgtttat

SEQ ID NO: 267882 - DNA, 25 bp, Mus musculus
atggtgatgctagattttcgtttat

SEQ ID NO: 267883 - DNA, 25 bp, Mus musculus
atggtgatgcttacgacctttggca

SEQ ID NO: 267884 - DNA, 25 bp, Mus musculus
atggtgatgctttcgacctttggca

SEQ ID NO: 267885 - DNA, 25 bp, Mus musculus
atggtgatggatcacatcctcctcg

SEQ ID NO: 267886 - DNA, 25 bp, Mus musculus
atggtgatggatgacatcctcctcg

SEQ ID NO: 267887 - DNA, 25 bp, Mus musculus
atggtgatgtctctcgtcctgagca

SEQ ID NO: 267888 - DNA, 25 bp, Mus musculus
atggtgatgtctgtcgtcctgagca

SEQ ID NO: 267889 - DNA, 25 bp, Mus musculus
atggtgatgtggacttcgctggcaa

SEQ ID NO: 267890 - DNA, 25 bp, Mus musculus
atggtgatgtggtcttcgctggcaa

SEQ ID NO: 267891 - DNA, 25 bp, Mus musculus
atggtgattgtgctcacatccgtcg

SEQ ID NO: 267892 - DNA, 25 bp, Mus musculus
atggtgattgtggtcacatccgtcg

SEQ ID NO: 267893 - DNA, 25 bp, Mus musculus
atggtgatttgtatcctggtttttg

SEQ ID NO: 267894 - DNA, 25 bp, Mus musculus
atggtgatttgtttcctggtttttg

SEQ ID NO: 267895 - DNA, 25 bp, Mus musculus
atggtgcacaccagttacctcagca

SEQ ID NO: 267896 - DNA, 25 bp, Mus musculus
atggtgcacacctgttacctcagca

SEQ ID NO: 267897 - DNA, 25 bp, Mus musculus
atggtgcaccatctcctgagtgtga

SEQ ID NO: 267898 - DNA, 25 bp, Mus musculus
atggtgcaccatgtcctgagtgtga

SEQ ID NO: 267899 - DNA, 25 bp, Mus musculus
atggtgcacctgcacagttcaccca

SEQ ID NO: 267900 - DNA, 25 bp, Mus musculus
atggtgcacctggacagttcaccca

SEQ ID NO: 267901 - DNA, 25 bp, Mus musculus
atggtgcacttcactcacagctaca

SEQ ID NO: 267902 - DNA, 25 bp, Mus musculus
atggtgcacttctctcacagctaca

SEQ ID NO: 267903 - DNA, 25 bp, Mus musculus
atggtgcactttattcgctatttaa

SEQ ID NO: 267904 - DNA, 25 bp, Mus musculus
atggtgcacttttttcgctatttaa

SEQ ID NO: 267905 - DNA, 25 bp, Mus musculus
atggtgcagatactgccaccctcaa

SEQ ID NO: 267906 - DNA, 25 bp, Mus musculus
atggtgcagatagtgccaccctcaa

SEQ ID NO: 267907 - DNA, 25 bp, Mus musculus
atggtgcagatgaatttcccgcgca

SEQ ID NO: 267908 - DNA, 25 bp, Mus musculus
atggtgcagatgtatttcccgcgca

SEQ ID NO: 267909 - DNA, 25 bp, Mus musculus
atggtgcagcctcactggacacaga

SEQ ID NO: 267910 - DNA, 25 bp, Mus musculus
atggtgcagcctgactggacacaga

SEQ ID NO: 267911 - DNA, 25 bp, Mus musculus
atggtgcatggtaggtttccatcca

SEQ ID NO: 267912 - DNA, 25 bp, Mus musculus
atggtgcatggttggtttccatcca

SEQ ID NO: 267913 - DNA, 25 bp, Mus musculus
atggtgccaacccaagtgtcactgg

SEQ ID NO: 267914 - DNA, 25 bp, Mus musculus
atggtgccaaccgaagtgtcactgg

SEQ ID NO: 267915 - DNA, 25 bp, Mus musculus
atggtgccacaacccttgaattcaa

SEQ ID NO: 267916 - DNA, 25 bp, Mus musculus
atggtgccacaagccttgaattcaa

SEQ ID NO: 267917 - DNA, 25 bp, Mus musculus
atggtgccaccaaagatctctactg

SEQ ID NO: 267918 - DNA, 25 bp, Mus musculus
atggtgccaccatagatctctactg

SEQ ID NO: 267919 - DNA, 25 bp, Mus musculus
atggtgccactcacttcgttacttt

SEQ ID NO: 267920 - DNA, 25 bp, Mus musculus
atggtgccactctcttcgttacttt

SEQ ID NO: 267921 - DNA, 25 bp, Mus musculus
atggtgccaggcatgtcctctgcag

SEQ ID NO: 267922 - DNA, 25 bp, Mus musculus
atggtgccaggcttgtcctctgcag

SEQ ID NO: 267923 - DNA, 25 bp, Mus musculus
atggtgccagggagaagcttcagat

SEQ ID NO: 267924 - DNA, 25 bp, Mus musculus
atggtgccagggtgaagcttcagat

SEQ ID NO: 267925 - DNA, 25 bp, Mus musculus
atggtgccattcctgatcaagtgtg

SEQ ID NO: 267926 - DNA, 25 bp, Mus musculus
atggtgccattcgtgatcaagtgtg

SEQ ID NO: 267927 - DNA, 25 bp, Mus musculus
atggtgcccaatctgcccgaggtgc

SEQ ID NO: 267928 - DNA, 25 bp, Mus musculus
atggtgcccaatgtgcccgaggtgc

SEQ ID NO: 267929 - DNA, 25 bp, Mus musculus
atggtgcccttaattgtcactacaa

SEQ ID NO: 267930 - DNA, 25 bp, Mus musculus
atggtgcccttatttgtcactacaa

SEQ ID NO: 267931 - DNA, 25 bp, Mus musculus
atggtgccggtcaaggtgtctgcct

SEQ ID NO: 267932 - DNA, 25 bp, Mus musculus
atggtgccggtctaggtgtctgcct

SEQ ID NO: 267933 - DNA, 25 bp, Mus musculus
atggtgccgttcaaccaacatccta

SEQ ID NO: 267934 - DNA, 25 bp, Mus musculus
atggtgccgttctaccaacatccta

SEQ ID NO: 267935 - DNA, 25 bp, Mus musculus
atggtgcctcccaaggtgaaatgct

SEQ ID NO: 267936 - DNA, 25 bp, Mus musculus
atggtgcctccctaggtgaaatgct

SEQ ID NO: 267937 - DNA, 25 bp, Mus musculus
atggtgcctcgtatctgtaactcta

SEQ ID NO: 267938 - DNA, 25 bp, Mus musculus
atggtgcctcgtttctgtaactcta

SEQ ID NO: 267939 - DNA, 25 bp, Mus musculus
atggtgcctgacagtgaggccctga

SEQ ID NO: 267940 - DNA, 25 bp, Mus musculus
atggtgcctgactgtgaggccctga

SEQ ID NO: 267941 - DNA, 25 bp, Mus musculus
atggtgcctgagatagtcctgtgcc

SEQ ID NO: 267942 - DNA, 25 bp, Mus musculus
atggtgcctgagttagtcctgtgcc

SEQ ID NO: 267943 - DNA, 25 bp, Mus musculus
atggtgcctgcaagccaacaactgg

SEQ ID NO: 267944 - DNA, 25 bp, Mus musculus
atggtgcctgcatgccaacaactgg

SEQ ID NO: 267945 - DNA, 25 bp, Mus musculus
atggtgcctgctaactatagattga

SEQ ID NO: 267946 - DNA, 25 bp, Mus musculus
atggtgcctgcttactatagattga

SEQ ID NO: 267947 - DNA, 25 bp, Mus musculus
atggtgcctgggagtgaattttctg

SEQ ID NO: 267948 - DNA, 25 bp, Mus musculus
atggtgcctgggtgtgaattttctg

SEQ ID NO: 267949 - DNA, 25 bp, Mus musculus
atggtgcctggtaagcttcttgctg

SEQ ID NO: 267950 - DNA, 25 bp, Mus musculus
atggtgcctggttagcttcttgctg

SEQ ID NO: 267951 - DNA, 25 bp, Mus musculus
atggtgccttccctgagagtgtccg

SEQ ID NO: 267952 - DNA, 25 bp, Mus musculus
atggtgccttccgtgagagtgtccg

SEQ ID NO: 267953 - DNA, 25 bp, Mus musculus
atggtgccttggagccttgatggcc

SEQ ID NO: 267954 - DNA, 25 bp, Mus musculus
atggtgccttggtgccttgatggcc

SEQ ID NO: 267955 - DNA, 25 bp, Mus musculus
atggtgcgagcacgtgcttgttctc

SEQ ID NO: 267956 - DNA, 25 bp, Mus musculus
atggtgcgagcaggtgcttgttctc

SEQ ID NO: 267957 - DNA, 25 bp, Mus musculus
atggtgcgatttactataggatagc

SEQ ID NO: 267958 - DNA, 25 bp, Mus musculus
atggtgcgattttctataggatagc

SEQ ID NO: 267959 - DNA, 25 bp, Mus musculus
atggtgcgcattcgcgtcttctcgg

SEQ ID NO: 267960 - DNA, 25 bp, Mus musculus
atggtgcgcattggcgtcttctcgg

SEQ ID NO: 267961 - DNA, 25 bp, Mus musculus
atggtgcgcctcatgaagcttaacc

SEQ ID NO: 267962 - DNA, 25 bp, Mus musculus
atggtgcgcctcttgaagcttaacc

SEQ ID NO: 267963 - DNA, 25 bp, Mus musculus
atggtgcggattcccagccgcgctt

SEQ ID NO: 267964 - DNA, 25 bp, Mus musculus
atggtgcggattgccagccgcgctt

SEQ ID NO: 267965 - DNA, 25 bp, Mus musculus
atggtgcggcagataccatgcgccc

SEQ ID NO: 267966 - DNA, 25 bp, Mus musculus
atggtgcggcagttaccatgcgccc

SEQ ID NO: 267967 - DNA, 25 bp, Mus musculus
atggtgcggccccttctgtgtgttc

SEQ ID NO: 267968 - DNA, 25 bp, Mus musculus
atggtgcggcccgttctgtgtgttc

SEQ ID NO: 267969 - DNA, 25 bp, Mus musculus
atggtgcgggtaaacctgttggatt

SEQ ID NO: 267970 - DNA, 25 bp, Mus musculus
atggtgcgggtatacctgttggatt

SEQ ID NO: 267971 - DNA, 25 bp, Mus musculus
atggtgctaactcctgttcaaacag

SEQ ID NO: 267972 - DNA, 25 bp, Mus musculus
atggtgctaactgctgttcaaacag

SEQ ID NO: 267973 - DNA, 25 bp, Mus musculus
atggtgctaattcacctggcagtca

SEQ ID NO: 267974 - DNA, 25 bp, Mus musculus
atggtgctaattgacctggcagtca

SEQ ID NO: 267975 - DNA, 25 bp, Mus musculus
atggtgctaccaatcagactcaatc

SEQ ID NO: 267976 - DNA, 25 bp, Mus musculus
atggtgctaccattcagactcaatc

SEQ ID NO: 267977 - DNA, 25 bp, Mus musculus
atggtgctcatgactccagcgaggg

SEQ ID NO: 267978 - DNA, 25 bp, Mus musculus
atggtgctcatgatctcttaccctg

SEQ ID NO: 267979 - DNA, 25 bp, Mus musculus
atggtgctcatgtctccagcgaggg

SEQ ID NO: 267980 - DNA, 25 bp, Mus musculus
atggtgctcatgttctcttaccctg

SEQ ID NO: 267981 - DNA, 25 bp, Mus musculus
atggtgctcattcgctgccacggtc

SEQ ID NO: 267982 - DNA, 25 bp, Mus musculus
atggtgctcattggctgccacggtc

SEQ ID NO: 267983 - DNA, 25 bp, Mus musculus
atggtgctccctcattggcctgtga

SEQ ID NO: 267984 - DNA, 25 bp, Mus musculus
atggtgctccctgattggcctgtga

SEQ ID NO: 267985 - DNA, 25 bp, Mus musculus
atggtgctgaatcgctgaggacatt

SEQ ID NO: 267986 - DNA, 25 bp, Mus musculus
atggtgctgaatggctgaggacatt

SEQ ID NO: 267987 - DNA, 25 bp, Mus musculus
atggtgctgtccacaagactcctga

SEQ ID NO: 267988 - DNA, 25 bp, Mus musculus
atggtgctgtcctcaagactcctga

SEQ ID NO: 267989 - DNA, 25 bp, Mus musculus
atggtgctgtttcaaatctgtagag

SEQ ID NO: 267990 - DNA, 25 bp, Mus musculus
atggtgctgtttgaaatctgtagag

SEQ ID NO: 267991 - DNA, 25 bp, Mus musculus
atggtgcttaacagattgattttga

SEQ ID NO: 267992 - DNA, 25 bp, Mus musculus
atggtgcttaactgattgattttga

SEQ ID NO: 267993 - DNA, 25 bp, Mus musculus
atggtgcttcaaaaaaccgcttcca

SEQ ID NO: 267994 - DNA, 25 bp, Mus musculus
atggtgcttcaataaaccgcttcca

SEQ ID NO: 267995 - DNA, 25 bp, Mus musculus
atggtgcttcatcggtgctctgcag

SEQ ID NO: 267996 - DNA, 25 bp, Mus musculus
atggtgcttcatgggtgctctgcag

SEQ ID NO: 267997 - DNA, 25 bp, Mus musculus
atggtgcttccaaaatactgccttc

SEQ ID NO: 267998 - DNA, 25 bp, Mus musculus
atggtgcttccataatactgccttc

SEQ ID NO: 267999 - DNA, 25 bp, Mus musculus
atggtgcttggacaccttgtagtcc

SEQ ID NO: 268000 - DNA, 25 bp, Mus musculus
atggtgcttggagaccttgtagtcc

SEQ ID NO: 268001 - DNA, 25 bp, Mus musculus
atggtgcttgtgctccctatatttc

SEQ ID NO: 268002 - DNA, 25 bp, Mus musculus
atggtgcttgtggtccctatatttc

SEQ ID NO: 268003 - DNA, 25 bp, Mus musculus
atggtgctttgcaaggatgtattta

SEQ ID NO: 268004 - DNA, 25 bp, Mus musculus
atggtgctttgctaggatgtattta

SEQ ID NO: 268005 - DNA, 25 bp, Mus musculus
atggtgctttttctggatgctaact

SEQ ID NO: 268006 - DNA, 25 bp, Mus musculus
atggtgctttttgtggatgctaact

SEQ ID NO: 268007 - DNA, 25 bp, Mus musculus
atggtggaacctcccagtactgggt

SEQ ID NO: 268008 - DNA, 25 bp, Mus musculus
atggtggaacctgccagtactgggt

SEQ ID NO: 268009 - DNA, 25 bp, Mus musculus
atggtggacaaaccgctgggttccc

SEQ ID NO: 268010 - DNA, 25 bp, Mus musculus
atggtggacaaagcgctgggttccc

SEQ ID NO: 268011 - DNA, 25 bp, Mus musculus
atggtggacattaactgaacttttc

SEQ ID NO: 268012 - DNA, 25 bp, Mus musculus
atggtggacatttactgaacttttc

SEQ ID NO: 268013 - DNA, 25 bp, Mus musculus
atggtggaccgcctcaaaatctctg

SEQ ID NO: 268014 - DNA, 25 bp, Mus musculus
atggtggaccgcgtcaaaatctctg

SEQ ID NO: 268015 - DNA, 25 bp, Mus musculus
atggtggacggccagcacctgctcc

SEQ ID NO: 268016 - DNA, 25 bp, Mus musculus
atggtggacggcgagcacctgctcc

SEQ ID NO: 268017 - DNA, 25 bp, Mus musculus
atggtggactcgactgaccggctaa

SEQ ID NO: 268018 - DNA, 25 bp, Mus musculus
atggtggactcgtctgaccggctaa

SEQ ID NO: 268019 - DNA, 25 bp, Mus musculus
atggtggacttcagggctaaggctt

SEQ ID NO: 268020 - DNA, 25 bp, Mus musculus
atggtggacttctgggctaaggctt

SEQ ID NO: 268021 - DNA, 25 bp, Mus musculus
atggtggagcctcccagctgaagtc

SEQ ID NO: 268022 - DNA, 25 bp, Mus musculus
atggtggagcctgccagctgaagtc

SEQ ID NO: 268023 - DNA, 25 bp, Mus musculus
atggtggaggcccacgcacttaatc

SEQ ID NO: 268024 - DNA, 25 bp, Mus musculus
atggtggaggccgacgcacttaatc

SEQ ID NO: 268025 - DNA, 25 bp, Mus musculus
atggtggagtctacaggctgggtct

SEQ ID NO: 268026 - DNA, 25 bp, Mus musculus
atggtggagtcttcaggctgggtct

SEQ ID NO: 268027 - DNA, 25 bp, Mus musculus
atggtggataatacacttctcaaaa

SEQ ID NO: 268028 - DNA, 25 bp, Mus musculus
atggtggataattcacttctcaaaa

SEQ ID NO: 268029 - DNA, 25 bp, Mus musculus
atggtggatcctcgaggacctcgta

SEQ ID NO: 268030 - DNA, 25 bp, Mus musculus
atggtggatcctggaggacctcgta

SEQ ID NO: 268031 - DNA, 25 bp, Mus musculus
atggtggatgtcatctttgccgatg

SEQ ID NO: 268032 - DNA, 25 bp, Mus musculus
atggtggatgtcttctttgccgatg

SEQ ID NO: 268033 - DNA, 25 bp, Mus musculus
atggtggatgtgaatgcccagagcc

SEQ ID NO: 268034 - DNA, 25 bp, Mus musculus
atggtggatgtgtatgcccagagcc

SEQ ID NO: 268035 - DNA, 25 bp, Mus musculus
atggtggattggaacccatccccaa

SEQ ID NO: 268036 - DNA, 25 bp, Mus musculus
atggtggattggtacccatccccaa

SEQ ID NO: 268037 - DNA, 25 bp, Mus musculus
atggtggcaaaccagaccacccagt

SEQ ID NO: 268038 - DNA, 25 bp, Mus musculus
atggtggcaaacgagaccacccagt

SEQ ID NO: 268039 - DNA, 25 bp, Mus musculus
atggtggcacacctgataccccttt

SEQ ID NO: 268040 - DNA, 25 bp, Mus musculus
atggtggcacacgtgataccccttt

SEQ ID NO: 268041 - DNA, 25 bp, Mus musculus
atggtggcacgcacagcaacagctc

SEQ ID NO: 268042 - DNA, 25 bp, Mus musculus
atggtggcacgctcagcaacagctc

SEQ ID NO: 268043 - DNA, 25 bp, Mus musculus
atggtggcactacttagagagagtc

SEQ ID NO: 268044 - DNA, 25 bp, Mus musculus
atggtggcactagttagagagagtc

SEQ ID NO: 268045 - DNA, 25 bp, Mus musculus
atggtggcagccaatctgattcagg

SEQ ID NO: 268046 - DNA, 25 bp, Mus musculus
atggtggcagcctatctgattcagg

SEQ ID NO: 268047 - DNA, 25 bp, Mus musculus
atggtggcagctctgacaacctgtt

SEQ ID NO: 268048 - DNA, 25 bp, Mus musculus
atggtggcagctgtgacaacctgtt

SEQ ID NO: 268049 - DNA, 25 bp, Mus musculus
atggtggcaggtatcatccgttacc

SEQ ID NO: 268050 - DNA, 25 bp, Mus musculus
atggtggcaggtttcatccgttacc

SEQ ID NO: 268051 - DNA, 25 bp, Mus musculus
atggtggcatatctacagcctctgt

SEQ ID NO: 268052 - DNA, 25 bp, Mus musculus
atggtggcatatgtacagcctctgt

SEQ ID NO: 268053 - DNA, 25 bp, Mus musculus
atggtggcatggattgtgatctctt

SEQ ID NO: 268054 - DNA, 25 bp, Mus musculus
atggtggcatggtttgtgatctctt

SEQ ID NO: 268055 - DNA, 25 bp, Mus musculus
atggtggcatgtaatgccctcttct

SEQ ID NO: 268056 - DNA, 25 bp, Mus musculus
atggtggcatgtagcaagttagtac

SEQ ID NO: 268057 - DNA, 25 bp, Mus musculus
atggtggcatgttatgccctcttct

SEQ ID NO: 268058 - DNA, 25 bp, Mus musculus
atggtggcatgttgcaagttagtac

SEQ ID NO: 268059 - DNA, 25 bp, Mus musculus
atggtggcattcctcatgacttgac

SEQ ID NO: 268060 - DNA, 25 bp, Mus musculus
atggtggcattcgtcatgacttgac

SEQ ID NO: 268061 - DNA, 25 bp, Mus musculus
atggtggccaaacctaccctacaaa

SEQ ID NO: 268062 - DNA, 25 bp, Mus musculus
atggtggccaaagctaccctacaaa

SEQ ID NO: 268063 - DNA, 25 bp, Mus musculus
atggtggccaccaatactccccgaa

SEQ ID NO: 268064 - DNA, 25 bp, Mus musculus
atggtggccacctatactccccgaa

SEQ ID NO: 268065 - DNA, 25 bp, Mus musculus
atggtggcccatcccatggccatgg

SEQ ID NO: 268066 - DNA, 25 bp, Mus musculus
atggtggcccatctccataatcctt

SEQ ID NO: 268067 - DNA, 25 bp, Mus musculus
atggtggcccatgccatggccatgg

SEQ ID NO: 268068 - DNA, 25 bp, Mus musculus
atggtggcccatgtccataatcctt

SEQ ID NO: 268069 - DNA, 25 bp, Mus musculus
atggtggccgcaaagaagacgaaaa

SEQ ID NO: 268070 - DNA, 25 bp, Mus musculus
atggtggccgcatagaagacgaaaa

SEQ ID NO: 268071 - DNA, 25 bp, Mus musculus
atggtggccgccctcttattgctga

SEQ ID NO: 268072 - DNA, 25 bp, Mus musculus
atggtggccgccgtcttattgctga

SEQ ID NO: 268073 - DNA, 25 bp, Mus musculus
atggtggccggtagttttctatgca

SEQ ID NO: 268074 - DNA, 25 bp, Mus musculus
atggtggccggttgttttctatgca

SEQ ID NO: 268075 - DNA, 25 bp, Mus musculus
atggtggcctcgacctgaaaagtaa

SEQ ID NO: 268076 - DNA, 25 bp, Mus musculus
atggtggcctcgtcctgaaaagtaa

SEQ ID NO: 268077 - DNA, 25 bp, Mus musculus
atggtggccttcaaatgtattctca

SEQ ID NO: 268078 - DNA, 25 bp, Mus musculus
atggtggccttctaatgtattctca

SEQ ID NO: 268079 - DNA, 25 bp, Mus musculus
atggtggcgaggaccagttccttaa

SEQ ID NO: 268080 - DNA, 25 bp, Mus musculus
atggtggcgaggtccagttccttaa

SEQ ID NO: 268081 - DNA, 25 bp, Mus musculus
atggtggctatgcagccagctgctt

SEQ ID NO: 268082 - DNA, 25 bp, Mus musculus
atggtggctatggagccagctgctt

SEQ ID NO: 268083 - DNA, 25 bp, Mus musculus
atggtggcttctcgctgtcccagtg

SEQ ID NO: 268084 - DNA, 25 bp, Mus musculus
atggtggcttctcgtagagtccttt

SEQ ID NO: 268085 - DNA, 25 bp, Mus musculus
atggtggcttctggctgtcccagtg

SEQ ID NO: 268086 - DNA, 25 bp, Mus musculus
atggtggcttctggtagagtccttt

SEQ ID NO: 268087 - DNA, 25 bp, Mus musculus
atggtggcttgcaaccacttgtaat

SEQ ID NO: 268088 - DNA, 25 bp, Mus musculus
atggtggcttgctaccacttgtaat

SEQ ID NO: 268089 - DNA, 25 bp, Mus musculus
atggtggcttgtcaggttatttttc

SEQ ID NO: 268090 - DNA, 25 bp, Mus musculus
atggtggcttgtgaggttatttttc

SEQ ID NO: 268091 - DNA, 25 bp, Mus musculus
atggtggctttcactgtagtcgcag

SEQ ID NO: 268092 - DNA, 25 bp, Mus musculus
atggtggctttctctgtagtcgcag

SEQ ID NO: 268093 - DNA, 25 bp, Mus musculus
atggtggctttgaagacctgctctc

SEQ ID NO: 268094 - DNA, 25 bp, Mus musculus
atggtggctttgtagacctgctctc

SEQ ID NO: 268095 - DNA, 25 bp, Mus musculus
atggtggcttttcccagttgtccca

SEQ ID NO: 268096 - DNA, 25 bp, Mus musculus
atggtggcttttgccagttgtccca

SEQ ID NO: 268097 - DNA, 25 bp, Mus musculus
atggtgggacttaatgccttggttc

SEQ ID NO: 268098 - DNA, 25 bp, Mus musculus
atggtgggactttatgccttggttc

SEQ ID NO: 268099 - DNA, 25 bp, Mus musculus
atggtgggcatgactcaagctgcca

SEQ ID NO: 268100 - DNA, 25 bp, Mus musculus
atggtgggcatgtctcaagctgcca

SEQ ID NO: 268101 - DNA, 25 bp, Mus musculus
atggtgggctctatttgttggagct

SEQ ID NO: 268102 - DNA, 25 bp, Mus musculus
atggtgggctctttttgttggagct

SEQ ID NO: 268103 - DNA, 25 bp, Mus musculus
atggtgggtcctagtgacttctggc

SEQ ID NO: 268104 - DNA, 25 bp, Mus musculus
atggtgggtccttgtgacttctggc

SEQ ID NO: 268105 - DNA, 25 bp, Mus musculus
atggtgggtgaaccaagctccaaca

SEQ ID NO: 268106 - DNA, 25 bp, Mus musculus
atggtgggtgaagcaagctccaaca

SEQ ID NO: 268107 - DNA, 25 bp, Mus musculus
atggtggtaaagctacttgtccctt

SEQ ID NO: 268108 - DNA, 25 bp, Mus musculus
atggtggtaaaggtacttgtccctt

SEQ ID NO: 268109 - DNA, 25 bp, Mus musculus
atggtggtaaatcttgtaaacaatc

SEQ ID NO: 268110 - DNA, 25 bp, Mus musculus
atggtggtaaatgttgtaaacaatc

SEQ ID NO: 268111 - DNA, 25 bp, Mus musculus
atggtggtcacaccctgtcactgag

SEQ ID NO: 268112 - DNA, 25 bp, Mus musculus
atggtggtcacagcctgtcactgag

SEQ ID NO: 268113 - DNA, 25 bp, Mus musculus
atggtggtcatcacagtgctgctgt

SEQ ID NO: 268114 - DNA, 25 bp, Mus musculus
atggtggtcatctcagtgctgctgt

SEQ ID NO: 268115 - DNA, 25 bp, Mus musculus
atggtggtcatgacagatccatcca

SEQ ID NO: 268116 - DNA, 25 bp, Mus musculus
atggtggtcatgtcagatccatcca

SEQ ID NO: 268117 - DNA, 25 bp, Mus musculus
atggtggtccccatatttcacaacg

SEQ ID NO: 268118 - DNA, 25 bp, Mus musculus
atggtggtccccttatttcacaacg

SEQ ID NO: 268119 - DNA, 25 bp, Mus musculus
atggtggtgcagatctataatctta

SEQ ID NO: 268120 - DNA, 25 bp, Mus musculus
atggtggtgcagttctataatctta

SEQ ID NO: 268121 - DNA, 25 bp, Mus musculus
atggtggtgcatagctgtggtatca

SEQ ID NO: 268122 - DNA, 25 bp, Mus musculus
atggtggtgcattgctgtggtatca

SEQ ID NO: 268123 - DNA, 25 bp, Mus musculus
atggtggtgcctacctctgacccaa

SEQ ID NO: 268124 - DNA, 25 bp, Mus musculus
atggtggtgccttcctctgacccaa

SEQ ID NO: 268125 - DNA, 25 bp, Mus musculus
atggtggtgctaacgacggtgctac

SEQ ID NO: 268126 - DNA, 25 bp, Mus musculus
atggtggtgctatcgacggtgctac

SEQ ID NO: 268127 - DNA, 25 bp, Mus musculus
atggtggtggcaccttgaattgatt

SEQ ID NO: 268128 - DNA, 25 bp, Mus musculus
atggtggtggcagcttgaattgatt

SEQ ID NO: 268129 - DNA, 25 bp, Mus musculus
atggtggtgggcatacttcacatca

SEQ ID NO: 268130 - DNA, 25 bp, Mus musculus
atggtggtgggcttacttcacatca

SEQ ID NO: 268131 - DNA, 25 bp, Mus musculus
atggtggtgttcagtgcagccatcc

SEQ ID NO: 268132 - DNA, 25 bp, Mus musculus
atggtggtgttctgtgcagccatcc

SEQ ID NO: 268133 - DNA, 25 bp, Mus musculus
atggtggttgccaggctacagttat

SEQ ID NO: 268134 - DNA, 25 bp, Mus musculus
atggtggttgcctggctacagttat

SEQ ID NO: 268135 - DNA, 25 bp, Mus musculus
atggtggttgctcagactgactatc

SEQ ID NO: 268136 - DNA, 25 bp, Mus musculus
atggtggttgctgagactgactatc

SEQ ID NO: 268137 - DNA, 25 bp, Mus musculus
atggtgtacaatcacctgctgcaga

SEQ ID NO: 268138 - DNA, 25 bp, Mus musculus
atggtgtacaatgacctgctgcaga

SEQ ID NO: 268139 - DNA, 25 bp, Mus musculus
atggtgtacaccaactcatccaaca

SEQ ID NO: 268140 - DNA, 25 bp, Mus musculus
atggtgtacacctactcatccaaca

SEQ ID NO: 268141 - DNA, 25 bp, Mus musculus
atggtgtaccgaatctcagcaccca

SEQ ID NO: 268142 - DNA, 25 bp, Mus musculus
atggtgtaccgaatgcctagctagc

SEQ ID NO: 268143 - DNA, 25 bp, Mus musculus
atggtgtaccgattctcagcaccca

SEQ ID NO: 268144 - DNA, 25 bp, Mus musculus
atggtgtaccgattgcctagctagc

SEQ ID NO: 268145 - DNA, 25 bp, Mus musculus
atggtgtaccggcacagccagagct

SEQ ID NO: 268146 - DNA, 25 bp, Mus musculus
atggtgtaccgggacagccagagct

SEQ ID NO: 268147 - DNA, 25 bp, Mus musculus
atggtgtacgacagttagagatgct

SEQ ID NO: 268148 - DNA, 25 bp, Mus musculus
atggtgtacgactgttagagatgct

SEQ ID NO: 268149 - DNA, 25 bp, Mus musculus
atggtgtagaaaatgcatgtaaaca

SEQ ID NO: 268150 - DNA, 25 bp, Mus musculus
atggtgtagaaattgcatgtaaaca

SEQ ID NO: 268151 - DNA, 25 bp, Mus musculus
atggtgtagtttccgtttgttcctt

SEQ ID NO: 268152 - DNA, 25 bp, Mus musculus
atggtgtagtttgcgtttgttcctt

SEQ ID NO: 268153 - DNA, 25 bp, Mus musculus
atggtgtatcttatggtgcattaaa

SEQ ID NO: 268154 - DNA, 25 bp, Mus musculus
atggtgtatcttttggtgcattaaa

SEQ ID NO: 268155 - DNA, 25 bp, Mus musculus
atggtgtattggctttctctaaaac

SEQ ID NO: 268156 - DNA, 25 bp, Mus musculus
atggtgtattgggtttctctaaaac

SEQ ID NO: 268157 - DNA, 25 bp, Mus musculus
atggtgtcaacaagcttaacccctc

SEQ ID NO: 268158 - DNA, 25 bp, Mus musculus
atggtgtcaacatgcttaacccctc

SEQ ID NO: 268159 - DNA, 25 bp, Mus musculus
atggtgtcaggtaccctttctggtc

SEQ ID NO: 268160 - DNA, 25 bp, Mus musculus
atggtgtcaggttccctttctggtc

SEQ ID NO: 268161 - DNA, 25 bp, Mus musculus
atggtgtcatgtaaggtgttcctga

SEQ ID NO: 268162 - DNA, 25 bp, Mus musculus
atggtgtcatgttaggtgttcctga

SEQ ID NO: 268163 - DNA, 25 bp, Mus musculus
atggtgtccacaagccagtgtgcat

SEQ ID NO: 268164 - DNA, 25 bp, Mus musculus
atggtgtccacatgccagtgtgcat

SEQ ID NO: 268165 - DNA, 25 bp, Mus musculus
atggtgtccatcactggcactgggc

SEQ ID NO: 268166 - DNA, 25 bp, Mus musculus
atggtgtccatctctggcactgggc

SEQ ID NO: 268167 - DNA, 25 bp, Mus musculus
atggtgtccccgctgaagatattac

SEQ ID NO: 268168 - DNA, 25 bp, Mus musculus
atggtgtccccggtgaagatattac

SEQ ID NO: 268169 - DNA, 25 bp, Mus musculus
atggtgtcccgcctctcagctgacg

SEQ ID NO: 268170 - DNA, 25 bp, Mus musculus
atggtgtcccgcgtctcagctgacg

SEQ ID NO: 268171 - DNA, 25 bp, Mus musculus
atggtgtccctgagatcttgtactt

SEQ ID NO: 268172 - DNA, 25 bp, Mus musculus
atggtgtccctgatgacctgctcta

SEQ ID NO: 268173 - DNA, 25 bp, Mus musculus
atggtgtccctgtgatcttgtactt

SEQ ID NO: 268174 - DNA, 25 bp, Mus musculus
atggtgtccctgttgacctgctcta

SEQ ID NO: 268175 - DNA, 25 bp, Mus musculus
atggtgtcctctatgctggcttgca

SEQ ID NO: 268176 - DNA, 25 bp, Mus musculus
atggtgtcctctcagcgccacaagc

SEQ ID NO: 268177 - DNA, 25 bp, Mus musculus
atggtgtcctctgagcgccacaagc

SEQ ID NO: 268178 - DNA, 25 bp, Mus musculus
atggtgtcctctttgctggcttgca

SEQ ID NO: 268179 - DNA, 25 bp, Mus musculus
atggtgtctatcatgtgcataggca

SEQ ID NO: 268180 - DNA, 25 bp, Mus musculus
atggtgtctatcttgtgcataggca

SEQ ID NO: 268181 - DNA, 25 bp, Mus musculus
atggtgtctcacacttttgagccca

SEQ ID NO: 268182 - DNA, 25 bp, Mus musculus
atggtgtctcactcttttgagccca

SEQ ID NO: 268183 - DNA, 25 bp, Mus musculus
atggtgtctcccagagtatcatgtg

SEQ ID NO: 268184 - DNA, 25 bp, Mus musculus
atggtgtctccctgagtatcatgtg

SEQ ID NO: 268185 - DNA, 25 bp, Mus musculus
atggtgtctcttccctcaatatagt

SEQ ID NO: 268186 - DNA, 25 bp, Mus musculus
atggtgtctcttgcctcaatatagt

SEQ ID NO: 268187 - DNA, 25 bp, Mus musculus
atggtgtctgttcttggttctaatt

SEQ ID NO: 268188 - DNA, 25 bp, Mus musculus
atggtgtctgttgttggttctaatt

SEQ ID NO: 268189 - DNA, 25 bp, Mus musculus
atggtgtgccatcggaacgcaattc

SEQ ID NO: 268190 - DNA, 25 bp, Mus musculus
atggtgtgccatgggaacgcaattc

SEQ ID NO: 268191 - DNA, 25 bp, Mus musculus
atggtgtgcctgaagccctaaggac

SEQ ID NO: 268192 - DNA, 25 bp, Mus musculus
atggtgtgcctgagagttagcctcc

SEQ ID NO: 268193 - DNA, 25 bp, Mus musculus
atggtgtgcctgtagccctaaggac

SEQ ID NO: 268194 - DNA, 25 bp, Mus musculus
atggtgtgcctgtgagttagcctcc

SEQ ID NO: 268195 - DNA, 25 bp, Mus musculus
atggtgtgctagaaaccccaggccg

SEQ ID NO: 268196 - DNA, 25 bp, Mus musculus
atggtgtgctagtaaccccaggccg

SEQ ID NO: 268197 - DNA, 25 bp, Mus musculus
atggtgtggagactcgaatgatacc

SEQ ID NO: 268198 - DNA, 25 bp, Mus musculus
atggtgtggagagtcgaatgatacc

SEQ ID NO: 268199 - DNA, 25 bp, Mus musculus
atggtgtggcctattccaataccct

SEQ ID NO: 268200 - DNA, 25 bp, Mus musculus
atggtgtggccttttccaataccct

SEQ ID NO: 268201 - DNA, 25 bp, Mus musculus
atggtgtggtcacagccctaggact

SEQ ID NO: 268202 - DNA, 25 bp, Mus musculus
atggtgtggtcagagccctaggact

SEQ ID NO: 268203 - DNA, 25 bp, Mus musculus
atggtgtgtactagagcaatcctca

SEQ ID NO: 268204 - DNA, 25 bp, Mus musculus
atggtgtgtacttgagcaatcctca

SEQ ID NO: 268205 - DNA, 25 bp, Mus musculus
atggtgtgtcagctaatcctctgtt

SEQ ID NO: 268206 - DNA, 25 bp, Mus musculus
atggtgtgtcaggtaatcctctgtt

SEQ ID NO: 268207 - DNA, 25 bp, Mus musculus
atggtgtgtctcctgtcagcacagt

SEQ ID NO: 268208 - DNA, 25 bp, Mus musculus
atggtgtgtctcgtgtcagcacagt

SEQ ID NO: 268209 - DNA, 25 bp, Mus musculus
atggtgtgtgcccttgtacaagaga

SEQ ID NO: 268210 - DNA, 25 bp, Mus musculus
atggtgtgtgccgttgtacaagaga

SEQ ID NO: 268211 - DNA, 25 bp, Mus musculus
atggtgttccttagtgattgtgttc

SEQ ID NO: 268212 - DNA, 25 bp, Mus musculus
atggtgttcctttgtgattgtgttc

SEQ ID NO: 268213 - DNA, 25 bp, Mus musculus
atggtgttcggcatcatcattggaa

SEQ ID NO: 268214 - DNA, 25 bp, Mus musculus
atggtgttcggcttcatcattggaa

SEQ ID NO: 268215 - DNA, 25 bp, Mus musculus
atggtgttcttccttaagatgccct

SEQ ID NO: 268216 - DNA, 25 bp, Mus musculus
atggtgttcttcgttaagatgccct

SEQ ID NO: 268217 - DNA, 25 bp, Mus musculus
atggtgttgactccagacacacaaa

SEQ ID NO: 268218 - DNA, 25 bp, Mus musculus
atggtgttgactgcagacacacaaa

SEQ ID NO: 268219 - DNA, 25 bp, Mus musculus
atggtgttggaacatgtcacagaat

SEQ ID NO: 268220 - DNA, 25 bp, Mus musculus
atggtgttggaagatgtcacagaat

SEQ ID NO: 268221 - DNA, 25 bp, Mus musculus
atggtgttgtacctctctgggatgc

SEQ ID NO: 268222 - DNA, 25 bp, Mus musculus
atggtgttgtacgtctctgggatgc

SEQ ID NO: 268223 - DNA, 25 bp, Mus musculus
atggtgtttaatccaagtcaaaagg

SEQ ID NO: 268224 - DNA, 25 bp, Mus musculus
atggtgtttaatgcaagtcaaaagg

SEQ ID NO: 268225 - DNA, 25 bp, Mus musculus
atggtgtttatacaaggaccttggc

SEQ ID NO: 268226 - DNA, 25 bp, Mus musculus
atggtgtttatagaaggaccttggc

SEQ ID NO: 268227 - DNA, 25 bp, Mus musculus
atggtgtttcacaactgcctttaat

SEQ ID NO: 268228 - DNA, 25 bp, Mus musculus
atggtgtttcactactgcctttaat

SEQ ID NO: 268229 - DNA, 25 bp, Mus musculus
atggtgtttccaagttttcagtttt

SEQ ID NO: 268230 - DNA, 25 bp, Mus musculus
atggtgtttccatgttttcagtttt

SEQ ID NO: 268231 - DNA, 25 bp, Mus musculus
atggtgtttcccaccatgtatgtct

SEQ ID NO: 268232 - DNA, 25 bp, Mus musculus
atggtgtttccctccatgtatgtct

SEQ ID NO: 268233 - DNA, 25 bp, Mus musculus
atggtgtttctaagtcttttctctc

SEQ ID NO: 268234 - DNA, 25 bp, Mus musculus
atggtgtttctatgtcttttctctc

SEQ ID NO: 268235 - DNA, 25 bp, Mus musculus
atggtgtttctcacgggcttgggaa

SEQ ID NO: 268236 - DNA, 25 bp, Mus musculus
atggtgtttctctcgggcttgggaa

SEQ ID NO: 268237 - DNA, 25 bp, Mus musculus
atggtgtttcttctgtcattccaaa

SEQ ID NO: 268238 - DNA, 25 bp, Mus musculus
atggtgtttcttgtgtcattccaaa

SEQ ID NO: 268239 - DNA, 25 bp, Mus musculus
atggtgtttgacattaacttgtgaa

SEQ ID NO: 268240 - DNA, 25 bp, Mus musculus
atggtgtttgactttaacttgtgaa

SEQ ID NO: 268241 - DNA, 25 bp, Mus musculus
atggtgtttgtgagggagtctccct

SEQ ID NO: 268242 - DNA, 25 bp, Mus musculus
atggtgtttgtgtgggagtctccct

SEQ ID NO: 268243 - DNA, 25 bp, Mus musculus
atggttaaaaatctgcactattgtg

SEQ ID NO: 268244 - DNA, 25 bp, Mus musculus
atggttaaaaatgtgcactattgtg

SEQ ID NO: 268245 - DNA, 25 bp, Mus musculus
atggttaaccttctgcactttctta

SEQ ID NO: 268246 - DNA, 25 bp, Mus musculus
atggttaaccttgtgcactttctta

SEQ ID NO: 268247 - DNA, 25 bp, Mus musculus
atggttaactttctctgcacagtga

SEQ ID NO: 268248 - DNA, 25 bp, Mus musculus
atggttaactttgtctgcacagtga

SEQ ID NO: 268249 - DNA, 25 bp, Mus musculus
atggttaagggtccttgcttccagg

SEQ ID NO: 268250 - DNA, 25 bp, Mus musculus
atggttaagggtgcttgcttccagg

SEQ ID NO: 268251 - DNA, 25 bp, Mus musculus
atggttaatcagctgtggtctccaa

SEQ ID NO: 268252 - DNA, 25 bp, Mus musculus
atggttaatcaggtgtggtctccaa

SEQ ID NO: 268253 - DNA, 25 bp, Mus musculus
atggttaatcttacatttatctcta

SEQ ID NO: 268254 - DNA, 25 bp, Mus musculus
atggttaatctttcatttatctcta

SEQ ID NO: 268255 - DNA, 25 bp, Mus musculus
atggttaatgctcaacttgattgtc

SEQ ID NO: 268256 - DNA, 25 bp, Mus musculus
atggttaatgctgaacttgattgtc

SEQ ID NO: 268257 - DNA, 25 bp, Mus musculus
atggttaatgtgactttcatcttgc

SEQ ID NO: 268258 - DNA, 25 bp, Mus musculus
atggttaatgtgtctttcatcttgc

SEQ ID NO: 268259 - DNA, 25 bp, Mus musculus
atggttacaacaaaggcctccagtc

SEQ ID NO: 268260 - DNA, 25 bp, Mus musculus
atggttacaacataggcctccagtc

SEQ ID NO: 268261 - DNA, 25 bp, Mus musculus
atggttacacagatttgccccactt

SEQ ID NO: 268262 - DNA, 25 bp, Mus musculus
atggttacacagttttgccccactt

SEQ ID NO: 268263 - DNA, 25 bp, Mus musculus
atggttacacgtcttcatgcctgtc

SEQ ID NO: 268264 - DNA, 25 bp, Mus musculus
atggttacacgtgttcatgcctgtc

SEQ ID NO: 268265 - DNA, 25 bp, Mus musculus
atggttacactgctcatatacaaag

SEQ ID NO: 268266 - DNA, 25 bp, Mus musculus
atggttacactggtcatatacaaag

SEQ ID NO: 268267 - DNA, 25 bp, Mus musculus
atggttacatatacatatgttcagg

SEQ ID NO: 268268 - DNA, 25 bp, Mus musculus
atggttacatattcatatgttcagg

SEQ ID NO: 268269 - DNA, 25 bp, Mus musculus
atggttacatcaccacagagttttt

SEQ ID NO: 268270 - DNA, 25 bp, Mus musculus
atggttacatcagcacagagttttt

SEQ ID NO: 268271 - DNA, 25 bp, Mus musculus
atggttacatcgcatcccgggtgct

SEQ ID NO: 268272 - DNA, 25 bp, Mus musculus
atggttacatcggatcccgggtgct

SEQ ID NO: 268273 - DNA, 25 bp, Mus musculus
atggttaccaccatccatgtgacat

SEQ ID NO: 268274 - DNA, 25 bp, Mus musculus
atggttaccaccttccatgtgacat

SEQ ID NO: 268275 - DNA, 25 bp, Mus musculus
atggttaccataagctttgcgaggc

SEQ ID NO: 268276 - DNA, 25 bp, Mus musculus
atggttaccatatgctttgcgaggc

SEQ ID NO: 268277 - DNA, 25 bp, Mus musculus
atggttacccttcatggcaaccctg

SEQ ID NO: 268278 - DNA, 25 bp, Mus musculus
atggttacccttgatggcaaccctg

SEQ ID NO: 268279 - DNA, 25 bp, Mus musculus
atggttaccttgcatactgccagaa

SEQ ID NO: 268280 - DNA, 25 bp, Mus musculus
atggttaccttggatactgccagaa

SEQ ID NO: 268281 - DNA, 25 bp, Mus musculus
atggttacgcatcctcggcttcagc

SEQ ID NO: 268282 - DNA, 25 bp, Mus musculus
atggttacgcatgctcggcttcagc

SEQ ID NO: 268283 - DNA, 25 bp, Mus musculus
atggttactgtcaaagcaggccctc

SEQ ID NO: 268284 - DNA, 25 bp, Mus musculus
atggttactgtctaagcaggccctc

SEQ ID NO: 268285 - DNA, 25 bp, Mus musculus
atggttactgtgactgctgtactcc

SEQ ID NO: 268286 - DNA, 25 bp, Mus musculus
atggttactgtgtctgctgtactcc

SEQ ID NO: 268287 - DNA, 25 bp, Mus musculus
atggttacttccactggttgtgcag

SEQ ID NO: 268288 - DNA, 25 bp, Mus musculus
atggttacttccaggcaagcaccgt

SEQ ID NO: 268289 - DNA, 25 bp, Mus musculus
atggttacttcctctggttgtgcag

SEQ ID NO: 268290 - DNA, 25 bp, Mus musculus
atggttacttcctggcaagcaccgt

SEQ ID NO: 268291 - DNA, 25 bp, Mus musculus
atggttacttgcatgtgcgtggcca

SEQ ID NO: 268292 - DNA, 25 bp, Mus musculus
atggttacttgcttgtgcgtggcca

SEQ ID NO: 268293 - DNA, 25 bp, Mus musculus
atggttagcggtaatcaacacatga

SEQ ID NO: 268294 - DNA, 25 bp, Mus musculus
atggttagcggttatcaacacatga

SEQ ID NO: 268295 - DNA, 25 bp, Mus musculus
atggttagctgaagttcatctttgc

SEQ ID NO: 268296 - DNA, 25 bp, Mus musculus
atggttagctgatgttcatctttgc

SEQ ID NO: 268297 - DNA, 25 bp, Mus musculus
atggttatcaccagctgcctgatgc

SEQ ID NO: 268298 - DNA, 25 bp, Mus musculus
atggttatcacctgctgcctgatgc

SEQ ID NO: 268299 - DNA, 25 bp, Mus musculus
atggttatcctcataatgcacctgc

SEQ ID NO: 268300 - DNA, 25 bp, Mus musculus
atggttatcctcttaatgcacctgc

SEQ ID NO: 268301 - DNA, 25 bp, Mus musculus
atggttatctggattccctaagcaa

SEQ ID NO: 268302 - DNA, 25 bp, Mus musculus
atggttatctggtttccctaagcaa

SEQ ID NO: 268303 - DNA, 25 bp, Mus musculus
atggttatgcatacactggcccaca

SEQ ID NO: 268304 - DNA, 25 bp, Mus musculus
atggttatgcattcactggcccaca

SEQ ID NO: 268305 - DNA, 25 bp, Mus musculus
atggttatggctcttgcagcccact

SEQ ID NO: 268306 - DNA, 25 bp, Mus musculus
atggttatggctgttgcagcccact

SEQ ID NO: 268307 - DNA, 25 bp, Mus musculus
atggttattccacgctattgctaat

SEQ ID NO: 268308 - DNA, 25 bp, Mus musculus
atggttattccaggctattgctaat

SEQ ID NO: 268309 - DNA, 25 bp, Mus musculus
atggttcaatgcatagcacctctcc

SEQ ID NO: 268310 - DNA, 25 bp, Mus musculus
atggttcaatgcttagcacctctcc

SEQ ID NO: 268311 - DNA, 25 bp, Mus musculus
atggttcacaacaactcgacagaag

SEQ ID NO: 268312 - DNA, 25 bp, Mus musculus
atggttcacaactactcgacagaag

SEQ ID NO: 268313 - DNA, 25 bp, Mus musculus
atggttcacagcagctctgtagtga

SEQ ID NO: 268314 - DNA, 25 bp, Mus musculus
atggttcacagctgctctgtagtga

SEQ ID NO: 268315 - DNA, 25 bp, Mus musculus
atggttcacgaacaactgacaggtg

SEQ ID NO: 268316 - DNA, 25 bp, Mus musculus
atggttcacgaagaactgacaggtg

SEQ ID NO: 268317 - DNA, 25 bp, Mus musculus
atggttcacttccgagattttcatt

SEQ ID NO: 268318 - DNA, 25 bp, Mus musculus
atggttcacttcggagattttcatt

SEQ ID NO: 268319 - DNA, 25 bp, Mus musculus
atggttcacttgagcatctctcatt

SEQ ID NO: 268320 - DNA, 25 bp, Mus musculus
atggttcacttgtgcatctctcatt

SEQ ID NO: 268321 - DNA, 25 bp, Mus musculus
atggttcagctgataggaacaccga

SEQ ID NO: 268322 - DNA, 25 bp, Mus musculus
atggttcagctgttaggaacaccga

SEQ ID NO: 268323 - DNA, 25 bp, Mus musculus
atggttcaggaaagacagctacaag

SEQ ID NO: 268324 - DNA, 25 bp, Mus musculus
atggttcaggaatgacagctacaag

SEQ ID NO: 268325 - DNA, 25 bp, Mus musculus
atggttcaggtgacttctggctcac

SEQ ID NO: 268326 - DNA, 25 bp, Mus musculus
atggttcaggtgtcttctggctcac

SEQ ID NO: 268327 - DNA, 25 bp, Mus musculus
atggttcaggttaacgacgtgcttt

SEQ ID NO: 268328 - DNA, 25 bp, Mus musculus
atggttcaggtttacgacgtgcttt

SEQ ID NO: 268329 - DNA, 25 bp, Mus musculus
atggttcagtgcacttgccttttta

SEQ ID NO: 268330 - DNA, 25 bp, Mus musculus
atggttcagtgctcttgccttttta

SEQ ID NO: 268331 - DNA, 25 bp, Mus musculus
atggttcagtttaaagttacagtct

SEQ ID NO: 268332 - DNA, 25 bp, Mus musculus
atggttcagtttccaatgtgagctt

SEQ ID NO: 268333 - DNA, 25 bp, Mus musculus
atggttcagtttgcaatgtgagctt

SEQ ID NO: 268334 - DNA, 25 bp, Mus musculus
atggttcagttttaagttacagtct

SEQ ID NO: 268335 - DNA, 25 bp, Mus musculus
atggttcataagagctcatggtcca

SEQ ID NO: 268336 - DNA, 25 bp, Mus musculus
atggttcataagtgctcatggtcca

SEQ ID NO: 268337 - DNA, 25 bp, Mus musculus
atggttcatggcagcacgggcacac

SEQ ID NO: 268338 - DNA, 25 bp, Mus musculus
atggttcatggctgcacgggcacac

SEQ ID NO: 268339 - DNA, 25 bp, Mus musculus
atggttcattacactccttgacttg

SEQ ID NO: 268340 - DNA, 25 bp, Mus musculus
atggttcattactctccttgacttg

SEQ ID NO: 268341 - DNA, 25 bp, Mus musculus
atggttcatttccaagggcacccta

SEQ ID NO: 268342 - DNA, 25 bp, Mus musculus
atggttcatttcgaagggcacccta

SEQ ID NO: 268343 - DNA, 25 bp, Mus musculus
atggttccacgaacaaccaagaagc

SEQ ID NO: 268344 - DNA, 25 bp, Mus musculus
atggttccacgatcaaccaagaagc

SEQ ID NO: 268345 - DNA, 25 bp, Mus musculus
atggttccagaaattgtcgtcccgg

SEQ ID NO: 268346 - DNA, 25 bp, Mus musculus
atggttccagaatttgtcgtcccgg

SEQ ID NO: 268347 - DNA, 25 bp, Mus musculus
atggttccataccatggtgccagaa

SEQ ID NO: 268348 - DNA, 25 bp, Mus musculus
atggttccatacgatggtgccagaa

SEQ ID NO: 268349 - DNA, 25 bp, Mus musculus
atggttccatggctgagctcagtcg

SEQ ID NO: 268350 - DNA, 25 bp, Mus musculus
atggttccatgggtgagctcagtcg

SEQ ID NO: 268351 - DNA, 25 bp, Mus musculus
atggttcccaacagtcgaagtttag

SEQ ID NO: 268352 - DNA, 25 bp, Mus musculus
atggttcccaactgtcgaagtttag

SEQ ID NO: 268353 - DNA, 25 bp, Mus musculus
atggttcccatcagctggtgtgaga

SEQ ID NO: 268354 - DNA, 25 bp, Mus musculus
atggttcccatctgctggtgtgaga

SEQ ID NO: 268355 - DNA, 25 bp, Mus musculus
atggttccctggaccttgagaggag

SEQ ID NO: 268356 - DNA, 25 bp, Mus musculus
atggttccctggtccttgagaggag

SEQ ID NO: 268357 - DNA, 25 bp, Mus musculus
atggttccgtgcctcctatttatgt

SEQ ID NO: 268358 - DNA, 25 bp, Mus musculus
atggttccgtgcgtcctatttatgt

SEQ ID NO: 268359 - DNA, 25 bp, Mus musculus
atggttcctaggctgtgtaatctca

SEQ ID NO: 268360 - DNA, 25 bp, Mus musculus
atggttcctagggtgtgtaatctca

SEQ ID NO: 268361 - DNA, 25 bp, Mus musculus
atggttcctgcgaggaaagtctccc

SEQ ID NO: 268362 - DNA, 25 bp, Mus musculus
atggttcctgcgtggaaagtctccc

SEQ ID NO: 268363 - DNA, 25 bp, Mus musculus
atggttcctggtatcacttgggcct

SEQ ID NO: 268364 - DNA, 25 bp, Mus musculus
atggttcctggtttcacttgggcct

SEQ ID NO: 268365 - DNA, 25 bp, Mus musculus
atggttcctttcaggtagagtcatt

SEQ ID NO: 268366 - DNA, 25 bp, Mus musculus
atggttcctttctggtagagtcatt

SEQ ID NO: 268367 - DNA, 25 bp, Mus musculus
atggttctaaagaccctagtcgctg

SEQ ID NO: 268368 - DNA, 25 bp, Mus musculus
atggttctaaagtccctagtcgctg

SEQ ID NO: 268369 - DNA, 25 bp, Mus musculus
atggttctaagtcatgtccaccccg

SEQ ID NO: 268370 - DNA, 25 bp, Mus musculus
atggttctaagtgatgtccaccccg

SEQ ID NO: 268371 - DNA, 25 bp, Mus musculus
atggttctacatcctgtcaagtgct

SEQ ID NO: 268372 - DNA, 25 bp, Mus musculus
atggttctacatgctgtcaagtgct

SEQ ID NO: 268373 - DNA, 25 bp, Mus musculus
atggttctagtaccaaagaatctgt

SEQ ID NO: 268374 - DNA, 25 bp, Mus musculus
atggttctagtagcaaagaatctgt

SEQ ID NO: 268375 - DNA, 25 bp, Mus musculus
atggttctagtcaatacatcctcaa

SEQ ID NO: 268376 - DNA, 25 bp, Mus musculus
atggttctagtctatacatcctcaa

SEQ ID NO: 268377 - DNA, 25 bp, Mus musculus
atggttctattcacattctctctga

SEQ ID NO: 268378 - DNA, 25 bp, Mus musculus
atggttctattctcattctctctga

SEQ ID NO: 268379 - DNA, 25 bp, Mus musculus
atggttctcagcagggtacagaggt

SEQ ID NO: 268380 - DNA, 25 bp, Mus musculus
atggttctcagctgggtacagaggt

SEQ ID NO: 268381 - DNA, 25 bp, Mus musculus
atggttctgaccacttttgctaaga

SEQ ID NO: 268382 - DNA, 25 bp, Mus musculus
atggttctgaccatcagtgccaaag

SEQ ID NO: 268383 - DNA, 25 bp, Mus musculus
atggttctgacctcttttgctaaga

SEQ ID NO: 268384 - DNA, 25 bp, Mus musculus
atggttctgaccttcagtgccaaag

SEQ ID NO: 268385 - DNA, 25 bp, Mus musculus
atggttctgcacacttctcggctca

SEQ ID NO: 268386 - DNA, 25 bp, Mus musculus
atggttctgcactcttctcggctca

SEQ ID NO: 268387 - DNA, 25 bp, Mus musculus
atggttctgcctcaagtgcatcgaa

SEQ ID NO: 268388 - DNA, 25 bp, Mus musculus
atggttctgcctgaagtgcatcgaa

SEQ ID NO: 268389 - DNA, 25 bp, Mus musculus
atggttctggacaacacaacgcgca

SEQ ID NO: 268390 - DNA, 25 bp, Mus musculus
atggttctggactacacaacgcgca

SEQ ID NO: 268391 - DNA, 25 bp, Mus musculus
atggttctggatacatgttctgaga

SEQ ID NO: 268392 - DNA, 25 bp, Mus musculus
atggttctggattcatgttctgaga

SEQ ID NO: 268393 - DNA, 25 bp, Mus musculus
atggttctggttccatcttctcctc

SEQ ID NO: 268394 - DNA, 25 bp, Mus musculus
atggttctggttgcatcttctcctc

SEQ ID NO: 268395 - DNA, 25 bp, Mus musculus
atggttctgtgcaggcctggagtca

SEQ ID NO: 268396 - DNA, 25 bp, Mus musculus
atggttctgtgcagttctagctagt

SEQ ID NO: 268397 - DNA, 25 bp, Mus musculus
atggttctgtgctggcctggagtca

SEQ ID NO: 268398 - DNA, 25 bp, Mus musculus
atggttctgtgctgttctagctagt

SEQ ID NO: 268399 - DNA, 25 bp, Mus musculus
atggttctgtttacatccgtcttca

SEQ ID NO: 268400 - DNA, 25 bp, Mus musculus
atggttctgttttcatccgtcttca

SEQ ID NO: 268401 - DNA, 25 bp, Mus musculus
atggttcttgttatcatctagtcat

SEQ ID NO: 268402 - DNA, 25 bp, Mus musculus
atggttcttgttttcatctagtcat

SEQ ID NO: 268403 - DNA, 25 bp, Mus musculus
atggttgaattaagtcctgcttcca

SEQ ID NO: 268404 - DNA, 25 bp, Mus musculus
atggttgaattatgtcctgcttcca

SEQ ID NO: 268405 - DNA, 25 bp, Mus musculus
atggttgacaagctcctgtaactcc

SEQ ID NO: 268406 - DNA, 25 bp, Mus musculus
atggttgacaaggtcctgtaactcc

SEQ ID NO: 268407 - DNA, 25 bp, Mus musculus
atggttgacagtacatgccaagaaa

SEQ ID NO: 268408 - DNA, 25 bp, Mus musculus
atggttgacagttcatgccaagaaa

SEQ ID NO: 268409 - DNA, 25 bp, Mus musculus
atggttgactgcatcattatggaca

SEQ ID NO: 268410 - DNA, 25 bp, Mus musculus
atggttgactgcttcattatggaca

SEQ ID NO: 268411 - DNA, 25 bp, Mus musculus
atggttgactgtactaatgactccc

SEQ ID NO: 268412 - DNA, 25 bp, Mus musculus
atggttgactgttctaatgactccc

SEQ ID NO: 268413 - DNA, 25 bp, Mus musculus
atggttgagtttcacacggttcctt

SEQ ID NO: 268414 - DNA, 25 bp, Mus musculus
atggttgagtttgacacggttcctt

SEQ ID NO: 268415 - DNA, 25 bp, Mus musculus
atggttgatgtgactccctgtgtga

SEQ ID NO: 268416 - DNA, 25 bp, Mus musculus
atggttgatgtgtctccctgtgtga

SEQ ID NO: 268417 - DNA, 25 bp, Mus musculus
atggttgcaagcacttcaggataac

SEQ ID NO: 268418 - DNA, 25 bp, Mus musculus
atggttgcaagctcttcaggataac

SEQ ID NO: 268419 - DNA, 25 bp, Mus musculus
atggttgcacatctcattagttttg

SEQ ID NO: 268420 - DNA, 25 bp, Mus musculus
atggttgcacatgtcattagttttg

SEQ ID NO: 268421 - DNA, 25 bp, Mus musculus
atggttgccatgattgcatcagaga

SEQ ID NO: 268422 - DNA, 25 bp, Mus musculus
atggttgccatgtttgcatcagaga

SEQ ID NO: 268423 - DNA, 25 bp, Mus musculus
atggttgccccaagttccagaccca

SEQ ID NO: 268424 - DNA, 25 bp, Mus musculus
atggttgccccatgttccagaccca

SEQ ID NO: 268425 - DNA, 25 bp, Mus musculus
atggttgcccgtcgtgccttgctca

SEQ ID NO: 268426 - DNA, 25 bp, Mus musculus
atggttgcccgtggtgccttgctca

SEQ ID NO: 268427 - DNA, 25 bp, Mus musculus
atggttgcgcccatggctgataaga

SEQ ID NO: 268428 - DNA, 25 bp, Mus musculus
atggttgcgcccttggctgataaga

SEQ ID NO: 268429 - DNA, 25 bp, Mus musculus
atggttgctgctaggaactcctgca

SEQ ID NO: 268430 - DNA, 25 bp, Mus musculus
atggttgctgcttggaactcctgca

SEQ ID NO: 268431 - DNA, 25 bp, Mus musculus
atggttgctggtatggaatctacac

SEQ ID NO: 268432 - DNA, 25 bp, Mus musculus
atggttgctggtttggaatctacac

SEQ ID NO: 268433 - DNA, 25 bp, Mus musculus
atggttgctttgagtcacagggcgc

SEQ ID NO: 268434 - DNA, 25 bp, Mus musculus
atggttgctttgtgtcacagggcgc

SEQ ID NO: 268435 - DNA, 25 bp, Mus musculus
atggttgggaaactacttgctaata

SEQ ID NO: 268436 - DNA, 25 bp, Mus musculus
atggttgggaaagtacttgctaata

SEQ ID NO: 268437 - DNA, 25 bp, Mus musculus
atggttgggctgagctatccaccgg

SEQ ID NO: 268438 - DNA, 25 bp, Mus musculus
atggttgggctgtgctatccaccgg

SEQ ID NO: 268439 - DNA, 25 bp, Mus musculus
atggttggtatcattccctaggctg

SEQ ID NO: 268440 - DNA, 25 bp, Mus musculus
atggttggtatctttccctaggctg

SEQ ID NO: 268441 - DNA, 25 bp, Mus musculus
atggttggtcccacattctgagtgt

SEQ ID NO: 268442 - DNA, 25 bp, Mus musculus
atggttggtccctcattctgagtgt

SEQ ID NO: 268443 - DNA, 25 bp, Mus musculus
atggttggtgacatgctgttaatac

SEQ ID NO: 268444 - DNA, 25 bp, Mus musculus
atggttggtgacttgctgttaatac

SEQ ID NO: 268445 - DNA, 25 bp, Mus musculus
atggttggttatctgtcatgttgcc

SEQ ID NO: 268446 - DNA, 25 bp, Mus musculus
atggttggttatgtgtcatgttgcc

SEQ ID NO: 268447 - DNA, 25 bp, Mus musculus
atggttgtacaaaccgttcaactgt

SEQ ID NO: 268448 - DNA, 25 bp, Mus musculus
atggttgtacaatccgttcaactgt

SEQ ID NO: 268449 - DNA, 25 bp, Mus musculus
atggttgtactgagatgccttagat

SEQ ID NO: 268450 - DNA, 25 bp, Mus musculus
atggttgtactgtgatgccttagat

SEQ ID NO: 268451 - DNA, 25 bp, Mus musculus
atggttgtattgatctgtactggta

SEQ ID NO: 268452 - DNA, 25 bp, Mus musculus
atggttgtattgttctgtactggta

SEQ ID NO: 268453 - DNA, 25 bp, Mus musculus
atggttgtatttatgccacaaaagg

SEQ ID NO: 268454 - DNA, 25 bp, Mus musculus
atggttgtatttttgccacaaaagg

SEQ ID NO: 268455 - DNA, 25 bp, Mus musculus
atggttgtcagcaagagattgttct

SEQ ID NO: 268456 - DNA, 25 bp, Mus musculus
atggttgtcagctagagattgttct

SEQ ID NO: 268457 - DNA, 25 bp, Mus musculus
atggttgtctccagggaggcagcca

SEQ ID NO: 268458 - DNA, 25 bp, Mus musculus
atggttgtctcctgggaggcagcca

SEQ ID NO: 268459 - DNA, 25 bp, Mus musculus
atggttgtctgcagtgttagttcct

SEQ ID NO: 268460 - DNA, 25 bp, Mus musculus
atggttgtctgcatagggcctgcca

SEQ ID NO: 268461 - DNA, 25 bp, Mus musculus
atggttgtctgctgtgttagttcct

SEQ ID NO: 268462 - DNA, 25 bp, Mus musculus
atggttgtctgcttagggcctgcca

SEQ ID NO: 268463 - DNA, 25 bp, Mus musculus
atggttgtctgtaggctttaggcca

SEQ ID NO: 268464 - DNA, 25 bp, Mus musculus
atggttgtctgttggctttaggcca

SEQ ID NO: 268465 - DNA, 25 bp, Mus musculus
atggttgtgccacgtggctgtactc

SEQ ID NO: 268466 - DNA, 25 bp, Mus musculus
atggttgtgccaggtggctgtactc

SEQ ID NO: 268467 - DNA, 25 bp, Mus musculus
atggttgtggtactgcagatgcctt

SEQ ID NO: 268468 - DNA, 25 bp, Mus musculus
atggttgtggtagtgcagatgcctt

SEQ ID NO: 268469 - DNA, 25 bp, Mus musculus
atggttgtgtcaaaatcatctcatt

SEQ ID NO: 268470 - DNA, 25 bp, Mus musculus
atggttgtgtcataatcatctcatt

SEQ ID NO: 268471 - DNA, 25 bp, Mus musculus
atggttgttggtatatctgcggtat

SEQ ID NO: 268472 - DNA, 25 bp, Mus musculus
atggttgttggtttatctgcggtat

SEQ ID NO: 268473 - DNA, 25 bp, Mus musculus
atggtttaagttcacctcaggtctt

SEQ ID NO: 268474 - DNA, 25 bp, Mus musculus
atggtttaagttgacctcaggtctt

SEQ ID NO: 268475 - DNA, 25 bp, Mus musculus
atggtttacaacaactctgctcaca

SEQ ID NO: 268476 - DNA, 25 bp, Mus musculus
atggtttacaactactctgctcaca

SEQ ID NO: 268477 - DNA, 25 bp, Mus musculus
atggtttacctgagcattgaccagt

SEQ ID NO: 268478 - DNA, 25 bp, Mus musculus
atggtttacctgtgcattgaccagt

SEQ ID NO: 268479 - DNA, 25 bp, Mus musculus
atggtttagtgccaggttctacctg

SEQ ID NO: 268480 - DNA, 25 bp, Mus musculus
atggtttagtgcgaggttctacctg

SEQ ID NO: 268481 - DNA, 25 bp, Mus musculus
atggtttatctcagactctttcttc

SEQ ID NO: 268482 - DNA, 25 bp, Mus musculus
atggtttatctctgactctttcttc

SEQ ID NO: 268483 - DNA, 25 bp, Mus musculus
atggtttatgcaagcccagtgcagc

SEQ ID NO: 268484 - DNA, 25 bp, Mus musculus
atggtttatgcatgcccagtgcagc

SEQ ID NO: 268485 - DNA, 25 bp, Mus musculus
atggtttatgccatcagccagactt

SEQ ID NO: 268486 - DNA, 25 bp, Mus musculus
atggtttatgccattttctatccct

SEQ ID NO: 268487 - DNA, 25 bp, Mus musculus
atggtttatgccttcagccagactt

SEQ ID NO: 268488 - DNA, 25 bp, Mus musculus
atggtttatgcctttttctatccct

SEQ ID NO: 268489 - DNA, 25 bp, Mus musculus
atggtttattctatactgtgccctc

SEQ ID NO: 268490 - DNA, 25 bp, Mus musculus
atggtttattctttactgtgccctc

SEQ ID NO: 268491 - DNA, 25 bp, Mus musculus
atggtttcaaagagctacctctcca

SEQ ID NO: 268492 - DNA, 25 bp, Mus musculus
atggtttcaaagtgctacctctcca

SEQ ID NO: 268493 - DNA, 25 bp, Mus musculus
atggtttcaaatcactgcgctgcgt

SEQ ID NO: 268494 - DNA, 25 bp, Mus musculus
atggtttcaaatgactgcgctgcgt

SEQ ID NO: 268495 - DNA, 25 bp, Mus musculus
atggtttcaatgaatctccttgagg

SEQ ID NO: 268496 - DNA, 25 bp, Mus musculus
atggtttcaatgtatctccttgagg

SEQ ID NO: 268497 - DNA, 25 bp, Mus musculus
atggtttcacacacagtgacagcaa

SEQ ID NO: 268498 - DNA, 25 bp, Mus musculus
atggtttcacactcagtgacagcaa

SEQ ID NO: 268499 - DNA, 25 bp, Mus musculus
atggtttcagctattacatttcaga

SEQ ID NO: 268500 - DNA, 25 bp, Mus musculus
atggtttcagcttttacatttcaga

SEQ ID NO: 268501 - DNA, 25 bp, Mus musculus
atggtttcaggaagtccacgaccct

SEQ ID NO: 268502 - DNA, 25 bp, Mus musculus
atggtttcaggatgtccacgaccct

SEQ ID NO: 268503 - DNA, 25 bp, Mus musculus
atggtttccaccaagaatgctcagc

SEQ ID NO: 268504 - DNA, 25 bp, Mus musculus
atggtttccacctagaatgctcagc

SEQ ID NO: 268505 - DNA, 25 bp, Mus musculus
atggtttccaggaccgtgtggccag

SEQ ID NO: 268506 - DNA, 25 bp, Mus musculus
atggtttccaggtccgtgtggccag

SEQ ID NO: 268507 - DNA, 25 bp, Mus musculus
atggtttccctgagattgcactcca

SEQ ID NO: 268508 - DNA, 25 bp, Mus musculus
atggtttccctgagcgcatgagaca

SEQ ID NO: 268509 - DNA, 25 bp, Mus musculus
atggtttccctgtgattgcactcca

SEQ ID NO: 268510 - DNA, 25 bp, Mus musculus
atggtttccctgtgcgcatgagaca

SEQ ID NO: 268511 - DNA, 25 bp, Mus musculus
atggtttccgctcatgctgacgcag

SEQ ID NO: 268512 - DNA, 25 bp, Mus musculus
atggtttccgctgatgctgacgcag

SEQ ID NO: 268513 - DNA, 25 bp, Mus musculus
atggtttcctggctgtacacagaac

SEQ ID NO: 268514 - DNA, 25 bp, Mus musculus
atggtttcctgggtgtacacagaac

SEQ ID NO: 268515 - DNA, 25 bp, Mus musculus
atggtttccttaaattatgagcaca

SEQ ID NO: 268516 - DNA, 25 bp, Mus musculus
atggtttccttatattatgagcaca

SEQ ID NO: 268517 - DNA, 25 bp, Mus musculus
atggtttcggtcaggccatctccag

SEQ ID NO: 268518 - DNA, 25 bp, Mus musculus
atggtttcggtctggccatctccag

SEQ ID NO: 268519 - DNA, 25 bp, Mus musculus
atggtttcgtgacatgtatacaatt

SEQ ID NO: 268520 - DNA, 25 bp, Mus musculus
atggtttcgtgagatgtatacaatt

SEQ ID NO: 268521 - DNA, 25 bp, Mus musculus
atggtttctcatagcactaggctgc

SEQ ID NO: 268522 - DNA, 25 bp, Mus musculus
atggtttctcattgcactaggctgc

SEQ ID NO: 268523 - DNA, 25 bp, Mus musculus
atggtttctctcatcaagtacacag

SEQ ID NO: 268524 - DNA, 25 bp, Mus musculus
atggtttctctcttcaagtacacag

SEQ ID NO: 268525 - DNA, 25 bp, Mus musculus
atggtttctgacctctgacccttaa

SEQ ID NO: 268526 - DNA, 25 bp, Mus musculus
atggtttctgacgtctgacccttaa

SEQ ID NO: 268527 - DNA, 25 bp, Mus musculus
atggtttctgccaagctggaatcac

SEQ ID NO: 268528 - DNA, 25 bp, Mus musculus
atggtttctgcctagctggaatcac

SEQ ID NO: 268529 - DNA, 25 bp, Mus musculus
atggtttcttggcacccataaccaa

SEQ ID NO: 268530 - DNA, 25 bp, Mus musculus
atggtttcttgggacccataaccaa

SEQ ID NO: 268531 - DNA, 25 bp, Mus musculus
atggtttcttgtaacctccaggatg

SEQ ID NO: 268532 - DNA, 25 bp, Mus musculus
atggtttcttgttacctccaggatg

SEQ ID NO: 268533 - DNA, 25 bp, Mus musculus
atggtttctttgcagtgcacctcaa

SEQ ID NO: 268534 - DNA, 25 bp, Mus musculus
atggtttctttggagtgcacctcaa

SEQ ID NO: 268535 - DNA, 25 bp, Mus musculus
atggtttgaactctgtctggtcctc

SEQ ID NO: 268536 - DNA, 25 bp, Mus musculus
atggtttgaactgtgtctggtcctc

SEQ ID NO: 268537 - DNA, 25 bp, Mus musculus
atggtttgactgaccctagttggat

SEQ ID NO: 268538 - DNA, 25 bp, Mus musculus
atggtttgactgtccctagttggat

SEQ ID NO: 268539 - DNA, 25 bp, Mus musculus
atggtttgagcacctactcccacta

SEQ ID NO: 268540 - DNA, 25 bp, Mus musculus
atggtttgagcagctactcccacta

SEQ ID NO: 268541 - DNA, 25 bp, Mus musculus
atggtttgcatgacttgacactata

SEQ ID NO: 268542 - DNA, 25 bp, Mus musculus
atggtttgcatgtcttgacactata

SEQ ID NO: 268543 - DNA, 25 bp, Mus musculus
atggtttgccatatatagcctttat

SEQ ID NO: 268544 - DNA, 25 bp, Mus musculus
atggtttgccatttatagcctttat

SEQ ID NO: 268545 - DNA, 25 bp, Mus musculus
atggtttgctgtaagtcggtggctt

SEQ ID NO: 268546 - DNA, 25 bp, Mus musculus
atggtttgctgtctgaccgacagat

SEQ ID NO: 268547 - DNA, 25 bp, Mus musculus
atggtttgctgtgtgaccgacagat

SEQ ID NO: 268548 - DNA, 25 bp, Mus musculus
atggtttgctgttagtcggtggctt

SEQ ID NO: 268549 - DNA, 25 bp, Mus musculus
atggtttggatgcttctatattgcc

SEQ ID NO: 268550 - DNA, 25 bp, Mus musculus
atggtttggatggttctatattgcc

SEQ ID NO: 268551 - DNA, 25 bp, Mus musculus
atggtttggattatgattgtactaa

SEQ ID NO: 268552 - DNA, 25 bp, Mus musculus
atggtttggattttgattgtactaa

SEQ ID NO: 268553 - DNA, 25 bp, Mus musculus
atggtttgtaagcactggaaaggac

SEQ ID NO: 268554 - DNA, 25 bp, Mus musculus
atggtttgtaaggactggaaaggac

SEQ ID NO: 268555 - DNA, 25 bp, Mus musculus
atggttttaattacctcagtactat

SEQ ID NO: 268556 - DNA, 25 bp, Mus musculus
atggttttaatttcctcagtactat

SEQ ID NO: 268557 - DNA, 25 bp, Mus musculus
atggttttactcagcagtgtaaaaa

SEQ ID NO: 268558 - DNA, 25 bp, Mus musculus
atggttttactctgcagtgtaaaaa

SEQ ID NO: 268559 - DNA, 25 bp, Mus musculus
atggttttactgcaatttttatcaa

SEQ ID NO: 268560 - DNA, 25 bp, Mus musculus
atggttttactggaatttttatcaa

SEQ ID NO: 268561 - DNA, 25 bp, Mus musculus
atggttttcctactgttaataaatg

SEQ ID NO: 268562 - DNA, 25 bp, Mus musculus
atggttttcctagtgttaataaatg

SEQ ID NO: 268563 - DNA, 25 bp, Mus musculus
atggttttccttcttgtcgctacac

SEQ ID NO: 268564 - DNA, 25 bp, Mus musculus
atggttttccttgttgtcgctacac

SEQ ID NO: 268565 - DNA, 25 bp, Mus musculus
atggttttcgtcaggacaccgtaca

SEQ ID NO: 268566 - DNA, 25 bp, Mus musculus
atggttttcgtctggacaccgtaca

SEQ ID NO: 268567 - DNA, 25 bp, Mus musculus
atggttttctatagagaactgtacc

SEQ ID NO: 268568 - DNA, 25 bp, Mus musculus
atggttttctattgagaactgtacc

SEQ ID NO: 268569 - DNA, 25 bp, Mus musculus
atggttttctgtaccgtggagtgta

SEQ ID NO: 268570 - DNA, 25 bp, Mus musculus
atggttttctgttccgtggagtgta

SEQ ID NO: 268571 - DNA, 25 bp, Mus musculus
atggttttcttcaatttgtattgac

SEQ ID NO: 268572 - DNA, 25 bp, Mus musculus
atggttttcttctatttgtattgac

SEQ ID NO: 268573 - DNA, 25 bp, Mus musculus
atggttttgacaagccctgagggtg

SEQ ID NO: 268574 - DNA, 25 bp, Mus musculus
atggttttgacatgccctgagggtg

SEQ ID NO: 268575 - DNA, 25 bp, Mus musculus
atggttttgactccctattcatgca

SEQ ID NO: 268576 - DNA, 25 bp, Mus musculus
atggttttgactgcctattcatgca

SEQ ID NO: 268577 - DNA, 25 bp, Mus musculus
atggttttgcacacagttgcccact

SEQ ID NO: 268578 - DNA, 25 bp, Mus musculus
atggttttgcactcagttgcccact

SEQ ID NO: 268579 - DNA, 25 bp, Mus musculus
atggttttgccacctgtggatagtt

SEQ ID NO: 268580 - DNA, 25 bp, Mus musculus
atggttttgccagctgtggatagtt

SEQ ID NO: 268581 - DNA, 25 bp, Mus musculus
atggttttggcccacttaggatggc

SEQ ID NO: 268582 - DNA, 25 bp, Mus musculus
atggttttggccgacttaggatggc

SEQ ID NO: 268583 - DNA, 25 bp, Mus musculus
atggttttgtctctcttggtttgat

SEQ ID NO: 268584 - DNA, 25 bp, Mus musculus
atggttttgtctgtcttggtttgat

SEQ ID NO: 268585 - DNA, 25 bp, Mus musculus
atggttttgtgaccatcccgggatg

SEQ ID NO: 268586 - DNA, 25 bp, Mus musculus
atggttttgtgagcatcccgggatg

SEQ ID NO: 268587 - DNA, 25 bp, Mus musculus
atggttttgttacactttgtgtact

SEQ ID NO: 268588 - DNA, 25 bp, Mus musculus
atggttttgttagactttgtgtact

SEQ ID NO: 268589 - DNA, 25 bp, Mus musculus
atggtttttactatgcccatctctt

SEQ ID NO: 268590 - DNA, 25 bp, Mus musculus
atggtttttactttgcccatctctt

SEQ ID NO: 268591 - DNA, 25 bp, Mus musculus
atggtttttcttagtagatgataac

SEQ ID NO: 268592 - DNA, 25 bp, Mus musculus
atggtttttctttgtagatgataac

SEQ ID NO: 268593 - DNA, 25 bp, Mus musculus
atggtttttgcacattacttgtatt

SEQ ID NO: 268594 - DNA, 25 bp, Mus musculus
atggtttttgcagattacttgtatt

SEQ ID NO: 268595 - DNA, 25 bp, Mus musculus
atggtttttgctcctttgagttcct

SEQ ID NO: 268596 - DNA, 25 bp, Mus musculus
atggtttttgctgctttgagttcct

SEQ ID NO: 268597 - DNA, 25 bp, Mus musculus
atgtaaaaatgccacctcactctca

SEQ ID NO: 268598 - DNA, 25 bp, Mus musculus
atgtaaaaatgcgacctcactctca

SEQ ID NO: 268599 - DNA, 25 bp, Mus musculus
atgtaaaaccacagtgcccagggct

SEQ ID NO: 268600 - DNA, 25 bp, Mus musculus
atgtaaaaccactgtgcccagggct

SEQ ID NO: 268601 - DNA, 25 bp, Mus musculus
atgtaaaactccactctgactgtca

SEQ ID NO: 268602 - DNA, 25 bp, Mus musculus
atgtaaaactccctgacttccacac

SEQ ID NO: 268603 - DNA, 25 bp, Mus musculus
atgtaaaactccgtgacttccacac

SEQ ID NO: 268604 - DNA, 25 bp, Mus musculus
atgtaaaactcctctctgactgtca

SEQ ID NO: 268605 - DNA, 25 bp, Mus musculus
atgtaaaagctgcaggccatgtcca

SEQ ID NO: 268606 - DNA, 25 bp, Mus musculus
atgtaaaagctggaggccatgtcca

SEQ ID NO: 268607 - DNA, 25 bp, Mus musculus
atgtaaacaaggagactttctgcta

SEQ ID NO: 268608 - DNA, 25 bp, Mus musculus
atgtaaacaaggtgactttctgcta

SEQ ID NO: 268609 - DNA, 25 bp, Mus musculus
atgtaaacaccgctgttcttccgga

SEQ ID NO: 268610 - DNA, 25 bp, Mus musculus
atgtaaacaccggtgttcttccgga

SEQ ID NO: 268611 - DNA, 25 bp, Mus musculus
atgtaaacatttctgccccatagat

SEQ ID NO: 268612 - DNA, 25 bp, Mus musculus
atgtaaacatttgtgccccatagat

SEQ ID NO: 268613 - DNA, 25 bp, Mus musculus
atgtaaaccagcatctctagtctgt

SEQ ID NO: 268614 - DNA, 25 bp, Mus musculus
atgtaaaccagcttctctagtctgt

SEQ ID NO: 268615 - DNA, 25 bp, Mus musculus
atgtaaaccatacgaacttcctgct

SEQ ID NO: 268616 - DNA, 25 bp, Mus musculus
atgtaaaccataggaacttcctgct

SEQ ID NO: 268617 - DNA, 25 bp, Mus musculus
atgtaaaccattagatccacctgat

SEQ ID NO: 268618 - DNA, 25 bp, Mus musculus
atgtaaaccatttgatccacctgat

SEQ ID NO: 268619 - DNA, 25 bp, Mus musculus
atgtaaaccgtgacaccagtgtgac

SEQ ID NO: 268620 - DNA, 25 bp, Mus musculus
atgtaaaccgtgtcaccagtgtgac

SEQ ID NO: 268621 - DNA, 25 bp, Mus musculus
atgtaaaccttgagagccgggctcc

SEQ ID NO: 268622 - DNA, 25 bp, Mus musculus
atgtaaaccttgtgagccgggctcc

SEQ ID NO: 268623 - DNA, 25 bp, Mus musculus
atgtaaacgcatcgcctgccttcct

SEQ ID NO: 268624 - DNA, 25 bp, Mus musculus
atgtaaacgcatggcctgccttcct

SEQ ID NO: 268625 - DNA, 25 bp, Mus musculus
atgtaaactgctatgcttaacctgt

SEQ ID NO: 268626 - DNA, 25 bp, Mus musculus
atgtaaactgctttgcttaacctgt

SEQ ID NO: 268627 - DNA, 25 bp, Mus musculus
atgtaaactgttctattgcttctgt

SEQ ID NO: 268628 - DNA, 25 bp, Mus musculus
atgtaaactgttgtattgcttctgt

SEQ ID NO: 268629 - DNA, 25 bp, Mus musculus
atgtaaacttccagccaccgaaact

SEQ ID NO: 268630 - DNA, 25 bp, Mus musculus
atgtaaacttcctgccaccgaaact

SEQ ID NO: 268631 - DNA, 25 bp, Mus musculus
atgtaaagatgtaagaggctcctca

SEQ ID NO: 268632 - DNA, 25 bp, Mus musculus
atgtaaagatgttagaggctcctca

SEQ ID NO: 268633 - DNA, 25 bp, Mus musculus
atgtaaagccgaaacggtgttgggc

SEQ ID NO: 268634 - DNA, 25 bp, Mus musculus
atgtaaagccgatacggtgttgggc

SEQ ID NO: 268635 - DNA, 25 bp, Mus musculus
atgtaaagccttcacccagtgttta

SEQ ID NO: 268636 - DNA, 25 bp, Mus musculus
atgtaaagccttgacccagtgttta

SEQ ID NO: 268637 - DNA, 25 bp, Mus musculus
atgtaaagtattccagagagctgct

SEQ ID NO: 268638 - DNA, 25 bp, Mus musculus
atgtaaagtattgcagagagctgct

SEQ ID NO: 268639 - DNA, 25 bp, Mus musculus
atgtaaagtcctattttcttgttca

SEQ ID NO: 268640 - DNA, 25 bp, Mus musculus
atgtaaagtccttttttcttgttca

SEQ ID NO: 268641 - DNA, 25 bp, Mus musculus
atgtaaagttccctgttgtccgctc

SEQ ID NO: 268642 - DNA, 25 bp, Mus musculus
atgtaaagttccgtgttgtccgctc

SEQ ID NO: 268643 - DNA, 25 bp, Mus musculus
atgtaaataaccattgtctccatgc

SEQ ID NO: 268644 - DNA, 25 bp, Mus musculus
atgtaaataacctttgtctccatgc

SEQ ID NO: 268645 - DNA, 25 bp, Mus musculus
atgtaaatataaacccatgaccatt

SEQ ID NO: 268646 - DNA, 25 bp, Mus musculus
atgtaaatataatcccatgaccatt

SEQ ID NO: 268647 - DNA, 25 bp, Mus musculus
atgtaaatatctcctgccttcctcg

SEQ ID NO: 268648 - DNA, 25 bp, Mus musculus
atgtaaatatctgctgccttcctcg

SEQ ID NO: 268649 - DNA, 25 bp, Mus musculus
atgtaaatatgcaccccttcctgtc

SEQ ID NO: 268650 - DNA, 25 bp, Mus musculus
atgtaaatatgctccccttcctgtc

SEQ ID NO: 268651 - DNA, 25 bp, Mus musculus
atgtaaatattcctgactgccttca

SEQ ID NO: 268652 - DNA, 25 bp, Mus musculus
atgtaaatattcgtgactgccttca

SEQ ID NO: 268653 - DNA, 25 bp, Mus musculus
atgtaaatgacccagtgtggttcct

SEQ ID NO: 268654 - DNA, 25 bp, Mus musculus
atgtaaatgaccgagtgtggttcct

SEQ ID NO: 268655 - DNA, 25 bp, Mus musculus
atgtaaatgctccatgttcctgtac

SEQ ID NO: 268656 - DNA, 25 bp, Mus musculus
atgtaaatgctcgatgttcctgtac

SEQ ID NO: 268657 - DNA, 25 bp, Mus musculus
atgtaaatttgaccccccactgttt

SEQ ID NO: 268658 - DNA, 25 bp, Mus musculus
atgtaaatttgagcccccactgttt

SEQ ID NO: 268659 - DNA, 25 bp, Mus musculus
atgtaaattttacccctgccagttc

SEQ ID NO: 268660 - DNA, 25 bp, Mus musculus
atgtaaattttagccctgccagttc

SEQ ID NO: 268661 - DNA, 25 bp, Mus musculus
atgtaaatttttcccatctctccct

SEQ ID NO: 268662 - DNA, 25 bp, Mus musculus
atgtaaatttttgccatctctccct

SEQ ID NO: 268663 - DNA, 25 bp, Mus musculus
atgtaacaacatcgtctgcagtaaa

SEQ ID NO: 268664 - DNA, 25 bp, Mus musculus
atgtaacaacatggtctgcagtaaa

SEQ ID NO: 268665 - DNA, 25 bp, Mus musculus
atgtaacaagtgaagctgtcgttaa

SEQ ID NO: 268666 - DNA, 25 bp, Mus musculus
atgtaacaagtgtagctgtcgttaa

SEQ ID NO: 268667 - DNA, 25 bp, Mus musculus
atgtaacagcttatagccaagtgga

SEQ ID NO: 268668 - DNA, 25 bp, Mus musculus
atgtaacagcttttagccaagtgga

SEQ ID NO: 268669 - DNA, 25 bp, Mus musculus
atgtaacaggcaatgtaacccttgt

SEQ ID NO: 268670 - DNA, 25 bp, Mus musculus
atgtaacaggcattgtaacccttgt

SEQ ID NO: 268671 - DNA, 25 bp, Mus musculus
atgtaacagtttaccaaagcacctc

SEQ ID NO: 268672 - DNA, 25 bp, Mus musculus
atgtaacagtttccttctcgattga

SEQ ID NO: 268673 - DNA, 25 bp, Mus musculus
atgtaacagtttgcttctcgattga

SEQ ID NO: 268674 - DNA, 25 bp, Mus musculus
atgtaacagttttccaaagcacctc

SEQ ID NO: 268675 - DNA, 25 bp, Mus musculus
atgtaacatccgaagcctgggttgt

SEQ ID NO: 268676 - DNA, 25 bp, Mus musculus
atgtaacatccgtagcctgggttgt

SEQ ID NO: 268677 - DNA, 25 bp, Mus musculus
atgtaaccccagacggtgctctgtg

SEQ ID NO: 268678 - DNA, 25 bp, Mus musculus
atgtaaccccagtcggtgctctgtg

SEQ ID NO: 268679 - DNA, 25 bp, Mus musculus
atgtaaccgcggcaagccgccgctg

SEQ ID NO: 268680 - DNA, 25 bp, Mus musculus
atgtaaccgcgggaagccgccgctg

SEQ ID NO: 268681 - DNA, 25 bp, Mus musculus
atgtaaccgcttctggcctgccatg

SEQ ID NO: 268682 - DNA, 25 bp, Mus musculus
atgtaaccgcttgtggcctgccatg

SEQ ID NO: 268683 - DNA, 25 bp, Mus musculus
atgtaacctagactggcctctccct

SEQ ID NO: 268684 - DNA, 25 bp, Mus musculus
atgtaacctagagtggcctctccct

SEQ ID NO: 268685 - DNA, 25 bp, Mus musculus
atgtaacctgcaaaggaccctgggt

SEQ ID NO: 268686 - DNA, 25 bp, Mus musculus
atgtaacctgcataggaccctgggt

SEQ ID NO: 268687 - DNA, 25 bp, Mus musculus
atgtaacctgggaagaagcactgcc

SEQ ID NO: 268688 - DNA, 25 bp, Mus musculus
atgtaacctgggtagaagcactgcc

SEQ ID NO: 268689 - DNA, 25 bp, Mus musculus
atgtaaccttgtctagctgctctga

SEQ ID NO: 268690 - DNA, 25 bp, Mus musculus
atgtaaccttgtgtagctgctctga

SEQ ID NO: 268691 - DNA, 25 bp, Mus musculus
atgtaacgaccgctgtgcttcagtt

SEQ ID NO: 268692 - DNA, 25 bp, Mus musculus
atgtaacgaccggtgtgcttcagtt

SEQ ID NO: 268693 - DNA, 25 bp, Mus musculus
atgtaacgccctagctgcttctgtg

SEQ ID NO: 268694 - DNA, 25 bp, Mus musculus
atgtaacgcccttgctgcttctgtg

SEQ ID NO: 268695 - DNA, 25 bp, Mus musculus
atgtaacggacaacagcacttgtgt

SEQ ID NO: 268696 - DNA, 25 bp, Mus musculus
atgtaacggacatcagcacttgtgt

SEQ ID NO: 268697 - DNA, 25 bp, Mus musculus
atgtaactacatatctggatcggat

SEQ ID NO: 268698 - DNA, 25 bp, Mus musculus
atgtaactacatttctggatcggat

SEQ ID NO: 268699 - DNA, 25 bp, Mus musculus
atgtaactacttactccctctggat

SEQ ID NO: 268700 - DNA, 25 bp, Mus musculus
atgtaactactttctccctctggat

SEQ ID NO: 268701 - DNA, 25 bp, Mus musculus
atgtaactattgcagcacagtcttt

SEQ ID NO: 268702 - DNA, 25 bp, Mus musculus
atgtaactattggagcacagtcttt

SEQ ID NO: 268703 - DNA, 25 bp, Mus musculus
atgtaactccacaatgtcttctgtt

SEQ ID NO: 268704 - DNA, 25 bp, Mus musculus
atgtaactccactatgtcttctgtt

SEQ ID NO: 268705 - DNA, 25 bp, Mus musculus
atgtaactgagccaggagccctact

SEQ ID NO: 268706 - DNA, 25 bp, Mus musculus
atgtaactgagcgaggagccctact

SEQ ID NO: 268707 - DNA, 25 bp, Mus musculus
atgtaactgtgtcgctagctgacta

SEQ ID NO: 268708 - DNA, 25 bp, Mus musculus
atgtaactgtgtggctagctgacta

SEQ ID NO: 268709 - DNA, 25 bp, Mus musculus
atgtaactgttaacaccgcgcttgt

SEQ ID NO: 268710 - DNA, 25 bp, Mus musculus
atgtaactgttatcaccgcgcttgt

SEQ ID NO: 268711 - DNA, 25 bp, Mus musculus
atgtaacttcagactcaggtgatcc

SEQ ID NO: 268712 - DNA, 25 bp, Mus musculus
atgtaacttcagtctcaggtgatcc

SEQ ID NO: 268713 - DNA, 25 bp, Mus musculus
atgtaacttgctacttaggcatcac

SEQ ID NO: 268714 - DNA, 25 bp, Mus musculus
atgtaacttgcttcttaggcatcac

SEQ ID NO: 268715 - DNA, 25 bp, Mus musculus
atgtaacttgtcacaaccccacaaa

SEQ ID NO: 268716 - DNA, 25 bp, Mus musculus
atgtaacttgtctcaaccccacaaa

SEQ ID NO: 268717 - DNA, 25 bp, Mus musculus
atgtaagaaacaccggacgtctgcc

SEQ ID NO: 268718 - DNA, 25 bp, Mus musculus
atgtaagaaacagcggacgtctgcc

SEQ ID NO: 268719 - DNA, 25 bp, Mus musculus
atgtaagaaagcaccgatcccaaaa

SEQ ID NO: 268720 - DNA, 25 bp, Mus musculus
atgtaagaaagctccgatcccaaaa

SEQ ID NO: 268721 - DNA, 25 bp, Mus musculus
atgtaagacaagcactcgaccactg

SEQ ID NO: 268722 - DNA, 25 bp, Mus musculus
atgtaagacaaggactcgaccactg

SEQ ID NO: 268723 - DNA, 25 bp, Mus musculus
atgtaagacgagctgcccttccttc

SEQ ID NO: 268724 - DNA, 25 bp, Mus musculus
atgtaagacgaggtgcccttccttc

SEQ ID NO: 268725 - DNA, 25 bp, Mus musculus
atgtaagagctgctcttgcctctca

SEQ ID NO: 268726 - DNA, 25 bp, Mus musculus
atgtaagagctggtcttgcctctca

SEQ ID NO: 268727 - DNA, 25 bp, Mus musculus
atgtaagatccaaccaacctgaaga

SEQ ID NO: 268728 - DNA, 25 bp, Mus musculus
atgtaagatccatccaacctgaaga

SEQ ID NO: 268729 - DNA, 25 bp, Mus musculus
atgtaagcaatgaccctacctgttt

SEQ ID NO: 268730 - DNA, 25 bp, Mus musculus
atgtaagcaatgtccctacctgttt

SEQ ID NO: 268731 - DNA, 25 bp, Mus musculus
atgtaagcacatccgcacactcctg

SEQ ID NO: 268732 - DNA, 25 bp, Mus musculus
atgtaagcacatgcgcacactcctg

SEQ ID NO: 268733 - DNA, 25 bp, Mus musculus
atgtaagccaacctatagttctacc

SEQ ID NO: 268734 - DNA, 25 bp, Mus musculus
atgtaagccaacgtatagttctacc

SEQ ID NO: 268735 - DNA, 25 bp, Mus musculus
atgtaagccagtcctccacatctaa

SEQ ID NO: 268736 - DNA, 25 bp, Mus musculus
atgtaagccagtgctccacatctaa

SEQ ID NO: 268737 - DNA, 25 bp, Mus musculus
atgtaagcccgcataccctgaccag

SEQ ID NO: 268738 - DNA, 25 bp, Mus musculus
atgtaagcccgcttaccctgaccag

SEQ ID NO: 268739 - DNA, 25 bp, Mus musculus
atgtaagcccttaactgcgtgatgt

SEQ ID NO: 268740 - DNA, 25 bp, Mus musculus
atgtaagccctttactgcgtgatgt

SEQ ID NO: 268741 - DNA, 25 bp, Mus musculus
atgtaagcctggatctccaactcca

SEQ ID NO: 268742 - DNA, 25 bp, Mus musculus
atgtaagcctggttctccaactcca

SEQ ID NO: 268743 - DNA, 25 bp, Mus musculus
atgtaagccttgcagaatccacggg

SEQ ID NO: 268744 - DNA, 25 bp, Mus musculus
atgtaagccttggagaatccacggg

SEQ ID NO: 268745 - DNA, 25 bp, Mus musculus
atgtaagctagaatggcctccgact

SEQ ID NO: 268746 - DNA, 25 bp, Mus musculus
atgtaagctagattggcctccgact

SEQ ID NO: 268747 - DNA, 25 bp, Mus musculus
atgtaagctcacaacagccctgtgt

SEQ ID NO: 268748 - DNA, 25 bp, Mus musculus
atgtaagctcactacagccctgtgt

SEQ ID NO: 268749 - DNA, 25 bp, Mus musculus
atgtaagcttggaggctcctgattc

SEQ ID NO: 268750 - DNA, 25 bp, Mus musculus
atgtaagcttggtggctcctgattc

SEQ ID NO: 268751 - DNA, 25 bp, Mus musculus
atgtaagcttgtctatgcctcggcc

SEQ ID NO: 268752 - DNA, 25 bp, Mus musculus
atgtaagcttgtgtatgcctcggcc

SEQ ID NO: 268753 - DNA, 25 bp, Mus musculus
atgtaaggacgcatctttgcctgga

SEQ ID NO: 268754 - DNA, 25 bp, Mus musculus
atgtaaggacgcttctttgcctgga

SEQ ID NO: 268755 - DNA, 25 bp, Mus musculus
atgtaaggagggaatggtatagtaa

SEQ ID NO: 268756 - DNA, 25 bp, Mus musculus
atgtaaggagggtatggtatagtaa

SEQ ID NO: 268757 - DNA, 25 bp, Mus musculus
atgtaaggccttccgcaatgagcag

SEQ ID NO: 268758 - DNA, 25 bp, Mus musculus
atgtaaggccttgcgcaatgagcag

SEQ ID NO: 268759 - DNA, 25 bp, Mus musculus
atgtaagggtggagatgtatttgat

SEQ ID NO: 268760 - DNA, 25 bp, Mus musculus
atgtaagggtggtgatgtatttgat

SEQ ID NO: 268761 - DNA, 25 bp, Mus musculus
atgtaagggttcctgctgagccgcc

SEQ ID NO: 268762 - DNA, 25 bp, Mus musculus
atgtaagggttcgtgctgagccgcc

SEQ ID NO: 268763 - DNA, 25 bp, Mus musculus
atgtaaggtcttactccatggagtc

SEQ ID NO: 268764 - DNA, 25 bp, Mus musculus
atgtaaggtctttctccatggagtc

SEQ ID NO: 268765 - DNA, 25 bp, Mus musculus
atgtaaggtttcaggttcactccct

SEQ ID NO: 268766 - DNA, 25 bp, Mus musculus
atgtaaggtttctggttcactccct

SEQ ID NO: 268767 - DNA, 25 bp, Mus musculus
atgtaagtaccaaattagtttctct

SEQ ID NO: 268768 - DNA, 25 bp, Mus musculus
atgtaagtaccatattagtttctct

SEQ ID NO: 268769 - DNA, 25 bp, Mus musculus
atgtaagtccttatcgggccatact

SEQ ID NO: 268770 - DNA, 25 bp, Mus musculus
atgtaagtccttttcgggccatact

SEQ ID NO: 268771 - DNA, 25 bp, Mus musculus
atgtaagtgcatcgcccgcgctgct

SEQ ID NO: 268772 - DNA, 25 bp, Mus musculus
atgtaagtgcatggcccgcgctgct

SEQ ID NO: 268773 - DNA, 25 bp, Mus musculus
atgtaagtttgtagaggtcactctc

SEQ ID NO: 268774 - DNA, 25 bp, Mus musculus
atgtaagtttgttgaggtcactctc

SEQ ID NO: 268775 - DNA, 25 bp, Mus musculus
atgtaataaggacacaagttccact

SEQ ID NO: 268776 - DNA, 25 bp, Mus musculus
atgtaataaggagacaagttccact

SEQ ID NO: 268777 - DNA, 25 bp, Mus musculus
atgtaataatgacccattgcccctt

SEQ ID NO: 268778 - DNA, 25 bp, Mus musculus
atgtaataatgagccattgcccctt

SEQ ID NO: 268779 - DNA, 25 bp, Mus musculus
atgtaataccttctctatgccccag

SEQ ID NO: 268780 - DNA, 25 bp, Mus musculus
atgtaataccttgtctatgccccag

SEQ ID NO: 268781 - DNA, 25 bp, Mus musculus
atgtaatagccgacttctgtactgc

SEQ ID NO: 268782 - DNA, 25 bp, Mus musculus
atgtaatagccgtcttctgtactgc

SEQ ID NO: 268783 - DNA, 25 bp, Mus musculus
atgtaatatggacacatgcgccact

SEQ ID NO: 268784 - DNA, 25 bp, Mus musculus
atgtaatatggagacatgcgccact

SEQ ID NO: 268785 - DNA, 25 bp, Mus musculus
atgtaatatttgaaatccctgtgca

SEQ ID NO: 268786 - DNA, 25 bp, Mus musculus
atgtaatatttgtaatccctgtgca

SEQ ID NO: 268787 - DNA, 25 bp, Mus musculus
atgtaatcattcctgcatagagggt

SEQ ID NO: 268788 - DNA, 25 bp, Mus musculus
atgtaatcattcgtgcatagagggt

SEQ ID NO: 268789 - DNA, 25 bp, Mus musculus
atgtaatccagtcgtagattgttcc

SEQ ID NO: 268790 - DNA, 25 bp, Mus musculus
atgtaatccagtggtagattgttcc

SEQ ID NO: 268791 - DNA, 25 bp, Mus musculus
atgtaatccatcaccaatgcggaaa

SEQ ID NO: 268792 - DNA, 25 bp, Mus musculus
atgtaatccatctccaatgcggaaa

SEQ ID NO: 268793 - DNA, 25 bp, Mus musculus
atgtaatcccatcgtttcatggcta

SEQ ID NO: 268794 - DNA, 25 bp, Mus musculus
atgtaatcccatggtttcatggcta

SEQ ID NO: 268795 - DNA, 25 bp, Mus musculus
atgtaatcgcggcaccataacagag

SEQ ID NO: 268796 - DNA, 25 bp, Mus musculus
atgtaatcgcgggaccataacagag

SEQ ID NO: 268797 - DNA, 25 bp, Mus musculus
atgtaatcgtcacttgttttgcttt

SEQ ID NO: 268798 - DNA, 25 bp, Mus musculus
atgtaatcgtcagttgttttgcttt

SEQ ID NO: 268799 - DNA, 25 bp, Mus musculus
atgtaatctagcagaccagtgttta

SEQ ID NO: 268800 - DNA, 25 bp, Mus musculus
atgtaatctagctgaccagtgttta

SEQ ID NO: 268801 - DNA, 25 bp, Mus musculus
atgtaatctcagcacgcctggcacc

SEQ ID NO: 268802 - DNA, 25 bp, Mus musculus
atgtaatctcaggacgcctggcacc

SEQ ID NO: 268803 - DNA, 25 bp, Mus musculus
atgtaatcttgcagccatgctatgt

SEQ ID NO: 268804 - DNA, 25 bp, Mus musculus
atgtaatcttgctgccatgctatgt

SEQ ID NO: 268805 - DNA, 25 bp, Mus musculus
atgtaatgcgatatctgagctcaga

SEQ ID NO: 268806 - DNA, 25 bp, Mus musculus
atgtaatgcgatttctgagctcaga

SEQ ID NO: 268807 - DNA, 25 bp, Mus musculus
atgtaatggcgtagagcctcgcttc

SEQ ID NO: 268808 - DNA, 25 bp, Mus musculus
atgtaatggcgttgagcctcgcttc

SEQ ID NO: 268809 - DNA, 25 bp, Mus musculus
atgtaatggtacattttccctcctc

SEQ ID NO: 268810 - DNA, 25 bp, Mus musculus
atgtaatggtactttttccctcctc

SEQ ID NO: 268811 - DNA, 25 bp, Mus musculus
atgtaatggtcacagcacctgcaga

SEQ ID NO: 268812 - DNA, 25 bp, Mus musculus
atgtaatggtcagagcacctgcaga

SEQ ID NO: 268813 - DNA, 25 bp, Mus musculus
atgtaatggtccacctgcagcagga

SEQ ID NO: 268814 - DNA, 25 bp, Mus musculus
atgtaatggtcctcctgcagcagga

SEQ ID NO: 268815 - DNA, 25 bp, Mus musculus
atgtaatgtcggagacctctcgcga

SEQ ID NO: 268816 - DNA, 25 bp, Mus musculus
atgtaatgtcggtgacctctcgcga

SEQ ID NO: 268817 - DNA, 25 bp, Mus musculus
atgtaatgttgaacgctgctgtgtt

SEQ ID NO: 268818 - DNA, 25 bp, Mus musculus
atgtaatgttgatcgctgctgtgtt

SEQ ID NO: 268819 - DNA, 25 bp, Mus musculus
atgtaatgttgcattcccatcctga

SEQ ID NO: 268820 - DNA, 25 bp, Mus musculus
atgtaatgttgctttcccatcctga

SEQ ID NO: 268821 - DNA, 25 bp, Mus musculus
atgtaattactgaacttttatgtgc

SEQ ID NO: 268822 - DNA, 25 bp, Mus musculus
atgtaattactgtacttttatgtgc

SEQ ID NO: 268823 - DNA, 25 bp, Mus musculus
atgtaattattcatggctttgccta

SEQ ID NO: 268824 - DNA, 25 bp, Mus musculus
atgtaattattcttggctttgccta

SEQ ID NO: 268825 - DNA, 25 bp, Mus musculus
atgtaattccatagccctagatgca

SEQ ID NO: 268826 - DNA, 25 bp, Mus musculus
atgtaattccattgccctagatgca

SEQ ID NO: 268827 - DNA, 25 bp, Mus musculus
atgtaattgagacccgccaccatcg

SEQ ID NO: 268828 - DNA, 25 bp, Mus musculus
atgtaattgagagccgccaccatcg

SEQ ID NO: 268829 - DNA, 25 bp, Mus musculus
atgtaattgcataccggccagttaa

SEQ ID NO: 268830 - DNA, 25 bp, Mus musculus
atgtaattgcattccggccagttaa

SEQ ID NO: 268831 - DNA, 25 bp, Mus musculus
atgtaatttatgctcctatcctctg

SEQ ID NO: 268832 - DNA, 25 bp, Mus musculus
atgtaatttatggtcctatcctctg

SEQ ID NO: 268833 - DNA, 25 bp, Mus musculus
atgtaatttcatacagcctgtctaa

SEQ ID NO: 268834 - DNA, 25 bp, Mus musculus
atgtaatttcattcagcctgtctaa

SEQ ID NO: 268835 - DNA, 25 bp, Mus musculus
atgtaatttccaaaccagactcagg

SEQ ID NO: 268836 - DNA, 25 bp, Mus musculus
atgtaatttccataccagactcagg

SEQ ID NO: 268837 - DNA, 25 bp, Mus musculus
atgtaatttcctagcaggccactct

SEQ ID NO: 268838 - DNA, 25 bp, Mus musculus
atgtaatttccttgcaggccactct

SEQ ID NO: 268839 - DNA, 25 bp, Mus musculus
atgtaatttctcagttccctgacta

SEQ ID NO: 268840 - DNA, 25 bp, Mus musculus
atgtaatttctctgttccctgacta

SEQ ID NO: 268841 - DNA, 25 bp, Mus musculus
atgtaatttgagagacccggtgcct

SEQ ID NO: 268842 - DNA, 25 bp, Mus musculus
atgtaatttgagtgacccggtgcct

SEQ ID NO: 268843 - DNA, 25 bp, Mus musculus
atgtaattttcccactgccacagac

SEQ ID NO: 268844 - DNA, 25 bp, Mus musculus
atgtaattttccgactgccacagac

SEQ ID NO: 268845 - DNA, 25 bp, Mus musculus
atgtacaaaactctttcttgtgtag

SEQ ID NO: 268846 - DNA, 25 bp, Mus musculus
atgtacaaaactgtttcttgtgtag

SEQ ID NO: 268847 - DNA, 25 bp, Mus musculus
atgtacaaacccacactttttcaga

SEQ ID NO: 268848 - DNA, 25 bp, Mus musculus
atgtacaaaccctcactttttcaga

SEQ ID NO: 268849 - DNA, 25 bp, Mus musculus
atgtacaaacggatcttgctgacca

SEQ ID NO: 268850 - DNA, 25 bp, Mus musculus
atgtacaaacggttcttgctgacca

SEQ ID NO: 268851 - DNA, 25 bp, Mus musculus
atgtacaaagggactccactccact

SEQ ID NO: 268852 - DNA, 25 bp, Mus musculus
atgtacaaagggtctccactccact

SEQ ID NO: 268853 - DNA, 25 bp, Mus musculus
atgtacaaatatacactcacacccc

SEQ ID NO: 268854 - DNA, 25 bp, Mus musculus
atgtacaaatattcactcacacccc

SEQ ID NO: 268855 - DNA, 25 bp, Mus musculus
atgtacaaccagactctgaacattg

SEQ ID NO: 268856 - DNA, 25 bp, Mus musculus
atgtacaaccagtctctgaacattg

SEQ ID NO: 268857 - DNA, 25 bp, Mus musculus
atgtacaaccctatcctgagggtga

SEQ ID NO: 268858 - DNA, 25 bp, Mus musculus
atgtacaaccctttcctgagggtga

SEQ ID NO: 268859 - DNA, 25 bp, Mus musculus
atgtacaagtccaaggaccagcgcc

SEQ ID NO: 268860 - DNA, 25 bp, Mus musculus
atgtacaagtcctaggaccagcgcc

SEQ ID NO: 268861 - DNA, 25 bp, Mus musculus
atgtacaatagtctcttcccaaccc

SEQ ID NO: 268862 - DNA, 25 bp, Mus musculus
atgtacaatagtgtcttcccaaccc

SEQ ID NO: 268863 - DNA, 25 bp, Mus musculus
atgtacaatcctaatgtttccatgt

SEQ ID NO: 268864 - DNA, 25 bp, Mus musculus
atgtacaatccttatgtttccatgt

SEQ ID NO: 268865 - DNA, 25 bp, Mus musculus
atgtacacacccatacagatatgca

SEQ ID NO: 268866 - DNA, 25 bp, Mus musculus
atgtacacacccttacagatatgca

SEQ ID NO: 268867 - DNA, 25 bp, Mus musculus
atgtacacaccgagatccctgattc

SEQ ID NO: 268868 - DNA, 25 bp, Mus musculus
atgtacacaccgtgatccctgattc

SEQ ID NO: 268869 - DNA, 25 bp, Mus musculus
atgtacacaggcacgcttgactgct

SEQ ID NO: 268870 - DNA, 25 bp, Mus musculus
atgtacacaggctcgcttgactgct

SEQ ID NO: 268871 - DNA, 25 bp, Mus musculus
atgtacacagggaaagcatccacag

SEQ ID NO: 268872 - DNA, 25 bp, Mus musculus
atgtacacagggtaagcatccacag

SEQ ID NO: 268873 - DNA, 25 bp, Mus musculus
atgtacacagtacactcccatgtga

SEQ ID NO: 268874 - DNA, 25 bp, Mus musculus
atgtacacagtagactcccatgtga

SEQ ID NO: 268875 - DNA, 25 bp, Mus musculus
atgtacacagtgcaacttcatcagg

SEQ ID NO: 268876 - DNA, 25 bp, Mus musculus
atgtacacagtggaacttcatcagg

SEQ ID NO: 268877 - DNA, 25 bp, Mus musculus
atgtacaccactcccactagaaatg

SEQ ID NO: 268878 - DNA, 25 bp, Mus musculus
atgtacaccactgccactagaaatg

SEQ ID NO: 268879 - DNA, 25 bp, Mus musculus
atgtacaccaggaacgcaaaggcaa

SEQ ID NO: 268880 - DNA, 25 bp, Mus musculus
atgtacaccaggtacgcaaaggcaa

SEQ ID NO: 268881 - DNA, 25 bp, Mus musculus
atgtacaccccaactgattggagct

SEQ ID NO: 268882 - DNA, 25 bp, Mus musculus
atgtacaccccatctgattggagct

SEQ ID NO: 268883 - DNA, 25 bp, Mus musculus
atgtacaccgtgcacaggccatgtc

SEQ ID NO: 268884 - DNA, 25 bp, Mus musculus
atgtacaccgtggacaggccatgtc

SEQ ID NO: 268885 - DNA, 25 bp, Mus musculus
atgtacacggcacgccttgactgct

SEQ ID NO: 268886 - DNA, 25 bp, Mus musculus
atgtacacggcaggccttgactgct

SEQ ID NO: 268887 - DNA, 25 bp, Mus musculus
atgtacactaccactgacgggcaaa

SEQ ID NO: 268888 - DNA, 25 bp, Mus musculus
atgtacactacctctgacgggcaaa

SEQ ID NO: 268889 - DNA, 25 bp, Mus musculus
atgtacactattacactctgtatat

SEQ ID NO: 268890 - DNA, 25 bp, Mus musculus
atgtacactatttcactctgtatat

SEQ ID NO: 268891 - DNA, 25 bp, Mus musculus
atgtacactgctatctctcattcaa

SEQ ID NO: 268892 - DNA, 25 bp, Mus musculus
atgtacactgctttctctcattcaa

SEQ ID NO: 268893 - DNA, 25 bp, Mus musculus
atgtacagactcagtttttcttatg

SEQ ID NO: 268894 - DNA, 25 bp, Mus musculus
atgtacagactctgtttttcttatg

SEQ ID NO: 268895 - DNA, 25 bp, Mus musculus
atgtacaggaacaggcttctgccat

SEQ ID NO: 268896 - DNA, 25 bp, Mus musculus
atgtacaggaactggcttctgccat

SEQ ID NO: 268897 - DNA, 25 bp, Mus musculus
atgtacaggcaaaaagcatccctaa

SEQ ID NO: 268898 - DNA, 25 bp, Mus musculus
atgtacaggcaataagcatccctaa

SEQ ID NO: 268899 - DNA, 25 bp, Mus musculus
atgtacaggtctagcttcacacaag

SEQ ID NO: 268900 - DNA, 25 bp, Mus musculus
atgtacaggtcttgcttcacacaag

SEQ ID NO: 268901 - DNA, 25 bp, Mus musculus
atgtacaggttaacagggcagagca

SEQ ID NO: 268902 - DNA, 25 bp, Mus musculus
atgtacaggttatcagggcagagca

SEQ ID NO: 268903 - DNA, 25 bp, Mus musculus
atgtacagtactcgctgtttcctcc

SEQ ID NO: 268904 - DNA, 25 bp, Mus musculus
atgtacagtactggctgtttcctcc

SEQ ID NO: 268905 - DNA, 25 bp, Mus musculus
atgtacagtcagcagaccctagacc

SEQ ID NO: 268906 - DNA, 25 bp, Mus musculus
atgtacagtcaggagaccctagacc

SEQ ID NO: 268907 - DNA, 25 bp, Mus musculus
atgtacagtctacctttgccttgca

SEQ ID NO: 268908 - DNA, 25 bp, Mus musculus
atgtacagtctagctttgccttgca

SEQ ID NO: 268909 - DNA, 25 bp, Mus musculus
atgtacagttataacagggcttctg

SEQ ID NO: 268910 - DNA, 25 bp, Mus musculus
atgtacagttattacagggcttctg

SEQ ID NO: 268911 - DNA, 25 bp, Mus musculus
atgtacatatgtaggccaggatcat

SEQ ID NO: 268912 - DNA, 25 bp, Mus musculus
atgtacatatgttggccaggatcat

SEQ ID NO: 268913 - DNA, 25 bp, Mus musculus
atgtacatatttatcaccccttcca

SEQ ID NO: 268914 - DNA, 25 bp, Mus musculus
atgtacatatttttcaccccttcca

SEQ ID NO: 268915 - DNA, 25 bp, Mus musculus
atgtacatcacccatgatacacagg

SEQ ID NO: 268916 - DNA, 25 bp, Mus musculus
atgtacatcaccgatgatacacagg

SEQ ID NO: 268917 - DNA, 25 bp, Mus musculus
atgtacatcagtagtgtgaatccac

SEQ ID NO: 268918 - DNA, 25 bp, Mus musculus
atgtacatcagttgtgtgaatccac

SEQ ID NO: 268919 - DNA, 25 bp, Mus musculus
atgtacatccatccctgtatctgca

SEQ ID NO: 268920 - DNA, 25 bp, Mus musculus
atgtacatccatgcctgtatctgca

SEQ ID NO: 268921 - DNA, 25 bp, Mus musculus
atgtacatctgacttatttggttaa

SEQ ID NO: 268922 - DNA, 25 bp, Mus musculus
atgtacatctgagttatttggttaa

SEQ ID NO: 268923 - DNA, 25 bp, Mus musculus
atgtacatcttcatcaccacttttg

SEQ ID NO: 268924 - DNA, 25 bp, Mus musculus
atgtacatcttcttcaccacttttg

SEQ ID NO: 268925 - DNA, 25 bp, Mus musculus
atgtacatgccgacagtcctctggt

SEQ ID NO: 268926 - DNA, 25 bp, Mus musculus
atgtacatgccgtcagtcctctggt

SEQ ID NO: 268927 - DNA, 25 bp, Mus musculus
atgtacatggcgcacccagcactca

SEQ ID NO: 268928 - DNA, 25 bp, Mus musculus
atgtacatggcggacccagcactca

SEQ ID NO: 268929 - DNA, 25 bp, Mus musculus
atgtacatggtccagagccaccagg

SEQ ID NO: 268930 - DNA, 25 bp, Mus musculus
atgtacatggtcgagagccaccagg

SEQ ID NO: 268931 - DNA, 25 bp, Mus musculus
atgtacatgtataaatttttgggtt

SEQ ID NO: 268932 - DNA, 25 bp, Mus musculus
atgtacatgtattaatttttgggtt

SEQ ID NO: 268933 - DNA, 25 bp, Mus musculus
atgtacatgtttctctccttatctt

SEQ ID NO: 268934 - DNA, 25 bp, Mus musculus
atgtacatgtttgtctccttatctt

SEQ ID NO: 268935 - DNA, 25 bp, Mus musculus
atgtacattctcaggaaggctcaca

SEQ ID NO: 268936 - DNA, 25 bp, Mus musculus
atgtacattctctggaaggctcaca

SEQ ID NO: 268937 - DNA, 25 bp, Mus musculus
atgtacattgtgagtgtagccatat

SEQ ID NO: 268938 - DNA, 25 bp, Mus musculus
atgtacattgtgtgtgtagccatat

SEQ ID NO: 268939 - DNA, 25 bp, Mus musculus
atgtacatttcccaacaatcttttt

SEQ ID NO: 268940 - DNA, 25 bp, Mus musculus
atgtacatttccgaacaatcttttt

SEQ ID NO: 268941 - DNA, 25 bp, Mus musculus
atgtaccaagccctgaaagaagctc

SEQ ID NO: 268942 - DNA, 25 bp, Mus musculus
atgtaccaagccgtgaaagaagctc

SEQ ID NO: 268943 - DNA, 25 bp, Mus musculus
atgtaccaatcgctggaccactggg

SEQ ID NO: 268944 - DNA, 25 bp, Mus musculus
atgtaccaatcggtggaccactggg

SEQ ID NO: 268945 - DNA, 25 bp, Mus musculus
atgtaccactccatagctctgcata

SEQ ID NO: 268946 - DNA, 25 bp, Mus musculus
atgtaccactccttagctctgcata

SEQ ID NO: 268947 - DNA, 25 bp, Mus musculus
atgtaccagcaacccttttcaacca

SEQ ID NO: 268948 - DNA, 25 bp, Mus musculus
atgtaccagcaagccttttcaacca

SEQ ID NO: 268949 - DNA, 25 bp, Mus musculus
atgtaccaggaacacggccctttgc

SEQ ID NO: 268950 - DNA, 25 bp, Mus musculus
atgtaccaggaagacggccctttgc

SEQ ID NO: 268951 - DNA, 25 bp, Mus musculus
atgtaccaggcccatacccacaaga

SEQ ID NO: 268952 - DNA, 25 bp, Mus musculus
atgtaccaggccgatacccacaaga

SEQ ID NO: 268953 - DNA, 25 bp, Mus musculus
atgtaccagttgactctggtgaaac

SEQ ID NO: 268954 - DNA, 25 bp, Mus musculus
atgtaccagttgtctctggtgaaac

SEQ ID NO: 268955 - DNA, 25 bp, Mus musculus
atgtaccagtttcctaacgcagact

SEQ ID NO: 268956 - DNA, 25 bp, Mus musculus
atgtaccagtttgctaacgcagact

SEQ ID NO: 268957 - DNA, 25 bp, Mus musculus
atgtaccataaccaacctattgcct

SEQ ID NO: 268958 - DNA, 25 bp, Mus musculus
atgtaccataacgaacctattgcct

SEQ ID NO: 268959 - DNA, 25 bp, Mus musculus
atgtaccatggactgagggacctca

SEQ ID NO: 268960 - DNA, 25 bp, Mus musculus
atgtaccatggagtgagggacctca

SEQ ID NO: 268961 - DNA, 25 bp, Mus musculus
atgtaccatggtctccaaaatccaa

SEQ ID NO: 268962 - DNA, 25 bp, Mus musculus
atgtaccatggtgtccaaaatccaa

SEQ ID NO: 268963 - DNA, 25 bp, Mus musculus
atgtacccaacacagccaagtgcag

SEQ ID NO: 268964 - DNA, 25 bp, Mus musculus
atgtacccaacagagccaagtgcag

SEQ ID NO: 268965 - DNA, 25 bp, Mus musculus
atgtacccagcacaagacctttttg

SEQ ID NO: 268966 - DNA, 25 bp, Mus musculus
atgtacccagcagaagacctttttg

SEQ ID NO: 268967 - DNA, 25 bp, Mus musculus
atgtacccagccactgttttagaat

SEQ ID NO: 268968 - DNA, 25 bp, Mus musculus
atgtacccagcctctgttttagaat

SEQ ID NO: 268969 - DNA, 25 bp, Mus musculus
atgtaccccgggaggctgccaaagg

SEQ ID NO: 268970 - DNA, 25 bp, Mus musculus
atgtaccccgggtggctgccaaagg

SEQ ID NO: 268971 - DNA, 25 bp, Mus musculus
atgtaccctcccagcaagtgcaaca

SEQ ID NO: 268972 - DNA, 25 bp, Mus musculus
atgtaccctccctgcaagtgcaaca

SEQ ID NO: 268973 - DNA, 25 bp, Mus musculus
atgtaccctctgaaatatagcaata

SEQ ID NO: 268974 - DNA, 25 bp, Mus musculus
atgtaccctctgtaatatagcaata

SEQ ID NO: 268975 - DNA, 25 bp, Mus musculus
atgtaccctgacacacaccaaatgt

SEQ ID NO: 268976 - DNA, 25 bp, Mus musculus
atgtaccctgactcacaccaaatgt

SEQ ID NO: 268977 - DNA, 25 bp, Mus musculus
atgtaccctgcccactgactgaggc

SEQ ID NO: 268978 - DNA, 25 bp, Mus musculus
atgtaccctgccgactgactgaggc

SEQ ID NO: 268979 - DNA, 25 bp, Mus musculus
atgtaccctggcactgtatgagaac

SEQ ID NO: 268980 - DNA, 25 bp, Mus musculus
atgtaccctggctctgtatgagaac

SEQ ID NO: 268981 - DNA, 25 bp, Mus musculus
atgtaccctggtatcgctgaccgca

SEQ ID NO: 268982 - DNA, 25 bp, Mus musculus
atgtaccctggtattgccgatcgta

SEQ ID NO: 268983 - DNA, 25 bp, Mus musculus
atgtaccctggtttcgctgaccgca

SEQ ID NO: 268984 - DNA, 25 bp, Mus musculus
atgtaccctggttttgccgatcgta

SEQ ID NO: 268985 - DNA, 25 bp, Mus musculus
atgtacccttgcatactgttccaca

SEQ ID NO: 268986 - DNA, 25 bp, Mus musculus
atgtacccttgcttactgttccaca

SEQ ID NO: 268987 - DNA, 25 bp, Mus musculus
atgtaccgcgtcacactggaaggag

SEQ ID NO: 268988 - DNA, 25 bp, Mus musculus
atgtaccgcgtctcactggaaggag

SEQ ID NO: 268989 - DNA, 25 bp, Mus musculus
atgtaccgtagcctcatgggtgcgt

SEQ ID NO: 268990 - DNA, 25 bp, Mus musculus
atgtaccgtagcgtcatgggtgcgt

SEQ ID NO: 268991 - DNA, 25 bp, Mus musculus
atgtacctacctatgtgcagggtcc

SEQ ID NO: 268992 - DNA, 25 bp, Mus musculus
atgtacctacctttgtgcagggtcc

SEQ ID NO: 268993 - DNA, 25 bp, Mus musculus
atgtacctagctcccagaggttgct

SEQ ID NO: 268994 - DNA, 25 bp, Mus musculus
atgtacctagctgccagaggttgct

SEQ ID NO: 268995 - DNA, 25 bp, Mus musculus
atgtacctatgtactggctccagct

SEQ ID NO: 268996 - DNA, 25 bp, Mus musculus
atgtacctatgttctggctccagct

SEQ ID NO: 268997 - DNA, 25 bp, Mus musculus
atgtacctatttcctattgtctaaa

SEQ ID NO: 268998 - DNA, 25 bp, Mus musculus
atgtacctatttgctattgtctaaa

SEQ ID NO: 268999 - DNA, 25 bp, Mus musculus
atgtacctcactctatgtgtgctgc

SEQ ID NO: 269000 - DNA, 25 bp, Mus musculus
atgtacctcactgtatgtgtgctgc

SEQ ID NO: 269001 - DNA, 25 bp, Mus musculus
atgtacctcatgcagagcagcgctt

SEQ ID NO: 269002 - DNA, 25 bp, Mus musculus
atgtacctcatggagagcagcgctt

SEQ ID NO: 269003 - DNA, 25 bp, Mus musculus
atgtacctctaaatgcttaattttg

SEQ ID NO: 269004 - DNA, 25 bp, Mus musculus
atgtacctctaattgcttaattttg

SEQ ID NO: 269005 - DNA, 25 bp, Mus musculus
atgtacctctctcttcagaattaaa

SEQ ID NO: 269006 - DNA, 25 bp, Mus musculus
atgtacctctctgttcagaattaaa

SEQ ID NO: 269007 - DNA, 25 bp, Mus musculus
atgtacctgaatctgtgctgccttg

SEQ ID NO: 269008 - DNA, 25 bp, Mus musculus
atgtacctgaatgtgtgctgccttg

SEQ ID NO: 269009 - DNA, 25 bp, Mus musculus
atgtacctgagcattcttatttctg

SEQ ID NO: 269010 - DNA, 25 bp, Mus musculus
atgtacctgagcatttttatgtctg

SEQ ID NO: 269011 - DNA, 25 bp, Mus musculus
atgtacctgagctttcttatttctg

SEQ ID NO: 269012 - DNA, 25 bp, Mus musculus
atgtacctgagcttttttatgtctg

SEQ ID NO: 269013 - DNA, 25 bp, Mus musculus
atgtacctgagtccactgcagcaag

SEQ ID NO: 269014 - DNA, 25 bp, Mus musculus
atgtacctgagtgcactgcagcaag

SEQ ID NO: 269015 - DNA, 25 bp, Mus musculus
atgtacctgcttagtcaatcctgca

SEQ ID NO: 269016 - DNA, 25 bp, Mus musculus
atgtacctgctttgtcaatcctgca

SEQ ID NO: 269017 - DNA, 25 bp, Mus musculus
atgtacctgggtcagatcgtccgta

SEQ ID NO: 269018 - DNA, 25 bp, Mus musculus
atgtacctgggtgagatcgtccgta

SEQ ID NO: 269019 - DNA, 25 bp, Mus musculus
atgtaccttcccactgagcttaatt

SEQ ID NO: 269020 - DNA, 25 bp, Mus musculus
atgtaccttccctctgagcttaatt

SEQ ID NO: 269021 - DNA, 25 bp, Mus musculus
atgtaccttttgcatgccttagaag

SEQ ID NO: 269022 - DNA, 25 bp, Mus musculus
atgtaccttttggatgccttagaag

SEQ ID NO: 269023 - DNA, 25 bp, Mus musculus
atgtacgagtgtctccggccttgta

SEQ ID NO: 269024 - DNA, 25 bp, Mus musculus
atgtacgagtgtgtccggccttgta

SEQ ID NO: 269025 - DNA, 25 bp, Mus musculus
atgtacgcacgaatggagcaggttt

SEQ ID NO: 269026 - DNA, 25 bp, Mus musculus
atgtacgcacgattggagcaggttt

SEQ ID NO: 269027 - DNA, 25 bp, Mus musculus
atgtacgcctttaatcacagactta

SEQ ID NO: 269028 - DNA, 25 bp, Mus musculus
atgtacgccttttatcacagactta

SEQ ID NO: 269029 - DNA, 25 bp, Mus musculus
atgtacggaatgatcttgcacccca

SEQ ID NO: 269030 - DNA, 25 bp, Mus musculus
atgtacggaatgttcttgcacccca

SEQ ID NO: 269031 - DNA, 25 bp, Mus musculus
atgtacggacccagtgtgctgtatt

SEQ ID NO: 269032 - DNA, 25 bp, Mus musculus
atgtacggaccctgtgtgctgtatt

SEQ ID NO: 269033 - DNA, 25 bp, Mus musculus
atgtacggatctaacgtcttcccag

SEQ ID NO: 269034 - DNA, 25 bp, Mus musculus
atgtacggatcttacgtcttcccag

SEQ ID NO: 269035 - DNA, 25 bp, Mus musculus
atgtacggattccatttcctggtgt

SEQ ID NO: 269036 - DNA, 25 bp, Mus musculus
atgtacggattcgatttcctggtgt

SEQ ID NO: 269037 - DNA, 25 bp, Mus musculus
atgtacggcatcattgtccagggta

SEQ ID NO: 269038 - DNA, 25 bp, Mus musculus
atgtacggcatctttgtccagggta

SEQ ID NO: 269039 - DNA, 25 bp, Mus musculus
atgtacggcgcaagcacacagctgt

SEQ ID NO: 269040 - DNA, 25 bp, Mus musculus
atgtacggcgcatgcacacagctgt

SEQ ID NO: 269041 - DNA, 25 bp, Mus musculus
atgtacggcttaagttctccaactg

SEQ ID NO: 269042 - DNA, 25 bp, Mus musculus
atgtacggcttatgttctccaactg

SEQ ID NO: 269043 - DNA, 25 bp, Mus musculus
atgtacgtacgaaatctcttctcag

SEQ ID NO: 269044 - DNA, 25 bp, Mus musculus
atgtacgtacgatatctcttctcag

SEQ ID NO: 269045 - DNA, 25 bp, Mus musculus
atgtacgtgctacgcctgcgcgtga

SEQ ID NO: 269046 - DNA, 25 bp, Mus musculus
atgtacgtgctaggcctgcgcgtga

SEQ ID NO: 269047 - DNA, 25 bp, Mus musculus
atgtacgtgtacatggtgtgatgta

SEQ ID NO: 269048 - DNA, 25 bp, Mus musculus
atgtacgtgtacttggtgtgatgta

SEQ ID NO: 269049 - DNA, 25 bp, Mus musculus
atgtacgtgtgtattcctgtatata

SEQ ID NO: 269050 - DNA, 25 bp, Mus musculus
atgtacgtgtgttttcctgtatata

SEQ ID NO: 269051 - DNA, 25 bp, Mus musculus
atgtactactgcattgttgaccaaa

SEQ ID NO: 269052 - DNA, 25 bp, Mus musculus
atgtactactgctttgttgaccaaa

SEQ ID NO: 269053 - DNA, 25 bp, Mus musculus
atgtactacttgcatgtatgtttac

SEQ ID NO: 269054 - DNA, 25 bp, Mus musculus
atgtactacttggatgtatgtttac

SEQ ID NO: 269055 - DNA, 25 bp, Mus musculus
atgtactagcaccaacttactttcc

SEQ ID NO: 269056 - DNA, 25 bp, Mus musculus
atgtactagcacgaacttactttcc

SEQ ID NO: 269057 - DNA, 25 bp, Mus musculus
atgtactatgcaatgtagcctcccc

SEQ ID NO: 269058 - DNA, 25 bp, Mus musculus
atgtactatgcattgtagcctcccc

SEQ ID NO: 269059 - DNA, 25 bp, Mus musculus
atgtactatttaccttcccactctg

SEQ ID NO: 269060 - DNA, 25 bp, Mus musculus
atgtactatttagcttcccactctg

SEQ ID NO: 269061 - DNA, 25 bp, Mus musculus
atgtactatttgatttgaggaccta

SEQ ID NO: 269062 - DNA, 25 bp, Mus musculus
atgtactatttgttttgaggaccta

SEQ ID NO: 269063 - DNA, 25 bp, Mus musculus
atgtactcactcaatgtgacccttg

SEQ ID NO: 269064 - DNA, 25 bp, Mus musculus
atgtactcactctatgtgacccttg

SEQ ID NO: 269065 - DNA, 25 bp, Mus musculus
atgtactcagtgagtgcagtgcagt

SEQ ID NO: 269066 - DNA, 25 bp, Mus musculus
atgtactcagtgtgtgcagtgcagt

SEQ ID NO: 269067 - DNA, 25 bp, Mus musculus
atgtactcatggatctgttggccac

SEQ ID NO: 269068 - DNA, 25 bp, Mus musculus
atgtactcatggttctgttggccac

SEQ ID NO: 269069 - DNA, 25 bp, Mus musculus
atgtactcattgaggtttgtgttta

SEQ ID NO: 269070 - DNA, 25 bp, Mus musculus
atgtactcattgtggtttgtgttta

SEQ ID NO: 269071 - DNA, 25 bp, Mus musculus
atgtactcggttatagtaggagctg

SEQ ID NO: 269072 - DNA, 25 bp, Mus musculus
atgtactcggttttagtaggagctg

SEQ ID NO: 269073 - DNA, 25 bp, Mus musculus
atgtactctcccctgatcacctagt

SEQ ID NO: 269074 - DNA, 25 bp, Mus musculus
atgtactctcccgtgatcacctagt

SEQ ID NO: 269075 - DNA, 25 bp, Mus musculus
atgtactctctactttctttttgga

SEQ ID NO: 269076 - DNA, 25 bp, Mus musculus
atgtactctctagtttctttttgga

SEQ ID NO: 269077 - DNA, 25 bp, Mus musculus
atgtactgaccaaaccagctctggt

SEQ ID NO: 269078 - DNA, 25 bp, Mus musculus
atgtactgaccataccagctctggt

SEQ ID NO: 269079 - DNA, 25 bp, Mus musculus
atgtactgagacatcggtatttgac

SEQ ID NO: 269080 - DNA, 25 bp, Mus musculus
atgtactgagacttcggtatttgac

SEQ ID NO: 269081 - DNA, 25 bp, Mus musculus
atgtactgctggcaccccagcttat

SEQ ID NO: 269082 - DNA, 25 bp, Mus musculus
atgtactgctgggaccccagcttat

SEQ ID NO: 269083 - DNA, 25 bp, Mus musculus
atgtactggaccatgctgcagcaac

SEQ ID NO: 269084 - DNA, 25 bp, Mus musculus
atgtactggaccttgctgcagcaac

SEQ ID NO: 269085 - DNA, 25 bp, Mus musculus
atgtactggacgaggccggctctgc

SEQ ID NO: 269086 - DNA, 25 bp, Mus musculus
atgtactggacgtggccggctctgc

SEQ ID NO: 269087 - DNA, 25 bp, Mus musculus
atgtactggctgacctccaacgtgt

SEQ ID NO: 269088 - DNA, 25 bp, Mus musculus
atgtactggctgtcctccaacgtgt

SEQ ID NO: 269089 - DNA, 25 bp, Mus musculus
atgtactgggatatgctgtgtgaac

SEQ ID NO: 269090 - DNA, 25 bp, Mus musculus
atgtactgggatttgctgtgtgaac

SEQ ID NO: 269091 - DNA, 25 bp, Mus musculus
atgtactgggccaggagatgtatca

SEQ ID NO: 269092 - DNA, 25 bp, Mus musculus
atgtactgggcctggagatgtatca

SEQ ID NO: 269093 - DNA, 25 bp, Mus musculus
atgtactgtatgacttattttgcac

SEQ ID NO: 269094 - DNA, 25 bp, Mus musculus
atgtactgtatgtcttattttgcac

SEQ ID NO: 269095 - DNA, 25 bp, Mus musculus
atgtactgtcgccattgcccaaaaa

SEQ ID NO: 269096 - DNA, 25 bp, Mus musculus
atgtactgtcgcgattgcccaaaaa

SEQ ID NO: 269097 - DNA, 25 bp, Mus musculus
atgtactgtgacatccctggcttct

SEQ ID NO: 269098 - DNA, 25 bp, Mus musculus
atgtactgtgacttccctggcttct

SEQ ID NO: 269099 - DNA, 25 bp, Mus musculus
atgtactgtgccattaactttagac

SEQ ID NO: 269100 - DNA, 25 bp, Mus musculus
atgtactgtgcctttaactttagac

SEQ ID NO: 269101 - DNA, 25 bp, Mus musculus
atgtactgtggcctctgaagctatg

SEQ ID NO: 269102 - DNA, 25 bp, Mus musculus
atgtactgtggcgtctgaagctatg

SEQ ID NO: 269103 - DNA, 25 bp, Mus musculus
atgtactgtgggaggattccttttg

SEQ ID NO: 269104 - DNA, 25 bp, Mus musculus
atgtactgtgggtggattccttttg

SEQ ID NO: 269105 - DNA, 25 bp, Mus musculus
atgtacttagtaatgtccagtggac

SEQ ID NO: 269106 - DNA, 25 bp, Mus musculus
atgtacttagtattgtccagtggac

SEQ ID NO: 269107 - DNA, 25 bp, Mus musculus
atgtacttatggagcgtctcctctc

SEQ ID NO: 269108 - DNA, 25 bp, Mus musculus
atgtacttatggtgcgtctcctctc

SEQ ID NO: 269109 - DNA, 25 bp, Mus musculus
atgtacttcaagcagtctccgcctt

SEQ ID NO: 269110 - DNA, 25 bp, Mus musculus
atgtacttcaaggagtctccgcctt

SEQ ID NO: 269111 - DNA, 25 bp, Mus musculus
atgtacttccatagcaacacctcca

SEQ ID NO: 269112 - DNA, 25 bp, Mus musculus
atgtacttccattgcaacacctcca

SEQ ID NO: 269113 - DNA, 25 bp, Mus musculus
atgtacttctaaactatccatccta

SEQ ID NO: 269114 - DNA, 25 bp, Mus musculus
atgtacttctaatctatccatccta

SEQ ID NO: 269115 - DNA, 25 bp, Mus musculus
atgtacttctatagacttgccctgc

SEQ ID NO: 269116 - DNA, 25 bp, Mus musculus
atgtacttctattgacttgccctgc

SEQ ID NO: 269117 - DNA, 25 bp, Mus musculus
atgtacttgcccatggttggactaa

SEQ ID NO: 269118 - DNA, 25 bp, Mus musculus
atgtacttgcccttggttggactaa

SEQ ID NO: 269119 - DNA, 25 bp, Mus musculus
atgtacttggctactcttgttattt

SEQ ID NO: 269120 - DNA, 25 bp, Mus musculus
atgtacttggcttctcttgttattt

SEQ ID NO: 269121 - DNA, 25 bp, Mus musculus
atgtacttgttgatggtctgtttgg

SEQ ID NO: 269122 - DNA, 25 bp, Mus musculus
atgtacttgttgttggtctgtttgg

SEQ ID NO: 269123 - DNA, 25 bp, Mus musculus
atgtactttagaatctcgctctgct

SEQ ID NO: 269124 - DNA, 25 bp, Mus musculus
atgtactttagattctcgctctgct

SEQ ID NO: 269125 - DNA, 25 bp, Mus musculus
atgtactttgatcctatttgccctt

SEQ ID NO: 269126 - DNA, 25 bp, Mus musculus
atgtactttgatgctatttgccctt

SEQ ID NO: 269127 - DNA, 25 bp, Mus musculus
atgtactttggaccaaccattgcca

SEQ ID NO: 269128 - DNA, 25 bp, Mus musculus
atgtactttggagcaaccattgcca

SEQ ID NO: 269129 - DNA, 25 bp, Mus musculus
atgtactttgttaaaccgcagtgta

SEQ ID NO: 269130 - DNA, 25 bp, Mus musculus
atgtactttgtttaaccgcagtgta

SEQ ID NO: 269131 - DNA, 25 bp, Mus musculus
atgtacttttatctggtagctgata

SEQ ID NO: 269132 - DNA, 25 bp, Mus musculus
atgtacttttatgtggtagctgata

SEQ ID NO: 269133 - DNA, 25 bp, Mus musculus
atgtacttttccacgggtgaccata

SEQ ID NO: 269134 - DNA, 25 bp, Mus musculus
atgtacttttcctcgggtgaccata

SEQ ID NO: 269135 - DNA, 25 bp, Mus musculus
atgtactttttaattatgctatggc

SEQ ID NO: 269136 - DNA, 25 bp, Mus musculus
atgtactttttatttatgctatggc

SEQ ID NO: 269137 - DNA, 25 bp, Mus musculus
atgtactttttcctcagggactgca

SEQ ID NO: 269138 - DNA, 25 bp, Mus musculus
atgtactttttcgtcagggactgca

SEQ ID NO: 269139 - DNA, 25 bp, Mus musculus
atgtagaacataccccagcttttga

SEQ ID NO: 269140 - DNA, 25 bp, Mus musculus
atgtagaacatagcccagcttttga

SEQ ID NO: 269141 - DNA, 25 bp, Mus musculus
atgtagaactaaactctgtggactg

SEQ ID NO: 269142 - DNA, 25 bp, Mus musculus
atgtagaactaatctctgtggactg

SEQ ID NO: 269143 - DNA, 25 bp, Mus musculus
atgtagaactacatccaactttctg

SEQ ID NO: 269144 - DNA, 25 bp, Mus musculus
atgtagaactacttccaactttctg

SEQ ID NO: 269145 - DNA, 25 bp, Mus musculus
atgtagaagggacttcctgtccaca

SEQ ID NO: 269146 - DNA, 25 bp, Mus musculus
atgtagaagggagttcctgtccaca

SEQ ID NO: 269147 - DNA, 25 bp, Mus musculus
atgtagaatcatatcctgatagagt

SEQ ID NO: 269148 - DNA, 25 bp, Mus musculus
atgtagaatcatttcctgatagagt

SEQ ID NO: 269149 - DNA, 25 bp, Mus musculus
atgtagacaaggaggcttcagactt

SEQ ID NO: 269150 - DNA, 25 bp, Mus musculus
atgtagacaaggtggcttcagactt

SEQ ID NO: 269151 - DNA, 25 bp, Mus musculus
atgtagacatccatgggcaggccac

SEQ ID NO: 269152 - DNA, 25 bp, Mus musculus
atgtagacatccttgggcaggccac

SEQ ID NO: 269153 - DNA, 25 bp, Mus musculus
atgtagaccattagacttcgtacct

SEQ ID NO: 269154 - DNA, 25 bp, Mus musculus
atgtagaccatttgacttcgtacct

SEQ ID NO: 269155 - DNA, 25 bp, Mus musculus
atgtagacgaacatcagtccctgac

SEQ ID NO: 269156 - DNA, 25 bp, Mus musculus
atgtagacgaacttcagtccctgac

SEQ ID NO: 269157 - DNA, 25 bp, Mus musculus
atgtagactgacatcctgcatgaca

SEQ ID NO: 269158 - DNA, 25 bp, Mus musculus
atgtagactgacttcctgcatgaca

SEQ ID NO: 269159 - DNA, 25 bp, Mus musculus
atgtagacttggaatttagggatgc

SEQ ID NO: 269160 - DNA, 25 bp, Mus musculus
atgtagacttggtatttagggatgc

SEQ ID NO: 269161 - DNA, 25 bp, Mus musculus
atgtagagacttacccctaactatg

SEQ ID NO: 269162 - DNA, 25 bp, Mus musculus
atgtagagactttcccctaactatg

SEQ ID NO: 269163 - DNA, 25 bp, Mus musculus
atgtagagagttccaaagcagcgct

SEQ ID NO: 269164 - DNA, 25 bp, Mus musculus
atgtagagagttgcaaagcagcgct

SEQ ID NO: 269165 - DNA, 25 bp, Mus musculus
atgtagagcaataacttggctttcc

SEQ ID NO: 269166 - DNA, 25 bp, Mus musculus
atgtagagcaattacttggctttcc

SEQ ID NO: 269167 - DNA, 25 bp, Mus musculus
atgtagagccccaggagcatgagca

SEQ ID NO: 269168 - DNA, 25 bp, Mus musculus
atgtagagcccctggagcatgagca

SEQ ID NO: 269169 - DNA, 25 bp, Mus musculus
atgtagagcttgaggtgtgaactgc

SEQ ID NO: 269170 - DNA, 25 bp, Mus musculus
atgtagagcttgtggtgtgaactgc

SEQ ID NO: 269171 - DNA, 25 bp, Mus musculus
atgtagaggataagacccgtggtca

SEQ ID NO: 269172 - DNA, 25 bp, Mus musculus
atgtagaggatatgacccgtggtca

SEQ ID NO: 269173 - DNA, 25 bp, Mus musculus
atgtagagtacaagtgagcatccct

SEQ ID NO: 269174 - DNA, 25 bp, Mus musculus
atgtagagtacatgtgagcatccct

SEQ ID NO: 269175 - DNA, 25 bp, Mus musculus
atgtagagtactcttaccgacccca

SEQ ID NO: 269176 - DNA, 25 bp, Mus musculus
atgtagagtactgttaccgacccca

SEQ ID NO: 269177 - DNA, 25 bp, Mus musculus
atgtagagtcagctggccttgacct

SEQ ID NO: 269178 - DNA, 25 bp, Mus musculus
atgtagagtcaggtggccttgacct

SEQ ID NO: 269179 - DNA, 25 bp, Mus musculus
atgtagagtcgactgtggtcctccc

SEQ ID NO: 269180 - DNA, 25 bp, Mus musculus
atgtagagtcgagtgtggtcctccc

SEQ ID NO: 269181 - DNA, 25 bp, Mus musculus
atgtagatctcacacatggctggca

SEQ ID NO: 269182 - DNA, 25 bp, Mus musculus
atgtagatctcagacatggctggca

SEQ ID NO: 269183 - DNA, 25 bp, Mus musculus
atgtagatctggatggccttgccac

SEQ ID NO: 269184 - DNA, 25 bp, Mus musculus
atgtagatctggttggccttgccac

SEQ ID NO: 269185 - DNA, 25 bp, Mus musculus
atgtagatctttcgactggcacccg

SEQ ID NO: 269186 - DNA, 25 bp, Mus musculus
atgtagatctttggactggcacccg

SEQ ID NO: 269187 - DNA, 25 bp, Mus musculus
atgtagatggaaagtcaccagactc

SEQ ID NO: 269188 - DNA, 25 bp, Mus musculus
atgtagatggaatgtcaccagactc

SEQ ID NO: 269189 - DNA, 25 bp, Mus musculus
atgtagatgggtctgtatattggct

SEQ ID NO: 269190 - DNA, 25 bp, Mus musculus
atgtagatgggtgtgtatattggct

SEQ ID NO: 269191 - DNA, 25 bp, Mus musculus
atgtagatttttcgtttgcacaaac

SEQ ID NO: 269192 - DNA, 25 bp, Mus musculus
atgtagatttttggtttgcacaaac

SEQ ID NO: 269193 - DNA, 25 bp, Mus musculus
atgtagcactggattccaccaagtt

SEQ ID NO: 269194 - DNA, 25 bp, Mus musculus
atgtagcactggtttccaccaagtt

SEQ ID NO: 269195 - DNA, 25 bp, Mus musculus
atgtagcactttacatttccctgct

SEQ ID NO: 269196 - DNA, 25 bp, Mus musculus
atgtagcacttttcatttccctgct

SEQ ID NO: 269197 - DNA, 25 bp, Mus musculus
atgtagcagcttatgattccctgca

SEQ ID NO: 269198 - DNA, 25 bp, Mus musculus
atgtagcagcttttgattccctgca

SEQ ID NO: 269199 - DNA, 25 bp, Mus musculus
atgtagcatccaagtgactgctgag

SEQ ID NO: 269200 - DNA, 25 bp, Mus musculus
atgtagcatccatgtgactgctgag

SEQ ID NO: 269201 - DNA, 25 bp, Mus musculus
atgtagccaactaagaatccattct

SEQ ID NO: 269202 - DNA, 25 bp, Mus musculus
atgtagccaacttagaatccattct

SEQ ID NO: 269203 - DNA, 25 bp, Mus musculus
atgtagccagcactctgttctccat

SEQ ID NO: 269204 - DNA, 25 bp, Mus musculus
atgtagccagcagtctgttctccat

SEQ ID NO: 269205 - DNA, 25 bp, Mus musculus
atgtagccatcgatttctgcacttg

SEQ ID NO: 269206 - DNA, 25 bp, Mus musculus
atgtagccatcgttttctgcacttg

SEQ ID NO: 269207 - DNA, 25 bp, Mus musculus
atgtagcccaaaatagccccagact

SEQ ID NO: 269208 - DNA, 25 bp, Mus musculus
atgtagcccaaacaaggtttccgtg

SEQ ID NO: 269209 - DNA, 25 bp, Mus musculus
atgtagcccaaagaaggtttccgtg

SEQ ID NO: 269210 - DNA, 25 bp, Mus musculus
atgtagcccaaattagccccagact

SEQ ID NO: 269211 - DNA, 25 bp, Mus musculus
atgtagcccaatactgcatcttgtt

SEQ ID NO: 269212 - DNA, 25 bp, Mus musculus
atgtagcccaattctgcatcttgtt

SEQ ID NO: 269213 - DNA, 25 bp, Mus musculus
atgtagcccagaagagcctgattga

SEQ ID NO: 269214 - DNA, 25 bp, Mus musculus
atgtagcccagatgagcctgattga

SEQ ID NO: 269215 - DNA, 25 bp, Mus musculus
atgtagcctaggaaagtcttgaata

SEQ ID NO: 269216 - DNA, 25 bp, Mus musculus
atgtagcctaggtaagtcttgaata

SEQ ID NO: 269217 - DNA, 25 bp, Mus musculus
atgtagcctgttccacatccggcaa

SEQ ID NO: 269218 - DNA, 25 bp, Mus musculus
atgtagcctgttgcacatccggcaa

SEQ ID NO: 269219 - DNA, 25 bp, Mus musculus
atgtagccttaaatagcagttcttt

SEQ ID NO: 269220 - DNA, 25 bp, Mus musculus
atgtagccttaattagcagttcttt

SEQ ID NO: 269221 - DNA, 25 bp, Mus musculus
atgtagcgaatgaggcgcaaccttt

SEQ ID NO: 269222 - DNA, 25 bp, Mus musculus
atgtagcgaatgtggcgcaaccttt

SEQ ID NO: 269223 - DNA, 25 bp, Mus musculus
atgtagcgtctcaggactgttattg

SEQ ID NO: 269224 - DNA, 25 bp, Mus musculus
atgtagcgtctctggactgttattg

SEQ ID NO: 269225 - DNA, 25 bp, Mus musculus
atgtagcgttggctggcctcaagtc

SEQ ID NO: 269226 - DNA, 25 bp, Mus musculus
atgtagcgttgggtggcctcaagtc

SEQ ID NO: 269227 - DNA, 25 bp, Mus musculus
atgtagctatcaatgtctgcccggg

SEQ ID NO: 269228 - DNA, 25 bp, Mus musculus
atgtagctatcattgtctgcccggg

SEQ ID NO: 269229 - DNA, 25 bp, Mus musculus
atgtagctccataggatccaatgcc

SEQ ID NO: 269230 - DNA, 25 bp, Mus musculus
atgtagctccattggatccaatgcc

SEQ ID NO: 269231 - DNA, 25 bp, Mus musculus
atgtagctccctcaggaggccatgt

SEQ ID NO: 269232 - DNA, 25 bp, Mus musculus
atgtagctccctgaggaggccatgt

SEQ ID NO: 269233 - DNA, 25 bp, Mus musculus
atgtagctccttagcatgttaagtg

SEQ ID NO: 269234 - DNA, 25 bp, Mus musculus
atgtagctcctttgcatgttaagtg

SEQ ID NO: 269235 - DNA, 25 bp, Mus musculus
atgtagctcggtcattaaattacta

SEQ ID NO: 269236 - DNA, 25 bp, Mus musculus
atgtagctcggtgattaaattacta

SEQ ID NO: 269237 - DNA, 25 bp, Mus musculus
atgtagctcttgaacagccacttaa

SEQ ID NO: 269238 - DNA, 25 bp, Mus musculus
atgtagctcttgaacgcccagtgcg

SEQ ID NO: 269239 - DNA, 25 bp, Mus musculus
atgtagctcttgcctatcctgtaac

SEQ ID NO: 269240 - DNA, 25 bp, Mus musculus
atgtagctcttggctatcctgtaac

SEQ ID NO: 269241 - DNA, 25 bp, Mus musculus
atgtagctcttgtacagccacttaa

SEQ ID NO: 269242 - DNA, 25 bp, Mus musculus
atgtagctcttgtacgcccagtgcg

SEQ ID NO: 269243 - DNA, 25 bp, Mus musculus
atgtagctgcatctaggttctcaga

SEQ ID NO: 269244 - DNA, 25 bp, Mus musculus
atgtagctgcatgtaggttctcaga

SEQ ID NO: 269245 - DNA, 25 bp, Mus musculus
atgtagctggaacctaccttctttt

SEQ ID NO: 269246 - DNA, 25 bp, Mus musculus
atgtagctggaagctaccttctttt

SEQ ID NO: 269247 - DNA, 25 bp, Mus musculus
atgtagctgtcaaccacaaagatgc

SEQ ID NO: 269248 - DNA, 25 bp, Mus musculus
atgtagctgtcatccacaaagatgc

SEQ ID NO: 269249 - DNA, 25 bp, Mus musculus
atgtagcttacgcacaggcctaagg

SEQ ID NO: 269250 - DNA, 25 bp, Mus musculus
atgtagcttacggacaggcctaagg

SEQ ID NO: 269251 - DNA, 25 bp, Mus musculus
atgtagcttactacctgagattttg

SEQ ID NO: 269252 - DNA, 25 bp, Mus musculus
atgtagcttacttcctgagattttg

SEQ ID NO: 269253 - DNA, 25 bp, Mus musculus
atgtagcttatgatatagtccctga

SEQ ID NO: 269254 - DNA, 25 bp, Mus musculus
atgtagcttatgttatagtccctga

SEQ ID NO: 269255 - DNA, 25 bp, Mus musculus
atgtagcttctacgaacctgcctca

SEQ ID NO: 269256 - DNA, 25 bp, Mus musculus
atgtagcttctaggaacctgcctca

SEQ ID NO: 269257 - DNA, 25 bp, Mus musculus
atgtagcttgtcagattcaccatgc

SEQ ID NO: 269258 - DNA, 25 bp, Mus musculus
atgtagcttgtctgattcaccatgc

SEQ ID NO: 269259 - DNA, 25 bp, Mus musculus
atgtagcttgttattgctatcaaca

SEQ ID NO: 269260 - DNA, 25 bp, Mus musculus
atgtagcttgtttttgctatcaaca

SEQ ID NO: 269261 - DNA, 25 bp, Mus musculus
atgtagctttaaagcccatgcccaa

SEQ ID NO: 269262 - DNA, 25 bp, Mus musculus
atgtagctttaatgcccatgcccaa

SEQ ID NO: 269263 - DNA, 25 bp, Mus musculus
atgtagctttgtcggttatgacttg

SEQ ID NO: 269264 - DNA, 25 bp, Mus musculus
atgtagctttgtgggttatgacttg

SEQ ID NO: 269265 - DNA, 25 bp, Mus musculus
atgtagcttttgcttagcttcgtca

SEQ ID NO: 269266 - DNA, 25 bp, Mus musculus
atgtagcttttggttagcttcgtca

SEQ ID NO: 269267 - DNA, 25 bp, Mus musculus
atgtaggaagtccttctgccaccgg

SEQ ID NO: 269268 - DNA, 25 bp, Mus musculus
atgtaggaagtcgttctgccaccgg

SEQ ID NO: 269269 - DNA, 25 bp, Mus musculus
atgtaggacgtgcttgttacctcca

SEQ ID NO: 269270 - DNA, 25 bp, Mus musculus
atgtaggacgtggttgttacctcca

SEQ ID NO: 269271 - DNA, 25 bp, Mus musculus
atgtaggagcagagtccctgtctct

SEQ ID NO: 269272 - DNA, 25 bp, Mus musculus
atgtaggagcagtgtccctgtctct

SEQ ID NO: 269273 - DNA, 25 bp, Mus musculus
atgtaggccaggaagcacccagcag

SEQ ID NO: 269274 - DNA, 25 bp, Mus musculus
atgtaggccaggcagcggaacactt

SEQ ID NO: 269275 - DNA, 25 bp, Mus musculus
atgtaggccagggagcggaacactt

SEQ ID NO: 269276 - DNA, 25 bp, Mus musculus
atgtaggccaggtagcacccagcag

SEQ ID NO: 269277 - DNA, 25 bp, Mus musculus
atgtagggcatacctcacctttgaa

SEQ ID NO: 269278 - DNA, 25 bp, Mus musculus
atgtagggcatagctcacctttgaa

SEQ ID NO: 269279 - DNA, 25 bp, Mus musculus
atgtagggccagatgcagttgctat

SEQ ID NO: 269280 - DNA, 25 bp, Mus musculus
atgtagggccagttgcagttgctat

SEQ ID NO: 269281 - DNA, 25 bp, Mus musculus
atgtagggcgacctagtttccagac

SEQ ID NO: 269282 - DNA, 25 bp, Mus musculus
atgtagggcgacgtagtttccagac

SEQ ID NO: 269283 - DNA, 25 bp, Mus musculus
atgtagggttgtccctgctgcccaa

SEQ ID NO: 269284 - DNA, 25 bp, Mus musculus
atgtagggttgtgcctgctgcccaa

SEQ ID NO: 269285 - DNA, 25 bp, Mus musculus
atgtaggtcaagattgcttctcatc

SEQ ID NO: 269286 - DNA, 25 bp, Mus musculus
atgtaggtcaagtttgcttctcatc

SEQ ID NO: 269287 - DNA, 25 bp, Mus musculus
atgtaggtctggacttccagggcat

SEQ ID NO: 269288 - DNA, 25 bp, Mus musculus
atgtaggtctggtcttccagggcat

SEQ ID NO: 269289 - DNA, 25 bp, Mus musculus
atgtaggttcttagccctgacagct

SEQ ID NO: 269290 - DNA, 25 bp, Mus musculus
atgtaggttctttgccctgacagct

SEQ ID NO: 269291 - DNA, 25 bp, Mus musculus
atgtagtagcctcctttttgccagc

SEQ ID NO: 269292 - DNA, 25 bp, Mus musculus
atgtagtagcctgctttttgccagc

SEQ ID NO: 269293 - DNA, 25 bp, Mus musculus
atgtagtatggcagactatcttcac

SEQ ID NO: 269294 - DNA, 25 bp, Mus musculus
atgtagtatggctgactatcttcac

SEQ ID NO: 269295 - DNA, 25 bp, Mus musculus
atgtagtcagacctttctgtgccca

SEQ ID NO: 269296 - DNA, 25 bp, Mus musculus
atgtagtcagacgtttctgtgccca

SEQ ID NO: 269297 - DNA, 25 bp, Mus musculus
atgtagtcatttagccagaagatgc

SEQ ID NO: 269298 - DNA, 25 bp, Mus musculus
atgtagtcattttgccagaagatgc

SEQ ID NO: 269299 - DNA, 25 bp, Mus musculus
atgtagtccactagaatttagttga

SEQ ID NO: 269300 - DNA, 25 bp, Mus musculus
atgtagtccacttgaatttagttga

SEQ ID NO: 269301 - DNA, 25 bp, Mus musculus
atgtagtccctgctcaaggtctgaa

SEQ ID NO: 269302 - DNA, 25 bp, Mus musculus
atgtagtccctggtcaaggtctgaa

SEQ ID NO: 269303 - DNA, 25 bp, Mus musculus
atgtagtcggtgctcactcagggtc

SEQ ID NO: 269304 - DNA, 25 bp, Mus musculus
atgtagtcggtggtcactcagggtc

SEQ ID NO: 269305 - DNA, 25 bp, Mus musculus
atgtagtctacacatcccacaaagt

SEQ ID NO: 269306 - DNA, 25 bp, Mus musculus
atgtagtctacagatcccacaaagt

SEQ ID NO: 269307 - DNA, 25 bp, Mus musculus
atgtagtctaggcttgggcttctgt

SEQ ID NO: 269308 - DNA, 25 bp, Mus musculus
atgtagtctagggttgggcttctgt

SEQ ID NO: 269309 - DNA, 25 bp, Mus musculus
atgtagtgaccaccccagcagtcac

SEQ ID NO: 269310 - DNA, 25 bp, Mus musculus
atgtagtgaccagcccagcagtcac

SEQ ID NO: 269311 - DNA, 25 bp, Mus musculus
atgtagtgcacaaacacgtgacgga

SEQ ID NO: 269312 - DNA, 25 bp, Mus musculus
atgtagtgcacatacacgtgacgga

SEQ ID NO: 269313 - DNA, 25 bp, Mus musculus
atgtagtgcctcagagcagtgtcta

SEQ ID NO: 269314 - DNA, 25 bp, Mus musculus
atgtagtgcctctgagcagtgtcta

SEQ ID NO: 269315 - DNA, 25 bp, Mus musculus
atgtagtgctgtcttgtggaatgtt

SEQ ID NO: 269316 - DNA, 25 bp, Mus musculus
atgtagtgctgtgttgtggaatgtt

SEQ ID NO: 269317 - DNA, 25 bp, Mus musculus
atgtagtgtactattgcttcccaga

SEQ ID NO: 269318 - DNA, 25 bp, Mus musculus
atgtagtgtacttttgcttcccaga

SEQ ID NO: 269319 - DNA, 25 bp, Mus musculus
atgtagtgtagccatcctcaagatg

SEQ ID NO: 269320 - DNA, 25 bp, Mus musculus
atgtagtgtagcgatcctcaagatg

SEQ ID NO: 269321 - DNA, 25 bp, Mus musculus
atgtagtgtcctctgtggccttggc

SEQ ID NO: 269322 - DNA, 25 bp, Mus musculus
atgtagtgtcctgtgtggccttggc

SEQ ID NO: 269323 - DNA, 25 bp, Mus musculus
atgtagttaggtcacctcaggtttg

SEQ ID NO: 269324 - DNA, 25 bp, Mus musculus
atgtagttaggtgacctcaggtttg

SEQ ID NO: 269325 - DNA, 25 bp, Mus musculus
atgtagttagtaaagctgccgggct

SEQ ID NO: 269326 - DNA, 25 bp, Mus musculus
atgtagttagtatagctgccgggct

SEQ ID NO: 269327 - DNA, 25 bp, Mus musculus
atgtagttatgtcaccatgtggtgt

SEQ ID NO: 269328 - DNA, 25 bp, Mus musculus
atgtagttatgtgaccatgtggtgt

SEQ ID NO: 269329 - DNA, 25 bp, Mus musculus
atgtagttgattatctaagtggtac

SEQ ID NO: 269330 - DNA, 25 bp, Mus musculus
atgtagttgattttctaagtggtac

SEQ ID NO: 269331 - DNA, 25 bp, Mus musculus
atgtagtttcagctgtcagcttcca

SEQ ID NO: 269332 - DNA, 25 bp, Mus musculus
atgtagtttcaggtgtcagcttcca

SEQ ID NO: 269333 - DNA, 25 bp, Mus musculus
atgtagttttctcatttagtaaaag

SEQ ID NO: 269334 - DNA, 25 bp, Mus musculus
atgtagttttctgatttagtaaaag

SEQ ID NO: 269335 - DNA, 25 bp, Mus musculus
atgtagttttgtcccaggccagaat

SEQ ID NO: 269336 - DNA, 25 bp, Mus musculus
atgtagttttgtgccaggccagaat

SEQ ID NO: 269337 - DNA, 25 bp, Mus musculus
atgtataaaatacctttgtttgccc

SEQ ID NO: 269338 - DNA, 25 bp, Mus musculus
atgtataaaatagctttgtttgccc

SEQ ID NO: 269339 - DNA, 25 bp, Mus musculus
atgtataaagtacccttcttctcag

SEQ ID NO: 269340 - DNA, 25 bp, Mus musculus
atgtataaagtagccttcttctcag

SEQ ID NO: 269341 - DNA, 25 bp, Mus musculus
atgtataactgtccccgccttgcca

SEQ ID NO: 269342 - DNA, 25 bp, Mus musculus
atgtataactgtgcccgccttgcca

SEQ ID NO: 269343 - DNA, 25 bp, Mus musculus
atgtataagcctattgacctccgga

SEQ ID NO: 269344 - DNA, 25 bp, Mus musculus
atgtataagccttttgacctccgga

SEQ ID NO: 269345 - DNA, 25 bp, Mus musculus
atgtataagttaaggcctggaccct

SEQ ID NO: 269346 - DNA, 25 bp, Mus musculus
atgtataagttatggcctggaccct

SEQ ID NO: 269347 - DNA, 25 bp, Mus musculus
atgtataagttcactggtttcagga

SEQ ID NO: 269348 - DNA, 25 bp, Mus musculus
atgtataagttctctggtttcagga

SEQ ID NO: 269349 - DNA, 25 bp, Mus musculus
atgtataatttgacaccggcatccc

SEQ ID NO: 269350 - DNA, 25 bp, Mus musculus
atgtataatttgtcaccggcatccc

SEQ ID NO: 269351 - DNA, 25 bp, Mus musculus
atgtatacacctcttcttcatgata

SEQ ID NO: 269352 - DNA, 25 bp, Mus musculus
atgtatacacctgttcttcatgata

SEQ ID NO: 269353 - DNA, 25 bp, Mus musculus
atgtatacactcctgtacaatagta

SEQ ID NO: 269354 - DNA, 25 bp, Mus musculus
atgtatacactcgtgtacaatagta

SEQ ID NO: 269355 - DNA, 25 bp, Mus musculus
atgtatacagctaagttgaccctta

SEQ ID NO: 269356 - DNA, 25 bp, Mus musculus
atgtatacagcttagttgaccctta

SEQ ID NO: 269357 - DNA, 25 bp, Mus musculus
atgtatacatctcctctgggcctga

SEQ ID NO: 269358 - DNA, 25 bp, Mus musculus
atgtatacatctgctctgggcctga

SEQ ID NO: 269359 - DNA, 25 bp, Mus musculus
atgtatacattactgatctgctgaa

SEQ ID NO: 269360 - DNA, 25 bp, Mus musculus
atgtatacattagtgatctgctgaa

SEQ ID NO: 269361 - DNA, 25 bp, Mus musculus
atgtataccaggctctgtgcccagg

SEQ ID NO: 269362 - DNA, 25 bp, Mus musculus
atgtataccagggtctgtgcccagg

SEQ ID NO: 269363 - DNA, 25 bp, Mus musculus
atgtatacctgaagactgctcaccc

SEQ ID NO: 269364 - DNA, 25 bp, Mus musculus
atgtatacctgatgactgctcaccc

SEQ ID NO: 269365 - DNA, 25 bp, Mus musculus
atgtatacctgcacaaatataatac

SEQ ID NO: 269366 - DNA, 25 bp, Mus musculus
atgtatacctgctcaaatataatac

SEQ ID NO: 269367 - DNA, 25 bp, Mus musculus
atgtatactatcattttatctggag

SEQ ID NO: 269368 - DNA, 25 bp, Mus musculus
atgtatactatctttttatctggag

SEQ ID NO: 269369 - DNA, 25 bp, Mus musculus
atgtatactctaagaagccctctag

SEQ ID NO: 269370 - DNA, 25 bp, Mus musculus
atgtatactctatgaagccctctag

SEQ ID NO: 269371 - DNA, 25 bp, Mus musculus
atgtatactgtactttgggcagggc

SEQ ID NO: 269372 - DNA, 25 bp, Mus musculus
atgtatactgtagtttgggcagggc

SEQ ID NO: 269373 - DNA, 25 bp, Mus musculus
atgtatacttacacctagaaattta

SEQ ID NO: 269374 - DNA, 25 bp, Mus musculus
atgtatacttactcctagaaattta

SEQ ID NO: 269375 - DNA, 25 bp, Mus musculus
atgtatacttctattccatggctgc

SEQ ID NO: 269376 - DNA, 25 bp, Mus musculus
atgtatacttcttttccatggctgc

SEQ ID NO: 269377 - DNA, 25 bp, Mus musculus
atgtatacttgtcttgctcaactgt

SEQ ID NO: 269378 - DNA, 25 bp, Mus musculus
atgtatacttgtgttgctcaactgt

SEQ ID NO: 269379 - DNA, 25 bp, Mus musculus
atgtatagcacaaccctacggctgg

SEQ ID NO: 269380 - DNA, 25 bp, Mus musculus
atgtatagcacatccctacggctgg

SEQ ID NO: 269381 - DNA, 25 bp, Mus musculus
atgtatagcctgatatctgcccaga

SEQ ID NO: 269382 - DNA, 25 bp, Mus musculus
atgtatagcctgttatctgcccaga

SEQ ID NO: 269383 - DNA, 25 bp, Mus musculus
atgtatagctccctagatctttcac

SEQ ID NO: 269384 - DNA, 25 bp, Mus musculus
atgtatagctccgtagatctttcac

SEQ ID NO: 269385 - DNA, 25 bp, Mus musculus
atgtataggatcaagggttcactgt

SEQ ID NO: 269386 - DNA, 25 bp, Mus musculus
atgtataggatctagggttcactgt

SEQ ID NO: 269387 - DNA, 25 bp, Mus musculus
atgtatagggtgatgtacaagtttc

SEQ ID NO: 269388 - DNA, 25 bp, Mus musculus
atgtatagggtgttgtacaagtttc

SEQ ID NO: 269389 - DNA, 25 bp, Mus musculus
atgtataggttcatattccccacca

SEQ ID NO: 269390 - DNA, 25 bp, Mus musculus
atgtataggttcttattccccacca

SEQ ID NO: 269391 - DNA, 25 bp, Mus musculus
atgtataggttgcatcattactcag

SEQ ID NO: 269392 - DNA, 25 bp, Mus musculus
atgtataggttggatcattactcag

SEQ ID NO: 269393 - DNA, 25 bp, Mus musculus
atgtatagtaagactttgtgcctga

SEQ ID NO: 269394 - DNA, 25 bp, Mus musculus
atgtatagtaagtctttgtgcctga

SEQ ID NO: 269395 - DNA, 25 bp, Mus musculus
atgtatagtagcatcccttcttttc

SEQ ID NO: 269396 - DNA, 25 bp, Mus musculus
atgtatagtagcttcccttcttttc

SEQ ID NO: 269397 - DNA, 25 bp, Mus musculus
atgtatatatacattccctctgttg

SEQ ID NO: 269398 - DNA, 25 bp, Mus musculus
atgtatatatactttccctctgttg

SEQ ID NO: 269399 - DNA, 25 bp, Mus musculus
atgtatatattgattttcccctgaa

SEQ ID NO: 269400 - DNA, 25 bp, Mus musculus
atgtatatattgtttttcccctgaa

SEQ ID NO: 269401 - DNA, 25 bp, Mus musculus
atgtatatcctgcagtgagtcttga

SEQ ID NO: 269402 - DNA, 25 bp, Mus musculus
atgtatatcctggagtgagtcttga

SEQ ID NO: 269403 - DNA, 25 bp, Mus musculus
atgtatatccttatgggtctgggtt

SEQ ID NO: 269404 - DNA, 25 bp, Mus musculus
atgtatatccttttgggtctgggtt

SEQ ID NO: 269405 - DNA, 25 bp, Mus musculus
atgtatatgacaccttttatttttg

SEQ ID NO: 269406 - DNA, 25 bp, Mus musculus
atgtatatgacagcttttatttttg

SEQ ID NO: 269407 - DNA, 25 bp, Mus musculus
atgtatattgaaccatgctccccag

SEQ ID NO: 269408 - DNA, 25 bp, Mus musculus
atgtatattgaagcatgctccccag

SEQ ID NO: 269409 - DNA, 25 bp, Mus musculus
atgtatatttaccacgtgcctctga

SEQ ID NO: 269410 - DNA, 25 bp, Mus musculus
atgtatatttacgacgtgcctctga

SEQ ID NO: 269411 - DNA, 25 bp, Mus musculus
atgtatcaacttacctacctgtgtt

SEQ ID NO: 269412 - DNA, 25 bp, Mus musculus
atgtatcaactttcctacctgtgtt

SEQ ID NO: 269413 - DNA, 25 bp, Mus musculus
atgtatcaccatccaacatcagcag

SEQ ID NO: 269414 - DNA, 25 bp, Mus musculus
atgtatcaccatgcaacatcagcag

SEQ ID NO: 269415 - DNA, 25 bp, Mus musculus
atgtatcactatagcccggcctttt

SEQ ID NO: 269416 - DNA, 25 bp, Mus musculus
atgtatcactattgcccggcctttt

SEQ ID NO: 269417 - DNA, 25 bp, Mus musculus
atgtatcagcagacattcaatatgg

SEQ ID NO: 269418 - DNA, 25 bp, Mus musculus
atgtatcagcagtcattcaatatgg

SEQ ID NO: 269419 - DNA, 25 bp, Mus musculus
atgtatcagttaccctaaggctcga

SEQ ID NO: 269420 - DNA, 25 bp, Mus musculus
atgtatcagttagcctaaggctcga

SEQ ID NO: 269421 - DNA, 25 bp, Mus musculus
atgtatcatagtcctttgttgccca

SEQ ID NO: 269422 - DNA, 25 bp, Mus musculus
atgtatcatagtgctttgttgccca

SEQ ID NO: 269423 - DNA, 25 bp, Mus musculus
atgtatccaacacactcttccatag

SEQ ID NO: 269424 - DNA, 25 bp, Mus musculus
atgtatccaacagactcttccatag

SEQ ID NO: 269425 - DNA, 25 bp, Mus musculus
atgtatccaatgctgcagagcagat

SEQ ID NO: 269426 - DNA, 25 bp, Mus musculus
atgtatccaatggtgcagagcagat

SEQ ID NO: 269427 - DNA, 25 bp, Mus musculus
atgtatccacttataactgcctatt

SEQ ID NO: 269428 - DNA, 25 bp, Mus musculus
atgtatccacttcgcgcctagaact

SEQ ID NO: 269429 - DNA, 25 bp, Mus musculus
atgtatccacttggcgcctagaact

SEQ ID NO: 269430 - DNA, 25 bp, Mus musculus
atgtatccacttttaactgcctatt

SEQ ID NO: 269431 - DNA, 25 bp, Mus musculus
atgtatccagtacttacactctgta

SEQ ID NO: 269432 - DNA, 25 bp, Mus musculus
atgtatccagtagttacactctgta

SEQ ID NO: 269433 - DNA, 25 bp, Mus musculus
atgtatccatccaatctcaactgaa

SEQ ID NO: 269434 - DNA, 25 bp, Mus musculus
atgtatccatcctatctcaactgaa

SEQ ID NO: 269435 - DNA, 25 bp, Mus musculus
atgtatcctgataacttttccaaga

SEQ ID NO: 269436 - DNA, 25 bp, Mus musculus
atgtatcctgattacttttccaaga

SEQ ID NO: 269437 - DNA, 25 bp, Mus musculus
atgtatcctggtatgcggtacactc

SEQ ID NO: 269438 - DNA, 25 bp, Mus musculus
atgtatcctggtttgcggtacactc

SEQ ID NO: 269439 - DNA, 25 bp, Mus musculus
atgtatcgatggctaccaggactgc

SEQ ID NO: 269440 - DNA, 25 bp, Mus musculus
atgtatcgatgggtaccaggactgc

SEQ ID NO: 269441 - DNA, 25 bp, Mus musculus
atgtatcggatacagtgctgctgca

SEQ ID NO: 269442 - DNA, 25 bp, Mus musculus
atgtatcggatagagtgctgctgca

SEQ ID NO: 269443 - DNA, 25 bp, Mus musculus
atgtatcgtcctcggaatcgcagcc

SEQ ID NO: 269444 - DNA, 25 bp, Mus musculus
atgtatcgtcctgggaatcgcagcc

SEQ ID NO: 269445 - DNA, 25 bp, Mus musculus
atgtatcgtctccagaaagccttct

SEQ ID NO: 269446 - DNA, 25 bp, Mus musculus
atgtatcgtctcgagaaagccttct

SEQ ID NO: 269447 - DNA, 25 bp, Mus musculus
atgtatctatatactggtactcaaa

SEQ ID NO: 269448 - DNA, 25 bp, Mus musculus
atgtatctatattctggtactcaaa

SEQ ID NO: 269449 - DNA, 25 bp, Mus musculus
atgtatctcatgacattgaaacggg

SEQ ID NO: 269450 - DNA, 25 bp, Mus musculus
atgtatctcatgtcattgaaacggg

SEQ ID NO: 269451 - DNA, 25 bp, Mus musculus
atgtatctcttcactgtagggttca

SEQ ID NO: 269452 - DNA, 25 bp, Mus musculus
atgtatctcttctctgtagggttca

SEQ ID NO: 269453 - DNA, 25 bp, Mus musculus
atgtatctctttcacctgcatggtt

SEQ ID NO: 269454 - DNA, 25 bp, Mus musculus
atgtatctctttgacctgcatggtt

SEQ ID NO: 269455 - DNA, 25 bp, Mus musculus
atgtatctgtgcatcttgttctctt

SEQ ID NO: 269456 - DNA, 25 bp, Mus musculus
atgtatctgtgcttcttgttctctt

SEQ ID NO: 269457 - DNA, 25 bp, Mus musculus
atgtatctgtgtaaagcgtcttaac

SEQ ID NO: 269458 - DNA, 25 bp, Mus musculus
atgtatctgtgttaagcgtcttaac

SEQ ID NO: 269459 - DNA, 25 bp, Mus musculus
atgtatcttgtaaccttctattctg

SEQ ID NO: 269460 - DNA, 25 bp, Mus musculus
atgtatcttgtatccttctattctg

SEQ ID NO: 269461 - DNA, 25 bp, Mus musculus
atgtatgaacaccacggatccggct

SEQ ID NO: 269462 - DNA, 25 bp, Mus musculus
atgtatgaacacgacggatccggct

SEQ ID NO: 269463 - DNA, 25 bp, Mus musculus
atgtatgaagcaaagtcacgctgta

SEQ ID NO: 269464 - DNA, 25 bp, Mus musculus
atgtatgaagcatagtcacgctgta

SEQ ID NO: 269465 - DNA, 25 bp, Mus musculus
atgtatgaaggtacttccggtcttc

SEQ ID NO: 269466 - DNA, 25 bp, Mus musculus
atgtatgaaggttcttccggtcttc

SEQ ID NO: 269467 - DNA, 25 bp, Mus musculus
atgtatgaatgtacctcagagactc

SEQ ID NO: 269468 - DNA, 25 bp, Mus musculus
atgtatgaatgttcctcagagactc

SEQ ID NO: 269469 - DNA, 25 bp, Mus musculus
atgtatgaccggcagtgaccttccc

SEQ ID NO: 269470 - DNA, 25 bp, Mus musculus
atgtatgaccgggagtgaccttccc

SEQ ID NO: 269471 - DNA, 25 bp, Mus musculus
atgtatgagtctcacgttcctgaac

SEQ ID NO: 269472 - DNA, 25 bp, Mus musculus
atgtatgagtctgacgttcctgaac

SEQ ID NO: 269473 - DNA, 25 bp, Mus musculus
atgtatgatagccaaggccgcccta

SEQ ID NO: 269474 - DNA, 25 bp, Mus musculus
atgtatgatagcgaaggccgcccta

SEQ ID NO: 269475 - DNA, 25 bp, Mus musculus
atgtatgatctgcacggtgacggca

SEQ ID NO: 269476 - DNA, 25 bp, Mus musculus
atgtatgatctggacggtgacggca

SEQ ID NO: 269477 - DNA, 25 bp, Mus musculus
atgtatgattacctacacctgagcc

SEQ ID NO: 269478 - DNA, 25 bp, Mus musculus
atgtatgattacgtacacctgagcc

SEQ ID NO: 269479 - DNA, 25 bp, Mus musculus
atgtatgattcgcacagtgacggcc

SEQ ID NO: 269480 - DNA, 25 bp, Mus musculus
atgtatgattcggacagtgacggcc

SEQ ID NO: 269481 - DNA, 25 bp, Mus musculus
atgtatgcacatccccagacataaa

SEQ ID NO: 269482 - DNA, 25 bp, Mus musculus
atgtatgcacatccgctcagcaaac

SEQ ID NO: 269483 - DNA, 25 bp, Mus musculus
atgtatgcacatgcccagacataaa

SEQ ID NO: 269484 - DNA, 25 bp, Mus musculus
atgtatgcacatgcgctcagcaaac

SEQ ID NO: 269485 - DNA, 25 bp, Mus musculus
atgtatgcacgccatgtgccatgaa

SEQ ID NO: 269486 - DNA, 25 bp, Mus musculus
atgtatgcacgcgatgtgccatgaa

SEQ ID NO: 269487 - DNA, 25 bp, Mus musculus
atgtatgcacgtccacatgcctgca

SEQ ID NO: 269488 - DNA, 25 bp, Mus musculus
atgtatgcacgtgcacatgcctgca

SEQ ID NO: 269489 - DNA, 25 bp, Mus musculus
atgtatgcagcgagcttttccttac

SEQ ID NO: 269490 - DNA, 25 bp, Mus musculus
atgtatgcagcgtgcttttccttac

SEQ ID NO: 269491 - DNA, 25 bp, Mus musculus
atgtatgcagttcccctccaagact

SEQ ID NO: 269492 - DNA, 25 bp, Mus musculus
atgtatgcagttgccctccaagact

SEQ ID NO: 269493 - DNA, 25 bp, Mus musculus
atgtatgcccaccggccacaggagg

SEQ ID NO: 269494 - DNA, 25 bp, Mus musculus
atgtatgcccacgggccacaggagg

SEQ ID NO: 269495 - DNA, 25 bp, Mus musculus
atgtatgccgatcgctacacacgac

SEQ ID NO: 269496 - DNA, 25 bp, Mus musculus
atgtatgccgatggctacacacgac

SEQ ID NO: 269497 - DNA, 25 bp, Mus musculus
atgtatgcctctaggcttgcacaga

SEQ ID NO: 269498 - DNA, 25 bp, Mus musculus
atgtatgcctcttggcttgcacaga

SEQ ID NO: 269499 - DNA, 25 bp, Mus musculus
atgtatgctaagctcccattgcctg

SEQ ID NO: 269500 - DNA, 25 bp, Mus musculus
atgtatgctaaggtcccattgcctg

SEQ ID NO: 269501 - DNA, 25 bp, Mus musculus
atgtatgctcatcccgatctgtatg

SEQ ID NO: 269502 - DNA, 25 bp, Mus musculus
atgtatgctcatgccgatctgtatg

SEQ ID NO: 269503 - DNA, 25 bp, Mus musculus
atgtatgctctgcaagaatcacaga

SEQ ID NO: 269504 - DNA, 25 bp, Mus musculus
atgtatgctctggaagaatcacaga

SEQ ID NO: 269505 - DNA, 25 bp, Mus musculus
atgtatgctgcacttgcaaaggacc

SEQ ID NO: 269506 - DNA, 25 bp, Mus musculus
atgtatgctgcagttgcaaaggacc

SEQ ID NO: 269507 - DNA, 25 bp, Mus musculus
atgtatgctgtaatattatcccttg

SEQ ID NO: 269508 - DNA, 25 bp, Mus musculus
atgtatgctgtattattatcccttg

SEQ ID NO: 269509 - DNA, 25 bp, Mus musculus
atgtatgcttatccccacctagatt

SEQ ID NO: 269510 - DNA, 25 bp, Mus musculus
atgtatgcttatgcccacctagatt

SEQ ID NO: 269511 - DNA, 25 bp, Mus musculus
atgtatggacttcacttttcacccc

SEQ ID NO: 269512 - DNA, 25 bp, Mus musculus
atgtatggacttgacttttcacccc

SEQ ID NO: 269513 - DNA, 25 bp, Mus musculus
atgtatggatacactggcagactgc

SEQ ID NO: 269514 - DNA, 25 bp, Mus musculus
atgtatggatactctggcagactgc

SEQ ID NO: 269515 - DNA, 25 bp, Mus musculus
atgtatggctttacccattcaattg

SEQ ID NO: 269516 - DNA, 25 bp, Mus musculus
atgtatggcttttcccattcaattg

SEQ ID NO: 269517 - DNA, 25 bp, Mus musculus
atgtatgggcctccaattccagcag

SEQ ID NO: 269518 - DNA, 25 bp, Mus musculus
atgtatgggcctgcaattccagcag

SEQ ID NO: 269519 - DNA, 25 bp, Mus musculus
atgtatggtgagaactgcctgtgcc

SEQ ID NO: 269520 - DNA, 25 bp, Mus musculus
atgtatggtgagtactgcctgtgcc

SEQ ID NO: 269521 - DNA, 25 bp, Mus musculus
atgtatggtgccatgcattcgccag

SEQ ID NO: 269522 - DNA, 25 bp, Mus musculus
atgtatggtgccttgcattcgccag

SEQ ID NO: 269523 - DNA, 25 bp, Mus musculus
atgtatgtacctcgcacccacagag

SEQ ID NO: 269524 - DNA, 25 bp, Mus musculus
atgtatgtacctggcacccacagag

SEQ ID NO: 269525 - DNA, 25 bp, Mus musculus
atgtatgtagcaacccacgtgtgaa

SEQ ID NO: 269526 - DNA, 25 bp, Mus musculus
atgtatgtagcatcccacgtgtgaa

SEQ ID NO: 269527 - DNA, 25 bp, Mus musculus
atgtatgtagggactctctttctga

SEQ ID NO: 269528 - DNA, 25 bp, Mus musculus
atgtatgtagggtctctctttctga

SEQ ID NO: 269529 - DNA, 25 bp, Mus musculus
atgtatgtatatcaggtcctccttc

SEQ ID NO: 269530 - DNA, 25 bp, Mus musculus
atgtatgtatatgaggtcctccttc

SEQ ID NO: 269531 - DNA, 25 bp, Mus musculus
atgtatgtatttcaggctttcacca

SEQ ID NO: 269532 - DNA, 25 bp, Mus musculus
atgtatgtatttgaggctttcacca

SEQ ID NO: 269533 - DNA, 25 bp, Mus musculus
atgtatgtcaaccatcctgcacaag

SEQ ID NO: 269534 - DNA, 25 bp, Mus musculus
atgtatgtcaacgatcctgcacaag

SEQ ID NO: 269535 - DNA, 25 bp, Mus musculus
atgtatgtcactccctggaattcac

SEQ ID NO: 269536 - DNA, 25 bp, Mus musculus
atgtatgtcactgcctggaattcac

SEQ ID NO: 269537 - DNA, 25 bp, Mus musculus
atgtatgtctccattcctgtctatc

SEQ ID NO: 269538 - DNA, 25 bp, Mus musculus
atgtatgtctcctttcctgtctatc

SEQ ID NO: 269539 - DNA, 25 bp, Mus musculus
atgtatgtcttacaactgtttctcc

SEQ ID NO: 269540 - DNA, 25 bp, Mus musculus
atgtatgtcttagaactgtttctcc

SEQ ID NO: 269541 - DNA, 25 bp, Mus musculus
atgtatgtgcatctagctctggcta

SEQ ID NO: 269542 - DNA, 25 bp, Mus musculus
atgtatgtgcatgtagctctggcta

SEQ ID NO: 269543 - DNA, 25 bp, Mus musculus
atgtatgtgccacctgatgttgata

SEQ ID NO: 269544 - DNA, 25 bp, Mus musculus
atgtatgtgccagctgatgttgata

SEQ ID NO: 269545 - DNA, 25 bp, Mus musculus
atgtatgtggcaaaccttctacctc

SEQ ID NO: 269546 - DNA, 25 bp, Mus musculus
atgtatgtggcataccttctacctc

SEQ ID NO: 269547 - DNA, 25 bp, Mus musculus
atgtatgtgtgaaacttggctctat

SEQ ID NO: 269548 - DNA, 25 bp, Mus musculus
atgtatgtgtgatacttggctctat

SEQ ID NO: 269549 - DNA, 25 bp, Mus musculus
atgtatgtgtgtatccatcctttct

SEQ ID NO: 269550 - DNA, 25 bp, Mus musculus
atgtatgtgtgtttccatcctttct

SEQ ID NO: 269551 - DNA, 25 bp, Mus musculus
atgtatgttagtattgttcccctca

SEQ ID NO: 269552 - DNA, 25 bp, Mus musculus
atgtatgttagttttgttcccctca

SEQ ID NO: 269553 - DNA, 25 bp, Mus musculus
atgtatgttgcaactttgaggccag

SEQ ID NO: 269554 - DNA, 25 bp, Mus musculus
atgtatgttgcatctttgaggccag

SEQ ID NO: 269555 - DNA, 25 bp, Mus musculus
atgtatgtttatagactcaaatcag

SEQ ID NO: 269556 - DNA, 25 bp, Mus musculus
atgtatgtttattgactcaaatcag

SEQ ID NO: 269557 - DNA, 25 bp, Mus musculus
atgtatgtttcccacctgattcagt

SEQ ID NO: 269558 - DNA, 25 bp, Mus musculus
atgtatgtttccgacctgattcagt

SEQ ID NO: 269559 - DNA, 25 bp, Mus musculus
atgtattaaagcatctcacctaact

SEQ ID NO: 269560 - DNA, 25 bp, Mus musculus
atgtattaaagcttctcacctaact

SEQ ID NO: 269561 - DNA, 25 bp, Mus musculus
atgtattactgtagagtcgctctgt

SEQ ID NO: 269562 - DNA, 25 bp, Mus musculus
atgtattactgttgagtcgctctgt

SEQ ID NO: 269563 - DNA, 25 bp, Mus musculus
atgtattagctaagggacacgccct

SEQ ID NO: 269564 - DNA, 25 bp, Mus musculus
atgtattagctatgggacacgccct

SEQ ID NO: 269565 - DNA, 25 bp, Mus musculus
atgtattataagatcagcactgcta

SEQ ID NO: 269566 - DNA, 25 bp, Mus musculus
atgtattataagttcagcactgcta

SEQ ID NO: 269567 - DNA, 25 bp, Mus musculus
atgtattattatcttgacctcagaa

SEQ ID NO: 269568 - DNA, 25 bp, Mus musculus
atgtattattatgttgacctcagaa

SEQ ID NO: 269569 - DNA, 25 bp, Mus musculus
atgtattcagttctttaatgtcaga

SEQ ID NO: 269570 - DNA, 25 bp, Mus musculus
atgtattcagttgtttaatgtcaga

SEQ ID NO: 269571 - DNA, 25 bp, Mus musculus
atgtattcccaactctcatgcagaa

SEQ ID NO: 269572 - DNA, 25 bp, Mus musculus
atgtattcccaagtctcatgcagaa

SEQ ID NO: 269573 - DNA, 25 bp, Mus musculus
atgtattcccacctagtcgactact

SEQ ID NO: 269574 - DNA, 25 bp, Mus musculus
atgtattcccacgtagtcgactact

SEQ ID NO: 269575 - DNA, 25 bp, Mus musculus
atgtattccccaacaaaacaccatc

SEQ ID NO: 269576 - DNA, 25 bp, Mus musculus
atgtattccccatcaaaacaccatc

SEQ ID NO: 269577 - DNA, 25 bp, Mus musculus
atgtattcctacctccagtttttgg

SEQ ID NO: 269578 - DNA, 25 bp, Mus musculus
atgtattcctacgtccagtttttgg

SEQ ID NO: 269579 - DNA, 25 bp, Mus musculus
atgtattcctcacttcagctttaag

SEQ ID NO: 269580 - DNA, 25 bp, Mus musculus
atgtattcctcagttcagctttaag

SEQ ID NO: 269581 - DNA, 25 bp, Mus musculus
atgtattctatcctgggtggttccc

SEQ ID NO: 269582 - DNA, 25 bp, Mus musculus
atgtattctatcgtgggtggttccc

SEQ ID NO: 269583 - DNA, 25 bp, Mus musculus
atgtattctcaaaacaacgccccag

SEQ ID NO: 269584 - DNA, 25 bp, Mus musculus
atgtattctcaatacaacgccccag

SEQ ID NO: 269585 - DNA, 25 bp, Mus musculus
atgtattctctacagtgccttcctt

SEQ ID NO: 269586 - DNA, 25 bp, Mus musculus
atgtattctctagagtgccttcctt

SEQ ID NO: 269587 - DNA, 25 bp, Mus musculus
atgtattgatgtattgtgtatgtgt

SEQ ID NO: 269588 - DNA, 25 bp, Mus musculus
atgtattgatgttttgtgtatgtgt

SEQ ID NO: 269589 - DNA, 25 bp, Mus musculus
atgtattgctggacgatggtttctc

SEQ ID NO: 269590 - DNA, 25 bp, Mus musculus
atgtattgctggtcgatggtttctc

SEQ ID NO: 269591 - DNA, 25 bp, Mus musculus
atgtattggtccagggtttttgctc

SEQ ID NO: 269592 - DNA, 25 bp, Mus musculus
atgtattggtcctgggtttttgctc

SEQ ID NO: 269593 - DNA, 25 bp, Mus musculus
atgtattggtttactggctgcatcc

SEQ ID NO: 269594 - DNA, 25 bp, Mus musculus
atgtattggtttccacagaaccatt

SEQ ID NO: 269595 - DNA, 25 bp, Mus musculus
atgtattggtttgcacagaaccatt

SEQ ID NO: 269596 - DNA, 25 bp, Mus musculus
atgtattggttttctggctgcatcc

SEQ ID NO: 269597 - DNA, 25 bp, Mus musculus
atgtattgtaagctattttacacgt

SEQ ID NO: 269598 - DNA, 25 bp, Mus musculus
atgtattgtaaggtattttacacgt

SEQ ID NO: 269599 - DNA, 25 bp, Mus musculus
atgtattgtgcgaagctccaggaaa

SEQ ID NO: 269600 - DNA, 25 bp, Mus musculus
atgtattgtgcgtagctccaggaaa

SEQ ID NO: 269601 - DNA, 25 bp, Mus musculus
atgtattgttttatagtggacactt

SEQ ID NO: 269602 - DNA, 25 bp, Mus musculus
atgtattgttttttagtggacactt

SEQ ID NO: 269603 - DNA, 25 bp, Mus musculus
atgtatttaacccacagaatgctta

SEQ ID NO: 269604 - DNA, 25 bp, Mus musculus
atgtatttaaccgacagaatgctta

SEQ ID NO: 269605 - DNA, 25 bp, Mus musculus
atgtatttaatcacagcgtggccat

SEQ ID NO: 269606 - DNA, 25 bp, Mus musculus
atgtatttaatctcagcgtggccat

SEQ ID NO: 269607 - DNA, 25 bp, Mus musculus
atgtatttattccaggccctttctg

SEQ ID NO: 269608 - DNA, 25 bp, Mus musculus
atgtatttattcgaggccctttctg

SEQ ID NO: 269609 - DNA, 25 bp, Mus musculus
atgtatttatttaccagtgcccctt

SEQ ID NO: 269610 - DNA, 25 bp, Mus musculus
atgtatttattttccagtgcccctt

SEQ ID NO: 269611 - DNA, 25 bp, Mus musculus
atgtatttcatcagctttcaagtct

SEQ ID NO: 269612 - DNA, 25 bp, Mus musculus
atgtatttcatctgctttcaagtct

SEQ ID NO: 269613 - DNA, 25 bp, Mus musculus
atgtatttccaaagcctgtgcctgt

SEQ ID NO: 269614 - DNA, 25 bp, Mus musculus
atgtatttccaatgcctgtgcctgt

SEQ ID NO: 269615 - DNA, 25 bp, Mus musculus
atgtatttccgaattgcccagaaga

SEQ ID NO: 269616 - DNA, 25 bp, Mus musculus
atgtatttccgatttgcccagaaga

SEQ ID NO: 269617 - DNA, 25 bp, Mus musculus
atgtatttctagaccacagagttgg

SEQ ID NO: 269618 - DNA, 25 bp, Mus musculus
atgtatttctagtccacagagttgg

SEQ ID NO: 269619 - DNA, 25 bp, Mus musculus
atgtatttgaagcttgtattgtttt

SEQ ID NO: 269620 - DNA, 25 bp, Mus musculus
atgtatttgaaggttgtattgtttt

SEQ ID NO: 269621 - DNA, 25 bp, Mus musculus
atgtatttgattaaaaccattctaa

SEQ ID NO: 269622 - DNA, 25 bp, Mus musculus
atgtatttgatttaaaccattctaa

SEQ ID NO: 269623 - DNA, 25 bp, Mus musculus
atgtatttgctcataatcactgtca

SEQ ID NO: 269624 - DNA, 25 bp, Mus musculus
atgtatttgctcttaatcactgtca

SEQ ID NO: 269625 - DNA, 25 bp, Mus musculus
atgtatttgcttccacagctgactt

SEQ ID NO: 269626 - DNA, 25 bp, Mus musculus
atgtatttgcttgcacagctgactt

SEQ ID NO: 269627 - DNA, 25 bp, Mus musculus
atgtatttgggaaatccctcccgga

SEQ ID NO: 269628 - DNA, 25 bp, Mus musculus
atgtatttgggatatccctcccgga

SEQ ID NO: 269629 - DNA, 25 bp, Mus musculus
atgtatttgtatatcttggcctata

SEQ ID NO: 269630 - DNA, 25 bp, Mus musculus
atgtatttgtatttcttggcctata

SEQ ID NO: 269631 - DNA, 25 bp, Mus musculus
atgtattttagtacaggacaccctc

SEQ ID NO: 269632 - DNA, 25 bp, Mus musculus
atgtattttagttcaggacaccctc

SEQ ID NO: 269633 - DNA, 25 bp, Mus musculus
atgtattttattccctccagctttg

SEQ ID NO: 269634 - DNA, 25 bp, Mus musculus
atgtattttattgcctccagctttg

SEQ ID NO: 269635 - DNA, 25 bp, Mus musculus
atgtattttcacaaccccagtggct

SEQ ID NO: 269636 - DNA, 25 bp, Mus musculus
atgtattttcactaccccagtggct

SEQ ID NO: 269637 - DNA, 25 bp, Mus musculus
atgtattttgcgctgtgacctcttt

SEQ ID NO: 269638 - DNA, 25 bp, Mus musculus
atgtattttgcggtgtgacctcttt

SEQ ID NO: 269639 - DNA, 25 bp, Mus musculus
atgtatttttcactcagctccatag

SEQ ID NO: 269640 - DNA, 25 bp, Mus musculus
atgtatttttcagtcagctccatag

SEQ ID NO: 269641 - DNA, 25 bp, Mus musculus
atgtattttttaagtgcctgtgagg

SEQ ID NO: 269642 - DNA, 25 bp, Mus musculus
atgtattttttatgtgcctgtgagg

SEQ ID NO: 269643 - DNA, 25 bp, Mus musculus
atgtcaaaactacgcttgcgtcaga

SEQ ID NO: 269644 - DNA, 25 bp, Mus musculus
atgtcaaaactaggcttgcgtcaga

SEQ ID NO: 269645 - DNA, 25 bp, Mus musculus
atgtcaaaagcaactcccagacttg

SEQ ID NO: 269646 - DNA, 25 bp, Mus musculus
atgtcaaaagcatctcccagacttg

SEQ ID NO: 269647 - DNA, 25 bp, Mus musculus
atgtcaaacaagaatggcaagccta

SEQ ID NO: 269648 - DNA, 25 bp, Mus musculus
atgtcaaacaagtatggcaagccta

SEQ ID NO: 269649 - DNA, 25 bp, Mus musculus
atgtcaaactatacctgcattgcta

SEQ ID NO: 269650 - DNA, 25 bp, Mus musculus
atgtcaaactattcctgcattgcta

SEQ ID NO: 269651 - DNA, 25 bp, Mus musculus
atgtcaaagtctattgtctaacaag

SEQ ID NO: 269652 - DNA, 25 bp, Mus musculus
atgtcaaagtcttttgtctaacaag

SEQ ID NO: 269653 - DNA, 25 bp, Mus musculus
atgtcaaagtgtctcgggacccaaa

SEQ ID NO: 269654 - DNA, 25 bp, Mus musculus
atgtcaaagtgtgtcgggacccaaa

SEQ ID NO: 269655 - DNA, 25 bp, Mus musculus
atgtcaaatcgcctatgaagcttta

SEQ ID NO: 269656 - DNA, 25 bp, Mus musculus
atgtcaaatcgcgtatgaagcttta

SEQ ID NO: 269657 - DNA, 25 bp, Mus musculus
atgtcaaatggcatggctctgtcat

SEQ ID NO: 269658 - DNA, 25 bp, Mus musculus
atgtcaaatggcttggctctgtcat

SEQ ID NO: 269659 - DNA, 25 bp, Mus musculus
atgtcaaatttacgtgtgcccattc

SEQ ID NO: 269660 - DNA, 25 bp, Mus musculus
atgtcaaatttaggtgtgcccattc

SEQ ID NO: 269661 - DNA, 25 bp, Mus musculus
atgtcaacagacacgtggctatcga

SEQ ID NO: 269662 - DNA, 25 bp, Mus musculus
atgtcaacagacacttcgagcagca

SEQ ID NO: 269663 - DNA, 25 bp, Mus musculus
atgtcaacagactcgtggctatcga

SEQ ID NO: 269664 - DNA, 25 bp, Mus musculus
atgtcaacagactcttcgagcagca

SEQ ID NO: 269665 - DNA, 25 bp, Mus musculus
atgtcaacataaactccccttgtga

SEQ ID NO: 269666 - DNA, 25 bp, Mus musculus
atgtcaacataatctccccttgtga

SEQ ID NO: 269667 - DNA, 25 bp, Mus musculus
atgtcaaccacaactcctcagttgt

SEQ ID NO: 269668 - DNA, 25 bp, Mus musculus
atgtcaaccacatctcctcagttgt

SEQ ID NO: 269669 - DNA, 25 bp, Mus musculus
atgtcaacccatcagaattatattt

SEQ ID NO: 269670 - DNA, 25 bp, Mus musculus
atgtcaacccatgagaattatattt

SEQ ID NO: 269671 - DNA, 25 bp, Mus musculus
atgtcaaccctgcagatttcaagag

SEQ ID NO: 269672 - DNA, 25 bp, Mus musculus
atgtcaaccctggagatttcaagag

SEQ ID NO: 269673 - DNA, 25 bp, Mus musculus
atgtcaacgaccaaattctctataa

SEQ ID NO: 269674 - DNA, 25 bp, Mus musculus
atgtcaacgacctaattctctataa

SEQ ID NO: 269675 - DNA, 25 bp, Mus musculus
atgtcaacgctcaggagccctgcaa

SEQ ID NO: 269676 - DNA, 25 bp, Mus musculus
atgtcaacgctctggagccctgcaa

SEQ ID NO: 269677 - DNA, 25 bp, Mus musculus
atgtcaactcctactctttcacaat

SEQ ID NO: 269678 - DNA, 25 bp, Mus musculus
atgtcaactccttctctttcacaat

SEQ ID NO: 269679 - DNA, 25 bp, Mus musculus
atgtcaactcttctgagattctcag

SEQ ID NO: 269680 - DNA, 25 bp, Mus musculus
atgtcaactcttgtgagattctcag

SEQ ID NO: 269681 - DNA, 25 bp, Mus musculus
atgtcaacttctactatgtcagttc

SEQ ID NO: 269682 - DNA, 25 bp, Mus musculus
atgtcaacttcttctatgtcagttc

SEQ ID NO: 269683 - DNA, 25 bp, Mus musculus
atgtcaacttgacactgcctagggt

SEQ ID NO: 269684 - DNA, 25 bp, Mus musculus
atgtcaacttgacggttttctccaa

SEQ ID NO: 269685 - DNA, 25 bp, Mus musculus
atgtcaacttgagactgcctagggt

SEQ ID NO: 269686 - DNA, 25 bp, Mus musculus
atgtcaacttgagggttttctccaa

SEQ ID NO: 269687 - DNA, 25 bp, Mus musculus
atgtcaactttgacctgagtgccac

SEQ ID NO: 269688 - DNA, 25 bp, Mus musculus
atgtcaactttgtcctgagtgccac

SEQ ID NO: 269689 - DNA, 25 bp, Mus musculus
atgtcaacttttcaccactgcactt

SEQ ID NO: 269690 - DNA, 25 bp, Mus musculus
atgtcaacttttgaccactgcactt

SEQ ID NO: 269691 - DNA, 25 bp, Mus musculus
atgtcaagaaatatgggctgagcca

SEQ ID NO: 269692 - DNA, 25 bp, Mus musculus
atgtcaagaaatttgggctgagcca

SEQ ID NO: 269693 - DNA, 25 bp, Mus musculus
atgtcaagagctatgcatcctgcac

SEQ ID NO: 269694 - DNA, 25 bp, Mus musculus
atgtcaagagctttgcatcctgcac

SEQ ID NO: 269695 - DNA, 25 bp, Mus musculus
atgtcaagcagcagctccggtcctg

SEQ ID NO: 269696 - DNA, 25 bp, Mus musculus
atgtcaagcagctgctccggtcctg

SEQ ID NO: 269697 - DNA, 25 bp, Mus musculus
atgtcaagcattaaagatgttcatt

SEQ ID NO: 269698 - DNA, 25 bp, Mus musculus
atgtcaagcattacagctcccgtgt

SEQ ID NO: 269699 - DNA, 25 bp, Mus musculus
atgtcaagcatttaagatgttcatt

SEQ ID NO: 269700 - DNA, 25 bp, Mus musculus
atgtcaagcatttcagctcccgtgt

SEQ ID NO: 269701 - DNA, 25 bp, Mus musculus
atgtcaaggcttcgtattctgagac

SEQ ID NO: 269702 - DNA, 25 bp, Mus musculus
atgtcaaggcttggtattctgagac

SEQ ID NO: 269703 - DNA, 25 bp, Mus musculus
atgtcaagtcctcgtcttgtgactc

SEQ ID NO: 269704 - DNA, 25 bp, Mus musculus
atgtcaagtcctggtcttgtgactc

SEQ ID NO: 269705 - DNA, 25 bp, Mus musculus
atgtcaagtgcccacaggttgtcat

SEQ ID NO: 269706 - DNA, 25 bp, Mus musculus
atgtcaagtgccgacaggttgtcat

SEQ ID NO: 269707 - DNA, 25 bp, Mus musculus
atgtcaagtttcatccatattctta

SEQ ID NO: 269708 - DNA, 25 bp, Mus musculus
atgtcaagtttcttccatattctta

SEQ ID NO: 269709 - DNA, 25 bp, Mus musculus
atgtcaatatcactaaacccctccg

SEQ ID NO: 269710 - DNA, 25 bp, Mus musculus
atgtcaatatcagtaaacccctccg

SEQ ID NO: 269711 - DNA, 25 bp, Mus musculus
atgtcaatgcccatatggtctgcca

SEQ ID NO: 269712 - DNA, 25 bp, Mus musculus
atgtcaatgcccttatggtctgcca

SEQ ID NO: 269713 - DNA, 25 bp, Mus musculus
atgtcaatgcttcgcgtgggaagaa

SEQ ID NO: 269714 - DNA, 25 bp, Mus musculus
atgtcaatgcttggcgtgggaagaa

SEQ ID NO: 269715 - DNA, 25 bp, Mus musculus
atgtcaatggttcgctacatcctgg

SEQ ID NO: 269716 - DNA, 25 bp, Mus musculus
atgtcaatggttggctacatcctgg

SEQ ID NO: 269717 - DNA, 25 bp, Mus musculus
atgtcaatgttgcagcccgggttca

SEQ ID NO: 269718 - DNA, 25 bp, Mus musculus
atgtcaatgttggagcccgggttca

SEQ ID NO: 269719 - DNA, 25 bp, Mus musculus
atgtcaatgtttcgaggtctctgta

SEQ ID NO: 269720 - DNA, 25 bp, Mus musculus
atgtcaatgtttggaggtctctgta

SEQ ID NO: 269721 - DNA, 25 bp, Mus musculus
atgtcaattatgagtgtccccaagt

SEQ ID NO: 269722 - DNA, 25 bp, Mus musculus
atgtcaattatgtgtgtccccaagt

SEQ ID NO: 269723 - DNA, 25 bp, Mus musculus
atgtcaattcgcactgagaccatcg

SEQ ID NO: 269724 - DNA, 25 bp, Mus musculus
atgtcaattcgctctgagaccatcg

SEQ ID NO: 269725 - DNA, 25 bp, Mus musculus
atgtcaattcttctgtacctttccc

SEQ ID NO: 269726 - DNA, 25 bp, Mus musculus
atgtcaattcttgtgtacctttccc

SEQ ID NO: 269727 - DNA, 25 bp, Mus musculus
atgtcaatttgcacaccttttgttg

SEQ ID NO: 269728 - DNA, 25 bp, Mus musculus
atgtcaatttgctcaccttttgttg

SEQ ID NO: 269729 - DNA, 25 bp, Mus musculus
atgtcacaaacactagccgtggcct

SEQ ID NO: 269730 - DNA, 25 bp, Mus musculus
atgtcacaaacagtagccgtggcct

SEQ ID NO: 269731 - DNA, 25 bp, Mus musculus
atgtcacaactcctggtgtcacaga

SEQ ID NO: 269732 - DNA, 25 bp, Mus musculus
atgtcacaactcgtggtgtcacaga

SEQ ID NO: 269733 - DNA, 25 bp, Mus musculus
atgtcacaatttcaaacgctcctga

SEQ ID NO: 269734 - DNA, 25 bp, Mus musculus
atgtcacaatttgaaacgctcctga

SEQ ID NO: 269735 - DNA, 25 bp, Mus musculus
atgtcacacacacattcccttaaaa

SEQ ID NO: 269736 - DNA, 25 bp, Mus musculus
atgtcacacacaccctctctagcag

SEQ ID NO: 269737 - DNA, 25 bp, Mus musculus
atgtcacacacagattcccttaaaa

SEQ ID NO: 269738 - DNA, 25 bp, Mus musculus
atgtcacacacagcctctctagcag

SEQ ID NO: 269739 - DNA, 25 bp, Mus musculus
atgtcacacgagaggaatcacccga

SEQ ID NO: 269740 - DNA, 25 bp, Mus musculus
atgtcacacgagtggaatcacccga

SEQ ID NO: 269741 - DNA, 25 bp, Mus musculus
atgtcacacttaaagctggccaaga

SEQ ID NO: 269742 - DNA, 25 bp, Mus musculus
atgtcacacttatagctggccaaga

SEQ ID NO: 269743 - DNA, 25 bp, Mus musculus
atgtcacactttcaagggagaaccc

SEQ ID NO: 269744 - DNA, 25 bp, Mus musculus
atgtcacactttgaagggagaaccc

SEQ ID NO: 269745 - DNA, 25 bp, Mus musculus
atgtcacagacgaaccagccagaag

SEQ ID NO: 269746 - DNA, 25 bp, Mus musculus
atgtcacagacgtaccagccagaag

SEQ ID NO: 269747 - DNA, 25 bp, Mus musculus
atgtcacagcccagtggttcttagg

SEQ ID NO: 269748 - DNA, 25 bp, Mus musculus
atgtcacagccctgtggttcttagg

SEQ ID NO: 269749 - DNA, 25 bp, Mus musculus
atgtcacagctgaggctatgctcta

SEQ ID NO: 269750 - DNA, 25 bp, Mus musculus
atgtcacagctgtggctatgctcta

SEQ ID NO: 269751 - DNA, 25 bp, Mus musculus
atgtcacagcttcctactctgagga

SEQ ID NO: 269752 - DNA, 25 bp, Mus musculus
atgtcacagcttgctactctgagga

SEQ ID NO: 269753 - DNA, 25 bp, Mus musculus
atgtcacaggcacccatacatgtgt

SEQ ID NO: 269754 - DNA, 25 bp, Mus musculus
atgtcacaggcagccatacatgtgt

SEQ ID NO: 269755 - DNA, 25 bp, Mus musculus
atgtcacagtacaccatgaattcat

SEQ ID NO: 269756 - DNA, 25 bp, Mus musculus
atgtcacagtactccatgaattcat

SEQ ID NO: 269757 - DNA, 25 bp, Mus musculus
atgtcacagtctacatcttttcagc

SEQ ID NO: 269758 - DNA, 25 bp, Mus musculus
atgtcacagtcttcatcttttcagc

SEQ ID NO: 269759 - DNA, 25 bp, Mus musculus
atgtcacagtgcaatttgctgtccc

SEQ ID NO: 269760 - DNA, 25 bp, Mus musculus
atgtcacagtgctatttgctgtccc

SEQ ID NO: 269761 - DNA, 25 bp, Mus musculus
atgtcacatacaaggttgtctttat

SEQ ID NO: 269762 - DNA, 25 bp, Mus musculus
atgtcacatacatggttgtctttat

SEQ ID NO: 269763 - DNA, 25 bp, Mus musculus
atgtcacatagcagtggcctctcgg

SEQ ID NO: 269764 - DNA, 25 bp, Mus musculus
atgtcacatagctgtggcctctcgg

SEQ ID NO: 269765 - DNA, 25 bp, Mus musculus
atgtcacatcaccagctctgagaag

SEQ ID NO: 269766 - DNA, 25 bp, Mus musculus
atgtcacatcacgagctctgagaag

SEQ ID NO: 269767 - DNA, 25 bp, Mus musculus
atgtcacatcccagccatggagtag

SEQ ID NO: 269768 - DNA, 25 bp, Mus musculus
atgtcacatccctgccatggagtag

SEQ ID NO: 269769 - DNA, 25 bp, Mus musculus
atgtcacatgaaacggaataccctc

SEQ ID NO: 269770 - DNA, 25 bp, Mus musculus
atgtcacatgaatcggaataccctc

SEQ ID NO: 269771 - DNA, 25 bp, Mus musculus
atgtcaccaaagataggatctatgt

SEQ ID NO: 269772 - DNA, 25 bp, Mus musculus
atgtcaccaaagttaggatctatgt

SEQ ID NO: 269773 - DNA, 25 bp, Mus musculus
atgtcaccaaatatgctgctctgta

SEQ ID NO: 269774 - DNA, 25 bp, Mus musculus
atgtcaccaaatttgctgctctgta

SEQ ID NO: 269775 - DNA, 25 bp, Mus musculus
atgtcaccaaccatggatcactcat

SEQ ID NO: 269776 - DNA, 25 bp, Mus musculus
atgtcaccaaccttggatcactcat

SEQ ID NO: 269777 - DNA, 25 bp, Mus musculus
atgtcaccagtgatgcatgagggaa

SEQ ID NO: 269778 - DNA, 25 bp, Mus musculus
atgtcaccagtgctgcctcagatga

SEQ ID NO: 269779 - DNA, 25 bp, Mus musculus
atgtcaccagtggtgcctcagatga

SEQ ID NO: 269780 - DNA, 25 bp, Mus musculus
atgtcaccagtgttgcatgagggaa

SEQ ID NO: 269781 - DNA, 25 bp, Mus musculus
atgtcaccataaccagtggttgttc

SEQ ID NO: 269782 - DNA, 25 bp, Mus musculus
atgtcaccataagcagtggttgttc

SEQ ID NO: 269783 - DNA, 25 bp, Mus musculus
atgtcaccatcaacaggttccagtg

SEQ ID NO: 269784 - DNA, 25 bp, Mus musculus
atgtcaccatcatcaggttccagtg

SEQ ID NO: 269785 - DNA, 25 bp, Mus musculus
atgtcaccatcgcaggccagaaaaa

SEQ ID NO: 269786 - DNA, 25 bp, Mus musculus
atgtcaccatcggaggccagaaaaa

SEQ ID NO: 269787 - DNA, 25 bp, Mus musculus
atgtcaccatgcaagagatgtccag

SEQ ID NO: 269788 - DNA, 25 bp, Mus musculus
atgtcaccatgctagagatgtccag

SEQ ID NO: 269789 - DNA, 25 bp, Mus musculus
atgtcacccaaaccagcagtgtcta

SEQ ID NO: 269790 - DNA, 25 bp, Mus musculus
atgtcacccaaagcagcagtgtcta

SEQ ID NO: 269791 - DNA, 25 bp, Mus musculus
atgtcacccactctcatttgtcaaa

SEQ ID NO: 269792 - DNA, 25 bp, Mus musculus
atgtcacccactgtcatttgtcaaa

SEQ ID NO: 269793 - DNA, 25 bp, Mus musculus
atgtcacccagacgaattctctccg

SEQ ID NO: 269794 - DNA, 25 bp, Mus musculus
atgtcacccagaggaattctctccg

SEQ ID NO: 269795 - DNA, 25 bp, Mus musculus
atgtcacccagtcatgccataggaa

SEQ ID NO: 269796 - DNA, 25 bp, Mus musculus
atgtcacccagtgatgccataggaa

SEQ ID NO: 269797 - DNA, 25 bp, Mus musculus
atgtcaccccaaaatctctaccgaa

SEQ ID NO: 269798 - DNA, 25 bp, Mus musculus
atgtcaccccaatatctctaccgaa

SEQ ID NO: 269799 - DNA, 25 bp, Mus musculus
atgtcacccctgattcttggcagat

SEQ ID NO: 269800 - DNA, 25 bp, Mus musculus
atgtcacccctgtttcttggcagat

SEQ ID NO: 269801 - DNA, 25 bp, Mus musculus
atgtcacccttcagtactacaaagt

SEQ ID NO: 269802 - DNA, 25 bp, Mus musculus
atgtcacccttctgtactacaaagt

SEQ ID NO: 269803 - DNA, 25 bp, Mus musculus
atgtcaccgaaaaagcatactactg

SEQ ID NO: 269804 - DNA, 25 bp, Mus musculus
atgtcaccgaaatagcatactactg

SEQ ID NO: 269805 - DNA, 25 bp, Mus musculus
atgtcaccgaatccttgcatgtgcc

SEQ ID NO: 269806 - DNA, 25 bp, Mus musculus
atgtcaccgaatgcttgcatgtgcc

SEQ ID NO: 269807 - DNA, 25 bp, Mus musculus
atgtcaccgcatcagggagcagacc

SEQ ID NO: 269808 - DNA, 25 bp, Mus musculus
atgtcaccgcatgagggagcagacc

SEQ ID NO: 269809 - DNA, 25 bp, Mus musculus
atgtcaccgccaactctgtaagatg

SEQ ID NO: 269810 - DNA, 25 bp, Mus musculus
atgtcaccgccatctctgtaagatg

SEQ ID NO: 269811 - DNA, 25 bp, Mus musculus
atgtcaccggcaagtgggtgtaccc

SEQ ID NO: 269812 - DNA, 25 bp, Mus musculus
atgtcaccggcatgtgggtgtaccc

SEQ ID NO: 269813 - DNA, 25 bp, Mus musculus
atgtcacctataaaacgggcattat

SEQ ID NO: 269814 - DNA, 25 bp, Mus musculus
atgtcacctatataacgggcattat

SEQ ID NO: 269815 - DNA, 25 bp, Mus musculus
atgtcacctcaaacctactaaatgg

SEQ ID NO: 269816 - DNA, 25 bp, Mus musculus
atgtcacctcaatcctactaaatgg

SEQ ID NO: 269817 - DNA, 25 bp, Mus musculus
atgtcacctccacaggacacacagg

SEQ ID NO: 269818 - DNA, 25 bp, Mus musculus
atgtcacctccagaggacacacagg

SEQ ID NO: 269819 - DNA, 25 bp, Mus musculus
atgtcacctctcacaaattcacaaa

SEQ ID NO: 269820 - DNA, 25 bp, Mus musculus
atgtcacctctctcaaattcacaaa

SEQ ID NO: 269821 - DNA, 25 bp, Mus musculus
atgtcacctggactcctaacgtggt

SEQ ID NO: 269822 - DNA, 25 bp, Mus musculus
atgtcacctggagtcctaacgtggt

SEQ ID NO: 269823 - DNA, 25 bp, Mus musculus
atgtcacctgtccaacatctatggt

SEQ ID NO: 269824 - DNA, 25 bp, Mus musculus
atgtcacctgtcgaacatctatggt

SEQ ID NO: 269825 - DNA, 25 bp, Mus musculus
atgtcacctgtgaccagagaaccag

SEQ ID NO: 269826 - DNA, 25 bp, Mus musculus
atgtcacctgtgtccagagaaccag

SEQ ID NO: 269827 - DNA, 25 bp, Mus musculus
atgtcaccttctcgctgcttagtaa

SEQ ID NO: 269828 - DNA, 25 bp, Mus musculus
atgtcaccttctctcaagactcagc

SEQ ID NO: 269829 - DNA, 25 bp, Mus musculus
atgtcaccttctggctgcttagtaa

SEQ ID NO: 269830 - DNA, 25 bp, Mus musculus
atgtcaccttctgtcaagactcagc

SEQ ID NO: 269831 - DNA, 25 bp, Mus musculus
atgtcacctttacccatgtttctgg

SEQ ID NO: 269832 - DNA, 25 bp, Mus musculus
atgtcacctttagccatgtttctgg

SEQ ID NO: 269833 - DNA, 25 bp, Mus musculus
atgtcacctttcctaacttgatcac

SEQ ID NO: 269834 - DNA, 25 bp, Mus musculus
atgtcacctttcgtaacttgatcac

SEQ ID NO: 269835 - DNA, 25 bp, Mus musculus
atgtcacgccttccagcttatatga

SEQ ID NO: 269836 - DNA, 25 bp, Mus musculus
atgtcacgccttgcagcttatatga

SEQ ID NO: 269837 - DNA, 25 bp, Mus musculus
atgtcactactcacttgttgtggcc

SEQ ID NO: 269838 - DNA, 25 bp, Mus musculus
atgtcactactctcttgttgtggcc

SEQ ID NO: 269839 - DNA, 25 bp, Mus musculus
atgtcactaggcactcagggtcttg

SEQ ID NO: 269840 - DNA, 25 bp, Mus musculus
atgtcactaggctctcagggtcttg

SEQ ID NO: 269841 - DNA, 25 bp, Mus musculus
atgtcactagtaactatcggctgca

SEQ ID NO: 269842 - DNA, 25 bp, Mus musculus
atgtcactagtatctatcggctgca

SEQ ID NO: 269843 - DNA, 25 bp, Mus musculus
atgtcactagtgatgttctattgag

SEQ ID NO: 269844 - DNA, 25 bp, Mus musculus
atgtcactagtgttgttctattgag

SEQ ID NO: 269845 - DNA, 25 bp, Mus musculus
atgtcactcaaacatccttcttcct

SEQ ID NO: 269846 - DNA, 25 bp, Mus musculus
atgtcactcaaagatccttcttcct

SEQ ID NO: 269847 - DNA, 25 bp, Mus musculus
atgtcactcagcactggctcagaga

SEQ ID NO: 269848 - DNA, 25 bp, Mus musculus
atgtcactcagctctggctcagaga

SEQ ID NO: 269849 - DNA, 25 bp, Mus musculus
atgtcactcagtcactttcatgtga

SEQ ID NO: 269850 - DNA, 25 bp, Mus musculus
atgtcactcagtctcttgcacgatg

SEQ ID NO: 269851 - DNA, 25 bp, Mus musculus
atgtcactcagtgactttcatgtga

SEQ ID NO: 269852 - DNA, 25 bp, Mus musculus
atgtcactcagtgtcttgcacgatg

SEQ ID NO: 269853 - DNA, 25 bp, Mus musculus
atgtcactcatcagagtcctggatg

SEQ ID NO: 269854 - DNA, 25 bp, Mus musculus
atgtcactcatcatccagcacagtg

SEQ ID NO: 269855 - DNA, 25 bp, Mus musculus
atgtcactcatctgagtcctggatg

SEQ ID NO: 269856 - DNA, 25 bp, Mus musculus
atgtcactcatcttccagcacagtg

SEQ ID NO: 269857 - DNA, 25 bp, Mus musculus
atgtcactccagaggaaacctttcc

SEQ ID NO: 269858 - DNA, 25 bp, Mus musculus
atgtcactccagtggaaacctttcc

SEQ ID NO: 269859 - DNA, 25 bp, Mus musculus
atgtcactcctaagagccagcttgg

SEQ ID NO: 269860 - DNA, 25 bp, Mus musculus
atgtcactcctatgagccagcttgg

SEQ ID NO: 269861 - DNA, 25 bp, Mus musculus
atgtcactcctcaccggagcaaagt

SEQ ID NO: 269862 - DNA, 25 bp, Mus musculus
atgtcactcctctccggagcaaagt

SEQ ID NO: 269863 - DNA, 25 bp, Mus musculus
atgtcactctctaactgagctcagt

SEQ ID NO: 269864 - DNA, 25 bp, Mus musculus
atgtcactctcttactgagctcagt

SEQ ID NO: 269865 - DNA, 25 bp, Mus musculus
atgtcactgagtagtctgagccccg

SEQ ID NO: 269866 - DNA, 25 bp, Mus musculus
atgtcactgagtcccttcaacatag

SEQ ID NO: 269867 - DNA, 25 bp, Mus musculus
atgtcactgagtgccttcaacatag

SEQ ID NO: 269868 - DNA, 25 bp, Mus musculus
atgtcactgagttgtctgagccccg

SEQ ID NO: 269869 - DNA, 25 bp, Mus musculus
atgtcactgattctcacagatccca

SEQ ID NO: 269870 - DNA, 25 bp, Mus musculus
atgtcactgattgtcacagatccca

SEQ ID NO: 269871 - DNA, 25 bp, Mus musculus
atgtcactgcaacttaagaatactt

SEQ ID NO: 269872 - DNA, 25 bp, Mus musculus
atgtcactgcaagttaagaatactt

SEQ ID NO: 269873 - DNA, 25 bp, Mus musculus
atgtcactgcccagacagttgcttg

SEQ ID NO: 269874 - DNA, 25 bp, Mus musculus
atgtcactgccctgacagttgcttg

SEQ ID NO: 269875 - DNA, 25 bp, Mus musculus
atgtcactggacattgccatagctc

SEQ ID NO: 269876 - DNA, 25 bp, Mus musculus
atgtcactggactttgccatagctc

SEQ ID NO: 269877 - DNA, 25 bp, Mus musculus
atgtcactggatatgataacttcac

SEQ ID NO: 269878 - DNA, 25 bp, Mus musculus
atgtcactggatttgataacttcac

SEQ ID NO: 269879 - DNA, 25 bp, Mus musculus
atgtcactggcaacccaagcaagga

SEQ ID NO: 269880 - DNA, 25 bp, Mus musculus
atgtcactggcatcccaagcaagga

SEQ ID NO: 269881 - DNA, 25 bp, Mus musculus
atgtcactgggacacagcagctgtc

SEQ ID NO: 269882 - DNA, 25 bp, Mus musculus
atgtcactgggaccggtggaggctg

SEQ ID NO: 269883 - DNA, 25 bp, Mus musculus
atgtcactgggagacagcagctgtc

SEQ ID NO: 269884 - DNA, 25 bp, Mus musculus
atgtcactgggagcggtggaggctg

SEQ ID NO: 269885 - DNA, 25 bp, Mus musculus
atgtcactggttaagatggcatcaa

SEQ ID NO: 269886 - DNA, 25 bp, Mus musculus
atgtcactggtttagatggcatcaa

SEQ ID NO: 269887 - DNA, 25 bp, Mus musculus
atgtcactgtctccatgagctttgg

SEQ ID NO: 269888 - DNA, 25 bp, Mus musculus
atgtcactgtctgcatgagctttgg

SEQ ID NO: 269889 - DNA, 25 bp, Mus musculus
atgtcactgtggacagtttagctga

SEQ ID NO: 269890 - DNA, 25 bp, Mus musculus
atgtcactgtggtcagtttagctga

SEQ ID NO: 269891 - DNA, 25 bp, Mus musculus
atgtcactgttaactgtttcctctt

SEQ ID NO: 269892 - DNA, 25 bp, Mus musculus
atgtcactgttatctgtttcctctt

SEQ ID NO: 269893 - DNA, 25 bp, Mus musculus
atgtcactgtttcgccctttgggaa

SEQ ID NO: 269894 - DNA, 25 bp, Mus musculus
atgtcactgtttggccctttgggaa

SEQ ID NO: 269895 - DNA, 25 bp, Mus musculus
atgtcacttcctaaatgagccagag

SEQ ID NO: 269896 - DNA, 25 bp, Mus musculus
atgtcacttccttaatgagccagag

SEQ ID NO: 269897 - DNA, 25 bp, Mus musculus
atgtcactttatcgaccgtgtgcaa

SEQ ID NO: 269898 - DNA, 25 bp, Mus musculus
atgtcactttatggaccgtgtgcaa

SEQ ID NO: 269899 - DNA, 25 bp, Mus musculus
atgtcagaatggatgcaggtttttc

SEQ ID NO: 269900 - DNA, 25 bp, Mus musculus
atgtcagaatggttgcaggtttttc

SEQ ID NO: 269901 - DNA, 25 bp, Mus musculus
atgtcagacaccaattggccgctgt

SEQ ID NO: 269902 - DNA, 25 bp, Mus musculus
atgtcagacacctattggccgctgt

SEQ ID NO: 269903 - DNA, 25 bp, Mus musculus
atgtcagacattacctgccaaccat

SEQ ID NO: 269904 - DNA, 25 bp, Mus musculus
atgtcagacatttcctgccaaccat

SEQ ID NO: 269905 - DNA, 25 bp, Mus musculus
atgtcagaccatacacaactccctg

SEQ ID NO: 269906 - DNA, 25 bp, Mus musculus
atgtcagaccattcacaactccctg

SEQ ID NO: 269907 - DNA, 25 bp, Mus musculus
atgtcagaccctcagttaggcatgt

SEQ ID NO: 269908 - DNA, 25 bp, Mus musculus
atgtcagaccctgagttaggcatgt

SEQ ID NO: 269909 - DNA, 25 bp, Mus musculus
atgtcagagagcatgccttcttcag

SEQ ID NO: 269910 - DNA, 25 bp, Mus musculus
atgtcagagagcttgccttcttcag

SEQ ID NO: 269911 - DNA, 25 bp, Mus musculus
atgtcagagcagaagagtgtccttt

SEQ ID NO: 269912 - DNA, 25 bp, Mus musculus
atgtcagagcagtagagtgtccttt

SEQ ID NO: 269913 - DNA, 25 bp, Mus musculus
atgtcagaggatcttcaagcgcaga

SEQ ID NO: 269914 - DNA, 25 bp, Mus musculus
atgtcagaggatgttcaagcgcaga

SEQ ID NO: 269915 - DNA, 25 bp, Mus musculus
atgtcagaggccctgttggatcccc

SEQ ID NO: 269916 - DNA, 25 bp, Mus musculus
atgtcagaggccgtgttggatcccc

SEQ ID NO: 269917 - DNA, 25 bp, Mus musculus
atgtcagatacccaactctgccaac

SEQ ID NO: 269918 - DNA, 25 bp, Mus musculus
atgtcagataccgaactctgccaac

SEQ ID NO: 269919 - DNA, 25 bp, Mus musculus
atgtcagatcacagttttgcccaca

SEQ ID NO: 269920 - DNA, 25 bp, Mus musculus
atgtcagatcactgttttgcccaca

SEQ ID NO: 269921 - DNA, 25 bp, Mus musculus
atgtcagatcccagggaggatatga

SEQ ID NO: 269922 - DNA, 25 bp, Mus musculus
atgtcagatccctgggaggatatga

SEQ ID NO: 269923 - DNA, 25 bp, Mus musculus
atgtcagatctgacagccagcgata

SEQ ID NO: 269924 - DNA, 25 bp, Mus musculus
atgtcagatctgacggttggaggcc

SEQ ID NO: 269925 - DNA, 25 bp, Mus musculus
atgtcagatctgtcagccagcgata

SEQ ID NO: 269926 - DNA, 25 bp, Mus musculus
atgtcagatctgtcggttggaggcc

SEQ ID NO: 269927 - DNA, 25 bp, Mus musculus
atgtcagatgaacggcctttagccc

SEQ ID NO: 269928 - DNA, 25 bp, Mus musculus
atgtcagatgaagggcctttagccc

SEQ ID NO: 269929 - DNA, 25 bp, Mus musculus
atgtcagatgtcaaagccatgcttg

SEQ ID NO: 269930 - DNA, 25 bp, Mus musculus
atgtcagatgtctaagccatgcttg

SEQ ID NO: 269931 - DNA, 25 bp, Mus musculus
atgtcagatttaccatgcctctcaa

SEQ ID NO: 269932 - DNA, 25 bp, Mus musculus
atgtcagatttagcatgcctctcaa

SEQ ID NO: 269933 - DNA, 25 bp, Mus musculus
atgtcagcaagcatgtgtatgagtt

SEQ ID NO: 269934 - DNA, 25 bp, Mus musculus
atgtcagcaagcttgtgtatgagtt

SEQ ID NO: 269935 - DNA, 25 bp, Mus musculus
atgtcagcactgatcctaacggctt

SEQ ID NO: 269936 - DNA, 25 bp, Mus musculus
atgtcagcactgttcctaacggctt

SEQ ID NO: 269937 - DNA, 25 bp, Mus musculus
atgtcagcagagcattcagccagcg

SEQ ID NO: 269938 - DNA, 25 bp, Mus musculus
atgtcagcagaggattcagccagcg

SEQ ID NO: 269939 - DNA, 25 bp, Mus musculus
atgtcagcagctatgcccaaggtgt

SEQ ID NO: 269940 - DNA, 25 bp, Mus musculus
atgtcagcagctttgcccaaggtgt

SEQ ID NO: 269941 - DNA, 25 bp, Mus musculus
atgtcagcatccaagtcccacagta

SEQ ID NO: 269942 - DNA, 25 bp, Mus musculus
atgtcagcatcctagtcccacagta

SEQ ID NO: 269943 - DNA, 25 bp, Mus musculus
atgtcagcatctattgggtaatcct

SEQ ID NO: 269944 - DNA, 25 bp, Mus musculus
atgtcagcatctcgagctcactttt

SEQ ID NO: 269945 - DNA, 25 bp, Mus musculus
atgtcagcatctggagctcactttt

SEQ ID NO: 269946 - DNA, 25 bp, Mus musculus
atgtcagcatcttttgggtaatcct

SEQ ID NO: 269947 - DNA, 25 bp, Mus musculus
atgtcagcatgtatggcattgcagc

SEQ ID NO: 269948 - DNA, 25 bp, Mus musculus
atgtcagcatgtttggcattgcagc

SEQ ID NO: 269949 - DNA, 25 bp, Mus musculus
atgtcagccctgacagacactgaga

SEQ ID NO: 269950 - DNA, 25 bp, Mus musculus
atgtcagccctgtcagacactgaga

SEQ ID NO: 269951 - DNA, 25 bp, Mus musculus
atgtcagccgccctgatgagaagaa

SEQ ID NO: 269952 - DNA, 25 bp, Mus musculus
atgtcagccgccgtgatgagaagaa

SEQ ID NO: 269953 - DNA, 25 bp, Mus musculus
atgtcagccgctacctgctggcttt

SEQ ID NO: 269954 - DNA, 25 bp, Mus musculus
atgtcagccgcttcctgctggcttt

SEQ ID NO: 269955 - DNA, 25 bp, Mus musculus
atgtcagccttcaggatgatgaccc

SEQ ID NO: 269956 - DNA, 25 bp, Mus musculus
atgtcagccttctggatgatgaccc

SEQ ID NO: 269957 - DNA, 25 bp, Mus musculus
atgtcagcgatcagcagttacgaag

SEQ ID NO: 269958 - DNA, 25 bp, Mus musculus
atgtcagcgatctgcagttacgaag

SEQ ID NO: 269959 - DNA, 25 bp, Mus musculus
atgtcagcggagctcttcgggccca

SEQ ID NO: 269960 - DNA, 25 bp, Mus musculus
atgtcagcggaggtcttcgggccca

SEQ ID NO: 269961 - DNA, 25 bp, Mus musculus
atgtcagcggcgctgggactctttc

SEQ ID NO: 269962 - DNA, 25 bp, Mus musculus
atgtcagcggcggtgggactctttc

SEQ ID NO: 269963 - DNA, 25 bp, Mus musculus
atgtcagctctgaaaagaacctcca

SEQ ID NO: 269964 - DNA, 25 bp, Mus musculus
atgtcagctctgagtttgggtattt

SEQ ID NO: 269965 - DNA, 25 bp, Mus musculus
atgtcagctctgtaaagaacctcca

SEQ ID NO: 269966 - DNA, 25 bp, Mus musculus
atgtcagctctgtgtttgggtattt

SEQ ID NO: 269967 - DNA, 25 bp, Mus musculus
atgtcagcttataaggtgcatcatt

SEQ ID NO: 269968 - DNA, 25 bp, Mus musculus
atgtcagcttattaggtgcatcatt

SEQ ID NO: 269969 - DNA, 25 bp, Mus musculus
atgtcaggaagtcagacccagcctc

SEQ ID NO: 269970 - DNA, 25 bp, Mus musculus
atgtcaggaagtgagacccagcctc

SEQ ID NO: 269971 - DNA, 25 bp, Mus musculus
atgtcaggaccaattggcggcgccg

SEQ ID NO: 269972 - DNA, 25 bp, Mus musculus
atgtcaggaccatttggcggcgccg

SEQ ID NO: 269973 - DNA, 25 bp, Mus musculus
atgtcaggagcacacttgtttcaac

SEQ ID NO: 269974 - DNA, 25 bp, Mus musculus
atgtcaggagcagacttgtttcaac

SEQ ID NO: 269975 - DNA, 25 bp, Mus musculus
atgtcaggatccagactccagcaga

SEQ ID NO: 269976 - DNA, 25 bp, Mus musculus
atgtcaggatcccttaccggtactt

SEQ ID NO: 269977 - DNA, 25 bp, Mus musculus
atgtcaggatccgttaccggtactt

SEQ ID NO: 269978 - DNA, 25 bp, Mus musculus
atgtcaggatcctgactccagcaga

SEQ ID NO: 269979 - DNA, 25 bp, Mus musculus
atgtcaggatgtaccaagcctctgg

SEQ ID NO: 269980 - DNA, 25 bp, Mus musculus
atgtcaggatgttccaagcctctgg

SEQ ID NO: 269981 - DNA, 25 bp, Mus musculus
atgtcaggattccaagagcccacct

SEQ ID NO: 269982 - DNA, 25 bp, Mus musculus
atgtcaggattcgaagagcccacct

SEQ ID NO: 269983 - DNA, 25 bp, Mus musculus
atgtcaggcaagcaccatcgtctct

SEQ ID NO: 269984 - DNA, 25 bp, Mus musculus
atgtcaggcaaggaccatcgtctct

SEQ ID NO: 269985 - DNA, 25 bp, Mus musculus
atgtcaggccttatatttcttcacc

SEQ ID NO: 269986 - DNA, 25 bp, Mus musculus
atgtcaggccttttatttcttcacc

SEQ ID NO: 269987 - DNA, 25 bp, Mus musculus
atgtcaggctcaaaccacttctcag

SEQ ID NO: 269988 - DNA, 25 bp, Mus musculus
atgtcaggctcataccacttctcag

SEQ ID NO: 269989 - DNA, 25 bp, Mus musculus
atgtcaggcttcaatggtattttct

SEQ ID NO: 269990 - DNA, 25 bp, Mus musculus
atgtcaggcttctatggtattttct

SEQ ID NO: 269991 - DNA, 25 bp, Mus musculus
atgtcagggtacacgccggatgaga

SEQ ID NO: 269992 - DNA, 25 bp, Mus musculus
atgtcagggtactcgccggatgaga

SEQ ID NO: 269993 - DNA, 25 bp, Mus musculus
atgtcaggtactatggtcacagcca

SEQ ID NO: 269994 - DNA, 25 bp, Mus musculus
atgtcaggtactttggtcacagcca

SEQ ID NO: 269995 - DNA, 25 bp, Mus musculus
atgtcaggtcatatgtctgttgtgt

SEQ ID NO: 269996 - DNA, 25 bp, Mus musculus
atgtcaggtcatttgtctgttgtgt

SEQ ID NO: 269997 - DNA, 25 bp, Mus musculus
atgtcaggtcctacaacagagggta

SEQ ID NO: 269998 - DNA, 25 bp, Mus musculus
atgtcaggtccttcaacagagggta

SEQ ID NO: 269999 - DNA, 25 bp, Mus musculus
atgtcaggtctcatagcctgcgact

SEQ ID NO: 270000 - DNA, 25 bp, Mus musculus
atgtcaggtctcttagcctgcgact

SEQ ID NO: 270001 - DNA, 25 bp, Mus musculus
atgtcaggtgacatttgactgcaaa

SEQ ID NO: 270002 - DNA, 25 bp, Mus musculus
atgtcaggtgacttttgactgcaaa

SEQ ID NO: 270003 - DNA, 25 bp, Mus musculus
atgtcaggtggaacacaacccctgt

SEQ ID NO: 270004 - DNA, 25 bp, Mus musculus
atgtcaggtggatcacaacccctgt

SEQ ID NO: 270005 - DNA, 25 bp, Mus musculus
atgtcaggtgtcctaaccagtcctc

SEQ ID NO: 270006 - DNA, 25 bp, Mus musculus
atgtcaggtgtcgtaaccagtcctc

SEQ ID NO: 270007 - DNA, 25 bp, Mus musculus
atgtcaggttggcactctgagttgt

SEQ ID NO: 270008 - DNA, 25 bp, Mus musculus
atgtcaggttgggactctgagttgt

SEQ ID NO: 270009 - DNA, 25 bp, Mus musculus
atgtcagtaaaacaatgccattggg

SEQ ID NO: 270010 - DNA, 25 bp, Mus musculus
atgtcagtaaaagaatgccattggg

SEQ ID NO: 270011 - DNA, 25 bp, Mus musculus
atgtcagtatttagcattgctgtgt

SEQ ID NO: 270012 - DNA, 25 bp, Mus musculus
atgtcagtattttgcattgctgtgt

SEQ ID NO: 270013 - DNA, 25 bp, Mus musculus
atgtcagtcaagaagttacctcctt

SEQ ID NO: 270014 - DNA, 25 bp, Mus musculus
atgtcagtcaagaccagatcccttt

SEQ ID NO: 270015 - DNA, 25 bp, Mus musculus
atgtcagtcaagtagttacctcctt

SEQ ID NO: 270016 - DNA, 25 bp, Mus musculus
atgtcagtcaagtccagatcccttt

SEQ ID NO: 270017 - DNA, 25 bp, Mus musculus
atgtcagtcactatagatttcttag

SEQ ID NO: 270018 - DNA, 25 bp, Mus musculus
atgtcagtcactctccatttgttgg

SEQ ID NO: 270019 - DNA, 25 bp, Mus musculus
atgtcagtcactgtccatttgttgg

SEQ ID NO: 270020 - DNA, 25 bp, Mus musculus
atgtcagtcactttagatttcttag

SEQ ID NO: 270021 - DNA, 25 bp, Mus musculus
atgtcagtccccacgcggaaggata

SEQ ID NO: 270022 - DNA, 25 bp, Mus musculus
atgtcagtcccctcgcggaaggata

SEQ ID NO: 270023 - DNA, 25 bp, Mus musculus
atgtcagtcctgatgtgaactatga

SEQ ID NO: 270024 - DNA, 25 bp, Mus musculus
atgtcagtcctgttgtgaactatga

SEQ ID NO: 270025 - DNA, 25 bp, Mus musculus
atgtcagtcttaatcctaattggta

SEQ ID NO: 270026 - DNA, 25 bp, Mus musculus
atgtcagtcttattcctaattggta

SEQ ID NO: 270027 - DNA, 25 bp, Mus musculus
atgtcagtgaccatgctggtaattg

SEQ ID NO: 270028 - DNA, 25 bp, Mus musculus
atgtcagtgaccttgctggtaattg

SEQ ID NO: 270029 - DNA, 25 bp, Mus musculus
atgtcagtgactaatgctcaccaaa

SEQ ID NO: 270030 - DNA, 25 bp, Mus musculus
atgtcagtgacttatgctcaccaaa

SEQ ID NO: 270031 - DNA, 25 bp, Mus musculus
atgtcagtgctgactagctagtgta

SEQ ID NO: 270032 - DNA, 25 bp, Mus musculus
atgtcagtgctgtctagctagtgta

SEQ ID NO: 270033 - DNA, 25 bp, Mus musculus
atgtcagtgcttccatactcattgt

SEQ ID NO: 270034 - DNA, 25 bp, Mus musculus
atgtcagtgcttgcatactcattgt

SEQ ID NO: 270035 - DNA, 25 bp, Mus musculus
atgtcagtggctcagtggttttgta

SEQ ID NO: 270036 - DNA, 25 bp, Mus musculus
atgtcagtggctgagtggttttgta

SEQ ID NO: 270037 - DNA, 25 bp, Mus musculus
atgtcagtgtgaatgcctcggctac

SEQ ID NO: 270038 - DNA, 25 bp, Mus musculus
atgtcagtgtgattgcctcggctac

SEQ ID NO: 270039 - DNA, 25 bp, Mus musculus
atgtcagttccaccattgttaaata

SEQ ID NO: 270040 - DNA, 25 bp, Mus musculus
atgtcagttccagcattgttaaata

SEQ ID NO: 270041 - DNA, 25 bp, Mus musculus
atgtcagttgtcaagtcactctcta

SEQ ID NO: 270042 - DNA, 25 bp, Mus musculus
atgtcagttgtctagtcactctcta

SEQ ID NO: 270043 - DNA, 25 bp, Mus musculus
atgtcagttgttatacgcaggtccc

SEQ ID NO: 270044 - DNA, 25 bp, Mus musculus
atgtcagttgttatctgtaaccttt

SEQ ID NO: 270045 - DNA, 25 bp, Mus musculus
atgtcagttgttttacgcaggtccc

SEQ ID NO: 270046 - DNA, 25 bp, Mus musculus
atgtcagttgttttctgtaaccttt

SEQ ID NO: 270047 - DNA, 25 bp, Mus musculus
atgtcagtttaactagtagagtcaa

SEQ ID NO: 270048 - DNA, 25 bp, Mus musculus
atgtcagtttaagtagtagagtcaa

SEQ ID NO: 270049 - DNA, 25 bp, Mus musculus
atgtcataatctctctgaagaaacc

SEQ ID NO: 270050 - DNA, 25 bp, Mus musculus
atgtcataatctgtctgaagaaacc

SEQ ID NO: 270051 - DNA, 25 bp, Mus musculus
atgtcatacacgaagatgtcagagg

SEQ ID NO: 270052 - DNA, 25 bp, Mus musculus
atgtcatacacgtagatgtcagagg

SEQ ID NO: 270053 - DNA, 25 bp, Mus musculus
atgtcatacgctcctggccaggcag

SEQ ID NO: 270054 - DNA, 25 bp, Mus musculus
atgtcatacgctgctggccaggcag

SEQ ID NO: 270055 - DNA, 25 bp, Mus musculus
atgtcatactgcagacttaaaatat

SEQ ID NO: 270056 - DNA, 25 bp, Mus musculus
atgtcatactgctgacttaaaatat

SEQ ID NO: 270057 - DNA, 25 bp, Mus musculus
atgtcatagaacaggagacgcctgt

SEQ ID NO: 270058 - DNA, 25 bp, Mus musculus
atgtcatagaactggagacgcctgt

SEQ ID NO: 270059 - DNA, 25 bp, Mus musculus
atgtcatagagcagcatgctcctct

SEQ ID NO: 270060 - DNA, 25 bp, Mus musculus
atgtcatagagctgcatgctcctct

SEQ ID NO: 270061 - DNA, 25 bp, Mus musculus
atgtcatagttcagcctccaaggga

SEQ ID NO: 270062 - DNA, 25 bp, Mus musculus
atgtcatagttctgcctccaaggga

SEQ ID NO: 270063 - DNA, 25 bp, Mus musculus
atgtcatagtttcctatagcccaga

SEQ ID NO: 270064 - DNA, 25 bp, Mus musculus
atgtcatagtttgctatagcccaga

SEQ ID NO: 270065 - DNA, 25 bp, Mus musculus
atgtcatatagccatctggcagcca

SEQ ID NO: 270066 - DNA, 25 bp, Mus musculus
atgtcatatagcgatctggcagcca

SEQ ID NO: 270067 - DNA, 25 bp, Mus musculus
atgtcatattgtcccaccatggggc

SEQ ID NO: 270068 - DNA, 25 bp, Mus musculus
atgtcatattgtgccaccatggggc

SEQ ID NO: 270069 - DNA, 25 bp, Mus musculus
atgtcatcaatcacacgatgcttcc

SEQ ID NO: 270070 - DNA, 25 bp, Mus musculus
atgtcatcaatctcacgatgcttcc

SEQ ID NO: 270071 - DNA, 25 bp, Mus musculus
atgtcatcacacaccttaacactgt

SEQ ID NO: 270072 - DNA, 25 bp, Mus musculus
atgtcatcacactccttaacactgt

SEQ ID NO: 270073 - DNA, 25 bp, Mus musculus
atgtcatcagcaaggcagtggctaa

SEQ ID NO: 270074 - DNA, 25 bp, Mus musculus
atgtcatcagcatggcagtggctaa

SEQ ID NO: 270075 - DNA, 25 bp, Mus musculus
atgtcatcagcgctgggaaccgtga

SEQ ID NO: 270076 - DNA, 25 bp, Mus musculus
atgtcatcagcggtgggaaccgtga

SEQ ID NO: 270077 - DNA, 25 bp, Mus musculus
atgtcatcaggcctcagattctctc

SEQ ID NO: 270078 - DNA, 25 bp, Mus musculus
atgtcatcaggcgtcagattctctc

SEQ ID NO: 270079 - DNA, 25 bp, Mus musculus
atgtcatcaggtattttgtgcttac

SEQ ID NO: 270080 - DNA, 25 bp, Mus musculus
atgtcatcaggttttttgtgcttac

SEQ ID NO: 270081 - DNA, 25 bp, Mus musculus
atgtcatcatagcactgatcattct

SEQ ID NO: 270082 - DNA, 25 bp, Mus musculus
atgtcatcataggactgatcattct

SEQ ID NO: 270083 - DNA, 25 bp, Mus musculus
atgtcatcatccatgctgcagtgaa

SEQ ID NO: 270084 - DNA, 25 bp, Mus musculus
atgtcatcatccttgctgcagtgaa

SEQ ID NO: 270085 - DNA, 25 bp, Mus musculus
atgtcatcatgacttccctgatcac

SEQ ID NO: 270086 - DNA, 25 bp, Mus musculus
atgtcatcatgagttccctgatcac

SEQ ID NO: 270087 - DNA, 25 bp, Mus musculus
atgtcatcattcacaacacgcttgt

SEQ ID NO: 270088 - DNA, 25 bp, Mus musculus
atgtcatcattctcaacacgcttgt

SEQ ID NO: 270089 - DNA, 25 bp, Mus musculus
atgtcatcattgacgactccggcaa

SEQ ID NO: 270090 - DNA, 25 bp, Mus musculus
atgtcatcattgtcgactccggcaa

SEQ ID NO: 270091 - DNA, 25 bp, Mus musculus
atgtcatccaagagattcccgaggc

SEQ ID NO: 270092 - DNA, 25 bp, Mus musculus
atgtcatccaagtgattcccgaggc

SEQ ID NO: 270093 - DNA, 25 bp, Mus musculus
atgtcatccagaaggcctgtcagta

SEQ ID NO: 270094 - DNA, 25 bp, Mus musculus
atgtcatccagatggcctgtcagta

SEQ ID NO: 270095 - DNA, 25 bp, Mus musculus
atgtcatcccacagagcatcggcag

SEQ ID NO: 270096 - DNA, 25 bp, Mus musculus
atgtcatcccactgagcatcggcag

SEQ ID NO: 270097 - DNA, 25 bp, Mus musculus
atgtcatccggcagatcgaggccca

SEQ ID NO: 270098 - DNA, 25 bp, Mus musculus
atgtcatccggctgatcgaggccca

SEQ ID NO: 270099 - DNA, 25 bp, Mus musculus
atgtcatccgttagtacagtttccc

SEQ ID NO: 270100 - DNA, 25 bp, Mus musculus
atgtcatccgtttgtacagtttccc

SEQ ID NO: 270101 - DNA, 25 bp, Mus musculus
atgtcatcctacacggtgctgagcg

SEQ ID NO: 270102 - DNA, 25 bp, Mus musculus
atgtcatcctactcggtgctgagcg

SEQ ID NO: 270103 - DNA, 25 bp, Mus musculus
atgtcatcctgtccagtgaatgcag

SEQ ID NO: 270104 - DNA, 25 bp, Mus musculus
atgtcatcctgtgcagtgaatgcag

SEQ ID NO: 270105 - DNA, 25 bp, Mus musculus
atgtcatcgactactctgagcacag

SEQ ID NO: 270106 - DNA, 25 bp, Mus musculus
atgtcatcgacttctctgagcacag

SEQ ID NO: 270107 - DNA, 25 bp, Mus musculus
atgtcatcgctcagggtgttggcaa

SEQ ID NO: 270108 - DNA, 25 bp, Mus musculus
atgtcatcgctctgggtgttggcaa

SEQ ID NO: 270109 - DNA, 25 bp, Mus musculus
atgtcatctattccttatcagccta

SEQ ID NO: 270110 - DNA, 25 bp, Mus musculus
atgtcatctattgcttatcagccta

SEQ ID NO: 270111 - DNA, 25 bp, Mus musculus
atgtcatctcctatgtgggttccag

SEQ ID NO: 270112 - DNA, 25 bp, Mus musculus
atgtcatctcctttgtgggttccag

SEQ ID NO: 270113 - DNA, 25 bp, Mus musculus
atgtcatctgacaccatgtatcctg

SEQ ID NO: 270114 - DNA, 25 bp, Mus musculus
atgtcatctgactccatgtatcctg

SEQ ID NO: 270115 - DNA, 25 bp, Mus musculus
atgtcatctgcacgtgccacatgtg

SEQ ID NO: 270116 - DNA, 25 bp, Mus musculus
atgtcatctgcaggtgccacatgtg

SEQ ID NO: 270117 - DNA, 25 bp, Mus musculus
atgtcatctgctccagtcaggtctt

SEQ ID NO: 270118 - DNA, 25 bp, Mus musculus
atgtcatctgctgcagtcaggtctt

SEQ ID NO: 270119 - DNA, 25 bp, Mus musculus
atgtcatgaaccctcgtagtagcta

SEQ ID NO: 270120 - DNA, 25 bp, Mus musculus
atgtcatgaaccgtcgtagtagcta

SEQ ID NO: 270121 - DNA, 25 bp, Mus musculus
atgtcatgaagtcagcatagtcccc

SEQ ID NO: 270122 - DNA, 25 bp, Mus musculus
atgtcatgaagtgagcatagtcccc

SEQ ID NO: 270123 - DNA, 25 bp, Mus musculus
atgtcatgagccacagtggcttcac

SEQ ID NO: 270124 - DNA, 25 bp, Mus musculus
atgtcatgagcctcagtggcttcac

SEQ ID NO: 270125 - DNA, 25 bp, Mus musculus
atgtcatgatgcatcctaccactag

SEQ ID NO: 270126 - DNA, 25 bp, Mus musculus
atgtcatgatgcttcctaccactag

SEQ ID NO: 270127 - DNA, 25 bp, Mus musculus
atgtcatgcgtcaaatggacttctc

SEQ ID NO: 270128 - DNA, 25 bp, Mus musculus
atgtcatgcgtctaatggacttctc

SEQ ID NO: 270129 - DNA, 25 bp, Mus musculus
atgtcatgctcaattgttcttcagc

SEQ ID NO: 270130 - DNA, 25 bp, Mus musculus
atgtcatgctcatttgttcttcagc

SEQ ID NO: 270131 - DNA, 25 bp, Mus musculus
atgtcatgctgtccactgctttcta

SEQ ID NO: 270132 - DNA, 25 bp, Mus musculus
atgtcatgctgtgcactgctttcta

SEQ ID NO: 270133 - DNA, 25 bp, Mus musculus
atgtcatggacactaccactcgcat

SEQ ID NO: 270134 - DNA, 25 bp, Mus musculus
atgtcatggacagtaccactcgcat

SEQ ID NO: 270135 - DNA, 25 bp, Mus musculus
atgtcatggctcacgtggctggctt

SEQ ID NO: 270136 - DNA, 25 bp, Mus musculus
atgtcatggctctcgtggctggctt

SEQ ID NO: 270137 - DNA, 25 bp, Mus musculus
atgtcatggcttccggaaccgtcaa

SEQ ID NO: 270138 - DNA, 25 bp, Mus musculus
atgtcatggcttgcggaaccgtcaa

SEQ ID NO: 270139 - DNA, 25 bp, Mus musculus
atgtcatgtatcctgtggagtcatc

SEQ ID NO: 270140 - DNA, 25 bp, Mus musculus
atgtcatgtatcgtgtggagtcatc

SEQ ID NO: 270141 - DNA, 25 bp, Mus musculus
atgtcatgtcacactttagtatgga

SEQ ID NO: 270142 - DNA, 25 bp, Mus musculus
atgtcatgtcacattgcactttaga

SEQ ID NO: 270143 - DNA, 25 bp, Mus musculus
atgtcatgtcactctttagtatgga

SEQ ID NO: 270144 - DNA, 25 bp, Mus musculus
atgtcatgtcactttgcactttaga

SEQ ID NO: 270145 - DNA, 25 bp, Mus musculus
atgtcatgtgtcactctgtaatgga

SEQ ID NO: 270146 - DNA, 25 bp, Mus musculus
atgtcatgtgtctctctgtaatgga

SEQ ID NO: 270147 - DNA, 25 bp, Mus musculus
atgtcatgtgtgagtagtcccgaag

SEQ ID NO: 270148 - DNA, 25 bp, Mus musculus
atgtcatgtgtgtgtagtcccgaag

SEQ ID NO: 270149 - DNA, 25 bp, Mus musculus
atgtcattagcacggttcttttaat

SEQ ID NO: 270150 - DNA, 25 bp, Mus musculus
atgtcattagcagggttcttttaat

SEQ ID NO: 270151 - DNA, 25 bp, Mus musculus
atgtcattatgtattagcccagttc

SEQ ID NO: 270152 - DNA, 25 bp, Mus musculus
atgtcattatgttttagcccagttc

SEQ ID NO: 270153 - DNA, 25 bp, Mus musculus
atgtcattcagtagcagtatctcac

SEQ ID NO: 270154 - DNA, 25 bp, Mus musculus
atgtcattcagttgcagtatctcac

SEQ ID NO: 270155 - DNA, 25 bp, Mus musculus
atgtcattcctaaccccagttagat

SEQ ID NO: 270156 - DNA, 25 bp, Mus musculus
atgtcattcctatccccagttagat

SEQ ID NO: 270157 - DNA, 25 bp, Mus musculus
atgtcattccttaggcatcttatct

SEQ ID NO: 270158 - DNA, 25 bp, Mus musculus
atgtcattcctttggcatcttatct

SEQ ID NO: 270159 - DNA, 25 bp, Mus musculus
atgtcattcttactaagtcctgtta

SEQ ID NO: 270160 - DNA, 25 bp, Mus musculus
atgtcattcttagtaagtcctgtta

SEQ ID NO: 270161 - DNA, 25 bp, Mus musculus
atgtcattgcctcttacctggatgc

SEQ ID NO: 270162 - DNA, 25 bp, Mus musculus
atgtcattgcctgttacctggatgc

SEQ ID NO: 270163 - DNA, 25 bp, Mus musculus
atgtcattggcaatggcaccagtgt

SEQ ID NO: 270164 - DNA, 25 bp, Mus musculus
atgtcattggcattggcaccagtgt

SEQ ID NO: 270165 - DNA, 25 bp, Mus musculus
atgtcattgggactttgagtggctt

SEQ ID NO: 270166 - DNA, 25 bp, Mus musculus
atgtcattgggagtttgagtggctt

SEQ ID NO: 270167 - DNA, 25 bp, Mus musculus
atgtcattgtcaccacgagtcgaat

SEQ ID NO: 270168 - DNA, 25 bp, Mus musculus
atgtcattgtcagcacgagtcgaat

SEQ ID NO: 270169 - DNA, 25 bp, Mus musculus
atgtcattgttcacagttgggtttg

SEQ ID NO: 270170 - DNA, 25 bp, Mus musculus
atgtcattgttctcagttgggtttg

SEQ ID NO: 270171 - DNA, 25 bp, Mus musculus
atgtcattgtttatggtctagagaa

SEQ ID NO: 270172 - DNA, 25 bp, Mus musculus
atgtcattgtttttggtctagagaa

SEQ ID NO: 270173 - DNA, 25 bp, Mus musculus
atgtcatttatcatatttctctatt

SEQ ID NO: 270174 - DNA, 25 bp, Mus musculus
atgtcatttatcttatttctctatt

SEQ ID NO: 270175 - DNA, 25 bp, Mus musculus
atgtcatttatgagttcatgcaggt

SEQ ID NO: 270176 - DNA, 25 bp, Mus musculus
atgtcatttatgtgttcatgcaggt

SEQ ID NO: 270177 - DNA, 25 bp, Mus musculus
atgtcatttcgtccaccccagtcga

SEQ ID NO: 270178 - DNA, 25 bp, Mus musculus
atgtcatttcgtgcaccccagtcga

SEQ ID NO: 270179 - DNA, 25 bp, Mus musculus
atgtcatttgccatcgaaaggagaa

SEQ ID NO: 270180 - DNA, 25 bp, Mus musculus
atgtcatttgccttcgaaaggagaa

SEQ ID NO: 270181 - DNA, 25 bp, Mus musculus
atgtccaaacccagctcaaatgtat

SEQ ID NO: 270182 - DNA, 25 bp, Mus musculus
atgtccaaacccatgctcatttaag

SEQ ID NO: 270183 - DNA, 25 bp, Mus musculus
atgtccaaaccctgctcaaatgtat

SEQ ID NO: 270184 - DNA, 25 bp, Mus musculus
atgtccaaacccttgctcatttaag

SEQ ID NO: 270185 - DNA, 25 bp, Mus musculus
atgtccaaacctagctgcaagcaca

SEQ ID NO: 270186 - DNA, 25 bp, Mus musculus
atgtccaaaccttgctgcaagcaca

SEQ ID NO: 270187 - DNA, 25 bp, Mus musculus
atgtccaaagatcgattcacccaac

SEQ ID NO: 270188 - DNA, 25 bp, Mus musculus
atgtccaaagatggattcacccaac

SEQ ID NO: 270189 - DNA, 25 bp, Mus musculus
atgtccaaggccattcgaagtgtgg

SEQ ID NO: 270190 - DNA, 25 bp, Mus musculus
atgtccaaggcctttcgaagtgtgg

SEQ ID NO: 270191 - DNA, 25 bp, Mus musculus
atgtccaagggcattcaggtttgta

SEQ ID NO: 270192 - DNA, 25 bp, Mus musculus
atgtccaagggctttcaggtttgta

SEQ ID NO: 270193 - DNA, 25 bp, Mus musculus
atgtccaatcccagaccaatggtgg

SEQ ID NO: 270194 - DNA, 25 bp, Mus musculus
atgtccaatccctgaccaatggtgg

SEQ ID NO: 270195 - DNA, 25 bp, Mus musculus
atgtccaatggaactgctggcagta

SEQ ID NO: 270196 - DNA, 25 bp, Mus musculus
atgtccaatggatctgctggcagta

SEQ ID NO: 270197 - DNA, 25 bp, Mus musculus
atgtccaattgtacctgtgagccac

SEQ ID NO: 270198 - DNA, 25 bp, Mus musculus
atgtccaattgttcctgtgagccac

SEQ ID NO: 270199 - DNA, 25 bp, Mus musculus
atgtccacaaagctgggagcctcat

SEQ ID NO: 270200 - DNA, 25 bp, Mus musculus
atgtccacaaaggtgggagcctcat

SEQ ID NO: 270201 - DNA, 25 bp, Mus musculus
atgtccacaagcattaggcctgggc

SEQ ID NO: 270202 - DNA, 25 bp, Mus musculus
atgtccacaagctttaggcctgggc

SEQ ID NO: 270203 - DNA, 25 bp, Mus musculus
atgtccacaatgaatcatcacctcc

SEQ ID NO: 270204 - DNA, 25 bp, Mus musculus
atgtccacaatgaggcaaatggcat

SEQ ID NO: 270205 - DNA, 25 bp, Mus musculus
atgtccacaatgtatcatcacctcc

SEQ ID NO: 270206 - DNA, 25 bp, Mus musculus
atgtccacaatgtggcaaatggcat

SEQ ID NO: 270207 - DNA, 25 bp, Mus musculus
atgtccacacttacatgaacgtctg

SEQ ID NO: 270208 - DNA, 25 bp, Mus musculus
atgtccacactttcatgaacgtctg

SEQ ID NO: 270209 - DNA, 25 bp, Mus musculus
atgtccacagaaaccatgagctatt

SEQ ID NO: 270210 - DNA, 25 bp, Mus musculus
atgtccacagaacgtattcccacgg

SEQ ID NO: 270211 - DNA, 25 bp, Mus musculus
atgtccacagaaggtattcccacgg

SEQ ID NO: 270212 - DNA, 25 bp, Mus musculus
atgtccacagaatccatgagctatt

SEQ ID NO: 270213 - DNA, 25 bp, Mus musculus
atgtccacagatcttcagatacagg

SEQ ID NO: 270214 - DNA, 25 bp, Mus musculus
atgtccacagatgttcagatacagg

SEQ ID NO: 270215 - DNA, 25 bp, Mus musculus
atgtccacagctacatggacaccgt

SEQ ID NO: 270216 - DNA, 25 bp, Mus musculus
atgtccacagcttcatggacaccgt

SEQ ID NO: 270217 - DNA, 25 bp, Mus musculus
atgtccacagtcaaggtcgctgagt

SEQ ID NO: 270218 - DNA, 25 bp, Mus musculus
atgtccacagtctaggtcgctgagt

SEQ ID NO: 270219 - DNA, 25 bp, Mus musculus
atgtccacatttagccatggtgtcc

SEQ ID NO: 270220 - DNA, 25 bp, Mus musculus
atgtccacattttgccatggtgtcc

SEQ ID NO: 270221 - DNA, 25 bp, Mus musculus
atgtccaccatgctctggttgagtg

SEQ ID NO: 270222 - DNA, 25 bp, Mus musculus
atgtccaccatggtctggttgagtg

SEQ ID NO: 270223 - DNA, 25 bp, Mus musculus
atgtccacctacaatgtcatgtatg

SEQ ID NO: 270224 - DNA, 25 bp, Mus musculus
atgtccacctactatgtcatgtatg

SEQ ID NO: 270225 - DNA, 25 bp, Mus musculus
atgtccacctctacttgaggccgga

SEQ ID NO: 270226 - DNA, 25 bp, Mus musculus
atgtccacctcttcttgaggccgga

SEQ ID NO: 270227 - DNA, 25 bp, Mus musculus
atgtccaccttcaatctgctggacc

SEQ ID NO: 270228 - DNA, 25 bp, Mus musculus
atgtccaccttctatctgctggacc

SEQ ID NO: 270229 - DNA, 25 bp, Mus musculus
atgtccacgctgcagagtcctgtgt

SEQ ID NO: 270230 - DNA, 25 bp, Mus musculus
atgtccacgctggagagtcctgtgt

SEQ ID NO: 270231 - DNA, 25 bp, Mus musculus
atgtccactcacagggaacggcggg

SEQ ID NO: 270232 - DNA, 25 bp, Mus musculus
atgtccactcactgggaacggcggg

SEQ ID NO: 270233 - DNA, 25 bp, Mus musculus
atgtccactcctcattctggaagag

SEQ ID NO: 270234 - DNA, 25 bp, Mus musculus
atgtccactcctgattctggaagag

SEQ ID NO: 270235 - DNA, 25 bp, Mus musculus
atgtccactctacgctttgacagct

SEQ ID NO: 270236 - DNA, 25 bp, Mus musculus
atgtccactctaggctttgacagct

SEQ ID NO: 270237 - DNA, 25 bp, Mus musculus
atgtccactgacaaattctggccaa

SEQ ID NO: 270238 - DNA, 25 bp, Mus musculus
atgtccactgactaattctggccaa

SEQ ID NO: 270239 - DNA, 25 bp, Mus musculus
atgtccactgtcacagaagttcgaa

SEQ ID NO: 270240 - DNA, 25 bp, Mus musculus
atgtccactgtctcagaagttcgaa

SEQ ID NO: 270241 - DNA, 25 bp, Mus musculus
atgtccacttctaccggcaggcggc

SEQ ID NO: 270242 - DNA, 25 bp, Mus musculus
atgtccacttcttccggcaggcggc

SEQ ID NO: 270243 - DNA, 25 bp, Mus musculus
atgtccagaactaaaacccactcca

SEQ ID NO: 270244 - DNA, 25 bp, Mus musculus
atgtccagaacttaaacccactcca

SEQ ID NO: 270245 - DNA, 25 bp, Mus musculus
atgtccagacccaaactgcaaggtg

SEQ ID NO: 270246 - DNA, 25 bp, Mus musculus
atgtccagaccctaactgcaaggtg

SEQ ID NO: 270247 - DNA, 25 bp, Mus musculus
atgtccagactacaacctgatcttg

SEQ ID NO: 270248 - DNA, 25 bp, Mus musculus
atgtccagactagaacctgatcttg

SEQ ID NO: 270249 - DNA, 25 bp, Mus musculus
atgtccagagtgaggaagttctcta

SEQ ID NO: 270250 - DNA, 25 bp, Mus musculus
atgtccagagtgtggaagttctcta

SEQ ID NO: 270251 - DNA, 25 bp, Mus musculus
atgtccagatctacatctgcaaaca

SEQ ID NO: 270252 - DNA, 25 bp, Mus musculus
atgtccagatcttcatctgcaaaca

SEQ ID NO: 270253 - DNA, 25 bp, Mus musculus
atgtccagcaagacttcatgcctga

SEQ ID NO: 270254 - DNA, 25 bp, Mus musculus
atgtccagcaagtcttcatgcctga

SEQ ID NO: 270255 - DNA, 25 bp, Mus musculus
atgtccagcatcatttctgggatgg

SEQ ID NO: 270256 - DNA, 25 bp, Mus musculus
atgtccagcatcttttctgggatgg

SEQ ID NO: 270257 - DNA, 25 bp, Mus musculus
atgtccagcattaaccagggcagct

SEQ ID NO: 270258 - DNA, 25 bp, Mus musculus
atgtccagcatttaccagggcagct

SEQ ID NO: 270259 - DNA, 25 bp, Mus musculus
atgtccagccttcccacaacaatga

SEQ ID NO: 270260 - DNA, 25 bp, Mus musculus
atgtccagccttgccacaacaatga

SEQ ID NO: 270261 - DNA, 25 bp, Mus musculus
atgtccaggagacgcgttcattaaa

SEQ ID NO: 270262 - DNA, 25 bp, Mus musculus
atgtccaggagaggcgttcattaaa

SEQ ID NO: 270263 - DNA, 25 bp, Mus musculus
atgtccagggacctctacagtactg

SEQ ID NO: 270264 - DNA, 25 bp, Mus musculus
atgtccagggacgtctacagtactg

SEQ ID NO: 270265 - DNA, 25 bp, Mus musculus
atgtccaggttcacacgcggttttt

SEQ ID NO: 270266 - DNA, 25 bp, Mus musculus
atgtccaggttctcacgcggttttt

SEQ ID NO: 270267 - DNA, 25 bp, Mus musculus
atgtccagtagaacctctttttcag

SEQ ID NO: 270268 - DNA, 25 bp, Mus musculus
atgtccagtagatcctctttttcag

SEQ ID NO: 270269 - DNA, 25 bp, Mus musculus
atgtccagtggaccctcaagttttc

SEQ ID NO: 270270 - DNA, 25 bp, Mus musculus
atgtccagtggagcctcaagttttc

SEQ ID NO: 270271 - DNA, 25 bp, Mus musculus
atgtccatacatatagcctagatta

SEQ ID NO: 270272 - DNA, 25 bp, Mus musculus
atgtccatacatttagcctagatta

SEQ ID NO: 270273 - DNA, 25 bp, Mus musculus
atgtccatactcacatcacatggtc

SEQ ID NO: 270274 - DNA, 25 bp, Mus musculus
atgtccatactctcatcacatggtc

SEQ ID NO: 270275 - DNA, 25 bp, Mus musculus
atgtccatactgacttgccttccac

SEQ ID NO: 270276 - DNA, 25 bp, Mus musculus
atgtccatactgtcttgccttccac

SEQ ID NO: 270277 - DNA, 25 bp, Mus musculus
atgtccatatttcccatgtgtctgt

SEQ ID NO: 270278 - DNA, 25 bp, Mus musculus
atgtccatatttgccatgtgtctgt

SEQ ID NO: 270279 - DNA, 25 bp, Mus musculus
atgtccatcaccacagacaggttca

SEQ ID NO: 270280 - DNA, 25 bp, Mus musculus
atgtccatcacctcagacaggttca

SEQ ID NO: 270281 - DNA, 25 bp, Mus musculus
atgtccatcagaagctgccatcctt

SEQ ID NO: 270282 - DNA, 25 bp, Mus musculus
atgtccatcagatgctgccatcctt

SEQ ID NO: 270283 - DNA, 25 bp, Mus musculus
atgtccatccgaaccaagttgcaga

SEQ ID NO: 270284 - DNA, 25 bp, Mus musculus
atgtccatccgatccaagttgcaga

SEQ ID NO: 270285 - DNA, 25 bp, Mus musculus
atgtccatctatacctccatccatt

SEQ ID NO: 270286 - DNA, 25 bp, Mus musculus
atgtccatctattcctccatccatt

SEQ ID NO: 270287 - DNA, 25 bp, Mus musculus
atgtccatcttacaagactgttgtg

SEQ ID NO: 270288 - DNA, 25 bp, Mus musculus
atgtccatcttagaagactgttgtg

SEQ ID NO: 270289 - DNA, 25 bp, Mus musculus
atgtccatgaacatgagctactcgt

SEQ ID NO: 270290 - DNA, 25 bp, Mus musculus
atgtccatgaacttgagctactcgt

SEQ ID NO: 270291 - DNA, 25 bp, Mus musculus
atgtccatgaccacaacaagtgcgg

SEQ ID NO: 270292 - DNA, 25 bp, Mus musculus
atgtccatgacctcaacaagtgcgg

SEQ ID NO: 270293 - DNA, 25 bp, Mus musculus
atgtccatgagcatcgcaccacgaa

SEQ ID NO: 270294 - DNA, 25 bp, Mus musculus
atgtccatgagcttcgcaccacgaa

SEQ ID NO: 270295 - DNA, 25 bp, Mus musculus
atgtccatgcagcttgatatcgttg

SEQ ID NO: 270296 - DNA, 25 bp, Mus musculus
atgtccatgcaggttgatatcgttg

SEQ ID NO: 270297 - DNA, 25 bp, Mus musculus
atgtccatggctctgcattttctta

SEQ ID NO: 270298 - DNA, 25 bp, Mus musculus
atgtccatggctgtgcattttctta

SEQ ID NO: 270299 - DNA, 25 bp, Mus musculus
atgtccatgtcccaatctgagttac

SEQ ID NO: 270300 - DNA, 25 bp, Mus musculus
atgtccatgtccgaatctgagttac

SEQ ID NO: 270301 - DNA, 25 bp, Mus musculus
atgtccatgtctatgtctcactgaa

SEQ ID NO: 270302 - DNA, 25 bp, Mus musculus
atgtccatgtctttgtctcactgaa

SEQ ID NO: 270303 - DNA, 25 bp, Mus musculus
atgtccatgtgcagttggaagatcc

SEQ ID NO: 270304 - DNA, 25 bp, Mus musculus
atgtccatgtgctgttggaagatcc

SEQ ID NO: 270305 - DNA, 25 bp, Mus musculus
atgtccatgtggacaaggctaaact

SEQ ID NO: 270306 - DNA, 25 bp, Mus musculus
atgtccatgtggtcaaggctaaact

SEQ ID NO: 270307 - DNA, 25 bp, Mus musculus
atgtccatgtgtagctataatttaa

SEQ ID NO: 270308 - DNA, 25 bp, Mus musculus
atgtccatgtgttgctataatttaa

SEQ ID NO: 270309 - DNA, 25 bp, Mus musculus
atgtccatttacactccacagactt

SEQ ID NO: 270310 - DNA, 25 bp, Mus musculus
atgtccatttactctccacagactt

SEQ ID NO: 270311 - DNA, 25 bp, Mus musculus
atgtcccaaaccacgatctggtcaa

SEQ ID NO: 270312 - DNA, 25 bp, Mus musculus
atgtcccaaacctcgatctggtcaa

SEQ ID NO: 270313 - DNA, 25 bp, Mus musculus
atgtcccaacaacctgttcagttta

SEQ ID NO: 270314 - DNA, 25 bp, Mus musculus
atgtcccaacaagctgttcagttta

SEQ ID NO: 270315 - DNA, 25 bp, Mus musculus
atgtcccaacctcaagctcatgagc

SEQ ID NO: 270316 - DNA, 25 bp, Mus musculus
atgtcccaacctgaagctcatgagc

SEQ ID NO: 270317 - DNA, 25 bp, Mus musculus
atgtcccaccacatccaatagatag

SEQ ID NO: 270318 - DNA, 25 bp, Mus musculus
atgtcccaccacttccaatagatag

SEQ ID NO: 270319 - DNA, 25 bp, Mus musculus
atgtcccaccggagggcagactgca

SEQ ID NO: 270320 - DNA, 25 bp, Mus musculus
atgtcccaccggtgggcagactgca

SEQ ID NO: 270321 - DNA, 25 bp, Mus musculus
atgtcccactaacactacaggttgt

SEQ ID NO: 270322 - DNA, 25 bp, Mus musculus
atgtcccactaagactacaggttgt

SEQ ID NO: 270323 - DNA, 25 bp, Mus musculus
atgtcccagaatctgctgttctgct

SEQ ID NO: 270324 - DNA, 25 bp, Mus musculus
atgtcccagaatgtgctgttctgct

SEQ ID NO: 270325 - DNA, 25 bp, Mus musculus
atgtcccagcacacgtagaccagac

SEQ ID NO: 270326 - DNA, 25 bp, Mus musculus
atgtcccagcactcgtagaccagac

SEQ ID NO: 270327 - DNA, 25 bp, Mus musculus
atgtcccagcagatctacagggcac

SEQ ID NO: 270328 - DNA, 25 bp, Mus musculus
atgtcccagcagttctacagggcac

SEQ ID NO: 270329 - DNA, 25 bp, Mus musculus
atgtcccagcgactctgtgtacagt

SEQ ID NO: 270330 - DNA, 25 bp, Mus musculus
atgtcccagcgagtctgtgtacagt

SEQ ID NO: 270331 - DNA, 25 bp, Mus musculus
atgtcccaggcaatagcctgagtga

SEQ ID NO: 270332 - DNA, 25 bp, Mus musculus
atgtcccaggcattagcctgagtga

SEQ ID NO: 270333 - DNA, 25 bp, Mus musculus
atgtcccagggtaacgtacaacaca

SEQ ID NO: 270334 - DNA, 25 bp, Mus musculus
atgtcccagggttacgtacaacaca

SEQ ID NO: 270335 - DNA, 25 bp, Mus musculus
atgtcccaggtcctctcgatgatgg

SEQ ID NO: 270336 - DNA, 25 bp, Mus musculus
atgtcccaggtcgtctcgatgatgg

SEQ ID NO: 270337 - DNA, 25 bp, Mus musculus
atgtcccaggtgacagtttgtcttt

SEQ ID NO: 270338 - DNA, 25 bp, Mus musculus
atgtcccaggtgtcagtttgtcttt

SEQ ID NO: 270339 - DNA, 25 bp, Mus musculus
atgtcccagtaaaccaatgcagtcc

SEQ ID NO: 270340 - DNA, 25 bp, Mus musculus
atgtcccagtaatccaatgcagtcc

SEQ ID NO: 270341 - DNA, 25 bp, Mus musculus
atgtcccatagcagattctagccat

SEQ ID NO: 270342 - DNA, 25 bp, Mus musculus
atgtcccatagccttcacagtaata

SEQ ID NO: 270343 - DNA, 25 bp, Mus musculus
atgtcccatagcgttcacagtaata

SEQ ID NO: 270344 - DNA, 25 bp, Mus musculus
atgtcccatagctgattctagccat

SEQ ID NO: 270345 - DNA, 25 bp, Mus musculus
atgtcccatattatgaatggctgga

SEQ ID NO: 270346 - DNA, 25 bp, Mus musculus
atgtcccatattttgaatggctgga

SEQ ID NO: 270347 - DNA, 25 bp, Mus musculus
atgtcccatcctacctaaaaattca

SEQ ID NO: 270348 - DNA, 25 bp, Mus musculus
atgtcccatcctctgggcattatgc

SEQ ID NO: 270349 - DNA, 25 bp, Mus musculus
atgtcccatcctgtgggcattatgc

SEQ ID NO: 270350 - DNA, 25 bp, Mus musculus
atgtcccatccttcctaaaaattca

SEQ ID NO: 270351 - DNA, 25 bp, Mus musculus
atgtcccatctaagactgccttgat

SEQ ID NO: 270352 - DNA, 25 bp, Mus musculus
atgtcccatctatgactgccttgat

SEQ ID NO: 270353 - DNA, 25 bp, Mus musculus
atgtcccatctgatgagactgagaa

SEQ ID NO: 270354 - DNA, 25 bp, Mus musculus
atgtcccatctgttgagactgagaa

SEQ ID NO: 270355 - DNA, 25 bp, Mus musculus
atgtccccaagacattggctcacca

SEQ ID NO: 270356 - DNA, 25 bp, Mus musculus
atgtccccaagagattggctcacca

SEQ ID NO: 270357 - DNA, 25 bp, Mus musculus
atgtccccactgaagcatgcatatg

SEQ ID NO: 270358 - DNA, 25 bp, Mus musculus
atgtccccactgtagcatgcatatg

SEQ ID NO: 270359 - DNA, 25 bp, Mus musculus
atgtccccagacacagtactgatga

SEQ ID NO: 270360 - DNA, 25 bp, Mus musculus
atgtccccagactcagtactgatga

SEQ ID NO: 270361 - DNA, 25 bp, Mus musculus
atgtccccatatatagtgctcagtc

SEQ ID NO: 270362 - DNA, 25 bp, Mus musculus
atgtccccatatttagtgctcagtc

SEQ ID NO: 270363 - DNA, 25 bp, Mus musculus
atgtccccatggagatagccgtgaa

SEQ ID NO: 270364 - DNA, 25 bp, Mus musculus
atgtccccatggtgatagccgtgaa

SEQ ID NO: 270365 - DNA, 25 bp, Mus musculus
atgtccccattaagttccatgtctg

SEQ ID NO: 270366 - DNA, 25 bp, Mus musculus
atgtccccattatgttccatgtctg

SEQ ID NO: 270367 - DNA, 25 bp, Mus musculus
atgtccccattgaacaaacactgcc

SEQ ID NO: 270368 - DNA, 25 bp, Mus musculus
atgtccccattgtacaaacactgcc

SEQ ID NO: 270369 - DNA, 25 bp, Mus musculus
atgtcccctccaactgttcagagga

SEQ ID NO: 270370 - DNA, 25 bp, Mus musculus
atgtcccctccatctgttcagagga

SEQ ID NO: 270371 - DNA, 25 bp, Mus musculus
atgtcccctgagcaattcacagaaa

SEQ ID NO: 270372 - DNA, 25 bp, Mus musculus
atgtcccctgaggaattcacagaaa

SEQ ID NO: 270373 - DNA, 25 bp, Mus musculus
atgtcccctggaaaaagctcaagaa

SEQ ID NO: 270374 - DNA, 25 bp, Mus musculus
atgtcccctggataaagctcaagaa

SEQ ID NO: 270375 - DNA, 25 bp, Mus musculus
atgtcccctgtgagttccaggaagc

SEQ ID NO: 270376 - DNA, 25 bp, Mus musculus
atgtcccctgtgtgttccaggaagc

SEQ ID NO: 270377 - DNA, 25 bp, Mus musculus
atgtcccctttgcaaacgggatttg

SEQ ID NO: 270378 - DNA, 25 bp, Mus musculus
atgtcccctttggaaacgggatttg

SEQ ID NO: 270379 - DNA, 25 bp, Mus musculus
atgtcccgagcacacagttcctgtg

SEQ ID NO: 270380 - DNA, 25 bp, Mus musculus
atgtcccgagcagacagttcctgtg

SEQ ID NO: 270381 - DNA, 25 bp, Mus musculus
atgtcccgccatactgaagggctta

SEQ ID NO: 270382 - DNA, 25 bp, Mus musculus
atgtcccgccattctgaagggctta

SEQ ID NO: 270383 - DNA, 25 bp, Mus musculus
atgtccctaaatatcctcatcaatt

SEQ ID NO: 270384 - DNA, 25 bp, Mus musculus
atgtccctaaatttcctcatcaatt

SEQ ID NO: 270385 - DNA, 25 bp, Mus musculus
atgtccctaagtcccagacattggg

SEQ ID NO: 270386 - DNA, 25 bp, Mus musculus
atgtccctaagtgccagacattggg

SEQ ID NO: 270387 - DNA, 25 bp, Mus musculus
atgtccctagagatctcagggatgg

SEQ ID NO: 270388 - DNA, 25 bp, Mus musculus
atgtccctagagttctcagggatgg

SEQ ID NO: 270389 - DNA, 25 bp, Mus musculus
atgtccctaggacctgtagcccttg

SEQ ID NO: 270390 - DNA, 25 bp, Mus musculus
atgtccctaggagctgtagcccttg

SEQ ID NO: 270391 - DNA, 25 bp, Mus musculus
atgtccctagtgctttgtggccaag

SEQ ID NO: 270392 - DNA, 25 bp, Mus musculus
atgtccctagtggtttgtggccaag

SEQ ID NO: 270393 - DNA, 25 bp, Mus musculus
atgtccctatcacgaagcccagatg

SEQ ID NO: 270394 - DNA, 25 bp, Mus musculus
atgtccctatcaggaagcccagatg

SEQ ID NO: 270395 - DNA, 25 bp, Mus musculus
atgtccctatgccttacgcaaaggt

SEQ ID NO: 270396 - DNA, 25 bp, Mus musculus
atgtccctatgcgttacgcaaaggt

SEQ ID NO: 270397 - DNA, 25 bp, Mus musculus
atgtccctccttctggctctaggag

SEQ ID NO: 270398 - DNA, 25 bp, Mus musculus
atgtccctccttgtggctctaggag

SEQ ID NO: 270399 - DNA, 25 bp, Mus musculus
atgtccctcgaaatcacttaacttt

SEQ ID NO: 270400 - DNA, 25 bp, Mus musculus
atgtccctcgaacctggagtgccaa

SEQ ID NO: 270401 - DNA, 25 bp, Mus musculus
atgtccctcgaagctggagtgccaa

SEQ ID NO: 270402 - DNA, 25 bp, Mus musculus
atgtccctcgaattcacttaacttt

SEQ ID NO: 270403 - DNA, 25 bp, Mus musculus
atgtccctgaagcaaacaccactgt

SEQ ID NO: 270404 - DNA, 25 bp, Mus musculus
atgtccctgaaggaaacaccactgt

SEQ ID NO: 270405 - DNA, 25 bp, Mus musculus
atgtccctgactatttggttcctgc

SEQ ID NO: 270406 - DNA, 25 bp, Mus musculus
atgtccctgactttttggttcctgc

SEQ ID NO: 270407 - DNA, 25 bp, Mus musculus
atgtccctgcagagtatccagtaaa

SEQ ID NO: 270408 - DNA, 25 bp, Mus musculus
atgtccctgcagatatgatgcaata

SEQ ID NO: 270409 - DNA, 25 bp, Mus musculus
atgtccctgcagtgtatccagtaaa

SEQ ID NO: 270410 - DNA, 25 bp, Mus musculus
atgtccctgcagttatgatgcaata

SEQ ID NO: 270411 - DNA, 25 bp, Mus musculus
atgtccctgggcagtttcagctcct

SEQ ID NO: 270412 - DNA, 25 bp, Mus musculus
atgtccctgggctgtttcagctcct

SEQ ID NO: 270413 - DNA, 25 bp, Mus musculus
atgtccctggtaatcaccttcaagt

SEQ ID NO: 270414 - DNA, 25 bp, Mus musculus
atgtccctggtattcaccttcaagt

SEQ ID NO: 270415 - DNA, 25 bp, Mus musculus
atgtccctggtcaggactgttgcct

SEQ ID NO: 270416 - DNA, 25 bp, Mus musculus
atgtccctggtctggactgttgcct

SEQ ID NO: 270417 - DNA, 25 bp, Mus musculus
atgtcccttagtctggaagtggcta

SEQ ID NO: 270418 - DNA, 25 bp, Mus musculus
atgtcccttagtgtggaagtggcta

SEQ ID NO: 270419 - DNA, 25 bp, Mus musculus
atgtcccttattatctttttctgtt

SEQ ID NO: 270420 - DNA, 25 bp, Mus musculus
atgtcccttattttctttttctgtt

SEQ ID NO: 270421 - DNA, 25 bp, Mus musculus
atgtcccttcacagaaaccggtaat

SEQ ID NO: 270422 - DNA, 25 bp, Mus musculus
atgtcccttcactgaaaccggtaat

SEQ ID NO: 270423 - DNA, 25 bp, Mus musculus
atgtcccttcttataggagctcaga

SEQ ID NO: 270424 - DNA, 25 bp, Mus musculus
atgtcccttcttttaggagctcaga

SEQ ID NO: 270425 - DNA, 25 bp, Mus musculus
atgtcccttgttccctgttattcag

SEQ ID NO: 270426 - DNA, 25 bp, Mus musculus
atgtcccttgttgcctgttattcag

SEQ ID NO: 270427 - DNA, 25 bp, Mus musculus
atgtccctttccataatgtgtttga

SEQ ID NO: 270428 - DNA, 25 bp, Mus musculus
atgtccctttccttaatgtgtttga

SEQ ID NO: 270429 - DNA, 25 bp, Mus musculus
atgtccctttgcacatggaaacgca

SEQ ID NO: 270430 - DNA, 25 bp, Mus musculus
atgtccctttgctcatggaaacgca

SEQ ID NO: 270431 - DNA, 25 bp, Mus musculus
atgtccgaagctcttcacccaaggt

SEQ ID NO: 270432 - DNA, 25 bp, Mus musculus
atgtccgaagctgttcacccaaggt

SEQ ID NO: 270433 - DNA, 25 bp, Mus musculus
atgtccgaatccaggcttcatggaa

SEQ ID NO: 270434 - DNA, 25 bp, Mus musculus
atgtccgaatcctggcttcatggaa

SEQ ID NO: 270435 - DNA, 25 bp, Mus musculus
atgtccgacattaaactctggtgcg

SEQ ID NO: 270436 - DNA, 25 bp, Mus musculus
atgtccgacatttaactctggtgcg

SEQ ID NO: 270437 - DNA, 25 bp, Mus musculus
atgtccgacctgagtatccaaatag

SEQ ID NO: 270438 - DNA, 25 bp, Mus musculus
atgtccgacctgtgtatccaaatag

SEQ ID NO: 270439 - DNA, 25 bp, Mus musculus
atgtccgaggaacctggctgacttg

SEQ ID NO: 270440 - DNA, 25 bp, Mus musculus
atgtccgaggaagctggctgacttg

SEQ ID NO: 270441 - DNA, 25 bp, Mus musculus
atgtccgatcggagctgagccgaaa

SEQ ID NO: 270442 - DNA, 25 bp, Mus musculus
atgtccgatcggtgctgagccgaaa

SEQ ID NO: 270443 - DNA, 25 bp, Mus musculus
atgtccgattgaagttctccaactg

SEQ ID NO: 270444 - DNA, 25 bp, Mus musculus
atgtccgattgatgttctccaactg

SEQ ID NO: 270445 - DNA, 25 bp, Mus musculus
atgtccgcaaggagatctactacag

SEQ ID NO: 270446 - DNA, 25 bp, Mus musculus
atgtccgcaaggtgatctactacag

SEQ ID NO: 270447 - DNA, 25 bp, Mus musculus
atgtccgcagcgacagctttaaaac

SEQ ID NO: 270448 - DNA, 25 bp, Mus musculus
atgtccgcagcgtcagctttaaaac

SEQ ID NO: 270449 - DNA, 25 bp, Mus musculus
atgtccgccagtatgttgtcaggaa

SEQ ID NO: 270450 - DNA, 25 bp, Mus musculus
atgtccgccagtttgttgtcaggaa

SEQ ID NO: 270451 - DNA, 25 bp, Mus musculus
atgtccgctactaattcagtgttgg

SEQ ID NO: 270452 - DNA, 25 bp, Mus musculus
atgtccgctacttattcagtgttgg

SEQ ID NO: 270453 - DNA, 25 bp, Mus musculus
atgtccggatctcctcccaagggag

SEQ ID NO: 270454 - DNA, 25 bp, Mus musculus
atgtccggatctgctcccaagggag

SEQ ID NO: 270455 - DNA, 25 bp, Mus musculus
atgtccggctgcaaactacccatgg

SEQ ID NO: 270456 - DNA, 25 bp, Mus musculus
atgtccggctgctaactacccatgg

SEQ ID NO: 270457 - DNA, 25 bp, Mus musculus
atgtccgggagccatttattaatgt

SEQ ID NO: 270458 - DNA, 25 bp, Mus musculus
atgtccgggagcgatttattaatgt

SEQ ID NO: 270459 - DNA, 25 bp, Mus musculus
atgtccgggcgacgcaagcagggcg

SEQ ID NO: 270460 - DNA, 25 bp, Mus musculus
atgtccgggcgaggcaagcagggcg

SEQ ID NO: 270461 - DNA, 25 bp, Mus musculus
atgtccgtatcaacacagtggcatg

SEQ ID NO: 270462 - DNA, 25 bp, Mus musculus
atgtccgtatcatcacagtggcatg

SEQ ID NO: 270463 - DNA, 25 bp, Mus musculus
atgtccgtatgcctcatgtttacca

SEQ ID NO: 270464 - DNA, 25 bp, Mus musculus
atgtccgtatgcgtcatgtttacca

SEQ ID NO: 270465 - DNA, 25 bp, Mus musculus
atgtccgtcgtactttttcatggtc

SEQ ID NO: 270466 - DNA, 25 bp, Mus musculus
atgtccgtcgtagtttttcatggtc

SEQ ID NO: 270467 - DNA, 25 bp, Mus musculus
atgtccgtgcaaagtggtatcctga

SEQ ID NO: 270468 - DNA, 25 bp, Mus musculus
atgtccgtgcaatgtggtatcctga

SEQ ID NO: 270469 - DNA, 25 bp, Mus musculus
atgtccgttctgatatcaggcacga

SEQ ID NO: 270470 - DNA, 25 bp, Mus musculus
atgtccgttctgttatcaggcacga

SEQ ID NO: 270471 - DNA, 25 bp, Mus musculus
atgtccgttgcgaggagccagacca

SEQ ID NO: 270472 - DNA, 25 bp, Mus musculus
atgtccgttgcgtggagccagacca

SEQ ID NO: 270473 - DNA, 25 bp, Mus musculus
atgtcctaatataaatgttcactgc

SEQ ID NO: 270474 - DNA, 25 bp, Mus musculus
atgtcctaatattaatgttcactgc

SEQ ID NO: 270475 - DNA, 25 bp, Mus musculus
atgtcctacatacatctggatgcta

SEQ ID NO: 270476 - DNA, 25 bp, Mus musculus
atgtcctacatagatctggatgcta

SEQ ID NO: 270477 - DNA, 25 bp, Mus musculus
atgtcctaccatatgctcagagaag

SEQ ID NO: 270478 - DNA, 25 bp, Mus musculus
atgtcctaccatttgctcagagaag

SEQ ID NO: 270479 - DNA, 25 bp, Mus musculus
atgtcctagagcatccatattagtg

SEQ ID NO: 270480 - DNA, 25 bp, Mus musculus
atgtcctagagcttccatattagtg

SEQ ID NO: 270481 - DNA, 25 bp, Mus musculus
atgtcctaggttctgtagatgcccg

SEQ ID NO: 270482 - DNA, 25 bp, Mus musculus
atgtcctaggttgtgtagatgcccg

SEQ ID NO: 270483 - DNA, 25 bp, Mus musculus
atgtcctatgatcattgccttaaac

SEQ ID NO: 270484 - DNA, 25 bp, Mus musculus
atgtcctatgatgattgccttaaac

SEQ ID NO: 270485 - DNA, 25 bp, Mus musculus
atgtcctatggccagcaagtttagt

SEQ ID NO: 270486 - DNA, 25 bp, Mus musculus
atgtcctatggcgagcaagtttagt

SEQ ID NO: 270487 - DNA, 25 bp, Mus musculus
atgtcctattctcgtgtgtttgata

SEQ ID NO: 270488 - DNA, 25 bp, Mus musculus
atgtcctattctggtgtgtttgata

SEQ ID NO: 270489 - DNA, 25 bp, Mus musculus
atgtcctcaacacttcagcacagat

SEQ ID NO: 270490 - DNA, 25 bp, Mus musculus
atgtcctcaacagttcagcacagat

SEQ ID NO: 270491 - DNA, 25 bp, Mus musculus
atgtcctcaagcagccaggtgacca

SEQ ID NO: 270492 - DNA, 25 bp, Mus musculus
atgtcctcaagctgccaggtgacca

SEQ ID NO: 270493 - DNA, 25 bp, Mus musculus
atgtcctcaatacccagtgtggcta

SEQ ID NO: 270494 - DNA, 25 bp, Mus musculus
atgtcctcaatagccagtgtggcta

SEQ ID NO: 270495 - DNA, 25 bp, Mus musculus
atgtcctcacctctaattgggctat

SEQ ID NO: 270496 - DNA, 25 bp, Mus musculus
atgtcctcacctctctagagccata

SEQ ID NO: 270497 - DNA, 25 bp, Mus musculus
atgtcctcacctgtaattgggctat

SEQ ID NO: 270498 - DNA, 25 bp, Mus musculus
atgtcctcacctgtctagagccata

SEQ ID NO: 270499 - DNA, 25 bp, Mus musculus
atgtcctcactactcactgttaaga

SEQ ID NO: 270500 - DNA, 25 bp, Mus musculus
atgtcctcactagtcactgttaaga

SEQ ID NO: 270501 - DNA, 25 bp, Mus musculus
atgtcctcactgagtctactaacga

SEQ ID NO: 270502 - DNA, 25 bp, Mus musculus
atgtcctcactgtgtctactaacga

SEQ ID NO: 270503 - DNA, 25 bp, Mus musculus
atgtcctcagagaagtggcaccaga

SEQ ID NO: 270504 - DNA, 25 bp, Mus musculus
atgtcctcagagtagtggcaccaga

SEQ ID NO: 270505 - DNA, 25 bp, Mus musculus
atgtcctcagatcatgggcagacta

SEQ ID NO: 270506 - DNA, 25 bp, Mus musculus
atgtcctcagatgatgggcagacta

SEQ ID NO: 270507 - DNA, 25 bp, Mus musculus
atgtcctcagtgatcatctatttta

SEQ ID NO: 270508 - DNA, 25 bp, Mus musculus
atgtcctcagtgttcatctatttta

SEQ ID NO: 270509 - DNA, 25 bp, Mus musculus
atgtcctcataaactactggctttc

SEQ ID NO: 270510 - DNA, 25 bp, Mus musculus
atgtcctcataatctactggctttc

SEQ ID NO: 270511 - DNA, 25 bp, Mus musculus
atgtcctcatcacctgtgcgacttg

SEQ ID NO: 270512 - DNA, 25 bp, Mus musculus
atgtcctcatcagctgtgcgacttg

SEQ ID NO: 270513 - DNA, 25 bp, Mus musculus
atgtcctcatggatgctgtagcaac

SEQ ID NO: 270514 - DNA, 25 bp, Mus musculus
atgtcctcatggttgctgtagcaac

SEQ ID NO: 270515 - DNA, 25 bp, Mus musculus
atgtcctcatgtctttgccaacaca

SEQ ID NO: 270516 - DNA, 25 bp, Mus musculus
atgtcctcatgtgtttgccaacaca

SEQ ID NO: 270517 - DNA, 25 bp, Mus musculus
atgtcctccaccctagattaatgct

SEQ ID NO: 270518 - DNA, 25 bp, Mus musculus
atgtcctccaccgtagattaatgct

SEQ ID NO: 270519 - DNA, 25 bp, Mus musculus
atgtcctcctgtctggtcatctgaa

SEQ ID NO: 270520 - DNA, 25 bp, Mus musculus
atgtcctcctgtgtggtcatctgaa

SEQ ID NO: 270521 - DNA, 25 bp, Mus musculus
atgtcctcgaggagcaccttgagag

SEQ ID NO: 270522 - DNA, 25 bp, Mus musculus
atgtcctcgaggtgcaccttgagag

SEQ ID NO: 270523 - DNA, 25 bp, Mus musculus
atgtcctcgataccaagttctcggg

SEQ ID NO: 270524 - DNA, 25 bp, Mus musculus
atgtcctcgatagcaagttctcggg

SEQ ID NO: 270525 - DNA, 25 bp, Mus musculus
atgtcctcggttacaaaggtcccag

SEQ ID NO: 270526 - DNA, 25 bp, Mus musculus
atgtcctcggtttcaaaggtcccag

SEQ ID NO: 270527 - DNA, 25 bp, Mus musculus
atgtcctcgtgaaacctgtcactta

SEQ ID NO: 270528 - DNA, 25 bp, Mus musculus
atgtcctcgtgatacctgtcactta

SEQ ID NO: 270529 - DNA, 25 bp, Mus musculus
atgtcctctaccagtttcctgatat

SEQ ID NO: 270530 - DNA, 25 bp, Mus musculus
atgtcctctacctgtttcctgatat

SEQ ID NO: 270531 - DNA, 25 bp, Mus musculus
atgtcctctagccagccagggagct

SEQ ID NO: 270532 - DNA, 25 bp, Mus musculus
atgtcctctagcgagccagggagct

SEQ ID NO: 270533 - DNA, 25 bp, Mus musculus
atgtcctctagtccagaatcacctc

SEQ ID NO: 270534 - DNA, 25 bp, Mus musculus
atgtcctctagtgcagaatcacctc

SEQ ID NO: 270535 - DNA, 25 bp, Mus musculus
atgtcctctcagaccacaacatgta

SEQ ID NO: 270536 - DNA, 25 bp, Mus musculus
atgtcctctcagtccacaacatgta

SEQ ID NO: 270537 - DNA, 25 bp, Mus musculus
atgtcctctctcaactgtagtgtca

SEQ ID NO: 270538 - DNA, 25 bp, Mus musculus
atgtcctctctcagctattgcaaat

SEQ ID NO: 270539 - DNA, 25 bp, Mus musculus
atgtcctctctctactgtagtgtca

SEQ ID NO: 270540 - DNA, 25 bp, Mus musculus
atgtcctctctctgctattgcaaat

SEQ ID NO: 270541 - DNA, 25 bp, Mus musculus
atgtcctctggcctgctacaatgta

SEQ ID NO: 270542 - DNA, 25 bp, Mus musculus
atgtcctctggcgtgctacaatgta

SEQ ID NO: 270543 - DNA, 25 bp, Mus musculus
atgtcctctgtaagtgtgccactcc

SEQ ID NO: 270544 - DNA, 25 bp, Mus musculus
atgtcctctgtatgtgtgccactcc

SEQ ID NO: 270545 - DNA, 25 bp, Mus musculus
atgtcctcttccagctcataactgt

SEQ ID NO: 270546 - DNA, 25 bp, Mus musculus
atgtcctcttcctgctcataactgt

SEQ ID NO: 270547 - DNA, 25 bp, Mus musculus
atgtcctcttttccagctcttatta

SEQ ID NO: 270548 - DNA, 25 bp, Mus musculus
atgtcctcttttgcagctcttatta

SEQ ID NO: 270549 - DNA, 25 bp, Mus musculus
atgtcctgaaaaaccatattcctgg

SEQ ID NO: 270550 - DNA, 25 bp, Mus musculus
atgtcctgaaaatccatattcctgg

SEQ ID NO: 270551 - DNA, 25 bp, Mus musculus
atgtcctgaaccataaattactatc

SEQ ID NO: 270552 - DNA, 25 bp, Mus musculus
atgtcctgaaccttaaattactatc

SEQ ID NO: 270553 - DNA, 25 bp, Mus musculus
atgtcctgaaggacacttggctatt

SEQ ID NO: 270554 - DNA, 25 bp, Mus musculus
atgtcctgaaggtcacttggctatt

SEQ ID NO: 270555 - DNA, 25 bp, Mus musculus
atgtcctgacaacaccctgggagtt

SEQ ID NO: 270556 - DNA, 25 bp, Mus musculus
atgtcctgacaagaccctgggagtt

SEQ ID NO: 270557 - DNA, 25 bp, Mus musculus
atgtcctgacccaagcgctctgatg

SEQ ID NO: 270558 - DNA, 25 bp, Mus musculus
atgtcctgaccctagcgctctgatg

SEQ ID NO: 270559 - DNA, 25 bp, Mus musculus
atgtcctgagacaacagtccaagaa

SEQ ID NO: 270560 - DNA, 25 bp, Mus musculus
atgtcctgagacagtggctacgggc

SEQ ID NO: 270561 - DNA, 25 bp, Mus musculus
atgtcctgagactacagtccaagaa

SEQ ID NO: 270562 - DNA, 25 bp, Mus musculus
atgtcctgagactgtggctacgggc

SEQ ID NO: 270563 - DNA, 25 bp, Mus musculus
atgtcctgagatcatggggtcaaga

SEQ ID NO: 270564 - DNA, 25 bp, Mus musculus
atgtcctgagatgatggggtcaaga

SEQ ID NO: 270565 - DNA, 25 bp, Mus musculus
atgtcctgaggcaacttgatctgtg

SEQ ID NO: 270566 - DNA, 25 bp, Mus musculus
atgtcctgaggctacttgatctgtg

SEQ ID NO: 270567 - DNA, 25 bp, Mus musculus
atgtcctgatctctgtgacttgtgc

SEQ ID NO: 270568 - DNA, 25 bp, Mus musculus
atgtcctgatctgtgtgacttgtgc

SEQ ID NO: 270569 - DNA, 25 bp, Mus musculus
atgtcctgccctcggagcaaagtgc

SEQ ID NO: 270570 - DNA, 25 bp, Mus musculus
atgtcctgccctgggagcaaagtgc

SEQ ID NO: 270571 - DNA, 25 bp, Mus musculus
atgtcctgccgactctgaactatag

SEQ ID NO: 270572 - DNA, 25 bp, Mus musculus
atgtcctgccgagtctgaactatag

SEQ ID NO: 270573 - DNA, 25 bp, Mus musculus
atgtcctgcctaccagtacttactt

SEQ ID NO: 270574 - DNA, 25 bp, Mus musculus
atgtcctgcctagcagtacttactt

SEQ ID NO: 270575 - DNA, 25 bp, Mus musculus
atgtcctgcgtgaatatcctacata

SEQ ID NO: 270576 - DNA, 25 bp, Mus musculus
atgtcctgcgtgtatatcctacata

SEQ ID NO: 270577 - DNA, 25 bp, Mus musculus
atgtcctgctttatggctgcccagt

SEQ ID NO: 270578 - DNA, 25 bp, Mus musculus
atgtcctgctttttggctgcccagt

SEQ ID NO: 270579 - DNA, 25 bp, Mus musculus
atgtcctggcacatgtgtctttgag

SEQ ID NO: 270580 - DNA, 25 bp, Mus musculus
atgtcctggcacttgtgtctttgag

SEQ ID NO: 270581 - DNA, 25 bp, Mus musculus
atgtcctggccaagcagttcaattg

SEQ ID NO: 270582 - DNA, 25 bp, Mus musculus
atgtcctggccatgcagttcaattg

SEQ ID NO: 270583 - DNA, 25 bp, Mus musculus
atgtcctgggttaggtgcccagcta

SEQ ID NO: 270584 - DNA, 25 bp, Mus musculus
atgtcctgggtttggtgcccagcta

SEQ ID NO: 270585 - DNA, 25 bp, Mus musculus
atgtcctggtccacagtggcctcca

SEQ ID NO: 270586 - DNA, 25 bp, Mus musculus
atgtcctggtcctcagtggcctcca

SEQ ID NO: 270587 - DNA, 25 bp, Mus musculus
atgtcctgtagcatattcttggtca

SEQ ID NO: 270588 - DNA, 25 bp, Mus musculus
atgtcctgtagcttattcttggtca

SEQ ID NO: 270589 - DNA, 25 bp, Mus musculus
atgtcctgtcaacaattcgtatagt

SEQ ID NO: 270590 - DNA, 25 bp, Mus musculus
atgtcctgtcaagaattcgtatagt

SEQ ID NO: 270591 - DNA, 25 bp, Mus musculus
atgtcctgtcatctcgaactcacta

SEQ ID NO: 270592 - DNA, 25 bp, Mus musculus
atgtcctgtcatgtcgaactcacta

SEQ ID NO: 270593 - DNA, 25 bp, Mus musculus
atgtcctgtcgtattttgcaatgtt

SEQ ID NO: 270594 - DNA, 25 bp, Mus musculus
atgtcctgtcgttttttgcaatgtt

SEQ ID NO: 270595 - DNA, 25 bp, Mus musculus
atgtcctgtcttagtcatctgataa

SEQ ID NO: 270596 - DNA, 25 bp, Mus musculus
atgtcctgtctttgtcatctgataa

SEQ ID NO: 270597 - DNA, 25 bp, Mus musculus
atgtcctgtgccctcttttcaatct

SEQ ID NO: 270598 - DNA, 25 bp, Mus musculus
atgtcctgtgccgtcttttcaatct

SEQ ID NO: 270599 - DNA, 25 bp, Mus musculus
atgtcctgtgggaggtgaagccaca

SEQ ID NO: 270600 - DNA, 25 bp, Mus musculus
atgtcctgtgggtggtgaagccaca

SEQ ID NO: 270601 - DNA, 25 bp, Mus musculus
atgtcctgtgtcagtctgtgcgtag

SEQ ID NO: 270602 - DNA, 25 bp, Mus musculus
atgtcctgtgtctgtctgtgcgtag

SEQ ID NO: 270603 - DNA, 25 bp, Mus musculus
atgtcctgtgtgagttgtttgtgtg

SEQ ID NO: 270604 - DNA, 25 bp, Mus musculus
atgtcctgtgtgtgttgtttgtgtg

SEQ ID NO: 270605 - DNA, 25 bp, Mus musculus
atgtcctgtttaatgatcacgagtc

SEQ ID NO: 270606 - DNA, 25 bp, Mus musculus
atgtcctgtttattgatcacgagtc

SEQ ID NO: 270607 - DNA, 25 bp, Mus musculus
atgtcctgtttcacagcaccaaggg

SEQ ID NO: 270608 - DNA, 25 bp, Mus musculus
atgtcctgtttctcagcaccaaggg

SEQ ID NO: 270609 - DNA, 25 bp, Mus musculus
atgtccttacgtatatgacccacag

SEQ ID NO: 270610 - DNA, 25 bp, Mus musculus
atgtccttacgtttatgacccacag

SEQ ID NO: 270611 - DNA, 25 bp, Mus musculus
atgtccttaggcaagtggctcatct

SEQ ID NO: 270612 - DNA, 25 bp, Mus musculus
atgtccttaggctagtggctcatct

SEQ ID NO: 270613 - DNA, 25 bp, Mus musculus
atgtccttagtaaagtcccactctt

SEQ ID NO: 270614 - DNA, 25 bp, Mus musculus
atgtccttagtatagtcccactctt

SEQ ID NO: 270615 - DNA, 25 bp, Mus musculus
atgtccttcagacgcattccacaca

SEQ ID NO: 270616 - DNA, 25 bp, Mus musculus
atgtccttcagaggcattccacaca

SEQ ID NO: 270617 - DNA, 25 bp, Mus musculus
atgtccttccctacttgtgagttat

SEQ ID NO: 270618 - DNA, 25 bp, Mus musculus
atgtccttccctcacatcaagaaag

SEQ ID NO: 270619 - DNA, 25 bp, Mus musculus
atgtccttccctgacatcaagaaag

SEQ ID NO: 270620 - DNA, 25 bp, Mus musculus
atgtccttcccttcttgtgagttat

SEQ ID NO: 270621 - DNA, 25 bp, Mus musculus
atgtccttcctcagttcacagttag

SEQ ID NO: 270622 - DNA, 25 bp, Mus musculus
atgtccttcctctgttcacagttag

SEQ ID NO: 270623 - DNA, 25 bp, Mus musculus
atgtccttcggacttacctggtgga

SEQ ID NO: 270624 - DNA, 25 bp, Mus musculus
atgtccttcggagttacctggtgga

SEQ ID NO: 270625 - DNA, 25 bp, Mus musculus
atgtccttgatcagcatcgaatgtt

SEQ ID NO: 270626 - DNA, 25 bp, Mus musculus
atgtccttgatctgcatcgaatgtt

SEQ ID NO: 270627 - DNA, 25 bp, Mus musculus
atgtccttgcatctcattgtgtctt

SEQ ID NO: 270628 - DNA, 25 bp, Mus musculus
atgtccttgcatgtcattgtgtctt

SEQ ID NO: 270629 - DNA, 25 bp, Mus musculus
atgtccttgcccactactcttaggt

SEQ ID NO: 270630 - DNA, 25 bp, Mus musculus
atgtccttgccctctactcttaggt

SEQ ID NO: 270631 - DNA, 25 bp, Mus musculus
atgtccttggacaagcatattttaa

SEQ ID NO: 270632 - DNA, 25 bp, Mus musculus
atgtccttggactagcatattttaa

SEQ ID NO: 270633 - DNA, 25 bp, Mus musculus
atgtccttggctcacactagcttca

SEQ ID NO: 270634 - DNA, 25 bp, Mus musculus
atgtccttggctgacactagcttca

SEQ ID NO: 270635 - DNA, 25 bp, Mus musculus
atgtccttgggcatgatggtgacac

SEQ ID NO: 270636 - DNA, 25 bp, Mus musculus
atgtccttgggcttgatggtgacac

SEQ ID NO: 270637 - DNA, 25 bp, Mus musculus
atgtccttgtcgagtctcatttcgt

SEQ ID NO: 270638 - DNA, 25 bp, Mus musculus
atgtccttgtcgtgtctcatttcgt

SEQ ID NO: 270639 - DNA, 25 bp, Mus musculus
atgtccttgtctactcttaagtgga

SEQ ID NO: 270640 - DNA, 25 bp, Mus musculus
atgtccttgtcttctcttaagtgga

SEQ ID NO: 270641 - DNA, 25 bp, Mus musculus
atgtccttgtgaaccagtatctgcc

SEQ ID NO: 270642 - DNA, 25 bp, Mus musculus
atgtccttgtgatccagtatctgcc

SEQ ID NO: 270643 - DNA, 25 bp, Mus musculus
atgtcctttacccagtagccagcat

SEQ ID NO: 270644 - DNA, 25 bp, Mus musculus
atgtcctttaccgagtagccagcat

SEQ ID NO: 270645 - DNA, 25 bp, Mus musculus
atgtcctttataaagactgccacag

SEQ ID NO: 270646 - DNA, 25 bp, Mus musculus
atgtcctttatatagactgccacag

SEQ ID NO: 270647 - DNA, 25 bp, Mus musculus
atgtcctttatcactgtgctacaaa

SEQ ID NO: 270648 - DNA, 25 bp, Mus musculus
atgtcctttatctctgtgctacaaa

SEQ ID NO: 270649 - DNA, 25 bp, Mus musculus
atgtcctttcagcaagggcctggga

SEQ ID NO: 270650 - DNA, 25 bp, Mus musculus
atgtcctttcaggaagggcctggga

SEQ ID NO: 270651 - DNA, 25 bp, Mus musculus
atgtcctttctacacttcaagtaag

SEQ ID NO: 270652 - DNA, 25 bp, Mus musculus
atgtcctttctactgtaagtttcca

SEQ ID NO: 270653 - DNA, 25 bp, Mus musculus
atgtcctttctagacttcaagtaag

SEQ ID NO: 270654 - DNA, 25 bp, Mus musculus
atgtcctttctagtgtaagtttcca

SEQ ID NO: 270655 - DNA, 25 bp, Mus musculus
atgtcctttgaacagtttctgtcta

SEQ ID NO: 270656 - DNA, 25 bp, Mus musculus
atgtcctttgaagagtttctgtcta

SEQ ID NO: 270657 - DNA, 25 bp, Mus musculus
atgtcctttgccaatcactgtaagc

SEQ ID NO: 270658 - DNA, 25 bp, Mus musculus
atgtcctttgcctatcactgtaagc

SEQ ID NO: 270659 - DNA, 25 bp, Mus musculus
atgtcctttggacgctagcacgcaa

SEQ ID NO: 270660 - DNA, 25 bp, Mus musculus
atgtcctttggaggctagcacgcaa

SEQ ID NO: 270661 - DNA, 25 bp, Mus musculus
atgtcctttgtacggcgtgttcaga

SEQ ID NO: 270662 - DNA, 25 bp, Mus musculus
atgtcctttgtagggcgtgttcaga

SEQ ID NO: 270663 - DNA, 25 bp, Mus musculus
atgtcctttgtcctcttcatgatct

SEQ ID NO: 270664 - DNA, 25 bp, Mus musculus
atgtcctttgtcgtcttcatgatct

SEQ ID NO: 270665 - DNA, 25 bp, Mus musculus
atgtcctttgttcccatctgctatg

SEQ ID NO: 270666 - DNA, 25 bp, Mus musculus
atgtcctttgttgccatctgctatg

SEQ ID NO: 270667 - DNA, 25 bp, Mus musculus
atgtccttttctactcctgtaatga

SEQ ID NO: 270668 - DNA, 25 bp, Mus musculus
atgtccttttcttctcctgtaatga

SEQ ID NO: 270669 - DNA, 25 bp, Mus musculus
atgtcgaatcaaacattagttgccc

SEQ ID NO: 270670 - DNA, 25 bp, Mus musculus
atgtcgaatcaatcattagttgccc

SEQ ID NO: 270671 - DNA, 25 bp, Mus musculus
atgtcgacccagcttcagaacacac

SEQ ID NO: 270672 - DNA, 25 bp, Mus musculus
atgtcgacccaggttcagaacacac

SEQ ID NO: 270673 - DNA, 25 bp, Mus musculus
atgtcgagacttaacgaaggctgat

SEQ ID NO: 270674 - DNA, 25 bp, Mus musculus
atgtcgagactttacgaaggctgat

SEQ ID NO: 270675 - DNA, 25 bp, Mus musculus
atgtcgagcttaagcaggatctgcc

SEQ ID NO: 270676 - DNA, 25 bp, Mus musculus
atgtcgagcttatgcaggatctgcc

SEQ ID NO: 270677 - DNA, 25 bp, Mus musculus
atgtcgaggctgagacttcaagatt

SEQ ID NO: 270678 - DNA, 25 bp, Mus musculus
atgtcgaggctgtgacttcaagatt

SEQ ID NO: 270679 - DNA, 25 bp, Mus musculus
atgtcgagggtcactttatctgcag

SEQ ID NO: 270680 - DNA, 25 bp, Mus musculus
atgtcgagggtctctttatctgcag

SEQ ID NO: 270681 - DNA, 25 bp, Mus musculus
atgtcgagtctacagagagctacca

SEQ ID NO: 270682 - DNA, 25 bp, Mus musculus
atgtcgagtctagagagagctacca

SEQ ID NO: 270683 - DNA, 25 bp, Mus musculus
atgtcgatctatcgctgtaactgtt

SEQ ID NO: 270684 - DNA, 25 bp, Mus musculus
atgtcgatctatggctgtaactgtt

SEQ ID NO: 270685 - DNA, 25 bp, Mus musculus
atgtcgatctttagctgaagagtat

SEQ ID NO: 270686 - DNA, 25 bp, Mus musculus
atgtcgatcttttgctgaagagtat

SEQ ID NO: 270687 - DNA, 25 bp, Mus musculus
atgtcgatgaggaggtcgcacccac

SEQ ID NO: 270688 - DNA, 25 bp, Mus musculus
atgtcgatgaggtggtcgcacccac

SEQ ID NO: 270689 - DNA, 25 bp, Mus musculus
atgtcgatgatgatggcttgctgga

SEQ ID NO: 270690 - DNA, 25 bp, Mus musculus
atgtcgatgatgttggcttgctgga

SEQ ID NO: 270691 - DNA, 25 bp, Mus musculus
atgtcgatgtacctctgtcacagtt

SEQ ID NO: 270692 - DNA, 25 bp, Mus musculus
atgtcgatgtacgtctgtcacagtt

SEQ ID NO: 270693 - DNA, 25 bp, Mus musculus
atgtcgcagaaaccgggcactgtgt

SEQ ID NO: 270694 - DNA, 25 bp, Mus musculus
atgtcgcagaaagcgggcactgtgt

SEQ ID NO: 270695 - DNA, 25 bp, Mus musculus
atgtcgcagacgagagggcagccat

SEQ ID NO: 270696 - DNA, 25 bp, Mus musculus
atgtcgcagacgtgagggcagccat

SEQ ID NO: 270697 - DNA, 25 bp, Mus musculus
atgtcgccatatcctgtatagtgat

SEQ ID NO: 270698 - DNA, 25 bp, Mus musculus
atgtcgccatatgctgtatagtgat

SEQ ID NO: 270699 - DNA, 25 bp, Mus musculus
atgtcgccatgccaaacccaaggtt

SEQ ID NO: 270700 - DNA, 25 bp, Mus musculus
atgtcgccatgcgaaacccaaggtt

SEQ ID NO: 270701 - DNA, 25 bp, Mus musculus
atgtcgcccttactgcggactcaga

SEQ ID NO: 270702 - DNA, 25 bp, Mus musculus
atgtcgcccttagtgcggactcaga

SEQ ID NO: 270703 - DNA, 25 bp, Mus musculus
atgtcgcctgtaaaaattgtacctg

SEQ ID NO: 270704 - DNA, 25 bp, Mus musculus
atgtcgcctgtataaattgtacctg

SEQ ID NO: 270705 - DNA, 25 bp, Mus musculus
atgtcgctatagaggttacgtttgc

SEQ ID NO: 270706 - DNA, 25 bp, Mus musculus
atgtcgctatagtggttacgtttgc

SEQ ID NO: 270707 - DNA, 25 bp, Mus musculus
atgtcgctcagtcgagagtgcttgc

SEQ ID NO: 270708 - DNA, 25 bp, Mus musculus
atgtcgctcagtggagagtgcttgc

SEQ ID NO: 270709 - DNA, 25 bp, Mus musculus
atgtcgctctccaggcctggtgaga

SEQ ID NO: 270710 - DNA, 25 bp, Mus musculus
atgtcgctctcctggcctggtgaga

SEQ ID NO: 270711 - DNA, 25 bp, Mus musculus
atgtcgctgacacttttcactacag

SEQ ID NO: 270712 - DNA, 25 bp, Mus musculus
atgtcgctgacagttttcactacag

SEQ ID NO: 270713 - DNA, 25 bp, Mus musculus
atgtcgctgtagactgctgctttcc

SEQ ID NO: 270714 - DNA, 25 bp, Mus musculus
atgtcgctgtagtctgctgctttcc

SEQ ID NO: 270715 - DNA, 25 bp, Mus musculus
atgtcgctgtgacttcctggttcaa

SEQ ID NO: 270716 - DNA, 25 bp, Mus musculus
atgtcgctgtgagttcctggttcaa

SEQ ID NO: 270717 - DNA, 25 bp, Mus musculus
atgtcgctgtttcagaacttcacct

SEQ ID NO: 270718 - DNA, 25 bp, Mus musculus
atgtcgctgtttgagaacttcacct

SEQ ID NO: 270719 - DNA, 25 bp, Mus musculus
atgtcgcttggaatgaggctgctgt

SEQ ID NO: 270720 - DNA, 25 bp, Mus musculus
atgtcgcttggattgaggctgctgt

SEQ ID NO: 270721 - DNA, 25 bp, Mus musculus
atgtcgcttttgatctcatgtaaca

SEQ ID NO: 270722 - DNA, 25 bp, Mus musculus
atgtcgcttttgttctcatgtaaca

SEQ ID NO: 270723 - DNA, 25 bp, Mus musculus
atgtcggaccatagcggcctgcaat

SEQ ID NO: 270724 - DNA, 25 bp, Mus musculus
atgtcggaccattgcggcctgcaat

SEQ ID NO: 270725 - DNA, 25 bp, Mus musculus
atgtcggaccggaacaagctctggg

SEQ ID NO: 270726 - DNA, 25 bp, Mus musculus
atgtcggaccggtacaagctctggg

SEQ ID NO: 270727 - DNA, 25 bp, Mus musculus
atgtcggactccctggtggtgtgtg

SEQ ID NO: 270728 - DNA, 25 bp, Mus musculus
atgtcggactccgtggtggtgtgtg

SEQ ID NO: 270729 - DNA, 25 bp, Mus musculus
atgtcggacttgatgtactcttgct

SEQ ID NO: 270730 - DNA, 25 bp, Mus musculus
atgtcggacttgttgtactcttgct

SEQ ID NO: 270731 - DNA, 25 bp, Mus musculus
atgtcggcagctatcggtctaggaa

SEQ ID NO: 270732 - DNA, 25 bp, Mus musculus
atgtcggcagctttcggtctaggaa

SEQ ID NO: 270733 - DNA, 25 bp, Mus musculus
atgtcggcataccagagtgcatcaa

SEQ ID NO: 270734 - DNA, 25 bp, Mus musculus
atgtcggcatacgagagtgcatcaa

SEQ ID NO: 270735 - DNA, 25 bp, Mus musculus
atgtcggcccaaatcagagtaactc

SEQ ID NO: 270736 - DNA, 25 bp, Mus musculus
atgtcggcccaattcagagtaactc

SEQ ID NO: 270737 - DNA, 25 bp, Mus musculus
atgtcggccctgcaagggctctaac

SEQ ID NO: 270738 - DNA, 25 bp, Mus musculus
atgtcggccctggaagggctctaac

SEQ ID NO: 270739 - DNA, 25 bp, Mus musculus
atgtcggcgaacactatccacatga

SEQ ID NO: 270740 - DNA, 25 bp, Mus musculus
atgtcggcgaactctatccacatga

SEQ ID NO: 270741 - DNA, 25 bp, Mus musculus
atgtcggcttgaatctagcatctcc

SEQ ID NO: 270742 - DNA, 25 bp, Mus musculus
atgtcggcttgattctagcatctcc

SEQ ID NO: 270743 - DNA, 25 bp, Mus musculus
atgtcgggattaaggtcagcatcac

SEQ ID NO: 270744 - DNA, 25 bp, Mus musculus
atgtcgggattatggtcagcatcac

SEQ ID NO: 270745 - DNA, 25 bp, Mus musculus
atgtcgggcactatcacacttgtag

SEQ ID NO: 270746 - DNA, 25 bp, Mus musculus
atgtcgggcactttcacacttgtag

SEQ ID NO: 270747 - DNA, 25 bp, Mus musculus
atgtcgggttctactagcgtcgccg

SEQ ID NO: 270748 - DNA, 25 bp, Mus musculus
atgtcgggttcttctagcgtcgccg

SEQ ID NO: 270749 - DNA, 25 bp, Mus musculus
atgtcggtgcagcagccggacccac

SEQ ID NO: 270750 - DNA, 25 bp, Mus musculus
atgtcggtgcaggagccggacccac

SEQ ID NO: 270751 - DNA, 25 bp, Mus musculus
atgtcggttgatacctttgtgaaca

SEQ ID NO: 270752 - DNA, 25 bp, Mus musculus
atgtcggttgattcctttgtgaaca

SEQ ID NO: 270753 - DNA, 25 bp, Mus musculus
atgtcgtatccgcaggagagctata

SEQ ID NO: 270754 - DNA, 25 bp, Mus musculus
atgtcgtatccggaggagagctata

SEQ ID NO: 270755 - DNA, 25 bp, Mus musculus
atgtcgtcatgtacctctactatgg

SEQ ID NO: 270756 - DNA, 25 bp, Mus musculus
atgtcgtcatgttcctctactatgg

SEQ ID NO: 270757 - DNA, 25 bp, Mus musculus
atgtcgtccattctagtctcaaact

SEQ ID NO: 270758 - DNA, 25 bp, Mus musculus
atgtcgtccattgtagtctcaaact

SEQ ID NO: 270759 - DNA, 25 bp, Mus musculus
atgtcgtccttaccgtttaccacag

SEQ ID NO: 270760 - DNA, 25 bp, Mus musculus
atgtcgtccttagcgtttaccacag

SEQ ID NO: 270761 - DNA, 25 bp, Mus musculus
atgtcgtcgaagatggtgcaggcct

SEQ ID NO: 270762 - DNA, 25 bp, Mus musculus
atgtcgtcgaagttggtgcaggcct

SEQ ID NO: 270763 - DNA, 25 bp, Mus musculus
atgtcgtctacacgttggcaagttc

SEQ ID NO: 270764 - DNA, 25 bp, Mus musculus
atgtcgtctacactcggctcctggg

SEQ ID NO: 270765 - DNA, 25 bp, Mus musculus
atgtcgtctacaggttggcaagttc

SEQ ID NO: 270766 - DNA, 25 bp, Mus musculus
atgtcgtctacagtcggctcctggg

SEQ ID NO: 270767 - DNA, 25 bp, Mus musculus
atgtcgtctgtaattattgccattt

SEQ ID NO: 270768 - DNA, 25 bp, Mus musculus
atgtcgtctgtatttattgccattt

SEQ ID NO: 270769 - DNA, 25 bp, Mus musculus
atgtcgtcttccatgaacctgcatg

SEQ ID NO: 270770 - DNA, 25 bp, Mus musculus
atgtcgtcttccttgaacctgcatg

SEQ ID NO: 270771 - DNA, 25 bp, Mus musculus
atgtcgtggacaactcccacttttt

SEQ ID NO: 270772 - DNA, 25 bp, Mus musculus
atgtcgtggacatctcccacttttt

SEQ ID NO: 270773 - DNA, 25 bp, Mus musculus
atgtcgtggccaacataggtaccca

SEQ ID NO: 270774 - DNA, 25 bp, Mus musculus
atgtcgtggccatcataggtaccca

SEQ ID NO: 270775 - DNA, 25 bp, Mus musculus
atgtcgtggcggaaccctgcatcct

SEQ ID NO: 270776 - DNA, 25 bp, Mus musculus
atgtcgtggcggtaccctgcatcct

SEQ ID NO: 270777 - DNA, 25 bp, Mus musculus
atgtcgtggtctccctctattatta

SEQ ID NO: 270778 - DNA, 25 bp, Mus musculus
atgtcgtggtctgcctctattatta

SEQ ID NO: 270779 - DNA, 25 bp, Mus musculus
atgtcgtggtttctaagatgcccgg

SEQ ID NO: 270780 - DNA, 25 bp, Mus musculus
atgtcgtggtttgtaagatgcccgg

SEQ ID NO: 270781 - DNA, 25 bp, Mus musculus
atgtcgtgtccaagtgaatggccac

SEQ ID NO: 270782 - DNA, 25 bp, Mus musculus
atgtcgtgtccatgtgaatggccac

SEQ ID NO: 270783 - DNA, 25 bp, Mus musculus
atgtcgttgattctcttcagcgttt

SEQ ID NO: 270784 - DNA, 25 bp, Mus musculus
atgtcgttgattgtcttcagcgttt

SEQ ID NO: 270785 - DNA, 25 bp, Mus musculus
atgtctaaaaatagcccctcctcag

SEQ ID NO: 270786 - DNA, 25 bp, Mus musculus
atgtctaaaaattgcccctcctcag

SEQ ID NO: 270787 - DNA, 25 bp, Mus musculus
atgtctaacacactcccggaggtgg

SEQ ID NO: 270788 - DNA, 25 bp, Mus musculus
atgtctaacacagtcccggaggtgg

SEQ ID NO: 270789 - DNA, 25 bp, Mus musculus
atgtctaacaggaagtgtcccgttc

SEQ ID NO: 270790 - DNA, 25 bp, Mus musculus
atgtctaacaggtagtgtcccgttc

SEQ ID NO: 270791 - DNA, 25 bp, Mus musculus
atgtctaagaagaccaccactgcct

SEQ ID NO: 270792 - DNA, 25 bp, Mus musculus
atgtctaagaagtccaccactgcct

SEQ ID NO: 270793 - DNA, 25 bp, Mus musculus
atgtctaagaccatcaaggaaggca

SEQ ID NO: 270794 - DNA, 25 bp, Mus musculus
atgtctaagaccttcaaggaaggca

SEQ ID NO: 270795 - DNA, 25 bp, Mus musculus
atgtctaagagcatgcccggcccct

SEQ ID NO: 270796 - DNA, 25 bp, Mus musculus
atgtctaagagcttgcccggcccct

SEQ ID NO: 270797 - DNA, 25 bp, Mus musculus
atgtctaagcatccgctcattcata

SEQ ID NO: 270798 - DNA, 25 bp, Mus musculus
atgtctaagcatctcgagtcaggtt

SEQ ID NO: 270799 - DNA, 25 bp, Mus musculus
atgtctaagcatgcgctcattcata

SEQ ID NO: 270800 - DNA, 25 bp, Mus musculus
atgtctaagcatgtcgagtcaggtt

SEQ ID NO: 270801 - DNA, 25 bp, Mus musculus
atgtctacaatgactcccgcgtttc

SEQ ID NO: 270802 - DNA, 25 bp, Mus musculus
atgtctacaatgtctcccgcgtttc

SEQ ID NO: 270803 - DNA, 25 bp, Mus musculus
atgtctacaccacgtcattttgctg

SEQ ID NO: 270804 - DNA, 25 bp, Mus musculus
atgtctacaccaggtcattttgctg

SEQ ID NO: 270805 - DNA, 25 bp, Mus musculus
atgtctacagggagtgccagcagct

SEQ ID NO: 270806 - DNA, 25 bp, Mus musculus
atgtctacagggtgtgccagcagct

SEQ ID NO: 270807 - DNA, 25 bp, Mus musculus
atgtctacatcaaacaccctgtttc

SEQ ID NO: 270808 - DNA, 25 bp, Mus musculus
atgtctacatcactgcattttaatg

SEQ ID NO: 270809 - DNA, 25 bp, Mus musculus
atgtctacatcagtgcattttaatg

SEQ ID NO: 270810 - DNA, 25 bp, Mus musculus
atgtctacatcatacaccctgtttc

SEQ ID NO: 270811 - DNA, 25 bp, Mus musculus
atgtctaccacaagatacagccgac

SEQ ID NO: 270812 - DNA, 25 bp, Mus musculus
atgtctaccacatgatacagccgac

SEQ ID NO: 270813 - DNA, 25 bp, Mus musculus
atgtctacccatagccatgaactgt

SEQ ID NO: 270814 - DNA, 25 bp, Mus musculus
atgtctacccatcctcttaagcgtt

SEQ ID NO: 270815 - DNA, 25 bp, Mus musculus
atgtctacccatctatttgtgagaa

SEQ ID NO: 270816 - DNA, 25 bp, Mus musculus
atgtctacccatgctcttaagcgtt

SEQ ID NO: 270817 - DNA, 25 bp, Mus musculus
atgtctacccatgtatttgtgagaa

SEQ ID NO: 270818 - DNA, 25 bp, Mus musculus
atgtctacccattgccatgaactgt

SEQ ID NO: 270819 - DNA, 25 bp, Mus musculus
atgtctacctgaaggagcccgcact

SEQ ID NO: 270820 - DNA, 25 bp, Mus musculus
atgtctacctgatggagcccgcact

SEQ ID NO: 270821 - DNA, 25 bp, Mus musculus
atgtctacgagcacatcaaccaggg

SEQ ID NO: 270822 - DNA, 25 bp, Mus musculus
atgtctacgagctcatcaaccaggg

SEQ ID NO: 270823 - DNA, 25 bp, Mus musculus
atgtctacgtaaagagcccctctaa

SEQ ID NO: 270824 - DNA, 25 bp, Mus musculus
atgtctacgtaatgagcccctctaa

SEQ ID NO: 270825 - DNA, 25 bp, Mus musculus
atgtctactaccagcaggtgactca

SEQ ID NO: 270826 - DNA, 25 bp, Mus musculus
atgtctactacctgcaggtgactca

SEQ ID NO: 270827 - DNA, 25 bp, Mus musculus
atgtctactcgcaggtgggtaccgt

SEQ ID NO: 270828 - DNA, 25 bp, Mus musculus
atgtctactcgctggtgggtaccgt

SEQ ID NO: 270829 - DNA, 25 bp, Mus musculus
atgtctactcttcagagctcctaag

SEQ ID NO: 270830 - DNA, 25 bp, Mus musculus
atgtctactcttgagagctcctaag

SEQ ID NO: 270831 - DNA, 25 bp, Mus musculus
atgtctactgctaatgagatctcta

SEQ ID NO: 270832 - DNA, 25 bp, Mus musculus
atgtctactgcttatgagatctcta

SEQ ID NO: 270833 - DNA, 25 bp, Mus musculus
atgtctactgttcttaggtttctgt

SEQ ID NO: 270834 - DNA, 25 bp, Mus musculus
atgtctactgttgttaggtttctgt

SEQ ID NO: 270835 - DNA, 25 bp, Mus musculus
atgtctacttttctcacttcaggga

SEQ ID NO: 270836 - DNA, 25 bp, Mus musculus
atgtctacttttgtcacttcaggga

SEQ ID NO: 270837 - DNA, 25 bp, Mus musculus
atgtctagaataccagtgtgctcag

SEQ ID NO: 270838 - DNA, 25 bp, Mus musculus
atgtctagaatagcagtgtgctcag

SEQ ID NO: 270839 - DNA, 25 bp, Mus musculus
atgtctagaattctctgccagatac

SEQ ID NO: 270840 - DNA, 25 bp, Mus musculus
atgtctagaattgtctgccagatac

SEQ ID NO: 270841 - DNA, 25 bp, Mus musculus
atgtctagagagcacctgccttacc

SEQ ID NO: 270842 - DNA, 25 bp, Mus musculus
atgtctagagaggacctgccttacc

SEQ ID NO: 270843 - DNA, 25 bp, Mus musculus
atgtctaggtgtatgcatccagaga

SEQ ID NO: 270844 - DNA, 25 bp, Mus musculus
atgtctaggtgtttgcatccagaga

SEQ ID NO: 270845 - DNA, 25 bp, Mus musculus
atgtctagtagaccccagagtttga

SEQ ID NO: 270846 - DNA, 25 bp, Mus musculus
atgtctagtagagcccagagtttga

SEQ ID NO: 270847 - DNA, 25 bp, Mus musculus
atgtctagtccactgagggtgccat

SEQ ID NO: 270848 - DNA, 25 bp, Mus musculus
atgtctagtccagtgagggtgccat

SEQ ID NO: 270849 - DNA, 25 bp, Mus musculus
atgtctatagagacaacttgtgctg

SEQ ID NO: 270850 - DNA, 25 bp, Mus musculus
atgtctatagagtcaacttgtgctg

SEQ ID NO: 270851 - DNA, 25 bp, Mus musculus
atgtctatataactccaggccaatt

SEQ ID NO: 270852 - DNA, 25 bp, Mus musculus
atgtctatataagtccaggccaatt

SEQ ID NO: 270853 - DNA, 25 bp, Mus musculus
atgtctatatacacccagaataagg

SEQ ID NO: 270854 - DNA, 25 bp, Mus musculus
atgtctatatactcccagaataagg

SEQ ID NO: 270855 - DNA, 25 bp, Mus musculus
atgtctatatccatgaaaccccagc

SEQ ID NO: 270856 - DNA, 25 bp, Mus musculus
atgtctatatccttgaaaccccagc

SEQ ID NO: 270857 - DNA, 25 bp, Mus musculus
atgtctatatttattctatcttctg

SEQ ID NO: 270858 - DNA, 25 bp, Mus musculus
atgtctatattttttctatcttctg

SEQ ID NO: 270859 - DNA, 25 bp, Mus musculus
atgtctatcagcagcacctctgatt

SEQ ID NO: 270860 - DNA, 25 bp, Mus musculus
atgtctatcagctgcacctctgatt

SEQ ID NO: 270861 - DNA, 25 bp, Mus musculus
atgtctatcattaagccaacaactg

SEQ ID NO: 270862 - DNA, 25 bp, Mus musculus
atgtctatcatttagccaacaactg

SEQ ID NO: 270863 - DNA, 25 bp, Mus musculus
atgtctatctgcatgttgctgtgct

SEQ ID NO: 270864 - DNA, 25 bp, Mus musculus
atgtctatctgcttgttgctgtgct

SEQ ID NO: 270865 - DNA, 25 bp, Mus musculus
atgtctatgactcctaatctctttc

SEQ ID NO: 270866 - DNA, 25 bp, Mus musculus
atgtctatgactgctaatctctttc

SEQ ID NO: 270867 - DNA, 25 bp, Mus musculus
atgtctatgaggcattgtcctgatt

SEQ ID NO: 270868 - DNA, 25 bp, Mus musculus
atgtctatgagggattgtcctgatt

SEQ ID NO: 270869 - DNA, 25 bp, Mus musculus
atgtctatgtgacggagccagatac

SEQ ID NO: 270870 - DNA, 25 bp, Mus musculus
atgtctatgtgagggagccagatac

SEQ ID NO: 270871 - DNA, 25 bp, Mus musculus
atgtctattatacccttttctagtt

SEQ ID NO: 270872 - DNA, 25 bp, Mus musculus
atgtctattatagccttttctagtt

SEQ ID NO: 270873 - DNA, 25 bp, Mus musculus
atgtctattcttatgctctggagtt

SEQ ID NO: 270874 - DNA, 25 bp, Mus musculus
atgtctattcttttgctctggagtt

SEQ ID NO: 270875 - DNA, 25 bp, Mus musculus
atgtctattggcatcaccttcatgg

SEQ ID NO: 270876 - DNA, 25 bp, Mus musculus
atgtctattggcttcaccttcatgg

SEQ ID NO: 270877 - DNA, 25 bp, Mus musculus
atgtctattggtaatttcctgccaa

SEQ ID NO: 270878 - DNA, 25 bp, Mus musculus
atgtctattggttatttcctgccaa

SEQ ID NO: 270879 - DNA, 25 bp, Mus musculus
atgtctatttttcttgatcgcagag

SEQ ID NO: 270880 - DNA, 25 bp, Mus musculus
atgtctatttttgttgatcgcagag

SEQ ID NO: 270881 - DNA, 25 bp, Mus musculus
atgtctcaactgctactttgaccct

SEQ ID NO: 270882 - DNA, 25 bp, Mus musculus
atgtctcaactggtactttgaccct

SEQ ID NO: 270883 - DNA, 25 bp, Mus musculus
atgtctcaagctatttgtcccttag

SEQ ID NO: 270884 - DNA, 25 bp, Mus musculus
atgtctcaagctccgctggtcaaga

SEQ ID NO: 270885 - DNA, 25 bp, Mus musculus
atgtctcaagctgcgctggtcaaga

SEQ ID NO: 270886 - DNA, 25 bp, Mus musculus
atgtctcaagctttttgtcccttag

SEQ ID NO: 270887 - DNA, 25 bp, Mus musculus
atgtctcacagacaggtccaatcct

SEQ ID NO: 270888 - DNA, 25 bp, Mus musculus
atgtctcacagagaggtccaatcct

SEQ ID NO: 270889 - DNA, 25 bp, Mus musculus
atgtctcaccttcctgtctctgaca

SEQ ID NO: 270890 - DNA, 25 bp, Mus musculus
atgtctcaccttgctgtctctgaca

SEQ ID NO: 270891 - DNA, 25 bp, Mus musculus
atgtctcagagtaggttcatcctct

SEQ ID NO: 270892 - DNA, 25 bp, Mus musculus
atgtctcagagttggttcatcctct

SEQ ID NO: 270893 - DNA, 25 bp, Mus musculus
atgtctcagcaacgtgtaagcttgt

SEQ ID NO: 270894 - DNA, 25 bp, Mus musculus
atgtctcagcaaggtgtaagcttgt

SEQ ID NO: 270895 - DNA, 25 bp, Mus musculus
atgtctcagggtaaaagacacacac

SEQ ID NO: 270896 - DNA, 25 bp, Mus musculus
atgtctcagggttaaagacacacac

SEQ ID NO: 270897 - DNA, 25 bp, Mus musculus
atgtctcagtctaggttcggtacaa

SEQ ID NO: 270898 - DNA, 25 bp, Mus musculus
atgtctcagtcttggttcggtacaa

SEQ ID NO: 270899 - DNA, 25 bp, Mus musculus
atgtctcatcttcctcaagttcaga

SEQ ID NO: 270900 - DNA, 25 bp, Mus musculus
atgtctcatcttgctcaagttcaga

SEQ ID NO: 270901 - DNA, 25 bp, Mus musculus
atgtctcattctacactggagcaga

SEQ ID NO: 270902 - DNA, 25 bp, Mus musculus
atgtctcattcttcactggagcaga

SEQ ID NO: 270903 - DNA, 25 bp, Mus musculus
atgtctccaacgacagtggcatcta

SEQ ID NO: 270904 - DNA, 25 bp, Mus musculus
atgtctccaacgtcagtggcatcta

SEQ ID NO: 270905 - DNA, 25 bp, Mus musculus
atgtctccaactatacatcatgtgg

SEQ ID NO: 270906 - DNA, 25 bp, Mus musculus
atgtctccaactttacatcatgtgg

SEQ ID NO: 270907 - DNA, 25 bp, Mus musculus
atgtctccactgatgattcgtgttt

SEQ ID NO: 270908 - DNA, 25 bp, Mus musculus
atgtctccactgttgattcgtgttt

SEQ ID NO: 270909 - DNA, 25 bp, Mus musculus
atgtctccagagacatgcagaaagt

SEQ ID NO: 270910 - DNA, 25 bp, Mus musculus
atgtctccagagtcatgcagaaagt

SEQ ID NO: 270911 - DNA, 25 bp, Mus musculus
atgtctccagcaaagggtcagaagc

SEQ ID NO: 270912 - DNA, 25 bp, Mus musculus
atgtctccagcatagggtcagaagc

SEQ ID NO: 270913 - DNA, 25 bp, Mus musculus
atgtctccaggccatgggatttgtg

SEQ ID NO: 270914 - DNA, 25 bp, Mus musculus
atgtctccaggcgatgggatttgtg

SEQ ID NO: 270915 - DNA, 25 bp, Mus musculus
atgtctccagtcaattctgctgatt

SEQ ID NO: 270916 - DNA, 25 bp, Mus musculus
atgtctccagtctattctgctgatt

SEQ ID NO: 270917 - DNA, 25 bp, Mus musculus
atgtctccataaacccaaaggcctg

SEQ ID NO: 270918 - DNA, 25 bp, Mus musculus
atgtctccataatcccaaaggcctg

SEQ ID NO: 270919 - DNA, 25 bp, Mus musculus
atgtctccatatcctctggagcatt

SEQ ID NO: 270920 - DNA, 25 bp, Mus musculus
atgtctccatatgctctggagcatt

SEQ ID NO: 270921 - DNA, 25 bp, Mus musculus
atgtctccatccccagacagacaga

SEQ ID NO: 270922 - DNA, 25 bp, Mus musculus
atgtctccatccgcagacagacaga

SEQ ID NO: 270923 - DNA, 25 bp, Mus musculus
atgtctccatttcgttcctgggact

SEQ ID NO: 270924 - DNA, 25 bp, Mus musculus
atgtctccatttggttcctgggact

SEQ ID NO: 270925 - DNA, 25 bp, Mus musculus
atgtctcccaaaaattctcattcca

SEQ ID NO: 270926 - DNA, 25 bp, Mus musculus
atgtctcccaaatattctcattcca

SEQ ID NO: 270927 - DNA, 25 bp, Mus musculus
atgtctcccaataactaggatttaa

SEQ ID NO: 270928 - DNA, 25 bp, Mus musculus
atgtctcccaattactaggatttaa

SEQ ID NO: 270929 - DNA, 25 bp, Mus musculus
atgtctcccacccatctaatcttta

SEQ ID NO: 270930 - DNA, 25 bp, Mus musculus
atgtctcccaccgatctaatcttta

SEQ ID NO: 270931 - DNA, 25 bp, Mus musculus
atgtctcctcaaaaaatatcttaaa

SEQ ID NO: 270932 - DNA, 25 bp, Mus musculus
atgtctcctcaataaatatcttaaa

SEQ ID NO: 270933 - DNA, 25 bp, Mus musculus
atgtctcctccactgagacttaaat

SEQ ID NO: 270934 - DNA, 25 bp, Mus musculus
atgtctcctccagtgagacttaaat

SEQ ID NO: 270935 - DNA, 25 bp, Mus musculus
atgtctcctctcagtgcgtgtgtgt

SEQ ID NO: 270936 - DNA, 25 bp, Mus musculus
atgtctcctctctgtgcgtgtgtgt

SEQ ID NO: 270937 - DNA, 25 bp, Mus musculus
atgtctcctgctatgatttgtatca

SEQ ID NO: 270938 - DNA, 25 bp, Mus musculus
atgtctcctgctttgatttgtatca

SEQ ID NO: 270939 - DNA, 25 bp, Mus musculus
atgtctcctgtccatggtggatgag

SEQ ID NO: 270940 - DNA, 25 bp, Mus musculus
atgtctcctgtcgatggtggatgag

SEQ ID NO: 270941 - DNA, 25 bp, Mus musculus
atgtctccttaaagttttatcctat

SEQ ID NO: 270942 - DNA, 25 bp, Mus musculus
atgtctccttaatgttttatcctat

SEQ ID NO: 270943 - DNA, 25 bp, Mus musculus
atgtctccttgtatttcatactctc

SEQ ID NO: 270944 - DNA, 25 bp, Mus musculus
atgtctccttgtttttcatactctc

SEQ ID NO: 270945 - DNA, 25 bp, Mus musculus
atgtctcgaaggcttttgttctcac

SEQ ID NO: 270946 - DNA, 25 bp, Mus musculus
atgtctcgaagggttttgttctcac

SEQ ID NO: 270947 - DNA, 25 bp, Mus musculus
atgtctcgcctgctgctactctgct

SEQ ID NO: 270948 - DNA, 25 bp, Mus musculus
atgtctcgcctggtgctactctgct

SEQ ID NO: 270949 - DNA, 25 bp, Mus musculus
atgtctctagcaccaatgccactga

SEQ ID NO: 270950 - DNA, 25 bp, Mus musculus
atgtctctagcagcaatgccactga

SEQ ID NO: 270951 - DNA, 25 bp, Mus musculus
atgtctctataacaattctggtttg

SEQ ID NO: 270952 - DNA, 25 bp, Mus musculus
atgtctctataagaattctggtttg

SEQ ID NO: 270953 - DNA, 25 bp, Mus musculus
atgtctctatgaacgtatgcagtgt

SEQ ID NO: 270954 - DNA, 25 bp, Mus musculus
atgtctctatgatcgtatgcagtgt

SEQ ID NO: 270955 - DNA, 25 bp, Mus musculus
atgtctctcccaaggatcatgttcc

SEQ ID NO: 270956 - DNA, 25 bp, Mus musculus
atgtctctcccatggatcatgttcc

SEQ ID NO: 270957 - DNA, 25 bp, Mus musculus
atgtctctcccgcatagcaagacaa

SEQ ID NO: 270958 - DNA, 25 bp, Mus musculus
atgtctctcccggatagcaagacaa

SEQ ID NO: 270959 - DNA, 25 bp, Mus musculus
atgtctctcctaagcgtcaagtgga

SEQ ID NO: 270960 - DNA, 25 bp, Mus musculus
atgtctctcctatgcgtcaagtgga

SEQ ID NO: 270961 - DNA, 25 bp, Mus musculus
atgtctctccttagttataacgtag

SEQ ID NO: 270962 - DNA, 25 bp, Mus musculus
atgtctctcctttgttataacgtag

SEQ ID NO: 270963 - DNA, 25 bp, Mus musculus
atgtctctcgctactgatggtggca

SEQ ID NO: 270964 - DNA, 25 bp, Mus musculus
atgtctctcgcttctgatggtggca

SEQ ID NO: 270965 - DNA, 25 bp, Mus musculus
atgtctctctccagggtgttggaag

SEQ ID NO: 270966 - DNA, 25 bp, Mus musculus
atgtctctctcctgggtgttggaag

SEQ ID NO: 270967 - DNA, 25 bp, Mus musculus
atgtctctctggatccacaagatac

SEQ ID NO: 270968 - DNA, 25 bp, Mus musculus
atgtctctctggttccacaagatac

SEQ ID NO: 270969 - DNA, 25 bp, Mus musculus
atgtctctcttccaggtcaatggca

SEQ ID NO: 270970 - DNA, 25 bp, Mus musculus
atgtctctcttcgaggtcaatggca

SEQ ID NO: 270971 - DNA, 25 bp, Mus musculus
atgtctctgaaaactttactcctct

SEQ ID NO: 270972 - DNA, 25 bp, Mus musculus
atgtctctgaaatctttactcctct

SEQ ID NO: 270973 - DNA, 25 bp, Mus musculus
atgtctctgataatgttggctggga

SEQ ID NO: 270974 - DNA, 25 bp, Mus musculus
atgtctctgatattgttggctggga

SEQ ID NO: 270975 - DNA, 25 bp, Mus musculus
atgtctctgcacattctgccattat

SEQ ID NO: 270976 - DNA, 25 bp, Mus musculus
atgtctctgcactttctgccattat

SEQ ID NO: 270977 - DNA, 25 bp, Mus musculus
atgtctctgctgatgcctgggtgat

SEQ ID NO: 270978 - DNA, 25 bp, Mus musculus
atgtctctgctgttgcctgggtgat

SEQ ID NO: 270979 - DNA, 25 bp, Mus musculus
atgtctctgggccaactcgggatgc

SEQ ID NO: 270980 - DNA, 25 bp, Mus musculus
atgtctctgggcgaactcgggatgc

SEQ ID NO: 270981 - DNA, 25 bp, Mus musculus
atgtctctgtcaaaggccaagtgcc

SEQ ID NO: 270982 - DNA, 25 bp, Mus musculus
atgtctctgtcaactatgtattcta

SEQ ID NO: 270983 - DNA, 25 bp, Mus musculus
atgtctctgtcataggccaagtgcc

SEQ ID NO: 270984 - DNA, 25 bp, Mus musculus
atgtctctgtcatctatgtattcta

SEQ ID NO: 270985 - DNA, 25 bp, Mus musculus
atgtctcttacccttctgatctctg

SEQ ID NO: 270986 - DNA, 25 bp, Mus musculus
atgtctcttaccgttctgatctctg

SEQ ID NO: 270987 - DNA, 25 bp, Mus musculus
atgtctcttatgacagcttcccaag

SEQ ID NO: 270988 - DNA, 25 bp, Mus musculus
atgtctcttatgtcagcttcccaag

SEQ ID NO: 270989 - DNA, 25 bp, Mus musculus
atgtctcttcatccaaaggtgttga

SEQ ID NO: 270990 - DNA, 25 bp, Mus musculus
atgtctcttcatgcaaaggtgttga

SEQ ID NO: 270991 - DNA, 25 bp, Mus musculus
atgtctcttgagcatcaatcttgtt

SEQ ID NO: 270992 - DNA, 25 bp, Mus musculus
atgtctcttgaggatcaatcttgtt

SEQ ID NO: 270993 - DNA, 25 bp, Mus musculus
atgtctcttggtctctttatgtgtc

SEQ ID NO: 270994 - DNA, 25 bp, Mus musculus
atgtctcttggtgtctttatgtgtc

SEQ ID NO: 270995 - DNA, 25 bp, Mus musculus
atgtctcttgtcctgcttctgagga

SEQ ID NO: 270996 - DNA, 25 bp, Mus musculus
atgtctcttgtcgtgcttctgagga

SEQ ID NO: 270997 - DNA, 25 bp, Mus musculus
atgtctcttgttcaccaactacgta

SEQ ID NO: 270998 - DNA, 25 bp, Mus musculus
atgtctcttgttgaccaactacgta

SEQ ID NO: 270999 - DNA, 25 bp, Mus musculus
atgtctctttctcaagctcgggcat

SEQ ID NO: 271000 - DNA, 25 bp, Mus musculus
atgtctctttctgaagctcgggcat

SEQ ID NO: 271001 - DNA, 25 bp, Mus musculus
atgtctctttgcaattttgtctgtt

SEQ ID NO: 271002 - DNA, 25 bp, Mus musculus
atgtctctttgctattttgtctgtt

SEQ ID NO: 271003 - DNA, 25 bp, Mus musculus
atgtctctttgtctcctggtgtttt

SEQ ID NO: 271004 - DNA, 25 bp, Mus musculus
atgtctctttgtgtcctggtgtttt

SEQ ID NO: 271005 - DNA, 25 bp, Mus musculus
atgtctgaaaacagtgatttcccca

SEQ ID NO: 271006 - DNA, 25 bp, Mus musculus
atgtctgaaaactgtgatttcccca

SEQ ID NO: 271007 - DNA, 25 bp, Mus musculus
atgtctgaacctacttttgatctga

SEQ ID NO: 271008 - DNA, 25 bp, Mus musculus
atgtctgaaccttcttttgatctga

SEQ ID NO: 271009 - DNA, 25 bp, Mus musculus
atgtctgaagctatgacctccttct

SEQ ID NO: 271010 - DNA, 25 bp, Mus musculus
atgtctgaagctttgacctccttct

SEQ ID NO: 271011 - DNA, 25 bp, Mus musculus
atgtctgaattgagtgtggtcccac

SEQ ID NO: 271012 - DNA, 25 bp, Mus musculus
atgtctgaattgtgtgtggtcccac

SEQ ID NO: 271013 - DNA, 25 bp, Mus musculus
atgtctgacaaacccgatatggctg

SEQ ID NO: 271014 - DNA, 25 bp, Mus musculus
atgtctgacaaagccgatatggctg

SEQ ID NO: 271015 - DNA, 25 bp, Mus musculus
atgtctgacagaccatctctccagt

SEQ ID NO: 271016 - DNA, 25 bp, Mus musculus
atgtctgacagagcatctctccagt

SEQ ID NO: 271017 - DNA, 25 bp, Mus musculus
atgtctgacggtcccgccgagaagc

SEQ ID NO: 271018 - DNA, 25 bp, Mus musculus
atgtctgacggtgccgccgagaagc

SEQ ID NO: 271019 - DNA, 25 bp, Mus musculus
atgtctgactatcaagccatttccc

SEQ ID NO: 271020 - DNA, 25 bp, Mus musculus
atgtctgactatgaagccatttccc

SEQ ID NO: 271021 - DNA, 25 bp, Mus musculus
atgtctgagccccaagggtggccct

SEQ ID NO: 271022 - DNA, 25 bp, Mus musculus
atgtctgagcccgaagggtggccct

SEQ ID NO: 271023 - DNA, 25 bp, Mus musculus
atgtctgagcctcctgccggcagag

SEQ ID NO: 271024 - DNA, 25 bp, Mus musculus
atgtctgagcctgctgccggcagag

SEQ ID NO: 271025 - DNA, 25 bp, Mus musculus
atgtctgagggcaagaggttgtcct

SEQ ID NO: 271026 - DNA, 25 bp, Mus musculus
atgtctgagggctagaggttgtcct

SEQ ID NO: 271027 - DNA, 25 bp, Mus musculus
atgtctgataccaatgaccttcaag

SEQ ID NO: 271028 - DNA, 25 bp, Mus musculus
atgtctgatacctatgaccttcaag

SEQ ID NO: 271029 - DNA, 25 bp, Mus musculus
atgtctgatgcacagcggttctcca

SEQ ID NO: 271030 - DNA, 25 bp, Mus musculus
atgtctgatgcagagcggttctcca

SEQ ID NO: 271031 - DNA, 25 bp, Mus musculus
atgtctgcaacgaagggagattcct

SEQ ID NO: 271032 - DNA, 25 bp, Mus musculus
atgtctgcaacgtagggagattcct

SEQ ID NO: 271033 - DNA, 25 bp, Mus musculus
atgtctgcacaaccaatgcaacgct

SEQ ID NO: 271034 - DNA, 25 bp, Mus musculus
atgtctgcacaagcaatgcaacgct

SEQ ID NO: 271035 - DNA, 25 bp, Mus musculus
atgtctgcagctcgtagacccacag

SEQ ID NO: 271036 - DNA, 25 bp, Mus musculus
atgtctgcagctggtagacccacag

SEQ ID NO: 271037 - DNA, 25 bp, Mus musculus
atgtctgcagtaactgctcactggg

SEQ ID NO: 271038 - DNA, 25 bp, Mus musculus
atgtctgcagtatctgctcactggg

SEQ ID NO: 271039 - DNA, 25 bp, Mus musculus
atgtctgcagtcactgttcagctct

SEQ ID NO: 271040 - DNA, 25 bp, Mus musculus
atgtctgcagtctctgttcagctct

SEQ ID NO: 271041 - DNA, 25 bp, Mus musculus
atgtctgcatggctggtggcatatt

SEQ ID NO: 271042 - DNA, 25 bp, Mus musculus
atgtctgcatgggtggtggcatatt

SEQ ID NO: 271043 - DNA, 25 bp, Mus musculus
atgtctgcattcactttagaagcca

SEQ ID NO: 271044 - DNA, 25 bp, Mus musculus
atgtctgcattctctttagaagcca

SEQ ID NO: 271045 - DNA, 25 bp, Mus musculus
atgtctgccagaaattattatgtgt

SEQ ID NO: 271046 - DNA, 25 bp, Mus musculus
atgtctgccagatattattatgtgt

SEQ ID NO: 271047 - DNA, 25 bp, Mus musculus
atgtctgccattattgcatcacttg

SEQ ID NO: 271048 - DNA, 25 bp, Mus musculus
atgtctgccatttttgcatcacttg

SEQ ID NO: 271049 - DNA, 25 bp, Mus musculus
atgtctgccctactgaatacatcct

SEQ ID NO: 271050 - DNA, 25 bp, Mus musculus
atgtctgccctagtgaatacatcct

SEQ ID NO: 271051 - DNA, 25 bp, Mus musculus
atgtctgccggtcattagccctgtg

SEQ ID NO: 271052 - DNA, 25 bp, Mus musculus
atgtctgccggtgattagccctgtg

SEQ ID NO: 271053 - DNA, 25 bp, Mus musculus
atgtctgcctgaacatcagttgtga

SEQ ID NO: 271054 - DNA, 25 bp, Mus musculus
atgtctgcctgatcatcagttgtga

SEQ ID NO: 271055 - DNA, 25 bp, Mus musculus
atgtctgcctgtaatcctgccatgt

SEQ ID NO: 271056 - DNA, 25 bp, Mus musculus
atgtctgcctgttatcctgccatgt

SEQ ID NO: 271057 - DNA, 25 bp, Mus musculus
atgtctgctacaatgagcttgtgca

SEQ ID NO: 271058 - DNA, 25 bp, Mus musculus
atgtctgctacattgagcttgtgca

SEQ ID NO: 271059 - DNA, 25 bp, Mus musculus
atgtctgctaggcttccagtaccct

SEQ ID NO: 271060 - DNA, 25 bp, Mus musculus
atgtctgctagggttccagtaccct

SEQ ID NO: 271061 - DNA, 25 bp, Mus musculus
atgtctgctattccaaatggagcat

SEQ ID NO: 271062 - DNA, 25 bp, Mus musculus
atgtctgctattgcaaatggagcat

SEQ ID NO: 271063 - DNA, 25 bp, Mus musculus
atgtctgctggtacatgccaggcac

SEQ ID NO: 271064 - DNA, 25 bp, Mus musculus
atgtctgctggttcatgccaggcac

SEQ ID NO: 271065 - DNA, 25 bp, Mus musculus
atgtctgctgtgcttgacatctggg

SEQ ID NO: 271066 - DNA, 25 bp, Mus musculus
atgtctgctgtggttgacatctggg

SEQ ID NO: 271067 - DNA, 25 bp, Mus musculus
atgtctgcttccatactgataaagt

SEQ ID NO: 271068 - DNA, 25 bp, Mus musculus
atgtctgcttccttactgataaagt

SEQ ID NO: 271069 - DNA, 25 bp, Mus musculus
atgtctgcttctagcgtttaagccc

SEQ ID NO: 271070 - DNA, 25 bp, Mus musculus
atgtctgcttcttgcgtttaagccc

SEQ ID NO: 271071 - DNA, 25 bp, Mus musculus
atgtctgcttgaagtgctctacacc

SEQ ID NO: 271072 - DNA, 25 bp, Mus musculus
atgtctgcttgatgtgctctacacc

SEQ ID NO: 271073 - DNA, 25 bp, Mus musculus
atgtctgcttgcagatttaccattg

SEQ ID NO: 271074 - DNA, 25 bp, Mus musculus
atgtctgcttgctgatttaccattg

SEQ ID NO: 271075 - DNA, 25 bp, Mus musculus
atgtctgctttgactgacaaggcca

SEQ ID NO: 271076 - DNA, 25 bp, Mus musculus
atgtctgctttgtctgacaaggcca

SEQ ID NO: 271077 - DNA, 25 bp, Mus musculus
atgtctggacctcgttcctgcttgg

SEQ ID NO: 271078 - DNA, 25 bp, Mus musculus
atgtctggacctggttcctgcttgg

SEQ ID NO: 271079 - DNA, 25 bp, Mus musculus
atgtctggactcattggttccatct

SEQ ID NO: 271080 - DNA, 25 bp, Mus musculus
atgtctggactctttggttccatct

SEQ ID NO: 271081 - DNA, 25 bp, Mus musculus
atgtctggagccaacacatagtgta

SEQ ID NO: 271082 - DNA, 25 bp, Mus musculus
atgtctggagccacggcatcaccat

SEQ ID NO: 271083 - DNA, 25 bp, Mus musculus
atgtctggagccagcgggtgcaaac

SEQ ID NO: 271084 - DNA, 25 bp, Mus musculus
atgtctggagcctacacatagtgta

SEQ ID NO: 271085 - DNA, 25 bp, Mus musculus
atgtctggagcctcggcatcaccat

SEQ ID NO: 271086 - DNA, 25 bp, Mus musculus
atgtctggagcctgcgggtgcaaac

SEQ ID NO: 271087 - DNA, 25 bp, Mus musculus
atgtctggatctactggacagcttc

SEQ ID NO: 271088 - DNA, 25 bp, Mus musculus
atgtctggatcttctggacagcttc

SEQ ID NO: 271089 - DNA, 25 bp, Mus musculus
atgtctggcacaatgcaatcctcaa

SEQ ID NO: 271090 - DNA, 25 bp, Mus musculus
atgtctggcacattgcaatcctcaa

SEQ ID NO: 271091 - DNA, 25 bp, Mus musculus
atgtctggcagcacccacagtggga

SEQ ID NO: 271092 - DNA, 25 bp, Mus musculus
atgtctggcagctcccacagtggga

SEQ ID NO: 271093 - DNA, 25 bp, Mus musculus
atgtctggcattacagatacctagg

SEQ ID NO: 271094 - DNA, 25 bp, Mus musculus
atgtctggcatttcagatacctagg

SEQ ID NO: 271095 - DNA, 25 bp, Mus musculus
atgtctggccccagagcaagtgcta

SEQ ID NO: 271096 - DNA, 25 bp, Mus musculus
atgtctggcccctgagcaagtgcta

SEQ ID NO: 271097 - DNA, 25 bp, Mus musculus
atgtctggcctgattagatgcctgc

SEQ ID NO: 271098 - DNA, 25 bp, Mus musculus
atgtctggcctgtttagatgcctgc

SEQ ID NO: 271099 - DNA, 25 bp, Mus musculus
atgtctggctctaagagtgccacat

SEQ ID NO: 271100 - DNA, 25 bp, Mus musculus
atgtctggctcttagagtgccacat

SEQ ID NO: 271101 - DNA, 25 bp, Mus musculus
atgtctgggaaccacttgcttttct

SEQ ID NO: 271102 - DNA, 25 bp, Mus musculus
atgtctgggaacgacttgcttttct

SEQ ID NO: 271103 - DNA, 25 bp, Mus musculus
atgtctgggactctctgaagtgcga

SEQ ID NO: 271104 - DNA, 25 bp, Mus musculus
atgtctgggactgtctgaagtgcga

SEQ ID NO: 271105 - DNA, 25 bp, Mus musculus
atgtctgggcaaatggctgtgtgtt

SEQ ID NO: 271106 - DNA, 25 bp, Mus musculus
atgtctgggcaattggctgtgtgtt

SEQ ID NO: 271107 - DNA, 25 bp, Mus musculus
atgtctgggcgtagaggatttgttc

SEQ ID NO: 271108 - DNA, 25 bp, Mus musculus
atgtctgggcgttgaggatttgttc

SEQ ID NO: 271109 - DNA, 25 bp, Mus musculus
atgtctgggtctatatatctgtgtg

SEQ ID NO: 271110 - DNA, 25 bp, Mus musculus
atgtctgggtctatggagtagtaac

SEQ ID NO: 271111 - DNA, 25 bp, Mus musculus
atgtctgggtctttatatctgtgtg

SEQ ID NO: 271112 - DNA, 25 bp, Mus musculus
atgtctgggtctttggagtagtaac

SEQ ID NO: 271113 - DNA, 25 bp, Mus musculus
atgtctgggtttaagctacctcgtt

SEQ ID NO: 271114 - DNA, 25 bp, Mus musculus
atgtctgggtttactctgcttcaat

SEQ ID NO: 271115 - DNA, 25 bp, Mus musculus
atgtctgggttttagctacctcgtt

SEQ ID NO: 271116 - DNA, 25 bp, Mus musculus
atgtctgggttttctctgcttcaat

SEQ ID NO: 271117 - DNA, 25 bp, Mus musculus
atgtctggtctccttggctgcaaag

SEQ ID NO: 271118 - DNA, 25 bp, Mus musculus
atgtctggtctcgttggctgcaaag

SEQ ID NO: 271119 - DNA, 25 bp, Mus musculus
atgtctggtgccattagatgctgga

SEQ ID NO: 271120 - DNA, 25 bp, Mus musculus
atgtctggtgcctttagatgctgga

SEQ ID NO: 271121 - DNA, 25 bp, Mus musculus
atgtctggttctatggtgtcctccg

SEQ ID NO: 271122 - DNA, 25 bp, Mus musculus
atgtctggttctttggtgtcctccg

SEQ ID NO: 271123 - DNA, 25 bp, Mus musculus
atgtctggttgcctgcagtgtgcac

SEQ ID NO: 271124 - DNA, 25 bp, Mus musculus
atgtctggttgcgtgcagtgtgcac

SEQ ID NO: 271125 - DNA, 25 bp, Mus musculus
atgtctggtttgatatcttccttgc

SEQ ID NO: 271126 - DNA, 25 bp, Mus musculus
atgtctggtttgttatcttccttgc

SEQ ID NO: 271127 - DNA, 25 bp, Mus musculus
atgtctgtaaacactggaaccccgt

SEQ ID NO: 271128 - DNA, 25 bp, Mus musculus
atgtctgtaaactctggaaccccgt

SEQ ID NO: 271129 - DNA, 25 bp, Mus musculus
atgtctgtaaagagtaacctaggaa

SEQ ID NO: 271130 - DNA, 25 bp, Mus musculus
atgtctgtaaagtgtaacctaggaa

SEQ ID NO: 271131 - DNA, 25 bp, Mus musculus
atgtctgtaatcacacactaggcag

SEQ ID NO: 271132 - DNA, 25 bp, Mus musculus
atgtctgtaatccatcttgtttcct

SEQ ID NO: 271133 - DNA, 25 bp, Mus musculus
atgtctgtaatcgatcttgtttcct

SEQ ID NO: 271134 - DNA, 25 bp, Mus musculus
atgtctgtaatctcacactaggcag

SEQ ID NO: 271135 - DNA, 25 bp, Mus musculus
atgtctgtaattccaatgttgtgaa

SEQ ID NO: 271136 - DNA, 25 bp, Mus musculus
atgtctgtaattcctgaacatggga

SEQ ID NO: 271137 - DNA, 25 bp, Mus musculus
atgtctgtaattgcaatgttgtgaa

SEQ ID NO: 271138 - DNA, 25 bp, Mus musculus
atgtctgtaattgctgaacatggga

SEQ ID NO: 271139 - DNA, 25 bp, Mus musculus
atgtctgtaccaaatgcatacggta

SEQ ID NO: 271140 - DNA, 25 bp, Mus musculus
atgtctgtaccatatgcatacggta

SEQ ID NO: 271141 - DNA, 25 bp, Mus musculus
atgtctgtactgctgacactggcca

SEQ ID NO: 271142 - DNA, 25 bp, Mus musculus
atgtctgtactggtgacactggcca

SEQ ID NO: 271143 - DNA, 25 bp, Mus musculus
atgtctgtagttcgtttttcagaaa

SEQ ID NO: 271144 - DNA, 25 bp, Mus musculus
atgtctgtagttggtttttcagaaa

SEQ ID NO: 271145 - DNA, 25 bp, Mus musculus
atgtctgtatatatccccattcact

SEQ ID NO: 271146 - DNA, 25 bp, Mus musculus
atgtctgtatatttccccattcact

SEQ ID NO: 271147 - DNA, 25 bp, Mus musculus
atgtctgtcacccatcagaactcag

SEQ ID NO: 271148 - DNA, 25 bp, Mus musculus
atgtctgtcaccgatcagaactcag

SEQ ID NO: 271149 - DNA, 25 bp, Mus musculus
atgtctgtcgacagggtctgtgctc

SEQ ID NO: 271150 - DNA, 25 bp, Mus musculus
atgtctgtcgactgggtctgtgctc

SEQ ID NO: 271151 - DNA, 25 bp, Mus musculus
atgtctgtcgggagtaccactctag

SEQ ID NO: 271152 - DNA, 25 bp, Mus musculus
atgtctgtcgggtgtaccactctag

SEQ ID NO: 271153 - DNA, 25 bp, Mus musculus
atgtctgtcggtatcccgggacttt

SEQ ID NO: 271154 - DNA, 25 bp, Mus musculus
atgtctgtcggtttcccgggacttt

SEQ ID NO: 271155 - DNA, 25 bp, Mus musculus
atgtctgtcgttcggccctggctgc

SEQ ID NO: 271156 - DNA, 25 bp, Mus musculus
atgtctgtcgttgggccctggctgc

SEQ ID NO: 271157 - DNA, 25 bp, Mus musculus
atgtctgtctcacctcacgtggtgt

SEQ ID NO: 271158 - DNA, 25 bp, Mus musculus
atgtctgtctcagctcacgtggtgt

SEQ ID NO: 271159 - DNA, 25 bp, Mus musculus
atgtctgtctccacaggcaagcaac

SEQ ID NO: 271160 - DNA, 25 bp, Mus musculus
atgtctgtctcctcaggcaagcaac

SEQ ID NO: 271161 - DNA, 25 bp, Mus musculus
atgtctgtctggaagaaggcattta

SEQ ID NO: 271162 - DNA, 25 bp, Mus musculus
atgtctgtctggtagaaggcattta

SEQ ID NO: 271163 - DNA, 25 bp, Mus musculus
atgtctgtcttgaccatcagctagc

SEQ ID NO: 271164 - DNA, 25 bp, Mus musculus
atgtctgtcttgtccatcagctagc

SEQ ID NO: 271165 - DNA, 25 bp, Mus musculus
atgtctgtctttcaagggcagccta

SEQ ID NO: 271166 - DNA, 25 bp, Mus musculus
atgtctgtctttgaagggcagccta

SEQ ID NO: 271167 - DNA, 25 bp, Mus musculus
atgtctgtgatgagtctggagtctc

SEQ ID NO: 271168 - DNA, 25 bp, Mus musculus
atgtctgtgatgataatttcttttg

SEQ ID NO: 271169 - DNA, 25 bp, Mus musculus
atgtctgtgatgtgtctggagtctc

SEQ ID NO: 271170 - DNA, 25 bp, Mus musculus
atgtctgtgatgttaatttcttttg

SEQ ID NO: 271171 - DNA, 25 bp, Mus musculus
atgtctgtgcacaacattcttgctt

SEQ ID NO: 271172 - DNA, 25 bp, Mus musculus
atgtctgtgcactacattcttgctt

SEQ ID NO: 271173 - DNA, 25 bp, Mus musculus
atgtctgtgcccatgaaggatgaag

SEQ ID NO: 271174 - DNA, 25 bp, Mus musculus
atgtctgtgcccttgaaggatgaag

SEQ ID NO: 271175 - DNA, 25 bp, Mus musculus
atgtctgtgctcatcctcaaaggtt

SEQ ID NO: 271176 - DNA, 25 bp, Mus musculus
atgtctgtgctccattaatcagaag

SEQ ID NO: 271177 - DNA, 25 bp, Mus musculus
atgtctgtgctcgattaatcagaag

SEQ ID NO: 271178 - DNA, 25 bp, Mus musculus
atgtctgtgctcttcctcaaaggtt

SEQ ID NO: 271179 - DNA, 25 bp, Mus musculus
atgtctgtgggactgttcctgaaat

SEQ ID NO: 271180 - DNA, 25 bp, Mus musculus
atgtctgtgggagtgttcctgaaat

SEQ ID NO: 271181 - DNA, 25 bp, Mus musculus
atgtctgtggttctgagtgacccta

SEQ ID NO: 271182 - DNA, 25 bp, Mus musculus
atgtctgtggttgtgagtgacccta

SEQ ID NO: 271183 - DNA, 25 bp, Mus musculus
atgtctgtgtccaacatgtcttgac

SEQ ID NO: 271184 - DNA, 25 bp, Mus musculus
atgtctgtgtcctacatgtcttgac

SEQ ID NO: 271185 - DNA, 25 bp, Mus musculus
atgtctgtgtgtcacatggtcacct

SEQ ID NO: 271186 - DNA, 25 bp, Mus musculus
atgtctgtgtgtgacatggtcacct

SEQ ID NO: 271187 - DNA, 25 bp, Mus musculus
atgtctgttactacttttgaatctg

SEQ ID NO: 271188 - DNA, 25 bp, Mus musculus
atgtctgttacttcttttgaatctg

SEQ ID NO: 271189 - DNA, 25 bp, Mus musculus
atgtctgttcctcacttcctatcca

SEQ ID NO: 271190 - DNA, 25 bp, Mus musculus
atgtctgttcctgacttcctatcca

SEQ ID NO: 271191 - DNA, 25 bp, Mus musculus
atgtctgttggccattttctctgta

SEQ ID NO: 271192 - DNA, 25 bp, Mus musculus
atgtctgttggcgattttctctgta

SEQ ID NO: 271193 - DNA, 25 bp, Mus musculus
atgtctgtttatctcctttgtggtt

SEQ ID NO: 271194 - DNA, 25 bp, Mus musculus
atgtctgtttatgtcctttgtggtt

SEQ ID NO: 271195 - DNA, 25 bp, Mus musculus
atgtctgtttgcagtgagtcttcca

SEQ ID NO: 271196 - DNA, 25 bp, Mus musculus
atgtctgtttgctgtgagtcttcca

SEQ ID NO: 271197 - DNA, 25 bp, Mus musculus
atgtctgttttcacgactcagtctc

SEQ ID NO: 271198 - DNA, 25 bp, Mus musculus
atgtctgttttcctcttgatgcgag

SEQ ID NO: 271199 - DNA, 25 bp, Mus musculus
atgtctgttttcgtcttgatgcgag

SEQ ID NO: 271200 - DNA, 25 bp, Mus musculus
atgtctgttttctcgactcagtctc

SEQ ID NO: 271201 - DNA, 25 bp, Mus musculus
atgtctgttttgaacctgtttcgga

SEQ ID NO: 271202 - DNA, 25 bp, Mus musculus
atgtctgttttgtacctgtttcgga

SEQ ID NO: 271203 - DNA, 25 bp, Mus musculus
atgtcttaaaacacagcttccagcc

SEQ ID NO: 271204 - DNA, 25 bp, Mus musculus
atgtcttaaaactcagcttccagcc

SEQ ID NO: 271205 - DNA, 25 bp, Mus musculus
atgtcttaaacaacctgagcctgta

SEQ ID NO: 271206 - DNA, 25 bp, Mus musculus
atgtcttaaacatcctgagcctgta

SEQ ID NO: 271207 - DNA, 25 bp, Mus musculus
atgtcttaaactacatgtcctttga

SEQ ID NO: 271208 - DNA, 25 bp, Mus musculus
atgtcttaaacttcatgtcctttga

SEQ ID NO: 271209 - DNA, 25 bp, Mus musculus
atgtcttaactcatattcgaatctg

SEQ ID NO: 271210 - DNA, 25 bp, Mus musculus
atgtcttaactcttattcgaatctg

SEQ ID NO: 271211 - DNA, 25 bp, Mus musculus
atgtcttacacaagcactacacggg

SEQ ID NO: 271212 - DNA, 25 bp, Mus musculus
atgtcttacacatgcactacacggg

SEQ ID NO: 271213 - DNA, 25 bp, Mus musculus
atgtcttacgctctgcaagctgaga

SEQ ID NO: 271214 - DNA, 25 bp, Mus musculus
atgtcttacgctgtgcaagctgaga

SEQ ID NO: 271215 - DNA, 25 bp, Mus musculus
atgtcttactcacaggcgacttgaa

SEQ ID NO: 271216 - DNA, 25 bp, Mus musculus
atgtcttactcagaggcgacttgaa

SEQ ID NO: 271217 - DNA, 25 bp, Mus musculus
atgtcttacttcacttgctcaaata

SEQ ID NO: 271218 - DNA, 25 bp, Mus musculus
atgtcttacttctcttgctcaaata

SEQ ID NO: 271219 - DNA, 25 bp, Mus musculus
atgtcttagaatcctgtcgccactt

SEQ ID NO: 271220 - DNA, 25 bp, Mus musculus
atgtcttagaatgctgtcgccactt

SEQ ID NO: 271221 - DNA, 25 bp, Mus musculus
atgtcttagctcagaaaattaacac

SEQ ID NO: 271222 - DNA, 25 bp, Mus musculus
atgtcttagctctgaaaattaacac

SEQ ID NO: 271223 - DNA, 25 bp, Mus musculus
atgtcttatgaacgttctgccccag

SEQ ID NO: 271224 - DNA, 25 bp, Mus musculus
atgtcttatgaaggttctgccccag

SEQ ID NO: 271225 - DNA, 25 bp, Mus musculus
atgtcttatgacagctgagcccagc

SEQ ID NO: 271226 - DNA, 25 bp, Mus musculus
atgtcttatgactgctgagcccagc

SEQ ID NO: 271227 - DNA, 25 bp, Mus musculus
atgtcttatgttaccttatcctatt

SEQ ID NO: 271228 - DNA, 25 bp, Mus musculus
atgtcttatgtttccttatcctatt

SEQ ID NO: 271229 - DNA, 25 bp, Mus musculus
atgtcttcaagtccctaggttgtga

SEQ ID NO: 271230 - DNA, 25 bp, Mus musculus
atgtcttcaagtgcctaggttgtga

SEQ ID NO: 271231 - DNA, 25 bp, Mus musculus
atgtcttcacgtcagcagaggagct

SEQ ID NO: 271232 - DNA, 25 bp, Mus musculus
atgtcttcacgtgagcagaggagct

SEQ ID NO: 271233 - DNA, 25 bp, Mus musculus
atgtcttcactgattctatgctatg

SEQ ID NO: 271234 - DNA, 25 bp, Mus musculus
atgtcttcactgtttctatgctatg

SEQ ID NO: 271235 - DNA, 25 bp, Mus musculus
atgtcttcagatccacagtggttga

SEQ ID NO: 271236 - DNA, 25 bp, Mus musculus
atgtcttcagatgcacagtggttga

SEQ ID NO: 271237 - DNA, 25 bp, Mus musculus
atgtcttcagggaattttttggtgg

SEQ ID NO: 271238 - DNA, 25 bp, Mus musculus
atgtcttcagggtattttttggtgg

SEQ ID NO: 271239 - DNA, 25 bp, Mus musculus
atgtcttcatcaaagtcatccagga

SEQ ID NO: 271240 - DNA, 25 bp, Mus musculus
atgtcttcatcatagtcatccagga

SEQ ID NO: 271241 - DNA, 25 bp, Mus musculus
atgtcttcatgtccagctacttgtt

SEQ ID NO: 271242 - DNA, 25 bp, Mus musculus
atgtcttcatgtgcagctacttgtt

SEQ ID NO: 271243 - DNA, 25 bp, Mus musculus
atgtcttcattgatggatgccatta

SEQ ID NO: 271244 - DNA, 25 bp, Mus musculus
atgtcttcattgcaagcagatgcaa

SEQ ID NO: 271245 - DNA, 25 bp, Mus musculus
atgtcttcattggaagcagatgcaa

SEQ ID NO: 271246 - DNA, 25 bp, Mus musculus
atgtcttcattgttggatgccatta

SEQ ID NO: 271247 - DNA, 25 bp, Mus musculus
atgtcttcatttctagtatctctat

SEQ ID NO: 271248 - DNA, 25 bp, Mus musculus
atgtcttcatttgtagtatctctat

SEQ ID NO: 271249 - DNA, 25 bp, Mus musculus
atgtcttccaccatagcatgcagta

SEQ ID NO: 271250 - DNA, 25 bp, Mus musculus
atgtcttccaccttagcatgcagta

SEQ ID NO: 271251 - DNA, 25 bp, Mus musculus
atgtcttccactagttgctatgcct

SEQ ID NO: 271252 - DNA, 25 bp, Mus musculus
atgtcttccacttgttgctatgcct

SEQ ID NO: 271253 - DNA, 25 bp, Mus musculus
atgtcttccataagggtctcactgg

SEQ ID NO: 271254 - DNA, 25 bp, Mus musculus
atgtcttccatatgggtctcactgg

SEQ ID NO: 271255 - DNA, 25 bp, Mus musculus
atgtcttccatgacctatgtttcca

SEQ ID NO: 271256 - DNA, 25 bp, Mus musculus
atgtcttccatgtcctatgtttcca

SEQ ID NO: 271257 - DNA, 25 bp, Mus musculus
atgtcttcccaacctctaattaatt

SEQ ID NO: 271258 - DNA, 25 bp, Mus musculus
atgtcttcccaagctctaattaatt

SEQ ID NO: 271259 - DNA, 25 bp, Mus musculus
atgtcttccctaacagaagttggta

SEQ ID NO: 271260 - DNA, 25 bp, Mus musculus
atgtcttccctatcagaagttggta

SEQ ID NO: 271261 - DNA, 25 bp, Mus musculus
atgtcttccctgctgtgttagaaaa

SEQ ID NO: 271262 - DNA, 25 bp, Mus musculus
atgtcttccctggtgtgttagaaaa

SEQ ID NO: 271263 - DNA, 25 bp, Mus musculus
atgtcttccgctaggttccatttat

SEQ ID NO: 271264 - DNA, 25 bp, Mus musculus
atgtcttccgcttggttccatttat

SEQ ID NO: 271265 - DNA, 25 bp, Mus musculus
atgtcttcctcactcggtaatctga

SEQ ID NO: 271266 - DNA, 25 bp, Mus musculus
atgtcttcctcagtcggtaatctga

SEQ ID NO: 271267 - DNA, 25 bp, Mus musculus
atgtcttcctcgaaaggcacagtgc

SEQ ID NO: 271268 - DNA, 25 bp, Mus musculus
atgtcttcctcgtaaggcacagtgc

SEQ ID NO: 271269 - DNA, 25 bp, Mus musculus
atgtcttcctgaactccggcggaga

SEQ ID NO: 271270 - DNA, 25 bp, Mus musculus
atgtcttcctgatctccggcggaga

SEQ ID NO: 271271 - DNA, 25 bp, Mus musculus
atgtcttcctggctattggtttggc

SEQ ID NO: 271272 - DNA, 25 bp, Mus musculus
atgtcttcctgggtattggtttggc

SEQ ID NO: 271273 - DNA, 25 bp, Mus musculus
atgtcttcgcttactacctcaaaaa

SEQ ID NO: 271274 - DNA, 25 bp, Mus musculus
atgtcttcgctttctacctcaaaaa

SEQ ID NO: 271275 - DNA, 25 bp, Mus musculus
atgtcttctaccaggccgtgggcaa

SEQ ID NO: 271276 - DNA, 25 bp, Mus musculus
atgtcttctacctggccgtgggcaa

SEQ ID NO: 271277 - DNA, 25 bp, Mus musculus
atgtcttctcatatgaaatcagagg

SEQ ID NO: 271278 - DNA, 25 bp, Mus musculus
atgtcttctcatttgaaatcagagg

SEQ ID NO: 271279 - DNA, 25 bp, Mus musculus
atgtcttctctgctggcagcaacga

SEQ ID NO: 271280 - DNA, 25 bp, Mus musculus
atgtcttctctggtggcagcaacga

SEQ ID NO: 271281 - DNA, 25 bp, Mus musculus
atgtcttctgccacaactgatcata

SEQ ID NO: 271282 - DNA, 25 bp, Mus musculus
atgtcttctgcctcaactgatcata

SEQ ID NO: 271283 - DNA, 25 bp, Mus musculus
atgtcttcttgaagtctagtcattg

SEQ ID NO: 271284 - DNA, 25 bp, Mus musculus
atgtcttcttgatgtctagtcattg

SEQ ID NO: 271285 - DNA, 25 bp, Mus musculus
atgtcttcttttcccatttgagttc

SEQ ID NO: 271286 - DNA, 25 bp, Mus musculus
atgtcttcttttgccatttgagttc

SEQ ID NO: 271287 - DNA, 25 bp, Mus musculus
atgtcttgaaccatctttacaggga

SEQ ID NO: 271288 - DNA, 25 bp, Mus musculus
atgtcttgaaccttctttacaggga

SEQ ID NO: 271289 - DNA, 25 bp, Mus musculus
atgtcttgagaaccagtctccctgg

SEQ ID NO: 271290 - DNA, 25 bp, Mus musculus
atgtcttgagaagcagtctccctgg

SEQ ID NO: 271291 - DNA, 25 bp, Mus musculus
atgtcttgatacaggacccacacta

SEQ ID NO: 271292 - DNA, 25 bp, Mus musculus
atgtcttgatactggacccacacta

SEQ ID NO: 271293 - DNA, 25 bp, Mus musculus
atgtcttgcaacatctcacagtaga

SEQ ID NO: 271294 - DNA, 25 bp, Mus musculus
atgtcttgcaacttctcacagtaga

SEQ ID NO: 271295 - DNA, 25 bp, Mus musculus
atgtcttgctcacggattaaaccca

SEQ ID NO: 271296 - DNA, 25 bp, Mus musculus
atgtcttgctcagggattaaaccca

SEQ ID NO: 271297 - DNA, 25 bp, Mus musculus
atgtcttgcttacagtggtgttgcc

SEQ ID NO: 271298 - DNA, 25 bp, Mus musculus
atgtcttgcttagagtggtgttgcc

SEQ ID NO: 271299 - DNA, 25 bp, Mus musculus
atgtcttggaaacacacgctccatc

SEQ ID NO: 271300 - DNA, 25 bp, Mus musculus
atgtcttggaaagacacgctccatc

SEQ ID NO: 271301 - DNA, 25 bp, Mus musculus
atgtcttgggagaaactccactcca

SEQ ID NO: 271302 - DNA, 25 bp, Mus musculus
atgtcttgggagtaactccactcca

SEQ ID NO: 271303 - DNA, 25 bp, Mus musculus
atgtcttgggtgcatctttagtaaa

SEQ ID NO: 271304 - DNA, 25 bp, Mus musculus
atgtcttgggtggatctttagtaaa

SEQ ID NO: 271305 - DNA, 25 bp, Mus musculus
atgtcttgtacaactgtttataggt

SEQ ID NO: 271306 - DNA, 25 bp, Mus musculus
atgtcttgtacatctgtttataggt

SEQ ID NO: 271307 - DNA, 25 bp, Mus musculus
atgtcttgtcagcaccatcagtgga

SEQ ID NO: 271308 - DNA, 25 bp, Mus musculus
atgtcttgtcaggaccatcagtgga

SEQ ID NO: 271309 - DNA, 25 bp, Mus musculus
atgtcttgtcatacaaattccaaag

SEQ ID NO: 271310 - DNA, 25 bp, Mus musculus
atgtcttgtcattcaaattccaaag

SEQ ID NO: 271311 - DNA, 25 bp, Mus musculus
atgtcttgtgcactaagctgggcta

SEQ ID NO: 271312 - DNA, 25 bp, Mus musculus
atgtcttgtgcagtaagctgggcta

SEQ ID NO: 271313 - DNA, 25 bp, Mus musculus
atgtcttgtgttacagacgctcaga

SEQ ID NO: 271314 - DNA, 25 bp, Mus musculus
atgtcttgtgtttcagacgctcaga

SEQ ID NO: 271315 - DNA, 25 bp, Mus musculus
atgtctttaaagacccactgtccag

SEQ ID NO: 271316 - DNA, 25 bp, Mus musculus
atgtctttaaagtcccactgtccag

SEQ ID NO: 271317 - DNA, 25 bp, Mus musculus
atgtctttaagcctgccaacaatgg

SEQ ID NO: 271318 - DNA, 25 bp, Mus musculus
atgtctttaagcgtgccaacaatgg

SEQ ID NO: 271319 - DNA, 25 bp, Mus musculus
atgtctttaaggcagcagtccaatg

SEQ ID NO: 271320 - DNA, 25 bp, Mus musculus
atgtctttaagggagcagtccaatg

SEQ ID NO: 271321 - DNA, 25 bp, Mus musculus
atgtctttccctcagccttgagcta

SEQ ID NO: 271322 - DNA, 25 bp, Mus musculus
atgtctttccctgagccttgagcta

SEQ ID NO: 271323 - DNA, 25 bp, Mus musculus
atgtctttcctacagtttgggttgt

SEQ ID NO: 271324 - DNA, 25 bp, Mus musculus
atgtctttcctagagtttgggttgt

SEQ ID NO: 271325 - DNA, 25 bp, Mus musculus
atgtctttctccaaagcattctttc

SEQ ID NO: 271326 - DNA, 25 bp, Mus musculus
atgtctttctcctaagcattctttc

SEQ ID NO: 271327 - DNA, 25 bp, Mus musculus
atgtctttctctccagtcatttaag

SEQ ID NO: 271328 - DNA, 25 bp, Mus musculus
atgtctttctctgcagtcatttaag

SEQ ID NO: 271329 - DNA, 25 bp, Mus musculus
atgtctttgaaacgtccctgcctat

SEQ ID NO: 271330 - DNA, 25 bp, Mus musculus
atgtctttgaaaggtccctgcctat

SEQ ID NO: 271331 - DNA, 25 bp, Mus musculus
atgtctttgactataatgccggtgc

SEQ ID NO: 271332 - DNA, 25 bp, Mus musculus
atgtctttgactttaatgccggtgc

SEQ ID NO: 271333 - DNA, 25 bp, Mus musculus
atgtctttgccacggagtgatttct

SEQ ID NO: 271334 - DNA, 25 bp, Mus musculus
atgtctttgccagggagtgatttct

SEQ ID NO: 271335 - DNA, 25 bp, Mus musculus
atgtctttggctatttgtgtggttt

SEQ ID NO: 271336 - DNA, 25 bp, Mus musculus
atgtctttggctttttgtgtggttt

SEQ ID NO: 271337 - DNA, 25 bp, Mus musculus
atgtctttgggcagaaattggcacc

SEQ ID NO: 271338 - DNA, 25 bp, Mus musculus
atgtctttgggctgaaattggcacc

SEQ ID NO: 271339 - DNA, 25 bp, Mus musculus
atgtcttttcacatttctctcggct

SEQ ID NO: 271340 - DNA, 25 bp, Mus musculus
atgtcttttcacttttctctcggct

SEQ ID NO: 271341 - DNA, 25 bp, Mus musculus
atgtcttttccaccgacgtggcgat

SEQ ID NO: 271342 - DNA, 25 bp, Mus musculus
atgtcttttccagcgacgtggcgat

SEQ ID NO: 271343 - DNA, 25 bp, Mus musculus
atgtcttttgagataaccactgggt

SEQ ID NO: 271344 - DNA, 25 bp, Mus musculus
atgtcttttgagttaaccactgggt

SEQ ID NO: 271345 - DNA, 25 bp, Mus musculus
atgtcttttttgaatgtaacgggat

SEQ ID NO: 271346 - DNA, 25 bp, Mus musculus
atgtcttttttgtatgtaacgggat

SEQ ID NO: 271347 - DNA, 25 bp, Mus musculus
atgtgaaaagagatttggcctgttt

SEQ ID NO: 271348 - DNA, 25 bp, Mus musculus
atgtgaaaagagttttggcctgttt

SEQ ID NO: 271349 - DNA, 25 bp, Mus musculus
atgtgaaacacacctgttccaacct

SEQ ID NO: 271350 - DNA, 25 bp, Mus musculus
atgtgaaacacagctgttccaacct

SEQ ID NO: 271351 - DNA, 25 bp, Mus musculus
atgtgaaacagcattaagacaggac

SEQ ID NO: 271352 - DNA, 25 bp, Mus musculus
atgtgaaacagctttaagacaggac

SEQ ID NO: 271353 - DNA, 25 bp, Mus musculus
atgtgaaacctgatctggatttgtt

SEQ ID NO: 271354 - DNA, 25 bp, Mus musculus
atgtgaaacctgttctggatttgtt

SEQ ID NO: 271355 - DNA, 25 bp, Mus musculus
atgtgaaacgcaccatgtccaccct

SEQ ID NO: 271356 - DNA, 25 bp, Mus musculus
atgtgaaacgcagcatgtccaccct

SEQ ID NO: 271357 - DNA, 25 bp, Mus musculus
atgtgaaagccaatattcccaaagg

SEQ ID NO: 271358 - DNA, 25 bp, Mus musculus
atgtgaaagccattattcccaaagg

SEQ ID NO: 271359 - DNA, 25 bp, Mus musculus
atgtgaaagtgccttcctaccttag

SEQ ID NO: 271360 - DNA, 25 bp, Mus musculus
atgtgaaagtgcgttcctaccttag

SEQ ID NO: 271361 - DNA, 25 bp, Mus musculus
atgtgaaataccattgaaactccaa

SEQ ID NO: 271362 - DNA, 25 bp, Mus musculus
atgtgaaatacctttgaaactccaa

SEQ ID NO: 271363 - DNA, 25 bp, Mus musculus
atgtgaaatattcgaactgtttctc

SEQ ID NO: 271364 - DNA, 25 bp, Mus musculus
atgtgaaatattggaactgtttctc

SEQ ID NO: 271365 - DNA, 25 bp, Mus musculus
atgtgaaatcacagcctcttgtagc

SEQ ID NO: 271366 - DNA, 25 bp, Mus musculus
atgtgaaatcactgcctcttgtagc

SEQ ID NO: 271367 - DNA, 25 bp, Mus musculus
atgtgaacaaacaacctatagaatg

SEQ ID NO: 271368 - DNA, 25 bp, Mus musculus
atgtgaacaaactacctatagaatg

SEQ ID NO: 271369 - DNA, 25 bp, Mus musculus
atgtgaacacatacgagagctgact

SEQ ID NO: 271370 - DNA, 25 bp, Mus musculus
atgtgaacacattcgagagctgact

SEQ ID NO: 271371 - DNA, 25 bp, Mus musculus
atgtgaacacccacttcttcagcca

SEQ ID NO: 271372 - DNA, 25 bp, Mus musculus
atgtgaacaccctcttcttcagcca

SEQ ID NO: 271373 - DNA, 25 bp, Mus musculus
atgtgaacagcaagcaccacgcgtt

SEQ ID NO: 271374 - DNA, 25 bp, Mus musculus
atgtgaacagcatgcaccacgcgtt

SEQ ID NO: 271375 - DNA, 25 bp, Mus musculus
atgtgaacagggacacgctgggctc

SEQ ID NO: 271376 - DNA, 25 bp, Mus musculus
atgtgaacagggtcacgctgggctc

SEQ ID NO: 271377 - DNA, 25 bp, Mus musculus
atgtgaacagttagccagatccggc

SEQ ID NO: 271378 - DNA, 25 bp, Mus musculus
atgtgaacagtttgccagatccggc

SEQ ID NO: 271379 - DNA, 25 bp, Mus musculus
atgtgaaccaagctggccataagca

SEQ ID NO: 271380 - DNA, 25 bp, Mus musculus
atgtgaaccaaggtggccataagca

SEQ ID NO: 271381 - DNA, 25 bp, Mus musculus
atgtgaaccaggactgtaggcttgt

SEQ ID NO: 271382 - DNA, 25 bp, Mus musculus
atgtgaaccaggtctgtaggcttgt

SEQ ID NO: 271383 - DNA, 25 bp, Mus musculus
atgtgaaccatcacatgccaccgca

SEQ ID NO: 271384 - DNA, 25 bp, Mus musculus
atgtgaaccatctcatgccaccgca

SEQ ID NO: 271385 - DNA, 25 bp, Mus musculus
atgtgaacccacactggcagctagt

SEQ ID NO: 271386 - DNA, 25 bp, Mus musculus
atgtgaacccactctggcagctagt

SEQ ID NO: 271387 - DNA, 25 bp, Mus musculus
atgtgaacccagattctctaggaat

SEQ ID NO: 271388 - DNA, 25 bp, Mus musculus
atgtgaacccagtttctctaggaat

SEQ ID NO: 271389 - DNA, 25 bp, Mus musculus
atgtgaaccccaacacttggtaggt

SEQ ID NO: 271390 - DNA, 25 bp, Mus musculus
atgtgaaccccaacttctcggtcta

SEQ ID NO: 271391 - DNA, 25 bp, Mus musculus
atgtgaaccccatcacttggtaggt

SEQ ID NO: 271392 - DNA, 25 bp, Mus musculus
atgtgaaccccatcttctcggtcta

SEQ ID NO: 271393 - DNA, 25 bp, Mus musculus
atgtgaaccgcaaagaggagctcaa

SEQ ID NO: 271394 - DNA, 25 bp, Mus musculus
atgtgaaccgcatagaggagctcaa

SEQ ID NO: 271395 - DNA, 25 bp, Mus musculus
atgtgaacctggacttgctttgtac

SEQ ID NO: 271396 - DNA, 25 bp, Mus musculus
atgtgaacctggtcttgctttgtac

SEQ ID NO: 271397 - DNA, 25 bp, Mus musculus
atgtgaaccttgcagcatcaaaatg

SEQ ID NO: 271398 - DNA, 25 bp, Mus musculus
atgtgaaccttggagcatcaaaatg

SEQ ID NO: 271399 - DNA, 25 bp, Mus musculus
atgtgaacgaggaggcaaagatttt

SEQ ID NO: 271400 - DNA, 25 bp, Mus musculus
atgtgaacgaggtggcaaagatttt

SEQ ID NO: 271401 - DNA, 25 bp, Mus musculus
atgtgaactcctagtggcacaggac

SEQ ID NO: 271402 - DNA, 25 bp, Mus musculus
atgtgaactccttgtggcacaggac

SEQ ID NO: 271403 - DNA, 25 bp, Mus musculus
atgtgaactggaatcagcagaccat

SEQ ID NO: 271404 - DNA, 25 bp, Mus musculus
atgtgaactggattcagcagaccat

SEQ ID NO: 271405 - DNA, 25 bp, Mus musculus
atgtgaacttgtagctcgtactaac

SEQ ID NO: 271406 - DNA, 25 bp, Mus musculus
atgtgaacttgttgctcgtactaac

SEQ ID NO: 271407 - DNA, 25 bp, Mus musculus
atgtgaagaaccaagaccctctgtt

SEQ ID NO: 271408 - DNA, 25 bp, Mus musculus
atgtgaagaacctagaccctctgtt

SEQ ID NO: 271409 - DNA, 25 bp, Mus musculus
atgtgaagaactactcctccttgct

SEQ ID NO: 271410 - DNA, 25 bp, Mus musculus
atgtgaagaacttctcctccttgct

SEQ ID NO: 271411 - DNA, 25 bp, Mus musculus
atgtgaagactgcacgcgtacgctg

SEQ ID NO: 271412 - DNA, 25 bp, Mus musculus
atgtgaagactggacgcgtacgctg

SEQ ID NO: 271413 - DNA, 25 bp, Mus musculus
atgtgaagatctatgtcactctgtt

SEQ ID NO: 271414 - DNA, 25 bp, Mus musculus
atgtgaagatctttgtcactctgtt

SEQ ID NO: 271415 - DNA, 25 bp, Mus musculus
atgtgaagatgccttgtagtttacc

SEQ ID NO: 271416 - DNA, 25 bp, Mus musculus
atgtgaagatgcgttgtagtttacc

SEQ ID NO: 271417 - DNA, 25 bp, Mus musculus
atgtgaagatttcactatgtgaact

SEQ ID NO: 271418 - DNA, 25 bp, Mus musculus
atgtgaagatttgactatgtgaact

SEQ ID NO: 271419 - DNA, 25 bp, Mus musculus
atgtgaagccgcaggcaccaggatg

SEQ ID NO: 271420 - DNA, 25 bp, Mus musculus
atgtgaagccgctggcaccaggatg

SEQ ID NO: 271421 - DNA, 25 bp, Mus musculus
atgtgaagctcccaggaccagcacc

SEQ ID NO: 271422 - DNA, 25 bp, Mus musculus
atgtgaagctccgaggaccagcacc

SEQ ID NO: 271423 - DNA, 25 bp, Mus musculus
atgtgaagctctcagtcatcccaac

SEQ ID NO: 271424 - DNA, 25 bp, Mus musculus
atgtgaagctctgagtcatcccaac

SEQ ID NO: 271425 - DNA, 25 bp, Mus musculus
atgtgaagctgtccacacctccaca

SEQ ID NO: 271426 - DNA, 25 bp, Mus musculus
atgtgaagctgtgcacacctccaca

SEQ ID NO: 271427 - DNA, 25 bp, Mus musculus
atgtgaaggatgactgcgctgcagc

SEQ ID NO: 271428 - DNA, 25 bp, Mus musculus
atgtgaaggatgtctgcgctgcagc

SEQ ID NO: 271429 - DNA, 25 bp, Mus musculus
atgtgaagggagctctttctgcctt

SEQ ID NO: 271430 - DNA, 25 bp, Mus musculus
atgtgaagggaggtctttctgcctt

SEQ ID NO: 271431 - DNA, 25 bp, Mus musculus
atgtgaagggtccaacttcctgcag

SEQ ID NO: 271432 - DNA, 25 bp, Mus musculus
atgtgaagggtcgaacttcctgcag

SEQ ID NO: 271433 - DNA, 25 bp, Mus musculus
atgtgaagtgccaatgccctcccca

SEQ ID NO: 271434 - DNA, 25 bp, Mus musculus
atgtgaagtgcctatgccctcccca

SEQ ID NO: 271435 - DNA, 25 bp, Mus musculus
atgtgaagtgctatagctttctggg

SEQ ID NO: 271436 - DNA, 25 bp, Mus musculus
atgtgaagtgctttagctttctggg

SEQ ID NO: 271437 - DNA, 25 bp, Mus musculus
atgtgaataactagacttgcgttga

SEQ ID NO: 271438 - DNA, 25 bp, Mus musculus
atgtgaataacttgacttgcgttga

SEQ ID NO: 271439 - DNA, 25 bp, Mus musculus
atgtgaatacacattatagctttaa

SEQ ID NO: 271440 - DNA, 25 bp, Mus musculus
atgtgaatacactttatagctttaa

SEQ ID NO: 271441 - DNA, 25 bp, Mus musculus
atgtgaatacctccatattccctgt

SEQ ID NO: 271442 - DNA, 25 bp, Mus musculus
atgtgaatacctgcatattccctgt

SEQ ID NO: 271443 - DNA, 25 bp, Mus musculus
atgtgaatcaggagagtcagacact

SEQ ID NO: 271444 - DNA, 25 bp, Mus musculus
atgtgaatcaggcacgagacggaca

SEQ ID NO: 271445 - DNA, 25 bp, Mus musculus
atgtgaatcagggacgagacggaca

SEQ ID NO: 271446 - DNA, 25 bp, Mus musculus
atgtgaatcaggtgagtcagacact

SEQ ID NO: 271447 - DNA, 25 bp, Mus musculus
atgtgaatccatcacctgcaacctg

SEQ ID NO: 271448 - DNA, 25 bp, Mus musculus
atgtgaatccatgacctgcaacctg

SEQ ID NO: 271449 - DNA, 25 bp, Mus musculus
atgtgaatcctcacatcaggctgga

SEQ ID NO: 271450 - DNA, 25 bp, Mus musculus
atgtgaatcctctcatcaggctgga

SEQ ID NO: 271451 - DNA, 25 bp, Mus musculus
atgtgaatcttaaagctgttttaat

SEQ ID NO: 271452 - DNA, 25 bp, Mus musculus
atgtgaatcttatagctgttttaat

SEQ ID NO: 271453 - DNA, 25 bp, Mus musculus
atgtgaatggatctttgcctgcatg

SEQ ID NO: 271454 - DNA, 25 bp, Mus musculus
atgtgaatggatgtttgcctgcatg

SEQ ID NO: 271455 - DNA, 25 bp, Mus musculus
atgtgaatggccaagagaacctatt

SEQ ID NO: 271456 - DNA, 25 bp, Mus musculus
atgtgaatggcctagagaacctatt

SEQ ID NO: 271457 - DNA, 25 bp, Mus musculus
atgtgaatgtacagtcttcggacac

SEQ ID NO: 271458 - DNA, 25 bp, Mus musculus
atgtgaatgtactgtcttcggacac

SEQ ID NO: 271459 - DNA, 25 bp, Mus musculus
atgtgaatgtcaattcgtgcacccc

SEQ ID NO: 271460 - DNA, 25 bp, Mus musculus
atgtgaatgtcactcaggtatttgt

SEQ ID NO: 271461 - DNA, 25 bp, Mus musculus
atgtgaatgtcagtcaggtatttgt

SEQ ID NO: 271462 - DNA, 25 bp, Mus musculus
atgtgaatgtcatttcgtgcacccc

SEQ ID NO: 271463 - DNA, 25 bp, Mus musculus
atgtgaattcggaggcgcccacaat

SEQ ID NO: 271464 - DNA, 25 bp, Mus musculus
atgtgaattcggtggcgcccacaat

SEQ ID NO: 271465 - DNA, 25 bp, Mus musculus
atgtgaattgcaaatctcgcctggc

SEQ ID NO: 271466 - DNA, 25 bp, Mus musculus
atgtgaattgcatatctcgcctggc

SEQ ID NO: 271467 - DNA, 25 bp, Mus musculus
atgtgaattggtacctgtctagctg

SEQ ID NO: 271468 - DNA, 25 bp, Mus musculus
atgtgaattggttcctgtctagctg

SEQ ID NO: 271469 - DNA, 25 bp, Mus musculus
atgtgaatttacaaggcctcagttt

SEQ ID NO: 271470 - DNA, 25 bp, Mus musculus
atgtgaatttactaggcctcagttt

SEQ ID NO: 271471 - DNA, 25 bp, Mus musculus
atgtgaatttccacctcagatattg

SEQ ID NO: 271472 - DNA, 25 bp, Mus musculus
atgtgaatttcctcctcagatattg

SEQ ID NO: 271473 - DNA, 25 bp, Mus musculus
atgtgacaacatagggtttggccag

SEQ ID NO: 271474 - DNA, 25 bp, Mus musculus
atgtgacaacattgggtttggccag

SEQ ID NO: 271475 - DNA, 25 bp, Mus musculus
atgtgacaagatcttggcccttcca

SEQ ID NO: 271476 - DNA, 25 bp, Mus musculus
atgtgacaagatgttggcccttcca

SEQ ID NO: 271477 - DNA, 25 bp, Mus musculus
atgtgacaaggccaagtatctataa

SEQ ID NO: 271478 - DNA, 25 bp, Mus musculus
atgtgacaaggcgaagtatctataa

SEQ ID NO: 271479 - DNA, 25 bp, Mus musculus
atgtgacacactattggcccaaact

SEQ ID NO: 271480 - DNA, 25 bp, Mus musculus
atgtgacacacttttggcccaaact

SEQ ID NO: 271481 - DNA, 25 bp, Mus musculus
atgtgacactgtctcaccaggctgg

SEQ ID NO: 271482 - DNA, 25 bp, Mus musculus
atgtgacactgtgtcaccaggctgg

SEQ ID NO: 271483 - DNA, 25 bp, Mus musculus
atgtgacacttgcaggacactacaa

SEQ ID NO: 271484 - DNA, 25 bp, Mus musculus
atgtgacacttggaggacactacaa

SEQ ID NO: 271485 - DNA, 25 bp, Mus musculus
atgtgacagaatctgttccttgttt

SEQ ID NO: 271486 - DNA, 25 bp, Mus musculus
atgtgacagaatgtgttccttgttt

SEQ ID NO: 271487 - DNA, 25 bp, Mus musculus
atgtgacagacgacgtgaacacctg

SEQ ID NO: 271488 - DNA, 25 bp, Mus musculus
atgtgacagacgtcgtgaacacctg

SEQ ID NO: 271489 - DNA, 25 bp, Mus musculus
atgtgacaggcaccactggctatcc

SEQ ID NO: 271490 - DNA, 25 bp, Mus musculus
atgtgacaggcagcactggctatcc

SEQ ID NO: 271491 - DNA, 25 bp, Mus musculus
atgtgacagggtctgtggtctttcc

SEQ ID NO: 271492 - DNA, 25 bp, Mus musculus
atgtgacagggtgtgtggtctttcc

SEQ ID NO: 271493 - DNA, 25 bp, Mus musculus
atgtgacatcatcgccaccagtgat

SEQ ID NO: 271494 - DNA, 25 bp, Mus musculus
atgtgacatcatggccaccagtgat

SEQ ID NO: 271495 - DNA, 25 bp, Mus musculus
atgtgacatgtcagaactggcaggg

SEQ ID NO: 271496 - DNA, 25 bp, Mus musculus
atgtgacatgtctgaactggcaggg

SEQ ID NO: 271497 - DNA, 25 bp, Mus musculus
atgtgacatgttagggtcctctggt

SEQ ID NO: 271498 - DNA, 25 bp, Mus musculus
atgtgacatgtttgggtcctctggt

SEQ ID NO: 271499 - DNA, 25 bp, Mus musculus
atgtgaccaagccagttggttacta

SEQ ID NO: 271500 - DNA, 25 bp, Mus musculus
atgtgaccaagcgagttggttacta

SEQ ID NO: 271501 - DNA, 25 bp, Mus musculus
atgtgaccaatgagagctgccacgt

SEQ ID NO: 271502 - DNA, 25 bp, Mus musculus
atgtgaccaatgtgagctgccacgt

SEQ ID NO: 271503 - DNA, 25 bp, Mus musculus
atgtgaccacagagaccaagttcct

SEQ ID NO: 271504 - DNA, 25 bp, Mus musculus
atgtgaccacagtgaccaagttcct

SEQ ID NO: 271505 - DNA, 25 bp, Mus musculus
atgtgaccagttccagttgcaaaaa

SEQ ID NO: 271506 - DNA, 25 bp, Mus musculus
atgtgaccagttgcagttgcaaaaa

SEQ ID NO: 271507 - DNA, 25 bp, Mus musculus
atgtgaccatgaaccgtttctatcg

SEQ ID NO: 271508 - DNA, 25 bp, Mus musculus
atgtgaccatgatccgtttctatcg

SEQ ID NO: 271509 - DNA, 25 bp, Mus musculus
atgtgaccatgtagtccctcctgat

SEQ ID NO: 271510 - DNA, 25 bp, Mus musculus
atgtgaccatgttgtccctcctgat

SEQ ID NO: 271511 - DNA, 25 bp, Mus musculus
atgtgaccattacccacaagcatgt

SEQ ID NO: 271512 - DNA, 25 bp, Mus musculus
atgtgaccattagccacaagcatgt

SEQ ID NO: 271513 - DNA, 25 bp, Mus musculus
atgtgacccgcacagactgagatct

SEQ ID NO: 271514 - DNA, 25 bp, Mus musculus
atgtgacccgcagagactgagatct

SEQ ID NO: 271515 - DNA, 25 bp, Mus musculus
atgtgacccggcagttgtacgctgg

SEQ ID NO: 271516 - DNA, 25 bp, Mus musculus
atgtgacccggctgttgtacgctgg

SEQ ID NO: 271517 - DNA, 25 bp, Mus musculus
atgtgaccgacactgagatgctgtg

SEQ ID NO: 271518 - DNA, 25 bp, Mus musculus
atgtgaccgacagtgagatgctgtg

SEQ ID NO: 271519 - DNA, 25 bp, Mus musculus
atgtgaccggaaagccatggcctat

SEQ ID NO: 271520 - DNA, 25 bp, Mus musculus
atgtgaccggaatgccatggcctat

SEQ ID NO: 271521 - DNA, 25 bp, Mus musculus
atgtgaccggctcaagtaaatgtga

SEQ ID NO: 271522 - DNA, 25 bp, Mus musculus
atgtgaccggctgaagtaaatgtga

SEQ ID NO: 271523 - DNA, 25 bp, Mus musculus
atgtgaccgtcactccaattgagaa

SEQ ID NO: 271524 - DNA, 25 bp, Mus musculus
atgtgaccgtcagtccaattgagaa

SEQ ID NO: 271525 - DNA, 25 bp, Mus musculus
atgtgacctggcaaagctgtccttt

SEQ ID NO: 271526 - DNA, 25 bp, Mus musculus
atgtgacctggcaccagtcgtgtgg

SEQ ID NO: 271527 - DNA, 25 bp, Mus musculus
atgtgacctggctaagctgtccttt

SEQ ID NO: 271528 - DNA, 25 bp, Mus musculus
atgtgacctggctccagtcgtgtgg

SEQ ID NO: 271529 - DNA, 25 bp, Mus musculus
atgtgacctgggagaagcctaccac

SEQ ID NO: 271530 - DNA, 25 bp, Mus musculus
atgtgacctgggtgaagcctaccac

SEQ ID NO: 271531 - DNA, 25 bp, Mus musculus
atgtgaccttcaccgggcttgctct

SEQ ID NO: 271532 - DNA, 25 bp, Mus musculus
atgtgaccttcagcgggcttgctct

SEQ ID NO: 271533 - DNA, 25 bp, Mus musculus
atgtgaccttccagctctatgatgt

SEQ ID NO: 271534 - DNA, 25 bp, Mus musculus
atgtgaccttcctgctctatgatgt

SEQ ID NO: 271535 - DNA, 25 bp, Mus musculus
atgtgaccttctccagctgactggc

SEQ ID NO: 271536 - DNA, 25 bp, Mus musculus
atgtgaccttctgcagctgactggc

SEQ ID NO: 271537 - DNA, 25 bp, Mus musculus
atgtgacctttacaggtgtcgtttc

SEQ ID NO: 271538 - DNA, 25 bp, Mus musculus
atgtgacctttagaggtgtcgtttc

SEQ ID NO: 271539 - DNA, 25 bp, Mus musculus
atgtgacgaagcagcttgggctctt

SEQ ID NO: 271540 - DNA, 25 bp, Mus musculus
atgtgacgaagctgcttgggctctt

SEQ ID NO: 271541 - DNA, 25 bp, Mus musculus
atgtgacgcatgcatttaactgttg

SEQ ID NO: 271542 - DNA, 25 bp, Mus musculus
atgtgacgcatggatttaactgttg

SEQ ID NO: 271543 - DNA, 25 bp, Mus musculus
atgtgacgttgcctacgttgggacc

SEQ ID NO: 271544 - DNA, 25 bp, Mus musculus
atgtgacgttgcgtacgttgggacc

SEQ ID NO: 271545 - DNA, 25 bp, Mus musculus
atgtgacgtttcacccaccactcac

SEQ ID NO: 271546 - DNA, 25 bp, Mus musculus
atgtgacgtttctcccaccactcac

SEQ ID NO: 271547 - DNA, 25 bp, Mus musculus
atgtgactaaatccccattttcctt

SEQ ID NO: 271548 - DNA, 25 bp, Mus musculus
atgtgactaaatgcccattttcctt

SEQ ID NO: 271549 - DNA, 25 bp, Mus musculus
atgtgactacatctgccctcagcac

SEQ ID NO: 271550 - DNA, 25 bp, Mus musculus
atgtgactacatgtgccctcagcac

SEQ ID NO: 271551 - DNA, 25 bp, Mus musculus
atgtgactagacacttgctaataga

SEQ ID NO: 271552 - DNA, 25 bp, Mus musculus
atgtgactagactcttgctaataga

SEQ ID NO: 271553 - DNA, 25 bp, Mus musculus
atgtgactagcgagacttgtagcgt

SEQ ID NO: 271554 - DNA, 25 bp, Mus musculus
atgtgactagcgtgacttgtagcgt

SEQ ID NO: 271555 - DNA, 25 bp, Mus musculus
atgtgactatcaccaccctgaggga

SEQ ID NO: 271556 - DNA, 25 bp, Mus musculus
atgtgactatcagcaccctgaggga

SEQ ID NO: 271557 - DNA, 25 bp, Mus musculus
atgtgactatttatgtaactgggtt

SEQ ID NO: 271558 - DNA, 25 bp, Mus musculus
atgtgactatttctctacccatggc

SEQ ID NO: 271559 - DNA, 25 bp, Mus musculus
atgtgactatttgtctacccatggc

SEQ ID NO: 271560 - DNA, 25 bp, Mus musculus
atgtgactatttttgtaactgggtt

SEQ ID NO: 271561 - DNA, 25 bp, Mus musculus
atgtgactcaggacctacggattca

SEQ ID NO: 271562 - DNA, 25 bp, Mus musculus
atgtgactcaggtcctacggattca

SEQ ID NO: 271563 - DNA, 25 bp, Mus musculus
atgtgactcctccacagtactaaag

SEQ ID NO: 271564 - DNA, 25 bp, Mus musculus
atgtgactcctcgacagtactaaag

SEQ ID NO: 271565 - DNA, 25 bp, Mus musculus
atgtgactctcactttacatgaaca

SEQ ID NO: 271566 - DNA, 25 bp, Mus musculus
atgtgactctcagtttacatgaaca

SEQ ID NO: 271567 - DNA, 25 bp, Mus musculus
atgtgactgaagctgaccacaggca

SEQ ID NO: 271568 - DNA, 25 bp, Mus musculus
atgtgactgaaggtgaccacaggca

SEQ ID NO: 271569 - DNA, 25 bp, Mus musculus
atgtgactgagacaggaccttgttt

SEQ ID NO: 271570 - DNA, 25 bp, Mus musculus
atgtgactgagagaggaccttgttt

SEQ ID NO: 271571 - DNA, 25 bp, Mus musculus
atgtgactgggaccctcgcatctca

SEQ ID NO: 271572 - DNA, 25 bp, Mus musculus
atgtgactgggagcctcgcatctca

SEQ ID NO: 271573 - DNA, 25 bp, Mus musculus
atgtgactgtatatgcattcttctg

SEQ ID NO: 271574 - DNA, 25 bp, Mus musculus
atgtgactgtatttgcattcttctg

SEQ ID NO: 271575 - DNA, 25 bp, Mus musculus
atgtgactgtgaacttgccttgttt

SEQ ID NO: 271576 - DNA, 25 bp, Mus musculus
atgtgactgtgatcttgccttgttt

SEQ ID NO: 271577 - DNA, 25 bp, Mus musculus
atgtgactgttgatttatgttgaca

SEQ ID NO: 271578 - DNA, 25 bp, Mus musculus
atgtgactgttgttttatgttgaca

SEQ ID NO: 271579 - DNA, 25 bp, Mus musculus
atgtgacttatcagttgcgggctcc

SEQ ID NO: 271580 - DNA, 25 bp, Mus musculus
atgtgacttatctgttgcgggctcc

SEQ ID NO: 271581 - DNA, 25 bp, Mus musculus
atgtgacttattatgccagttgaag

SEQ ID NO: 271582 - DNA, 25 bp, Mus musculus
atgtgacttattttgccagttgaag

SEQ ID NO: 271583 - DNA, 25 bp, Mus musculus
atgtgacttcatatgccaggagatc

SEQ ID NO: 271584 - DNA, 25 bp, Mus musculus
atgtgacttcatatggacccatgct

SEQ ID NO: 271585 - DNA, 25 bp, Mus musculus
atgtgacttcatttgccaggagatc

SEQ ID NO: 271586 - DNA, 25 bp, Mus musculus
atgtgacttcatttggacccatgct

SEQ ID NO: 271587 - DNA, 25 bp, Mus musculus
atgtgacttcggcttgtctgttatt

SEQ ID NO: 271588 - DNA, 25 bp, Mus musculus
atgtgacttcgggttgtctgttatt

SEQ ID NO: 271589 - DNA, 25 bp, Mus musculus
atgtgacttctgatacatccgttct

SEQ ID NO: 271590 - DNA, 25 bp, Mus musculus
atgtgacttctgttacatccgttct

SEQ ID NO: 271591 - DNA, 25 bp, Mus musculus
atgtgactttatatcttatcagaag

SEQ ID NO: 271592 - DNA, 25 bp, Mus musculus
atgtgactttatttcttatcagaag

SEQ ID NO: 271593 - DNA, 25 bp, Mus musculus
atgtgagaagtgagccaaggactgt

SEQ ID NO: 271594 - DNA, 25 bp, Mus musculus
atgtgagaagtgtgccaaggactgt

SEQ ID NO: 271595 - DNA, 25 bp, Mus musculus
atgtgagagcccacatcagataccc

SEQ ID NO: 271596 - DNA, 25 bp, Mus musculus
atgtgagagccctcatcagataccc

SEQ ID NO: 271597 - DNA, 25 bp, Mus musculus
atgtgagagtgtcctaagccctaaa

SEQ ID NO: 271598 - DNA, 25 bp, Mus musculus
atgtgagagtgtgctaagccctaaa

SEQ ID NO: 271599 - DNA, 25 bp, Mus musculus
atgtgagataccatctgcctgaaaa

SEQ ID NO: 271600 - DNA, 25 bp, Mus musculus
atgtgagataccttctgcctgaaaa

SEQ ID NO: 271601 - DNA, 25 bp, Mus musculus
atgtgagatatgaacacactggcag

SEQ ID NO: 271602 - DNA, 25 bp, Mus musculus
atgtgagatatgtacacactggcag

SEQ ID NO: 271603 - DNA, 25 bp, Mus musculus
atgtgagattgtacttgcttatgtc

SEQ ID NO: 271604 - DNA, 25 bp, Mus musculus
atgtgagattgttcttgcttatgtc

SEQ ID NO: 271605 - DNA, 25 bp, Mus musculus
atgtgagatttcatcccctgaatcc

SEQ ID NO: 271606 - DNA, 25 bp, Mus musculus
atgtgagatttcttcccctgaatcc

SEQ ID NO: 271607 - DNA, 25 bp, Mus musculus
atgtgagcaccaattattataccct

SEQ ID NO: 271608 - DNA, 25 bp, Mus musculus
atgtgagcaccatttattataccct

SEQ ID NO: 271609 - DNA, 25 bp, Mus musculus
atgtgagcacggctacctctgattc

SEQ ID NO: 271610 - DNA, 25 bp, Mus musculus
atgtgagcacgggtacctctgattc

SEQ ID NO: 271611 - DNA, 25 bp, Mus musculus
atgtgagcactcagctactgttctg

SEQ ID NO: 271612 - DNA, 25 bp, Mus musculus
atgtgagcactctgctactgttctg

SEQ ID NO: 271613 - DNA, 25 bp, Mus musculus
atgtgagcagctcttaatctagtgc

SEQ ID NO: 271614 - DNA, 25 bp, Mus musculus
atgtgagcagctgttaatctagtgc

SEQ ID NO: 271615 - DNA, 25 bp, Mus musculus
atgtgagcagtcactgtatggtcac

SEQ ID NO: 271616 - DNA, 25 bp, Mus musculus
atgtgagcagtctctgtatggtcac

SEQ ID NO: 271617 - DNA, 25 bp, Mus musculus
atgtgagcatcacttacagcagagt

SEQ ID NO: 271618 - DNA, 25 bp, Mus musculus
atgtgagcatcagttacagcagagt

SEQ ID NO: 271619 - DNA, 25 bp, Mus musculus
atgtgagcatggacattcttgcccc

SEQ ID NO: 271620 - DNA, 25 bp, Mus musculus
atgtgagcatggtcattcttgcccc

SEQ ID NO: 271621 - DNA, 25 bp, Mus musculus
atgtgagcatttctgacccctgtga

SEQ ID NO: 271622 - DNA, 25 bp, Mus musculus
atgtgagcatttgtgacccctgtga

SEQ ID NO: 271623 - DNA, 25 bp, Mus musculus
atgtgagccactacgtttatttacc

SEQ ID NO: 271624 - DNA, 25 bp, Mus musculus
atgtgagccacttcgtttatttacc

SEQ ID NO: 271625 - DNA, 25 bp, Mus musculus
atgtgagccagccattctttatcgt

SEQ ID NO: 271626 - DNA, 25 bp, Mus musculus
atgtgagccagcgattctttatcgt

SEQ ID NO: 271627 - DNA, 25 bp, Mus musculus
atgtgagccctgactgtattggcat

SEQ ID NO: 271628 - DNA, 25 bp, Mus musculus
atgtgagccctgtctgtattggcat

SEQ ID NO: 271629 - DNA, 25 bp, Mus musculus
atgtgagcctgaaccctgacattgg

SEQ ID NO: 271630 - DNA, 25 bp, Mus musculus
atgtgagcctgatccctgacattgg

SEQ ID NO: 271631 - DNA, 25 bp, Mus musculus
atgtgagcctggagggcagccctcc

SEQ ID NO: 271632 - DNA, 25 bp, Mus musculus
atgtgagcctggtgggcagccctcc

SEQ ID NO: 271633 - DNA, 25 bp, Mus musculus
atgtgagcggcactgccgttccaga

SEQ ID NO: 271634 - DNA, 25 bp, Mus musculus
atgtgagcggcagtgccgttccaga

SEQ ID NO: 271635 - DNA, 25 bp, Mus musculus
atgtgagcgtgacacaaacacccgc

SEQ ID NO: 271636 - DNA, 25 bp, Mus musculus
atgtgagcgtgagacaaacacccgc

SEQ ID NO: 271637 - DNA, 25 bp, Mus musculus
atgtgagctattctaacatctctaa

SEQ ID NO: 271638 - DNA, 25 bp, Mus musculus
atgtgagctattgtaacatctctaa

SEQ ID NO: 271639 - DNA, 25 bp, Mus musculus
atgtgagctcagagatttccctgct

SEQ ID NO: 271640 - DNA, 25 bp, Mus musculus
atgtgagctcagtgatttccctgct

SEQ ID NO: 271641 - DNA, 25 bp, Mus musculus
atgtgagctctcctagtgagccctg

SEQ ID NO: 271642 - DNA, 25 bp, Mus musculus
atgtgagctctcgtagtgagccctg

SEQ ID NO: 271643 - DNA, 25 bp, Mus musculus
atgtgagctcttctaacaactctag

SEQ ID NO: 271644 - DNA, 25 bp, Mus musculus
atgtgagctcttgtaacaactctag

SEQ ID NO: 271645 - DNA, 25 bp, Mus musculus
atgtgagcttgcatcagttcttcag

SEQ ID NO: 271646 - DNA, 25 bp, Mus musculus
atgtgagcttgcttcagttcttcag

SEQ ID NO: 271647 - DNA, 25 bp, Mus musculus
atgtgaggaactccgggcactctac

SEQ ID NO: 271648 - DNA, 25 bp, Mus musculus
atgtgaggaactgcgggcactctac

SEQ ID NO: 271649 - DNA, 25 bp, Mus musculus
atgtgaggagccacccttgcaatca

SEQ ID NO: 271650 - DNA, 25 bp, Mus musculus
atgtgaggagccagacgcagccctg

SEQ ID NO: 271651 - DNA, 25 bp, Mus musculus
atgtgaggagcccaccttcatttta

SEQ ID NO: 271652 - DNA, 25 bp, Mus musculus
atgtgaggagccgaccttcatttta

SEQ ID NO: 271653 - DNA, 25 bp, Mus musculus
atgtgaggagcctcccttgcaatca

SEQ ID NO: 271654 - DNA, 25 bp, Mus musculus
atgtgaggagcctgacgcagccctg

SEQ ID NO: 271655 - DNA, 25 bp, Mus musculus
atgtgaggaggcaccagtatgagct

SEQ ID NO: 271656 - DNA, 25 bp, Mus musculus
atgtgaggaggctccagtatgagct

SEQ ID NO: 271657 - DNA, 25 bp, Mus musculus
atgtgaggatctccgttcatggcca

SEQ ID NO: 271658 - DNA, 25 bp, Mus musculus
atgtgaggatctgcgttcatggcca

SEQ ID NO: 271659 - DNA, 25 bp, Mus musculus
atgtgaggatgaagtattcgtttct

SEQ ID NO: 271660 - DNA, 25 bp, Mus musculus
atgtgaggatgatgtattcgtttct

SEQ ID NO: 271661 - DNA, 25 bp, Mus musculus
atgtgaggcactcctgagccgagca

SEQ ID NO: 271662 - DNA, 25 bp, Mus musculus
atgtgaggcactgctgagccgagca

SEQ ID NO: 271663 - DNA, 25 bp, Mus musculus
atgtgaggcatcagtgacttcagta

SEQ ID NO: 271664 - DNA, 25 bp, Mus musculus
atgtgaggcatctgtgacttcagta

SEQ ID NO: 271665 - DNA, 25 bp, Mus musculus
atgtgaggcgacctgaagctcagcc

SEQ ID NO: 271666 - DNA, 25 bp, Mus musculus
atgtgaggcgacgtgaagctcagcc

SEQ ID NO: 271667 - DNA, 25 bp, Mus musculus
atgtgaggctctcatgagggttcct

SEQ ID NO: 271668 - DNA, 25 bp, Mus musculus
atgtgaggctctgatgagggttcct

SEQ ID NO: 271669 - DNA, 25 bp, Mus musculus
atgtgagggcatcacccatccatct

SEQ ID NO: 271670 - DNA, 25 bp, Mus musculus
atgtgagggcatgacccatccatct

SEQ ID NO: 271671 - DNA, 25 bp, Mus musculus
atgtgaggttcacacagtgagatgt

SEQ ID NO: 271672 - DNA, 25 bp, Mus musculus
atgtgaggttcagacagtgagatgt

SEQ ID NO: 271673 - DNA, 25 bp, Mus musculus
atgtgaggtttcctgatctgcagca

SEQ ID NO: 271674 - DNA, 25 bp, Mus musculus
atgtgaggtttcgtgatctgcagca

SEQ ID NO: 271675 - DNA, 25 bp, Mus musculus
atgtgagtaaatccttcccatctcc

SEQ ID NO: 271676 - DNA, 25 bp, Mus musculus
atgtgagtaaatgcttcccatctcc

SEQ ID NO: 271677 - DNA, 25 bp, Mus musculus
atgtgagtacagactctgtcctcag

SEQ ID NO: 271678 - DNA, 25 bp, Mus musculus
atgtgagtacagtctctgtcctcag

SEQ ID NO: 271679 - DNA, 25 bp, Mus musculus
atgtgagtacatatcctagaatgac

SEQ ID NO: 271680 - DNA, 25 bp, Mus musculus
atgtgagtacatttcctagaatgac

SEQ ID NO: 271681 - DNA, 25 bp, Mus musculus
atgtgagtacgcagcacctcagact

SEQ ID NO: 271682 - DNA, 25 bp, Mus musculus
atgtgagtacgctgcacctcagact

SEQ ID NO: 271683 - DNA, 25 bp, Mus musculus
atgtgagtactgatcgctacccacg

SEQ ID NO: 271684 - DNA, 25 bp, Mus musculus
atgtgagtactgctgtagcctggta

SEQ ID NO: 271685 - DNA, 25 bp, Mus musculus
atgtgagtactggtgtagcctggta

SEQ ID NO: 271686 - DNA, 25 bp, Mus musculus
atgtgagtactgttcgctacccacg

SEQ ID NO: 271687 - DNA, 25 bp, Mus musculus
atgtgagtagacctgctgtgaccaa

SEQ ID NO: 271688 - DNA, 25 bp, Mus musculus
atgtgagtagacgtgctgtgaccaa

SEQ ID NO: 271689 - DNA, 25 bp, Mus musculus
atgtgagtaggaaccccagcattct

SEQ ID NO: 271690 - DNA, 25 bp, Mus musculus
atgtgagtaggatccccagcattct

SEQ ID NO: 271691 - DNA, 25 bp, Mus musculus
atgtgagtatatcttaaagccctta

SEQ ID NO: 271692 - DNA, 25 bp, Mus musculus
atgtgagtatatgttaaagccctta

SEQ ID NO: 271693 - DNA, 25 bp, Mus musculus
atgtgagtccctcgaattccttact

SEQ ID NO: 271694 - DNA, 25 bp, Mus musculus
atgtgagtccctggaattccttact

SEQ ID NO: 271695 - DNA, 25 bp, Mus musculus
atgtgagtcctaaacaactgaaaca

SEQ ID NO: 271696 - DNA, 25 bp, Mus musculus
atgtgagtcctaaggagctacacgg

SEQ ID NO: 271697 - DNA, 25 bp, Mus musculus
atgtgagtcctatacaactgaaaca

SEQ ID NO: 271698 - DNA, 25 bp, Mus musculus
atgtgagtcctatggagctacacgg

SEQ ID NO: 271699 - DNA, 25 bp, Mus musculus
atgtgagtcgctatgatgtgtatct

SEQ ID NO: 271700 - DNA, 25 bp, Mus musculus
atgtgagtcgctttgatgtgtatct

SEQ ID NO: 271701 - DNA, 25 bp, Mus musculus
atgtgagtctgaccaaagaagttct

SEQ ID NO: 271702 - DNA, 25 bp, Mus musculus
atgtgagtctgagcaaagaagttct

SEQ ID NO: 271703 - DNA, 25 bp, Mus musculus
atgtgagtgaccacggtaggcgatt

SEQ ID NO: 271704 - DNA, 25 bp, Mus musculus
atgtgagtgacccagactccttgtg

SEQ ID NO: 271705 - DNA, 25 bp, Mus musculus
atgtgagtgaccgagactccttgtg

SEQ ID NO: 271706 - DNA, 25 bp, Mus musculus
atgtgagtgacctcggtaggcgatt

SEQ ID NO: 271707 - DNA, 25 bp, Mus musculus
atgtgagtgcatcatttgggcatca

SEQ ID NO: 271708 - DNA, 25 bp, Mus musculus
atgtgagtgcatgatttgggcatca

SEQ ID NO: 271709 - DNA, 25 bp, Mus musculus
atgtgagtggccagtcatcatggac

SEQ ID NO: 271710 - DNA, 25 bp, Mus musculus
atgtgagtggcctgtcatcatggac

SEQ ID NO: 271711 - DNA, 25 bp, Mus musculus
atgtgagttctcagtttctgctcta

SEQ ID NO: 271712 - DNA, 25 bp, Mus musculus
atgtgagttctctgtttctgctcta

SEQ ID NO: 271713 - DNA, 25 bp, Mus musculus
atgtgagttctgaatgggcctctct

SEQ ID NO: 271714 - DNA, 25 bp, Mus musculus
atgtgagttctgtatgggcctctct

SEQ ID NO: 271715 - DNA, 25 bp, Mus musculus
atgtgagttgccaggtgaccccatc

SEQ ID NO: 271716 - DNA, 25 bp, Mus musculus
atgtgagttgcctggtgaccccatc

SEQ ID NO: 271717 - DNA, 25 bp, Mus musculus
atgtgataagccagcagttttgtag

SEQ ID NO: 271718 - DNA, 25 bp, Mus musculus
atgtgataagcctgcagttttgtag

SEQ ID NO: 271719 - DNA, 25 bp, Mus musculus
atgtgatacacacggcttcagagcc

SEQ ID NO: 271720 - DNA, 25 bp, Mus musculus
atgtgatacacagggcttcagagcc

SEQ ID NO: 271721 - DNA, 25 bp, Mus musculus
atgtgatacagaactcaggaactcc

SEQ ID NO: 271722 - DNA, 25 bp, Mus musculus
atgtgatacagatctcaggaactcc

SEQ ID NO: 271723 - DNA, 25 bp, Mus musculus
atgtgatacctacaagtgtcgggtt

SEQ ID NO: 271724 - DNA, 25 bp, Mus musculus
atgtgatacctagaagtgtcgggtt

SEQ ID NO: 271725 - DNA, 25 bp, Mus musculus
atgtgatacctcatctcgtctagac

SEQ ID NO: 271726 - DNA, 25 bp, Mus musculus
atgtgatacctcttctcgtctagac

SEQ ID NO: 271727 - DNA, 25 bp, Mus musculus
atgtgataggaccacctgcttgctt

SEQ ID NO: 271728 - DNA, 25 bp, Mus musculus
atgtgataggacgacctgcttgctt

SEQ ID NO: 271729 - DNA, 25 bp, Mus musculus
atgtgatagttcaccagcttgctcc

SEQ ID NO: 271730 - DNA, 25 bp, Mus musculus
atgtgatagttctccagcttgctcc

SEQ ID NO: 271731 - DNA, 25 bp, Mus musculus
atgtgatatgaaacgctgtctcaat

SEQ ID NO: 271732 - DNA, 25 bp, Mus musculus
atgtgatatgaatcgctgtctcaat

SEQ ID NO: 271733 - DNA, 25 bp, Mus musculus
atgtgatcaaaacccattgtatgca

SEQ ID NO: 271734 - DNA, 25 bp, Mus musculus
atgtgatcaaaagccattgtatgca

SEQ ID NO: 271735 - DNA, 25 bp, Mus musculus
atgtgatcaagcaatttgaccggag

SEQ ID NO: 271736 - DNA, 25 bp, Mus musculus
atgtgatcaagctatttgaccggag

SEQ ID NO: 271737 - DNA, 25 bp, Mus musculus
atgtgatcacaccatgactgtagtg

SEQ ID NO: 271738 - DNA, 25 bp, Mus musculus
atgtgatcacacgatgactgtagtg

SEQ ID NO: 271739 - DNA, 25 bp, Mus musculus
atgtgatcacagactcaggatggat

SEQ ID NO: 271740 - DNA, 25 bp, Mus musculus
atgtgatcacagtctcaggatggat

SEQ ID NO: 271741 - DNA, 25 bp, Mus musculus
atgtgatcagacagccgttgggtcc

SEQ ID NO: 271742 - DNA, 25 bp, Mus musculus
atgtgatcagactgccgttgggtcc

SEQ ID NO: 271743 - DNA, 25 bp, Mus musculus
atgtgatcagatagtacgaaagacg

SEQ ID NO: 271744 - DNA, 25 bp, Mus musculus
atgtgatcagattgtacgaaagacg

SEQ ID NO: 271745 - DNA, 25 bp, Mus musculus
atgtgatccattcggctagtggtcc

SEQ ID NO: 271746 - DNA, 25 bp, Mus musculus
atgtgatccattgggctagtggtcc

SEQ ID NO: 271747 - DNA, 25 bp, Mus musculus
atgtgatcccacactagaaaatttg

SEQ ID NO: 271748 - DNA, 25 bp, Mus musculus
atgtgatcccactctagaaaatttg

SEQ ID NO: 271749 - DNA, 25 bp, Mus musculus
atgtgatcccgaattgcctttagat

SEQ ID NO: 271750 - DNA, 25 bp, Mus musculus
atgtgatcccgatttgcctttagat

SEQ ID NO: 271751 - DNA, 25 bp, Mus musculus
atgtgatccctgactctggcagatg

SEQ ID NO: 271752 - DNA, 25 bp, Mus musculus
atgtgatccctgtctctggcagatg

SEQ ID NO: 271753 - DNA, 25 bp, Mus musculus
atgtgatccgggatagccatgtgct

SEQ ID NO: 271754 - DNA, 25 bp, Mus musculus
atgtgatccgggttagccatgtgct

SEQ ID NO: 271755 - DNA, 25 bp, Mus musculus
atgtgatccttcaggctctggcttg

SEQ ID NO: 271756 - DNA, 25 bp, Mus musculus
atgtgatccttctggctctggcttg

SEQ ID NO: 271757 - DNA, 25 bp, Mus musculus
atgtgatcgaggcaccggagataaa

SEQ ID NO: 271758 - DNA, 25 bp, Mus musculus
atgtgatcgagggaccggagataaa

SEQ ID NO: 271759 - DNA, 25 bp, Mus musculus
atgtgatcgattaccttgagcctca

SEQ ID NO: 271760 - DNA, 25 bp, Mus musculus
atgtgatcgatttccttgagcctca

SEQ ID NO: 271761 - DNA, 25 bp, Mus musculus
atgtgatctcaacagacacaaagaa

SEQ ID NO: 271762 - DNA, 25 bp, Mus musculus
atgtgatctcaagagacacaaagaa

SEQ ID NO: 271763 - DNA, 25 bp, Mus musculus
atgtgatctgcactgcttctgaagt

SEQ ID NO: 271764 - DNA, 25 bp, Mus musculus
atgtgatctgcagtgcttctgaagt

SEQ ID NO: 271765 - DNA, 25 bp, Mus musculus
atgtgatcttcaccttggattcctt

SEQ ID NO: 271766 - DNA, 25 bp, Mus musculus
atgtgatcttcagcttggattcctt

SEQ ID NO: 271767 - DNA, 25 bp, Mus musculus
atgtgatgaactccaatcttttcca

SEQ ID NO: 271768 - DNA, 25 bp, Mus musculus
atgtgatgaactgcaatcttttcca

SEQ ID NO: 271769 - DNA, 25 bp, Mus musculus
atgtgatgacgcaggcctgtgatcc

SEQ ID NO: 271770 - DNA, 25 bp, Mus musculus
atgtgatgacgctggcctgtgatcc

SEQ ID NO: 271771 - DNA, 25 bp, Mus musculus
atgtgatgctaactgttgccctctt

SEQ ID NO: 271772 - DNA, 25 bp, Mus musculus
atgtgatgctaagtgttgccctctt

SEQ ID NO: 271773 - DNA, 25 bp, Mus musculus
atgtgatggataagcctcacccggg

SEQ ID NO: 271774 - DNA, 25 bp, Mus musculus
atgtgatggatatgcctcacccggg

SEQ ID NO: 271775 - DNA, 25 bp, Mus musculus
atgtgatgggttatttgtataatgt

SEQ ID NO: 271776 - DNA, 25 bp, Mus musculus
atgtgatgggttttttgtataatgt

SEQ ID NO: 271777 - DNA, 25 bp, Mus musculus
atgtgatgtagccatgtttgctgac

SEQ ID NO: 271778 - DNA, 25 bp, Mus musculus
atgtgatgtagcgatgtttgctgac

SEQ ID NO: 271779 - DNA, 25 bp, Mus musculus
atgtgatgtcatcccatgcaatgcc

SEQ ID NO: 271780 - DNA, 25 bp, Mus musculus
atgtgatgtcatgccatgcaatgcc

SEQ ID NO: 271781 - DNA, 25 bp, Mus musculus
atgtgatgtcttatctggctatatt

SEQ ID NO: 271782 - DNA, 25 bp, Mus musculus
atgtgatgtcttttctggctatatt

SEQ ID NO: 271783 - DNA, 25 bp, Mus musculus
atgtgatgtgatattatcctttgga

SEQ ID NO: 271784 - DNA, 25 bp, Mus musculus
atgtgatgtgattttatcctttgga

SEQ ID NO: 271785 - DNA, 25 bp, Mus musculus
atgtgatgtgctattccagtatctt

SEQ ID NO: 271786 - DNA, 25 bp, Mus musculus
atgtgatgtgcttttccagtatctt

SEQ ID NO: 271787 - DNA, 25 bp, Mus musculus
atgtgatgtgtgagagctggggacc

SEQ ID NO: 271788 - DNA, 25 bp, Mus musculus
atgtgatgtgtgtgagctggggacc

SEQ ID NO: 271789 - DNA, 25 bp, Mus musculus
atgtgattagaaacctgcccttcat

SEQ ID NO: 271790 - DNA, 25 bp, Mus musculus
atgtgattagaatcctgcccttcat

SEQ ID NO: 271791 - DNA, 25 bp, Mus musculus
atgtgattattgagtctctctacca

SEQ ID NO: 271792 - DNA, 25 bp, Mus musculus
atgtgattattgtgtctctctacca

SEQ ID NO: 271793 - DNA, 25 bp, Mus musculus
atgtgattcatgaccctttttataa

SEQ ID NO: 271794 - DNA, 25 bp, Mus musculus
atgtgattcatgtccctttttataa

SEQ ID NO: 271795 - DNA, 25 bp, Mus musculus
atgtgattccaccaccgggttcttt

SEQ ID NO: 271796 - DNA, 25 bp, Mus musculus
atgtgattccacgaccgggttcttt

SEQ ID NO: 271797 - DNA, 25 bp, Mus musculus
atgtgattctagaaccttatattag

SEQ ID NO: 271798 - DNA, 25 bp, Mus musculus
atgtgattctagtaccttatattag

SEQ ID NO: 271799 - DNA, 25 bp, Mus musculus
atgtgattctgaacaaggtgagacc

SEQ ID NO: 271800 - DNA, 25 bp, Mus musculus
atgtgattctgatcaaggtgagacc

SEQ ID NO: 271801 - DNA, 25 bp, Mus musculus
atgtgattgatactgcatttgcctt

SEQ ID NO: 271802 - DNA, 25 bp, Mus musculus
atgtgattgatagtgcatttgcctt

SEQ ID NO: 271803 - DNA, 25 bp, Mus musculus
atgtgattgattcctacggctgctc

SEQ ID NO: 271804 - DNA, 25 bp, Mus musculus
atgtgattgattgctacggctgctc

SEQ ID NO: 271805 - DNA, 25 bp, Mus musculus
atgtgattgcatagctggcatctgt

SEQ ID NO: 271806 - DNA, 25 bp, Mus musculus
atgtgattgcattgctggcatctgt

SEQ ID NO: 271807 - DNA, 25 bp, Mus musculus
atgtgattgcctatatgagctttgc

SEQ ID NO: 271808 - DNA, 25 bp, Mus musculus
atgtgattgcctttatgagctttgc

SEQ ID NO: 271809 - DNA, 25 bp, Mus musculus
atgtgattgctaagcacgggcatat

SEQ ID NO: 271810 - DNA, 25 bp, Mus musculus
atgtgattgctatgcacgggcatat

SEQ ID NO: 271811 - DNA, 25 bp, Mus musculus
atgtgattgctccagaggaccagga

SEQ ID NO: 271812 - DNA, 25 bp, Mus musculus
atgtgattgctcgagaggaccagga

SEQ ID NO: 271813 - DNA, 25 bp, Mus musculus
atgtgattggctaccatccaacctt

SEQ ID NO: 271814 - DNA, 25 bp, Mus musculus
atgtgattggcttccatccaacctt

SEQ ID NO: 271815 - DNA, 25 bp, Mus musculus
atgtgattgttgctttccgagaagc

SEQ ID NO: 271816 - DNA, 25 bp, Mus musculus
atgtgattgttggtttccgagaagc

SEQ ID NO: 271817 - DNA, 25 bp, Mus musculus
atgtgatttcagactattcttttcc

SEQ ID NO: 271818 - DNA, 25 bp, Mus musculus
atgtgatttcagtctattcttttcc

SEQ ID NO: 271819 - DNA, 25 bp, Mus musculus
atgtgatttctcacatctagcctag

SEQ ID NO: 271820 - DNA, 25 bp, Mus musculus
atgtgatttctctcatctagcctag

SEQ ID NO: 271821 - DNA, 25 bp, Mus musculus
atgtgatttctgatccagctgtata

SEQ ID NO: 271822 - DNA, 25 bp, Mus musculus
atgtgatttctgttccagctgtata

SEQ ID NO: 271823 - DNA, 25 bp, Mus musculus
atgtgatttcttctttcaagtttaa

SEQ ID NO: 271824 - DNA, 25 bp, Mus musculus
atgtgatttcttgtttcaagtttaa

SEQ ID NO: 271825 - DNA, 25 bp, Mus musculus
atgtgatttggccttctggtttccc

SEQ ID NO: 271826 - DNA, 25 bp, Mus musculus
atgtgatttggcgttctggtttccc

SEQ ID NO: 271827 - DNA, 25 bp, Mus musculus
atgtgatttttcagggccctggagg

SEQ ID NO: 271828 - DNA, 25 bp, Mus musculus
atgtgatttttctgggccctggagg

SEQ ID NO: 271829 - DNA, 25 bp, Mus musculus
atgtgatttttgaccccaattactt

SEQ ID NO: 271830 - DNA, 25 bp, Mus musculus
atgtgatttttgtccccaattactt

SEQ ID NO: 271831 - DNA, 25 bp, Mus musculus
atgtgcaaaagaagccccgtgccct

SEQ ID NO: 271832 - DNA, 25 bp, Mus musculus
atgtgcaaaagatgccccgtgccct

SEQ ID NO: 271833 - DNA, 25 bp, Mus musculus
atgtgcaaccacatcttatgtttct

SEQ ID NO: 271834 - DNA, 25 bp, Mus musculus
atgtgcaaccacttcttatgtttct

SEQ ID NO: 271835 - DNA, 25 bp, Mus musculus
atgtgcaaccccatgactttatgta

SEQ ID NO: 271836 - DNA, 25 bp, Mus musculus
atgtgcaaccccttgactttatgta

SEQ ID NO: 271837 - DNA, 25 bp, Mus musculus
atgtgcaaccttcattgtccatctt

SEQ ID NO: 271838 - DNA, 25 bp, Mus musculus
atgtgcaaccttgattgtccatctt

SEQ ID NO: 271839 - DNA, 25 bp, Mus musculus
atgtgcaactgaatcttcctgggct

SEQ ID NO: 271840 - DNA, 25 bp, Mus musculus
atgtgcaactgattcttcctgggct

SEQ ID NO: 271841 - DNA, 25 bp, Mus musculus
atgtgcaagatccacagcctaccaa

SEQ ID NO: 271842 - DNA, 25 bp, Mus musculus
atgtgcaagatcgacagcctaccaa

SEQ ID NO: 271843 - DNA, 25 bp, Mus musculus
atgtgcaagcagagtcctctacttg

SEQ ID NO: 271844 - DNA, 25 bp, Mus musculus
atgtgcaagcagtgtcctctacttg

SEQ ID NO: 271845 - DNA, 25 bp, Mus musculus
atgtgcaataaaacatccaagatca

SEQ ID NO: 271846 - DNA, 25 bp, Mus musculus
atgtgcaataaatcatccaagatca

SEQ ID NO: 271847 - DNA, 25 bp, Mus musculus
atgtgcaatgctagcttcctcctcc

SEQ ID NO: 271848 - DNA, 25 bp, Mus musculus
atgtgcaatgcttgcttcctcctcc

SEQ ID NO: 271849 - DNA, 25 bp, Mus musculus
atgtgcaatggaacgttgtccccac

SEQ ID NO: 271850 - DNA, 25 bp, Mus musculus
atgtgcaatggacatggaagaggtc

SEQ ID NO: 271851 - DNA, 25 bp, Mus musculus
atgtgcaatggagatggaagaggtc

SEQ ID NO: 271852 - DNA, 25 bp, Mus musculus
atgtgcaatggatcgttgtccccac

SEQ ID NO: 271853 - DNA, 25 bp, Mus musculus
atgtgcaatttgattcttaggtaga

SEQ ID NO: 271854 - DNA, 25 bp, Mus musculus
atgtgcaatttgtttcttaggtaga

SEQ ID NO: 271855 - DNA, 25 bp, Mus musculus
atgtgcacacacatggtgttgacct

SEQ ID NO: 271856 - DNA, 25 bp, Mus musculus
atgtgcacacacattggcagaaggg

SEQ ID NO: 271857 - DNA, 25 bp, Mus musculus
atgtgcacacacttggtgttgacct

SEQ ID NO: 271858 - DNA, 25 bp, Mus musculus
atgtgcacacactttggcagaaggg

SEQ ID NO: 271859 - DNA, 25 bp, Mus musculus
atgtgcacacagctcatcttatatg

SEQ ID NO: 271860 - DNA, 25 bp, Mus musculus
atgtgcacacaggtcatcttatatg

SEQ ID NO: 271861 - DNA, 25 bp, Mus musculus
atgtgcacacatacatgtccatata

SEQ ID NO: 271862 - DNA, 25 bp, Mus musculus
atgtgcacacatcttgaggaacgct

SEQ ID NO: 271863 - DNA, 25 bp, Mus musculus
atgtgcacacatgttgaggaacgct

SEQ ID NO: 271864 - DNA, 25 bp, Mus musculus
atgtgcacacattcatgtccatata

SEQ ID NO: 271865 - DNA, 25 bp, Mus musculus
atgtgcacacctcacacgggttaaa

SEQ ID NO: 271866 - DNA, 25 bp, Mus musculus
atgtgcacacctgacacgggttaaa

SEQ ID NO: 271867 - DNA, 25 bp, Mus musculus
atgtgcacactcatagtgctctctc

SEQ ID NO: 271868 - DNA, 25 bp, Mus musculus
atgtgcacactccttggactccaga

SEQ ID NO: 271869 - DNA, 25 bp, Mus musculus
atgtgcacactcgttggactccaga

SEQ ID NO: 271870 - DNA, 25 bp, Mus musculus
atgtgcacactcttagtgctctctc

SEQ ID NO: 271871 - DNA, 25 bp, Mus musculus
atgtgcacagaaatcctaaggtcga

SEQ ID NO: 271872 - DNA, 25 bp, Mus musculus
atgtgcacagaattcctaaggtcga

SEQ ID NO: 271873 - DNA, 25 bp, Mus musculus
atgtgcacagacctacatggaagca

SEQ ID NO: 271874 - DNA, 25 bp, Mus musculus
atgtgcacagacgtacatggaagca

SEQ ID NO: 271875 - DNA, 25 bp, Mus musculus
atgtgcacaggcatcgaggccagag

SEQ ID NO: 271876 - DNA, 25 bp, Mus musculus
atgtgcacaggcttcgaggccagag

SEQ ID NO: 271877 - DNA, 25 bp, Mus musculus
atgtgcaccgctatcaaaaatactt

SEQ ID NO: 271878 - DNA, 25 bp, Mus musculus
atgtgcaccgctttcaaaaatactt

SEQ ID NO: 271879 - DNA, 25 bp, Mus musculus
atgtgcaccgtgaccaatggtcaaa

SEQ ID NO: 271880 - DNA, 25 bp, Mus musculus
atgtgcaccgtgtccaatggtcaaa

SEQ ID NO: 271881 - DNA, 25 bp, Mus musculus
atgtgcacctcacatggcaagctct

SEQ ID NO: 271882 - DNA, 25 bp, Mus musculus
atgtgcacctcagatggcaagctct

SEQ ID NO: 271883 - DNA, 25 bp, Mus musculus
atgtgcacctgtcctactcatacat

SEQ ID NO: 271884 - DNA, 25 bp, Mus musculus
atgtgcacctgtgctactcatacat

SEQ ID NO: 271885 - DNA, 25 bp, Mus musculus
atgtgcacctttcagtgtgcctcat

SEQ ID NO: 271886 - DNA, 25 bp, Mus musculus
atgtgcacctttgagtgtgcctcat

SEQ ID NO: 271887 - DNA, 25 bp, Mus musculus
atgtgcactagtctacctgttgccc

SEQ ID NO: 271888 - DNA, 25 bp, Mus musculus
atgtgcactagtgtacctgttgccc

SEQ ID NO: 271889 - DNA, 25 bp, Mus musculus
atgtgcactccactgtgaacatggc

SEQ ID NO: 271890 - DNA, 25 bp, Mus musculus
atgtgcactccagtgtgaacatggc

SEQ ID NO: 271891 - DNA, 25 bp, Mus musculus
atgtgcactctgatgacttgtcaaa

SEQ ID NO: 271892 - DNA, 25 bp, Mus musculus
atgtgcactctgttgacttgtcaaa

SEQ ID NO: 271893 - DNA, 25 bp, Mus musculus
atgtgcactggacatgtggacagaa

SEQ ID NO: 271894 - DNA, 25 bp, Mus musculus
atgtgcactggagatgtggacagaa

SEQ ID NO: 271895 - DNA, 25 bp, Mus musculus
atgtgcactggtatccaatttaagg

SEQ ID NO: 271896 - DNA, 25 bp, Mus musculus
atgtgcactggtttccaatttaagg

SEQ ID NO: 271897 - DNA, 25 bp, Mus musculus
atgtgcagaacaccctagacttgcc

SEQ ID NO: 271898 - DNA, 25 bp, Mus musculus
atgtgcagaacagcctagacttgcc

SEQ ID NO: 271899 - DNA, 25 bp, Mus musculus
atgtgcagaagaacagggtcatcct

SEQ ID NO: 271900 - DNA, 25 bp, Mus musculus
atgtgcagaagatcagggtcatcct

SEQ ID NO: 271901 - DNA, 25 bp, Mus musculus
atgtgcagaagcactgtcagtcttt

SEQ ID NO: 271902 - DNA, 25 bp, Mus musculus
atgtgcagaagctctgtcagtcttt

SEQ ID NO: 271903 - DNA, 25 bp, Mus musculus
atgtgcagaatcctcgttcccttgg

SEQ ID NO: 271904 - DNA, 25 bp, Mus musculus
atgtgcagaatcgtcgttcccttgg

SEQ ID NO: 271905 - DNA, 25 bp, Mus musculus
atgtgcagaatgaggtaagggcttt

SEQ ID NO: 271906 - DNA, 25 bp, Mus musculus
atgtgcagaatgtggtaagggcttt

SEQ ID NO: 271907 - DNA, 25 bp, Mus musculus
atgtgcagacagaaccccagtctca

SEQ ID NO: 271908 - DNA, 25 bp, Mus musculus
atgtgcagacagtaccccagtctca

SEQ ID NO: 271909 - DNA, 25 bp, Mus musculus
atgtgcagacccaatatgcctgtgt

SEQ ID NO: 271910 - DNA, 25 bp, Mus musculus
atgtgcagaccctatatgcctgtgt

SEQ ID NO: 271911 - DNA, 25 bp, Mus musculus
atgtgcagacgtcacaagataatga

SEQ ID NO: 271912 - DNA, 25 bp, Mus musculus
atgtgcagacgtgacaagataatga

SEQ ID NO: 271913 - DNA, 25 bp, Mus musculus
atgtgcagagtgaagtgcctcaccc

SEQ ID NO: 271914 - DNA, 25 bp, Mus musculus
atgtgcagagtgcttcagttagcca

SEQ ID NO: 271915 - DNA, 25 bp, Mus musculus
atgtgcagagtggttcagttagcca

SEQ ID NO: 271916 - DNA, 25 bp, Mus musculus
atgtgcagagtgtagtgcctcaccc

SEQ ID NO: 271917 - DNA, 25 bp, Mus musculus
atgtgcagatgcagagacactctat

SEQ ID NO: 271918 - DNA, 25 bp, Mus musculus
atgtgcagatgctgagacactctat

SEQ ID NO: 271919 - DNA, 25 bp, Mus musculus
atgtgcagcacaactatgggccttc

SEQ ID NO: 271920 - DNA, 25 bp, Mus musculus
atgtgcagcacatctatgggccttc

SEQ ID NO: 271921 - DNA, 25 bp, Mus musculus
atgtgcagccagctgcaagggtcta

SEQ ID NO: 271922 - DNA, 25 bp, Mus musculus
atgtgcagccaggtgcaagggtcta

SEQ ID NO: 271923 - DNA, 25 bp, Mus musculus
atgtgcagcgccagtgtccctcgac

SEQ ID NO: 271924 - DNA, 25 bp, Mus musculus
atgtgcagcgcctgtgtccctcgac

SEQ ID NO: 271925 - DNA, 25 bp, Mus musculus
atgtgcagctctatggcatacttgt

SEQ ID NO: 271926 - DNA, 25 bp, Mus musculus
atgtgcagctctttggcatacttgt

SEQ ID NO: 271927 - DNA, 25 bp, Mus musculus
atgtgcagctttctgttcaacttga

SEQ ID NO: 271928 - DNA, 25 bp, Mus musculus
atgtgcagctttgtgttcaacttga

SEQ ID NO: 271929 - DNA, 25 bp, Mus musculus
atgtgcaggacacctgagagtcact

SEQ ID NO: 271930 - DNA, 25 bp, Mus musculus
atgtgcaggacagctgagagtcact

SEQ ID NO: 271931 - DNA, 25 bp, Mus musculus
atgtgcaggatgctgccttcaacct

SEQ ID NO: 271932 - DNA, 25 bp, Mus musculus
atgtgcaggatggtgccttcaacct

SEQ ID NO: 271933 - DNA, 25 bp, Mus musculus
atgtgcaggccactggtacctgaaa

SEQ ID NO: 271934 - DNA, 25 bp, Mus musculus
atgtgcaggccagtggtacctgaaa

SEQ ID NO: 271935 - DNA, 25 bp, Mus musculus
atgtgcagggccaacaatgccaaca

SEQ ID NO: 271936 - DNA, 25 bp, Mus musculus
atgtgcagggcctacaatgccaaca

SEQ ID NO: 271937 - DNA, 25 bp, Mus musculus
atgtgcagtaatccgacccttcagg

SEQ ID NO: 271938 - DNA, 25 bp, Mus musculus
atgtgcagtaatgcgacccttcagg

SEQ ID NO: 271939 - DNA, 25 bp, Mus musculus
atgtgcagtagcatagcctggtact

SEQ ID NO: 271940 - DNA, 25 bp, Mus musculus
atgtgcagtagcttagcctggtact

SEQ ID NO: 271941 - DNA, 25 bp, Mus musculus
atgtgcagtctgatatgggttcctt

SEQ ID NO: 271942 - DNA, 25 bp, Mus musculus
atgtgcagtctgttatgggttcctt

SEQ ID NO: 271943 - DNA, 25 bp, Mus musculus
atgtgcagtgccactagtgtgctgt

SEQ ID NO: 271944 - DNA, 25 bp, Mus musculus
atgtgcagtgcctctagtgtgctgt

SEQ ID NO: 271945 - DNA, 25 bp, Mus musculus
atgtgcagttaaccgacatcaccct

SEQ ID NO: 271946 - DNA, 25 bp, Mus musculus
atgtgcagttaagcgacatcaccct

SEQ ID NO: 271947 - DNA, 25 bp, Mus musculus
atgtgcataaccatataacctttga

SEQ ID NO: 271948 - DNA, 25 bp, Mus musculus
atgtgcataaccttataacctttga

SEQ ID NO: 271949 - DNA, 25 bp, Mus musculus
atgtgcatacccagagtcctgctgc

SEQ ID NO: 271950 - DNA, 25 bp, Mus musculus
atgtgcataccctgagtcctgctgc

SEQ ID NO: 271951 - DNA, 25 bp, Mus musculus
atgtgcatagtcagttgtccttttt

SEQ ID NO: 271952 - DNA, 25 bp, Mus musculus
atgtgcatagtctgttgtccttttt

SEQ ID NO: 271953 - DNA, 25 bp, Mus musculus
atgtgcatatgcagacgcctgagaa

SEQ ID NO: 271954 - DNA, 25 bp, Mus musculus
atgtgcatatgctgacgcctgagaa

SEQ ID NO: 271955 - DNA, 25 bp, Mus musculus
atgtgcatattgaacttaggagtgt

SEQ ID NO: 271956 - DNA, 25 bp, Mus musculus
atgtgcatattgtacttaggagtgt

SEQ ID NO: 271957 - DNA, 25 bp, Mus musculus
atgtgcatcaaaaacccaactccag

SEQ ID NO: 271958 - DNA, 25 bp, Mus musculus
atgtgcatcaaatacccaactccag

SEQ ID NO: 271959 - DNA, 25 bp, Mus musculus
atgtgcatccagagatcatgatttc

SEQ ID NO: 271960 - DNA, 25 bp, Mus musculus
atgtgcatccagtgatcatgatttc

SEQ ID NO: 271961 - DNA, 25 bp, Mus musculus
atgtgcatcgcaccttggtctatgg

SEQ ID NO: 271962 - DNA, 25 bp, Mus musculus
atgtgcatcgcagcttggtctatgg

SEQ ID NO: 271963 - DNA, 25 bp, Mus musculus
atgtgcatgcatctacttcacccat

SEQ ID NO: 271964 - DNA, 25 bp, Mus musculus
atgtgcatgcatgtacttcacccat

SEQ ID NO: 271965 - DNA, 25 bp, Mus musculus
atgtgcatgtaccagagtccaacca

SEQ ID NO: 271966 - DNA, 25 bp, Mus musculus
atgtgcatgtacgagagtccaacca

SEQ ID NO: 271967 - DNA, 25 bp, Mus musculus
atgtgcattccaaatacctgggctc

SEQ ID NO: 271968 - DNA, 25 bp, Mus musculus
atgtgcattccatatacctgggctc

SEQ ID NO: 271969 - DNA, 25 bp, Mus musculus
atgtgcattgccacctctgttgtcc

SEQ ID NO: 271970 - DNA, 25 bp, Mus musculus
atgtgcattgcctcctctgttgtcc

SEQ ID NO: 271971 - DNA, 25 bp, Mus musculus
atgtgcattgtaaggctggtcgatc

SEQ ID NO: 271972 - DNA, 25 bp, Mus musculus
atgtgcattgtatggctggtcgatc

SEQ ID NO: 271973 - DNA, 25 bp, Mus musculus
atgtgcattgtgcactcgccagagt

SEQ ID NO: 271974 - DNA, 25 bp, Mus musculus
atgtgcattgtggactcgccagagt

SEQ ID NO: 271975 - DNA, 25 bp, Mus musculus
atgtgccaaaagactacatcccagc

SEQ ID NO: 271976 - DNA, 25 bp, Mus musculus
atgtgccaaaagtctacatcccagc

SEQ ID NO: 271977 - DNA, 25 bp, Mus musculus
atgtgccaaagcatttcttgtcttg

SEQ ID NO: 271978 - DNA, 25 bp, Mus musculus
atgtgccaaagcttttcttgtcttg

SEQ ID NO: 271979 - DNA, 25 bp, Mus musculus
atgtgccaaggcaccaacagacaag

SEQ ID NO: 271980 - DNA, 25 bp, Mus musculus
atgtgccaaggctccaacagacaag

SEQ ID NO: 271981 - DNA, 25 bp, Mus musculus
atgtgccacacaagtccctagagtt

SEQ ID NO: 271982 - DNA, 25 bp, Mus musculus
atgtgccacacatgtccctagagtt

SEQ ID NO: 271983 - DNA, 25 bp, Mus musculus
atgtgccacagtatctagtttctca

SEQ ID NO: 271984 - DNA, 25 bp, Mus musculus
atgtgccacagtttctagtttctca

SEQ ID NO: 271985 - DNA, 25 bp, Mus musculus
atgtgccacattatagcccatttac

SEQ ID NO: 271986 - DNA, 25 bp, Mus musculus
atgtgccacattattctgtgtctta

SEQ ID NO: 271987 - DNA, 25 bp, Mus musculus
atgtgccacattttagcccatttac

SEQ ID NO: 271988 - DNA, 25 bp, Mus musculus
atgtgccacatttttctgtgtctta

SEQ ID NO: 271989 - DNA, 25 bp, Mus musculus
atgtgccaccttccctaatattggt

SEQ ID NO: 271990 - DNA, 25 bp, Mus musculus
atgtgccaccttgcctaatattggt

SEQ ID NO: 271991 - DNA, 25 bp, Mus musculus
atgtgccacgttagtgggtacttca

SEQ ID NO: 271992 - DNA, 25 bp, Mus musculus
atgtgccacgtttgtgggtacttca

SEQ ID NO: 271993 - DNA, 25 bp, Mus musculus
atgtgccactaactccagcttagca

SEQ ID NO: 271994 - DNA, 25 bp, Mus musculus
atgtgccactaagtccagcttagca

SEQ ID NO: 271995 - DNA, 25 bp, Mus musculus
atgtgccactcaacgggagaggttc

SEQ ID NO: 271996 - DNA, 25 bp, Mus musculus
atgtgccactcatcgggagaggttc

SEQ ID NO: 271997 - DNA, 25 bp, Mus musculus
atgtgccactggcattctcctggat

SEQ ID NO: 271998 - DNA, 25 bp, Mus musculus
atgtgccactgggattctcctggat

SEQ ID NO: 271999 - DNA, 25 bp, Mus musculus
atgtgccagagtctgcatgcttcag

SEQ ID NO: 272000 - DNA, 25 bp, Mus musculus
atgtgccagagtgtgcatgcttcag

SEQ ID NO: 272001 - DNA, 25 bp, Mus musculus
atgtgccagcccatctgcttccttg

SEQ ID NO: 272002 - DNA, 25 bp, Mus musculus
atgtgccagcccttctgcttccttg

SEQ ID NO: 272003 - DNA, 25 bp, Mus musculus
atgtgccagcctctggtctcagtgc

SEQ ID NO: 272004 - DNA, 25 bp, Mus musculus
atgtgccagcctgtggtctcagtgc

SEQ ID NO: 272005 - DNA, 25 bp, Mus musculus
atgtgccagctgcaaccatggagga

SEQ ID NO: 272006 - DNA, 25 bp, Mus musculus
atgtgccagctggaaccatggagga

SEQ ID NO: 272007 - DNA, 25 bp, Mus musculus
atgtgccaggcccaagaacaagctt

SEQ ID NO: 272008 - DNA, 25 bp, Mus musculus
atgtgccaggccgaagaacaagctt

SEQ ID NO: 272009 - DNA, 25 bp, Mus musculus
atgtgccaggcgactccgcgctgaa

SEQ ID NO: 272010 - DNA, 25 bp, Mus musculus
atgtgccaggcgtctccgcgctgaa

SEQ ID NO: 272011 - DNA, 25 bp, Mus musculus
atgtgccaggtaaggctctagccac

SEQ ID NO: 272012 - DNA, 25 bp, Mus musculus
atgtgccaggtatggctctagccac

SEQ ID NO: 272013 - DNA, 25 bp, Mus musculus
atgtgcccaataaaagagagctgtg

SEQ ID NO: 272014 - DNA, 25 bp, Mus musculus
atgtgcccaatataagagagctgtg

SEQ ID NO: 272015 - DNA, 25 bp, Mus musculus
atgtgcccacagataaacagtggtc

SEQ ID NO: 272016 - DNA, 25 bp, Mus musculus
atgtgcccacagttaaacagtggtc

SEQ ID NO: 272017 - DNA, 25 bp, Mus musculus
atgtgcccagcgctggtggccaaat

SEQ ID NO: 272018 - DNA, 25 bp, Mus musculus
atgtgcccagcggtggtggccaaat

SEQ ID NO: 272019 - DNA, 25 bp, Mus musculus
atgtgcccagtgaagtcgtggcttt

SEQ ID NO: 272020 - DNA, 25 bp, Mus musculus
atgtgcccagtgcaccaggctatgg

SEQ ID NO: 272021 - DNA, 25 bp, Mus musculus
atgtgcccagtggaccaggctatgg

SEQ ID NO: 272022 - DNA, 25 bp, Mus musculus
atgtgcccagtgtagtcgtggcttt

SEQ ID NO: 272023 - DNA, 25 bp, Mus musculus
atgtgcccatgcattcctatagtgt

SEQ ID NO: 272024 - DNA, 25 bp, Mus musculus
atgtgcccatgcctggcttgtttaa

SEQ ID NO: 272025 - DNA, 25 bp, Mus musculus
atgtgcccatgcgtggcttgtttaa

SEQ ID NO: 272026 - DNA, 25 bp, Mus musculus
atgtgcccatgctttcctatagtgt

SEQ ID NO: 272027 - DNA, 25 bp, Mus musculus
atgtgcccatttatacctactactt

SEQ ID NO: 272028 - DNA, 25 bp, Mus musculus
atgtgcccatttttacctactactt

SEQ ID NO: 272029 - DNA, 25 bp, Mus musculus
atgtgccccacgctttagtgacttt

SEQ ID NO: 272030 - DNA, 25 bp, Mus musculus
atgtgccccacggtttagtgacttt

SEQ ID NO: 272031 - DNA, 25 bp, Mus musculus
atgtgccccagaacactgtggttta

SEQ ID NO: 272032 - DNA, 25 bp, Mus musculus
atgtgccccagatcactgtggttta

SEQ ID NO: 272033 - DNA, 25 bp, Mus musculus
atgtgcccctgtcaccgtttctctg

SEQ ID NO: 272034 - DNA, 25 bp, Mus musculus
atgtgcccctgtgaccgtttctctg

SEQ ID NO: 272035 - DNA, 25 bp, Mus musculus
atgtgccctcacagagtgacctgga

SEQ ID NO: 272036 - DNA, 25 bp, Mus musculus
atgtgccctcactgagtgacctgga

SEQ ID NO: 272037 - DNA, 25 bp, Mus musculus
atgtgccctgttatttccactggac

SEQ ID NO: 272038 - DNA, 25 bp, Mus musculus
atgtgccctgttttttccactggac

SEQ ID NO: 272039 - DNA, 25 bp, Mus musculus
atgtgccctttacgtgagcctgctg

SEQ ID NO: 272040 - DNA, 25 bp, Mus musculus
atgtgccctttaggtgagcctgctg

SEQ ID NO: 272041 - DNA, 25 bp, Mus musculus
atgtgccgcctgaacataggatacc

SEQ ID NO: 272042 - DNA, 25 bp, Mus musculus
atgtgccgcctgtacataggatacc

SEQ ID NO: 272043 - DNA, 25 bp, Mus musculus
atgtgccgcgtgaataagtagtccc

SEQ ID NO: 272044 - DNA, 25 bp, Mus musculus
atgtgccgcgtgtataagtagtccc

SEQ ID NO: 272045 - DNA, 25 bp, Mus musculus
atgtgccggatgatcttgacggtgc

SEQ ID NO: 272046 - DNA, 25 bp, Mus musculus
atgtgccggatgttcttgacggtgc

SEQ ID NO: 272047 - DNA, 25 bp, Mus musculus
atgtgccgggtaattacaccagagt

SEQ ID NO: 272048 - DNA, 25 bp, Mus musculus
atgtgccgggtatttacaccagagt

SEQ ID NO: 272049 - DNA, 25 bp, Mus musculus
atgtgccggtctatcggaacgggat

SEQ ID NO: 272050 - DNA, 25 bp, Mus musculus
atgtgccggtctttcggaacgggat

SEQ ID NO: 272051 - DNA, 25 bp, Mus musculus
atgtgccgtggcagacaggtcacta

SEQ ID NO: 272052 - DNA, 25 bp, Mus musculus
atgtgccgtggctgacaggtcacta

SEQ ID NO: 272053 - DNA, 25 bp, Mus musculus
atgtgccgttgaatacacctgatcc

SEQ ID NO: 272054 - DNA, 25 bp, Mus musculus
atgtgccgttgattacacctgatcc

SEQ ID NO: 272055 - DNA, 25 bp, Mus musculus
atgtgccgttttagcttcaagctca

SEQ ID NO: 272056 - DNA, 25 bp, Mus musculus
atgtgccgtttttgcttcaagctca

SEQ ID NO: 272057 - DNA, 25 bp, Mus musculus
atgtgcctacctaaccaggaggatt

SEQ ID NO: 272058 - DNA, 25 bp, Mus musculus
atgtgcctaccttaccaggaggatt

SEQ ID NO: 272059 - DNA, 25 bp, Mus musculus
atgtgcctatgaacctaccacttag

SEQ ID NO: 272060 - DNA, 25 bp, Mus musculus
atgtgcctatgatcctaccacttag

SEQ ID NO: 272061 - DNA, 25 bp, Mus musculus
atgtgcctatgcaggtctgtgcctt

SEQ ID NO: 272062 - DNA, 25 bp, Mus musculus
atgtgcctatgctggtctgtgcctt

SEQ ID NO: 272063 - DNA, 25 bp, Mus musculus
atgtgcctatgtcccagatgacgtt

SEQ ID NO: 272064 - DNA, 25 bp, Mus musculus
atgtgcctatgtgccagatgacgtt

SEQ ID NO: 272065 - DNA, 25 bp, Mus musculus
atgtgcctcaacctctggtgtggac

SEQ ID NO: 272066 - DNA, 25 bp, Mus musculus
atgtgcctcaacgtctggtgtggac

SEQ ID NO: 272067 - DNA, 25 bp, Mus musculus
atgtgcctcacaatatctttctgtt

SEQ ID NO: 272068 - DNA, 25 bp, Mus musculus
atgtgcctcacattatctttctgtt

SEQ ID NO: 272069 - DNA, 25 bp, Mus musculus
atgtgcctcagaacctaacgaatgc

SEQ ID NO: 272070 - DNA, 25 bp, Mus musculus
atgtgcctcagatcctaacgaatgc

SEQ ID NO: 272071 - DNA, 25 bp, Mus musculus
atgtgcctcagcaaatggctttgtt

SEQ ID NO: 272072 - DNA, 25 bp, Mus musculus
atgtgcctcagcaagaacatgctca

SEQ ID NO: 272073 - DNA, 25 bp, Mus musculus
atgtgcctcagctaatggctttgtt

SEQ ID NO: 272074 - DNA, 25 bp, Mus musculus
atgtgcctcagctagaacatgctca

SEQ ID NO: 272075 - DNA, 25 bp, Mus musculus
atgtgcctctacagactagatacta

SEQ ID NO: 272076 - DNA, 25 bp, Mus musculus
atgtgcctctactgactagatacta

SEQ ID NO: 272077 - DNA, 25 bp, Mus musculus
atgtgcctctcgaatgccaaacttt

SEQ ID NO: 272078 - DNA, 25 bp, Mus musculus
atgtgcctctcgtatgccaaacttt

SEQ ID NO: 272079 - DNA, 25 bp, Mus musculus
atgtgcctctgtatctaccgtgagg

SEQ ID NO: 272080 - DNA, 25 bp, Mus musculus
atgtgcctctgtttctaccgtgagg

SEQ ID NO: 272081 - DNA, 25 bp, Mus musculus
atgtgcctgaaactactgccattcc

SEQ ID NO: 272082 - DNA, 25 bp, Mus musculus
atgtgcctgaaagtactgccattcc

SEQ ID NO: 272083 - DNA, 25 bp, Mus musculus
atgtgcctgagtctcctaaccgaag

SEQ ID NO: 272084 - DNA, 25 bp, Mus musculus
atgtgcctgagtgtcctaaccgaag

SEQ ID NO: 272085 - DNA, 25 bp, Mus musculus
atgtgcctgattcagagtgatgccc

SEQ ID NO: 272086 - DNA, 25 bp, Mus musculus
atgtgcctgattgagagtgatgccc

SEQ ID NO: 272087 - DNA, 25 bp, Mus musculus
atgtgcctgcagcatatcgtggagt

SEQ ID NO: 272088 - DNA, 25 bp, Mus musculus
atgtgcctgcaggatatcgtggagt

SEQ ID NO: 272089 - DNA, 25 bp, Mus musculus
atgtgcctggccacaaagcactctg

SEQ ID NO: 272090 - DNA, 25 bp, Mus musculus
atgtgcctggcctcaaagcactctg

SEQ ID NO: 272091 - DNA, 25 bp, Mus musculus
atgtgcctgggaatagttcactaac

SEQ ID NO: 272092 - DNA, 25 bp, Mus musculus
atgtgcctgggattagttcactaac

SEQ ID NO: 272093 - DNA, 25 bp, Mus musculus
atgtgcctgtccattgtcccagaga

SEQ ID NO: 272094 - DNA, 25 bp, Mus musculus
atgtgcctgtcctttgtcccagaga

SEQ ID NO: 272095 - DNA, 25 bp, Mus musculus
atgtgcctgtggaccttaccatccg

SEQ ID NO: 272096 - DNA, 25 bp, Mus musculus
atgtgcctgtggtccttaccatccg

SEQ ID NO: 272097 - DNA, 25 bp, Mus musculus
atgtgccttagacaaaaccctcaag

SEQ ID NO: 272098 - DNA, 25 bp, Mus musculus
atgtgccttagagaaaaccctcaag

SEQ ID NO: 272099 - DNA, 25 bp, Mus musculus
atgtgccttatgactcttgtgggtc

SEQ ID NO: 272100 - DNA, 25 bp, Mus musculus
atgtgccttatgtctcttgtgggtc

SEQ ID NO: 272101 - DNA, 25 bp, Mus musculus
atgtgccttcatctttaatcctctc

SEQ ID NO: 272102 - DNA, 25 bp, Mus musculus
atgtgccttcatgtttaatcctctc

SEQ ID NO: 272103 - DNA, 25 bp, Mus musculus
atgtgccttgcgaggaaaagcgaat

SEQ ID NO: 272104 - DNA, 25 bp, Mus musculus
atgtgccttgcgtggaaaagcgaat

SEQ ID NO: 272105 - DNA, 25 bp, Mus musculus
atgtgccttgtccaggaaccgcctg

SEQ ID NO: 272106 - DNA, 25 bp, Mus musculus
atgtgccttgtcgaggaaccgcctg

SEQ ID NO: 272107 - DNA, 25 bp, Mus musculus
atgtgcctttagacttaatttacct

SEQ ID NO: 272108 - DNA, 25 bp, Mus musculus
atgtgcctttagtcttaatttacct

SEQ ID NO: 272109 - DNA, 25 bp, Mus musculus
atgtgcctttcaagagaagatttcc

SEQ ID NO: 272110 - DNA, 25 bp, Mus musculus
atgtgcctttcatgagaagatttcc

SEQ ID NO: 272111 - DNA, 25 bp, Mus musculus
atgtgccttttcatgtcaggtgtga

SEQ ID NO: 272112 - DNA, 25 bp, Mus musculus
atgtgccttttcttgtcaggtgtga

SEQ ID NO: 272113 - DNA, 25 bp, Mus musculus
atgtgcgaaggccattcacctgaaa

SEQ ID NO: 272114 - DNA, 25 bp, Mus musculus
atgtgcgaaggcgattcacctgaaa

SEQ ID NO: 272115 - DNA, 25 bp, Mus musculus
atgtgcgaatctacatcacggtctt

SEQ ID NO: 272116 - DNA, 25 bp, Mus musculus
atgtgcgaatcttcatcacggtctt

SEQ ID NO: 272117 - DNA, 25 bp, Mus musculus
atgtgcgaccacattaccagtgaat

SEQ ID NO: 272118 - DNA, 25 bp, Mus musculus
atgtgcgaccactttaccagtgaat

SEQ ID NO: 272119 - DNA, 25 bp, Mus musculus
atgtgcgattctaccattacttccg

SEQ ID NO: 272120 - DNA, 25 bp, Mus musculus
atgtgcgattcttccattacttccg

SEQ ID NO: 272121 - DNA, 25 bp, Mus musculus
atgtgcgccattcatgggcaggcaa

SEQ ID NO: 272122 - DNA, 25 bp, Mus musculus
atgtgcgccattgatgggcaggcaa

SEQ ID NO: 272123 - DNA, 25 bp, Mus musculus
atgtgcgcctgcagacagtcttctg

SEQ ID NO: 272124 - DNA, 25 bp, Mus musculus
atgtgcgcctgctgacagtcttctg

SEQ ID NO: 272125 - DNA, 25 bp, Mus musculus
atgtgcgctagaagagctccattcc

SEQ ID NO: 272126 - DNA, 25 bp, Mus musculus
atgtgcgctagatgagctccattcc

SEQ ID NO: 272127 - DNA, 25 bp, Mus musculus
atgtgcggatggacatcatcaacca

SEQ ID NO: 272128 - DNA, 25 bp, Mus musculus
atgtgcggatggtcatcatcaacca

SEQ ID NO: 272129 - DNA, 25 bp, Mus musculus
atgtgcggattcaggaagttcccaa

SEQ ID NO: 272130 - DNA, 25 bp, Mus musculus
atgtgcggattctggaagttcccaa

SEQ ID NO: 272131 - DNA, 25 bp, Mus musculus
atgtgcgggtggcaatagtttccaa

SEQ ID NO: 272132 - DNA, 25 bp, Mus musculus
atgtgcgggtgggaatagtttccaa

SEQ ID NO: 272133 - DNA, 25 bp, Mus musculus
atgtgcggtgccactagtgtgatct

SEQ ID NO: 272134 - DNA, 25 bp, Mus musculus
atgtgcggtgcctctagtgtgatct

SEQ ID NO: 272135 - DNA, 25 bp, Mus musculus
atgtgcggttctaccgtggtttctc

SEQ ID NO: 272136 - DNA, 25 bp, Mus musculus
atgtgcggttcttccgtggtttctc

SEQ ID NO: 272137 - DNA, 25 bp, Mus musculus
atgtgcgtagctatattagtaattc

SEQ ID NO: 272138 - DNA, 25 bp, Mus musculus
atgtgcgtagctttattagtaattc

SEQ ID NO: 272139 - DNA, 25 bp, Mus musculus
atgtgcgtatatctgttgtatcaga

SEQ ID NO: 272140 - DNA, 25 bp, Mus musculus
atgtgcgtatatgtgttgtatcaga

SEQ ID NO: 272141 - DNA, 25 bp, Mus musculus
atgtgcgtgcacacagacctgataa

SEQ ID NO: 272142 - DNA, 25 bp, Mus musculus
atgtgcgtgcactcagacctgataa

SEQ ID NO: 272143 - DNA, 25 bp, Mus musculus
atgtgcgtgcatcctgggaactaac

SEQ ID NO: 272144 - DNA, 25 bp, Mus musculus
atgtgcgtgcatgctgggaactaac

SEQ ID NO: 272145 - DNA, 25 bp, Mus musculus
atgtgcgtgggccagtgtccccacc

SEQ ID NO: 272146 - DNA, 25 bp, Mus musculus
atgtgcgtgggcgagtgtccccacc

SEQ ID NO: 272147 - DNA, 25 bp, Mus musculus
atgtgcgtttcccaatattctctga

SEQ ID NO: 272148 - DNA, 25 bp, Mus musculus
atgtgcgtttccgaatattctctga

SEQ ID NO: 272149 - DNA, 25 bp, Mus musculus
atgtgctaaagacggcaccctgctt

SEQ ID NO: 272150 - DNA, 25 bp, Mus musculus
atgtgctaaagagggcaccctgctt

SEQ ID NO: 272151 - DNA, 25 bp, Mus musculus
atgtgctaacacacctctgaaacag

SEQ ID NO: 272152 - DNA, 25 bp, Mus musculus
atgtgctaacactcctctgaaacag

SEQ ID NO: 272153 - DNA, 25 bp, Mus musculus
atgtgctaacagctttctccttaat

SEQ ID NO: 272154 - DNA, 25 bp, Mus musculus
atgtgctaacaggtttctccttaat

SEQ ID NO: 272155 - DNA, 25 bp, Mus musculus
atgtgctaatatattgcccttaagg

SEQ ID NO: 272156 - DNA, 25 bp, Mus musculus
atgtgctaatattttgcccttaagg

SEQ ID NO: 272157 - DNA, 25 bp, Mus musculus
atgtgctaccacagtctgtcatctt

SEQ ID NO: 272158 - DNA, 25 bp, Mus musculus
atgtgctaccactgtctgtcatctt

SEQ ID NO: 272159 - DNA, 25 bp, Mus musculus
atgtgctactccaggcttaagaaaa

SEQ ID NO: 272160 - DNA, 25 bp, Mus musculus
atgtgctactcctggcttaagaaaa

SEQ ID NO: 272161 - DNA, 25 bp, Mus musculus
atgtgctagcatccatagcctaatg

SEQ ID NO: 272162 - DNA, 25 bp, Mus musculus
atgtgctagcatgcatagcctaatg

SEQ ID NO: 272163 - DNA, 25 bp, Mus musculus
atgtgctagtccaacaaagctctct

SEQ ID NO: 272164 - DNA, 25 bp, Mus musculus
atgtgctagtcctacaaagctctct

SEQ ID NO: 272165 - DNA, 25 bp, Mus musculus
atgtgctatcccatgagtttccgtt

SEQ ID NO: 272166 - DNA, 25 bp, Mus musculus
atgtgctatcccttgagtttccgtt

SEQ ID NO: 272167 - DNA, 25 bp, Mus musculus
atgtgctatctactgtgagcccctt

SEQ ID NO: 272168 - DNA, 25 bp, Mus musculus
atgtgctatctagtgtgagcccctt

SEQ ID NO: 272169 - DNA, 25 bp, Mus musculus
atgtgctatctccttatttaactga

SEQ ID NO: 272170 - DNA, 25 bp, Mus musculus
atgtgctatctcgttatttaactga

SEQ ID NO: 272171 - DNA, 25 bp, Mus musculus
atgtgctatgcccagaacatcccaa

SEQ ID NO: 272172 - DNA, 25 bp, Mus musculus
atgtgctatgccgagaacatcccaa

SEQ ID NO: 272173 - DNA, 25 bp, Mus musculus
atgtgctatgctcctacaggccact

SEQ ID NO: 272174 - DNA, 25 bp, Mus musculus
atgtgctatgctcctcacctctcat

SEQ ID NO: 272175 - DNA, 25 bp, Mus musculus
atgtgctatgctgctacaggccact

SEQ ID NO: 272176 - DNA, 25 bp, Mus musculus
atgtgctatgctgctcacctctcat

SEQ ID NO: 272177 - DNA, 25 bp, Mus musculus
atgtgctatggcaaagcatggcccc

SEQ ID NO: 272178 - DNA, 25 bp, Mus musculus
atgtgctatggctaagcatggcccc

SEQ ID NO: 272179 - DNA, 25 bp, Mus musculus
atgtgctatggtattatcaacaata

SEQ ID NO: 272180 - DNA, 25 bp, Mus musculus
atgtgctatggttttatcaacaata

SEQ ID NO: 272181 - DNA, 25 bp, Mus musculus
atgtgctcaatgaatgtgtctgctc

SEQ ID NO: 272182 - DNA, 25 bp, Mus musculus
atgtgctcaatgtatgtgtctgctc

SEQ ID NO: 272183 - DNA, 25 bp, Mus musculus
atgtgctcacacacgggtgatgtgt

SEQ ID NO: 272184 - DNA, 25 bp, Mus musculus
atgtgctcacactcgggtgatgtgt

SEQ ID NO: 272185 - DNA, 25 bp, Mus musculus
atgtgctcagaaagtgtacctgtat

SEQ ID NO: 272186 - DNA, 25 bp, Mus musculus
atgtgctcagaatgtgtacctgtat

SEQ ID NO: 272187 - DNA, 25 bp, Mus musculus
atgtgctcatgcactttcttccaga

SEQ ID NO: 272188 - DNA, 25 bp, Mus musculus
atgtgctcatgctctttcttccaga

SEQ ID NO: 272189 - DNA, 25 bp, Mus musculus
atgtgctcattcctggatgctgtga

SEQ ID NO: 272190 - DNA, 25 bp, Mus musculus
atgtgctcattcgtggatgctgtga

SEQ ID NO: 272191 - DNA, 25 bp, Mus musculus
atgtgctccaatctacttgtgctta

SEQ ID NO: 272192 - DNA, 25 bp, Mus musculus
atgtgctccaatgtacttgtgctta

SEQ ID NO: 272193 - DNA, 25 bp, Mus musculus
atgtgctccgctctttttaaatgtg

SEQ ID NO: 272194 - DNA, 25 bp, Mus musculus
atgtgctccgctgtttttaaatgtg

SEQ ID NO: 272195 - DNA, 25 bp, Mus musculus
atgtgctcctcacacagggtgtgct

SEQ ID NO: 272196 - DNA, 25 bp, Mus musculus
atgtgctcctcagacagggtgtgct

SEQ ID NO: 272197 - DNA, 25 bp, Mus musculus
atgtgctcctgtagttcccttatga

SEQ ID NO: 272198 - DNA, 25 bp, Mus musculus
atgtgctcctgttgttcccttatga

SEQ ID NO: 272199 - DNA, 25 bp, Mus musculus
atgtgctccttccaacggacagcag

SEQ ID NO: 272200 - DNA, 25 bp, Mus musculus
atgtgctccttcgaacggacagcag

SEQ ID NO: 272201 - DNA, 25 bp, Mus musculus
atgtgctcgggacctactgtgtgct

SEQ ID NO: 272202 - DNA, 25 bp, Mus musculus
atgtgctcgggagctactgtgtgct

SEQ ID NO: 272203 - DNA, 25 bp, Mus musculus
atgtgctcgtatctttatatgctta

SEQ ID NO: 272204 - DNA, 25 bp, Mus musculus
atgtgctcgtatgtttatatgctta

SEQ ID NO: 272205 - DNA, 25 bp, Mus musculus
atgtgctctaacacctgtctgtctg

SEQ ID NO: 272206 - DNA, 25 bp, Mus musculus
atgtgctctaactcctgtctgtctg

SEQ ID NO: 272207 - DNA, 25 bp, Mus musculus
atgtgctctgagctctctataggat

SEQ ID NO: 272208 - DNA, 25 bp, Mus musculus
atgtgctctgaggtctctataggat

SEQ ID NO: 272209 - DNA, 25 bp, Mus musculus
atgtgctctgcaaactcatttaata

SEQ ID NO: 272210 - DNA, 25 bp, Mus musculus
atgtgctctgcatactcatttaata

SEQ ID NO: 272211 - DNA, 25 bp, Mus musculus
atgtgctctggaccacagacatcta

SEQ ID NO: 272212 - DNA, 25 bp, Mus musculus
atgtgctctggagcacagacatcta

SEQ ID NO: 272213 - DNA, 25 bp, Mus musculus
atgtgctcttagattgcttcagtgt

SEQ ID NO: 272214 - DNA, 25 bp, Mus musculus
atgtgctcttagtttgcttcagtgt

SEQ ID NO: 272215 - DNA, 25 bp, Mus musculus
atgtgctcttttcatcaatcgaaat

SEQ ID NO: 272216 - DNA, 25 bp, Mus musculus
atgtgctcttttgatcaatcgaaat

SEQ ID NO: 272217 - DNA, 25 bp, Mus musculus
atgtgctgactgagctcagactgag

SEQ ID NO: 272218 - DNA, 25 bp, Mus musculus
atgtgctgactgtgctcagactgag

SEQ ID NO: 272219 - DNA, 25 bp, Mus musculus
atgtgctgagttccggtagccacca

SEQ ID NO: 272220 - DNA, 25 bp, Mus musculus
atgtgctgagttgcggtagccacca

SEQ ID NO: 272221 - DNA, 25 bp, Mus musculus
atgtgctgatcgcacccgtgagcag

SEQ ID NO: 272222 - DNA, 25 bp, Mus musculus
atgtgctgatcggacccgtgagcag

SEQ ID NO: 272223 - DNA, 25 bp, Mus musculus
atgtgctgatggctgcttctagaga

SEQ ID NO: 272224 - DNA, 25 bp, Mus musculus
atgtgctgatgggtgcttctagaga

SEQ ID NO: 272225 - DNA, 25 bp, Mus musculus
atgtgctgcagcagattgtcaatct

SEQ ID NO: 272226 - DNA, 25 bp, Mus musculus
atgtgctgcagctgattgtcaatct

SEQ ID NO: 272227 - DNA, 25 bp, Mus musculus
atgtgctgcattattattccaccag

SEQ ID NO: 272228 - DNA, 25 bp, Mus musculus
atgtgctgcatttttattccaccag

SEQ ID NO: 272229 - DNA, 25 bp, Mus musculus
atgtgctgccagagttaagttctag

SEQ ID NO: 272230 - DNA, 25 bp, Mus musculus
atgtgctgccagtgttaagttctag

SEQ ID NO: 272231 - DNA, 25 bp, Mus musculus
atgtgctgctatccttgactctgca

SEQ ID NO: 272232 - DNA, 25 bp, Mus musculus
atgtgctgctatgcttgactctgca

SEQ ID NO: 272233 - DNA, 25 bp, Mus musculus
atgtgctgctgaacattggccacgt

SEQ ID NO: 272234 - DNA, 25 bp, Mus musculus
atgtgctgctgatcattggccacgt

SEQ ID NO: 272235 - DNA, 25 bp, Mus musculus
atgtgctgctgtagaaagggagcct

SEQ ID NO: 272236 - DNA, 25 bp, Mus musculus
atgtgctgctgttgaaagggagcct

SEQ ID NO: 272237 - DNA, 25 bp, Mus musculus
atgtgctggaaaaccaacgttgttt

SEQ ID NO: 272238 - DNA, 25 bp, Mus musculus
atgtgctggaaatccaacgttgttt

SEQ ID NO: 272239 - DNA, 25 bp, Mus musculus
atgtgctggaccacttcagcattga

SEQ ID NO: 272240 - DNA, 25 bp, Mus musculus
atgtgctggacctcttcagcattga

SEQ ID NO: 272241 - DNA, 25 bp, Mus musculus
atgtgctggctgagaagagcttccg

SEQ ID NO: 272242 - DNA, 25 bp, Mus musculus
atgtgctggctgtgaagagcttccg

SEQ ID NO: 272243 - DNA, 25 bp, Mus musculus
atgtgctgtaatccaagcccttggg

SEQ ID NO: 272244 - DNA, 25 bp, Mus musculus
atgtgctgtaatgcaagcccttggg

SEQ ID NO: 272245 - DNA, 25 bp, Mus musculus
atgtgctgtagcagcgaagtcccgg

SEQ ID NO: 272246 - DNA, 25 bp, Mus musculus
atgtgctgtagctgcgaagtcccgg

SEQ ID NO: 272247 - DNA, 25 bp, Mus musculus
atgtgctgtattaatgttccctcca

SEQ ID NO: 272248 - DNA, 25 bp, Mus musculus
atgtgctgtatttatgttccctcca

SEQ ID NO: 272249 - DNA, 25 bp, Mus musculus
atgtgctgtctcagagccaatgctg

SEQ ID NO: 272250 - DNA, 25 bp, Mus musculus
atgtgctgtctctgagccaatgctg

SEQ ID NO: 272251 - DNA, 25 bp, Mus musculus
atgtgctgtgcaaaggtgcctggct

SEQ ID NO: 272252 - DNA, 25 bp, Mus musculus
atgtgctgtgcaacaggagagcgac

SEQ ID NO: 272253 - DNA, 25 bp, Mus musculus
atgtgctgtgcacctacaggtccat

SEQ ID NO: 272254 - DNA, 25 bp, Mus musculus
atgtgctgtgcagctacaggtccat

SEQ ID NO: 272255 - DNA, 25 bp, Mus musculus
atgtgctgtgcataggtgcctggct

SEQ ID NO: 272256 - DNA, 25 bp, Mus musculus
atgtgctgtgcatcaggagagcgac

SEQ ID NO: 272257 - DNA, 25 bp, Mus musculus
atgtgctgtgtaaatctcacatgga

SEQ ID NO: 272258 - DNA, 25 bp, Mus musculus
atgtgctgtgtatatctcacatgga

SEQ ID NO: 272259 - DNA, 25 bp, Mus musculus
atgtgctgtgtgattctccccacgc

SEQ ID NO: 272260 - DNA, 25 bp, Mus musculus
atgtgctgtgtgtttctccccacgc

SEQ ID NO: 272261 - DNA, 25 bp, Mus musculus
atgtgctgtttgactgttagggacc

SEQ ID NO: 272262 - DNA, 25 bp, Mus musculus
atgtgctgtttgtctgttagggacc

SEQ ID NO: 272263 - DNA, 25 bp, Mus musculus
atgtgcttattacactagggactaa

SEQ ID NO: 272264 - DNA, 25 bp, Mus musculus
atgtgcttattagactagggactaa

SEQ ID NO: 272265 - DNA, 25 bp, Mus musculus
atgtgcttattgatgtgggaaccgg

SEQ ID NO: 272266 - DNA, 25 bp, Mus musculus
atgtgcttattgttgtgggaaccgg

SEQ ID NO: 272267 - DNA, 25 bp, Mus musculus
atgtgcttcacacgtttttcccaag

SEQ ID NO: 272268 - DNA, 25 bp, Mus musculus
atgtgcttcacaggtttttcccaag

SEQ ID NO: 272269 - DNA, 25 bp, Mus musculus
atgtgcttcagtccaaactacaggg

SEQ ID NO: 272270 - DNA, 25 bp, Mus musculus
atgtgcttcagtgcaaactacaggg

SEQ ID NO: 272271 - DNA, 25 bp, Mus musculus
atgtgcttcataattcccagggcag

SEQ ID NO: 272272 - DNA, 25 bp, Mus musculus
atgtgcttcatatttcccagggcag

SEQ ID NO: 272273 - DNA, 25 bp, Mus musculus
atgtgcttccaaagtccttcttatt

SEQ ID NO: 272274 - DNA, 25 bp, Mus musculus
atgtgcttccaatgtccttcttatt

SEQ ID NO: 272275 - DNA, 25 bp, Mus musculus
atgtgcttccatatacactggcagg

SEQ ID NO: 272276 - DNA, 25 bp, Mus musculus
atgtgcttccatttacactggcagg

SEQ ID NO: 272277 - DNA, 25 bp, Mus musculus
atgtgcttccctccctcgtgggaaa

SEQ ID NO: 272278 - DNA, 25 bp, Mus musculus
atgtgcttccctgcctcgtgggaaa

SEQ ID NO: 272279 - DNA, 25 bp, Mus musculus
atgtgcttccggcattgctggtgac

SEQ ID NO: 272280 - DNA, 25 bp, Mus musculus
atgtgcttccgggattgctggtgac

SEQ ID NO: 272281 - DNA, 25 bp, Mus musculus
atgtgcttccttcatgaggactcaa

SEQ ID NO: 272282 - DNA, 25 bp, Mus musculus
atgtgcttccttgatgaggactcaa

SEQ ID NO: 272283 - DNA, 25 bp, Mus musculus
atgtgcttcgaaatcaagggtctta

SEQ ID NO: 272284 - DNA, 25 bp, Mus musculus
atgtgcttcgaattcaagggtctta

SEQ ID NO: 272285 - DNA, 25 bp, Mus musculus
atgtgcttcgtacaactccctggag

SEQ ID NO: 272286 - DNA, 25 bp, Mus musculus
atgtgcttcgtagaactccctggag

SEQ ID NO: 272287 - DNA, 25 bp, Mus musculus
atgtgcttctagagctgccctgacc

SEQ ID NO: 272288 - DNA, 25 bp, Mus musculus
atgtgcttctagtgctgccctgacc

SEQ ID NO: 272289 - DNA, 25 bp, Mus musculus
atgtgcttctgcctgctggattaaa

SEQ ID NO: 272290 - DNA, 25 bp, Mus musculus
atgtgcttctgcgtgctggattaaa

SEQ ID NO: 272291 - DNA, 25 bp, Mus musculus
atgtgcttctggcacagtgctgcac

SEQ ID NO: 272292 - DNA, 25 bp, Mus musculus
atgtgcttctgggacagtgctgcac

SEQ ID NO: 272293 - DNA, 25 bp, Mus musculus
atgtgcttcttgagatcaacctcgg

SEQ ID NO: 272294 - DNA, 25 bp, Mus musculus
atgtgcttcttgtgatcaacctcgg

SEQ ID NO: 272295 - DNA, 25 bp, Mus musculus
atgtgcttgaaaatatgcttacctt

SEQ ID NO: 272296 - DNA, 25 bp, Mus musculus
atgtgcttgaaattatgcttacctt

SEQ ID NO: 272297 - DNA, 25 bp, Mus musculus
atgtgcttgaatcgctgaccactct

SEQ ID NO: 272298 - DNA, 25 bp, Mus musculus
atgtgcttgaatggctgaccactct

SEQ ID NO: 272299 - DNA, 25 bp, Mus musculus
atgtgcttgcacacttttggaccac

SEQ ID NO: 272300 - DNA, 25 bp, Mus musculus
atgtgcttgcactcttttggaccac

SEQ ID NO: 272301 - DNA, 25 bp, Mus musculus
atgtgcttgcagacttcttctaaaa

SEQ ID NO: 272302 - DNA, 25 bp, Mus musculus
atgtgcttgcagtcttcttctaaaa

SEQ ID NO: 272303 - DNA, 25 bp, Mus musculus
atgtgcttgcataattttgcgttac

SEQ ID NO: 272304 - DNA, 25 bp, Mus musculus
atgtgcttgcattattttgcgttac

SEQ ID NO: 272305 - DNA, 25 bp, Mus musculus
atgtgcttgccaacttatgccctgg

SEQ ID NO: 272306 - DNA, 25 bp, Mus musculus
atgtgcttgccatcttatgccctgg

SEQ ID NO: 272307 - DNA, 25 bp, Mus musculus
atgtgcttgctcacgtgtgtgtatg

SEQ ID NO: 272308 - DNA, 25 bp, Mus musculus
atgtgcttgctctcgtgtgtgtatg

SEQ ID NO: 272309 - DNA, 25 bp, Mus musculus
atgtgcttgcttaagggaaacagtc

SEQ ID NO: 272310 - DNA, 25 bp, Mus musculus
atgtgcttgcttatgttgaatgtga

SEQ ID NO: 272311 - DNA, 25 bp, Mus musculus
atgtgcttgctttagggaaacagtc

SEQ ID NO: 272312 - DNA, 25 bp, Mus musculus
atgtgcttgcttttgttgaatgtga

SEQ ID NO: 272313 - DNA, 25 bp, Mus musculus
atgtgcttggttattcctctgtgat

SEQ ID NO: 272314 - DNA, 25 bp, Mus musculus
atgtgcttggtttttcctctgtgat

SEQ ID NO: 272315 - DNA, 25 bp, Mus musculus
atgtgcttgtcacagatccctgttt

SEQ ID NO: 272316 - DNA, 25 bp, Mus musculus
atgtgcttgtcagagatccctgttt

SEQ ID NO: 272317 - DNA, 25 bp, Mus musculus
atgtgcttgtccacatcttttgctg

SEQ ID NO: 272318 - DNA, 25 bp, Mus musculus
atgtgcttgtcctcatcttttgctg

SEQ ID NO: 272319 - DNA, 25 bp, Mus musculus
atgtgcttgtgcatgatgactgtgt

SEQ ID NO: 272320 - DNA, 25 bp, Mus musculus
atgtgcttgtgcttgatgactgtgt

SEQ ID NO: 272321 - DNA, 25 bp, Mus musculus
atgtgctttaaaatagtaatccttt

SEQ ID NO: 272322 - DNA, 25 bp, Mus musculus
atgtgctttaaattagtaatccttt

SEQ ID NO: 272323 - DNA, 25 bp, Mus musculus
atgtgctttccgattgcaaggtgac

SEQ ID NO: 272324 - DNA, 25 bp, Mus musculus
atgtgctttccgtttgcaaggtgac

SEQ ID NO: 272325 - DNA, 25 bp, Mus musculus
atgtgctttctgaataaaggcagac

SEQ ID NO: 272326 - DNA, 25 bp, Mus musculus
atgtgctttctgtataaaggcagac

SEQ ID NO: 272327 - DNA, 25 bp, Mus musculus
atgtgctttcttaaacctagatgga

SEQ ID NO: 272328 - DNA, 25 bp, Mus musculus
atgtgctttcttcttgggttggtct

SEQ ID NO: 272329 - DNA, 25 bp, Mus musculus
atgtgctttcttgttgggttggtct

SEQ ID NO: 272330 - DNA, 25 bp, Mus musculus
atgtgctttctttaacctagatgga

SEQ ID NO: 272331 - DNA, 25 bp, Mus musculus
atgtgctttgccctctgtgcaacaa

SEQ ID NO: 272332 - DNA, 25 bp, Mus musculus
atgtgctttgccgtctgtgcaacaa

SEQ ID NO: 272333 - DNA, 25 bp, Mus musculus
atgtgctttgtcatttgagttctta

SEQ ID NO: 272334 - DNA, 25 bp, Mus musculus
atgtgctttgtcttttgagttctta

SEQ ID NO: 272335 - DNA, 25 bp, Mus musculus
atgtgcttttagagcaattttgaaa

SEQ ID NO: 272336 - DNA, 25 bp, Mus musculus
atgtgcttttagtgcaattttgaaa

SEQ ID NO: 272337 - DNA, 25 bp, Mus musculus
atgtgcttttccagtatcttcagtc

SEQ ID NO: 272338 - DNA, 25 bp, Mus musculus
atgtgcttttcccagctgactcaga

SEQ ID NO: 272339 - DNA, 25 bp, Mus musculus
atgtgcttttccgagctgactcaga

SEQ ID NO: 272340 - DNA, 25 bp, Mus musculus
atgtgcttttcctgtatcttcagtc

SEQ ID NO: 272341 - DNA, 25 bp, Mus musculus
atgtgctttttcatagtcaccccat

SEQ ID NO: 272342 - DNA, 25 bp, Mus musculus
atgtgctttttcttagtcaccccat

SEQ ID NO: 272343 - DNA, 25 bp, Mus musculus
atgtggaaacttaagcccttctctt

SEQ ID NO: 272344 - DNA, 25 bp, Mus musculus
atgtggaaactttagcccttctctt

SEQ ID NO: 272345 - DNA, 25 bp, Mus musculus
atgtggaaagcgatcatgtctcatc

SEQ ID NO: 272346 - DNA, 25 bp, Mus musculus
atgtggaaagcgttcatgtctcatc

SEQ ID NO: 272347 - DNA, 25 bp, Mus musculus
atgtggaaatccctcagctgaaccg

SEQ ID NO: 272348 - DNA, 25 bp, Mus musculus
atgtggaaatccgtcagctgaaccg

SEQ ID NO: 272349 - DNA, 25 bp, Mus musculus
atgtggaaccctagtgtgattatca

SEQ ID NO: 272350 - DNA, 25 bp, Mus musculus
atgtggaacccttgtgtgattatca

SEQ ID NO: 272351 - DNA, 25 bp, Mus musculus
atgtggaaccttcgctcttcattga

SEQ ID NO: 272352 - DNA, 25 bp, Mus musculus
atgtggaaccttggctcttcattga

SEQ ID NO: 272353 - DNA, 25 bp, Mus musculus
atgtggaagacgaccttaccagctt

SEQ ID NO: 272354 - DNA, 25 bp, Mus musculus
atgtggaagacgtccttaccagctt

SEQ ID NO: 272355 - DNA, 25 bp, Mus musculus
atgtggaatgcaagaccgacccctg

SEQ ID NO: 272356 - DNA, 25 bp, Mus musculus
atgtggaatgcatgaccgacccctg

SEQ ID NO: 272357 - DNA, 25 bp, Mus musculus
atgtggaatgttcgttggcttgggt

SEQ ID NO: 272358 - DNA, 25 bp, Mus musculus
atgtggaatgttggttggcttgggt

SEQ ID NO: 272359 - DNA, 25 bp, Mus musculus
atgtggaattggaatgctcatttta

SEQ ID NO: 272360 - DNA, 25 bp, Mus musculus
atgtggaattggtatgctcatttta

SEQ ID NO: 272361 - DNA, 25 bp, Mus musculus
atgtggaatttacccatggaaggaa

SEQ ID NO: 272362 - DNA, 25 bp, Mus musculus
atgtggaatttagccatggaaggaa

SEQ ID NO: 272363 - DNA, 25 bp, Mus musculus
atgtggacaagcaaaaccggcgtat

SEQ ID NO: 272364 - DNA, 25 bp, Mus musculus
atgtggacaagctaaaccggcgtat

SEQ ID NO: 272365 - DNA, 25 bp, Mus musculus
atgtggacaatgattttcttccctg

SEQ ID NO: 272366 - DNA, 25 bp, Mus musculus
atgtggacaatgtttttcttccctg

SEQ ID NO: 272367 - DNA, 25 bp, Mus musculus
atgtggacacacacaagcttgcggt

SEQ ID NO: 272368 - DNA, 25 bp, Mus musculus
atgtggacacactcaagcttgcggt

SEQ ID NO: 272369 - DNA, 25 bp, Mus musculus
atgtggacaggcacttcttcagctt

SEQ ID NO: 272370 - DNA, 25 bp, Mus musculus
atgtggacaggctcttcttcagctt

SEQ ID NO: 272371 - DNA, 25 bp, Mus musculus
atgtggacagttcttcggcctgctg

SEQ ID NO: 272372 - DNA, 25 bp, Mus musculus
atgtggacagttgttcggcctgctg

SEQ ID NO: 272373 - DNA, 25 bp, Mus musculus
atgtggaccaggctgccacagaagt

SEQ ID NO: 272374 - DNA, 25 bp, Mus musculus
atgtggaccagggtgccacagaagt

SEQ ID NO: 272375 - DNA, 25 bp, Mus musculus
atgtggaccctacccgggcacggca

SEQ ID NO: 272376 - DNA, 25 bp, Mus musculus
atgtggaccctagccgggcacggca

SEQ ID NO: 272377 - DNA, 25 bp, Mus musculus
atgtggacctctcacagtggtgcca

SEQ ID NO: 272378 - DNA, 25 bp, Mus musculus
atgtggacctctgacagtggtgcca

SEQ ID NO: 272379 - DNA, 25 bp, Mus musculus
atgtggacgacaatctgcgaagtta

SEQ ID NO: 272380 - DNA, 25 bp, Mus musculus
atgtggacgacattctgcgaagtta

SEQ ID NO: 272381 - DNA, 25 bp, Mus musculus
atgtggacgctcacggcaagtcact

SEQ ID NO: 272382 - DNA, 25 bp, Mus musculus
atgtggacgctctcggcaagtcact

SEQ ID NO: 272383 - DNA, 25 bp, Mus musculus
atgtggactaggactgtcaggctga

SEQ ID NO: 272384 - DNA, 25 bp, Mus musculus
atgtggactaggtctgtcaggctga

SEQ ID NO: 272385 - DNA, 25 bp, Mus musculus
atgtggactctactgcagagccatg

SEQ ID NO: 272386 - DNA, 25 bp, Mus musculus
atgtggactctagtgcagagccatg

SEQ ID NO: 272387 - DNA, 25 bp, Mus musculus
atgtggactgctccaggtatcgaga

SEQ ID NO: 272388 - DNA, 25 bp, Mus musculus
atgtggactgctgcaggtatcgaga

SEQ ID NO: 272389 - DNA, 25 bp, Mus musculus
atgtggactggccacgtgaatgctt

SEQ ID NO: 272390 - DNA, 25 bp, Mus musculus
atgtggactggcgacgtgaatgctt

SEQ ID NO: 272391 - DNA, 25 bp, Mus musculus
atgtggactggtctcattacccggc

SEQ ID NO: 272392 - DNA, 25 bp, Mus musculus
atgtggactggtgtcattacccggc

SEQ ID NO: 272393 - DNA, 25 bp, Mus musculus
atgtggactgtgacctaatactgag

SEQ ID NO: 272394 - DNA, 25 bp, Mus musculus
atgtggactgtgtcctaatactgag

SEQ ID NO: 272395 - DNA, 25 bp, Mus musculus
atgtggacttgtacagtggctcctc

SEQ ID NO: 272396 - DNA, 25 bp, Mus musculus
atgtggacttgttcagtggctcctc

SEQ ID NO: 272397 - DNA, 25 bp, Mus musculus
atgtggactttgaaccctatgataa

SEQ ID NO: 272398 - DNA, 25 bp, Mus musculus
atgtggactttgtaccctatgataa

SEQ ID NO: 272399 - DNA, 25 bp, Mus musculus
atgtggagatgcaaatgtgacctgg

SEQ ID NO: 272400 - DNA, 25 bp, Mus musculus
atgtggagatgctaatgtgacctgg

SEQ ID NO: 272401 - DNA, 25 bp, Mus musculus
atgtggagcacacccaacctcagac

SEQ ID NO: 272402 - DNA, 25 bp, Mus musculus
atgtggagcacagccaacctcagac

SEQ ID NO: 272403 - DNA, 25 bp, Mus musculus
atgtggagcactctctgaaagggtt

SEQ ID NO: 272404 - DNA, 25 bp, Mus musculus
atgtggagcactgtctgaaagggtt

SEQ ID NO: 272405 - DNA, 25 bp, Mus musculus
atgtggagcatcatcagtggcacca

SEQ ID NO: 272406 - DNA, 25 bp, Mus musculus
atgtggagcatcttcagtggcacca

SEQ ID NO: 272407 - DNA, 25 bp, Mus musculus
atgtggagcatgagcatgtcaggca

SEQ ID NO: 272408 - DNA, 25 bp, Mus musculus
atgtggagcatgagtccaatctaga

SEQ ID NO: 272409 - DNA, 25 bp, Mus musculus
atgtggagcatgtgcatgtcaggca

SEQ ID NO: 272410 - DNA, 25 bp, Mus musculus
atgtggagcatgtgtccaatctaga

SEQ ID NO: 272411 - DNA, 25 bp, Mus musculus
atgtggagccagatgctggtttcca

SEQ ID NO: 272412 - DNA, 25 bp, Mus musculus
atgtggagccagttgctggtttcca

SEQ ID NO: 272413 - DNA, 25 bp, Mus musculus
atgtggagcccaactgtacgacagg

SEQ ID NO: 272414 - DNA, 25 bp, Mus musculus
atgtggagcccatctgtacgacagg

SEQ ID NO: 272415 - DNA, 25 bp, Mus musculus
atgtggagccgtccaagtttcagaa

SEQ ID NO: 272416 - DNA, 25 bp, Mus musculus
atgtggagccgtgcaagtttcagaa

SEQ ID NO: 272417 - DNA, 25 bp, Mus musculus
atgtggagcctaccatgaacagccc

SEQ ID NO: 272418 - DNA, 25 bp, Mus musculus
atgtggagcctagcatgaacagccc

SEQ ID NO: 272419 - DNA, 25 bp, Mus musculus
atgtggagcctccaaaggcagctca

SEQ ID NO: 272420 - DNA, 25 bp, Mus musculus
atgtggagcctcgaaaggcagctca

SEQ ID NO: 272421 - DNA, 25 bp, Mus musculus
atgtggagcctgacagctggagcac

SEQ ID NO: 272422 - DNA, 25 bp, Mus musculus
atgtggagcctgtcagctggagcac

SEQ ID NO: 272423 - DNA, 25 bp, Mus musculus
atgtggagctcaaacgtcgccttaa

SEQ ID NO: 272424 - DNA, 25 bp, Mus musculus
atgtggagctcatacgtcgccttaa

SEQ ID NO: 272425 - DNA, 25 bp, Mus musculus
atgtggagctgcaaggttcttcccg

SEQ ID NO: 272426 - DNA, 25 bp, Mus musculus
atgtggagctgctaggttcttcccg

SEQ ID NO: 272427 - DNA, 25 bp, Mus musculus
atgtggaggactatcgccgcactgt

SEQ ID NO: 272428 - DNA, 25 bp, Mus musculus
atgtggaggactttcgccgcactgt

SEQ ID NO: 272429 - DNA, 25 bp, Mus musculus
atgtggaggagcatgcccgagacgg

SEQ ID NO: 272430 - DNA, 25 bp, Mus musculus
atgtggaggagcttgcccgagacgg

SEQ ID NO: 272431 - DNA, 25 bp, Mus musculus
atgtggaggtcaacccagcctattc

SEQ ID NO: 272432 - DNA, 25 bp, Mus musculus
atgtggaggtcatcccagcctattc

SEQ ID NO: 272433 - DNA, 25 bp, Mus musculus
atgtggaggtgccaacaatgatgaa

SEQ ID NO: 272434 - DNA, 25 bp, Mus musculus
atgtggaggtgcgaacaatgatgaa

SEQ ID NO: 272435 - DNA, 25 bp, Mus musculus
atgtggagttgtaactgcccgaaaa

SEQ ID NO: 272436 - DNA, 25 bp, Mus musculus
atgtggagttgttactgcccgaaaa

SEQ ID NO: 272437 - DNA, 25 bp, Mus musculus
atgtggagtttacatgggcctctga

SEQ ID NO: 272438 - DNA, 25 bp, Mus musculus
atgtggagtttagatgggcctctga

SEQ ID NO: 272439 - DNA, 25 bp, Mus musculus
atgtggatagccattaggcccctgc

SEQ ID NO: 272440 - DNA, 25 bp, Mus musculus
atgtggatagcctttaggcccctgc

SEQ ID NO: 272441 - DNA, 25 bp, Mus musculus
atgtggatatccagtagttcaggat

SEQ ID NO: 272442 - DNA, 25 bp, Mus musculus
atgtggatatcctgtagttcaggat

SEQ ID NO: 272443 - DNA, 25 bp, Mus musculus
atgtggatcatgagcttggtgtcaa

SEQ ID NO: 272444 - DNA, 25 bp, Mus musculus
atgtggatcatgtgcttggtgtcaa

SEQ ID NO: 272445 - DNA, 25 bp, Mus musculus
atgtggatcgcccatgccaatttag

SEQ ID NO: 272446 - DNA, 25 bp, Mus musculus
atgtggatcgccgatgccaatttag

SEQ ID NO: 272447 - DNA, 25 bp, Mus musculus
atgtggatcgtgaactctagtttct

SEQ ID NO: 272448 - DNA, 25 bp, Mus musculus
atgtggatcgtgtactctagtttct

SEQ ID NO: 272449 - DNA, 25 bp, Mus musculus
atgtggatctcactaacgagccctg

SEQ ID NO: 272450 - DNA, 25 bp, Mus musculus
atgtggatctcagtaacgagccctg

SEQ ID NO: 272451 - DNA, 25 bp, Mus musculus
atgtggatgactcccaggatgttgc

SEQ ID NO: 272452 - DNA, 25 bp, Mus musculus
atgtggatgactgccaggatgttgc

SEQ ID NO: 272453 - DNA, 25 bp, Mus musculus
atgtggatgccacaaagtgcttact

SEQ ID NO: 272454 - DNA, 25 bp, Mus musculus
atgtggatgccagaaagtgcttact

SEQ ID NO: 272455 - DNA, 25 bp, Mus musculus
atgtggatggaaatccccagccatt

SEQ ID NO: 272456 - DNA, 25 bp, Mus musculus
atgtggatggaattccccagccatt

SEQ ID NO: 272457 - DNA, 25 bp, Mus musculus
atgtggatggatcctctgtttctca

SEQ ID NO: 272458 - DNA, 25 bp, Mus musculus
atgtggatggatgctctgtttctca

SEQ ID NO: 272459 - DNA, 25 bp, Mus musculus
atgtggattcagaggcagattcaga

SEQ ID NO: 272460 - DNA, 25 bp, Mus musculus
atgtggattcagtggcagattcaga

SEQ ID NO: 272461 - DNA, 25 bp, Mus musculus
atgtggattcccctcaactgagggt

SEQ ID NO: 272462 - DNA, 25 bp, Mus musculus
atgtggattcccgtcaactgagggt

SEQ ID NO: 272463 - DNA, 25 bp, Mus musculus
atgtggattccgatatatcccctgg

SEQ ID NO: 272464 - DNA, 25 bp, Mus musculus
atgtggattccgttatatcccctgg

SEQ ID NO: 272465 - DNA, 25 bp, Mus musculus
atgtggattctgctgttttctgtat

SEQ ID NO: 272466 - DNA, 25 bp, Mus musculus
atgtggattctggtgttttctgtat

SEQ ID NO: 272467 - DNA, 25 bp, Mus musculus
atgtggatttacatgccggcagaag

SEQ ID NO: 272468 - DNA, 25 bp, Mus musculus
atgtggatttacttgccggcagaag

SEQ ID NO: 272469 - DNA, 25 bp, Mus musculus
atgtggatttatcgcactaaacact

SEQ ID NO: 272470 - DNA, 25 bp, Mus musculus
atgtggatttatggcactaaacact

SEQ ID NO: 272471 - DNA, 25 bp, Mus musculus
atgtggatttctcactgtgactgaa

SEQ ID NO: 272472 - DNA, 25 bp, Mus musculus
atgtggatttctgactgtgactgaa

SEQ ID NO: 272473 - DNA, 25 bp, Mus musculus
atgtggcaaccactacttaggcgtg

SEQ ID NO: 272474 - DNA, 25 bp, Mus musculus
atgtggcaaccagtacttaggcgtg

SEQ ID NO: 272475 - DNA, 25 bp, Mus musculus
atgtggcaactgaggtgagatttca

SEQ ID NO: 272476 - DNA, 25 bp, Mus musculus
atgtggcaactgtggtgagatttca

SEQ ID NO: 272477 - DNA, 25 bp, Mus musculus
atgtggcaacttccttatgcctaaa

SEQ ID NO: 272478 - DNA, 25 bp, Mus musculus
atgtggcaacttgcttatgcctaaa

SEQ ID NO: 272479 - DNA, 25 bp, Mus musculus
atgtggcaagaccttattaactatg

SEQ ID NO: 272480 - DNA, 25 bp, Mus musculus
atgtggcaagacgttattaactatg

SEQ ID NO: 272481 - DNA, 25 bp, Mus musculus
atgtggcaagggactgccccgagta

SEQ ID NO: 272482 - DNA, 25 bp, Mus musculus
atgtggcaagggtctgccccgagta

SEQ ID NO: 272483 - DNA, 25 bp, Mus musculus
atgtggcaatgtctgctttcataca

SEQ ID NO: 272484 - DNA, 25 bp, Mus musculus
atgtggcaatgtgtgctttcataca

SEQ ID NO: 272485 - DNA, 25 bp, Mus musculus
atgtggcaccaacctactaccctag

SEQ ID NO: 272486 - DNA, 25 bp, Mus musculus
atgtggcaccaagctactaccctag

SEQ ID NO: 272487 - DNA, 25 bp, Mus musculus
atgtggcacgcacctttcatctcag

SEQ ID NO: 272488 - DNA, 25 bp, Mus musculus
atgtggcacgcagctttcatctcag

SEQ ID NO: 272489 - DNA, 25 bp, Mus musculus
atgtggcactcacttcctctgggaa

SEQ ID NO: 272490 - DNA, 25 bp, Mus musculus
atgtggcactcagttcctctgggaa

SEQ ID NO: 272491 - DNA, 25 bp, Mus musculus
atgtggcactgaaacgaactgggca

SEQ ID NO: 272492 - DNA, 25 bp, Mus musculus
atgtggcactgatacgaactgggca

SEQ ID NO: 272493 - DNA, 25 bp, Mus musculus
atgtggcactgtcggttctggacct

SEQ ID NO: 272494 - DNA, 25 bp, Mus musculus
atgtggcactgtgggttctggacct

SEQ ID NO: 272495 - DNA, 25 bp, Mus musculus
atgtggcagcacagggcaagtatat

SEQ ID NO: 272496 - DNA, 25 bp, Mus musculus
atgtggcagcactgggcaagtatat

SEQ ID NO: 272497 - DNA, 25 bp, Mus musculus
atgtggcagcagacttcttggagac

SEQ ID NO: 272498 - DNA, 25 bp, Mus musculus
atgtggcagcagtcttcttggagac

SEQ ID NO: 272499 - DNA, 25 bp, Mus musculus
atgtggcaggtgattgctctcttgc

SEQ ID NO: 272500 - DNA, 25 bp, Mus musculus
atgtggcaggtgtttgctctcttgc

SEQ ID NO: 272501 - DNA, 25 bp, Mus musculus
atgtggcagttaaaatacaccttca

SEQ ID NO: 272502 - DNA, 25 bp, Mus musculus
atgtggcagttataatacaccttca

SEQ ID NO: 272503 - DNA, 25 bp, Mus musculus
atgtggcagttcaactcctgaagcc

SEQ ID NO: 272504 - DNA, 25 bp, Mus musculus
atgtggcagttctactcctgaagcc

SEQ ID NO: 272505 - DNA, 25 bp, Mus musculus
atgtggcatcccagaagcctttcaa

SEQ ID NO: 272506 - DNA, 25 bp, Mus musculus
atgtggcatccctgaagcctttcaa

SEQ ID NO: 272507 - DNA, 25 bp, Mus musculus
atgtggcatgtgactctggtcctgg

SEQ ID NO: 272508 - DNA, 25 bp, Mus musculus
atgtggcatgtgtctctggtcctgg

SEQ ID NO: 272509 - DNA, 25 bp, Mus musculus
atgtggccaaaacgaacaagcgaag

SEQ ID NO: 272510 - DNA, 25 bp, Mus musculus
atgtggccaaaaggaacaagcgaag

SEQ ID NO: 272511 - DNA, 25 bp, Mus musculus
atgtggccaactactacgtttccca

SEQ ID NO: 272512 - DNA, 25 bp, Mus musculus
atgtggccaacttctacgtttccca

SEQ ID NO: 272513 - DNA, 25 bp, Mus musculus
atgtggccaaggaactcgatctgtg

SEQ ID NO: 272514 - DNA, 25 bp, Mus musculus
atgtggccaaggtactcgatctgtg

SEQ ID NO: 272515 - DNA, 25 bp, Mus musculus
atgtggccactgaagtatctccttt

SEQ ID NO: 272516 - DNA, 25 bp, Mus musculus
atgtggccactgagacaggtttcct

SEQ ID NO: 272517 - DNA, 25 bp, Mus musculus
atgtggccactgtagtatctccttt

SEQ ID NO: 272518 - DNA, 25 bp, Mus musculus
atgtggccactgtgacaggtttcct

SEQ ID NO: 272519 - DNA, 25 bp, Mus musculus
atgtggccagcacggtccagacata

SEQ ID NO: 272520 - DNA, 25 bp, Mus musculus
atgtggccagcagggtccagacata

SEQ ID NO: 272521 - DNA, 25 bp, Mus musculus
atgtggccagccagcggacaccaga

SEQ ID NO: 272522 - DNA, 25 bp, Mus musculus
atgtggccagccctcagacagcagt

SEQ ID NO: 272523 - DNA, 25 bp, Mus musculus
atgtggccagccgtcagacagcagt

SEQ ID NO: 272524 - DNA, 25 bp, Mus musculus
atgtggccagcctgcggacaccaga

SEQ ID NO: 272525 - DNA, 25 bp, Mus musculus
atgtggccatgtatcagttgaggac

SEQ ID NO: 272526 - DNA, 25 bp, Mus musculus
atgtggccatgtttcagttgaggac

SEQ ID NO: 272527 - DNA, 25 bp, Mus musculus
atgtggccattgctaagtcccaggg

SEQ ID NO: 272528 - DNA, 25 bp, Mus musculus
atgtggccattggtaagtcccaggg

SEQ ID NO: 272529 - DNA, 25 bp, Mus musculus
atgtggcccattaaggtcctttgtc

SEQ ID NO: 272530 - DNA, 25 bp, Mus musculus
atgtggcccatttaggtcctttgtc

SEQ ID NO: 272531 - DNA, 25 bp, Mus musculus
atgtggccccttcgaactaatccca

SEQ ID NO: 272532 - DNA, 25 bp, Mus musculus
atgtggccccttctgactctgttga

SEQ ID NO: 272533 - DNA, 25 bp, Mus musculus
atgtggccccttggaactaatccca

SEQ ID NO: 272534 - DNA, 25 bp, Mus musculus
atgtggccccttgtgactctgttga

SEQ ID NO: 272535 - DNA, 25 bp, Mus musculus
atgtggcccggaagccaatgaccaa

SEQ ID NO: 272536 - DNA, 25 bp, Mus musculus
atgtggcccggatgccaatgaccaa

SEQ ID NO: 272537 - DNA, 25 bp, Mus musculus
atgtggcccggcaacttcgagagta

SEQ ID NO: 272538 - DNA, 25 bp, Mus musculus
atgtggcccggctacttcgagagta

SEQ ID NO: 272539 - DNA, 25 bp, Mus musculus
atgtggcccgtaacaatttgaggag

SEQ ID NO: 272540 - DNA, 25 bp, Mus musculus
atgtggcccgtatcaatttgaggag

SEQ ID NO: 272541 - DNA, 25 bp, Mus musculus
atgtggccctatcttgttattttac

SEQ ID NO: 272542 - DNA, 25 bp, Mus musculus
atgtggccctatgttgttattttac

SEQ ID NO: 272543 - DNA, 25 bp, Mus musculus
atgtggccctctacatggctttctt

SEQ ID NO: 272544 - DNA, 25 bp, Mus musculus
atgtggccctcttcatggctttctt

SEQ ID NO: 272545 - DNA, 25 bp, Mus musculus
atgtggccctgtcaagacgccgact

SEQ ID NO: 272546 - DNA, 25 bp, Mus musculus
atgtggccctgtgaagacgccgact

SEQ ID NO: 272547 - DNA, 25 bp, Mus musculus
atgtggcccttaacacttgacactc

SEQ ID NO: 272548 - DNA, 25 bp, Mus musculus
atgtggcccttatcacttgacactc

SEQ ID NO: 272549 - DNA, 25 bp, Mus musculus
atgtggccgcacaaggcaagtacat

SEQ ID NO: 272550 - DNA, 25 bp, Mus musculus
atgtggccgcactaggcaagtacat

SEQ ID NO: 272551 - DNA, 25 bp, Mus musculus
atgtggccgcctcagagcctacaga

SEQ ID NO: 272552 - DNA, 25 bp, Mus musculus
atgtggccgcctcccagctaatagg

SEQ ID NO: 272553 - DNA, 25 bp, Mus musculus
atgtggccgcctgagagcctacaga

SEQ ID NO: 272554 - DNA, 25 bp, Mus musculus
atgtggccgcctgccagctaatagg

SEQ ID NO: 272555 - DNA, 25 bp, Mus musculus
atgtggcctactaagcagggtgcgt

SEQ ID NO: 272556 - DNA, 25 bp, Mus musculus
atgtggcctacttagcagggtgcgt

SEQ ID NO: 272557 - DNA, 25 bp, Mus musculus
atgtggcctgccacattaccatgta

SEQ ID NO: 272558 - DNA, 25 bp, Mus musculus
atgtggcctgcctcattaccatgta

SEQ ID NO: 272559 - DNA, 25 bp, Mus musculus
atgtggcctgtgagctcgcacgccc

SEQ ID NO: 272560 - DNA, 25 bp, Mus musculus
atgtggcctgtgtgctcgcacgccc

SEQ ID NO: 272561 - DNA, 25 bp, Mus musculus
atgtggccttggaatgctgagcaaa

SEQ ID NO: 272562 - DNA, 25 bp, Mus musculus
atgtggccttggtatgctgagcaaa

SEQ ID NO: 272563 - DNA, 25 bp, Mus musculus
atgtggcgattcaacgtggaaaatt

SEQ ID NO: 272564 - DNA, 25 bp, Mus musculus
atgtggcgattctacgtggaaaatt

SEQ ID NO: 272565 - DNA, 25 bp, Mus musculus
atgtggctagtgatggctctaccca

SEQ ID NO: 272566 - DNA, 25 bp, Mus musculus
atgtggctagtgttggctctaccca

SEQ ID NO: 272567 - DNA, 25 bp, Mus musculus
atgtggctatatatcctagagcacc

SEQ ID NO: 272568 - DNA, 25 bp, Mus musculus
atgtggctatatttcctagagcacc

SEQ ID NO: 272569 - DNA, 25 bp, Mus musculus
atgtggctcagcacaaggcattcat

SEQ ID NO: 272570 - DNA, 25 bp, Mus musculus
atgtggctcagctcaaggcattcat

SEQ ID NO: 272571 - DNA, 25 bp, Mus musculus
atgtggctcccacatctgtgttatt

SEQ ID NO: 272572 - DNA, 25 bp, Mus musculus
atgtggctcccagatctgtgttatt

SEQ ID NO: 272573 - DNA, 25 bp, Mus musculus
atgtggctccctaggacattggtgc

SEQ ID NO: 272574 - DNA, 25 bp, Mus musculus
atgtggctcccttggacattggtgc

SEQ ID NO: 272575 - DNA, 25 bp, Mus musculus
atgtggctcgaaatgtggcccttac

SEQ ID NO: 272576 - DNA, 25 bp, Mus musculus
atgtggctcgaattgtggcccttac

SEQ ID NO: 272577 - DNA, 25 bp, Mus musculus
atgtggctctcaagtgcttcctcca

SEQ ID NO: 272578 - DNA, 25 bp, Mus musculus
atgtggctctcatgtgcttcctcca

SEQ ID NO: 272579 - DNA, 25 bp, Mus musculus
atgtggctctgtctggcatatgccc

SEQ ID NO: 272580 - DNA, 25 bp, Mus musculus
atgtggctctgtgtggcatatgccc

SEQ ID NO: 272581 - DNA, 25 bp, Mus musculus
atgtggctgcagcatcctctggaaa

SEQ ID NO: 272582 - DNA, 25 bp, Mus musculus
atgtggctgcaggatcctctggaaa

SEQ ID NO: 272583 - DNA, 25 bp, Mus musculus
atgtggctgcatatgcaaacccctt

SEQ ID NO: 272584 - DNA, 25 bp, Mus musculus
atgtggctgcatttgcaaacccctt

SEQ ID NO: 272585 - DNA, 25 bp, Mus musculus
atgtggctgctaacaaggaaaaggt

SEQ ID NO: 272586 - DNA, 25 bp, Mus musculus
atgtggctgctatcaaggaaaaggt

SEQ ID NO: 272587 - DNA, 25 bp, Mus musculus
atgtggctgctccaggtgactcttg

SEQ ID NO: 272588 - DNA, 25 bp, Mus musculus
atgtggctgctcgaggtgactcttg

SEQ ID NO: 272589 - DNA, 25 bp, Mus musculus
atgtggctgctgaggtccaaactct

SEQ ID NO: 272590 - DNA, 25 bp, Mus musculus
atgtggctgctgtggtccaaactct

SEQ ID NO: 272591 - DNA, 25 bp, Mus musculus
atgtggctgcttcgctggcaacaaa

SEQ ID NO: 272592 - DNA, 25 bp, Mus musculus
atgtggctgcttggctggcaacaaa

SEQ ID NO: 272593 - DNA, 25 bp, Mus musculus
atgtggctgtccagagtgtccttaa

SEQ ID NO: 272594 - DNA, 25 bp, Mus musculus
atgtggctgtcctgagtgtccttaa

SEQ ID NO: 272595 - DNA, 25 bp, Mus musculus
atgtggctgtgcaaaccattttcgc

SEQ ID NO: 272596 - DNA, 25 bp, Mus musculus
atgtggctgtgctaaccattttcgc

SEQ ID NO: 272597 - DNA, 25 bp, Mus musculus
atgtggctgtggagggattctttct

SEQ ID NO: 272598 - DNA, 25 bp, Mus musculus
atgtggctgtggtgggattctttct

SEQ ID NO: 272599 - DNA, 25 bp, Mus musculus
atgtggctgttaatttcctaggctt

SEQ ID NO: 272600 - DNA, 25 bp, Mus musculus
atgtggctgttattttcctaggctt

SEQ ID NO: 272601 - DNA, 25 bp, Mus musculus
atgtggctgttgagtccacagaccc

SEQ ID NO: 272602 - DNA, 25 bp, Mus musculus
atgtggctgttgtgtccacagaccc

SEQ ID NO: 272603 - DNA, 25 bp, Mus musculus
atgtggctgtttacgatggctcctg

SEQ ID NO: 272604 - DNA, 25 bp, Mus musculus
atgtggctgttttcgatggctcctg

SEQ ID NO: 272605 - DNA, 25 bp, Mus musculus
atgtggcttacaacaatgtggagac

SEQ ID NO: 272606 - DNA, 25 bp, Mus musculus
atgtggcttacatcaatgtggagac

SEQ ID NO: 272607 - DNA, 25 bp, Mus musculus
atgtggcttagtattatgttttgat

SEQ ID NO: 272608 - DNA, 25 bp, Mus musculus
atgtggcttagttttatgttttgat

SEQ ID NO: 272609 - DNA, 25 bp, Mus musculus
atgtggcttcacaggtaacttacaa

SEQ ID NO: 272610 - DNA, 25 bp, Mus musculus
atgtggcttcactggtaacttacaa

SEQ ID NO: 272611 - DNA, 25 bp, Mus musculus
atgtggcttcatccaggtttgctgt

SEQ ID NO: 272612 - DNA, 25 bp, Mus musculus
atgtggcttcatgcaggtttgctgt

SEQ ID NO: 272613 - DNA, 25 bp, Mus musculus
atgtggcttgccctcacgtacagtg

SEQ ID NO: 272614 - DNA, 25 bp, Mus musculus
atgtggcttgccgtcacgtacagtg

SEQ ID NO: 272615 - DNA, 25 bp, Mus musculus
atgtggctttgaaatgcctacattt

SEQ ID NO: 272616 - DNA, 25 bp, Mus musculus
atgtggctttgatatgcctacattt

SEQ ID NO: 272617 - DNA, 25 bp, Mus musculus
atgtggctttttacagcacttggac

SEQ ID NO: 272618 - DNA, 25 bp, Mus musculus
atgtggcttttttcagcacttggac

SEQ ID NO: 272619 - DNA, 25 bp, Mus musculus
atgtgggaactaaagccatagctat

SEQ ID NO: 272620 - DNA, 25 bp, Mus musculus
atgtgggaactatagccatagctat

SEQ ID NO: 272621 - DNA, 25 bp, Mus musculus
atgtgggaacttacttcgttgtctg

SEQ ID NO: 272622 - DNA, 25 bp, Mus musculus
atgtgggaactttcttcgttgtctg

SEQ ID NO: 272623 - DNA, 25 bp, Mus musculus
atgtgggaagaaccctggcttcagt

SEQ ID NO: 272624 - DNA, 25 bp, Mus musculus
atgtgggaagaagcctggcttcagt

SEQ ID NO: 272625 - DNA, 25 bp, Mus musculus
atgtgggaagcaactttacaatatt

SEQ ID NO: 272626 - DNA, 25 bp, Mus musculus
atgtgggaagcatctttacaatatt

SEQ ID NO: 272627 - DNA, 25 bp, Mus musculus
atgtgggaagccaataaacgccatt

SEQ ID NO: 272628 - DNA, 25 bp, Mus musculus
atgtgggaagcctataaacgccatt

SEQ ID NO: 272629 - DNA, 25 bp, Mus musculus
atgtgggaagttatatagtccctgt

SEQ ID NO: 272630 - DNA, 25 bp, Mus musculus
atgtgggaagttttatagtccctgt

SEQ ID NO: 272631 - DNA, 25 bp, Mus musculus
atgtgggaatgcacccatgctgcgt

SEQ ID NO: 272632 - DNA, 25 bp, Mus musculus
atgtgggaatgctcccatgctgcgt

SEQ ID NO: 272633 - DNA, 25 bp, Mus musculus
atgtgggacagcagagccacactgc

SEQ ID NO: 272634 - DNA, 25 bp, Mus musculus
atgtgggacagcctctgtctgtgtc

SEQ ID NO: 272635 - DNA, 25 bp, Mus musculus
atgtgggacagcgtctgtctgtgtc

SEQ ID NO: 272636 - DNA, 25 bp, Mus musculus
atgtgggacagctgagccacactgc

SEQ ID NO: 272637 - DNA, 25 bp, Mus musculus
atgtgggacatcaacagcttcgacc

SEQ ID NO: 272638 - DNA, 25 bp, Mus musculus
atgtgggacatctacagcttcgacc

SEQ ID NO: 272639 - DNA, 25 bp, Mus musculus
atgtgggactaacgcccaatccctg

SEQ ID NO: 272640 - DNA, 25 bp, Mus musculus
atgtgggactaaggcccaatccctg

SEQ ID NO: 272641 - DNA, 25 bp, Mus musculus
atgtgggactcactagtcttccata

SEQ ID NO: 272642 - DNA, 25 bp, Mus musculus
atgtgggactcagtagtcttccata

SEQ ID NO: 272643 - DNA, 25 bp, Mus musculus
atgtgggagagcattgccagcgcct

SEQ ID NO: 272644 - DNA, 25 bp, Mus musculus
atgtgggagagctttgccagcgcct

SEQ ID NO: 272645 - DNA, 25 bp, Mus musculus
atgtgggagatcctaacaccattag

SEQ ID NO: 272646 - DNA, 25 bp, Mus musculus
atgtgggagatcgtaacaccattag

SEQ ID NO: 272647 - DNA, 25 bp, Mus musculus
atgtgggagtcacttcgggcctttc

SEQ ID NO: 272648 - DNA, 25 bp, Mus musculus
atgtgggagtcagttcgggcctttc

SEQ ID NO: 272649 - DNA, 25 bp, Mus musculus
atgtgggatgccatattcactaaga

SEQ ID NO: 272650 - DNA, 25 bp, Mus musculus
atgtgggatgccttattcactaaga

SEQ ID NO: 272651 - DNA, 25 bp, Mus musculus
atgtgggattgcatttactctctgt

SEQ ID NO: 272652 - DNA, 25 bp, Mus musculus
atgtgggattgcttttactctctgt

SEQ ID NO: 272653 - DNA, 25 bp, Mus musculus
atgtgggcacgaatttgtacttaga

SEQ ID NO: 272654 - DNA, 25 bp, Mus musculus
atgtgggcacgattttgtacttaga

SEQ ID NO: 272655 - DNA, 25 bp, Mus musculus
atgtgggcactccatggatgatacc

SEQ ID NO: 272656 - DNA, 25 bp, Mus musculus
atgtgggcactcgatggatgatacc

SEQ ID NO: 272657 - DNA, 25 bp, Mus musculus
atgtgggcactgagaattgaacctt

SEQ ID NO: 272658 - DNA, 25 bp, Mus musculus
atgtgggcactgtgaattgaacctt

SEQ ID NO: 272659 - DNA, 25 bp, Mus musculus
atgtgggcagcgagttcccctaatc

SEQ ID NO: 272660 - DNA, 25 bp, Mus musculus
atgtgggcagcgtgttcccctaatc

SEQ ID NO: 272661 - DNA, 25 bp, Mus musculus
atgtgggcattcagctccgacgacc

SEQ ID NO: 272662 - DNA, 25 bp, Mus musculus
atgtgggcattctgctccgacgacc

SEQ ID NO: 272663 - DNA, 25 bp, Mus musculus
atgtgggccacaagaccgagagacc

SEQ ID NO: 272664 - DNA, 25 bp, Mus musculus
atgtgggccacacggttttactctc

SEQ ID NO: 272665 - DNA, 25 bp, Mus musculus
atgtgggccacagggttttactctc

SEQ ID NO: 272666 - DNA, 25 bp, Mus musculus
atgtgggccacatgaccgagagacc

SEQ ID NO: 272667 - DNA, 25 bp, Mus musculus
atgtgggccactcaagccctatgaa

SEQ ID NO: 272668 - DNA, 25 bp, Mus musculus
atgtgggccactgaagccctatgaa

SEQ ID NO: 272669 - DNA, 25 bp, Mus musculus
atgtgggccagcatgaactcacaga

SEQ ID NO: 272670 - DNA, 25 bp, Mus musculus
atgtgggccagcttgaactcacaga

SEQ ID NO: 272671 - DNA, 25 bp, Mus musculus
atgtgggcccgcactgcagggtaca

SEQ ID NO: 272672 - DNA, 25 bp, Mus musculus
atgtgggcccgctctgcagggtaca

SEQ ID NO: 272673 - DNA, 25 bp, Mus musculus
atgtgggccgtgaccaagcagttac

SEQ ID NO: 272674 - DNA, 25 bp, Mus musculus
atgtgggccgtgtccaagcagttac

SEQ ID NO: 272675 - DNA, 25 bp, Mus musculus
atgtgggctgatctctgcaaaaaca

SEQ ID NO: 272676 - DNA, 25 bp, Mus musculus
atgtgggctgatgtctgcaaaaaca

SEQ ID NO: 272677 - DNA, 25 bp, Mus musculus
atgtgggctgctacatctatgaccc

SEQ ID NO: 272678 - DNA, 25 bp, Mus musculus
atgtgggctgcttcatctatgaccc

SEQ ID NO: 272679 - DNA, 25 bp, Mus musculus
atgtgggctggtattcctcatggac

SEQ ID NO: 272680 - DNA, 25 bp, Mus musculus
atgtgggctggttttcctcatggac

SEQ ID NO: 272681 - DNA, 25 bp, Mus musculus
atgtgggctgttacacacttgtgga

SEQ ID NO: 272682 - DNA, 25 bp, Mus musculus
atgtgggctgtttcacacttgtgga

SEQ ID NO: 272683 - DNA, 25 bp, Mus musculus
atgtgggcttatccattataacttt

SEQ ID NO: 272684 - DNA, 25 bp, Mus musculus
atgtgggcttatgcattataacttt

SEQ ID NO: 272685 - DNA, 25 bp, Mus musculus
atgtgggcttctctatggtatccct

SEQ ID NO: 272686 - DNA, 25 bp, Mus musculus
atgtgggcttctgtatggtatccct

SEQ ID NO: 272687 - DNA, 25 bp, Mus musculus
atgtgggtaccacccaggagactca

SEQ ID NO: 272688 - DNA, 25 bp, Mus musculus
atgtgggtaccagccaggagactca

SEQ ID NO: 272689 - DNA, 25 bp, Mus musculus
atgtgggtataaatgtagacgtgtt

SEQ ID NO: 272690 - DNA, 25 bp, Mus musculus
atgtgggtataattgtagacgtgtt

SEQ ID NO: 272691 - DNA, 25 bp, Mus musculus
atgtgggtataccatgtatgtgcag

SEQ ID NO: 272692 - DNA, 25 bp, Mus musculus
atgtgggtatacgatgtatgtgcag

SEQ ID NO: 272693 - DNA, 25 bp, Mus musculus
atgtgggtatccacaagggcccgga

SEQ ID NO: 272694 - DNA, 25 bp, Mus musculus
atgtgggtatcctcaagggcccgga

SEQ ID NO: 272695 - DNA, 25 bp, Mus musculus
atgtgggtatctcctacttctccat

SEQ ID NO: 272696 - DNA, 25 bp, Mus musculus
atgtgggtatctgctacttctccat

SEQ ID NO: 272697 - DNA, 25 bp, Mus musculus
atgtgggtcacgcagcagagccact

SEQ ID NO: 272698 - DNA, 25 bp, Mus musculus
atgtgggtcacggagcagagccact

SEQ ID NO: 272699 - DNA, 25 bp, Mus musculus
atgtgggtcactagcagtgctgtga

SEQ ID NO: 272700 - DNA, 25 bp, Mus musculus
atgtgggtcacttgcagtgctgtga

SEQ ID NO: 272701 - DNA, 25 bp, Mus musculus
atgtgggtcataatgccaaagcttt

SEQ ID NO: 272702 - DNA, 25 bp, Mus musculus
atgtgggtcatattgccaaagcttt

SEQ ID NO: 272703 - DNA, 25 bp, Mus musculus
atgtgggtcattcctgtcactctac

SEQ ID NO: 272704 - DNA, 25 bp, Mus musculus
atgtgggtcattgctgtcactctac

SEQ ID NO: 272705 - DNA, 25 bp, Mus musculus
atgtgggtctagcttctaagaagcc

SEQ ID NO: 272706 - DNA, 25 bp, Mus musculus
atgtgggtctaggttctaagaagcc

SEQ ID NO: 272707 - DNA, 25 bp, Mus musculus
atgtgggtctcaacgcaattcggtg

SEQ ID NO: 272708 - DNA, 25 bp, Mus musculus
atgtgggtctcatcgcaattcggtg

SEQ ID NO: 272709 - DNA, 25 bp, Mus musculus
atgtgggtctgaatggtggaattaa

SEQ ID NO: 272710 - DNA, 25 bp, Mus musculus
atgtgggtctgattggtggaattaa

SEQ ID NO: 272711 - DNA, 25 bp, Mus musculus
atgtgggtgctcacagaaccaagcc

SEQ ID NO: 272712 - DNA, 25 bp, Mus musculus
atgtgggtgctctcagaaccaagcc

SEQ ID NO: 272713 - DNA, 25 bp, Mus musculus
atgtgggtggctaatctgatcccta

SEQ ID NO: 272714 - DNA, 25 bp, Mus musculus
atgtgggtggcttatctgatcccta

SEQ ID NO: 272715 - DNA, 25 bp, Mus musculus
atgtgggtttgccaagcaaggacaa

SEQ ID NO: 272716 - DNA, 25 bp, Mus musculus
atgtgggtttgcgaagcaaggacaa

SEQ ID NO: 272717 - DNA, 25 bp, Mus musculus
atgtggtaaacaatttataagtcac

SEQ ID NO: 272718 - DNA, 25 bp, Mus musculus
atgtggtaaacattttataagtcac

SEQ ID NO: 272719 - DNA, 25 bp, Mus musculus
atgtggtaaacccaatgcgccggcc

SEQ ID NO: 272720 - DNA, 25 bp, Mus musculus
atgtggtaaaccgaatgcgccggcc

SEQ ID NO: 272721 - DNA, 25 bp, Mus musculus
atgtggtaacatcacttggtcttcc

SEQ ID NO: 272722 - DNA, 25 bp, Mus musculus
atgtggtaacatgacttggtcttcc

SEQ ID NO: 272723 - DNA, 25 bp, Mus musculus
atgtggtaactaatccttcacgtcc

SEQ ID NO: 272724 - DNA, 25 bp, Mus musculus
atgtggtaactattccttcacgtcc

SEQ ID NO: 272725 - DNA, 25 bp, Mus musculus
atgtggtaattcattccctcaactg

SEQ ID NO: 272726 - DNA, 25 bp, Mus musculus
atgtggtaattctttccctcaactg

SEQ ID NO: 272727 - DNA, 25 bp, Mus musculus
atgtggtacccaactcaggtcataa

SEQ ID NO: 272728 - DNA, 25 bp, Mus musculus
atgtggtacccatctcaggtcataa

SEQ ID NO: 272729 - DNA, 25 bp, Mus musculus
atgtggtaccgcatgtatcacactt

SEQ ID NO: 272730 - DNA, 25 bp, Mus musculus
atgtggtaccgcttgtatcacactt

SEQ ID NO: 272731 - DNA, 25 bp, Mus musculus
atgtggtagctgatgctcccaggtc

SEQ ID NO: 272732 - DNA, 25 bp, Mus musculus
atgtggtagctgttgctcccaggtc

SEQ ID NO: 272733 - DNA, 25 bp, Mus musculus
atgtggtagtttcgatagttattac

SEQ ID NO: 272734 - DNA, 25 bp, Mus musculus
atgtggtagtttggatagttattac

SEQ ID NO: 272735 - DNA, 25 bp, Mus musculus
atgtggtatccaactatatccattg

SEQ ID NO: 272736 - DNA, 25 bp, Mus musculus
atgtggtatccatctatatccattg

SEQ ID NO: 272737 - DNA, 25 bp, Mus musculus
atgtggtatgtcacacttcaacgcc

SEQ ID NO: 272738 - DNA, 25 bp, Mus musculus
atgtggtatgtctcacttcaacgcc

SEQ ID NO: 272739 - DNA, 25 bp, Mus musculus
atgtggtattacagccatcctaggc

SEQ ID NO: 272740 - DNA, 25 bp, Mus musculus
atgtggtattactgccatcctaggc

SEQ ID NO: 272741 - DNA, 25 bp, Mus musculus
atgtggtattcaactagtgcctgct

SEQ ID NO: 272742 - DNA, 25 bp, Mus musculus
atgtggtattcatctagtgcctgct

SEQ ID NO: 272743 - DNA, 25 bp, Mus musculus
atgtggtcaattcagccggtacggc

SEQ ID NO: 272744 - DNA, 25 bp, Mus musculus
atgtggtcaattgagccggtacggc

SEQ ID NO: 272745 - DNA, 25 bp, Mus musculus
atgtggtcacagatacaaccctcta

SEQ ID NO: 272746 - DNA, 25 bp, Mus musculus
atgtggtcacagttacaaccctcta

SEQ ID NO: 272747 - DNA, 25 bp, Mus musculus
atgtggtcacccatgggcaggagtc

SEQ ID NO: 272748 - DNA, 25 bp, Mus musculus
atgtggtcacccttgggcaggagtc

SEQ ID NO: 272749 - DNA, 25 bp, Mus musculus
atgtggtcagacatggaactcttat

SEQ ID NO: 272750 - DNA, 25 bp, Mus musculus
atgtggtcagacttggaactcttat

SEQ ID NO: 272751 - DNA, 25 bp, Mus musculus
atgtggtcagcaagaacctgctctg

SEQ ID NO: 272752 - DNA, 25 bp, Mus musculus
atgtggtcagcatgaacctgctctg

SEQ ID NO: 272753 - DNA, 25 bp, Mus musculus
atgtggtcatctcctatggcctggt

SEQ ID NO: 272754 - DNA, 25 bp, Mus musculus
atgtggtcatctgctatggcctggt

SEQ ID NO: 272755 - DNA, 25 bp, Mus musculus
atgtggtcatgaaagggcaccctcc

SEQ ID NO: 272756 - DNA, 25 bp, Mus musculus
atgtggtcatgatagggcaccctcc

SEQ ID NO: 272757 - DNA, 25 bp, Mus musculus
atgtggtcattgcatgagcctgtgc

SEQ ID NO: 272758 - DNA, 25 bp, Mus musculus
atgtggtcattggatgagcctgtgc

SEQ ID NO: 272759 - DNA, 25 bp, Mus musculus
atgtggtccaacagacattcattta

SEQ ID NO: 272760 - DNA, 25 bp, Mus musculus
atgtggtccaactgacattcattta

SEQ ID NO: 272761 - DNA, 25 bp, Mus musculus
atgtggtccatacccagaactgtaa

SEQ ID NO: 272762 - DNA, 25 bp, Mus musculus
atgtggtccataccttcttcagttc

SEQ ID NO: 272763 - DNA, 25 bp, Mus musculus
atgtggtccatagccagaactgtaa

SEQ ID NO: 272764 - DNA, 25 bp, Mus musculus
atgtggtccatagcttcttcagttc

SEQ ID NO: 272765 - DNA, 25 bp, Mus musculus
atgtggtccatcatcttagaggctc

SEQ ID NO: 272766 - DNA, 25 bp, Mus musculus
atgtggtccatcttcttagaggctc

SEQ ID NO: 272767 - DNA, 25 bp, Mus musculus
atgtggtccgacatcttttatctaa

SEQ ID NO: 272768 - DNA, 25 bp, Mus musculus
atgtggtccgacttcttttatctaa

SEQ ID NO: 272769 - DNA, 25 bp, Mus musculus
atgtggtccgataatgatttctgaa

SEQ ID NO: 272770 - DNA, 25 bp, Mus musculus
atgtggtccgattatgatttctgaa

SEQ ID NO: 272771 - DNA, 25 bp, Mus musculus
atgtggtccgtaaggctccaaacgt

SEQ ID NO: 272772 - DNA, 25 bp, Mus musculus
atgtggtccgtatggctccaaacgt

SEQ ID NO: 272773 - DNA, 25 bp, Mus musculus
atgtggtcctcacatctagtcagct

SEQ ID NO: 272774 - DNA, 25 bp, Mus musculus
atgtggtcctcagatctagtcagct

SEQ ID NO: 272775 - DNA, 25 bp, Mus musculus
atgtggtcctccaccttggctggta

SEQ ID NO: 272776 - DNA, 25 bp, Mus musculus
atgtggtcctcctccttggctggta

SEQ ID NO: 272777 - DNA, 25 bp, Mus musculus
atgtggtcctggaggaacgctgcac

SEQ ID NO: 272778 - DNA, 25 bp, Mus musculus
atgtggtcctggtggaacgctgcac

SEQ ID NO: 272779 - DNA, 25 bp, Mus musculus
atgtggtctaacctggccttaagtc

SEQ ID NO: 272780 - DNA, 25 bp, Mus musculus
atgtggtctaacgtggccttaagtc

SEQ ID NO: 272781 - DNA, 25 bp, Mus musculus
atgtggtctcctccattcggaactt

SEQ ID NO: 272782 - DNA, 25 bp, Mus musculus
atgtggtctcctgcattcggaactt

SEQ ID NO: 272783 - DNA, 25 bp, Mus musculus
atgtggtctgcacgtgtcatattcc

SEQ ID NO: 272784 - DNA, 25 bp, Mus musculus
atgtggtctgcaggtgtcatattcc

SEQ ID NO: 272785 - DNA, 25 bp, Mus musculus
atgtggtcttacactgtagttcagg

SEQ ID NO: 272786 - DNA, 25 bp, Mus musculus
atgtggtcttacattggtgtctgca

SEQ ID NO: 272787 - DNA, 25 bp, Mus musculus
atgtggtcttactctgtagttcagg

SEQ ID NO: 272788 - DNA, 25 bp, Mus musculus
atgtggtcttactttggtgtctgca

SEQ ID NO: 272789 - DNA, 25 bp, Mus musculus
atgtggtgacatccattggcttttg

SEQ ID NO: 272790 - DNA, 25 bp, Mus musculus
atgtggtgacatgcattggcttttg

SEQ ID NO: 272791 - DNA, 25 bp, Mus musculus
atgtggtgaccaacatcaagggcaa

SEQ ID NO: 272792 - DNA, 25 bp, Mus musculus
atgtggtgaccatcatcaagggcaa

SEQ ID NO: 272793 - DNA, 25 bp, Mus musculus
atgtggtgagccagaccgagtccct

SEQ ID NO: 272794 - DNA, 25 bp, Mus musculus
atgtggtgagcctgaccgagtccct

SEQ ID NO: 272795 - DNA, 25 bp, Mus musculus
atgtggtgatcacgagcttgtgtca

SEQ ID NO: 272796 - DNA, 25 bp, Mus musculus
atgtggtgatcaggagcttgtgtca

SEQ ID NO: 272797 - DNA, 25 bp, Mus musculus
atgtggtgcatccttggttatctgt

SEQ ID NO: 272798 - DNA, 25 bp, Mus musculus
atgtggtgcatcgttggttatctgt

SEQ ID NO: 272799 - DNA, 25 bp, Mus musculus
atgtggtgccaaagccaagcagtcc

SEQ ID NO: 272800 - DNA, 25 bp, Mus musculus
atgtggtgccaatgccaagcagtcc

SEQ ID NO: 272801 - DNA, 25 bp, Mus musculus
atgtggtgccacaagcctgtaatcc

SEQ ID NO: 272802 - DNA, 25 bp, Mus musculus
atgtggtgccactagcctgtaatcc

SEQ ID NO: 272803 - DNA, 25 bp, Mus musculus
atgtggtgcctaagggaacatgcca

SEQ ID NO: 272804 - DNA, 25 bp, Mus musculus
atgtggtgcctatgggaacatgcca

SEQ ID NO: 272805 - DNA, 25 bp, Mus musculus
atgtggtgcgctaacacgtgtactt

SEQ ID NO: 272806 - DNA, 25 bp, Mus musculus
atgtggtgcgcttacacgtgtactt

SEQ ID NO: 272807 - DNA, 25 bp, Mus musculus
atgtggtgctcacacattcaggcaa

SEQ ID NO: 272808 - DNA, 25 bp, Mus musculus
atgtggtgctcagacattcaggcaa

SEQ ID NO: 272809 - DNA, 25 bp, Mus musculus
atgtggtggacaacgtggctcctgc

SEQ ID NO: 272810 - DNA, 25 bp, Mus musculus
atgtggtggacatcgtggctcctgc

SEQ ID NO: 272811 - DNA, 25 bp, Mus musculus
atgtggtggaccctgatgtgtaact

SEQ ID NO: 272812 - DNA, 25 bp, Mus musculus
atgtggtggaccgtgatgtgtaact

SEQ ID NO: 272813 - DNA, 25 bp, Mus musculus
atgtggtggtgacagccttcctgtc

SEQ ID NO: 272814 - DNA, 25 bp, Mus musculus
atgtggtggtgagagccttcctgtc

SEQ ID NO: 272815 - DNA, 25 bp, Mus musculus
atgtggtgtatcaggcatcatgtag

SEQ ID NO: 272816 - DNA, 25 bp, Mus musculus
atgtggtgtatctggcatcatgtag

SEQ ID NO: 272817 - DNA, 25 bp, Mus musculus
atgtggttacgtaccttgactgaac

SEQ ID NO: 272818 - DNA, 25 bp, Mus musculus
atgtggttacgttccttgactgaac

SEQ ID NO: 272819 - DNA, 25 bp, Mus musculus
atgtggttactgaactgtcctcagg

SEQ ID NO: 272820 - DNA, 25 bp, Mus musculus
atgtggttactgtactgtcctcagg

SEQ ID NO: 272821 - DNA, 25 bp, Mus musculus
atgtggttacttacccaaacagtga

SEQ ID NO: 272822 - DNA, 25 bp, Mus musculus
atgtggttactttcccaaacagtga

SEQ ID NO: 272823 - DNA, 25 bp, Mus musculus
atgtggttatctatgttgtattggc

SEQ ID NO: 272824 - DNA, 25 bp, Mus musculus
atgtggttatctttgttgtattggc

SEQ ID NO: 272825 - DNA, 25 bp, Mus musculus
atgtggttcatgatagtgtagtaga

SEQ ID NO: 272826 - DNA, 25 bp, Mus musculus
atgtggttcatgttagtgtagtaga

SEQ ID NO: 272827 - DNA, 25 bp, Mus musculus
atgtggttccagacagagtgtgctc

SEQ ID NO: 272828 - DNA, 25 bp, Mus musculus
atgtggttccagtcagagtgtgctc

SEQ ID NO: 272829 - DNA, 25 bp, Mus musculus
atgtggttcgtcaggaaatctttgc

SEQ ID NO: 272830 - DNA, 25 bp, Mus musculus
atgtggttcgtctggaaatctttgc

SEQ ID NO: 272831 - DNA, 25 bp, Mus musculus
atgtggttgtgcatctattgccaat

SEQ ID NO: 272832 - DNA, 25 bp, Mus musculus
atgtggttgtgcttctattgccaat

SEQ ID NO: 272833 - DNA, 25 bp, Mus musculus
atgtggtttcagctcagggtccgtc

SEQ ID NO: 272834 - DNA, 25 bp, Mus musculus
atgtggtttcaggtcagggtccgtc

SEQ ID NO: 272835 - DNA, 25 bp, Mus musculus
atgtggtttctgacagaagcggcac

SEQ ID NO: 272836 - DNA, 25 bp, Mus musculus
atgtggtttctgtcagaagcggcac

SEQ ID NO: 272837 - DNA, 25 bp, Mus musculus
atgtggtttggtccccgtcgttcag

SEQ ID NO: 272838 - DNA, 25 bp, Mus musculus
atgtggtttggtgcccgtcgttcag

SEQ ID NO: 272839 - DNA, 25 bp, Mus musculus
atgtgtaaacccacgatttgtttgt

SEQ ID NO: 272840 - DNA, 25 bp, Mus musculus
atgtgtaaaccctcgatttgtttgt

SEQ ID NO: 272841 - DNA, 25 bp, Mus musculus
atgtgtaaaggtactggcctgagcc

SEQ ID NO: 272842 - DNA, 25 bp, Mus musculus
atgtgtaaaggttctggcctgagcc

SEQ ID NO: 272843 - DNA, 25 bp, Mus musculus
atgtgtaaatatagctgcagcattt

SEQ ID NO: 272844 - DNA, 25 bp, Mus musculus
atgtgtaaatattgctgcagcattt

SEQ ID NO: 272845 - DNA, 25 bp, Mus musculus
atgtgtaacaaacccgtaccttgcc

SEQ ID NO: 272846 - DNA, 25 bp, Mus musculus
atgtgtaacaaagccgtaccttgcc

SEQ ID NO: 272847 - DNA, 25 bp, Mus musculus
atgtgtaaccacctgctaggaccat

SEQ ID NO: 272848 - DNA, 25 bp, Mus musculus
atgtgtaaccacgtgctaggaccat

SEQ ID NO: 272849 - DNA, 25 bp, Mus musculus
atgtgtaacccaagccagtccgtta

SEQ ID NO: 272850 - DNA, 25 bp, Mus musculus
atgtgtaacccatgccagtccgtta

SEQ ID NO: 272851 - DNA, 25 bp, Mus musculus
atgtgtaagaagactgtcccaggca

SEQ ID NO: 272852 - DNA, 25 bp, Mus musculus
atgtgtaagaagtctgtcccaggca

SEQ ID NO: 272853 - DNA, 25 bp, Mus musculus
atgtgtaagcacactttcctggagc

SEQ ID NO: 272854 - DNA, 25 bp, Mus musculus
atgtgtaagcactctttcctggagc

SEQ ID NO: 272855 - DNA, 25 bp, Mus musculus
atgtgtaagctcattgaatcaactt

SEQ ID NO: 272856 - DNA, 25 bp, Mus musculus
atgtgtaagctctttgaatcaactt

SEQ ID NO: 272857 - DNA, 25 bp, Mus musculus
atgtgtaagtcactcctgtaatctt

SEQ ID NO: 272858 - DNA, 25 bp, Mus musculus
atgtgtaagtcagtcctgtaatctt

SEQ ID NO: 272859 - DNA, 25 bp, Mus musculus
atgtgtaagtgtccctgattggcca

SEQ ID NO: 272860 - DNA, 25 bp, Mus musculus
atgtgtaagtgtgcctgattggcca

SEQ ID NO: 272861 - DNA, 25 bp, Mus musculus
atgtgtaatatgatgaacctgtcag

SEQ ID NO: 272862 - DNA, 25 bp, Mus musculus
atgtgtaatatgttgaacctgtcag

SEQ ID NO: 272863 - DNA, 25 bp, Mus musculus
atgtgtaatctccactgaactttta

SEQ ID NO: 272864 - DNA, 25 bp, Mus musculus
atgtgtaatctcgactgaactttta

SEQ ID NO: 272865 - DNA, 25 bp, Mus musculus
atgtgtaattgcataccgtttgcag

SEQ ID NO: 272866 - DNA, 25 bp, Mus musculus
atgtgtaattgcttaccgtttgcag

SEQ ID NO: 272867 - DNA, 25 bp, Mus musculus
atgtgtaattgtaccagcattccaa

SEQ ID NO: 272868 - DNA, 25 bp, Mus musculus
atgtgtaattgttccagcattccaa

SEQ ID NO: 272869 - DNA, 25 bp, Mus musculus
atgtgtaatttcaactctgtgcccg

SEQ ID NO: 272870 - DNA, 25 bp, Mus musculus
atgtgtaatttcagatgctcttgat

SEQ ID NO: 272871 - DNA, 25 bp, Mus musculus
atgtgtaatttctactctgtgcccg

SEQ ID NO: 272872 - DNA, 25 bp, Mus musculus
atgtgtaatttctgatgctcttgat

SEQ ID NO: 272873 - DNA, 25 bp, Mus musculus
atgtgtacaagaaccacccaggaga

SEQ ID NO: 272874 - DNA, 25 bp, Mus musculus
atgtgtacaagaccgagctaaccaa

SEQ ID NO: 272875 - DNA, 25 bp, Mus musculus
atgtgtacaagagcgagctaaccaa

SEQ ID NO: 272876 - DNA, 25 bp, Mus musculus
atgtgtacaagatccacccaggaga

SEQ ID NO: 272877 - DNA, 25 bp, Mus musculus
atgtgtacaccactttcagttctct

SEQ ID NO: 272878 - DNA, 25 bp, Mus musculus
atgtgtacaccagtttcagttctct

SEQ ID NO: 272879 - DNA, 25 bp, Mus musculus
atgtgtacagagagattgagcttga

SEQ ID NO: 272880 - DNA, 25 bp, Mus musculus
atgtgtacagagtgattgagcttga

SEQ ID NO: 272881 - DNA, 25 bp, Mus musculus
atgtgtacagtaagctcctagatat

SEQ ID NO: 272882 - DNA, 25 bp, Mus musculus
atgtgtacagtatgctcctagatat

SEQ ID NO: 272883 - DNA, 25 bp, Mus musculus
atgtgtacatacagtttctcttctt

SEQ ID NO: 272884 - DNA, 25 bp, Mus musculus
atgtgtacatactgtttctcttctt

SEQ ID NO: 272885 - DNA, 25 bp, Mus musculus
atgtgtacatagatcaccttcccaa

SEQ ID NO: 272886 - DNA, 25 bp, Mus musculus
atgtgtacatagttcaccttcccaa

SEQ ID NO: 272887 - DNA, 25 bp, Mus musculus
atgtgtacatcccactgggcgggtc

SEQ ID NO: 272888 - DNA, 25 bp, Mus musculus
atgtgtacatccgactgggcgggtc

SEQ ID NO: 272889 - DNA, 25 bp, Mus musculus
atgtgtacatggctacacgcgtgta

SEQ ID NO: 272890 - DNA, 25 bp, Mus musculus
atgtgtacatgggtacacgcgtgta

SEQ ID NO: 272891 - DNA, 25 bp, Mus musculus
atgtgtacatgtcatctcgaaagga

SEQ ID NO: 272892 - DNA, 25 bp, Mus musculus
atgtgtacatgtgatctcgaaagga

SEQ ID NO: 272893 - DNA, 25 bp, Mus musculus
atgtgtaccatgacatccagcctta

SEQ ID NO: 272894 - DNA, 25 bp, Mus musculus
atgtgtaccatgtcatccagcctta

SEQ ID NO: 272895 - DNA, 25 bp, Mus musculus
atgtgtacccagataaagcagatga

SEQ ID NO: 272896 - DNA, 25 bp, Mus musculus
atgtgtacccagttaaagcagatga

SEQ ID NO: 272897 - DNA, 25 bp, Mus musculus
atgtgtaccccgcactgtggaggaa

SEQ ID NO: 272898 - DNA, 25 bp, Mus musculus
atgtgtaccccggactgtggaggaa

SEQ ID NO: 272899 - DNA, 25 bp, Mus musculus
atgtgtacccctacctggatgggac

SEQ ID NO: 272900 - DNA, 25 bp, Mus musculus
atgtgtaccccttcctggatgggac

SEQ ID NO: 272901 - DNA, 25 bp, Mus musculus
atgtgtaccgtaaactgcaggagga

SEQ ID NO: 272902 - DNA, 25 bp, Mus musculus
atgtgtaccgtatactgcaggagga

SEQ ID NO: 272903 - DNA, 25 bp, Mus musculus
atgtgtacgaatcttgcctgcatgt

SEQ ID NO: 272904 - DNA, 25 bp, Mus musculus
atgtgtacgaatgttgcctgcatgt

SEQ ID NO: 272905 - DNA, 25 bp, Mus musculus
atgtgtacgacaatgctgggtcctt

SEQ ID NO: 272906 - DNA, 25 bp, Mus musculus
atgtgtacgacattgctgggtcctt

SEQ ID NO: 272907 - DNA, 25 bp, Mus musculus
atgtgtactcttattgataggactc

SEQ ID NO: 272908 - DNA, 25 bp, Mus musculus
atgtgtactctttttgataggactc

SEQ ID NO: 272909 - DNA, 25 bp, Mus musculus
atgtgtactgtaagtgcccccaaat

SEQ ID NO: 272910 - DNA, 25 bp, Mus musculus
atgtgtactgtaatcttgaccgttg

SEQ ID NO: 272911 - DNA, 25 bp, Mus musculus
atgtgtactgtatgtgcccccaaat

SEQ ID NO: 272912 - DNA, 25 bp, Mus musculus
atgtgtactgtattcttgaccgttg

SEQ ID NO: 272913 - DNA, 25 bp, Mus musculus
atgtgtactgtcagttcagctcatc

SEQ ID NO: 272914 - DNA, 25 bp, Mus musculus
atgtgtactgtctgttcagctcatc

SEQ ID NO: 272915 - DNA, 25 bp, Mus musculus
atgtgtacttgaatacagggccaga

SEQ ID NO: 272916 - DNA, 25 bp, Mus musculus
atgtgtacttgattacagggccaga

SEQ ID NO: 272917 - DNA, 25 bp, Mus musculus
atgtgtacttgtaagctgttggctt

SEQ ID NO: 272918 - DNA, 25 bp, Mus musculus
atgtgtacttgttagctgttggctt

SEQ ID NO: 272919 - DNA, 25 bp, Mus musculus
atgtgtactttgaagtcggtgcctt

SEQ ID NO: 272920 - DNA, 25 bp, Mus musculus
atgtgtactttgtagtcggtgcctt

SEQ ID NO: 272921 - DNA, 25 bp, Mus musculus
atgtgtagaggtctctctcactgac

SEQ ID NO: 272922 - DNA, 25 bp, Mus musculus
atgtgtagaggtgtctctcactgac

SEQ ID NO: 272923 - DNA, 25 bp, Mus musculus
atgtgtagcacaaagccagcatctc

SEQ ID NO: 272924 - DNA, 25 bp, Mus musculus
atgtgtagcacaactgcgtgtggat

SEQ ID NO: 272925 - DNA, 25 bp, Mus musculus
atgtgtagcacatagccagcatctc

SEQ ID NO: 272926 - DNA, 25 bp, Mus musculus
atgtgtagcacatctgcgtgtggat

SEQ ID NO: 272927 - DNA, 25 bp, Mus musculus
atgtgtagcactcttcactgcactt

SEQ ID NO: 272928 - DNA, 25 bp, Mus musculus
atgtgtagcactgttcactgcactt

SEQ ID NO: 272929 - DNA, 25 bp, Mus musculus
atgtgtagcagaattccgcaaggac

SEQ ID NO: 272930 - DNA, 25 bp, Mus musculus
atgtgtagcagatttccgcaaggac

SEQ ID NO: 272931 - DNA, 25 bp, Mus musculus
atgtgtagccataagggttttgcct

SEQ ID NO: 272932 - DNA, 25 bp, Mus musculus
atgtgtagccattagggttttgcct

SEQ ID NO: 272933 - DNA, 25 bp, Mus musculus
atgtgtagctgaagatgaccctcca

SEQ ID NO: 272934 - DNA, 25 bp, Mus musculus
atgtgtagctgatgatgaccctcca

SEQ ID NO: 272935 - DNA, 25 bp, Mus musculus
atgtgtaggctaacagatatccctg

SEQ ID NO: 272936 - DNA, 25 bp, Mus musculus
atgtgtaggctatcagatatccctg

SEQ ID NO: 272937 - DNA, 25 bp, Mus musculus
atgtgtaggtaaagctctgccatac

SEQ ID NO: 272938 - DNA, 25 bp, Mus musculus
atgtgtaggtaatgctctgccatac

SEQ ID NO: 272939 - DNA, 25 bp, Mus musculus
atgtgtagtcagacctactctgcag

SEQ ID NO: 272940 - DNA, 25 bp, Mus musculus
atgtgtagtcagtcctactctgcag

SEQ ID NO: 272941 - DNA, 25 bp, Mus musculus
atgtgtagtcgcaaaaccgaactag

SEQ ID NO: 272942 - DNA, 25 bp, Mus musculus
atgtgtagtcgctaaaccgaactag

SEQ ID NO: 272943 - DNA, 25 bp, Mus musculus
atgtgtagtctgctcacttttctgt

SEQ ID NO: 272944 - DNA, 25 bp, Mus musculus
atgtgtagtctggtcacttttctgt

SEQ ID NO: 272945 - DNA, 25 bp, Mus musculus
atgtgtagtcttcccgattatgtga

SEQ ID NO: 272946 - DNA, 25 bp, Mus musculus
atgtgtagtcttgccgattatgtga

SEQ ID NO: 272947 - DNA, 25 bp, Mus musculus
atgtgtataaacctgcataaaccca

SEQ ID NO: 272948 - DNA, 25 bp, Mus musculus
atgtgtataaacgtgcataaaccca

SEQ ID NO: 272949 - DNA, 25 bp, Mus musculus
atgtgtatagctctggaccatagcc

SEQ ID NO: 272950 - DNA, 25 bp, Mus musculus
atgtgtatagctgtggaccatagcc

SEQ ID NO: 272951 - DNA, 25 bp, Mus musculus
atgtgtatatatctcaactaagaat

SEQ ID NO: 272952 - DNA, 25 bp, Mus musculus
atgtgtatatatgtcaactaagaat

SEQ ID NO: 272953 - DNA, 25 bp, Mus musculus
atgtgtatcacacgacactccttgc

SEQ ID NO: 272954 - DNA, 25 bp, Mus musculus
atgtgtatcacaggacactccttgc

SEQ ID NO: 272955 - DNA, 25 bp, Mus musculus
atgtgtatcaccatgactgcttcgc

SEQ ID NO: 272956 - DNA, 25 bp, Mus musculus
atgtgtatcaccctgaggcatctta

SEQ ID NO: 272957 - DNA, 25 bp, Mus musculus
atgtgtatcaccgtgaggcatctta

SEQ ID NO: 272958 - DNA, 25 bp, Mus musculus
atgtgtatcaccttgactgcttcgc

SEQ ID NO: 272959 - DNA, 25 bp, Mus musculus
atgtgtatcataagcccatggagac

SEQ ID NO: 272960 - DNA, 25 bp, Mus musculus
atgtgtatcatatgcccatggagac

SEQ ID NO: 272961 - DNA, 25 bp, Mus musculus
atgtgtatccctatgtgggttttgt

SEQ ID NO: 272962 - DNA, 25 bp, Mus musculus
atgtgtatccctttgtgggttttgt

SEQ ID NO: 272963 - DNA, 25 bp, Mus musculus
atgtgtatcgaccatgtgccgtatg

SEQ ID NO: 272964 - DNA, 25 bp, Mus musculus
atgtgtatcgacgatgtgccgtatg

SEQ ID NO: 272965 - DNA, 25 bp, Mus musculus
atgtgtatctgtaacgcaggtatat

SEQ ID NO: 272966 - DNA, 25 bp, Mus musculus
atgtgtatctgtatgggtctctgct

SEQ ID NO: 272967 - DNA, 25 bp, Mus musculus
atgtgtatctgttacgcaggtatat

SEQ ID NO: 272968 - DNA, 25 bp, Mus musculus
atgtgtatctgtttgggtctctgct

SEQ ID NO: 272969 - DNA, 25 bp, Mus musculus
atgtgtatgtatatcctatgacgtc

SEQ ID NO: 272970 - DNA, 25 bp, Mus musculus
atgtgtatgtatttcctatgacgtc

SEQ ID NO: 272971 - DNA, 25 bp, Mus musculus
atgtgtattacaattcttttgaaac

SEQ ID NO: 272972 - DNA, 25 bp, Mus musculus
atgtgtattacatttcttttgaaac

SEQ ID NO: 272973 - DNA, 25 bp, Mus musculus
atgtgtattcctctgtacatttgag

SEQ ID NO: 272974 - DNA, 25 bp, Mus musculus
atgtgtattcctgtgtacatttgag

SEQ ID NO: 272975 - DNA, 25 bp, Mus musculus
atgtgtattgagcagatagtttttc

SEQ ID NO: 272976 - DNA, 25 bp, Mus musculus
atgtgtattgaggagatagtttttc

SEQ ID NO: 272977 - DNA, 25 bp, Mus musculus
atgtgtatttttcccatagcaggta

SEQ ID NO: 272978 - DNA, 25 bp, Mus musculus
atgtgtatttttgccatagcaggta

SEQ ID NO: 272979 - DNA, 25 bp, Mus musculus
atgtgtcaaagtatcactttcctaa

SEQ ID NO: 272980 - DNA, 25 bp, Mus musculus
atgtgtcaaagtttcactttcctaa

SEQ ID NO: 272981 - DNA, 25 bp, Mus musculus
atgtgtcaaccacataaccctgtgg

SEQ ID NO: 272982 - DNA, 25 bp, Mus musculus
atgtgtcaaccagataaccctgtgg

SEQ ID NO: 272983 - DNA, 25 bp, Mus musculus
atgtgtcaagatacctgtgcattta

SEQ ID NO: 272984 - DNA, 25 bp, Mus musculus
atgtgtcaagattcctgtgcattta

SEQ ID NO: 272985 - DNA, 25 bp, Mus musculus
atgtgtcacacaatcacactgtagg

SEQ ID NO: 272986 - DNA, 25 bp, Mus musculus
atgtgtcacacattcacactgtagg

SEQ ID NO: 272987 - DNA, 25 bp, Mus musculus
atgtgtcacaccagagtaccactgt

SEQ ID NO: 272988 - DNA, 25 bp, Mus musculus
atgtgtcacacctgagtaccactgt

SEQ ID NO: 272989 - DNA, 25 bp, Mus musculus
atgtgtcacacgaacgtgggtaatt

SEQ ID NO: 272990 - DNA, 25 bp, Mus musculus
atgtgtcacacgtacgtgggtaatt

SEQ ID NO: 272991 - DNA, 25 bp, Mus musculus
atgtgtcacattaggcagaggctca

SEQ ID NO: 272992 - DNA, 25 bp, Mus musculus
atgtgtcacatttggcagaggctca

SEQ ID NO: 272993 - DNA, 25 bp, Mus musculus
atgtgtcaccagagcttttgtggac

SEQ ID NO: 272994 - DNA, 25 bp, Mus musculus
atgtgtcaccagcacctcagattct

SEQ ID NO: 272995 - DNA, 25 bp, Mus musculus
atgtgtcaccaggacctcagattct

SEQ ID NO: 272996 - DNA, 25 bp, Mus musculus
atgtgtcaccagtgcttttgtggac

SEQ ID NO: 272997 - DNA, 25 bp, Mus musculus
atgtgtcaccatccaactttaaaaa

SEQ ID NO: 272998 - DNA, 25 bp, Mus musculus
atgtgtcaccatgcaactttaaaaa

SEQ ID NO: 272999 - DNA, 25 bp, Mus musculus
atgtgtcacccaatcctcagtaact

SEQ ID NO: 273000 - DNA, 25 bp, Mus musculus
atgtgtcacccattcctcagtaact

SEQ ID NO: 273001 - DNA, 25 bp, Mus musculus
atgtgtcaccccatattcggtgttc

SEQ ID NO: 273002 - DNA, 25 bp, Mus musculus
atgtgtcaccccttattcggtgttc

SEQ ID NO: 273003 - DNA, 25 bp, Mus musculus
atgtgtcaccgtcttgcccactata

SEQ ID NO: 273004 - DNA, 25 bp, Mus musculus
atgtgtcaccgtgttgcccactata

SEQ ID NO: 273005 - DNA, 25 bp, Mus musculus
atgtgtcacgagatccttgctggct

SEQ ID NO: 273006 - DNA, 25 bp, Mus musculus
atgtgtcacgagttccttgctggct

SEQ ID NO: 273007 - DNA, 25 bp, Mus musculus
atgtgtcactagaggctgtggctgt

SEQ ID NO: 273008 - DNA, 25 bp, Mus musculus
atgtgtcactagtggctgtggctgt

SEQ ID NO: 273009 - DNA, 25 bp, Mus musculus
atgtgtcagccgcttgcagaagacc

SEQ ID NO: 273010 - DNA, 25 bp, Mus musculus
atgtgtcagccggttgcagaagacc

SEQ ID NO: 273011 - DNA, 25 bp, Mus musculus
atgtgtcaggttatcctccaagaaa

SEQ ID NO: 273012 - DNA, 25 bp, Mus musculus
atgtgtcaggttttcctccaagaaa

SEQ ID NO: 273013 - DNA, 25 bp, Mus musculus
atgtgtcagttcagggttcccagag

SEQ ID NO: 273014 - DNA, 25 bp, Mus musculus
atgtgtcagttctgggttcccagag

SEQ ID NO: 273015 - DNA, 25 bp, Mus musculus
atgtgtcatatactcttaccaatac

SEQ ID NO: 273016 - DNA, 25 bp, Mus musculus
atgtgtcatatagtcttaccaatac

SEQ ID NO: 273017 - DNA, 25 bp, Mus musculus
atgtgtcattccaaggtgtcttcaa

SEQ ID NO: 273018 - DNA, 25 bp, Mus musculus
atgtgtcattcctaggtgtcttcaa

SEQ ID NO: 273019 - DNA, 25 bp, Mus musculus
atgtgtcatttacgtcaggtggcag

SEQ ID NO: 273020 - DNA, 25 bp, Mus musculus
atgtgtcatttaggtcaggtggcag

SEQ ID NO: 273021 - DNA, 25 bp, Mus musculus
atgtgtccaaagctgtctgctctac

SEQ ID NO: 273022 - DNA, 25 bp, Mus musculus
atgtgtccaaaggtgtctgctctac

SEQ ID NO: 273023 - DNA, 25 bp, Mus musculus
atgtgtccaagcctgattcttcagc

SEQ ID NO: 273024 - DNA, 25 bp, Mus musculus
atgtgtccaagcgtgattcttcagc

SEQ ID NO: 273025 - DNA, 25 bp, Mus musculus
atgtgtccacaaccaaagaatgcta

SEQ ID NO: 273026 - DNA, 25 bp, Mus musculus
atgtgtccacaagcaaagaatgcta

SEQ ID NO: 273027 - DNA, 25 bp, Mus musculus
atgtgtccacttcaagaaagccaag

SEQ ID NO: 273028 - DNA, 25 bp, Mus musculus
atgtgtccacttgaagaaagccaag

SEQ ID NO: 273029 - DNA, 25 bp, Mus musculus
atgtgtccataaaactgtcaagcca

SEQ ID NO: 273030 - DNA, 25 bp, Mus musculus
atgtgtccataatactgtcaagcca

SEQ ID NO: 273031 - DNA, 25 bp, Mus musculus
atgtgtcccaatcctccctagaagt

SEQ ID NO: 273032 - DNA, 25 bp, Mus musculus
atgtgtcccaatgctccctagaagt

SEQ ID NO: 273033 - DNA, 25 bp, Mus musculus
atgtgtcccagaagtcatgcatagt

SEQ ID NO: 273034 - DNA, 25 bp, Mus musculus
atgtgtcccagatgtcatgcatagt

SEQ ID NO: 273035 - DNA, 25 bp, Mus musculus
atgtgtcccaggactaattctttgc

SEQ ID NO: 273036 - DNA, 25 bp, Mus musculus
atgtgtcccaggtctaattctttgc

SEQ ID NO: 273037 - DNA, 25 bp, Mus musculus
atgtgtccccagcaccacgaaacag

SEQ ID NO: 273038 - DNA, 25 bp, Mus musculus
atgtgtccccaggaccacgaaacag

SEQ ID NO: 273039 - DNA, 25 bp, Mus musculus
atgtgtcccgaaagccctgctctct

SEQ ID NO: 273040 - DNA, 25 bp, Mus musculus
atgtgtcccgaatgccctgctctct

SEQ ID NO: 273041 - DNA, 25 bp, Mus musculus
atgtgtcccgataacgagctgatgt

SEQ ID NO: 273042 - DNA, 25 bp, Mus musculus
atgtgtcccgattacgagctgatgt

SEQ ID NO: 273043 - DNA, 25 bp, Mus musculus
atgtgtccctcacctatgcagactg

SEQ ID NO: 273044 - DNA, 25 bp, Mus musculus
atgtgtccctcagctatgcagactg

SEQ ID NO: 273045 - DNA, 25 bp, Mus musculus
atgtgtccctgacttgtcccaggtt

SEQ ID NO: 273046 - DNA, 25 bp, Mus musculus
atgtgtccctgagttgtcccaggtt

SEQ ID NO: 273047 - DNA, 25 bp, Mus musculus
atgtgtccctttaagccaaccagtg

SEQ ID NO: 273048 - DNA, 25 bp, Mus musculus
atgtgtcccttttagccaaccagtg

SEQ ID NO: 273049 - DNA, 25 bp, Mus musculus
atgtgtcctcctagtgtaactgtct

SEQ ID NO: 273050 - DNA, 25 bp, Mus musculus
atgtgtcctccttgtgtaactgtct

SEQ ID NO: 273051 - DNA, 25 bp, Mus musculus
atgtgtcctcgactagagagctctt

SEQ ID NO: 273052 - DNA, 25 bp, Mus musculus
atgtgtcctcgagtagagagctctt

SEQ ID NO: 273053 - DNA, 25 bp, Mus musculus
atgtgtcctgaaaacatccacagac

SEQ ID NO: 273054 - DNA, 25 bp, Mus musculus
atgtgtcctgaatacatccacagac

SEQ ID NO: 273055 - DNA, 25 bp, Mus musculus
atgtgtcctgtcactccaagaggag

SEQ ID NO: 273056 - DNA, 25 bp, Mus musculus
atgtgtcctgtctctccaagaggag

SEQ ID NO: 273057 - DNA, 25 bp, Mus musculus
atgtgtccttaaaaagctttgagta

SEQ ID NO: 273058 - DNA, 25 bp, Mus musculus
atgtgtccttaataagctttgagta

SEQ ID NO: 273059 - DNA, 25 bp, Mus musculus
atgtgtcctttgaaacaccacctcc

SEQ ID NO: 273060 - DNA, 25 bp, Mus musculus
atgtgtcctttgacgacgagccgca

SEQ ID NO: 273061 - DNA, 25 bp, Mus musculus
atgtgtcctttgtaacaccacctcc

SEQ ID NO: 273062 - DNA, 25 bp, Mus musculus
atgtgtcctttgtcgacgagccgca

SEQ ID NO: 273063 - DNA, 25 bp, Mus musculus
atgtgtcgcagtagttttgaccctc

SEQ ID NO: 273064 - DNA, 25 bp, Mus musculus
atgtgtcgcagttgttttgaccctc

SEQ ID NO: 273065 - DNA, 25 bp, Mus musculus
atgtgtcgcccaacgggtatgagct

SEQ ID NO: 273066 - DNA, 25 bp, Mus musculus
atgtgtcgcccatcgggtatgagct

SEQ ID NO: 273067 - DNA, 25 bp, Mus musculus
atgtgtcgctagatttccagggtga

SEQ ID NO: 273068 - DNA, 25 bp, Mus musculus
atgtgtcgctagttttccagggtga

SEQ ID NO: 273069 - DNA, 25 bp, Mus musculus
atgtgtcggacacgcgacttctttt

SEQ ID NO: 273070 - DNA, 25 bp, Mus musculus
atgtgtcggacaggcgacttctttt

SEQ ID NO: 273071 - DNA, 25 bp, Mus musculus
atgtgtcggtcaagcgcacgtgcac

SEQ ID NO: 273072 - DNA, 25 bp, Mus musculus
atgtgtcggtcatgcgcacgtgcac

SEQ ID NO: 273073 - DNA, 25 bp, Mus musculus
atgtgtcgtagaagtgtttattttg

SEQ ID NO: 273074 - DNA, 25 bp, Mus musculus
atgtgtcgtagatgtgtttattttg

SEQ ID NO: 273075 - DNA, 25 bp, Mus musculus
atgtgtctaaaccaagctgccttct

SEQ ID NO: 273076 - DNA, 25 bp, Mus musculus
atgtgtctaaacgaagctgccttct

SEQ ID NO: 273077 - DNA, 25 bp, Mus musculus
atgtgtctaaggaccattgagcaga

SEQ ID NO: 273078 - DNA, 25 bp, Mus musculus
atgtgtctaaggtccattgagcaga

SEQ ID NO: 273079 - DNA, 25 bp, Mus musculus
atgtgtctacaaccactgcgcgggc

SEQ ID NO: 273080 - DNA, 25 bp, Mus musculus
atgtgtctacaagcactgcgcgggc

SEQ ID NO: 273081 - DNA, 25 bp, Mus musculus
atgtgtctatgtcagtctatggcca

SEQ ID NO: 273082 - DNA, 25 bp, Mus musculus
atgtgtctatgtgagtctatggcca

SEQ ID NO: 273083 - DNA, 25 bp, Mus musculus
atgtgtctattgattcttggtcccc

SEQ ID NO: 273084 - DNA, 25 bp, Mus musculus
atgtgtctattgtttcttggtcccc

SEQ ID NO: 273085 - DNA, 25 bp, Mus musculus
atgtgtctcaagatgggccaatcat

SEQ ID NO: 273086 - DNA, 25 bp, Mus musculus
atgtgtctcaagttgggccaatcat

SEQ ID NO: 273087 - DNA, 25 bp, Mus musculus
atgtgtctccatatagcttttaaga

SEQ ID NO: 273088 - DNA, 25 bp, Mus musculus
atgtgtctccatttagcttttaaga

SEQ ID NO: 273089 - DNA, 25 bp, Mus musculus
atgtgtctccctcgcggactaaagc

SEQ ID NO: 273090 - DNA, 25 bp, Mus musculus
atgtgtctccctggcggactaaagc

SEQ ID NO: 273091 - DNA, 25 bp, Mus musculus
atgtgtctccttaacaaacgcaacg

SEQ ID NO: 273092 - DNA, 25 bp, Mus musculus
atgtgtctcctttacaaacgcaacg

SEQ ID NO: 273093 - DNA, 25 bp, Mus musculus
atgtgtctctctattgtgggcttcc

SEQ ID NO: 273094 - DNA, 25 bp, Mus musculus
atgtgtctctctccagtcaggcagt

SEQ ID NO: 273095 - DNA, 25 bp, Mus musculus
atgtgtctctctgcagtcaggcagt

SEQ ID NO: 273096 - DNA, 25 bp, Mus musculus
atgtgtctctcttttgtgggcttcc

SEQ ID NO: 273097 - DNA, 25 bp, Mus musculus
atgtgtctcttcagccgaactgacg

SEQ ID NO: 273098 - DNA, 25 bp, Mus musculus
atgtgtctcttctgccgaactgacg

SEQ ID NO: 273099 - DNA, 25 bp, Mus musculus
atgtgtctgaccagatttctataaa

SEQ ID NO: 273100 - DNA, 25 bp, Mus musculus
atgtgtctgacctgatttctataaa

SEQ ID NO: 273101 - DNA, 25 bp, Mus musculus
atgtgtctgatcagccctctgaaga

SEQ ID NO: 273102 - DNA, 25 bp, Mus musculus
atgtgtctgatctgccctctgaaga

SEQ ID NO: 273103 - DNA, 25 bp, Mus musculus
atgtgtctgatgacattcctagaag

SEQ ID NO: 273104 - DNA, 25 bp, Mus musculus
atgtgtctgatgtcattcctagaag

SEQ ID NO: 273105 - DNA, 25 bp, Mus musculus
atgtgtctgcacacttcctgaagag

SEQ ID NO: 273106 - DNA, 25 bp, Mus musculus
atgtgtctgcactcttcctgaagag

SEQ ID NO: 273107 - DNA, 25 bp, Mus musculus
atgtgtctgcagaagaccagtcacc

SEQ ID NO: 273108 - DNA, 25 bp, Mus musculus
atgtgtctgcagtagaccagtcacc

SEQ ID NO: 273109 - DNA, 25 bp, Mus musculus
atgtgtctgcatatagttcaatatt

SEQ ID NO: 273110 - DNA, 25 bp, Mus musculus
atgtgtctgcatttagttcaatatt

SEQ ID NO: 273111 - DNA, 25 bp, Mus musculus
atgtgtctgccaccgcgggcatgcc

SEQ ID NO: 273112 - DNA, 25 bp, Mus musculus
atgtgtctgccagcgcgggcatgcc

SEQ ID NO: 273113 - DNA, 25 bp, Mus musculus
atgtgtctgcttcgtgcctgaaaac

SEQ ID NO: 273114 - DNA, 25 bp, Mus musculus
atgtgtctgcttggtgcctgaaaac

SEQ ID NO: 273115 - DNA, 25 bp, Mus musculus
atgtgtctgtgaacacgcagaggct

SEQ ID NO: 273116 - DNA, 25 bp, Mus musculus
atgtgtctgtgatcacgcagaggct

SEQ ID NO: 273117 - DNA, 25 bp, Mus musculus
atgtgtctgttgcatgctcttgtgt

SEQ ID NO: 273118 - DNA, 25 bp, Mus musculus
atgtgtctgttggatgctcttgtgt

SEQ ID NO: 273119 - DNA, 25 bp, Mus musculus
atgtgtcttagtaatgctgtgtgca

SEQ ID NO: 273120 - DNA, 25 bp, Mus musculus
atgtgtcttagttatgctgtgtgca

SEQ ID NO: 273121 - DNA, 25 bp, Mus musculus
atgtgtcttgtgatacttggagcta

SEQ ID NO: 273122 - DNA, 25 bp, Mus musculus
atgtgtcttgtgttacttggagcta

SEQ ID NO: 273123 - DNA, 25 bp, Mus musculus
atgtgtctttacatgcgtgtgtaca

SEQ ID NO: 273124 - DNA, 25 bp, Mus musculus
atgtgtctttacttgcgtgtgtaca

SEQ ID NO: 273125 - DNA, 25 bp, Mus musculus
atgtgtctttagatagccctgtcct

SEQ ID NO: 273126 - DNA, 25 bp, Mus musculus
atgtgtctttagttagccctgtcct

SEQ ID NO: 273127 - DNA, 25 bp, Mus musculus
atgtgtctttgcactggttccttca

SEQ ID NO: 273128 - DNA, 25 bp, Mus musculus
atgtgtctttgctctggttccttca

SEQ ID NO: 273129 - DNA, 25 bp, Mus musculus
atgtgtgaaataaggccactcaggc

SEQ ID NO: 273130 - DNA, 25 bp, Mus musculus
atgtgtgaaatatggccactcaggc

SEQ ID NO: 273131 - DNA, 25 bp, Mus musculus
atgtgtgaacaaccacttctgatca

SEQ ID NO: 273132 - DNA, 25 bp, Mus musculus
atgtgtgaacaagcacttctgatca

SEQ ID NO: 273133 - DNA, 25 bp, Mus musculus
atgtgtgaacctaatacgtcagtta

SEQ ID NO: 273134 - DNA, 25 bp, Mus musculus
atgtgtgaaccttatacgtcagtta

SEQ ID NO: 273135 - DNA, 25 bp, Mus musculus
atgtgtgaagtaccttcctccctca

SEQ ID NO: 273136 - DNA, 25 bp, Mus musculus
atgtgtgaagtagcttcctccctca

SEQ ID NO: 273137 - DNA, 25 bp, Mus musculus
atgtgtgaatgtctctatctgtcca

SEQ ID NO: 273138 - DNA, 25 bp, Mus musculus
atgtgtgaatgtgtctatctgtcca

SEQ ID NO: 273139 - DNA, 25 bp, Mus musculus
atgtgtgaattgatggctgcccagt

SEQ ID NO: 273140 - DNA, 25 bp, Mus musculus
atgtgtgaattgttggctgcccagt

SEQ ID NO: 273141 - DNA, 25 bp, Mus musculus
atgtgtgacaacatcttagagggcc

SEQ ID NO: 273142 - DNA, 25 bp, Mus musculus
atgtgtgacaacttcttagagggcc

SEQ ID NO: 273143 - DNA, 25 bp, Mus musculus
atgtgtgacaccatcattaccatca

SEQ ID NO: 273144 - DNA, 25 bp, Mus musculus
atgtgtgacaccttcattaccatca

SEQ ID NO: 273145 - DNA, 25 bp, Mus musculus
atgtgtgacactcagtcctaagcca

SEQ ID NO: 273146 - DNA, 25 bp, Mus musculus
atgtgtgacactgagtcctaagcca

SEQ ID NO: 273147 - DNA, 25 bp, Mus musculus
atgtgtgacatcctttaattctttg

SEQ ID NO: 273148 - DNA, 25 bp, Mus musculus
atgtgtgacatcgtttaattctttg

SEQ ID NO: 273149 - DNA, 25 bp, Mus musculus
atgtgtgaccggcaccatccttcat

SEQ ID NO: 273150 - DNA, 25 bp, Mus musculus
atgtgtgaccgggaccatccttcat

SEQ ID NO: 273151 - DNA, 25 bp, Mus musculus
atgtgtgaccgtctctggaagtcaa

SEQ ID NO: 273152 - DNA, 25 bp, Mus musculus
atgtgtgaccgtgtctggaagtcaa

SEQ ID NO: 273153 - DNA, 25 bp, Mus musculus
atgtgtgacctaagagactgagcct

SEQ ID NO: 273154 - DNA, 25 bp, Mus musculus
atgtgtgacctatgagactgagcct

SEQ ID NO: 273155 - DNA, 25 bp, Mus musculus
atgtgtgactccctaacattccaat

SEQ ID NO: 273156 - DNA, 25 bp, Mus musculus
atgtgtgactccgtaacattccaat

SEQ ID NO: 273157 - DNA, 25 bp, Mus musculus
atgtgtgactctacaggatcctaga

SEQ ID NO: 273158 - DNA, 25 bp, Mus musculus
atgtgtgactctccaaattcttgcc

SEQ ID NO: 273159 - DNA, 25 bp, Mus musculus
atgtgtgactctgcaaattcttgcc

SEQ ID NO: 273160 - DNA, 25 bp, Mus musculus
atgtgtgactcttcaggatcctaga

SEQ ID NO: 273161 - DNA, 25 bp, Mus musculus
atgtgtgactgcactacagggctta

SEQ ID NO: 273162 - DNA, 25 bp, Mus musculus
atgtgtgactgctctacagggctta

SEQ ID NO: 273163 - DNA, 25 bp, Mus musculus
atgtgtgactggacgtctactgacc

SEQ ID NO: 273164 - DNA, 25 bp, Mus musculus
atgtgtgactggtcgtctactgacc

SEQ ID NO: 273165 - DNA, 25 bp, Mus musculus
atgtgtgagaatcaatcagatgctc

SEQ ID NO: 273166 - DNA, 25 bp, Mus musculus
atgtgtgagaatgaatcagatgctc

SEQ ID NO: 273167 - DNA, 25 bp, Mus musculus
atgtgtgagacaaagcttcttccac

SEQ ID NO: 273168 - DNA, 25 bp, Mus musculus
atgtgtgagacatagcttcttccac

SEQ ID NO: 273169 - DNA, 25 bp, Mus musculus
atgtgtgagcatcgcctccttactc

SEQ ID NO: 273170 - DNA, 25 bp, Mus musculus
atgtgtgagcatggcctccttactc

SEQ ID NO: 273171 - DNA, 25 bp, Mus musculus
atgtgtgagctcagcaatgactgtt

SEQ ID NO: 273172 - DNA, 25 bp, Mus musculus
atgtgtgagctctgcaatgactgtt

SEQ ID NO: 273173 - DNA, 25 bp, Mus musculus
atgtgtgaggccattggtacaaaaa

SEQ ID NO: 273174 - DNA, 25 bp, Mus musculus
atgtgtgaggcctttggtacaaaaa

SEQ ID NO: 273175 - DNA, 25 bp, Mus musculus
atgtgtgaggctcacaggctgcttt

SEQ ID NO: 273176 - DNA, 25 bp, Mus musculus
atgtgtgaggctgacaggctgcttt

SEQ ID NO: 273177 - DNA, 25 bp, Mus musculus
atgtgtgagtacagacgcctcgagt

SEQ ID NO: 273178 - DNA, 25 bp, Mus musculus
atgtgtgagtactgacgcctcgagt

SEQ ID NO: 273179 - DNA, 25 bp, Mus musculus
atgtgtgcaaacaatcatgccatgc

SEQ ID NO: 273180 - DNA, 25 bp, Mus musculus
atgtgtgcaaactatcatgccatgc

SEQ ID NO: 273181 - DNA, 25 bp, Mus musculus
atgtgtgcaatgcagtcactctcct

SEQ ID NO: 273182 - DNA, 25 bp, Mus musculus
atgtgtgcaatggagtcactctcct

SEQ ID NO: 273183 - DNA, 25 bp, Mus musculus
atgtgtgcacagactgtaccagtta

SEQ ID NO: 273184 - DNA, 25 bp, Mus musculus
atgtgtgcacagtctgtaccagtta

SEQ ID NO: 273185 - DNA, 25 bp, Mus musculus
atgtgtgcacatataagttcaagag

SEQ ID NO: 273186 - DNA, 25 bp, Mus musculus
atgtgtgcacatttaagttcaagag

SEQ ID NO: 273187 - DNA, 25 bp, Mus musculus
atgtgtgcaccaaggctcacacgta

SEQ ID NO: 273188 - DNA, 25 bp, Mus musculus
atgtgtgcaccatggctcacacgta

SEQ ID NO: 273189 - DNA, 25 bp, Mus musculus
atgtgtgcaccgactgtggcatcaa

SEQ ID NO: 273190 - DNA, 25 bp, Mus musculus
atgtgtgcaccgtctgtggcatcaa

SEQ ID NO: 273191 - DNA, 25 bp, Mus musculus
atgtgtgcagaaactttgtctcctc

SEQ ID NO: 273192 - DNA, 25 bp, Mus musculus
atgtgtgcagaactcctaaggtcga

SEQ ID NO: 273193 - DNA, 25 bp, Mus musculus
atgtgtgcagaagtcctaaggtcga

SEQ ID NO: 273194 - DNA, 25 bp, Mus musculus
atgtgtgcagaatctttgtctcctc

SEQ ID NO: 273195 - DNA, 25 bp, Mus musculus
atgtgtgcagacattagccccactt

SEQ ID NO: 273196 - DNA, 25 bp, Mus musculus
atgtgtgcagactttagccccactt

SEQ ID NO: 273197 - DNA, 25 bp, Mus musculus
atgtgtgcagagctctggaacccga

SEQ ID NO: 273198 - DNA, 25 bp, Mus musculus
atgtgtgcagaggtctggaacccga

SEQ ID NO: 273199 - DNA, 25 bp, Mus musculus
atgtgtgcaggtatccacagagtcc

SEQ ID NO: 273200 - DNA, 25 bp, Mus musculus
atgtgtgcaggtttccacagagtcc

SEQ ID NO: 273201 - DNA, 25 bp, Mus musculus
atgtgtgcatccatttagagctgtt

SEQ ID NO: 273202 - DNA, 25 bp, Mus musculus
atgtgtgcatccttttagagctgtt

SEQ ID NO: 273203 - DNA, 25 bp, Mus musculus
atgtgtgcatgaaaactgccttttt

SEQ ID NO: 273204 - DNA, 25 bp, Mus musculus
atgtgtgcatgataactgccttttt

SEQ ID NO: 273205 - DNA, 25 bp, Mus musculus
atgtgtgcatgcagtcaaaagactg

SEQ ID NO: 273206 - DNA, 25 bp, Mus musculus
atgtgtgcatgctgtcaaaagactg

SEQ ID NO: 273207 - DNA, 25 bp, Mus musculus
atgtgtgccaagctaagagtgacaa

SEQ ID NO: 273208 - DNA, 25 bp, Mus musculus
atgtgtgccaaggtaagagtgacaa

SEQ ID NO: 273209 - DNA, 25 bp, Mus musculus
atgtgtgccagaaaaggttccgtca

SEQ ID NO: 273210 - DNA, 25 bp, Mus musculus
atgtgtgccagataaggttccgtca

SEQ ID NO: 273211 - DNA, 25 bp, Mus musculus
atgtgtgccccaccaggtgatgcct

SEQ ID NO: 273212 - DNA, 25 bp, Mus musculus
atgtgtgccccagcaggtgatgcct

SEQ ID NO: 273213 - DNA, 25 bp, Mus musculus
atgtgtgcctatccagttgtcttca

SEQ ID NO: 273214 - DNA, 25 bp, Mus musculus
atgtgtgcctatgcagttgtcttca

SEQ ID NO: 273215 - DNA, 25 bp, Mus musculus
atgtgtgcctccagaggtctgtaag

SEQ ID NO: 273216 - DNA, 25 bp, Mus musculus
atgtgtgcctcctgaggtctgtaag

SEQ ID NO: 273217 - DNA, 25 bp, Mus musculus
atgtgtgcctggagttctcagatat

SEQ ID NO: 273218 - DNA, 25 bp, Mus musculus
atgtgtgcctggtgttctcagatat

SEQ ID NO: 273219 - DNA, 25 bp, Mus musculus
atgtgtgcctgtctcttaacactaa

SEQ ID NO: 273220 - DNA, 25 bp, Mus musculus
atgtgtgcctgtgtcttaacactaa

SEQ ID NO: 273221 - DNA, 25 bp, Mus musculus
atgtgtgccttgagcccaaggtcag

SEQ ID NO: 273222 - DNA, 25 bp, Mus musculus
atgtgtgccttgtgcccaaggtcag

SEQ ID NO: 273223 - DNA, 25 bp, Mus musculus
atgtgtgcgacgatgaccagctgct

SEQ ID NO: 273224 - DNA, 25 bp, Mus musculus
atgtgtgcgacgttgaccagctgct

SEQ ID NO: 273225 - DNA, 25 bp, Mus musculus
atgtgtgcgccaagagattattgaa

SEQ ID NO: 273226 - DNA, 25 bp, Mus musculus
atgtgtgcgccatgagattattgaa

SEQ ID NO: 273227 - DNA, 25 bp, Mus musculus
atgtgtgctatgatgccatttcaaa

SEQ ID NO: 273228 - DNA, 25 bp, Mus musculus
atgtgtgctatgttgccatttcaaa

SEQ ID NO: 273229 - DNA, 25 bp, Mus musculus
atgtgtgctcaaactcacgtgggaa

SEQ ID NO: 273230 - DNA, 25 bp, Mus musculus
atgtgtgctcaatctcacgtgggaa

SEQ ID NO: 273231 - DNA, 25 bp, Mus musculus
atgtgtgctcccatttcataattac

SEQ ID NO: 273232 - DNA, 25 bp, Mus musculus
atgtgtgctcccttttcataattac

SEQ ID NO: 273233 - DNA, 25 bp, Mus musculus
atgtgtgctctcagactccaggagc

SEQ ID NO: 273234 - DNA, 25 bp, Mus musculus
atgtgtgctctctgactccaggagc

SEQ ID NO: 273235 - DNA, 25 bp, Mus musculus
atgtgtgctctgaggtaatgtaccc

SEQ ID NO: 273236 - DNA, 25 bp, Mus musculus
atgtgtgctctgtggtaatgtaccc

SEQ ID NO: 273237 - DNA, 25 bp, Mus musculus
atgtgtgctcttactgtcttcttgg

SEQ ID NO: 273238 - DNA, 25 bp, Mus musculus
atgtgtgctctttctgtcttcttgg

SEQ ID NO: 273239 - DNA, 25 bp, Mus musculus
atgtgtgctgagaatctatgcccaa

SEQ ID NO: 273240 - DNA, 25 bp, Mus musculus
atgtgtgctgagtatctatgcccaa

SEQ ID NO: 273241 - DNA, 25 bp, Mus musculus
atgtgtgctgatacatggccatttt

SEQ ID NO: 273242 - DNA, 25 bp, Mus musculus
atgtgtgctgattcatggccatttt

SEQ ID NO: 273243 - DNA, 25 bp, Mus musculus
atgtgtgctgctaagtctttcctca

SEQ ID NO: 273244 - DNA, 25 bp, Mus musculus
atgtgtgctgcttagtctttcctca

SEQ ID NO: 273245 - DNA, 25 bp, Mus musculus
atgtgtgctgtcctggaaagtcacc

SEQ ID NO: 273246 - DNA, 25 bp, Mus musculus
atgtgtgctgtcgtggaaagtcacc

SEQ ID NO: 273247 - DNA, 25 bp, Mus musculus
atgtgtgctgtgacaaccttctaaa

SEQ ID NO: 273248 - DNA, 25 bp, Mus musculus
atgtgtgctgtgtcaaccttctaaa

SEQ ID NO: 273249 - DNA, 25 bp, Mus musculus
atgtgtgcttatcaaaagtggtctc

SEQ ID NO: 273250 - DNA, 25 bp, Mus musculus
atgtgtgcttatgaaaagtggtctc

SEQ ID NO: 273251 - DNA, 25 bp, Mus musculus
atgtgtgcttcacggttctcaggaa

SEQ ID NO: 273252 - DNA, 25 bp, Mus musculus
atgtgtgcttcagggttctcaggaa

SEQ ID NO: 273253 - DNA, 25 bp, Mus musculus
atgtgtgcttccacagatgggttta

SEQ ID NO: 273254 - DNA, 25 bp, Mus musculus
atgtgtgcttcctcagatgggttta

SEQ ID NO: 273255 - DNA, 25 bp, Mus musculus
atgtgtgctttcatagtgcagctct

SEQ ID NO: 273256 - DNA, 25 bp, Mus musculus
atgtgtgctttcttagtgcagctct

SEQ ID NO: 273257 - DNA, 25 bp, Mus musculus
atgtgtggaatcacaagttgctgtg

SEQ ID NO: 273258 - DNA, 25 bp, Mus musculus
atgtgtggaatctcaagttgctgtg

SEQ ID NO: 273259 - DNA, 25 bp, Mus musculus
atgtgtggacacagcagggaccaga

SEQ ID NO: 273260 - DNA, 25 bp, Mus musculus
atgtgtggacactgcagggaccaga

SEQ ID NO: 273261 - DNA, 25 bp, Mus musculus
atgtgtggaccaccaggcatctgac

SEQ ID NO: 273262 - DNA, 25 bp, Mus musculus
atgtgtggaccacttggacgtagaa

SEQ ID NO: 273263 - DNA, 25 bp, Mus musculus
atgtgtggaccagcaggcatctgac

SEQ ID NO: 273264 - DNA, 25 bp, Mus musculus
atgtgtggaccagttggacgtagaa

SEQ ID NO: 273265 - DNA, 25 bp, Mus musculus
atgtgtggactgactcccagagaag

SEQ ID NO: 273266 - DNA, 25 bp, Mus musculus
atgtgtggactgtctcccagagaag

SEQ ID NO: 273267 - DNA, 25 bp, Mus musculus
atgtgtggacttccaacggaaatca

SEQ ID NO: 273268 - DNA, 25 bp, Mus musculus
atgtgtggacttgcaacggaaatca

SEQ ID NO: 273269 - DNA, 25 bp, Mus musculus
atgtgtggagaaacagtcccagcac

SEQ ID NO: 273270 - DNA, 25 bp, Mus musculus
atgtgtggagaatcagtcccagcac

SEQ ID NO: 273271 - DNA, 25 bp, Mus musculus
atgtgtggagtgatgcctcctgaca

SEQ ID NO: 273272 - DNA, 25 bp, Mus musculus
atgtgtggagtgttgcctcctgaca

SEQ ID NO: 273273 - DNA, 25 bp, Mus musculus
atgtgtggccataacttttgtcttc

SEQ ID NO: 273274 - DNA, 25 bp, Mus musculus
atgtgtggccattacttttgtcttc

SEQ ID NO: 273275 - DNA, 25 bp, Mus musculus
atgtgtggccgacactcccttggta

SEQ ID NO: 273276 - DNA, 25 bp, Mus musculus
atgtgtggccgagactcccttggta

SEQ ID NO: 273277 - DNA, 25 bp, Mus musculus
atgtgtggcctaatgtgtttgagac

SEQ ID NO: 273278 - DNA, 25 bp, Mus musculus
atgtgtggcctattgtgtttgagac

SEQ ID NO: 273279 - DNA, 25 bp, Mus musculus
atgtgtggcttgctgcacacgtcag

SEQ ID NO: 273280 - DNA, 25 bp, Mus musculus
atgtgtggcttggtgcacacgtcag

SEQ ID NO: 273281 - DNA, 25 bp, Mus musculus
atgtgtgggaaccactagcctcttt

SEQ ID NO: 273282 - DNA, 25 bp, Mus musculus
atgtgtgggaacgactagcctcttt

SEQ ID NO: 273283 - DNA, 25 bp, Mus musculus
atgtgtgggatgcagaaagttccaa

SEQ ID NO: 273284 - DNA, 25 bp, Mus musculus
atgtgtgggatggagaaagttccaa

SEQ ID NO: 273285 - DNA, 25 bp, Mus musculus
atgtgtgggcaaagagctcctcgga

SEQ ID NO: 273286 - DNA, 25 bp, Mus musculus
atgtgtgggcaatgagctcctcgga

SEQ ID NO: 273287 - DNA, 25 bp, Mus musculus
atgtgtgggcacaacttttgctgag

SEQ ID NO: 273288 - DNA, 25 bp, Mus musculus
atgtgtgggcactacttttgctgag

SEQ ID NO: 273289 - DNA, 25 bp, Mus musculus
atgtgtgggcgcctgagtgccctga

SEQ ID NO: 273290 - DNA, 25 bp, Mus musculus
atgtgtgggcgcgtgagtgccctga

SEQ ID NO: 273291 - DNA, 25 bp, Mus musculus
atgtgtgggctgatttcatcttcaa

SEQ ID NO: 273292 - DNA, 25 bp, Mus musculus
atgtgtgggctgttttcatcttcaa

SEQ ID NO: 273293 - DNA, 25 bp, Mus musculus
atgtgtggtagccatgccttcttgc

SEQ ID NO: 273294 - DNA, 25 bp, Mus musculus
atgtgtggtagcgatgccttcttgc

SEQ ID NO: 273295 - DNA, 25 bp, Mus musculus
atgtgtggtcggaccctggagacat

SEQ ID NO: 273296 - DNA, 25 bp, Mus musculus
atgtgtggtcggtccctggagacat

SEQ ID NO: 273297 - DNA, 25 bp, Mus musculus
atgtgtggtgacagctttgtagtga

SEQ ID NO: 273298 - DNA, 25 bp, Mus musculus
atgtgtggtgactgctttgtagtga

SEQ ID NO: 273299 - DNA, 25 bp, Mus musculus
atgtgtggtggcacctacacgtggt

SEQ ID NO: 273300 - DNA, 25 bp, Mus musculus
atgtgtggtggctcctacacgtggt

SEQ ID NO: 273301 - DNA, 25 bp, Mus musculus
atgtgtggtgtaaatgcagttggac

SEQ ID NO: 273302 - DNA, 25 bp, Mus musculus
atgtgtggtgtatatgcagttggac

SEQ ID NO: 273303 - DNA, 25 bp, Mus musculus
atgtgtggtttacgatgggctttaa

SEQ ID NO: 273304 - DNA, 25 bp, Mus musculus
atgtgtggtttaggatgggctttaa

SEQ ID NO: 273305 - DNA, 25 bp, Mus musculus
atgtgtgtaataatgtttgcctgca

SEQ ID NO: 273306 - DNA, 25 bp, Mus musculus
atgtgtgtaatattgtttgcctgca

SEQ ID NO: 273307 - DNA, 25 bp, Mus musculus
atgtgtgtacagataaaggtctcca

SEQ ID NO: 273308 - DNA, 25 bp, Mus musculus
atgtgtgtacagctcggtgtctgca

SEQ ID NO: 273309 - DNA, 25 bp, Mus musculus
atgtgtgtacaggtcggtgtctgca

SEQ ID NO: 273310 - DNA, 25 bp, Mus musculus
atgtgtgtacagttaaaggtctcca

SEQ ID NO: 273311 - DNA, 25 bp, Mus musculus
atgtgtgtacccactgtggactggg

SEQ ID NO: 273312 - DNA, 25 bp, Mus musculus
atgtgtgtaccctctgtggactggg

SEQ ID NO: 273313 - DNA, 25 bp, Mus musculus
atgtgtgtacctcatgcccaagaag

SEQ ID NO: 273314 - DNA, 25 bp, Mus musculus
atgtgtgtacctgatgcccaagaag

SEQ ID NO: 273315 - DNA, 25 bp, Mus musculus
atgtgtgtacgaagtgctttgatca

SEQ ID NO: 273316 - DNA, 25 bp, Mus musculus
atgtgtgtacgatgtgctttgatca

SEQ ID NO: 273317 - DNA, 25 bp, Mus musculus
atgtgtgtactcaggacagaatcca

SEQ ID NO: 273318 - DNA, 25 bp, Mus musculus
atgtgtgtactcatgccaaggcaac

SEQ ID NO: 273319 - DNA, 25 bp, Mus musculus
atgtgtgtactctggacagaatcca

SEQ ID NO: 273320 - DNA, 25 bp, Mus musculus
atgtgtgtactcttgccaaggcaac

SEQ ID NO: 273321 - DNA, 25 bp, Mus musculus
atgtgtgtaggcacgcagacaaaac

SEQ ID NO: 273322 - DNA, 25 bp, Mus musculus
atgtgtgtaggctcgcagacaaaac

SEQ ID NO: 273323 - DNA, 25 bp, Mus musculus
atgtgtgtatccatcctttctatca

SEQ ID NO: 273324 - DNA, 25 bp, Mus musculus
atgtgtgtatccttcctttctatca

SEQ ID NO: 273325 - DNA, 25 bp, Mus musculus
atgtgtgtattgcttaatcagcaac

SEQ ID NO: 273326 - DNA, 25 bp, Mus musculus
atgtgtgtattggttaatcagcaac

SEQ ID NO: 273327 - DNA, 25 bp, Mus musculus
atgtgtgtcagcatgtgcatggtct

SEQ ID NO: 273328 - DNA, 25 bp, Mus musculus
atgtgtgtcagcttgtgcatggtct

SEQ ID NO: 273329 - DNA, 25 bp, Mus musculus
atgtgtgtcagtattttgtctgcag

SEQ ID NO: 273330 - DNA, 25 bp, Mus musculus
atgtgtgtcagttttttgtctgcag

SEQ ID NO: 273331 - DNA, 25 bp, Mus musculus
atgtgtgtcattaattttaaaccta

SEQ ID NO: 273332 - DNA, 25 bp, Mus musculus
atgtgtgtcatttattttaaaccta

SEQ ID NO: 273333 - DNA, 25 bp, Mus musculus
atgtgtgtctctaaatgttctgcct

SEQ ID NO: 273334 - DNA, 25 bp, Mus musculus
atgtgtgtctctcagaggctcaccc

SEQ ID NO: 273335 - DNA, 25 bp, Mus musculus
atgtgtgtctctgagaggctcaccc

SEQ ID NO: 273336 - DNA, 25 bp, Mus musculus
atgtgtgtctcttaatgttctgcct

SEQ ID NO: 273337 - DNA, 25 bp, Mus musculus
atgtgtgtctggagcctctggagtc

SEQ ID NO: 273338 - DNA, 25 bp, Mus musculus
atgtgtgtctggtgcctctggagtc

SEQ ID NO: 273339 - DNA, 25 bp, Mus musculus
atgtgtgtctgtcaacccggcctca

SEQ ID NO: 273340 - DNA, 25 bp, Mus musculus
atgtgtgtctgtcgcaagaatcctg

SEQ ID NO: 273341 - DNA, 25 bp, Mus musculus
atgtgtgtctgtgaacccggcctca

SEQ ID NO: 273342 - DNA, 25 bp, Mus musculus
atgtgtgtctgtggcaagaatcctg

SEQ ID NO: 273343 - DNA, 25 bp, Mus musculus
atgtgtgtgagcagtggcaatgaca

SEQ ID NO: 273344 - DNA, 25 bp, Mus musculus
atgtgtgtgagctgtggcaatgaca

SEQ ID NO: 273345 - DNA, 25 bp, Mus musculus
atgtgtgtgaggcaatcgttccgtc

SEQ ID NO: 273346 - DNA, 25 bp, Mus musculus
atgtgtgtgagggaatcgttccgtc

SEQ ID NO: 273347 - DNA, 25 bp, Mus musculus
atgtgtgtgcagagttgtcatttgg

SEQ ID NO: 273348 - DNA, 25 bp, Mus musculus
atgtgtgtgcagtgttgtcatttgg

SEQ ID NO: 273349 - DNA, 25 bp, Mus musculus
atgtgtgtgccacaggcagttctga

SEQ ID NO: 273350 - DNA, 25 bp, Mus musculus
atgtgtgtgccagaggcagttctga

SEQ ID NO: 273351 - DNA, 25 bp, Mus musculus
atgtgtgtgcccacgtgttgtcttc

SEQ ID NO: 273352 - DNA, 25 bp, Mus musculus
atgtgtgtgcccagtatgtctgcgc

SEQ ID NO: 273353 - DNA, 25 bp, Mus musculus
atgtgtgtgccctcgtgttgtcttc

SEQ ID NO: 273354 - DNA, 25 bp, Mus musculus
atgtgtgtgccctgtatgtctgcgc

SEQ ID NO: 273355 - DNA, 25 bp, Mus musculus
atgtgtgtgcgccacgttcatgcct

SEQ ID NO: 273356 - DNA, 25 bp, Mus musculus
atgtgtgtgcgcgacgttcatgcct

SEQ ID NO: 273357 - DNA, 25 bp, Mus musculus
atgtgtgtgcttaacagacctttcc

SEQ ID NO: 273358 - DNA, 25 bp, Mus musculus
atgtgtgtgctttacagacctttcc

SEQ ID NO: 273359 - DNA, 25 bp, Mus musculus
atgtgtgtggatcacgcttacgtga

SEQ ID NO: 273360 - DNA, 25 bp, Mus musculus
atgtgtgtggatgacgcttacgtga

SEQ ID NO: 273361 - DNA, 25 bp, Mus musculus
atgtgtgtggttctgtactgagtat

SEQ ID NO: 273362 - DNA, 25 bp, Mus musculus
atgtgtgtggttgtgtactgagtat

SEQ ID NO: 273363 - DNA, 25 bp, Mus musculus
atgtgtgtgtatcctgggtaccctc

SEQ ID NO: 273364 - DNA, 25 bp, Mus musculus
atgtgtgtgtatgctgggtaccctc

SEQ ID NO: 273365 - DNA, 25 bp, Mus musculus
atgtgtgtgttacatgcctgcaacc

SEQ ID NO: 273366 - DNA, 25 bp, Mus musculus
atgtgtgtgttagatgcctgcaacc

SEQ ID NO: 273367 - DNA, 25 bp, Mus musculus
atgtgtgtgttccagttactggcct

SEQ ID NO: 273368 - DNA, 25 bp, Mus musculus
atgtgtgtgttcgagttactggcct

SEQ ID NO: 273369 - DNA, 25 bp, Mus musculus
atgtgtgttacaactccaacatatt

SEQ ID NO: 273370 - DNA, 25 bp, Mus musculus
atgtgtgttacatctccaacatatt

SEQ ID NO: 273371 - DNA, 25 bp, Mus musculus
atgtgtgttcatacccttttacaac

SEQ ID NO: 273372 - DNA, 25 bp, Mus musculus
atgtgtgttcattcccttttacaac

SEQ ID NO: 273373 - DNA, 25 bp, Mus musculus
atgtgtgttccaaatgtatatccat

SEQ ID NO: 273374 - DNA, 25 bp, Mus musculus
atgtgtgttccatatgtatatccat

SEQ ID NO: 273375 - DNA, 25 bp, Mus musculus
atgtgtgttctaattgcattgaaac

SEQ ID NO: 273376 - DNA, 25 bp, Mus musculus
atgtgtgttctatttgcattgaaac

SEQ ID NO: 273377 - DNA, 25 bp, Mus musculus
atgtgtgttctcatctatcctgcac

SEQ ID NO: 273378 - DNA, 25 bp, Mus musculus
atgtgtgttctcttctatcctgcac

SEQ ID NO: 273379 - DNA, 25 bp, Mus musculus
atgtgtgttgacatggtccctgtac

SEQ ID NO: 273380 - DNA, 25 bp, Mus musculus
atgtgtgttgacttggtccctgtac

SEQ ID NO: 273381 - DNA, 25 bp, Mus musculus
atgtgtgtttagatcagtcctgagt

SEQ ID NO: 273382 - DNA, 25 bp, Mus musculus
atgtgtgtttagcaacccatgccca

SEQ ID NO: 273383 - DNA, 25 bp, Mus musculus
atgtgtgtttaggaacccatgccca

SEQ ID NO: 273384 - DNA, 25 bp, Mus musculus
atgtgtgtttagttcagtcctgagt

SEQ ID NO: 273385 - DNA, 25 bp, Mus musculus
atgtgtgtttccagttattccttat

SEQ ID NO: 273386 - DNA, 25 bp, Mus musculus
atgtgtgtttcctgttattccttat

SEQ ID NO: 273387 - DNA, 25 bp, Mus musculus
atgtgtgtttctagcatatcttcaa

SEQ ID NO: 273388 - DNA, 25 bp, Mus musculus
atgtgtgtttcttgcatatcttcaa

SEQ ID NO: 273389 - DNA, 25 bp, Mus musculus
atgtgtgtttgcaagctcacttgtc

SEQ ID NO: 273390 - DNA, 25 bp, Mus musculus
atgtgtgtttgccaaggtccctctt

SEQ ID NO: 273391 - DNA, 25 bp, Mus musculus
atgtgtgtttgcgaaggtccctctt

SEQ ID NO: 273392 - DNA, 25 bp, Mus musculus
atgtgtgtttgctagctcacttgtc

SEQ ID NO: 273393 - DNA, 25 bp, Mus musculus
atgtgtgtttttaatctatagagtg

SEQ ID NO: 273394 - DNA, 25 bp, Mus musculus
atgtgtgtttttacagccttaatat

SEQ ID NO: 273395 - DNA, 25 bp, Mus musculus
atgtgtgttttttatctatagagtg

SEQ ID NO: 273396 - DNA, 25 bp, Mus musculus
atgtgtgttttttcagccttaatat

SEQ ID NO: 273397 - DNA, 25 bp, Mus musculus
atgtgttaaaacagatttgctgtgt

SEQ ID NO: 273398 - DNA, 25 bp, Mus musculus
atgtgttaaaactgatttgctgtgt

SEQ ID NO: 273399 - DNA, 25 bp, Mus musculus
atgtgttaacacactccatccagtg

SEQ ID NO: 273400 - DNA, 25 bp, Mus musculus
atgtgttaacactctccatccagtg

SEQ ID NO: 273401 - DNA, 25 bp, Mus musculus
atgtgttagcccagaacgttacaaa

SEQ ID NO: 273402 - DNA, 25 bp, Mus musculus
atgtgttagccctgaacgttacaaa

SEQ ID NO: 273403 - DNA, 25 bp, Mus musculus
atgtgttatgaaaggcgtgacttcc

SEQ ID NO: 273404 - DNA, 25 bp, Mus musculus
atgtgttatgaatggcgtgacttcc

SEQ ID NO: 273405 - DNA, 25 bp, Mus musculus
atgtgttatgtaagtctggtttcct

SEQ ID NO: 273406 - DNA, 25 bp, Mus musculus
atgtgttatgtatgtctggtttcct

SEQ ID NO: 273407 - DNA, 25 bp, Mus musculus
atgtgttattaacttcagcttccta

SEQ ID NO: 273408 - DNA, 25 bp, Mus musculus
atgtgttattaagttcagcttccta

SEQ ID NO: 273409 - DNA, 25 bp, Mus musculus
atgtgttatttacttctctaactat

SEQ ID NO: 273410 - DNA, 25 bp, Mus musculus
atgtgttatttagttctctaactat

SEQ ID NO: 273411 - DNA, 25 bp, Mus musculus
atgtgttcaagccagcagacccttt

SEQ ID NO: 273412 - DNA, 25 bp, Mus musculus
atgtgttcaagcgagcagacccttt

SEQ ID NO: 273413 - DNA, 25 bp, Mus musculus
atgtgttcaatgaccacgatgtgta

SEQ ID NO: 273414 - DNA, 25 bp, Mus musculus
atgtgttcaatgtccacgatgtgta

SEQ ID NO: 273415 - DNA, 25 bp, Mus musculus
atgtgttcacacactcaacacttta

SEQ ID NO: 273416 - DNA, 25 bp, Mus musculus
atgtgttcacactctcaacacttta

SEQ ID NO: 273417 - DNA, 25 bp, Mus musculus
atgtgttcactgaaggaaacgcaac

SEQ ID NO: 273418 - DNA, 25 bp, Mus musculus
atgtgttcactgtaggaaacgcaac

SEQ ID NO: 273419 - DNA, 25 bp, Mus musculus
atgtgttcagacaggtcctggtcat

SEQ ID NO: 273420 - DNA, 25 bp, Mus musculus
atgtgttcagacataccgccatctt

SEQ ID NO: 273421 - DNA, 25 bp, Mus musculus
atgtgttcagactggtcctggtcat

SEQ ID NO: 273422 - DNA, 25 bp, Mus musculus
atgtgttcagacttaccgccatctt

SEQ ID NO: 273423 - DNA, 25 bp, Mus musculus
atgtgttcaggccagttgagttctg

SEQ ID NO: 273424 - DNA, 25 bp, Mus musculus
atgtgttcaggcgagttgagttctg

SEQ ID NO: 273425 - DNA, 25 bp, Mus musculus
atgtgttcataactgccaaccggct

SEQ ID NO: 273426 - DNA, 25 bp, Mus musculus
atgtgttcataagtgccaaccggct

SEQ ID NO: 273427 - DNA, 25 bp, Mus musculus
atgtgttccattctatgcacctgta

SEQ ID NO: 273428 - DNA, 25 bp, Mus musculus
atgtgttccattgtatgcacctgta

SEQ ID NO: 273429 - DNA, 25 bp, Mus musculus
atgtgttccggcatcgctgttcaaa

SEQ ID NO: 273430 - DNA, 25 bp, Mus musculus
atgtgttccggcttcgctgttcaaa

SEQ ID NO: 273431 - DNA, 25 bp, Mus musculus
atgtgttcctgaaacacgtccgcct

SEQ ID NO: 273432 - DNA, 25 bp, Mus musculus
atgtgttcctgatacacgtccgcct

SEQ ID NO: 273433 - DNA, 25 bp, Mus musculus
atgtgttcgccgagtcaagctctaa

SEQ ID NO: 273434 - DNA, 25 bp, Mus musculus
atgtgttcgccgtgtcaagctctaa

SEQ ID NO: 273435 - DNA, 25 bp, Mus musculus
atgtgttcggctctgccgctaactc

SEQ ID NO: 273436 - DNA, 25 bp, Mus musculus
atgtgttcggctgtgccgctaactc

SEQ ID NO: 273437 - DNA, 25 bp, Mus musculus
atgtgttctacaattctcttttcaa

SEQ ID NO: 273438 - DNA, 25 bp, Mus musculus
atgtgttctacatttctcttttcaa

SEQ ID NO: 273439 - DNA, 25 bp, Mus musculus
atgtgttctattccatttgtcccgt

SEQ ID NO: 273440 - DNA, 25 bp, Mus musculus
atgtgttctattgcatttgtcccgt

SEQ ID NO: 273441 - DNA, 25 bp, Mus musculus
atgtgttctcatcttataattttag

SEQ ID NO: 273442 - DNA, 25 bp, Mus musculus
atgtgttctcatgttataattttag

SEQ ID NO: 273443 - DNA, 25 bp, Mus musculus
atgtgttctctgaacagcctgtttc

SEQ ID NO: 273444 - DNA, 25 bp, Mus musculus
atgtgttctctgtacagcctgtttc

SEQ ID NO: 273445 - DNA, 25 bp, Mus musculus
atgtgttctgaaacctcgtgactaa

SEQ ID NO: 273446 - DNA, 25 bp, Mus musculus
atgtgttctgaatcctcgtgactaa

SEQ ID NO: 273447 - DNA, 25 bp, Mus musculus
atgtgttctgatctgttatggttcc

SEQ ID NO: 273448 - DNA, 25 bp, Mus musculus
atgtgttctgatgtgttatggttcc

SEQ ID NO: 273449 - DNA, 25 bp, Mus musculus
atgtgttctttaacagccgcctgtg

SEQ ID NO: 273450 - DNA, 25 bp, Mus musculus
atgtgttctttatcagccgcctgtg

SEQ ID NO: 273451 - DNA, 25 bp, Mus musculus
atgtgttctttcacatatgttaaag

SEQ ID NO: 273452 - DNA, 25 bp, Mus musculus
atgtgttctttcatgaatggatttc

SEQ ID NO: 273453 - DNA, 25 bp, Mus musculus
atgtgttctttctcatatgttaaag

SEQ ID NO: 273454 - DNA, 25 bp, Mus musculus
atgtgttctttcttgaatggatttc

SEQ ID NO: 273455 - DNA, 25 bp, Mus musculus
atgtgttcttttcaggatattttct

SEQ ID NO: 273456 - DNA, 25 bp, Mus musculus
atgtgttcttttccccaccactgtt

SEQ ID NO: 273457 - DNA, 25 bp, Mus musculus
atgtgttcttttgaggatattttct

SEQ ID NO: 273458 - DNA, 25 bp, Mus musculus
atgtgttcttttgcccaccactgtt

SEQ ID NO: 273459 - DNA, 25 bp, Mus musculus
atgtgttgaagtccacgcctcatct

SEQ ID NO: 273460 - DNA, 25 bp, Mus musculus
atgtgttgaagtgcacgcctcatct

SEQ ID NO: 273461 - DNA, 25 bp, Mus musculus
atgtgttgagttcttactgagtgtt

SEQ ID NO: 273462 - DNA, 25 bp, Mus musculus
atgtgttgagttgttactgagtgtt

SEQ ID NO: 273463 - DNA, 25 bp, Mus musculus
atgtgttgcttgctccttacatgat

SEQ ID NO: 273464 - DNA, 25 bp, Mus musculus
atgtgttgcttggtccttacatgat

SEQ ID NO: 273465 - DNA, 25 bp, Mus musculus
atgtgttgctttacatgtgctgtgc

SEQ ID NO: 273466 - DNA, 25 bp, Mus musculus
atgtgttgcttttcatgtgctgtgc

SEQ ID NO: 273467 - DNA, 25 bp, Mus musculus
atgtgttggccgagcttagctggct

SEQ ID NO: 273468 - DNA, 25 bp, Mus musculus
atgtgttggccgtgcttagctggct

SEQ ID NO: 273469 - DNA, 25 bp, Mus musculus
atgtgttgggtcaacttgttggtct

SEQ ID NO: 273470 - DNA, 25 bp, Mus musculus
atgtgttgggtctacttgttggtct

SEQ ID NO: 273471 - DNA, 25 bp, Mus musculus
atgtgttggttcagtcacacttcct

SEQ ID NO: 273472 - DNA, 25 bp, Mus musculus
atgtgttggttctgtcacacttcct

SEQ ID NO: 273473 - DNA, 25 bp, Mus musculus
atgtgttgtaagctagtttctttct

SEQ ID NO: 273474 - DNA, 25 bp, Mus musculus
atgtgttgtaaggtagtttctttct

SEQ ID NO: 273475 - DNA, 25 bp, Mus musculus
atgtgttgtataaatccgtcttagt

SEQ ID NO: 273476 - DNA, 25 bp, Mus musculus
atgtgttgtatatatccgtcttagt

SEQ ID NO: 273477 - DNA, 25 bp, Mus musculus
atgtgttgtattcagagaaactcct

SEQ ID NO: 273478 - DNA, 25 bp, Mus musculus
atgtgttgtattgagagaaactcct

SEQ ID NO: 273479 - DNA, 25 bp, Mus musculus
atgtgttgtctgattgggctctcta

SEQ ID NO: 273480 - DNA, 25 bp, Mus musculus
atgtgttgtctgtttgggctctcta

SEQ ID NO: 273481 - DNA, 25 bp, Mus musculus
atgtgttgtcttagagtctctgctt

SEQ ID NO: 273482 - DNA, 25 bp, Mus musculus
atgtgttgtcttatggctccattat

SEQ ID NO: 273483 - DNA, 25 bp, Mus musculus
atgtgttgtctttgagtctctgctt

SEQ ID NO: 273484 - DNA, 25 bp, Mus musculus
atgtgttgtcttttggctccattat

SEQ ID NO: 273485 - DNA, 25 bp, Mus musculus
atgtgttgtgacaatctctcctcgc

SEQ ID NO: 273486 - DNA, 25 bp, Mus musculus
atgtgttgtgactatctctcctcgc

SEQ ID NO: 273487 - DNA, 25 bp, Mus musculus
atgtgttgtttgaactgtgcgcgct

SEQ ID NO: 273488 - DNA, 25 bp, Mus musculus
atgtgttgtttgtactgtgcgcgct

SEQ ID NO: 273489 - DNA, 25 bp, Mus musculus
atgtgtttaacacgacgcaataatt

SEQ ID NO: 273490 - DNA, 25 bp, Mus musculus
atgtgtttaacaggacgcaataatt

SEQ ID NO: 273491 - DNA, 25 bp, Mus musculus
atgtgtttacaaatcacctccctat

SEQ ID NO: 273492 - DNA, 25 bp, Mus musculus
atgtgtttacaattcacctccctat

SEQ ID NO: 273493 - DNA, 25 bp, Mus musculus
atgtgtttaccaagcagcggaggga

SEQ ID NO: 273494 - DNA, 25 bp, Mus musculus
atgtgtttaccatgcagcggaggga

SEQ ID NO: 273495 - DNA, 25 bp, Mus musculus
atgtgtttactaagttgtctgtgaa

SEQ ID NO: 273496 - DNA, 25 bp, Mus musculus
atgtgtttactatgttgtctgtgaa

SEQ ID NO: 273497 - DNA, 25 bp, Mus musculus
atgtgtttactccacgctgtatatc

SEQ ID NO: 273498 - DNA, 25 bp, Mus musculus
atgtgtttactcgacgctgtatatc

SEQ ID NO: 273499 - DNA, 25 bp, Mus musculus
atgtgtttatccagccatatgggaa

SEQ ID NO: 273500 - DNA, 25 bp, Mus musculus
atgtgtttatcctgccatatgggaa

SEQ ID NO: 273501 - DNA, 25 bp, Mus musculus
atgtgtttatctcactgctagcctt

SEQ ID NO: 273502 - DNA, 25 bp, Mus musculus
atgtgtttatctgactgctagcctt

SEQ ID NO: 273503 - DNA, 25 bp, Mus musculus
atgtgtttcacaatgcatgtctctc

SEQ ID NO: 273504 - DNA, 25 bp, Mus musculus
atgtgtttcacattgcatgtctctc

SEQ ID NO: 273505 - DNA, 25 bp, Mus musculus
atgtgtttcagacacgacttccttt

SEQ ID NO: 273506 - DNA, 25 bp, Mus musculus
atgtgtttcagagacgacttccttt

SEQ ID NO: 273507 - DNA, 25 bp, Mus musculus
atgtgtttcaggattataggtgttt

SEQ ID NO: 273508 - DNA, 25 bp, Mus musculus
atgtgtttcaggtttataggtgttt

SEQ ID NO: 273509 - DNA, 25 bp, Mus musculus
atgtgtttccacatcataattagtt

SEQ ID NO: 273510 - DNA, 25 bp, Mus musculus
atgtgtttccacttcataattagtt

SEQ ID NO: 273511 - DNA, 25 bp, Mus musculus
atgtgtttccataatgactccattt

SEQ ID NO: 273512 - DNA, 25 bp, Mus musculus
atgtgtttccattatgactccattt

SEQ ID NO: 273513 - DNA, 25 bp, Mus musculus
atgtgtttccccatataggtcaagg

SEQ ID NO: 273514 - DNA, 25 bp, Mus musculus
atgtgtttccccttataggtcaagg

SEQ ID NO: 273515 - DNA, 25 bp, Mus musculus
atgtgtttctataattctggagaga

SEQ ID NO: 273516 - DNA, 25 bp, Mus musculus
atgtgtttctattattctggagaga

SEQ ID NO: 273517 - DNA, 25 bp, Mus musculus
atgtgtttctccatagctctttgcc

SEQ ID NO: 273518 - DNA, 25 bp, Mus musculus
atgtgtttctccttagctctttgcc

SEQ ID NO: 273519 - DNA, 25 bp, Mus musculus
atgtgtttcttactgtgagccgctt

SEQ ID NO: 273520 - DNA, 25 bp, Mus musculus
atgtgtttcttagtgtgagccgctt

SEQ ID NO: 273521 - DNA, 25 bp, Mus musculus
atgtgtttcttcacgaaggcttcgt

SEQ ID NO: 273522 - DNA, 25 bp, Mus musculus
atgtgtttcttctcgaaggcttcgt

SEQ ID NO: 273523 - DNA, 25 bp, Mus musculus
atgtgtttgaccagagtgcgctgtc

SEQ ID NO: 273524 - DNA, 25 bp, Mus musculus
atgtgtttgacctgagtgcgctgtc

SEQ ID NO: 273525 - DNA, 25 bp, Mus musculus
atgtgtttgatcactccctaatcac

SEQ ID NO: 273526 - DNA, 25 bp, Mus musculus
atgtgtttgatctctccctaatcac

SEQ ID NO: 273527 - DNA, 25 bp, Mus musculus
atgtgtttgcaactcctgggtgtaa

SEQ ID NO: 273528 - DNA, 25 bp, Mus musculus
atgtgtttgcaagtcctgggtgtaa

SEQ ID NO: 273529 - DNA, 25 bp, Mus musculus
atgtgtttgcagacatctcgccctg

SEQ ID NO: 273530 - DNA, 25 bp, Mus musculus
atgtgtttgcagtcatctcgccctg

SEQ ID NO: 273531 - DNA, 25 bp, Mus musculus
atgtgtttggccattcttactggac

SEQ ID NO: 273532 - DNA, 25 bp, Mus musculus
atgtgtttggcctttcttactggac

SEQ ID NO: 273533 - DNA, 25 bp, Mus musculus
atgtgtttggctcttttcacctatg

SEQ ID NO: 273534 - DNA, 25 bp, Mus musculus
atgtgtttggctgttttcacctatg

SEQ ID NO: 273535 - DNA, 25 bp, Mus musculus
atgtgtttgggcacagatagactat

SEQ ID NO: 273536 - DNA, 25 bp, Mus musculus
atgtgtttgggctcagatagactat

SEQ ID NO: 273537 - DNA, 25 bp, Mus musculus
atgtgtttggtaacaacaaactgac

SEQ ID NO: 273538 - DNA, 25 bp, Mus musculus
atgtgtttggtatcaacaaactgac

SEQ ID NO: 273539 - DNA, 25 bp, Mus musculus
atgtgtttggttagctggagtgaat

SEQ ID NO: 273540 - DNA, 25 bp, Mus musculus
atgtgtttggtttgctggagtgaat

SEQ ID NO: 273541 - DNA, 25 bp, Mus musculus
atgtgtttgtaaatactctggcttc

SEQ ID NO: 273542 - DNA, 25 bp, Mus musculus
atgtgtttgtaattactctggcttc

SEQ ID NO: 273543 - DNA, 25 bp, Mus musculus
atgtgtttgtacaaaattgcctttg

SEQ ID NO: 273544 - DNA, 25 bp, Mus musculus
atgtgtttgtactaaattgcctttg

SEQ ID NO: 273545 - DNA, 25 bp, Mus musculus
atgtgttttaaacattctgctgtaa

SEQ ID NO: 273546 - DNA, 25 bp, Mus musculus
atgtgttttaaagattctgctgtaa

SEQ ID NO: 273547 - DNA, 25 bp, Mus musculus
atgtgttttagaattactgctcaaa

SEQ ID NO: 273548 - DNA, 25 bp, Mus musculus
atgtgttttagatttactgctcaaa

SEQ ID NO: 273549 - DNA, 25 bp, Mus musculus
atgtgttttgacctgcatccttgaa

SEQ ID NO: 273550 - DNA, 25 bp, Mus musculus
atgtgttttgacgtgcatccttgaa

SEQ ID NO: 273551 - DNA, 25 bp, Mus musculus
atgtgtttttgcacaggcaaccatg

SEQ ID NO: 273552 - DNA, 25 bp, Mus musculus
atgtgtttttgcatatgtcaccaaa

SEQ ID NO: 273553 - DNA, 25 bp, Mus musculus
atgtgtttttgctcaggcaaccatg

SEQ ID NO: 273554 - DNA, 25 bp, Mus musculus
atgtgtttttgcttatgtcaccaaa

SEQ ID NO: 273555 - DNA, 25 bp, Mus musculus
atgttaaaatgccagttatgtgtga

SEQ ID NO: 273556 - DNA, 25 bp, Mus musculus
atgttaaaatgcgagttatgtgtga

SEQ ID NO: 273557 - DNA, 25 bp, Mus musculus
atgttaaaccatacactctcagcgc

SEQ ID NO: 273558 - DNA, 25 bp, Mus musculus
atgttaaaccattcactctcagcgc

SEQ ID NO: 273559 - DNA, 25 bp, Mus musculus
atgttaaactttacttagcattttg

SEQ ID NO: 273560 - DNA, 25 bp, Mus musculus
atgttaaacttttcttagcattttg

SEQ ID NO: 273561 - DNA, 25 bp, Mus musculus
atgttaaagcgcatattcctgatga

SEQ ID NO: 273562 - DNA, 25 bp, Mus musculus
atgttaaagcgcttattcctgatga

SEQ ID NO: 273563 - DNA, 25 bp, Mus musculus
atgttaaatctaacctccagtttca

SEQ ID NO: 273564 - DNA, 25 bp, Mus musculus
atgttaaatctatcctccagtttca

SEQ ID NO: 273565 - DNA, 25 bp, Mus musculus
atgttaaatgcaattcccgtggcag

SEQ ID NO: 273566 - DNA, 25 bp, Mus musculus
atgttaaatgcatttcccgtggcag

SEQ ID NO: 273567 - DNA, 25 bp, Mus musculus
atgttaacacttaccctggtaattg

SEQ ID NO: 273568 - DNA, 25 bp, Mus musculus
atgttaacactttccctggtaattg

SEQ ID NO: 273569 - DNA, 25 bp, Mus musculus
atgttaacagaaccccttcttcaag

SEQ ID NO: 273570 - DNA, 25 bp, Mus musculus
atgttaacagaagcccttcttcaag

SEQ ID NO: 273571 - DNA, 25 bp, Mus musculus
atgttaacatttcctgacactcaag

SEQ ID NO: 273572 - DNA, 25 bp, Mus musculus
atgttaacatttgctgacactcaag

SEQ ID NO: 273573 - DNA, 25 bp, Mus musculus
atgttaaccaacaaccttctagcct

SEQ ID NO: 273574 - DNA, 25 bp, Mus musculus
atgttaaccaactaccttctagcct

SEQ ID NO: 273575 - DNA, 25 bp, Mus musculus
atgttaacgtctcactctgtccaaa

SEQ ID NO: 273576 - DNA, 25 bp, Mus musculus
atgttaacgtctgactctgtccaaa

SEQ ID NO: 273577 - DNA, 25 bp, Mus musculus
atgttaacgtttaccatttcatcac

SEQ ID NO: 273578 - DNA, 25 bp, Mus musculus
atgttaacgttttccatttcatcac

SEQ ID NO: 273579 - DNA, 25 bp, Mus musculus
atgttaactaccacaactggtcaga

SEQ ID NO: 273580 - DNA, 25 bp, Mus musculus
atgttaactacctcaactggtcaga

SEQ ID NO: 273581 - DNA, 25 bp, Mus musculus
atgttaactcttctctatgtagaag

SEQ ID NO: 273582 - DNA, 25 bp, Mus musculus
atgttaactcttgtctatgtagaag

SEQ ID NO: 273583 - DNA, 25 bp, Mus musculus
atgttaactggcaagcagatatata

SEQ ID NO: 273584 - DNA, 25 bp, Mus musculus
atgttaactggctagcagatatata

SEQ ID NO: 273585 - DNA, 25 bp, Mus musculus
atgttaactgtaaatctcaatcccc

SEQ ID NO: 273586 - DNA, 25 bp, Mus musculus
atgttaactgtatatctcaatcccc

SEQ ID NO: 273587 - DNA, 25 bp, Mus musculus
atgttaacttacagcctttctccct

SEQ ID NO: 273588 - DNA, 25 bp, Mus musculus
atgttaacttactgcctttctccct

SEQ ID NO: 273589 - DNA, 25 bp, Mus musculus
atgttaacttttaatagcactagct

SEQ ID NO: 273590 - DNA, 25 bp, Mus musculus
atgttaactttttatagcactagct

SEQ ID NO: 273591 - DNA, 25 bp, Mus musculus
atgttaagaagcaggcttggtgcca

SEQ ID NO: 273592 - DNA, 25 bp, Mus musculus
atgttaagaagctggcttggtgcca

SEQ ID NO: 273593 - DNA, 25 bp, Mus musculus
atgttaagggtgctcctttcccctg

SEQ ID NO: 273594 - DNA, 25 bp, Mus musculus
atgttaagggtggtcctttcccctg

SEQ ID NO: 273595 - DNA, 25 bp, Mus musculus
atgttaagtaacaggcccaaagcca

SEQ ID NO: 273596 - DNA, 25 bp, Mus musculus
atgttaagtaactggcccaaagcca

SEQ ID NO: 273597 - DNA, 25 bp, Mus musculus
atgttaagtcatatcatcaggaatg

SEQ ID NO: 273598 - DNA, 25 bp, Mus musculus
atgttaagtcatttcatcaggaatg

SEQ ID NO: 273599 - DNA, 25 bp, Mus musculus
atgttaagtgtaatctcattgatga

SEQ ID NO: 273600 - DNA, 25 bp, Mus musculus
atgttaagtgtattctcattgatga

SEQ ID NO: 273601 - DNA, 25 bp, Mus musculus
atgttaatccaaccaatgtgtcact

SEQ ID NO: 273602 - DNA, 25 bp, Mus musculus
atgttaatccaagcaatgtgtcact

SEQ ID NO: 273603 - DNA, 25 bp, Mus musculus
atgttaatgacgaggctgactgcaa

SEQ ID NO: 273604 - DNA, 25 bp, Mus musculus
atgttaatgacgtggctgactgcaa

SEQ ID NO: 273605 - DNA, 25 bp, Mus musculus
atgttaatggctcgcctctccttat

SEQ ID NO: 273606 - DNA, 25 bp, Mus musculus
atgttaatggctggcctctccttat

SEQ ID NO: 273607 - DNA, 25 bp, Mus musculus
atgttaattccccatcagactctca

SEQ ID NO: 273608 - DNA, 25 bp, Mus musculus
atgttaattcccgatcagactctca

SEQ ID NO: 273609 - DNA, 25 bp, Mus musculus
atgttaattctgactccaatgggcc

SEQ ID NO: 273610 - DNA, 25 bp, Mus musculus
atgttaattctgtctccaatgggcc

SEQ ID NO: 273611 - DNA, 25 bp, Mus musculus
atgttacacactacctcactctgat

SEQ ID NO: 273612 - DNA, 25 bp, Mus musculus
atgttacacactcaagtttcacccc

SEQ ID NO: 273613 - DNA, 25 bp, Mus musculus
atgttacacactgaagtttcacccc

SEQ ID NO: 273614 - DNA, 25 bp, Mus musculus
atgttacacacttcctcactctgat

SEQ ID NO: 273615 - DNA, 25 bp, Mus musculus
atgttacaccaaccagagcactgct

SEQ ID NO: 273616 - DNA, 25 bp, Mus musculus
atgttacaccaagcagagcactgct

SEQ ID NO: 273617 - DNA, 25 bp, Mus musculus
atgttacagaaccaatgggtcaata

SEQ ID NO: 273618 - DNA, 25 bp, Mus musculus
atgttacagaacgaatgggtcaata

SEQ ID NO: 273619 - DNA, 25 bp, Mus musculus
atgttacagaatacactcactcact

SEQ ID NO: 273620 - DNA, 25 bp, Mus musculus
atgttacagaattcactcactcact

SEQ ID NO: 273621 - DNA, 25 bp, Mus musculus
atgttacagcacacttgatcctacc

SEQ ID NO: 273622 - DNA, 25 bp, Mus musculus
atgttacagcactcttgatcctacc

SEQ ID NO: 273623 - DNA, 25 bp, Mus musculus
atgttacagcttcgcaggcccaagt

SEQ ID NO: 273624 - DNA, 25 bp, Mus musculus
atgttacagcttggcaggcccaagt

SEQ ID NO: 273625 - DNA, 25 bp, Mus musculus
atgttacaggctcctgatgtttaaa

SEQ ID NO: 273626 - DNA, 25 bp, Mus musculus
atgttacaggctgctgatgtttaaa

SEQ ID NO: 273627 - DNA, 25 bp, Mus musculus
atgttacagttcactcctgtatcta

SEQ ID NO: 273628 - DNA, 25 bp, Mus musculus
atgttacagttctctcctgtatcta

SEQ ID NO: 273629 - DNA, 25 bp, Mus musculus
atgttacagtttatcacaagcttag

SEQ ID NO: 273630 - DNA, 25 bp, Mus musculus
atgttacagtttttcacaagcttag

SEQ ID NO: 273631 - DNA, 25 bp, Mus musculus
atgttacatcttacactagcctgtc

SEQ ID NO: 273632 - DNA, 25 bp, Mus musculus
atgttacatctttcactagcctgtc

SEQ ID NO: 273633 - DNA, 25 bp, Mus musculus
atgttacatgttacatttctcacga

SEQ ID NO: 273634 - DNA, 25 bp, Mus musculus
atgttacatgtttcatttctcacga

SEQ ID NO: 273635 - DNA, 25 bp, Mus musculus
atgttaccactgaactagatctcaa

SEQ ID NO: 273636 - DNA, 25 bp, Mus musculus
atgttaccactgtactagatctcaa

SEQ ID NO: 273637 - DNA, 25 bp, Mus musculus
atgttaccagagaccatcgcaatcg

SEQ ID NO: 273638 - DNA, 25 bp, Mus musculus
atgttaccagagtccatcgcaatcg

SEQ ID NO: 273639 - DNA, 25 bp, Mus musculus
atgttacccatgaggttgctgccga

SEQ ID NO: 273640 - DNA, 25 bp, Mus musculus
atgttacccatgtggttgctgccga

SEQ ID NO: 273641 - DNA, 25 bp, Mus musculus
atgttaccccacaaactgtgattgt

SEQ ID NO: 273642 - DNA, 25 bp, Mus musculus
atgttaccccactaactgtgattgt

SEQ ID NO: 273643 - DNA, 25 bp, Mus musculus
atgttaccccataagtgaataaaga

SEQ ID NO: 273644 - DNA, 25 bp, Mus musculus
atgttaccccattagtgaataaaga

SEQ ID NO: 273645 - DNA, 25 bp, Mus musculus
atgttacccgtcactgagccacata

SEQ ID NO: 273646 - DNA, 25 bp, Mus musculus
atgttacccgtctctgagccacata

SEQ ID NO: 273647 - DNA, 25 bp, Mus musculus
atgttacctaacctctaagtctcag

SEQ ID NO: 273648 - DNA, 25 bp, Mus musculus
atgttacctaacgtctaagtctcag

SEQ ID NO: 273649 - DNA, 25 bp, Mus musculus
atgttacctcttaaaaaatcactgg

SEQ ID NO: 273650 - DNA, 25 bp, Mus musculus
atgttacctctttaaaaatcactgg

SEQ ID NO: 273651 - DNA, 25 bp, Mus musculus
atgttactactaatcttagtttgta

SEQ ID NO: 273652 - DNA, 25 bp, Mus musculus
atgttactactattcttagtttgta

SEQ ID NO: 273653 - DNA, 25 bp, Mus musculus
atgttactactcatgctatgtatta

SEQ ID NO: 273654 - DNA, 25 bp, Mus musculus
atgttactactcttgctatgtatta

SEQ ID NO: 273655 - DNA, 25 bp, Mus musculus
atgttactagtaaagatcgttcttg

SEQ ID NO: 273656 - DNA, 25 bp, Mus musculus
atgttactagtatagatcgttcttg

SEQ ID NO: 273657 - DNA, 25 bp, Mus musculus
atgttactatatagccctttgtggg

SEQ ID NO: 273658 - DNA, 25 bp, Mus musculus
atgttactatattgccctttgtggg

SEQ ID NO: 273659 - DNA, 25 bp, Mus musculus
atgttactatggctacttgccccta

SEQ ID NO: 273660 - DNA, 25 bp, Mus musculus
atgttactatgggtacttgccccta

SEQ ID NO: 273661 - DNA, 25 bp, Mus musculus
atgttactcaccattccagtctttg

SEQ ID NO: 273662 - DNA, 25 bp, Mus musculus
atgttactcacctttccagtctttg

SEQ ID NO: 273663 - DNA, 25 bp, Mus musculus
atgttactcgttacctgttctagac

SEQ ID NO: 273664 - DNA, 25 bp, Mus musculus
atgttactcgtttcctgttctagac

SEQ ID NO: 273665 - DNA, 25 bp, Mus musculus
atgttactgaataactgctgccctt

SEQ ID NO: 273666 - DNA, 25 bp, Mus musculus
atgttactgaattactgctgccctt

SEQ ID NO: 273667 - DNA, 25 bp, Mus musculus
atgttactgagaaagatttacatca

SEQ ID NO: 273668 - DNA, 25 bp, Mus musculus
atgttactgagatagatttacatca

SEQ ID NO: 273669 - DNA, 25 bp, Mus musculus
atgttactgcatactttcactgact

SEQ ID NO: 273670 - DNA, 25 bp, Mus musculus
atgttactgcattctttcactgact

SEQ ID NO: 273671 - DNA, 25 bp, Mus musculus
atgttactggacctcatctctacag

SEQ ID NO: 273672 - DNA, 25 bp, Mus musculus
atgttactggacgtcatctctacag

SEQ ID NO: 273673 - DNA, 25 bp, Mus musculus
atgttactgtatcctcttccccgtg

SEQ ID NO: 273674 - DNA, 25 bp, Mus musculus
atgttactgtatgctcttccccgtg

SEQ ID NO: 273675 - DNA, 25 bp, Mus musculus
atgttacttcttacaaggacaagca

SEQ ID NO: 273676 - DNA, 25 bp, Mus musculus
atgttacttctttcaaggacaagca

SEQ ID NO: 273677 - DNA, 25 bp, Mus musculus
atgttacttgacattgtaccaggtc

SEQ ID NO: 273678 - DNA, 25 bp, Mus musculus
atgttacttgactttgtaccaggtc

SEQ ID NO: 273679 - DNA, 25 bp, Mus musculus
atgttagacaagcaatccactgtta

SEQ ID NO: 273680 - DNA, 25 bp, Mus musculus
atgttagacaaggaatccactgtta

SEQ ID NO: 273681 - DNA, 25 bp, Mus musculus
atgttagactcaagacacacttccc

SEQ ID NO: 273682 - DNA, 25 bp, Mus musculus
atgttagactcatgacacacttccc

SEQ ID NO: 273683 - DNA, 25 bp, Mus musculus
atgttagagcacactgatccagcca

SEQ ID NO: 273684 - DNA, 25 bp, Mus musculus
atgttagagcactctgatccagcca

SEQ ID NO: 273685 - DNA, 25 bp, Mus musculus
atgttagagcctagctgttgcttct

SEQ ID NO: 273686 - DNA, 25 bp, Mus musculus
atgttagagccttgctgttgcttct

SEQ ID NO: 273687 - DNA, 25 bp, Mus musculus
atgttagatatcctgcatcatgcag

SEQ ID NO: 273688 - DNA, 25 bp, Mus musculus
atgttagatatcgtgcatcatgcag

SEQ ID NO: 273689 - DNA, 25 bp, Mus musculus
atgttagatcaaacgccacctggtc

SEQ ID NO: 273690 - DNA, 25 bp, Mus musculus
atgttagatcaatcgccacctggtc

SEQ ID NO: 273691 - DNA, 25 bp, Mus musculus
atgttagattgtctgagcctcttcc

SEQ ID NO: 273692 - DNA, 25 bp, Mus musculus
atgttagattgtgtgagcctcttcc

SEQ ID NO: 273693 - DNA, 25 bp, Mus musculus
atgttagcatgtcagatcattccaa

SEQ ID NO: 273694 - DNA, 25 bp, Mus musculus
atgttagcatgtgagatcattccaa

SEQ ID NO: 273695 - DNA, 25 bp, Mus musculus
atgttagcccatctttgtttctcac

SEQ ID NO: 273696 - DNA, 25 bp, Mus musculus
atgttagcccatgtttgtttctcac

SEQ ID NO: 273697 - DNA, 25 bp, Mus musculus
atgttagcgcggagtcccgcctcag

SEQ ID NO: 273698 - DNA, 25 bp, Mus musculus
atgttagcgcggtgtcccgcctcag

SEQ ID NO: 273699 - DNA, 25 bp, Mus musculus
atgttagctagtatctgctacctgt

SEQ ID NO: 273700 - DNA, 25 bp, Mus musculus
atgttagctagtttctgctacctgt

SEQ ID NO: 273701 - DNA, 25 bp, Mus musculus
atgttagctcatatcccaattttat

SEQ ID NO: 273702 - DNA, 25 bp, Mus musculus
atgttagctcatttcccaattttat

SEQ ID NO: 273703 - DNA, 25 bp, Mus musculus
atgttagctgctccaactgggtttc

SEQ ID NO: 273704 - DNA, 25 bp, Mus musculus
atgttagctgctcgctccccatggg

SEQ ID NO: 273705 - DNA, 25 bp, Mus musculus
atgttagctgctgcaactgggtttc

SEQ ID NO: 273706 - DNA, 25 bp, Mus musculus
atgttagctgctggctccccatggg

SEQ ID NO: 273707 - DNA, 25 bp, Mus musculus
atgttagctttcactgtagttgacc

SEQ ID NO: 273708 - DNA, 25 bp, Mus musculus
atgttagctttctctgtagttgacc

SEQ ID NO: 273709 - DNA, 25 bp, Mus musculus
atgttaggatgtaggttgcaggttt

SEQ ID NO: 273710 - DNA, 25 bp, Mus musculus
atgttaggatgttggttgcaggttt

SEQ ID NO: 273711 - DNA, 25 bp, Mus musculus
atgttaggcagtcggcaacatcctc

SEQ ID NO: 273712 - DNA, 25 bp, Mus musculus
atgttaggcagtgggcaacatcctc

SEQ ID NO: 273713 - DNA, 25 bp, Mus musculus
atgttaggcttccattagactcaga

SEQ ID NO: 273714 - DNA, 25 bp, Mus musculus
atgttaggcttcgattagactcaga

SEQ ID NO: 273715 - DNA, 25 bp, Mus musculus
atgttaggcttgagggtgattcccc

SEQ ID NO: 273716 - DNA, 25 bp, Mus musculus
atgttaggcttgtgggtgattcccc

SEQ ID NO: 273717 - DNA, 25 bp, Mus musculus
atgttagggcacaagcagcacggag

SEQ ID NO: 273718 - DNA, 25 bp, Mus musculus
atgttagggcactagcagcacggag

SEQ ID NO: 273719 - DNA, 25 bp, Mus musculus
atgttagggctaacggctcttctca

SEQ ID NO: 273720 - DNA, 25 bp, Mus musculus
atgttagggctatcggctcttctca

SEQ ID NO: 273721 - DNA, 25 bp, Mus musculus
atgttaggtgttagaggtccagaaa

SEQ ID NO: 273722 - DNA, 25 bp, Mus musculus
atgttaggtgtttgaggtccagaaa

SEQ ID NO: 273723 - DNA, 25 bp, Mus musculus
atgttaggtttccaggctccagcaa

SEQ ID NO: 273724 - DNA, 25 bp, Mus musculus
atgttaggtttcgaggctccagcaa

SEQ ID NO: 273725 - DNA, 25 bp, Mus musculus
atgttagtaattacgcctcaagccc

SEQ ID NO: 273726 - DNA, 25 bp, Mus musculus
atgttagtaatttcgcctcaagccc

SEQ ID NO: 273727 - DNA, 25 bp, Mus musculus
atgttagtacagctacagtttactc

SEQ ID NO: 273728 - DNA, 25 bp, Mus musculus
atgttagtacaggtacagtttactc

SEQ ID NO: 273729 - DNA, 25 bp, Mus musculus
atgttagtacatattcatcctgaat

SEQ ID NO: 273730 - DNA, 25 bp, Mus musculus
atgttagtacattttcatcctgaat

SEQ ID NO: 273731 - DNA, 25 bp, Mus musculus
atgttagtaggtatcatgcatacaa

SEQ ID NO: 273732 - DNA, 25 bp, Mus musculus
atgttagtaggtttcatgcatacaa

SEQ ID NO: 273733 - DNA, 25 bp, Mus musculus
atgttagtatgcagctgctgtcttc

SEQ ID NO: 273734 - DNA, 25 bp, Mus musculus
atgttagtatgctgctgctgtcttc

SEQ ID NO: 273735 - DNA, 25 bp, Mus musculus
atgttagtcttgcttgtgcctgtct

SEQ ID NO: 273736 - DNA, 25 bp, Mus musculus
atgttagtcttggttgtgcctgtct

SEQ ID NO: 273737 - DNA, 25 bp, Mus musculus
atgttagtgagcaggactggtcatt

SEQ ID NO: 273738 - DNA, 25 bp, Mus musculus
atgttagtgagctggactggtcatt

SEQ ID NO: 273739 - DNA, 25 bp, Mus musculus
atgttagtggatagttagggcctga

SEQ ID NO: 273740 - DNA, 25 bp, Mus musculus
atgttagtggattgttagggcctga

SEQ ID NO: 273741 - DNA, 25 bp, Mus musculus
atgttagtttccaaggacctctgtc

SEQ ID NO: 273742 - DNA, 25 bp, Mus musculus
atgttagtttcctaggacctctgtc

SEQ ID NO: 273743 - DNA, 25 bp, Mus musculus
atgttatacagtattccattaagga

SEQ ID NO: 273744 - DNA, 25 bp, Mus musculus
atgttatacagttttccattaagga

SEQ ID NO: 273745 - DNA, 25 bp, Mus musculus
atgttatacgtgatagactcggtac

SEQ ID NO: 273746 - DNA, 25 bp, Mus musculus
atgttatacgtgttagactcggtac

SEQ ID NO: 273747 - DNA, 25 bp, Mus musculus
atgttatatccccttggatcccaag

SEQ ID NO: 273748 - DNA, 25 bp, Mus musculus
atgttatatcccgttggatcccaag

SEQ ID NO: 273749 - DNA, 25 bp, Mus musculus
atgttatatgtcaggctttgtgcta

SEQ ID NO: 273750 - DNA, 25 bp, Mus musculus
atgttatatgtctggctttgtgcta

SEQ ID NO: 273751 - DNA, 25 bp, Mus musculus
atgttatatttcaactggtctggaa

SEQ ID NO: 273752 - DNA, 25 bp, Mus musculus
atgttatatttctactggtctggaa

SEQ ID NO: 273753 - DNA, 25 bp, Mus musculus
atgttatcaccaccgagaagctcag

SEQ ID NO: 273754 - DNA, 25 bp, Mus musculus
atgttatcaccagcgagaagctcag

SEQ ID NO: 273755 - DNA, 25 bp, Mus musculus
atgttatccgttatatgacttgtct

SEQ ID NO: 273756 - DNA, 25 bp, Mus musculus
atgttatccgttttatgacttgtct

SEQ ID NO: 273757 - DNA, 25 bp, Mus musculus
atgttatcctgcatctgtcctagaa

SEQ ID NO: 273758 - DNA, 25 bp, Mus musculus
atgttatcctgcttctgtcctagaa

SEQ ID NO: 273759 - DNA, 25 bp, Mus musculus
atgttatcttggatgtctggtggta

SEQ ID NO: 273760 - DNA, 25 bp, Mus musculus
atgttatcttggcagggcatcactt

SEQ ID NO: 273761 - DNA, 25 bp, Mus musculus
atgttatcttgggagggcatcactt

SEQ ID NO: 273762 - DNA, 25 bp, Mus musculus
atgttatcttggttgtctggtggta

SEQ ID NO: 273763 - DNA, 25 bp, Mus musculus
atgttatcttgtctacctcttttaa

SEQ ID NO: 273764 - DNA, 25 bp, Mus musculus
atgttatcttgtgtacctcttttaa

SEQ ID NO: 273765 - DNA, 25 bp, Mus musculus
atgttatctttcatgtgtcctagag

SEQ ID NO: 273766 - DNA, 25 bp, Mus musculus
atgttatctttcttgtgtcctagag

SEQ ID NO: 273767 - DNA, 25 bp, Mus musculus
atgttatgcactacagcctgatctt

SEQ ID NO: 273768 - DNA, 25 bp, Mus musculus
atgttatgcacttcagcctgatctt

SEQ ID NO: 273769 - DNA, 25 bp, Mus musculus
atgttatgccctatgtaacagcaga

SEQ ID NO: 273770 - DNA, 25 bp, Mus musculus
atgttatgccctttgtaacagcaga

SEQ ID NO: 273771 - DNA, 25 bp, Mus musculus
atgttatggcatcaggttatcctaa

SEQ ID NO: 273772 - DNA, 25 bp, Mus musculus
atgttatggcatgaggttatcctaa

SEQ ID NO: 273773 - DNA, 25 bp, Mus musculus
atgttatggcttaaactgctcctcc

SEQ ID NO: 273774 - DNA, 25 bp, Mus musculus
atgttatggctttaactgctcctcc

SEQ ID NO: 273775 - DNA, 25 bp, Mus musculus
atgttatgttagagctttggaccca

SEQ ID NO: 273776 - DNA, 25 bp, Mus musculus
atgttatgttagtgctttggaccca

SEQ ID NO: 273777 - DNA, 25 bp, Mus musculus
atgttattaatgacactactttcag

SEQ ID NO: 273778 - DNA, 25 bp, Mus musculus
atgttattaatgtcactactttcag

SEQ ID NO: 273779 - DNA, 25 bp, Mus musculus
atgttattcaaacctggcacccatg

SEQ ID NO: 273780 - DNA, 25 bp, Mus musculus
atgttattcaaagctggcacccatg

SEQ ID NO: 273781 - DNA, 25 bp, Mus musculus
atgttattcacaaagccttattaat

SEQ ID NO: 273782 - DNA, 25 bp, Mus musculus
atgttattcacatagccttattaat

SEQ ID NO: 273783 - DNA, 25 bp, Mus musculus
atgttattcaccagtcaccctgtag

SEQ ID NO: 273784 - DNA, 25 bp, Mus musculus
atgttattcacctgtcaccctgtag

SEQ ID NO: 273785 - DNA, 25 bp, Mus musculus
atgttattccctcaagcacaacgcc

SEQ ID NO: 273786 - DNA, 25 bp, Mus musculus
atgttattccctgaagcacaacgcc

SEQ ID NO: 273787 - DNA, 25 bp, Mus musculus
atgttattcctcagatgtcattaat

SEQ ID NO: 273788 - DNA, 25 bp, Mus musculus
atgttattcctctgatgtcattaat

SEQ ID NO: 273789 - DNA, 25 bp, Mus musculus
atgttatttatcagtgcttccaggc

SEQ ID NO: 273790 - DNA, 25 bp, Mus musculus
atgttatttatctgtgcttccaggc

SEQ ID NO: 273791 - DNA, 25 bp, Mus musculus
atgttatttctactctcaccctgag

SEQ ID NO: 273792 - DNA, 25 bp, Mus musculus
atgttatttctagtctcaccctgag

SEQ ID NO: 273793 - DNA, 25 bp, Mus musculus
atgttatttgccatatgtgccccat

SEQ ID NO: 273794 - DNA, 25 bp, Mus musculus
atgttatttgccttatgtgccccat

SEQ ID NO: 273795 - DNA, 25 bp, Mus musculus
atgttatttggaaggtgcactgcac

SEQ ID NO: 273796 - DNA, 25 bp, Mus musculus
atgttatttggatggtgcactgcac

SEQ ID NO: 273797 - DNA, 25 bp, Mus musculus
atgttcaaaattccgcttcaagcct

SEQ ID NO: 273798 - DNA, 25 bp, Mus musculus
atgttcaaaattgcgcttcaagcct

SEQ ID NO: 273799 - DNA, 25 bp, Mus musculus
atgttcaaagctcttttctgctctc

SEQ ID NO: 273800 - DNA, 25 bp, Mus musculus
atgttcaaagctgttttctgctctc

SEQ ID NO: 273801 - DNA, 25 bp, Mus musculus
atgttcaaagttcagcctatgtcta

SEQ ID NO: 273802 - DNA, 25 bp, Mus musculus
atgttcaaagttgagcctatgtcta

SEQ ID NO: 273803 - DNA, 25 bp, Mus musculus
atgttcaagaccagaaccctgggct

SEQ ID NO: 273804 - DNA, 25 bp, Mus musculus
atgttcaagacctgaaccctgggct

SEQ ID NO: 273805 - DNA, 25 bp, Mus musculus
atgttcaagactagctgcacctgcg

SEQ ID NO: 273806 - DNA, 25 bp, Mus musculus
atgttcaagacttgctgcacctgcg

SEQ ID NO: 273807 - DNA, 25 bp, Mus musculus
atgttcaaggaaccctgcctatgca

SEQ ID NO: 273808 - DNA, 25 bp, Mus musculus
atgttcaaggaagcctgcctatgca

SEQ ID NO: 273809 - DNA, 25 bp, Mus musculus
atgttcaatcctctgtgatctgtcg

SEQ ID NO: 273810 - DNA, 25 bp, Mus musculus
atgttcaatcctgtgtgatctgtcg

SEQ ID NO: 273811 - DNA, 25 bp, Mus musculus
atgttcacaagtcgctatgttttaa

SEQ ID NO: 273812 - DNA, 25 bp, Mus musculus
atgttcacaagtggctatgttttaa

SEQ ID NO: 273813 - DNA, 25 bp, Mus musculus
atgttcacaatgaggcagcttcaca

SEQ ID NO: 273814 - DNA, 25 bp, Mus musculus
atgttcacaatgtggcagcttcaca

SEQ ID NO: 273815 - DNA, 25 bp, Mus musculus
atgttcacagacactaatgttgttt

SEQ ID NO: 273816 - DNA, 25 bp, Mus musculus
atgttcacagactctaatgttgttt

SEQ ID NO: 273817 - DNA, 25 bp, Mus musculus
atgttcacaggacctgtcctctgac

SEQ ID NO: 273818 - DNA, 25 bp, Mus musculus
atgttcacaggagctgtcctctgac

SEQ ID NO: 273819 - DNA, 25 bp, Mus musculus
atgttcacatctcccataacttcga

SEQ ID NO: 273820 - DNA, 25 bp, Mus musculus
atgttcacatctgccataacttcga

SEQ ID NO: 273821 - DNA, 25 bp, Mus musculus
atgttcaccatgcaaagtgcctatg

SEQ ID NO: 273822 - DNA, 25 bp, Mus musculus
atgttcaccatggaaagtgcctatg

SEQ ID NO: 273823 - DNA, 25 bp, Mus musculus
atgttcacctgaatgtcgccttcag

SEQ ID NO: 273824 - DNA, 25 bp, Mus musculus
atgttcacctgattgtcgccttcag

SEQ ID NO: 273825 - DNA, 25 bp, Mus musculus
atgttcacctggatcgagccgatgt

SEQ ID NO: 273826 - DNA, 25 bp, Mus musculus
atgttcacctggttcgagccgatgt

SEQ ID NO: 273827 - DNA, 25 bp, Mus musculus
atgttcacgcgacctctggagtacc

SEQ ID NO: 273828 - DNA, 25 bp, Mus musculus
atgttcacgcgagctctggagtacc

SEQ ID NO: 273829 - DNA, 25 bp, Mus musculus
atgttcacgttcaggacaggcttcc

SEQ ID NO: 273830 - DNA, 25 bp, Mus musculus
atgttcacgttctggacaggcttcc

SEQ ID NO: 273831 - DNA, 25 bp, Mus musculus
atgttcactaggactgttcctatcc

SEQ ID NO: 273832 - DNA, 25 bp, Mus musculus
atgttcactaggcatcctcaaccag

SEQ ID NO: 273833 - DNA, 25 bp, Mus musculus
atgttcactagggatcctcaaccag

SEQ ID NO: 273834 - DNA, 25 bp, Mus musculus
atgttcactaggtctgttcctatcc

SEQ ID NO: 273835 - DNA, 25 bp, Mus musculus
atgttcacttgcatatctacggatg

SEQ ID NO: 273836 - DNA, 25 bp, Mus musculus
atgttcacttgcttatctacggatg

SEQ ID NO: 273837 - DNA, 25 bp, Mus musculus
atgttcagaagcagagccctcagtg

SEQ ID NO: 273838 - DNA, 25 bp, Mus musculus
atgttcagaagctgagccctcagtg

SEQ ID NO: 273839 - DNA, 25 bp, Mus musculus
atgttcagagagatcacccagcaga

SEQ ID NO: 273840 - DNA, 25 bp, Mus musculus
atgttcagagagttcacccagcaga

SEQ ID NO: 273841 - DNA, 25 bp, Mus musculus
atgttcagagcacaggcttcaactc

SEQ ID NO: 273842 - DNA, 25 bp, Mus musculus
atgttcagagcagaggcttcaactc

SEQ ID NO: 273843 - DNA, 25 bp, Mus musculus
atgttcagagtgcttcacagctgtg

SEQ ID NO: 273844 - DNA, 25 bp, Mus musculus
atgttcagagtggttcacagctgtg

SEQ ID NO: 273845 - DNA, 25 bp, Mus musculus
atgttcagcgctcgatccctgagaa

SEQ ID NO: 273846 - DNA, 25 bp, Mus musculus
atgttcagcgctggatccctgagaa

SEQ ID NO: 273847 - DNA, 25 bp, Mus musculus
atgttcagcgtgacactgcttgtga

SEQ ID NO: 273848 - DNA, 25 bp, Mus musculus
atgttcagcgtgtcactgcttgtga

SEQ ID NO: 273849 - DNA, 25 bp, Mus musculus
atgttcagctcgagcgccaagatcg

SEQ ID NO: 273850 - DNA, 25 bp, Mus musculus
atgttcagctcgtgcgccaagatcg

SEQ ID NO: 273851 - DNA, 25 bp, Mus musculus
atgttcagcttcattgcatgtaatg

SEQ ID NO: 273852 - DNA, 25 bp, Mus musculus
atgttcagcttctttgcatgtaatg

SEQ ID NO: 273853 - DNA, 25 bp, Mus musculus
atgttcaggaacagctgcgacagct

SEQ ID NO: 273854 - DNA, 25 bp, Mus musculus
atgttcaggaactgctgcgacagct

SEQ ID NO: 273855 - DNA, 25 bp, Mus musculus
atgttcaggcacaggattacgttgt

SEQ ID NO: 273856 - DNA, 25 bp, Mus musculus
atgttcaggcactggattacgttgt

SEQ ID NO: 273857 - DNA, 25 bp, Mus musculus
atgttcagggcaattcaatcaatac

SEQ ID NO: 273858 - DNA, 25 bp, Mus musculus
atgttcagggcatttcaatcaatac

SEQ ID NO: 273859 - DNA, 25 bp, Mus musculus
atgttcagggctcctggcttgcaca

SEQ ID NO: 273860 - DNA, 25 bp, Mus musculus
atgttcagggctgctggcttgcaca

SEQ ID NO: 273861 - DNA, 25 bp, Mus musculus
atgttcaggtccctgggttcatttc

SEQ ID NO: 273862 - DNA, 25 bp, Mus musculus
atgttcaggtccgtgggttcatttc

SEQ ID NO: 273863 - DNA, 25 bp, Mus musculus
atgttcaggtttaagtgttccctct

SEQ ID NO: 273864 - DNA, 25 bp, Mus musculus
atgttcaggttttagtgttccctct

SEQ ID NO: 273865 - DNA, 25 bp, Mus musculus
atgttcagtcacacctttatgatag

SEQ ID NO: 273866 - DNA, 25 bp, Mus musculus
atgttcagtcactcctttatgatag

SEQ ID NO: 273867 - DNA, 25 bp, Mus musculus
atgttcagtcagcaaacccatgatt

SEQ ID NO: 273868 - DNA, 25 bp, Mus musculus
atgttcagtcaggaaacccatgatt

SEQ ID NO: 273869 - DNA, 25 bp, Mus musculus
atgttcatacaaacagaccaaggag

SEQ ID NO: 273870 - DNA, 25 bp, Mus musculus
atgttcatacaatcagaccaaggag

SEQ ID NO: 273871 - DNA, 25 bp, Mus musculus
atgttcatacccattcagtaagtaa

SEQ ID NO: 273872 - DNA, 25 bp, Mus musculus
atgttcataccctttcagtaagtaa

SEQ ID NO: 273873 - DNA, 25 bp, Mus musculus
atgttcatgaagctgagccggcccc

SEQ ID NO: 273874 - DNA, 25 bp, Mus musculus
atgttcatgaaggtgagccggcccc

SEQ ID NO: 273875 - DNA, 25 bp, Mus musculus
atgttcatgcaaaactaacctctcc

SEQ ID NO: 273876 - DNA, 25 bp, Mus musculus
atgttcatgcaatactaacctctcc

SEQ ID NO: 273877 - DNA, 25 bp, Mus musculus
atgttcatgcatagggcacctgttc

SEQ ID NO: 273878 - DNA, 25 bp, Mus musculus
atgttcatgcattgggcacctgttc

SEQ ID NO: 273879 - DNA, 25 bp, Mus musculus
atgttcatggacacacagcttcaac

SEQ ID NO: 273880 - DNA, 25 bp, Mus musculus
atgttcatggactcacagcttcaac

SEQ ID NO: 273881 - DNA, 25 bp, Mus musculus
atgttcatggctaatgttatctcat

SEQ ID NO: 273882 - DNA, 25 bp, Mus musculus
atgttcatggcttatgttatctcat

SEQ ID NO: 273883 - DNA, 25 bp, Mus musculus
atgttcatgtgcaacctcatgggaa

SEQ ID NO: 273884 - DNA, 25 bp, Mus musculus
atgttcatgtgctacctcatgggaa

SEQ ID NO: 273885 - DNA, 25 bp, Mus musculus
atgttcatttagacctgcctaggag

SEQ ID NO: 273886 - DNA, 25 bp, Mus musculus
atgttcatttagtcctgcctaggag

SEQ ID NO: 273887 - DNA, 25 bp, Mus musculus
atgttccaacagactgcttaatgaa

SEQ ID NO: 273888 - DNA, 25 bp, Mus musculus
atgttccaacagtctgcttaatgaa

SEQ ID NO: 273889 - DNA, 25 bp, Mus musculus
atgttccaacatcgccgtaccagtg

SEQ ID NO: 273890 - DNA, 25 bp, Mus musculus
atgttccaacatggccgtaccagtg

SEQ ID NO: 273891 - DNA, 25 bp, Mus musculus
atgttccactaaccttgagctggtg

SEQ ID NO: 273892 - DNA, 25 bp, Mus musculus
atgttccactaagcttgagctggtg

SEQ ID NO: 273893 - DNA, 25 bp, Mus musculus
atgttccactcgctctttgccattg

SEQ ID NO: 273894 - DNA, 25 bp, Mus musculus
atgttccactcggtctttgccattg

SEQ ID NO: 273895 - DNA, 25 bp, Mus musculus
atgttccagagcatggtcttctgtg

SEQ ID NO: 273896 - DNA, 25 bp, Mus musculus
atgttccagagcttggtcttctgtg

SEQ ID NO: 273897 - DNA, 25 bp, Mus musculus
atgttccagcaaccttgtcccatgt

SEQ ID NO: 273898 - DNA, 25 bp, Mus musculus
atgttccagcaagcttgtcccatgt

SEQ ID NO: 273899 - DNA, 25 bp, Mus musculus
atgttccagccccagcttgaaaaaa

SEQ ID NO: 273900 - DNA, 25 bp, Mus musculus
atgttccagcccgagcttgaaaaaa

SEQ ID NO: 273901 - DNA, 25 bp, Mus musculus
atgttccatcatcaaaatatttttc

SEQ ID NO: 273902 - DNA, 25 bp, Mus musculus
atgttccatcatgaaaatatttttc

SEQ ID NO: 273903 - DNA, 25 bp, Mus musculus
atgttcccaataatccctgtggcta

SEQ ID NO: 273904 - DNA, 25 bp, Mus musculus
atgttcccaatattccctgtggcta

SEQ ID NO: 273905 - DNA, 25 bp, Mus musculus
atgttcccaccgactgtaaatctgt

SEQ ID NO: 273906 - DNA, 25 bp, Mus musculus
atgttcccaccgtctgtaaatctgt

SEQ ID NO: 273907 - DNA, 25 bp, Mus musculus
atgttcccagaaccaggtgtgtgaa

SEQ ID NO: 273908 - DNA, 25 bp, Mus musculus
atgttcccagaagcaggtgtgtgaa

SEQ ID NO: 273909 - DNA, 25 bp, Mus musculus
atgttcccagaccagcctgaaaagc

SEQ ID NO: 273910 - DNA, 25 bp, Mus musculus
atgttcccagacgagcctgaaaagc

SEQ ID NO: 273911 - DNA, 25 bp, Mus musculus
atgttcccagcacgcatctatgaca

SEQ ID NO: 273912 - DNA, 25 bp, Mus musculus
atgttcccagcaggcatctatgaca

SEQ ID NO: 273913 - DNA, 25 bp, Mus musculus
atgttcccaggtccaggaacctact

SEQ ID NO: 273914 - DNA, 25 bp, Mus musculus
atgttcccaggtgcaggaacctact

SEQ ID NO: 273915 - DNA, 25 bp, Mus musculus
atgttcccagtgctcactcgaggaa

SEQ ID NO: 273916 - DNA, 25 bp, Mus musculus
atgttcccagtggtcactcgaggaa

SEQ ID NO: 273917 - DNA, 25 bp, Mus musculus
atgttcccattaactggttgtagag

SEQ ID NO: 273918 - DNA, 25 bp, Mus musculus
atgttcccattatctggttgtagag

SEQ ID NO: 273919 - DNA, 25 bp, Mus musculus
atgttccccaaacacatggtctata

SEQ ID NO: 273920 - DNA, 25 bp, Mus musculus
atgttccccaaagacatggtctata

SEQ ID NO: 273921 - DNA, 25 bp, Mus musculus
atgttccccaatcaaagatgctgca

SEQ ID NO: 273922 - DNA, 25 bp, Mus musculus
atgttccccaatgaaagatgctgca

SEQ ID NO: 273923 - DNA, 25 bp, Mus musculus
atgttccccagtctgaaaccttgga

SEQ ID NO: 273924 - DNA, 25 bp, Mus musculus
atgttccccagtgtgaaaccttgga

SEQ ID NO: 273925 - DNA, 25 bp, Mus musculus
atgttccccggaaggccacttatac

SEQ ID NO: 273926 - DNA, 25 bp, Mus musculus
atgttccccggatggccacttatac

SEQ ID NO: 273927 - DNA, 25 bp, Mus musculus
atgttcccggacaacaagctgtgaa

SEQ ID NO: 273928 - DNA, 25 bp, Mus musculus
atgttcccggactacaagctgtgaa

SEQ ID NO: 273929 - DNA, 25 bp, Mus musculus
atgttccctccaatttctgagtagc

SEQ ID NO: 273930 - DNA, 25 bp, Mus musculus
atgttccctccattttctgagtagc

SEQ ID NO: 273931 - DNA, 25 bp, Mus musculus
atgttccctcctaactacgatcaga

SEQ ID NO: 273932 - DNA, 25 bp, Mus musculus
atgttccctccttactacgatcaga

SEQ ID NO: 273933 - DNA, 25 bp, Mus musculus
atgttccctgtgagctatgggttca

SEQ ID NO: 273934 - DNA, 25 bp, Mus musculus
atgttccctgtgagcttgggttcag

SEQ ID NO: 273935 - DNA, 25 bp, Mus musculus
atgttccctgtgagtctgcgggctc

SEQ ID NO: 273936 - DNA, 25 bp, Mus musculus
atgttccctgtgtgctatgggttca

SEQ ID NO: 273937 - DNA, 25 bp, Mus musculus
atgttccctgtgtgcttgggttcag

SEQ ID NO: 273938 - DNA, 25 bp, Mus musculus
atgttccctgtgtgtctgcgggctc

SEQ ID NO: 273939 - DNA, 25 bp, Mus musculus
atgttcccttaaatgtcttgttgtt

SEQ ID NO: 273940 - DNA, 25 bp, Mus musculus
atgttcccttaattgtcttgttgtt

SEQ ID NO: 273941 - DNA, 25 bp, Mus musculus
atgttcccttagaccattaaatgaa

SEQ ID NO: 273942 - DNA, 25 bp, Mus musculus
atgttcccttagtccattaaatgaa

SEQ ID NO: 273943 - DNA, 25 bp, Mus musculus
atgttccgatgcactcattaaacga

SEQ ID NO: 273944 - DNA, 25 bp, Mus musculus
atgttccgatgctctcattaaacga

SEQ ID NO: 273945 - DNA, 25 bp, Mus musculus
atgttccggaagctgcataactctt

SEQ ID NO: 273946 - DNA, 25 bp, Mus musculus
atgttccggaaggtgcataactctt

SEQ ID NO: 273947 - DNA, 25 bp, Mus musculus
atgttccgtgtcacgcaacaactaa

SEQ ID NO: 273948 - DNA, 25 bp, Mus musculus
atgttccgtgtctcgcaacaactaa

SEQ ID NO: 273949 - DNA, 25 bp, Mus musculus
atgttcctaaggacagttctctgct

SEQ ID NO: 273950 - DNA, 25 bp, Mus musculus
atgttcctaaggtcagttctctgct

SEQ ID NO: 273951 - DNA, 25 bp, Mus musculus
atgttcctaggaagggaatccctgg

SEQ ID NO: 273952 - DNA, 25 bp, Mus musculus
atgttcctaggatgggaatccctgg

SEQ ID NO: 273953 - DNA, 25 bp, Mus musculus
atgttcctcagaaagcgctgtaccc

SEQ ID NO: 273954 - DNA, 25 bp, Mus musculus
atgttcctcagactatctacttcag

SEQ ID NO: 273955 - DNA, 25 bp, Mus musculus
atgttcctcagagtatctacttcag

SEQ ID NO: 273956 - DNA, 25 bp, Mus musculus
atgttcctcagatagcgctgtaccc

SEQ ID NO: 273957 - DNA, 25 bp, Mus musculus
atgttcctcaggcacgtgattccga

SEQ ID NO: 273958 - DNA, 25 bp, Mus musculus
atgttcctcagggacgtgattccga

SEQ ID NO: 273959 - DNA, 25 bp, Mus musculus
atgttcctccttatgagtgccgaga

SEQ ID NO: 273960 - DNA, 25 bp, Mus musculus
atgttcctccttctgattgtctttg

SEQ ID NO: 273961 - DNA, 25 bp, Mus musculus
atgttcctccttgtgattgtctttg

SEQ ID NO: 273962 - DNA, 25 bp, Mus musculus
atgttcctccttttgagtgccgaga

SEQ ID NO: 273963 - DNA, 25 bp, Mus musculus
atgttcctgaatctgaaactgtcgt

SEQ ID NO: 273964 - DNA, 25 bp, Mus musculus
atgttcctgaatgtgaaactgtcgt

SEQ ID NO: 273965 - DNA, 25 bp, Mus musculus
atgttcctgctcactaatccatgct

SEQ ID NO: 273966 - DNA, 25 bp, Mus musculus
atgttcctgctcatgaacctagtgt

SEQ ID NO: 273967 - DNA, 25 bp, Mus musculus
atgttcctgctctctaatccatgct

SEQ ID NO: 273968 - DNA, 25 bp, Mus musculus
atgttcctgctcttgaacctagtgt

SEQ ID NO: 273969 - DNA, 25 bp, Mus musculus
atgttcctgcttccagctcttgagt

SEQ ID NO: 273970 - DNA, 25 bp, Mus musculus
atgttcctgcttgcagctcttgagt

SEQ ID NO: 273971 - DNA, 25 bp, Mus musculus
atgttcctggatccttgtatgtttg

SEQ ID NO: 273972 - DNA, 25 bp, Mus musculus
atgttcctggatgcttgtatgtttg

SEQ ID NO: 273973 - DNA, 25 bp, Mus musculus
atgttcctggcacttgacagccaag

SEQ ID NO: 273974 - DNA, 25 bp, Mus musculus
atgttcctggcagttgacagccaag

SEQ ID NO: 273975 - DNA, 25 bp, Mus musculus
atgttcctggttataagatctttgg

SEQ ID NO: 273976 - DNA, 25 bp, Mus musculus
atgttcctggttttaagatctttgg

SEQ ID NO: 273977 - DNA, 25 bp, Mus musculus
atgttcctgtacctgccggtgtagg

SEQ ID NO: 273978 - DNA, 25 bp, Mus musculus
atgttcctgtacgtgccggtgtagg

SEQ ID NO: 273979 - DNA, 25 bp, Mus musculus
atgttcctgtgaccctgcaactgct

SEQ ID NO: 273980 - DNA, 25 bp, Mus musculus
atgttcctgtgagcctgcaactgct

SEQ ID NO: 273981 - DNA, 25 bp, Mus musculus
atgttcctgttgctatagactatgt

SEQ ID NO: 273982 - DNA, 25 bp, Mus musculus
atgttcctgttgctcgtgggtctta

SEQ ID NO: 273983 - DNA, 25 bp, Mus musculus
atgttcctgttggtatagactatgt

SEQ ID NO: 273984 - DNA, 25 bp, Mus musculus
atgttcctgttggtcgtgggtctta

SEQ ID NO: 273985 - DNA, 25 bp, Mus musculus
atgttccttaacagtcctcgtgtta

SEQ ID NO: 273986 - DNA, 25 bp, Mus musculus
atgttccttaactgtcctcgtgtta

SEQ ID NO: 273987 - DNA, 25 bp, Mus musculus
atgttccttagccttctgaatccat

SEQ ID NO: 273988 - DNA, 25 bp, Mus musculus
atgttccttagcgttctgaatccat

SEQ ID NO: 273989 - DNA, 25 bp, Mus musculus
atgttccttattaaaaccatgcctg

SEQ ID NO: 273990 - DNA, 25 bp, Mus musculus
atgttccttatttaaaccatgcctg

SEQ ID NO: 273991 - DNA, 25 bp, Mus musculus
atgttccttcctcctattgtatatt

SEQ ID NO: 273992 - DNA, 25 bp, Mus musculus
atgttccttcctgctattgtatatt

SEQ ID NO: 273993 - DNA, 25 bp, Mus musculus
atgttccttgaaaggctaccaccag

SEQ ID NO: 273994 - DNA, 25 bp, Mus musculus
atgttccttgaatggctaccaccag

SEQ ID NO: 273995 - DNA, 25 bp, Mus musculus
atgttccttggaatttgcaggctac

SEQ ID NO: 273996 - DNA, 25 bp, Mus musculus
atgttccttggattttgcaggctac

SEQ ID NO: 273997 - DNA, 25 bp, Mus musculus
atgttccttgtgaaaccacctggat

SEQ ID NO: 273998 - DNA, 25 bp, Mus musculus
atgttccttgtgtaaccacctggat

SEQ ID NO: 273999 - DNA, 25 bp, Mus musculus
atgttcgaacaaccccagattcagg

SEQ ID NO: 274000 - DNA, 25 bp, Mus musculus
atgttcgaacaagcccagattcagg

SEQ ID NO: 274001 - DNA, 25 bp, Mus musculus
atgttcgaactgattgccatagtaa

SEQ ID NO: 274002 - DNA, 25 bp, Mus musculus
atgttcgaactgtttgccatagtaa

SEQ ID NO: 274003 - DNA, 25 bp, Mus musculus
atgttcgaccgaaacaccaagcgtg

SEQ ID NO: 274004 - DNA, 25 bp, Mus musculus
atgttcgaccgatacaccaagcgtg

SEQ ID NO: 274005 - DNA, 25 bp, Mus musculus
atgttcgacgctcctaagtccccga

SEQ ID NO: 274006 - DNA, 25 bp, Mus musculus
atgttcgacgctgctaagtccccga

SEQ ID NO: 274007 - DNA, 25 bp, Mus musculus
atgttcgatgtcaccagaagggtgg

SEQ ID NO: 274008 - DNA, 25 bp, Mus musculus
atgttcgatgtctccagaagggtgg

SEQ ID NO: 274009 - DNA, 25 bp, Mus musculus
atgttcgcactccagacttggacaa

SEQ ID NO: 274010 - DNA, 25 bp, Mus musculus
atgttcgcactcgagacttggacaa

SEQ ID NO: 274011 - DNA, 25 bp, Mus musculus
atgttcgcattcctcataacagctt

SEQ ID NO: 274012 - DNA, 25 bp, Mus musculus
atgttcgcattcgtcataacagctt

SEQ ID NO: 274013 - DNA, 25 bp, Mus musculus
atgttcgccgtgagcgttcttgtgc

SEQ ID NO: 274014 - DNA, 25 bp, Mus musculus
atgttcgccgtgtgcgttcttgtgc

SEQ ID NO: 274015 - DNA, 25 bp, Mus musculus
atgttcgcctttcatgaaggacaga

SEQ ID NO: 274016 - DNA, 25 bp, Mus musculus
atgttcgcctttgatgaaggacaga

SEQ ID NO: 274017 - DNA, 25 bp, Mus musculus
atgttcggagggaattctcaggcct

SEQ ID NO: 274018 - DNA, 25 bp, Mus musculus
atgttcggagggtattctcaggcct

SEQ ID NO: 274019 - DNA, 25 bp, Mus musculus
atgttcggcctaatgcatgggacct

SEQ ID NO: 274020 - DNA, 25 bp, Mus musculus
atgttcggcctattgcatgggacct

SEQ ID NO: 274021 - DNA, 25 bp, Mus musculus
atgttcggttagataactcactgta

SEQ ID NO: 274022 - DNA, 25 bp, Mus musculus
atgttcggttagttaactcactgta

SEQ ID NO: 274023 - DNA, 25 bp, Mus musculus
atgttcgtaaatcccatgttgatga

SEQ ID NO: 274024 - DNA, 25 bp, Mus musculus
atgttcgtaaatgccatgttgatga

SEQ ID NO: 274025 - DNA, 25 bp, Mus musculus
atgttcgtaagcacctatcaccaag

SEQ ID NO: 274026 - DNA, 25 bp, Mus musculus
atgttcgtaagctcctatcaccaag

SEQ ID NO: 274027 - DNA, 25 bp, Mus musculus
atgttcgtcagtcggttgacacgga

SEQ ID NO: 274028 - DNA, 25 bp, Mus musculus
atgttcgtcagtgggttgacacgga

SEQ ID NO: 274029 - DNA, 25 bp, Mus musculus
atgttcgtgaacattcccatttcca

SEQ ID NO: 274030 - DNA, 25 bp, Mus musculus
atgttcgtgaactttcccatttcca

SEQ ID NO: 274031 - DNA, 25 bp, Mus musculus
atgttcgtgacacttgtagccctca

SEQ ID NO: 274032 - DNA, 25 bp, Mus musculus
atgttcgtgacagttgtagccctca

SEQ ID NO: 274033 - DNA, 25 bp, Mus musculus
atgttcgtgtcactgttcagtgttt

SEQ ID NO: 274034 - DNA, 25 bp, Mus musculus
atgttcgtgtcagtgttcagtgttt

SEQ ID NO: 274035 - DNA, 25 bp, Mus musculus
atgttcgttcaaagttggcactttg

SEQ ID NO: 274036 - DNA, 25 bp, Mus musculus
atgttcgttcaatgttggcactttg

SEQ ID NO: 274037 - DNA, 25 bp, Mus musculus
atgttctaagatagtgcacagcagc

SEQ ID NO: 274038 - DNA, 25 bp, Mus musculus
atgttctaagattgtgcacagcagc

SEQ ID NO: 274039 - DNA, 25 bp, Mus musculus
atgttctacatcatactcaagtctt

SEQ ID NO: 274040 - DNA, 25 bp, Mus musculus
atgttctacatcttactcaagtctt

SEQ ID NO: 274041 - DNA, 25 bp, Mus musculus
atgttctaccatcttggccacttca

SEQ ID NO: 274042 - DNA, 25 bp, Mus musculus
atgttctaccatgttggccacttca

SEQ ID NO: 274043 - DNA, 25 bp, Mus musculus
atgttctacgatcatgtcttctgag

SEQ ID NO: 274044 - DNA, 25 bp, Mus musculus
atgttctacgatgatgtcttctgag

SEQ ID NO: 274045 - DNA, 25 bp, Mus musculus
atgttctactaacggaggtgctatc

SEQ ID NO: 274046 - DNA, 25 bp, Mus musculus
atgttctactaagggaggtgctatc

SEQ ID NO: 274047 - DNA, 25 bp, Mus musculus
atgttctactctagtcagcatgcca

SEQ ID NO: 274048 - DNA, 25 bp, Mus musculus
atgttctactcttgtcagcatgcca

SEQ ID NO: 274049 - DNA, 25 bp, Mus musculus
atgttctactgcatgaagctcctgg

SEQ ID NO: 274050 - DNA, 25 bp, Mus musculus
atgttctactgcttgaagctcctgg

SEQ ID NO: 274051 - DNA, 25 bp, Mus musculus
atgttctactttatgggcctcgaag

SEQ ID NO: 274052 - DNA, 25 bp, Mus musculus
atgttctactttttgggcctcgaag

SEQ ID NO: 274053 - DNA, 25 bp, Mus musculus
atgttctagcatagagtacattgca

SEQ ID NO: 274054 - DNA, 25 bp, Mus musculus
atgttctagcattgagtacattgca

SEQ ID NO: 274055 - DNA, 25 bp, Mus musculus
atgttctaggcaccaagagcttcca

SEQ ID NO: 274056 - DNA, 25 bp, Mus musculus
atgttctaggcagcaagagcttcca

SEQ ID NO: 274057 - DNA, 25 bp, Mus musculus
atgttctagtttaatagctgctgct

SEQ ID NO: 274058 - DNA, 25 bp, Mus musculus
atgttctagttttatagctgctgct

SEQ ID NO: 274059 - DNA, 25 bp, Mus musculus
atgttctattgaaaccagtgtaaca

SEQ ID NO: 274060 - DNA, 25 bp, Mus musculus
atgttctattgataccagtgtaaca

SEQ ID NO: 274061 - DNA, 25 bp, Mus musculus
atgttctcaactccaagctattgtc

SEQ ID NO: 274062 - DNA, 25 bp, Mus musculus
atgttctcaactgcaagctattgtc

SEQ ID NO: 274063 - DNA, 25 bp, Mus musculus
atgttctcatttagatactgcacat

SEQ ID NO: 274064 - DNA, 25 bp, Mus musculus
atgttctcattttgatactgcacat

SEQ ID NO: 274065 - DNA, 25 bp, Mus musculus
atgttctccaacagtgagggatgta

SEQ ID NO: 274066 - DNA, 25 bp, Mus musculus
atgttctccaactgtgagggatgta

SEQ ID NO: 274067 - DNA, 25 bp, Mus musculus
atgttctccacaagccagtatctat

SEQ ID NO: 274068 - DNA, 25 bp, Mus musculus
atgttctccacatgccagtatctat

SEQ ID NO: 274069 - DNA, 25 bp, Mus musculus
atgttctccaccattggaagtggga

SEQ ID NO: 274070 - DNA, 25 bp, Mus musculus
atgttctccacctttggaagtggga

SEQ ID NO: 274071 - DNA, 25 bp, Mus musculus
atgttctccactatctgagccagat

SEQ ID NO: 274072 - DNA, 25 bp, Mus musculus
atgttctccactcaataggcacaca

SEQ ID NO: 274073 - DNA, 25 bp, Mus musculus
atgttctccactgaataggcacaca

SEQ ID NO: 274074 - DNA, 25 bp, Mus musculus
atgttctccactttctgagccagat

SEQ ID NO: 274075 - DNA, 25 bp, Mus musculus
atgttctccatgctacagtccggct

SEQ ID NO: 274076 - DNA, 25 bp, Mus musculus
atgttctccatggtacagtccggct

SEQ ID NO: 274077 - DNA, 25 bp, Mus musculus
atgttctcccatactgattgtatat

SEQ ID NO: 274078 - DNA, 25 bp, Mus musculus
atgttctcccattctgattgtatat

SEQ ID NO: 274079 - DNA, 25 bp, Mus musculus
atgttctccctcagtaaagtgtgtg

SEQ ID NO: 274080 - DNA, 25 bp, Mus musculus
atgttctccctctgtaaagtgtgtg

SEQ ID NO: 274081 - DNA, 25 bp, Mus musculus
atgttctcctgtagtggtgactaga

SEQ ID NO: 274082 - DNA, 25 bp, Mus musculus
atgttctcctgttgtggtgactaga

SEQ ID NO: 274083 - DNA, 25 bp, Mus musculus
atgttctccttcatgtaagtgcctg

SEQ ID NO: 274084 - DNA, 25 bp, Mus musculus
atgttctccttcttgtaagtgcctg

SEQ ID NO: 274085 - DNA, 25 bp, Mus musculus
atgttctcctttagagacaccttct

SEQ ID NO: 274086 - DNA, 25 bp, Mus musculus
atgttctccttttgagacaccttct

SEQ ID NO: 274087 - DNA, 25 bp, Mus musculus
atgttctcgagcatcagacttgagc

SEQ ID NO: 274088 - DNA, 25 bp, Mus musculus
atgttctcgagcttcagacttgagc

SEQ ID NO: 274089 - DNA, 25 bp, Mus musculus
atgttctcgcctattttgctcgaga

SEQ ID NO: 274090 - DNA, 25 bp, Mus musculus
atgttctcgccttttttgctcgaga

SEQ ID NO: 274091 - DNA, 25 bp, Mus musculus
atgttctctaacactgtgctaccac

SEQ ID NO: 274092 - DNA, 25 bp, Mus musculus
atgttctctaactctgtgctaccac

SEQ ID NO: 274093 - DNA, 25 bp, Mus musculus
atgttctctactctattatctgtta

SEQ ID NO: 274094 - DNA, 25 bp, Mus musculus
atgttctctactcttcatctttgcg

SEQ ID NO: 274095 - DNA, 25 bp, Mus musculus
atgttctctactgtattatctgtta

SEQ ID NO: 274096 - DNA, 25 bp, Mus musculus
atgttctctactgttcatctttgcg

SEQ ID NO: 274097 - DNA, 25 bp, Mus musculus
atgttctctctcattagtgacccag

SEQ ID NO: 274098 - DNA, 25 bp, Mus musculus
atgttctctctctttagtgacccag

SEQ ID NO: 274099 - DNA, 25 bp, Mus musculus
atgttctctcttataggcgtgtgaa

SEQ ID NO: 274100 - DNA, 25 bp, Mus musculus
atgttctctcttttaggcgtgtgaa

SEQ ID NO: 274101 - DNA, 25 bp, Mus musculus
atgttctctgaaaacaatctgtgtg

SEQ ID NO: 274102 - DNA, 25 bp, Mus musculus
atgttctctgaatacaatctgtgtg

SEQ ID NO: 274103 - DNA, 25 bp, Mus musculus
atgttctctgtgctctgcgaatcag

SEQ ID NO: 274104 - DNA, 25 bp, Mus musculus
atgttctctgtggtctgcgaatcag

SEQ ID NO: 274105 - DNA, 25 bp, Mus musculus
atgttctctgttaaggcccaagaag

SEQ ID NO: 274106 - DNA, 25 bp, Mus musculus
atgttctctgtttaggcccaagaag

SEQ ID NO: 274107 - DNA, 25 bp, Mus musculus
atgttctcttgtatccacgttttag

SEQ ID NO: 274108 - DNA, 25 bp, Mus musculus
atgttctcttgtttccacgttttag

SEQ ID NO: 274109 - DNA, 25 bp, Mus musculus
atgttctgagaaatcttgtgttgta

SEQ ID NO: 274110 - DNA, 25 bp, Mus musculus
atgttctgagaattcttgtgttgta

SEQ ID NO: 274111 - DNA, 25 bp, Mus musculus
atgttctgatgaatctgttccattt

SEQ ID NO: 274112 - DNA, 25 bp, Mus musculus
atgttctgatgattctgttccattt

SEQ ID NO: 274113 - DNA, 25 bp, Mus musculus
atgttctgatttactgctaatagcc

SEQ ID NO: 274114 - DNA, 25 bp, Mus musculus
atgttctgattttctgctaatagcc

SEQ ID NO: 274115 - DNA, 25 bp, Mus musculus
atgttctgcctcattggactagcca

SEQ ID NO: 274116 - DNA, 25 bp, Mus musculus
atgttctgcctctttggactagcca

SEQ ID NO: 274117 - DNA, 25 bp, Mus musculus
atgttctggcatcttccctgaagga

SEQ ID NO: 274118 - DNA, 25 bp, Mus musculus
atgttctggcatgttccctgaagga

SEQ ID NO: 274119 - DNA, 25 bp, Mus musculus
atgttctggctcacatcgtgatcgc

SEQ ID NO: 274120 - DNA, 25 bp, Mus musculus
atgttctggctctcatcgtgatcgc

SEQ ID NO: 274121 - DNA, 25 bp, Mus musculus
atgttctgtagaaagtctgtactta

SEQ ID NO: 274122 - DNA, 25 bp, Mus musculus
atgttctgtagatagtctgtactta

SEQ ID NO: 274123 - DNA, 25 bp, Mus musculus
atgttctgtatgagcttcttccgca

SEQ ID NO: 274124 - DNA, 25 bp, Mus musculus
atgttctgtatgtgcttcttccgca

SEQ ID NO: 274125 - DNA, 25 bp, Mus musculus
atgttcttaaccatcccacagaaac

SEQ ID NO: 274126 - DNA, 25 bp, Mus musculus
atgttcttaaccttcccacagaaac

SEQ ID NO: 274127 - DNA, 25 bp, Mus musculus
atgttcttaatgaggtcagcgccag

SEQ ID NO: 274128 - DNA, 25 bp, Mus musculus
atgttcttaatgtggtcagcgccag

SEQ ID NO: 274129 - DNA, 25 bp, Mus musculus
atgttcttacctactcagcttatat

SEQ ID NO: 274130 - DNA, 25 bp, Mus musculus
atgttcttaccttctcagcttatat

SEQ ID NO: 274131 - DNA, 25 bp, Mus musculus
atgttcttagcaccacagtgtctgg

SEQ ID NO: 274132 - DNA, 25 bp, Mus musculus
atgttcttagcagcacagtgtctgg

SEQ ID NO: 274133 - DNA, 25 bp, Mus musculus
atgttcttcaaaacaatctctcaga

SEQ ID NO: 274134 - DNA, 25 bp, Mus musculus
atgttcttcaaatcaatctctcaga

SEQ ID NO: 274135 - DNA, 25 bp, Mus musculus
atgttcttcagcaacacacattctc

SEQ ID NO: 274136 - DNA, 25 bp, Mus musculus
atgttcttcagctacacacattctc

SEQ ID NO: 274137 - DNA, 25 bp, Mus musculus
atgttcttcagtaccgcactggtgc

SEQ ID NO: 274138 - DNA, 25 bp, Mus musculus
atgttcttcagtccatgaccgtgag

SEQ ID NO: 274139 - DNA, 25 bp, Mus musculus
atgttcttcagtctcaggcccggga

SEQ ID NO: 274140 - DNA, 25 bp, Mus musculus
atgttcttcagtgcatgaccgtgag

SEQ ID NO: 274141 - DNA, 25 bp, Mus musculus
atgttcttcagtgtcaggcccggga

SEQ ID NO: 274142 - DNA, 25 bp, Mus musculus
atgttcttcagttccgcactggtgc

SEQ ID NO: 274143 - DNA, 25 bp, Mus musculus
atgttcttcattcgcttcactgcgc

SEQ ID NO: 274144 - DNA, 25 bp, Mus musculus
atgttcttcattggcttcactgcgc

SEQ ID NO: 274145 - DNA, 25 bp, Mus musculus
atgttcttccaaaaccatttctgcc

SEQ ID NO: 274146 - DNA, 25 bp, Mus musculus
atgttcttccaataccatttctgcc

SEQ ID NO: 274147 - DNA, 25 bp, Mus musculus
atgttcttccctctcttaggtgtac

SEQ ID NO: 274148 - DNA, 25 bp, Mus musculus
atgttcttccctgtcttaggtgtac

SEQ ID NO: 274149 - DNA, 25 bp, Mus musculus
atgttcttccgtactgctgtttcat

SEQ ID NO: 274150 - DNA, 25 bp, Mus musculus
atgttcttccgttctgctgtttcat

SEQ ID NO: 274151 - DNA, 25 bp, Mus musculus
atgttcttcctcaggctgttggtag

SEQ ID NO: 274152 - DNA, 25 bp, Mus musculus
atgttcttcctctggctgttggtag

SEQ ID NO: 274153 - DNA, 25 bp, Mus musculus
atgttcttcgcccaccaggtggaca

SEQ ID NO: 274154 - DNA, 25 bp, Mus musculus
atgttcttcgccgaccaggtggaca

SEQ ID NO: 274155 - DNA, 25 bp, Mus musculus
atgttcttctacagcttcatcttca

SEQ ID NO: 274156 - DNA, 25 bp, Mus musculus
atgttcttctactgcttcatcttca

SEQ ID NO: 274157 - DNA, 25 bp, Mus musculus
atgttcttgctaagccatgtaggcc

SEQ ID NO: 274158 - DNA, 25 bp, Mus musculus
atgttcttgctatgccatgtaggcc

SEQ ID NO: 274159 - DNA, 25 bp, Mus musculus
atgttcttggagcttacgcccctgt

SEQ ID NO: 274160 - DNA, 25 bp, Mus musculus
atgttcttggaggttacgcccctgt

SEQ ID NO: 274161 - DNA, 25 bp, Mus musculus
atgttcttgggcaaatggagcaaca

SEQ ID NO: 274162 - DNA, 25 bp, Mus musculus
atgttcttgggcagtcttctaattc

SEQ ID NO: 274163 - DNA, 25 bp, Mus musculus
atgttcttgggctaatggagcaaca

SEQ ID NO: 274164 - DNA, 25 bp, Mus musculus
atgttcttgggctgtcttctaattc

SEQ ID NO: 274165 - DNA, 25 bp, Mus musculus
atgttcttgtcaatgcagcatcatc

SEQ ID NO: 274166 - DNA, 25 bp, Mus musculus
atgttcttgtcattgcagcatcatc

SEQ ID NO: 274167 - DNA, 25 bp, Mus musculus
atgttctttcatctttttggctctg

SEQ ID NO: 274168 - DNA, 25 bp, Mus musculus
atgttctttcatgtttttggctctg

SEQ ID NO: 274169 - DNA, 25 bp, Mus musculus
atgttctttcctcctgaggtcagtg

SEQ ID NO: 274170 - DNA, 25 bp, Mus musculus
atgttctttcctgctgaggtcagtg

SEQ ID NO: 274171 - DNA, 25 bp, Mus musculus
atgttctttgctccaacaccatgtt

SEQ ID NO: 274172 - DNA, 25 bp, Mus musculus
atgttctttgctgcaacaccatgtt

SEQ ID NO: 274173 - DNA, 25 bp, Mus musculus
atgttctttgttctctgtatagttg

SEQ ID NO: 274174 - DNA, 25 bp, Mus musculus
atgttctttgttgtctgtatagttg

SEQ ID NO: 274175 - DNA, 25 bp, Mus musculus
atgttcttttaacctggcacccgag

SEQ ID NO: 274176 - DNA, 25 bp, Mus musculus
atgttcttttaagctggcacccgag

SEQ ID NO: 274177 - DNA, 25 bp, Mus musculus
atgttcttttggagactgcagtgat

SEQ ID NO: 274178 - DNA, 25 bp, Mus musculus
atgttcttttggtgactgcagtgat

SEQ ID NO: 274179 - DNA, 25 bp, Mus musculus
atgttgaaacacatctgcattttta

SEQ ID NO: 274180 - DNA, 25 bp, Mus musculus
atgttgaaacacctttgccttttgg

SEQ ID NO: 274181 - DNA, 25 bp, Mus musculus
atgttgaaacacgtttgccttttgg

SEQ ID NO: 274182 - DNA, 25 bp, Mus musculus
atgttgaaacacttctgcattttta

SEQ ID NO: 274183 - DNA, 25 bp, Mus musculus
atgttgaaagtcagaggctccctct

SEQ ID NO: 274184 - DNA, 25 bp, Mus musculus
atgttgaaagtctgaggctccctct

SEQ ID NO: 274185 - DNA, 25 bp, Mus musculus
atgttgaaccacactgtctcctacc

SEQ ID NO: 274186 - DNA, 25 bp, Mus musculus
atgttgaaccactctgtctcctacc

SEQ ID NO: 274187 - DNA, 25 bp, Mus musculus
atgttgaaccatattatactattgc

SEQ ID NO: 274188 - DNA, 25 bp, Mus musculus
atgttgaaccattttatactattgc

SEQ ID NO: 274189 - DNA, 25 bp, Mus musculus
atgttgaagcaaactcactttccct

SEQ ID NO: 274190 - DNA, 25 bp, Mus musculus
atgttgaagcaaattttcccagagg

SEQ ID NO: 274191 - DNA, 25 bp, Mus musculus
atgttgaagcaatctcactttccct

SEQ ID NO: 274192 - DNA, 25 bp, Mus musculus
atgttgaagcaatttttcccagagg

SEQ ID NO: 274193 - DNA, 25 bp, Mus musculus
atgttgaagctcatggcccctgaag

SEQ ID NO: 274194 - DNA, 25 bp, Mus musculus
atgttgaagctcttggcccctgaag

SEQ ID NO: 274195 - DNA, 25 bp, Mus musculus
atgttgaagctgaacccttacgcca

SEQ ID NO: 274196 - DNA, 25 bp, Mus musculus
atgttgaagctgtacccttacgcca

SEQ ID NO: 274197 - DNA, 25 bp, Mus musculus
atgttgaataacactcttgagtcat

SEQ ID NO: 274198 - DNA, 25 bp, Mus musculus
atgttgaataactctcttgagtcat

SEQ ID NO: 274199 - DNA, 25 bp, Mus musculus
atgttgaatgtcatccttggtgcca

SEQ ID NO: 274200 - DNA, 25 bp, Mus musculus
atgttgaatgtcttccttggtgcca

SEQ ID NO: 274201 - DNA, 25 bp, Mus musculus
atgttgaattatatttggagctgaa

SEQ ID NO: 274202 - DNA, 25 bp, Mus musculus
atgttgaattatttttggagctgaa

SEQ ID NO: 274203 - DNA, 25 bp, Mus musculus
atgttgaattgaagtgtccagccac

SEQ ID NO: 274204 - DNA, 25 bp, Mus musculus
atgttgaattgatgtgtccagccac

SEQ ID NO: 274205 - DNA, 25 bp, Mus musculus
atgttgacaccaatccgaagttcat

SEQ ID NO: 274206 - DNA, 25 bp, Mus musculus
atgttgacaccattccgaagttcat

SEQ ID NO: 274207 - DNA, 25 bp, Mus musculus
atgttgacagtaataactcccaaaa

SEQ ID NO: 274208 - DNA, 25 bp, Mus musculus
atgttgacagtattaactcccaaaa

SEQ ID NO: 274209 - DNA, 25 bp, Mus musculus
atgttgacagtcctcgctttaagcc

SEQ ID NO: 274210 - DNA, 25 bp, Mus musculus
atgttgacagtcgtcgctttaagcc

SEQ ID NO: 274211 - DNA, 25 bp, Mus musculus
atgttgacatgtctcaggttcctgt

SEQ ID NO: 274212 - DNA, 25 bp, Mus musculus
atgttgacatgtgtcaggttcctgt

SEQ ID NO: 274213 - DNA, 25 bp, Mus musculus
atgttgaccaccctgtagtccttaa

SEQ ID NO: 274214 - DNA, 25 bp, Mus musculus
atgttgaccaccgtgtagtccttaa

SEQ ID NO: 274215 - DNA, 25 bp, Mus musculus
atgttgaccaggatgtcctcgaact

SEQ ID NO: 274216 - DNA, 25 bp, Mus musculus
atgttgaccaggttgtcctcgaact

SEQ ID NO: 274217 - DNA, 25 bp, Mus musculus
atgttgaccattaccccaatttact

SEQ ID NO: 274218 - DNA, 25 bp, Mus musculus
atgttgaccatttccccaatttact

SEQ ID NO: 274219 - DNA, 25 bp, Mus musculus
atgttgacgacaacaccagctttgg

SEQ ID NO: 274220 - DNA, 25 bp, Mus musculus
atgttgacgacatcaccagctttgg

SEQ ID NO: 274221 - DNA, 25 bp, Mus musculus
atgttgacggctatgtgattgattc

SEQ ID NO: 274222 - DNA, 25 bp, Mus musculus
atgttgacggctttgtgattgattc

SEQ ID NO: 274223 - DNA, 25 bp, Mus musculus
atgttgactaggaactgcctggaat

SEQ ID NO: 274224 - DNA, 25 bp, Mus musculus
atgttgactaggtactgcctggaat

SEQ ID NO: 274225 - DNA, 25 bp, Mus musculus
atgttgactccgcaggttttagaat

SEQ ID NO: 274226 - DNA, 25 bp, Mus musculus
atgttgactccggaggttttagaat

SEQ ID NO: 274227 - DNA, 25 bp, Mus musculus
atgttgactctgcattaccatctcc

SEQ ID NO: 274228 - DNA, 25 bp, Mus musculus
atgttgactctggattaccatctcc

SEQ ID NO: 274229 - DNA, 25 bp, Mus musculus
atgttgactgtaaggcttcattgca

SEQ ID NO: 274230 - DNA, 25 bp, Mus musculus
atgttgactgtatggcttcattgca

SEQ ID NO: 274231 - DNA, 25 bp, Mus musculus
atgttgacttggattccagactcct

SEQ ID NO: 274232 - DNA, 25 bp, Mus musculus
atgttgacttggtttccagactcct

SEQ ID NO: 274233 - DNA, 25 bp, Mus musculus
atgttgagacggcaacagcgcccct

SEQ ID NO: 274234 - DNA, 25 bp, Mus musculus
atgttgagacgggaacagcgcccct

SEQ ID NO: 274235 - DNA, 25 bp, Mus musculus
atgttgagactgatacatcctttaa

SEQ ID NO: 274236 - DNA, 25 bp, Mus musculus
atgttgagactgttacatcctttaa

SEQ ID NO: 274237 - DNA, 25 bp, Mus musculus
atgttgagaggtccatcctgcccat

SEQ ID NO: 274238 - DNA, 25 bp, Mus musculus
atgttgagaggtgcatcctgcccat

SEQ ID NO: 274239 - DNA, 25 bp, Mus musculus
atgttgagcaaacccgcgtctgtgg

SEQ ID NO: 274240 - DNA, 25 bp, Mus musculus
atgttgagcaaagccgcgtctgtgg

SEQ ID NO: 274241 - DNA, 25 bp, Mus musculus
atgttgagccacagttgtcatgcca

SEQ ID NO: 274242 - DNA, 25 bp, Mus musculus
atgttgagccactgttgtcatgcca

SEQ ID NO: 274243 - DNA, 25 bp, Mus musculus
atgttgaggactccattaagttatc

SEQ ID NO: 274244 - DNA, 25 bp, Mus musculus
atgttgaggactgcattaagttatc

SEQ ID NO: 274245 - DNA, 25 bp, Mus musculus
atgttgaggagaactggccacctgt

SEQ ID NO: 274246 - DNA, 25 bp, Mus musculus
atgttgaggagatctggccacctgt

SEQ ID NO: 274247 - DNA, 25 bp, Mus musculus
atgttgaggctgaatctgttctgta

SEQ ID NO: 274248 - DNA, 25 bp, Mus musculus
atgttgaggctgtatctgttctgta

SEQ ID NO: 274249 - DNA, 25 bp, Mus musculus
atgttgataccactgcctttactca

SEQ ID NO: 274250 - DNA, 25 bp, Mus musculus
atgttgataccagtgcctttactca

SEQ ID NO: 274251 - DNA, 25 bp, Mus musculus
atgttgatcagcaccctcatgtgta

SEQ ID NO: 274252 - DNA, 25 bp, Mus musculus
atgttgatcagctccctcatgtgta

SEQ ID NO: 274253 - DNA, 25 bp, Mus musculus
atgttgatcccaccagtgtgtgtct

SEQ ID NO: 274254 - DNA, 25 bp, Mus musculus
atgttgatcccagcagtgtgtgtct

SEQ ID NO: 274255 - DNA, 25 bp, Mus musculus
atgttgatcgtgaggtgatttgtcg

SEQ ID NO: 274256 - DNA, 25 bp, Mus musculus
atgttgatcgtgtggtgatttgtcg

SEQ ID NO: 274257 - DNA, 25 bp, Mus musculus
atgttgatgcctacagtctgatgga

SEQ ID NO: 274258 - DNA, 25 bp, Mus musculus
atgttgatgccttcagtctgatgga

SEQ ID NO: 274259 - DNA, 25 bp, Mus musculus
atgttgatgtggaatcttactttca

SEQ ID NO: 274260 - DNA, 25 bp, Mus musculus
atgttgatgtggtatcttactttca

SEQ ID NO: 274261 - DNA, 25 bp, Mus musculus
atgttgattattccccaggcagtgg

SEQ ID NO: 274262 - DNA, 25 bp, Mus musculus
atgttgattattgcccaggcagtgg

SEQ ID NO: 274263 - DNA, 25 bp, Mus musculus
atgttgattcttcagcatctgtggt

SEQ ID NO: 274264 - DNA, 25 bp, Mus musculus
atgttgattcttgagcatctgtggt

SEQ ID NO: 274265 - DNA, 25 bp, Mus musculus
atgttgattggcaaacacagagctc

SEQ ID NO: 274266 - DNA, 25 bp, Mus musculus
atgttgattggctaacacagagctc

SEQ ID NO: 274267 - DNA, 25 bp, Mus musculus
atgttgattttcatcttagcctgct

SEQ ID NO: 274268 - DNA, 25 bp, Mus musculus
atgttgattttcttcttagcctgct

SEQ ID NO: 274269 - DNA, 25 bp, Mus musculus
atgttgcaaactcatctttgtttta

SEQ ID NO: 274270 - DNA, 25 bp, Mus musculus
atgttgcaaactgatctttgtttta

SEQ ID NO: 274271 - DNA, 25 bp, Mus musculus
atgttgcaagcaccccttaagacag

SEQ ID NO: 274272 - DNA, 25 bp, Mus musculus
atgttgcaagcagcccttaagacag

SEQ ID NO: 274273 - DNA, 25 bp, Mus musculus
atgttgcaagtgaggaccgctctga

SEQ ID NO: 274274 - DNA, 25 bp, Mus musculus
atgttgcaagtgtggaccgctctga

SEQ ID NO: 274275 - DNA, 25 bp, Mus musculus
atgttgcacacgctgggttcctgat

SEQ ID NO: 274276 - DNA, 25 bp, Mus musculus
atgttgcacacggtgggttcctgat

SEQ ID NO: 274277 - DNA, 25 bp, Mus musculus
atgttgcaccaacggcagcttggtt

SEQ ID NO: 274278 - DNA, 25 bp, Mus musculus
atgttgcaccaagggcagcttggtt

SEQ ID NO: 274279 - DNA, 25 bp, Mus musculus
atgttgcacccaatcactgtatgac

SEQ ID NO: 274280 - DNA, 25 bp, Mus musculus
atgttgcacccattcactgtatgac

SEQ ID NO: 274281 - DNA, 25 bp, Mus musculus
atgttgcacctgatgtaagtgatca

SEQ ID NO: 274282 - DNA, 25 bp, Mus musculus
atgttgcacctgttgtaagtgatca

SEQ ID NO: 274283 - DNA, 25 bp, Mus musculus
atgttgcacttaccagccatgtggt

SEQ ID NO: 274284 - DNA, 25 bp, Mus musculus
atgttgcacttagcagccatgtggt

SEQ ID NO: 274285 - DNA, 25 bp, Mus musculus
atgttgcagaatctaagccaccaaa

SEQ ID NO: 274286 - DNA, 25 bp, Mus musculus
atgttgcagaatctagacctccaag

SEQ ID NO: 274287 - DNA, 25 bp, Mus musculus
atgttgcagaatgtaagccaccaaa

SEQ ID NO: 274288 - DNA, 25 bp, Mus musculus
atgttgcagaatgtagacctccaag

SEQ ID NO: 274289 - DNA, 25 bp, Mus musculus
atgttgcagaccagtaatcctggcc

SEQ ID NO: 274290 - DNA, 25 bp, Mus musculus
atgttgcagacctgtaatcctggcc

SEQ ID NO: 274291 - DNA, 25 bp, Mus musculus
atgttgcagagtcgttgtccaatcc

SEQ ID NO: 274292 - DNA, 25 bp, Mus musculus
atgttgcagagtggttgtccaatcc

SEQ ID NO: 274293 - DNA, 25 bp, Mus musculus
atgttgcagcttcaggtcaccacca

SEQ ID NO: 274294 - DNA, 25 bp, Mus musculus
atgttgcagcttgaggtcaccacca

SEQ ID NO: 274295 - DNA, 25 bp, Mus musculus
atgttgcatgagaacatgttcacgc

SEQ ID NO: 274296 - DNA, 25 bp, Mus musculus
atgttgcatgagtacatgttcacgc

SEQ ID NO: 274297 - DNA, 25 bp, Mus musculus
atgttgcatgcacaaacattatttt

SEQ ID NO: 274298 - DNA, 25 bp, Mus musculus
atgttgcatgcagaaacattatttt

SEQ ID NO: 274299 - DNA, 25 bp, Mus musculus
atgttgcattggacttcatctctgt

SEQ ID NO: 274300 - DNA, 25 bp, Mus musculus
atgttgcattggtcttcatctctgt

SEQ ID NO: 274301 - DNA, 25 bp, Mus musculus
atgttgcattttctgtgaccgtcca

SEQ ID NO: 274302 - DNA, 25 bp, Mus musculus
atgttgcattttgtgtgaccgtcca

SEQ ID NO: 274303 - DNA, 25 bp, Mus musculus
atgttgccacatactccaataaagg

SEQ ID NO: 274304 - DNA, 25 bp, Mus musculus
atgttgccacattctccaataaagg

SEQ ID NO: 274305 - DNA, 25 bp, Mus musculus
atgttgccctctagatattattctg

SEQ ID NO: 274306 - DNA, 25 bp, Mus musculus
atgttgccctcttgatattattctg

SEQ ID NO: 274307 - DNA, 25 bp, Mus musculus
atgttgcctacacctatgagttaag

SEQ ID NO: 274308 - DNA, 25 bp, Mus musculus
atgttgcctacagctatgagttaag

SEQ ID NO: 274309 - DNA, 25 bp, Mus musculus
atgttgcctagtatttaagccttga

SEQ ID NO: 274310 - DNA, 25 bp, Mus musculus
atgttgcctagtttttaagccttga

SEQ ID NO: 274311 - DNA, 25 bp, Mus musculus
atgttgcctctcaaaaatgctgcct

SEQ ID NO: 274312 - DNA, 25 bp, Mus musculus
atgttgcctctctaaaatgctgcct

SEQ ID NO: 274313 - DNA, 25 bp, Mus musculus
atgttgcctgaacctatggtcttta

SEQ ID NO: 274314 - DNA, 25 bp, Mus musculus
atgttgcctgaagctatggtcttta

SEQ ID NO: 274315 - DNA, 25 bp, Mus musculus
atgttgcctgcaagaatgtatatgt

SEQ ID NO: 274316 - DNA, 25 bp, Mus musculus
atgttgcctgcacttgagcaaggaa

SEQ ID NO: 274317 - DNA, 25 bp, Mus musculus
atgttgcctgcagttgagcaaggaa

SEQ ID NO: 274318 - DNA, 25 bp, Mus musculus
atgttgcctgcatgaatgtatatgt

SEQ ID NO: 274319 - DNA, 25 bp, Mus musculus
atgttgccttatcagggagcctcta

SEQ ID NO: 274320 - DNA, 25 bp, Mus musculus
atgttgccttatgagggagcctcta

SEQ ID NO: 274321 - DNA, 25 bp, Mus musculus
atgttgccttccagtgagttccaaa

SEQ ID NO: 274322 - DNA, 25 bp, Mus musculus
atgttgccttcctgtgagttccaaa

SEQ ID NO: 274323 - DNA, 25 bp, Mus musculus
atgttgccttggaaacttcccgctg

SEQ ID NO: 274324 - DNA, 25 bp, Mus musculus
atgttgccttggtaacttcccgctg

SEQ ID NO: 274325 - DNA, 25 bp, Mus musculus
atgttgccttgtattatgtgaccta

SEQ ID NO: 274326 - DNA, 25 bp, Mus musculus
atgttgccttgttttatgtgaccta

SEQ ID NO: 274327 - DNA, 25 bp, Mus musculus
atgttgcctttgacatgtgcagaac

SEQ ID NO: 274328 - DNA, 25 bp, Mus musculus
atgttgcctttgtcatgtgcagaac

SEQ ID NO: 274329 - DNA, 25 bp, Mus musculus
atgttgccttttctgtatctcttat

SEQ ID NO: 274330 - DNA, 25 bp, Mus musculus
atgttgccttttgtgtatctcttat

SEQ ID NO: 274331 - DNA, 25 bp, Mus musculus
atgttgctaacccactaagtccagt

SEQ ID NO: 274332 - DNA, 25 bp, Mus musculus
atgttgctaaccgactaagtccagt

SEQ ID NO: 274333 - DNA, 25 bp, Mus musculus
atgttgctaaggagcagctacccct

SEQ ID NO: 274334 - DNA, 25 bp, Mus musculus
atgttgctaaggtgcagctacccct

SEQ ID NO: 274335 - DNA, 25 bp, Mus musculus
atgttgctacttcgcaaggtcgatt

SEQ ID NO: 274336 - DNA, 25 bp, Mus musculus
atgttgctacttggcaaggtcgatt

SEQ ID NO: 274337 - DNA, 25 bp, Mus musculus
atgttgctagaaattaggctgttga

SEQ ID NO: 274338 - DNA, 25 bp, Mus musculus
atgttgctagaatttaggctgttga

SEQ ID NO: 274339 - DNA, 25 bp, Mus musculus
atgttgctattgacatctattagag

SEQ ID NO: 274340 - DNA, 25 bp, Mus musculus
atgttgctattgtcatctattagag

SEQ ID NO: 274341 - DNA, 25 bp, Mus musculus
atgttgctcacaatgtacttacaat

SEQ ID NO: 274342 - DNA, 25 bp, Mus musculus
atgttgctcacattgtacttacaat

SEQ ID NO: 274343 - DNA, 25 bp, Mus musculus
atgttgctccacagtataagacaag

SEQ ID NO: 274344 - DNA, 25 bp, Mus musculus
atgttgctccactgtataagacaag

SEQ ID NO: 274345 - DNA, 25 bp, Mus musculus
atgttgctcctgctcaagttggcga

SEQ ID NO: 274346 - DNA, 25 bp, Mus musculus
atgttgctcctggtcaagttggcga

SEQ ID NO: 274347 - DNA, 25 bp, Mus musculus
atgttgctcggcagatactcgtttc

SEQ ID NO: 274348 - DNA, 25 bp, Mus musculus
atgttgctcggctgatactcgtttc

SEQ ID NO: 274349 - DNA, 25 bp, Mus musculus
atgttgctgatcaaaggtctatttt

SEQ ID NO: 274350 - DNA, 25 bp, Mus musculus
atgttgctgatctaaggtctatttt

SEQ ID NO: 274351 - DNA, 25 bp, Mus musculus
atgttgctgccaagtgtcctgtgtt

SEQ ID NO: 274352 - DNA, 25 bp, Mus musculus
atgttgctgccatgtgtcctgtgtt

SEQ ID NO: 274353 - DNA, 25 bp, Mus musculus
atgttgctgcttccttctcagtctt

SEQ ID NO: 274354 - DNA, 25 bp, Mus musculus
atgttgctgcttgcttctcagtctt

SEQ ID NO: 274355 - DNA, 25 bp, Mus musculus
atgttgctggatatgctgccttcag

SEQ ID NO: 274356 - DNA, 25 bp, Mus musculus
atgttgctggatttgctgccttcag

SEQ ID NO: 274357 - DNA, 25 bp, Mus musculus
atgttgctggttccatttctagcta

SEQ ID NO: 274358 - DNA, 25 bp, Mus musculus
atgttgctggttgcatttctagcta

SEQ ID NO: 274359 - DNA, 25 bp, Mus musculus
atgttgctgttaccaagacaccctt

SEQ ID NO: 274360 - DNA, 25 bp, Mus musculus
atgttgctgttagcaagacaccctt

SEQ ID NO: 274361 - DNA, 25 bp, Mus musculus
atgttgctgtttatagtctggcccg

SEQ ID NO: 274362 - DNA, 25 bp, Mus musculus
atgttgctgtttttagtctggcccg

SEQ ID NO: 274363 - DNA, 25 bp, Mus musculus
atgttgcttactaccaggccaggct

SEQ ID NO: 274364 - DNA, 25 bp, Mus musculus
atgttgcttacttccaggccaggct

SEQ ID NO: 274365 - DNA, 25 bp, Mus musculus
atgttgcttatcatccaaactttag

SEQ ID NO: 274366 - DNA, 25 bp, Mus musculus
atgttgcttatcttccaaactttag

SEQ ID NO: 274367 - DNA, 25 bp, Mus musculus
atgttgcttatgaccctatctgtga

SEQ ID NO: 274368 - DNA, 25 bp, Mus musculus
atgttgcttatgtccctatctgtga

SEQ ID NO: 274369 - DNA, 25 bp, Mus musculus
atgttgcttattcttcctgtctgac

SEQ ID NO: 274370 - DNA, 25 bp, Mus musculus
atgttgcttattgttcctgtctgac

SEQ ID NO: 274371 - DNA, 25 bp, Mus musculus
atgttgcttgcccttttctataaat

SEQ ID NO: 274372 - DNA, 25 bp, Mus musculus
atgttgcttgccgttttctataaat

SEQ ID NO: 274373 - DNA, 25 bp, Mus musculus
atgttgcttgttcctttctcagtgt

SEQ ID NO: 274374 - DNA, 25 bp, Mus musculus
atgttgcttgttgctttctcagtgt

SEQ ID NO: 274375 - DNA, 25 bp, Mus musculus
atgttgctttttctcattctctcca

SEQ ID NO: 274376 - DNA, 25 bp, Mus musculus
atgttgctttttgtcattctctcca

SEQ ID NO: 274377 - DNA, 25 bp, Mus musculus
atgttggaacagctaatgctccgta

SEQ ID NO: 274378 - DNA, 25 bp, Mus musculus
atgttggaacaggtaatgctccgta

SEQ ID NO: 274379 - DNA, 25 bp, Mus musculus
atgttggaacttcaccacctgcttg

SEQ ID NO: 274380 - DNA, 25 bp, Mus musculus
atgttggaacttgaccacctgcttg

SEQ ID NO: 274381 - DNA, 25 bp, Mus musculus
atgttggagcagaatgacaagctac

SEQ ID NO: 274382 - DNA, 25 bp, Mus musculus
atgttggagcagtatgacaagctac

SEQ ID NO: 274383 - DNA, 25 bp, Mus musculus
atgttggagcgcatttgccggagcc

SEQ ID NO: 274384 - DNA, 25 bp, Mus musculus
atgttggagcgcttttgccggagcc

SEQ ID NO: 274385 - DNA, 25 bp, Mus musculus
atgttggataccagcatctagcttc

SEQ ID NO: 274386 - DNA, 25 bp, Mus musculus
atgttggatacctgcatctagcttc

SEQ ID NO: 274387 - DNA, 25 bp, Mus musculus
atgttggatataactggcagctcta

SEQ ID NO: 274388 - DNA, 25 bp, Mus musculus
atgttggatatatctggcagctcta

SEQ ID NO: 274389 - DNA, 25 bp, Mus musculus
atgttggatgccagttgcagcagcc

SEQ ID NO: 274390 - DNA, 25 bp, Mus musculus
atgttggatgcctgttgcagcagcc

SEQ ID NO: 274391 - DNA, 25 bp, Mus musculus
atgttggcaatcagtgaggtgtgtc

SEQ ID NO: 274392 - DNA, 25 bp, Mus musculus
atgttggcaatctgtgaggtgtgtc

SEQ ID NO: 274393 - DNA, 25 bp, Mus musculus
atgttggcagacaccatctgagctt

SEQ ID NO: 274394 - DNA, 25 bp, Mus musculus
atgttggcagactccatctgagctt

SEQ ID NO: 274395 - DNA, 25 bp, Mus musculus
atgttggccaagcttgtcctgaatt

SEQ ID NO: 274396 - DNA, 25 bp, Mus musculus
atgttggccaaggttgtcctgaatt

SEQ ID NO: 274397 - DNA, 25 bp, Mus musculus
atgttggctattcgcctgctggatg

SEQ ID NO: 274398 - DNA, 25 bp, Mus musculus
atgttggctattggcctgctggatg

SEQ ID NO: 274399 - DNA, 25 bp, Mus musculus
atgttggctgctataacttctggat

SEQ ID NO: 274400 - DNA, 25 bp, Mus musculus
atgttggctgctttaacttctggat

SEQ ID NO: 274401 - DNA, 25 bp, Mus musculus
atgttggctgttaaaatctttgtta

SEQ ID NO: 274402 - DNA, 25 bp, Mus musculus
atgttggctgtttaaatctttgtta

SEQ ID NO: 274403 - DNA, 25 bp, Mus musculus
atgttggcttcccatggaaccttgt

SEQ ID NO: 274404 - DNA, 25 bp, Mus musculus
atgttggcttccgatggaaccttgt

SEQ ID NO: 274405 - DNA, 25 bp, Mus musculus
atgttgggaggtaactggctacaga

SEQ ID NO: 274406 - DNA, 25 bp, Mus musculus
atgttgggaggttactggctacaga

SEQ ID NO: 274407 - DNA, 25 bp, Mus musculus
atgttgggatttcgtttatattagc

SEQ ID NO: 274408 - DNA, 25 bp, Mus musculus
atgttgggatttggtttatattagc

SEQ ID NO: 274409 - DNA, 25 bp, Mus musculus
atgttgggcattagccacagggata

SEQ ID NO: 274410 - DNA, 25 bp, Mus musculus
atgttgggcattattgtatcatcaa

SEQ ID NO: 274411 - DNA, 25 bp, Mus musculus
atgttgggcatttgccacagggata

SEQ ID NO: 274412 - DNA, 25 bp, Mus musculus
atgttgggcatttttgtatcatcaa

SEQ ID NO: 274413 - DNA, 25 bp, Mus musculus
atgttgggtctcaaccaccgagagg

SEQ ID NO: 274414 - DNA, 25 bp, Mus musculus
atgttgggtctctaccaccgagagg

SEQ ID NO: 274415 - DNA, 25 bp, Mus musculus
atgttgggtgaacggctgtttcctc

SEQ ID NO: 274416 - DNA, 25 bp, Mus musculus
atgttgggtgaagggctgtttcctc

SEQ ID NO: 274417 - DNA, 25 bp, Mus musculus
atgttgggtggcactcaactgcctg

SEQ ID NO: 274418 - DNA, 25 bp, Mus musculus
atgttgggtggctctcaactgcctg

SEQ ID NO: 274419 - DNA, 25 bp, Mus musculus
atgttggtcaccagcctggtggccc

SEQ ID NO: 274420 - DNA, 25 bp, Mus musculus
atgttggtcaccaggtgcctttcaa

SEQ ID NO: 274421 - DNA, 25 bp, Mus musculus
atgttggtcacctgcctggtggccc

SEQ ID NO: 274422 - DNA, 25 bp, Mus musculus
atgttggtcacctggtgcctttcaa

SEQ ID NO: 274423 - DNA, 25 bp, Mus musculus
atgttggtcagcacaggagcctctc

SEQ ID NO: 274424 - DNA, 25 bp, Mus musculus
atgttggtcagctcaggagcctctc

SEQ ID NO: 274425 - DNA, 25 bp, Mus musculus
atgttggtccacacacagccttcca

SEQ ID NO: 274426 - DNA, 25 bp, Mus musculus
atgttggtccactcacagccttcca

SEQ ID NO: 274427 - DNA, 25 bp, Mus musculus
atgttggtccatcgtgtcgtttcca

SEQ ID NO: 274428 - DNA, 25 bp, Mus musculus
atgttggtccatggtgtcgtttcca

SEQ ID NO: 274429 - DNA, 25 bp, Mus musculus
atgttggtgcacagggtgttctgaa

SEQ ID NO: 274430 - DNA, 25 bp, Mus musculus
atgttggtgcactgggtgttctgaa

SEQ ID NO: 274431 - DNA, 25 bp, Mus musculus
atgttggtgctcacagttctgtgca

SEQ ID NO: 274432 - DNA, 25 bp, Mus musculus
atgttggtgctctcagttctgtgca

SEQ ID NO: 274433 - DNA, 25 bp, Mus musculus
atgttggtggtcacactgcttgtct

SEQ ID NO: 274434 - DNA, 25 bp, Mus musculus
atgttggtggtctcactgcttgtct

SEQ ID NO: 274435 - DNA, 25 bp, Mus musculus
atgttggtgtggactgaaccccaga

SEQ ID NO: 274436 - DNA, 25 bp, Mus musculus
atgttggtgtggtctgaaccccaga

SEQ ID NO: 274437 - DNA, 25 bp, Mus musculus
atgttggttcacacccacctgtaac

SEQ ID NO: 274438 - DNA, 25 bp, Mus musculus
atgttggttcactcccacctgtaac

SEQ ID NO: 274439 - DNA, 25 bp, Mus musculus
atgttggttcccatgaatccttgcc

SEQ ID NO: 274440 - DNA, 25 bp, Mus musculus
atgttggttcccttgaatccttgcc

SEQ ID NO: 274441 - DNA, 25 bp, Mus musculus
atgttggttgatactctttggtgat

SEQ ID NO: 274442 - DNA, 25 bp, Mus musculus
atgttggttgattctctttggtgat

SEQ ID NO: 274443 - DNA, 25 bp, Mus musculus
atgttggttttacttgaatgattca

SEQ ID NO: 274444 - DNA, 25 bp, Mus musculus
atgttggttttagttgaatgattca

SEQ ID NO: 274445 - DNA, 25 bp, Mus musculus
atgttgtaaagtcccgacctgctgt

SEQ ID NO: 274446 - DNA, 25 bp, Mus musculus
atgttgtaaagtgccgacctgctgt

SEQ ID NO: 274447 - DNA, 25 bp, Mus musculus
atgttgtaacccaatatgccaggct

SEQ ID NO: 274448 - DNA, 25 bp, Mus musculus
atgttgtaaccctatatgccaggct

SEQ ID NO: 274449 - DNA, 25 bp, Mus musculus
atgttgtacattattgctgttatct

SEQ ID NO: 274450 - DNA, 25 bp, Mus musculus
atgttgtacatttttgctgttatct

SEQ ID NO: 274451 - DNA, 25 bp, Mus musculus
atgttgtaccgcactgtgaaacagt

SEQ ID NO: 274452 - DNA, 25 bp, Mus musculus
atgttgtaccgctctgtgaaacagt

SEQ ID NO: 274453 - DNA, 25 bp, Mus musculus
atgttgtacctgctttgtggtgtga

SEQ ID NO: 274454 - DNA, 25 bp, Mus musculus
atgttgtacctggtttgtggtgtga

SEQ ID NO: 274455 - DNA, 25 bp, Mus musculus
atgttgtaccttattgctgaggcga

SEQ ID NO: 274456 - DNA, 25 bp, Mus musculus
atgttgtacctttttgctgaggcga

SEQ ID NO: 274457 - DNA, 25 bp, Mus musculus
atgttgtactttcccgtgcatctgc

SEQ ID NO: 274458 - DNA, 25 bp, Mus musculus
atgttgtactttgccgtgcatctgc

SEQ ID NO: 274459 - DNA, 25 bp, Mus musculus
atgttgtagtttccacagactttca

SEQ ID NO: 274460 - DNA, 25 bp, Mus musculus
atgttgtagtttgcacagactttca

SEQ ID NO: 274461 - DNA, 25 bp, Mus musculus
atgttgtatttaatgctttgtggcc

SEQ ID NO: 274462 - DNA, 25 bp, Mus musculus
atgttgtatttattgctttgtggcc

SEQ ID NO: 274463 - DNA, 25 bp, Mus musculus
atgttgtcaaatactccagtctcgg

SEQ ID NO: 274464 - DNA, 25 bp, Mus musculus
atgttgtcaaattctccagtctcgg

SEQ ID NO: 274465 - DNA, 25 bp, Mus musculus
atgttgtcacatcttgccactttca

SEQ ID NO: 274466 - DNA, 25 bp, Mus musculus
atgttgtcacatgttgccactttca

SEQ ID NO: 274467 - DNA, 25 bp, Mus musculus
atgttgtcagaaacactgtcagtga

SEQ ID NO: 274468 - DNA, 25 bp, Mus musculus
atgttgtcagaatcactgtcagtga

SEQ ID NO: 274469 - DNA, 25 bp, Mus musculus
atgttgtcaggaagcccttaaacaa

SEQ ID NO: 274470 - DNA, 25 bp, Mus musculus
atgttgtcaggatgcccttaaacaa

SEQ ID NO: 274471 - DNA, 25 bp, Mus musculus
atgttgtcatctaaccaccagaggg

SEQ ID NO: 274472 - DNA, 25 bp, Mus musculus
atgttgtcatcttaccaccagaggg

SEQ ID NO: 274473 - DNA, 25 bp, Mus musculus
atgttgtcatttagtggaactacta

SEQ ID NO: 274474 - DNA, 25 bp, Mus musculus
atgttgtcatttatgtgagactcaa

SEQ ID NO: 274475 - DNA, 25 bp, Mus musculus
atgttgtcattttgtggaactacta

SEQ ID NO: 274476 - DNA, 25 bp, Mus musculus
atgttgtcatttttgtgagactcaa

SEQ ID NO: 274477 - DNA, 25 bp, Mus musculus
atgttgtccagacacgctgtctgta

SEQ ID NO: 274478 - DNA, 25 bp, Mus musculus
atgttgtccagagacgctgtctgta

SEQ ID NO: 274479 - DNA, 25 bp, Mus musculus
atgttgtccagcctaagagggagct

SEQ ID NO: 274480 - DNA, 25 bp, Mus musculus
atgttgtccagcgtaagagggagct

SEQ ID NO: 274481 - DNA, 25 bp, Mus musculus
atgttgtccattataggaggttccc

SEQ ID NO: 274482 - DNA, 25 bp, Mus musculus
atgttgtccattttaggaggttccc

SEQ ID NO: 274483 - DNA, 25 bp, Mus musculus
atgttgtcccagatgatagtcagaa

SEQ ID NO: 274484 - DNA, 25 bp, Mus musculus
atgttgtcccagttgatagtcagaa

SEQ ID NO: 274485 - DNA, 25 bp, Mus musculus
atgttgtcctctcaacctcattggc

SEQ ID NO: 274486 - DNA, 25 bp, Mus musculus
atgttgtcctctgaacctcattggc

SEQ ID NO: 274487 - DNA, 25 bp, Mus musculus
atgttgtcgctgctgtcagacgctc

SEQ ID NO: 274488 - DNA, 25 bp, Mus musculus
atgttgtcgctggtgtcagacgctc

SEQ ID NO: 274489 - DNA, 25 bp, Mus musculus
atgttgtctacacttccggtggcca

SEQ ID NO: 274490 - DNA, 25 bp, Mus musculus
atgttgtctacagttccggtggcca

SEQ ID NO: 274491 - DNA, 25 bp, Mus musculus
atgttgtctataatttctcccctaa

SEQ ID NO: 274492 - DNA, 25 bp, Mus musculus
atgttgtctatattttctcccctaa

SEQ ID NO: 274493 - DNA, 25 bp, Mus musculus
atgttgtctctcaagcggtgtctca

SEQ ID NO: 274494 - DNA, 25 bp, Mus musculus
atgttgtctctctagcggtgtctca

SEQ ID NO: 274495 - DNA, 25 bp, Mus musculus
atgttgtgactaaagccacgcacca

SEQ ID NO: 274496 - DNA, 25 bp, Mus musculus
atgttgtgactatagccacgcacca

SEQ ID NO: 274497 - DNA, 25 bp, Mus musculus
atgttgtgattaaagctctgtggct

SEQ ID NO: 274498 - DNA, 25 bp, Mus musculus
atgttgtgattatagctctgtggct

SEQ ID NO: 274499 - DNA, 25 bp, Mus musculus
atgttgtgatttccacggcttgtca

SEQ ID NO: 274500 - DNA, 25 bp, Mus musculus
atgttgtgatttgcacggcttgtca

SEQ ID NO: 274501 - DNA, 25 bp, Mus musculus
atgttgtgcacccaaattacattaa

SEQ ID NO: 274502 - DNA, 25 bp, Mus musculus
atgttgtgcaccgaaattacattaa

SEQ ID NO: 274503 - DNA, 25 bp, Mus musculus
atgttgtgcctaaggctgccggaaa

SEQ ID NO: 274504 - DNA, 25 bp, Mus musculus
atgttgtgcctatggctgccggaaa

SEQ ID NO: 274505 - DNA, 25 bp, Mus musculus
atgttgtgctctattgaagacgtta

SEQ ID NO: 274506 - DNA, 25 bp, Mus musculus
atgttgtgctcttttgaagacgtta

SEQ ID NO: 274507 - DNA, 25 bp, Mus musculus
atgttgtggcatcttaacttttaca

SEQ ID NO: 274508 - DNA, 25 bp, Mus musculus
atgttgtggcatgttaacttttaca

SEQ ID NO: 274509 - DNA, 25 bp, Mus musculus
atgttgtgtctacagagcccacgtc

SEQ ID NO: 274510 - DNA, 25 bp, Mus musculus
atgttgtgtctagagagcccacgtc

SEQ ID NO: 274511 - DNA, 25 bp, Mus musculus
atgttgtgtgtcagcctgtttctaa

SEQ ID NO: 274512 - DNA, 25 bp, Mus musculus
atgttgtgtgtctgcctgtttctaa

SEQ ID NO: 274513 - DNA, 25 bp, Mus musculus
atgttgttagctcatctgggtgatg

SEQ ID NO: 274514 - DNA, 25 bp, Mus musculus
atgttgttagctgatctgggtgatg

SEQ ID NO: 274515 - DNA, 25 bp, Mus musculus
atgttgttccaaagtgagttacgac

SEQ ID NO: 274516 - DNA, 25 bp, Mus musculus
atgttgttccaatgtgagttacgac

SEQ ID NO: 274517 - DNA, 25 bp, Mus musculus
atgttgttcgtcagagctatgtccc

SEQ ID NO: 274518 - DNA, 25 bp, Mus musculus
atgttgttcgtctgagctatgtccc

SEQ ID NO: 274519 - DNA, 25 bp, Mus musculus
atgttgttctaacgatgtgtcagga

SEQ ID NO: 274520 - DNA, 25 bp, Mus musculus
atgttgttctaaggatgtgtcagga

SEQ ID NO: 274521 - DNA, 25 bp, Mus musculus
atgttgttgatgatgggcctgctgc

SEQ ID NO: 274522 - DNA, 25 bp, Mus musculus
atgttgttgatgttgggcctgctgc

SEQ ID NO: 274523 - DNA, 25 bp, Mus musculus
atgttgttgctgagatgtcttatac

SEQ ID NO: 274524 - DNA, 25 bp, Mus musculus
atgttgttgctgagtgtggccatcc

SEQ ID NO: 274525 - DNA, 25 bp, Mus musculus
atgttgttgctgtgatgtcttatac

SEQ ID NO: 274526 - DNA, 25 bp, Mus musculus
atgttgttgctgtgtgtggccatcc

SEQ ID NO: 274527 - DNA, 25 bp, Mus musculus
atgttgttgttgatccatctgatac

SEQ ID NO: 274528 - DNA, 25 bp, Mus musculus
atgttgttgttgttccatctgatac

SEQ ID NO: 274529 - DNA, 25 bp, Mus musculus
atgttgttgtttctccaagacttca

SEQ ID NO: 274530 - DNA, 25 bp, Mus musculus
atgttgttgtttgtccaagacttca

SEQ ID NO: 274531 - DNA, 25 bp, Mus musculus
atgttgtttcttcaaggctgctccc

SEQ ID NO: 274532 - DNA, 25 bp, Mus musculus
atgttgtttcttgaaggctgctccc

SEQ ID NO: 274533 - DNA, 25 bp, Mus musculus
atgttgtttttaagtgcctattgca

SEQ ID NO: 274534 - DNA, 25 bp, Mus musculus
atgttgtttttatgtgcctattgca

SEQ ID NO: 274535 - DNA, 25 bp, Mus musculus
atgttgtttttcacagtactgtgta

SEQ ID NO: 274536 - DNA, 25 bp, Mus musculus
atgttgtttttctcagtactgtgta

SEQ ID NO: 274537 - DNA, 25 bp, Mus musculus
atgtttaaaataaaggctgcctgtc

SEQ ID NO: 274538 - DNA, 25 bp, Mus musculus
atgtttaaaatataggctgcctgtc

SEQ ID NO: 274539 - DNA, 25 bp, Mus musculus
atgtttaaaatgaaggcttgaccct

SEQ ID NO: 274540 - DNA, 25 bp, Mus musculus
atgtttaaaatgtaggcttgaccct

SEQ ID NO: 274541 - DNA, 25 bp, Mus musculus
atgtttaaagacacacctgcacttg

SEQ ID NO: 274542 - DNA, 25 bp, Mus musculus
atgtttaaagactcacctgcacttg

SEQ ID NO: 274543 - DNA, 25 bp, Mus musculus
atgtttaacacaatacagacaagtt

SEQ ID NO: 274544 - DNA, 25 bp, Mus musculus
atgtttaacacattacagacaagtt

SEQ ID NO: 274545 - DNA, 25 bp, Mus musculus
atgtttaacattccacctcatggcc

SEQ ID NO: 274546 - DNA, 25 bp, Mus musculus
atgtttaacattgcacctcatggcc

SEQ ID NO: 274547 - DNA, 25 bp, Mus musculus
atgtttaaccacaagtctacctaat

SEQ ID NO: 274548 - DNA, 25 bp, Mus musculus
atgtttaaccactagtctacctaat

SEQ ID NO: 274549 - DNA, 25 bp, Mus musculus
atgtttaacctcatcgtgggcacag

SEQ ID NO: 274550 - DNA, 25 bp, Mus musculus
atgtttaacctcttcgtgggcacag

SEQ ID NO: 274551 - DNA, 25 bp, Mus musculus
atgtttaacctgcaatacttgggaa

SEQ ID NO: 274552 - DNA, 25 bp, Mus musculus
atgtttaacctggaatacttgggaa

SEQ ID NO: 274553 - DNA, 25 bp, Mus musculus
atgtttaatacacagcctccagctg

SEQ ID NO: 274554 - DNA, 25 bp, Mus musculus
atgtttaatacagagcctccagctg

SEQ ID NO: 274555 - DNA, 25 bp, Mus musculus
atgtttaatggtagggtctcactgt

SEQ ID NO: 274556 - DNA, 25 bp, Mus musculus
atgtttaatggtcctgccatgctat

SEQ ID NO: 274557 - DNA, 25 bp, Mus musculus
atgtttaatggtgctgccatgctat

SEQ ID NO: 274558 - DNA, 25 bp, Mus musculus
atgtttaatggttgggtctcactgt

SEQ ID NO: 274559 - DNA, 25 bp, Mus musculus
atgtttaatgtaccttctgtttcta

SEQ ID NO: 274560 - DNA, 25 bp, Mus musculus
atgtttaatgtagcttctgtttcta

SEQ ID NO: 274561 - DNA, 25 bp, Mus musculus
atgtttaattccctggaaggctggc

SEQ ID NO: 274562 - DNA, 25 bp, Mus musculus
atgtttaattccgtggaaggctggc

SEQ ID NO: 274563 - DNA, 25 bp, Mus musculus
atgtttaattgccacactgcagctg

SEQ ID NO: 274564 - DNA, 25 bp, Mus musculus
atgtttaattgcgacactgcagctg

SEQ ID NO: 274565 - DNA, 25 bp, Mus musculus
atgtttaattttctctgcccttact

SEQ ID NO: 274566 - DNA, 25 bp, Mus musculus
atgtttaattttgtctgcccttact

SEQ ID NO: 274567 - DNA, 25 bp, Mus musculus
atgtttacaaccaagggccacctct

SEQ ID NO: 274568 - DNA, 25 bp, Mus musculus
atgtttacaacctagggccacctct

SEQ ID NO: 274569 - DNA, 25 bp, Mus musculus
atgtttacacagaaggaggttccag

SEQ ID NO: 274570 - DNA, 25 bp, Mus musculus
atgtttacacagtaggaggttccag

SEQ ID NO: 274571 - DNA, 25 bp, Mus musculus
atgtttacactcacagtgccctgat

SEQ ID NO: 274572 - DNA, 25 bp, Mus musculus
atgtttacactctcagtgccctgat

SEQ ID NO: 274573 - DNA, 25 bp, Mus musculus
atgtttacagtgcttgggctccact

SEQ ID NO: 274574 - DNA, 25 bp, Mus musculus
atgtttacagtggttgggctccact

SEQ ID NO: 274575 - DNA, 25 bp, Mus musculus
atgtttacagttccttttcccagtt

SEQ ID NO: 274576 - DNA, 25 bp, Mus musculus
atgtttacagttgcttttcccagtt

SEQ ID NO: 274577 - DNA, 25 bp, Mus musculus
atgtttacatagcttctggtgatat

SEQ ID NO: 274578 - DNA, 25 bp, Mus musculus
atgtttacataggttctggtgatat

SEQ ID NO: 274579 - DNA, 25 bp, Mus musculus
atgtttacatctcgccaaacctcag

SEQ ID NO: 274580 - DNA, 25 bp, Mus musculus
atgtttacatctggccaaacctcag

SEQ ID NO: 274581 - DNA, 25 bp, Mus musculus
atgtttacattcacttctgtcttgg

SEQ ID NO: 274582 - DNA, 25 bp, Mus musculus
atgtttacattctcttctgtcttgg

SEQ ID NO: 274583 - DNA, 25 bp, Mus musculus
atgtttaccatacccctattggagg

SEQ ID NO: 274584 - DNA, 25 bp, Mus musculus
atgtttaccatagccctattggagg

SEQ ID NO: 274585 - DNA, 25 bp, Mus musculus
atgtttaccatcctgagcttagaaa

SEQ ID NO: 274586 - DNA, 25 bp, Mus musculus
atgtttaccatcgtgagcttagaaa

SEQ ID NO: 274587 - DNA, 25 bp, Mus musculus
atgtttactatgcagccattttgtg

SEQ ID NO: 274588 - DNA, 25 bp, Mus musculus
atgtttactatggagccattttgtg

SEQ ID NO: 274589 - DNA, 25 bp, Mus musculus
atgtttactcatactatttggtggg

SEQ ID NO: 274590 - DNA, 25 bp, Mus musculus
atgtttactcattctatttggtggg

SEQ ID NO: 274591 - DNA, 25 bp, Mus musculus
atgtttactgtaaccatttctaatg

SEQ ID NO: 274592 - DNA, 25 bp, Mus musculus
atgtttactgtaacttgtgacttaa

SEQ ID NO: 274593 - DNA, 25 bp, Mus musculus
atgtttactgtatccatttctaatg

SEQ ID NO: 274594 - DNA, 25 bp, Mus musculus
atgtttactgtatcttgtgacttaa

SEQ ID NO: 274595 - DNA, 25 bp, Mus musculus
atgtttactgtcactgttttcctgt

SEQ ID NO: 274596 - DNA, 25 bp, Mus musculus
atgtttactgtctctgttttcctgt

SEQ ID NO: 274597 - DNA, 25 bp, Mus musculus
atgtttagactgctgttctgaccct

SEQ ID NO: 274598 - DNA, 25 bp, Mus musculus
atgtttagactggtgttctgaccct

SEQ ID NO: 274599 - DNA, 25 bp, Mus musculus
atgtttagacttctcactgaataaa

SEQ ID NO: 274600 - DNA, 25 bp, Mus musculus
atgtttagacttgtcactgaataaa

SEQ ID NO: 274601 - DNA, 25 bp, Mus musculus
atgtttagataaactccttccccag

SEQ ID NO: 274602 - DNA, 25 bp, Mus musculus
atgtttagataatctccttccccag

SEQ ID NO: 274603 - DNA, 25 bp, Mus musculus
atgtttagccagatggcagcagtct

SEQ ID NO: 274604 - DNA, 25 bp, Mus musculus
atgtttagccagttggcagcagtct

SEQ ID NO: 274605 - DNA, 25 bp, Mus musculus
atgtttagccttcggattccttctt

SEQ ID NO: 274606 - DNA, 25 bp, Mus musculus
atgtttagccttgggattccttctt

SEQ ID NO: 274607 - DNA, 25 bp, Mus musculus
atgtttaggcttcgatcctattccc

SEQ ID NO: 274608 - DNA, 25 bp, Mus musculus
atgtttaggcttggatcctattccc

SEQ ID NO: 274609 - DNA, 25 bp, Mus musculus
atgtttagtcttcttgatttggttc

SEQ ID NO: 274610 - DNA, 25 bp, Mus musculus
atgtttagtcttgttgatttggttc

SEQ ID NO: 274611 - DNA, 25 bp, Mus musculus
atgtttagtgatcagttccttctct

SEQ ID NO: 274612 - DNA, 25 bp, Mus musculus
atgtttagtgatgagttccttctct

SEQ ID NO: 274613 - DNA, 25 bp, Mus musculus
atgtttagttacaaatgtccttcac

SEQ ID NO: 274614 - DNA, 25 bp, Mus musculus
atgtttagttactaatgtccttcac

SEQ ID NO: 274615 - DNA, 25 bp, Mus musculus
atgtttatccatatgtgaccacttc

SEQ ID NO: 274616 - DNA, 25 bp, Mus musculus
atgtttatccatttgtgaccacttc

SEQ ID NO: 274617 - DNA, 25 bp, Mus musculus
atgtttatccttcgctgtcttgatc

SEQ ID NO: 274618 - DNA, 25 bp, Mus musculus
atgtttatccttggctgtcttgatc

SEQ ID NO: 274619 - DNA, 25 bp, Mus musculus
atgtttatcgttatcactgtgtgta

SEQ ID NO: 274620 - DNA, 25 bp, Mus musculus
atgtttatcgttttcactgtgtgta

SEQ ID NO: 274621 - DNA, 25 bp, Mus musculus
atgtttatgctcagcctagggatgg

SEQ ID NO: 274622 - DNA, 25 bp, Mus musculus
atgtttatgctctgcctagggatgg

SEQ ID NO: 274623 - DNA, 25 bp, Mus musculus
atgtttatgtggaattgtctcagat

SEQ ID NO: 274624 - DNA, 25 bp, Mus musculus
atgtttatgtggtattgtctcagat

SEQ ID NO: 274625 - DNA, 25 bp, Mus musculus
atgtttatgttcacccagattcctg

SEQ ID NO: 274626 - DNA, 25 bp, Mus musculus
atgtttatgttctcccagattcctg

SEQ ID NO: 274627 - DNA, 25 bp, Mus musculus
atgtttattacaaaggtggtcaggt

SEQ ID NO: 274628 - DNA, 25 bp, Mus musculus
atgtttattacataggtggtcaggt

SEQ ID NO: 274629 - DNA, 25 bp, Mus musculus
atgtttattctccaagttccttcag

SEQ ID NO: 274630 - DNA, 25 bp, Mus musculus
atgtttattctcgaagttccttcag

SEQ ID NO: 274631 - DNA, 25 bp, Mus musculus
atgtttattgcacttcatgttttca

SEQ ID NO: 274632 - DNA, 25 bp, Mus musculus
atgtttattgcagttcatgttttca

SEQ ID NO: 274633 - DNA, 25 bp, Mus musculus
atgtttcaatttaatctggtcctta

SEQ ID NO: 274634 - DNA, 25 bp, Mus musculus
atgtttcaattttatctggtcctta

SEQ ID NO: 274635 - DNA, 25 bp, Mus musculus
atgtttcacaatcagtacgcacttt

SEQ ID NO: 274636 - DNA, 25 bp, Mus musculus
atgtttcacaatgagtacgcacttt

SEQ ID NO: 274637 - DNA, 25 bp, Mus musculus
atgtttcacctaaaaggctcatttt

SEQ ID NO: 274638 - DNA, 25 bp, Mus musculus
atgtttcacctataaggctcatttt

SEQ ID NO: 274639 - DNA, 25 bp, Mus musculus
atgtttcacttaattcccactgctt

SEQ ID NO: 274640 - DNA, 25 bp, Mus musculus
atgtttcacttatttcccactgctt

SEQ ID NO: 274641 - DNA, 25 bp, Mus musculus
atgtttcagcaaattggagacctac

SEQ ID NO: 274642 - DNA, 25 bp, Mus musculus
atgtttcagcaatttggagacctac

SEQ ID NO: 274643 - DNA, 25 bp, Mus musculus
atgtttcagcatatagacggtttgt

SEQ ID NO: 274644 - DNA, 25 bp, Mus musculus
atgtttcagcatttagacggtttgt

SEQ ID NO: 274645 - DNA, 25 bp, Mus musculus
atgtttcaggcaactgttttctcta

SEQ ID NO: 274646 - DNA, 25 bp, Mus musculus
atgtttcaggcatctgttttctcta

SEQ ID NO: 274647 - DNA, 25 bp, Mus musculus
atgtttcaggctcggcacaggactc

SEQ ID NO: 274648 - DNA, 25 bp, Mus musculus
atgtttcaggctgggcacaggactc

SEQ ID NO: 274649 - DNA, 25 bp, Mus musculus
atgtttcagggaagtgcgggcaacc

SEQ ID NO: 274650 - DNA, 25 bp, Mus musculus
atgtttcagggatgtgcgggcaacc

SEQ ID NO: 274651 - DNA, 25 bp, Mus musculus
atgtttcaggtcagctcggtgttgc

SEQ ID NO: 274652 - DNA, 25 bp, Mus musculus
atgtttcaggtctgctcggtgttgc

SEQ ID NO: 274653 - DNA, 25 bp, Mus musculus
atgtttcagtagatttccaaacgag

SEQ ID NO: 274654 - DNA, 25 bp, Mus musculus
atgtttcagtagttttccaaacgag

SEQ ID NO: 274655 - DNA, 25 bp, Mus musculus
atgtttcatgacacccactttgatt

SEQ ID NO: 274656 - DNA, 25 bp, Mus musculus
atgtttcatgacatttggatctgcg

SEQ ID NO: 274657 - DNA, 25 bp, Mus musculus
atgtttcatgactcccactttgatt

SEQ ID NO: 274658 - DNA, 25 bp, Mus musculus
atgtttcatgacttttggatctgcg

SEQ ID NO: 274659 - DNA, 25 bp, Mus musculus
atgtttcattcaaacgtcttcaagg

SEQ ID NO: 274660 - DNA, 25 bp, Mus musculus
atgtttcattcatacgtcttcaagg

SEQ ID NO: 274661 - DNA, 25 bp, Mus musculus
atgtttcattgtattagggtgttct

SEQ ID NO: 274662 - DNA, 25 bp, Mus musculus
atgtttcattgttttagggtgttct

SEQ ID NO: 274663 - DNA, 25 bp, Mus musculus
atgtttccaaaaatgctgtcctcaa

SEQ ID NO: 274664 - DNA, 25 bp, Mus musculus
atgtttccaaaattgctgtcctcaa

SEQ ID NO: 274665 - DNA, 25 bp, Mus musculus
atgtttccaaaccagtacacctgtc

SEQ ID NO: 274666 - DNA, 25 bp, Mus musculus
atgtttccaaacgagtacacctgtc

SEQ ID NO: 274667 - DNA, 25 bp, Mus musculus
atgtttccaaccaattagtgctttt

SEQ ID NO: 274668 - DNA, 25 bp, Mus musculus
atgtttccaacctattagtgctttt

SEQ ID NO: 274669 - DNA, 25 bp, Mus musculus
atgtttccaatcaggttctggctgg

SEQ ID NO: 274670 - DNA, 25 bp, Mus musculus
atgtttccaatctggttctggctgg

SEQ ID NO: 274671 - DNA, 25 bp, Mus musculus
atgtttccacaaagtcattcccttg

SEQ ID NO: 274672 - DNA, 25 bp, Mus musculus
atgtttccacaatgtcattcccttg

SEQ ID NO: 274673 - DNA, 25 bp, Mus musculus
atgtttccacctcagggagctatgt

SEQ ID NO: 274674 - DNA, 25 bp, Mus musculus
atgtttccacctgagggagctatgt

SEQ ID NO: 274675 - DNA, 25 bp, Mus musculus
atgtttccagacatggcctcagtgt

SEQ ID NO: 274676 - DNA, 25 bp, Mus musculus
atgtttccagacttggcctcagtgt

SEQ ID NO: 274677 - DNA, 25 bp, Mus musculus
atgtttccaggccagtaggcctcac

SEQ ID NO: 274678 - DNA, 25 bp, Mus musculus
atgtttccaggcgagtaggcctcac

SEQ ID NO: 274679 - DNA, 25 bp, Mus musculus
atgtttccatgccaccacaataaaa

SEQ ID NO: 274680 - DNA, 25 bp, Mus musculus
atgtttccatgcgaccacaataaaa

SEQ ID NO: 274681 - DNA, 25 bp, Mus musculus
atgtttcccaacagagcatcttaga

SEQ ID NO: 274682 - DNA, 25 bp, Mus musculus
atgtttcccaactgagcatcttaga

SEQ ID NO: 274683 - DNA, 25 bp, Mus musculus
atgtttcccaatcttatgctcgctt

SEQ ID NO: 274684 - DNA, 25 bp, Mus musculus
atgtttcccaatgttatgctcgctt

SEQ ID NO: 274685 - DNA, 25 bp, Mus musculus
atgtttcccataccttcccagtttg

SEQ ID NO: 274686 - DNA, 25 bp, Mus musculus
atgtttcccatagcttcccagtttg

SEQ ID NO: 274687 - DNA, 25 bp, Mus musculus
atgtttccccatccgcaggagacca

SEQ ID NO: 274688 - DNA, 25 bp, Mus musculus
atgtttccccatgcgcaggagacca

SEQ ID NO: 274689 - DNA, 25 bp, Mus musculus
atgtttccccgaagttgtcctgctt

SEQ ID NO: 274690 - DNA, 25 bp, Mus musculus
atgtttccccgatgttgtcctgctt

SEQ ID NO: 274691 - DNA, 25 bp, Mus musculus
atgtttcccctcatattgaactctg

SEQ ID NO: 274692 - DNA, 25 bp, Mus musculus
atgtttcccctcttattgaactctg

SEQ ID NO: 274693 - DNA, 25 bp, Mus musculus
atgtttccctacactaaactcagac

SEQ ID NO: 274694 - DNA, 25 bp, Mus musculus
atgtttccctactctaaactcagac

SEQ ID NO: 274695 - DNA, 25 bp, Mus musculus
atgtttccctctctagttttgtctt

SEQ ID NO: 274696 - DNA, 25 bp, Mus musculus
atgtttccctctgtagttttgtctt

SEQ ID NO: 274697 - DNA, 25 bp, Mus musculus
atgtttccctttcgcttatagttgg

SEQ ID NO: 274698 - DNA, 25 bp, Mus musculus
atgtttccctttggcttatagttgg

SEQ ID NO: 274699 - DNA, 25 bp, Mus musculus
atgtttccgcatccttcaatgtgtg

SEQ ID NO: 274700 - DNA, 25 bp, Mus musculus
atgtttccgcatgcttcaatgtgtg

SEQ ID NO: 274701 - DNA, 25 bp, Mus musculus
atgtttcctaacacctgtcctttat

SEQ ID NO: 274702 - DNA, 25 bp, Mus musculus
atgtttcctaactcctgtcctttat

SEQ ID NO: 274703 - DNA, 25 bp, Mus musculus
atgtttcctactacagtagcttttc

SEQ ID NO: 274704 - DNA, 25 bp, Mus musculus
atgtttcctacttcagtagcttttc

SEQ ID NO: 274705 - DNA, 25 bp, Mus musculus
atgtttcctcaacacttctggcctg

SEQ ID NO: 274706 - DNA, 25 bp, Mus musculus
atgtttcctcaagacttctggcctg

SEQ ID NO: 274707 - DNA, 25 bp, Mus musculus
atgtttcctgaacaattctctcata

SEQ ID NO: 274708 - DNA, 25 bp, Mus musculus
atgtttcctgaagaattctctcata

SEQ ID NO: 274709 - DNA, 25 bp, Mus musculus
atgtttcctgcaatgagcgtcaggt

SEQ ID NO: 274710 - DNA, 25 bp, Mus musculus
atgtttcctgcattgagcgtcaggt

SEQ ID NO: 274711 - DNA, 25 bp, Mus musculus
atgtttcctgccaactacgtggagc

SEQ ID NO: 274712 - DNA, 25 bp, Mus musculus
atgtttcctgcctactacgtggagc

SEQ ID NO: 274713 - DNA, 25 bp, Mus musculus
atgtttcctgtcaggtgagtgtcac

SEQ ID NO: 274714 - DNA, 25 bp, Mus musculus
atgtttcctgtctggtgagtgtcac

SEQ ID NO: 274715 - DNA, 25 bp, Mus musculus
atgtttcctgttaacgtatccacca

SEQ ID NO: 274716 - DNA, 25 bp, Mus musculus
atgtttcctgtttacgtatccacca

SEQ ID NO: 274717 - DNA, 25 bp, Mus musculus
atgtttccttagatgcagctgcatg

SEQ ID NO: 274718 - DNA, 25 bp, Mus musculus
atgtttccttagcagcttgggcaca

SEQ ID NO: 274719 - DNA, 25 bp, Mus musculus
atgtttccttaggagcttgggcaca

SEQ ID NO: 274720 - DNA, 25 bp, Mus musculus
atgtttccttagttgcagctgcatg

SEQ ID NO: 274721 - DNA, 25 bp, Mus musculus
atgtttccttccctgtgccagatta

SEQ ID NO: 274722 - DNA, 25 bp, Mus musculus
atgtttccttccgtgtgccagatta

SEQ ID NO: 274723 - DNA, 25 bp, Mus musculus
atgtttcctttaagactgtcagaga

SEQ ID NO: 274724 - DNA, 25 bp, Mus musculus
atgtttcctttatgactgtcagaga

SEQ ID NO: 274725 - DNA, 25 bp, Mus musculus
atgtttccttttaatgagcaattgt

SEQ ID NO: 274726 - DNA, 25 bp, Mus musculus
atgtttcctttttatgagcaattgt

SEQ ID NO: 274727 - DNA, 25 bp, Mus musculus
atgtttcgaggcctttaacatgtag

SEQ ID NO: 274728 - DNA, 25 bp, Mus musculus
atgtttcgaggcgtttaacatgtag

SEQ ID NO: 274729 - DNA, 25 bp, Mus musculus
atgtttctaaacaagtgcaccctgc

SEQ ID NO: 274730 - DNA, 25 bp, Mus musculus
atgtttctaaactagtgcaccctgc

SEQ ID NO: 274731 - DNA, 25 bp, Mus musculus
atgtttctacgtatgctcgtgacaa

SEQ ID NO: 274732 - DNA, 25 bp, Mus musculus
atgtttctacgtttgctcgtgacaa

SEQ ID NO: 274733 - DNA, 25 bp, Mus musculus
atgtttctagtaagtgacgtcagga

SEQ ID NO: 274734 - DNA, 25 bp, Mus musculus
atgtttctagtatgtgacgtcagga

SEQ ID NO: 274735 - DNA, 25 bp, Mus musculus
atgtttctagttactagtcccaata

SEQ ID NO: 274736 - DNA, 25 bp, Mus musculus
atgtttctagtttctagtcccaata

SEQ ID NO: 274737 - DNA, 25 bp, Mus musculus
atgtttctatctagtctgtgcgccg

SEQ ID NO: 274738 - DNA, 25 bp, Mus musculus
atgtttctatcttgtctgtgcgccg

SEQ ID NO: 274739 - DNA, 25 bp, Mus musculus
atgtttctatggcacaggcctcatc

SEQ ID NO: 274740 - DNA, 25 bp, Mus musculus
atgtttctatgggacaggcctcatc

SEQ ID NO: 274741 - DNA, 25 bp, Mus musculus
atgtttctcagacacccttaaaggc

SEQ ID NO: 274742 - DNA, 25 bp, Mus musculus
atgtttctcagagacccttaaaggc

SEQ ID NO: 274743 - DNA, 25 bp, Mus musculus
atgtttctcagtagtccctgttgct

SEQ ID NO: 274744 - DNA, 25 bp, Mus musculus
atgtttctcagttgtccctgttgct

SEQ ID NO: 274745 - DNA, 25 bp, Mus musculus
atgtttctcataatcttacttgctt

SEQ ID NO: 274746 - DNA, 25 bp, Mus musculus
atgtttctcatattcttacttgctt

SEQ ID NO: 274747 - DNA, 25 bp, Mus musculus
atgtttctcccaaagacctcagcct

SEQ ID NO: 274748 - DNA, 25 bp, Mus musculus
atgtttctcccatagacctcagcct

SEQ ID NO: 274749 - DNA, 25 bp, Mus musculus
atgtttctcctgcttaaacctccga

SEQ ID NO: 274750 - DNA, 25 bp, Mus musculus
atgtttctcctggttaaacctccga

SEQ ID NO: 274751 - DNA, 25 bp, Mus musculus
atgtttctcgaccagctaagtgcag

SEQ ID NO: 274752 - DNA, 25 bp, Mus musculus
atgtttctcgacgagctaagtgcag

SEQ ID NO: 274753 - DNA, 25 bp, Mus musculus
atgtttctctccacagttacaagta

SEQ ID NO: 274754 - DNA, 25 bp, Mus musculus
atgtttctctcctcagttacaagta

SEQ ID NO: 274755 - DNA, 25 bp, Mus musculus
atgtttctcttgcaaccgtgaccag

SEQ ID NO: 274756 - DNA, 25 bp, Mus musculus
atgtttctcttgctggctcgggtgc

SEQ ID NO: 274757 - DNA, 25 bp, Mus musculus
atgtttctcttggaaccgtgaccag

SEQ ID NO: 274758 - DNA, 25 bp, Mus musculus
atgtttctcttggtggctcgggtgc

SEQ ID NO: 274759 - DNA, 25 bp, Mus musculus
atgtttctgagaacttgccaccgta

SEQ ID NO: 274760 - DNA, 25 bp, Mus musculus
atgtttctgagatcttgccaccgta

SEQ ID NO: 274761 - DNA, 25 bp, Mus musculus
atgtttctgatccactacgtgcaaa

SEQ ID NO: 274762 - DNA, 25 bp, Mus musculus
atgtttctgatcgactacgtgcaaa

SEQ ID NO: 274763 - DNA, 25 bp, Mus musculus
atgtttctgcacagctgctttacca

SEQ ID NO: 274764 - DNA, 25 bp, Mus musculus
atgtttctgcactgctgctttacca

SEQ ID NO: 274765 - DNA, 25 bp, Mus musculus
atgtttctgcatataatttagatga

SEQ ID NO: 274766 - DNA, 25 bp, Mus musculus
atgtttctgcatttaatttagatga

SEQ ID NO: 274767 - DNA, 25 bp, Mus musculus
atgtttctgcctctctggaattaga

SEQ ID NO: 274768 - DNA, 25 bp, Mus musculus
atgtttctgcctgtctggaattaga

SEQ ID NO: 274769 - DNA, 25 bp, Mus musculus
atgtttctgctccaggaatgcaggg

SEQ ID NO: 274770 - DNA, 25 bp, Mus musculus
atgtttctgctcgaggaatgcaggg

SEQ ID NO: 274771 - DNA, 25 bp, Mus musculus
atgtttctggccctaacagtgggtt

SEQ ID NO: 274772 - DNA, 25 bp, Mus musculus
atgtttctggccgtaacagtgggtt

SEQ ID NO: 274773 - DNA, 25 bp, Mus musculus
atgtttctggtactgctgagttaat

SEQ ID NO: 274774 - DNA, 25 bp, Mus musculus
atgtttctggtagtgctgagttaat

SEQ ID NO: 274775 - DNA, 25 bp, Mus musculus
atgtttctgtctagccaacaactgc

SEQ ID NO: 274776 - DNA, 25 bp, Mus musculus
atgtttctgtcttgccaacaactgc

SEQ ID NO: 274777 - DNA, 25 bp, Mus musculus
atgtttctgtttagctgcttcctaa

SEQ ID NO: 274778 - DNA, 25 bp, Mus musculus
atgtttctgttttgctgcttcctaa

SEQ ID NO: 274779 - DNA, 25 bp, Mus musculus
atgtttcttaagcatccactcaaaa

SEQ ID NO: 274780 - DNA, 25 bp, Mus musculus
atgtttcttaaggatccactcaaaa

SEQ ID NO: 274781 - DNA, 25 bp, Mus musculus
atgtttcttaccaccgtatgttcat

SEQ ID NO: 274782 - DNA, 25 bp, Mus musculus
atgtttcttacctccgtatgttcat

SEQ ID NO: 274783 - DNA, 25 bp, Mus musculus
atgtttcttagtcttggccttctga

SEQ ID NO: 274784 - DNA, 25 bp, Mus musculus
atgtttcttagtgttggccttctga

SEQ ID NO: 274785 - DNA, 25 bp, Mus musculus
atgtttcttctcaaagatccgtgac

SEQ ID NO: 274786 - DNA, 25 bp, Mus musculus
atgtttcttctctaagatccgtgac

SEQ ID NO: 274787 - DNA, 25 bp, Mus musculus
atgtttcttttccagcactgccatt

SEQ ID NO: 274788 - DNA, 25 bp, Mus musculus
atgtttcttttcgagcactgccatt

SEQ ID NO: 274789 - DNA, 25 bp, Mus musculus
atgtttgaagctcgtctgggatata

SEQ ID NO: 274790 - DNA, 25 bp, Mus musculus
atgtttgaagctggtctgggatata

SEQ ID NO: 274791 - DNA, 25 bp, Mus musculus
atgtttgaagtccagcccagactct

SEQ ID NO: 274792 - DNA, 25 bp, Mus musculus
atgtttgaagtcgagcccagactct

SEQ ID NO: 274793 - DNA, 25 bp, Mus musculus
atgtttgaatgacatcctgcccgca

SEQ ID NO: 274794 - DNA, 25 bp, Mus musculus
atgtttgaatgagatcctgcccgca

SEQ ID NO: 274795 - DNA, 25 bp, Mus musculus
atgtttgacagcatccctttgctca

SEQ ID NO: 274796 - DNA, 25 bp, Mus musculus
atgtttgacagcttccctttgctca

SEQ ID NO: 274797 - DNA, 25 bp, Mus musculus
atgtttgacataatcctggacgaga

SEQ ID NO: 274798 - DNA, 25 bp, Mus musculus
atgtttgacatattcctggacgaga

SEQ ID NO: 274799 - DNA, 25 bp, Mus musculus
atgtttgacgtgacactgaatcgac

SEQ ID NO: 274800 - DNA, 25 bp, Mus musculus
atgtttgacgtgtcactgaatcgac

SEQ ID NO: 274801 - DNA, 25 bp, Mus musculus
atgtttgactggagccggagtcctg

SEQ ID NO: 274802 - DNA, 25 bp, Mus musculus
atgtttgactggtgccggagtcctg

SEQ ID NO: 274803 - DNA, 25 bp, Mus musculus
atgtttgacttcatcacccatatgc

SEQ ID NO: 274804 - DNA, 25 bp, Mus musculus
atgtttgacttcattttcccatcag

SEQ ID NO: 274805 - DNA, 25 bp, Mus musculus
atgtttgacttcttcacccatatgc

SEQ ID NO: 274806 - DNA, 25 bp, Mus musculus
atgtttgacttctttttcccatcag

SEQ ID NO: 274807 - DNA, 25 bp, Mus musculus
atgtttgagattatactggtaatac

SEQ ID NO: 274808 - DNA, 25 bp, Mus musculus
atgtttgagattttactggtaatac

SEQ ID NO: 274809 - DNA, 25 bp, Mus musculus
atgtttgagccacctgccctcattc

SEQ ID NO: 274810 - DNA, 25 bp, Mus musculus
atgtttgagccagctgccctcattc

SEQ ID NO: 274811 - DNA, 25 bp, Mus musculus
atgtttgagctccagttcttctatg

SEQ ID NO: 274812 - DNA, 25 bp, Mus musculus
atgtttgagctcgagttcttctatg

SEQ ID NO: 274813 - DNA, 25 bp, Mus musculus
atgtttgagctgcatctacccactg

SEQ ID NO: 274814 - DNA, 25 bp, Mus musculus
atgtttgagctggatctacccactg

SEQ ID NO: 274815 - DNA, 25 bp, Mus musculus
atgtttgaggccctcagttcagtct

SEQ ID NO: 274816 - DNA, 25 bp, Mus musculus
atgtttgaggccgtcagttcagtct

SEQ ID NO: 274817 - DNA, 25 bp, Mus musculus
atgtttgatgcactctggatgtcca

SEQ ID NO: 274818 - DNA, 25 bp, Mus musculus
atgtttgatgcagtctggatgtcca

SEQ ID NO: 274819 - DNA, 25 bp, Mus musculus
atgtttgatgccagagaccgacgtg

SEQ ID NO: 274820 - DNA, 25 bp, Mus musculus
atgtttgatgcctgagaccgacgtg

SEQ ID NO: 274821 - DNA, 25 bp, Mus musculus
atgtttgatgtacatccctgctggg

SEQ ID NO: 274822 - DNA, 25 bp, Mus musculus
atgtttgatgtagatccctgctggg

SEQ ID NO: 274823 - DNA, 25 bp, Mus musculus
atgtttgcaaatactggagcccagt

SEQ ID NO: 274824 - DNA, 25 bp, Mus musculus
atgtttgcaaattctggagcccagt

SEQ ID NO: 274825 - DNA, 25 bp, Mus musculus
atgtttgcactacgagctcctgatc

SEQ ID NO: 274826 - DNA, 25 bp, Mus musculus
atgtttgcactaggagctcctgatc

SEQ ID NO: 274827 - DNA, 25 bp, Mus musculus
atgtttgcagcacacatttctaaac

SEQ ID NO: 274828 - DNA, 25 bp, Mus musculus
atgtttgcagcagacatttctaaac

SEQ ID NO: 274829 - DNA, 25 bp, Mus musculus
atgtttgcagccctcatgccgaccg

SEQ ID NO: 274830 - DNA, 25 bp, Mus musculus
atgtttgcagccgtcatgccgaccg

SEQ ID NO: 274831 - DNA, 25 bp, Mus musculus
atgtttgcatacctacctgttgcaa

SEQ ID NO: 274832 - DNA, 25 bp, Mus musculus
atgtttgcatacgtacctgttgcaa

SEQ ID NO: 274833 - DNA, 25 bp, Mus musculus
atgtttgcatcaagctagcagctaa

SEQ ID NO: 274834 - DNA, 25 bp, Mus musculus
atgtttgcatcatgctagcagctaa

SEQ ID NO: 274835 - DNA, 25 bp, Mus musculus
atgtttgcatctcacatcggaggaa

SEQ ID NO: 274836 - DNA, 25 bp, Mus musculus
atgtttgcatctgacatcggaggaa

SEQ ID NO: 274837 - DNA, 25 bp, Mus musculus
atgtttgccaatactcttataatag

SEQ ID NO: 274838 - DNA, 25 bp, Mus musculus
atgtttgccaattctcttataatag

SEQ ID NO: 274839 - DNA, 25 bp, Mus musculus
atgtttgccaccacagggagttcag

SEQ ID NO: 274840 - DNA, 25 bp, Mus musculus
atgtttgccacctcagggagttcag

SEQ ID NO: 274841 - DNA, 25 bp, Mus musculus
atgtttgccattaaacctcaacttt

SEQ ID NO: 274842 - DNA, 25 bp, Mus musculus
atgtttgccattactaatctcctag

SEQ ID NO: 274843 - DNA, 25 bp, Mus musculus
atgtttgccatttaacctcaacttt

SEQ ID NO: 274844 - DNA, 25 bp, Mus musculus
atgtttgccatttctaatctcctag

SEQ ID NO: 274845 - DNA, 25 bp, Mus musculus
atgtttgcccagatggagatctaaa

SEQ ID NO: 274846 - DNA, 25 bp, Mus musculus
atgtttgcccagatttctagaaaag

SEQ ID NO: 274847 - DNA, 25 bp, Mus musculus
atgtttgcccagttggagatctaaa

SEQ ID NO: 274848 - DNA, 25 bp, Mus musculus
atgtttgcccagttttctagaaaag

SEQ ID NO: 274849 - DNA, 25 bp, Mus musculus
atgtttgcccctcaggtggcttcca

SEQ ID NO: 274850 - DNA, 25 bp, Mus musculus
atgtttgcccctgaggtggcttcca

SEQ ID NO: 274851 - DNA, 25 bp, Mus musculus
atgtttgccctgatttaaatgttaa

SEQ ID NO: 274852 - DNA, 25 bp, Mus musculus
atgtttgccctgcaagcctatgaga

SEQ ID NO: 274853 - DNA, 25 bp, Mus musculus
atgtttgccctggaagcctatgaga

SEQ ID NO: 274854 - DNA, 25 bp, Mus musculus
atgtttgccctgttttaaatgttaa

SEQ ID NO: 274855 - DNA, 25 bp, Mus musculus
atgtttgcctagcatctcatatcaa

SEQ ID NO: 274856 - DNA, 25 bp, Mus musculus
atgtttgcctaggatctcatatcaa

SEQ ID NO: 274857 - DNA, 25 bp, Mus musculus
atgtttgcctgcagggatccctgca

SEQ ID NO: 274858 - DNA, 25 bp, Mus musculus
atgtttgcctgctgggatccctgca

SEQ ID NO: 274859 - DNA, 25 bp, Mus musculus
atgtttgcctttagcgccattttat

SEQ ID NO: 274860 - DNA, 25 bp, Mus musculus
atgtttgccttttgcgccattttat

SEQ ID NO: 274861 - DNA, 25 bp, Mus musculus
atgtttgcgaaccaacggctgccac

SEQ ID NO: 274862 - DNA, 25 bp, Mus musculus
atgtttgcgaacgaacggctgccac

SEQ ID NO: 274863 - DNA, 25 bp, Mus musculus
atgtttgcgcacatgctttctcttt

SEQ ID NO: 274864 - DNA, 25 bp, Mus musculus
atgtttgcgcacttgctttctcttt

SEQ ID NO: 274865 - DNA, 25 bp, Mus musculus
atgtttgcgctgctgctggtagaac

SEQ ID NO: 274866 - DNA, 25 bp, Mus musculus
atgtttgcgctggtgctggtagaac

SEQ ID NO: 274867 - DNA, 25 bp, Mus musculus
atgtttgcggccagtgacctgctgc

SEQ ID NO: 274868 - DNA, 25 bp, Mus musculus
atgtttgcggcctgtgacctgctgc

SEQ ID NO: 274869 - DNA, 25 bp, Mus musculus
atgtttgctacaacccagtctggac

SEQ ID NO: 274870 - DNA, 25 bp, Mus musculus
atgtttgctacatcccagtctggac

SEQ ID NO: 274871 - DNA, 25 bp, Mus musculus
atgtttgctactaagtgacccgtgt

SEQ ID NO: 274872 - DNA, 25 bp, Mus musculus
atgtttgctacttagtgacccgtgt

SEQ ID NO: 274873 - DNA, 25 bp, Mus musculus
atgtttgctagcatccccaccacca

SEQ ID NO: 274874 - DNA, 25 bp, Mus musculus
atgtttgctagcttccccaccacca

SEQ ID NO: 274875 - DNA, 25 bp, Mus musculus
atgtttgctctgatcaggtgtccaa

SEQ ID NO: 274876 - DNA, 25 bp, Mus musculus
atgtttgctctgttcaggtgtccaa

SEQ ID NO: 274877 - DNA, 25 bp, Mus musculus
atgtttgctgacatgagcccctgcc

SEQ ID NO: 274878 - DNA, 25 bp, Mus musculus
atgtttgctgacttgagcccctgcc

SEQ ID NO: 274879 - DNA, 25 bp, Mus musculus
atgtttgctgataaactatggtgaa

SEQ ID NO: 274880 - DNA, 25 bp, Mus musculus
atgtttgctgattaactatggtgaa

SEQ ID NO: 274881 - DNA, 25 bp, Mus musculus
atgtttgctgcccaggagatgttca

SEQ ID NO: 274882 - DNA, 25 bp, Mus musculus
atgtttgctgccgaggagatgttca

SEQ ID NO: 274883 - DNA, 25 bp, Mus musculus
atgtttgctttaagccatcttagga

SEQ ID NO: 274884 - DNA, 25 bp, Mus musculus
atgtttgctttatgccatcttagga

SEQ ID NO: 274885 - DNA, 25 bp, Mus musculus
atgtttgctttcactgatacagaga

SEQ ID NO: 274886 - DNA, 25 bp, Mus musculus
atgtttgctttctctgatacagaga

SEQ ID NO: 274887 - DNA, 25 bp, Mus musculus
atgtttgcttttatgcaagccccaa

SEQ ID NO: 274888 - DNA, 25 bp, Mus musculus
atgtttgcttttttgcaagccccaa

SEQ ID NO: 274889 - DNA, 25 bp, Mus musculus
atgtttggatctaacctaccatgga

SEQ ID NO: 274890 - DNA, 25 bp, Mus musculus
atgtttggatcttacctaccatgga

SEQ ID NO: 274891 - DNA, 25 bp, Mus musculus
atgtttggcacaccagcatcctgcg

SEQ ID NO: 274892 - DNA, 25 bp, Mus musculus
atgtttggcacagcagcatcctgcg

SEQ ID NO: 274893 - DNA, 25 bp, Mus musculus
atgtttggcatacggaaattcctga

SEQ ID NO: 274894 - DNA, 25 bp, Mus musculus
atgtttggcatagggaaattcctga

SEQ ID NO: 274895 - DNA, 25 bp, Mus musculus
atgtttggccagactcttgcattga

SEQ ID NO: 274896 - DNA, 25 bp, Mus musculus
atgtttggccagtctcttgcattga

SEQ ID NO: 274897 - DNA, 25 bp, Mus musculus
atgtttggcttacaactccgggtgc

SEQ ID NO: 274898 - DNA, 25 bp, Mus musculus
atgtttggcttagaactccgggtgc

SEQ ID NO: 274899 - DNA, 25 bp, Mus musculus
atgtttgggtagacttcttgaagcc

SEQ ID NO: 274900 - DNA, 25 bp, Mus musculus
atgtttgggtagtcttcttgaagcc

SEQ ID NO: 274901 - DNA, 25 bp, Mus musculus
atgtttggtcagagggtgtgatctt

SEQ ID NO: 274902 - DNA, 25 bp, Mus musculus
atgtttggtcagtgggtgtgatctt

SEQ ID NO: 274903 - DNA, 25 bp, Mus musculus
atgtttggtcctcgcttggtagaac

SEQ ID NO: 274904 - DNA, 25 bp, Mus musculus
atgtttggtcctggcttggtagaac

SEQ ID NO: 274905 - DNA, 25 bp, Mus musculus
atgtttggtgtaatcctttcctata

SEQ ID NO: 274906 - DNA, 25 bp, Mus musculus
atgtttggtgtattcctttcctata

SEQ ID NO: 274907 - DNA, 25 bp, Mus musculus
atgtttggttaacctggtaccagca

SEQ ID NO: 274908 - DNA, 25 bp, Mus musculus
atgtttggttaagctggtaccagca

SEQ ID NO: 274909 - DNA, 25 bp, Mus musculus
atgtttggtttcaaaccacctccag

SEQ ID NO: 274910 - DNA, 25 bp, Mus musculus
atgtttggtttctaaccacctccag

SEQ ID NO: 274911 - DNA, 25 bp, Mus musculus
atgtttgtaaatctgggctcctcac

SEQ ID NO: 274912 - DNA, 25 bp, Mus musculus
atgtttgtaaatgtgggctcctcac

SEQ ID NO: 274913 - DNA, 25 bp, Mus musculus
atgtttgtaacccaactgtgacaga

SEQ ID NO: 274914 - DNA, 25 bp, Mus musculus
atgtttgtaaccgaactgtgacaga

SEQ ID NO: 274915 - DNA, 25 bp, Mus musculus
atgtttgtaatgactggccctgcgc

SEQ ID NO: 274916 - DNA, 25 bp, Mus musculus
atgtttgtaatgtctggccctgcgc

SEQ ID NO: 274917 - DNA, 25 bp, Mus musculus
atgtttgtacataattatgccttgt

SEQ ID NO: 274918 - DNA, 25 bp, Mus musculus
atgtttgtacattattatgccttgt

SEQ ID NO: 274919 - DNA, 25 bp, Mus musculus
atgtttgtactgaaatcctttgctt

SEQ ID NO: 274920 - DNA, 25 bp, Mus musculus
atgtttgtactgtaatcctttgctt

SEQ ID NO: 274921 - DNA, 25 bp, Mus musculus
atgtttgtatttactgccatgcaat

SEQ ID NO: 274922 - DNA, 25 bp, Mus musculus
atgtttgtattttctgccatgcaat

SEQ ID NO: 274923 - DNA, 25 bp, Mus musculus
atgtttgtcccacagagcatcacta

SEQ ID NO: 274924 - DNA, 25 bp, Mus musculus
atgtttgtcccagagagcatcacta

SEQ ID NO: 274925 - DNA, 25 bp, Mus musculus
atgtttgtctggatccaagtggaac

SEQ ID NO: 274926 - DNA, 25 bp, Mus musculus
atgtttgtctggttccaagtggaac

SEQ ID NO: 274927 - DNA, 25 bp, Mus musculus
atgtttgtcttgagaccatgtgctt

SEQ ID NO: 274928 - DNA, 25 bp, Mus musculus
atgtttgtcttgtgaccatgtgctt

SEQ ID NO: 274929 - DNA, 25 bp, Mus musculus
atgtttgtgaagatgccagatttaa

SEQ ID NO: 274930 - DNA, 25 bp, Mus musculus
atgtttgtgaagttgccagatttaa

SEQ ID NO: 274931 - DNA, 25 bp, Mus musculus
atgtttgtgagcaacagacccatgg

SEQ ID NO: 274932 - DNA, 25 bp, Mus musculus
atgtttgtgagctacagacccatgg

SEQ ID NO: 274933 - DNA, 25 bp, Mus musculus
atgtttgtgagtcgcgtctgctaat

SEQ ID NO: 274934 - DNA, 25 bp, Mus musculus
atgtttgtgagtggcgtctgctaat

SEQ ID NO: 274935 - DNA, 25 bp, Mus musculus
atgtttgtgcataaatattttcagt

SEQ ID NO: 274936 - DNA, 25 bp, Mus musculus
atgtttgtgcattaatattttcagt

SEQ ID NO: 274937 - DNA, 25 bp, Mus musculus
atgtttgtgccaaggatggtggtac

SEQ ID NO: 274938 - DNA, 25 bp, Mus musculus
atgtttgtgccactgatttagccac

SEQ ID NO: 274939 - DNA, 25 bp, Mus musculus
atgtttgtgccagtgatttagccac

SEQ ID NO: 274940 - DNA, 25 bp, Mus musculus
atgtttgtgccatggatggtggtac

SEQ ID NO: 274941 - DNA, 25 bp, Mus musculus
atgtttgtgctacgtctccactgag

SEQ ID NO: 274942 - DNA, 25 bp, Mus musculus
atgtttgtgctaggtctccactgag

SEQ ID NO: 274943 - DNA, 25 bp, Mus musculus
atgtttgtgcttaccccaacatgtt

SEQ ID NO: 274944 - DNA, 25 bp, Mus musculus
atgtttgtgctttccccaacatgtt

SEQ ID NO: 274945 - DNA, 25 bp, Mus musculus
atgtttgtgggcaactgctttcatc

SEQ ID NO: 274946 - DNA, 25 bp, Mus musculus
atgtttgtgggctactgctttcatc

SEQ ID NO: 274947 - DNA, 25 bp, Mus musculus
atgtttgtggtgctaatctctgtgt

SEQ ID NO: 274948 - DNA, 25 bp, Mus musculus
atgtttgtggtggtaatctctgtgt

SEQ ID NO: 274949 - DNA, 25 bp, Mus musculus
atgtttgtggttacaccgtgtcttc

SEQ ID NO: 274950 - DNA, 25 bp, Mus musculus
atgtttgtggtttcaccgtgtcttc

SEQ ID NO: 274951 - DNA, 25 bp, Mus musculus
atgtttgtgtacagagtcacccacc

SEQ ID NO: 274952 - DNA, 25 bp, Mus musculus
atgtttgtgtactgagtcacccacc

SEQ ID NO: 274953 - DNA, 25 bp, Mus musculus
atgtttgtgtgtaaggcacaccttt

SEQ ID NO: 274954 - DNA, 25 bp, Mus musculus
atgtttgtgtgttaggcacaccttt

SEQ ID NO: 274955 - DNA, 25 bp, Mus musculus
atgtttgtgttgacctcacccacct

SEQ ID NO: 274956 - DNA, 25 bp, Mus musculus
atgtttgtgttgtcctcacccacct

SEQ ID NO: 274957 - DNA, 25 bp, Mus musculus
atgtttgtgtttatacacctagaag

SEQ ID NO: 274958 - DNA, 25 bp, Mus musculus
atgtttgtgtttttacacctagaag

SEQ ID NO: 274959 - DNA, 25 bp, Mus musculus
atgtttgttactactacaagttgac

SEQ ID NO: 274960 - DNA, 25 bp, Mus musculus
atgtttgttacttctacaagttgac

SEQ ID NO: 274961 - DNA, 25 bp, Mus musculus
atgtttgttataccttgccccgagg

SEQ ID NO: 274962 - DNA, 25 bp, Mus musculus
atgtttgttataccttggcccgagg

SEQ ID NO: 274963 - DNA, 25 bp, Mus musculus
atgtttgttatagcttgccccgagg

SEQ ID NO: 274964 - DNA, 25 bp, Mus musculus
atgtttgttatagcttggcccgagg

SEQ ID NO: 274965 - DNA, 25 bp, Mus musculus
atgtttgttcctaaccatatctgtt

SEQ ID NO: 274966 - DNA, 25 bp, Mus musculus
atgtttgttccttaccatatctgtt

SEQ ID NO: 274967 - DNA, 25 bp, Mus musculus
atgtttgtttagacagccagcttct

SEQ ID NO: 274968 - DNA, 25 bp, Mus musculus
atgtttgtttagtcagccagcttct

SEQ ID NO: 274969 - DNA, 25 bp, Mus musculus
atgtttgtttatccactagttcaga

SEQ ID NO: 274970 - DNA, 25 bp, Mus musculus
atgtttgtttatgcactagttcaga

SEQ ID NO: 274971 - DNA, 25 bp, Mus musculus
atgtttgtttcactgccatacggaa

SEQ ID NO: 274972 - DNA, 25 bp, Mus musculus
atgtttgtttcagtgccatacggaa

SEQ ID NO: 274973 - DNA, 25 bp, Mus musculus
atgttttaacacctgactctggtca

SEQ ID NO: 274974 - DNA, 25 bp, Mus musculus
atgttttaacacgtgactctggtca

SEQ ID NO: 274975 - DNA, 25 bp, Mus musculus
atgttttaactcataccatgccctg

SEQ ID NO: 274976 - DNA, 25 bp, Mus musculus
atgttttaactcttaccatgccctg

SEQ ID NO: 274977 - DNA, 25 bp, Mus musculus
atgttttaagttcaatcccctctag

SEQ ID NO: 274978 - DNA, 25 bp, Mus musculus
atgttttaagttgaatcccctctag

SEQ ID NO: 274979 - DNA, 25 bp, Mus musculus
atgttttacaatcctaccgtggttc

SEQ ID NO: 274980 - DNA, 25 bp, Mus musculus
atgttttacaatgctaccgtggttc

SEQ ID NO: 274981 - DNA, 25 bp, Mus musculus
atgttttacattatcttactggctt

SEQ ID NO: 274982 - DNA, 25 bp, Mus musculus
atgttttacattttcttactggctt

SEQ ID NO: 274983 - DNA, 25 bp, Mus musculus
atgttttaccttatgagccatttga

SEQ ID NO: 274984 - DNA, 25 bp, Mus musculus
atgttttaccttttgagccatttga

SEQ ID NO: 274985 - DNA, 25 bp, Mus musculus
atgttttagccacacgacacactgt

SEQ ID NO: 274986 - DNA, 25 bp, Mus musculus
atgttttagccagacgacacactgt

SEQ ID NO: 274987 - DNA, 25 bp, Mus musculus
atgttttagcccatgttgtgagcag

SEQ ID NO: 274988 - DNA, 25 bp, Mus musculus
atgttttagcccttgttgtgagcag

SEQ ID NO: 274989 - DNA, 25 bp, Mus musculus
atgttttagccgattcctctatcac

SEQ ID NO: 274990 - DNA, 25 bp, Mus musculus
atgttttagccgtttcctctatcac

SEQ ID NO: 274991 - DNA, 25 bp, Mus musculus
atgttttagcctattgtttcttatg

SEQ ID NO: 274992 - DNA, 25 bp, Mus musculus
atgttttagccttttgtttcttatg

SEQ ID NO: 274993 - DNA, 25 bp, Mus musculus
atgttttagctgatggtgactggca

SEQ ID NO: 274994 - DNA, 25 bp, Mus musculus
atgttttagctgttggtgactggca

SEQ ID NO: 274995 - DNA, 25 bp, Mus musculus
atgttttagtataacatggcacaga

SEQ ID NO: 274996 - DNA, 25 bp, Mus musculus
atgttttagtattacatggcacaga

SEQ ID NO: 274997 - DNA, 25 bp, Mus musculus
atgttttatcagattggtccttatg

SEQ ID NO: 274998 - DNA, 25 bp, Mus musculus
atgttttatcagtttggtccttatg

SEQ ID NO: 274999 - DNA, 25 bp, Mus musculus
atgttttatcatatagagctcaaag

SEQ ID NO: 275000 - DNA, 25 bp, Mus musculus
atgttttatcatttagagctcaaag

SEQ ID NO: 275001 - DNA, 25 bp, Mus musculus
atgttttatccgctgtggtccacag

SEQ ID NO: 275002 - DNA, 25 bp, Mus musculus
atgttttatccggtgtggtccacag

SEQ ID NO: 275003 - DNA, 25 bp, Mus musculus
atgttttatcgcctagtcttcatgc

SEQ ID NO: 275004 - DNA, 25 bp, Mus musculus
atgttttatcgcgtagtcttcatgc

SEQ ID NO: 275005 - DNA, 25 bp, Mus musculus
atgttttatggaaccttcctgcagc

SEQ ID NO: 275006 - DNA, 25 bp, Mus musculus
atgttttatggatccttcctgcagc

SEQ ID NO: 275007 - DNA, 25 bp, Mus musculus
atgttttatttcctacttcattgag

SEQ ID NO: 275008 - DNA, 25 bp, Mus musculus
atgttttatttcgtacttcattgag

SEQ ID NO: 275009 - DNA, 25 bp, Mus musculus
atgttttattttccagaactcattt

SEQ ID NO: 275010 - DNA, 25 bp, Mus musculus
atgttttattttgcagaactcattt

SEQ ID NO: 275011 - DNA, 25 bp, Mus musculus
atgttttcactaccaccttcagaga

SEQ ID NO: 275012 - DNA, 25 bp, Mus musculus
atgttttcactagcaccttcagaga

SEQ ID NO: 275013 - DNA, 25 bp, Mus musculus
atgttttcactgacatctgcaacct

SEQ ID NO: 275014 - DNA, 25 bp, Mus musculus
atgttttcactgtcatctgcaacct

SEQ ID NO: 275015 - DNA, 25 bp, Mus musculus
atgttttcagacagagctcggctca

SEQ ID NO: 275016 - DNA, 25 bp, Mus musculus
atgttttcagactgagctcggctca

SEQ ID NO: 275017 - DNA, 25 bp, Mus musculus
atgttttcagagaacttctcgcccg

SEQ ID NO: 275018 - DNA, 25 bp, Mus musculus
atgttttcagagtacttctcgcccg

SEQ ID NO: 275019 - DNA, 25 bp, Mus musculus
atgttttcaggacaagccagtatgt

SEQ ID NO: 275020 - DNA, 25 bp, Mus musculus
atgttttcaggagaagccagtatgt

SEQ ID NO: 275021 - DNA, 25 bp, Mus musculus
atgttttcagttatttcagttcttt

SEQ ID NO: 275022 - DNA, 25 bp, Mus musculus
atgttttcagttctatggttctttg

SEQ ID NO: 275023 - DNA, 25 bp, Mus musculus
atgttttcagttgtatggttctttg

SEQ ID NO: 275024 - DNA, 25 bp, Mus musculus
atgttttcagttttttcagttcttt

SEQ ID NO: 275025 - DNA, 25 bp, Mus musculus
atgttttcatgacaacccaagacta

SEQ ID NO: 275026 - DNA, 25 bp, Mus musculus
atgttttcatgagaacccaagacta

SEQ ID NO: 275027 - DNA, 25 bp, Mus musculus
atgttttcatgcatgatccctggat

SEQ ID NO: 275028 - DNA, 25 bp, Mus musculus
atgttttcatgcttgatccctggat

SEQ ID NO: 275029 - DNA, 25 bp, Mus musculus
atgttttccacaatgccatattaag

SEQ ID NO: 275030 - DNA, 25 bp, Mus musculus
atgttttccacattgccatattaag

SEQ ID NO: 275031 - DNA, 25 bp, Mus musculus
atgttttccacgaagatggccatca

SEQ ID NO: 275032 - DNA, 25 bp, Mus musculus
atgttttccacgtagatggccatca

SEQ ID NO: 275033 - DNA, 25 bp, Mus musculus
atgttttccatacccatggccatca

SEQ ID NO: 275034 - DNA, 25 bp, Mus musculus
atgttttccatagccatggccatca

SEQ ID NO: 275035 - DNA, 25 bp, Mus musculus
atgttttcccacagatcgtgctaag

SEQ ID NO: 275036 - DNA, 25 bp, Mus musculus
atgttttcccactgatcgtgctaag

SEQ ID NO: 275037 - DNA, 25 bp, Mus musculus
atgttttccccaactgacctggaca

SEQ ID NO: 275038 - DNA, 25 bp, Mus musculus
atgttttccccatctgacctggaca

SEQ ID NO: 275039 - DNA, 25 bp, Mus musculus
atgttttccctcattgttgactgtc

SEQ ID NO: 275040 - DNA, 25 bp, Mus musculus
atgttttccctctttgttgactgtc

SEQ ID NO: 275041 - DNA, 25 bp, Mus musculus
atgttttcctcgaattccagggtgc

SEQ ID NO: 275042 - DNA, 25 bp, Mus musculus
atgttttcctcgtattccagggtgc

SEQ ID NO: 275043 - DNA, 25 bp, Mus musculus
atgttttctataatgtgcttcagga

SEQ ID NO: 275044 - DNA, 25 bp, Mus musculus
atgttttctatattgtgcttcagga

SEQ ID NO: 275045 - DNA, 25 bp, Mus musculus
atgttttctatgaaagctttgcagt

SEQ ID NO: 275046 - DNA, 25 bp, Mus musculus
atgttttctatgtaagctttgcagt

SEQ ID NO: 275047 - DNA, 25 bp, Mus musculus
atgttttctcagagctgggcgggaa

SEQ ID NO: 275048 - DNA, 25 bp, Mus musculus
atgttttctcagtgctgggcgggaa

SEQ ID NO: 275049 - DNA, 25 bp, Mus musculus
atgttttctcatcctctaatgtaaa

SEQ ID NO: 275050 - DNA, 25 bp, Mus musculus
atgttttctcatgctctaatgtaaa

SEQ ID NO: 275051 - DNA, 25 bp, Mus musculus
atgttttctcctaattttgttaatg

SEQ ID NO: 275052 - DNA, 25 bp, Mus musculus
atgttttctccttattttgttaatg

SEQ ID NO: 275053 - DNA, 25 bp, Mus musculus
atgttttctctaaacgtgttgccaa

SEQ ID NO: 275054 - DNA, 25 bp, Mus musculus
atgttttctctatacgtgttgccaa

SEQ ID NO: 275055 - DNA, 25 bp, Mus musculus
atgttttctcttctgcatcaattta

SEQ ID NO: 275056 - DNA, 25 bp, Mus musculus
atgttttctcttgtgcatcaattta

SEQ ID NO: 275057 - DNA, 25 bp, Mus musculus
atgttttctgcaccgatggccatca

SEQ ID NO: 275058 - DNA, 25 bp, Mus musculus
atgttttctgcagcgatggccatca

SEQ ID NO: 275059 - DNA, 25 bp, Mus musculus
atgttttctgccatagtctgggtgt

SEQ ID NO: 275060 - DNA, 25 bp, Mus musculus
atgttttctgccttagtctgggtgt

SEQ ID NO: 275061 - DNA, 25 bp, Mus musculus
atgttttctgtaatcctgtttgtgg

SEQ ID NO: 275062 - DNA, 25 bp, Mus musculus
atgttttctgtattcctgtttgtgg

SEQ ID NO: 275063 - DNA, 25 bp, Mus musculus
atgttttgcattcctagaagcaggt

SEQ ID NO: 275064 - DNA, 25 bp, Mus musculus
atgttttgcattgctagaagcaggt

SEQ ID NO: 275065 - DNA, 25 bp, Mus musculus
atgttttgccatatctcttttccac

SEQ ID NO: 275066 - DNA, 25 bp, Mus musculus
atgttttgccatttctcttttccac

SEQ ID NO: 275067 - DNA, 25 bp, Mus musculus
atgttttgccccatgtgagtttcta

SEQ ID NO: 275068 - DNA, 25 bp, Mus musculus
atgttttgccccttgtgagtttcta

SEQ ID NO: 275069 - DNA, 25 bp, Mus musculus
atgttttgcctgcaagcgtttctgt

SEQ ID NO: 275070 - DNA, 25 bp, Mus musculus
atgttttgcctggaagcgtttctgt

SEQ ID NO: 275071 - DNA, 25 bp, Mus musculus
atgttttggtgtcactgtgcctcgc

SEQ ID NO: 275072 - DNA, 25 bp, Mus musculus
atgttttggtgtgactgtgcctcgc

SEQ ID NO: 275073 - DNA, 25 bp, Mus musculus
atgttttgtcttcgactggacttaa

SEQ ID NO: 275074 - DNA, 25 bp, Mus musculus
atgttttgtcttggactggacttaa

SEQ ID NO: 275075 - DNA, 25 bp, Mus musculus
atgttttgttatctcgaggtatttc

SEQ ID NO: 275076 - DNA, 25 bp, Mus musculus
atgttttgttatgtcgaggtatttc

SEQ ID NO: 275077 - DNA, 25 bp, Mus musculus
atgtttttccctaccatccaagcac

SEQ ID NO: 275078 - DNA, 25 bp, Mus musculus
atgtttttcccttccatccaagcac

SEQ ID NO: 275079 - DNA, 25 bp, Mus musculus
atgtttttccggcagctgtctgaac

SEQ ID NO: 275080 - DNA, 25 bp, Mus musculus
atgtttttccgggagctgtctgaac

SEQ ID NO: 275081 - DNA, 25 bp, Mus musculus
atgtttttctacaggttctgatgta

SEQ ID NO: 275082 - DNA, 25 bp, Mus musculus
atgtttttctactggttctgatgta

SEQ ID NO: 275083 - DNA, 25 bp, Mus musculus
atgtttttctcaactgtgcacatga

SEQ ID NO: 275084 - DNA, 25 bp, Mus musculus
atgtttttctcatctgtgcacatga

SEQ ID NO: 275085 - DNA, 25 bp, Mus musculus
atgtttttctccatgtttgcggatg

SEQ ID NO: 275086 - DNA, 25 bp, Mus musculus
atgtttttctcccaattttgtgata

SEQ ID NO: 275087 - DNA, 25 bp, Mus musculus
atgtttttctccgaattttgtgata

SEQ ID NO: 275088 - DNA, 25 bp, Mus musculus
atgtttttctccttgtttgcggatg

SEQ ID NO: 275089 - DNA, 25 bp, Mus musculus
atgtttttctggattactgtacttt

SEQ ID NO: 275090 - DNA, 25 bp, Mus musculus
atgtttttctggtttactgtacttt

SEQ ID NO: 275091 - DNA, 25 bp, Mus musculus
atgtttttctttccatcgggatcct

SEQ ID NO: 275092 - DNA, 25 bp, Mus musculus
atgtttttctttgcatcgggatcct

SEQ ID NO: 275093 - DNA, 25 bp, Mus musculus
atgtttttgaatctaatgtagccac

SEQ ID NO: 275094 - DNA, 25 bp, Mus musculus
atgtttttgaatgtaatgtagccac

SEQ ID NO: 275095 - DNA, 25 bp, Mus musculus
atgtttttgatacagcatagctcag

SEQ ID NO: 275096 - DNA, 25 bp, Mus musculus
atgtttttgatagagcatagctcag

SEQ ID NO: 275097 - DNA, 25 bp, Mus musculus
atgtttttgcctatcatctcagcct

SEQ ID NO: 275098 - DNA, 25 bp, Mus musculus
atgtttttgcctttcatctcagcct

SEQ ID NO: 275099 - DNA, 25 bp, Mus musculus
atgtttttgctgaatattgtttcta

SEQ ID NO: 275100 - DNA, 25 bp, Mus musculus
atgtttttgctgtatattgtttcta

SEQ ID NO: 275101 - DNA, 25 bp, Mus musculus
atgttttttatgatgcccctgagta

SEQ ID NO: 275102 - DNA, 25 bp, Mus musculus
atgttttttatgttgcccctgagta

SEQ ID NO: 275103 - DNA, 25 bp, Mus musculus
atgttttttcctacttcagcagatg

SEQ ID NO: 275104 - DNA, 25 bp, Mus musculus
atgttttttcctccacctatgaatg

SEQ ID NO: 275105 - DNA, 25 bp, Mus musculus
atgttttttcctgcacctatgaatg

SEQ ID NO: 275106 - DNA, 25 bp, Mus musculus
atgttttttccttcttcagcagatg

SEQ ID NO: 275107 - DNA, 25 bp, Mus musculus
atgttttttcggagtctcaggaatc

SEQ ID NO: 275108 - DNA, 25 bp, Mus musculus
atgttttttcggtgtctcaggaatc

SEQ ID NO: 275109 - DNA, 25 bp, Mus musculus
attaaaaacacacttcgaagctgga

SEQ ID NO: 275110 - DNA, 25 bp, Mus musculus
attaaaaacacagttcgaagctgga

SEQ ID NO: 275111 - DNA, 25 bp, Mus musculus
attaaaaactaaactgcatctcccc

SEQ ID NO: 275112 - DNA, 25 bp, Mus musculus
attaaaaactaatctgcatctcccc

SEQ ID NO: 275113 - DNA, 25 bp, Mus musculus
attaaaaagcgaccgagtgcacccg

SEQ ID NO: 275114 - DNA, 25 bp, Mus musculus
attaaaaagcgagcgagtgcacccg

SEQ ID NO: 275115 - DNA, 25 bp, Mus musculus
attaaaaagtagcttggctgggctg

SEQ ID NO: 275116 - DNA, 25 bp, Mus musculus
attaaaaagtaggttggctgggctg

SEQ ID NO: 275117 - DNA, 25 bp, Mus musculus
attaaaacccttcagtgaccgccat

SEQ ID NO: 275118 - DNA, 25 bp, Mus musculus
attaaaacccttgagtgaccgccat

SEQ ID NO: 275119 - DNA, 25 bp, Mus musculus
attaaaactactaggactgctatat

SEQ ID NO: 275120 - DNA, 25 bp, Mus musculus
attaaaactacttggactgctatat

SEQ ID NO: 275121 - DNA, 25 bp, Mus musculus
attaaaactagaaatccaatacatc

SEQ ID NO: 275122 - DNA, 25 bp, Mus musculus
attaaaactagatatccaatacatc

SEQ ID NO: 275123 - DNA, 25 bp, Mus musculus
attaaaactcctaactaatgcggat

SEQ ID NO: 275124 - DNA, 25 bp, Mus musculus
attaaaactccttactaatgcggat

SEQ ID NO: 275125 - DNA, 25 bp, Mus musculus
attaaaagacaacccatctggctgt

SEQ ID NO: 275126 - DNA, 25 bp, Mus musculus
attaaaagacaagccatctggctgt

SEQ ID NO: 275127 - DNA, 25 bp, Mus musculus
attaaaagcctccagttccactcag

SEQ ID NO: 275128 - DNA, 25 bp, Mus musculus
attaaaagcctcgagttccactcag

SEQ ID NO: 275129 - DNA, 25 bp, Mus musculus
attaaaagctgcagaggcctcctca

SEQ ID NO: 275130 - DNA, 25 bp, Mus musculus
attaaaagctgctgaggcctcctca

SEQ ID NO: 275131 - DNA, 25 bp, Mus musculus
attaaaagggccagagacctcagga

SEQ ID NO: 275132 - DNA, 25 bp, Mus musculus
attaaaagggcctgagacctcagga

SEQ ID NO: 275133 - DNA, 25 bp, Mus musculus
attaaaataatgctcgctctggctg

SEQ ID NO: 275134 - DNA, 25 bp, Mus musculus
attaaaataatggtcgctctggctg

SEQ ID NO: 275135 - DNA, 25 bp, Mus musculus
attaaaatggtcctcccttccatgg

SEQ ID NO: 275136 - DNA, 25 bp, Mus musculus
attaaaatggtcgtcccttccatgg

SEQ ID NO: 275137 - DNA, 25 bp, Mus musculus
attaaaattactccacagttgtgcc

SEQ ID NO: 275138 - DNA, 25 bp, Mus musculus
attaaaattactgcacagttgtgcc

SEQ ID NO: 275139 - DNA, 25 bp, Mus musculus
attaaaatttgtaatgccactgcca

SEQ ID NO: 275140 - DNA, 25 bp, Mus musculus
attaaaatttgttatgccactgcca

SEQ ID NO: 275141 - DNA, 25 bp, Mus musculus
attaaacaagttaccttctgccagt

SEQ ID NO: 275142 - DNA, 25 bp, Mus musculus
attaaacaagtttccttctgccagt

SEQ ID NO: 275143 - DNA, 25 bp, Mus musculus
attaaacaatatatcctctcggctg

SEQ ID NO: 275144 - DNA, 25 bp, Mus musculus
attaaacaatatttcctctcggctg

SEQ ID NO: 275145 - DNA, 25 bp, Mus musculus
attaaacacccgattgctcatcagt

SEQ ID NO: 275146 - DNA, 25 bp, Mus musculus
attaaacacccgtttgctcatcagt

SEQ ID NO: 275147 - DNA, 25 bp, Mus musculus
attaaacactcccaatctgtctgtg

SEQ ID NO: 275148 - DNA, 25 bp, Mus musculus
attaaacactccgaatctgtctgtg

SEQ ID NO: 275149 - DNA, 25 bp, Mus musculus
attaaacagctgagctgctcctctg

SEQ ID NO: 275150 - DNA, 25 bp, Mus musculus
attaaacagctgtgctgctcctctg

SEQ ID NO: 275151 - DNA, 25 bp, Mus musculus
attaaacatcaccaaaccagctgct

SEQ ID NO: 275152 - DNA, 25 bp, Mus musculus
attaaacatcacgaaaccagctgct

SEQ ID NO: 275153 - DNA, 25 bp, Mus musculus
attaaacatctactgtgctcctggc

SEQ ID NO: 275154 - DNA, 25 bp, Mus musculus
attaaacatctagtgtgctcctggc

SEQ ID NO: 275155 - DNA, 25 bp, Mus musculus
attaaacatctccagcccggaacgt

SEQ ID NO: 275156 - DNA, 25 bp, Mus musculus
attaaacatctcgagcccggaacgt

SEQ ID NO: 275157 - DNA, 25 bp, Mus musculus
attaaaccatcaaagggctagccct

SEQ ID NO: 275158 - DNA, 25 bp, Mus musculus
attaaaccatcatagggctagccct

SEQ ID NO: 275159 - DNA, 25 bp, Mus musculus
attaaacccacaaccagctccagac

SEQ ID NO: 275160 - DNA, 25 bp, Mus musculus
attaaacccacatccagctccagac

SEQ ID NO: 275161 - DNA, 25 bp, Mus musculus
attaaacggacgcacttcatcctca

SEQ ID NO: 275162 - DNA, 25 bp, Mus musculus
attaaacggacggacttcatcctca

SEQ ID NO: 275163 - DNA, 25 bp, Mus musculus
attaaactactcaaatgcgttcgag

SEQ ID NO: 275164 - DNA, 25 bp, Mus musculus
attaaactactctaatgcgttcgag

SEQ ID NO: 275165 - DNA, 25 bp, Mus musculus
attaaactggctcctttgacacacc

SEQ ID NO: 275166 - DNA, 25 bp, Mus musculus
attaaactggctgctttgacacacc

SEQ ID NO: 275167 - DNA, 25 bp, Mus musculus
attaaacttcgtctcgttgactagg

SEQ ID NO: 275168 - DNA, 25 bp, Mus musculus
attaaacttcgtgtcgttgactagg

SEQ ID NO: 275169 - DNA, 25 bp, Mus musculus
attaaacttgttaccattctcatcc

SEQ ID NO: 275170 - DNA, 25 bp, Mus musculus
attaaacttgtttccattctcatcc

SEQ ID NO: 275171 - DNA, 25 bp, Mus musculus
attaaagaaccccaccaagagcact

SEQ ID NO: 275172 - DNA, 25 bp, Mus musculus
attaaagaacccgaccaagagcact

SEQ ID NO: 275173 - DNA, 25 bp, Mus musculus
attaaagacagtctcccttgcttgt

SEQ ID NO: 275174 - DNA, 25 bp, Mus musculus
attaaagacagtgtcccttgcttgt

SEQ ID NO: 275175 - DNA, 25 bp, Mus musculus
attaaagagtcaacctggctcccag

SEQ ID NO: 275176 - DNA, 25 bp, Mus musculus
attaaagagtcatcctggctcccag

SEQ ID NO: 275177 - DNA, 25 bp, Mus musculus
attaaagatgatagctcagcagcgg

SEQ ID NO: 275178 - DNA, 25 bp, Mus musculus
attaaagatgattgctcagcagcgg

SEQ ID NO: 275179 - DNA, 25 bp, Mus musculus
attaaagcactgatccctgggaggt

SEQ ID NO: 275180 - DNA, 25 bp, Mus musculus
attaaagcactgttccctgggaggt

SEQ ID NO: 275181 - DNA, 25 bp, Mus musculus
attaaagcatctaaaagtcccaatt

SEQ ID NO: 275182 - DNA, 25 bp, Mus musculus
attaaagcatcttaaagtcccaatt

SEQ ID NO: 275183 - DNA, 25 bp, Mus musculus
attaaagcccgtcagctgagcgctt

SEQ ID NO: 275184 - DNA, 25 bp, Mus musculus
attaaagcccgtgagctgagcgctt

SEQ ID NO: 275185 - DNA, 25 bp, Mus musculus
attaaagccctacatttagagccta

SEQ ID NO: 275186 - DNA, 25 bp, Mus musculus
attaaagccctagatttagagccta

SEQ ID NO: 275187 - DNA, 25 bp, Mus musculus
attaaagcctccaggaagaagccct

SEQ ID NO: 275188 - DNA, 25 bp, Mus musculus
attaaagcctcctggaagaagccct

SEQ ID NO: 275189 - DNA, 25 bp, Mus musculus
attaaagcctctcctacattctcga

SEQ ID NO: 275190 - DNA, 25 bp, Mus musculus
attaaagcctctgctacattctcga

SEQ ID NO: 275191 - DNA, 25 bp, Mus musculus
attaaagcgacgcatcactgcctac

SEQ ID NO: 275192 - DNA, 25 bp, Mus musculus
attaaagcgacggatcactgcctac

SEQ ID NO: 275193 - DNA, 25 bp, Mus musculus
attaaagctgtcaatctcttccctg

SEQ ID NO: 275194 - DNA, 25 bp, Mus musculus
attaaagctgtctatctcttccctg

SEQ ID NO: 275195 - DNA, 25 bp, Mus musculus
attaaagcttacctgttctacaaag

SEQ ID NO: 275196 - DNA, 25 bp, Mus musculus
attaaagcttacgtgttctacaaag

SEQ ID NO: 275197 - DNA, 25 bp, Mus musculus
attaaaggcatgctatctgggttgt

SEQ ID NO: 275198 - DNA, 25 bp, Mus musculus
attaaaggcatggtatctgggttgt

SEQ ID NO: 275199 - DNA, 25 bp, Mus musculus
attaaaggccacactgcttctcaga

SEQ ID NO: 275200 - DNA, 25 bp, Mus musculus
attaaaggccactctgcttctcaga

SEQ ID NO: 275201 - DNA, 25 bp, Mus musculus
attaaaggcggtccactggtactgg

SEQ ID NO: 275202 - DNA, 25 bp, Mus musculus
attaaaggcggtgcactggtactgg

SEQ ID NO: 275203 - DNA, 25 bp, Mus musculus
attaaaggctgtcctcacgtgacaa

SEQ ID NO: 275204 - DNA, 25 bp, Mus musculus
attaaaggctgtgctcacgtgacaa

SEQ ID NO: 275205 - DNA, 25 bp, Mus musculus
attaaaggcttactcaaacattcat

SEQ ID NO: 275206 - DNA, 25 bp, Mus musculus
attaaaggcttagtcaaacattcat

SEQ ID NO: 275207 - DNA, 25 bp, Mus musculus
attaaaggtgaacgaggctctccag

SEQ ID NO: 275208 - DNA, 25 bp, Mus musculus
attaaaggtgaaggaggctctccag

SEQ ID NO: 275209 - DNA, 25 bp, Mus musculus
attaaaggtgcgatctcccagtcat

SEQ ID NO: 275210 - DNA, 25 bp, Mus musculus
attaaaggtgcgttctcccagtcat

SEQ ID NO: 275211 - DNA, 25 bp, Mus musculus
attaaagtgaagacgctgactggga

SEQ ID NO: 275212 - DNA, 25 bp, Mus musculus
attaaagtgaagtcgctgactggga

SEQ ID NO: 275213 - DNA, 25 bp, Mus musculus
attaaagtgcgcctgggccaggaga

SEQ ID NO: 275214 - DNA, 25 bp, Mus musculus
attaaagtgcgcgtgggccaggaga

SEQ ID NO: 275215 - DNA, 25 bp, Mus musculus
attaaagtgtataccgccatgccca

SEQ ID NO: 275216 - DNA, 25 bp, Mus musculus
attaaagtgtattccgccatgccca

SEQ ID NO: 275217 - DNA, 25 bp, Mus musculus
attaaagttacgacagcagctgctg

SEQ ID NO: 275218 - DNA, 25 bp, Mus musculus
attaaagttacgtcagcagctgctg

SEQ ID NO: 275219 - DNA, 25 bp, Mus musculus
attaaagttctacccaccacatgtg

SEQ ID NO: 275220 - DNA, 25 bp, Mus musculus
attaaagttctagccaccacatgtg

SEQ ID NO: 275221 - DNA, 25 bp, Mus musculus
attaaagtttctcttggccaccact

SEQ ID NO: 275222 - DNA, 25 bp, Mus musculus
attaaagtttctgttggccaccact

SEQ ID NO: 275223 - DNA, 25 bp, Mus musculus
attaaatatctacacacacccacac

SEQ ID NO: 275224 - DNA, 25 bp, Mus musculus
attaaatatctagacacacccacac

SEQ ID NO: 275225 - DNA, 25 bp, Mus musculus
attaaatcaaccacctcagtggaga

SEQ ID NO: 275226 - DNA, 25 bp, Mus musculus
attaaatcaacctcctcagtggaga

SEQ ID NO: 275227 - DNA, 25 bp, Mus musculus
attaaatccagtactgcgttggctg

SEQ ID NO: 275228 - DNA, 25 bp, Mus musculus
attaaatccagttctgcgttggctg

SEQ ID NO: 275229 - DNA, 25 bp, Mus musculus
attaaatcccacctcaaaatactga

SEQ ID NO: 275230 - DNA, 25 bp, Mus musculus
attaaatcccacgtcaaaatactga

SEQ ID NO: 275231 - DNA, 25 bp, Mus musculus
attaaatcccagatgccctttgaga

SEQ ID NO: 275232 - DNA, 25 bp, Mus musculus
attaaatcccagttgccctttgaga

SEQ ID NO: 275233 - DNA, 25 bp, Mus musculus
attaaatcccatacaggcacggtgc

SEQ ID NO: 275234 - DNA, 25 bp, Mus musculus
attaaatcccattcaggcacggtgc

SEQ ID NO: 275235 - DNA, 25 bp, Mus musculus
attaaatcccggctgttacttctca

SEQ ID NO: 275236 - DNA, 25 bp, Mus musculus
attaaatcccgggtgttacttctca

SEQ ID NO: 275237 - DNA, 25 bp, Mus musculus
attaaatcccttcttgcagaaccac

SEQ ID NO: 275238 - DNA, 25 bp, Mus musculus
attaaatcccttgttgcagaaccac

SEQ ID NO: 275239 - DNA, 25 bp, Mus musculus
attaaatctccacaagtttcagtgt

SEQ ID NO: 275240 - DNA, 25 bp, Mus musculus
attaaatctccagaagtttcagtgt

SEQ ID NO: 275241 - DNA, 25 bp, Mus musculus
attaaatgcccaccttgtttgtaag

SEQ ID NO: 275242 - DNA, 25 bp, Mus musculus
attaaatgcccagcttgtttgtaag

SEQ ID NO: 275243 - DNA, 25 bp, Mus musculus
attaaatgcctgcagttaacacctg

SEQ ID NO: 275244 - DNA, 25 bp, Mus musculus
attaaatgcctggagttaacacctg

SEQ ID NO: 275245 - DNA, 25 bp, Mus musculus
attaaatgcgttctttggctgctaa

SEQ ID NO: 275246 - DNA, 25 bp, Mus musculus
attaaatgcgttgtttggctgctaa

SEQ ID NO: 275247 - DNA, 25 bp, Mus musculus
attaaatgctctacttggcaataat

SEQ ID NO: 275248 - DNA, 25 bp, Mus musculus
attaaatgctcttcttggcaataat

SEQ ID NO: 275249 - DNA, 25 bp, Mus musculus
attaaatgctttctcctttaagagt

SEQ ID NO: 275250 - DNA, 25 bp, Mus musculus
attaaatgctttgtcctttaagagt

SEQ ID NO: 275251 - DNA, 25 bp, Mus musculus
attaaatggtgcctgtccctgagac

SEQ ID NO: 275252 - DNA, 25 bp, Mus musculus
attaaatggtgcgtgtccctgagac

SEQ ID NO: 275253 - DNA, 25 bp, Mus musculus
attaaatgtcatctctcccaaactg

SEQ ID NO: 275254 - DNA, 25 bp, Mus musculus
attaaatgtcatgtctcccaaactg

SEQ ID NO: 275255 - DNA, 25 bp, Mus musculus
attaaatgtcgtcgcttcttggtct

SEQ ID NO: 275256 - DNA, 25 bp, Mus musculus
attaaatgtcgtggcttcttggtct

SEQ ID NO: 275257 - DNA, 25 bp, Mus musculus
attaaatgtgccacagacacctttg

SEQ ID NO: 275258 - DNA, 25 bp, Mus musculus
attaaatgtgcctcagacacctttg

SEQ ID NO: 275259 - DNA, 25 bp, Mus musculus
attaaattgtacagagccatccctt

SEQ ID NO: 275260 - DNA, 25 bp, Mus musculus
attaaattgtactgagccatccctt

SEQ ID NO: 275261 - DNA, 25 bp, Mus musculus
attaaatttactatgccatgccaca

SEQ ID NO: 275262 - DNA, 25 bp, Mus musculus
attaaatttactttgccatgccaca

SEQ ID NO: 275263 - DNA, 25 bp, Mus musculus
attaacaaccaacctgtgcaacctg

SEQ ID NO: 275264 - DNA, 25 bp, Mus musculus
attaacaaccaagctgtgcaacctg

SEQ ID NO: 275265 - DNA, 25 bp, Mus musculus
attaacaagctccttaagcccctga

SEQ ID NO: 275266 - DNA, 25 bp, Mus musculus
attaacaagctcgttaagcccctga

SEQ ID NO: 275267 - DNA, 25 bp, Mus musculus
attaacaagtaaccctaacagcagt

SEQ ID NO: 275268 - DNA, 25 bp, Mus musculus
attaacaagtaagcctaacagcagt

SEQ ID NO: 275269 - DNA, 25 bp, Mus musculus
attaacaatgccatctcactgtggt

SEQ ID NO: 275270 - DNA, 25 bp, Mus musculus
attaacaatgccttctcactgtggt

SEQ ID NO: 275271 - DNA, 25 bp, Mus musculus
attaacacaaaaaattcctggcatg

SEQ ID NO: 275272 - DNA, 25 bp, Mus musculus
attaacacaaaatattcctggcatg

SEQ ID NO: 275273 - DNA, 25 bp, Mus musculus
attaacacagtgatacctcgcttct

SEQ ID NO: 275274 - DNA, 25 bp, Mus musculus
attaacacagtgttacctcgcttct

SEQ ID NO: 275275 - DNA, 25 bp, Mus musculus
attaacaccaggaggtgacactggg

SEQ ID NO: 275276 - DNA, 25 bp, Mus musculus
attaacaccaggtggtgacactggg

SEQ ID NO: 275277 - DNA, 25 bp, Mus musculus
attaacactgggacaatgggcaaga

SEQ ID NO: 275278 - DNA, 25 bp, Mus musculus
attaacactgggtcaatgggcaaga

SEQ ID NO: 275279 - DNA, 25 bp, Mus musculus
attaacacttcaatgccctggcttt

SEQ ID NO: 275280 - DNA, 25 bp, Mus musculus
attaacacttcattgccctggcttt

SEQ ID NO: 275281 - DNA, 25 bp, Mus musculus
attaacagacatagggctctcatcc

SEQ ID NO: 275282 - DNA, 25 bp, Mus musculus
attaacagacattgggctctcatcc

SEQ ID NO: 275283 - DNA, 25 bp, Mus musculus
attaacagccagagtgccaatggtg

SEQ ID NO: 275284 - DNA, 25 bp, Mus musculus
attaacagccagtgtgccaatggtg

SEQ ID NO: 275285 - DNA, 25 bp, Mus musculus
attaacagctgcattgggtagcctg

SEQ ID NO: 275286 - DNA, 25 bp, Mus musculus
attaacagctgctttgggtagcctg

SEQ ID NO: 275287 - DNA, 25 bp, Mus musculus
attaacaggcttattcgtcttctca

SEQ ID NO: 275288 - DNA, 25 bp, Mus musculus
attaacaggctttttcgtcttctca

SEQ ID NO: 275289 - DNA, 25 bp, Mus musculus
attaacatccttacccagcattctg

SEQ ID NO: 275290 - DNA, 25 bp, Mus musculus
attaacatcctttcccagcattctg

SEQ ID NO: 275291 - DNA, 25 bp, Mus musculus
attaacatctatccccaagtccaac

SEQ ID NO: 275292 - DNA, 25 bp, Mus musculus
attaacatctatgcccaagtccaac

SEQ ID NO: 275293 - DNA, 25 bp, Mus musculus
attaacatgtatcctgagcaattta

SEQ ID NO: 275294 - DNA, 25 bp, Mus musculus
attaacatgtatgctgagcaattta

SEQ ID NO: 275295 - DNA, 25 bp, Mus musculus
attaacatgttgactctactgcagc

SEQ ID NO: 275296 - DNA, 25 bp, Mus musculus
attaacatgttgtctctactgcagc

SEQ ID NO: 275297 - DNA, 25 bp, Mus musculus
attaacattaatactcagcaatcat

SEQ ID NO: 275298 - DNA, 25 bp, Mus musculus
attaacattaattctcagcaatcat

SEQ ID NO: 275299 - DNA, 25 bp, Mus musculus
attaaccaacggaagtaggaagcat

SEQ ID NO: 275300 - DNA, 25 bp, Mus musculus
attaaccaacggtagtaggaagcat

SEQ ID NO: 275301 - DNA, 25 bp, Mus musculus
attaaccaatgcactcatatgcaag

SEQ ID NO: 275302 - DNA, 25 bp, Mus musculus
attaaccaatgctctcatatgcaag

SEQ ID NO: 275303 - DNA, 25 bp, Mus musculus
attaaccacctgacagagcacctga

SEQ ID NO: 275304 - DNA, 25 bp, Mus musculus
attaaccacctgtcagagcacctga

SEQ ID NO: 275305 - DNA, 25 bp, Mus musculus
attaaccatataaacatcccgagct

SEQ ID NO: 275306 - DNA, 25 bp, Mus musculus
attaaccatatatacatcccgagct

SEQ ID NO: 275307 - DNA, 25 bp, Mus musculus
attaacccagctcgacatggacctg

SEQ ID NO: 275308 - DNA, 25 bp, Mus musculus
attaacccagctggacatggacctg

SEQ ID NO: 275309 - DNA, 25 bp, Mus musculus
attaaccccagtcctgataatgcta

SEQ ID NO: 275310 - DNA, 25 bp, Mus musculus
attaaccccagtgctgataatgcta

SEQ ID NO: 275311 - DNA, 25 bp, Mus musculus
attaacccttctcctaatgtccatt

SEQ ID NO: 275312 - DNA, 25 bp, Mus musculus
attaacccttctgctaatgtccatt

SEQ ID NO: 275313 - DNA, 25 bp, Mus musculus
attaaccgggaaacacctggcagcc

SEQ ID NO: 275314 - DNA, 25 bp, Mus musculus
attaaccgggaatcacctggcagcc

SEQ ID NO: 275315 - DNA, 25 bp, Mus musculus
attaacctaaaacaccctcatcaga

SEQ ID NO: 275316 - DNA, 25 bp, Mus musculus
attaacctaaaaccacacatcagtg

SEQ ID NO: 275317 - DNA, 25 bp, Mus musculus
attaacctaaaagaccctcatcaga

SEQ ID NO: 275318 - DNA, 25 bp, Mus musculus
attaacctaaaagcacacatcagtg

SEQ ID NO: 275319 - DNA, 25 bp, Mus musculus
attaacctcggtattttatctcagt

SEQ ID NO: 275320 - DNA, 25 bp, Mus musculus
attaacctcggttttttatctcagt

SEQ ID NO: 275321 - DNA, 25 bp, Mus musculus
attaacctctagcatgaagtgacca

SEQ ID NO: 275322 - DNA, 25 bp, Mus musculus
attaacctctaggatgaagtgacca

SEQ ID NO: 275323 - DNA, 25 bp, Mus musculus
attaacctgacccagcatggaagga

SEQ ID NO: 275324 - DNA, 25 bp, Mus musculus
attaacctgaccgagcatggaagga

SEQ ID NO: 275325 - DNA, 25 bp, Mus musculus
attaaccttctgacaagcttgtagt

SEQ ID NO: 275326 - DNA, 25 bp, Mus musculus
attaaccttctgtcaagcttgtagt

SEQ ID NO: 275327 - DNA, 25 bp, Mus musculus
attaacgaactgcaaacctcatctt

SEQ ID NO: 275328 - DNA, 25 bp, Mus musculus
attaacgaactggaaacctcatctt

SEQ ID NO: 275329 - DNA, 25 bp, Mus musculus
attaacgaagcaccactgatgggta

SEQ ID NO: 275330 - DNA, 25 bp, Mus musculus
attaacgaagcagcactgatgggta

SEQ ID NO: 275331 - DNA, 25 bp, Mus musculus
attaacgaaggcaggacctcgctgg

SEQ ID NO: 275332 - DNA, 25 bp, Mus musculus
attaacgaaggctggacctcgctgg

SEQ ID NO: 275333 - DNA, 25 bp, Mus musculus
attaacgccagaacatgttgctcaa

SEQ ID NO: 275334 - DNA, 25 bp, Mus musculus
attaacgccagatcatgttgctcaa

SEQ ID NO: 275335 - DNA, 25 bp, Mus musculus
attaacgcgttcccagttgcagcga

SEQ ID NO: 275336 - DNA, 25 bp, Mus musculus
attaacgcgttcgcagttgcagcga

SEQ ID NO: 275337 - DNA, 25 bp, Mus musculus
attaacggtactccacaaggccatg

SEQ ID NO: 275338 - DNA, 25 bp, Mus musculus
attaacggtactgcacaaggccatg

SEQ ID NO: 275339 - DNA, 25 bp, Mus musculus
attaacgttatcattccatccccag

SEQ ID NO: 275340 - DNA, 25 bp, Mus musculus
attaacgttatctttccatccccag

SEQ ID NO: 275341 - DNA, 25 bp, Mus musculus
attaactaactcctgtcacccaata

SEQ ID NO: 275342 - DNA, 25 bp, Mus musculus
attaactaactcgtgtcacccaata

SEQ ID NO: 275343 - DNA, 25 bp, Mus musculus
attaactacgttatcctcaatattg

SEQ ID NO: 275344 - DNA, 25 bp, Mus musculus
attaactacgttttcctcaatattg

SEQ ID NO: 275345 - DNA, 25 bp, Mus musculus
attaactactgtccttgcagaggcc

SEQ ID NO: 275346 - DNA, 25 bp, Mus musculus
attaactactgtgcttgcagaggcc

SEQ ID NO: 275347 - DNA, 25 bp, Mus musculus
attaactagcagctcccatggttgg

SEQ ID NO: 275348 - DNA, 25 bp, Mus musculus
attaactagcaggtcccatggttgg

SEQ ID NO: 275349 - DNA, 25 bp, Mus musculus
attaactattttatgcactgggtga

SEQ ID NO: 275350 - DNA, 25 bp, Mus musculus
attaactattttttgcactgggtga

SEQ ID NO: 275351 - DNA, 25 bp, Mus musculus
attaactcagtcatgccgagcacca

SEQ ID NO: 275352 - DNA, 25 bp, Mus musculus
attaactcagtcttgccgagcacca

SEQ ID NO: 275353 - DNA, 25 bp, Mus musculus
attaactcattcatactgcacagca

SEQ ID NO: 275354 - DNA, 25 bp, Mus musculus
attaactcattcttactgcacagca

SEQ ID NO: 275355 - DNA, 25 bp, Mus musculus
attaactcctggagctttgtactac

SEQ ID NO: 275356 - DNA, 25 bp, Mus musculus
attaactcctggtgctttgtactac

SEQ ID NO: 275357 - DNA, 25 bp, Mus musculus
attaactcgctgcagataatctcat

SEQ ID NO: 275358 - DNA, 25 bp, Mus musculus
attaactcgctggagataatctcat

SEQ ID NO: 275359 - DNA, 25 bp, Mus musculus
attaactcggtgatttttgtcagac

SEQ ID NO: 275360 - DNA, 25 bp, Mus musculus
attaactcggtgttttttgtcagac

SEQ ID NO: 275361 - DNA, 25 bp, Mus musculus
attaactctgccatcgcttgtgtgt

SEQ ID NO: 275362 - DNA, 25 bp, Mus musculus
attaactctgccttcgcttgtgtgt

SEQ ID NO: 275363 - DNA, 25 bp, Mus musculus
attaactctttgaatgctgctcgtc

SEQ ID NO: 275364 - DNA, 25 bp, Mus musculus
attaactctttgtatgctgctcgtc

SEQ ID NO: 275365 - DNA, 25 bp, Mus musculus
attaactgcaggatagtgcacactt

SEQ ID NO: 275366 - DNA, 25 bp, Mus musculus
attaactgcaggttagtgcacactt

SEQ ID NO: 275367 - DNA, 25 bp, Mus musculus
attaactgctgtatgtcgtctgtcc

SEQ ID NO: 275368 - DNA, 25 bp, Mus musculus
attaactgctgtttgtcgtctgtcc

SEQ ID NO: 275369 - DNA, 25 bp, Mus musculus
attaactgcttaatctgaagaaaga

SEQ ID NO: 275370 - DNA, 25 bp, Mus musculus
attaactgcttattctgaagaaaga

SEQ ID NO: 275371 - DNA, 25 bp, Mus musculus
attaactggctgaggtgaccgactt

SEQ ID NO: 275372 - DNA, 25 bp, Mus musculus
attaactggctgtggtgaccgactt

SEQ ID NO: 275373 - DNA, 25 bp, Mus musculus
attaactggttcatgcgtagcatca

SEQ ID NO: 275374 - DNA, 25 bp, Mus musculus
attaactggttcttgcgtagcatca

SEQ ID NO: 275375 - DNA, 25 bp, Mus musculus
attaactgtgttctcaccgcaaggt

SEQ ID NO: 275376 - DNA, 25 bp, Mus musculus
attaactgtgttgtcaccgcaaggt

SEQ ID NO: 275377 - DNA, 25 bp, Mus musculus
attaactgttcactccccagattca

SEQ ID NO: 275378 - DNA, 25 bp, Mus musculus
attaactgttcagtccccagattca

SEQ ID NO: 275379 - DNA, 25 bp, Mus musculus
attaacttagttctaggctctgtga

SEQ ID NO: 275380 - DNA, 25 bp, Mus musculus
attaacttagttgtaggctctgtga

SEQ ID NO: 275381 - DNA, 25 bp, Mus musculus
attaacttcatgattagtagtccta

SEQ ID NO: 275382 - DNA, 25 bp, Mus musculus
attaacttcatgtttagtagtccta

SEQ ID NO: 275383 - DNA, 25 bp, Mus musculus
attaacttgcacatgttacatgtga

SEQ ID NO: 275384 - DNA, 25 bp, Mus musculus
attaacttgcacttgttacatgtga

SEQ ID NO: 275385 - DNA, 25 bp, Mus musculus
attaacttgctcaaaaacctgcagt

SEQ ID NO: 275386 - DNA, 25 bp, Mus musculus
attaacttgctctaaaacctgcagt

SEQ ID NO: 275387 - DNA, 25 bp, Mus musculus
attaactttcaaatggagccacaca

SEQ ID NO: 275388 - DNA, 25 bp, Mus musculus
attaactttcaattggagccacaca

SEQ ID NO: 275389 - DNA, 25 bp, Mus musculus
attaactttccaagtgctgccattc

SEQ ID NO: 275390 - DNA, 25 bp, Mus musculus
attaactttccatgtgctgccattc

SEQ ID NO: 275391 - DNA, 25 bp, Mus musculus
attaactttctgactcaattactag

SEQ ID NO: 275392 - DNA, 25 bp, Mus musculus
attaactttctgtctcaattactag

SEQ ID NO: 275393 - DNA, 25 bp, Mus musculus
attaacttttagagcccagcctggt

SEQ ID NO: 275394 - DNA, 25 bp, Mus musculus
attaacttttagtgcccagcctggt

SEQ ID NO: 275395 - DNA, 25 bp, Mus musculus
attaagaaatcaccctctccttcac

SEQ ID NO: 275396 - DNA, 25 bp, Mus musculus
attaagaaatcagcctctccttcac

SEQ ID NO: 275397 - DNA, 25 bp, Mus musculus
attaagaacctgactcaggcccagg

SEQ ID NO: 275398 - DNA, 25 bp, Mus musculus
attaagaacctgtctcaggcccagg

SEQ ID NO: 275399 - DNA, 25 bp, Mus musculus
attaagaagtgtcttctgctcactc

SEQ ID NO: 275400 - DNA, 25 bp, Mus musculus
attaagaagtgtgttctgctcactc

SEQ ID NO: 275401 - DNA, 25 bp, Mus musculus
attaagacacggatccaggaatctg

SEQ ID NO: 275402 - DNA, 25 bp, Mus musculus
attaagacacggttccaggaatctg

SEQ ID NO: 275403 - DNA, 25 bp, Mus musculus
attaagaccctgaatcagaaccttg

SEQ ID NO: 275404 - DNA, 25 bp, Mus musculus
attaagaccctgtatcagaaccttg

SEQ ID NO: 275405 - DNA, 25 bp, Mus musculus
attaagactgcccaacctggggatc

SEQ ID NO: 275406 - DNA, 25 bp, Mus musculus
attaagactgccgaacctggggatc

SEQ ID NO: 275407 - DNA, 25 bp, Mus musculus
attaagactggacatgcttctgctt

SEQ ID NO: 275408 - DNA, 25 bp, Mus musculus
attaagactggagatgcttctgctt

SEQ ID NO: 275409 - DNA, 25 bp, Mus musculus
attaagagacagagccttgtggcaa

SEQ ID NO: 275410 - DNA, 25 bp, Mus musculus
attaagagacagtgccttgtggcaa

SEQ ID NO: 275411 - DNA, 25 bp, Mus musculus
attaagaggtctagggcctctgcca

SEQ ID NO: 275412 - DNA, 25 bp, Mus musculus
attaagaggtcttgggcctctgcca

SEQ ID NO: 275413 - DNA, 25 bp, Mus musculus
attaagaggtgtccactagccgggc

SEQ ID NO: 275414 - DNA, 25 bp, Mus musculus
attaagaggtgtgcactagccgggc

SEQ ID NO: 275415 - DNA, 25 bp, Mus musculus
attaagatccatctcctttggctcc

SEQ ID NO: 275416 - DNA, 25 bp, Mus musculus
attaagatccatgtcctttggctcc

SEQ ID NO: 275417 - DNA, 25 bp, Mus musculus
attaagatctttattgcctctccca

SEQ ID NO: 275418 - DNA, 25 bp, Mus musculus
attaagatcttttttgcctctccca

SEQ ID NO: 275419 - DNA, 25 bp, Mus musculus
attaagattggcaggcttttaacca

SEQ ID NO: 275420 - DNA, 25 bp, Mus musculus
attaagattggctggcttttaacca

SEQ ID NO: 275421 - DNA, 25 bp, Mus musculus
attaagcaagctccaccatgatcag

SEQ ID NO: 275422 - DNA, 25 bp, Mus musculus
attaagcaagctgcaccatgatcag

SEQ ID NO: 275423 - DNA, 25 bp, Mus musculus
attaagcaccctaaccagctgaagc

SEQ ID NO: 275424 - DNA, 25 bp, Mus musculus
attaagcacccttaccagctgaagc

SEQ ID NO: 275425 - DNA, 25 bp, Mus musculus
attaagcacgcgcactctttttgac

SEQ ID NO: 275426 - DNA, 25 bp, Mus musculus
attaagcacgcggactctttttgac

SEQ ID NO: 275427 - DNA, 25 bp, Mus musculus
attaagcacttaaggtttagatgta

SEQ ID NO: 275428 - DNA, 25 bp, Mus musculus
attaagcacttatggtttagatgta

SEQ ID NO: 275429 - DNA, 25 bp, Mus musculus
attaagccaggcaactcgtttcctt

SEQ ID NO: 275430 - DNA, 25 bp, Mus musculus
attaagccaggctactcgtttcctt

SEQ ID NO: 275431 - DNA, 25 bp, Mus musculus
attaagcctccacgtactgcagttc

SEQ ID NO: 275432 - DNA, 25 bp, Mus musculus
attaagcctccaggtactgcagttc

SEQ ID NO: 275433 - DNA, 25 bp, Mus musculus
attaagcctgttacctttactctag

SEQ ID NO: 275434 - DNA, 25 bp, Mus musculus
attaagcctgtttcctttactctag

SEQ ID NO: 275435 - DNA, 25 bp, Mus musculus
attaagccttttactcacaatgtaa

SEQ ID NO: 275436 - DNA, 25 bp, Mus musculus
attaagcctttttctcacaatgtaa

SEQ ID NO: 275437 - DNA, 25 bp, Mus musculus
attaagcggtgtactgagtgtgcgc

SEQ ID NO: 275438 - DNA, 25 bp, Mus musculus
attaagcggtgttctgagtgtgcgc

SEQ ID NO: 275439 - DNA, 25 bp, Mus musculus
attaagctacacacaagggccacta

SEQ ID NO: 275440 - DNA, 25 bp, Mus musculus
attaagctacactcaagggccacta

SEQ ID NO: 275441 - DNA, 25 bp, Mus musculus
attaagctcataatttagcacatct

SEQ ID NO: 275442 - DNA, 25 bp, Mus musculus
attaagctcatattttagcacatct

SEQ ID NO: 275443 - DNA, 25 bp, Mus musculus
attaagctctctctctggtcctaat

SEQ ID NO: 275444 - DNA, 25 bp, Mus musculus
attaagctctctgtctggtcctaat

SEQ ID NO: 275445 - DNA, 25 bp, Mus musculus
attaagctgagccaggtggtacaca

SEQ ID NO: 275446 - DNA, 25 bp, Mus musculus
attaagctgagcgaggtggtacaca

SEQ ID NO: 275447 - DNA, 25 bp, Mus musculus
attaagctgcaaatgttatttctgc

SEQ ID NO: 275448 - DNA, 25 bp, Mus musculus
attaagctgcaattgttatttctgc

SEQ ID NO: 275449 - DNA, 25 bp, Mus musculus
attaagcttttccagggtgtgcggt

SEQ ID NO: 275450 - DNA, 25 bp, Mus musculus
attaagcttttcgagggtgtgcggt

SEQ ID NO: 275451 - DNA, 25 bp, Mus musculus
attaaggaagccatcttgaggagga

SEQ ID NO: 275452 - DNA, 25 bp, Mus musculus
attaaggaagccttcttgaggagga

SEQ ID NO: 275453 - DNA, 25 bp, Mus musculus
attaaggaaggcaccagcgtccggg

SEQ ID NO: 275454 - DNA, 25 bp, Mus musculus
attaaggaaggctccagcgtccggg

SEQ ID NO: 275455 - DNA, 25 bp, Mus musculus
attaaggaccataataagacccatt

SEQ ID NO: 275456 - DNA, 25 bp, Mus musculus
attaaggaccattataagacccatt

SEQ ID NO: 275457 - DNA, 25 bp, Mus musculus
attaaggaccgccactgtgagtctg

SEQ ID NO: 275458 - DNA, 25 bp, Mus musculus
attaaggaccgcgactgtgagtctg

SEQ ID NO: 275459 - DNA, 25 bp, Mus musculus
attaaggatgaactagaagctgggt

SEQ ID NO: 275460 - DNA, 25 bp, Mus musculus
attaaggatgaagtagaagctgggt

SEQ ID NO: 275461 - DNA, 25 bp, Mus musculus
attaaggatggacacctttgaccct

SEQ ID NO: 275462 - DNA, 25 bp, Mus musculus
attaaggatggagacctttgaccct

SEQ ID NO: 275463 - DNA, 25 bp, Mus musculus
attaaggatggcctctgcttggcca

SEQ ID NO: 275464 - DNA, 25 bp, Mus musculus
attaaggatggcgtctgcttggcca

SEQ ID NO: 275465 - DNA, 25 bp, Mus musculus
attaaggctcggcacctgcgcggca

SEQ ID NO: 275466 - DNA, 25 bp, Mus musculus
attaaggctcgggacctgcgcggca

SEQ ID NO: 275467 - DNA, 25 bp, Mus musculus
attaaggctcttatttcacctggca

SEQ ID NO: 275468 - DNA, 25 bp, Mus musculus
attaaggctcttttttcacctggca

SEQ ID NO: 275469 - DNA, 25 bp, Mus musculus
attaaggcttctcattccactaact

SEQ ID NO: 275470 - DNA, 25 bp, Mus musculus
attaaggcttctgattccactaact

SEQ ID NO: 275471 - DNA, 25 bp, Mus musculus
attaagggacgaccctgatgcatct

SEQ ID NO: 275472 - DNA, 25 bp, Mus musculus
attaagggacgagcctgatgcatct

SEQ ID NO: 275473 - DNA, 25 bp, Mus musculus
attaagggctgacttgattggagtt

SEQ ID NO: 275474 - DNA, 25 bp, Mus musculus
attaagggctgagttgattggagtt

SEQ ID NO: 275475 - DNA, 25 bp, Mus musculus
attaaggtacctccggtcagctggc

SEQ ID NO: 275476 - DNA, 25 bp, Mus musculus
attaaggtacctgcggtcagctggc

SEQ ID NO: 275477 - DNA, 25 bp, Mus musculus
attaaggtactaagccaagcgttta

SEQ ID NO: 275478 - DNA, 25 bp, Mus musculus
attaaggtactatgccaagcgttta

SEQ ID NO: 275479 - DNA, 25 bp, Mus musculus
attaaggtatccatgatgcttcata

SEQ ID NO: 275480 - DNA, 25 bp, Mus musculus
attaaggtatccttgatgcttcata

SEQ ID NO: 275481 - DNA, 25 bp, Mus musculus
attaaggtattcagttgcccctact

SEQ ID NO: 275482 - DNA, 25 bp, Mus musculus
attaaggtattctgttgcccctact

SEQ ID NO: 275483 - DNA, 25 bp, Mus musculus
attaaggtcacgaggagacgcagaa

SEQ ID NO: 275484 - DNA, 25 bp, Mus musculus
attaaggtcacgtggagacgcagaa

SEQ ID NO: 275485 - DNA, 25 bp, Mus musculus
attaaggtcagcactgttctccatg

SEQ ID NO: 275486 - DNA, 25 bp, Mus musculus
attaaggtcagctctgttctccatg

SEQ ID NO: 275487 - DNA, 25 bp, Mus musculus
attaaggtgaacctcctcgttcctg

SEQ ID NO: 275488 - DNA, 25 bp, Mus musculus
attaaggtgaacgtcctcgttcctg

SEQ ID NO: 275489 - DNA, 25 bp, Mus musculus
attaaggtgataatccttcctcaat

SEQ ID NO: 275490 - DNA, 25 bp, Mus musculus
attaaggtgatattccttcctcaat

SEQ ID NO: 275491 - DNA, 25 bp, Mus musculus
attaaggtgcctaccactgtcgtgg

SEQ ID NO: 275492 - DNA, 25 bp, Mus musculus
attaaggtgccttccactgtcgtgg

SEQ ID NO: 275493 - DNA, 25 bp, Mus musculus
attaaggttcatacattgtcaggtc

SEQ ID NO: 275494 - DNA, 25 bp, Mus musculus
attaaggttcattcattgtcaggtc

SEQ ID NO: 275495 - DNA, 25 bp, Mus musculus
attaaggttgacagtcagtgtcccc

SEQ ID NO: 275496 - DNA, 25 bp, Mus musculus
attaaggttgactgtcagtgtcccc

SEQ ID NO: 275497 - DNA, 25 bp, Mus musculus
attaagtagcttatcgcaggccact

SEQ ID NO: 275498 - DNA, 25 bp, Mus musculus
attaagtagcttttcgcaggccact

SEQ ID NO: 275499 - DNA, 25 bp, Mus musculus
attaagtcagtgctatccccaggat

SEQ ID NO: 275500 - DNA, 25 bp, Mus musculus
attaagtcagtggtatccccaggat

SEQ ID NO: 275501 - DNA, 25 bp, Mus musculus
attaagtcctatcaaatctgggcca

SEQ ID NO: 275502 - DNA, 25 bp, Mus musculus
attaagtcctatgaaatctgggcca

SEQ ID NO: 275503 - DNA, 25 bp, Mus musculus
attaagtctctgctggcgaagctgc

SEQ ID NO: 275504 - DNA, 25 bp, Mus musculus
attaagtctctggtggcgaagctgc

SEQ ID NO: 275505 - DNA, 25 bp, Mus musculus
attaagtgaactcccagcagctctg

SEQ ID NO: 275506 - DNA, 25 bp, Mus musculus
attaagtgaactgccagcagctctg

SEQ ID NO: 275507 - DNA, 25 bp, Mus musculus
attaagtgatctccggatccaccca

SEQ ID NO: 275508 - DNA, 25 bp, Mus musculus
attaagtgatctgcggatccaccca

SEQ ID NO: 275509 - DNA, 25 bp, Mus musculus
attaagtgcatacccatcacctgcc

SEQ ID NO: 275510 - DNA, 25 bp, Mus musculus
attaagtgcatagccatcacctgcc

SEQ ID NO: 275511 - DNA, 25 bp, Mus musculus
attaagtgccccagccaggacctgc

SEQ ID NO: 275512 - DNA, 25 bp, Mus musculus
attaagtgcccctgccaggacctgc

SEQ ID NO: 275513 - DNA, 25 bp, Mus musculus
attaagtgctgtcttgaaggcccaa

SEQ ID NO: 275514 - DNA, 25 bp, Mus musculus
attaagtgctgtgttgaaggcccaa

SEQ ID NO: 275515 - DNA, 25 bp, Mus musculus
attaagtgggtcaggactcttggcc

SEQ ID NO: 275516 - DNA, 25 bp, Mus musculus
attaagtgggtctggactcttggcc

SEQ ID NO: 275517 - DNA, 25 bp, Mus musculus
attaagtgtccaaagcatcagctca

SEQ ID NO: 275518 - DNA, 25 bp, Mus musculus
attaagtgtccatagcatcagctca

SEQ ID NO: 275519 - DNA, 25 bp, Mus musculus
attaagtgtgtgcatctcgctgggc

SEQ ID NO: 275520 - DNA, 25 bp, Mus musculus
attaagtgtgtggatctcgctgggc

SEQ ID NO: 275521 - DNA, 25 bp, Mus musculus
attaagtgtttccaaagaggctatt

SEQ ID NO: 275522 - DNA, 25 bp, Mus musculus
attaagtgtttcgaaagaggctatt

SEQ ID NO: 275523 - DNA, 25 bp, Mus musculus
attaagttacatccaatcgtgcttg

SEQ ID NO: 275524 - DNA, 25 bp, Mus musculus
attaagttacatgcaatcgtgcttg

SEQ ID NO: 275525 - DNA, 25 bp, Mus musculus
attaagttaggtcgcctttgcctag

SEQ ID NO: 275526 - DNA, 25 bp, Mus musculus
attaagttaggtggcctttgcctag

SEQ ID NO: 275527 - DNA, 25 bp, Mus musculus
attaagttcatcaggacgtttgtct

SEQ ID NO: 275528 - DNA, 25 bp, Mus musculus
attaagttcatcagttcttctcagc

SEQ ID NO: 275529 - DNA, 25 bp, Mus musculus
attaagttcatctggacgtttgtct

SEQ ID NO: 275530 - DNA, 25 bp, Mus musculus
attaagttcatctgttcttctcagc

SEQ ID NO: 275531 - DNA, 25 bp, Mus musculus
attaagttccatagcatgagacctt

SEQ ID NO: 275532 - DNA, 25 bp, Mus musculus
attaagttccattgcatgagacctt

SEQ ID NO: 275533 - DNA, 25 bp, Mus musculus
attaagttctaactgtcctcaaaag

SEQ ID NO: 275534 - DNA, 25 bp, Mus musculus
attaagttctaagtgtcctcaaaag

SEQ ID NO: 275535 - DNA, 25 bp, Mus musculus
attaagttgaaacctgggcttggct

SEQ ID NO: 275536 - DNA, 25 bp, Mus musculus
attaagttgaaagctgggcttggct

SEQ ID NO: 275537 - DNA, 25 bp, Mus musculus
attaagttgctactacctctttctg

SEQ ID NO: 275538 - DNA, 25 bp, Mus musculus
attaagttgctagtacctctttctg

SEQ ID NO: 275539 - DNA, 25 bp, Mus musculus
attaagttggacaaagcgaccttga

SEQ ID NO: 275540 - DNA, 25 bp, Mus musculus
attaagttggactaagcgaccttga

SEQ ID NO: 275541 - DNA, 25 bp, Mus musculus
attaagttggagctcagtccggact

SEQ ID NO: 275542 - DNA, 25 bp, Mus musculus
attaagttggaggtcagtccggact

SEQ ID NO: 275543 - DNA, 25 bp, Mus musculus
attaataatctgaatgagggcggca

SEQ ID NO: 275544 - DNA, 25 bp, Mus musculus
attaataatctgtatgagggcggca

SEQ ID NO: 275545 - DNA, 25 bp, Mus musculus
attaataatgcccgtttctctagac

SEQ ID NO: 275546 - DNA, 25 bp, Mus musculus
attaataatgccggtttctctagac

SEQ ID NO: 275547 - DNA, 25 bp, Mus musculus
attaatacagccctcatgccagatt

SEQ ID NO: 275548 - DNA, 25 bp, Mus musculus
attaatacagccgtcatgccagatt

SEQ ID NO: 275549 - DNA, 25 bp, Mus musculus
attaataccctcagggatcccttgg

SEQ ID NO: 275550 - DNA, 25 bp, Mus musculus
attaataccctctgggatcccttgg

SEQ ID NO: 275551 - DNA, 25 bp, Mus musculus
attaatactatgctgtctcaggaca

SEQ ID NO: 275552 - DNA, 25 bp, Mus musculus
attaatactatggtgtctcaggaca

SEQ ID NO: 275553 - DNA, 25 bp, Mus musculus
attaatactattcggacactttgtc

SEQ ID NO: 275554 - DNA, 25 bp, Mus musculus
attaatactattgggacactttgtc

SEQ ID NO: 275555 - DNA, 25 bp, Mus musculus
attaatacttggctgaactggagga

SEQ ID NO: 275556 - DNA, 25 bp, Mus musculus
attaatacttgggtgaactggagga

SEQ ID NO: 275557 - DNA, 25 bp, Mus musculus
attaatagcactcgtttcctcctgc

SEQ ID NO: 275558 - DNA, 25 bp, Mus musculus
attaatagcactggtttcctcctgc

SEQ ID NO: 275559 - DNA, 25 bp, Mus musculus
attaatatcttgacccagagctcct

SEQ ID NO: 275560 - DNA, 25 bp, Mus musculus
attaatatcttgtcccagagctcct

SEQ ID NO: 275561 - DNA, 25 bp, Mus musculus
attaatatgcacacggtggtctgca

SEQ ID NO: 275562 - DNA, 25 bp, Mus musculus
attaatatgcactcggtggtctgca

SEQ ID NO: 275563 - DNA, 25 bp, Mus musculus
attaatatgcatattccctaacagg

SEQ ID NO: 275564 - DNA, 25 bp, Mus musculus
attaatatgcattttccctaacagg

SEQ ID NO: 275565 - DNA, 25 bp, Mus musculus
attaatatgggtcgcctatttgctc

SEQ ID NO: 275566 - DNA, 25 bp, Mus musculus
attaatatgggtggcctatttgctc

SEQ ID NO: 275567 - DNA, 25 bp, Mus musculus
attaatattcatcgtacttcctctg

SEQ ID NO: 275568 - DNA, 25 bp, Mus musculus
attaatattcatggtacttcctctg

SEQ ID NO: 275569 - DNA, 25 bp, Mus musculus
attaatcaaggccactgtgcacgcc

SEQ ID NO: 275570 - DNA, 25 bp, Mus musculus
attaatcaaggcgactgtgcacgcc

SEQ ID NO: 275571 - DNA, 25 bp, Mus musculus
attaatcaccctacattactttggg

SEQ ID NO: 275572 - DNA, 25 bp, Mus musculus
attaatcacccttcattactttggg

SEQ ID NO: 275573 - DNA, 25 bp, Mus musculus
attaatcaggttaggcacttttatt

SEQ ID NO: 275574 - DNA, 25 bp, Mus musculus
attaatcaggtttggcacttttatt

SEQ ID NO: 275575 - DNA, 25 bp, Mus musculus
attaatcatatcacagcaaagccaa

SEQ ID NO: 275576 - DNA, 25 bp, Mus musculus
attaatcatatctcagcaaagccaa

SEQ ID NO: 275577 - DNA, 25 bp, Mus musculus
attaatcatcatattcgttgtagaa

SEQ ID NO: 275578 - DNA, 25 bp, Mus musculus
attaatcatcattttcgttgtagaa

SEQ ID NO: 275579 - DNA, 25 bp, Mus musculus
attaatccatgaccttacacttaca

SEQ ID NO: 275580 - DNA, 25 bp, Mus musculus
attaatccatgagcttacacttaca

SEQ ID NO: 275581 - DNA, 25 bp, Mus musculus
attaatcccaatattcctttcttgg

SEQ ID NO: 275582 - DNA, 25 bp, Mus musculus
attaatcccaattttcctttcttgg

SEQ ID NO: 275583 - DNA, 25 bp, Mus musculus
attaatccccttcccatgtggtctt

SEQ ID NO: 275584 - DNA, 25 bp, Mus musculus
attaatccccttgccatgtggtctt

SEQ ID NO: 275585 - DNA, 25 bp, Mus musculus
attaatccctgaacactgtgctaag

SEQ ID NO: 275586 - DNA, 25 bp, Mus musculus
attaatccctgatcactgtgctaag

SEQ ID NO: 275587 - DNA, 25 bp, Mus musculus
attaatcctcacatgttagcacctc

SEQ ID NO: 275588 - DNA, 25 bp, Mus musculus
attaatcctcacttgttagcacctc

SEQ ID NO: 275589 - DNA, 25 bp, Mus musculus
attaatcctggacttctttgatgca

SEQ ID NO: 275590 - DNA, 25 bp, Mus musculus
attaatcctggagttctttgatgca

SEQ ID NO: 275591 - DNA, 25 bp, Mus musculus
attaatcgaattacagctgcctccc

SEQ ID NO: 275592 - DNA, 25 bp, Mus musculus
attaatcgaatttcagctgcctccc

SEQ ID NO: 275593 - DNA, 25 bp, Mus musculus
attaatcgggataccctgtgacccg

SEQ ID NO: 275594 - DNA, 25 bp, Mus musculus
attaatcgggattccctgtgacccg

SEQ ID NO: 275595 - DNA, 25 bp, Mus musculus
attaatctctctcgcagccacttcg

SEQ ID NO: 275596 - DNA, 25 bp, Mus musculus
attaatctctctggcagccacttcg

SEQ ID NO: 275597 - DNA, 25 bp, Mus musculus
attaatctgaggcttggcagcaaca

SEQ ID NO: 275598 - DNA, 25 bp, Mus musculus
attaatctgagggttggcagcaaca

SEQ ID NO: 275599 - DNA, 25 bp, Mus musculus
attaatctggagactcgggctgtag

SEQ ID NO: 275600 - DNA, 25 bp, Mus musculus
attaatctggagtctcgggctgtag

SEQ ID NO: 275601 - DNA, 25 bp, Mus musculus
attaatctgggcaccgttctcatct

SEQ ID NO: 275602 - DNA, 25 bp, Mus musculus
attaatctgggctccgttctcatct

SEQ ID NO: 275603 - DNA, 25 bp, Mus musculus
attaatctgtcaaccctcacaattg

SEQ ID NO: 275604 - DNA, 25 bp, Mus musculus
attaatctgtcatccctcacaattg

SEQ ID NO: 275605 - DNA, 25 bp, Mus musculus
attaatctgtccctttcagacctag

SEQ ID NO: 275606 - DNA, 25 bp, Mus musculus
attaatctgtccgtttcagacctag

SEQ ID NO: 275607 - DNA, 25 bp, Mus musculus
attaatctgttaatggttcttccac

SEQ ID NO: 275608 - DNA, 25 bp, Mus musculus
attaatctgttattggttcttccac

SEQ ID NO: 275609 - DNA, 25 bp, Mus musculus
attaatcttcctagttaccttgcca

SEQ ID NO: 275610 - DNA, 25 bp, Mus musculus
attaatcttccttgttaccttgcca

SEQ ID NO: 275611 - DNA, 25 bp, Mus musculus
attaatcttctcctcgtatggtatt

SEQ ID NO: 275612 - DNA, 25 bp, Mus musculus
attaatcttctcgtcgtatggtatt

SEQ ID NO: 275613 - DNA, 25 bp, Mus musculus
attaatgaaaccctctccagagaga

SEQ ID NO: 275614 - DNA, 25 bp, Mus musculus
attaatgaaaccgtctccagagaga

SEQ ID NO: 275615 - DNA, 25 bp, Mus musculus
attaatgacccgcagcatccactga

SEQ ID NO: 275616 - DNA, 25 bp, Mus musculus
attaatgacccggagcatccactga

SEQ ID NO: 275617 - DNA, 25 bp, Mus musculus
attaatgatctacccaatggccgag

SEQ ID NO: 275618 - DNA, 25 bp, Mus musculus
attaatgatctagccaatggccgag

SEQ ID NO: 275619 - DNA, 25 bp, Mus musculus
attaatgatgcacgcttactaaaat

SEQ ID NO: 275620 - DNA, 25 bp, Mus musculus
attaatgatgcaggcttactaaaat

SEQ ID NO: 275621 - DNA, 25 bp, Mus musculus
attaatgcagacactacttgtggca

SEQ ID NO: 275622 - DNA, 25 bp, Mus musculus
attaatgcagactctacttgtggca

SEQ ID NO: 275623 - DNA, 25 bp, Mus musculus
attaatgcaggtcattcctcccgct

SEQ ID NO: 275624 - DNA, 25 bp, Mus musculus
attaatgcaggtgattcctcccgct

SEQ ID NO: 275625 - DNA, 25 bp, Mus musculus
attaatgccaaccttgaagccagtg

SEQ ID NO: 275626 - DNA, 25 bp, Mus musculus
attaatgccaacgttgaagccagtg

SEQ ID NO: 275627 - DNA, 25 bp, Mus musculus
attaatgccatacctccagagaatc

SEQ ID NO: 275628 - DNA, 25 bp, Mus musculus
attaatgccatagctccagagaatc

SEQ ID NO: 275629 - DNA, 25 bp, Mus musculus
attaatgcccaaaccttatagtcag

SEQ ID NO: 275630 - DNA, 25 bp, Mus musculus
attaatgcccaatccttatagtcag

SEQ ID NO: 275631 - DNA, 25 bp, Mus musculus
attaatgcccttactctatttgaga

SEQ ID NO: 275632 - DNA, 25 bp, Mus musculus
attaatgccctttctctatttgaga

SEQ ID NO: 275633 - DNA, 25 bp, Mus musculus
attaatgccgctatgatttctgtct

SEQ ID NO: 275634 - DNA, 25 bp, Mus musculus
attaatgccgctttgatttctgtct

SEQ ID NO: 275635 - DNA, 25 bp, Mus musculus
attaatgccgtgaacttgccttact

SEQ ID NO: 275636 - DNA, 25 bp, Mus musculus
attaatgccgtgtacttgccttact

SEQ ID NO: 275637 - DNA, 25 bp, Mus musculus
attaatgctctccaagtgcgatctt

SEQ ID NO: 275638 - DNA, 25 bp, Mus musculus
attaatgctctcgaagtgcgatctt

SEQ ID NO: 275639 - DNA, 25 bp, Mus musculus
attaatgcttctacattggtacccc

SEQ ID NO: 275640 - DNA, 25 bp, Mus musculus
attaatgcttcttcattggtacccc

SEQ ID NO: 275641 - DNA, 25 bp, Mus musculus
attaatgcttgcctggcccttttcc

SEQ ID NO: 275642 - DNA, 25 bp, Mus musculus
attaatgcttgcgtggcccttttcc

SEQ ID NO: 275643 - DNA, 25 bp, Mus musculus
attaatggactgatctctctggtgt

SEQ ID NO: 275644 - DNA, 25 bp, Mus musculus
attaatggactgttctctctggtgt

SEQ ID NO: 275645 - DNA, 25 bp, Mus musculus
attaatggtatccatggctctgata

SEQ ID NO: 275646 - DNA, 25 bp, Mus musculus
attaatggtatcgatggctctgata

SEQ ID NO: 275647 - DNA, 25 bp, Mus musculus
attaatggtcctcatctgactcttg

SEQ ID NO: 275648 - DNA, 25 bp, Mus musculus
attaatggtcctgatctgactcttg

SEQ ID NO: 275649 - DNA, 25 bp, Mus musculus
attaatggtgtcagtcggtatgccc

SEQ ID NO: 275650 - DNA, 25 bp, Mus musculus
attaatggtgtctgtcggtatgccc

SEQ ID NO: 275651 - DNA, 25 bp, Mus musculus
attaatgtattcacaccagccgacc

SEQ ID NO: 275652 - DNA, 25 bp, Mus musculus
attaatgtattctcaccagccgacc

SEQ ID NO: 275653 - DNA, 25 bp, Mus musculus
attaatgtccccagttgattttctt

SEQ ID NO: 275654 - DNA, 25 bp, Mus musculus
attaatgtcccctgttgattttctt

SEQ ID NO: 275655 - DNA, 25 bp, Mus musculus
attaatgtgcgtatctgttgcctgg

SEQ ID NO: 275656 - DNA, 25 bp, Mus musculus
attaatgtgcgtttctgttgcctgg

SEQ ID NO: 275657 - DNA, 25 bp, Mus musculus
attaatgtggacaccagcttccgct

SEQ ID NO: 275658 - DNA, 25 bp, Mus musculus
attaatgtggactccagcttccgct

SEQ ID NO: 275659 - DNA, 25 bp, Mus musculus
attaatgtggatctgtcggccttta

SEQ ID NO: 275660 - DNA, 25 bp, Mus musculus
attaatgtggatgtgtcggccttta

SEQ ID NO: 275661 - DNA, 25 bp, Mus musculus
attaatgttcccacctaactacgat

SEQ ID NO: 275662 - DNA, 25 bp, Mus musculus
attaatgttccctcctaactacgat

SEQ ID NO: 275663 - DNA, 25 bp, Mus musculus
attaatgttgtgcacccaaattaca

SEQ ID NO: 275664 - DNA, 25 bp, Mus musculus
attaatgttgtggacccaaattaca

SEQ ID NO: 275665 - DNA, 25 bp, Mus musculus
attaattaatacatggctgaactgg

SEQ ID NO: 275666 - DNA, 25 bp, Mus musculus
attaattaatacttggctgaactgg

SEQ ID NO: 275667 - DNA, 25 bp, Mus musculus
attaattaggtacacctgtgccgat

SEQ ID NO: 275668 - DNA, 25 bp, Mus musculus
attaattaggtagacctgtgccgat

SEQ ID NO: 275669 - DNA, 25 bp, Mus musculus
attaattatgaactacccaaattct

SEQ ID NO: 275670 - DNA, 25 bp, Mus musculus
attaattatgaagtacccaaattct

SEQ ID NO: 275671 - DNA, 25 bp, Mus musculus
attaattcagatctggtcccagtac

SEQ ID NO: 275672 - DNA, 25 bp, Mus musculus
attaattcagatgtggtcccagtac

SEQ ID NO: 275673 - DNA, 25 bp, Mus musculus
attaattccaccaaactcagcgatg

SEQ ID NO: 275674 - DNA, 25 bp, Mus musculus
attaattccacctaactcagcgatg

SEQ ID NO: 275675 - DNA, 25 bp, Mus musculus
attaattctcccattcctggtagct

SEQ ID NO: 275676 - DNA, 25 bp, Mus musculus
attaattctccctttcctggtagct

SEQ ID NO: 275677 - DNA, 25 bp, Mus musculus
attaattgcagcctttggtttttct

SEQ ID NO: 275678 - DNA, 25 bp, Mus musculus
attaattgcagcgtttggtttttct

SEQ ID NO: 275679 - DNA, 25 bp, Mus musculus
attaattgcttaagcacttagtcac

SEQ ID NO: 275680 - DNA, 25 bp, Mus musculus
attaattgcttatgcacttagtcac

SEQ ID NO: 275681 - DNA, 25 bp, Mus musculus
attaattggtccatcctggctttac

SEQ ID NO: 275682 - DNA, 25 bp, Mus musculus
attaattggtccttcctggctttac

SEQ ID NO: 275683 - DNA, 25 bp, Mus musculus
attaattgtcggaattgccggaaca

SEQ ID NO: 275684 - DNA, 25 bp, Mus musculus
attaattgtcggtattgccggaaca

SEQ ID NO: 275685 - DNA, 25 bp, Mus musculus
attaattgtcttatatgagcagcag

SEQ ID NO: 275686 - DNA, 25 bp, Mus musculus
attaattgtcttttatgagcagcag

SEQ ID NO: 275687 - DNA, 25 bp, Mus musculus
attaattgtttcatcctggctacct

SEQ ID NO: 275688 - DNA, 25 bp, Mus musculus
attaattgtttcttcctggctacct

SEQ ID NO: 275689 - DNA, 25 bp, Mus musculus
attaatttacttccccaccaacatc

SEQ ID NO: 275690 - DNA, 25 bp, Mus musculus
attaatttacttgcccaccaacatc

SEQ ID NO: 275691 - DNA, 25 bp, Mus musculus
attaatttagcgatcctcaaggaat

SEQ ID NO: 275692 - DNA, 25 bp, Mus musculus
attaatttagcgttcctcaaggaat

SEQ ID NO: 275693 - DNA, 25 bp, Mus musculus
attaatttatctcttccgaatgcct

SEQ ID NO: 275694 - DNA, 25 bp, Mus musculus
attaatttatctgttccgaatgcct

SEQ ID NO: 275695 - DNA, 25 bp, Mus musculus
attaatttatgtatagctctctgag

SEQ ID NO: 275696 - DNA, 25 bp, Mus musculus
attaatttatgtttagctctctgag

SEQ ID NO: 275697 - DNA, 25 bp, Mus musculus
attaatttcaccatttcggctggct

SEQ ID NO: 275698 - DNA, 25 bp, Mus musculus
attaatttcaccttttcggctggct

SEQ ID NO: 275699 - DNA, 25 bp, Mus musculus
attaatttgacacccttctaccttg

SEQ ID NO: 275700 - DNA, 25 bp, Mus musculus
attaatttgacagccttctaccttg

SEQ ID NO: 275701 - DNA, 25 bp, Mus musculus
attaatttgcgaattcagacccggg

SEQ ID NO: 275702 - DNA, 25 bp, Mus musculus
attaatttgcgatttcagacccggg

SEQ ID NO: 275703 - DNA, 25 bp, Mus musculus
attaatttggtgacgtgggcccgag

SEQ ID NO: 275704 - DNA, 25 bp, Mus musculus
attaatttggtgtcgtgggcccgag

SEQ ID NO: 275705 - DNA, 25 bp, Mus musculus
attaattttctcagtcctcagattt

SEQ ID NO: 275706 - DNA, 25 bp, Mus musculus
attaattttctctgtcctcagattt

SEQ ID NO: 275707 - DNA, 25 bp, Mus musculus
attaattttgtcagtattacaccaa

SEQ ID NO: 275708 - DNA, 25 bp, Mus musculus
attaattttgtctgtattacaccaa

SEQ ID NO: 275709 - DNA, 25 bp, Mus musculus
attaattttttcatacactgactgt

SEQ ID NO: 275710 - DNA, 25 bp, Mus musculus
attaattttttcatatgaccagcag

SEQ ID NO: 275711 - DNA, 25 bp, Mus musculus
attaattttttcttacactgactgt

SEQ ID NO: 275712 - DNA, 25 bp, Mus musculus
attaattttttcttatgaccagcag

SEQ ID NO: 275713 - DNA, 25 bp, Mus musculus
attacaaaacagagcccttgctagg

SEQ ID NO: 275714 - DNA, 25 bp, Mus musculus
attacaaaacagtgcccttgctagg

SEQ ID NO: 275715 - DNA, 25 bp, Mus musculus
attacaaaaggactccgccttctgg

SEQ ID NO: 275716 - DNA, 25 bp, Mus musculus
attacaaaaggagtccgccttctgg

SEQ ID NO: 275717 - DNA, 25 bp, Mus musculus
attacaaagccgatttttgccgctg

SEQ ID NO: 275718 - DNA, 25 bp, Mus musculus
attacaaagccgttttttgccgctg

SEQ ID NO: 275719 - DNA, 25 bp, Mus musculus
attacaaagtgaaggttctgtgttt

SEQ ID NO: 275720 - DNA, 25 bp, Mus musculus
attacaaagtgatggttctgtgttt

SEQ ID NO: 275721 - DNA, 25 bp, Mus musculus
attacaaatataaaggacatgccaa

SEQ ID NO: 275722 - DNA, 25 bp, Mus musculus
attacaaatatataggacatgccaa

SEQ ID NO: 275723 - DNA, 25 bp, Mus musculus
attacaacaaggctcgggtgccagg

SEQ ID NO: 275724 - DNA, 25 bp, Mus musculus
attacaacaagggtcgggtgccagg

SEQ ID NO: 275725 - DNA, 25 bp, Mus musculus
attacaacagagctggaatgcccaa

SEQ ID NO: 275726 - DNA, 25 bp, Mus musculus
attacaacagaggtggaatgcccaa

SEQ ID NO: 275727 - DNA, 25 bp, Mus musculus
attacaacagcactttcccgggata

SEQ ID NO: 275728 - DNA, 25 bp, Mus musculus
attacaacagcagtttcccgggata

SEQ ID NO: 275729 - DNA, 25 bp, Mus musculus
attacaacgagcaatccctgcacga

SEQ ID NO: 275730 - DNA, 25 bp, Mus musculus
attacaacgagctatccctgcacga

SEQ ID NO: 275731 - DNA, 25 bp, Mus musculus
attacaactatgacatccgggctaa

SEQ ID NO: 275732 - DNA, 25 bp, Mus musculus
attacaactatgtcatccgggctaa

SEQ ID NO: 275733 - DNA, 25 bp, Mus musculus
attacaactccacttccacctcagt

SEQ ID NO: 275734 - DNA, 25 bp, Mus musculus
attacaactccagttccacctcagt

SEQ ID NO: 275735 - DNA, 25 bp, Mus musculus
attacaagagtgcttgccccacatg

SEQ ID NO: 275736 - DNA, 25 bp, Mus musculus
attacaagagtggttgccccacatg

SEQ ID NO: 275737 - DNA, 25 bp, Mus musculus
attacaagctggagccccaccaaat

SEQ ID NO: 275738 - DNA, 25 bp, Mus musculus
attacaagctggtgccccaccaaat

SEQ ID NO: 275739 - DNA, 25 bp, Mus musculus
attacaagcttgaatccagatacat

SEQ ID NO: 275740 - DNA, 25 bp, Mus musculus
attacaagcttgtatccagatacat

SEQ ID NO: 275741 - DNA, 25 bp, Mus musculus
attacaagtaatatggtcccaatgt

SEQ ID NO: 275742 - DNA, 25 bp, Mus musculus
attacaagtaatttggtcccaatgt

SEQ ID NO: 275743 - DNA, 25 bp, Mus musculus
attacaatcggaacacattcagctg

SEQ ID NO: 275744 - DNA, 25 bp, Mus musculus
attacaatcggatcacattcagctg

SEQ ID NO: 275745 - DNA, 25 bp, Mus musculus
attacaatgaaaaccagtgtctaaa

SEQ ID NO: 275746 - DNA, 25 bp, Mus musculus
attacaatgaaatccagtgtctaaa

SEQ ID NO: 275747 - DNA, 25 bp, Mus musculus
attacaatgtagaaaatccaggcaa

SEQ ID NO: 275748 - DNA, 25 bp, Mus musculus
attacaatgtagtaaatccaggcaa

SEQ ID NO: 275749 - DNA, 25 bp, Mus musculus
attacaattccaactctaatcttgg

SEQ ID NO: 275750 - DNA, 25 bp, Mus musculus
attacaattccatctctaatcttgg

SEQ ID NO: 275751 - DNA, 25 bp, Mus musculus
attacaattgagaaacagactacct

SEQ ID NO: 275752 - DNA, 25 bp, Mus musculus
attacaattgagtaacagactacct

SEQ ID NO: 275753 - DNA, 25 bp, Mus musculus
attacacaaaccctagagccctgtc

SEQ ID NO: 275754 - DNA, 25 bp, Mus musculus
attacacaaaccgtagagccctgtc

SEQ ID NO: 275755 - DNA, 25 bp, Mus musculus
attacacaacgacgctctacttcct

SEQ ID NO: 275756 - DNA, 25 bp, Mus musculus
attacacaacgaggctctacttcct

SEQ ID NO: 275757 - DNA, 25 bp, Mus musculus
attacacacgtacctttcaaaacag

SEQ ID NO: 275758 - DNA, 25 bp, Mus musculus
attacacacgtagctttcaaaacag

SEQ ID NO: 275759 - DNA, 25 bp, Mus musculus
attacacactgcacactgcttcaca

SEQ ID NO: 275760 - DNA, 25 bp, Mus musculus
attacacactgctcactgcttcaca

SEQ ID NO: 275761 - DNA, 25 bp, Mus musculus
attacacacttgacttggagccaca

SEQ ID NO: 275762 - DNA, 25 bp, Mus musculus
attacacacttgtcttggagccaca

SEQ ID NO: 275763 - DNA, 25 bp, Mus musculus
attacacagagcctgagttccgttc

SEQ ID NO: 275764 - DNA, 25 bp, Mus musculus
attacacagagcgtgagttccgttc

SEQ ID NO: 275765 - DNA, 25 bp, Mus musculus
attacacaggcaaagtaagggccct

SEQ ID NO: 275766 - DNA, 25 bp, Mus musculus
attacacaggcatagtaagggccct

SEQ ID NO: 275767 - DNA, 25 bp, Mus musculus
attacacataacaggctcacaccca

SEQ ID NO: 275768 - DNA, 25 bp, Mus musculus
attacacataactggctcacaccca

SEQ ID NO: 275769 - DNA, 25 bp, Mus musculus
attacacatcctcatataacccaaa

SEQ ID NO: 275770 - DNA, 25 bp, Mus musculus
attacacatcctgatataacccaaa

SEQ ID NO: 275771 - DNA, 25 bp, Mus musculus
attacacatttcaatcagctttaaa

SEQ ID NO: 275772 - DNA, 25 bp, Mus musculus
attacacatttctatcagctttaaa

SEQ ID NO: 275773 - DNA, 25 bp, Mus musculus
attacaccaccaaactaggctacta

SEQ ID NO: 275774 - DNA, 25 bp, Mus musculus
attacaccaccatactaggctacta

SEQ ID NO: 275775 - DNA, 25 bp, Mus musculus
attacaccagagagatacgagaaat

SEQ ID NO: 275776 - DNA, 25 bp, Mus musculus
attacaccagagtgatacgagaaat

SEQ ID NO: 275777 - DNA, 25 bp, Mus musculus
attacacccacaagatggcaaaagt

SEQ ID NO: 275778 - DNA, 25 bp, Mus musculus
attacacccacatgatggcaaaagt

SEQ ID NO: 275779 - DNA, 25 bp, Mus musculus
attacacccaccaaattccaattca

SEQ ID NO: 275780 - DNA, 25 bp, Mus musculus
attacacccacctaattccaattca

SEQ ID NO: 275781 - DNA, 25 bp, Mus musculus
attacaccccagaaacatgggagga

SEQ ID NO: 275782 - DNA, 25 bp, Mus musculus
attacaccccagtaacatgggagga

SEQ ID NO: 275783 - DNA, 25 bp, Mus musculus
attacaccccatagtgtggatcctg

SEQ ID NO: 275784 - DNA, 25 bp, Mus musculus
attacaccccattgtgtggatcctg

SEQ ID NO: 275785 - DNA, 25 bp, Mus musculus
attacacccgtcatatacgaacccg

SEQ ID NO: 275786 - DNA, 25 bp, Mus musculus
attacacccgtcttatacgaacccg

SEQ ID NO: 275787 - DNA, 25 bp, Mus musculus
attacaccgtacctcatatactagg

SEQ ID NO: 275788 - DNA, 25 bp, Mus musculus
attacaccgtacgtcatatactagg

SEQ ID NO: 275789 - DNA, 25 bp, Mus musculus
attacacctaggaaagcagcagcag

SEQ ID NO: 275790 - DNA, 25 bp, Mus musculus
attacacctaggctacatctttctt

SEQ ID NO: 275791 - DNA, 25 bp, Mus musculus
attacacctagggtacatctttctt

SEQ ID NO: 275792 - DNA, 25 bp, Mus musculus
attacacctaggtaagcagcagcag

SEQ ID NO: 275793 - DNA, 25 bp, Mus musculus
attacacctagtcaccttttcaaga

SEQ ID NO: 275794 - DNA, 25 bp, Mus musculus
attacacctagtgaccttttcaaga

SEQ ID NO: 275795 - DNA, 25 bp, Mus musculus
attacacggatgatggctggccgcc

SEQ ID NO: 275796 - DNA, 25 bp, Mus musculus
attacacggatgttggctggccgcc

SEQ ID NO: 275797 - DNA, 25 bp, Mus musculus
attacactaggcactcagggtgcgg

SEQ ID NO: 275798 - DNA, 25 bp, Mus musculus
attacactaggctctcagggtgcgg

SEQ ID NO: 275799 - DNA, 25 bp, Mus musculus
attacactcaatcaggtcccttcat

SEQ ID NO: 275800 - DNA, 25 bp, Mus musculus
attacactcaatgaggtcccttcat

SEQ ID NO: 275801 - DNA, 25 bp, Mus musculus
attacactgactatttacattgaaa

SEQ ID NO: 275802 - DNA, 25 bp, Mus musculus
attacactgactttttacattgaaa

SEQ ID NO: 275803 - DNA, 25 bp, Mus musculus
attacactgagtaagcggcatttaa

SEQ ID NO: 275804 - DNA, 25 bp, Mus musculus
attacactgagttagcggcatttaa

SEQ ID NO: 275805 - DNA, 25 bp, Mus musculus
attacactgcctagcgatccaaaac

SEQ ID NO: 275806 - DNA, 25 bp, Mus musculus
attacactgccttgcgatccaaaac

SEQ ID NO: 275807 - DNA, 25 bp, Mus musculus
attacactggacagatgacatgagg

SEQ ID NO: 275808 - DNA, 25 bp, Mus musculus
attacactggactgatgacatgagg

SEQ ID NO: 275809 - DNA, 25 bp, Mus musculus
attacactggtgacctttgcactca

SEQ ID NO: 275810 - DNA, 25 bp, Mus musculus
attacactggtgtcctttgcactca

SEQ ID NO: 275811 - DNA, 25 bp, Mus musculus
attacacttagaagcagaccactgc

SEQ ID NO: 275812 - DNA, 25 bp, Mus musculus
attacacttagatgcagaccactgc

SEQ ID NO: 275813 - DNA, 25 bp, Mus musculus
attacactttgtactgctcttatca

SEQ ID NO: 275814 - DNA, 25 bp, Mus musculus
attacactttgttctgctcttatca

SEQ ID NO: 275815 - DNA, 25 bp, Mus musculus
attacagaaagtcacccaacagttt

SEQ ID NO: 275816 - DNA, 25 bp, Mus musculus
attacagaaagtgacccaacagttt

SEQ ID NO: 275817 - DNA, 25 bp, Mus musculus
attacagaacttcccgttttgctgc

SEQ ID NO: 275818 - DNA, 25 bp, Mus musculus
attacagaacttgccgttttgctgc

SEQ ID NO: 275819 - DNA, 25 bp, Mus musculus
attacagaatccaaacccagctcaa

SEQ ID NO: 275820 - DNA, 25 bp, Mus musculus
attacagaatcctaacccagctcaa

SEQ ID NO: 275821 - DNA, 25 bp, Mus musculus
attacagaattcactgttcagtaca

SEQ ID NO: 275822 - DNA, 25 bp, Mus musculus
attacagaattctctgttcagtaca

SEQ ID NO: 275823 - DNA, 25 bp, Mus musculus
attacagacaacataccattttatt

SEQ ID NO: 275824 - DNA, 25 bp, Mus musculus
attacagacaacttaccattttatt

SEQ ID NO: 275825 - DNA, 25 bp, Mus musculus
attacagacatcaaggagccaagac

SEQ ID NO: 275826 - DNA, 25 bp, Mus musculus
attacagacatctaggagccaagac

SEQ ID NO: 275827 - DNA, 25 bp, Mus musculus
attacagacggtattgaacaatcct

SEQ ID NO: 275828 - DNA, 25 bp, Mus musculus
attacagacggttttgaacaatcct

SEQ ID NO: 275829 - DNA, 25 bp, Mus musculus
attacagactgcatgctcgcttgtt

SEQ ID NO: 275830 - DNA, 25 bp, Mus musculus
attacagactgcttgctcgcttgtt

SEQ ID NO: 275831 - DNA, 25 bp, Mus musculus
attacagagataagattcccaaccc

SEQ ID NO: 275832 - DNA, 25 bp, Mus musculus
attacagagatatgattcccaaccc

SEQ ID NO: 275833 - DNA, 25 bp, Mus musculus
attacagagttaatgacaaccttgg

SEQ ID NO: 275834 - DNA, 25 bp, Mus musculus
attacagagttattgacaaccttgg

SEQ ID NO: 275835 - DNA, 25 bp, Mus musculus
attacagataccatttcctttcttt

SEQ ID NO: 275836 - DNA, 25 bp, Mus musculus
attacagataccttttcctttcttt

SEQ ID NO: 275837 - DNA, 25 bp, Mus musculus
attacagatctactggagggtgcca

SEQ ID NO: 275838 - DNA, 25 bp, Mus musculus
attacagatctagtggagggtgcca

SEQ ID NO: 275839 - DNA, 25 bp, Mus musculus
attacagatctgaccttgaccaaca

SEQ ID NO: 275840 - DNA, 25 bp, Mus musculus
attacagatctgtccttgaccaaca

SEQ ID NO: 275841 - DNA, 25 bp, Mus musculus
attacagcaattcactcagtagaag

SEQ ID NO: 275842 - DNA, 25 bp, Mus musculus
attacagcaattgactcagtagaag

SEQ ID NO: 275843 - DNA, 25 bp, Mus musculus
attacagcagccacattaaccaagc

SEQ ID NO: 275844 - DNA, 25 bp, Mus musculus
attacagcagcctcattaaccaagc

SEQ ID NO: 275845 - DNA, 25 bp, Mus musculus
attacagcagtcaggtttacactaa

SEQ ID NO: 275846 - DNA, 25 bp, Mus musculus
attacagcagtctggtttacactaa

SEQ ID NO: 275847 - DNA, 25 bp, Mus musculus
attacagctggtattacctcctgtc

SEQ ID NO: 275848 - DNA, 25 bp, Mus musculus
attacagctggttttacctcctgtc

SEQ ID NO: 275849 - DNA, 25 bp, Mus musculus
attacaggacctagacaagcagcaa

SEQ ID NO: 275850 - DNA, 25 bp, Mus musculus
attacaggaccttgacaagcagcaa

SEQ ID NO: 275851 - DNA, 25 bp, Mus musculus
attacaggcacacaggctgctacag

SEQ ID NO: 275852 - DNA, 25 bp, Mus musculus
attacaggcacagaggctgctacag

SEQ ID NO: 275853 - DNA, 25 bp, Mus musculus
attacaggcagcaaggacaactcct

SEQ ID NO: 275854 - DNA, 25 bp, Mus musculus
attacaggcagctaggacaactcct

SEQ ID NO: 275855 - DNA, 25 bp, Mus musculus
attacaggcaggatccaccagacag

SEQ ID NO: 275856 - DNA, 25 bp, Mus musculus
attacaggcaggttccaccagacag

SEQ ID NO: 275857 - DNA, 25 bp, Mus musculus
attacaggcatcaacatggcagact

SEQ ID NO: 275858 - DNA, 25 bp, Mus musculus
attacaggcatctacatggcagact

SEQ ID NO: 275859 - DNA, 25 bp, Mus musculus
attacaggccatatgtgagcacagg

SEQ ID NO: 275860 - DNA, 25 bp, Mus musculus
attacaggccatttgtgagcacagg

SEQ ID NO: 275861 - DNA, 25 bp, Mus musculus
attacaggcctgagttgctaccata

SEQ ID NO: 275862 - DNA, 25 bp, Mus musculus
attacaggcctgtgttgctaccata

SEQ ID NO: 275863 - DNA, 25 bp, Mus musculus
attacaggcttaccttgctcttctg

SEQ ID NO: 275864 - DNA, 25 bp, Mus musculus
attacaggcttagcttgctcttctg

SEQ ID NO: 275865 - DNA, 25 bp, Mus musculus
attacagggcccctgataccaggac

SEQ ID NO: 275866 - DNA, 25 bp, Mus musculus
attacagggcccgtgataccaggac

SEQ ID NO: 275867 - DNA, 25 bp, Mus musculus
attacaggtatcactttaagcattc

SEQ ID NO: 275868 - DNA, 25 bp, Mus musculus
attacaggtatctctttaagcattc

SEQ ID NO: 275869 - DNA, 25 bp, Mus musculus
attacaggtctaacactgacctcag

SEQ ID NO: 275870 - DNA, 25 bp, Mus musculus
attacaggtctatcactgacctcag

SEQ ID NO: 275871 - DNA, 25 bp, Mus musculus
attacaggtctgcactaccatgcct

SEQ ID NO: 275872 - DNA, 25 bp, Mus musculus
attacaggtctggactaccatgcct

SEQ ID NO: 275873 - DNA, 25 bp, Mus musculus
attacaggtgtgatcctttctacca

SEQ ID NO: 275874 - DNA, 25 bp, Mus musculus
attacaggtgtgttcctttctacca

SEQ ID NO: 275875 - DNA, 25 bp, Mus musculus
attacaggtgttcgccatgaccggc

SEQ ID NO: 275876 - DNA, 25 bp, Mus musculus
attacaggtgttggccatgaccggc

SEQ ID NO: 275877 - DNA, 25 bp, Mus musculus
attacaggtttgacttctgctcttc

SEQ ID NO: 275878 - DNA, 25 bp, Mus musculus
attacaggtttgtcttctgctcttc

SEQ ID NO: 275879 - DNA, 25 bp, Mus musculus
attacagtattgaccattacccagt

SEQ ID NO: 275880 - DNA, 25 bp, Mus musculus
attacagtattgtccattacccagt

SEQ ID NO: 275881 - DNA, 25 bp, Mus musculus
attacagtccccacaggtagtgtca

SEQ ID NO: 275882 - DNA, 25 bp, Mus musculus
attacagtcccctcaggtagtgtca

SEQ ID NO: 275883 - DNA, 25 bp, Mus musculus
attacagtcgctatgccctggagga

SEQ ID NO: 275884 - DNA, 25 bp, Mus musculus
attacagtcgctttgccctggagga

SEQ ID NO: 275885 - DNA, 25 bp, Mus musculus
attacagtctatcatcgaaggcagt

SEQ ID NO: 275886 - DNA, 25 bp, Mus musculus
attacagtctatgatcgaaggcagt

SEQ ID NO: 275887 - DNA, 25 bp, Mus musculus
attacagtctcacaatccaagttct

SEQ ID NO: 275888 - DNA, 25 bp, Mus musculus
attacagtctcagaatccaagttct

SEQ ID NO: 275889 - DNA, 25 bp, Mus musculus
attacagtgaacaccaatggctaaa

SEQ ID NO: 275890 - DNA, 25 bp, Mus musculus
attacagtgaacagtgtttccttgt

SEQ ID NO: 275891 - DNA, 25 bp, Mus musculus
attacagtgaactccaatggctaaa

SEQ ID NO: 275892 - DNA, 25 bp, Mus musculus
attacagtgaactgtgtttccttgt

SEQ ID NO: 275893 - DNA, 25 bp, Mus musculus
attacagtgcttaggctggctgaag

SEQ ID NO: 275894 - DNA, 25 bp, Mus musculus
attacagtgctttggctggctgaag

SEQ ID NO: 275895 - DNA, 25 bp, Mus musculus
attacagtggtgaggaccccataac

SEQ ID NO: 275896 - DNA, 25 bp, Mus musculus
attacagtggtgtggaccccataac

SEQ ID NO: 275897 - DNA, 25 bp, Mus musculus
attacagtggttcatgccctccatg

SEQ ID NO: 275898 - DNA, 25 bp, Mus musculus
attacagtggttgatgccctccatg

SEQ ID NO: 275899 - DNA, 25 bp, Mus musculus
attacagtgtatagctctccttcat

SEQ ID NO: 275900 - DNA, 25 bp, Mus musculus
attacagtgtattgctctccttcat

SEQ ID NO: 275901 - DNA, 25 bp, Mus musculus
attacagttaggagattgcaagagt

SEQ ID NO: 275902 - DNA, 25 bp, Mus musculus
attacagttaggtgattgcaagagt

SEQ ID NO: 275903 - DNA, 25 bp, Mus musculus
attacataatccacagcgccagaac

SEQ ID NO: 275904 - DNA, 25 bp, Mus musculus
attacataatcctcagcgccagaac

SEQ ID NO: 275905 - DNA, 25 bp, Mus musculus
attacatagatgacgcccagcaaga

SEQ ID NO: 275906 - DNA, 25 bp, Mus musculus
attacatagatgtcgcccagcaaga

SEQ ID NO: 275907 - DNA, 25 bp, Mus musculus
attacatcaaagactccccgagggt

SEQ ID NO: 275908 - DNA, 25 bp, Mus musculus
attacatcaaagtctccccgagggt

SEQ ID NO: 275909 - DNA, 25 bp, Mus musculus
attacatcacacacttagctcttaa

SEQ ID NO: 275910 - DNA, 25 bp, Mus musculus
attacatcacactcttagctcttaa

SEQ ID NO: 275911 - DNA, 25 bp, Mus musculus
attacatcatgaaactggagctcag

SEQ ID NO: 275912 - DNA, 25 bp, Mus musculus
attacatcatgatactggagctcag

SEQ ID NO: 275913 - DNA, 25 bp, Mus musculus
attacatccaaactttcgttcgact

SEQ ID NO: 275914 - DNA, 25 bp, Mus musculus
attacatccaaagtttcgttcgact

SEQ ID NO: 275915 - DNA, 25 bp, Mus musculus
attacatccaatatccactttatag

SEQ ID NO: 275916 - DNA, 25 bp, Mus musculus
attacatccaatttccactttatag

SEQ ID NO: 275917 - DNA, 25 bp, Mus musculus
attacatccagaattaggcacccag

SEQ ID NO: 275918 - DNA, 25 bp, Mus musculus
attacatccagatttaggcacccag

SEQ ID NO: 275919 - DNA, 25 bp, Mus musculus
attacatcgtcaacccaaacatctc

SEQ ID NO: 275920 - DNA, 25 bp, Mus musculus
attacatcgtcatcccaaacatctc

SEQ ID NO: 275921 - DNA, 25 bp, Mus musculus
attacatctagaaccatcgactgtg

SEQ ID NO: 275922 - DNA, 25 bp, Mus musculus
attacatctagatccatcgactgtg

SEQ ID NO: 275923 - DNA, 25 bp, Mus musculus
attacatctatgactctctttgagg

SEQ ID NO: 275924 - DNA, 25 bp, Mus musculus
attacatctatgtctctctttgagg

SEQ ID NO: 275925 - DNA, 25 bp, Mus musculus
attacatctcatctagtcatctgtg

SEQ ID NO: 275926 - DNA, 25 bp, Mus musculus
attacatctcatgtagtcatctgtg

SEQ ID NO: 275927 - DNA, 25 bp, Mus musculus
attacatctctgaggcccttataat

SEQ ID NO: 275928 - DNA, 25 bp, Mus musculus
attacatctctgtggcccttataat

SEQ ID NO: 275929 - DNA, 25 bp, Mus musculus
attacatctcttcctgcggcaagaa

SEQ ID NO: 275930 - DNA, 25 bp, Mus musculus
attacatctcttgctgcggcaagaa

SEQ ID NO: 275931 - DNA, 25 bp, Mus musculus
attacatctgataggcttaccagcc

SEQ ID NO: 275932 - DNA, 25 bp, Mus musculus
attacatctgattggcttaccagcc

SEQ ID NO: 275933 - DNA, 25 bp, Mus musculus
attacatcttgcatggttcctactt

SEQ ID NO: 275934 - DNA, 25 bp, Mus musculus
attacatcttgcttggttcctactt

SEQ ID NO: 275935 - DNA, 25 bp, Mus musculus
attacatgcagtctgagctgcccaa

SEQ ID NO: 275936 - DNA, 25 bp, Mus musculus
attacatgcagtgtgagctgcccaa

SEQ ID NO: 275937 - DNA, 25 bp, Mus musculus
attacatgccaaagaaccacacctc

SEQ ID NO: 275938 - DNA, 25 bp, Mus musculus
attacatgccaatgaaccacacctc

SEQ ID NO: 275939 - DNA, 25 bp, Mus musculus
attacatgcgccctcttgtgaatta

SEQ ID NO: 275940 - DNA, 25 bp, Mus musculus
attacatgcgccgtcttgtgaatta

SEQ ID NO: 275941 - DNA, 25 bp, Mus musculus
attacatgctatcttgtcaataaac

SEQ ID NO: 275942 - DNA, 25 bp, Mus musculus
attacatgctatgttgtcaataaac

SEQ ID NO: 275943 - DNA, 25 bp, Mus musculus
attacatggcacagttagcggaaat

SEQ ID NO: 275944 - DNA, 25 bp, Mus musculus
attacatggcactgttagcggaaat

SEQ ID NO: 275945 - DNA, 25 bp, Mus musculus
attacatgtattaaaaacgtcacgt

SEQ ID NO: 275946 - DNA, 25 bp, Mus musculus
attacatgtatttaaaacgtcacgt

SEQ ID NO: 275947 - DNA, 25 bp, Mus musculus
attacatgtttcagtgcagcatggt

SEQ ID NO: 275948 - DNA, 25 bp, Mus musculus
attacatgtttctgtgcagcatggt

SEQ ID NO: 275949 - DNA, 25 bp, Mus musculus
attacattctttcttctctattccg

SEQ ID NO: 275950 - DNA, 25 bp, Mus musculus
attacattctttgttctctattccg

SEQ ID NO: 275951 - DNA, 25 bp, Mus musculus
attacatttgagacagagaccctga

SEQ ID NO: 275952 - DNA, 25 bp, Mus musculus
attacatttgagtcagagaccctga

SEQ ID NO: 275953 - DNA, 25 bp, Mus musculus
attacattttctatgtgtcatggtt

SEQ ID NO: 275954 - DNA, 25 bp, Mus musculus
attacattttctttgtgtcatggtt

SEQ ID NO: 275955 - DNA, 25 bp, Mus musculus
attaccaacccgatgcaaactgcga

SEQ ID NO: 275956 - DNA, 25 bp, Mus musculus
attaccaacccgttgcaaactgcga

SEQ ID NO: 275957 - DNA, 25 bp, Mus musculus
attaccaagatccaaaactgttcaa

SEQ ID NO: 275958 - DNA, 25 bp, Mus musculus
attaccaagatcgaaaactgttcaa

SEQ ID NO: 275959 - DNA, 25 bp, Mus musculus
attaccaatttcctcttccagttgg

SEQ ID NO: 275960 - DNA, 25 bp, Mus musculus
attaccaatttcgtcttccagttgg

SEQ ID NO: 275961 - DNA, 25 bp, Mus musculus
attaccacacccagcggatcggcgg

SEQ ID NO: 275962 - DNA, 25 bp, Mus musculus
attaccacaccctgcggatcggcgg

SEQ ID NO: 275963 - DNA, 25 bp, Mus musculus
attaccacagcactctcacaatagt

SEQ ID NO: 275964 - DNA, 25 bp, Mus musculus
attaccacagcagtctcacaatagt

SEQ ID NO: 275965 - DNA, 25 bp, Mus musculus
attaccacatctcctaatacatcgg

SEQ ID NO: 275966 - DNA, 25 bp, Mus musculus
attaccacatctgctaatacatcgg

SEQ ID NO: 275967 - DNA, 25 bp, Mus musculus
attaccacatgcagggtttctgtac

SEQ ID NO: 275968 - DNA, 25 bp, Mus musculus
attaccacatgctgggtttctgtac

SEQ ID NO: 275969 - DNA, 25 bp, Mus musculus
attaccacatttccattgatattgc

SEQ ID NO: 275970 - DNA, 25 bp, Mus musculus
attaccacatttgcattgatattgc

SEQ ID NO: 275971 - DNA, 25 bp, Mus musculus
attaccaccctgataacacacagtg

SEQ ID NO: 275972 - DNA, 25 bp, Mus musculus
attaccaccctgttaacacacagtg

SEQ ID NO: 275973 - DNA, 25 bp, Mus musculus
attaccaccggcacttaatgctagt

SEQ ID NO: 275974 - DNA, 25 bp, Mus musculus
attaccaccggctcttaatgctagt

SEQ ID NO: 275975 - DNA, 25 bp, Mus musculus
attaccactcatatcttaactccac

SEQ ID NO: 275976 - DNA, 25 bp, Mus musculus
attaccactcatttcttaactccac

SEQ ID NO: 275977 - DNA, 25 bp, Mus musculus
attaccactctcaggtccgtcttat

SEQ ID NO: 275978 - DNA, 25 bp, Mus musculus
attaccactctctggtccgtcttat

SEQ ID NO: 275979 - DNA, 25 bp, Mus musculus
attaccactgctctttgaatcggct

SEQ ID NO: 275980 - DNA, 25 bp, Mus musculus
attaccactgctgtttgaatcggct

SEQ ID NO: 275981 - DNA, 25 bp, Mus musculus
attaccagagtaatgcaccacttcc

SEQ ID NO: 275982 - DNA, 25 bp, Mus musculus
attaccagagtattgcaccacttcc

SEQ ID NO: 275983 - DNA, 25 bp, Mus musculus
attaccagatacagtggtgcatgtg

SEQ ID NO: 275984 - DNA, 25 bp, Mus musculus
attaccagatactgtggtgcatgtg

SEQ ID NO: 275985 - DNA, 25 bp, Mus musculus
attaccaggagcagcatacatcaca

SEQ ID NO: 275986 - DNA, 25 bp, Mus musculus
attaccaggagctgcatacatcaca

SEQ ID NO: 275987 - DNA, 25 bp, Mus musculus
attaccaggattcatggagcgggat

SEQ ID NO: 275988 - DNA, 25 bp, Mus musculus
attaccaggattgatggagcgggat

SEQ ID NO: 275989 - DNA, 25 bp, Mus musculus
attaccaggtcaaaacttccaattg

SEQ ID NO: 275990 - DNA, 25 bp, Mus musculus
attaccaggtcataacttccaattg

SEQ ID NO: 275991 - DNA, 25 bp, Mus musculus
attaccaggtctccatcattcctcg

SEQ ID NO: 275992 - DNA, 25 bp, Mus musculus
attaccaggtctgcatcattcctcg

SEQ ID NO: 275993 - DNA, 25 bp, Mus musculus
attaccatacaaactgctacatagg

SEQ ID NO: 275994 - DNA, 25 bp, Mus musculus
attaccatacaatctgctacatagg

SEQ ID NO: 275995 - DNA, 25 bp, Mus musculus
attaccatagctcactgggactggc

SEQ ID NO: 275996 - DNA, 25 bp, Mus musculus
attaccatagctgactgggactggc

SEQ ID NO: 275997 - DNA, 25 bp, Mus musculus
attaccatatacacttaccagcctg

SEQ ID NO: 275998 - DNA, 25 bp, Mus musculus
attaccatatactcttaccagcctg

SEQ ID NO: 275999 - DNA, 25 bp, Mus musculus
attaccatatttacctgagcatcct

SEQ ID NO: 276000 - DNA, 25 bp, Mus musculus
attaccatattttcctgagcatcct

SEQ ID NO: 276001 - DNA, 25 bp, Mus musculus
attaccatcaggcactttctttaag

SEQ ID NO: 276002 - DNA, 25 bp, Mus musculus
attaccatcagggactttctttaag

SEQ ID NO: 276003 - DNA, 25 bp, Mus musculus
attaccatcttgcttagcctcaaag

SEQ ID NO: 276004 - DNA, 25 bp, Mus musculus
attaccatcttggttagcctcaaag

SEQ ID NO: 276005 - DNA, 25 bp, Mus musculus
attaccatgaagaggcaggcccctg

SEQ ID NO: 276006 - DNA, 25 bp, Mus musculus
attaccatgaagtggcaggcccctg

SEQ ID NO: 276007 - DNA, 25 bp, Mus musculus
attaccatgccgaaggaccaatccg

SEQ ID NO: 276008 - DNA, 25 bp, Mus musculus
attaccatgccgtaggaccaatccg

SEQ ID NO: 276009 - DNA, 25 bp, Mus musculus
attaccatgctcattcttgcactag

SEQ ID NO: 276010 - DNA, 25 bp, Mus musculus
attaccatgctctttcttgcactag

SEQ ID NO: 276011 - DNA, 25 bp, Mus musculus
attaccatgggtatcaggccagctt

SEQ ID NO: 276012 - DNA, 25 bp, Mus musculus
attaccatgggtttcaggccagctt

SEQ ID NO: 276013 - DNA, 25 bp, Mus musculus
attaccattcatatccgttccaaaa

SEQ ID NO: 276014 - DNA, 25 bp, Mus musculus
attaccattcatttccgttccaaaa

SEQ ID NO: 276015 - DNA, 25 bp, Mus musculus
attacccaagtaccatcagaaccaa

SEQ ID NO: 276016 - DNA, 25 bp, Mus musculus
attacccaagtaccgtcatgaccaa

SEQ ID NO: 276017 - DNA, 25 bp, Mus musculus
attacccaagtagcatcagaaccaa

SEQ ID NO: 276018 - DNA, 25 bp, Mus musculus
attacccaagtagcgtcatgaccaa

SEQ ID NO: 276019 - DNA, 25 bp, Mus musculus
attacccacctacggcgtcagtgct

SEQ ID NO: 276020 - DNA, 25 bp, Mus musculus
attacccacctagggcgtcagtgct

SEQ ID NO: 276021 - DNA, 25 bp, Mus musculus
attacccacctcactgttagtgaag

SEQ ID NO: 276022 - DNA, 25 bp, Mus musculus
attacccacctctctgttagtgaag

SEQ ID NO: 276023 - DNA, 25 bp, Mus musculus
attacccagccacagaatcttgaat

SEQ ID NO: 276024 - DNA, 25 bp, Mus musculus
attacccagccagagaatcttgaat

SEQ ID NO: 276025 - DNA, 25 bp, Mus musculus
attacccaggctcaagctcagagag

SEQ ID NO: 276026 - DNA, 25 bp, Mus musculus
attacccaggctgaagctcagagag

SEQ ID NO: 276027 - DNA, 25 bp, Mus musculus
attacccaggttaatcagctagagg

SEQ ID NO: 276028 - DNA, 25 bp, Mus musculus
attacccaggtttatcagctagagg

SEQ ID NO: 276029 - DNA, 25 bp, Mus musculus
attacccagtttccacagcagtgtg

SEQ ID NO: 276030 - DNA, 25 bp, Mus musculus
attacccagtttgcacagcagtgtg

SEQ ID NO: 276031 - DNA, 25 bp, Mus musculus
attaccccagtgactagtgtacgca

SEQ ID NO: 276032 - DNA, 25 bp, Mus musculus
attaccccagtgtctagtgtacgca

SEQ ID NO: 276033 - DNA, 25 bp, Mus musculus
attaccccattcaccgtggtagaag

SEQ ID NO: 276034 - DNA, 25 bp, Mus musculus
attaccccattctccgtggtagaag

SEQ ID NO: 276035 - DNA, 25 bp, Mus musculus
attacccctgcacagtcttctaaac

SEQ ID NO: 276036 - DNA, 25 bp, Mus musculus
attacccctgcagagtcttctaaac

SEQ ID NO: 276037 - DNA, 25 bp, Mus musculus
attacccctgtcattgagcaggttg

SEQ ID NO: 276038 - DNA, 25 bp, Mus musculus
attacccctgtctttgagcaggttg

SEQ ID NO: 276039 - DNA, 25 bp, Mus musculus
attacccctgtgaggttcttggata

SEQ ID NO: 276040 - DNA, 25 bp, Mus musculus
attacccctgtgtggttcttggata

SEQ ID NO: 276041 - DNA, 25 bp, Mus musculus
attaccccttcacatacagtttttg

SEQ ID NO: 276042 - DNA, 25 bp, Mus musculus
attaccccttcagatacagtttttg

SEQ ID NO: 276043 - DNA, 25 bp, Mus musculus
attaccctacttcgtacattcctca

SEQ ID NO: 276044 - DNA, 25 bp, Mus musculus
attaccctacttggtacattcctca

SEQ ID NO: 276045 - DNA, 25 bp, Mus musculus
attaccctagttacatattatgcca

SEQ ID NO: 276046 - DNA, 25 bp, Mus musculus
attaccctagtttcatattatgcca

SEQ ID NO: 276047 - DNA, 25 bp, Mus musculus
attaccctctgtcacttcattgtgc

SEQ ID NO: 276048 - DNA, 25 bp, Mus musculus
attaccctctgtgacttcattgtgc

SEQ ID NO: 276049 - DNA, 25 bp, Mus musculus
attaccctgcagcagtaccgccggg

SEQ ID NO: 276050 - DNA, 25 bp, Mus musculus
attaccctgcaggagtaccgccggg

SEQ ID NO: 276051 - DNA, 25 bp, Mus musculus
attaccctggccagcgataataagt

SEQ ID NO: 276052 - DNA, 25 bp, Mus musculus
attaccctggcctgcgataataagt

SEQ ID NO: 276053 - DNA, 25 bp, Mus musculus
attaccctggtgcaatgcagtctag

SEQ ID NO: 276054 - DNA, 25 bp, Mus musculus
attaccctggtggaatgcagtctag

SEQ ID NO: 276055 - DNA, 25 bp, Mus musculus
attacccttaatagcatacattgtt

SEQ ID NO: 276056 - DNA, 25 bp, Mus musculus
attacccttaattgcatacattgtt

SEQ ID NO: 276057 - DNA, 25 bp, Mus musculus
attacccttactacaggactgccga

SEQ ID NO: 276058 - DNA, 25 bp, Mus musculus
attacccttacttcaggactgccga

SEQ ID NO: 276059 - DNA, 25 bp, Mus musculus
attacccttcccacaactagagtat

SEQ ID NO: 276060 - DNA, 25 bp, Mus musculus
attacccttccctcaactagagtat

SEQ ID NO: 276061 - DNA, 25 bp, Mus musculus
attacccttgctattcctgagttcg

SEQ ID NO: 276062 - DNA, 25 bp, Mus musculus
attacccttgcttttcctgagttcg

SEQ ID NO: 276063 - DNA, 25 bp, Mus musculus
attaccctttcactcttctcacagg

SEQ ID NO: 276064 - DNA, 25 bp, Mus musculus
attaccctttcagtcttctcacagg

SEQ ID NO: 276065 - DNA, 25 bp, Mus musculus
attaccgacgcacacgcccagagaa

SEQ ID NO: 276066 - DNA, 25 bp, Mus musculus
attaccgacgcagacgcccagagaa

SEQ ID NO: 276067 - DNA, 25 bp, Mus musculus
attaccgacgtcattgatgttttgt

SEQ ID NO: 276068 - DNA, 25 bp, Mus musculus
attaccgacgtctttgatgttttgt

SEQ ID NO: 276069 - DNA, 25 bp, Mus musculus
attaccgacttgcagtacctccttg

SEQ ID NO: 276070 - DNA, 25 bp, Mus musculus
attaccgacttggagtacctccttg

SEQ ID NO: 276071 - DNA, 25 bp, Mus musculus
attaccgagaggagagacactgagg

SEQ ID NO: 276072 - DNA, 25 bp, Mus musculus
attaccgagaggtgagacactgagg

SEQ ID NO: 276073 - DNA, 25 bp, Mus musculus
attaccgagatgctcaggctttgct

SEQ ID NO: 276074 - DNA, 25 bp, Mus musculus
attaccgagatggtcaggctttgct

SEQ ID NO: 276075 - DNA, 25 bp, Mus musculus
attaccgatacaatggcagaaccaa

SEQ ID NO: 276076 - DNA, 25 bp, Mus musculus
attaccgatacattggcagaaccaa

SEQ ID NO: 276077 - DNA, 25 bp, Mus musculus
attaccgatagtactgccatataca

SEQ ID NO: 276078 - DNA, 25 bp, Mus musculus
attaccgatagttctgccatataca

SEQ ID NO: 276079 - DNA, 25 bp, Mus musculus
attaccggaagtcccagactggagc

SEQ ID NO: 276080 - DNA, 25 bp, Mus musculus
attaccggaagtgccagactggagc

SEQ ID NO: 276081 - DNA, 25 bp, Mus musculus
attaccgtacaacatctgcactgga

SEQ ID NO: 276082 - DNA, 25 bp, Mus musculus
attaccgtacaagatctgcactgga

SEQ ID NO: 276083 - DNA, 25 bp, Mus musculus
attaccgtcctgagtaaagcatttt

SEQ ID NO: 276084 - DNA, 25 bp, Mus musculus
attaccgtcctgtgtaaagcatttt

SEQ ID NO: 276085 - DNA, 25 bp, Mus musculus
attaccgttctcagaggcactggag

SEQ ID NO: 276086 - DNA, 25 bp, Mus musculus
attaccgttctctgaggcactggag

SEQ ID NO: 276087 - DNA, 25 bp, Mus musculus
attaccgtttacaggttctgcctat

SEQ ID NO: 276088 - DNA, 25 bp, Mus musculus
attaccgtttactggttctgcctat

SEQ ID NO: 276089 - DNA, 25 bp, Mus musculus
attacctacatgcacgagctcactc

SEQ ID NO: 276090 - DNA, 25 bp, Mus musculus
attacctacatggacgagctcactc

SEQ ID NO: 276091 - DNA, 25 bp, Mus musculus
attacctaccacaaaatcgactgga

SEQ ID NO: 276092 - DNA, 25 bp, Mus musculus
attacctaccactaaatcgactgga

SEQ ID NO: 276093 - DNA, 25 bp, Mus musculus
attacctagacgagagcttcccata

SEQ ID NO: 276094 - DNA, 25 bp, Mus musculus
attacctagacgtgagcttcccata

SEQ ID NO: 276095 - DNA, 25 bp, Mus musculus
attacctagagcaaggtgatcagat

SEQ ID NO: 276096 - DNA, 25 bp, Mus musculus
attacctagagctaggtgatcagat

SEQ ID NO: 276097 - DNA, 25 bp, Mus musculus
attacctaggtacgctatgcttcct

SEQ ID NO: 276098 - DNA, 25 bp, Mus musculus
attacctaggtaggctatgcttcct

SEQ ID NO: 276099 - DNA, 25 bp, Mus musculus
attacctatgatcttcttcgttcag

SEQ ID NO: 276100 - DNA, 25 bp, Mus musculus
attacctatgatgttcttcgttcag

SEQ ID NO: 276101 - DNA, 25 bp, Mus musculus
attacctattatatgtgtggctgta

SEQ ID NO: 276102 - DNA, 25 bp, Mus musculus
attacctattatttgtgtggctgta

SEQ ID NO: 276103 - DNA, 25 bp, Mus musculus
attacctcaaatatcatgccttaaa

SEQ ID NO: 276104 - DNA, 25 bp, Mus musculus
attacctcaaatttcatgccttaaa

SEQ ID NO: 276105 - DNA, 25 bp, Mus musculus
attacctcagtcagcaggacctggc

SEQ ID NO: 276106 - DNA, 25 bp, Mus musculus
attacctcagtctgcaggacctggc

SEQ ID NO: 276107 - DNA, 25 bp, Mus musculus
attacctcatacctcacgggagaac

SEQ ID NO: 276108 - DNA, 25 bp, Mus musculus
attacctcatacgtcacgggagaac

SEQ ID NO: 276109 - DNA, 25 bp, Mus musculus
attacctccatgacatgtctctgta

SEQ ID NO: 276110 - DNA, 25 bp, Mus musculus
attacctccatgtcatgtctctgta

SEQ ID NO: 276111 - DNA, 25 bp, Mus musculus
attacctccccaattctagtggaag

SEQ ID NO: 276112 - DNA, 25 bp, Mus musculus
attacctccccatttctagtggaag

SEQ ID NO: 276113 - DNA, 25 bp, Mus musculus
attacctccgcgagaagctgcggca

SEQ ID NO: 276114 - DNA, 25 bp, Mus musculus
attacctccgcgtgaagctgcggca

SEQ ID NO: 276115 - DNA, 25 bp, Mus musculus
attacctcctacacctcagagaaca

SEQ ID NO: 276116 - DNA, 25 bp, Mus musculus
attacctcctactcctcagagaaca

SEQ ID NO: 276117 - DNA, 25 bp, Mus musculus
attacctcgttgagacttttcagtg

SEQ ID NO: 276118 - DNA, 25 bp, Mus musculus
attacctcgttgtgacttttcagtg

SEQ ID NO: 276119 - DNA, 25 bp, Mus musculus
attacctctcacacagtacatctga

SEQ ID NO: 276120 - DNA, 25 bp, Mus musculus
attacctctcactcagtacatctga

SEQ ID NO: 276121 - DNA, 25 bp, Mus musculus
attacctctcatcagatgggcttga

SEQ ID NO: 276122 - DNA, 25 bp, Mus musculus
attacctctcatgagatgggcttga

SEQ ID NO: 276123 - DNA, 25 bp, Mus musculus
attacctctctgaactatggtgtga

SEQ ID NO: 276124 - DNA, 25 bp, Mus musculus
attacctctctgtactatggtgtga

SEQ ID NO: 276125 - DNA, 25 bp, Mus musculus
attacctctgaacgttttcctctga

SEQ ID NO: 276126 - DNA, 25 bp, Mus musculus
attacctctgaaggttttcctctga

SEQ ID NO: 276127 - DNA, 25 bp, Mus musculus
attacctctgatctatgttcttgca

SEQ ID NO: 276128 - DNA, 25 bp, Mus musculus
attacctctgatgtatgttcttgca

SEQ ID NO: 276129 - DNA, 25 bp, Mus musculus
attacctcttcacagacagccagca

SEQ ID NO: 276130 - DNA, 25 bp, Mus musculus
attacctcttcagagacagccagca

SEQ ID NO: 276131 - DNA, 25 bp, Mus musculus
attacctctttgagtacagttgtga

SEQ ID NO: 276132 - DNA, 25 bp, Mus musculus
attacctctttgtgtacagttgtga

SEQ ID NO: 276133 - DNA, 25 bp, Mus musculus
attacctgacaaaaaagtttaactg

SEQ ID NO: 276134 - DNA, 25 bp, Mus musculus
attacctgacaataaagtttaactg

SEQ ID NO: 276135 - DNA, 25 bp, Mus musculus
attacctgaccaacttccggaagtt

SEQ ID NO: 276136 - DNA, 25 bp, Mus musculus
attacctgaccatcttccggaagtt

SEQ ID NO: 276137 - DNA, 25 bp, Mus musculus
attacctgagtgattcatgctgctg

SEQ ID NO: 276138 - DNA, 25 bp, Mus musculus
attacctgagtgtttcatgctgctg

SEQ ID NO: 276139 - DNA, 25 bp, Mus musculus
attaccttacacaggtcagtgttgt

SEQ ID NO: 276140 - DNA, 25 bp, Mus musculus
attaccttacactggtcagtgttgt

SEQ ID NO: 276141 - DNA, 25 bp, Mus musculus
attaccttactacagtgatcagtga

SEQ ID NO: 276142 - DNA, 25 bp, Mus musculus
attaccttactagagtgatcagtga

SEQ ID NO: 276143 - DNA, 25 bp, Mus musculus
attaccttagtgagtattttctata

SEQ ID NO: 276144 - DNA, 25 bp, Mus musculus
attaccttagtgcttcagacgtcag

SEQ ID NO: 276145 - DNA, 25 bp, Mus musculus
attaccttagtggttcagacgtcag

SEQ ID NO: 276146 - DNA, 25 bp, Mus musculus
attaccttagtgtgtattttctata

SEQ ID NO: 276147 - DNA, 25 bp, Mus musculus
attaccttcaagattgtgccaagct

SEQ ID NO: 276148 - DNA, 25 bp, Mus musculus
attaccttcaagtttgtgccaagct

SEQ ID NO: 276149 - DNA, 25 bp, Mus musculus
attaccttccacacagcatttcagt

SEQ ID NO: 276150 - DNA, 25 bp, Mus musculus
attaccttccactcagcatttcagt

SEQ ID NO: 276151 - DNA, 25 bp, Mus musculus
attaccttcgacaactggcgcttgc

SEQ ID NO: 276152 - DNA, 25 bp, Mus musculus
attaccttcgactactggcgcttgc

SEQ ID NO: 276153 - DNA, 25 bp, Mus musculus
attaccttcgatccttgtgtccact

SEQ ID NO: 276154 - DNA, 25 bp, Mus musculus
attaccttcgatgcttgtgtccact

SEQ ID NO: 276155 - DNA, 25 bp, Mus musculus
attaccttctgcagatgaaactttg

SEQ ID NO: 276156 - DNA, 25 bp, Mus musculus
attaccttctgctgatgaaactttg

SEQ ID NO: 276157 - DNA, 25 bp, Mus musculus
attaccttcttcagagttttgtgag

SEQ ID NO: 276158 - DNA, 25 bp, Mus musculus
attaccttcttctgagttttgtgag

SEQ ID NO: 276159 - DNA, 25 bp, Mus musculus
attaccttgtgcagcccttcatgga

SEQ ID NO: 276160 - DNA, 25 bp, Mus musculus
attaccttgtgctgcccttcatgga

SEQ ID NO: 276161 - DNA, 25 bp, Mus musculus
attacgaagtctcttcttgccagtt

SEQ ID NO: 276162 - DNA, 25 bp, Mus musculus
attacgaagtctgttcttgccagtt

SEQ ID NO: 276163 - DNA, 25 bp, Mus musculus
attacgagcagaacaggcccctggg

SEQ ID NO: 276164 - DNA, 25 bp, Mus musculus
attacgagcagatcaggcccctggg

SEQ ID NO: 276165 - DNA, 25 bp, Mus musculus
attacgagcattagcacagggccca

SEQ ID NO: 276166 - DNA, 25 bp, Mus musculus
attacgagcatttgcacagggccca

SEQ ID NO: 276167 - DNA, 25 bp, Mus musculus
attacgatacagactgacactgttg

SEQ ID NO: 276168 - DNA, 25 bp, Mus musculus
attacgatacagtctgacactgttg

SEQ ID NO: 276169 - DNA, 25 bp, Mus musculus
attacgattcaccactgtagcaata

SEQ ID NO: 276170 - DNA, 25 bp, Mus musculus
attacgattcacgactgtagcaata

SEQ ID NO: 276171 - DNA, 25 bp, Mus musculus
attacgcagagcagaccatgtctca

SEQ ID NO: 276172 - DNA, 25 bp, Mus musculus
attacgcagagctgaccatgtctca

SEQ ID NO: 276173 - DNA, 25 bp, Mus musculus
attacgcatctaactactcagagag

SEQ ID NO: 276174 - DNA, 25 bp, Mus musculus
attacgcatctatctactcagagag

SEQ ID NO: 276175 - DNA, 25 bp, Mus musculus
attacgcattgtctctttctacttc

SEQ ID NO: 276176 - DNA, 25 bp, Mus musculus
attacgcattgtgtctttctacttc

SEQ ID NO: 276177 - DNA, 25 bp, Mus musculus
attacgccagctcaggttggtgtcc

SEQ ID NO: 276178 - DNA, 25 bp, Mus musculus
attacgccagctgaggttggtgtcc

SEQ ID NO: 276179 - DNA, 25 bp, Mus musculus
attacgccttgcaagaagcttttaa

SEQ ID NO: 276180 - DNA, 25 bp, Mus musculus
attacgccttgctagaagcttttaa

SEQ ID NO: 276181 - DNA, 25 bp, Mus musculus
attacgctagctaggcctttgtgga

SEQ ID NO: 276182 - DNA, 25 bp, Mus musculus
attacgctagcttggcctttgtgga

SEQ ID NO: 276183 - DNA, 25 bp, Mus musculus
attacgctgggaattcttgctggag

SEQ ID NO: 276184 - DNA, 25 bp, Mus musculus
attacgctgggatttcttgctggag

SEQ ID NO: 276185 - DNA, 25 bp, Mus musculus
attacggacttaatcagcgaatgta

SEQ ID NO: 276186 - DNA, 25 bp, Mus musculus
attacggacttattcagcgaatgta

SEQ ID NO: 276187 - DNA, 25 bp, Mus musculus
attacggcaacaactgaaaccatgt

SEQ ID NO: 276188 - DNA, 25 bp, Mus musculus
attacggcaacatctgaaaccatgt

SEQ ID NO: 276189 - DNA, 25 bp, Mus musculus
attacggcagccattcggattgata

SEQ ID NO: 276190 - DNA, 25 bp, Mus musculus
attacggcagcctttcggattgata

SEQ ID NO: 276191 - DNA, 25 bp, Mus musculus
attacgggagttctactgtcctcgc

SEQ ID NO: 276192 - DNA, 25 bp, Mus musculus
attacgggagttgtactgtcctcgc

SEQ ID NO: 276193 - DNA, 25 bp, Mus musculus
attacgggtccgatgacgaatgcat

SEQ ID NO: 276194 - DNA, 25 bp, Mus musculus
attacgggtccgttgacgaatgcat

SEQ ID NO: 276195 - DNA, 25 bp, Mus musculus
attacggtcacgctgctcatgactg

SEQ ID NO: 276196 - DNA, 25 bp, Mus musculus
attacggtcacggtgctcatgactg

SEQ ID NO: 276197 - DNA, 25 bp, Mus musculus
attacggtggctaacactggctgcc

SEQ ID NO: 276198 - DNA, 25 bp, Mus musculus
attacggtggcttacactggctgcc

SEQ ID NO: 276199 - DNA, 25 bp, Mus musculus
attacggtgtggctcaaaatgcctg

SEQ ID NO: 276200 - DNA, 25 bp, Mus musculus
attacggtgtgggtcaaaatgcctg

SEQ ID NO: 276201 - DNA, 25 bp, Mus musculus
attacggtttggataatgcaatcca

SEQ ID NO: 276202 - DNA, 25 bp, Mus musculus
attacggtttggttaatgcaatcca

SEQ ID NO: 276203 - DNA, 25 bp, Mus musculus
attacgtctttgacgtgccagtaga

SEQ ID NO: 276204 - DNA, 25 bp, Mus musculus
attacgtctttgtcgtgccagtaga

SEQ ID NO: 276205 - DNA, 25 bp, Mus musculus
attacgtgagtcagagctgttcccc

SEQ ID NO: 276206 - DNA, 25 bp, Mus musculus
attacgtgagtctgagctgttcccc

SEQ ID NO: 276207 - DNA, 25 bp, Mus musculus
attacgtgatctaaatgtccctcga

SEQ ID NO: 276208 - DNA, 25 bp, Mus musculus
attacgtgatcttaatgtccctcga

SEQ ID NO: 276209 - DNA, 25 bp, Mus musculus
attacgtggctcaagaatactcgct

SEQ ID NO: 276210 - DNA, 25 bp, Mus musculus
attacgtggctctagaatactcgct

SEQ ID NO: 276211 - DNA, 25 bp, Mus musculus
attacgtgggcaacgccagtgctgt

SEQ ID NO: 276212 - DNA, 25 bp, Mus musculus
attacgtgggcatcgccagtgctgt

SEQ ID NO: 276213 - DNA, 25 bp, Mus musculus
attacgtgttctacacatccatggt

SEQ ID NO: 276214 - DNA, 25 bp, Mus musculus
attacgtgttcttcacatccatggt

SEQ ID NO: 276215 - DNA, 25 bp, Mus musculus
attacgttacacatatacaccctct

SEQ ID NO: 276216 - DNA, 25 bp, Mus musculus
attacgttacacttatacaccctct

SEQ ID NO: 276217 - DNA, 25 bp, Mus musculus
attacgttgcctcggcagtccttga

SEQ ID NO: 276218 - DNA, 25 bp, Mus musculus
attacgttgcctgggcagtccttga

SEQ ID NO: 276219 - DNA, 25 bp, Mus musculus
attacgttgtgtatgtgtgcgagct

SEQ ID NO: 276220 - DNA, 25 bp, Mus musculus
attacgttgtgtttgtgtgcgagct

SEQ ID NO: 276221 - DNA, 25 bp, Mus musculus
attactaactcaatatggctgcatt

SEQ ID NO: 276222 - DNA, 25 bp, Mus musculus
attactaactcattatggctgcatt

SEQ ID NO: 276223 - DNA, 25 bp, Mus musculus
attactaactgcaaagcaattccag

SEQ ID NO: 276224 - DNA, 25 bp, Mus musculus
attactaactgctaagcaattccag

SEQ ID NO: 276225 - DNA, 25 bp, Mus musculus
attactaaggaaactctgcctctcc

SEQ ID NO: 276226 - DNA, 25 bp, Mus musculus
attactaaggaatctctgcctctcc

SEQ ID NO: 276227 - DNA, 25 bp, Mus musculus
attactaatcctacagcattctccc

SEQ ID NO: 276228 - DNA, 25 bp, Mus musculus
attactaatccttcagcattctccc

SEQ ID NO: 276229 - DNA, 25 bp, Mus musculus
attactacagtaccttaacaagttt

SEQ ID NO: 276230 - DNA, 25 bp, Mus musculus
attactacagtacttgatgctcgtg

SEQ ID NO: 276231 - DNA, 25 bp, Mus musculus
attactacagtagcttaacaagttt

SEQ ID NO: 276232 - DNA, 25 bp, Mus musculus
attactacagtagttgatgctcgtg

SEQ ID NO: 276233 - DNA, 25 bp, Mus musculus
attactacatgcatctttctgactc

SEQ ID NO: 276234 - DNA, 25 bp, Mus musculus
attactacatgcttctttctgactc

SEQ ID NO: 276235 - DNA, 25 bp, Mus musculus
attactacgagactcccactggaat

SEQ ID NO: 276236 - DNA, 25 bp, Mus musculus
attactacgagagtcccactggaat

SEQ ID NO: 276237 - DNA, 25 bp, Mus musculus
attactacggtactagctcgtttgc

SEQ ID NO: 276238 - DNA, 25 bp, Mus musculus
attactacggtagtagctcgtttgc

SEQ ID NO: 276239 - DNA, 25 bp, Mus musculus
attactactcgccattaagaccaag

SEQ ID NO: 276240 - DNA, 25 bp, Mus musculus
attactactcgcgattaagaccaag

SEQ ID NO: 276241 - DNA, 25 bp, Mus musculus
attactactgtactcgtgatggccg

SEQ ID NO: 276242 - DNA, 25 bp, Mus musculus
attactactgtagtcgtgatggccg

SEQ ID NO: 276243 - DNA, 25 bp, Mus musculus
attactactgtgcaaacttggtggg

SEQ ID NO: 276244 - DNA, 25 bp, Mus musculus
attactactgtggaaacttggtggg

SEQ ID NO: 276245 - DNA, 25 bp, Mus musculus
attactagaaacacatcctgtcggt

SEQ ID NO: 276246 - DNA, 25 bp, Mus musculus
attactagaaactcatcctgtcggt

SEQ ID NO: 276247 - DNA, 25 bp, Mus musculus
attactagacctagtctctttctgg

SEQ ID NO: 276248 - DNA, 25 bp, Mus musculus
attactagaccttgtctctttctgg

SEQ ID NO: 276249 - DNA, 25 bp, Mus musculus
attactagctctcaaccatgataaa

SEQ ID NO: 276250 - DNA, 25 bp, Mus musculus
attactagctctgaaccatgataaa

SEQ ID NO: 276251 - DNA, 25 bp, Mus musculus
attactagggctcacttcactcaga

SEQ ID NO: 276252 - DNA, 25 bp, Mus musculus
attactagggctgacttcactcaga

SEQ ID NO: 276253 - DNA, 25 bp, Mus musculus
attactataattaacatggcttcag

SEQ ID NO: 276254 - DNA, 25 bp, Mus musculus
attactataatttacatggcttcag

SEQ ID NO: 276255 - DNA, 25 bp, Mus musculus
attactatacagattttccaaggga

SEQ ID NO: 276256 - DNA, 25 bp, Mus musculus
attactatacagtttttccaaggga

SEQ ID NO: 276257 - DNA, 25 bp, Mus musculus
attactatacatcttacccttgctc

SEQ ID NO: 276258 - DNA, 25 bp, Mus musculus
attactatacatgttacccttgctc

SEQ ID NO: 276259 - DNA, 25 bp, Mus musculus
attactatcatcacagtcgatcttg

SEQ ID NO: 276260 - DNA, 25 bp, Mus musculus
attactatcatctcagtcgatcttg

SEQ ID NO: 276261 - DNA, 25 bp, Mus musculus
attactatccaaaatggccctgtag

SEQ ID NO: 276262 - DNA, 25 bp, Mus musculus
attactatccaatatggccctgtag

SEQ ID NO: 276263 - DNA, 25 bp, Mus musculus
attactatgtacaatgctctgacta

SEQ ID NO: 276264 - DNA, 25 bp, Mus musculus
attactatgtactatgctctgacta

SEQ ID NO: 276265 - DNA, 25 bp, Mus musculus
attactattaggatgctgttttgac

SEQ ID NO: 276266 - DNA, 25 bp, Mus musculus
attactattaggttgctgttttgac

SEQ ID NO: 276267 - DNA, 25 bp, Mus musculus
attactattccccattccagataat

SEQ ID NO: 276268 - DNA, 25 bp, Mus musculus
attactattcccgattccagataat

SEQ ID NO: 276269 - DNA, 25 bp, Mus musculus
attactcaaattcgaacctgtccag

SEQ ID NO: 276270 - DNA, 25 bp, Mus musculus
attactcaaattggaacctgtccag

SEQ ID NO: 276271 - DNA, 25 bp, Mus musculus
attactcaagacaccaagttgtatt

SEQ ID NO: 276272 - DNA, 25 bp, Mus musculus
attactcaagactccaagttgtatt

SEQ ID NO: 276273 - DNA, 25 bp, Mus musculus
attactcactcgctatcttcgaatt

SEQ ID NO: 276274 - DNA, 25 bp, Mus musculus
attactcactcggtatcttcgaatt

SEQ ID NO: 276275 - DNA, 25 bp, Mus musculus
attactcagaccacagtcatctcaa

SEQ ID NO: 276276 - DNA, 25 bp, Mus musculus
attactcagacctcagtcatctcaa

SEQ ID NO: 276277 - DNA, 25 bp, Mus musculus
attactcagagtaagcaccagctgg

SEQ ID NO: 276278 - DNA, 25 bp, Mus musculus
attactcagagttagcaccagctgg

SEQ ID NO: 276279 - DNA, 25 bp, Mus musculus
attactcaggcaactaatatctggt

SEQ ID NO: 276280 - DNA, 25 bp, Mus musculus
attactcaggcatctaatatctggt

SEQ ID NO: 276281 - DNA, 25 bp, Mus musculus
attactcagggcattcattcttgta

SEQ ID NO: 276282 - DNA, 25 bp, Mus musculus
attactcagggctttcattcttgta

SEQ ID NO: 276283 - DNA, 25 bp, Mus musculus
attactcagtaaacccaaggcatct

SEQ ID NO: 276284 - DNA, 25 bp, Mus musculus
attactcagtaatcccaaggcatct

SEQ ID NO: 276285 - DNA, 25 bp, Mus musculus
attactcatcagctaaagacctttg

SEQ ID NO: 276286 - DNA, 25 bp, Mus musculus
attactcatcaggtaaagacctttg

SEQ ID NO: 276287 - DNA, 25 bp, Mus musculus
attactcattttatcaatccctatt

SEQ ID NO: 276288 - DNA, 25 bp, Mus musculus
attactcattttttcaatccctatt

SEQ ID NO: 276289 - DNA, 25 bp, Mus musculus
attactcccagcaccatgaggaaga

SEQ ID NO: 276290 - DNA, 25 bp, Mus musculus
attactcccagctccatgaggaaga

SEQ ID NO: 276291 - DNA, 25 bp, Mus musculus
attactccccaaccatattgaagca

SEQ ID NO: 276292 - DNA, 25 bp, Mus musculus
attactccccaagcatattgaagca

SEQ ID NO: 276293 - DNA, 25 bp, Mus musculus
attactccccagagactcagcatta

SEQ ID NO: 276294 - DNA, 25 bp, Mus musculus
attactccccagtgactcagcatta

SEQ ID NO: 276295 - DNA, 25 bp, Mus musculus
attactcccttcaatgtgatggtcc

SEQ ID NO: 276296 - DNA, 25 bp, Mus musculus
attactcccttctatgtgatggtcc

SEQ ID NO: 276297 - DNA, 25 bp, Mus musculus
attactccggagacagggtttggct

SEQ ID NO: 276298 - DNA, 25 bp, Mus musculus
attactccggagtcagggtttggct

SEQ ID NO: 276299 - DNA, 25 bp, Mus musculus
attactcctccactgaattgctaaa

SEQ ID NO: 276300 - DNA, 25 bp, Mus musculus
attactcctccagtgaattgctaaa

SEQ ID NO: 276301 - DNA, 25 bp, Mus musculus
attactccttagcaaatgttccctc

SEQ ID NO: 276302 - DNA, 25 bp, Mus musculus
attactccttaggaaatgttccctc

SEQ ID NO: 276303 - DNA, 25 bp, Mus musculus
attactcgaaagaagttcctgagat

SEQ ID NO: 276304 - DNA, 25 bp, Mus musculus
attactcgaaagtagttcctgagat

SEQ ID NO: 276305 - DNA, 25 bp, Mus musculus
attactcgatttatctccattccct

SEQ ID NO: 276306 - DNA, 25 bp, Mus musculus
attactcgatttttctccattccct

SEQ ID NO: 276307 - DNA, 25 bp, Mus musculus
attactcgggaacctccgatgatga

SEQ ID NO: 276308 - DNA, 25 bp, Mus musculus
attactcgggaagctccgatgatga

SEQ ID NO: 276309 - DNA, 25 bp, Mus musculus
attactcgtacccacaccatatatt

SEQ ID NO: 276310 - DNA, 25 bp, Mus musculus
attactcgtaccgacaccatatatt

SEQ ID NO: 276311 - DNA, 25 bp, Mus musculus
attactctaaaaaacatctactgga

SEQ ID NO: 276312 - DNA, 25 bp, Mus musculus
attactctaaaatacatctactgga

SEQ ID NO: 276313 - DNA, 25 bp, Mus musculus
attactctactgctcactatgcaag

SEQ ID NO: 276314 - DNA, 25 bp, Mus musculus
attactctactggtcactatgcaag

SEQ ID NO: 276315 - DNA, 25 bp, Mus musculus
attactctagcaaacctggttccct

SEQ ID NO: 276316 - DNA, 25 bp, Mus musculus
attactctagcatacctggttccct

SEQ ID NO: 276317 - DNA, 25 bp, Mus musculus
attactctagggaaaacactgacga

SEQ ID NO: 276318 - DNA, 25 bp, Mus musculus
attactctagggtaaacactgacga

SEQ ID NO: 276319 - DNA, 25 bp, Mus musculus
attactctcgagatcacggtctttc

SEQ ID NO: 276320 - DNA, 25 bp, Mus musculus
attactctcgagttcacggtctttc

SEQ ID NO: 276321 - DNA, 25 bp, Mus musculus
attactctgaatctggatgctgtag

SEQ ID NO: 276322 - DNA, 25 bp, Mus musculus
attactctgaatgtggatgctgtag

SEQ ID NO: 276323 - DNA, 25 bp, Mus musculus
attactctgaccattgcttcttggc

SEQ ID NO: 276324 - DNA, 25 bp, Mus musculus
attactctgacctttgcttcttggc

SEQ ID NO: 276325 - DNA, 25 bp, Mus musculus
attactctgctaatatgctgacctg

SEQ ID NO: 276326 - DNA, 25 bp, Mus musculus
attactctgctacccttgattttcg

SEQ ID NO: 276327 - DNA, 25 bp, Mus musculus
attactctgctagccttgattttcg

SEQ ID NO: 276328 - DNA, 25 bp, Mus musculus
attactctgctattatgctgacctg

SEQ ID NO: 276329 - DNA, 25 bp, Mus musculus
attactctgctccaaagtgtttcca

SEQ ID NO: 276330 - DNA, 25 bp, Mus musculus
attactctgctcgaaagtgtttcca

SEQ ID NO: 276331 - DNA, 25 bp, Mus musculus
attactctgctgaggctgatggaga

SEQ ID NO: 276332 - DNA, 25 bp, Mus musculus
attactctgctgtggctgatggaga

SEQ ID NO: 276333 - DNA, 25 bp, Mus musculus
attactctgggtatggatatgctca

SEQ ID NO: 276334 - DNA, 25 bp, Mus musculus
attactctgggtttggatatgctca

SEQ ID NO: 276335 - DNA, 25 bp, Mus musculus
attactcttcctcatcatgttggtg

SEQ ID NO: 276336 - DNA, 25 bp, Mus musculus
attactcttcctgatcatgttggtg

SEQ ID NO: 276337 - DNA, 25 bp, Mus musculus
attactcttctgaagtcacaaactg

SEQ ID NO: 276338 - DNA, 25 bp, Mus musculus
attactcttctgtagtcacaaactg

SEQ ID NO: 276339 - DNA, 25 bp, Mus musculus
attactgaagccagcctgacggttt

SEQ ID NO: 276340 - DNA, 25 bp, Mus musculus
attactgaagcctgcctgacggttt

SEQ ID NO: 276341 - DNA, 25 bp, Mus musculus
attactgaattgacgacctttgctt

SEQ ID NO: 276342 - DNA, 25 bp, Mus musculus
attactgaattgtcgacctttgctt

SEQ ID NO: 276343 - DNA, 25 bp, Mus musculus
attactgacacaagccagtcatcaa

SEQ ID NO: 276344 - DNA, 25 bp, Mus musculus
attactgacacatgccagtcatcaa

SEQ ID NO: 276345 - DNA, 25 bp, Mus musculus
attactgaccttcctgtcaagagct

SEQ ID NO: 276346 - DNA, 25 bp, Mus musculus
attactgaccttgctgtcaagagct

SEQ ID NO: 276347 - DNA, 25 bp, Mus musculus
attactgagattccctgcagacctc

SEQ ID NO: 276348 - DNA, 25 bp, Mus musculus
attactgagattgcctgcagacctc

SEQ ID NO: 276349 - DNA, 25 bp, Mus musculus
attactgagggaaaggtgctatcta

SEQ ID NO: 276350 - DNA, 25 bp, Mus musculus
attactgagggataggtgctatcta

SEQ ID NO: 276351 - DNA, 25 bp, Mus musculus
attactgagtagctagtttcctgag

SEQ ID NO: 276352 - DNA, 25 bp, Mus musculus
attactgagtaggtagtttcctgag

SEQ ID NO: 276353 - DNA, 25 bp, Mus musculus
attactgagttgctgattaaatctt

SEQ ID NO: 276354 - DNA, 25 bp, Mus musculus
attactgagttggtgattaaatctt

SEQ ID NO: 276355 - DNA, 25 bp, Mus musculus
attactgatgtgcttttccgacctg

SEQ ID NO: 276356 - DNA, 25 bp, Mus musculus
attactgatgtggttttccgacctg

SEQ ID NO: 276357 - DNA, 25 bp, Mus musculus
attactgattttctctgtaagtaga

SEQ ID NO: 276358 - DNA, 25 bp, Mus musculus
attactgattttgtctgtaagtaga

SEQ ID NO: 276359 - DNA, 25 bp, Mus musculus
attactgcaaaaagcctgaatctgt

SEQ ID NO: 276360 - DNA, 25 bp, Mus musculus
attactgcaaaatgcctgaatctgt

SEQ ID NO: 276361 - DNA, 25 bp, Mus musculus
attactgcaaagatatgtgatcaca

SEQ ID NO: 276362 - DNA, 25 bp, Mus musculus
attactgcaaagttatgtgatcaca

SEQ ID NO: 276363 - DNA, 25 bp, Mus musculus
attactgcagaacaagacacatttg

SEQ ID NO: 276364 - DNA, 25 bp, Mus musculus
attactgcagaactcttagccgtga

SEQ ID NO: 276365 - DNA, 25 bp, Mus musculus
attactgcagaagaagacacatttg

SEQ ID NO: 276366 - DNA, 25 bp, Mus musculus
attactgcagaagtcttagccgtga

SEQ ID NO: 276367 - DNA, 25 bp, Mus musculus
attactgcatacatgagttttgtac

SEQ ID NO: 276368 - DNA, 25 bp, Mus musculus
attactgcatacttgagttttgtac

SEQ ID NO: 276369 - DNA, 25 bp, Mus musculus
attactgcatttccgtacacccatt

SEQ ID NO: 276370 - DNA, 25 bp, Mus musculus
attactgcatttgcgtacacccatt

SEQ ID NO: 276371 - DNA, 25 bp, Mus musculus
attactgccagcctggagagaggaa

SEQ ID NO: 276372 - DNA, 25 bp, Mus musculus
attactgccagcgtggagagaggaa

SEQ ID NO: 276373 - DNA, 25 bp, Mus musculus
attactgccctgacataaatcctat

SEQ ID NO: 276374 - DNA, 25 bp, Mus musculus
attactgccctgtcataaatcctat

SEQ ID NO: 276375 - DNA, 25 bp, Mus musculus
attactgcctccatctttgttttca

SEQ ID NO: 276376 - DNA, 25 bp, Mus musculus
attactgcctccttctttgttttca

SEQ ID NO: 276377 - DNA, 25 bp, Mus musculus
attactgcgaagagcttaccaggca

SEQ ID NO: 276378 - DNA, 25 bp, Mus musculus
attactgcgaagtgcttaccaggca

SEQ ID NO: 276379 - DNA, 25 bp, Mus musculus
attactgcgagtaagctcacccttt

SEQ ID NO: 276380 - DNA, 25 bp, Mus musculus
attactgcgagttagctcacccttt

SEQ ID NO: 276381 - DNA, 25 bp, Mus musculus
attactgctacccttgtgggaacca

SEQ ID NO: 276382 - DNA, 25 bp, Mus musculus
attactgctaccgttgtgggaacca

SEQ ID NO: 276383 - DNA, 25 bp, Mus musculus
attactgctctgagcccattcatgt

SEQ ID NO: 276384 - DNA, 25 bp, Mus musculus
attactgctctgtgcccattcatgt

SEQ ID NO: 276385 - DNA, 25 bp, Mus musculus
attactgctggcacctgacaaaatt

SEQ ID NO: 276386 - DNA, 25 bp, Mus musculus
attactgctggcacttgctggttat

SEQ ID NO: 276387 - DNA, 25 bp, Mus musculus
attactgctggctcctgacaaaatt

SEQ ID NO: 276388 - DNA, 25 bp, Mus musculus
attactgctggctcttgctggttat

SEQ ID NO: 276389 - DNA, 25 bp, Mus musculus
attactgctgtgaagaaacattagt

SEQ ID NO: 276390 - DNA, 25 bp, Mus musculus
attactgctgtgtagaaacattagt

SEQ ID NO: 276391 - DNA, 25 bp, Mus musculus
attactgctgttacacctccattcg

SEQ ID NO: 276392 - DNA, 25 bp, Mus musculus
attactgctgtttcacctccattcg

SEQ ID NO: 276393 - DNA, 25 bp, Mus musculus
attactgctttactgtgtatctcaa

SEQ ID NO: 276394 - DNA, 25 bp, Mus musculus
attactgctttagtgtgtatctcaa

SEQ ID NO: 276395 - DNA, 25 bp, Mus musculus
attactggaccaacattaaatgtgt

SEQ ID NO: 276396 - DNA, 25 bp, Mus musculus
attactggaccatcattaaatgtgt

SEQ ID NO: 276397 - DNA, 25 bp, Mus musculus
attactggacttctacacacagaga

SEQ ID NO: 276398 - DNA, 25 bp, Mus musculus
attactggacttgtacacacagaga

SEQ ID NO: 276399 - DNA, 25 bp, Mus musculus
attactggagtgactagggcacttt

SEQ ID NO: 276400 - DNA, 25 bp, Mus musculus
attactggagtgtctagggcacttt

SEQ ID NO: 276401 - DNA, 25 bp, Mus musculus
attactggagttctccgggataaag

SEQ ID NO: 276402 - DNA, 25 bp, Mus musculus
attactggagttgtccgggataaag

SEQ ID NO: 276403 - DNA, 25 bp, Mus musculus
attactggcaaacccgtgaagctca

SEQ ID NO: 276404 - DNA, 25 bp, Mus musculus
attactggcaaagccgtgaagctca

SEQ ID NO: 276405 - DNA, 25 bp, Mus musculus
attactggctacaccttcagagaat

SEQ ID NO: 276406 - DNA, 25 bp, Mus musculus
attactggctactccttcagagaat

SEQ ID NO: 276407 - DNA, 25 bp, Mus musculus
attactgggcctataatgtcggtcc

SEQ ID NO: 276408 - DNA, 25 bp, Mus musculus
attactgggcctttaatgtcggtcc

SEQ ID NO: 276409 - DNA, 25 bp, Mus musculus
attactgggttgactctgaataagg

SEQ ID NO: 276410 - DNA, 25 bp, Mus musculus
attactgggttgtctctgaataagg

SEQ ID NO: 276411 - DNA, 25 bp, Mus musculus
attactggtactagtgggtcagcca

SEQ ID NO: 276412 - DNA, 25 bp, Mus musculus
attactggtacttgtgggtcagcca

SEQ ID NO: 276413 - DNA, 25 bp, Mus musculus
attactggtcgacatgtgggcttcc

SEQ ID NO: 276414 - DNA, 25 bp, Mus musculus
attactggtcgagatgtgggcttcc

SEQ ID NO: 276415 - DNA, 25 bp, Mus musculus
attactggtctgatgacttcctcct

SEQ ID NO: 276416 - DNA, 25 bp, Mus musculus
attactggtctgttgacttcctcct

SEQ ID NO: 276417 - DNA, 25 bp, Mus musculus
attactgtagcaaggttttattttc

SEQ ID NO: 276418 - DNA, 25 bp, Mus musculus
attactgtagcatggttttattttc

SEQ ID NO: 276419 - DNA, 25 bp, Mus musculus
attactgtagtacccttgcttaaag

SEQ ID NO: 276420 - DNA, 25 bp, Mus musculus
attactgtagtactttcccaggatg

SEQ ID NO: 276421 - DNA, 25 bp, Mus musculus
attactgtagtagccttgcttaaag

SEQ ID NO: 276422 - DNA, 25 bp, Mus musculus
attactgtagtagtttcccaggatg

SEQ ID NO: 276423 - DNA, 25 bp, Mus musculus
attactgtatttacacttgctcttt

SEQ ID NO: 276424 - DNA, 25 bp, Mus musculus
attactgtattttcacttgctcttt

SEQ ID NO: 276425 - DNA, 25 bp, Mus musculus
attactgtcagtatcattttagaga

SEQ ID NO: 276426 - DNA, 25 bp, Mus musculus
attactgtcagtttcattttagaga

SEQ ID NO: 276427 - DNA, 25 bp, Mus musculus
attactgtcatgcagagtgcccctt

SEQ ID NO: 276428 - DNA, 25 bp, Mus musculus
attactgtcatggagagtgcccctt

SEQ ID NO: 276429 - DNA, 25 bp, Mus musculus
attactgtgagtctgatgtcatcct

SEQ ID NO: 276430 - DNA, 25 bp, Mus musculus
attactgtgagtgtgatgtcatcct

SEQ ID NO: 276431 - DNA, 25 bp, Mus musculus
attactgtgggtcacagcgccctct

SEQ ID NO: 276432 - DNA, 25 bp, Mus musculus
attactgtgggtgacagcgccctct

SEQ ID NO: 276433 - DNA, 25 bp, Mus musculus
attactgtgtccatctgttgtgtgt

SEQ ID NO: 276434 - DNA, 25 bp, Mus musculus
attactgtgtccttctgttgtgtgt

SEQ ID NO: 276435 - DNA, 25 bp, Mus musculus
attactgtgtgtcttctgagacctc

SEQ ID NO: 276436 - DNA, 25 bp, Mus musculus
attactgtgtgtgttctgagacctc

SEQ ID NO: 276437 - DNA, 25 bp, Mus musculus
attactgttactcagggcgtctttc

SEQ ID NO: 276438 - DNA, 25 bp, Mus musculus
attactgttactgagggcgtctttc

SEQ ID NO: 276439 - DNA, 25 bp, Mus musculus
attactgttattatactattgttac

SEQ ID NO: 276440 - DNA, 25 bp, Mus musculus
attactgttattttactattgttac

SEQ ID NO: 276441 - DNA, 25 bp, Mus musculus
attactgttcagcactggatggcaa

SEQ ID NO: 276442 - DNA, 25 bp, Mus musculus
attactgttcaggactggatggcaa

SEQ ID NO: 276443 - DNA, 25 bp, Mus musculus
attactgttctgaagttgcaacgga

SEQ ID NO: 276444 - DNA, 25 bp, Mus musculus
attactgttctgtagttgcaacgga

SEQ ID NO: 276445 - DNA, 25 bp, Mus musculus
attactgttcttagatagggctttt

SEQ ID NO: 276446 - DNA, 25 bp, Mus musculus
attactgttctttgatagggctttt

SEQ ID NO: 276447 - DNA, 25 bp, Mus musculus
attactgtttataaagctgctgttt

SEQ ID NO: 276448 - DNA, 25 bp, Mus musculus
attactgtttattaagctgctgttt

SEQ ID NO: 276449 - DNA, 25 bp, Mus musculus
attactgtttggaatgaccccgctg

SEQ ID NO: 276450 - DNA, 25 bp, Mus musculus
attactgtttggctgtttatctcac

SEQ ID NO: 276451 - DNA, 25 bp, Mus musculus
attactgtttgggtgtttatctcac

SEQ ID NO: 276452 - DNA, 25 bp, Mus musculus
attactgtttggtatgaccccgctg

SEQ ID NO: 276453 - DNA, 25 bp, Mus musculus
attactgtttgtctatgtgcctgca

SEQ ID NO: 276454 - DNA, 25 bp, Mus musculus
attactgtttgtgtatgtgcctgca

SEQ ID NO: 276455 - DNA, 25 bp, Mus musculus
attactgtttttaagcatttgcctg

SEQ ID NO: 276456 - DNA, 25 bp, Mus musculus
attactgttttttagcatttgcctg

SEQ ID NO: 276457 - DNA, 25 bp, Mus musculus
attacttaaaaaacatacactgtgg

SEQ ID NO: 276458 - DNA, 25 bp, Mus musculus
attacttaaaaatcatacactgtgg

SEQ ID NO: 276459 - DNA, 25 bp, Mus musculus
attacttaaatgatgtctctgctta

SEQ ID NO: 276460 - DNA, 25 bp, Mus musculus
attacttaaatgttgtctctgctta

SEQ ID NO: 276461 - DNA, 25 bp, Mus musculus
attacttaacctcagaatcgggcca

SEQ ID NO: 276462 - DNA, 25 bp, Mus musculus
attacttaacctgagaatcgggcca

SEQ ID NO: 276463 - DNA, 25 bp, Mus musculus
attacttacacactgtttcctgggc

SEQ ID NO: 276464 - DNA, 25 bp, Mus musculus
attacttacacagtgtttcctgggc

SEQ ID NO: 276465 - DNA, 25 bp, Mus musculus
attacttacactctatgacttaaat

SEQ ID NO: 276466 - DNA, 25 bp, Mus musculus
attacttacactgtatgacttaaat

SEQ ID NO: 276467 - DNA, 25 bp, Mus musculus
attacttagaccatctttgagggca

SEQ ID NO: 276468 - DNA, 25 bp, Mus musculus
attacttagaccttctttgagggca

SEQ ID NO: 276469 - DNA, 25 bp, Mus musculus
attacttaggatcgagccttcctcc

SEQ ID NO: 276470 - DNA, 25 bp, Mus musculus
attacttaggatggagccttcctcc

SEQ ID NO: 276471 - DNA, 25 bp, Mus musculus
attacttaggtaagtcagcactttt

SEQ ID NO: 276472 - DNA, 25 bp, Mus musculus
attacttaggtacaaactcgtggtg

SEQ ID NO: 276473 - DNA, 25 bp, Mus musculus
attacttaggtagaaactcgtggtg

SEQ ID NO: 276474 - DNA, 25 bp, Mus musculus
attacttaggtatgtcagcactttt

SEQ ID NO: 276475 - DNA, 25 bp, Mus musculus
attacttagtatcagcttgcgagct

SEQ ID NO: 276476 - DNA, 25 bp, Mus musculus
attacttagtatgagcttgcgagct

SEQ ID NO: 276477 - DNA, 25 bp, Mus musculus
attacttagttcatgttttctatta

SEQ ID NO: 276478 - DNA, 25 bp, Mus musculus
attacttagttcttgttttctatta

SEQ ID NO: 276479 - DNA, 25 bp, Mus musculus
attacttcaaaaacatctgggtcaa

SEQ ID NO: 276480 - DNA, 25 bp, Mus musculus
attacttcaaaatcatctgggtcaa

SEQ ID NO: 276481 - DNA, 25 bp, Mus musculus
attacttcacacaccaaccagaatt

SEQ ID NO: 276482 - DNA, 25 bp, Mus musculus
attacttcacactccaaccagaatt

SEQ ID NO: 276483 - DNA, 25 bp, Mus musculus
attacttcacgaattctcctttctg

SEQ ID NO: 276484 - DNA, 25 bp, Mus musculus
attacttcacgatttctcctttctg

SEQ ID NO: 276485 - DNA, 25 bp, Mus musculus
attacttcatctccttgggagaggc

SEQ ID NO: 276486 - DNA, 25 bp, Mus musculus
attacttcatctgcttgggagaggc

SEQ ID NO: 276487 - DNA, 25 bp, Mus musculus
attacttcctggctgcctgaacata

SEQ ID NO: 276488 - DNA, 25 bp, Mus musculus
attacttcctgggtgcctgaacata

SEQ ID NO: 276489 - DNA, 25 bp, Mus musculus
attacttccttcctacagacagctt

SEQ ID NO: 276490 - DNA, 25 bp, Mus musculus
attacttccttcgtacagacagctt

SEQ ID NO: 276491 - DNA, 25 bp, Mus musculus
attacttcggtaatccaaggagcgg

SEQ ID NO: 276492 - DNA, 25 bp, Mus musculus
attacttcggtattccaaggagcgg

SEQ ID NO: 276493 - DNA, 25 bp, Mus musculus
attacttctccgaaatatctattaa

SEQ ID NO: 276494 - DNA, 25 bp, Mus musculus
attacttctccgtaatatctattaa

SEQ ID NO: 276495 - DNA, 25 bp, Mus musculus
attacttctgatcactgatggccag

SEQ ID NO: 276496 - DNA, 25 bp, Mus musculus
attacttctgatgactgatggccag

SEQ ID NO: 276497 - DNA, 25 bp, Mus musculus
attacttctgctatactaggcccta

SEQ ID NO: 276498 - DNA, 25 bp, Mus musculus
attacttctgctttactaggcccta

SEQ ID NO: 276499 - DNA, 25 bp, Mus musculus
attacttcttctattgcttgcattg

SEQ ID NO: 276500 - DNA, 25 bp, Mus musculus
attacttcttcttttgcttgcattg

SEQ ID NO: 276501 - DNA, 25 bp, Mus musculus
attacttgagtacatggacaggcct

SEQ ID NO: 276502 - DNA, 25 bp, Mus musculus
attacttgagtagatggacaggcct

SEQ ID NO: 276503 - DNA, 25 bp, Mus musculus
attacttgagttcattggtgctaat

SEQ ID NO: 276504 - DNA, 25 bp, Mus musculus
attacttgagttgattggtgctaat

SEQ ID NO: 276505 - DNA, 25 bp, Mus musculus
attacttgccctaaagatctacctt

SEQ ID NO: 276506 - DNA, 25 bp, Mus musculus
attacttgcccttaagatctacctt

SEQ ID NO: 276507 - DNA, 25 bp, Mus musculus
attacttggccacagatccatgaca

SEQ ID NO: 276508 - DNA, 25 bp, Mus musculus
attacttggccagagatccatgaca

SEQ ID NO: 276509 - DNA, 25 bp, Mus musculus
attacttggtaactcttctgtggac

SEQ ID NO: 276510 - DNA, 25 bp, Mus musculus
attacttggtaagtcttctgtggac

SEQ ID NO: 276511 - DNA, 25 bp, Mus musculus
attacttggttcctggtataagcgc

SEQ ID NO: 276512 - DNA, 25 bp, Mus musculus
attacttggttcgtggtataagcgc

SEQ ID NO: 276513 - DNA, 25 bp, Mus musculus
attacttgtacgatgaaggatgcct

SEQ ID NO: 276514 - DNA, 25 bp, Mus musculus
attacttgtacgttgaaggatgcct

SEQ ID NO: 276515 - DNA, 25 bp, Mus musculus
attacttgtgagacaccagctgcca

SEQ ID NO: 276516 - DNA, 25 bp, Mus musculus
attacttgtgagtcaccagctgcca

SEQ ID NO: 276517 - DNA, 25 bp, Mus musculus
attacttgtgttaagggcaacgcat

SEQ ID NO: 276518 - DNA, 25 bp, Mus musculus
attacttgtgtttagggcaacgcat

SEQ ID NO: 276519 - DNA, 25 bp, Mus musculus
attacttgtttgctttctgcccaat

SEQ ID NO: 276520 - DNA, 25 bp, Mus musculus
attacttgtttggtttctgcccaat

SEQ ID NO: 276521 - DNA, 25 bp, Mus musculus
attactttacagcatcctcatagcc

SEQ ID NO: 276522 - DNA, 25 bp, Mus musculus
attactttacaggatcctcatagcc

SEQ ID NO: 276523 - DNA, 25 bp, Mus musculus
attactttagacctgtagttctcaa

SEQ ID NO: 276524 - DNA, 25 bp, Mus musculus
attactttagacgtgtagttctcaa

SEQ ID NO: 276525 - DNA, 25 bp, Mus musculus
attactttccaaaagctgtaggaat

SEQ ID NO: 276526 - DNA, 25 bp, Mus musculus
attactttccaatagctgtaggaat

SEQ ID NO: 276527 - DNA, 25 bp, Mus musculus
attactttccagataagtccaagca

SEQ ID NO: 276528 - DNA, 25 bp, Mus musculus
attactttccagttaagtccaagca

SEQ ID NO: 276529 - DNA, 25 bp, Mus musculus
attactttcctacatccctgttgtt

SEQ ID NO: 276530 - DNA, 25 bp, Mus musculus
attactttcctagatccctgttgtt

SEQ ID NO: 276531 - DNA, 25 bp, Mus musculus
attactttgaacaacattggcttgg

SEQ ID NO: 276532 - DNA, 25 bp, Mus musculus
attactttgaactacattggcttgg

SEQ ID NO: 276533 - DNA, 25 bp, Mus musculus
attactttgctaccttttcctaggg

SEQ ID NO: 276534 - DNA, 25 bp, Mus musculus
attactttgctagcttttcctaggg

SEQ ID NO: 276535 - DNA, 25 bp, Mus musculus
attactttgctccagtacctttggg

SEQ ID NO: 276536 - DNA, 25 bp, Mus musculus
attactttgctcgagtacctttggg

SEQ ID NO: 276537 - DNA, 25 bp, Mus musculus
attactttgctgctattttgctaac

SEQ ID NO: 276538 - DNA, 25 bp, Mus musculus
attactttgctggtattttgctaac

SEQ ID NO: 276539 - DNA, 25 bp, Mus musculus
attagaaagctcacgagccgcctcg

SEQ ID NO: 276540 - DNA, 25 bp, Mus musculus
attagaaagctctcgagccgcctcg

SEQ ID NO: 276541 - DNA, 25 bp, Mus musculus
attagaaagctgcttcccttgcttc

SEQ ID NO: 276542 - DNA, 25 bp, Mus musculus
attagaaagctggttcccttgcttc

SEQ ID NO: 276543 - DNA, 25 bp, Mus musculus
attagaaagtccatctcaaagagat

SEQ ID NO: 276544 - DNA, 25 bp, Mus musculus
attagaaagtccttctcaaagagat

SEQ ID NO: 276545 - DNA, 25 bp, Mus musculus
attagaacatttcgtttctctcctc

SEQ ID NO: 276546 - DNA, 25 bp, Mus musculus
attagaacatttggtttctctcctc

SEQ ID NO: 276547 - DNA, 25 bp, Mus musculus
attagaaccaatacccatcatcttc

SEQ ID NO: 276548 - DNA, 25 bp, Mus musculus
attagaaccaattcccatcatcttc

SEQ ID NO: 276549 - DNA, 25 bp, Mus musculus
attagaacccttatcatgttttgag

SEQ ID NO: 276550 - DNA, 25 bp, Mus musculus
attagaacccttttcatgttttgag

SEQ ID NO: 276551 - DNA, 25 bp, Mus musculus
attagaaccgctattccattcagag

SEQ ID NO: 276552 - DNA, 25 bp, Mus musculus
attagaaccgcttttccattcagag

SEQ ID NO: 276553 - DNA, 25 bp, Mus musculus
attagaaccggacgccccagagatg

SEQ ID NO: 276554 - DNA, 25 bp, Mus musculus
attagaaccggaggccccagagatg

SEQ ID NO: 276555 - DNA, 25 bp, Mus musculus
attagaagaatccaactctggcccc

SEQ ID NO: 276556 - DNA, 25 bp, Mus musculus
attagaagaatcgaactctggcccc

SEQ ID NO: 276557 - DNA, 25 bp, Mus musculus
attagaagatgcctgaccgacccta

SEQ ID NO: 276558 - DNA, 25 bp, Mus musculus
attagaagatgcgtgaccgacccta

SEQ ID NO: 276559 - DNA, 25 bp, Mus musculus
attagaaggaatctccctgtgggag

SEQ ID NO: 276560 - DNA, 25 bp, Mus musculus
attagaaggaatgtccctgtgggag

SEQ ID NO: 276561 - DNA, 25 bp, Mus musculus
attagaaggcccaaggtgcctacca

SEQ ID NO: 276562 - DNA, 25 bp, Mus musculus
attagaaggccctaggtgcctacca

SEQ ID NO: 276563 - DNA, 25 bp, Mus musculus
attagaatgtccacccgaagaattg

SEQ ID NO: 276564 - DNA, 25 bp, Mus musculus
attagaatgtcctcccgaagaattg

SEQ ID NO: 276565 - DNA, 25 bp, Mus musculus
attagacaatcaagctactactgag

SEQ ID NO: 276566 - DNA, 25 bp, Mus musculus
attagacaatcatgctactactgag

SEQ ID NO: 276567 - DNA, 25 bp, Mus musculus
attagacacagtcccttccatccat

SEQ ID NO: 276568 - DNA, 25 bp, Mus musculus
attagacacagtgccttccatccat

SEQ ID NO: 276569 - DNA, 25 bp, Mus musculus
attagacagcaacccacagcaaagg

SEQ ID NO: 276570 - DNA, 25 bp, Mus musculus
attagacagcaagccacagcaaagg

SEQ ID NO: 276571 - DNA, 25 bp, Mus musculus
attagacagcctcggatgcactcat

SEQ ID NO: 276572 - DNA, 25 bp, Mus musculus
attagacagcctgggatgcactcat

SEQ ID NO: 276573 - DNA, 25 bp, Mus musculus
attagaccagctcctccaaatgagt

SEQ ID NO: 276574 - DNA, 25 bp, Mus musculus
attagaccagctgctccaaatgagt

SEQ ID NO: 276575 - DNA, 25 bp, Mus musculus
attagaccataaccctctttctcct

SEQ ID NO: 276576 - DNA, 25 bp, Mus musculus
attagaccataagcctctttctcct

SEQ ID NO: 276577 - DNA, 25 bp, Mus musculus
attagacccaccagggcacgtgaga

SEQ ID NO: 276578 - DNA, 25 bp, Mus musculus
attagacccacctgggcacgtgaga

SEQ ID NO: 276579 - DNA, 25 bp, Mus musculus
attagaccccggacttctggtgagc

SEQ ID NO: 276580 - DNA, 25 bp, Mus musculus
attagaccccggtcttctggtgagc

SEQ ID NO: 276581 - DNA, 25 bp, Mus musculus
attagaccctccatttctgtgttct

SEQ ID NO: 276582 - DNA, 25 bp, Mus musculus
attagaccctccttttctgtgttct

SEQ ID NO: 276583 - DNA, 25 bp, Mus musculus
attagaccctgtcttgtgaaactac

SEQ ID NO: 276584 - DNA, 25 bp, Mus musculus
attagaccctgtgttgtgaaactac

SEQ ID NO: 276585 - DNA, 25 bp, Mus musculus
attagacctttgaggcgacattact

SEQ ID NO: 276586 - DNA, 25 bp, Mus musculus
attagacctttgtggcgacattact

SEQ ID NO: 276587 - DNA, 25 bp, Mus musculus
attagacgccacagaatttgcctgt

SEQ ID NO: 276588 - DNA, 25 bp, Mus musculus
attagacgccactgaatttgcctgt

SEQ ID NO: 276589 - DNA, 25 bp, Mus musculus
attagactatccatgttacttcgta

SEQ ID NO: 276590 - DNA, 25 bp, Mus musculus
attagactatccttgttacttcgta

SEQ ID NO: 276591 - DNA, 25 bp, Mus musculus
attagactatttattagctgccctc

SEQ ID NO: 276592 - DNA, 25 bp, Mus musculus
attagactatttctgctccttcctg

SEQ ID NO: 276593 - DNA, 25 bp, Mus musculus
attagactatttgtgctccttcctg

SEQ ID NO: 276594 - DNA, 25 bp, Mus musculus
attagactattttttagctgccctc

SEQ ID NO: 276595 - DNA, 25 bp, Mus musculus
attagactcacaccacacaagtatc

SEQ ID NO: 276596 - DNA, 25 bp, Mus musculus
attagactcacagcacacaagtatc

SEQ ID NO: 276597 - DNA, 25 bp, Mus musculus
attagactcagcaacgccattgttc

SEQ ID NO: 276598 - DNA, 25 bp, Mus musculus
attagactcagctacgccattgttc

SEQ ID NO: 276599 - DNA, 25 bp, Mus musculus
attagactccccacttctatcatgt

SEQ ID NO: 276600 - DNA, 25 bp, Mus musculus
attagactcccctcttctatcatgt

SEQ ID NO: 276601 - DNA, 25 bp, Mus musculus
attagactccttaggacctcaggca

SEQ ID NO: 276602 - DNA, 25 bp, Mus musculus
attagactcctttggacctcaggca

SEQ ID NO: 276603 - DNA, 25 bp, Mus musculus
attagactgatcaagttcgcggccg

SEQ ID NO: 276604 - DNA, 25 bp, Mus musculus
attagactgatctagttcgcggccg

SEQ ID NO: 276605 - DNA, 25 bp, Mus musculus
attagacttaagaatcctacggttg

SEQ ID NO: 276606 - DNA, 25 bp, Mus musculus
attagacttaagtatcctacggttg

SEQ ID NO: 276607 - DNA, 25 bp, Mus musculus
attagacttagcaagcaccccaggg

SEQ ID NO: 276608 - DNA, 25 bp, Mus musculus
attagacttagctagcaccccaggg

SEQ ID NO: 276609 - DNA, 25 bp, Mus musculus
attagagaacatacctagctcccct

SEQ ID NO: 276610 - DNA, 25 bp, Mus musculus
attagagaacattcctagctcccct

SEQ ID NO: 276611 - DNA, 25 bp, Mus musculus
attagagaactcactggctggccag

SEQ ID NO: 276612 - DNA, 25 bp, Mus musculus
attagagaactctctggctggccag

SEQ ID NO: 276613 - DNA, 25 bp, Mus musculus
attagagaagtcattggcctggaaa

SEQ ID NO: 276614 - DNA, 25 bp, Mus musculus
attagagaagtctttggcctggaaa

SEQ ID NO: 276615 - DNA, 25 bp, Mus musculus
attagagaatataagccgtgccacc

SEQ ID NO: 276616 - DNA, 25 bp, Mus musculus
attagagaatattagccgtgccacc

SEQ ID NO: 276617 - DNA, 25 bp, Mus musculus
attagagaccacacggagcgttctc

SEQ ID NO: 276618 - DNA, 25 bp, Mus musculus
attagagaccactcggagcgttctc

SEQ ID NO: 276619 - DNA, 25 bp, Mus musculus
attagagaccatcttgtatggtgcc

SEQ ID NO: 276620 - DNA, 25 bp, Mus musculus
attagagaccatgttgtatggtgcc

SEQ ID NO: 276621 - DNA, 25 bp, Mus musculus
attagagaccttctgcagtgcaatt

SEQ ID NO: 276622 - DNA, 25 bp, Mus musculus
attagagaccttgtgcagtgcaatt

SEQ ID NO: 276623 - DNA, 25 bp, Mus musculus
attagagactccctgagaccagctt

SEQ ID NO: 276624 - DNA, 25 bp, Mus musculus
attagagactccgtgagaccagctt

SEQ ID NO: 276625 - DNA, 25 bp, Mus musculus
attagagacttacttcttatgaagc

SEQ ID NO: 276626 - DNA, 25 bp, Mus musculus
attagagacttagttcttatgaagc

SEQ ID NO: 276627 - DNA, 25 bp, Mus musculus
attagagagggtcatgtgtcaccat

SEQ ID NO: 276628 - DNA, 25 bp, Mus musculus
attagagagggtgatgtgtcaccat

SEQ ID NO: 276629 - DNA, 25 bp, Mus musculus
attagagaggtgaccagtggctccg

SEQ ID NO: 276630 - DNA, 25 bp, Mus musculus
attagagaggtgtccagtggctccg

SEQ ID NO: 276631 - DNA, 25 bp, Mus musculus
attagagatttactcccagggcctt

SEQ ID NO: 276632 - DNA, 25 bp, Mus musculus
attagagatttagtcccagggcctt

SEQ ID NO: 276633 - DNA, 25 bp, Mus musculus
attagagccattaagccacaaccca

SEQ ID NO: 276634 - DNA, 25 bp, Mus musculus
attagagccatttagccacaaccca

SEQ ID NO: 276635 - DNA, 25 bp, Mus musculus
attagagcctaaacctacagattga

SEQ ID NO: 276636 - DNA, 25 bp, Mus musculus
attagagcctaatcctacagattga

SEQ ID NO: 276637 - DNA, 25 bp, Mus musculus
attagagccttaagtcaaccccaga

SEQ ID NO: 276638 - DNA, 25 bp, Mus musculus
attagagccttatgtcaaccccaga

SEQ ID NO: 276639 - DNA, 25 bp, Mus musculus
attagagcgaacaaaacagtatctg

SEQ ID NO: 276640 - DNA, 25 bp, Mus musculus
attagagcgaactaaacagtatctg

SEQ ID NO: 276641 - DNA, 25 bp, Mus musculus
attagagctattacttagtatccac

SEQ ID NO: 276642 - DNA, 25 bp, Mus musculus
attagagctatttcttagtatccac

SEQ ID NO: 276643 - DNA, 25 bp, Mus musculus
attagagctggtatctgtcctggtc

SEQ ID NO: 276644 - DNA, 25 bp, Mus musculus
attagagctggtttctgtcctggtc

SEQ ID NO: 276645 - DNA, 25 bp, Mus musculus
attagagcttgtctttgtttactgc

SEQ ID NO: 276646 - DNA, 25 bp, Mus musculus
attagagcttgtgtttgtttactgc

SEQ ID NO: 276647 - DNA, 25 bp, Mus musculus
attagaggcagcctatggacattta

SEQ ID NO: 276648 - DNA, 25 bp, Mus musculus
attagaggcagcgtatggacattta

SEQ ID NO: 276649 - DNA, 25 bp, Mus musculus
attagaggcaggctctcatcatgta

SEQ ID NO: 276650 - DNA, 25 bp, Mus musculus
attagaggcagggtctcatcatgta

SEQ ID NO: 276651 - DNA, 25 bp, Mus musculus
attagaggctctccaagatgccctg

SEQ ID NO: 276652 - DNA, 25 bp, Mus musculus
attagaggctctgcaagatgccctg

SEQ ID NO: 276653 - DNA, 25 bp, Mus musculus
attagagggcctcactggtacccta

SEQ ID NO: 276654 - DNA, 25 bp, Mus musculus
attagagggcctgactggtacccta

SEQ ID NO: 276655 - DNA, 25 bp, Mus musculus
attagaggtacgctcagccatgccc

SEQ ID NO: 276656 - DNA, 25 bp, Mus musculus
attagaggtacggtcagccatgccc

SEQ ID NO: 276657 - DNA, 25 bp, Mus musculus
attagagtagaaacgaggagcctga

SEQ ID NO: 276658 - DNA, 25 bp, Mus musculus
attagagtagaatcgaggagcctga

SEQ ID NO: 276659 - DNA, 25 bp, Mus musculus
attagagtggagaccctaccaccgc

SEQ ID NO: 276660 - DNA, 25 bp, Mus musculus
attagagtggagtccctaccaccgc

SEQ ID NO: 276661 - DNA, 25 bp, Mus musculus
attagagtttagcatcctcccaatt

SEQ ID NO: 276662 - DNA, 25 bp, Mus musculus
attagagtttaggatcctcccaatt

SEQ ID NO: 276663 - DNA, 25 bp, Mus musculus
attagataagatcatctacgtcccc

SEQ ID NO: 276664 - DNA, 25 bp, Mus musculus
attagataagatgatctacgtcccc

SEQ ID NO: 276665 - DNA, 25 bp, Mus musculus
attagatacatgatttgcccctcct

SEQ ID NO: 276666 - DNA, 25 bp, Mus musculus
attagatacatgttttgcccctcct

SEQ ID NO: 276667 - DNA, 25 bp, Mus musculus
attagatagaaccatgttccttttt

SEQ ID NO: 276668 - DNA, 25 bp, Mus musculus
attagatagaacgatgttccttttt

SEQ ID NO: 276669 - DNA, 25 bp, Mus musculus
attagatattcgattgctttttgta

SEQ ID NO: 276670 - DNA, 25 bp, Mus musculus
attagatattcgtttgctttttgta

SEQ ID NO: 276671 - DNA, 25 bp, Mus musculus
attagatcaactatgaagcctgtga

SEQ ID NO: 276672 - DNA, 25 bp, Mus musculus
attagatcaactttgaagcctgtga

SEQ ID NO: 276673 - DNA, 25 bp, Mus musculus
attagatcatgccatattactgtac

SEQ ID NO: 276674 - DNA, 25 bp, Mus musculus
attagatcatgcgatattactgtac

SEQ ID NO: 276675 - DNA, 25 bp, Mus musculus
attagatcttctaactgatggttgt

SEQ ID NO: 276676 - DNA, 25 bp, Mus musculus
attagatcttcttactgatggttgt

SEQ ID NO: 276677 - DNA, 25 bp, Mus musculus
attagatgcaggacacacagccaga

SEQ ID NO: 276678 - DNA, 25 bp, Mus musculus
attagatgcaggtcacacagccaga

SEQ ID NO: 276679 - DNA, 25 bp, Mus musculus
attagatgccatcagcttcgctttt

SEQ ID NO: 276680 - DNA, 25 bp, Mus musculus
attagatgccatgagcttcgctttt

SEQ ID NO: 276681 - DNA, 25 bp, Mus musculus
attagatgctatcttcccagaagga

SEQ ID NO: 276682 - DNA, 25 bp, Mus musculus
attagatgctatgttcccagaagga

SEQ ID NO: 276683 - DNA, 25 bp, Mus musculus
attagatgctccacaaggttgtccc

SEQ ID NO: 276684 - DNA, 25 bp, Mus musculus
attagatgctccactctgagacatg

SEQ ID NO: 276685 - DNA, 25 bp, Mus musculus
attagatgctcctcaaggttgtccc

SEQ ID NO: 276686 - DNA, 25 bp, Mus musculus
attagatgctcctctctgagacatg

SEQ ID NO: 276687 - DNA, 25 bp, Mus musculus
attagatgggctactttctcttgct

SEQ ID NO: 276688 - DNA, 25 bp, Mus musculus
attagatgggcttctttctcttgct

SEQ ID NO: 276689 - DNA, 25 bp, Mus musculus
attagattcttaacctacatcccac

SEQ ID NO: 276690 - DNA, 25 bp, Mus musculus
attagattcttatcctacatcccac

SEQ ID NO: 276691 - DNA, 25 bp, Mus musculus
attagcaaacagatccccacatatc

SEQ ID NO: 276692 - DNA, 25 bp, Mus musculus
attagcaaacagttccccacatatc

SEQ ID NO: 276693 - DNA, 25 bp, Mus musculus
attagcaaagcaacctttcacccgt

SEQ ID NO: 276694 - DNA, 25 bp, Mus musculus
attagcaaagcaccccggtgcttca

SEQ ID NO: 276695 - DNA, 25 bp, Mus musculus
attagcaaagcagcccggtgcttca

SEQ ID NO: 276696 - DNA, 25 bp, Mus musculus
attagcaaagcatcctttcacccgt

SEQ ID NO: 276697 - DNA, 25 bp, Mus musculus
attagcaacagcagttctttctccc

SEQ ID NO: 276698 - DNA, 25 bp, Mus musculus
attagcaacagctgttctttctccc

SEQ ID NO: 276699 - DNA, 25 bp, Mus musculus
attagcaaccatcttttacctaaag

SEQ ID NO: 276700 - DNA, 25 bp, Mus musculus
attagcaaccatgttttacctaaag

SEQ ID NO: 276701 - DNA, 25 bp, Mus musculus
attagcaacctgcagtgctctctgt

SEQ ID NO: 276702 - DNA, 25 bp, Mus musculus
attagcaacctggagtgctctctgt

SEQ ID NO: 276703 - DNA, 25 bp, Mus musculus
attagcaagtcaactctctcagagt

SEQ ID NO: 276704 - DNA, 25 bp, Mus musculus
attagcaagtcatctctctcagagt

SEQ ID NO: 276705 - DNA, 25 bp, Mus musculus
attagcaatcttcactttgtgcctg

SEQ ID NO: 276706 - DNA, 25 bp, Mus musculus
attagcaatcttgactttgtgcctg

SEQ ID NO: 276707 - DNA, 25 bp, Mus musculus
attagcaatgagctgtaaccctctt

SEQ ID NO: 276708 - DNA, 25 bp, Mus musculus
attagcaatgaggtgtaaccctctt

SEQ ID NO: 276709 - DNA, 25 bp, Mus musculus
attagcaatttgatgactctcatca

SEQ ID NO: 276710 - DNA, 25 bp, Mus musculus
attagcaatttgttgactctcatca

SEQ ID NO: 276711 - DNA, 25 bp, Mus musculus
attagcacaaccagggcagagccgc

SEQ ID NO: 276712 - DNA, 25 bp, Mus musculus
attagcacaacctgggcagagccgc

SEQ ID NO: 276713 - DNA, 25 bp, Mus musculus
attagcacaactcgctccgtaactt

SEQ ID NO: 276714 - DNA, 25 bp, Mus musculus
attagcacaactggctccgtaactt

SEQ ID NO: 276715 - DNA, 25 bp, Mus musculus
attagcacactcatatgcattccca

SEQ ID NO: 276716 - DNA, 25 bp, Mus musculus
attagcacactcttatgcattccca

SEQ ID NO: 276717 - DNA, 25 bp, Mus musculus
attagcacagacaccaaagtccaca

SEQ ID NO: 276718 - DNA, 25 bp, Mus musculus
attagcacagactccaaagtccaca

SEQ ID NO: 276719 - DNA, 25 bp, Mus musculus
attagcacagcccataaggcaagac

SEQ ID NO: 276720 - DNA, 25 bp, Mus musculus
attagcacagccgataaggcaagac

SEQ ID NO: 276721 - DNA, 25 bp, Mus musculus
attagcaccaaacactccatgaagg

SEQ ID NO: 276722 - DNA, 25 bp, Mus musculus
attagcaccaaagactccatgaagg

SEQ ID NO: 276723 - DNA, 25 bp, Mus musculus
attagcacccacctatacacaggca

SEQ ID NO: 276724 - DNA, 25 bp, Mus musculus
attagcacccacgtatacacaggca

SEQ ID NO: 276725 - DNA, 25 bp, Mus musculus
attagcacccatacctactaggtct

SEQ ID NO: 276726 - DNA, 25 bp, Mus musculus
attagcacccattcctactaggtct

SEQ ID NO: 276727 - DNA, 25 bp, Mus musculus
attagcaccctcattcctggttggt

SEQ ID NO: 276728 - DNA, 25 bp, Mus musculus
attagcaccctctttcctggttggt

SEQ ID NO: 276729 - DNA, 25 bp, Mus musculus
attagcacctagctcaggcctggag

SEQ ID NO: 276730 - DNA, 25 bp, Mus musculus
attagcacctaggtcaggcctggag

SEQ ID NO: 276731 - DNA, 25 bp, Mus musculus
attagcacgaggaacattttccctg

SEQ ID NO: 276732 - DNA, 25 bp, Mus musculus
attagcacgaggtacattttccctg

SEQ ID NO: 276733 - DNA, 25 bp, Mus musculus
attagcactgggatgtcggccggtc

SEQ ID NO: 276734 - DNA, 25 bp, Mus musculus
attagcactgggttgtcggccggtc

SEQ ID NO: 276735 - DNA, 25 bp, Mus musculus
attagcagagttatttccatagccc

SEQ ID NO: 276736 - DNA, 25 bp, Mus musculus
attagcagagttttttccatagccc

SEQ ID NO: 276737 - DNA, 25 bp, Mus musculus
attagcagcaacattccatcggtaa

SEQ ID NO: 276738 - DNA, 25 bp, Mus musculus
attagcagcaactttccatcggtaa

SEQ ID NO: 276739 - DNA, 25 bp, Mus musculus
attagcaggcctctcagaggagttg

SEQ ID NO: 276740 - DNA, 25 bp, Mus musculus
attagcaggcctgtcagaggagttg

SEQ ID NO: 276741 - DNA, 25 bp, Mus musculus
attagcagggttagtcagcctcccg

SEQ ID NO: 276742 - DNA, 25 bp, Mus musculus
attagcagggtttgtcagcctcccg

SEQ ID NO: 276743 - DNA, 25 bp, Mus musculus
attagcagtcaacgccaatgttggg

SEQ ID NO: 276744 - DNA, 25 bp, Mus musculus
attagcagtcaaggccaatgttggg

SEQ ID NO: 276745 - DNA, 25 bp, Mus musculus
attagcagtgtgcaacagcagctgt

SEQ ID NO: 276746 - DNA, 25 bp, Mus musculus
attagcagtgtggaacagcagctgt

SEQ ID NO: 276747 - DNA, 25 bp, Mus musculus
attagcatagctcccagagtctctt

SEQ ID NO: 276748 - DNA, 25 bp, Mus musculus
attagcatagctgccagagtctctt

SEQ ID NO: 276749 - DNA, 25 bp, Mus musculus
attagcatatgtaatcactacctgt

SEQ ID NO: 276750 - DNA, 25 bp, Mus musculus
attagcatatgtcctctgaagctat

SEQ ID NO: 276751 - DNA, 25 bp, Mus musculus
attagcatatgtgctctgaagctat

SEQ ID NO: 276752 - DNA, 25 bp, Mus musculus
attagcatatgttatcactacctgt

SEQ ID NO: 276753 - DNA, 25 bp, Mus musculus
attagcatctgaatcactactctca

SEQ ID NO: 276754 - DNA, 25 bp, Mus musculus
attagcatctgattcactactctca

SEQ ID NO: 276755 - DNA, 25 bp, Mus musculus
attagcatgcatcttacccttgaat

SEQ ID NO: 276756 - DNA, 25 bp, Mus musculus
attagcatgcatgttacccttgaat

SEQ ID NO: 276757 - DNA, 25 bp, Mus musculus
attagcatgggtatcccacttcagt

SEQ ID NO: 276758 - DNA, 25 bp, Mus musculus
attagcatgggtttcccacttcagt

SEQ ID NO: 276759 - DNA, 25 bp, Mus musculus
attagcattcagctgtccaaccctt

SEQ ID NO: 276760 - DNA, 25 bp, Mus musculus
attagcattcaggtgtccaaccctt

SEQ ID NO: 276761 - DNA, 25 bp, Mus musculus
attagcattgtcacacagataacat

SEQ ID NO: 276762 - DNA, 25 bp, Mus musculus
attagcattgtctcacagataacat

SEQ ID NO: 276763 - DNA, 25 bp, Mus musculus
attagcatttataagtttccacatt

SEQ ID NO: 276764 - DNA, 25 bp, Mus musculus
attagcatttattagtttccacatt

SEQ ID NO: 276765 - DNA, 25 bp, Mus musculus
attagcatttggctgatggcagcag

SEQ ID NO: 276766 - DNA, 25 bp, Mus musculus
attagcatttgggtgatggcagcag

SEQ ID NO: 276767 - DNA, 25 bp, Mus musculus
attagccaaatgcacagaatgtcca

SEQ ID NO: 276768 - DNA, 25 bp, Mus musculus
attagccaaatggacagaatgtcca

SEQ ID NO: 276769 - DNA, 25 bp, Mus musculus
attagccaaattcagttcagaccag

SEQ ID NO: 276770 - DNA, 25 bp, Mus musculus
attagccaaattgagttcagaccag

SEQ ID NO: 276771 - DNA, 25 bp, Mus musculus
attagccaacatacccacaaagtga

SEQ ID NO: 276772 - DNA, 25 bp, Mus musculus
attagccaacattcccacaaagtga

SEQ ID NO: 276773 - DNA, 25 bp, Mus musculus
attagccaaccccttgcaggtaaga

SEQ ID NO: 276774 - DNA, 25 bp, Mus musculus
attagccaacccgttgcaggtaaga

SEQ ID NO: 276775 - DNA, 25 bp, Mus musculus
attagccacctcaattttgtgtagg

SEQ ID NO: 276776 - DNA, 25 bp, Mus musculus
attagccacctctattttgtgtagg

SEQ ID NO: 276777 - DNA, 25 bp, Mus musculus
attagccagctgctacatatctcca

SEQ ID NO: 276778 - DNA, 25 bp, Mus musculus
attagccagctggtacatatctcca

SEQ ID NO: 276779 - DNA, 25 bp, Mus musculus
attagccatctaatgtcctccttgg

SEQ ID NO: 276780 - DNA, 25 bp, Mus musculus
attagccatctattgtcctccttgg

SEQ ID NO: 276781 - DNA, 25 bp, Mus musculus
attagccatcttaagcctgggtttt

SEQ ID NO: 276782 - DNA, 25 bp, Mus musculus
attagccatctttagcctgggtttt

SEQ ID NO: 276783 - DNA, 25 bp, Mus musculus
attagccattatcctcttctggtcc

SEQ ID NO: 276784 - DNA, 25 bp, Mus musculus
attagccattatgctcttctggtcc

SEQ ID NO: 276785 - DNA, 25 bp, Mus musculus
attagcccaaccacaatgctttgag

SEQ ID NO: 276786 - DNA, 25 bp, Mus musculus
attagcccaacctcaatgctttgag

SEQ ID NO: 276787 - DNA, 25 bp, Mus musculus
attagcccagggagggtttatcaga

SEQ ID NO: 276788 - DNA, 25 bp, Mus musculus
attagcccagggtgggtttatcaga

SEQ ID NO: 276789 - DNA, 25 bp, Mus musculus
attagcccatgacacaccattctta

SEQ ID NO: 276790 - DNA, 25 bp, Mus musculus
attagcccatgagacaccattctta

SEQ ID NO: 276791 - DNA, 25 bp, Mus musculus
attagcccgagtatggacttggtat

SEQ ID NO: 276792 - DNA, 25 bp, Mus musculus
attagcccgagtttggacttggtat

SEQ ID NO: 276793 - DNA, 25 bp, Mus musculus
attagccctgccctgaaaggacttc

SEQ ID NO: 276794 - DNA, 25 bp, Mus musculus
attagccctgccgtgaaaggacttc

SEQ ID NO: 276795 - DNA, 25 bp, Mus musculus
attagcccttgcattgggacgttca

SEQ ID NO: 276796 - DNA, 25 bp, Mus musculus
attagcccttgctttgggacgttca

SEQ ID NO: 276797 - DNA, 25 bp, Mus musculus
attagccgggctatggtgcataccc

SEQ ID NO: 276798 - DNA, 25 bp, Mus musculus
attagccgggctttggtgcataccc

SEQ ID NO: 276799 - DNA, 25 bp, Mus musculus
attagccgggtcacttgcctagcat

SEQ ID NO: 276800 - DNA, 25 bp, Mus musculus
attagccgggtctcttgcctagcat

SEQ ID NO: 276801 - DNA, 25 bp, Mus musculus
attagcctaaagcatcccagctcaa

SEQ ID NO: 276802 - DNA, 25 bp, Mus musculus
attagcctaaaggatcccagctcaa

SEQ ID NO: 276803 - DNA, 25 bp, Mus musculus
attagcctacctcgacttgggtcac

SEQ ID NO: 276804 - DNA, 25 bp, Mus musculus
attagcctacctggacttgggtcac

SEQ ID NO: 276805 - DNA, 25 bp, Mus musculus
attagcctagaaagtgcatgtgtga

SEQ ID NO: 276806 - DNA, 25 bp, Mus musculus
attagcctagaatgtgcatgtgtga

SEQ ID NO: 276807 - DNA, 25 bp, Mus musculus
attagcctcgccactgaggaagcgc

SEQ ID NO: 276808 - DNA, 25 bp, Mus musculus
attagcctcgcctctgaggaagcgc

SEQ ID NO: 276809 - DNA, 25 bp, Mus musculus
attagcctctcacctagcacactag

SEQ ID NO: 276810 - DNA, 25 bp, Mus musculus
attagcctctcagctagcacactag

SEQ ID NO: 276811 - DNA, 25 bp, Mus musculus
attagcctgaaacccaacaggcggt

SEQ ID NO: 276812 - DNA, 25 bp, Mus musculus
attagcctgaaagccaacaggcggt

SEQ ID NO: 276813 - DNA, 25 bp, Mus musculus
attagcctgctacctgacagagcct

SEQ ID NO: 276814 - DNA, 25 bp, Mus musculus
attagcctgctagctgacagagcct

SEQ ID NO: 276815 - DNA, 25 bp, Mus musculus
attagcctttaacagtcacgttcca

SEQ ID NO: 276816 - DNA, 25 bp, Mus musculus
attagcctttaagagtcacgttcca

SEQ ID NO: 276817 - DNA, 25 bp, Mus musculus
attagcctttggatctggcgtggga

SEQ ID NO: 276818 - DNA, 25 bp, Mus musculus
attagcctttggttctggcgtggga

SEQ ID NO: 276819 - DNA, 25 bp, Mus musculus
attagcgaactcaatgatcccatga

SEQ ID NO: 276820 - DNA, 25 bp, Mus musculus
attagcgaactctatgatcccatga

SEQ ID NO: 276821 - DNA, 25 bp, Mus musculus
attagcgaagccagacctctgtcat

SEQ ID NO: 276822 - DNA, 25 bp, Mus musculus
attagcgaagcctgacctctgtcat

SEQ ID NO: 276823 - DNA, 25 bp, Mus musculus
attagcgacgagctggaccacgccc

SEQ ID NO: 276824 - DNA, 25 bp, Mus musculus
attagcgacgaggtggaccacgccc

SEQ ID NO: 276825 - DNA, 25 bp, Mus musculus
attagcgataagctaggtgttccta

SEQ ID NO: 276826 - DNA, 25 bp, Mus musculus
attagcgataaggtaggtgttccta

SEQ ID NO: 276827 - DNA, 25 bp, Mus musculus
attagcgcaaacaaaccagtgagtg

SEQ ID NO: 276828 - DNA, 25 bp, Mus musculus
attagcgcaaactaaccagtgagtg

SEQ ID NO: 276829 - DNA, 25 bp, Mus musculus
attagcgcacacaatctgcggaggc

SEQ ID NO: 276830 - DNA, 25 bp, Mus musculus
attagcgcacactatctgcggaggc

SEQ ID NO: 276831 - DNA, 25 bp, Mus musculus
attagctaaaatcaccctggtattc

SEQ ID NO: 276832 - DNA, 25 bp, Mus musculus
attagctaaaatgaccctggtattc

SEQ ID NO: 276833 - DNA, 25 bp, Mus musculus
attagctaacccaaggcaggactgc

SEQ ID NO: 276834 - DNA, 25 bp, Mus musculus
attagctaaccctaggcaggactgc

SEQ ID NO: 276835 - DNA, 25 bp, Mus musculus
attagctaactcctaacagaaatgt

SEQ ID NO: 276836 - DNA, 25 bp, Mus musculus
attagctaactcgtaacagaaatgt

SEQ ID NO: 276837 - DNA, 25 bp, Mus musculus
attagctaccctagatcattctgag

SEQ ID NO: 276838 - DNA, 25 bp, Mus musculus
attagctacccttgatcattctgag

SEQ ID NO: 276839 - DNA, 25 bp, Mus musculus
attagctaggcacctgactgtcagc

SEQ ID NO: 276840 - DNA, 25 bp, Mus musculus
attagctaggcagctgactgtcagc

SEQ ID NO: 276841 - DNA, 25 bp, Mus musculus
attagctaggtgctcatttgcctgg

SEQ ID NO: 276842 - DNA, 25 bp, Mus musculus
attagctaggtggtcatttgcctgg

SEQ ID NO: 276843 - DNA, 25 bp, Mus musculus
attagctcatgaaacccaatttggg

SEQ ID NO: 276844 - DNA, 25 bp, Mus musculus
attagctcatgatacccaatttggg

SEQ ID NO: 276845 - DNA, 25 bp, Mus musculus
attagctcatgtcagggtcctgggt

SEQ ID NO: 276846 - DNA, 25 bp, Mus musculus
attagctcatgtgagggtcctgggt

SEQ ID NO: 276847 - DNA, 25 bp, Mus musculus
attagctcattcctaaggtatttaa

SEQ ID NO: 276848 - DNA, 25 bp, Mus musculus
attagctcattcgtaaggtatttaa

SEQ ID NO: 276849 - DNA, 25 bp, Mus musculus
attagctccaaacgctgaaaccatt

SEQ ID NO: 276850 - DNA, 25 bp, Mus musculus
attagctccaaaggctgaaaccatt

SEQ ID NO: 276851 - DNA, 25 bp, Mus musculus
attagctccagaagtgagacccggg

SEQ ID NO: 276852 - DNA, 25 bp, Mus musculus
attagctccagatgtgagacccggg

SEQ ID NO: 276853 - DNA, 25 bp, Mus musculus
attagctcggcaccaccagctgtca

SEQ ID NO: 276854 - DNA, 25 bp, Mus musculus
attagctcggcagcaccagctgtca

SEQ ID NO: 276855 - DNA, 25 bp, Mus musculus
attagctcgggtcagctcacttcca

SEQ ID NO: 276856 - DNA, 25 bp, Mus musculus
attagctcgggtgagctcacttcca

SEQ ID NO: 276857 - DNA, 25 bp, Mus musculus
attagctcggtacaactgccccgaa

SEQ ID NO: 276858 - DNA, 25 bp, Mus musculus
attagctcggtagaactgccccgaa

SEQ ID NO: 276859 - DNA, 25 bp, Mus musculus
attagctctgttcgcatggtgactt

SEQ ID NO: 276860 - DNA, 25 bp, Mus musculus
attagctctgttggcatggtgactt

SEQ ID NO: 276861 - DNA, 25 bp, Mus musculus
attagctgaaagcttgactgtcccc

SEQ ID NO: 276862 - DNA, 25 bp, Mus musculus
attagctgaaaggttgactgtcccc

SEQ ID NO: 276863 - DNA, 25 bp, Mus musculus
attagctgaagtccgtttgataacc

SEQ ID NO: 276864 - DNA, 25 bp, Mus musculus
attagctgaagtgcgtttgataacc

SEQ ID NO: 276865 - DNA, 25 bp, Mus musculus
attagctgagctcccttgccttttg

SEQ ID NO: 276866 - DNA, 25 bp, Mus musculus
attagctgagctgccttgccttttg

SEQ ID NO: 276867 - DNA, 25 bp, Mus musculus
attagctgccagcatttactaactg

SEQ ID NO: 276868 - DNA, 25 bp, Mus musculus
attagctgccaggatttactaactg

SEQ ID NO: 276869 - DNA, 25 bp, Mus musculus
attagctgccctcttgtaaccttta

SEQ ID NO: 276870 - DNA, 25 bp, Mus musculus
attagctgccctgttgtaaccttta

SEQ ID NO: 276871 - DNA, 25 bp, Mus musculus
attagctgggaaaccagtctcccct

SEQ ID NO: 276872 - DNA, 25 bp, Mus musculus
attagctgggaatccagtctcccct

SEQ ID NO: 276873 - DNA, 25 bp, Mus musculus
attagctgtagccatttctgtcttg

SEQ ID NO: 276874 - DNA, 25 bp, Mus musculus
attagctgtagcgatttctgtcttg

SEQ ID NO: 276875 - DNA, 25 bp, Mus musculus
attagctgtcaactctcttctctgc

SEQ ID NO: 276876 - DNA, 25 bp, Mus musculus
attagctgtcaagtctcttctctgc

SEQ ID NO: 276877 - DNA, 25 bp, Mus musculus
attagctgtctgaactccaatgcaa

SEQ ID NO: 276878 - DNA, 25 bp, Mus musculus
attagctgtctgtactccaatgcaa

SEQ ID NO: 276879 - DNA, 25 bp, Mus musculus
attagctgtgggaagaatttcatca

SEQ ID NO: 276880 - DNA, 25 bp, Mus musculus
attagctgtgggtagaatttcatca

SEQ ID NO: 276881 - DNA, 25 bp, Mus musculus
attagctgttgactcttagcctccc

SEQ ID NO: 276882 - DNA, 25 bp, Mus musculus
attagctgttgagtcttagcctccc

SEQ ID NO: 276883 - DNA, 25 bp, Mus musculus
attagctgtttcagggttaggctgt

SEQ ID NO: 276884 - DNA, 25 bp, Mus musculus
attagctgtttctgggttaggctgt

SEQ ID NO: 276885 - DNA, 25 bp, Mus musculus
attagcttacacatgtcgtcaggga

SEQ ID NO: 276886 - DNA, 25 bp, Mus musculus
attagcttacacttgtcgtcaggga

SEQ ID NO: 276887 - DNA, 25 bp, Mus musculus
attagcttagtacacactgtgttgt

SEQ ID NO: 276888 - DNA, 25 bp, Mus musculus
attagcttagtagacactgtgttgt

SEQ ID NO: 276889 - DNA, 25 bp, Mus musculus
attagcttagtcaattcaatttata

SEQ ID NO: 276890 - DNA, 25 bp, Mus musculus
attagcttagtctattcaatttata

SEQ ID NO: 276891 - DNA, 25 bp, Mus musculus
attagcttatgcatgcttcaaactt

SEQ ID NO: 276892 - DNA, 25 bp, Mus musculus
attagcttatgcttgcttcaaactt

SEQ ID NO: 276893 - DNA, 25 bp, Mus musculus
attagcttatgtctccgatgttcca

SEQ ID NO: 276894 - DNA, 25 bp, Mus musculus
attagcttatgtgtccgatgttcca

SEQ ID NO: 276895 - DNA, 25 bp, Mus musculus
attagcttcaccactttggtatttt

SEQ ID NO: 276896 - DNA, 25 bp, Mus musculus
attagcttcacctctttggtatttt

SEQ ID NO: 276897 - DNA, 25 bp, Mus musculus
attagcttcctgcttcagttgcagc

SEQ ID NO: 276898 - DNA, 25 bp, Mus musculus
attagcttcctggttcagttgcagc

SEQ ID NO: 276899 - DNA, 25 bp, Mus musculus
attagcttgatgagatgctgaccaa

SEQ ID NO: 276900 - DNA, 25 bp, Mus musculus
attagcttgatgtgatgctgaccaa

SEQ ID NO: 276901 - DNA, 25 bp, Mus musculus
attagctttcaccatgtctatgtca

SEQ ID NO: 276902 - DNA, 25 bp, Mus musculus
attagctttcacgatgtctatgtca

SEQ ID NO: 276903 - DNA, 25 bp, Mus musculus
attagctttcccaaaatccgtcatt

SEQ ID NO: 276904 - DNA, 25 bp, Mus musculus
attagctttccctaaatccgtcatt

SEQ ID NO: 276905 - DNA, 25 bp, Mus musculus
attagctttctaacttttacctgga

SEQ ID NO: 276906 - DNA, 25 bp, Mus musculus
attagctttctatcttttacctgga

SEQ ID NO: 276907 - DNA, 25 bp, Mus musculus
attagcttttctcagcctccagttt

SEQ ID NO: 276908 - DNA, 25 bp, Mus musculus
attagcttttctgagcctccagttt

SEQ ID NO: 276909 - DNA, 25 bp, Mus musculus
attagcttttgcatatttgcttaaa

SEQ ID NO: 276910 - DNA, 25 bp, Mus musculus
attagcttttgcttatttgcttaaa

SEQ ID NO: 276911 - DNA, 25 bp, Mus musculus
attaggaacccacatgccaccttct

SEQ ID NO: 276912 - DNA, 25 bp, Mus musculus
attaggaacccagatgccaccttct

SEQ ID NO: 276913 - DNA, 25 bp, Mus musculus
attaggaactgacctcatattctct

SEQ ID NO: 276914 - DNA, 25 bp, Mus musculus
attaggaactgagctcatattctct

SEQ ID NO: 276915 - DNA, 25 bp, Mus musculus
attaggaagcatcgctcctctctgc

SEQ ID NO: 276916 - DNA, 25 bp, Mus musculus
attaggaagcatggctcctctctgc

SEQ ID NO: 276917 - DNA, 25 bp, Mus musculus
attaggaagtgccttgcggctccat

SEQ ID NO: 276918 - DNA, 25 bp, Mus musculus
attaggaagtgcgttgcggctccat

SEQ ID NO: 276919 - DNA, 25 bp, Mus musculus
attaggaatcctcgcacaccaacca

SEQ ID NO: 276920 - DNA, 25 bp, Mus musculus
attaggaatcctggcacaccaacca

SEQ ID NO: 276921 - DNA, 25 bp, Mus musculus
attaggacccctaagaagtagcata

SEQ ID NO: 276922 - DNA, 25 bp, Mus musculus
attaggaccccttagaagtagcata

SEQ ID NO: 276923 - DNA, 25 bp, Mus musculus
attaggacgccaaactacactcttc

SEQ ID NO: 276924 - DNA, 25 bp, Mus musculus
attaggacgccatactacactcttc

SEQ ID NO: 276925 - DNA, 25 bp, Mus musculus
attaggagacaaatgacgcggagcc

SEQ ID NO: 276926 - DNA, 25 bp, Mus musculus
attaggagacaattgacgcggagcc

SEQ ID NO: 276927 - DNA, 25 bp, Mus musculus
attaggagcaatccctctgcctagg

SEQ ID NO: 276928 - DNA, 25 bp, Mus musculus
attaggagcaatgcctctgcctagg

SEQ ID NO: 276929 - DNA, 25 bp, Mus musculus
attaggagcctacctcacactggca

SEQ ID NO: 276930 - DNA, 25 bp, Mus musculus
attaggagcctagctcacactggca

SEQ ID NO: 276931 - DNA, 25 bp, Mus musculus
attaggagcgacaactttgtattgt

SEQ ID NO: 276932 - DNA, 25 bp, Mus musculus
attaggagcgactactttgtattgt

SEQ ID NO: 276933 - DNA, 25 bp, Mus musculus
attaggagcgatccaagtgcccttc

SEQ ID NO: 276934 - DNA, 25 bp, Mus musculus
attaggagcgatgcaagtgcccttc

SEQ ID NO: 276935 - DNA, 25 bp, Mus musculus
attaggagctagatcttcctccttt

SEQ ID NO: 276936 - DNA, 25 bp, Mus musculus
attaggagctagttcttcctccttt

SEQ ID NO: 276937 - DNA, 25 bp, Mus musculus
attaggagctgaccaggctgtgcac

SEQ ID NO: 276938 - DNA, 25 bp, Mus musculus
attaggagctgagcaggctgtgcac

SEQ ID NO: 276939 - DNA, 25 bp, Mus musculus
attaggagtggtagtgagcccacca

SEQ ID NO: 276940 - DNA, 25 bp, Mus musculus
attaggagtggttgtgagcccacca

SEQ ID NO: 276941 - DNA, 25 bp, Mus musculus
attaggatcatgctgttagtcaaag

SEQ ID NO: 276942 - DNA, 25 bp, Mus musculus
attaggatcatggtgttagtcaaag

SEQ ID NO: 276943 - DNA, 25 bp, Mus musculus
attaggatcctgagctggctggctc

SEQ ID NO: 276944 - DNA, 25 bp, Mus musculus
attaggatcctgtgctggctggctc

SEQ ID NO: 276945 - DNA, 25 bp, Mus musculus
attaggattcaccaatcaccccttt

SEQ ID NO: 276946 - DNA, 25 bp, Mus musculus
attaggattcacgaatcaccccttt

SEQ ID NO: 276947 - DNA, 25 bp, Mus musculus
attaggcaacgcataaccacatgta

SEQ ID NO: 276948 - DNA, 25 bp, Mus musculus
attaggcaacgcttaaccacatgta

SEQ ID NO: 276949 - DNA, 25 bp, Mus musculus
attaggcacctgaagctcaagtccc

SEQ ID NO: 276950 - DNA, 25 bp, Mus musculus
attaggcacctgtagctcaagtccc

SEQ ID NO: 276951 - DNA, 25 bp, Mus musculus
attaggcagcctcatggcgtcccga

SEQ ID NO: 276952 - DNA, 25 bp, Mus musculus
attaggcagcctgatggcgtcccga

SEQ ID NO: 276953 - DNA, 25 bp, Mus musculus
attaggcattctcatatttaacaag

SEQ ID NO: 276954 - DNA, 25 bp, Mus musculus
attaggcattctgatatttaacaag

SEQ ID NO: 276955 - DNA, 25 bp, Mus musculus
attaggccacccaggtgctcagaga

SEQ ID NO: 276956 - DNA, 25 bp, Mus musculus
attaggccaccctggtgctcagaga

SEQ ID NO: 276957 - DNA, 25 bp, Mus musculus
attaggccacctagaagagagcaat

SEQ ID NO: 276958 - DNA, 25 bp, Mus musculus
attaggccaccttgaagagagcaat

SEQ ID NO: 276959 - DNA, 25 bp, Mus musculus
attaggccagacatcttgcatctct

SEQ ID NO: 276960 - DNA, 25 bp, Mus musculus
attaggccagacttcttgcatctct

SEQ ID NO: 276961 - DNA, 25 bp, Mus musculus
attaggccagccatattccatgtcg

SEQ ID NO: 276962 - DNA, 25 bp, Mus musculus
attaggccagccttattccatgtcg

SEQ ID NO: 276963 - DNA, 25 bp, Mus musculus
attaggcccaatatggtgatacaca

SEQ ID NO: 276964 - DNA, 25 bp, Mus musculus
attaggcccaatttggtgatacaca

SEQ ID NO: 276965 - DNA, 25 bp, Mus musculus
attaggccgcctagagggagtctgc

SEQ ID NO: 276966 - DNA, 25 bp, Mus musculus
attaggccgccttgagggagtctgc

SEQ ID NO: 276967 - DNA, 25 bp, Mus musculus
attaggccggacacctgtaatccac

SEQ ID NO: 276968 - DNA, 25 bp, Mus musculus
attaggccggactcctgtaatccac

SEQ ID NO: 276969 - DNA, 25 bp, Mus musculus
attaggcctgaactatgaccccttg

SEQ ID NO: 276970 - DNA, 25 bp, Mus musculus
attaggcctgaagtatgaccccttg

SEQ ID NO: 276971 - DNA, 25 bp, Mus musculus
attaggcctgtgatctgggagatac

SEQ ID NO: 276972 - DNA, 25 bp, Mus musculus
attaggcctgtgttctgggagatac

SEQ ID NO: 276973 - DNA, 25 bp, Mus musculus
attaggcggctactgcttgcatgtt

SEQ ID NO: 276974 - DNA, 25 bp, Mus musculus
attaggcggctagtgcttgcatgtt

SEQ ID NO: 276975 - DNA, 25 bp, Mus musculus
attaggctagacatttcacaaggtt

SEQ ID NO: 276976 - DNA, 25 bp, Mus musculus
attaggctagacttttcacaaggtt

SEQ ID NO: 276977 - DNA, 25 bp, Mus musculus
attaggctccgacataccgttagtc

SEQ ID NO: 276978 - DNA, 25 bp, Mus musculus
attaggctccgagataccgttagtc

SEQ ID NO: 276979 - DNA, 25 bp, Mus musculus
attaggctgcaccatgtatatgtaa

SEQ ID NO: 276980 - DNA, 25 bp, Mus musculus
attaggctgcacgatgtatatgtaa

SEQ ID NO: 276981 - DNA, 25 bp, Mus musculus
attaggctgcccagtacatgtagaa

SEQ ID NO: 276982 - DNA, 25 bp, Mus musculus
attaggctgccctgtacatgtagaa

SEQ ID NO: 276983 - DNA, 25 bp, Mus musculus
attaggcttagtcaagaggctatgt

SEQ ID NO: 276984 - DNA, 25 bp, Mus musculus
attaggcttagtgaagaggctatgt

SEQ ID NO: 276985 - DNA, 25 bp, Mus musculus
attaggcttccgcacgtgctctgga

SEQ ID NO: 276986 - DNA, 25 bp, Mus musculus
attaggcttccggacgtgctctgga

SEQ ID NO: 276987 - DNA, 25 bp, Mus musculus
attagggacaagagctgctcctggg

SEQ ID NO: 276988 - DNA, 25 bp, Mus musculus
attagggacaagtgctgctcctggg

SEQ ID NO: 276989 - DNA, 25 bp, Mus musculus
attagggacctaaccagcgcagtca

SEQ ID NO: 276990 - DNA, 25 bp, Mus musculus
attagggacctatccagcgcagtca

SEQ ID NO: 276991 - DNA, 25 bp, Mus musculus
attagggatcaaaccatgtactgaa

SEQ ID NO: 276992 - DNA, 25 bp, Mus musculus
attagggatcaatccatgtactgaa

SEQ ID NO: 276993 - DNA, 25 bp, Mus musculus
attagggattccatctcaacatagg

SEQ ID NO: 276994 - DNA, 25 bp, Mus musculus
attagggattccttctcaacatagg

SEQ ID NO: 276995 - DNA, 25 bp, Mus musculus
attagggcactcagaaacatttcat

SEQ ID NO: 276996 - DNA, 25 bp, Mus musculus
attagggcactctgaaacatttcat

SEQ ID NO: 276997 - DNA, 25 bp, Mus musculus
attagggcagcaagttcaacatcaa

SEQ ID NO: 276998 - DNA, 25 bp, Mus musculus
attagggcagcatgttcaacatcaa

SEQ ID NO: 276999 - DNA, 25 bp, Mus musculus
attagggccggtcacagataacctg

SEQ ID NO: 277000 - DNA, 25 bp, Mus musculus
attagggccggtgacagataacctg

SEQ ID NO: 277001 - DNA, 25 bp, Mus musculus
attagggcctgacctattggtgttc

SEQ ID NO: 277002 - DNA, 25 bp, Mus musculus
attagggcctgagctattggtgttc

SEQ ID NO: 277003 - DNA, 25 bp, Mus musculus
attagggctaatctgggatgtttca

SEQ ID NO: 277004 - DNA, 25 bp, Mus musculus
attagggctaatgtgggatgtttca

SEQ ID NO: 277005 - DNA, 25 bp, Mus musculus
attagggcttaacagacgagtgcat

SEQ ID NO: 277006 - DNA, 25 bp, Mus musculus
attagggcttaagagacgagtgcat

SEQ ID NO: 277007 - DNA, 25 bp, Mus musculus
attagggtaaacacaagaagcttat

SEQ ID NO: 277008 - DNA, 25 bp, Mus musculus
attagggtaaactcaagaagcttat

SEQ ID NO: 277009 - DNA, 25 bp, Mus musculus
attagggtaaccaattagccatttg

SEQ ID NO: 277010 - DNA, 25 bp, Mus musculus
attagggtaacctattagccatttg

SEQ ID NO: 277011 - DNA, 25 bp, Mus musculus
attagggtctccacggaccgggatg

SEQ ID NO: 277012 - DNA, 25 bp, Mus musculus
attagggtctcctcggaccgggatg

SEQ ID NO: 277013 - DNA, 25 bp, Mus musculus
attagggttgagacctagcccagct

SEQ ID NO: 277014 - DNA, 25 bp, Mus musculus
attagggttgagtcctagcccagct

SEQ ID NO: 277015 - DNA, 25 bp, Mus musculus
attagggtttggattcacacattga

SEQ ID NO: 277016 - DNA, 25 bp, Mus musculus
attagggtttggtttcacacattga

SEQ ID NO: 277017 - DNA, 25 bp, Mus musculus
attagggttttcagcatcctctgct

SEQ ID NO: 277018 - DNA, 25 bp, Mus musculus
attagggttttctgcatcctctgct

SEQ ID NO: 277019 - DNA, 25 bp, Mus musculus
attaggtatattcctcctctccaat

SEQ ID NO: 277020 - DNA, 25 bp, Mus musculus
attaggtatattgctcctctccaat

SEQ ID NO: 277021 - DNA, 25 bp, Mus musculus
attaggtatcagctgtccctggagt

SEQ ID NO: 277022 - DNA, 25 bp, Mus musculus
attaggtatcaggtgtccctggagt

SEQ ID NO: 277023 - DNA, 25 bp, Mus musculus
attaggtatctcaacatatatattc

SEQ ID NO: 277024 - DNA, 25 bp, Mus musculus
attaggtatctctacatatatattc

SEQ ID NO: 277025 - DNA, 25 bp, Mus musculus
attaggtcagctatttctacccata

SEQ ID NO: 277026 - DNA, 25 bp, Mus musculus
attaggtcagctttttctacccata

SEQ ID NO: 277027 - DNA, 25 bp, Mus musculus
attaggtcagggagcttccagtctt

SEQ ID NO: 277028 - DNA, 25 bp, Mus musculus
attaggtcagggtgcttccagtctt

SEQ ID NO: 277029 - DNA, 25 bp, Mus musculus
attaggtcattaaccatgcaccctg

SEQ ID NO: 277030 - DNA, 25 bp, Mus musculus
attaggtcattatccatgcaccctg

SEQ ID NO: 277031 - DNA, 25 bp, Mus musculus
attaggtcccaaaccaaggtctctg

SEQ ID NO: 277032 - DNA, 25 bp, Mus musculus
attaggtcccaatccaaggtctctg

SEQ ID NO: 277033 - DNA, 25 bp, Mus musculus
attaggtcccagacgctaacagcaa

SEQ ID NO: 277034 - DNA, 25 bp, Mus musculus
attaggtcccagtcgctaacagcaa

SEQ ID NO: 277035 - DNA, 25 bp, Mus musculus
attaggtcccctaatggcaggaagg

SEQ ID NO: 277036 - DNA, 25 bp, Mus musculus
attaggtccccttatggcaggaagg

SEQ ID NO: 277037 - DNA, 25 bp, Mus musculus
attaggtctaagagacaccaaggtc

SEQ ID NO: 277038 - DNA, 25 bp, Mus musculus
attaggtctaagtgacaccaaggtc

SEQ ID NO: 277039 - DNA, 25 bp, Mus musculus
attaggtctaccactacttaccaca

SEQ ID NO: 277040 - DNA, 25 bp, Mus musculus
attaggtctacctctacttaccaca

SEQ ID NO: 277041 - DNA, 25 bp, Mus musculus
attaggtctctgctagtgtgtccca

SEQ ID NO: 277042 - DNA, 25 bp, Mus musculus
attaggtctctggtagtgtgtccca

SEQ ID NO: 277043 - DNA, 25 bp, Mus musculus
attaggtgacttacttgggagctgg

SEQ ID NO: 277044 - DNA, 25 bp, Mus musculus
attaggtgactttcttgggagctgg

SEQ ID NO: 277045 - DNA, 25 bp, Mus musculus
attaggtgcctcactgaagccacac

SEQ ID NO: 277046 - DNA, 25 bp, Mus musculus
attaggtgcctctctgaagccacac

SEQ ID NO: 277047 - DNA, 25 bp, Mus musculus
attaggtgctgcattctcagacggc

SEQ ID NO: 277048 - DNA, 25 bp, Mus musculus
attaggtgctgctttctcagacggc

SEQ ID NO: 277049 - DNA, 25 bp, Mus musculus
attaggtgctttctaatcctctgtg

SEQ ID NO: 277050 - DNA, 25 bp, Mus musculus
attaggtgctttgtaatcctctgtg

SEQ ID NO: 277051 - DNA, 25 bp, Mus musculus
attaggtgtgtacactctgggttca

SEQ ID NO: 277052 - DNA, 25 bp, Mus musculus
attaggtgtgtagactctgggttca

SEQ ID NO: 277053 - DNA, 25 bp, Mus musculus
attaggttattgaagcttcatttac

SEQ ID NO: 277054 - DNA, 25 bp, Mus musculus
attaggttattgtagcttcatttac

SEQ ID NO: 277055 - DNA, 25 bp, Mus musculus
attaggttcattcctttcattggtg

SEQ ID NO: 277056 - DNA, 25 bp, Mus musculus
attaggttcattgctttcattggtg

SEQ ID NO: 277057 - DNA, 25 bp, Mus musculus
attaggttctctagcagccatcaaa

SEQ ID NO: 277058 - DNA, 25 bp, Mus musculus
attaggttctcttgcagccatcaaa

SEQ ID NO: 277059 - DNA, 25 bp, Mus musculus
attaggttgagcatgggactcctgt

SEQ ID NO: 277060 - DNA, 25 bp, Mus musculus
attaggttgagcttgggactcctgt

SEQ ID NO: 277061 - DNA, 25 bp, Mus musculus
attagtaaaccaagaacactcctca

SEQ ID NO: 277062 - DNA, 25 bp, Mus musculus
attagtaaaccatgaacactcctca

SEQ ID NO: 277063 - DNA, 25 bp, Mus musculus
attagtaacaacactgtagcagtct

SEQ ID NO: 277064 - DNA, 25 bp, Mus musculus
attagtaacaactctgtagcagtct

SEQ ID NO: 277065 - DNA, 25 bp, Mus musculus
attagtaaggccagtagtgggctgt

SEQ ID NO: 277066 - DNA, 25 bp, Mus musculus
attagtaaggcctgtagtgggctgt

SEQ ID NO: 277067 - DNA, 25 bp, Mus musculus
attagtaagtcaacacccagtgagg

SEQ ID NO: 277068 - DNA, 25 bp, Mus musculus
attagtaagtcatcacccagtgagg

SEQ ID NO: 277069 - DNA, 25 bp, Mus musculus
attagtaatggaatttgcctttcaa

SEQ ID NO: 277070 - DNA, 25 bp, Mus musculus
attagtaatggattttgcctttcaa

SEQ ID NO: 277071 - DNA, 25 bp, Mus musculus
attagtaattccctgggtcgaggag

SEQ ID NO: 277072 - DNA, 25 bp, Mus musculus
attagtaattccgtgggtcgaggag

SEQ ID NO: 277073 - DNA, 25 bp, Mus musculus
attagtaccccaatgcctgagcata

SEQ ID NO: 277074 - DNA, 25 bp, Mus musculus
attagtaccccattgcctgagcata

SEQ ID NO: 277075 - DNA, 25 bp, Mus musculus
attagtaccttgcagcattgctgag

SEQ ID NO: 277076 - DNA, 25 bp, Mus musculus
attagtaccttggagcattgctgag

SEQ ID NO: 277077 - DNA, 25 bp, Mus musculus
attagtacttgtaccattgtataag

SEQ ID NO: 277078 - DNA, 25 bp, Mus musculus
attagtacttgttccattgtataag

SEQ ID NO: 277079 - DNA, 25 bp, Mus musculus
attagtagaaggaccccaccggctg

SEQ ID NO: 277080 - DNA, 25 bp, Mus musculus
attagtagaaggtccccaccggctg

SEQ ID NO: 277081 - DNA, 25 bp, Mus musculus
attagtagacatagactgaaaccag

SEQ ID NO: 277082 - DNA, 25 bp, Mus musculus
attagtagacattgactgaaaccag

SEQ ID NO: 277083 - DNA, 25 bp, Mus musculus
attagtaggtgtaaggctccggcca

SEQ ID NO: 277084 - DNA, 25 bp, Mus musculus
attagtaggtgttaggctccggcca

SEQ ID NO: 277085 - DNA, 25 bp, Mus musculus
attagtatcatacagggcccaagat

SEQ ID NO: 277086 - DNA, 25 bp, Mus musculus
attagtatcatagagggcccaagat

SEQ ID NO: 277087 - DNA, 25 bp, Mus musculus
attagtattagcatcctgttctcag

SEQ ID NO: 277088 - DNA, 25 bp, Mus musculus
attagtattagcttcctgttctcag

SEQ ID NO: 277089 - DNA, 25 bp, Mus musculus
attagtcaaaatacgaggttcatgt

SEQ ID NO: 277090 - DNA, 25 bp, Mus musculus
attagtcaaaattcgaggttcatgt

SEQ ID NO: 277091 - DNA, 25 bp, Mus musculus
attagtcacacaccctaagctagcc

SEQ ID NO: 277092 - DNA, 25 bp, Mus musculus
attagtcacacagcctaagctagcc

SEQ ID NO: 277093 - DNA, 25 bp, Mus musculus
attagtcacgcgcaagcagtagagt

SEQ ID NO: 277094 - DNA, 25 bp, Mus musculus
attagtcacgcggaagcagtagagt

SEQ ID NO: 277095 - DNA, 25 bp, Mus musculus
attagtcactataaatctctctgtg

SEQ ID NO: 277096 - DNA, 25 bp, Mus musculus
attagtcactattaatctctctgtg

SEQ ID NO: 277097 - DNA, 25 bp, Mus musculus
attagtcatattacccataacattt

SEQ ID NO: 277098 - DNA, 25 bp, Mus musculus
attagtcatatttcccataacattt

SEQ ID NO: 277099 - DNA, 25 bp, Mus musculus
attagtcatttacaacgtggcttta

SEQ ID NO: 277100 - DNA, 25 bp, Mus musculus
attagtcatttagaacgtggcttta

SEQ ID NO: 277101 - DNA, 25 bp, Mus musculus
attagtccacttctggatgagctgg

SEQ ID NO: 277102 - DNA, 25 bp, Mus musculus
attagtccacttgtggatgagctgg

SEQ ID NO: 277103 - DNA, 25 bp, Mus musculus
attagtccagtacgaaacgctcacg

SEQ ID NO: 277104 - DNA, 25 bp, Mus musculus
attagtccagtaggaaacgctcacg

SEQ ID NO: 277105 - DNA, 25 bp, Mus musculus
attagtccccgaagtttgagataag

SEQ ID NO: 277106 - DNA, 25 bp, Mus musculus
attagtccccgatgtttgagataag

SEQ ID NO: 277107 - DNA, 25 bp, Mus musculus
attagtcccgtacgcagtggtataa

SEQ ID NO: 277108 - DNA, 25 bp, Mus musculus
attagtcccgtaggcagtggtataa

SEQ ID NO: 277109 - DNA, 25 bp, Mus musculus
attagtcctcctacgttggaacact

SEQ ID NO: 277110 - DNA, 25 bp, Mus musculus
attagtcctccttcgttggaacact

SEQ ID NO: 277111 - DNA, 25 bp, Mus musculus
attagtcctgatatgtctttttctt

SEQ ID NO: 277112 - DNA, 25 bp, Mus musculus
attagtcctgatttgtctttttctt

SEQ ID NO: 277113 - DNA, 25 bp, Mus musculus
attagtccttgccagagaccttcga

SEQ ID NO: 277114 - DNA, 25 bp, Mus musculus
attagtccttgcgagagaccttcga

SEQ ID NO: 277115 - DNA, 25 bp, Mus musculus
attagtcgtcgaacttaaagacctt

SEQ ID NO: 277116 - DNA, 25 bp, Mus musculus
attagtcgtcgatcttaaagacctt

SEQ ID NO: 277117 - DNA, 25 bp, Mus musculus
attagtctactcatttaaccaatga

SEQ ID NO: 277118 - DNA, 25 bp, Mus musculus
attagtctactcttttaaccaatga

SEQ ID NO: 277119 - DNA, 25 bp, Mus musculus
attagtctctttaacttccatgttg

SEQ ID NO: 277120 - DNA, 25 bp, Mus musculus
attagtctcttttacttccatgttg

SEQ ID NO: 277121 - DNA, 25 bp, Mus musculus
attagtctttgcatgttttaccata

SEQ ID NO: 277122 - DNA, 25 bp, Mus musculus
attagtctttgcttgttttaccata

SEQ ID NO: 277123 - DNA, 25 bp, Mus musculus
attagtgaactgatgatgtaatgtt

SEQ ID NO: 277124 - DNA, 25 bp, Mus musculus
attagtgaactgttgatgtaatgtt

SEQ ID NO: 277125 - DNA, 25 bp, Mus musculus
attagtgaatctatggccaacagag

SEQ ID NO: 277126 - DNA, 25 bp, Mus musculus
attagtgaatctttggccaacagag

SEQ ID NO: 277127 - DNA, 25 bp, Mus musculus
attagtgagaaaccttgccaagacg

SEQ ID NO: 277128 - DNA, 25 bp, Mus musculus
attagtgagaaagcttgccaagacg

SEQ ID NO: 277129 - DNA, 25 bp, Mus musculus
attagtgagcaccttagatgccagg

SEQ ID NO: 277130 - DNA, 25 bp, Mus musculus
attagtgagcacgttagatgccagg

SEQ ID NO: 277131 - DNA, 25 bp, Mus musculus
attagtgagcttccagctgttagcc

SEQ ID NO: 277132 - DNA, 25 bp, Mus musculus
attagtgagcttgcagctgttagcc

SEQ ID NO: 277133 - DNA, 25 bp, Mus musculus
attagtgaggcaaactctttaataa

SEQ ID NO: 277134 - DNA, 25 bp, Mus musculus
attagtgaggcatactctttaataa

SEQ ID NO: 277135 - DNA, 25 bp, Mus musculus
attagtgaggctcacgcgtcacggt

SEQ ID NO: 277136 - DNA, 25 bp, Mus musculus
attagtgaggctgacgcgtcacggt

SEQ ID NO: 277137 - DNA, 25 bp, Mus musculus
attagtgatcacacgcacatacccc

SEQ ID NO: 277138 - DNA, 25 bp, Mus musculus
attagtgatcactcgcacatacccc

SEQ ID NO: 277139 - DNA, 25 bp, Mus musculus
attagtgcagcacagcttcgccatg

SEQ ID NO: 277140 - DNA, 25 bp, Mus musculus
attagtgcagcagagcttcgccatg

SEQ ID NO: 277141 - DNA, 25 bp, Mus musculus
attagtgcctggagtacatgtcctg

SEQ ID NO: 277142 - DNA, 25 bp, Mus musculus
attagtgcctggtgtacatgtcctg

SEQ ID NO: 277143 - DNA, 25 bp, Mus musculus
attagtgccttgctttgggccctgc

SEQ ID NO: 277144 - DNA, 25 bp, Mus musculus
attagtgccttggtttgggccctgc

SEQ ID NO: 277145 - DNA, 25 bp, Mus musculus
attagtgctgttctgaggctgttaa

SEQ ID NO: 277146 - DNA, 25 bp, Mus musculus
attagtgctgttgtgaggctgttaa

SEQ ID NO: 277147 - DNA, 25 bp, Mus musculus
attagtgcttttaacgggcttccat

SEQ ID NO: 277148 - DNA, 25 bp, Mus musculus
attagtgctttttacgggcttccat

SEQ ID NO: 277149 - DNA, 25 bp, Mus musculus
attagtggactgaatttagatttag

SEQ ID NO: 277150 - DNA, 25 bp, Mus musculus
attagtggactgtatttagatttag

SEQ ID NO: 277151 - DNA, 25 bp, Mus musculus
attagtggaggcatcgctcaccgaa

SEQ ID NO: 277152 - DNA, 25 bp, Mus musculus
attagtggaggcttcgctcaccgaa

SEQ ID NO: 277153 - DNA, 25 bp, Mus musculus
attagtggcagcctgttggttccca

SEQ ID NO: 277154 - DNA, 25 bp, Mus musculus
attagtggcagcgtgttggttccca

SEQ ID NO: 277155 - DNA, 25 bp, Mus musculus
attagtggcattccttactccttac

SEQ ID NO: 277156 - DNA, 25 bp, Mus musculus
attagtggcattgcttactccttac

SEQ ID NO: 277157 - DNA, 25 bp, Mus musculus
attagtggcctgctagtcttaaact

SEQ ID NO: 277158 - DNA, 25 bp, Mus musculus
attagtggcctggtagtcttaaact

SEQ ID NO: 277159 - DNA, 25 bp, Mus musculus
attagtggtaaaatgccttctgtaa

SEQ ID NO: 277160 - DNA, 25 bp, Mus musculus
attagtggtaaattgccttctgtaa

SEQ ID NO: 277161 - DNA, 25 bp, Mus musculus
attagtggtcaaaagggcccattgt

SEQ ID NO: 277162 - DNA, 25 bp, Mus musculus
attagtggtcaatagggcccattgt

SEQ ID NO: 277163 - DNA, 25 bp, Mus musculus
attagtgtaccgaatagggagcaac

SEQ ID NO: 277164 - DNA, 25 bp, Mus musculus
attagtgtaccgtatagggagcaac

SEQ ID NO: 277165 - DNA, 25 bp, Mus musculus
attagtgtcatgaatgtttcccctt

SEQ ID NO: 277166 - DNA, 25 bp, Mus musculus
attagtgtcatgtatgtttcccctt

SEQ ID NO: 277167 - DNA, 25 bp, Mus musculus
attagtgtcccaatgttctgtcagt

SEQ ID NO: 277168 - DNA, 25 bp, Mus musculus
attagtgtcccattgttctgtcagt

SEQ ID NO: 277169 - DNA, 25 bp, Mus musculus
attagtgtctctccagcaacagtcc

SEQ ID NO: 277170 - DNA, 25 bp, Mus musculus
attagtgtctctgcagcaacagtcc

SEQ ID NO: 277171 - DNA, 25 bp, Mus musculus
attagtgtgactctaactaaacaag

SEQ ID NO: 277172 - DNA, 25 bp, Mus musculus
attagtgtgactgtaactaaacaag

SEQ ID NO: 277173 - DNA, 25 bp, Mus musculus
attagtgtgagcagctgttcttggg

SEQ ID NO: 277174 - DNA, 25 bp, Mus musculus
attagtgtgagctgctgttcttggg

SEQ ID NO: 277175 - DNA, 25 bp, Mus musculus
attagtgtgcaaaacgctcagcggc

SEQ ID NO: 277176 - DNA, 25 bp, Mus musculus
attagtgtgcaatacgctcagcggc

SEQ ID NO: 277177 - DNA, 25 bp, Mus musculus
attagtgtgggcctctcttactcca

SEQ ID NO: 277178 - DNA, 25 bp, Mus musculus
attagtgtgggcgtctcttactcca

SEQ ID NO: 277179 - DNA, 25 bp, Mus musculus
attagtgttacaattcctgtgaatc

SEQ ID NO: 277180 - DNA, 25 bp, Mus musculus
attagtgttacatttcctgtgaatc

SEQ ID NO: 277181 - DNA, 25 bp, Mus musculus
attagtgttatcactggttaccctg

SEQ ID NO: 277182 - DNA, 25 bp, Mus musculus
attagtgttatctctggttaccctg

SEQ ID NO: 277183 - DNA, 25 bp, Mus musculus
attagtgtttaaaaccggaatgact

SEQ ID NO: 277184 - DNA, 25 bp, Mus musculus
attagtgtttaataccggaatgact

SEQ ID NO: 277185 - DNA, 25 bp, Mus musculus
attagttacagtcgtggcactttct

SEQ ID NO: 277186 - DNA, 25 bp, Mus musculus
attagttacagtggtggcactttct

SEQ ID NO: 277187 - DNA, 25 bp, Mus musculus
attagttacctaccaacggcttgcc

SEQ ID NO: 277188 - DNA, 25 bp, Mus musculus
attagttacctagcaacggcttgcc

SEQ ID NO: 277189 - DNA, 25 bp, Mus musculus
attagttactgccttcttgatgaga

SEQ ID NO: 277190 - DNA, 25 bp, Mus musculus
attagttactgcgttcttgatgaga

SEQ ID NO: 277191 - DNA, 25 bp, Mus musculus
attagttcaaggaccattcactcac

SEQ ID NO: 277192 - DNA, 25 bp, Mus musculus
attagttcaaggtccattcactcac

SEQ ID NO: 277193 - DNA, 25 bp, Mus musculus
attagttcacctcaattgtcgtgga

SEQ ID NO: 277194 - DNA, 25 bp, Mus musculus
attagttcacctgaattgtcgtgga

SEQ ID NO: 277195 - DNA, 25 bp, Mus musculus
attagttccattatatacatcaagt

SEQ ID NO: 277196 - DNA, 25 bp, Mus musculus
attagttccattttatacatcaagt

SEQ ID NO: 277197 - DNA, 25 bp, Mus musculus
attagttccctaagattgccattaa

SEQ ID NO: 277198 - DNA, 25 bp, Mus musculus
attagttccctatgattgccattaa

SEQ ID NO: 277199 - DNA, 25 bp, Mus musculus
attagttccgtcaattaggaggaga

SEQ ID NO: 277200 - DNA, 25 bp, Mus musculus
attagttccgtctattaggaggaga

SEQ ID NO: 277201 - DNA, 25 bp, Mus musculus
attagttcctatattgtgtacccag

SEQ ID NO: 277202 - DNA, 25 bp, Mus musculus
attagttcctattttgtgtacccag

SEQ ID NO: 277203 - DNA, 25 bp, Mus musculus
attagttcgagaagaccttgggttt

SEQ ID NO: 277204 - DNA, 25 bp, Mus musculus
attagttcgagatgaccttgggttt

SEQ ID NO: 277205 - DNA, 25 bp, Mus musculus
attagttctcctactcagggatttc

SEQ ID NO: 277206 - DNA, 25 bp, Mus musculus
attagttctccttctcagggatttc

SEQ ID NO: 277207 - DNA, 25 bp, Mus musculus
attagttctggactgaatctatcaa

SEQ ID NO: 277208 - DNA, 25 bp, Mus musculus
attagttctggagtgaatctatcaa

SEQ ID NO: 277209 - DNA, 25 bp, Mus musculus
attagttctggcatagtttacatga

SEQ ID NO: 277210 - DNA, 25 bp, Mus musculus
attagttctggcttagtttacatga

SEQ ID NO: 277211 - DNA, 25 bp, Mus musculus
attagttctttcctcactctaaatg

SEQ ID NO: 277212 - DNA, 25 bp, Mus musculus
attagttctttcgtcactctaaatg

SEQ ID NO: 277213 - DNA, 25 bp, Mus musculus
attagttgcaggcactgatgcttct

SEQ ID NO: 277214 - DNA, 25 bp, Mus musculus
attagttgcagggactgatgcttct

SEQ ID NO: 277215 - DNA, 25 bp, Mus musculus
attagttgctttctattctttgaac

SEQ ID NO: 277216 - DNA, 25 bp, Mus musculus
attagttgctttgtattctttgaac

SEQ ID NO: 277217 - DNA, 25 bp, Mus musculus
attagttgggtcacctatgttcacg

SEQ ID NO: 277218 - DNA, 25 bp, Mus musculus
attagttgggtctcctatgttcacg

SEQ ID NO: 277219 - DNA, 25 bp, Mus musculus
attagttggtcaactctagtctgtg

SEQ ID NO: 277220 - DNA, 25 bp, Mus musculus
attagttggtcatctctagtctgtg

SEQ ID NO: 277221 - DNA, 25 bp, Mus musculus
attagtttacggcaggcattgtgtg

SEQ ID NO: 277222 - DNA, 25 bp, Mus musculus
attagtttacgggaggcattgtgtg

SEQ ID NO: 277223 - DNA, 25 bp, Mus musculus
attagtttcacaattcttaagcagc

SEQ ID NO: 277224 - DNA, 25 bp, Mus musculus
attagtttcacatttcttaagcagc

SEQ ID NO: 277225 - DNA, 25 bp, Mus musculus
attagttttgagatccagggcggca

SEQ ID NO: 277226 - DNA, 25 bp, Mus musculus
attagttttgagttccagggcggca

SEQ ID NO: 277227 - DNA, 25 bp, Mus musculus
attataaaatctccccatccctgta

SEQ ID NO: 277228 - DNA, 25 bp, Mus musculus
attataaaatctgcccatccctgta

SEQ ID NO: 277229 - DNA, 25 bp, Mus musculus
attataaacactcatggcccctggg

SEQ ID NO: 277230 - DNA, 25 bp, Mus musculus
attataaacactgatggcccctggg

SEQ ID NO: 277231 - DNA, 25 bp, Mus musculus
attataaacgctaggcttgcttgcc

SEQ ID NO: 277232 - DNA, 25 bp, Mus musculus
attataaacgcttggcttgcttgcc

SEQ ID NO: 277233 - DNA, 25 bp, Mus musculus
attataaatgctattgttcctttga

SEQ ID NO: 277234 - DNA, 25 bp, Mus musculus
attataaatgcttttgttcctttga

SEQ ID NO: 277235 - DNA, 25 bp, Mus musculus
attataacactcatacaggccctgt

SEQ ID NO: 277236 - DNA, 25 bp, Mus musculus
attataacactcttacaggccctgt

SEQ ID NO: 277237 - DNA, 25 bp, Mus musculus
attataaccctgctggactgcggcc

SEQ ID NO: 277238 - DNA, 25 bp, Mus musculus
attataaccctggtggactgcggcc

SEQ ID NO: 277239 - DNA, 25 bp, Mus musculus
attataactgcgatgggcctcctaa

SEQ ID NO: 277240 - DNA, 25 bp, Mus musculus
attataactgcgttgggcctcctaa

SEQ ID NO: 277241 - DNA, 25 bp, Mus musculus
attataagaattatcttcctctgat

SEQ ID NO: 277242 - DNA, 25 bp, Mus musculus
attataagaattttcttcctctgat

SEQ ID NO: 277243 - DNA, 25 bp, Mus musculus
attataagctctccatagtgttggc

SEQ ID NO: 277244 - DNA, 25 bp, Mus musculus
attataagctctgcatagtgttggc

SEQ ID NO: 277245 - DNA, 25 bp, Mus musculus
attataagggaacgctcactggagg

SEQ ID NO: 277246 - DNA, 25 bp, Mus musculus
attataagggaaggctcactggagg

SEQ ID NO: 277247 - DNA, 25 bp, Mus musculus
attataagtaaacatcagaaccctg

SEQ ID NO: 277248 - DNA, 25 bp, Mus musculus
attataagtaaagatcagaaccctg

SEQ ID NO: 277249 - DNA, 25 bp, Mus musculus
attataatatgcattgtaccacaca

SEQ ID NO: 277250 - DNA, 25 bp, Mus musculus
attataatatgctttgtaccacaca

SEQ ID NO: 277251 - DNA, 25 bp, Mus musculus
attataatcgccatgttctctcttt

SEQ ID NO: 277252 - DNA, 25 bp, Mus musculus
attataatcgccttgttctctcttt

SEQ ID NO: 277253 - DNA, 25 bp, Mus musculus
attataatgactactttccctacac

SEQ ID NO: 277254 - DNA, 25 bp, Mus musculus
attataatgacttctttccctacac

SEQ ID NO: 277255 - DNA, 25 bp, Mus musculus
attataatgctactatcttctacag

SEQ ID NO: 277256 - DNA, 25 bp, Mus musculus
attataatgctagtatcttctacag

SEQ ID NO: 277257 - DNA, 25 bp, Mus musculus
attatacaaacaagtccccatcccg

SEQ ID NO: 277258 - DNA, 25 bp, Mus musculus
attatacaaacatgtccccatcccg

SEQ ID NO: 277259 - DNA, 25 bp, Mus musculus
attatacaactgcaacccttttcta

SEQ ID NO: 277260 - DNA, 25 bp, Mus musculus
attatacaactggaacccttttcta

SEQ ID NO: 277261 - DNA, 25 bp, Mus musculus
attatacacaacacagcaccaactt

SEQ ID NO: 277262 - DNA, 25 bp, Mus musculus
attatacacaactcagcaccaactt

SEQ ID NO: 277263 - DNA, 25 bp, Mus musculus
attatacacttccttcttctagaag

SEQ ID NO: 277264 - DNA, 25 bp, Mus musculus
attatacacttcgttcttctagaag

SEQ ID NO: 277265 - DNA, 25 bp, Mus musculus
attatacagagtaaagcctccgctg

SEQ ID NO: 277266 - DNA, 25 bp, Mus musculus
attatacagagttaagcctccgctg

SEQ ID NO: 277267 - DNA, 25 bp, Mus musculus
attatacagcttcttgatttcaaca

SEQ ID NO: 277268 - DNA, 25 bp, Mus musculus
attatacagcttgttgatttcaaca

SEQ ID NO: 277269 - DNA, 25 bp, Mus musculus
attatacatgctactgctctctcct

SEQ ID NO: 277270 - DNA, 25 bp, Mus musculus
attatacatgcttctgctctctcct

SEQ ID NO: 277271 - DNA, 25 bp, Mus musculus
attatacatgtcaaaaggcccagga

SEQ ID NO: 277272 - DNA, 25 bp, Mus musculus
attatacatgtctaaaggcccagga

SEQ ID NO: 277273 - DNA, 25 bp, Mus musculus
attatacccagaatattgacagcta

SEQ ID NO: 277274 - DNA, 25 bp, Mus musculus
attatacccagattattgacagcta

SEQ ID NO: 277275 - DNA, 25 bp, Mus musculus
attatacccagtactcatgtcttat

SEQ ID NO: 277276 - DNA, 25 bp, Mus musculus
attatacccagttctcatgtcttat

SEQ ID NO: 277277 - DNA, 25 bp, Mus musculus
attatacccctgctcaggaatggca

SEQ ID NO: 277278 - DNA, 25 bp, Mus musculus
attatacccctggtcaggaatggca

SEQ ID NO: 277279 - DNA, 25 bp, Mus musculus
attatacctataccctaaattgaga

SEQ ID NO: 277280 - DNA, 25 bp, Mus musculus
attatacctatagcctaaattgaga

SEQ ID NO: 277281 - DNA, 25 bp, Mus musculus
attataccttggcatcagttactca

SEQ ID NO: 277282 - DNA, 25 bp, Mus musculus
attataccttgggatcagttactca

SEQ ID NO: 277283 - DNA, 25 bp, Mus musculus
attatacgattcaccttctttcgag

SEQ ID NO: 277284 - DNA, 25 bp, Mus musculus
attatacgattctccttctttcgag

SEQ ID NO: 277285 - DNA, 25 bp, Mus musculus
attatactctcgctatgaatcccgt

SEQ ID NO: 277286 - DNA, 25 bp, Mus musculus
attatactctcggtatgaatcccgt

SEQ ID NO: 277287 - DNA, 25 bp, Mus musculus
attatactgagtcggtgcagaacct

SEQ ID NO: 277288 - DNA, 25 bp, Mus musculus
attatactgagtgggtgcagaacct

SEQ ID NO: 277289 - DNA, 25 bp, Mus musculus
attatacttacaccattcccaccat

SEQ ID NO: 277290 - DNA, 25 bp, Mus musculus
attatacttacagcattcccaccat

SEQ ID NO: 277291 - DNA, 25 bp, Mus musculus
attatacttaccagacaccattgtt

SEQ ID NO: 277292 - DNA, 25 bp, Mus musculus
attatacttacctgacaccattgtt

SEQ ID NO: 277293 - DNA, 25 bp, Mus musculus
attatacttgttagattggcatatc

SEQ ID NO: 277294 - DNA, 25 bp, Mus musculus
attatacttgtttgattggcatatc

SEQ ID NO: 277295 - DNA, 25 bp, Mus musculus
attatagagcatagggtctggcagc

SEQ ID NO: 277296 - DNA, 25 bp, Mus musculus
attatagagcattgggtctggcagc

SEQ ID NO: 277297 - DNA, 25 bp, Mus musculus
attatagaggcactctggtcctttc

SEQ ID NO: 277298 - DNA, 25 bp, Mus musculus
attatagaggcagtctggtcctttc

SEQ ID NO: 277299 - DNA, 25 bp, Mus musculus
attatagatcgtccctttgtaacaa

SEQ ID NO: 277300 - DNA, 25 bp, Mus musculus
attatagatcgtgcctttgtaacaa

SEQ ID NO: 277301 - DNA, 25 bp, Mus musculus
attatagatggtagccccaagttcc

SEQ ID NO: 277302 - DNA, 25 bp, Mus musculus
attatagatggttgccccaagttcc

SEQ ID NO: 277303 - DNA, 25 bp, Mus musculus
attatagattgtatccttgtgtggg

SEQ ID NO: 277304 - DNA, 25 bp, Mus musculus
attatagattgtttccttgtgtggg

SEQ ID NO: 277305 - DNA, 25 bp, Mus musculus
attatagcaaacacctcaatcgcca

SEQ ID NO: 277306 - DNA, 25 bp, Mus musculus
attatagcaaactcctcaatcgcca

SEQ ID NO: 277307 - DNA, 25 bp, Mus musculus
attatagcactaaggccaccgttgg

SEQ ID NO: 277308 - DNA, 25 bp, Mus musculus
attatagcactatggccaccgttgg

SEQ ID NO: 277309 - DNA, 25 bp, Mus musculus
attatagcccacatgagggctgtga

SEQ ID NO: 277310 - DNA, 25 bp, Mus musculus
attatagcccacttgagggctgtga

SEQ ID NO: 277311 - DNA, 25 bp, Mus musculus
attatagccccgagaagccaagcct

SEQ ID NO: 277312 - DNA, 25 bp, Mus musculus
attatagccccgtgaagccaagcct

SEQ ID NO: 277313 - DNA, 25 bp, Mus musculus
attatagctattctttattggcccc

SEQ ID NO: 277314 - DNA, 25 bp, Mus musculus
attatagctattgtttattggcccc

SEQ ID NO: 277315 - DNA, 25 bp, Mus musculus
attataggctccagcatttttacga

SEQ ID NO: 277316 - DNA, 25 bp, Mus musculus
attataggctcctgcatttttacga

SEQ ID NO: 277317 - DNA, 25 bp, Mus musculus
attataggtatgagccagcatgcca

SEQ ID NO: 277318 - DNA, 25 bp, Mus musculus
attataggtatgtgccagcatgcca

SEQ ID NO: 277319 - DNA, 25 bp, Mus musculus
attataggtgtgcgctactactgcc

SEQ ID NO: 277320 - DNA, 25 bp, Mus musculus
attataggtgtgggctactactgcc

SEQ ID NO: 277321 - DNA, 25 bp, Mus musculus
attatagtagcgcttctcactgtgt

SEQ ID NO: 277322 - DNA, 25 bp, Mus musculus
attatagtagcggttctcactgtgt

SEQ ID NO: 277323 - DNA, 25 bp, Mus musculus
attatagtattcagagctttggagg

SEQ ID NO: 277324 - DNA, 25 bp, Mus musculus
attatagtattctgagctttggagg

SEQ ID NO: 277325 - DNA, 25 bp, Mus musculus
attatagtcactcctctcagagttt

SEQ ID NO: 277326 - DNA, 25 bp, Mus musculus
attatagtcactgctctcagagttt

SEQ ID NO: 277327 - DNA, 25 bp, Mus musculus
attatagtcagacttttttcccagg

SEQ ID NO: 277328 - DNA, 25 bp, Mus musculus
attatagtcagagttttttcccagg

SEQ ID NO: 277329 - DNA, 25 bp, Mus musculus
attatagtcataatttaattggcca

SEQ ID NO: 277330 - DNA, 25 bp, Mus musculus
attatagtcatattttaattggcca

SEQ ID NO: 277331 - DNA, 25 bp, Mus musculus
attatagttcttaagccacccaaat

SEQ ID NO: 277332 - DNA, 25 bp, Mus musculus
attatagttctttagccacccaaat

SEQ ID NO: 277333 - DNA, 25 bp, Mus musculus
attatataagccactcccttacttc

SEQ ID NO: 277334 - DNA, 25 bp, Mus musculus
attatataagcctctcccttacttc

SEQ ID NO: 277335 - DNA, 25 bp, Mus musculus
attatatcctgccttctattcctct

SEQ ID NO: 277336 - DNA, 25 bp, Mus musculus
attatatcctgcgttctattcctct

SEQ ID NO: 277337 - DNA, 25 bp, Mus musculus
attatatgaactatgatggattcaa

SEQ ID NO: 277338 - DNA, 25 bp, Mus musculus
attatatgaactttgatggattcaa

SEQ ID NO: 277339 - DNA, 25 bp, Mus musculus
attatatgcctcaactcctgcgtga

SEQ ID NO: 277340 - DNA, 25 bp, Mus musculus
attatatgcctctactcctgcgtga

SEQ ID NO: 277341 - DNA, 25 bp, Mus musculus
attatatgctcaccccaaacctggt

SEQ ID NO: 277342 - DNA, 25 bp, Mus musculus
attatatgctcagcccaaacctggt

SEQ ID NO: 277343 - DNA, 25 bp, Mus musculus
attatatgtccaaacttgcctcagg

SEQ ID NO: 277344 - DNA, 25 bp, Mus musculus
attatatgtccatacttgcctcagg

SEQ ID NO: 277345 - DNA, 25 bp, Mus musculus
attatatgtcttagtcccataagta

SEQ ID NO: 277346 - DNA, 25 bp, Mus musculus
attatatgtctttgtcccataagta

SEQ ID NO: 277347 - DNA, 25 bp, Mus musculus
attatatgttgcatgcatatctgtg

SEQ ID NO: 277348 - DNA, 25 bp, Mus musculus
attatatgttgcttgcatatctgtg

SEQ ID NO: 277349 - DNA, 25 bp, Mus musculus
attatattagctatcccaaaatccg

SEQ ID NO: 277350 - DNA, 25 bp, Mus musculus
attatattagctttcccaaaatccg

SEQ ID NO: 277351 - DNA, 25 bp, Mus musculus
attatattcattagtttcactattt

SEQ ID NO: 277352 - DNA, 25 bp, Mus musculus
attatattcatttgtttcactattt

SEQ ID NO: 277353 - DNA, 25 bp, Mus musculus
attatattctatcatcaaagccagg

SEQ ID NO: 277354 - DNA, 25 bp, Mus musculus
attatattctatgatcaaagccagg

SEQ ID NO: 277355 - DNA, 25 bp, Mus musculus
attatattggccatttattgttttg

SEQ ID NO: 277356 - DNA, 25 bp, Mus musculus
attatattggccttttattgttttg

SEQ ID NO: 277357 - DNA, 25 bp, Mus musculus
attatatttagaaaactggcctgta

SEQ ID NO: 277358 - DNA, 25 bp, Mus musculus
attatatttagataactggcctgta

SEQ ID NO: 277359 - DNA, 25 bp, Mus musculus
attatcaaatctaacacccggcaca

SEQ ID NO: 277360 - DNA, 25 bp, Mus musculus
attatcaaatcttacacccggcaca

SEQ ID NO: 277361 - DNA, 25 bp, Mus musculus
attatcaacatgacgtctgtggcct

SEQ ID NO: 277362 - DNA, 25 bp, Mus musculus
attatcaacatgtcgtctgtggcct

SEQ ID NO: 277363 - DNA, 25 bp, Mus musculus
attatcaactccaggtttgcgcagg

SEQ ID NO: 277364 - DNA, 25 bp, Mus musculus
attatcaactcctggtttgcgcagg

SEQ ID NO: 277365 - DNA, 25 bp, Mus musculus
attatcaagagcacatgccaccggg

SEQ ID NO: 277366 - DNA, 25 bp, Mus musculus
attatcaagagctcatgccaccggg

SEQ ID NO: 277367 - DNA, 25 bp, Mus musculus
attatcaaggatatgaagccactcc

SEQ ID NO: 277368 - DNA, 25 bp, Mus musculus
attatcaaggatttgaagccactcc

SEQ ID NO: 277369 - DNA, 25 bp, Mus musculus
attatcaattccatgttcacatctc

SEQ ID NO: 277370 - DNA, 25 bp, Mus musculus
attatcaattccttgttcacatctc

SEQ ID NO: 277371 - DNA, 25 bp, Mus musculus
attatcacagtgcatctaccattta

SEQ ID NO: 277372 - DNA, 25 bp, Mus musculus
attatcacagtggatctaccattta

SEQ ID NO: 277373 - DNA, 25 bp, Mus musculus
attatcaccacaagcaccagcaaaa

SEQ ID NO: 277374 - DNA, 25 bp, Mus musculus
attatcaccacatgcaccagcaaaa

SEQ ID NO: 277375 - DNA, 25 bp, Mus musculus
attatcacggagcactccttagacc

SEQ ID NO: 277376 - DNA, 25 bp, Mus musculus
attatcacggaggactccttagacc

SEQ ID NO: 277377 - DNA, 25 bp, Mus musculus
attatcacgttgctctatgcgatcg

SEQ ID NO: 277378 - DNA, 25 bp, Mus musculus
attatcacgttggtctatgcgatcg

SEQ ID NO: 277379 - DNA, 25 bp, Mus musculus
attatcactgtgcacttgtcactgc

SEQ ID NO: 277380 - DNA, 25 bp, Mus musculus
attatcactgtggacttgtcactgc

SEQ ID NO: 277381 - DNA, 25 bp, Mus musculus
attatcacttttccagtgctggctc

SEQ ID NO: 277382 - DNA, 25 bp, Mus musculus
attatcacttttgcagtgctggctc

SEQ ID NO: 277383 - DNA, 25 bp, Mus musculus
attatcagcaaaagtctggctacat

SEQ ID NO: 277384 - DNA, 25 bp, Mus musculus
attatcagcaaatgtctggctacat

SEQ ID NO: 277385 - DNA, 25 bp, Mus musculus
attatcagcaaccaaacgcgtcaat

SEQ ID NO: 277386 - DNA, 25 bp, Mus musculus
attatcagcaacgaaacgcgtcaat

SEQ ID NO: 277387 - DNA, 25 bp, Mus musculus
attatcaggatcaacatgctagaat

SEQ ID NO: 277388 - DNA, 25 bp, Mus musculus
attatcaggatctacatgctagaat

SEQ ID NO: 277389 - DNA, 25 bp, Mus musculus
attatcagggctcaatgcacgctca

SEQ ID NO: 277390 - DNA, 25 bp, Mus musculus
attatcagggctgaatgcacgctca

SEQ ID NO: 277391 - DNA, 25 bp, Mus musculus
attatcagtaacagaattcctcctg

SEQ ID NO: 277392 - DNA, 25 bp, Mus musculus
attatcagtaactgaattcctcctg

SEQ ID NO: 277393 - DNA, 25 bp, Mus musculus
attatcatcacgagcagcttcacac

SEQ ID NO: 277394 - DNA, 25 bp, Mus musculus
attatcatcacgtgcagcttcacac

SEQ ID NO: 277395 - DNA, 25 bp, Mus musculus
attatcatcgccaccctaattaggg

SEQ ID NO: 277396 - DNA, 25 bp, Mus musculus
attatcatcgcctccctaattaggg

SEQ ID NO: 277397 - DNA, 25 bp, Mus musculus
attatcatctctctccagcacagtt

SEQ ID NO: 277398 - DNA, 25 bp, Mus musculus
attatcatctctgtccagcacagtt

SEQ ID NO: 277399 - DNA, 25 bp, Mus musculus
attatcatctttatcctctgccaga

SEQ ID NO: 277400 - DNA, 25 bp, Mus musculus
attatcatctttttcctctgccaga

SEQ ID NO: 277401 - DNA, 25 bp, Mus musculus
attatcatttctacatggccaacca

SEQ ID NO: 277402 - DNA, 25 bp, Mus musculus
attatcatttctattgctgtgacca

SEQ ID NO: 277403 - DNA, 25 bp, Mus musculus
attatcatttcttcatggccaacca

SEQ ID NO: 277404 - DNA, 25 bp, Mus musculus
attatcatttcttttgctgtgacca

SEQ ID NO: 277405 - DNA, 25 bp, Mus musculus
attatcatttggcttcactcaggaa

SEQ ID NO: 277406 - DNA, 25 bp, Mus musculus
attatcatttgggttcactcaggaa

SEQ ID NO: 277407 - DNA, 25 bp, Mus musculus
attatccaatgcatgtttgttctct

SEQ ID NO: 277408 - DNA, 25 bp, Mus musculus
attatccaatgcttgtttgttctct

SEQ ID NO: 277409 - DNA, 25 bp, Mus musculus
attatccacacgaaatttgccacga

SEQ ID NO: 277410 - DNA, 25 bp, Mus musculus
attatccacacgagtactcacttgt

SEQ ID NO: 277411 - DNA, 25 bp, Mus musculus
attatccacacgtaatttgccacga

SEQ ID NO: 277412 - DNA, 25 bp, Mus musculus
attatccacacgtgtactcacttgt

SEQ ID NO: 277413 - DNA, 25 bp, Mus musculus
attatccaccacaaagatcccttct

SEQ ID NO: 277414 - DNA, 25 bp, Mus musculus
attatccaccactaagatcccttct

SEQ ID NO: 277415 - DNA, 25 bp, Mus musculus
attatccactttcaacttctagctg

SEQ ID NO: 277416 - DNA, 25 bp, Mus musculus
attatccactttgaacttctagctg

SEQ ID NO: 277417 - DNA, 25 bp, Mus musculus
attatccagatgagcccaaaatgag

SEQ ID NO: 277418 - DNA, 25 bp, Mus musculus
attatccagatgtgcccaaaatgag

SEQ ID NO: 277419 - DNA, 25 bp, Mus musculus
attatccagcctagaccgaatgtat

SEQ ID NO: 277420 - DNA, 25 bp, Mus musculus
attatccagccttgaccgaatgtat

SEQ ID NO: 277421 - DNA, 25 bp, Mus musculus
attatccagctgctcctggaacaga

SEQ ID NO: 277422 - DNA, 25 bp, Mus musculus
attatccagctggtcctggaacaga

SEQ ID NO: 277423 - DNA, 25 bp, Mus musculus
attatccaggccatgacgatgctca

SEQ ID NO: 277424 - DNA, 25 bp, Mus musculus
attatccaggccttgacgatgctca

SEQ ID NO: 277425 - DNA, 25 bp, Mus musculus
attatccattgcccgatgtcctctc

SEQ ID NO: 277426 - DNA, 25 bp, Mus musculus
attatccattgcgcgatgtcctctc

SEQ ID NO: 277427 - DNA, 25 bp, Mus musculus
attatcccacagagcattgcaagag

SEQ ID NO: 277428 - DNA, 25 bp, Mus musculus
attatcccacagtgcattgcaagag

SEQ ID NO: 277429 - DNA, 25 bp, Mus musculus
attatcccagatcatttttgctaag

SEQ ID NO: 277430 - DNA, 25 bp, Mus musculus
attatcccagatgatttttgctaag

SEQ ID NO: 277431 - DNA, 25 bp, Mus musculus
attatcccagcactagccaaggacc

SEQ ID NO: 277432 - DNA, 25 bp, Mus musculus
attatcccagcagtagccaaggacc

SEQ ID NO: 277433 - DNA, 25 bp, Mus musculus
attatcccagctccggctatcaaag

SEQ ID NO: 277434 - DNA, 25 bp, Mus musculus
attatcccagctgcggctatcaaag

SEQ ID NO: 277435 - DNA, 25 bp, Mus musculus
attatccccagcaagaagcttcgga

SEQ ID NO: 277436 - DNA, 25 bp, Mus musculus
attatccccagctagaagcttcgga

SEQ ID NO: 277437 - DNA, 25 bp, Mus musculus
attatccctgttcccagttgagctg

SEQ ID NO: 277438 - DNA, 25 bp, Mus musculus
attatccctgttgccagttgagctg

SEQ ID NO: 277439 - DNA, 25 bp, Mus musculus
attatccggccccttgggatggctt

SEQ ID NO: 277440 - DNA, 25 bp, Mus musculus
attatccggcccgttgggatggctt

SEQ ID NO: 277441 - DNA, 25 bp, Mus musculus
attatcctaacaactctcctttata

SEQ ID NO: 277442 - DNA, 25 bp, Mus musculus
attatcctaacatctctcctttata

SEQ ID NO: 277443 - DNA, 25 bp, Mus musculus
attatcctatgtatacttctgcccc

SEQ ID NO: 277444 - DNA, 25 bp, Mus musculus
attatcctatgtttacttctgcccc

SEQ ID NO: 277445 - DNA, 25 bp, Mus musculus
attatcctcaaccttgctcaaggcg

SEQ ID NO: 277446 - DNA, 25 bp, Mus musculus
attatcctcaacgttgctcaaggcg

SEQ ID NO: 277447 - DNA, 25 bp, Mus musculus
attatcctgcttcacttggtttaaa

SEQ ID NO: 277448 - DNA, 25 bp, Mus musculus
attatcctgcttgacttggtttaaa

SEQ ID NO: 277449 - DNA, 25 bp, Mus musculus
attatcctgttcactttttgttcac

SEQ ID NO: 277450 - DNA, 25 bp, Mus musculus
attatcctgttctctttttgttcac

SEQ ID NO: 277451 - DNA, 25 bp, Mus musculus
attatccttgttagcaacatttgga

SEQ ID NO: 277452 - DNA, 25 bp, Mus musculus
attatccttgtttgcaacatttgga

SEQ ID NO: 277453 - DNA, 25 bp, Mus musculus
attatcgaggatacagacgcacagc

SEQ ID NO: 277454 - DNA, 25 bp, Mus musculus
attatcgaggattcagacgcacagc

SEQ ID NO: 277455 - DNA, 25 bp, Mus musculus
attatcgagggtcaaactgcttcct

SEQ ID NO: 277456 - DNA, 25 bp, Mus musculus
attatcgagggtgaaactgcttcct

SEQ ID NO: 277457 - DNA, 25 bp, Mus musculus
attatcgcaatcacaggtcctggtt

SEQ ID NO: 277458 - DNA, 25 bp, Mus musculus
attatcgcaatctcaggtcctggtt

SEQ ID NO: 277459 - DNA, 25 bp, Mus musculus
attatcggcctcagctgaagttggg

SEQ ID NO: 277460 - DNA, 25 bp, Mus musculus
attatcggcctctgctgaagttggg

SEQ ID NO: 277461 - DNA, 25 bp, Mus musculus
attatcggcgacatcaacacgacca

SEQ ID NO: 277462 - DNA, 25 bp, Mus musculus
attatcggcgacttcaacacgacca

SEQ ID NO: 277463 - DNA, 25 bp, Mus musculus
attatcgggtttcttctgcagagca

SEQ ID NO: 277464 - DNA, 25 bp, Mus musculus
attatcgggtttgttctgcagagca

SEQ ID NO: 277465 - DNA, 25 bp, Mus musculus
attatcgtgagcaggatgattgccc

SEQ ID NO: 277466 - DNA, 25 bp, Mus musculus
attatcgtgagctggatgattgccc

SEQ ID NO: 277467 - DNA, 25 bp, Mus musculus
attatctaatacacacgcctttcag

SEQ ID NO: 277468 - DNA, 25 bp, Mus musculus
attatctaatactcacgcctttcag

SEQ ID NO: 277469 - DNA, 25 bp, Mus musculus
attatctacatgctcctttgtctca

SEQ ID NO: 277470 - DNA, 25 bp, Mus musculus
attatctacatggtcctttgtctca

SEQ ID NO: 277471 - DNA, 25 bp, Mus musculus
attatctacctcaataacattttag

SEQ ID NO: 277472 - DNA, 25 bp, Mus musculus
attatctacctctataacattttag

SEQ ID NO: 277473 - DNA, 25 bp, Mus musculus
attatctagcttaaacatatcggtt

SEQ ID NO: 277474 - DNA, 25 bp, Mus musculus
attatctagctttaacatatcggtt

SEQ ID NO: 277475 - DNA, 25 bp, Mus musculus
attatctagttaaggctggtctgca

SEQ ID NO: 277476 - DNA, 25 bp, Mus musculus
attatctagttatggctggtctgca

SEQ ID NO: 277477 - DNA, 25 bp, Mus musculus
attatctatggacctgctcttagct

SEQ ID NO: 277478 - DNA, 25 bp, Mus musculus
attatctatggagctgctcttagct

SEQ ID NO: 277479 - DNA, 25 bp, Mus musculus
attatctatgtacctgtgtttccct

SEQ ID NO: 277480 - DNA, 25 bp, Mus musculus
attatctatgtagctgtgtttccct

SEQ ID NO: 277481 - DNA, 25 bp, Mus musculus
attatctcaatgctactgccaaggg

SEQ ID NO: 277482 - DNA, 25 bp, Mus musculus
attatctcaatggtactgccaaggg

SEQ ID NO: 277483 - DNA, 25 bp, Mus musculus
attatctcacatatgcctcaccaaa

SEQ ID NO: 277484 - DNA, 25 bp, Mus musculus
attatctcacatttgcctcaccaaa

SEQ ID NO: 277485 - DNA, 25 bp, Mus musculus
attatctcacgcatacagtttaaag

SEQ ID NO: 277486 - DNA, 25 bp, Mus musculus
attatctcacgcttacagtttaaag

SEQ ID NO: 277487 - DNA, 25 bp, Mus musculus
attatctcatcactgtgccaactat

SEQ ID NO: 277488 - DNA, 25 bp, Mus musculus
attatctcatcagtgtgccaactat

SEQ ID NO: 277489 - DNA, 25 bp, Mus musculus
attatctccactcagctagttcaag

SEQ ID NO: 277490 - DNA, 25 bp, Mus musculus
attatctccactgagctagttcaag

SEQ ID NO: 277491 - DNA, 25 bp, Mus musculus
attatctccagtaactgattcctta

SEQ ID NO: 277492 - DNA, 25 bp, Mus musculus
attatctccagttactgattcctta

SEQ ID NO: 277493 - DNA, 25 bp, Mus musculus
attatctccttgaagtgctgcctag

SEQ ID NO: 277494 - DNA, 25 bp, Mus musculus
attatctccttgtagtgctgcctag

SEQ ID NO: 277495 - DNA, 25 bp, Mus musculus
attatctcctttaatcctgctgtca

SEQ ID NO: 277496 - DNA, 25 bp, Mus musculus
attatctccttttatcctgctgtca

SEQ ID NO: 277497 - DNA, 25 bp, Mus musculus
attatctcgtcaaaattcttttgta

SEQ ID NO: 277498 - DNA, 25 bp, Mus musculus
attatctcgtcataattcttttgta

SEQ ID NO: 277499 - DNA, 25 bp, Mus musculus
attatctctaggaggcatacctgga

SEQ ID NO: 277500 - DNA, 25 bp, Mus musculus
attatctctaggtggcatacctgga

SEQ ID NO: 277501 - DNA, 25 bp, Mus musculus
attatctctattcgaccctgaccct

SEQ ID NO: 277502 - DNA, 25 bp, Mus musculus
attatctctattggaccctgaccct

SEQ ID NO: 277503 - DNA, 25 bp, Mus musculus
attatctctcgcagggttttccaga

SEQ ID NO: 277504 - DNA, 25 bp, Mus musculus
attatctctcgctgggttttccaga

SEQ ID NO: 277505 - DNA, 25 bp, Mus musculus
attatctctgaccattttgacccat

SEQ ID NO: 277506 - DNA, 25 bp, Mus musculus
attatctctgacgattttgacccat

SEQ ID NO: 277507 - DNA, 25 bp, Mus musculus
attatctctgttcagccctcaatat

SEQ ID NO: 277508 - DNA, 25 bp, Mus musculus
attatctctgttgagccctcaatat

SEQ ID NO: 277509 - DNA, 25 bp, Mus musculus
attatctcttatacgcctgctggaa

SEQ ID NO: 277510 - DNA, 25 bp, Mus musculus
attatctcttattcgcctgctggaa

SEQ ID NO: 277511 - DNA, 25 bp, Mus musculus
attatctgatgtcatgcctgttgag

SEQ ID NO: 277512 - DNA, 25 bp, Mus musculus
attatctgatgtgatgcctgttgag

SEQ ID NO: 277513 - DNA, 25 bp, Mus musculus
attatctggactccatgggcaccta

SEQ ID NO: 277514 - DNA, 25 bp, Mus musculus
attatctggactgcatgggcaccta

SEQ ID NO: 277515 - DNA, 25 bp, Mus musculus
attatctgtgcaattaaggcttact

SEQ ID NO: 277516 - DNA, 25 bp, Mus musculus
attatctgtgcatttaaggcttact

SEQ ID NO: 277517 - DNA, 25 bp, Mus musculus
attatctgtggcagttcttgcctgg

SEQ ID NO: 277518 - DNA, 25 bp, Mus musculus
attatctgtggctgttcttgcctgg

SEQ ID NO: 277519 - DNA, 25 bp, Mus musculus
attatctgtgttatttgcctgcctc

SEQ ID NO: 277520 - DNA, 25 bp, Mus musculus
attatctgtgttttttgcctgcctc

SEQ ID NO: 277521 - DNA, 25 bp, Mus musculus
attatcttaattctttcctcttttg

SEQ ID NO: 277522 - DNA, 25 bp, Mus musculus
attatcttaattgtttcctcttttg

SEQ ID NO: 277523 - DNA, 25 bp, Mus musculus
attatcttcgacaacctcagagcag

SEQ ID NO: 277524 - DNA, 25 bp, Mus musculus
attatcttcgactacctcagagcag

SEQ ID NO: 277525 - DNA, 25 bp, Mus musculus
attatcttctgccagacacgtcgaa

SEQ ID NO: 277526 - DNA, 25 bp, Mus musculus
attatcttctgcgagacacgtcgaa

SEQ ID NO: 277527 - DNA, 25 bp, Mus musculus
attatcttctggagcatgttcttct

SEQ ID NO: 277528 - DNA, 25 bp, Mus musculus
attatcttctggtgcatgttcttct

SEQ ID NO: 277529 - DNA, 25 bp, Mus musculus
attatgaagaagcatctagccacat

SEQ ID NO: 277530 - DNA, 25 bp, Mus musculus
attatgaagaaggatctagccacat

SEQ ID NO: 277531 - DNA, 25 bp, Mus musculus
attatgacaccaaagaatctttttt

SEQ ID NO: 277532 - DNA, 25 bp, Mus musculus
attatgacaccatagaatctttttt

SEQ ID NO: 277533 - DNA, 25 bp, Mus musculus
attatgacatttcgtgtgtatttta

SEQ ID NO: 277534 - DNA, 25 bp, Mus musculus
attatgacatttggtgtgtatttta

SEQ ID NO: 277535 - DNA, 25 bp, Mus musculus
attatgaccattcccttctctagac

SEQ ID NO: 277536 - DNA, 25 bp, Mus musculus
attatgaccattgccttctctagac

SEQ ID NO: 277537 - DNA, 25 bp, Mus musculus
attatgacccagaatgtggagcgga

SEQ ID NO: 277538 - DNA, 25 bp, Mus musculus
attatgacccagtatgtggagcgga

SEQ ID NO: 277539 - DNA, 25 bp, Mus musculus
attatgacctgcacacgctcaatgg

SEQ ID NO: 277540 - DNA, 25 bp, Mus musculus
attatgacctgctcacgctcaatgg

SEQ ID NO: 277541 - DNA, 25 bp, Mus musculus
attatgacgcacagccaacgcaatg

SEQ ID NO: 277542 - DNA, 25 bp, Mus musculus
attatgacgcactgccaacgcaatg

SEQ ID NO: 277543 - DNA, 25 bp, Mus musculus
attatgagaaccacttacaccagaa

SEQ ID NO: 277544 - DNA, 25 bp, Mus musculus
attatgagaacctcttacaccagaa

SEQ ID NO: 277545 - DNA, 25 bp, Mus musculus
attatgagtcagagttttggctatg

SEQ ID NO: 277546 - DNA, 25 bp, Mus musculus
attatgagtcagtgttttggctatg

SEQ ID NO: 277547 - DNA, 25 bp, Mus musculus
attatgatatccattcctgtgggac

SEQ ID NO: 277548 - DNA, 25 bp, Mus musculus
attatgatatcctttcctgtgggac

SEQ ID NO: 277549 - DNA, 25 bp, Mus musculus
attatgatgaggctaggtaggcgtc

SEQ ID NO: 277550 - DNA, 25 bp, Mus musculus
attatgatgagggtaggtaggcgtc

SEQ ID NO: 277551 - DNA, 25 bp, Mus musculus
attatgatggccagtatccttccta

SEQ ID NO: 277552 - DNA, 25 bp, Mus musculus
attatgatggcctgtatccttccta

SEQ ID NO: 277553 - DNA, 25 bp, Mus musculus
attatgatttcaactgtgttacacc

SEQ ID NO: 277554 - DNA, 25 bp, Mus musculus
attatgatttcatctgtgttacacc

SEQ ID NO: 277555 - DNA, 25 bp, Mus musculus
attatgcacgatagagtcactcccc

SEQ ID NO: 277556 - DNA, 25 bp, Mus musculus
attatgcacgattgagtcactcccc

SEQ ID NO: 277557 - DNA, 25 bp, Mus musculus
attatgcactcaagaatcctactag

SEQ ID NO: 277558 - DNA, 25 bp, Mus musculus
attatgcactcatgaatcctactag

SEQ ID NO: 277559 - DNA, 25 bp, Mus musculus
attatgcagattagccagcagaaga

SEQ ID NO: 277560 - DNA, 25 bp, Mus musculus
attatgcagatttgccagcagaaga

SEQ ID NO: 277561 - DNA, 25 bp, Mus musculus
attatgcatcataccaaggctagcc

SEQ ID NO: 277562 - DNA, 25 bp, Mus musculus
attatgcatcattccaaggctagcc

SEQ ID NO: 277563 - DNA, 25 bp, Mus musculus
attatgcatctcctggatgaggagg

SEQ ID NO: 277564 - DNA, 25 bp, Mus musculus
attatgcatctcgtggatgaggagg

SEQ ID NO: 277565 - DNA, 25 bp, Mus musculus
attatgcatgaaacactgtgtaaat

SEQ ID NO: 277566 - DNA, 25 bp, Mus musculus
attatgcatgaatcactgtgtaaat

SEQ ID NO: 277567 - DNA, 25 bp, Mus musculus
attatgcatttactgcctgcccagt

SEQ ID NO: 277568 - DNA, 25 bp, Mus musculus
attatgcatttagtgcctgcccagt

SEQ ID NO: 277569 - DNA, 25 bp, Mus musculus
attatgccaatcaacactccaaaga

SEQ ID NO: 277570 - DNA, 25 bp, Mus musculus
attatgccaatctacactccaaaga

SEQ ID NO: 277571 - DNA, 25 bp, Mus musculus
attatgcccatgattagcccctaca

SEQ ID NO: 277572 - DNA, 25 bp, Mus musculus
attatgcccatgtttagcccctaca

SEQ ID NO: 277573 - DNA, 25 bp, Mus musculus
attatgccgaagctctgctgaggct

SEQ ID NO: 277574 - DNA, 25 bp, Mus musculus
attatgccgaaggtctgctgaggct

SEQ ID NO: 277575 - DNA, 25 bp, Mus musculus
attatgcctggtagtgccagcacct

SEQ ID NO: 277576 - DNA, 25 bp, Mus musculus
attatgcctggttgtgccagcacct

SEQ ID NO: 277577 - DNA, 25 bp, Mus musculus
attatgcctgtgaatccatgtcgga

SEQ ID NO: 277578 - DNA, 25 bp, Mus musculus
attatgcctgtgtatccatgtcgga

SEQ ID NO: 277579 - DNA, 25 bp, Mus musculus
attatgcgggtgctgaccatatcct

SEQ ID NO: 277580 - DNA, 25 bp, Mus musculus
attatgcgggtggtgaccatatcct

SEQ ID NO: 277581 - DNA, 25 bp, Mus musculus
attatgcgttttcccagtgtttgag

SEQ ID NO: 277582 - DNA, 25 bp, Mus musculus
attatgcgttttgccagtgtttgag

SEQ ID NO: 277583 - DNA, 25 bp, Mus musculus
attatgctacctccttattgtgggc

SEQ ID NO: 277584 - DNA, 25 bp, Mus musculus
attatgctacctgcttattgtgggc

SEQ ID NO: 277585 - DNA, 25 bp, Mus musculus
attatgcttcacagtgataattcca

SEQ ID NO: 277586 - DNA, 25 bp, Mus musculus
attatgcttcactgtgataattcca

SEQ ID NO: 277587 - DNA, 25 bp, Mus musculus
attatgctttaaatctgaggaccat

SEQ ID NO: 277588 - DNA, 25 bp, Mus musculus
attatgctttaattctgaggaccat

SEQ ID NO: 277589 - DNA, 25 bp, Mus musculus
attatgctttcaagctgtatgttta

SEQ ID NO: 277590 - DNA, 25 bp, Mus musculus
attatgctttcatgctgtatgttta

SEQ ID NO: 277591 - DNA, 25 bp, Mus musculus
attatggaaataaagcctctttaga

SEQ ID NO: 277592 - DNA, 25 bp, Mus musculus
attatggaaatatagcctctttaga

SEQ ID NO: 277593 - DNA, 25 bp, Mus musculus
attatggaaggccaccgtagccagc

SEQ ID NO: 277594 - DNA, 25 bp, Mus musculus
attatggaaggcgaccgtagccagc

SEQ ID NO: 277595 - DNA, 25 bp, Mus musculus
attatggaccctcacgagcaattgg

SEQ ID NO: 277596 - DNA, 25 bp, Mus musculus
attatggaccctgacgagcaattgg

SEQ ID NO: 277597 - DNA, 25 bp, Mus musculus
attatggagaacaacagccttgtgt

SEQ ID NO: 277598 - DNA, 25 bp, Mus musculus
attatggagaactacagccttgtgt

SEQ ID NO: 277599 - DNA, 25 bp, Mus musculus
attatggcacaccaactgcaggatc

SEQ ID NO: 277600 - DNA, 25 bp, Mus musculus
attatggcacacgaactgcaggatc

SEQ ID NO: 277601 - DNA, 25 bp, Mus musculus
attatggcctgtcgtccagtctgag

SEQ ID NO: 277602 - DNA, 25 bp, Mus musculus
attatggcctgtggtccagtctgag

SEQ ID NO: 277603 - DNA, 25 bp, Mus musculus
attatggctaatacggctgttacag

SEQ ID NO: 277604 - DNA, 25 bp, Mus musculus
attatggctaattcggctgttacag

SEQ ID NO: 277605 - DNA, 25 bp, Mus musculus
attatggctcctccacctggtatga

SEQ ID NO: 277606 - DNA, 25 bp, Mus musculus
attatggctcctgcacctggtatga

SEQ ID NO: 277607 - DNA, 25 bp, Mus musculus
attatggctcgaacattatccagga

SEQ ID NO: 277608 - DNA, 25 bp, Mus musculus
attatggctcgatcattatccagga

SEQ ID NO: 277609 - DNA, 25 bp, Mus musculus
attatggctgcacttgtctattttc

SEQ ID NO: 277610 - DNA, 25 bp, Mus musculus
attatggctgcagttgtctattttc

SEQ ID NO: 277611 - DNA, 25 bp, Mus musculus
attatggcttggcaccatcaccgta

SEQ ID NO: 277612 - DNA, 25 bp, Mus musculus
attatggcttgggaccatcaccgta

SEQ ID NO: 277613 - DNA, 25 bp, Mus musculus
attatgggagtacctccgaccggtt

SEQ ID NO: 277614 - DNA, 25 bp, Mus musculus
attatgggagtagctccgaccggtt

SEQ ID NO: 277615 - DNA, 25 bp, Mus musculus
attatgggagtcataagctcaggtt

SEQ ID NO: 277616 - DNA, 25 bp, Mus musculus
attatgggagtcttaagctcaggtt

SEQ ID NO: 277617 - DNA, 25 bp, Mus musculus
attatgggttcaagccaccaggccc

SEQ ID NO: 277618 - DNA, 25 bp, Mus musculus
attatgggttcatgccaccaggccc

SEQ ID NO: 277619 - DNA, 25 bp, Mus musculus
attatggtaactactgtgctgcttt

SEQ ID NO: 277620 - DNA, 25 bp, Mus musculus
attatggtaactcctgctgttgtca

SEQ ID NO: 277621 - DNA, 25 bp, Mus musculus
attatggtaactgctgctgttgtca

SEQ ID NO: 277622 - DNA, 25 bp, Mus musculus
attatggtaacttctgtgctgcttt

SEQ ID NO: 277623 - DNA, 25 bp, Mus musculus
attatggtataactgcactgtggaa

SEQ ID NO: 277624 - DNA, 25 bp, Mus musculus
attatggtataagtgcactgtggaa

SEQ ID NO: 277625 - DNA, 25 bp, Mus musculus
attatggtcaccactgtgtctgtaa

SEQ ID NO: 277626 - DNA, 25 bp, Mus musculus
attatggtcacctctgtgtctgtaa

SEQ ID NO: 277627 - DNA, 25 bp, Mus musculus
attatggtccaacaagcctgatcac

SEQ ID NO: 277628 - DNA, 25 bp, Mus musculus
attatggtccaagaagcctgatcac

SEQ ID NO: 277629 - DNA, 25 bp, Mus musculus
attatggtctggctgatgattgtca

SEQ ID NO: 277630 - DNA, 25 bp, Mus musculus
attatggtctgggtgatgattgtca

SEQ ID NO: 277631 - DNA, 25 bp, Mus musculus
attatggtgagcagatgttcgggaa

SEQ ID NO: 277632 - DNA, 25 bp, Mus musculus
attatggtgagctgatgttcgggaa

SEQ ID NO: 277633 - DNA, 25 bp, Mus musculus
attatggtgttcatttcagtctttt

SEQ ID NO: 277634 - DNA, 25 bp, Mus musculus
attatggtgttcttttcagtctttt

SEQ ID NO: 277635 - DNA, 25 bp, Mus musculus
attatggttgccaggtgtgtcccca

SEQ ID NO: 277636 - DNA, 25 bp, Mus musculus
attatggttgcctggtgtgtcccca

SEQ ID NO: 277637 - DNA, 25 bp, Mus musculus
attatggttttcaactttaggtgat

SEQ ID NO: 277638 - DNA, 25 bp, Mus musculus
attatggttttctactttaggtgat

SEQ ID NO: 277639 - DNA, 25 bp, Mus musculus
attatgtaaagtagctgctccctcc

SEQ ID NO: 277640 - DNA, 25 bp, Mus musculus
attatgtaaagttgctgctccctcc

SEQ ID NO: 277641 - DNA, 25 bp, Mus musculus
attatgtagctgagagcaagtatac

SEQ ID NO: 277642 - DNA, 25 bp, Mus musculus
attatgtagctgtgagcaagtatac

SEQ ID NO: 277643 - DNA, 25 bp, Mus musculus
attatgtattaccagcagggtgttt

SEQ ID NO: 277644 - DNA, 25 bp, Mus musculus
attatgtattacgagcagggtgttt

SEQ ID NO: 277645 - DNA, 25 bp, Mus musculus
attatgtcaccccagtgaaccggaa

SEQ ID NO: 277646 - DNA, 25 bp, Mus musculus
attatgtcacccgagtgaaccggaa

SEQ ID NO: 277647 - DNA, 25 bp, Mus musculus
attatgtcactgctcccatgtggtc

SEQ ID NO: 277648 - DNA, 25 bp, Mus musculus
attatgtcactggtcccatgtggtc

SEQ ID NO: 277649 - DNA, 25 bp, Mus musculus
attatgtcatgtaatagctgctata

SEQ ID NO: 277650 - DNA, 25 bp, Mus musculus
attatgtcatgttatagctgctata

SEQ ID NO: 277651 - DNA, 25 bp, Mus musculus
attatgtcccaaccccaaacgatgg

SEQ ID NO: 277652 - DNA, 25 bp, Mus musculus
attatgtcccaagcccaaacgatgg

SEQ ID NO: 277653 - DNA, 25 bp, Mus musculus
attatgtcccacagaccagagatga

SEQ ID NO: 277654 - DNA, 25 bp, Mus musculus
attatgtcccactgaccagagatga

SEQ ID NO: 277655 - DNA, 25 bp, Mus musculus
attatgtcctggcagaccgtgaccg

SEQ ID NO: 277656 - DNA, 25 bp, Mus musculus
attatgtcctgggagaccgtgaccg

SEQ ID NO: 277657 - DNA, 25 bp, Mus musculus
attatgtccttcaaattgtatgtca

SEQ ID NO: 277658 - DNA, 25 bp, Mus musculus
attatgtccttctaattgtatgtca

SEQ ID NO: 277659 - DNA, 25 bp, Mus musculus
attatgtgaaaacatccttccttga

SEQ ID NO: 277660 - DNA, 25 bp, Mus musculus
attatgtgaaaagatccttccttga

SEQ ID NO: 277661 - DNA, 25 bp, Mus musculus
attatgtgagcaagagactatgcac

SEQ ID NO: 277662 - DNA, 25 bp, Mus musculus
attatgtgagcatgagactatgcac

SEQ ID NO: 277663 - DNA, 25 bp, Mus musculus
attatgtgccgactgcagttagccc

SEQ ID NO: 277664 - DNA, 25 bp, Mus musculus
attatgtgccgagtgcagttagccc

SEQ ID NO: 277665 - DNA, 25 bp, Mus musculus
attatgtgggttacctagttcctgt

SEQ ID NO: 277666 - DNA, 25 bp, Mus musculus
attatgtgggtttcctagttcctgt

SEQ ID NO: 277667 - DNA, 25 bp, Mus musculus
attatgtgtgacatctacgtctccc

SEQ ID NO: 277668 - DNA, 25 bp, Mus musculus
attatgtgtgacttctacgtctccc

SEQ ID NO: 277669 - DNA, 25 bp, Mus musculus
attatgttcattatgtaattcaata

SEQ ID NO: 277670 - DNA, 25 bp, Mus musculus
attatgttcattttgtaattcaata

SEQ ID NO: 277671 - DNA, 25 bp, Mus musculus
attatgttcgttcgtatgccaccaa

SEQ ID NO: 277672 - DNA, 25 bp, Mus musculus
attatgttcgttggtatgccaccaa

SEQ ID NO: 277673 - DNA, 25 bp, Mus musculus
attatgttctccatcaagtcagttt

SEQ ID NO: 277674 - DNA, 25 bp, Mus musculus
attatgttctccttcaagtcagttt

SEQ ID NO: 277675 - DNA, 25 bp, Mus musculus
attatgttctctctgccccggaaga

SEQ ID NO: 277676 - DNA, 25 bp, Mus musculus
attatgttctctgtgccccggaaga

SEQ ID NO: 277677 - DNA, 25 bp, Mus musculus
attatgttctgtcgtatggctggct

SEQ ID NO: 277678 - DNA, 25 bp, Mus musculus
attatgttctgtggtatggctggct

SEQ ID NO: 277679 - DNA, 25 bp, Mus musculus
attatgttgccaaggtgctccgaaa

SEQ ID NO: 277680 - DNA, 25 bp, Mus musculus
attatgttgccacctgatccagaaa

SEQ ID NO: 277681 - DNA, 25 bp, Mus musculus
attatgttgccagctgatccagaaa

SEQ ID NO: 277682 - DNA, 25 bp, Mus musculus
attatgttgccatggtgctccgaaa

SEQ ID NO: 277683 - DNA, 25 bp, Mus musculus
attatgttggaaaggcctgtttgcc

SEQ ID NO: 277684 - DNA, 25 bp, Mus musculus
attatgttggaatggcctgtttgcc

SEQ ID NO: 277685 - DNA, 25 bp, Mus musculus
attatgtttatcacatgccttcctg

SEQ ID NO: 277686 - DNA, 25 bp, Mus musculus
attatgtttatctcatgccttcctg

SEQ ID NO: 277687 - DNA, 25 bp, Mus musculus
attatgtttgtcatcttggtttgat

SEQ ID NO: 277688 - DNA, 25 bp, Mus musculus
attatgtttgtcttcttggtttgat

SEQ ID NO: 277689 - DNA, 25 bp, Mus musculus
attatgttttctaggtgctgccaaa

SEQ ID NO: 277690 - DNA, 25 bp, Mus musculus
attatgttttcttggtgctgccaaa

SEQ ID NO: 277691 - DNA, 25 bp, Mus musculus
attatgtttttaagttcttgggcta

SEQ ID NO: 277692 - DNA, 25 bp, Mus musculus
attatgtttttatgttcttgggcta

SEQ ID NO: 277693 - DNA, 25 bp, Mus musculus
attattaacattcgtactcactcag

SEQ ID NO: 277694 - DNA, 25 bp, Mus musculus
attattaacattggtactcactcag

SEQ ID NO: 277695 - DNA, 25 bp, Mus musculus
attattaacttcaggcaagattgtt

SEQ ID NO: 277696 - DNA, 25 bp, Mus musculus
attattaacttctggcaagattgtt

SEQ ID NO: 277697 - DNA, 25 bp, Mus musculus
attattaagtacctgttggagtctg

SEQ ID NO: 277698 - DNA, 25 bp, Mus musculus
attattaagtacgtgttggagtctg

SEQ ID NO: 277699 - DNA, 25 bp, Mus musculus
attattacttccagacttgggccct

SEQ ID NO: 277700 - DNA, 25 bp, Mus musculus
attattacttcctgacttgggccct

SEQ ID NO: 277701 - DNA, 25 bp, Mus musculus
attattacttttatcctagtgggag

SEQ ID NO: 277702 - DNA, 25 bp, Mus musculus
attattacttttttcctagtgggag

SEQ ID NO: 277703 - DNA, 25 bp, Mus musculus
attattagaactctagtagtcttcc

SEQ ID NO: 277704 - DNA, 25 bp, Mus musculus
attattagaactgtagtagtcttcc

SEQ ID NO: 277705 - DNA, 25 bp, Mus musculus
attattagaatgattgttccccact

SEQ ID NO: 277706 - DNA, 25 bp, Mus musculus
attattagaatgtttgttccccact

SEQ ID NO: 277707 - DNA, 25 bp, Mus musculus
attattaggcatcccagactctgat

SEQ ID NO: 277708 - DNA, 25 bp, Mus musculus
attattaggcatgccagactctgat

SEQ ID NO: 277709 - DNA, 25 bp, Mus musculus
attattagggtaacagtctggcgga

SEQ ID NO: 277710 - DNA, 25 bp, Mus musculus
attattagggtatcagtctggcgga

SEQ ID NO: 277711 - DNA, 25 bp, Mus musculus
attattattataacctggaggctac

SEQ ID NO: 277712 - DNA, 25 bp, Mus musculus
attattattatatcctggaggctac

SEQ ID NO: 277713 - DNA, 25 bp, Mus musculus
attattcaatgaacctccatcccct

SEQ ID NO: 277714 - DNA, 25 bp, Mus musculus
attattcaatgatcctccatcccct

SEQ ID NO: 277715 - DNA, 25 bp, Mus musculus
attattcaattaacaccgtttgtgt

SEQ ID NO: 277716 - DNA, 25 bp, Mus musculus
attattcaattatcaccgtttgtgt

SEQ ID NO: 277717 - DNA, 25 bp, Mus musculus
attattcaccctcttaatcccactt

SEQ ID NO: 277718 - DNA, 25 bp, Mus musculus
attattcaccctgttaatcccactt

SEQ ID NO: 277719 - DNA, 25 bp, Mus musculus
attattcactacattctcgtgatat

SEQ ID NO: 277720 - DNA, 25 bp, Mus musculus
attattcactactttctcgtgatat

SEQ ID NO: 277721 - DNA, 25 bp, Mus musculus
attattcagagtcccgaaccttcgc

SEQ ID NO: 277722 - DNA, 25 bp, Mus musculus
attattcagagtgccgaaccttcgc

SEQ ID NO: 277723 - DNA, 25 bp, Mus musculus
attattcagatgataagtcatttca

SEQ ID NO: 277724 - DNA, 25 bp, Mus musculus
attattcagatgttaagtcatttca

SEQ ID NO: 277725 - DNA, 25 bp, Mus musculus
attattcagcttcgcgagcgctttt

SEQ ID NO: 277726 - DNA, 25 bp, Mus musculus
attattcagcttggcgagcgctttt

SEQ ID NO: 277727 - DNA, 25 bp, Mus musculus
attattcatcatatgcccttcttgc

SEQ ID NO: 277728 - DNA, 25 bp, Mus musculus
attattcatcatttgcccttcttgc

SEQ ID NO: 277729 - DNA, 25 bp, Mus musculus
attattcatctcatctgtgtgcctg

SEQ ID NO: 277730 - DNA, 25 bp, Mus musculus
attattcatctcttctgtgtgcctg

SEQ ID NO: 277731 - DNA, 25 bp, Mus musculus
attattcatgttcttggcttattgg

SEQ ID NO: 277732 - DNA, 25 bp, Mus musculus
attattcatgttgttggcttattgg

SEQ ID NO: 277733 - DNA, 25 bp, Mus musculus
attattcccagacaacaggctaccc

SEQ ID NO: 277734 - DNA, 25 bp, Mus musculus
attattcccagagaacaggctaccc

SEQ ID NO: 277735 - DNA, 25 bp, Mus musculus
attattccctttcactgtgtcctca

SEQ ID NO: 277736 - DNA, 25 bp, Mus musculus
attattccctttgactgtgtcctca

SEQ ID NO: 277737 - DNA, 25 bp, Mus musculus
attattcctcagattctaacctgtg

SEQ ID NO: 277738 - DNA, 25 bp, Mus musculus
attattcctcagtttctaacctgtg

SEQ ID NO: 277739 - DNA, 25 bp, Mus musculus
attattcctcggagtgacttctttc

SEQ ID NO: 277740 - DNA, 25 bp, Mus musculus
attattcctcggtgtgacttctttc

SEQ ID NO: 277741 - DNA, 25 bp, Mus musculus
attattcctcttcaattcctgtcct

SEQ ID NO: 277742 - DNA, 25 bp, Mus musculus
attattcctcttgaattcctgtcct

SEQ ID NO: 277743 - DNA, 25 bp, Mus musculus
attattcctggcagtatctgagtcc

SEQ ID NO: 277744 - DNA, 25 bp, Mus musculus
attattcctggctgtatctgagtcc

SEQ ID NO: 277745 - DNA, 25 bp, Mus musculus
attattcggtagaagctccaggaca

SEQ ID NO: 277746 - DNA, 25 bp, Mus musculus
attattcggtagtagctccaggaca

SEQ ID NO: 277747 - DNA, 25 bp, Mus musculus
attattcggtctccattcccagtgg

SEQ ID NO: 277748 - DNA, 25 bp, Mus musculus
attattcggtctgcattcccagtgg

SEQ ID NO: 277749 - DNA, 25 bp, Mus musculus
attattctagaacagcttgccgcat

SEQ ID NO: 277750 - DNA, 25 bp, Mus musculus
attattctagaagagcttgccgcat

SEQ ID NO: 277751 - DNA, 25 bp, Mus musculus
attattctagctctgatatcgtggg

SEQ ID NO: 277752 - DNA, 25 bp, Mus musculus
attattctagctgtgatatcgtggg

SEQ ID NO: 277753 - DNA, 25 bp, Mus musculus
attattctcattaagtgcccctgta

SEQ ID NO: 277754 - DNA, 25 bp, Mus musculus
attattctcatttagtgcccctgta

SEQ ID NO: 277755 - DNA, 25 bp, Mus musculus
attattctctaaccctcaatttgcg

SEQ ID NO: 277756 - DNA, 25 bp, Mus musculus
attattctctaagcctcaatttgcg

SEQ ID NO: 277757 - DNA, 25 bp, Mus musculus
attattctggctatctggctttcac

SEQ ID NO: 277758 - DNA, 25 bp, Mus musculus
attattctggctttctggctttcac

SEQ ID NO: 277759 - DNA, 25 bp, Mus musculus
attattcttgtaacacctctggttt

SEQ ID NO: 277760 - DNA, 25 bp, Mus musculus
attattcttgtatcacctctggttt

SEQ ID NO: 277761 - DNA, 25 bp, Mus musculus
attattgaaacaatatgcgacgatg

SEQ ID NO: 277762 - DNA, 25 bp, Mus musculus
attattgaaacattatgcgacgatg

SEQ ID NO: 277763 - DNA, 25 bp, Mus musculus
attattgaacccaagctgtggcaag

SEQ ID NO: 277764 - DNA, 25 bp, Mus musculus
attattgaaccctagctgtggcaag

SEQ ID NO: 277765 - DNA, 25 bp, Mus musculus
attattgaagacactccttaccccg

SEQ ID NO: 277766 - DNA, 25 bp, Mus musculus
attattgaagactctccttaccccg

SEQ ID NO: 277767 - DNA, 25 bp, Mus musculus
attattgaagtcattctcctttgcc

SEQ ID NO: 277768 - DNA, 25 bp, Mus musculus
attattgaagtctttctcctttgcc

SEQ ID NO: 277769 - DNA, 25 bp, Mus musculus
attattgaccagattatcccggtgt

SEQ ID NO: 277770 - DNA, 25 bp, Mus musculus
attattgaccagtttatcccggtgt

SEQ ID NO: 277771 - DNA, 25 bp, Mus musculus
attattgacccgctggacaccaggc

SEQ ID NO: 277772 - DNA, 25 bp, Mus musculus
attattgacccggtggacaccaggc

SEQ ID NO: 277773 - DNA, 25 bp, Mus musculus
attattgagaggacctggcctgccg

SEQ ID NO: 277774 - DNA, 25 bp, Mus musculus
attattgagaggtcctggcctgccg

SEQ ID NO: 277775 - DNA, 25 bp, Mus musculus
attattgagccacttcacaagcctc

SEQ ID NO: 277776 - DNA, 25 bp, Mus musculus
attattgagccagttcacaagcctc

SEQ ID NO: 277777 - DNA, 25 bp, Mus musculus
attattgagccgataccagcatccc

SEQ ID NO: 277778 - DNA, 25 bp, Mus musculus
attattgagccgttaccagcatccc

SEQ ID NO: 277779 - DNA, 25 bp, Mus musculus
attattgatctacgatatgccaagg

SEQ ID NO: 277780 - DNA, 25 bp, Mus musculus
attattgatctaggatatgccaagg

SEQ ID NO: 277781 - DNA, 25 bp, Mus musculus
attattgatggcctctggtcttttc

SEQ ID NO: 277782 - DNA, 25 bp, Mus musculus
attattgatggcgtctggtcttttc

SEQ ID NO: 277783 - DNA, 25 bp, Mus musculus
attattgatgtgactgtccgggccc

SEQ ID NO: 277784 - DNA, 25 bp, Mus musculus
attattgatgtgtctgtccgggccc

SEQ ID NO: 277785 - DNA, 25 bp, Mus musculus
attattgcagttcctcttacgagct

SEQ ID NO: 277786 - DNA, 25 bp, Mus musculus
attattgcagttgctcttacgagct

SEQ ID NO: 277787 - DNA, 25 bp, Mus musculus
attattgcccagatgttttagaagt

SEQ ID NO: 277788 - DNA, 25 bp, Mus musculus
attattgcccagttgttttagaagt

SEQ ID NO: 277789 - DNA, 25 bp, Mus musculus
attattgccttcacccctaatagca

SEQ ID NO: 277790 - DNA, 25 bp, Mus musculus
attattgccttctcccctaatagca

SEQ ID NO: 277791 - DNA, 25 bp, Mus musculus
attattgcgtatatggacccatttc

SEQ ID NO: 277792 - DNA, 25 bp, Mus musculus
attattgcgtatttggacccatttc

SEQ ID NO: 277793 - DNA, 25 bp, Mus musculus
attattgctcttacgaatgtgcata

SEQ ID NO: 277794 - DNA, 25 bp, Mus musculus
attattgctctttcgaatgtgcata

SEQ ID NO: 277795 - DNA, 25 bp, Mus musculus
attattgctgcactcagatgtcaga

SEQ ID NO: 277796 - DNA, 25 bp, Mus musculus
attattgctgcagtcagatgtcaga

SEQ ID NO: 277797 - DNA, 25 bp, Mus musculus
attattgctgctattttctgcctcc

SEQ ID NO: 277798 - DNA, 25 bp, Mus musculus
attattgctgcttttttctgcctcc

SEQ ID NO: 277799 - DNA, 25 bp, Mus musculus
attattggatctcctgaatgaaggc

SEQ ID NO: 277800 - DNA, 25 bp, Mus musculus
attattggatctgctgaatgaaggc

SEQ ID NO: 277801 - DNA, 25 bp, Mus musculus
attattggccttcgcctagaccttt

SEQ ID NO: 277802 - DNA, 25 bp, Mus musculus
attattggccttggcctagaccttt

SEQ ID NO: 277803 - DNA, 25 bp, Mus musculus
attattgtaactaccagtgccctgg

SEQ ID NO: 277804 - DNA, 25 bp, Mus musculus
attattgtaacttccagtgccctgg

SEQ ID NO: 277805 - DNA, 25 bp, Mus musculus
attattgtacctcaacttacagttt

SEQ ID NO: 277806 - DNA, 25 bp, Mus musculus
attattgtacctgaacttacagttt

SEQ ID NO: 277807 - DNA, 25 bp, Mus musculus
attattgtctcgatgtgcacagcca

SEQ ID NO: 277808 - DNA, 25 bp, Mus musculus
attattgtctcgttgtgcacagcca

SEQ ID NO: 277809 - DNA, 25 bp, Mus musculus
attattgtcttgaaagtctcccgct

SEQ ID NO: 277810 - DNA, 25 bp, Mus musculus
attattgtcttgtaagtctcccgct

SEQ ID NO: 277811 - DNA, 25 bp, Mus musculus
attattgtggtcacactgtccactg

SEQ ID NO: 277812 - DNA, 25 bp, Mus musculus
attattgtggtctcactgtccactg

SEQ ID NO: 277813 - DNA, 25 bp, Mus musculus
attattgtgtttagtgctactgtag

SEQ ID NO: 277814 - DNA, 25 bp, Mus musculus
attattgtgttttgtgctactgtag

SEQ ID NO: 277815 - DNA, 25 bp, Mus musculus
attattgttctcagacaaaaaccac

SEQ ID NO: 277816 - DNA, 25 bp, Mus musculus
attattgttctctgacaaaaaccac

SEQ ID NO: 277817 - DNA, 25 bp, Mus musculus
attattgtttgaagtttttcacaca

SEQ ID NO: 277818 - DNA, 25 bp, Mus musculus
attattgtttgatgtttttcacaca

SEQ ID NO: 277819 - DNA, 25 bp, Mus musculus
attatttactgaaaacacttccaaa

SEQ ID NO: 277820 - DNA, 25 bp, Mus musculus
attatttactgataacacttccaaa

SEQ ID NO: 277821 - DNA, 25 bp, Mus musculus
attatttagactagtatttagaacg

SEQ ID NO: 277822 - DNA, 25 bp, Mus musculus
attatttagacttgtatttagaacg

SEQ ID NO: 277823 - DNA, 25 bp, Mus musculus
attatttagctacccactgtgttac

SEQ ID NO: 277824 - DNA, 25 bp, Mus musculus
attatttagctagccactgtgttac

SEQ ID NO: 277825 - DNA, 25 bp, Mus musculus
attatttataggcacagcacccctc

SEQ ID NO: 277826 - DNA, 25 bp, Mus musculus
attatttatagggacagcacccctc

SEQ ID NO: 277827 - DNA, 25 bp, Mus musculus
attatttcacccatgtgctttctca

SEQ ID NO: 277828 - DNA, 25 bp, Mus musculus
attatttcacccttgtgctttctca

SEQ ID NO: 277829 - DNA, 25 bp, Mus musculus
attatttcacttctcattgcttaag

SEQ ID NO: 277830 - DNA, 25 bp, Mus musculus
attatttcacttgtcattgcttaag

SEQ ID NO: 277831 - DNA, 25 bp, Mus musculus
attatttcatgcacttcctacctta

SEQ ID NO: 277832 - DNA, 25 bp, Mus musculus
attatttcatgctcttcctacctta

SEQ ID NO: 277833 - DNA, 25 bp, Mus musculus
attatttccatgaagttctccgagg

SEQ ID NO: 277834 - DNA, 25 bp, Mus musculus
attatttccatgtagttctccgagg

SEQ ID NO: 277835 - DNA, 25 bp, Mus musculus
attatttccattaccctctcttatt

SEQ ID NO: 277836 - DNA, 25 bp, Mus musculus
attatttccatttccctctcttatt

SEQ ID NO: 277837 - DNA, 25 bp, Mus musculus
attatttcccataccactcagttct

SEQ ID NO: 277838 - DNA, 25 bp, Mus musculus
attatttcccattccactcagttct

SEQ ID NO: 277839 - DNA, 25 bp, Mus musculus
attatttctctgatggtttgtacca

SEQ ID NO: 277840 - DNA, 25 bp, Mus musculus
attatttctctgttggtttgtacca

SEQ ID NO: 277841 - DNA, 25 bp, Mus musculus
attatttctgctaaacctctgaggt

SEQ ID NO: 277842 - DNA, 25 bp, Mus musculus
attatttctgcttaacctctgaggt

SEQ ID NO: 277843 - DNA, 25 bp, Mus musculus
attatttctgtgacctggaaccatg

SEQ ID NO: 277844 - DNA, 25 bp, Mus musculus
attatttctgtgtcctggaaccatg

SEQ ID NO: 277845 - DNA, 25 bp, Mus musculus
attatttgacagaagtgcctcttat

SEQ ID NO: 277846 - DNA, 25 bp, Mus musculus
attatttgacagtagtgcctcttat

SEQ ID NO: 277847 - DNA, 25 bp, Mus musculus
attatttgagatatctttttgtgaa

SEQ ID NO: 277848 - DNA, 25 bp, Mus musculus
attatttgagatttctttttgtgaa

SEQ ID NO: 277849 - DNA, 25 bp, Mus musculus
attatttgcctgatggattggaaaa

SEQ ID NO: 277850 - DNA, 25 bp, Mus musculus
attatttgcctgttggattggaaaa

SEQ ID NO: 277851 - DNA, 25 bp, Mus musculus
attatttggtatatccagtggccta

SEQ ID NO: 277852 - DNA, 25 bp, Mus musculus
attatttggtatttccagtggccta

SEQ ID NO: 277853 - DNA, 25 bp, Mus musculus
attatttgtaaacttacctgctgtt

SEQ ID NO: 277854 - DNA, 25 bp, Mus musculus
attatttgtaaagttacctgctgtt

SEQ ID NO: 277855 - DNA, 25 bp, Mus musculus
attatttgtaacaggccatgcaacc

SEQ ID NO: 277856 - DNA, 25 bp, Mus musculus
attatttgtaactggccatgcaacc

SEQ ID NO: 277857 - DNA, 25 bp, Mus musculus
attatttgtgagcttttgtctgtat

SEQ ID NO: 277858 - DNA, 25 bp, Mus musculus
attatttgtgaggttttgtctgtat

SEQ ID NO: 277859 - DNA, 25 bp, Mus musculus
attatttgtgcgcaatgccagccct

SEQ ID NO: 277860 - DNA, 25 bp, Mus musculus
attatttgtgcggaatgccagccct

SEQ ID NO: 277861 - DNA, 25 bp, Mus musculus
attatttgttctacctatgccacac

SEQ ID NO: 277862 - DNA, 25 bp, Mus musculus
attatttgttcttcctatgccacac

SEQ ID NO: 277863 - DNA, 25 bp, Mus musculus
attattttaaacctgagattctcac

SEQ ID NO: 277864 - DNA, 25 bp, Mus musculus
attattttaaacgtgagattctcac

SEQ ID NO: 277865 - DNA, 25 bp, Mus musculus
attattttacttcccagagctgcca

SEQ ID NO: 277866 - DNA, 25 bp, Mus musculus
attattttacttgccagagctgcca

SEQ ID NO: 277867 - DNA, 25 bp, Mus musculus
attattttatccctatatggaaaag

SEQ ID NO: 277868 - DNA, 25 bp, Mus musculus
attattttatccgtatatggaaaag

SEQ ID NO: 277869 - DNA, 25 bp, Mus musculus
attattttcattctcatagcaaggg

SEQ ID NO: 277870 - DNA, 25 bp, Mus musculus
attattttcattgtcatagcaaggg

SEQ ID NO: 277871 - DNA, 25 bp, Mus musculus
attattttccaacaacagtcctgag

SEQ ID NO: 277872 - DNA, 25 bp, Mus musculus
attattttccaagaacagtcctgag

SEQ ID NO: 277873 - DNA, 25 bp, Mus musculus
attattttccatctcagggttgtaa

SEQ ID NO: 277874 - DNA, 25 bp, Mus musculus
attattttccatgtcagggttgtaa

SEQ ID NO: 277875 - DNA, 25 bp, Mus musculus
attattttcccacttatgctttcca

SEQ ID NO: 277876 - DNA, 25 bp, Mus musculus
attattttcccagttatgctttcca

SEQ ID NO: 277877 - DNA, 25 bp, Mus musculus
attattttccctatgctggatctgc

SEQ ID NO: 277878 - DNA, 25 bp, Mus musculus
attattttccctttgctggatctgc

SEQ ID NO: 277879 - DNA, 25 bp, Mus musculus
attattttctctcctatttcataac

SEQ ID NO: 277880 - DNA, 25 bp, Mus musculus
attattttctctgctatttcataac

SEQ ID NO: 277881 - DNA, 25 bp, Mus musculus
attattttctgtatcgtagtcttgt

SEQ ID NO: 277882 - DNA, 25 bp, Mus musculus
attattttctgtttcgtagtcttgt

SEQ ID NO: 277883 - DNA, 25 bp, Mus musculus
attattttgatcataacctcacagg

SEQ ID NO: 277884 - DNA, 25 bp, Mus musculus
attattttgatcttaacctcacagg

SEQ ID NO: 277885 - DNA, 25 bp, Mus musculus
attattttgcatcccacatgtgctg

SEQ ID NO: 277886 - DNA, 25 bp, Mus musculus
attattttgcatgccacatgtgctg

SEQ ID NO: 277887 - DNA, 25 bp, Mus musculus
attattttgctaagagactgtatgc

SEQ ID NO: 277888 - DNA, 25 bp, Mus musculus
attattttgctatgagactgtatgc

SEQ ID NO: 277889 - DNA, 25 bp, Mus musculus
attattttgggcaggtgcaggctcc

SEQ ID NO: 277890 - DNA, 25 bp, Mus musculus
attattttgggctggtgcaggctcc

SEQ ID NO: 277891 - DNA, 25 bp, Mus musculus
attatttttactaaactgagctcaa

SEQ ID NO: 277892 - DNA, 25 bp, Mus musculus
attatttttacttaactgagctcaa

SEQ ID NO: 277893 - DNA, 25 bp, Mus musculus
attatttttatcatctagcttccag

SEQ ID NO: 277894 - DNA, 25 bp, Mus musculus
attatttttatcttctagcttccag

SEQ ID NO: 277895 - DNA, 25 bp, Mus musculus
attatttttcaaagtgcacctgcca

SEQ ID NO: 277896 - DNA, 25 bp, Mus musculus
attatttttcaatgtgcacctgcca

SEQ ID NO: 277897 - DNA, 25 bp, Mus musculus
attatttttgggactgtgctttctg

SEQ ID NO: 277898 - DNA, 25 bp, Mus musculus
attatttttgggtctgtgctttctg

SEQ ID NO: 277899 - DNA, 25 bp, Mus musculus
attcaaaactcaaccccagaggagg

SEQ ID NO: 277900 - DNA, 25 bp, Mus musculus
attcaaaactcatccccagaggagg

SEQ ID NO: 277901 - DNA, 25 bp, Mus musculus
attcaaaatctacggttccacccag

SEQ ID NO: 277902 - DNA, 25 bp, Mus musculus
attcaaaatctagggttccacccag

SEQ ID NO: 277903 - DNA, 25 bp, Mus musculus
attcaaacatttcagctccagaatg

SEQ ID NO: 277904 - DNA, 25 bp, Mus musculus
attcaaacatttgagctccagaatg

SEQ ID NO: 277905 - DNA, 25 bp, Mus musculus
attcaaaccacccaagatcacattt

SEQ ID NO: 277906 - DNA, 25 bp, Mus musculus
attcaaaccaccgaagatcacattt

SEQ ID NO: 277907 - DNA, 25 bp, Mus musculus
attcaaaccagcacacttgggtaac

SEQ ID NO: 277908 - DNA, 25 bp, Mus musculus
attcaaaccagctcacttgggtaac

SEQ ID NO: 277909 - DNA, 25 bp, Mus musculus
attcaaaccctcacaccagtaaagg

SEQ ID NO: 277910 - DNA, 25 bp, Mus musculus
attcaaaccctctcaccagtaaagg

SEQ ID NO: 277911 - DNA, 25 bp, Mus musculus
attcaaaccgtaccactgggcattt

SEQ ID NO: 277912 - DNA, 25 bp, Mus musculus
attcaaaccgtagcactgggcattt

SEQ ID NO: 277913 - DNA, 25 bp, Mus musculus
attcaaaccttgacacactgtggga

SEQ ID NO: 277914 - DNA, 25 bp, Mus musculus
attcaaaccttgtcacactgtggga

SEQ ID NO: 277915 - DNA, 25 bp, Mus musculus
attcaaacgcgaagtcagagcccca

SEQ ID NO: 277916 - DNA, 25 bp, Mus musculus
attcaaacgcgatgtcagagcccca

SEQ ID NO: 277917 - DNA, 25 bp, Mus musculus
attcaaacgcggctaggtgtcactg

SEQ ID NO: 277918 - DNA, 25 bp, Mus musculus
attcaaacgcgggtaggtgtcactg

SEQ ID NO: 277919 - DNA, 25 bp, Mus musculus
attcaaacgcttaccatttaagcaa

SEQ ID NO: 277920 - DNA, 25 bp, Mus musculus
attcaaacgctttccatttaagcaa

SEQ ID NO: 277921 - DNA, 25 bp, Mus musculus
attcaaagccttaatgcagatgcac

SEQ ID NO: 277922 - DNA, 25 bp, Mus musculus
attcaaagcctttatgcagatgcac

SEQ ID NO: 277923 - DNA, 25 bp, Mus musculus
attcaaagctgaactgtctctcaca

SEQ ID NO: 277924 - DNA, 25 bp, Mus musculus
attcaaagctgatctgtctctcaca

SEQ ID NO: 277925 - DNA, 25 bp, Mus musculus
attcaaagctttctaccaacctcct

SEQ ID NO: 277926 - DNA, 25 bp, Mus musculus
attcaaagctttgtaccaacctcct

SEQ ID NO: 277927 - DNA, 25 bp, Mus musculus
attcaaaggaataagccgggcagca

SEQ ID NO: 277928 - DNA, 25 bp, Mus musculus
attcaaaggaattagccgggcagca

SEQ ID NO: 277929 - DNA, 25 bp, Mus musculus
attcaaaggcacacagtcagccaaa

SEQ ID NO: 277930 - DNA, 25 bp, Mus musculus
attcaaaggcactcagtcagccaaa

SEQ ID NO: 277931 - DNA, 25 bp, Mus musculus
attcaaaggtatccctatccctcag

SEQ ID NO: 277932 - DNA, 25 bp, Mus musculus
attcaaaggtatgcctatccctcag

SEQ ID NO: 277933 - DNA, 25 bp, Mus musculus
attcaaagtcacagacgcccgggat

SEQ ID NO: 277934 - DNA, 25 bp, Mus musculus
attcaaagtcactgacgcccgggat

SEQ ID NO: 277935 - DNA, 25 bp, Mus musculus
attcaaagttggatcctaagtagca

SEQ ID NO: 277936 - DNA, 25 bp, Mus musculus
attcaaagttggttcctaagtagca

SEQ ID NO: 277937 - DNA, 25 bp, Mus musculus
attcaaatacctccaattgtttagt

SEQ ID NO: 277938 - DNA, 25 bp, Mus musculus
attcaaatacctgcaattgtttagt

SEQ ID NO: 277939 - DNA, 25 bp, Mus musculus
attcaaatctgcagagctacctcta

SEQ ID NO: 277940 - DNA, 25 bp, Mus musculus
attcaaatctgctgagctacctcta

SEQ ID NO: 277941 - DNA, 25 bp, Mus musculus
attcaaatcttgagcactgcactgc

SEQ ID NO: 277942 - DNA, 25 bp, Mus musculus
attcaaatcttgtgcactgcactgc

SEQ ID NO: 277943 - DNA, 25 bp, Mus musculus
attcaaatgattccaaccccgttag

SEQ ID NO: 277944 - DNA, 25 bp, Mus musculus
attcaaatgattgcaaccccgttag

SEQ ID NO: 277945 - DNA, 25 bp, Mus musculus
attcaaatgtggaagccgtgccccg

SEQ ID NO: 277946 - DNA, 25 bp, Mus musculus
attcaaatgtggtagccgtgccccg

SEQ ID NO: 277947 - DNA, 25 bp, Mus musculus
attcaaattacaaccctcctctgtc

SEQ ID NO: 277948 - DNA, 25 bp, Mus musculus
attcaaattacatccctcctctgtc

SEQ ID NO: 277949 - DNA, 25 bp, Mus musculus
attcaaatttcccaagtctatcata

SEQ ID NO: 277950 - DNA, 25 bp, Mus musculus
attcaaatttccgaagtctatcata

SEQ ID NO: 277951 - DNA, 25 bp, Mus musculus
attcaacaaactcactaaagtagac

SEQ ID NO: 277952 - DNA, 25 bp, Mus musculus
attcaacaaactgactaaagtagac

SEQ ID NO: 277953 - DNA, 25 bp, Mus musculus
attcaacaagctacatgctcatata

SEQ ID NO: 277954 - DNA, 25 bp, Mus musculus
attcaacaagcttcatgctcatata

SEQ ID NO: 277955 - DNA, 25 bp, Mus musculus
attcaacaatctactgatccctagg

SEQ ID NO: 277956 - DNA, 25 bp, Mus musculus
attcaacaatcttctgatccctagg

SEQ ID NO: 277957 - DNA, 25 bp, Mus musculus
attcaacaccggaaagatggctcac

SEQ ID NO: 277958 - DNA, 25 bp, Mus musculus
attcaacaccggtaagatggctcac

SEQ ID NO: 277959 - DNA, 25 bp, Mus musculus
attcaacaccttaggcctgtatggg

SEQ ID NO: 277960 - DNA, 25 bp, Mus musculus
attcaacacctttggcctgtatggg

SEQ ID NO: 277961 - DNA, 25 bp, Mus musculus
attcaacaggtacacatggcggcac

SEQ ID NO: 277962 - DNA, 25 bp, Mus musculus
attcaacaggtagacatggcggcac

SEQ ID NO: 277963 - DNA, 25 bp, Mus musculus
attcaacatctaaggctgcaagggc

SEQ ID NO: 277964 - DNA, 25 bp, Mus musculus
attcaacatctatggctgcaagggc

SEQ ID NO: 277965 - DNA, 25 bp, Mus musculus
attcaacatgacaattctttcataa

SEQ ID NO: 277966 - DNA, 25 bp, Mus musculus
attcaacatgactattctttcataa

SEQ ID NO: 277967 - DNA, 25 bp, Mus musculus
attcaacatgtaattattgtccttt

SEQ ID NO: 277968 - DNA, 25 bp, Mus musculus
attcaacatgtatttattgtccttt

SEQ ID NO: 277969 - DNA, 25 bp, Mus musculus
attcaacattcccaagacactcata

SEQ ID NO: 277970 - DNA, 25 bp, Mus musculus
attcaacattccgaagacactcata

SEQ ID NO: 277971 - DNA, 25 bp, Mus musculus
attcaaccaacaccagagaactggg

SEQ ID NO: 277972 - DNA, 25 bp, Mus musculus
attcaaccaacagcagagaactggg

SEQ ID NO: 277973 - DNA, 25 bp, Mus musculus
attcaaccatgcatctatgacctca

SEQ ID NO: 277974 - DNA, 25 bp, Mus musculus
attcaaccatgcttctatgacctca

SEQ ID NO: 277975 - DNA, 25 bp, Mus musculus
attcaacccaagcagcatacccgtg

SEQ ID NO: 277976 - DNA, 25 bp, Mus musculus
attcaacccaaggagcatacccgtg

SEQ ID NO: 277977 - DNA, 25 bp, Mus musculus
attcaacccacacgactaacgtgat

SEQ ID NO: 277978 - DNA, 25 bp, Mus musculus
attcaacccacaggactaacgtgat

SEQ ID NO: 277979 - DNA, 25 bp, Mus musculus
attcaacctgaacttcatctctcct

SEQ ID NO: 277980 - DNA, 25 bp, Mus musculus
attcaacctgaagttcatctctcct

SEQ ID NO: 277981 - DNA, 25 bp, Mus musculus
attcaacctgctattttagccatgg

SEQ ID NO: 277982 - DNA, 25 bp, Mus musculus
attcaacctgcttttttagccatgg

SEQ ID NO: 277983 - DNA, 25 bp, Mus musculus
attcaacctggtcaacacatgaaga

SEQ ID NO: 277984 - DNA, 25 bp, Mus musculus
attcaacctggtgaacacatgaaga

SEQ ID NO: 277985 - DNA, 25 bp, Mus musculus
attcaacgtaaaacccatccattct

SEQ ID NO: 277986 - DNA, 25 bp, Mus musculus
attcaacgtaaatcccatccattct

SEQ ID NO: 277987 - DNA, 25 bp, Mus musculus
attcaacgttctccacgaagtcggc

SEQ ID NO: 277988 - DNA, 25 bp, Mus musculus
attcaacgttctgcacgaagtcggc

SEQ ID NO: 277989 - DNA, 25 bp, Mus musculus
attcaactaggccatttgcttcact

SEQ ID NO: 277990 - DNA, 25 bp, Mus musculus
attcaactaggcgatttgcttcact

SEQ ID NO: 277991 - DNA, 25 bp, Mus musculus
attcaactcaccaatgttactcttc

SEQ ID NO: 277992 - DNA, 25 bp, Mus musculus
attcaactcacctatgttactcttc

SEQ ID NO: 277993 - DNA, 25 bp, Mus musculus
attcaactccctcttttagtctgct

SEQ ID NO: 277994 - DNA, 25 bp, Mus musculus
attcaactccctgttttagtctgct

SEQ ID NO: 277995 - DNA, 25 bp, Mus musculus
attcaactgtaaaagcccgttcctt

SEQ ID NO: 277996 - DNA, 25 bp, Mus musculus
attcaactgtaatagcccgttcctt

SEQ ID NO: 277997 - DNA, 25 bp, Mus musculus
attcaactgtgactcttggatcccc

SEQ ID NO: 277998 - DNA, 25 bp, Mus musculus
attcaactgtgagtcttggatcccc

SEQ ID NO: 277999 - DNA, 25 bp, Mus musculus
attcaacttgagatttccctgggct

SEQ ID NO: 278000 - DNA, 25 bp, Mus musculus
attcaacttgagttttccctgggct

SEQ ID NO: 278001 - DNA, 25 bp, Mus musculus
attcaactttgaaggcttccggatc

SEQ ID NO: 278002 - DNA, 25 bp, Mus musculus
attcaactttgatggcttccggatc

SEQ ID NO: 278003 - DNA, 25 bp, Mus musculus
attcaagaaataccgccttccttca

SEQ ID NO: 278004 - DNA, 25 bp, Mus musculus
attcaagaaatagcgccttccttca

SEQ ID NO: 278005 - DNA, 25 bp, Mus musculus
attcaagaaggccacatttcctggg

SEQ ID NO: 278006 - DNA, 25 bp, Mus musculus
attcaagaaggcgacatttcctggg

SEQ ID NO: 278007 - DNA, 25 bp, Mus musculus
attcaagaatggcaccgagagcaga

SEQ ID NO: 278008 - DNA, 25 bp, Mus musculus
attcaagaatgggaccgagagcaga

SEQ ID NO: 278009 - DNA, 25 bp, Mus musculus
attcaagacaatattctgctcacaa

SEQ ID NO: 278010 - DNA, 25 bp, Mus musculus
attcaagacaattttctgctcacaa

SEQ ID NO: 278011 - DNA, 25 bp, Mus musculus
attcaagaccttatgctggttcctg

SEQ ID NO: 278012 - DNA, 25 bp, Mus musculus
attcaagaccttttgctggttcctg

SEQ ID NO: 278013 - DNA, 25 bp, Mus musculus
attcaagatgacctgggactgggaa

SEQ ID NO: 278014 - DNA, 25 bp, Mus musculus
attcaagatgacgtgggactgggaa

SEQ ID NO: 278015 - DNA, 25 bp, Mus musculus
attcaagattgtattagctgtcctg

SEQ ID NO: 278016 - DNA, 25 bp, Mus musculus
attcaagattgttttagctgtcctg

SEQ ID NO: 278017 - DNA, 25 bp, Mus musculus
attcaagcaaaaacccagcagagag

SEQ ID NO: 278018 - DNA, 25 bp, Mus musculus
attcaagcaaaatcccagcagagag

SEQ ID NO: 278019 - DNA, 25 bp, Mus musculus
attcaagcaactctacggagcggca

SEQ ID NO: 278020 - DNA, 25 bp, Mus musculus
attcaagcaactgtacggagcggca

SEQ ID NO: 278021 - DNA, 25 bp, Mus musculus
attcaagcatacacccttggccttc

SEQ ID NO: 278022 - DNA, 25 bp, Mus musculus
attcaagcatactcccttggccttc

SEQ ID NO: 278023 - DNA, 25 bp, Mus musculus
attcaagccaccacaatagctttgt

SEQ ID NO: 278024 - DNA, 25 bp, Mus musculus
attcaagccacctcaatagctttgt

SEQ ID NO: 278025 - DNA, 25 bp, Mus musculus
attcaagccctacacctgtgggaaa

SEQ ID NO: 278026 - DNA, 25 bp, Mus musculus
attcaagccctagacctgtgggaaa

SEQ ID NO: 278027 - DNA, 25 bp, Mus musculus
attcaagcctgcagtgataggagtc

SEQ ID NO: 278028 - DNA, 25 bp, Mus musculus
attcaagcctgctgtgataggagtc

SEQ ID NO: 278029 - DNA, 25 bp, Mus musculus
attcaagctaacagccttctaggtt

SEQ ID NO: 278030 - DNA, 25 bp, Mus musculus
attcaagctaactgccttctaggtt

SEQ ID NO: 278031 - DNA, 25 bp, Mus musculus
attcaagctacaatttcgttttatg

SEQ ID NO: 278032 - DNA, 25 bp, Mus musculus
attcaagctacattttcgttttatg

SEQ ID NO: 278033 - DNA, 25 bp, Mus musculus
attcaagcttcaccttatcagagga

SEQ ID NO: 278034 - DNA, 25 bp, Mus musculus
attcaagcttcagcttatcagagga

SEQ ID NO: 278035 - DNA, 25 bp, Mus musculus
attcaaggaacacacgctggccgtt

SEQ ID NO: 278036 - DNA, 25 bp, Mus musculus
attcaaggaacagacgctggccgtt

SEQ ID NO: 278037 - DNA, 25 bp, Mus musculus
attcaaggaagcattctccctattc

SEQ ID NO: 278038 - DNA, 25 bp, Mus musculus
attcaaggaagctttctccctattc

SEQ ID NO: 278039 - DNA, 25 bp, Mus musculus
attcaaggaatactgcatagctgat

SEQ ID NO: 278040 - DNA, 25 bp, Mus musculus
attcaaggaatagtgcatagctgat

SEQ ID NO: 278041 - DNA, 25 bp, Mus musculus
attcaaggaatcctgtagttgctgc

SEQ ID NO: 278042 - DNA, 25 bp, Mus musculus
attcaaggaatcgtgtagttgctgc

SEQ ID NO: 278043 - DNA, 25 bp, Mus musculus
attcaaggattgaatgacttcacaa

SEQ ID NO: 278044 - DNA, 25 bp, Mus musculus
attcaaggattgtatgacttcacaa

SEQ ID NO: 278045 - DNA, 25 bp, Mus musculus
attcaaggcccaccataaattccac

SEQ ID NO: 278046 - DNA, 25 bp, Mus musculus
attcaaggcccagcataaattccac

SEQ ID NO: 278047 - DNA, 25 bp, Mus musculus
attcaaggccccagacaggccagca

SEQ ID NO: 278048 - DNA, 25 bp, Mus musculus
attcaaggcccctgacaggccagca

SEQ ID NO: 278049 - DNA, 25 bp, Mus musculus
attcaaggctctacttcaagcacca

SEQ ID NO: 278050 - DNA, 25 bp, Mus musculus
attcaaggctcttcttcaagcacca

SEQ ID NO: 278051 - DNA, 25 bp, Mus musculus
attcaagggacgcaactcctctgga

SEQ ID NO: 278052 - DNA, 25 bp, Mus musculus
attcaagggacggaactcctctgga

SEQ ID NO: 278053 - DNA, 25 bp, Mus musculus
attcaagggcatcgtctgcggcgac

SEQ ID NO: 278054 - DNA, 25 bp, Mus musculus
attcaagggcatggtctgcggcgac

SEQ ID NO: 278055 - DNA, 25 bp, Mus musculus
attcaagggcttcctattctaggta

SEQ ID NO: 278056 - DNA, 25 bp, Mus musculus
attcaagggcttgctattctaggta

SEQ ID NO: 278057 - DNA, 25 bp, Mus musculus
attcaaggttccctgagaacccctg

SEQ ID NO: 278058 - DNA, 25 bp, Mus musculus
attcaaggttccgtgagaacccctg

SEQ ID NO: 278059 - DNA, 25 bp, Mus musculus
attcaaggttctaagcactgcacta

SEQ ID NO: 278060 - DNA, 25 bp, Mus musculus
attcaaggttcttagcactgcacta

SEQ ID NO: 278061 - DNA, 25 bp, Mus musculus
attcaagtaaacagagctcctccca

SEQ ID NO: 278062 - DNA, 25 bp, Mus musculus
attcaagtaaactgagctcctccca

SEQ ID NO: 278063 - DNA, 25 bp, Mus musculus
attcaagtacccagttgtcaacgtt

SEQ ID NO: 278064 - DNA, 25 bp, Mus musculus
attcaagtaccctgttgtcaacgtt

SEQ ID NO: 278065 - DNA, 25 bp, Mus musculus
attcaagtagagaacaggctaggct

SEQ ID NO: 278066 - DNA, 25 bp, Mus musculus
attcaagtagagtacaggctaggct

SEQ ID NO: 278067 - DNA, 25 bp, Mus musculus
attcaagtccagaatcagtattaaa

SEQ ID NO: 278068 - DNA, 25 bp, Mus musculus
attcaagtccagtatcagtattaaa

SEQ ID NO: 278069 - DNA, 25 bp, Mus musculus
attcaagtcgttacagaacacacag

SEQ ID NO: 278070 - DNA, 25 bp, Mus musculus
attcaagtcgtttcagaacacacag

SEQ ID NO: 278071 - DNA, 25 bp, Mus musculus
attcaagtctggacatttatttccc

SEQ ID NO: 278072 - DNA, 25 bp, Mus musculus
attcaagtctggtcatttatttccc

SEQ ID NO: 278073 - DNA, 25 bp, Mus musculus
attcaagtctttcggtgccatacca

SEQ ID NO: 278074 - DNA, 25 bp, Mus musculus
attcaagtctttgggtgccatacca

SEQ ID NO: 278075 - DNA, 25 bp, Mus musculus
attcaagtgagcagatgcccacggt

SEQ ID NO: 278076 - DNA, 25 bp, Mus musculus
attcaagtgagctgatgcccacggt

SEQ ID NO: 278077 - DNA, 25 bp, Mus musculus
attcaagtgaggatccaggagacaa

SEQ ID NO: 278078 - DNA, 25 bp, Mus musculus
attcaagtgaggttccaggagacaa

SEQ ID NO: 278079 - DNA, 25 bp, Mus musculus
attcaagttcatctttatgtctatg

SEQ ID NO: 278080 - DNA, 25 bp, Mus musculus
attcaagttcatgtttatgtctatg

SEQ ID NO: 278081 - DNA, 25 bp, Mus musculus
attcaagttcgaatgatttcctgct

SEQ ID NO: 278082 - DNA, 25 bp, Mus musculus
attcaagttcgattgatttcctgct

SEQ ID NO: 278083 - DNA, 25 bp, Mus musculus
attcaagttctacttctggtgaaag

SEQ ID NO: 278084 - DNA, 25 bp, Mus musculus
attcaagttctagttctggtgaaag

SEQ ID NO: 278085 - DNA, 25 bp, Mus musculus
attcaagttgtaagtcttccctacc

SEQ ID NO: 278086 - DNA, 25 bp, Mus musculus
attcaagttgtatgtcttccctacc

SEQ ID NO: 278087 - DNA, 25 bp, Mus musculus
attcaagtttgacgtgaaccctttg

SEQ ID NO: 278088 - DNA, 25 bp, Mus musculus
attcaagtttgaggtgaaccctttg

SEQ ID NO: 278089 - DNA, 25 bp, Mus musculus
attcaagttttccagctctacagag

SEQ ID NO: 278090 - DNA, 25 bp, Mus musculus
attcaagttttcgagctctacagag

SEQ ID NO: 278091 - DNA, 25 bp, Mus musculus
attcaataaagaattcccagagaca

SEQ ID NO: 278092 - DNA, 25 bp, Mus musculus
attcaataaagatttcccagagaca

SEQ ID NO: 278093 - DNA, 25 bp, Mus musculus
attcaataccatacagctgtggctt

SEQ ID NO: 278094 - DNA, 25 bp, Mus musculus
attcaataccattcagctgtggctt

SEQ ID NO: 278095 - DNA, 25 bp, Mus musculus
attcaatacctcagtttctttccca

SEQ ID NO: 278096 - DNA, 25 bp, Mus musculus
attcaatacctctgtttctttccca

SEQ ID NO: 278097 - DNA, 25 bp, Mus musculus
attcaatagtctatcacctgtctgc

SEQ ID NO: 278098 - DNA, 25 bp, Mus musculus
attcaatagtctttcacctgtctgc

SEQ ID NO: 278099 - DNA, 25 bp, Mus musculus
attcaatatatccttccaagtatat

SEQ ID NO: 278100 - DNA, 25 bp, Mus musculus
attcaatatatcgttccaagtatat

SEQ ID NO: 278101 - DNA, 25 bp, Mus musculus
attcaatatttcacttactcccaag

SEQ ID NO: 278102 - DNA, 25 bp, Mus musculus
attcaatatttctcttactcccaag

SEQ ID NO: 278103 - DNA, 25 bp, Mus musculus
attcaatcacatcgtgaacctcaag

SEQ ID NO: 278104 - DNA, 25 bp, Mus musculus
attcaatcacatggtgaacctcaag

SEQ ID NO: 278105 - DNA, 25 bp, Mus musculus
attcaatcgtctctatcctgttgtg

SEQ ID NO: 278106 - DNA, 25 bp, Mus musculus
attcaatcgtctgtatcctgttgtg

SEQ ID NO: 278107 - DNA, 25 bp, Mus musculus
attcaatctcccatgtcaatcgtgt

SEQ ID NO: 278108 - DNA, 25 bp, Mus musculus
attcaatctcccttgtcaatcgtgt

SEQ ID NO: 278109 - DNA, 25 bp, Mus musculus
attcaatctcgtcccatggctccat

SEQ ID NO: 278110 - DNA, 25 bp, Mus musculus
attcaatctcgtgccatggctccat

SEQ ID NO: 278111 - DNA, 25 bp, Mus musculus
attcaatctttgacccaaactgtag

SEQ ID NO: 278112 - DNA, 25 bp, Mus musculus
attcaatctttgtcccaaactgtag

SEQ ID NO: 278113 - DNA, 25 bp, Mus musculus
attcaatgaactatgttctgaaggg

SEQ ID NO: 278114 - DNA, 25 bp, Mus musculus
attcaatgaactttgttctgaaggg

SEQ ID NO: 278115 - DNA, 25 bp, Mus musculus
attcaatgagtccagctatccagct

SEQ ID NO: 278116 - DNA, 25 bp, Mus musculus
attcaatgagtcgagctatccagct

SEQ ID NO: 278117 - DNA, 25 bp, Mus musculus
attcaatggcatcgataaaaactac

SEQ ID NO: 278118 - DNA, 25 bp, Mus musculus
attcaatggcatggataaaaactac

SEQ ID NO: 278119 - DNA, 25 bp, Mus musculus
attcaatggcgcagtgtgtcaccac

SEQ ID NO: 278120 - DNA, 25 bp, Mus musculus
attcaatggcgctgtgtgtcaccac

SEQ ID NO: 278121 - DNA, 25 bp, Mus musculus
attcaatgtaccagtaagcctggag

SEQ ID NO: 278122 - DNA, 25 bp, Mus musculus
attcaatgtacctgtaagcctggag

SEQ ID NO: 278123 - DNA, 25 bp, Mus musculus
attcaatgtgctaacctgtgcctct

SEQ ID NO: 278124 - DNA, 25 bp, Mus musculus
attcaatgtgcttacctgtgcctct

SEQ ID NO: 278125 - DNA, 25 bp, Mus musculus
attcaatgttggcagatgcttctca

SEQ ID NO: 278126 - DNA, 25 bp, Mus musculus
attcaatgttgggagatgcttctca

SEQ ID NO: 278127 - DNA, 25 bp, Mus musculus
attcaattagggagtcagctgtgct

SEQ ID NO: 278128 - DNA, 25 bp, Mus musculus
attcaattagggtgtcagctgtgct

SEQ ID NO: 278129 - DNA, 25 bp, Mus musculus
attcaattcctaacccaaagttata

SEQ ID NO: 278130 - DNA, 25 bp, Mus musculus
attcaattcctatcccaaagttata

SEQ ID NO: 278131 - DNA, 25 bp, Mus musculus
attcaatttactatcaccatggtgg

SEQ ID NO: 278132 - DNA, 25 bp, Mus musculus
attcaatttactttcaccatggtgg

SEQ ID NO: 278133 - DNA, 25 bp, Mus musculus
attcaatttaggcagattcttcatg

SEQ ID NO: 278134 - DNA, 25 bp, Mus musculus
attcaatttagggagattcttcatg

SEQ ID NO: 278135 - DNA, 25 bp, Mus musculus
attcaatttcccactggagttccac

SEQ ID NO: 278136 - DNA, 25 bp, Mus musculus
attcaatttccctctggagttccac

SEQ ID NO: 278137 - DNA, 25 bp, Mus musculus
attcaatttctactgtttattccca

SEQ ID NO: 278138 - DNA, 25 bp, Mus musculus
attcaatttctagtgtttattccca

SEQ ID NO: 278139 - DNA, 25 bp, Mus musculus
attcaatttggaatcagaaagctgg

SEQ ID NO: 278140 - DNA, 25 bp, Mus musculus
attcaatttggattcagaaagctgg

SEQ ID NO: 278141 - DNA, 25 bp, Mus musculus
attcaatttgtacctctactagagc

SEQ ID NO: 278142 - DNA, 25 bp, Mus musculus
attcaatttgtagctctactagagc

SEQ ID NO: 278143 - DNA, 25 bp, Mus musculus
attcacaaaagcattacccccacag

SEQ ID NO: 278144 - DNA, 25 bp, Mus musculus
attcacaaaagctttacccccacag

SEQ ID NO: 278145 - DNA, 25 bp, Mus musculus
attcacaaactgctgggccacgaga

SEQ ID NO: 278146 - DNA, 25 bp, Mus musculus
attcacaaactggtgggccacgaga

SEQ ID NO: 278147 - DNA, 25 bp, Mus musculus
attcacaaagctcattcaattcttt

SEQ ID NO: 278148 - DNA, 25 bp, Mus musculus
attcacaaagctgattcaattcttt

SEQ ID NO: 278149 - DNA, 25 bp, Mus musculus
attcacaaatgacagcccctgattt

SEQ ID NO: 278150 - DNA, 25 bp, Mus musculus
attcacaaatgagagcccctgattt

SEQ ID NO: 278151 - DNA, 25 bp, Mus musculus
attcacaagcaaaaacagtcagcag

SEQ ID NO: 278152 - DNA, 25 bp, Mus musculus
attcacaagcaaataggttggttta

SEQ ID NO: 278153 - DNA, 25 bp, Mus musculus
attcacaagcaataacagtcagcag

SEQ ID NO: 278154 - DNA, 25 bp, Mus musculus
attcacaagcaattaggttggttta

SEQ ID NO: 278155 - DNA, 25 bp, Mus musculus
attcacaagcttcaagcagctgctg

SEQ ID NO: 278156 - DNA, 25 bp, Mus musculus
attcacaagcttgaagcagctgctg

SEQ ID NO: 278157 - DNA, 25 bp, Mus musculus
attcacaatatcagaagttccctct

SEQ ID NO: 278158 - DNA, 25 bp, Mus musculus
attcacaatatctgaagttccctct

SEQ ID NO: 278159 - DNA, 25 bp, Mus musculus
attcacacaagcattaccatttcct

SEQ ID NO: 278160 - DNA, 25 bp, Mus musculus
attcacacaagctttaccatttcct

SEQ ID NO: 278161 - DNA, 25 bp, Mus musculus
attcacacaatcatgccaaaagtag

SEQ ID NO: 278162 - DNA, 25 bp, Mus musculus
attcacacaatcttgccaaaagtag

SEQ ID NO: 278163 - DNA, 25 bp, Mus musculus
attcacacacatcgagttgctacag

SEQ ID NO: 278164 - DNA, 25 bp, Mus musculus
attcacacacatggagttgctacag

SEQ ID NO: 278165 - DNA, 25 bp, Mus musculus
attcacacaccaaattcagatcatg

SEQ ID NO: 278166 - DNA, 25 bp, Mus musculus
attcacacaccatattcagatcatg

SEQ ID NO: 278167 - DNA, 25 bp, Mus musculus
attcacacactcattctcaggtgtt

SEQ ID NO: 278168 - DNA, 25 bp, Mus musculus
attcacacactctttctcaggtgtt

SEQ ID NO: 278169 - DNA, 25 bp, Mus musculus
attcacaccacccttgataggatgc

SEQ ID NO: 278170 - DNA, 25 bp, Mus musculus
attcacaccaccgttgataggatgc

SEQ ID NO: 278171 - DNA, 25 bp, Mus musculus
attcacaccataagcatgatgctgc

SEQ ID NO: 278172 - DNA, 25 bp, Mus musculus
attcacaccatatgcatgatgctgc

SEQ ID NO: 278173 - DNA, 25 bp, Mus musculus
attcacactatgcagtccgccttat

SEQ ID NO: 278174 - DNA, 25 bp, Mus musculus
attcacactatggagtccgccttat

SEQ ID NO: 278175 - DNA, 25 bp, Mus musculus
attcacagaaatccttagtccccag

SEQ ID NO: 278176 - DNA, 25 bp, Mus musculus
attcacagaaatgcttagtccccag

SEQ ID NO: 278177 - DNA, 25 bp, Mus musculus
attcacagaaccattcctcaagtgt

SEQ ID NO: 278178 - DNA, 25 bp, Mus musculus
attcacagaacctttcctcaagtgt

SEQ ID NO: 278179 - DNA, 25 bp, Mus musculus
attcacagaattaccttggatccag

SEQ ID NO: 278180 - DNA, 25 bp, Mus musculus
attcacagaatttccttggatccag

SEQ ID NO: 278181 - DNA, 25 bp, Mus musculus
attcacagacagaatgcatgcaggt

SEQ ID NO: 278182 - DNA, 25 bp, Mus musculus
attcacagacagtatgcatgcaggt

SEQ ID NO: 278183 - DNA, 25 bp, Mus musculus
attcacagacgtctgggtccaatca

SEQ ID NO: 278184 - DNA, 25 bp, Mus musculus
attcacagacgtgtgggtccaatca

SEQ ID NO: 278185 - DNA, 25 bp, Mus musculus
attcacagagacatttcataccagt

SEQ ID NO: 278186 - DNA, 25 bp, Mus musculus
attcacagagacttttcataccagt

SEQ ID NO: 278187 - DNA, 25 bp, Mus musculus
attcacagagccagtgcttggctac

SEQ ID NO: 278188 - DNA, 25 bp, Mus musculus
attcacagagcctgtgcttggctac

SEQ ID NO: 278189 - DNA, 25 bp, Mus musculus
attcacagccagaagctcctgagaa

SEQ ID NO: 278190 - DNA, 25 bp, Mus musculus
attcacagccagtagctcctgagaa

SEQ ID NO: 278191 - DNA, 25 bp, Mus musculus
attcacaggacacgctctgacgggc

SEQ ID NO: 278192 - DNA, 25 bp, Mus musculus
attcacaggacaggctctgacgggc

SEQ ID NO: 278193 - DNA, 25 bp, Mus musculus
attcacagtatcagtgtctcctgca

SEQ ID NO: 278194 - DNA, 25 bp, Mus musculus
attcacagtatctgtgtctcctgca

SEQ ID NO: 278195 - DNA, 25 bp, Mus musculus
attcacagtgttaatgctcctcctc

SEQ ID NO: 278196 - DNA, 25 bp, Mus musculus
attcacagtgtttatgctcctcctc

SEQ ID NO: 278197 - DNA, 25 bp, Mus musculus
attcacataacaatgctatagcagc

SEQ ID NO: 278198 - DNA, 25 bp, Mus musculus
attcacataacattgctatagcagc

SEQ ID NO: 278199 - DNA, 25 bp, Mus musculus
attcacatccttacaggcctttaat

SEQ ID NO: 278200 - DNA, 25 bp, Mus musculus
attcacatcctttcaggcctttaat

SEQ ID NO: 278201 - DNA, 25 bp, Mus musculus
attcacatctccatgctttcaagta

SEQ ID NO: 278202 - DNA, 25 bp, Mus musculus
attcacatctccttgctttcaagta

SEQ ID NO: 278203 - DNA, 25 bp, Mus musculus
attcacatctctagtcttactggac

SEQ ID NO: 278204 - DNA, 25 bp, Mus musculus
attcacatctcttgtcttactggac

SEQ ID NO: 278205 - DNA, 25 bp, Mus musculus
attcacatgcttcttactgaagtcc

SEQ ID NO: 278206 - DNA, 25 bp, Mus musculus
attcacatgcttgttactgaagtcc

SEQ ID NO: 278207 - DNA, 25 bp, Mus musculus
attcacatggcgatcacctggcagg

SEQ ID NO: 278208 - DNA, 25 bp, Mus musculus
attcacatggcgttcacctggcagg

SEQ ID NO: 278209 - DNA, 25 bp, Mus musculus
attcacattcatctatttggctcat

SEQ ID NO: 278210 - DNA, 25 bp, Mus musculus
attcacattcatgtatttggctcat

SEQ ID NO: 278211 - DNA, 25 bp, Mus musculus
attcacattgctctgcagtgctaga

SEQ ID NO: 278212 - DNA, 25 bp, Mus musculus
attcacattgctgtgcagtgctaga

SEQ ID NO: 278213 - DNA, 25 bp, Mus musculus
attcaccaacaaacagctcttcttc

SEQ ID NO: 278214 - DNA, 25 bp, Mus musculus
attcaccaacaatcagctcttcttc

SEQ ID NO: 278215 - DNA, 25 bp, Mus musculus
attcaccaatgacctccagacactg

SEQ ID NO: 278216 - DNA, 25 bp, Mus musculus
attcaccaatgagctccagacactg

SEQ ID NO: 278217 - DNA, 25 bp, Mus musculus
attcaccacggcatggatgacctca

SEQ ID NO: 278218 - DNA, 25 bp, Mus musculus
attcaccacggcttggatgacctca

SEQ ID NO: 278219 - DNA, 25 bp, Mus musculus
attcaccagattcttcctatgtaga

SEQ ID NO: 278220 - DNA, 25 bp, Mus musculus
attcaccagattgttcctatgtaga

SEQ ID NO: 278221 - DNA, 25 bp, Mus musculus
attcaccagcaacatgatcccaatg

SEQ ID NO: 278222 - DNA, 25 bp, Mus musculus
attcaccagcaagatgatcccaatg

SEQ ID NO: 278223 - DNA, 25 bp, Mus musculus
attcaccagcatccatgggagtaca

SEQ ID NO: 278224 - DNA, 25 bp, Mus musculus
attcaccagcatgcatgggagtaca

SEQ ID NO: 278225 - DNA, 25 bp, Mus musculus
attcaccagtctacctatggcaaga

SEQ ID NO: 278226 - DNA, 25 bp, Mus musculus
attcaccagtcttcctatggcaaga

SEQ ID NO: 278227 - DNA, 25 bp, Mus musculus
attcaccagtgacggcgccacgctg

SEQ ID NO: 278228 - DNA, 25 bp, Mus musculus
attcaccagtgagggcgccacgctg

SEQ ID NO: 278229 - DNA, 25 bp, Mus musculus
attcaccatagtatttattctttgg

SEQ ID NO: 278230 - DNA, 25 bp, Mus musculus
attcaccatagtttttattctttgg

SEQ ID NO: 278231 - DNA, 25 bp, Mus musculus
attcaccatcaacacaatgctggga

SEQ ID NO: 278232 - DNA, 25 bp, Mus musculus
attcaccatcaagacaatgctggga

SEQ ID NO: 278233 - DNA, 25 bp, Mus musculus
attcaccatgggaatttccatcctc

SEQ ID NO: 278234 - DNA, 25 bp, Mus musculus
attcaccatgggtatttccatcctc

SEQ ID NO: 278235 - DNA, 25 bp, Mus musculus
attcacccaagaaagcacacacgta

SEQ ID NO: 278236 - DNA, 25 bp, Mus musculus
attcacccaagatagcacacacgta

SEQ ID NO: 278237 - DNA, 25 bp, Mus musculus
attcacccagcaaagctgtgccctg

SEQ ID NO: 278238 - DNA, 25 bp, Mus musculus
attcacccagcatagctgtgccctg

SEQ ID NO: 278239 - DNA, 25 bp, Mus musculus
attcacccagctatagtttcctgtt

SEQ ID NO: 278240 - DNA, 25 bp, Mus musculus
attcacccagctttagtttcctgtt

SEQ ID NO: 278241 - DNA, 25 bp, Mus musculus
attcacccaggcaattttgctgtac

SEQ ID NO: 278242 - DNA, 25 bp, Mus musculus
attcacccaggctattttgctgtac

SEQ ID NO: 278243 - DNA, 25 bp, Mus musculus
attcacccaggtcgctacaggccag

SEQ ID NO: 278244 - DNA, 25 bp, Mus musculus
attcacccaggtggctacaggccag

SEQ ID NO: 278245 - DNA, 25 bp, Mus musculus
attcacccatcaataccttgctttg

SEQ ID NO: 278246 - DNA, 25 bp, Mus musculus
attcacccatcattaccttgctttg

SEQ ID NO: 278247 - DNA, 25 bp, Mus musculus
attcacccatttatctggtccaaag

SEQ ID NO: 278248 - DNA, 25 bp, Mus musculus
attcacccatttttctggtccaaag

SEQ ID NO: 278249 - DNA, 25 bp, Mus musculus
attcaccccaagaggtgtcacagga

SEQ ID NO: 278250 - DNA, 25 bp, Mus musculus
attcaccccaagatcaaatgcatca

SEQ ID NO: 278251 - DNA, 25 bp, Mus musculus
attcaccccaagtggtgtcacagga

SEQ ID NO: 278252 - DNA, 25 bp, Mus musculus
attcaccccaagttcaaatgcatca

SEQ ID NO: 278253 - DNA, 25 bp, Mus musculus
attcaccccaataggctggatgtag

SEQ ID NO: 278254 - DNA, 25 bp, Mus musculus
attcaccccaattggctggatgtag

SEQ ID NO: 278255 - DNA, 25 bp, Mus musculus
attcaccccagacgtgcaggctgcc

SEQ ID NO: 278256 - DNA, 25 bp, Mus musculus
attcaccccagaggtgcaggctgcc

SEQ ID NO: 278257 - DNA, 25 bp, Mus musculus
attcaccccgagctcaatggtgcca

SEQ ID NO: 278258 - DNA, 25 bp, Mus musculus
attcaccccgaggtcaatggtgcca

SEQ ID NO: 278259 - DNA, 25 bp, Mus musculus
attcaccccgtgactaccatggtga

SEQ ID NO: 278260 - DNA, 25 bp, Mus musculus
attcaccccgtgtctaccatggtga

SEQ ID NO: 278261 - DNA, 25 bp, Mus musculus
attcaccctcagagacggatgtgag

SEQ ID NO: 278262 - DNA, 25 bp, Mus musculus
attcaccctcagtgacggatgtgag

SEQ ID NO: 278263 - DNA, 25 bp, Mus musculus
attcaccctgaaactttagtcttag

SEQ ID NO: 278264 - DNA, 25 bp, Mus musculus
attcaccctgaatctttagtcttag

SEQ ID NO: 278265 - DNA, 25 bp, Mus musculus
attcaccctgtgataaaactgtagt

SEQ ID NO: 278266 - DNA, 25 bp, Mus musculus
attcaccctgtgatgtccaaattaa

SEQ ID NO: 278267 - DNA, 25 bp, Mus musculus
attcaccctgtgttaaaactgtagt

SEQ ID NO: 278268 - DNA, 25 bp, Mus musculus
attcaccctgtgttgtccaaattaa

SEQ ID NO: 278269 - DNA, 25 bp, Mus musculus
attcaccctgttaatcccacttcag

SEQ ID NO: 278270 - DNA, 25 bp, Mus musculus
attcaccctgtttatcccacttcag

SEQ ID NO: 278271 - DNA, 25 bp, Mus musculus
attcacccttataagttggtggtgg

SEQ ID NO: 278272 - DNA, 25 bp, Mus musculus
attcacccttattagttggtggtgg

SEQ ID NO: 278273 - DNA, 25 bp, Mus musculus
attcaccgggacctcaagtccatca

SEQ ID NO: 278274 - DNA, 25 bp, Mus musculus
attcaccgggacgtcaagtccatca

SEQ ID NO: 278275 - DNA, 25 bp, Mus musculus
attcacctaaaacctctggcctgaa

SEQ ID NO: 278276 - DNA, 25 bp, Mus musculus
attcacctaaaagctctggcctgaa

SEQ ID NO: 278277 - DNA, 25 bp, Mus musculus
attcacctatatcccagggtgttcc

SEQ ID NO: 278278 - DNA, 25 bp, Mus musculus
attcacctatatgccagggtgttcc

SEQ ID NO: 278279 - DNA, 25 bp, Mus musculus
attcacctcagcaagtttcacaatc

SEQ ID NO: 278280 - DNA, 25 bp, Mus musculus
attcacctcagctagtttcacaatc

SEQ ID NO: 278281 - DNA, 25 bp, Mus musculus
attcacctcgtgcactgggctacat

SEQ ID NO: 278282 - DNA, 25 bp, Mus musculus
attcacctcgtggactgggctacat

SEQ ID NO: 278283 - DNA, 25 bp, Mus musculus
attcacctctttccttatcagggat

SEQ ID NO: 278284 - DNA, 25 bp, Mus musculus
attcacctctttgcttatcagggat

SEQ ID NO: 278285 - DNA, 25 bp, Mus musculus
attcacctgaaaacgcaagcactag

SEQ ID NO: 278286 - DNA, 25 bp, Mus musculus
attcacctgaaatcgcaagcactag

SEQ ID NO: 278287 - DNA, 25 bp, Mus musculus
attcacctgaagaaattgtcgtctg

SEQ ID NO: 278288 - DNA, 25 bp, Mus musculus
attcacctgaagtaattgtcgtctg

SEQ ID NO: 278289 - DNA, 25 bp, Mus musculus
attcacctgagtcatcctgtgtgtg

SEQ ID NO: 278290 - DNA, 25 bp, Mus musculus
attcacctgagtgatcctgtgtgtg

SEQ ID NO: 278291 - DNA, 25 bp, Mus musculus
attcaccttaataagcctgatgagc

SEQ ID NO: 278292 - DNA, 25 bp, Mus musculus
attcaccttaattagcctgatgagc

SEQ ID NO: 278293 - DNA, 25 bp, Mus musculus
attcaccttcagctgctgccttaga

SEQ ID NO: 278294 - DNA, 25 bp, Mus musculus
attcaccttcaggtgctgccttaga

SEQ ID NO: 278295 - DNA, 25 bp, Mus musculus
attcaccttcctcttttgaggaaca

SEQ ID NO: 278296 - DNA, 25 bp, Mus musculus
attcaccttcctgttttgaggaaca

SEQ ID NO: 278297 - DNA, 25 bp, Mus musculus
attcaccttctgctccaatttggaa

SEQ ID NO: 278298 - DNA, 25 bp, Mus musculus
attcaccttctggtccaatttggaa

SEQ ID NO: 278299 - DNA, 25 bp, Mus musculus
attcaccttgacatgaccatcttga

SEQ ID NO: 278300 - DNA, 25 bp, Mus musculus
attcaccttgacttgaccatcttga

SEQ ID NO: 278301 - DNA, 25 bp, Mus musculus
attcacctttcaagttttcacacca

SEQ ID NO: 278302 - DNA, 25 bp, Mus musculus
attcacctttcatgttttcacacca

SEQ ID NO: 278303 - DNA, 25 bp, Mus musculus
attcacctttgactttccatatccc

SEQ ID NO: 278304 - DNA, 25 bp, Mus musculus
attcacctttgagtttccatatccc

SEQ ID NO: 278305 - DNA, 25 bp, Mus musculus
attcacgccagacacttggaagtga

SEQ ID NO: 278306 - DNA, 25 bp, Mus musculus
attcacgccagagacttggaagtga

SEQ ID NO: 278307 - DNA, 25 bp, Mus musculus
attcacgccgtaattctttctgtct

SEQ ID NO: 278308 - DNA, 25 bp, Mus musculus
attcacgccgtatttctttctgtct

SEQ ID NO: 278309 - DNA, 25 bp, Mus musculus
attcacgcctggaacagttccactt

SEQ ID NO: 278310 - DNA, 25 bp, Mus musculus
attcacgcctggtacagttccactt

SEQ ID NO: 278311 - DNA, 25 bp, Mus musculus
attcacgcgtttcaccactgccggg

SEQ ID NO: 278312 - DNA, 25 bp, Mus musculus
attcacgcgtttgaccactgccggg

SEQ ID NO: 278313 - DNA, 25 bp, Mus musculus
attcacgctttcacatggaagtcct

SEQ ID NO: 278314 - DNA, 25 bp, Mus musculus
attcacgctttctcatggaagtcct

SEQ ID NO: 278315 - DNA, 25 bp, Mus musculus
attcacggaggcaggttgcactctt

SEQ ID NO: 278316 - DNA, 25 bp, Mus musculus
attcacggaggctggttgcactctt

SEQ ID NO: 278317 - DNA, 25 bp, Mus musculus
attcacggcacaacctcattgttgt

SEQ ID NO: 278318 - DNA, 25 bp, Mus musculus
attcacggcacatcctcattgttgt

SEQ ID NO: 278319 - DNA, 25 bp, Mus musculus
attcacggcatcacttctgtatagt

SEQ ID NO: 278320 - DNA, 25 bp, Mus musculus
attcacggcatctcttctgtatagt

SEQ ID NO: 278321 - DNA, 25 bp, Mus musculus
attcacggcgtcacttttctaggac

SEQ ID NO: 278322 - DNA, 25 bp, Mus musculus
attcacggcgtctcttttctaggac

SEQ ID NO: 278323 - DNA, 25 bp, Mus musculus
attcacggctcgctgctcattgagt

SEQ ID NO: 278324 - DNA, 25 bp, Mus musculus
attcacggctcggtgctcattgagt

SEQ ID NO: 278325 - DNA, 25 bp, Mus musculus
attcacggctttcaaagttgacaag

SEQ ID NO: 278326 - DNA, 25 bp, Mus musculus
attcacggctttgaaagttgacaag

SEQ ID NO: 278327 - DNA, 25 bp, Mus musculus
attcacgggttgattactcttatat

SEQ ID NO: 278328 - DNA, 25 bp, Mus musculus
attcacgggttgtttactcttatat

SEQ ID NO: 278329 - DNA, 25 bp, Mus musculus
attcacggtattcttcaactgtaga

SEQ ID NO: 278330 - DNA, 25 bp, Mus musculus
attcacggtattgttcaactgtaga

SEQ ID NO: 278331 - DNA, 25 bp, Mus musculus
attcacggttggctgtgcattgcag

SEQ ID NO: 278332 - DNA, 25 bp, Mus musculus
attcacggttgggtgtgcattgcag

SEQ ID NO: 278333 - DNA, 25 bp, Mus musculus
attcacggtttcatctaccatctgt

SEQ ID NO: 278334 - DNA, 25 bp, Mus musculus
attcacggtttcttctaccatctgt

SEQ ID NO: 278335 - DNA, 25 bp, Mus musculus
attcacgtacttcgaggccgacagc

SEQ ID NO: 278336 - DNA, 25 bp, Mus musculus
attcacgtacttggaggccgacagc

SEQ ID NO: 278337 - DNA, 25 bp, Mus musculus
attcacgtcaaaacctttatcagag

SEQ ID NO: 278338 - DNA, 25 bp, Mus musculus
attcacgtcaaatcctttatcagag

SEQ ID NO: 278339 - DNA, 25 bp, Mus musculus
attcacgtcgtaagggtcgcaacag

SEQ ID NO: 278340 - DNA, 25 bp, Mus musculus
attcacgtcgtatgggtcgcaacag

SEQ ID NO: 278341 - DNA, 25 bp, Mus musculus
attcacgtggtgattgctgaggaca

SEQ ID NO: 278342 - DNA, 25 bp, Mus musculus
attcacgtggtgtttgctgaggaca

SEQ ID NO: 278343 - DNA, 25 bp, Mus musculus
attcacgttctaatcttgacaacaa

SEQ ID NO: 278344 - DNA, 25 bp, Mus musculus
attcacgttctattcttgacaacaa

SEQ ID NO: 278345 - DNA, 25 bp, Mus musculus
attcacgttctgctttctcaactga

SEQ ID NO: 278346 - DNA, 25 bp, Mus musculus
attcacgttctggtttctcaactga

SEQ ID NO: 278347 - DNA, 25 bp, Mus musculus
attcacgttcttcactgtgtatcct

SEQ ID NO: 278348 - DNA, 25 bp, Mus musculus
attcacgttcttgactgtgtatcct

SEQ ID NO: 278349 - DNA, 25 bp, Mus musculus
attcactacctgaagcttctcagta

SEQ ID NO: 278350 - DNA, 25 bp, Mus musculus
attcactacctgtagcttctcagta

SEQ ID NO: 278351 - DNA, 25 bp, Mus musculus
attcactactgcacactgcataaac

SEQ ID NO: 278352 - DNA, 25 bp, Mus musculus
attcactactgctcactgcataaac

SEQ ID NO: 278353 - DNA, 25 bp, Mus musculus
attcactagttcaatgattccagtc

SEQ ID NO: 278354 - DNA, 25 bp, Mus musculus
attcactagttctatgattccagtc

SEQ ID NO: 278355 - DNA, 25 bp, Mus musculus
attcactatcatcacagcgggctaa

SEQ ID NO: 278356 - DNA, 25 bp, Mus musculus
attcactatcatgacagcgggctaa

SEQ ID NO: 278357 - DNA, 25 bp, Mus musculus
attcactatccaaagtgttcccacc

SEQ ID NO: 278358 - DNA, 25 bp, Mus musculus
attcactatccatagtgttcccacc

SEQ ID NO: 278359 - DNA, 25 bp, Mus musculus
attcactatgtaagctgtcgtagac

SEQ ID NO: 278360 - DNA, 25 bp, Mus musculus
attcactatgtatgctgtcgtagac

SEQ ID NO: 278361 - DNA, 25 bp, Mus musculus
attcactatgttcacttttaacagg

SEQ ID NO: 278362 - DNA, 25 bp, Mus musculus
attcactatgttgacttttaacagg

SEQ ID NO: 278363 - DNA, 25 bp, Mus musculus
attcactcacttattaccaaggcca

SEQ ID NO: 278364 - DNA, 25 bp, Mus musculus
attcactcactttttaccaaggcca

SEQ ID NO: 278365 - DNA, 25 bp, Mus musculus
attcactcaggcctttcaatggcag

SEQ ID NO: 278366 - DNA, 25 bp, Mus musculus
attcactcaggcgtttcaatggcag

SEQ ID NO: 278367 - DNA, 25 bp, Mus musculus
attcactcattgcttcttcctgact

SEQ ID NO: 278368 - DNA, 25 bp, Mus musculus
attcactcattggttcttcctgact

SEQ ID NO: 278369 - DNA, 25 bp, Mus musculus
attcactccagcagtatcatatttc

SEQ ID NO: 278370 - DNA, 25 bp, Mus musculus
attcactccagctgtatcatatttc

SEQ ID NO: 278371 - DNA, 25 bp, Mus musculus
attcactcctatattatgtgccagg

SEQ ID NO: 278372 - DNA, 25 bp, Mus musculus
attcactcctattttatgtgccagg

SEQ ID NO: 278373 - DNA, 25 bp, Mus musculus
attcactcctggctatgtgggagca

SEQ ID NO: 278374 - DNA, 25 bp, Mus musculus
attcactcctgggtatgtgggagca

SEQ ID NO: 278375 - DNA, 25 bp, Mus musculus
attcactctatcagaatccgcgttt

SEQ ID NO: 278376 - DNA, 25 bp, Mus musculus
attcactctatctgaatccgcgttt

SEQ ID NO: 278377 - DNA, 25 bp, Mus musculus
attcactcttttagaccatgactgt

SEQ ID NO: 278378 - DNA, 25 bp, Mus musculus
attcactctttttgaccatgactgt

SEQ ID NO: 278379 - DNA, 25 bp, Mus musculus
attcactgaccaaagacggatttct

SEQ ID NO: 278380 - DNA, 25 bp, Mus musculus
attcactgaccatagacggatttct

SEQ ID NO: 278381 - DNA, 25 bp, Mus musculus
attcactgatatatgctgatgttca

SEQ ID NO: 278382 - DNA, 25 bp, Mus musculus
attcactgatatttgctgatgttca

SEQ ID NO: 278383 - DNA, 25 bp, Mus musculus
attcactgccaaactggaatcctgc

SEQ ID NO: 278384 - DNA, 25 bp, Mus musculus
attcactgccaatctggaatcctgc

SEQ ID NO: 278385 - DNA, 25 bp, Mus musculus
attcactggagcctcgaatgtccat

SEQ ID NO: 278386 - DNA, 25 bp, Mus musculus
attcactggagcgtcgaatgtccat

SEQ ID NO: 278387 - DNA, 25 bp, Mus musculus
attcactgggctcgctccgaccttt

SEQ ID NO: 278388 - DNA, 25 bp, Mus musculus
attcactgggctggctccgaccttt

SEQ ID NO: 278389 - DNA, 25 bp, Mus musculus
attcactgggtaacacagcctttgg

SEQ ID NO: 278390 - DNA, 25 bp, Mus musculus
attcactgggtatcacagcctttgg

SEQ ID NO: 278391 - DNA, 25 bp, Mus musculus
attcactgtgacatcctttcatgtg

SEQ ID NO: 278392 - DNA, 25 bp, Mus musculus
attcactgtgacttcctttcatgtg

SEQ ID NO: 278393 - DNA, 25 bp, Mus musculus
attcactgttgacttctggtttcta

SEQ ID NO: 278394 - DNA, 25 bp, Mus musculus
attcactgttgagttctggtttcta

SEQ ID NO: 278395 - DNA, 25 bp, Mus musculus
attcactgtttaaactgacttctgt

SEQ ID NO: 278396 - DNA, 25 bp, Mus musculus
attcactgtttatactgacttctgt

SEQ ID NO: 278397 - DNA, 25 bp, Mus musculus
attcacttaatgctatgtctgcaac

SEQ ID NO: 278398 - DNA, 25 bp, Mus musculus
attcacttaatggtatgtctgcaac

SEQ ID NO: 278399 - DNA, 25 bp, Mus musculus
attcacttagctcacacggtatgct

SEQ ID NO: 278400 - DNA, 25 bp, Mus musculus
attcacttagctgacacggtatgct

SEQ ID NO: 278401 - DNA, 25 bp, Mus musculus
attcacttcactacagcaaaaacag

SEQ ID NO: 278402 - DNA, 25 bp, Mus musculus
attcacttcacttcagcaaaaacag

SEQ ID NO: 278403 - DNA, 25 bp, Mus musculus
attcacttccagctttccaagcaat

SEQ ID NO: 278404 - DNA, 25 bp, Mus musculus
attcacttccaggtttccaagcaat

SEQ ID NO: 278405 - DNA, 25 bp, Mus musculus
attcacttcgtgagtttgcacttca

SEQ ID NO: 278406 - DNA, 25 bp, Mus musculus
attcacttcgtgtgtttgcacttca

SEQ ID NO: 278407 - DNA, 25 bp, Mus musculus
attcacttgcaactgttttctttgg

SEQ ID NO: 278408 - DNA, 25 bp, Mus musculus
attcacttgcaagtgttttctttgg

SEQ ID NO: 278409 - DNA, 25 bp, Mus musculus
attcacttgcctcatgtccacatca

SEQ ID NO: 278410 - DNA, 25 bp, Mus musculus
attcacttgcctgatgtccacatca

SEQ ID NO: 278411 - DNA, 25 bp, Mus musculus
attcacttgtgcagaccttcttgac

SEQ ID NO: 278412 - DNA, 25 bp, Mus musculus
attcacttgtgctgaccttcttgac

SEQ ID NO: 278413 - DNA, 25 bp, Mus musculus
attcacttgttaaaatcatactggg

SEQ ID NO: 278414 - DNA, 25 bp, Mus musculus
attcacttgttataatcatactggg

SEQ ID NO: 278415 - DNA, 25 bp, Mus musculus
attcacttgttcacggtttgattga

SEQ ID NO: 278416 - DNA, 25 bp, Mus musculus
attcacttgttctcggtttgattga

SEQ ID NO: 278417 - DNA, 25 bp, Mus musculus
attcactttcatcgctttcttacta

SEQ ID NO: 278418 - DNA, 25 bp, Mus musculus
attcactttcatggctttcttacta

SEQ ID NO: 278419 - DNA, 25 bp, Mus musculus
attcactttctcaatttcatccatt

SEQ ID NO: 278420 - DNA, 25 bp, Mus musculus
attcactttctctatttcatccatt

SEQ ID NO: 278421 - DNA, 25 bp, Mus musculus
attcactttgtaccccgtgctgata

SEQ ID NO: 278422 - DNA, 25 bp, Mus musculus
attcactttgtagcccgtgctgata

SEQ ID NO: 278423 - DNA, 25 bp, Mus musculus
attcacttttcacacatgatactaa

SEQ ID NO: 278424 - DNA, 25 bp, Mus musculus
attcacttttcagacatgatactaa

SEQ ID NO: 278425 - DNA, 25 bp, Mus musculus
attcactttttgaggatgcctgcca

SEQ ID NO: 278426 - DNA, 25 bp, Mus musculus
attcactttttgtggatgcctgcca

SEQ ID NO: 278427 - DNA, 25 bp, Mus musculus
attcagaaagcaaggtttgactcat

SEQ ID NO: 278428 - DNA, 25 bp, Mus musculus
attcagaaagcatggtttgactcat

SEQ ID NO: 278429 - DNA, 25 bp, Mus musculus
attcagaaattcaggttttcctgtt

SEQ ID NO: 278430 - DNA, 25 bp, Mus musculus
attcagaaattctggttttcctgtt

SEQ ID NO: 278431 - DNA, 25 bp, Mus musculus
attcagaacagtatttcccatcttt

SEQ ID NO: 278432 - DNA, 25 bp, Mus musculus
attcagaacagtttttcccatcttt

SEQ ID NO: 278433 - DNA, 25 bp, Mus musculus
attcagaacctgatgtcctatacaa

SEQ ID NO: 278434 - DNA, 25 bp, Mus musculus
attcagaacctgttgtcctatacaa

SEQ ID NO: 278435 - DNA, 25 bp, Mus musculus
attcagaagatcataggttcacagc

SEQ ID NO: 278436 - DNA, 25 bp, Mus musculus
attcagaagatcttaggttcacagc

SEQ ID NO: 278437 - DNA, 25 bp, Mus musculus
attcagaatgaacttggaagcctct

SEQ ID NO: 278438 - DNA, 25 bp, Mus musculus
attcagaatgaagttggaagcctct

SEQ ID NO: 278439 - DNA, 25 bp, Mus musculus
attcagaattacagcctgtcccagg

SEQ ID NO: 278440 - DNA, 25 bp, Mus musculus
attcagaattactgcctgtcccagg

SEQ ID NO: 278441 - DNA, 25 bp, Mus musculus
attcagacaacactatctctctctc

SEQ ID NO: 278442 - DNA, 25 bp, Mus musculus
attcagacaacagtatctctctctc

SEQ ID NO: 278443 - DNA, 25 bp, Mus musculus
attcagacaccacagtggacgcgat

SEQ ID NO: 278444 - DNA, 25 bp, Mus musculus
attcagacaccagagtggacgcgat

SEQ ID NO: 278445 - DNA, 25 bp, Mus musculus
attcagacacctcgcctgtgggaaa

SEQ ID NO: 278446 - DNA, 25 bp, Mus musculus
attcagacacctggcctgtgggaaa

SEQ ID NO: 278447 - DNA, 25 bp, Mus musculus
attcagacagacaacttgtacttta

SEQ ID NO: 278448 - DNA, 25 bp, Mus musculus
attcagacagactacttgtacttta

SEQ ID NO: 278449 - DNA, 25 bp, Mus musculus
attcagacagccactgctttcagcc

SEQ ID NO: 278450 - DNA, 25 bp, Mus musculus
attcagacagcctctgctttcagcc

SEQ ID NO: 278451 - DNA, 25 bp, Mus musculus
attcagacatggattccgtgaggga

SEQ ID NO: 278452 - DNA, 25 bp, Mus musculus
attcagacatggtttccgtgaggga

SEQ ID NO: 278453 - DNA, 25 bp, Mus musculus
attcagaccacaaagcaccttggac

SEQ ID NO: 278454 - DNA, 25 bp, Mus musculus
attcagaccacatagcaccttggac

SEQ ID NO: 278455 - DNA, 25 bp, Mus musculus
attcagaccctgacaacggatcaca

SEQ ID NO: 278456 - DNA, 25 bp, Mus musculus
attcagaccctgtcaacggatcaca

SEQ ID NO: 278457 - DNA, 25 bp, Mus musculus
attcagacctgaacacattgtttcc

SEQ ID NO: 278458 - DNA, 25 bp, Mus musculus
attcagacctgatcacattgtttcc

SEQ ID NO: 278459 - DNA, 25 bp, Mus musculus
attcagacgctaagacacggatcag

SEQ ID NO: 278460 - DNA, 25 bp, Mus musculus
attcagacgctatgacacggatcag

SEQ ID NO: 278461 - DNA, 25 bp, Mus musculus
attcagactcaaacttggaagttta

SEQ ID NO: 278462 - DNA, 25 bp, Mus musculus
attcagactcaatcttggaagttta

SEQ ID NO: 278463 - DNA, 25 bp, Mus musculus
attcagactgacaccccggtgtggg

SEQ ID NO: 278464 - DNA, 25 bp, Mus musculus
attcagactgactccccggtgtggg

SEQ ID NO: 278465 - DNA, 25 bp, Mus musculus
attcagacttggagtgagtcctgga

SEQ ID NO: 278466 - DNA, 25 bp, Mus musculus
attcagacttggtgtgagtcctgga

SEQ ID NO: 278467 - DNA, 25 bp, Mus musculus
attcagagagcacaccaccacagca

SEQ ID NO: 278468 - DNA, 25 bp, Mus musculus
attcagagagcagaccaccacagca

SEQ ID NO: 278469 - DNA, 25 bp, Mus musculus
attcagagatcacgcccgtgtggat

SEQ ID NO: 278470 - DNA, 25 bp, Mus musculus
attcagagatcaggcccgtgtggat

SEQ ID NO: 278471 - DNA, 25 bp, Mus musculus
attcagagcactaatcaaactccaa

SEQ ID NO: 278472 - DNA, 25 bp, Mus musculus
attcagagcacttatcaaactccaa

SEQ ID NO: 278473 - DNA, 25 bp, Mus musculus
attcagagccataacgtgaactgtt

SEQ ID NO: 278474 - DNA, 25 bp, Mus musculus
attcagagccattacgtgaactgtt

SEQ ID NO: 278475 - DNA, 25 bp, Mus musculus
attcagagccctaatcccaatttgg

SEQ ID NO: 278476 - DNA, 25 bp, Mus musculus
attcagagcccttatcccaatttgg

SEQ ID NO: 278477 - DNA, 25 bp, Mus musculus
attcagagcctacgattgcttctac

SEQ ID NO: 278478 - DNA, 25 bp, Mus musculus
attcagagcctaggattgcttctac

SEQ ID NO: 278479 - DNA, 25 bp, Mus musculus
attcagaggagtcttctccatctcc

SEQ ID NO: 278480 - DNA, 25 bp, Mus musculus
attcagaggagtgttctccatctcc

SEQ ID NO: 278481 - DNA, 25 bp, Mus musculus
attcagaggccccagtctgtagtcc

SEQ ID NO: 278482 - DNA, 25 bp, Mus musculus
attcagaggcccgagtctgtagtcc

SEQ ID NO: 278483 - DNA, 25 bp, Mus musculus
attcagaggtcaatgggatgccagg

SEQ ID NO: 278484 - DNA, 25 bp, Mus musculus
attcagaggtcattgggatgccagg

SEQ ID NO: 278485 - DNA, 25 bp, Mus musculus
attcagagtattatcattactccct

SEQ ID NO: 278486 - DNA, 25 bp, Mus musculus
attcagagtattttcattactccct

SEQ ID NO: 278487 - DNA, 25 bp, Mus musculus
attcagagtccacaactttcctctc

SEQ ID NO: 278488 - DNA, 25 bp, Mus musculus
attcagagtccagaactttcctctc

SEQ ID NO: 278489 - DNA, 25 bp, Mus musculus
attcagataactcgaaggtatagca

SEQ ID NO: 278490 - DNA, 25 bp, Mus musculus
attcagataactggaaggtatagca

SEQ ID NO: 278491 - DNA, 25 bp, Mus musculus
attcagatatccaaagacgggctcc

SEQ ID NO: 278492 - DNA, 25 bp, Mus musculus
attcagatatcctaagacgggctcc

SEQ ID NO: 278493 - DNA, 25 bp, Mus musculus
attcagatatgcacattccctaatg

SEQ ID NO: 278494 - DNA, 25 bp, Mus musculus
attcagatatgctcattccctaatg

SEQ ID NO: 278495 - DNA, 25 bp, Mus musculus
attcagatcaccctttcaaggccca

SEQ ID NO: 278496 - DNA, 25 bp, Mus musculus
attcagatcaccgtttcaaggccca

SEQ ID NO: 278497 - DNA, 25 bp, Mus musculus
attcagatcactagttgctgtttta

SEQ ID NO: 278498 - DNA, 25 bp, Mus musculus
attcagatcactcgtgtttcccatt

SEQ ID NO: 278499 - DNA, 25 bp, Mus musculus
attcagatcactggtgtttcccatt

SEQ ID NO: 278500 - DNA, 25 bp, Mus musculus
attcagatcacttgttgctgtttta

SEQ ID NO: 278501 - DNA, 25 bp, Mus musculus
attcagatccaaaagattccccagg

SEQ ID NO: 278502 - DNA, 25 bp, Mus musculus
attcagatccaatagattccccagg

SEQ ID NO: 278503 - DNA, 25 bp, Mus musculus
attcagatcctacacttgatgtcag

SEQ ID NO: 278504 - DNA, 25 bp, Mus musculus
attcagatcctagacttgatgtcag

SEQ ID NO: 278505 - DNA, 25 bp, Mus musculus
attcagatcctgaccatcactatac

SEQ ID NO: 278506 - DNA, 25 bp, Mus musculus
attcagatcctgtccatcactatac

SEQ ID NO: 278507 - DNA, 25 bp, Mus musculus
attcagatctggatccctaacagtt

SEQ ID NO: 278508 - DNA, 25 bp, Mus musculus
attcagatctggttccctaacagtt

SEQ ID NO: 278509 - DNA, 25 bp, Mus musculus
attcagatgatgagccaatggtgct

SEQ ID NO: 278510 - DNA, 25 bp, Mus musculus
attcagatgatgtgccaatggtgct

SEQ ID NO: 278511 - DNA, 25 bp, Mus musculus
attcagatgggaaatcatggtcttc

SEQ ID NO: 278512 - DNA, 25 bp, Mus musculus
attcagatgggatatcatggtcttc

SEQ ID NO: 278513 - DNA, 25 bp, Mus musculus
attcagatggttcggtacgtgcttg

SEQ ID NO: 278514 - DNA, 25 bp, Mus musculus
attcagatggttgggtacgtgcttg

SEQ ID NO: 278515 - DNA, 25 bp, Mus musculus
attcagattcaactcctctacaaaa

SEQ ID NO: 278516 - DNA, 25 bp, Mus musculus
attcagattcaagtcctctacaaaa

SEQ ID NO: 278517 - DNA, 25 bp, Mus musculus
attcagcaaaggctcattcttgtaa

SEQ ID NO: 278518 - DNA, 25 bp, Mus musculus
attcagcaaagggtcattcttgtaa

SEQ ID NO: 278519 - DNA, 25 bp, Mus musculus
attcagcacacaaccttgaacaagc

SEQ ID NO: 278520 - DNA, 25 bp, Mus musculus
attcagcacacatccttgaacaagc

SEQ ID NO: 278521 - DNA, 25 bp, Mus musculus
attcagcacagaagcctgggctgca

SEQ ID NO: 278522 - DNA, 25 bp, Mus musculus
attcagcacagatgcctgggctgca

SEQ ID NO: 278523 - DNA, 25 bp, Mus musculus
attcagcacgacatgattttctccc

SEQ ID NO: 278524 - DNA, 25 bp, Mus musculus
attcagcacgacttgattttctccc

SEQ ID NO: 278525 - DNA, 25 bp, Mus musculus
attcagcacttaatctgtccaggtc

SEQ ID NO: 278526 - DNA, 25 bp, Mus musculus
attcagcacttattctgtccaggtc

SEQ ID NO: 278527 - DNA, 25 bp, Mus musculus
attcagcagcacaaaacagtagtgg

SEQ ID NO: 278528 - DNA, 25 bp, Mus musculus
attcagcagcactaaacagtagtgg

SEQ ID NO: 278529 - DNA, 25 bp, Mus musculus
attcagcagctgactttcgcagaga

SEQ ID NO: 278530 - DNA, 25 bp, Mus musculus
attcagcagctgtctttcgcagaga

SEQ ID NO: 278531 - DNA, 25 bp, Mus musculus
attcagcagggacccgcatggatct

SEQ ID NO: 278532 - DNA, 25 bp, Mus musculus
attcagcagggagccgcatggatct

SEQ ID NO: 278533 - DNA, 25 bp, Mus musculus
attcagccaggcctcgtagcacagg

SEQ ID NO: 278534 - DNA, 25 bp, Mus musculus
attcagccaggcgtcgtagcacagg

SEQ ID NO: 278535 - DNA, 25 bp, Mus musculus
attcagccatttccggctcagagga

SEQ ID NO: 278536 - DNA, 25 bp, Mus musculus
attcagccatttgcggctcagagga

SEQ ID NO: 278537 - DNA, 25 bp, Mus musculus
attcagcccacaacaaggtcaggtc

SEQ ID NO: 278538 - DNA, 25 bp, Mus musculus
attcagcccacatcaaggtcaggtc

SEQ ID NO: 278539 - DNA, 25 bp, Mus musculus
attcagccccacaaaaatatgatac

SEQ ID NO: 278540 - DNA, 25 bp, Mus musculus
attcagccccactaaaatatgatac

SEQ ID NO: 278541 - DNA, 25 bp, Mus musculus
attcagccctctataagcttagcac

SEQ ID NO: 278542 - DNA, 25 bp, Mus musculus
attcagccctctttaagcttagcac

SEQ ID NO: 278543 - DNA, 25 bp, Mus musculus
attcagcccttacatacattcaaca

SEQ ID NO: 278544 - DNA, 25 bp, Mus musculus
attcagcccttagatacattcaaca

SEQ ID NO: 278545 - DNA, 25 bp, Mus musculus
attcagcccttcatccatgaaaaga

SEQ ID NO: 278546 - DNA, 25 bp, Mus musculus
attcagcccttcttccatgaaaaga

SEQ ID NO: 278547 - DNA, 25 bp, Mus musculus
attcagccggccaggagacgagcac

SEQ ID NO: 278548 - DNA, 25 bp, Mus musculus
attcagccggcctggagacgagcac

SEQ ID NO: 278549 - DNA, 25 bp, Mus musculus
attcagcctatgacactaatcgtct

SEQ ID NO: 278550 - DNA, 25 bp, Mus musculus
attcagcctatgtcactaatcgtct

SEQ ID NO: 278551 - DNA, 25 bp, Mus musculus
attcagcctcttagttcctgactgc

SEQ ID NO: 278552 - DNA, 25 bp, Mus musculus
attcagcctctttgttcctgactgc

SEQ ID NO: 278553 - DNA, 25 bp, Mus musculus
attcagcctggaacttttacaatat

SEQ ID NO: 278554 - DNA, 25 bp, Mus musculus
attcagcctggatcttttacaatat

SEQ ID NO: 278555 - DNA, 25 bp, Mus musculus
attcagcgcatcattgtacaagttc

SEQ ID NO: 278556 - DNA, 25 bp, Mus musculus
attcagcgcatctttgtacaagttc

SEQ ID NO: 278557 - DNA, 25 bp, Mus musculus
attcagcgcgttaccatttctttct

SEQ ID NO: 278558 - DNA, 25 bp, Mus musculus
attcagcgcgtttccatttctttct

SEQ ID NO: 278559 - DNA, 25 bp, Mus musculus
attcagcgggtaagtacaggcagat

SEQ ID NO: 278560 - DNA, 25 bp, Mus musculus
attcagcgggtatgtacaggcagat

SEQ ID NO: 278561 - DNA, 25 bp, Mus musculus
attcagctagctcttgggaactgct

SEQ ID NO: 278562 - DNA, 25 bp, Mus musculus
attcagctagctgttgggaactgct

SEQ ID NO: 278563 - DNA, 25 bp, Mus musculus
attcagctaggacacacttgttgca

SEQ ID NO: 278564 - DNA, 25 bp, Mus musculus
attcagctaggagacacttgttgca

SEQ ID NO: 278565 - DNA, 25 bp, Mus musculus
attcagctcactccttaactgaaca

SEQ ID NO: 278566 - DNA, 25 bp, Mus musculus
attcagctcactgcttaactgaaca

SEQ ID NO: 278567 - DNA, 25 bp, Mus musculus
attcagctcagtccccagcatcagt

SEQ ID NO: 278568 - DNA, 25 bp, Mus musculus
attcagctcagtgcccagcatcagt

SEQ ID NO: 278569 - DNA, 25 bp, Mus musculus
attcagctcgatcgagcttatccaa

SEQ ID NO: 278570 - DNA, 25 bp, Mus musculus
attcagctcgatggagcttatccaa

SEQ ID NO: 278571 - DNA, 25 bp, Mus musculus
attcagctgaatccactgaagccca

SEQ ID NO: 278572 - DNA, 25 bp, Mus musculus
attcagctgaatgcactgaagccca

SEQ ID NO: 278573 - DNA, 25 bp, Mus musculus
attcagctgctccattgggtacagg

SEQ ID NO: 278574 - DNA, 25 bp, Mus musculus
attcagctgctcgattgggtacagg

SEQ ID NO: 278575 - DNA, 25 bp, Mus musculus
attcagctgtggagatgattccctc

SEQ ID NO: 278576 - DNA, 25 bp, Mus musculus
attcagctgtggtgatgattccctc

SEQ ID NO: 278577 - DNA, 25 bp, Mus musculus
attcagctgttcatcactgcagtga

SEQ ID NO: 278578 - DNA, 25 bp, Mus musculus
attcagctgttccacacaaatgttg

SEQ ID NO: 278579 - DNA, 25 bp, Mus musculus
attcagctgttcgacacaaatgttg

SEQ ID NO: 278580 - DNA, 25 bp, Mus musculus
attcagctgttcttcactgcagtga

SEQ ID NO: 278581 - DNA, 25 bp, Mus musculus
attcagcttcatacccagtatctag

SEQ ID NO: 278582 - DNA, 25 bp, Mus musculus
attcagcttcattcccagtatctag

SEQ ID NO: 278583 - DNA, 25 bp, Mus musculus
attcagcttccccaaatggccagaa

SEQ ID NO: 278584 - DNA, 25 bp, Mus musculus
attcagcttcccgaaatggccagaa

SEQ ID NO: 278585 - DNA, 25 bp, Mus musculus
attcagcttgagcaagccatcacag

SEQ ID NO: 278586 - DNA, 25 bp, Mus musculus
attcagcttgaggaagccatcacag

SEQ ID NO: 278587 - DNA, 25 bp, Mus musculus
attcagcttttcaggaaggtggaca

SEQ ID NO: 278588 - DNA, 25 bp, Mus musculus
attcagcttttctggaaggtggaca

SEQ ID NO: 278589 - DNA, 25 bp, Mus musculus
attcaggaacctctagcctttagct

SEQ ID NO: 278590 - DNA, 25 bp, Mus musculus
attcaggaacctgtagcctttagct

SEQ ID NO: 278591 - DNA, 25 bp, Mus musculus
attcaggaagcaagtgtcatcccct

SEQ ID NO: 278592 - DNA, 25 bp, Mus musculus
attcaggaagcatgtgtcatcccct

SEQ ID NO: 278593 - DNA, 25 bp, Mus musculus
attcaggaagcccttgaccagctgg

SEQ ID NO: 278594 - DNA, 25 bp, Mus musculus
attcaggaagccgttgaccagctgg

SEQ ID NO: 278595 - DNA, 25 bp, Mus musculus
attcaggacaagactgtccacgtct

SEQ ID NO: 278596 - DNA, 25 bp, Mus musculus
attcaggacaagtctgtccacgtct

SEQ ID NO: 278597 - DNA, 25 bp, Mus musculus
attcaggacgttcatctttccagag

SEQ ID NO: 278598 - DNA, 25 bp, Mus musculus
attcaggacgttgatctttccagag

SEQ ID NO: 278599 - DNA, 25 bp, Mus musculus
attcaggagtagaactcccttccct

SEQ ID NO: 278600 - DNA, 25 bp, Mus musculus
attcaggagtagtactcccttccct

SEQ ID NO: 278601 - DNA, 25 bp, Mus musculus
attcaggatgaaaacaagatggttg

SEQ ID NO: 278602 - DNA, 25 bp, Mus musculus
attcaggatgaatacaagatggttg

SEQ ID NO: 278603 - DNA, 25 bp, Mus musculus
attcaggcagctaccaagcgaggaa

SEQ ID NO: 278604 - DNA, 25 bp, Mus musculus
attcaggcagctaccttaggtctta

SEQ ID NO: 278605 - DNA, 25 bp, Mus musculus
attcaggcagcttccaagcgaggaa

SEQ ID NO: 278606 - DNA, 25 bp, Mus musculus
attcaggcagcttccttaggtctta

SEQ ID NO: 278607 - DNA, 25 bp, Mus musculus
attcaggcaggaaattcattttaaa

SEQ ID NO: 278608 - DNA, 25 bp, Mus musculus
attcaggcaggatattcattttaaa

SEQ ID NO: 278609 - DNA, 25 bp, Mus musculus
attcaggcagttccgctaccaggaa

SEQ ID NO: 278610 - DNA, 25 bp, Mus musculus
attcaggcagttgcgctaccaggaa

SEQ ID NO: 278611 - DNA, 25 bp, Mus musculus
attcaggccatcatgaatacctcat

SEQ ID NO: 278612 - DNA, 25 bp, Mus musculus
attcaggccatcttgaatacctcat

SEQ ID NO: 278613 - DNA, 25 bp, Mus musculus
attcaggcccatcaagtcctggttt

SEQ ID NO: 278614 - DNA, 25 bp, Mus musculus
attcaggcccatgaagtcctggttt

SEQ ID NO: 278615 - DNA, 25 bp, Mus musculus
attcaggcctgtacccttggaaaag

SEQ ID NO: 278616 - DNA, 25 bp, Mus musculus
attcaggcctgttcccttggaaaag

SEQ ID NO: 278617 - DNA, 25 bp, Mus musculus
attcaggcgggcatcccgaaggagt

SEQ ID NO: 278618 - DNA, 25 bp, Mus musculus
attcaggcgggcttcccgaaggagt

SEQ ID NO: 278619 - DNA, 25 bp, Mus musculus
attcaggctaccatcccaaggaata

SEQ ID NO: 278620 - DNA, 25 bp, Mus musculus
attcaggctaccttcccaaggaata

SEQ ID NO: 278621 - DNA, 25 bp, Mus musculus
attcaggctatactattcttttcag

SEQ ID NO: 278622 - DNA, 25 bp, Mus musculus
attcaggctatagtattcttttcag

SEQ ID NO: 278623 - DNA, 25 bp, Mus musculus
attcaggctccacgttgttgctgtg

SEQ ID NO: 278624 - DNA, 25 bp, Mus musculus
attcaggctccaggttgttgctgtg

SEQ ID NO: 278625 - DNA, 25 bp, Mus musculus
attcaggctctcaaggactggccct

SEQ ID NO: 278626 - DNA, 25 bp, Mus musculus
attcaggctctctaggactggccct

SEQ ID NO: 278627 - DNA, 25 bp, Mus musculus
attcaggctctgcttgtttctagcc

SEQ ID NO: 278628 - DNA, 25 bp, Mus musculus
attcaggctctggttgtttctagcc

SEQ ID NO: 278629 - DNA, 25 bp, Mus musculus
attcaggctgtgagcttagtcccgt

SEQ ID NO: 278630 - DNA, 25 bp, Mus musculus
attcaggctgtgtgcttagtcccgt

SEQ ID NO: 278631 - DNA, 25 bp, Mus musculus
attcaggcttggcactgttgatgat

SEQ ID NO: 278632 - DNA, 25 bp, Mus musculus
attcaggcttgggactgttgatgat

SEQ ID NO: 278633 - DNA, 25 bp, Mus musculus
attcagggccctacaggagcatttg

SEQ ID NO: 278634 - DNA, 25 bp, Mus musculus
attcagggcccttcaggagcatttg

SEQ ID NO: 278635 - DNA, 25 bp, Mus musculus
attcagggtagtaggactctcgctc

SEQ ID NO: 278636 - DNA, 25 bp, Mus musculus
attcagggtagttggactctcgctc

SEQ ID NO: 278637 - DNA, 25 bp, Mus musculus
attcagggtcttcgacagagtctct

SEQ ID NO: 278638 - DNA, 25 bp, Mus musculus
attcagggtcttggacagagtctct

SEQ ID NO: 278639 - DNA, 25 bp, Mus musculus
attcagggtgaaccctggctgtcac

SEQ ID NO: 278640 - DNA, 25 bp, Mus musculus
attcagggtgaagcctggctgtcac

SEQ ID NO: 278641 - DNA, 25 bp, Mus musculus
attcagggttccccgcttcacattc

SEQ ID NO: 278642 - DNA, 25 bp, Mus musculus
attcagggttccgcgcttcacattc

SEQ ID NO: 278643 - DNA, 25 bp, Mus musculus
attcaggtcaggaatgcttccttta

SEQ ID NO: 278644 - DNA, 25 bp, Mus musculus
attcaggtcaggtatgcttccttta

SEQ ID NO: 278645 - DNA, 25 bp, Mus musculus
attcaggtctctctcttaacttcag

SEQ ID NO: 278646 - DNA, 25 bp, Mus musculus
attcaggtctctgtcttaacttcag

SEQ ID NO: 278647 - DNA, 25 bp, Mus musculus
attcaggtgatcagacttgttggca

SEQ ID NO: 278648 - DNA, 25 bp, Mus musculus
attcaggtgatctgacttgttggca

SEQ ID NO: 278649 - DNA, 25 bp, Mus musculus
attcaggtgcctcccagagcttgag

SEQ ID NO: 278650 - DNA, 25 bp, Mus musculus
attcaggtgcctgccagagcttgag

SEQ ID NO: 278651 - DNA, 25 bp, Mus musculus
attcaggtggcacgaatccctcaag

SEQ ID NO: 278652 - DNA, 25 bp, Mus musculus
attcaggtggcaggaatccctcaag

SEQ ID NO: 278653 - DNA, 25 bp, Mus musculus
attcaggttattcggtttggagtca

SEQ ID NO: 278654 - DNA, 25 bp, Mus musculus
attcaggttattgggtttggagtca

SEQ ID NO: 278655 - DNA, 25 bp, Mus musculus
attcaggttctgattctagtggaag

SEQ ID NO: 278656 - DNA, 25 bp, Mus musculus
attcaggttctgcatgtcggtcacc

SEQ ID NO: 278657 - DNA, 25 bp, Mus musculus
attcaggttctggatgtcggtcacc

SEQ ID NO: 278658 - DNA, 25 bp, Mus musculus
attcaggttctgtttctagtggaag

SEQ ID NO: 278659 - DNA, 25 bp, Mus musculus
attcaggtttacagcacagggccct

SEQ ID NO: 278660 - DNA, 25 bp, Mus musculus
attcaggtttactgcacagggccct

SEQ ID NO: 278661 - DNA, 25 bp, Mus musculus
attcagtaagctatctctggtttta

SEQ ID NO: 278662 - DNA, 25 bp, Mus musculus
attcagtaagctttctctggtttta

SEQ ID NO: 278663 - DNA, 25 bp, Mus musculus
attcagtacccaccaaccaggagct

SEQ ID NO: 278664 - DNA, 25 bp, Mus musculus
attcagtacccagcaaccaggagct

SEQ ID NO: 278665 - DNA, 25 bp, Mus musculus
attcagtactaccacaatctttgcc

SEQ ID NO: 278666 - DNA, 25 bp, Mus musculus
attcagtactacgacaatctttgcc

SEQ ID NO: 278667 - DNA, 25 bp, Mus musculus
attcagtatggccacatatccctcc

SEQ ID NO: 278668 - DNA, 25 bp, Mus musculus
attcagtatggcgacatatccctcc

SEQ ID NO: 278669 - DNA, 25 bp, Mus musculus
attcagtcccaactaagtgctgtgt

SEQ ID NO: 278670 - DNA, 25 bp, Mus musculus
attcagtcccaagtaagtgctgtgt

SEQ ID NO: 278671 - DNA, 25 bp, Mus musculus
attcagtcctggaggctgcagaaga

SEQ ID NO: 278672 - DNA, 25 bp, Mus musculus
attcagtcctggtggctgcagaaga

SEQ ID NO: 278673 - DNA, 25 bp, Mus musculus
attcagtcctgtctctaggcaagtc

SEQ ID NO: 278674 - DNA, 25 bp, Mus musculus
attcagtcctgtgtctaggcaagtc

SEQ ID NO: 278675 - DNA, 25 bp, Mus musculus
attcagtcctttctcctatgattcc

SEQ ID NO: 278676 - DNA, 25 bp, Mus musculus
attcagtcctttgtcctatgattcc

SEQ ID NO: 278677 - DNA, 25 bp, Mus musculus
attcagtctcccattttgccttgtt

SEQ ID NO: 278678 - DNA, 25 bp, Mus musculus
attcagtctccctttttgccttgtt

SEQ ID NO: 278679 - DNA, 25 bp, Mus musculus
attcagtctctgctggatgaaccga

SEQ ID NO: 278680 - DNA, 25 bp, Mus musculus
attcagtctctggtggatgaaccga

SEQ ID NO: 278681 - DNA, 25 bp, Mus musculus
attcagtcttacatcccaggatttt

SEQ ID NO: 278682 - DNA, 25 bp, Mus musculus
attcagtcttacttcccaggatttt

SEQ ID NO: 278683 - DNA, 25 bp, Mus musculus
attcagtcttcaaacttggcaccat

SEQ ID NO: 278684 - DNA, 25 bp, Mus musculus
attcagtcttcatacttggcaccat

SEQ ID NO: 278685 - DNA, 25 bp, Mus musculus
attcagtgactcatttcatcttcag

SEQ ID NO: 278686 - DNA, 25 bp, Mus musculus
attcagtgactcttttcatcttcag

SEQ ID NO: 278687 - DNA, 25 bp, Mus musculus
attcagtgatctctatccctttttc

SEQ ID NO: 278688 - DNA, 25 bp, Mus musculus
attcagtgatctgtatccctttttc

SEQ ID NO: 278689 - DNA, 25 bp, Mus musculus
attcagtgcacaactgcagtcccca

SEQ ID NO: 278690 - DNA, 25 bp, Mus musculus
attcagtgcacatctgcagtcccca

SEQ ID NO: 278691 - DNA, 25 bp, Mus musculus
attcagtgccacactatacgctgag

SEQ ID NO: 278692 - DNA, 25 bp, Mus musculus
attcagtgccactctatacgctgag

SEQ ID NO: 278693 - DNA, 25 bp, Mus musculus
attcagtgctgacggcaggtgcatc

SEQ ID NO: 278694 - DNA, 25 bp, Mus musculus
attcagtgctgagggcaggtgcatc

SEQ ID NO: 278695 - DNA, 25 bp, Mus musculus
attcagtgctgtcataaactgacat

SEQ ID NO: 278696 - DNA, 25 bp, Mus musculus
attcagtgctgtgataaactgacat

SEQ ID NO: 278697 - DNA, 25 bp, Mus musculus
attcagtgctttcatcactactgac

SEQ ID NO: 278698 - DNA, 25 bp, Mus musculus
attcagtgctttgatcactactgac

SEQ ID NO: 278699 - DNA, 25 bp, Mus musculus
attcagtggacccaagaggctcaga

SEQ ID NO: 278700 - DNA, 25 bp, Mus musculus
attcagtggaccgaagaggctcaga

SEQ ID NO: 278701 - DNA, 25 bp, Mus musculus
attcagtggcaaatctgtcttccct

SEQ ID NO: 278702 - DNA, 25 bp, Mus musculus
attcagtggcaattctgtcttccct

SEQ ID NO: 278703 - DNA, 25 bp, Mus musculus
attcagtgtacgaagctgctttcca

SEQ ID NO: 278704 - DNA, 25 bp, Mus musculus
attcagtgtacgtagctgctttcca

SEQ ID NO: 278705 - DNA, 25 bp, Mus musculus
attcagtgtcctccctctttaatcc

SEQ ID NO: 278706 - DNA, 25 bp, Mus musculus
attcagtgtcctgcctctttaatcc

SEQ ID NO: 278707 - DNA, 25 bp, Mus musculus
attcagtgttccaagacgccaacgc

SEQ ID NO: 278708 - DNA, 25 bp, Mus musculus
attcagtgttcctagacgccaacgc

SEQ ID NO: 278709 - DNA, 25 bp, Mus musculus
attcagttacaaaccacctgggttg

SEQ ID NO: 278710 - DNA, 25 bp, Mus musculus
attcagttacaatccacctgggttg

SEQ ID NO: 278711 - DNA, 25 bp, Mus musculus
attcagttacggattcgagaccttg

SEQ ID NO: 278712 - DNA, 25 bp, Mus musculus
attcagttacggtttcgagaccttg

SEQ ID NO: 278713 - DNA, 25 bp, Mus musculus
attcagttactgctcgctggagaga

SEQ ID NO: 278714 - DNA, 25 bp, Mus musculus
attcagttactggtcgctggagaga

SEQ ID NO: 278715 - DNA, 25 bp, Mus musculus
attcagttatctcacctgactgctt

SEQ ID NO: 278716 - DNA, 25 bp, Mus musculus
attcagttatctgacctgactgctt

SEQ ID NO: 278717 - DNA, 25 bp, Mus musculus
attcagttcaacactccatcattga

SEQ ID NO: 278718 - DNA, 25 bp, Mus musculus
attcagttcaactctccatcattga

SEQ ID NO: 278719 - DNA, 25 bp, Mus musculus
attcagttcccgaggtgctaagtca

SEQ ID NO: 278720 - DNA, 25 bp, Mus musculus
attcagttcccgtggtgctaagtca

SEQ ID NO: 278721 - DNA, 25 bp, Mus musculus
attcagttgaccaggagaatccgag

SEQ ID NO: 278722 - DNA, 25 bp, Mus musculus
attcagttgacctggagaatccgag

SEQ ID NO: 278723 - DNA, 25 bp, Mus musculus
attcagttggttcagctatggtgct

SEQ ID NO: 278724 - DNA, 25 bp, Mus musculus
attcagttggttgagctatggtgct

SEQ ID NO: 278725 - DNA, 25 bp, Mus musculus
attcagtttactattcatgcttatg

SEQ ID NO: 278726 - DNA, 25 bp, Mus musculus
attcagtttacttttcatgcttatg

SEQ ID NO: 278727 - DNA, 25 bp, Mus musculus
attcagttttatcgtcccaggccct

SEQ ID NO: 278728 - DNA, 25 bp, Mus musculus
attcagttttatggtcccaggccct

SEQ ID NO: 278729 - DNA, 25 bp, Mus musculus
attcagttttcaagatcggaaggac

SEQ ID NO: 278730 - DNA, 25 bp, Mus musculus
attcagttttcatgatcggaaggac

SEQ ID NO: 278731 - DNA, 25 bp, Mus musculus
attcataaccccagtccgtggatct

SEQ ID NO: 278732 - DNA, 25 bp, Mus musculus
attcataacccctgtccgtggatct

SEQ ID NO: 278733 - DNA, 25 bp, Mus musculus
attcataaccggcacatgctgctgc

SEQ ID NO: 278734 - DNA, 25 bp, Mus musculus
attcataaccgggacatgctgctgc

SEQ ID NO: 278735 - DNA, 25 bp, Mus musculus
attcataatgccacttcccattgca

SEQ ID NO: 278736 - DNA, 25 bp, Mus musculus
attcataatgcctcttcccattgca

SEQ ID NO: 278737 - DNA, 25 bp, Mus musculus
attcatacagtgcaggctaacctca

SEQ ID NO: 278738 - DNA, 25 bp, Mus musculus
attcatacagtggaggctaacctca

SEQ ID NO: 278739 - DNA, 25 bp, Mus musculus
attcatacccacactaaagctgctg

SEQ ID NO: 278740 - DNA, 25 bp, Mus musculus
attcatacccactctaaagctgctg

SEQ ID NO: 278741 - DNA, 25 bp, Mus musculus
attcatactgacaaaatccccaagg

SEQ ID NO: 278742 - DNA, 25 bp, Mus musculus
attcatactgactaaatccccaagg

SEQ ID NO: 278743 - DNA, 25 bp, Mus musculus
attcatagacataacatatattgct

SEQ ID NO: 278744 - DNA, 25 bp, Mus musculus
attcatagacattacatatattgct

SEQ ID NO: 278745 - DNA, 25 bp, Mus musculus
attcatagctctctggtttcgtggg

SEQ ID NO: 278746 - DNA, 25 bp, Mus musculus
attcatagctctgtggtttcgtggg

SEQ ID NO: 278747 - DNA, 25 bp, Mus musculus
attcataggcagagttgttcattaa

SEQ ID NO: 278748 - DNA, 25 bp, Mus musculus
attcataggcagtgttgttcattaa

SEQ ID NO: 278749 - DNA, 25 bp, Mus musculus
attcatatagatcaatcgagtacac

SEQ ID NO: 278750 - DNA, 25 bp, Mus musculus
attcatatagatgaatcgagtacac

SEQ ID NO: 278751 - DNA, 25 bp, Mus musculus
attcatatcagtatccagttgtagc

SEQ ID NO: 278752 - DNA, 25 bp, Mus musculus
attcatatcagtttccagttgtagc

SEQ ID NO: 278753 - DNA, 25 bp, Mus musculus
attcatatctgcaggatcctcacag

SEQ ID NO: 278754 - DNA, 25 bp, Mus musculus
attcatatctgctggatcctcacag

SEQ ID NO: 278755 - DNA, 25 bp, Mus musculus
attcatatcttactaactcctttaa

SEQ ID NO: 278756 - DNA, 25 bp, Mus musculus
attcatatcttagtaactcctttaa

SEQ ID NO: 278757 - DNA, 25 bp, Mus musculus
attcatatgaacagccacggagact

SEQ ID NO: 278758 - DNA, 25 bp, Mus musculus
attcatatgaactgccacggagact

SEQ ID NO: 278759 - DNA, 25 bp, Mus musculus
attcatatgcttactctgtaagtag

SEQ ID NO: 278760 - DNA, 25 bp, Mus musculus
attcatatgctttctctgtaagtag

SEQ ID NO: 278761 - DNA, 25 bp, Mus musculus
attcatatggttatactcagcagtg

SEQ ID NO: 278762 - DNA, 25 bp, Mus musculus
attcatatggttttactcagcagtg

SEQ ID NO: 278763 - DNA, 25 bp, Mus musculus
attcatattcatatgtatccaaggt

SEQ ID NO: 278764 - DNA, 25 bp, Mus musculus
attcatattcatttgtatccaaggt

SEQ ID NO: 278765 - DNA, 25 bp, Mus musculus
attcatcaacctagagcctctacat

SEQ ID NO: 278766 - DNA, 25 bp, Mus musculus
attcatcaaccttgagcctctacat

SEQ ID NO: 278767 - DNA, 25 bp, Mus musculus
attcatcaacgtacagtctgtggcc

SEQ ID NO: 278768 - DNA, 25 bp, Mus musculus
attcatcaacgttcagtctgtggcc

SEQ ID NO: 278769 - DNA, 25 bp, Mus musculus
attcatcaagaactccctcaatatc

SEQ ID NO: 278770 - DNA, 25 bp, Mus musculus
attcatcaagaagtccctcaatatc

SEQ ID NO: 278771 - DNA, 25 bp, Mus musculus
attcatcagagaccctgtggcgttg

SEQ ID NO: 278772 - DNA, 25 bp, Mus musculus
attcatcagagagcctgtggcgttg

SEQ ID NO: 278773 - DNA, 25 bp, Mus musculus
attcatcagcttcgtttacagtgct

SEQ ID NO: 278774 - DNA, 25 bp, Mus musculus
attcatcagcttggtttacagtgct

SEQ ID NO: 278775 - DNA, 25 bp, Mus musculus
attcatcaggcccttggacgagtgg

SEQ ID NO: 278776 - DNA, 25 bp, Mus musculus
attcatcaggccgttggacgagtgg

SEQ ID NO: 278777 - DNA, 25 bp, Mus musculus
attcatcagttcagacaggctggct

SEQ ID NO: 278778 - DNA, 25 bp, Mus musculus
attcatcagttctgacaggctggct

SEQ ID NO: 278779 - DNA, 25 bp, Mus musculus
attcatcagtttcggccactagaga

SEQ ID NO: 278780 - DNA, 25 bp, Mus musculus
attcatcagtttgggccactagaga

SEQ ID NO: 278781 - DNA, 25 bp, Mus musculus
attcatcatgtgagttattggagac

SEQ ID NO: 278782 - DNA, 25 bp, Mus musculus
attcatcatgtgatggacacccgca

SEQ ID NO: 278783 - DNA, 25 bp, Mus musculus
attcatcatgtgtgttattggagac

SEQ ID NO: 278784 - DNA, 25 bp, Mus musculus
attcatcatgtgttggacacccgca

SEQ ID NO: 278785 - DNA, 25 bp, Mus musculus
attcatcatgttatcacatgccttt

SEQ ID NO: 278786 - DNA, 25 bp, Mus musculus
attcatcatgttttcacatgccttt

SEQ ID NO: 278787 - DNA, 25 bp, Mus musculus
attcatccaatactctttcctcagt

SEQ ID NO: 278788 - DNA, 25 bp, Mus musculus
attcatccaatagtctttcctcagt

SEQ ID NO: 278789 - DNA, 25 bp, Mus musculus
attcatccagtcctcagcatcgaat

SEQ ID NO: 278790 - DNA, 25 bp, Mus musculus
attcatccagtcgtcagcatcgaat

SEQ ID NO: 278791 - DNA, 25 bp, Mus musculus
attcatccatgaaaataccccagcc

SEQ ID NO: 278792 - DNA, 25 bp, Mus musculus
attcatccatgataataccccagcc

SEQ ID NO: 278793 - DNA, 25 bp, Mus musculus
attcatcccagccactattatatca

SEQ ID NO: 278794 - DNA, 25 bp, Mus musculus
attcatcccagcgactattatatca

SEQ ID NO: 278795 - DNA, 25 bp, Mus musculus
attcatccctgaatgtgtgtgccca

SEQ ID NO: 278796 - DNA, 25 bp, Mus musculus
attcatccctgattgtgtgtgccca

SEQ ID NO: 278797 - DNA, 25 bp, Mus musculus
attcatcccttcatttggattagtg

SEQ ID NO: 278798 - DNA, 25 bp, Mus musculus
attcatcccttcttttggattagtg

SEQ ID NO: 278799 - DNA, 25 bp, Mus musculus
attcatccctttctgttcagataaa

SEQ ID NO: 278800 - DNA, 25 bp, Mus musculus
attcatccctttgtgttcagataaa

SEQ ID NO: 278801 - DNA, 25 bp, Mus musculus
attcatccgcaaatcatgttgagac

SEQ ID NO: 278802 - DNA, 25 bp, Mus musculus
attcatccgcaattcatgttgagac

SEQ ID NO: 278803 - DNA, 25 bp, Mus musculus
attcatccgggcctttggactgtaa

SEQ ID NO: 278804 - DNA, 25 bp, Mus musculus
attcatccgggcgtttggactgtaa

SEQ ID NO: 278805 - DNA, 25 bp, Mus musculus
attcatccgtctagcatgtgtgcat

SEQ ID NO: 278806 - DNA, 25 bp, Mus musculus
attcatccgtcttgcatgtgtgcat

SEQ ID NO: 278807 - DNA, 25 bp, Mus musculus
attcatcctgtaaatttgtatttca

SEQ ID NO: 278808 - DNA, 25 bp, Mus musculus
attcatcctgtatatttgtatttca

SEQ ID NO: 278809 - DNA, 25 bp, Mus musculus
attcatccttggctggccagaaata

SEQ ID NO: 278810 - DNA, 25 bp, Mus musculus
attcatccttgggtggccagaaata

SEQ ID NO: 278811 - DNA, 25 bp, Mus musculus
attcatctaaccaacctgggctctg

SEQ ID NO: 278812 - DNA, 25 bp, Mus musculus
attcatctaacctacctgggctctg

SEQ ID NO: 278813 - DNA, 25 bp, Mus musculus
attcatctatacattctacctgctc

SEQ ID NO: 278814 - DNA, 25 bp, Mus musculus
attcatctatactttctacctgctc

SEQ ID NO: 278815 - DNA, 25 bp, Mus musculus
attcatctatggctgacatgatctt

SEQ ID NO: 278816 - DNA, 25 bp, Mus musculus
attcatctatgggtgacatgatctt

SEQ ID NO: 278817 - DNA, 25 bp, Mus musculus
attcatctcactctatctactctat

SEQ ID NO: 278818 - DNA, 25 bp, Mus musculus
attcatctcactgtatctactctat

SEQ ID NO: 278819 - DNA, 25 bp, Mus musculus
attcatctcccgattagagtcctaa

SEQ ID NO: 278820 - DNA, 25 bp, Mus musculus
attcatctcccgtttagagtcctaa

SEQ ID NO: 278821 - DNA, 25 bp, Mus musculus
attcatctgaccaccagaccaaaga

SEQ ID NO: 278822 - DNA, 25 bp, Mus musculus
attcatctgacctccagaccaaaga

SEQ ID NO: 278823 - DNA, 25 bp, Mus musculus
attcatctgcatatgaagtcactca

SEQ ID NO: 278824 - DNA, 25 bp, Mus musculus
attcatctgcatttgaagtcactca

SEQ ID NO: 278825 - DNA, 25 bp, Mus musculus
attcatctggttcttggtgactgca

SEQ ID NO: 278826 - DNA, 25 bp, Mus musculus
attcatctggttgttggtgactgca

SEQ ID NO: 278827 - DNA, 25 bp, Mus musculus
attcatctgtatacaatgcctttga

SEQ ID NO: 278828 - DNA, 25 bp, Mus musculus
attcatctgtattcaatgcctttga

SEQ ID NO: 278829 - DNA, 25 bp, Mus musculus
attcatctttctagcttcatgtgta

SEQ ID NO: 278830 - DNA, 25 bp, Mus musculus
attcatctttcttgcttcatgtgta

SEQ ID NO: 278831 - DNA, 25 bp, Mus musculus
attcatctttgcaggacggcaggca

SEQ ID NO: 278832 - DNA, 25 bp, Mus musculus
attcatctttgctggacggcaggca

SEQ ID NO: 278833 - DNA, 25 bp, Mus musculus
attcatcttttaattagccctcctg

SEQ ID NO: 278834 - DNA, 25 bp, Mus musculus
attcatcttttacctgtagaaggag

SEQ ID NO: 278835 - DNA, 25 bp, Mus musculus
attcatcttttagctgtagaaggag

SEQ ID NO: 278836 - DNA, 25 bp, Mus musculus
attcatcttttatttagccctcctg

SEQ ID NO: 278837 - DNA, 25 bp, Mus musculus
attcatctttttcatccggcttcac

SEQ ID NO: 278838 - DNA, 25 bp, Mus musculus
attcatctttttgatccggcttcac

SEQ ID NO: 278839 - DNA, 25 bp, Mus musculus
attcatgaagttatttgcctcccac

SEQ ID NO: 278840 - DNA, 25 bp, Mus musculus
attcatgaagttttttgcctcccac

SEQ ID NO: 278841 - DNA, 25 bp, Mus musculus
attcatgaatcccatgtccacctga

SEQ ID NO: 278842 - DNA, 25 bp, Mus musculus
attcatgaatccgatgtccacctga

SEQ ID NO: 278843 - DNA, 25 bp, Mus musculus
attcatgaatggcccttagcatttc

SEQ ID NO: 278844 - DNA, 25 bp, Mus musculus
attcatgaatgggccttagcatttc

SEQ ID NO: 278845 - DNA, 25 bp, Mus musculus
attcatgacagaagggaatttgcta

SEQ ID NO: 278846 - DNA, 25 bp, Mus musculus
attcatgacagatgggaatttgcta

SEQ ID NO: 278847 - DNA, 25 bp, Mus musculus
attcatgaccgacaacaacgactat

SEQ ID NO: 278848 - DNA, 25 bp, Mus musculus
attcatgaccgagaacaacgactat

SEQ ID NO: 278849 - DNA, 25 bp, Mus musculus
attcatgaggatctactgtggtctt

SEQ ID NO: 278850 - DNA, 25 bp, Mus musculus
attcatgaggatgtactgtggtctt

SEQ ID NO: 278851 - DNA, 25 bp, Mus musculus
attcatgataaactgtgatgttttc

SEQ ID NO: 278852 - DNA, 25 bp, Mus musculus
attcatgataaagtgtgatgttttc

SEQ ID NO: 278853 - DNA, 25 bp, Mus musculus
attcatgatagcactgactcagtga

SEQ ID NO: 278854 - DNA, 25 bp, Mus musculus
attcatgatagctctgactcagtga

SEQ ID NO: 278855 - DNA, 25 bp, Mus musculus
attcatgatcagaatacgacagcag

SEQ ID NO: 278856 - DNA, 25 bp, Mus musculus
attcatgatcagtatacgacagcag

SEQ ID NO: 278857 - DNA, 25 bp, Mus musculus
attcatgatggcatcaattttctgc

SEQ ID NO: 278858 - DNA, 25 bp, Mus musculus
attcatgatggcttcaattttctgc

SEQ ID NO: 278859 - DNA, 25 bp, Mus musculus
attcatgcaaggatggtggcgcctt

SEQ ID NO: 278860 - DNA, 25 bp, Mus musculus
attcatgcaaggttggtggcgcctt

SEQ ID NO: 278861 - DNA, 25 bp, Mus musculus
attcatgcccttacacgacttagca

SEQ ID NO: 278862 - DNA, 25 bp, Mus musculus
attcatgccctttcacgacttagca

SEQ ID NO: 278863 - DNA, 25 bp, Mus musculus
attcatgccgctctgtgggaaccca

SEQ ID NO: 278864 - DNA, 25 bp, Mus musculus
attcatgccgctgtgtgggaaccca

SEQ ID NO: 278865 - DNA, 25 bp, Mus musculus
attcatgctatacctcagattggcg

SEQ ID NO: 278866 - DNA, 25 bp, Mus musculus
attcatgctatagctcagattggcg

SEQ ID NO: 278867 - DNA, 25 bp, Mus musculus
attcatgctgaaaaacctgtagttt

SEQ ID NO: 278868 - DNA, 25 bp, Mus musculus
attcatgctgaataacctgtagttt

SEQ ID NO: 278869 - DNA, 25 bp, Mus musculus
attcatgctgacctaaaaccatata

SEQ ID NO: 278870 - DNA, 25 bp, Mus musculus
attcatgctgacgtaaaaccatata

SEQ ID NO: 278871 - DNA, 25 bp, Mus musculus
attcatgctgatcatatcccacctc

SEQ ID NO: 278872 - DNA, 25 bp, Mus musculus
attcatgctgatgatatcccacctc

SEQ ID NO: 278873 - DNA, 25 bp, Mus musculus
attcatgctggacatgcctgcttgt

SEQ ID NO: 278874 - DNA, 25 bp, Mus musculus
attcatgctggagatgcctgcttgt

SEQ ID NO: 278875 - DNA, 25 bp, Mus musculus
attcatgctggtcagtggcacactc

SEQ ID NO: 278876 - DNA, 25 bp, Mus musculus
attcatgctggtgagtggcacactc

SEQ ID NO: 278877 - DNA, 25 bp, Mus musculus
attcatgcttagaactgtgatgtag

SEQ ID NO: 278878 - DNA, 25 bp, Mus musculus
attcatgcttagtactgtgatgtag

SEQ ID NO: 278879 - DNA, 25 bp, Mus musculus
attcatgcttgaagcttaccactta

SEQ ID NO: 278880 - DNA, 25 bp, Mus musculus
attcatgcttgatgcttaccactta

SEQ ID NO: 278881 - DNA, 25 bp, Mus musculus
attcatgctttaaccatatttagtg

SEQ ID NO: 278882 - DNA, 25 bp, Mus musculus
attcatgctttacatctctgctcct

SEQ ID NO: 278883 - DNA, 25 bp, Mus musculus
attcatgctttagatctctgctcct

SEQ ID NO: 278884 - DNA, 25 bp, Mus musculus
attcatgctttatccatatttagtg

SEQ ID NO: 278885 - DNA, 25 bp, Mus musculus
attcatggaagcatatgcctgtgag

SEQ ID NO: 278886 - DNA, 25 bp, Mus musculus
attcatggaagcttatgcctgtgag

SEQ ID NO: 278887 - DNA, 25 bp, Mus musculus
attcatggactgacattcagagcag

SEQ ID NO: 278888 - DNA, 25 bp, Mus musculus
attcatggactgtcattcagagcag

SEQ ID NO: 278889 - DNA, 25 bp, Mus musculus
attcatggagctcatgtggctaaca

SEQ ID NO: 278890 - DNA, 25 bp, Mus musculus
attcatggagctgatgtggctaaca

SEQ ID NO: 278891 - DNA, 25 bp, Mus musculus
attcatggagtacacttataggcac

SEQ ID NO: 278892 - DNA, 25 bp, Mus musculus
attcatggagtagacttataggcac

SEQ ID NO: 278893 - DNA, 25 bp, Mus musculus
attcatggatatccagctttactct

SEQ ID NO: 278894 - DNA, 25 bp, Mus musculus
attcatggatatgcagctttactct

SEQ ID NO: 278895 - DNA, 25 bp, Mus musculus
attcatggcccacctatgatgtcat

SEQ ID NO: 278896 - DNA, 25 bp, Mus musculus
attcatggcccagctatgatgtcat

SEQ ID NO: 278897 - DNA, 25 bp, Mus musculus
attcatggctctcatcgcatctgag

SEQ ID NO: 278898 - DNA, 25 bp, Mus musculus
attcatggctctgatcgcatctgag

SEQ ID NO: 278899 - DNA, 25 bp, Mus musculus
attcatgggagacatttagcccaca

SEQ ID NO: 278900 - DNA, 25 bp, Mus musculus
attcatgggagagatttagcccaca

SEQ ID NO: 278901 - DNA, 25 bp, Mus musculus
attcatgggatgctcagtacttaac

SEQ ID NO: 278902 - DNA, 25 bp, Mus musculus
attcatgggatggtcagtacttaac

SEQ ID NO: 278903 - DNA, 25 bp, Mus musculus
attcatgggattaggacttcagtta

SEQ ID NO: 278904 - DNA, 25 bp, Mus musculus
attcatgggatttggacttcagtta

SEQ ID NO: 278905 - DNA, 25 bp, Mus musculus
attcatggtaacacagttctctgat

SEQ ID NO: 278906 - DNA, 25 bp, Mus musculus
attcatggtaactcagttctctgat

SEQ ID NO: 278907 - DNA, 25 bp, Mus musculus
attcatggtaatattgctttgcctc

SEQ ID NO: 278908 - DNA, 25 bp, Mus musculus
attcatggtaattttgctttgcctc

SEQ ID NO: 278909 - DNA, 25 bp, Mus musculus
attcatggtatcattccttctcttt

SEQ ID NO: 278910 - DNA, 25 bp, Mus musculus
attcatggtatctttccttctcttt

SEQ ID NO: 278911 - DNA, 25 bp, Mus musculus
attcatggtatgagccgggcttggt

SEQ ID NO: 278912 - DNA, 25 bp, Mus musculus
attcatggtatgtgccgggcttggt

SEQ ID NO: 278913 - DNA, 25 bp, Mus musculus
attcatgtatttacactctgttgtt

SEQ ID NO: 278914 - DNA, 25 bp, Mus musculus
attcatgtattttcactctgttgtt

SEQ ID NO: 278915 - DNA, 25 bp, Mus musculus
attcatgtcactagcatatgtggac

SEQ ID NO: 278916 - DNA, 25 bp, Mus musculus
attcatgtcacttgcatatgtggac

SEQ ID NO: 278917 - DNA, 25 bp, Mus musculus
attcatgtcagcaccatctgtctaa

SEQ ID NO: 278918 - DNA, 25 bp, Mus musculus
attcatgtcagctccatctgtctaa

SEQ ID NO: 278919 - DNA, 25 bp, Mus musculus
attcatgtcatgagtgtcagcacgt

SEQ ID NO: 278920 - DNA, 25 bp, Mus musculus
attcatgtcatgtgtgtcagcacgt

SEQ ID NO: 278921 - DNA, 25 bp, Mus musculus
attcatgtccctccttcaagttctc

SEQ ID NO: 278922 - DNA, 25 bp, Mus musculus
attcatgtccctgcttcaagttctc

SEQ ID NO: 278923 - DNA, 25 bp, Mus musculus
attcatgtctgtcaagcttttaaca

SEQ ID NO: 278924 - DNA, 25 bp, Mus musculus
attcatgtctgtgaagcttttaaca

SEQ ID NO: 278925 - DNA, 25 bp, Mus musculus
attcatgtcttacgaagccttaccc

SEQ ID NO: 278926 - DNA, 25 bp, Mus musculus
attcatgtcttaggaagccttaccc

SEQ ID NO: 278927 - DNA, 25 bp, Mus musculus
attcatgtgatgcatgcagtaatac

SEQ ID NO: 278928 - DNA, 25 bp, Mus musculus
attcatgtgatggatgcagtaatac

SEQ ID NO: 278929 - DNA, 25 bp, Mus musculus
attcatgtgtggatgtgtctagtta

SEQ ID NO: 278930 - DNA, 25 bp, Mus musculus
attcatgtgtggttgtgtctagtta

SEQ ID NO: 278931 - DNA, 25 bp, Mus musculus
attcatgttcctagttatgcctatt

SEQ ID NO: 278932 - DNA, 25 bp, Mus musculus
attcatgttccttgttatgcctatt

SEQ ID NO: 278933 - DNA, 25 bp, Mus musculus
attcatgttgtcaccagtagtttta

SEQ ID NO: 278934 - DNA, 25 bp, Mus musculus
attcatgttgtctccagtagtttta

SEQ ID NO: 278935 - DNA, 25 bp, Mus musculus
attcattaacataggaaccttgtga

SEQ ID NO: 278936 - DNA, 25 bp, Mus musculus
attcattaacattggaaccttgtga

SEQ ID NO: 278937 - DNA, 25 bp, Mus musculus
attcattacaagactacaatatatt

SEQ ID NO: 278938 - DNA, 25 bp, Mus musculus
attcattacaagtctacaatatatt

SEQ ID NO: 278939 - DNA, 25 bp, Mus musculus
attcattacccacctctgtgtctga

SEQ ID NO: 278940 - DNA, 25 bp, Mus musculus
attcattacccagctctgtgtctga

SEQ ID NO: 278941 - DNA, 25 bp, Mus musculus
attcattacgcgatgatttttcagc

SEQ ID NO: 278942 - DNA, 25 bp, Mus musculus
attcattacgcgttgatttttcagc

SEQ ID NO: 278943 - DNA, 25 bp, Mus musculus
attcattagcatactacgcgtctca

SEQ ID NO: 278944 - DNA, 25 bp, Mus musculus
attcattagcattctacgcgtctca

SEQ ID NO: 278945 - DNA, 25 bp, Mus musculus
attcattatcaaccacttcacacag

SEQ ID NO: 278946 - DNA, 25 bp, Mus musculus
attcattatcaagcacttcacacag

SEQ ID NO: 278947 - DNA, 25 bp, Mus musculus
attcattatcttcgactgacagtca

SEQ ID NO: 278948 - DNA, 25 bp, Mus musculus
attcattatcttggactgacagtca

SEQ ID NO: 278949 - DNA, 25 bp, Mus musculus
attcattattctacacattcaacat

SEQ ID NO: 278950 - DNA, 25 bp, Mus musculus
attcattattcttcacattcaacat

SEQ ID NO: 278951 - DNA, 25 bp, Mus musculus
attcattattgcatgataccctgtt

SEQ ID NO: 278952 - DNA, 25 bp, Mus musculus
attcattattgcttgataccctgtt

SEQ ID NO: 278953 - DNA, 25 bp, Mus musculus
attcattattttcattggctaggtg

SEQ ID NO: 278954 - DNA, 25 bp, Mus musculus
attcattattttgattggctaggtg

SEQ ID NO: 278955 - DNA, 25 bp, Mus musculus
attcattcaacaactgctgtcacaa

SEQ ID NO: 278956 - DNA, 25 bp, Mus musculus
attcattcaacatctgctgtcacaa

SEQ ID NO: 278957 - DNA, 25 bp, Mus musculus
attcattcaccaccatcatgttcag

SEQ ID NO: 278958 - DNA, 25 bp, Mus musculus
attcattcaccagcatcatgttcag

SEQ ID NO: 278959 - DNA, 25 bp, Mus musculus
attcattcagttagaaggctgccaa

SEQ ID NO: 278960 - DNA, 25 bp, Mus musculus
attcattcagtttgaaggctgccaa

SEQ ID NO: 278961 - DNA, 25 bp, Mus musculus
attcattcataaatccaaatggatg

SEQ ID NO: 278962 - DNA, 25 bp, Mus musculus
attcattcataattccaaatggatg

SEQ ID NO: 278963 - DNA, 25 bp, Mus musculus
attcattcattaactcggctacggg

SEQ ID NO: 278964 - DNA, 25 bp, Mus musculus
attcattcattatctcggctacggg

SEQ ID NO: 278965 - DNA, 25 bp, Mus musculus
attcattcccggcactgaaatgcac

SEQ ID NO: 278966 - DNA, 25 bp, Mus musculus
attcattcccgggactgaaatgcac

SEQ ID NO: 278967 - DNA, 25 bp, Mus musculus
attcattcccttaccagaaattgcc

SEQ ID NO: 278968 - DNA, 25 bp, Mus musculus
attcattccctttccagaaattgcc

SEQ ID NO: 278969 - DNA, 25 bp, Mus musculus
attcattcctcaagtctctcattta

SEQ ID NO: 278970 - DNA, 25 bp, Mus musculus
attcattcctcatgtctctcattta

SEQ ID NO: 278971 - DNA, 25 bp, Mus musculus
attcattcgactctggttctctcaa

SEQ ID NO: 278972 - DNA, 25 bp, Mus musculus
attcattcgactgtggttctctcaa

SEQ ID NO: 278973 - DNA, 25 bp, Mus musculus
attcattcgcatcgccatttggcca

SEQ ID NO: 278974 - DNA, 25 bp, Mus musculus
attcattcgcatggccatttggcca

SEQ ID NO: 278975 - DNA, 25 bp, Mus musculus
attcattcgtaacccaatcctttta

SEQ ID NO: 278976 - DNA, 25 bp, Mus musculus
attcattcgtaagccaatcctttta

SEQ ID NO: 278977 - DNA, 25 bp, Mus musculus
attcattctatacatcttgttccac

SEQ ID NO: 278978 - DNA, 25 bp, Mus musculus
attcattctatagatcttgttccac

SEQ ID NO: 278979 - DNA, 25 bp, Mus musculus
attcattctatcattgctcaaattg

SEQ ID NO: 278980 - DNA, 25 bp, Mus musculus
attcattctatctttgctcaaattg

SEQ ID NO: 278981 - DNA, 25 bp, Mus musculus
attcattctcacatggtagaggtct

SEQ ID NO: 278982 - DNA, 25 bp, Mus musculus
attcattctcacttggtagaggtct

SEQ ID NO: 278983 - DNA, 25 bp, Mus musculus
attcattctctgaaagcctttgtct

SEQ ID NO: 278984 - DNA, 25 bp, Mus musculus
attcattctctgtaagcctttgtct

SEQ ID NO: 278985 - DNA, 25 bp, Mus musculus
attcattctgcaacctttgttgtta

SEQ ID NO: 278986 - DNA, 25 bp, Mus musculus
attcattctgcatcctttgttgtta

SEQ ID NO: 278987 - DNA, 25 bp, Mus musculus
attcattcttgtatccccttcctag

SEQ ID NO: 278988 - DNA, 25 bp, Mus musculus
attcattcttgtctcaattcaccaa

SEQ ID NO: 278989 - DNA, 25 bp, Mus musculus
attcattcttgtgtcaattcaccaa

SEQ ID NO: 278990 - DNA, 25 bp, Mus musculus
attcattcttgtttccccttcctag

SEQ ID NO: 278991 - DNA, 25 bp, Mus musculus
attcattctttccaagggctttgca

SEQ ID NO: 278992 - DNA, 25 bp, Mus musculus
attcattctttcgaagggctttgca

SEQ ID NO: 278993 - DNA, 25 bp, Mus musculus
attcattgacttagggcagctttta

SEQ ID NO: 278994 - DNA, 25 bp, Mus musculus
attcattgactttgggcagctttta

SEQ ID NO: 278995 - DNA, 25 bp, Mus musculus
attcattgagctagatcctttccct

SEQ ID NO: 278996 - DNA, 25 bp, Mus musculus
attcattgagcttgatcctttccct

SEQ ID NO: 278997 - DNA, 25 bp, Mus musculus
attcattgcagaccgtgctagcgtc

SEQ ID NO: 278998 - DNA, 25 bp, Mus musculus
attcattgcagagcgtgctagcgtc

SEQ ID NO: 278999 - DNA, 25 bp, Mus musculus
attcattgcgtaaggcttgatcttt

SEQ ID NO: 279000 - DNA, 25 bp, Mus musculus
attcattgcgtatggcttgatcttt

SEQ ID NO: 279001 - DNA, 25 bp, Mus musculus
attcattgctataatgactggtgac

SEQ ID NO: 279002 - DNA, 25 bp, Mus musculus
attcattgctattatgactggtgac

SEQ ID NO: 279003 - DNA, 25 bp, Mus musculus
attcatttacctcagtgcagcggct

SEQ ID NO: 279004 - DNA, 25 bp, Mus musculus
attcatttacctgagtgcagcggct

SEQ ID NO: 279005 - DNA, 25 bp, Mus musculus
attcatttatgcattaccagtaaca

SEQ ID NO: 279006 - DNA, 25 bp, Mus musculus
attcatttatgctttaccagtaaca

SEQ ID NO: 279007 - DNA, 25 bp, Mus musculus
attcatttatggagggtgccttggc

SEQ ID NO: 279008 - DNA, 25 bp, Mus musculus
attcatttatggtgggtgccttggc

SEQ ID NO: 279009 - DNA, 25 bp, Mus musculus
attcatttattactgaggcatactc

SEQ ID NO: 279010 - DNA, 25 bp, Mus musculus
attcatttattagtgaggcatactc

SEQ ID NO: 279011 - DNA, 25 bp, Mus musculus
attcatttccaccagggactcttag

SEQ ID NO: 279012 - DNA, 25 bp, Mus musculus
attcatttccacgagggactcttag

SEQ ID NO: 279013 - DNA, 25 bp, Mus musculus
attcatttccagcttgaaagccccg

SEQ ID NO: 279014 - DNA, 25 bp, Mus musculus
attcatttccaggttgaaagccccg

SEQ ID NO: 279015 - DNA, 25 bp, Mus musculus
attcatttccatatataacccagca

SEQ ID NO: 279016 - DNA, 25 bp, Mus musculus
attcatttccatttataacccagca

SEQ ID NO: 279017 - DNA, 25 bp, Mus musculus
attcatttccttccatcgttagtgt

SEQ ID NO: 279018 - DNA, 25 bp, Mus musculus
attcatttccttgcatcgttagtgt

SEQ ID NO: 279019 - DNA, 25 bp, Mus musculus
attcatttctatcttctcagaagcc

SEQ ID NO: 279020 - DNA, 25 bp, Mus musculus
attcatttctatgttctcagaagcc

SEQ ID NO: 279021 - DNA, 25 bp, Mus musculus
attcatttgaagctggctcctgcca

SEQ ID NO: 279022 - DNA, 25 bp, Mus musculus
attcatttgaaggtggctcctgcca

SEQ ID NO: 279023 - DNA, 25 bp, Mus musculus
attcatttgcaactattttggcaca

SEQ ID NO: 279024 - DNA, 25 bp, Mus musculus
attcatttgcaagtattttggcaca

SEQ ID NO: 279025 - DNA, 25 bp, Mus musculus
attcatttgctgcttgccagtcgtc

SEQ ID NO: 279026 - DNA, 25 bp, Mus musculus
attcatttgctggttgccagtcgtc

SEQ ID NO: 279027 - DNA, 25 bp, Mus musculus
attcatttggttatgttcctctggg

SEQ ID NO: 279028 - DNA, 25 bp, Mus musculus
attcatttggttttgttcctctggg

SEQ ID NO: 279029 - DNA, 25 bp, Mus musculus
attcatttgtgaaagcagcctggat

SEQ ID NO: 279030 - DNA, 25 bp, Mus musculus
attcatttgtgatagcagcctggat

SEQ ID NO: 279031 - DNA, 25 bp, Mus musculus
attcattttagcagttcaaatccaa

SEQ ID NO: 279032 - DNA, 25 bp, Mus musculus
attcattttagctgttcaaatccaa

SEQ ID NO: 279033 - DNA, 25 bp, Mus musculus
attcattttattagaccttcctggt

SEQ ID NO: 279034 - DNA, 25 bp, Mus musculus
attcattttatttgaccttcctggt

SEQ ID NO: 279035 - DNA, 25 bp, Mus musculus
attcattttcatatgtgtccacatg

SEQ ID NO: 279036 - DNA, 25 bp, Mus musculus
attcattttcatttgtgtccacatg

SEQ ID NO: 279037 - DNA, 25 bp, Mus musculus
attcattttccccttgtgcagagaa

SEQ ID NO: 279038 - DNA, 25 bp, Mus musculus
attcattttcccgttgtgcagagaa

SEQ ID NO: 279039 - DNA, 25 bp, Mus musculus
attcattttctgctttcctacccaa

SEQ ID NO: 279040 - DNA, 25 bp, Mus musculus
attcattttctggtttcctacccaa

SEQ ID NO: 279041 - DNA, 25 bp, Mus musculus
attcattttgttcttgcagtgtagc

SEQ ID NO: 279042 - DNA, 25 bp, Mus musculus
attcattttgttgttgcagtgtagc

SEQ ID NO: 279043 - DNA, 25 bp, Mus musculus
attcatttttcaactattcttcccc

SEQ ID NO: 279044 - DNA, 25 bp, Mus musculus
attcatttttcatctattcttcccc

SEQ ID NO: 279045 - DNA, 25 bp, Mus musculus
attcatttttgtagccactggtcca

SEQ ID NO: 279046 - DNA, 25 bp, Mus musculus
attcatttttgttgccactggtcca

SEQ ID NO: 279047 - DNA, 25 bp, Mus musculus
attccaaacaggagttctgctgtga

SEQ ID NO: 279048 - DNA, 25 bp, Mus musculus
attccaaacaggtgttctgctgtga

SEQ ID NO: 279049 - DNA, 25 bp, Mus musculus
attccaaacatcactgtccttagag

SEQ ID NO: 279050 - DNA, 25 bp, Mus musculus
attccaaacatctctgtccttagag

SEQ ID NO: 279051 - DNA, 25 bp, Mus musculus
attccaaaccccagatgatctccag

SEQ ID NO: 279052 - DNA, 25 bp, Mus musculus
attccaaacccctgatgatctccag

SEQ ID NO: 279053 - DNA, 25 bp, Mus musculus
attccaaacctaaatctcatcccag

SEQ ID NO: 279054 - DNA, 25 bp, Mus musculus
attccaaacctatatctcatcccag

SEQ ID NO: 279055 - DNA, 25 bp, Mus musculus
attccaaacgagctgggcattcttt

SEQ ID NO: 279056 - DNA, 25 bp, Mus musculus
attccaaacgaggtgggcattcttt

SEQ ID NO: 279057 - DNA, 25 bp, Mus musculus
attccaaagatgcctttgtttgctt

SEQ ID NO: 279058 - DNA, 25 bp, Mus musculus
attccaaagatggctttgtttgctt

SEQ ID NO: 279059 - DNA, 25 bp, Mus musculus
attccaaaggtcaccagtccatagg

SEQ ID NO: 279060 - DNA, 25 bp, Mus musculus
attccaaaggtctccagtccatagg

SEQ ID NO: 279061 - DNA, 25 bp, Mus musculus
attccaaatagtcgcgcggtggact

SEQ ID NO: 279062 - DNA, 25 bp, Mus musculus
attccaaatagtggcgcggtggact

SEQ ID NO: 279063 - DNA, 25 bp, Mus musculus
attccaaatcaaatgctcgtggctc

SEQ ID NO: 279064 - DNA, 25 bp, Mus musculus
attccaaatcaattgctcgtggctc

SEQ ID NO: 279065 - DNA, 25 bp, Mus musculus
attccaaatgaaaggtactgtaaat

SEQ ID NO: 279066 - DNA, 25 bp, Mus musculus
attccaaatgaatggtactgtaaat

SEQ ID NO: 279067 - DNA, 25 bp, Mus musculus
attccaacacctaaacctatgtttg

SEQ ID NO: 279068 - DNA, 25 bp, Mus musculus
attccaacaccttaacctatgtttg

SEQ ID NO: 279069 - DNA, 25 bp, Mus musculus
attccaacactaccagggtttttct

SEQ ID NO: 279070 - DNA, 25 bp, Mus musculus
attccaacactagcagggtttttct

SEQ ID NO: 279071 - DNA, 25 bp, Mus musculus
attccaacagccatgaccttgatga

SEQ ID NO: 279072 - DNA, 25 bp, Mus musculus
attccaacagccttgaccttgatga

SEQ ID NO: 279073 - DNA, 25 bp, Mus musculus
attccaacagttaaatgaagatcta

SEQ ID NO: 279074 - DNA, 25 bp, Mus musculus
attccaacagtttaatgaagatcta

SEQ ID NO: 279075 - DNA, 25 bp, Mus musculus
attccaaccctcagtgttttgggat

SEQ ID NO: 279076 - DNA, 25 bp, Mus musculus
attccaaccctctgtgttttgggat

SEQ ID NO: 279077 - DNA, 25 bp, Mus musculus
attccaaccttacagtgccgtctgg

SEQ ID NO: 279078 - DNA, 25 bp, Mus musculus
attccaaccttagagtgccgtctgg

SEQ ID NO: 279079 - DNA, 25 bp, Mus musculus
attccaactactatcatcacagcct

SEQ ID NO: 279080 - DNA, 25 bp, Mus musculus
attccaactactttcatcacagcct

SEQ ID NO: 279081 - DNA, 25 bp, Mus musculus
attccaactgatctgtttccacatg

SEQ ID NO: 279082 - DNA, 25 bp, Mus musculus
attccaactgatgtgtttccacatg

SEQ ID NO: 279083 - DNA, 25 bp, Mus musculus
attccaactggacatcttgctagat

SEQ ID NO: 279084 - DNA, 25 bp, Mus musculus
attccaactggagatcttgctagat

SEQ ID NO: 279085 - DNA, 25 bp, Mus musculus
attccaagaagaattgcccacggga

SEQ ID NO: 279086 - DNA, 25 bp, Mus musculus
attccaagaagatttgcccacggga

SEQ ID NO: 279087 - DNA, 25 bp, Mus musculus
attccaagccaacttatttgcaagc

SEQ ID NO: 279088 - DNA, 25 bp, Mus musculus
attccaagccaagttatttgcaagc

SEQ ID NO: 279089 - DNA, 25 bp, Mus musculus
attccaagccagcagagccaaaatg

SEQ ID NO: 279090 - DNA, 25 bp, Mus musculus
attccaagccaggagagccaaaatg

SEQ ID NO: 279091 - DNA, 25 bp, Mus musculus
attccaagcccgctaatgggttcat

SEQ ID NO: 279092 - DNA, 25 bp, Mus musculus
attccaagcccggtaatgggttcat

SEQ ID NO: 279093 - DNA, 25 bp, Mus musculus
attccaagccctcccaaaacatgag

SEQ ID NO: 279094 - DNA, 25 bp, Mus musculus
attccaagccctgccaaaacatgag

SEQ ID NO: 279095 - DNA, 25 bp, Mus musculus
attccaaggagcaatggttgtcaca

SEQ ID NO: 279096 - DNA, 25 bp, Mus musculus
attccaaggagctatggttgtcaca

SEQ ID NO: 279097 - DNA, 25 bp, Mus musculus
attccaagggacaccagccaacctg

SEQ ID NO: 279098 - DNA, 25 bp, Mus musculus
attccaagggactccagccaacctg

SEQ ID NO: 279099 - DNA, 25 bp, Mus musculus
attccaagggagctgactgtagctt

SEQ ID NO: 279100 - DNA, 25 bp, Mus musculus
attccaagggaggtgactgtagctt

SEQ ID NO: 279101 - DNA, 25 bp, Mus musculus
attccaagtattatgtacctcattg

SEQ ID NO: 279102 - DNA, 25 bp, Mus musculus
attccaagtattttgtacctcattg

SEQ ID NO: 279103 - DNA, 25 bp, Mus musculus
attccaagtgctctggagcccagca

SEQ ID NO: 279104 - DNA, 25 bp, Mus musculus
attccaagtgctgtggagcccagca

SEQ ID NO: 279105 - DNA, 25 bp, Mus musculus
attccaatatttacgaggtgacctg

SEQ ID NO: 279106 - DNA, 25 bp, Mus musculus
attccaatattttcgaggtgacctg

SEQ ID NO: 279107 - DNA, 25 bp, Mus musculus
attccaatcactaccagccagaagt

SEQ ID NO: 279108 - DNA, 25 bp, Mus musculus
attccaatcacttccagccagaagt

SEQ ID NO: 279109 - DNA, 25 bp, Mus musculus
attccaatcctgatggctggcatta

SEQ ID NO: 279110 - DNA, 25 bp, Mus musculus
attccaatcctgttggctggcatta

SEQ ID NO: 279111 - DNA, 25 bp, Mus musculus
attccaatgcaaatgtgtgtcttca

SEQ ID NO: 279112 - DNA, 25 bp, Mus musculus
attccaatgcaacggctggtgcgat

SEQ ID NO: 279113 - DNA, 25 bp, Mus musculus
attccaatgcaagggctggtgcgat

SEQ ID NO: 279114 - DNA, 25 bp, Mus musculus
attccaatgcaattgtgtgtcttca

SEQ ID NO: 279115 - DNA, 25 bp, Mus musculus
attccaatgctgctagctggactca

SEQ ID NO: 279116 - DNA, 25 bp, Mus musculus
attccaatgctggtagctggactca

SEQ ID NO: 279117 - DNA, 25 bp, Mus musculus
attccaatgggcaagcagctctcat

SEQ ID NO: 279118 - DNA, 25 bp, Mus musculus
attccaatgggctagcagctctcat

SEQ ID NO: 279119 - DNA, 25 bp, Mus musculus
attccaatggtgctgacttaatgcg

SEQ ID NO: 279120 - DNA, 25 bp, Mus musculus
attccaatggtggtgacttaatgcg

SEQ ID NO: 279121 - DNA, 25 bp, Mus musculus
attccaatgtacacaacgaaggcaa

SEQ ID NO: 279122 - DNA, 25 bp, Mus musculus
attccaatgtactcaacgaaggcaa

SEQ ID NO: 279123 - DNA, 25 bp, Mus musculus
attccaattcacagatgatctctac

SEQ ID NO: 279124 - DNA, 25 bp, Mus musculus
attccaattcactgatgatctctac

SEQ ID NO: 279125 - DNA, 25 bp, Mus musculus
attccaattctgactctggactggc

SEQ ID NO: 279126 - DNA, 25 bp, Mus musculus
attccaattctgtctctggactggc

SEQ ID NO: 279127 - DNA, 25 bp, Mus musculus
attccaattgatactgataaccctt

SEQ ID NO: 279128 - DNA, 25 bp, Mus musculus
attccaattgattctgataaccctt

SEQ ID NO: 279129 - DNA, 25 bp, Mus musculus
attccaattttaaaagccagtgtac

SEQ ID NO: 279130 - DNA, 25 bp, Mus musculus
attccaattttataagccagtgtac

SEQ ID NO: 279131 - DNA, 25 bp, Mus musculus
attccacaccaaattttcctatctt

SEQ ID NO: 279132 - DNA, 25 bp, Mus musculus
attccacaccaatttttcctatctt

SEQ ID NO: 279133 - DNA, 25 bp, Mus musculus
attccacacctaacttcacttgata

SEQ ID NO: 279134 - DNA, 25 bp, Mus musculus
attccacacctatcttcacttgata

SEQ ID NO: 279135 - DNA, 25 bp, Mus musculus
attccacacggacaagccatttact

SEQ ID NO: 279136 - DNA, 25 bp, Mus musculus
attccacacggagaagccatttact

SEQ ID NO: 279137 - DNA, 25 bp, Mus musculus
attccacactggattcacatgcatt

SEQ ID NO: 279138 - DNA, 25 bp, Mus musculus
attccacactggtttcacatgcatt

SEQ ID NO: 279139 - DNA, 25 bp, Mus musculus
attccacactgtagactgtttttct

SEQ ID NO: 279140 - DNA, 25 bp, Mus musculus
attccacactgttgactgtttttct

SEQ ID NO: 279141 - DNA, 25 bp, Mus musculus
attccacacttacttccagagctct

SEQ ID NO: 279142 - DNA, 25 bp, Mus musculus
attccacacttagttccagagctct

SEQ ID NO: 279143 - DNA, 25 bp, Mus musculus
attccacagcatcctgagtgtcttg

SEQ ID NO: 279144 - DNA, 25 bp, Mus musculus
attccacagcatgctgagtgtcttg

SEQ ID NO: 279145 - DNA, 25 bp, Mus musculus
attccacagcttacatgtctactca

SEQ ID NO: 279146 - DNA, 25 bp, Mus musculus
attccacagctttcatgtctactca

SEQ ID NO: 279147 - DNA, 25 bp, Mus musculus
attccacaggcaaggactcagacaa

SEQ ID NO: 279148 - DNA, 25 bp, Mus musculus
attccacaggcatggactcagacaa

SEQ ID NO: 279149 - DNA, 25 bp, Mus musculus
attccacagtttccctgatggtaat

SEQ ID NO: 279150 - DNA, 25 bp, Mus musculus
attccacagtttgcctgatggtaat

SEQ ID NO: 279151 - DNA, 25 bp, Mus musculus
attccacatgaaatctgacaaggca

SEQ ID NO: 279152 - DNA, 25 bp, Mus musculus
attccacatgaattctgacaaggca

SEQ ID NO: 279153 - DNA, 25 bp, Mus musculus
attccacatgtgcacactttcaggg

SEQ ID NO: 279154 - DNA, 25 bp, Mus musculus
attccacatgtggacactttcaggg

SEQ ID NO: 279155 - DNA, 25 bp, Mus musculus
attccaccagttagtgttgccagta

SEQ ID NO: 279156 - DNA, 25 bp, Mus musculus
attccaccagtttgtgttgccagta

SEQ ID NO: 279157 - DNA, 25 bp, Mus musculus
attccaccatgcacccaagctagtt

SEQ ID NO: 279158 - DNA, 25 bp, Mus musculus
attccaccatgctcccaagctagtt

SEQ ID NO: 279159 - DNA, 25 bp, Mus musculus
attccacccattactatggcttgtt

SEQ ID NO: 279160 - DNA, 25 bp, Mus musculus
attccacccatttctatggcttgtt

SEQ ID NO: 279161 - DNA, 25 bp, Mus musculus
attccacccctgatacctgagatga

SEQ ID NO: 279162 - DNA, 25 bp, Mus musculus
attccacccctgttacctgagatga

SEQ ID NO: 279163 - DNA, 25 bp, Mus musculus
attccacctgcaaacctgtgccagt

SEQ ID NO: 279164 - DNA, 25 bp, Mus musculus
attccacctgcatacctgtgccagt

SEQ ID NO: 279165 - DNA, 25 bp, Mus musculus
attccacgactacttcagctgcttg

SEQ ID NO: 279166 - DNA, 25 bp, Mus musculus
attccacgactagttcagctgcttg

SEQ ID NO: 279167 - DNA, 25 bp, Mus musculus
attccacgctgtatcattcaagttt

SEQ ID NO: 279168 - DNA, 25 bp, Mus musculus
attccacgctgtttcattcaagttt

SEQ ID NO: 279169 - DNA, 25 bp, Mus musculus
attccacggctgatgcagaatgaag

SEQ ID NO: 279170 - DNA, 25 bp, Mus musculus
attccacggctgttgcagaatgaag

SEQ ID NO: 279171 - DNA, 25 bp, Mus musculus
attccacgtaatatattcacccaag

SEQ ID NO: 279172 - DNA, 25 bp, Mus musculus
attccacgtaatttattcacccaag

SEQ ID NO: 279173 - DNA, 25 bp, Mus musculus
attccactactaagcagatctctgt

SEQ ID NO: 279174 - DNA, 25 bp, Mus musculus
attccactactatgcagatctctgt

SEQ ID NO: 279175 - DNA, 25 bp, Mus musculus
attccactagccatggttgtgcagc

SEQ ID NO: 279176 - DNA, 25 bp, Mus musculus
attccactagccttggttgtgcagc

SEQ ID NO: 279177 - DNA, 25 bp, Mus musculus
attccactcaaaccatgggtccctg

SEQ ID NO: 279178 - DNA, 25 bp, Mus musculus
attccactcaaagcatgggtccctg

SEQ ID NO: 279179 - DNA, 25 bp, Mus musculus
attccactcaccatggcagccggag

SEQ ID NO: 279180 - DNA, 25 bp, Mus musculus
attccactcaccttggcagccggag

SEQ ID NO: 279181 - DNA, 25 bp, Mus musculus
attccactcactaatggctttgagc

SEQ ID NO: 279182 - DNA, 25 bp, Mus musculus
attccactcacttatggctttgagc

SEQ ID NO: 279183 - DNA, 25 bp, Mus musculus
attccactccggagccaaaggccag

SEQ ID NO: 279184 - DNA, 25 bp, Mus musculus
attccactccggtgccaaaggccag

SEQ ID NO: 279185 - DNA, 25 bp, Mus musculus
attccactcgcccacctgcgcagtg

SEQ ID NO: 279186 - DNA, 25 bp, Mus musculus
attccactcgccgacctgcgcagtg

SEQ ID NO: 279187 - DNA, 25 bp, Mus musculus
attccactgactactcacagagcag

SEQ ID NO: 279188 - DNA, 25 bp, Mus musculus
attccactgacttctcacagagcag

SEQ ID NO: 279189 - DNA, 25 bp, Mus musculus
attccactgagcataggtcttgcac

SEQ ID NO: 279190 - DNA, 25 bp, Mus musculus
attccactgagcttaggtcttgcac

SEQ ID NO: 279191 - DNA, 25 bp, Mus musculus
attccactgcctaatttattacaaa

SEQ ID NO: 279192 - DNA, 25 bp, Mus musculus
attccactgccttatttattacaaa

SEQ ID NO: 279193 - DNA, 25 bp, Mus musculus
attccactgtggcttgcattaatag

SEQ ID NO: 279194 - DNA, 25 bp, Mus musculus
attccactgtgggttgcattaatag

SEQ ID NO: 279195 - DNA, 25 bp, Mus musculus
attccacttcccaattaatgctgta

SEQ ID NO: 279196 - DNA, 25 bp, Mus musculus
attccacttccctattaatgctgta

SEQ ID NO: 279197 - DNA, 25 bp, Mus musculus
attccacttgaaagaagtacctaga

SEQ ID NO: 279198 - DNA, 25 bp, Mus musculus
attccacttgaatgaagtacctaga

SEQ ID NO: 279199 - DNA, 25 bp, Mus musculus
attccacttggaattcctctagcaa

SEQ ID NO: 279200 - DNA, 25 bp, Mus musculus
attccacttggatttcctctagcaa

SEQ ID NO: 279201 - DNA, 25 bp, Mus musculus
attccacttggcctgtgtaagtgaa

SEQ ID NO: 279202 - DNA, 25 bp, Mus musculus
attccacttggccttatgctgttga

SEQ ID NO: 279203 - DNA, 25 bp, Mus musculus
attccacttggcgtgtgtaagtgaa

SEQ ID NO: 279204 - DNA, 25 bp, Mus musculus
attccacttggcgttatgctgttga

SEQ ID NO: 279205 - DNA, 25 bp, Mus musculus
attccactttgacatccaagccaca

SEQ ID NO: 279206 - DNA, 25 bp, Mus musculus
attccactttgagatccaagccaca

SEQ ID NO: 279207 - DNA, 25 bp, Mus musculus
attccagaaattagccccttgtatg

SEQ ID NO: 279208 - DNA, 25 bp, Mus musculus
attccagaaatttgccccttgtatg

SEQ ID NO: 279209 - DNA, 25 bp, Mus musculus
attccagaaccccaactatttgctg

SEQ ID NO: 279210 - DNA, 25 bp, Mus musculus
attccagaacccgaactatttgctg

SEQ ID NO: 279211 - DNA, 25 bp, Mus musculus
attccagaactacttgacaggtttt

SEQ ID NO: 279212 - DNA, 25 bp, Mus musculus
attccagaactagttgacaggtttt

SEQ ID NO: 279213 - DNA, 25 bp, Mus musculus
attccagaatcccacagcattttga

SEQ ID NO: 279214 - DNA, 25 bp, Mus musculus
attccagaatccgacagcattttga

SEQ ID NO: 279215 - DNA, 25 bp, Mus musculus
attccagaattcattcatatcatga

SEQ ID NO: 279216 - DNA, 25 bp, Mus musculus
attccagaattctttcatatcatga

SEQ ID NO: 279217 - DNA, 25 bp, Mus musculus
attccagacagaattcacccaggaa

SEQ ID NO: 279218 - DNA, 25 bp, Mus musculus
attccagacagatttcacccaggaa

SEQ ID NO: 279219 - DNA, 25 bp, Mus musculus
attccagacatcatcaaggtggcca

SEQ ID NO: 279220 - DNA, 25 bp, Mus musculus
attccagacatcttcaaggtggcca

SEQ ID NO: 279221 - DNA, 25 bp, Mus musculus
attccagaccttattattgccatta

SEQ ID NO: 279222 - DNA, 25 bp, Mus musculus
attccagacctttttattgccatta

SEQ ID NO: 279223 - DNA, 25 bp, Mus musculus
attccagagaatccttgtcaagtcc

SEQ ID NO: 279224 - DNA, 25 bp, Mus musculus
attccagagaatgcttgtcaagtcc

SEQ ID NO: 279225 - DNA, 25 bp, Mus musculus
attccagagctcaagttgtaggcag

SEQ ID NO: 279226 - DNA, 25 bp, Mus musculus
attccagagctctagttgtaggcag

SEQ ID NO: 279227 - DNA, 25 bp, Mus musculus
attccagataaactgtttcagccta

SEQ ID NO: 279228 - DNA, 25 bp, Mus musculus
attccagataaagtgtttcagccta

SEQ ID NO: 279229 - DNA, 25 bp, Mus musculus
attccagatacccacggggcatgaa

SEQ ID NO: 279230 - DNA, 25 bp, Mus musculus
attccagataccgacggggcatgaa

SEQ ID NO: 279231 - DNA, 25 bp, Mus musculus
attccagataggacagcgcaccagg

SEQ ID NO: 279232 - DNA, 25 bp, Mus musculus
attccagataggtcagcgcaccagg

SEQ ID NO: 279233 - DNA, 25 bp, Mus musculus
attccagatattcctcttgaaccag

SEQ ID NO: 279234 - DNA, 25 bp, Mus musculus
attccagatattgctcttgaaccag

SEQ ID NO: 279235 - DNA, 25 bp, Mus musculus
attccagatctgcaacctcactctt

SEQ ID NO: 279236 - DNA, 25 bp, Mus musculus
attccagatctggaacctcactctt

SEQ ID NO: 279237 - DNA, 25 bp, Mus musculus
attccagatgcacgtctcagagctg

SEQ ID NO: 279238 - DNA, 25 bp, Mus musculus
attccagatgcaggtctcagagctg

SEQ ID NO: 279239 - DNA, 25 bp, Mus musculus
attccagatgcgatttggtgggctg

SEQ ID NO: 279240 - DNA, 25 bp, Mus musculus
attccagatgcgttttggtgggctg

SEQ ID NO: 279241 - DNA, 25 bp, Mus musculus
attccagattctccagacgggcttg

SEQ ID NO: 279242 - DNA, 25 bp, Mus musculus
attccagattctgcagacgggcttg

SEQ ID NO: 279243 - DNA, 25 bp, Mus musculus
attccagattgtattcatatgccta

SEQ ID NO: 279244 - DNA, 25 bp, Mus musculus
attccagattgttttcatatgccta

SEQ ID NO: 279245 - DNA, 25 bp, Mus musculus
attccagcagacatcgtctttgttt

SEQ ID NO: 279246 - DNA, 25 bp, Mus musculus
attccagcagacttcgtctttgttt

SEQ ID NO: 279247 - DNA, 25 bp, Mus musculus
attccagcagatcctacaataagtc

SEQ ID NO: 279248 - DNA, 25 bp, Mus musculus
attccagcagatgctacaataagtc

SEQ ID NO: 279249 - DNA, 25 bp, Mus musculus
attccagcatgacccttgtttgacc

SEQ ID NO: 279250 - DNA, 25 bp, Mus musculus
attccagcatgagccttgtttgacc

SEQ ID NO: 279251 - DNA, 25 bp, Mus musculus
attccagcatgcaagagttgagtca

SEQ ID NO: 279252 - DNA, 25 bp, Mus musculus
attccagcatgctagagttgagtca

SEQ ID NO: 279253 - DNA, 25 bp, Mus musculus
attccagccgggattttgcaggctt

SEQ ID NO: 279254 - DNA, 25 bp, Mus musculus
attccagccgggtttttgcaggctt

SEQ ID NO: 279255 - DNA, 25 bp, Mus musculus
attccagcgattcataacaccattg

SEQ ID NO: 279256 - DNA, 25 bp, Mus musculus
attccagcgattgataacaccattg

SEQ ID NO: 279257 - DNA, 25 bp, Mus musculus
attccagcgctccacagaccggaga

SEQ ID NO: 279258 - DNA, 25 bp, Mus musculus
attccagcgctcgacagaccggaga

SEQ ID NO: 279259 - DNA, 25 bp, Mus musculus
attccagctactagacagacgaggc

SEQ ID NO: 279260 - DNA, 25 bp, Mus musculus
attccagctactagaggttaagtta

SEQ ID NO: 279261 - DNA, 25 bp, Mus musculus
attccagctacttgacagacgaggc

SEQ ID NO: 279262 - DNA, 25 bp, Mus musculus
attccagctacttgaggttaagtta

SEQ ID NO: 279263 - DNA, 25 bp, Mus musculus
attccagctatccagttttctaacg

SEQ ID NO: 279264 - DNA, 25 bp, Mus musculus
attccagctatcctgcaaagcgcag

SEQ ID NO: 279265 - DNA, 25 bp, Mus musculus
attccagctatcgagttttctaacg

SEQ ID NO: 279266 - DNA, 25 bp, Mus musculus
attccagctatcgtgcaaagcgcag

SEQ ID NO: 279267 - DNA, 25 bp, Mus musculus
attccagctatgatcatgttgattc

SEQ ID NO: 279268 - DNA, 25 bp, Mus musculus
attccagctatgttcatgttgattc

SEQ ID NO: 279269 - DNA, 25 bp, Mus musculus
attccagctcgaacaatcttccttc

SEQ ID NO: 279270 - DNA, 25 bp, Mus musculus
attccagctcgatcaatcttccttc

SEQ ID NO: 279271 - DNA, 25 bp, Mus musculus
attccagctgacaaaaacatactct

SEQ ID NO: 279272 - DNA, 25 bp, Mus musculus
attccagctgactaaaacatactct

SEQ ID NO: 279273 - DNA, 25 bp, Mus musculus
attccagctggaaagtcttaggcat

SEQ ID NO: 279274 - DNA, 25 bp, Mus musculus
attccagctggatagtcttaggcat

SEQ ID NO: 279275 - DNA, 25 bp, Mus musculus
attccagctgtaacattttcctgag

SEQ ID NO: 279276 - DNA, 25 bp, Mus musculus
attccagctgtatcattttcctgag

SEQ ID NO: 279277 - DNA, 25 bp, Mus musculus
attccagctgttccctactacagat

SEQ ID NO: 279278 - DNA, 25 bp, Mus musculus
attccagctgttgcctactacagat

SEQ ID NO: 279279 - DNA, 25 bp, Mus musculus
attccagctttcaagtccagatcgg

SEQ ID NO: 279280 - DNA, 25 bp, Mus musculus
attccagctttctagtccagatcgg

SEQ ID NO: 279281 - DNA, 25 bp, Mus musculus
attccaggaaccaaactcacgtcat

SEQ ID NO: 279282 - DNA, 25 bp, Mus musculus
attccaggaacctaactcacgtcat

SEQ ID NO: 279283 - DNA, 25 bp, Mus musculus
attccaggacatcccaactgctctt

SEQ ID NO: 279284 - DNA, 25 bp, Mus musculus
attccaggacatgccaactgctctt

SEQ ID NO: 279285 - DNA, 25 bp, Mus musculus
attccaggagttaaacccctgcttg

SEQ ID NO: 279286 - DNA, 25 bp, Mus musculus
attccaggagtttaacccctgcttg

SEQ ID NO: 279287 - DNA, 25 bp, Mus musculus
attccaggatggctgtgacagtcat

SEQ ID NO: 279288 - DNA, 25 bp, Mus musculus
attccaggatgggtgtgacagtcat

SEQ ID NO: 279289 - DNA, 25 bp, Mus musculus
attccaggccaacacggctctaatg

SEQ ID NO: 279290 - DNA, 25 bp, Mus musculus
attccaggccaagacggctctaatg

SEQ ID NO: 279291 - DNA, 25 bp, Mus musculus
attccaggccaccataacaagtcat

SEQ ID NO: 279292 - DNA, 25 bp, Mus musculus
attccaggccacgataacaagtcat

SEQ ID NO: 279293 - DNA, 25 bp, Mus musculus
attccaggccatatgggatatatga

SEQ ID NO: 279294 - DNA, 25 bp, Mus musculus
attccaggccatttgggatatatga

SEQ ID NO: 279295 - DNA, 25 bp, Mus musculus
attccaggcccccaatatttcagaa

SEQ ID NO: 279296 - DNA, 25 bp, Mus musculus
attccaggccccgaatatttcagaa

SEQ ID NO: 279297 - DNA, 25 bp, Mus musculus
attccagggagaagttgtttggtca

SEQ ID NO: 279298 - DNA, 25 bp, Mus musculus
attccagggagatgttgtttggtca

SEQ ID NO: 279299 - DNA, 25 bp, Mus musculus
attccagggcatatgtcctgtttta

SEQ ID NO: 279300 - DNA, 25 bp, Mus musculus
attccagggcatttgtcctgtttta

SEQ ID NO: 279301 - DNA, 25 bp, Mus musculus
attccaggtagacatcccagagcac

SEQ ID NO: 279302 - DNA, 25 bp, Mus musculus
attccaggtagagatcccagagcac

SEQ ID NO: 279303 - DNA, 25 bp, Mus musculus
attccaggtcatcttcggagtcagg

SEQ ID NO: 279304 - DNA, 25 bp, Mus musculus
attccaggtcatgttcggagtcagg

SEQ ID NO: 279305 - DNA, 25 bp, Mus musculus
attccaggtggaattgctgacagac

SEQ ID NO: 279306 - DNA, 25 bp, Mus musculus
attccaggtggatttgctgacagac

SEQ ID NO: 279307 - DNA, 25 bp, Mus musculus
attccaggtgtcactaacagttcca

SEQ ID NO: 279308 - DNA, 25 bp, Mus musculus
attccaggtgtctctaacagttcca

SEQ ID NO: 279309 - DNA, 25 bp, Mus musculus
attccaggtgttaaaggtgatcggg

SEQ ID NO: 279310 - DNA, 25 bp, Mus musculus
attccaggtgtttaaggtgatcggg

SEQ ID NO: 279311 - DNA, 25 bp, Mus musculus
attccaggttaaagttcagtggcag

SEQ ID NO: 279312 - DNA, 25 bp, Mus musculus
attccaggttaatgttcagtggcag

SEQ ID NO: 279313 - DNA, 25 bp, Mus musculus
attccagtacacaggcaatcccatg

SEQ ID NO: 279314 - DNA, 25 bp, Mus musculus
attccagtacactggcaatcccatg

SEQ ID NO: 279315 - DNA, 25 bp, Mus musculus
attccagtagatcaactttcctcaa

SEQ ID NO: 279316 - DNA, 25 bp, Mus musculus
attccagtagatgaactttcctcaa

SEQ ID NO: 279317 - DNA, 25 bp, Mus musculus
attccagtaggtcgcgctaggctgt

SEQ ID NO: 279318 - DNA, 25 bp, Mus musculus
attccagtaggtggcgctaggctgt

SEQ ID NO: 279319 - DNA, 25 bp, Mus musculus
attccagtatagacttcccacagtg

SEQ ID NO: 279320 - DNA, 25 bp, Mus musculus
attccagtatagtcttcccacagtg

SEQ ID NO: 279321 - DNA, 25 bp, Mus musculus
attccagtatcaatttgcctgtggt

SEQ ID NO: 279322 - DNA, 25 bp, Mus musculus
attccagtatcattttgcctgtggt

SEQ ID NO: 279323 - DNA, 25 bp, Mus musculus
attccagtatggcatcaagatgtct

SEQ ID NO: 279324 - DNA, 25 bp, Mus musculus
attccagtatgggatcaagatgtct

SEQ ID NO: 279325 - DNA, 25 bp, Mus musculus
attccagtattgatgtcacaggcgt

SEQ ID NO: 279326 - DNA, 25 bp, Mus musculus
attccagtattgttgtcacaggcgt

SEQ ID NO: 279327 - DNA, 25 bp, Mus musculus
attccagtcactctcataaactttt

SEQ ID NO: 279328 - DNA, 25 bp, Mus musculus
attccagtcactgtcataaactttt

SEQ ID NO: 279329 - DNA, 25 bp, Mus musculus
attccagtcagcagtcacaaccatg

SEQ ID NO: 279330 - DNA, 25 bp, Mus musculus
attccagtcagctgtcacaaccatg

SEQ ID NO: 279331 - DNA, 25 bp, Mus musculus
attccagtcatgctaggcagggcag

SEQ ID NO: 279332 - DNA, 25 bp, Mus musculus
attccagtcatggtaggcagggcag

SEQ ID NO: 279333 - DNA, 25 bp, Mus musculus
attccagtcctaacgacaggcatca

SEQ ID NO: 279334 - DNA, 25 bp, Mus musculus
attccagtcctatcgacaggcatca

SEQ ID NO: 279335 - DNA, 25 bp, Mus musculus
attccagtcctcaactcggttccaa

SEQ ID NO: 279336 - DNA, 25 bp, Mus musculus
attccagtcctctactcggttccaa

SEQ ID NO: 279337 - DNA, 25 bp, Mus musculus
attccagtctatacacttctctgca

SEQ ID NO: 279338 - DNA, 25 bp, Mus musculus
attccagtctattcacttctctgca

SEQ ID NO: 279339 - DNA, 25 bp, Mus musculus
attccagtgaccacagtggtcattt

SEQ ID NO: 279340 - DNA, 25 bp, Mus musculus
attccagtgacctcagtggtcattt

SEQ ID NO: 279341 - DNA, 25 bp, Mus musculus
attccagtgccaatctatgtcagct

SEQ ID NO: 279342 - DNA, 25 bp, Mus musculus
attccagtgccattctatgtcagct

SEQ ID NO: 279343 - DNA, 25 bp, Mus musculus
attccagtgctgacaagctccaggg

SEQ ID NO: 279344 - DNA, 25 bp, Mus musculus
attccagtgctgtcaagctccaggg

SEQ ID NO: 279345 - DNA, 25 bp, Mus musculus
attccagtggcacgtagcctggctt

SEQ ID NO: 279346 - DNA, 25 bp, Mus musculus
attccagtggcaggtagcctggctt

SEQ ID NO: 279347 - DNA, 25 bp, Mus musculus
attccagttagaacttgctctcaca

SEQ ID NO: 279348 - DNA, 25 bp, Mus musculus
attccagttagatcttgctctcaca

SEQ ID NO: 279349 - DNA, 25 bp, Mus musculus
attccagttcatactaaaggcagtt

SEQ ID NO: 279350 - DNA, 25 bp, Mus musculus
attccagttcattctaaaggcagtt

SEQ ID NO: 279351 - DNA, 25 bp, Mus musculus
attccagttcctagacctcatggct

SEQ ID NO: 279352 - DNA, 25 bp, Mus musculus
attccagttccttgacctcatggct

SEQ ID NO: 279353 - DNA, 25 bp, Mus musculus
attccagttctacggagtctgactt

SEQ ID NO: 279354 - DNA, 25 bp, Mus musculus
attccagttctagggagtctgactt

SEQ ID NO: 279355 - DNA, 25 bp, Mus musculus
attccagttctgacttcctaattag

SEQ ID NO: 279356 - DNA, 25 bp, Mus musculus
attccagttctgtcttcctaattag

SEQ ID NO: 279357 - DNA, 25 bp, Mus musculus
attccagttgggaatattgctgcca

SEQ ID NO: 279358 - DNA, 25 bp, Mus musculus
attccagttgggtatattgctgcca

SEQ ID NO: 279359 - DNA, 25 bp, Mus musculus
attccagttttcctgatggtgaaca

SEQ ID NO: 279360 - DNA, 25 bp, Mus musculus
attccagttttcgtgatggtgaaca

SEQ ID NO: 279361 - DNA, 25 bp, Mus musculus
attccataacgtctagatgcttccc

SEQ ID NO: 279362 - DNA, 25 bp, Mus musculus
attccataacgtgtagatgcttccc

SEQ ID NO: 279363 - DNA, 25 bp, Mus musculus
attccataatccaaatgctgcctag

SEQ ID NO: 279364 - DNA, 25 bp, Mus musculus
attccataatcctaatgctgcctag

SEQ ID NO: 279365 - DNA, 25 bp, Mus musculus
attccataatcgaccaggttagtcc

SEQ ID NO: 279366 - DNA, 25 bp, Mus musculus
attccataatcgtccaggttagtcc

SEQ ID NO: 279367 - DNA, 25 bp, Mus musculus
attccataattcataaaggtccaga

SEQ ID NO: 279368 - DNA, 25 bp, Mus musculus
attccataattcttaaaggtccaga

SEQ ID NO: 279369 - DNA, 25 bp, Mus musculus
attccatacaatcagtctccccata

SEQ ID NO: 279370 - DNA, 25 bp, Mus musculus
attccatacaatgagtctccccata

SEQ ID NO: 279371 - DNA, 25 bp, Mus musculus
attccatacaccagctctcacagga

SEQ ID NO: 279372 - DNA, 25 bp, Mus musculus
attccatacacctgctctcacagga

SEQ ID NO: 279373 - DNA, 25 bp, Mus musculus
attccataccttcaggtcacagctc

SEQ ID NO: 279374 - DNA, 25 bp, Mus musculus
attccataccttgaggtcacagctc

SEQ ID NO: 279375 - DNA, 25 bp, Mus musculus
attccatacgatctgtttcttttct

SEQ ID NO: 279376 - DNA, 25 bp, Mus musculus
attccatacgatgtgtttcttttct

SEQ ID NO: 279377 - DNA, 25 bp, Mus musculus
attccatatagtacagactgtcaag

SEQ ID NO: 279378 - DNA, 25 bp, Mus musculus
attccatatagttcagactgtcaag

SEQ ID NO: 279379 - DNA, 25 bp, Mus musculus
attccatatatgatggtcctgactg

SEQ ID NO: 279380 - DNA, 25 bp, Mus musculus
attccatatatgttggtcctgactg

SEQ ID NO: 279381 - DNA, 25 bp, Mus musculus
attccatatcatactcctgcaattg

SEQ ID NO: 279382 - DNA, 25 bp, Mus musculus
attccatatcattctcctgcaattg

SEQ ID NO: 279383 - DNA, 25 bp, Mus musculus
attccatatcctcactgaagttcat

SEQ ID NO: 279384 - DNA, 25 bp, Mus musculus
attccatatcctgactgaagttcat

SEQ ID NO: 279385 - DNA, 25 bp, Mus musculus
attccatatgccaacttgtactcag

SEQ ID NO: 279386 - DNA, 25 bp, Mus musculus
attccatatgcctacttgtactcag

SEQ ID NO: 279387 - DNA, 25 bp, Mus musculus
attccatatgtaccatccatccttg

SEQ ID NO: 279388 - DNA, 25 bp, Mus musculus
attccatatgtagcatccatccttg

SEQ ID NO: 279389 - DNA, 25 bp, Mus musculus
attccatattcaattgctaccctgc

SEQ ID NO: 279390 - DNA, 25 bp, Mus musculus
attccatattcatttgctaccctgc

SEQ ID NO: 279391 - DNA, 25 bp, Mus musculus
attccatcaaacctatcatcactgc

SEQ ID NO: 279392 - DNA, 25 bp, Mus musculus
attccatcaaacgtatcatcactgc

SEQ ID NO: 279393 - DNA, 25 bp, Mus musculus
attccatcagaaagacaccttctca

SEQ ID NO: 279394 - DNA, 25 bp, Mus musculus
attccatcagaatgacaccttctca

SEQ ID NO: 279395 - DNA, 25 bp, Mus musculus
attccatcatctattctttgttccc

SEQ ID NO: 279396 - DNA, 25 bp, Mus musculus
attccatcatcttttctttgttccc

SEQ ID NO: 279397 - DNA, 25 bp, Mus musculus
attccatccaacatcctttggtact

SEQ ID NO: 279398 - DNA, 25 bp, Mus musculus
attccatccaacttcctttggtact

SEQ ID NO: 279399 - DNA, 25 bp, Mus musculus
attccatccattcactatacttttc

SEQ ID NO: 279400 - DNA, 25 bp, Mus musculus
attccatccattgactatacttttc

SEQ ID NO: 279401 - DNA, 25 bp, Mus musculus
attccatcccttaatgaaggcctct

SEQ ID NO: 279402 - DNA, 25 bp, Mus musculus
attccatccctttatgaaggcctct

SEQ ID NO: 279403 - DNA, 25 bp, Mus musculus
attccatcctcgattttatcacaga

SEQ ID NO: 279404 - DNA, 25 bp, Mus musculus
attccatcctcgtttttatcacaga

SEQ ID NO: 279405 - DNA, 25 bp, Mus musculus
attccatcctgaccggccgtatctg

SEQ ID NO: 279406 - DNA, 25 bp, Mus musculus
attccatcctgagcggccgtatctg

SEQ ID NO: 279407 - DNA, 25 bp, Mus musculus
attccatccttgctggtcatcagaa

SEQ ID NO: 279408 - DNA, 25 bp, Mus musculus
attccatccttggtggtcatcagaa

SEQ ID NO: 279409 - DNA, 25 bp, Mus musculus
attccatcggctaggtttggttcca

SEQ ID NO: 279410 - DNA, 25 bp, Mus musculus
attccatcggcttggtttggttcca

SEQ ID NO: 279411 - DNA, 25 bp, Mus musculus
attccatctaggctctcaacttaat

SEQ ID NO: 279412 - DNA, 25 bp, Mus musculus
attccatctagggtctcaacttaat

SEQ ID NO: 279413 - DNA, 25 bp, Mus musculus
attccatctattcatcaactcctga

SEQ ID NO: 279414 - DNA, 25 bp, Mus musculus
attccatctattgatcaactcctga

SEQ ID NO: 279415 - DNA, 25 bp, Mus musculus
attccatctccaaggtatccagtgc

SEQ ID NO: 279416 - DNA, 25 bp, Mus musculus
attccatctccatggtatccagtgc

SEQ ID NO: 279417 - DNA, 25 bp, Mus musculus
attccatctgttataaggatgtcct

SEQ ID NO: 279418 - DNA, 25 bp, Mus musculus
attccatctgttttaaggatgtcct

SEQ ID NO: 279419 - DNA, 25 bp, Mus musculus
attccatcttcaaagactgggttct

SEQ ID NO: 279420 - DNA, 25 bp, Mus musculus
attccatcttcatagactgggttct

SEQ ID NO: 279421 - DNA, 25 bp, Mus musculus
attccatgacatatccctaagattc

SEQ ID NO: 279422 - DNA, 25 bp, Mus musculus
attccatgacatttccctaagattc

SEQ ID NO: 279423 - DNA, 25 bp, Mus musculus
attccatgacgcaggagccgttgaa

SEQ ID NO: 279424 - DNA, 25 bp, Mus musculus
attccatgacgctggagccgttgaa

SEQ ID NO: 279425 - DNA, 25 bp, Mus musculus
attccatgactacttttgacaggca

SEQ ID NO: 279426 - DNA, 25 bp, Mus musculus
attccatgactagttttgacaggca

SEQ ID NO: 279427 - DNA, 25 bp, Mus musculus
attccatgagagatagggcgcccgg

SEQ ID NO: 279428 - DNA, 25 bp, Mus musculus
attccatgagagttagggcgcccgg

SEQ ID NO: 279429 - DNA, 25 bp, Mus musculus
attccatgatgtaggtacttgataa

SEQ ID NO: 279430 - DNA, 25 bp, Mus musculus
attccatgatgttggtacttgataa

SEQ ID NO: 279431 - DNA, 25 bp, Mus musculus
attccatgcactccgttgtcacaga

SEQ ID NO: 279432 - DNA, 25 bp, Mus musculus
attccatgcactgcgttgtcacaga

SEQ ID NO: 279433 - DNA, 25 bp, Mus musculus
attccatgccaaagtgctgctgcta

SEQ ID NO: 279434 - DNA, 25 bp, Mus musculus
attccatgccaatgtgctgctgcta

SEQ ID NO: 279435 - DNA, 25 bp, Mus musculus
attccatgccataagtattttgttt

SEQ ID NO: 279436 - DNA, 25 bp, Mus musculus
attccatgccattagtattttgttt

SEQ ID NO: 279437 - DNA, 25 bp, Mus musculus
attccatgcctcacttaattcttaa

SEQ ID NO: 279438 - DNA, 25 bp, Mus musculus
attccatgcctctcttaattcttaa

SEQ ID NO: 279439 - DNA, 25 bp, Mus musculus
attccatgctagcaccaggtactct

SEQ ID NO: 279440 - DNA, 25 bp, Mus musculus
attccatgctaggaccaggtactct

SEQ ID NO: 279441 - DNA, 25 bp, Mus musculus
attccatgctatctgttcttcttcc

SEQ ID NO: 279442 - DNA, 25 bp, Mus musculus
attccatgctatgtgttcttcttcc

SEQ ID NO: 279443 - DNA, 25 bp, Mus musculus
attccatggagcaatgttaatttag

SEQ ID NO: 279444 - DNA, 25 bp, Mus musculus
attccatggagctatgttaatttag

SEQ ID NO: 279445 - DNA, 25 bp, Mus musculus
attccatggatgaaaggtgatagtt

SEQ ID NO: 279446 - DNA, 25 bp, Mus musculus
attccatggatgtaaggtgatagtt

SEQ ID NO: 279447 - DNA, 25 bp, Mus musculus
attccatggcatactaaacctaaat

SEQ ID NO: 279448 - DNA, 25 bp, Mus musculus
attccatggcattctaaacctaaat

SEQ ID NO: 279449 - DNA, 25 bp, Mus musculus
attccatggctcagggctagagtct

SEQ ID NO: 279450 - DNA, 25 bp, Mus musculus
attccatggctctgggctagagtct

SEQ ID NO: 279451 - DNA, 25 bp, Mus musculus
attccatggtggctgttctgcttac

SEQ ID NO: 279452 - DNA, 25 bp, Mus musculus
attccatggtgggtgttctgcttac

SEQ ID NO: 279453 - DNA, 25 bp, Mus musculus
attccatgtagtaggtacccttgtg

SEQ ID NO: 279454 - DNA, 25 bp, Mus musculus
attccatgtagttggtacccttgtg

SEQ ID NO: 279455 - DNA, 25 bp, Mus musculus
attccatgtatcactgttgacacca

SEQ ID NO: 279456 - DNA, 25 bp, Mus musculus
attccatgtatctctgttgacacca

SEQ ID NO: 279457 - DNA, 25 bp, Mus musculus
attccatgtcggcaagaggtttctt

SEQ ID NO: 279458 - DNA, 25 bp, Mus musculus
attccatgtcgggaagaggtttctt

SEQ ID NO: 279459 - DNA, 25 bp, Mus musculus
attccatgtcttatgatatgtctac

SEQ ID NO: 279460 - DNA, 25 bp, Mus musculus
attccatgtcttttgatatgtctac

SEQ ID NO: 279461 - DNA, 25 bp, Mus musculus
attccatgttttcgctctatctcat

SEQ ID NO: 279462 - DNA, 25 bp, Mus musculus
attccatgttttggctctatctcat

SEQ ID NO: 279463 - DNA, 25 bp, Mus musculus
attccattcatgctctaagatgtca

SEQ ID NO: 279464 - DNA, 25 bp, Mus musculus
attccattcatggtctaagatgtca

SEQ ID NO: 279465 - DNA, 25 bp, Mus musculus
attccattcattaaagcctagctaa

SEQ ID NO: 279466 - DNA, 25 bp, Mus musculus
attccattcatttaagcctagctaa

SEQ ID NO: 279467 - DNA, 25 bp, Mus musculus
attccattccagctaccaagtgaag

SEQ ID NO: 279468 - DNA, 25 bp, Mus musculus
attccattccaggtaccaagtgaag

SEQ ID NO: 279469 - DNA, 25 bp, Mus musculus
attccattcccaaattcaactgcag

SEQ ID NO: 279470 - DNA, 25 bp, Mus musculus
attccattcccatattcaactgcag

SEQ ID NO: 279471 - DNA, 25 bp, Mus musculus
attccattctgacccgcaattcctt

SEQ ID NO: 279472 - DNA, 25 bp, Mus musculus
attccattctgagccgcaattcctt

SEQ ID NO: 279473 - DNA, 25 bp, Mus musculus
attccattgaatataccacgcatca

SEQ ID NO: 279474 - DNA, 25 bp, Mus musculus
attccattgaatttaccacgcatca

SEQ ID NO: 279475 - DNA, 25 bp, Mus musculus
attccattgcatcaaaacactcaac

SEQ ID NO: 279476 - DNA, 25 bp, Mus musculus
attccattgcatgaaaacactcaac

SEQ ID NO: 279477 - DNA, 25 bp, Mus musculus
attccattgctgaaccctcattgga

SEQ ID NO: 279478 - DNA, 25 bp, Mus musculus
attccattgctgtaccctcattgga

SEQ ID NO: 279479 - DNA, 25 bp, Mus musculus
attccattggagaaggagttaccca

SEQ ID NO: 279480 - DNA, 25 bp, Mus musculus
attccattggagtaggagttaccca

SEQ ID NO: 279481 - DNA, 25 bp, Mus musculus
attccattgtgcatgctaccagcaa

SEQ ID NO: 279482 - DNA, 25 bp, Mus musculus
attccattgtgcttgctaccagcaa

SEQ ID NO: 279483 - DNA, 25 bp, Mus musculus
attccattgtggacagtaatacgca

SEQ ID NO: 279484 - DNA, 25 bp, Mus musculus
attccattgtggtcagtaatacgca

SEQ ID NO: 279485 - DNA, 25 bp, Mus musculus
attccatttaccagctgacgtctgt

SEQ ID NO: 279486 - DNA, 25 bp, Mus musculus
attccatttacctgctgacgtctgt

SEQ ID NO: 279487 - DNA, 25 bp, Mus musculus
attccatttatccaatacccgtgta

SEQ ID NO: 279488 - DNA, 25 bp, Mus musculus
attccatttatcgaatacccgtgta

SEQ ID NO: 279489 - DNA, 25 bp, Mus musculus
attccatttcagctcagttcctagt

SEQ ID NO: 279490 - DNA, 25 bp, Mus musculus
attccatttcaggtcagttcctagt

SEQ ID NO: 279491 - DNA, 25 bp, Mus musculus
attccatttccaactgcagtgtact

SEQ ID NO: 279492 - DNA, 25 bp, Mus musculus
attccatttccatctgcagtgtact

SEQ ID NO: 279493 - DNA, 25 bp, Mus musculus
attccatttcccacaactgaatact

SEQ ID NO: 279494 - DNA, 25 bp, Mus musculus
attccatttccctcaactgaatact

SEQ ID NO: 279495 - DNA, 25 bp, Mus musculus
attccatttccgattacatatacca

SEQ ID NO: 279496 - DNA, 25 bp, Mus musculus
attccatttccgtttacatatacca

SEQ ID NO: 279497 - DNA, 25 bp, Mus musculus
attccatttgggacagcctggctgg

SEQ ID NO: 279498 - DNA, 25 bp, Mus musculus
attccatttgggtcagcctggctgg

SEQ ID NO: 279499 - DNA, 25 bp, Mus musculus
attccattttaaccgctacctcact

SEQ ID NO: 279500 - DNA, 25 bp, Mus musculus
attccattttaagcgctacctcact

SEQ ID NO: 279501 - DNA, 25 bp, Mus musculus
attccattttacactctgtccaact

SEQ ID NO: 279502 - DNA, 25 bp, Mus musculus
attccattttactctctgtccaact

SEQ ID NO: 279503 - DNA, 25 bp, Mus musculus
attccattttagagcttgaccgtgc

SEQ ID NO: 279504 - DNA, 25 bp, Mus musculus
attccattttagtgcttgaccgtgc

SEQ ID NO: 279505 - DNA, 25 bp, Mus musculus
attccattttgtaaggcacttccgc

SEQ ID NO: 279506 - DNA, 25 bp, Mus musculus
attccattttgttaggcacttccgc

SEQ ID NO: 279507 - DNA, 25 bp, Mus musculus
attcccaaaggaccggcagagtcag

SEQ ID NO: 279508 - DNA, 25 bp, Mus musculus
attcccaaaggagcggcagagtcag

SEQ ID NO: 279509 - DNA, 25 bp, Mus musculus
attcccaaattcaactgcagctagg

SEQ ID NO: 279510 - DNA, 25 bp, Mus musculus
attcccaaattctactgcagctagg

SEQ ID NO: 279511 - DNA, 25 bp, Mus musculus
attcccaacaccaggacttgtcagg

SEQ ID NO: 279512 - DNA, 25 bp, Mus musculus
attcccaacacctggacttgtcagg

SEQ ID NO: 279513 - DNA, 25 bp, Mus musculus
attcccaactgtcccatagtgataa

SEQ ID NO: 279514 - DNA, 25 bp, Mus musculus
attcccaactgtgccatagtgataa

SEQ ID NO: 279515 - DNA, 25 bp, Mus musculus
attcccaagaaccatgagtcagccg

SEQ ID NO: 279516 - DNA, 25 bp, Mus musculus
attcccaagaacgatgagtcagccg

SEQ ID NO: 279517 - DNA, 25 bp, Mus musculus
attcccaagagccatagtgattaag

SEQ ID NO: 279518 - DNA, 25 bp, Mus musculus
attcccaagagcgatagtgattaag

SEQ ID NO: 279519 - DNA, 25 bp, Mus musculus
attcccaagtgtacagttgaggcca

SEQ ID NO: 279520 - DNA, 25 bp, Mus musculus
attcccaagtgttcagttgaggcca

SEQ ID NO: 279521 - DNA, 25 bp, Mus musculus
attcccaatgcccaccgtgtgttgc

SEQ ID NO: 279522 - DNA, 25 bp, Mus musculus
attcccaatgccgaccgtgtgttgc

SEQ ID NO: 279523 - DNA, 25 bp, Mus musculus
attcccacaactcgctggctggaac

SEQ ID NO: 279524 - DNA, 25 bp, Mus musculus
attcccacaactggctggctggaac

SEQ ID NO: 279525 - DNA, 25 bp, Mus musculus
attcccacaatcctctgcattagtt

SEQ ID NO: 279526 - DNA, 25 bp, Mus musculus
attcccacaatcgtctgcattagtt

SEQ ID NO: 279527 - DNA, 25 bp, Mus musculus
attcccacagggacttgttaaagct

SEQ ID NO: 279528 - DNA, 25 bp, Mus musculus
attcccacagggtcttgttaaagct

SEQ ID NO: 279529 - DNA, 25 bp, Mus musculus
attcccaccacacttcagaacgtag

SEQ ID NO: 279530 - DNA, 25 bp, Mus musculus
attcccaccacagttcagaacgtag

SEQ ID NO: 279531 - DNA, 25 bp, Mus musculus
attcccaccctcatataactgtttg

SEQ ID NO: 279532 - DNA, 25 bp, Mus musculus
attcccaccctcttataactgtttg

SEQ ID NO: 279533 - DNA, 25 bp, Mus musculus
attcccaccgctcagttcagaggct

SEQ ID NO: 279534 - DNA, 25 bp, Mus musculus
attcccaccgctgagttcagaggct

SEQ ID NO: 279535 - DNA, 25 bp, Mus musculus
attcccacctacaatgtggcctgtg

SEQ ID NO: 279536 - DNA, 25 bp, Mus musculus
attcccacctactatgtggcctgtg

SEQ ID NO: 279537 - DNA, 25 bp, Mus musculus
attcccacggtcatgttcacagttg

SEQ ID NO: 279538 - DNA, 25 bp, Mus musculus
attcccacggtcttgttcacagttg

SEQ ID NO: 279539 - DNA, 25 bp, Mus musculus
attcccacggtgcaggttaatcatg

SEQ ID NO: 279540 - DNA, 25 bp, Mus musculus
attcccacggtggaggttaatcatg

SEQ ID NO: 279541 - DNA, 25 bp, Mus musculus
attcccactgtgatctacgagcata

SEQ ID NO: 279542 - DNA, 25 bp, Mus musculus
attcccactgtgttctacgagcata

SEQ ID NO: 279543 - DNA, 25 bp, Mus musculus
attcccacttaaatcaaagcagctg

SEQ ID NO: 279544 - DNA, 25 bp, Mus musculus
attcccacttaattcaaagcagctg

SEQ ID NO: 279545 - DNA, 25 bp, Mus musculus
attcccactttgaggccatatggtg

SEQ ID NO: 279546 - DNA, 25 bp, Mus musculus
attcccactttgtggccatatggtg

SEQ ID NO: 279547 - DNA, 25 bp, Mus musculus
attcccagaaccatgagtcagaaaa

SEQ ID NO: 279548 - DNA, 25 bp, Mus musculus
attcccagaaccttgagtcagaaaa

SEQ ID NO: 279549 - DNA, 25 bp, Mus musculus
attcccagacctcttgggaggatgg

SEQ ID NO: 279550 - DNA, 25 bp, Mus musculus
attcccagacctgttgggaggatgg

SEQ ID NO: 279551 - DNA, 25 bp, Mus musculus
attcccagagctatgtctttgttgg

SEQ ID NO: 279552 - DNA, 25 bp, Mus musculus
attcccagagctttgtctttgttgg

SEQ ID NO: 279553 - DNA, 25 bp, Mus musculus
attcccagaggcatcaattcacttg

SEQ ID NO: 279554 - DNA, 25 bp, Mus musculus
attcccagaggcttcaattcacttg

SEQ ID NO: 279555 - DNA, 25 bp, Mus musculus
attcccagcaaccaggtattagtca

SEQ ID NO: 279556 - DNA, 25 bp, Mus musculus
attcccagcaacgaggtattagtca

SEQ ID NO: 279557 - DNA, 25 bp, Mus musculus
attcccagcaatccacagctttgtg

SEQ ID NO: 279558 - DNA, 25 bp, Mus musculus
attcccagcaatgcacagctttgtg

SEQ ID NO: 279559 - DNA, 25 bp, Mus musculus
attcccagcctgctggtcccagagg

SEQ ID NO: 279560 - DNA, 25 bp, Mus musculus
attcccagcctggtggtcccagagg

SEQ ID NO: 279561 - DNA, 25 bp, Mus musculus
attcccagctgtaatgttgtgtatg

SEQ ID NO: 279562 - DNA, 25 bp, Mus musculus
attcccagctgttatgttgtgtatg

SEQ ID NO: 279563 - DNA, 25 bp, Mus musculus
attcccagcttaaatacagtcccta

SEQ ID NO: 279564 - DNA, 25 bp, Mus musculus
attcccagcttatatacagtcccta

SEQ ID NO: 279565 - DNA, 25 bp, Mus musculus
attcccaggaatccgtatggtggga

SEQ ID NO: 279566 - DNA, 25 bp, Mus musculus
attcccaggaatgcgtatggtggga

SEQ ID NO: 279567 - DNA, 25 bp, Mus musculus
attcccaggaccctggtggcagatg

SEQ ID NO: 279568 - DNA, 25 bp, Mus musculus
attcccaggaccgtggtggcagatg

SEQ ID NO: 279569 - DNA, 25 bp, Mus musculus
attcccaggcaccagcaagtattta

SEQ ID NO: 279570 - DNA, 25 bp, Mus musculus
attcccaggcacgagcaagtattta

SEQ ID NO: 279571 - DNA, 25 bp, Mus musculus
attcccaggctaagtgtgtattcaa

SEQ ID NO: 279572 - DNA, 25 bp, Mus musculus
attcccaggctatgtgtgtattcaa

SEQ ID NO: 279573 - DNA, 25 bp, Mus musculus
attcccaggctgataacgcggtttg

SEQ ID NO: 279574 - DNA, 25 bp, Mus musculus
attcccaggctgttaacgcggtttg

SEQ ID NO: 279575 - DNA, 25 bp, Mus musculus
attcccagggacattctgtcattgc

SEQ ID NO: 279576 - DNA, 25 bp, Mus musculus
attcccagggactttctgtcattgc

SEQ ID NO: 279577 - DNA, 25 bp, Mus musculus
attcccagggagctcaggccacatt

SEQ ID NO: 279578 - DNA, 25 bp, Mus musculus
attcccagggaggtcaggccacatt

SEQ ID NO: 279579 - DNA, 25 bp, Mus musculus
attcccagggatcattgatgccggc

SEQ ID NO: 279580 - DNA, 25 bp, Mus musculus
attcccagggatgattgatgccggc

SEQ ID NO: 279581 - DNA, 25 bp, Mus musculus
attcccagtagacccaagaagccta

SEQ ID NO: 279582 - DNA, 25 bp, Mus musculus
attcccagtagagccaagaagccta

SEQ ID NO: 279583 - DNA, 25 bp, Mus musculus
attcccagtcctaagctgtccactg

SEQ ID NO: 279584 - DNA, 25 bp, Mus musculus
attcccagtccttagctgtccactg

SEQ ID NO: 279585 - DNA, 25 bp, Mus musculus
attcccagtctcagacgtgtttaag

SEQ ID NO: 279586 - DNA, 25 bp, Mus musculus
attcccagtctctgacgtgtttaag

SEQ ID NO: 279587 - DNA, 25 bp, Mus musculus
attcccagtcttacttacaactagc

SEQ ID NO: 279588 - DNA, 25 bp, Mus musculus
attcccagtctttcttacaactagc

SEQ ID NO: 279589 - DNA, 25 bp, Mus musculus
attcccagtgggacataagtttaca

SEQ ID NO: 279590 - DNA, 25 bp, Mus musculus
attcccagtgggtcataagtttaca

SEQ ID NO: 279591 - DNA, 25 bp, Mus musculus
attcccagttctaccctcagggaga

SEQ ID NO: 279592 - DNA, 25 bp, Mus musculus
attcccagttcttccctcagggaga

SEQ ID NO: 279593 - DNA, 25 bp, Mus musculus
attcccagttgcctgtggttgtgtc

SEQ ID NO: 279594 - DNA, 25 bp, Mus musculus
attcccagttgcgtgtggttgtgtc

SEQ ID NO: 279595 - DNA, 25 bp, Mus musculus
attcccagttgtctaggtgctggta

SEQ ID NO: 279596 - DNA, 25 bp, Mus musculus
attcccagttgtgtaggtgctggta

SEQ ID NO: 279597 - DNA, 25 bp, Mus musculus
attcccatacaaagatgaccctgag

SEQ ID NO: 279598 - DNA, 25 bp, Mus musculus
attcccatacaatgatgaccctgag

SEQ ID NO: 279599 - DNA, 25 bp, Mus musculus
attcccatatctaaatggtctccag

SEQ ID NO: 279600 - DNA, 25 bp, Mus musculus
attcccatatcttaatggtctccag

SEQ ID NO: 279601 - DNA, 25 bp, Mus musculus
attcccatatgaccggccttaggag

SEQ ID NO: 279602 - DNA, 25 bp, Mus musculus
attcccatatgagcggccttaggag

SEQ ID NO: 279603 - DNA, 25 bp, Mus musculus
attcccatccttcaagccagaatgc

SEQ ID NO: 279604 - DNA, 25 bp, Mus musculus
attcccatccttgaagccagaatgc

SEQ ID NO: 279605 - DNA, 25 bp, Mus musculus
attcccatcgggaattccgggcacg

SEQ ID NO: 279606 - DNA, 25 bp, Mus musculus
attcccatcgggtattccgggcacg

SEQ ID NO: 279607 - DNA, 25 bp, Mus musculus
attcccatctctccataactgagta

SEQ ID NO: 279608 - DNA, 25 bp, Mus musculus
attcccatctctgcataactgagta

SEQ ID NO: 279609 - DNA, 25 bp, Mus musculus
attcccatgaggctgagagttcttt

SEQ ID NO: 279610 - DNA, 25 bp, Mus musculus
attcccatgagggtgagagttcttt

SEQ ID NO: 279611 - DNA, 25 bp, Mus musculus
attcccatgtgtcgcatatgcacac

SEQ ID NO: 279612 - DNA, 25 bp, Mus musculus
attcccatgtgtggcatatgcacac

SEQ ID NO: 279613 - DNA, 25 bp, Mus musculus
attcccattattctttgtgctgctg

SEQ ID NO: 279614 - DNA, 25 bp, Mus musculus
attcccattattgtttgtgctgctg

SEQ ID NO: 279615 - DNA, 25 bp, Mus musculus
attcccattcataccagagtaagct

SEQ ID NO: 279616 - DNA, 25 bp, Mus musculus
attcccattcattccagagtaagct

SEQ ID NO: 279617 - DNA, 25 bp, Mus musculus
attcccattcttagaggttggaagc

SEQ ID NO: 279618 - DNA, 25 bp, Mus musculus
attcccattctttgaggttggaagc

SEQ ID NO: 279619 - DNA, 25 bp, Mus musculus
attcccattggacactgagttgcag

SEQ ID NO: 279620 - DNA, 25 bp, Mus musculus
attcccattggagactgagttgcag

SEQ ID NO: 279621 - DNA, 25 bp, Mus musculus
attccccaaacactcaggtggagat

SEQ ID NO: 279622 - DNA, 25 bp, Mus musculus
attccccaaacagtcaggtggagat

SEQ ID NO: 279623 - DNA, 25 bp, Mus musculus
attccccaaggcctagcagagagtt

SEQ ID NO: 279624 - DNA, 25 bp, Mus musculus
attccccaaggcgtagcagagagtt

SEQ ID NO: 279625 - DNA, 25 bp, Mus musculus
attccccaatagactatcttccaga

SEQ ID NO: 279626 - DNA, 25 bp, Mus musculus
attccccaatagtctatcttccaga

SEQ ID NO: 279627 - DNA, 25 bp, Mus musculus
attccccaatcccaagcaagatgag

SEQ ID NO: 279628 - DNA, 25 bp, Mus musculus
attccccaatccgaagcaagatgag

SEQ ID NO: 279629 - DNA, 25 bp, Mus musculus
attccccaatggcatcaagcaactg

SEQ ID NO: 279630 - DNA, 25 bp, Mus musculus
attccccaatgggatcaagcaactg

SEQ ID NO: 279631 - DNA, 25 bp, Mus musculus
attccccaattaaaggtgttgactg

SEQ ID NO: 279632 - DNA, 25 bp, Mus musculus
attccccaattataggtgttgactg

SEQ ID NO: 279633 - DNA, 25 bp, Mus musculus
attccccacaatccttggtcattat

SEQ ID NO: 279634 - DNA, 25 bp, Mus musculus
attccccacaatgcttggtcattat

SEQ ID NO: 279635 - DNA, 25 bp, Mus musculus
attccccacccaccttatgatgata

SEQ ID NO: 279636 - DNA, 25 bp, Mus musculus
attccccacccagcttatgatgata

SEQ ID NO: 279637 - DNA, 25 bp, Mus musculus
attccccactgcataacagtctatt

SEQ ID NO: 279638 - DNA, 25 bp, Mus musculus
attccccactgcttaacagtctatt

SEQ ID NO: 279639 - DNA, 25 bp, Mus musculus
attccccagcccattaggccagaag

SEQ ID NO: 279640 - DNA, 25 bp, Mus musculus
attccccagccctttaggccagaag

SEQ ID NO: 279641 - DNA, 25 bp, Mus musculus
attccccagcctcatgctttaaaag

SEQ ID NO: 279642 - DNA, 25 bp, Mus musculus
attccccagcctgatgctttaaaag

SEQ ID NO: 279643 - DNA, 25 bp, Mus musculus
attccccagtgcattcttcagaaag

SEQ ID NO: 279644 - DNA, 25 bp, Mus musculus
attccccagtgctttcttcagaaag

SEQ ID NO: 279645 - DNA, 25 bp, Mus musculus
attccccatcataccagagggcatg

SEQ ID NO: 279646 - DNA, 25 bp, Mus musculus
attccccatcattccagagggcatg

SEQ ID NO: 279647 - DNA, 25 bp, Mus musculus
attccccatgggaccagcgcaacag

SEQ ID NO: 279648 - DNA, 25 bp, Mus musculus
attccccatgggtccagcgcaacag

SEQ ID NO: 279649 - DNA, 25 bp, Mus musculus
attccccattacaatgagtcctagc

SEQ ID NO: 279650 - DNA, 25 bp, Mus musculus
attccccattactatgagtcctagc

SEQ ID NO: 279651 - DNA, 25 bp, Mus musculus
attccccggcttaatataatttgcg

SEQ ID NO: 279652 - DNA, 25 bp, Mus musculus
attccccggctttatataatttgcg

SEQ ID NO: 279653 - DNA, 25 bp, Mus musculus
attccccgtacgaatacacaggatt

SEQ ID NO: 279654 - DNA, 25 bp, Mus musculus
attccccgtacgtatacacaggatt

SEQ ID NO: 279655 - DNA, 25 bp, Mus musculus
attccccgtaggctagagtgtctaa

SEQ ID NO: 279656 - DNA, 25 bp, Mus musculus
attccccgtagggtagagtgtctaa

SEQ ID NO: 279657 - DNA, 25 bp, Mus musculus
attcccctaagtatcttaactgcat

SEQ ID NO: 279658 - DNA, 25 bp, Mus musculus
attcccctaagtttcttaactgcat

SEQ ID NO: 279659 - DNA, 25 bp, Mus musculus
attcccctagaacagcaatgtcctt

SEQ ID NO: 279660 - DNA, 25 bp, Mus musculus
attcccctagaagagcaatgtcctt

SEQ ID NO: 279661 - DNA, 25 bp, Mus musculus
attcccctagatcctggagaaagcc

SEQ ID NO: 279662 - DNA, 25 bp, Mus musculus
attcccctagatgctggagaaagcc

SEQ ID NO: 279663 - DNA, 25 bp, Mus musculus
attcccctcactaatacactggata

SEQ ID NO: 279664 - DNA, 25 bp, Mus musculus
attcccctcacttatacactggata

SEQ ID NO: 279665 - DNA, 25 bp, Mus musculus
attcccctccaaacattgttatggc

SEQ ID NO: 279666 - DNA, 25 bp, Mus musculus
attcccctccaatcattgttatggc

SEQ ID NO: 279667 - DNA, 25 bp, Mus musculus
attcccctctgaagtggcctcagct

SEQ ID NO: 279668 - DNA, 25 bp, Mus musculus
attcccctctgatgtggcctcagct

SEQ ID NO: 279669 - DNA, 25 bp, Mus musculus
attcccctgacgataatagctgtga

SEQ ID NO: 279670 - DNA, 25 bp, Mus musculus
attcccctgacgttaatagctgtga

SEQ ID NO: 279671 - DNA, 25 bp, Mus musculus
attcccctgcgtataagcatgcatg

SEQ ID NO: 279672 - DNA, 25 bp, Mus musculus
attcccctgcgtttaagcatgcatg

SEQ ID NO: 279673 - DNA, 25 bp, Mus musculus
attcccctggaactgcatttggaaa

SEQ ID NO: 279674 - DNA, 25 bp, Mus musculus
attcccctggaagtgcatttggaaa

SEQ ID NO: 279675 - DNA, 25 bp, Mus musculus
attcccctgtacagtatactttact

SEQ ID NO: 279676 - DNA, 25 bp, Mus musculus
attcccctgtactgtatactttact

SEQ ID NO: 279677 - DNA, 25 bp, Mus musculus
attcccctgtttcaaattcctgatg

SEQ ID NO: 279678 - DNA, 25 bp, Mus musculus
attcccctgtttgaaattcctgatg

SEQ ID NO: 279679 - DNA, 25 bp, Mus musculus
attccccttctacatgcagtgttgc

SEQ ID NO: 279680 - DNA, 25 bp, Mus musculus
attccccttctagatgcagtgttgc

SEQ ID NO: 279681 - DNA, 25 bp, Mus musculus
attcccctttctccaagacagggat

SEQ ID NO: 279682 - DNA, 25 bp, Mus musculus
attcccctttctgcaagacagggat

SEQ ID NO: 279683 - DNA, 25 bp, Mus musculus
attcccgaaacaacactccggagtg

SEQ ID NO: 279684 - DNA, 25 bp, Mus musculus
attcccgaaacatcactccggagtg

SEQ ID NO: 279685 - DNA, 25 bp, Mus musculus
attcccgaacagcatctggcattct

SEQ ID NO: 279686 - DNA, 25 bp, Mus musculus
attcccgaacaggatctggcattct

SEQ ID NO: 279687 - DNA, 25 bp, Mus musculus
attcccgaatcccaatatcactgat

SEQ ID NO: 279688 - DNA, 25 bp, Mus musculus
attcccgaatccgaatatcactgat

SEQ ID NO: 279689 - DNA, 25 bp, Mus musculus
attcccgacgatactggtgtttgcg

SEQ ID NO: 279690 - DNA, 25 bp, Mus musculus
attcccgacgattctggtgtttgcg

SEQ ID NO: 279691 - DNA, 25 bp, Mus musculus
attcccgatgacatgcgcgtatgag

SEQ ID NO: 279692 - DNA, 25 bp, Mus musculus
attcccgatgacttgcgcgtatgag

SEQ ID NO: 279693 - DNA, 25 bp, Mus musculus
attcccgattatctgctgggccaga

SEQ ID NO: 279694 - DNA, 25 bp, Mus musculus
attcccgattatgtgctgggccaga

SEQ ID NO: 279695 - DNA, 25 bp, Mus musculus
attcccgcaggcacaaagaatcctt

SEQ ID NO: 279696 - DNA, 25 bp, Mus musculus
attcccgcaggctcaaagaatcctt

SEQ ID NO: 279697 - DNA, 25 bp, Mus musculus
attcccgcgtggaggtcctaatgga

SEQ ID NO: 279698 - DNA, 25 bp, Mus musculus
attcccgcgtggtggtcctaatgga

SEQ ID NO: 279699 - DNA, 25 bp, Mus musculus
attcccggagcaccaaggcaggttt

SEQ ID NO: 279700 - DNA, 25 bp, Mus musculus
attcccggagcagcaaggcaggttt

SEQ ID NO: 279701 - DNA, 25 bp, Mus musculus
attcccggcacacaccttggttaag

SEQ ID NO: 279702 - DNA, 25 bp, Mus musculus
attcccggcacagaccttggttaag

SEQ ID NO: 279703 - DNA, 25 bp, Mus musculus
attcccgggcagcaaggtctcgagt

SEQ ID NO: 279704 - DNA, 25 bp, Mus musculus
attcccgggcaggaaggtctcgagt

SEQ ID NO: 279705 - DNA, 25 bp, Mus musculus
attcccggtcggctggcttccagtg

SEQ ID NO: 279706 - DNA, 25 bp, Mus musculus
attcccggtcgggtggcttccagtg

SEQ ID NO: 279707 - DNA, 25 bp, Mus musculus
attcccgtcattcggccactgaaga

SEQ ID NO: 279708 - DNA, 25 bp, Mus musculus
attcccgtcattgggccactgaaga

SEQ ID NO: 279709 - DNA, 25 bp, Mus musculus
attcccgtgactcagagcatgtcca

SEQ ID NO: 279710 - DNA, 25 bp, Mus musculus
attcccgtgactgagagcatgtcca

SEQ ID NO: 279711 - DNA, 25 bp, Mus musculus
attcccgtgtctcacaacagttcca

SEQ ID NO: 279712 - DNA, 25 bp, Mus musculus
attcccgtgtctgacaacagttcca

SEQ ID NO: 279713 - DNA, 25 bp, Mus musculus
attcccgttattagcattctttaag

SEQ ID NO: 279714 - DNA, 25 bp, Mus musculus
attcccgttatttgcattctttaag

SEQ ID NO: 279715 - DNA, 25 bp, Mus musculus
attccctacacgatcatccttagag

SEQ ID NO: 279716 - DNA, 25 bp, Mus musculus
attccctacacgttcatccttagag

SEQ ID NO: 279717 - DNA, 25 bp, Mus musculus
attccctaccacacttaaagatcta

SEQ ID NO: 279718 - DNA, 25 bp, Mus musculus
attccctaccactcttaaagatcta

SEQ ID NO: 279719 - DNA, 25 bp, Mus musculus
attccctacgctattccctgtggct

SEQ ID NO: 279720 - DNA, 25 bp, Mus musculus
attccctacgcttttccctgtggct

SEQ ID NO: 279721 - DNA, 25 bp, Mus musculus
attccctactctctaattatccttg

SEQ ID NO: 279722 - DNA, 25 bp, Mus musculus
attccctactctgtaattatccttg

SEQ ID NO: 279723 - DNA, 25 bp, Mus musculus
attccctagaccacccagttggtga

SEQ ID NO: 279724 - DNA, 25 bp, Mus musculus
attccctagacctcccagttggtga

SEQ ID NO: 279725 - DNA, 25 bp, Mus musculus
attccctagatgcagggagccgatc

SEQ ID NO: 279726 - DNA, 25 bp, Mus musculus
attccctagatggagggagccgatc

SEQ ID NO: 279727 - DNA, 25 bp, Mus musculus
attccctagcaaccagtccaaatct

SEQ ID NO: 279728 - DNA, 25 bp, Mus musculus
attccctagcaagcagtccaaatct

SEQ ID NO: 279729 - DNA, 25 bp, Mus musculus
attccctatcacagaggtggcctga

SEQ ID NO: 279730 - DNA, 25 bp, Mus musculus
attccctatcactgaggtggcctga

SEQ ID NO: 279731 - DNA, 25 bp, Mus musculus
attccctatggtaagctctagatac

SEQ ID NO: 279732 - DNA, 25 bp, Mus musculus
attccctatggttagctctagatac

SEQ ID NO: 279733 - DNA, 25 bp, Mus musculus
attccctatttcactgtccttgatc

SEQ ID NO: 279734 - DNA, 25 bp, Mus musculus
attccctatttctctgtccttgatc

SEQ ID NO: 279735 - DNA, 25 bp, Mus musculus
attccctcacacacttcagtgacat

SEQ ID NO: 279736 - DNA, 25 bp, Mus musculus
attccctcacactcttcagtgacat

SEQ ID NO: 279737 - DNA, 25 bp, Mus musculus
attccctcacatctgtagttcacgg

SEQ ID NO: 279738 - DNA, 25 bp, Mus musculus
attccctcacatgtgtagttcacgg

SEQ ID NO: 279739 - DNA, 25 bp, Mus musculus
attccctcagcaaatcattggccat

SEQ ID NO: 279740 - DNA, 25 bp, Mus musculus
attccctcagcatatcattggccat

SEQ ID NO: 279741 - DNA, 25 bp, Mus musculus
attccctcagctccagatgtattaa

SEQ ID NO: 279742 - DNA, 25 bp, Mus musculus
attccctcagctgcagatgtattaa

SEQ ID NO: 279743 - DNA, 25 bp, Mus musculus
attccctcaggcaggtgagacggcc

SEQ ID NO: 279744 - DNA, 25 bp, Mus musculus
attccctcaggctggtgagacggcc

SEQ ID NO: 279745 - DNA, 25 bp, Mus musculus
attccctcagtgagttgtgatgggt

SEQ ID NO: 279746 - DNA, 25 bp, Mus musculus
attccctcagtgtgttgtgatgggt

SEQ ID NO: 279747 - DNA, 25 bp, Mus musculus
attccctccagcattgaagtgtagt

SEQ ID NO: 279748 - DNA, 25 bp, Mus musculus
attccctccagctttgaagtgtagt

SEQ ID NO: 279749 - DNA, 25 bp, Mus musculus
attccctccattatcagccatctgt

SEQ ID NO: 279750 - DNA, 25 bp, Mus musculus
attccctccattttcagccatctgt

SEQ ID NO: 279751 - DNA, 25 bp, Mus musculus
attccctcccatatatgaagtgaag

SEQ ID NO: 279752 - DNA, 25 bp, Mus musculus
attccctcccatttatgaagtgaag

SEQ ID NO: 279753 - DNA, 25 bp, Mus musculus
attccctccgagagtttctatcaaa

SEQ ID NO: 279754 - DNA, 25 bp, Mus musculus
attccctccgagtgtttctatcaaa

SEQ ID NO: 279755 - DNA, 25 bp, Mus musculus
attccctccttgatgactgtgttaa

SEQ ID NO: 279756 - DNA, 25 bp, Mus musculus
attccctccttgttgactgtgttaa

SEQ ID NO: 279757 - DNA, 25 bp, Mus musculus
attccctcgggaataaactgagaat

SEQ ID NO: 279758 - DNA, 25 bp, Mus musculus
attccctcgggacctgaggtcagat

SEQ ID NO: 279759 - DNA, 25 bp, Mus musculus
attccctcgggagctgaggtcagat

SEQ ID NO: 279760 - DNA, 25 bp, Mus musculus
attccctcgggattaaactgagaat

SEQ ID NO: 279761 - DNA, 25 bp, Mus musculus
attccctctaagcaagcaggcgcca

SEQ ID NO: 279762 - DNA, 25 bp, Mus musculus
attccctctaaggaagcaggcgcca

SEQ ID NO: 279763 - DNA, 25 bp, Mus musculus
attccctctcatctcaggtcgctga

SEQ ID NO: 279764 - DNA, 25 bp, Mus musculus
attccctctcatgtcaggtcgctga

SEQ ID NO: 279765 - DNA, 25 bp, Mus musculus
attccctctcttcctttgtatattt

SEQ ID NO: 279766 - DNA, 25 bp, Mus musculus
attccctctcttgctttgtatattt

SEQ ID NO: 279767 - DNA, 25 bp, Mus musculus
attccctctgatagcactcgaagaa

SEQ ID NO: 279768 - DNA, 25 bp, Mus musculus
attccctctgattgcactcgaagaa

SEQ ID NO: 279769 - DNA, 25 bp, Mus musculus
attccctctgtgcatactcttgtag

SEQ ID NO: 279770 - DNA, 25 bp, Mus musculus
attccctctgtggatactcttgtag

SEQ ID NO: 279771 - DNA, 25 bp, Mus musculus
attccctcttcgatcacagatgtag

SEQ ID NO: 279772 - DNA, 25 bp, Mus musculus
attccctcttcgttcacagatgtag

SEQ ID NO: 279773 - DNA, 25 bp, Mus musculus
attccctgaagaaataaacctctgc

SEQ ID NO: 279774 - DNA, 25 bp, Mus musculus
attccctgaagaaatgggaccctga

SEQ ID NO: 279775 - DNA, 25 bp, Mus musculus
attccctgaagatataaacctctgc

SEQ ID NO: 279776 - DNA, 25 bp, Mus musculus
attccctgaagatatgggaccctga

SEQ ID NO: 279777 - DNA, 25 bp, Mus musculus
attccctgagatactaattagctga

SEQ ID NO: 279778 - DNA, 25 bp, Mus musculus
attccctgagattctaattagctga

SEQ ID NO: 279779 - DNA, 25 bp, Mus musculus
attccctgatttatccacaacttct

SEQ ID NO: 279780 - DNA, 25 bp, Mus musculus
attccctgatttttccacaacttct

SEQ ID NO: 279781 - DNA, 25 bp, Mus musculus
attccctgcaggacaaattgccggt

SEQ ID NO: 279782 - DNA, 25 bp, Mus musculus
attccctgcaggtcaaattgccggt

SEQ ID NO: 279783 - DNA, 25 bp, Mus musculus
attccctgcctaccatgaaggcttc

SEQ ID NO: 279784 - DNA, 25 bp, Mus musculus
attccctgcctagcatgaaggcttc

SEQ ID NO: 279785 - DNA, 25 bp, Mus musculus
attccctggcatatatacctacata

SEQ ID NO: 279786 - DNA, 25 bp, Mus musculus
attccctggcatttatacctacata

SEQ ID NO: 279787 - DNA, 25 bp, Mus musculus
attccctggccgaaggtaggatgaa

SEQ ID NO: 279788 - DNA, 25 bp, Mus musculus
attccctggccgtaggtaggatgaa

SEQ ID NO: 279789 - DNA, 25 bp, Mus musculus
attccctggtttctgtttgagtgtc

SEQ ID NO: 279790 - DNA, 25 bp, Mus musculus
attccctggtttgtgtttgagtgtc

SEQ ID NO: 279791 - DNA, 25 bp, Mus musculus
attccctgtcagaaaatatctagaa

SEQ ID NO: 279792 - DNA, 25 bp, Mus musculus
attccctgtcagcaacttttcatcc

SEQ ID NO: 279793 - DNA, 25 bp, Mus musculus
attccctgtcaggaacttttcatcc

SEQ ID NO: 279794 - DNA, 25 bp, Mus musculus
attccctgtcagtaaatatctagaa

SEQ ID NO: 279795 - DNA, 25 bp, Mus musculus
attccctgtcccaggaggtggatgg

SEQ ID NO: 279796 - DNA, 25 bp, Mus musculus
attccctgtccctggaggtggatgg

SEQ ID NO: 279797 - DNA, 25 bp, Mus musculus
attccctgtgggatagcacttaata

SEQ ID NO: 279798 - DNA, 25 bp, Mus musculus
attccctgtgggttagcacttaata

SEQ ID NO: 279799 - DNA, 25 bp, Mus musculus
attccctgtgtgcttcagtgttcca

SEQ ID NO: 279800 - DNA, 25 bp, Mus musculus
attccctgtgtggttcagtgttcca

SEQ ID NO: 279801 - DNA, 25 bp, Mus musculus
attccctgttggatcctgtttcact

SEQ ID NO: 279802 - DNA, 25 bp, Mus musculus
attccctgttggttcctgtttcact

SEQ ID NO: 279803 - DNA, 25 bp, Mus musculus
attccctgtttgaaatcactttctt

SEQ ID NO: 279804 - DNA, 25 bp, Mus musculus
attccctgtttgtaatcactttctt

SEQ ID NO: 279805 - DNA, 25 bp, Mus musculus
attcccttaaggaggatgatccatt

SEQ ID NO: 279806 - DNA, 25 bp, Mus musculus
attcccttaaggatgagactatagt

SEQ ID NO: 279807 - DNA, 25 bp, Mus musculus
attcccttaaggtggatgatccatt

SEQ ID NO: 279808 - DNA, 25 bp, Mus musculus
attcccttaaggttgagactatagt

SEQ ID NO: 279809 - DNA, 25 bp, Mus musculus
attcccttaatgctaaacagaccag

SEQ ID NO: 279810 - DNA, 25 bp, Mus musculus
attcccttaatggtaaacagaccag

SEQ ID NO: 279811 - DNA, 25 bp, Mus musculus
attcccttagctccacacaggagtg

SEQ ID NO: 279812 - DNA, 25 bp, Mus musculus
attcccttagctgcacacaggagtg

SEQ ID NO: 279813 - DNA, 25 bp, Mus musculus
attcccttagtaatttctgcaattc

SEQ ID NO: 279814 - DNA, 25 bp, Mus musculus
attcccttagtattttctgcaattc

SEQ ID NO: 279815 - DNA, 25 bp, Mus musculus
attcccttcagacggacatcgaggc

SEQ ID NO: 279816 - DNA, 25 bp, Mus musculus
attcccttcagagggacatcgaggc

SEQ ID NO: 279817 - DNA, 25 bp, Mus musculus
attcccttcaggataacttcagcta

SEQ ID NO: 279818 - DNA, 25 bp, Mus musculus
attcccttcaggttaacttcagcta

SEQ ID NO: 279819 - DNA, 25 bp, Mus musculus
attcccttcgtaaaatggtgattca

SEQ ID NO: 279820 - DNA, 25 bp, Mus musculus
attcccttcgtataatggtgattca

SEQ ID NO: 279821 - DNA, 25 bp, Mus musculus
attcccttctaaatgcactgtgtac

SEQ ID NO: 279822 - DNA, 25 bp, Mus musculus
attcccttctaattgcactgtgtac

SEQ ID NO: 279823 - DNA, 25 bp, Mus musculus
attcccttcttacgcagcacaaaga

SEQ ID NO: 279824 - DNA, 25 bp, Mus musculus
attcccttcttaggcagcacaaaga

SEQ ID NO: 279825 - DNA, 25 bp, Mus musculus
attcccttcttcaattttcccagag

SEQ ID NO: 279826 - DNA, 25 bp, Mus musculus
attcccttcttctattttcccagag

SEQ ID NO: 279827 - DNA, 25 bp, Mus musculus
attcccttgactaggattataccca

SEQ ID NO: 279828 - DNA, 25 bp, Mus musculus
attcccttgacttggattataccca

SEQ ID NO: 279829 - DNA, 25 bp, Mus musculus
attcccttggtgatgattctgttaa

SEQ ID NO: 279830 - DNA, 25 bp, Mus musculus
attcccttggtgttgattctgttaa

SEQ ID NO: 279831 - DNA, 25 bp, Mus musculus
attcccttgtaaattattactgtgg

SEQ ID NO: 279832 - DNA, 25 bp, Mus musculus
attcccttgtaatttattactgtgg

SEQ ID NO: 279833 - DNA, 25 bp, Mus musculus
attcccttgtggatctaggagcaca

SEQ ID NO: 279834 - DNA, 25 bp, Mus musculus
attcccttgtggttctaggagcaca

SEQ ID NO: 279835 - DNA, 25 bp, Mus musculus
attccctttccacaaattgccagtg

SEQ ID NO: 279836 - DNA, 25 bp, Mus musculus
attccctttccagaaattgccagtg

SEQ ID NO: 279837 - DNA, 25 bp, Mus musculus
attccctttcccctatgtaaagctg

SEQ ID NO: 279838 - DNA, 25 bp, Mus musculus
attccctttcccgtatgtaaagctg

SEQ ID NO: 279839 - DNA, 25 bp, Mus musculus
attccctttctaccttctatgtaga

SEQ ID NO: 279840 - DNA, 25 bp, Mus musculus
attccctttctagcttctatgtaga

SEQ ID NO: 279841 - DNA, 25 bp, Mus musculus
attccctttctcagaagtcccagaa

SEQ ID NO: 279842 - DNA, 25 bp, Mus musculus
attccctttctctgaagtcccagaa

SEQ ID NO: 279843 - DNA, 25 bp, Mus musculus
attccctttctgaagctacacagtc

SEQ ID NO: 279844 - DNA, 25 bp, Mus musculus
attccctttctgtagctacacagtc

SEQ ID NO: 279845 - DNA, 25 bp, Mus musculus
attccctttgcactgcttcaggtta

SEQ ID NO: 279846 - DNA, 25 bp, Mus musculus
attccctttgcagtgcttcaggtta

SEQ ID NO: 279847 - DNA, 25 bp, Mus musculus
attccctttttcctgttggatcttg

SEQ ID NO: 279848 - DNA, 25 bp, Mus musculus
attccctttttcgtgttggatcttg

SEQ ID NO: 279849 - DNA, 25 bp, Mus musculus
attccgaaaagaatgcttccccctg

SEQ ID NO: 279850 - DNA, 25 bp, Mus musculus
attccgaaaagattgcttccccctg

SEQ ID NO: 279851 - DNA, 25 bp, Mus musculus
attccgaatgtcacagcatccattt

SEQ ID NO: 279852 - DNA, 25 bp, Mus musculus
attccgaatgtctcagcatccattt

SEQ ID NO: 279853 - DNA, 25 bp, Mus musculus
attccgacatccacacaaacattga

SEQ ID NO: 279854 - DNA, 25 bp, Mus musculus
attccgacatcctcacaaacattga

SEQ ID NO: 279855 - DNA, 25 bp, Mus musculus
attccgacccctccgtggaggagag

SEQ ID NO: 279856 - DNA, 25 bp, Mus musculus
attccgacccctgcgtggaggagag

SEQ ID NO: 279857 - DNA, 25 bp, Mus musculus
attccgagaaccacgggatgttcca

SEQ ID NO: 279858 - DNA, 25 bp, Mus musculus
attccgagaacctcgggatgttcca

SEQ ID NO: 279859 - DNA, 25 bp, Mus musculus
attccgagaagcaccagggtcccag

SEQ ID NO: 279860 - DNA, 25 bp, Mus musculus
attccgagaagctccagggtcccag

SEQ ID NO: 279861 - DNA, 25 bp, Mus musculus
attccgagagtaaagctatgtccca

SEQ ID NO: 279862 - DNA, 25 bp, Mus musculus
attccgagagtatagctatgtccca

SEQ ID NO: 279863 - DNA, 25 bp, Mus musculus
attccgagagtcagcttaaaaccac

SEQ ID NO: 279864 - DNA, 25 bp, Mus musculus
attccgagagtctgcttaaaaccac

SEQ ID NO: 279865 - DNA, 25 bp, Mus musculus
attccgagcacactgggctgctctc

SEQ ID NO: 279866 - DNA, 25 bp, Mus musculus
attccgagcacagtgggctgctctc

SEQ ID NO: 279867 - DNA, 25 bp, Mus musculus
attccgagcgctctcaaggcaggac

SEQ ID NO: 279868 - DNA, 25 bp, Mus musculus
attccgagcgctgtcaaggcaggac

SEQ ID NO: 279869 - DNA, 25 bp, Mus musculus
attccgagctgaacgggtgtgctga

SEQ ID NO: 279870 - DNA, 25 bp, Mus musculus
attccgagctgatcgggtgtgctga

SEQ ID NO: 279871 - DNA, 25 bp, Mus musculus
attccgaggccgctacagaagtccc

SEQ ID NO: 279872 - DNA, 25 bp, Mus musculus
attccgaggccggtacagaagtccc

SEQ ID NO: 279873 - DNA, 25 bp, Mus musculus
attccgagtaaaatcttcatagatt

SEQ ID NO: 279874 - DNA, 25 bp, Mus musculus
attccgagtaaattcttcatagatt

SEQ ID NO: 279875 - DNA, 25 bp, Mus musculus
attccgattcaaccatacacaagac

SEQ ID NO: 279876 - DNA, 25 bp, Mus musculus
attccgattcaagcatacacaagac

SEQ ID NO: 279877 - DNA, 25 bp, Mus musculus
attccgattcccaatgaactcagta

SEQ ID NO: 279878 - DNA, 25 bp, Mus musculus
attccgattccctatgaactcagta

SEQ ID NO: 279879 - DNA, 25 bp, Mus musculus
attccgcactggcaagccctaagga

SEQ ID NO: 279880 - DNA, 25 bp, Mus musculus
attccgcactgggaagccctaagga

SEQ ID NO: 279881 - DNA, 25 bp, Mus musculus
attccgcagctcaactactgcagga

SEQ ID NO: 279882 - DNA, 25 bp, Mus musculus
attccgcagctctactactgcagga

SEQ ID NO: 279883 - DNA, 25 bp, Mus musculus
attccgcatcgcctaaatgaaggta

SEQ ID NO: 279884 - DNA, 25 bp, Mus musculus
attccgcatcgcgtaaatgaaggta

SEQ ID NO: 279885 - DNA, 25 bp, Mus musculus
attccgcccaataccagtgacatgg

SEQ ID NO: 279886 - DNA, 25 bp, Mus musculus
attccgcccaattccagtgacatgg

SEQ ID NO: 279887 - DNA, 25 bp, Mus musculus
attccgcccttcagtactgtgaatg

SEQ ID NO: 279888 - DNA, 25 bp, Mus musculus
attccgcccttctgtactgtgaatg

SEQ ID NO: 279889 - DNA, 25 bp, Mus musculus
attccgcgcaataaacgacagcatt

SEQ ID NO: 279890 - DNA, 25 bp, Mus musculus
attccgcgcaattaacgacagcatt

SEQ ID NO: 279891 - DNA, 25 bp, Mus musculus
attccgcgtagaatatggctctttc

SEQ ID NO: 279892 - DNA, 25 bp, Mus musculus
attccgcgtagattatggctctttc

SEQ ID NO: 279893 - DNA, 25 bp, Mus musculus
attccgctgaaaaaggctaatgctt

SEQ ID NO: 279894 - DNA, 25 bp, Mus musculus
attccgctgaaataggctaatgctt

SEQ ID NO: 279895 - DNA, 25 bp, Mus musculus
attccgctttaccaattgagccttg

SEQ ID NO: 279896 - DNA, 25 bp, Mus musculus
attccgctttacgaattgagccttg

SEQ ID NO: 279897 - DNA, 25 bp, Mus musculus
attccggaaagtcacctgctcacca

SEQ ID NO: 279898 - DNA, 25 bp, Mus musculus
attccggaaagtgacctgctcacca

SEQ ID NO: 279899 - DNA, 25 bp, Mus musculus
attccggagcccagttgagcctttt

SEQ ID NO: 279900 - DNA, 25 bp, Mus musculus
attccggagccctgttgagcctttt

SEQ ID NO: 279901 - DNA, 25 bp, Mus musculus
attccggaggtcctgtggtctgcaa

SEQ ID NO: 279902 - DNA, 25 bp, Mus musculus
attccggaggtcgtgtggtctgcaa

SEQ ID NO: 279903 - DNA, 25 bp, Mus musculus
attccggatacacgcattttgtgga

SEQ ID NO: 279904 - DNA, 25 bp, Mus musculus
attccggatacaggcattttgtgga

SEQ ID NO: 279905 - DNA, 25 bp, Mus musculus
attccggatggccagcatgctatgg

SEQ ID NO: 279906 - DNA, 25 bp, Mus musculus
attccggatggcgagcatgctatgg

SEQ ID NO: 279907 - DNA, 25 bp, Mus musculus
attccggcaggtcctgggaatgtca

SEQ ID NO: 279908 - DNA, 25 bp, Mus musculus
attccggcaggtgctgggaatgtca

SEQ ID NO: 279909 - DNA, 25 bp, Mus musculus
attccgggatagaagaaccagggca

SEQ ID NO: 279910 - DNA, 25 bp, Mus musculus
attccgggatagtagaaccagggca

SEQ ID NO: 279911 - DNA, 25 bp, Mus musculus
attccgggcattcgtagggtcgctc

SEQ ID NO: 279912 - DNA, 25 bp, Mus musculus
attccgggcattggtagggtcgctc

SEQ ID NO: 279913 - DNA, 25 bp, Mus musculus
attccggtcactaccagaggtttga

SEQ ID NO: 279914 - DNA, 25 bp, Mus musculus
attccggtcacttccagaggtttga

SEQ ID NO: 279915 - DNA, 25 bp, Mus musculus
attccggttcccataccacattcag

SEQ ID NO: 279916 - DNA, 25 bp, Mus musculus
attccggttcccttaccacattcag

SEQ ID NO: 279917 - DNA, 25 bp, Mus musculus
attccgtagatcactagactccttg

SEQ ID NO: 279918 - DNA, 25 bp, Mus musculus
attccgtagatctctagactccttg

SEQ ID NO: 279919 - DNA, 25 bp, Mus musculus
attccgtcagaaatctagattcgaa

SEQ ID NO: 279920 - DNA, 25 bp, Mus musculus
attccgtcagaattctagattcgaa

SEQ ID NO: 279921 - DNA, 25 bp, Mus musculus
attccgtcagccactccgtgtgttc

SEQ ID NO: 279922 - DNA, 25 bp, Mus musculus
attccgtcagcctctccgtgtgttc

SEQ ID NO: 279923 - DNA, 25 bp, Mus musculus
attccgtcatgtctgctaggtatgc

SEQ ID NO: 279924 - DNA, 25 bp, Mus musculus
attccgtcatgtgtgctaggtatgc

SEQ ID NO: 279925 - DNA, 25 bp, Mus musculus
attccgtctagcagccttagtaagg

SEQ ID NO: 279926 - DNA, 25 bp, Mus musculus
attccgtctagctgccttagtaagg

SEQ ID NO: 279927 - DNA, 25 bp, Mus musculus
attccgtgacggactgagttctgag

SEQ ID NO: 279928 - DNA, 25 bp, Mus musculus
attccgtgacggtctgagttctgag

SEQ ID NO: 279929 - DNA, 25 bp, Mus musculus
attccgtgatttaggtgctttctgt

SEQ ID NO: 279930 - DNA, 25 bp, Mus musculus
attccgtgattttggtgctttctgt

SEQ ID NO: 279931 - DNA, 25 bp, Mus musculus
attccgtgcacgcaaagggacgctc

SEQ ID NO: 279932 - DNA, 25 bp, Mus musculus
attccgtgcacggaaagggacgctc

SEQ ID NO: 279933 - DNA, 25 bp, Mus musculus
attccgtggagtacatcatgcattt

SEQ ID NO: 279934 - DNA, 25 bp, Mus musculus
attccgtggagttcatcatgcattt

SEQ ID NO: 279935 - DNA, 25 bp, Mus musculus
attccgtggtccacagatcctcaga

SEQ ID NO: 279936 - DNA, 25 bp, Mus musculus
attccgtggtcctcagatcctcaga

SEQ ID NO: 279937 - DNA, 25 bp, Mus musculus
attccgtggtttcttttgggtgctg

SEQ ID NO: 279938 - DNA, 25 bp, Mus musculus
attccgtggtttgttttgggtgctg

SEQ ID NO: 279939 - DNA, 25 bp, Mus musculus
attccgttacggcaaagggctgctg

SEQ ID NO: 279940 - DNA, 25 bp, Mus musculus
attccgttacgggaaagggctgctg

SEQ ID NO: 279941 - DNA, 25 bp, Mus musculus
attccgtttctgatgttattcacca

SEQ ID NO: 279942 - DNA, 25 bp, Mus musculus
attccgtttctgttgttattcacca

SEQ ID NO: 279943 - DNA, 25 bp, Mus musculus
attccgttttttagttctgatgcca

SEQ ID NO: 279944 - DNA, 25 bp, Mus musculus
attccgtttttttgttctgatgcca

SEQ ID NO: 279945 - DNA, 25 bp, Mus musculus
attcctaaactacacgaggcagccc

SEQ ID NO: 279946 - DNA, 25 bp, Mus musculus
attcctaaactagacgaggcagccc

SEQ ID NO: 279947 - DNA, 25 bp, Mus musculus
attcctaaaggcacaacagtcatta

SEQ ID NO: 279948 - DNA, 25 bp, Mus musculus
attcctaaaggctcaacagtcatta

SEQ ID NO: 279949 - DNA, 25 bp, Mus musculus
attcctaacactaggttcactacag

SEQ ID NO: 279950 - DNA, 25 bp, Mus musculus
attcctaacacttggttcactacag

SEQ ID NO: 279951 - DNA, 25 bp, Mus musculus
attcctaactcaaggcaatgccttt

SEQ ID NO: 279952 - DNA, 25 bp, Mus musculus
attcctaactcatggcaatgccttt

SEQ ID NO: 279953 - DNA, 25 bp, Mus musculus
attcctaagacacgctgtggcaggc

SEQ ID NO: 279954 - DNA, 25 bp, Mus musculus
attcctaagacaggctgtggcaggc

SEQ ID NO: 279955 - DNA, 25 bp, Mus musculus
attcctaagagaaattcccttatat

SEQ ID NO: 279956 - DNA, 25 bp, Mus musculus
attcctaagagatattcccttatat

SEQ ID NO: 279957 - DNA, 25 bp, Mus musculus
attcctaaggagacatggccgtggc

SEQ ID NO: 279958 - DNA, 25 bp, Mus musculus
attcctaaggagtcatggccgtggc

SEQ ID NO: 279959 - DNA, 25 bp, Mus musculus
attcctaaggatccttcctcaggag

SEQ ID NO: 279960 - DNA, 25 bp, Mus musculus
attcctaaggatgcttcctcaggag

SEQ ID NO: 279961 - DNA, 25 bp, Mus musculus
attcctacagcaacaagcagaaaca

SEQ ID NO: 279962 - DNA, 25 bp, Mus musculus
attcctacagcatcaagcagaaaca

SEQ ID NO: 279963 - DNA, 25 bp, Mus musculus
attcctaccacaaatactgcagaga

SEQ ID NO: 279964 - DNA, 25 bp, Mus musculus
attcctaccacatatactgcagaga

SEQ ID NO: 279965 - DNA, 25 bp, Mus musculus
attcctactgatacccatgctatga

SEQ ID NO: 279966 - DNA, 25 bp, Mus musculus
attcctactgattcccatgctatga

SEQ ID NO: 279967 - DNA, 25 bp, Mus musculus
attcctactgcaacccatcttgtgt

SEQ ID NO: 279968 - DNA, 25 bp, Mus musculus
attcctactgcatcccatcttgtgt

SEQ ID NO: 279969 - DNA, 25 bp, Mus musculus
attcctactgttaaaatttcatctg

SEQ ID NO: 279970 - DNA, 25 bp, Mus musculus
attcctactgtttaaatttcatctg

SEQ ID NO: 279971 - DNA, 25 bp, Mus musculus
attcctagaaatcagcgccgtcttc

SEQ ID NO: 279972 - DNA, 25 bp, Mus musculus
attcctagaaatgagcgccgtcttc

SEQ ID NO: 279973 - DNA, 25 bp, Mus musculus
attcctagctataatgaagatcagt

SEQ ID NO: 279974 - DNA, 25 bp, Mus musculus
attcctagctattatgaagatcagt

SEQ ID NO: 279975 - DNA, 25 bp, Mus musculus
attcctagcttcagtatagttctct

SEQ ID NO: 279976 - DNA, 25 bp, Mus musculus
attcctagcttctgtatagttctct

SEQ ID NO: 279977 - DNA, 25 bp, Mus musculus
attcctaggaagcttgcagtgacta

SEQ ID NO: 279978 - DNA, 25 bp, Mus musculus
attcctaggaaggttgcagtgacta

SEQ ID NO: 279979 - DNA, 25 bp, Mus musculus
attcctaggattatcgccacctcca

SEQ ID NO: 279980 - DNA, 25 bp, Mus musculus
attcctaggattttcgccacctcca

SEQ ID NO: 279981 - DNA, 25 bp, Mus musculus
attcctaggcacacttgtcaagaca

SEQ ID NO: 279982 - DNA, 25 bp, Mus musculus
attcctaggcactcttgtcaagaca

SEQ ID NO: 279983 - DNA, 25 bp, Mus musculus
attcctaggccccacgtaaagatgg

SEQ ID NO: 279984 - DNA, 25 bp, Mus musculus
attcctaggcccgacgtaaagatgg

SEQ ID NO: 279985 - DNA, 25 bp, Mus musculus
attcctagtagaacggtaaccactt

SEQ ID NO: 279986 - DNA, 25 bp, Mus musculus
attcctagtagatcggtaaccactt

SEQ ID NO: 279987 - DNA, 25 bp, Mus musculus
attcctagtgagacccatcctctaa

SEQ ID NO: 279988 - DNA, 25 bp, Mus musculus
attcctagtgagtcccatcctctaa

SEQ ID NO: 279989 - DNA, 25 bp, Mus musculus
attcctagtgcccaaggtggccaga

SEQ ID NO: 279990 - DNA, 25 bp, Mus musculus
attcctagtgccgaaggtggccaga

SEQ ID NO: 279991 - DNA, 25 bp, Mus musculus
attcctagtgctcacaccgggttag

SEQ ID NO: 279992 - DNA, 25 bp, Mus musculus
attcctagtgctgacaccgggttag

SEQ ID NO: 279993 - DNA, 25 bp, Mus musculus
attcctagttggagagaaacctgtt

SEQ ID NO: 279994 - DNA, 25 bp, Mus musculus
attcctagttggtgagaaacctgtt

SEQ ID NO: 279995 - DNA, 25 bp, Mus musculus
attcctagttgtagggactctttgc

SEQ ID NO: 279996 - DNA, 25 bp, Mus musculus
attcctagttgttgggactctttgc

SEQ ID NO: 279997 - DNA, 25 bp, Mus musculus
attcctataatgattttcctgcctc

SEQ ID NO: 279998 - DNA, 25 bp, Mus musculus
attcctataatgtttttcctgcctc

SEQ ID NO: 279999 - DNA, 25 bp, Mus musculus
attcctatagtcatattttccagta

SEQ ID NO: 280000 - DNA, 25 bp, Mus musculus
attcctatagtcttattttccagta

SEQ ID NO: 280001 - DNA, 25 bp, Mus musculus
attcctatatctccatgaatgtgta

SEQ ID NO: 280002 - DNA, 25 bp, Mus musculus
attcctatatctgcatgaatgtgta

SEQ ID NO: 280003 - DNA, 25 bp, Mus musculus
attcctatcgtcaaggaggtcccag

SEQ ID NO: 280004 - DNA, 25 bp, Mus musculus
attcctatcgtctaggaggtcccag

SEQ ID NO: 280005 - DNA, 25 bp, Mus musculus
attcctatctttcccagccacaggg

SEQ ID NO: 280006 - DNA, 25 bp, Mus musculus
attcctatctttgccagccacaggg

SEQ ID NO: 280007 - DNA, 25 bp, Mus musculus
attcctattacaaatcccctcaaga

SEQ ID NO: 280008 - DNA, 25 bp, Mus musculus
attcctattacatatcccctcaaga

SEQ ID NO: 280009 - DNA, 25 bp, Mus musculus
attcctattaccaagcaccattata

SEQ ID NO: 280010 - DNA, 25 bp, Mus musculus
attcctattacctagcaccattata

SEQ ID NO: 280011 - DNA, 25 bp, Mus musculus
attcctattggccatacatactact

SEQ ID NO: 280012 - DNA, 25 bp, Mus musculus
attcctattggcgatacatactact

SEQ ID NO: 280013 - DNA, 25 bp, Mus musculus
attcctattgtcatttgctctgctt

SEQ ID NO: 280014 - DNA, 25 bp, Mus musculus
attcctattgtcttttgctctgctt

SEQ ID NO: 280015 - DNA, 25 bp, Mus musculus
attcctatttccaatcccgatcaaa

SEQ ID NO: 280016 - DNA, 25 bp, Mus musculus
attcctatttcctatcccgatcaaa

SEQ ID NO: 280017 - DNA, 25 bp, Mus musculus
attcctcaactactcagggcactga

SEQ ID NO: 280018 - DNA, 25 bp, Mus musculus
attcctcaactagtcagggcactga

SEQ ID NO: 280019 - DNA, 25 bp, Mus musculus
attcctcaagaaccaagctttgaaa

SEQ ID NO: 280020 - DNA, 25 bp, Mus musculus
attcctcaagaagcaagctttgaaa

SEQ ID NO: 280021 - DNA, 25 bp, Mus musculus
attcctcaagtgaattattagtcag

SEQ ID NO: 280022 - DNA, 25 bp, Mus musculus
attcctcaagtgtattattagtcag

SEQ ID NO: 280023 - DNA, 25 bp, Mus musculus
attcctcaagttctgggcattctca

SEQ ID NO: 280024 - DNA, 25 bp, Mus musculus
attcctcaagttgtgggcattctca

SEQ ID NO: 280025 - DNA, 25 bp, Mus musculus
attcctcaatttatctgcctgttat

SEQ ID NO: 280026 - DNA, 25 bp, Mus musculus
attcctcaatttttctgcctgttat

SEQ ID NO: 280027 - DNA, 25 bp, Mus musculus
attcctcacacgctataaatattta

SEQ ID NO: 280028 - DNA, 25 bp, Mus musculus
attcctcacacggtataaatattta

SEQ ID NO: 280029 - DNA, 25 bp, Mus musculus
attcctcacataccaatttgttcta

SEQ ID NO: 280030 - DNA, 25 bp, Mus musculus
attcctcacatagcaatttgttcta

SEQ ID NO: 280031 - DNA, 25 bp, Mus musculus
attcctcagaaaagtggtggcctca

SEQ ID NO: 280032 - DNA, 25 bp, Mus musculus
attcctcagaaatgtggtggcctca

SEQ ID NO: 280033 - DNA, 25 bp, Mus musculus
attcctcagaagacttcggctggtt

SEQ ID NO: 280034 - DNA, 25 bp, Mus musculus
attcctcagaagtcttcggctggtt

SEQ ID NO: 280035 - DNA, 25 bp, Mus musculus
attcctcagacactctgctgattta

SEQ ID NO: 280036 - DNA, 25 bp, Mus musculus
attcctcagacagtctgctgattta

SEQ ID NO: 280037 - DNA, 25 bp, Mus musculus
attcctcagacgcttgcaaactgtt

SEQ ID NO: 280038 - DNA, 25 bp, Mus musculus
attcctcagacggttgcaaactgtt

SEQ ID NO: 280039 - DNA, 25 bp, Mus musculus
attcctcagaggaaccaggtattcc

SEQ ID NO: 280040 - DNA, 25 bp, Mus musculus
attcctcagaggtaccaggtattcc

SEQ ID NO: 280041 - DNA, 25 bp, Mus musculus
attcctcagctcactgagtgtcata

SEQ ID NO: 280042 - DNA, 25 bp, Mus musculus
attcctcagctctctgagtgtcata

SEQ ID NO: 280043 - DNA, 25 bp, Mus musculus
attcctcaggatacatactttcttg

SEQ ID NO: 280044 - DNA, 25 bp, Mus musculus
attcctcaggattcatactttcttg

SEQ ID NO: 280045 - DNA, 25 bp, Mus musculus
attcctcaggctccatctctactat

SEQ ID NO: 280046 - DNA, 25 bp, Mus musculus
attcctcaggctgcatctctactat

SEQ ID NO: 280047 - DNA, 25 bp, Mus musculus
attcctcagtatcgcagggttcaac

SEQ ID NO: 280048 - DNA, 25 bp, Mus musculus
attcctcagtatggcagggttcaac

SEQ ID NO: 280049 - DNA, 25 bp, Mus musculus
attcctcataggactcttggctgct

SEQ ID NO: 280050 - DNA, 25 bp, Mus musculus
attcctcataggcagaactcgtctg

SEQ ID NO: 280051 - DNA, 25 bp, Mus musculus
attcctcatagggagaactcgtctg

SEQ ID NO: 280052 - DNA, 25 bp, Mus musculus
attcctcataggtctcttggctgct

SEQ ID NO: 280053 - DNA, 25 bp, Mus musculus
attcctccacagatcctctgggaaa

SEQ ID NO: 280054 - DNA, 25 bp, Mus musculus
attcctccacagttcctctgggaaa

SEQ ID NO: 280055 - DNA, 25 bp, Mus musculus
attcctccactgagaattgggctgg

SEQ ID NO: 280056 - DNA, 25 bp, Mus musculus
attcctccactgtgaattgggctgg

SEQ ID NO: 280057 - DNA, 25 bp, Mus musculus
attcctccagacagaatgagggctt

SEQ ID NO: 280058 - DNA, 25 bp, Mus musculus
attcctccagactgaatgagggctt

SEQ ID NO: 280059 - DNA, 25 bp, Mus musculus
attcctccagtacctgtatttctga

SEQ ID NO: 280060 - DNA, 25 bp, Mus musculus
attcctccagtagctgtatttctga

SEQ ID NO: 280061 - DNA, 25 bp, Mus musculus
attcctccatgtaccattccgggaa

SEQ ID NO: 280062 - DNA, 25 bp, Mus musculus
attcctccatgttccattccgggaa

SEQ ID NO: 280063 - DNA, 25 bp, Mus musculus
attcctcccaagaggttactgttct

SEQ ID NO: 280064 - DNA, 25 bp, Mus musculus
attcctcccaagtggttactgttct

SEQ ID NO: 280065 - DNA, 25 bp, Mus musculus
attcctcccaatccacaagtgaaga

SEQ ID NO: 280066 - DNA, 25 bp, Mus musculus
attcctcccaatgcacaagtgaaga

SEQ ID NO: 280067 - DNA, 25 bp, Mus musculus
attcctcccagtaggccatcaagag

SEQ ID NO: 280068 - DNA, 25 bp, Mus musculus
attcctcccagttggccatcaagag

SEQ ID NO: 280069 - DNA, 25 bp, Mus musculus
attcctcctagtcagcttgcaaagc

SEQ ID NO: 280070 - DNA, 25 bp, Mus musculus
attcctcctagtgagcttgcaaagc

SEQ ID NO: 280071 - DNA, 25 bp, Mus musculus
attcctcctcataatttctggcaga

SEQ ID NO: 280072 - DNA, 25 bp, Mus musculus
attcctcctcattatttctggcaga

SEQ ID NO: 280073 - DNA, 25 bp, Mus musculus
attcctcctccaagtactgctcttg

SEQ ID NO: 280074 - DNA, 25 bp, Mus musculus
attcctcctccatgtactgctcttg

SEQ ID NO: 280075 - DNA, 25 bp, Mus musculus
attcctcctgacagagctggtgtaa

SEQ ID NO: 280076 - DNA, 25 bp, Mus musculus
attcctcctgactgagctggtgtaa

SEQ ID NO: 280077 - DNA, 25 bp, Mus musculus
attcctcctgagagtagctgtttgc

SEQ ID NO: 280078 - DNA, 25 bp, Mus musculus
attcctcctgagtgtagctgtttgc

SEQ ID NO: 280079 - DNA, 25 bp, Mus musculus
attcctccttccatgttcagagggc

SEQ ID NO: 280080 - DNA, 25 bp, Mus musculus
attcctccttccttgttcagagggc

SEQ ID NO: 280081 - DNA, 25 bp, Mus musculus
attcctcgcctcaactcagatttaa

SEQ ID NO: 280082 - DNA, 25 bp, Mus musculus
attcctcgcctctactcagatttaa

SEQ ID NO: 280083 - DNA, 25 bp, Mus musculus
attcctcgctgaccatattctgaaa

SEQ ID NO: 280084 - DNA, 25 bp, Mus musculus
attcctcgctgagcatattctgaaa

SEQ ID NO: 280085 - DNA, 25 bp, Mus musculus
attcctcgctgcaaaggcatctagt

SEQ ID NO: 280086 - DNA, 25 bp, Mus musculus
attcctcgctgctaaggcatctagt

SEQ ID NO: 280087 - DNA, 25 bp, Mus musculus
attcctcgctggcacatgtttttga

SEQ ID NO: 280088 - DNA, 25 bp, Mus musculus
attcctcgctgggacatgtttttga

SEQ ID NO: 280089 - DNA, 25 bp, Mus musculus
attcctcgggttcacgttcatatct

SEQ ID NO: 280090 - DNA, 25 bp, Mus musculus
attcctcgggttgacgttcatatct

SEQ ID NO: 280091 - DNA, 25 bp, Mus musculus
attcctcgttttcaaggcctcagag

SEQ ID NO: 280092 - DNA, 25 bp, Mus musculus
attcctcgttttgaaggcctcagag

SEQ ID NO: 280093 - DNA, 25 bp, Mus musculus
attcctctccctaagacaaccaaag

SEQ ID NO: 280094 - DNA, 25 bp, Mus musculus
attcctctcccttagacaaccaaag

SEQ ID NO: 280095 - DNA, 25 bp, Mus musculus
attcctctctgaacttcactcatat

SEQ ID NO: 280096 - DNA, 25 bp, Mus musculus
attcctctctgatcttcactcatat

SEQ ID NO: 280097 - DNA, 25 bp, Mus musculus
attcctctgaggcacttggcctgag

SEQ ID NO: 280098 - DNA, 25 bp, Mus musculus
attcctctgagggacttggcctgag

SEQ ID NO: 280099 - DNA, 25 bp, Mus musculus
attcctctgatcctggacagcagca

SEQ ID NO: 280100 - DNA, 25 bp, Mus musculus
attcctctgatcgtggacagcagca

SEQ ID NO: 280101 - DNA, 25 bp, Mus musculus
attcctctgcaaaaagtcaagccac

SEQ ID NO: 280102 - DNA, 25 bp, Mus musculus
attcctctgcaataagtcaagccac

SEQ ID NO: 280103 - DNA, 25 bp, Mus musculus
attcctctgctcattggcacggcct

SEQ ID NO: 280104 - DNA, 25 bp, Mus musculus
attcctctgctctttggcacggcct

SEQ ID NO: 280105 - DNA, 25 bp, Mus musculus
attcctctggaaaccaagctgtaga

SEQ ID NO: 280106 - DNA, 25 bp, Mus musculus
attcctctggaaaccacagtgttga

SEQ ID NO: 280107 - DNA, 25 bp, Mus musculus
attcctctggaatccaagctgtaga

SEQ ID NO: 280108 - DNA, 25 bp, Mus musculus
attcctctggaatccacagtgttga

SEQ ID NO: 280109 - DNA, 25 bp, Mus musculus
attcctctgtagatgcacggcttag

SEQ ID NO: 280110 - DNA, 25 bp, Mus musculus
attcctctgtagttgcacggcttag

SEQ ID NO: 280111 - DNA, 25 bp, Mus musculus
attcctctgtatactggtcatgtgc

SEQ ID NO: 280112 - DNA, 25 bp, Mus musculus
attcctctgtattctggtcatgtgc

SEQ ID NO: 280113 - DNA, 25 bp, Mus musculus
attcctcttctaattgctagatagc

SEQ ID NO: 280114 - DNA, 25 bp, Mus musculus
attcctcttctatttgctagatagc

SEQ ID NO: 280115 - DNA, 25 bp, Mus musculus
attcctcttctcaatctgcacaaga

SEQ ID NO: 280116 - DNA, 25 bp, Mus musculus
attcctcttctctatctgcacaaga

SEQ ID NO: 280117 - DNA, 25 bp, Mus musculus
attcctcttcttaagcattcctgaa

SEQ ID NO: 280118 - DNA, 25 bp, Mus musculus
attcctcttctttagcattcctgaa

SEQ ID NO: 280119 - DNA, 25 bp, Mus musculus
attcctcttgctcaactcagaatca

SEQ ID NO: 280120 - DNA, 25 bp, Mus musculus
attcctcttgctgaactcagaatca

SEQ ID NO: 280121 - DNA, 25 bp, Mus musculus
attcctcttggacttgggctgacac

SEQ ID NO: 280122 - DNA, 25 bp, Mus musculus
attcctcttggagttgggctgacac

SEQ ID NO: 280123 - DNA, 25 bp, Mus musculus
attcctcttgtcaatagccagccga

SEQ ID NO: 280124 - DNA, 25 bp, Mus musculus
attcctcttgtcagtaactgccaaa

SEQ ID NO: 280125 - DNA, 25 bp, Mus musculus
attcctcttgtctatagccagccga

SEQ ID NO: 280126 - DNA, 25 bp, Mus musculus
attcctcttgtctgtaactgccaaa

SEQ ID NO: 280127 - DNA, 25 bp, Mus musculus
attcctctttcaatgtttaggcaga

SEQ ID NO: 280128 - DNA, 25 bp, Mus musculus
attcctctttcattgtttaggcaga

SEQ ID NO: 280129 - DNA, 25 bp, Mus musculus
attcctcttttaatgatctctcttt

SEQ ID NO: 280130 - DNA, 25 bp, Mus musculus
attcctcttttattgatctctcttt

SEQ ID NO: 280131 - DNA, 25 bp, Mus musculus
attcctgaagcgcaagttccagcac

SEQ ID NO: 280132 - DNA, 25 bp, Mus musculus
attcctgaagcggaagttccagcac

SEQ ID NO: 280133 - DNA, 25 bp, Mus musculus
attcctgaagttcctcgtaattgtt

SEQ ID NO: 280134 - DNA, 25 bp, Mus musculus
attcctgaagttgctcgtaattgtt

SEQ ID NO: 280135 - DNA, 25 bp, Mus musculus
attcctgaattcattcggttcattg

SEQ ID NO: 280136 - DNA, 25 bp, Mus musculus
attcctgaattctttcggttcattg

SEQ ID NO: 280137 - DNA, 25 bp, Mus musculus
attcctgacaaaaagttctctttta

SEQ ID NO: 280138 - DNA, 25 bp, Mus musculus
attcctgacaaatagttctctttta

SEQ ID NO: 280139 - DNA, 25 bp, Mus musculus
attcctgacaacaatcaccctgtgg

SEQ ID NO: 280140 - DNA, 25 bp, Mus musculus
attcctgacaactatcaccctgtgg

SEQ ID NO: 280141 - DNA, 25 bp, Mus musculus
attcctgacaatacgaaggttcttg

SEQ ID NO: 280142 - DNA, 25 bp, Mus musculus
attcctgacaattcgaaggttcttg

SEQ ID NO: 280143 - DNA, 25 bp, Mus musculus
attcctgacagcacatctactaatc

SEQ ID NO: 280144 - DNA, 25 bp, Mus musculus
attcctgacagctcatctactaatc

SEQ ID NO: 280145 - DNA, 25 bp, Mus musculus
attcctgactgtagtcgtatgacac

SEQ ID NO: 280146 - DNA, 25 bp, Mus musculus
attcctgactgttgtcgtatgacac

SEQ ID NO: 280147 - DNA, 25 bp, Mus musculus
attcctgagctaaaatcatactgag

SEQ ID NO: 280148 - DNA, 25 bp, Mus musculus
attcctgagctataatcatactgag

SEQ ID NO: 280149 - DNA, 25 bp, Mus musculus
attcctgaggataattctgcacgtc

SEQ ID NO: 280150 - DNA, 25 bp, Mus musculus
attcctgaggattattctgcacgtc

SEQ ID NO: 280151 - DNA, 25 bp, Mus musculus
attcctgaggtcaaggttatggcat

SEQ ID NO: 280152 - DNA, 25 bp, Mus musculus
attcctgaggtctaggttatggcat

SEQ ID NO: 280153 - DNA, 25 bp, Mus musculus
attcctgagtagaggtgtgctgacc

SEQ ID NO: 280154 - DNA, 25 bp, Mus musculus
attcctgagtagtggtgtgctgacc

SEQ ID NO: 280155 - DNA, 25 bp, Mus musculus
attcctgataggctgtgtgtgcatt

SEQ ID NO: 280156 - DNA, 25 bp, Mus musculus
attcctgatagggtgtgtgtgcatt

SEQ ID NO: 280157 - DNA, 25 bp, Mus musculus
attcctgatatgagttattcctata

SEQ ID NO: 280158 - DNA, 25 bp, Mus musculus
attcctgatatgtgttattcctata

SEQ ID NO: 280159 - DNA, 25 bp, Mus musculus
attcctgatcctaaacataactttt

SEQ ID NO: 280160 - DNA, 25 bp, Mus musculus
attcctgatcctcgcaagattttta

SEQ ID NO: 280161 - DNA, 25 bp, Mus musculus
attcctgatcctggcaagattttta

SEQ ID NO: 280162 - DNA, 25 bp, Mus musculus
attcctgatccttaacataactttt

SEQ ID NO: 280163 - DNA, 25 bp, Mus musculus
attcctgatcgaactttaaccctaa

SEQ ID NO: 280164 - DNA, 25 bp, Mus musculus
attcctgatcgatctttaaccctaa

SEQ ID NO: 280165 - DNA, 25 bp, Mus musculus
attcctgatcggagtggtggttccc

SEQ ID NO: 280166 - DNA, 25 bp, Mus musculus
attcctgatcggtgtggtggttccc

SEQ ID NO: 280167 - DNA, 25 bp, Mus musculus
attcctgatggacctcttaagtttc

SEQ ID NO: 280168 - DNA, 25 bp, Mus musculus
attcctgatggagctcttaagtttc

SEQ ID NO: 280169 - DNA, 25 bp, Mus musculus
attcctgatgggagacaccatgcct

SEQ ID NO: 280170 - DNA, 25 bp, Mus musculus
attcctgatgggtgacaccatgcct

SEQ ID NO: 280171 - DNA, 25 bp, Mus musculus
attcctgcaatgctgaatagtcaca

SEQ ID NO: 280172 - DNA, 25 bp, Mus musculus
attcctgcaatggtgaatagtcaca

SEQ ID NO: 280173 - DNA, 25 bp, Mus musculus
attcctgcagcaatagacgtgtgta

SEQ ID NO: 280174 - DNA, 25 bp, Mus musculus
attcctgcagcattagacgtgtgta

SEQ ID NO: 280175 - DNA, 25 bp, Mus musculus
attcctgcaggacccaagccaatgc

SEQ ID NO: 280176 - DNA, 25 bp, Mus musculus
attcctgcaggagccaagccaatgc

SEQ ID NO: 280177 - DNA, 25 bp, Mus musculus
attcctgcaggcacaaaccagctaa

SEQ ID NO: 280178 - DNA, 25 bp, Mus musculus
attcctgcaggctcaaaccagctaa

SEQ ID NO: 280179 - DNA, 25 bp, Mus musculus
attcctgcatagagggtacgtacgc

SEQ ID NO: 280180 - DNA, 25 bp, Mus musculus
attcctgcatagtgggtacgtacgc

SEQ ID NO: 280181 - DNA, 25 bp, Mus musculus
attcctgcatatcagagtgactgta

SEQ ID NO: 280182 - DNA, 25 bp, Mus musculus
attcctgcatatgagagtgactgta

SEQ ID NO: 280183 - DNA, 25 bp, Mus musculus
attcctgccaagctacctaggctga

SEQ ID NO: 280184 - DNA, 25 bp, Mus musculus
attcctgccaaggtacctaggctga

SEQ ID NO: 280185 - DNA, 25 bp, Mus musculus
attcctgcccctatgtttggaatgc

SEQ ID NO: 280186 - DNA, 25 bp, Mus musculus
attcctgcccctttgtttggaatgc

SEQ ID NO: 280187 - DNA, 25 bp, Mus musculus
attcctgccctgcaggtgccagcta

SEQ ID NO: 280188 - DNA, 25 bp, Mus musculus
attcctgccctggaggtgccagcta

SEQ ID NO: 280189 - DNA, 25 bp, Mus musculus
attcctgccgaactgggtggagtcc

SEQ ID NO: 280190 - DNA, 25 bp, Mus musculus
attcctgccgaagtgggtggagtcc

SEQ ID NO: 280191 - DNA, 25 bp, Mus musculus
attcctgcctggaggctggtgcgtt

SEQ ID NO: 280192 - DNA, 25 bp, Mus musculus
attcctgcctggtggctggtgcgtt

SEQ ID NO: 280193 - DNA, 25 bp, Mus musculus
attcctgccttcatggtcaaaggag

SEQ ID NO: 280194 - DNA, 25 bp, Mus musculus
attcctgccttcttggtcaaaggag

SEQ ID NO: 280195 - DNA, 25 bp, Mus musculus
attcctgcgccaatcttgggtgaag

SEQ ID NO: 280196 - DNA, 25 bp, Mus musculus
attcctgcgccattcttgggtgaag

SEQ ID NO: 280197 - DNA, 25 bp, Mus musculus
attcctgcgtgacaattttaccaga

SEQ ID NO: 280198 - DNA, 25 bp, Mus musculus
attcctgcgtgagaattttaccaga

SEQ ID NO: 280199 - DNA, 25 bp, Mus musculus
attcctgctaccaagggttcttctt

SEQ ID NO: 280200 - DNA, 25 bp, Mus musculus
attcctgctacctagggttcttctt

SEQ ID NO: 280201 - DNA, 25 bp, Mus musculus
attcctgctccaaatgaggtgctga

SEQ ID NO: 280202 - DNA, 25 bp, Mus musculus
attcctgctccatatgaggtgctga

SEQ ID NO: 280203 - DNA, 25 bp, Mus musculus
attcctgctggaaacccttttttat

SEQ ID NO: 280204 - DNA, 25 bp, Mus musculus
attcctgctggatacccttttttat

SEQ ID NO: 280205 - DNA, 25 bp, Mus musculus
attcctgcttcgctggctacgcggg

SEQ ID NO: 280206 - DNA, 25 bp, Mus musculus
attcctgcttcggtggctacgcggg

SEQ ID NO: 280207 - DNA, 25 bp, Mus musculus
attcctggaaggagctcgcacacag

SEQ ID NO: 280208 - DNA, 25 bp, Mus musculus
attcctggaaggtgctcgcacacag

SEQ ID NO: 280209 - DNA, 25 bp, Mus musculus
attcctggagacaaagcccacctgc

SEQ ID NO: 280210 - DNA, 25 bp, Mus musculus
attcctggagactaagcccacctgc

SEQ ID NO: 280211 - DNA, 25 bp, Mus musculus
attcctggagctcgcaactgattcc

SEQ ID NO: 280212 - DNA, 25 bp, Mus musculus
attcctggagctggcaactgattcc

SEQ ID NO: 280213 - DNA, 25 bp, Mus musculus
attcctggaggaacgactgacggtg

SEQ ID NO: 280214 - DNA, 25 bp, Mus musculus
attcctggaggatcgactgacggtg

SEQ ID NO: 280215 - DNA, 25 bp, Mus musculus
attcctggagtcaccttctaaatga

SEQ ID NO: 280216 - DNA, 25 bp, Mus musculus
attcctggagtctccttctaaatga

SEQ ID NO: 280217 - DNA, 25 bp, Mus musculus
attcctggcaagaagactgcacttt

SEQ ID NO: 280218 - DNA, 25 bp, Mus musculus
attcctggcaagtagactgcacttt

SEQ ID NO: 280219 - DNA, 25 bp, Mus musculus
attcctggccacacagaatagagcc

SEQ ID NO: 280220 - DNA, 25 bp, Mus musculus
attcctggccactcagaatagagcc

SEQ ID NO: 280221 - DNA, 25 bp, Mus musculus
attcctggccatatcacatttctta

SEQ ID NO: 280222 - DNA, 25 bp, Mus musculus
attcctggccatttcacatttctta

SEQ ID NO: 280223 - DNA, 25 bp, Mus musculus
attcctggcctactgtttattgttt

SEQ ID NO: 280224 - DNA, 25 bp, Mus musculus
attcctggcctagtgtttattgttt

SEQ ID NO: 280225 - DNA, 25 bp, Mus musculus
attcctggcgctccatgcaggtggt

SEQ ID NO: 280226 - DNA, 25 bp, Mus musculus
attcctggcgctgcatgcaggtggt

SEQ ID NO: 280227 - DNA, 25 bp, Mus musculus
attcctggcttgagtcatgcatcgt

SEQ ID NO: 280228 - DNA, 25 bp, Mus musculus
attcctggcttgtgtcatgcatcgt

SEQ ID NO: 280229 - DNA, 25 bp, Mus musculus
attcctgggaagcagcagctgttga

SEQ ID NO: 280230 - DNA, 25 bp, Mus musculus
attcctgggaaggagcagctgttga

SEQ ID NO: 280231 - DNA, 25 bp, Mus musculus
attcctgggaggatttcacaatgtc

SEQ ID NO: 280232 - DNA, 25 bp, Mus musculus
attcctgggaggttttcacaatgtc

SEQ ID NO: 280233 - DNA, 25 bp, Mus musculus
attcctgggagtatgtgctcttttg

SEQ ID NO: 280234 - DNA, 25 bp, Mus musculus
attcctgggagtttgtgctcttttg

SEQ ID NO: 280235 - DNA, 25 bp, Mus musculus
attcctgggttcagatgtttttgaa

SEQ ID NO: 280236 - DNA, 25 bp, Mus musculus
attcctgggttctgatgtttttgaa

SEQ ID NO: 280237 - DNA, 25 bp, Mus musculus
attcctggtactccatggtgtgttg

SEQ ID NO: 280238 - DNA, 25 bp, Mus musculus
attcctggtactgcatggtgtgttg

SEQ ID NO: 280239 - DNA, 25 bp, Mus musculus
attcctggtgatctgtactctgttt

SEQ ID NO: 280240 - DNA, 25 bp, Mus musculus
attcctggtgatgtgtactctgttt

SEQ ID NO: 280241 - DNA, 25 bp, Mus musculus
attcctggttctcggtgttctagat

SEQ ID NO: 280242 - DNA, 25 bp, Mus musculus
attcctggttctgggtgttctagat

SEQ ID NO: 280243 - DNA, 25 bp, Mus musculus
attcctgtaaggcactcatgtttga

SEQ ID NO: 280244 - DNA, 25 bp, Mus musculus
attcctgtaagggactcatgtttga

SEQ ID NO: 280245 - DNA, 25 bp, Mus musculus
attcctgtaattcaagatgctcgac

SEQ ID NO: 280246 - DNA, 25 bp, Mus musculus
attcctgtaattgaagatgctcgac

SEQ ID NO: 280247 - DNA, 25 bp, Mus musculus
attcctgtacctactatgagtgtca

SEQ ID NO: 280248 - DNA, 25 bp, Mus musculus
attcctgtacctcttatgacatgtg

SEQ ID NO: 280249 - DNA, 25 bp, Mus musculus
attcctgtacctgttatgacatgtg

SEQ ID NO: 280250 - DNA, 25 bp, Mus musculus
attcctgtaccttctatgagtgtca

SEQ ID NO: 280251 - DNA, 25 bp, Mus musculus
attcctgtagccaggagggagccac

SEQ ID NO: 280252 - DNA, 25 bp, Mus musculus
attcctgtagcctggagggagccac

SEQ ID NO: 280253 - DNA, 25 bp, Mus musculus
attcctgtatggactcttgacaaac

SEQ ID NO: 280254 - DNA, 25 bp, Mus musculus
attcctgtatggtctcttgacaaac

SEQ ID NO: 280255 - DNA, 25 bp, Mus musculus
attcctgtatgtcaaggatttgcct

SEQ ID NO: 280256 - DNA, 25 bp, Mus musculus
attcctgtatgtgaaggatttgcct

SEQ ID NO: 280257 - DNA, 25 bp, Mus musculus
attcctgtatttacatgggtctacc

SEQ ID NO: 280258 - DNA, 25 bp, Mus musculus
attcctgtattttcatgggtctacc

SEQ ID NO: 280259 - DNA, 25 bp, Mus musculus
attcctgtcaacagagctggccagc

SEQ ID NO: 280260 - DNA, 25 bp, Mus musculus
attcctgtcaactgagctggccagc

SEQ ID NO: 280261 - DNA, 25 bp, Mus musculus
attcctgtcacaacactacttggta

SEQ ID NO: 280262 - DNA, 25 bp, Mus musculus
attcctgtcacatcactacttggta

SEQ ID NO: 280263 - DNA, 25 bp, Mus musculus
attcctgtcaggatacttaatactc

SEQ ID NO: 280264 - DNA, 25 bp, Mus musculus
attcctgtcaggattaagctttgtt

SEQ ID NO: 280265 - DNA, 25 bp, Mus musculus
attcctgtcaggttacttaatactc

SEQ ID NO: 280266 - DNA, 25 bp, Mus musculus
attcctgtcaggtttaagctttgtt

SEQ ID NO: 280267 - DNA, 25 bp, Mus musculus
attcctgtcagtcaagccatacctc

SEQ ID NO: 280268 - DNA, 25 bp, Mus musculus
attcctgtcagtgaagccatacctc

SEQ ID NO: 280269 - DNA, 25 bp, Mus musculus
attcctgtccagagtggttactcct

SEQ ID NO: 280270 - DNA, 25 bp, Mus musculus
attcctgtccagtgtggttactcct

SEQ ID NO: 280271 - DNA, 25 bp, Mus musculus
attcctgtccctaaatacattccag

SEQ ID NO: 280272 - DNA, 25 bp, Mus musculus
attcctgtcccttaatacattccag

SEQ ID NO: 280273 - DNA, 25 bp, Mus musculus
attcctgtcctaaaagagggctgtg

SEQ ID NO: 280274 - DNA, 25 bp, Mus musculus
attcctgtcctataagagggctgtg

SEQ ID NO: 280275 - DNA, 25 bp, Mus musculus
attcctgtccttattgtcttacttg

SEQ ID NO: 280276 - DNA, 25 bp, Mus musculus
attcctgtcctttttgtcttacttg

SEQ ID NO: 280277 - DNA, 25 bp, Mus musculus
attcctgtcgttaatcttagaaaag

SEQ ID NO: 280278 - DNA, 25 bp, Mus musculus
attcctgtcgtttatcttagaaaag

SEQ ID NO: 280279 - DNA, 25 bp, Mus musculus
attcctgtcttaacaaagaattctg

SEQ ID NO: 280280 - DNA, 25 bp, Mus musculus
attcctgtcttatcaaagaattctg

SEQ ID NO: 280281 - DNA, 25 bp, Mus musculus
attcctgtgattcgtgattggtggc

SEQ ID NO: 280282 - DNA, 25 bp, Mus musculus
attcctgtgattggtgattggtggc

SEQ ID NO: 280283 - DNA, 25 bp, Mus musculus
attcctgtgcaaatcaaacgtccca

SEQ ID NO: 280284 - DNA, 25 bp, Mus musculus
attcctgtgcaattcaaacgtccca

SEQ ID NO: 280285 - DNA, 25 bp, Mus musculus
attcctgtgcgtcatctggaagcct

SEQ ID NO: 280286 - DNA, 25 bp, Mus musculus
attcctgtgcgtgatctggaagcct

SEQ ID NO: 280287 - DNA, 25 bp, Mus musculus
attcctgtgctcatggtgtatctat

SEQ ID NO: 280288 - DNA, 25 bp, Mus musculus
attcctgtgctcatttatgtataga

SEQ ID NO: 280289 - DNA, 25 bp, Mus musculus
attcctgtgctcttggtgtatctat

SEQ ID NO: 280290 - DNA, 25 bp, Mus musculus
attcctgtgctcttttatgtataga

SEQ ID NO: 280291 - DNA, 25 bp, Mus musculus
attcctgtgcttctgttcaagctta

SEQ ID NO: 280292 - DNA, 25 bp, Mus musculus
attcctgtgcttgtgttcaagctta

SEQ ID NO: 280293 - DNA, 25 bp, Mus musculus
attcctgtggccattatattttgac

SEQ ID NO: 280294 - DNA, 25 bp, Mus musculus
attcctgtggccatttatcaatacc

SEQ ID NO: 280295 - DNA, 25 bp, Mus musculus
attcctgtggcctttatattttgac

SEQ ID NO: 280296 - DNA, 25 bp, Mus musculus
attcctgtggccttttatcaatacc

SEQ ID NO: 280297 - DNA, 25 bp, Mus musculus
attcctgtgtataaaccaccaaatc

SEQ ID NO: 280298 - DNA, 25 bp, Mus musculus
attcctgtgtataaccttcttctga

SEQ ID NO: 280299 - DNA, 25 bp, Mus musculus
attcctgtgtattaaccaccaaatc

SEQ ID NO: 280300 - DNA, 25 bp, Mus musculus
attcctgtgtattaccttcttctga

SEQ ID NO: 280301 - DNA, 25 bp, Mus musculus
attcctgtgttcagtcgctatagct

SEQ ID NO: 280302 - DNA, 25 bp, Mus musculus
attcctgtgttctgtcgctatagct

SEQ ID NO: 280303 - DNA, 25 bp, Mus musculus
attcctgttacaaattttatagcaa

SEQ ID NO: 280304 - DNA, 25 bp, Mus musculus
attcctgttacatattttatagcaa

SEQ ID NO: 280305 - DNA, 25 bp, Mus musculus
attcctgttcagacttttcctgatg

SEQ ID NO: 280306 - DNA, 25 bp, Mus musculus
attcctgttcagtcttttcctgatg

SEQ ID NO: 280307 - DNA, 25 bp, Mus musculus
attcctgttcctcgtctttccagtg

SEQ ID NO: 280308 - DNA, 25 bp, Mus musculus
attcctgttcctctgctgagaaagg

SEQ ID NO: 280309 - DNA, 25 bp, Mus musculus
attcctgttcctggtctttccagtg

SEQ ID NO: 280310 - DNA, 25 bp, Mus musculus
attcctgttcctgtgctgagaaagg

SEQ ID NO: 280311 - DNA, 25 bp, Mus musculus
attcctgttggaacagctttcccag

SEQ ID NO: 280312 - DNA, 25 bp, Mus musculus
attcctgttggaatgttcaaattac

SEQ ID NO: 280313 - DNA, 25 bp, Mus musculus
attcctgttggatcagctttcccag

SEQ ID NO: 280314 - DNA, 25 bp, Mus musculus
attcctgttggattgttcaaattac

SEQ ID NO: 280315 - DNA, 25 bp, Mus musculus
attcctgttgtaagatggtccagtc

SEQ ID NO: 280316 - DNA, 25 bp, Mus musculus
attcctgttgtatgatggtccagtc

SEQ ID NO: 280317 - DNA, 25 bp, Mus musculus
attcctgttgtgatctttgcagacc

SEQ ID NO: 280318 - DNA, 25 bp, Mus musculus
attcctgttgtgttctttgcagacc

SEQ ID NO: 280319 - DNA, 25 bp, Mus musculus
attcctgtttacagaatatgcctct

SEQ ID NO: 280320 - DNA, 25 bp, Mus musculus
attcctgtttactgaatatgcctct

SEQ ID NO: 280321 - DNA, 25 bp, Mus musculus
attccttaaaggatgctgctatttc

SEQ ID NO: 280322 - DNA, 25 bp, Mus musculus
attccttaaaggttgctgctatttc

SEQ ID NO: 280323 - DNA, 25 bp, Mus musculus
attccttaaatgatacgagagccta

SEQ ID NO: 280324 - DNA, 25 bp, Mus musculus
attccttaaatgttacgagagccta

SEQ ID NO: 280325 - DNA, 25 bp, Mus musculus
attccttaaattccatacgtgtgta

SEQ ID NO: 280326 - DNA, 25 bp, Mus musculus
attccttaaattgcatacgtgtgta

SEQ ID NO: 280327 - DNA, 25 bp, Mus musculus
attccttaagcaaacatttaccaag

SEQ ID NO: 280328 - DNA, 25 bp, Mus musculus
attccttaagcatacatttaccaag

SEQ ID NO: 280329 - DNA, 25 bp, Mus musculus
attccttaagtgaacacccatgatg

SEQ ID NO: 280330 - DNA, 25 bp, Mus musculus
attccttaagtgtacacccatgatg

SEQ ID NO: 280331 - DNA, 25 bp, Mus musculus
attccttaatgcacttcgccaggaa

SEQ ID NO: 280332 - DNA, 25 bp, Mus musculus
attccttaatgctcttcgccaggaa

SEQ ID NO: 280333 - DNA, 25 bp, Mus musculus
attccttacatgatcctttcattac

SEQ ID NO: 280334 - DNA, 25 bp, Mus musculus
attccttacatgttcctttcattac

SEQ ID NO: 280335 - DNA, 25 bp, Mus musculus
attccttaccgtcaaagaagctagt

SEQ ID NO: 280336 - DNA, 25 bp, Mus musculus
attccttaccgtgaaagaagctagt

SEQ ID NO: 280337 - DNA, 25 bp, Mus musculus
attccttactaaattgtctgggtga

SEQ ID NO: 280338 - DNA, 25 bp, Mus musculus
attccttactaatttgtctgggtga

SEQ ID NO: 280339 - DNA, 25 bp, Mus musculus
attccttagacactatccacctatt

SEQ ID NO: 280340 - DNA, 25 bp, Mus musculus
attccttagacagtatccacctatt

SEQ ID NO: 280341 - DNA, 25 bp, Mus musculus
attccttagaggaagctgtccttaa

SEQ ID NO: 280342 - DNA, 25 bp, Mus musculus
attccttagaggtagctgtccttaa

SEQ ID NO: 280343 - DNA, 25 bp, Mus musculus
attccttataaaccaccatcatatg

SEQ ID NO: 280344 - DNA, 25 bp, Mus musculus
attccttataaagcaccatcatatg

SEQ ID NO: 280345 - DNA, 25 bp, Mus musculus
attccttatcatatcttggcattac

SEQ ID NO: 280346 - DNA, 25 bp, Mus musculus
attccttatcatttcttggcattac

SEQ ID NO: 280347 - DNA, 25 bp, Mus musculus
attccttatcttatccaagccagtg

SEQ ID NO: 280348 - DNA, 25 bp, Mus musculus
attccttatcttttccaagccagtg

SEQ ID NO: 280349 - DNA, 25 bp, Mus musculus
attccttcacccaccagcttcattt

SEQ ID NO: 280350 - DNA, 25 bp, Mus musculus
attccttcaccctccagcttcattt

SEQ ID NO: 280351 - DNA, 25 bp, Mus musculus
attccttcacttatgagctgaggga

SEQ ID NO: 280352 - DNA, 25 bp, Mus musculus
attccttcacttttgagctgaggga

SEQ ID NO: 280353 - DNA, 25 bp, Mus musculus
attccttcagaaatatatggcctac

SEQ ID NO: 280354 - DNA, 25 bp, Mus musculus
attccttcagaattatatggcctac

SEQ ID NO: 280355 - DNA, 25 bp, Mus musculus
attccttcagcgctcttgggtttct

SEQ ID NO: 280356 - DNA, 25 bp, Mus musculus
attccttcagcggtcttgggtttct

SEQ ID NO: 280357 - DNA, 25 bp, Mus musculus
attccttcaggcctaaggtcagaga

SEQ ID NO: 280358 - DNA, 25 bp, Mus musculus
attccttcaggcgtaaggtcagaga

SEQ ID NO: 280359 - DNA, 25 bp, Mus musculus
attccttcatagctttgagtcctcc

SEQ ID NO: 280360 - DNA, 25 bp, Mus musculus
attccttcataggtttgagtcctcc

SEQ ID NO: 280361 - DNA, 25 bp, Mus musculus
attccttcatgtatgctttcgttgg

SEQ ID NO: 280362 - DNA, 25 bp, Mus musculus
attccttcatgtttgctttcgttgg

SEQ ID NO: 280363 - DNA, 25 bp, Mus musculus
attccttccaaacctattgcagatg

SEQ ID NO: 280364 - DNA, 25 bp, Mus musculus
attccttccaaagctattgcagatg

SEQ ID NO: 280365 - DNA, 25 bp, Mus musculus
attccttccacaagctgtcttatct

SEQ ID NO: 280366 - DNA, 25 bp, Mus musculus
attccttccacatgctgtcttatct

SEQ ID NO: 280367 - DNA, 25 bp, Mus musculus
attccttccacccatttcagtaaat

SEQ ID NO: 280368 - DNA, 25 bp, Mus musculus
attccttccaccgatttcagtaaat

SEQ ID NO: 280369 - DNA, 25 bp, Mus musculus
attccttccagtcaaacgttcttag

SEQ ID NO: 280370 - DNA, 25 bp, Mus musculus
attccttccagtgaaacgttcttag

SEQ ID NO: 280371 - DNA, 25 bp, Mus musculus
attccttccatcaattcctcaggga

SEQ ID NO: 280372 - DNA, 25 bp, Mus musculus
attccttccatctattcctcaggga

SEQ ID NO: 280373 - DNA, 25 bp, Mus musculus
attccttcccatacttgaattattg

SEQ ID NO: 280374 - DNA, 25 bp, Mus musculus
attccttcccattcttgaattattg

SEQ ID NO: 280375 - DNA, 25 bp, Mus musculus
attccttcccctcatacaaaatgta

SEQ ID NO: 280376 - DNA, 25 bp, Mus musculus
attccttcccctgatacaaaatgta

SEQ ID NO: 280377 - DNA, 25 bp, Mus musculus
attccttcctatatttcttgctttg

SEQ ID NO: 280378 - DNA, 25 bp, Mus musculus
attccttcctatcaggcgttcaaga

SEQ ID NO: 280379 - DNA, 25 bp, Mus musculus
attccttcctatccacttgtgtgaa

SEQ ID NO: 280380 - DNA, 25 bp, Mus musculus
attccttcctatgaggcgttcaaga

SEQ ID NO: 280381 - DNA, 25 bp, Mus musculus
attccttcctatgcacttgtgtgaa

SEQ ID NO: 280382 - DNA, 25 bp, Mus musculus
attccttcctatttttcttgctttg

SEQ ID NO: 280383 - DNA, 25 bp, Mus musculus
attccttccttaacacactggacaa

SEQ ID NO: 280384 - DNA, 25 bp, Mus musculus
attccttccttatcacactggacaa

SEQ ID NO: 280385 - DNA, 25 bp, Mus musculus
attccttccttcacgctgggacgac

SEQ ID NO: 280386 - DNA, 25 bp, Mus musculus
attccttccttctcgctgggacgac

SEQ ID NO: 280387 - DNA, 25 bp, Mus musculus
attccttctaccatactaaaagctg

SEQ ID NO: 280388 - DNA, 25 bp, Mus musculus
attccttctaccttactaaaagctg

SEQ ID NO: 280389 - DNA, 25 bp, Mus musculus
attccttgaagaagattgttgtaca

SEQ ID NO: 280390 - DNA, 25 bp, Mus musculus
attccttgaagatgattgttgtaca

SEQ ID NO: 280391 - DNA, 25 bp, Mus musculus
attccttgagataatagcagcctta

SEQ ID NO: 280392 - DNA, 25 bp, Mus musculus
attccttgagattatagcagcctta

SEQ ID NO: 280393 - DNA, 25 bp, Mus musculus
attccttgagtcatatgtgcagcta

SEQ ID NO: 280394 - DNA, 25 bp, Mus musculus
attccttgagtcttatgtgcagcta

SEQ ID NO: 280395 - DNA, 25 bp, Mus musculus
attccttgatgaagtctggaggcat

SEQ ID NO: 280396 - DNA, 25 bp, Mus musculus
attccttgatgatgtctggaggcat

SEQ ID NO: 280397 - DNA, 25 bp, Mus musculus
attccttgcggaattctgtgggaga

SEQ ID NO: 280398 - DNA, 25 bp, Mus musculus
attccttgcggatttctgtgggaga

SEQ ID NO: 280399 - DNA, 25 bp, Mus musculus
attccttgctgcagagcccagtgtg

SEQ ID NO: 280400 - DNA, 25 bp, Mus musculus
attccttgctgccttggtactgagc

SEQ ID NO: 280401 - DNA, 25 bp, Mus musculus
attccttgctgcgttggtactgagc

SEQ ID NO: 280402 - DNA, 25 bp, Mus musculus
attccttgctgctgagcccagtgtg

SEQ ID NO: 280403 - DNA, 25 bp, Mus musculus
attccttggaatcctttcccaggca

SEQ ID NO: 280404 - DNA, 25 bp, Mus musculus
attccttggaatgctttcccaggca

SEQ ID NO: 280405 - DNA, 25 bp, Mus musculus
attccttgggaaatggttgccagct

SEQ ID NO: 280406 - DNA, 25 bp, Mus musculus
attccttgggaattggttgccagct

SEQ ID NO: 280407 - DNA, 25 bp, Mus musculus
attccttgtcacagatttctttttg

SEQ ID NO: 280408 - DNA, 25 bp, Mus musculus
attccttgtcactgatttctttttg

SEQ ID NO: 280409 - DNA, 25 bp, Mus musculus
attccttgtgacacttgtaacttta

SEQ ID NO: 280410 - DNA, 25 bp, Mus musculus
attccttgtgactcttgtaacttta

SEQ ID NO: 280411 - DNA, 25 bp, Mus musculus
attccttgtggtccagagccctgtg

SEQ ID NO: 280412 - DNA, 25 bp, Mus musculus
attccttgtggtgcagagccctgtg

SEQ ID NO: 280413 - DNA, 25 bp, Mus musculus
attccttgtgttccagctttgttca

SEQ ID NO: 280414 - DNA, 25 bp, Mus musculus
attccttgtgttgcagctttgttca

SEQ ID NO: 280415 - DNA, 25 bp, Mus musculus
attccttgttggctgtcagtgctga

SEQ ID NO: 280416 - DNA, 25 bp, Mus musculus
attccttgttgggtgtcagtgctga

SEQ ID NO: 280417 - DNA, 25 bp, Mus musculus
attcctttaataccagtatctggga

SEQ ID NO: 280418 - DNA, 25 bp, Mus musculus
attcctttaatagcagtatctggga

SEQ ID NO: 280419 - DNA, 25 bp, Mus musculus
attcctttagcacattgcttctcag

SEQ ID NO: 280420 - DNA, 25 bp, Mus musculus
attcctttagcagattgcttctcag

SEQ ID NO: 280421 - DNA, 25 bp, Mus musculus
attcctttcaaccaaagactccaga

SEQ ID NO: 280422 - DNA, 25 bp, Mus musculus
attcctttcaacgaaagactccaga

SEQ ID NO: 280423 - DNA, 25 bp, Mus musculus
attcctttccagctgctctgattta

SEQ ID NO: 280424 - DNA, 25 bp, Mus musculus
attcctttccaggtgctctgattta

SEQ ID NO: 280425 - DNA, 25 bp, Mus musculus
attcctttcccacggatcagatttc

SEQ ID NO: 280426 - DNA, 25 bp, Mus musculus
attcctttcccagggatcagatttc

SEQ ID NO: 280427 - DNA, 25 bp, Mus musculus
attcctttccctactgtacacggag

SEQ ID NO: 280428 - DNA, 25 bp, Mus musculus
attcctttcccttctgtacacggag

SEQ ID NO: 280429 - DNA, 25 bp, Mus musculus
attcctttctcgcacccaagaggaa

SEQ ID NO: 280430 - DNA, 25 bp, Mus musculus
attcctttctcggacccaagaggaa

SEQ ID NO: 280431 - DNA, 25 bp, Mus musculus
attcctttgaacagttgtagctctg

SEQ ID NO: 280432 - DNA, 25 bp, Mus musculus
attcctttgaactgttgtagctctg

SEQ ID NO: 280433 - DNA, 25 bp, Mus musculus
attcctttgactactctgacatcag

SEQ ID NO: 280434 - DNA, 25 bp, Mus musculus
attcctttgacttctctgacatcag

SEQ ID NO: 280435 - DNA, 25 bp, Mus musculus
attcctttgcaacatatgagcatta

SEQ ID NO: 280436 - DNA, 25 bp, Mus musculus
attcctttgcaagatatgagcatta

SEQ ID NO: 280437 - DNA, 25 bp, Mus musculus
attcctttgcatccatatcctgcct

SEQ ID NO: 280438 - DNA, 25 bp, Mus musculus
attcctttgcatgcatatcctgcct

SEQ ID NO: 280439 - DNA, 25 bp, Mus musculus
attcctttggagcatagcatagctg

SEQ ID NO: 280440 - DNA, 25 bp, Mus musculus
attcctttggaggatagcatagctg

SEQ ID NO: 280441 - DNA, 25 bp, Mus musculus
attcctttggccacctacttaatgt

SEQ ID NO: 280442 - DNA, 25 bp, Mus musculus
attcctttggcctcctacttaatgt

SEQ ID NO: 280443 - DNA, 25 bp, Mus musculus
attcctttgtatcggtgggtgcatg

SEQ ID NO: 280444 - DNA, 25 bp, Mus musculus
attcctttgtatgggtgggtgcatg

SEQ ID NO: 280445 - DNA, 25 bp, Mus musculus
attcctttgtgcagactatgctgag

SEQ ID NO: 280446 - DNA, 25 bp, Mus musculus
attcctttgtgctgactatgctgag

SEQ ID NO: 280447 - DNA, 25 bp, Mus musculus
attcctttgttgagacttcttgtgc

SEQ ID NO: 280448 - DNA, 25 bp, Mus musculus
attcctttgttgtgacttcttgtgc

SEQ ID NO: 280449 - DNA, 25 bp, Mus musculus
attcctttgtttccggtgtactgag

SEQ ID NO: 280450 - DNA, 25 bp, Mus musculus
attcctttgtttgcggtgtactgag

SEQ ID NO: 280451 - DNA, 25 bp, Mus musculus
attccttttaatagggagacgctct

SEQ ID NO: 280452 - DNA, 25 bp, Mus musculus
attccttttaattgggagacgctct

SEQ ID NO: 280453 - DNA, 25 bp, Mus musculus
attccttttacaaatggcaacatca

SEQ ID NO: 280454 - DNA, 25 bp, Mus musculus
attccttttacatatggcaacatca

SEQ ID NO: 280455 - DNA, 25 bp, Mus musculus
attccttttggacatggcagacaga

SEQ ID NO: 280456 - DNA, 25 bp, Mus musculus
attccttttggagatggcagacaga

SEQ ID NO: 280457 - DNA, 25 bp, Mus musculus
attccttttggcagagtggatgcgg

SEQ ID NO: 280458 - DNA, 25 bp, Mus musculus
attccttttggctgagtggatgcgg

SEQ ID NO: 280459 - DNA, 25 bp, Mus musculus
attccttttgtgcatgtgaatttcc

SEQ ID NO: 280460 - DNA, 25 bp, Mus musculus
attccttttgtggatgtgaatttcc

SEQ ID NO: 280461 - DNA, 25 bp, Mus musculus
attcctttttccagatcactgtctt

SEQ ID NO: 280462 - DNA, 25 bp, Mus musculus
attcctttttcctgatcactgtctt

SEQ ID NO: 280463 - DNA, 25 bp, Mus musculus
attcctttttgtacattctccatcc

SEQ ID NO: 280464 - DNA, 25 bp, Mus musculus
attcctttttgttcattctccatcc

SEQ ID NO: 280465 - DNA, 25 bp, Mus musculus
attcgaaacctgcaggaacgccgca

SEQ ID NO: 280466 - DNA, 25 bp, Mus musculus
attcgaaacctggaggaacgccgca

SEQ ID NO: 280467 - DNA, 25 bp, Mus musculus
attcgaaactttaggactcgtcaga

SEQ ID NO: 280468 - DNA, 25 bp, Mus musculus
attcgaaactttctgctcgggtcga

SEQ ID NO: 280469 - DNA, 25 bp, Mus musculus
attcgaaactttgtgctcgggtcga

SEQ ID NO: 280470 - DNA, 25 bp, Mus musculus
attcgaaacttttggactcgtcaga

SEQ ID NO: 280471 - DNA, 25 bp, Mus musculus
attcgaaagcctaacagtgttatac

SEQ ID NO: 280472 - DNA, 25 bp, Mus musculus
attcgaaagccttacagtgttatac

SEQ ID NO: 280473 - DNA, 25 bp, Mus musculus
attcgaaatcagcaactgtgcgtca

SEQ ID NO: 280474 - DNA, 25 bp, Mus musculus
attcgaaatcaggaactgtgcgtca

SEQ ID NO: 280475 - DNA, 25 bp, Mus musculus
attcgaaatgtgacgtgcccgaagg

SEQ ID NO: 280476 - DNA, 25 bp, Mus musculus
attcgaaatgtgtcgtgcccgaagg

SEQ ID NO: 280477 - DNA, 25 bp, Mus musculus
attcgaaccatcatctcaacggctg

SEQ ID NO: 280478 - DNA, 25 bp, Mus musculus
attcgaaccatcttctcaacggctg

SEQ ID NO: 280479 - DNA, 25 bp, Mus musculus
attcgaagagaaagtgcagcccaaa

SEQ ID NO: 280480 - DNA, 25 bp, Mus musculus
attcgaagagaatgtgcagcccaaa

SEQ ID NO: 280481 - DNA, 25 bp, Mus musculus
attcgaaggtgtcgacgcagtagac

SEQ ID NO: 280482 - DNA, 25 bp, Mus musculus
attcgaaggtgtggacgcagtagac

SEQ ID NO: 280483 - DNA, 25 bp, Mus musculus
attcgaatgcggacacgttttcagc

SEQ ID NO: 280484 - DNA, 25 bp, Mus musculus
attcgaatgcggtcacgttttcagc

SEQ ID NO: 280485 - DNA, 25 bp, Mus musculus
attcgacaccacagatgaaggccct

SEQ ID NO: 280486 - DNA, 25 bp, Mus musculus
attcgacaccactgatgaaggccct

SEQ ID NO: 280487 - DNA, 25 bp, Mus musculus
attcgacagctcaggttccttcctg

SEQ ID NO: 280488 - DNA, 25 bp, Mus musculus
attcgacagctctggttccttcctg

SEQ ID NO: 280489 - DNA, 25 bp, Mus musculus
attcgacatgtcattcagtactagt

SEQ ID NO: 280490 - DNA, 25 bp, Mus musculus
attcgacatgtctttcagtactagt

SEQ ID NO: 280491 - DNA, 25 bp, Mus musculus
attcgacctaccactgggaatagtt

SEQ ID NO: 280492 - DNA, 25 bp, Mus musculus
attcgacctacctctgggaatagtt

SEQ ID NO: 280493 - DNA, 25 bp, Mus musculus
attcgacggtaaacagctggaggat

SEQ ID NO: 280494 - DNA, 25 bp, Mus musculus
attcgacggtaatcagctggaggat

SEQ ID NO: 280495 - DNA, 25 bp, Mus musculus
attcgactccggaagggcttagctt

SEQ ID NO: 280496 - DNA, 25 bp, Mus musculus
attcgactccggtagggcttagctt

SEQ ID NO: 280497 - DNA, 25 bp, Mus musculus
attcgactctgtatttattagcatt

SEQ ID NO: 280498 - DNA, 25 bp, Mus musculus
attcgactctgtttttattagcatt

SEQ ID NO: 280499 - DNA, 25 bp, Mus musculus
attcgactggatcgaaaccctatca

SEQ ID NO: 280500 - DNA, 25 bp, Mus musculus
attcgactggatggaaaccctatca

SEQ ID NO: 280501 - DNA, 25 bp, Mus musculus
attcgactgggccacttgattgtgc

SEQ ID NO: 280502 - DNA, 25 bp, Mus musculus
attcgactgggcgacttgattgtgc

SEQ ID NO: 280503 - DNA, 25 bp, Mus musculus
attcgactgttgacagctgtcactg

SEQ ID NO: 280504 - DNA, 25 bp, Mus musculus
attcgactgttgtcagctgtcactg

SEQ ID NO: 280505 - DNA, 25 bp, Mus musculus
attcgagaaccaaagaacccttcct

SEQ ID NO: 280506 - DNA, 25 bp, Mus musculus
attcgagaaccatagaacccttcct

SEQ ID NO: 280507 - DNA, 25 bp, Mus musculus
attcgagactagattttattccttg

SEQ ID NO: 280508 - DNA, 25 bp, Mus musculus
attcgagactagtttttattccttg

SEQ ID NO: 280509 - DNA, 25 bp, Mus musculus
attcgagagactacccctgtttcag

SEQ ID NO: 280510 - DNA, 25 bp, Mus musculus
attcgagagacttcccctgtttcag

SEQ ID NO: 280511 - DNA, 25 bp, Mus musculus
attcgagatgggacttgcttgtgta

SEQ ID NO: 280512 - DNA, 25 bp, Mus musculus
attcgagatgggtcttgcttgtgta

SEQ ID NO: 280513 - DNA, 25 bp, Mus musculus
attcgagcaacaaggagcactggta

SEQ ID NO: 280514 - DNA, 25 bp, Mus musculus
attcgagcaacatggagcactggta

SEQ ID NO: 280515 - DNA, 25 bp, Mus musculus
attcgagcagatcccacaggtgcct

SEQ ID NO: 280516 - DNA, 25 bp, Mus musculus
attcgagcagatgccacaggtgcct

SEQ ID NO: 280517 - DNA, 25 bp, Mus musculus
attcgagccttaccaaatcaccacg

SEQ ID NO: 280518 - DNA, 25 bp, Mus musculus
attcgagccttagcaaatcaccacg

SEQ ID NO: 280519 - DNA, 25 bp, Mus musculus
attcgagggctcagcagcgtatacc

SEQ ID NO: 280520 - DNA, 25 bp, Mus musculus
attcgagggctctgcagcgtatacc

SEQ ID NO: 280521 - DNA, 25 bp, Mus musculus
attcgagttttcaagagtatatttc

SEQ ID NO: 280522 - DNA, 25 bp, Mus musculus
attcgagttttctagagtatatttc

SEQ ID NO: 280523 - DNA, 25 bp, Mus musculus
attcgataaagaaggtgacggcacc

SEQ ID NO: 280524 - DNA, 25 bp, Mus musculus
attcgataaagatggtgacggcacc

SEQ ID NO: 280525 - DNA, 25 bp, Mus musculus
attcgatcagcaacacttcaggtcc

SEQ ID NO: 280526 - DNA, 25 bp, Mus musculus
attcgatcagcatcacttcaggtcc

SEQ ID NO: 280527 - DNA, 25 bp, Mus musculus
attcgatcgatcctgtaaccttatt

SEQ ID NO: 280528 - DNA, 25 bp, Mus musculus
attcgatcgatcgtgtaaccttatt

SEQ ID NO: 280529 - DNA, 25 bp, Mus musculus
attcgatctctcaatgctgtttcca

SEQ ID NO: 280530 - DNA, 25 bp, Mus musculus
attcgatctctctatgctgtttcca

SEQ ID NO: 280531 - DNA, 25 bp, Mus musculus
attcgatgatagctctcttagtttg

SEQ ID NO: 280532 - DNA, 25 bp, Mus musculus
attcgatgataggtctcttagtttg

SEQ ID NO: 280533 - DNA, 25 bp, Mus musculus
attcgatgtttgaaacagatacgtt

SEQ ID NO: 280534 - DNA, 25 bp, Mus musculus
attcgatgtttgtaacagatacgtt

SEQ ID NO: 280535 - DNA, 25 bp, Mus musculus
attcgattatttcctgaagagcagt

SEQ ID NO: 280536 - DNA, 25 bp, Mus musculus
attcgattatttgctgaagagcagt

SEQ ID NO: 280537 - DNA, 25 bp, Mus musculus
attcgcaaaagcacttgtcggctgc

SEQ ID NO: 280538 - DNA, 25 bp, Mus musculus
attcgcaaaagctcttgtcggctgc

SEQ ID NO: 280539 - DNA, 25 bp, Mus musculus
attcgcaaactcatcctgcgcagga

SEQ ID NO: 280540 - DNA, 25 bp, Mus musculus
attcgcaaactcttcctgcgcagga

SEQ ID NO: 280541 - DNA, 25 bp, Mus musculus
attcgcacattgaacgtatcgggtt

SEQ ID NO: 280542 - DNA, 25 bp, Mus musculus
attcgcacattgtacgtatcgggtt

SEQ ID NO: 280543 - DNA, 25 bp, Mus musculus
attcgcagaactcgcacggtggaca

SEQ ID NO: 280544 - DNA, 25 bp, Mus musculus
attcgcagaactggcacggtggaca

SEQ ID NO: 280545 - DNA, 25 bp, Mus musculus
attcgcagactcctggatttctgac

SEQ ID NO: 280546 - DNA, 25 bp, Mus musculus
attcgcagactcgtggatttctgac

SEQ ID NO: 280547 - DNA, 25 bp, Mus musculus
attcgcatcaaaccagttttcaggg

SEQ ID NO: 280548 - DNA, 25 bp, Mus musculus
attcgcatcaaagcagttttcaggg

SEQ ID NO: 280549 - DNA, 25 bp, Mus musculus
attcgcatcattctgaccagagcag

SEQ ID NO: 280550 - DNA, 25 bp, Mus musculus
attcgcatcattgtgaccagagcag

SEQ ID NO: 280551 - DNA, 25 bp, Mus musculus
attcgcatgatgacaactggctcta

SEQ ID NO: 280552 - DNA, 25 bp, Mus musculus
attcgcatgatgtcaactggctcta

SEQ ID NO: 280553 - DNA, 25 bp, Mus musculus
attcgcattaagcatcagtagcatt

SEQ ID NO: 280554 - DNA, 25 bp, Mus musculus
attcgcattaaggatcagtagcatt

SEQ ID NO: 280555 - DNA, 25 bp, Mus musculus
attcgcattactctgcgtgtgtgct

SEQ ID NO: 280556 - DNA, 25 bp, Mus musculus
attcgcattactgtgcgtgtgtgct

SEQ ID NO: 280557 - DNA, 25 bp, Mus musculus
attcgcatttggaacgtctgctcag

SEQ ID NO: 280558 - DNA, 25 bp, Mus musculus
attcgcatttggtacgtctgctcag

SEQ ID NO: 280559 - DNA, 25 bp, Mus musculus
attcgccaacgtcagatggaagaac

SEQ ID NO: 280560 - DNA, 25 bp, Mus musculus
attcgccaacgtgagatggaagaac

SEQ ID NO: 280561 - DNA, 25 bp, Mus musculus
attcgccaccatcagtgtaactatg

SEQ ID NO: 280562 - DNA, 25 bp, Mus musculus
attcgccaccatgagtgtaactatg

SEQ ID NO: 280563 - DNA, 25 bp, Mus musculus
attcgcccagggaccatgacctgct

SEQ ID NO: 280564 - DNA, 25 bp, Mus musculus
attcgcccagggtccatgacctgct

SEQ ID NO: 280565 - DNA, 25 bp, Mus musculus
attcgccctttcagctgaaggaatg

SEQ ID NO: 280566 - DNA, 25 bp, Mus musculus
attcgccctttctgctgaaggaatg

SEQ ID NO: 280567 - DNA, 25 bp, Mus musculus
attcgccggttgctcagtggctctg

SEQ ID NO: 280568 - DNA, 25 bp, Mus musculus
attcgccggttggtcagtggctctg

SEQ ID NO: 280569 - DNA, 25 bp, Mus musculus
attcgcctctttatggagttgccca

SEQ ID NO: 280570 - DNA, 25 bp, Mus musculus
attcgcctctttttggagttgccca

SEQ ID NO: 280571 - DNA, 25 bp, Mus musculus
attcgcctgttcactcagaggcaga

SEQ ID NO: 280572 - DNA, 25 bp, Mus musculus
attcgcctgttctctcagaggcaga

SEQ ID NO: 280573 - DNA, 25 bp, Mus musculus
attcgccttctacaagcctaaattc

SEQ ID NO: 280574 - DNA, 25 bp, Mus musculus
attcgccttctagaagcctaaattc

SEQ ID NO: 280575 - DNA, 25 bp, Mus musculus
attcgcgcaggaagaatttgagttc

SEQ ID NO: 280576 - DNA, 25 bp, Mus musculus
attcgcgcaggatgaatttgagttc

SEQ ID NO: 280577 - DNA, 25 bp, Mus musculus
attcgcggaggtccagttgtcagct

SEQ ID NO: 280578 - DNA, 25 bp, Mus musculus
attcgcggaggtgcagttgtcagct

SEQ ID NO: 280579 - DNA, 25 bp, Mus musculus
attcgcggatgtcgttttcacagcc

SEQ ID NO: 280580 - DNA, 25 bp, Mus musculus
attcgcggatgtggttttcacagcc

SEQ ID NO: 280581 - DNA, 25 bp, Mus musculus
attcgcggccggaactgctctgcag

SEQ ID NO: 280582 - DNA, 25 bp, Mus musculus
attcgcggccggtactgctctgcag

SEQ ID NO: 280583 - DNA, 25 bp, Mus musculus
attcgcggtgtgcacagtggactct

SEQ ID NO: 280584 - DNA, 25 bp, Mus musculus
attcgcggtgtggacagtggactct

SEQ ID NO: 280585 - DNA, 25 bp, Mus musculus
attcgcgtaagaatttgccctcaaa

SEQ ID NO: 280586 - DNA, 25 bp, Mus musculus
attcgcgtaagattttgccctcaaa

SEQ ID NO: 280587 - DNA, 25 bp, Mus musculus
attcgcgtgacgctgattgcactgg

SEQ ID NO: 280588 - DNA, 25 bp, Mus musculus
attcgcgtgacggtgattgcactgg

SEQ ID NO: 280589 - DNA, 25 bp, Mus musculus
attcgctaggagcttaggagcactt

SEQ ID NO: 280590 - DNA, 25 bp, Mus musculus
attcgctaggaggttaggagcactt

SEQ ID NO: 280591 - DNA, 25 bp, Mus musculus
attcgctaggcactctttgtaacag

SEQ ID NO: 280592 - DNA, 25 bp, Mus musculus
attcgctaggcagtctttgtaacag

SEQ ID NO: 280593 - DNA, 25 bp, Mus musculus
attcgctccttaacgttgaggctga

SEQ ID NO: 280594 - DNA, 25 bp, Mus musculus
attcgctccttatcgttgaggctga

SEQ ID NO: 280595 - DNA, 25 bp, Mus musculus
attcgctctactcaggcgtcaggtg

SEQ ID NO: 280596 - DNA, 25 bp, Mus musculus
attcgctctactgaggcgtcaggtg

SEQ ID NO: 280597 - DNA, 25 bp, Mus musculus
attcgctctttcatttatgcagcaa

SEQ ID NO: 280598 - DNA, 25 bp, Mus musculus
attcgctctttcttttatgcagcaa

SEQ ID NO: 280599 - DNA, 25 bp, Mus musculus
attcgctgcacgaactgcgcccggt

SEQ ID NO: 280600 - DNA, 25 bp, Mus musculus
attcgctgcacgtactgcgcccggt

SEQ ID NO: 280601 - DNA, 25 bp, Mus musculus
attcgctgcattaggagtgctgtct

SEQ ID NO: 280602 - DNA, 25 bp, Mus musculus
attcgctgcatttggagtgctgtct

SEQ ID NO: 280603 - DNA, 25 bp, Mus musculus
attcgctgggttaggatcgggcaca

SEQ ID NO: 280604 - DNA, 25 bp, Mus musculus
attcgctgggtttggatcgggcaca

SEQ ID NO: 280605 - DNA, 25 bp, Mus musculus
attcgctgtggcatggcaactttga

SEQ ID NO: 280606 - DNA, 25 bp, Mus musculus
attcgctgtggcttggcaactttga

SEQ ID NO: 280607 - DNA, 25 bp, Mus musculus
attcgcttcgaaaaggtgatcacca

SEQ ID NO: 280608 - DNA, 25 bp, Mus musculus
attcgcttcgaataggtgatcacca

SEQ ID NO: 280609 - DNA, 25 bp, Mus musculus
attcgcttgcctctaaactcatgat

SEQ ID NO: 280610 - DNA, 25 bp, Mus musculus
attcgcttgcctgtaaactcatgat

SEQ ID NO: 280611 - DNA, 25 bp, Mus musculus
attcggaacagaaccaccctgaaag

SEQ ID NO: 280612 - DNA, 25 bp, Mus musculus
attcggaacagatccaccctgaaag

SEQ ID NO: 280613 - DNA, 25 bp, Mus musculus
attcggaagccccttggtgctatgg

SEQ ID NO: 280614 - DNA, 25 bp, Mus musculus
attcggaagcccgttggtgctatgg

SEQ ID NO: 280615 - DNA, 25 bp, Mus musculus
attcggaaggatactcatctgtcat

SEQ ID NO: 280616 - DNA, 25 bp, Mus musculus
attcggaaggattctcatctgtcat

SEQ ID NO: 280617 - DNA, 25 bp, Mus musculus
attcggaatgtaaatgttggctgtt

SEQ ID NO: 280618 - DNA, 25 bp, Mus musculus
attcggaatgtatatgttggctgtt

SEQ ID NO: 280619 - DNA, 25 bp, Mus musculus
attcggacaacaccggcaatatgga

SEQ ID NO: 280620 - DNA, 25 bp, Mus musculus
attcggacaacagcggcaatatgga

SEQ ID NO: 280621 - DNA, 25 bp, Mus musculus
attcggacatgtctgccaataggca

SEQ ID NO: 280622 - DNA, 25 bp, Mus musculus
attcggacatgtgtgccaataggca

SEQ ID NO: 280623 - DNA, 25 bp, Mus musculus
attcggacctcactggttatttaga

SEQ ID NO: 280624 - DNA, 25 bp, Mus musculus
attcggacctcagtggttatttaga

SEQ ID NO: 280625 - DNA, 25 bp, Mus musculus
attcggagaggaagcacccgtccaa

SEQ ID NO: 280626 - DNA, 25 bp, Mus musculus
attcggagaggatgcacccgtccaa

SEQ ID NO: 280627 - DNA, 25 bp, Mus musculus
attcggagcctcagaacccatataa

SEQ ID NO: 280628 - DNA, 25 bp, Mus musculus
attcggagcctctgaacccatataa

SEQ ID NO: 280629 - DNA, 25 bp, Mus musculus
attcggagcgacaagggcaaccagt

SEQ ID NO: 280630 - DNA, 25 bp, Mus musculus
attcggagcgactagggcaaccagt

SEQ ID NO: 280631 - DNA, 25 bp, Mus musculus
attcggaggcccagcatcctgcaac

SEQ ID NO: 280632 - DNA, 25 bp, Mus musculus
attcggaggccctgcatcctgcaac

SEQ ID NO: 280633 - DNA, 25 bp, Mus musculus
attcggaggcttattccgtgcagca

SEQ ID NO: 280634 - DNA, 25 bp, Mus musculus
attcggaggctttttccgtgcagca

SEQ ID NO: 280635 - DNA, 25 bp, Mus musculus
attcggagtcgcctggaacacagag

SEQ ID NO: 280636 - DNA, 25 bp, Mus musculus
attcggagtcgcgtggaacacagag

SEQ ID NO: 280637 - DNA, 25 bp, Mus musculus
attcggattgctccatctttcaagg

SEQ ID NO: 280638 - DNA, 25 bp, Mus musculus
attcggattgctgcatctttcaagg

SEQ ID NO: 280639 - DNA, 25 bp, Mus musculus
attcggatttgaagctccccaagca

SEQ ID NO: 280640 - DNA, 25 bp, Mus musculus
attcggatttgatgctccccaagca

SEQ ID NO: 280641 - DNA, 25 bp, Mus musculus
attcggcaagccattcatacattag

SEQ ID NO: 280642 - DNA, 25 bp, Mus musculus
attcggcaagcctttcatacattag

SEQ ID NO: 280643 - DNA, 25 bp, Mus musculus
attcggcccaggaacagctcgtcag

SEQ ID NO: 280644 - DNA, 25 bp, Mus musculus
attcggcccaggtacagctcgtcag

SEQ ID NO: 280645 - DNA, 25 bp, Mus musculus
attcggcccttacccaacataagag

SEQ ID NO: 280646 - DNA, 25 bp, Mus musculus
attcggcccttagccaacataagag

SEQ ID NO: 280647 - DNA, 25 bp, Mus musculus
attcggctctcaaaggcaccaagta

SEQ ID NO: 280648 - DNA, 25 bp, Mus musculus
attcggctctcataggcaccaagta

SEQ ID NO: 280649 - DNA, 25 bp, Mus musculus
attcggctgatcaaacatgatctga

SEQ ID NO: 280650 - DNA, 25 bp, Mus musculus
attcggctgatctaacatgatctga

SEQ ID NO: 280651 - DNA, 25 bp, Mus musculus
attcggctgtcaccaatggcagcaa

SEQ ID NO: 280652 - DNA, 25 bp, Mus musculus
attcggctgtcagcaatggcagcaa

SEQ ID NO: 280653 - DNA, 25 bp, Mus musculus
attcgggaaaagctggccaaaatgt

SEQ ID NO: 280654 - DNA, 25 bp, Mus musculus
attcgggaaaaggtggccaaaatgt

SEQ ID NO: 280655 - DNA, 25 bp, Mus musculus
attcgggaagccaccagcggtgcag

SEQ ID NO: 280656 - DNA, 25 bp, Mus musculus
attcgggaagcctccagcggtgcag

SEQ ID NO: 280657 - DNA, 25 bp, Mus musculus
attcgggctgaaaggtcgctgagtc

SEQ ID NO: 280658 - DNA, 25 bp, Mus musculus
attcgggctgaatggtcgctgagtc

SEQ ID NO: 280659 - DNA, 25 bp, Mus musculus
attcggtaatggagcgcttgcctaa

SEQ ID NO: 280660 - DNA, 25 bp, Mus musculus
attcggtaatggtgcgcttgcctaa

SEQ ID NO: 280661 - DNA, 25 bp, Mus musculus
attcggtactacaaggtcactcttt

SEQ ID NO: 280662 - DNA, 25 bp, Mus musculus
attcggtactactaggtcactcttt

SEQ ID NO: 280663 - DNA, 25 bp, Mus musculus
attcggtcaattctcactgtcatca

SEQ ID NO: 280664 - DNA, 25 bp, Mus musculus
attcggtcaattgtcactgtcatca

SEQ ID NO: 280665 - DNA, 25 bp, Mus musculus
attcggtctccaaaaatgaggtgga

SEQ ID NO: 280666 - DNA, 25 bp, Mus musculus
attcggtctccataaatgaggtgga

SEQ ID NO: 280667 - DNA, 25 bp, Mus musculus
attcggtctgcaatcccagtgggca

SEQ ID NO: 280668 - DNA, 25 bp, Mus musculus
attcggtctgcattcccagtgggca

SEQ ID NO: 280669 - DNA, 25 bp, Mus musculus
attcggtgctctacaagtggtttca

SEQ ID NO: 280670 - DNA, 25 bp, Mus musculus
attcggtgctcttcaagtggtttca

SEQ ID NO: 280671 - DNA, 25 bp, Mus musculus
attcggtggaacacatgtacactca

SEQ ID NO: 280672 - DNA, 25 bp, Mus musculus
attcggtggaactcatgtacactca

SEQ ID NO: 280673 - DNA, 25 bp, Mus musculus
attcggtgtgtgatgatgtccatac

SEQ ID NO: 280674 - DNA, 25 bp, Mus musculus
attcggtgtgtgttgatgtccatac

SEQ ID NO: 280675 - DNA, 25 bp, Mus musculus
attcggttaattatcccagctggct

SEQ ID NO: 280676 - DNA, 25 bp, Mus musculus
attcggttaattttcccagctggct

SEQ ID NO: 280677 - DNA, 25 bp, Mus musculus
attcggttgagtcgctgctatgcag

SEQ ID NO: 280678 - DNA, 25 bp, Mus musculus
attcggttgagtggctgctatgcag

SEQ ID NO: 280679 - DNA, 25 bp, Mus musculus
attcgtaaactgaagagtgcaccgc

SEQ ID NO: 280680 - DNA, 25 bp, Mus musculus
attcgtaaactgtagagtgcaccgc

SEQ ID NO: 280681 - DNA, 25 bp, Mus musculus
attcgtaatgccaggaaacactttg

SEQ ID NO: 280682 - DNA, 25 bp, Mus musculus
attcgtaatgcctggaaacactttg

SEQ ID NO: 280683 - DNA, 25 bp, Mus musculus
attcgtaccttgctgcgctgtggtg

SEQ ID NO: 280684 - DNA, 25 bp, Mus musculus
attcgtaccttggtgcgctgtggtg

SEQ ID NO: 280685 - DNA, 25 bp, Mus musculus
attcgtatagagacctctttgaacc

SEQ ID NO: 280686 - DNA, 25 bp, Mus musculus
attcgtatagagtcctctttgaacc

SEQ ID NO: 280687 - DNA, 25 bp, Mus musculus
attcgtattttcagtgtttgccata

SEQ ID NO: 280688 - DNA, 25 bp, Mus musculus
attcgtattttctgtgtttgccata

SEQ ID NO: 280689 - DNA, 25 bp, Mus musculus
attcgtcaacgtcgcttacaatggc

SEQ ID NO: 280690 - DNA, 25 bp, Mus musculus
attcgtcaacgtggcttacaatggc

SEQ ID NO: 280691 - DNA, 25 bp, Mus musculus
attcgtcacactcctagggttttat

SEQ ID NO: 280692 - DNA, 25 bp, Mus musculus
attcgtcacactgctagggttttat

SEQ ID NO: 280693 - DNA, 25 bp, Mus musculus
attcgtcagctgaatgcaacttctg

SEQ ID NO: 280694 - DNA, 25 bp, Mus musculus
attcgtcagctgtatgcaacttctg

SEQ ID NO: 280695 - DNA, 25 bp, Mus musculus
attcgtcatccgacaatcccttgca

SEQ ID NO: 280696 - DNA, 25 bp, Mus musculus
attcgtcatccgtcaatcccttgca

SEQ ID NO: 280697 - DNA, 25 bp, Mus musculus
attcgtcctgttacacattaaaact

SEQ ID NO: 280698 - DNA, 25 bp, Mus musculus
attcgtcctgtttcacattaaaact

SEQ ID NO: 280699 - DNA, 25 bp, Mus musculus
attcgtctacctctacaatgcggct

SEQ ID NO: 280700 - DNA, 25 bp, Mus musculus
attcgtctacctgtacaatgcggct

SEQ ID NO: 280701 - DNA, 25 bp, Mus musculus
attcgtctccataaggtttcaacat

SEQ ID NO: 280702 - DNA, 25 bp, Mus musculus
attcgtctccattaggtttcaacat

SEQ ID NO: 280703 - DNA, 25 bp, Mus musculus
attcgtctgcttacctcccttcggg

SEQ ID NO: 280704 - DNA, 25 bp, Mus musculus
attcgtctgctttcctcccttcggg

SEQ ID NO: 280705 - DNA, 25 bp, Mus musculus
attcgtcttcaaagtcggttgccaa

SEQ ID NO: 280706 - DNA, 25 bp, Mus musculus
attcgtcttcaatgtcggttgccaa

SEQ ID NO: 280707 - DNA, 25 bp, Mus musculus
attcgtctttcacaagtgtcttcag

SEQ ID NO: 280708 - DNA, 25 bp, Mus musculus
attcgtctttcagaagtgtcttcag

SEQ ID NO: 280709 - DNA, 25 bp, Mus musculus
attcgtgaaaacctcagtgcctgtc

SEQ ID NO: 280710 - DNA, 25 bp, Mus musculus
attcgtgaaaacgtcagtgcctgtc

SEQ ID NO: 280711 - DNA, 25 bp, Mus musculus
attcgtgaagcacctggaccagtgt

SEQ ID NO: 280712 - DNA, 25 bp, Mus musculus
attcgtgaagcagctggaccagtgt

SEQ ID NO: 280713 - DNA, 25 bp, Mus musculus
attcgtgcaacaagctttccctact

SEQ ID NO: 280714 - DNA, 25 bp, Mus musculus
attcgtgcaacactgcagtcattgc

SEQ ID NO: 280715 - DNA, 25 bp, Mus musculus
attcgtgcaacagtgcagtcattgc

SEQ ID NO: 280716 - DNA, 25 bp, Mus musculus
attcgtgcaacatgctttccctact

SEQ ID NO: 280717 - DNA, 25 bp, Mus musculus
attcgtgccagtaaatcagacagtc

SEQ ID NO: 280718 - DNA, 25 bp, Mus musculus
attcgtgccagttaatcagacagtc

SEQ ID NO: 280719 - DNA, 25 bp, Mus musculus
attcgtgccttgaaagattgttgta

SEQ ID NO: 280720 - DNA, 25 bp, Mus musculus
attcgtgccttgtaagattgttgta

SEQ ID NO: 280721 - DNA, 25 bp, Mus musculus
attcgtgctcgtatttatatccata

SEQ ID NO: 280722 - DNA, 25 bp, Mus musculus
attcgtgctcgtttttatatccata

SEQ ID NO: 280723 - DNA, 25 bp, Mus musculus
attcgtgcttcacttggtttacaaa

SEQ ID NO: 280724 - DNA, 25 bp, Mus musculus
attcgtgcttcagttggtttacaaa

SEQ ID NO: 280725 - DNA, 25 bp, Mus musculus
attcgtggaagtatgggcctcactg

SEQ ID NO: 280726 - DNA, 25 bp, Mus musculus
attcgtggaagtttgggcctcactg

SEQ ID NO: 280727 - DNA, 25 bp, Mus musculus
attcgtggagtgcagagcctctctt

SEQ ID NO: 280728 - DNA, 25 bp, Mus musculus
attcgtggagtggagagcctctctt

SEQ ID NO: 280729 - DNA, 25 bp, Mus musculus
attcgtggcccaattgtgctgttct

SEQ ID NO: 280730 - DNA, 25 bp, Mus musculus
attcgtggcccatttgtgctgttct

SEQ ID NO: 280731 - DNA, 25 bp, Mus musculus
attcgtggtaacatctcctttgaca

SEQ ID NO: 280732 - DNA, 25 bp, Mus musculus
attcgtggtaacttctcctttgaca

SEQ ID NO: 280733 - DNA, 25 bp, Mus musculus
attcgtgtctatattaacttcaatg

SEQ ID NO: 280734 - DNA, 25 bp, Mus musculus
attcgtgtctattttaacttcaatg

SEQ ID NO: 280735 - DNA, 25 bp, Mus musculus
attcgtgttgtcacggttttccatc

SEQ ID NO: 280736 - DNA, 25 bp, Mus musculus
attcgtgttgtctcggttttccatc

SEQ ID NO: 280737 - DNA, 25 bp, Mus musculus
attcgtgttttgaatcgtgtcttca

SEQ ID NO: 280738 - DNA, 25 bp, Mus musculus
attcgtgttttgtatcgtgtcttca

SEQ ID NO: 280739 - DNA, 25 bp, Mus musculus
attcgttagagacggagcgtgtcat

SEQ ID NO: 280740 - DNA, 25 bp, Mus musculus
attcgttagagagggagcgtgtcat

SEQ ID NO: 280741 - DNA, 25 bp, Mus musculus
attcgtttcctcatggagcagactg

SEQ ID NO: 280742 - DNA, 25 bp, Mus musculus
attcgtttcctcttggagcagactg

SEQ ID NO: 280743 - DNA, 25 bp, Mus musculus
attcgtttctcaactaaagggccct

SEQ ID NO: 280744 - DNA, 25 bp, Mus musculus
attcgtttctcatctaaagggccct

SEQ ID NO: 280745 - DNA, 25 bp, Mus musculus
attcgtttgtgcacaggttctcatt

SEQ ID NO: 280746 - DNA, 25 bp, Mus musculus
attcgtttgtgctcaggttctcatt

SEQ ID NO: 280747 - DNA, 25 bp, Mus musculus
attcgttttctcctgtcttgaacat

SEQ ID NO: 280748 - DNA, 25 bp, Mus musculus
attcgttttctcgtgtcttgaacat

SEQ ID NO: 280749 - DNA, 25 bp, Mus musculus
attctaaagcgcatgtgttacacaa

SEQ ID NO: 280750 - DNA, 25 bp, Mus musculus
attctaaagcgcttgtgttacacaa

SEQ ID NO: 280751 - DNA, 25 bp, Mus musculus
attctaaatccaacaccttttgctg

SEQ ID NO: 280752 - DNA, 25 bp, Mus musculus
attctaaatccatcaccttttgctg

SEQ ID NO: 280753 - DNA, 25 bp, Mus musculus
attctaaattttctggccattattg

SEQ ID NO: 280754 - DNA, 25 bp, Mus musculus
attctaaattttgtggccattattg

SEQ ID NO: 280755 - DNA, 25 bp, Mus musculus
attctaacagttatggcatcccaga

SEQ ID NO: 280756 - DNA, 25 bp, Mus musculus
attctaacagttttggcatcccaga

SEQ ID NO: 280757 - DNA, 25 bp, Mus musculus
attctaacatctaatatttcctgga

SEQ ID NO: 280758 - DNA, 25 bp, Mus musculus
attctaacatcttatatttcctgga

SEQ ID NO: 280759 - DNA, 25 bp, Mus musculus
attctaacggcgacttgtgggtcca

SEQ ID NO: 280760 - DNA, 25 bp, Mus musculus
attctaacggcgtcttgtgggtcca

SEQ ID NO: 280761 - DNA, 25 bp, Mus musculus
attctaacttatccacgactactca

SEQ ID NO: 280762 - DNA, 25 bp, Mus musculus
attctaacttatgcacgactactca

SEQ ID NO: 280763 - DNA, 25 bp, Mus musculus
attctaagatggctttgtctgtgga

SEQ ID NO: 280764 - DNA, 25 bp, Mus musculus
attctaagatgggtttgtctgtgga

SEQ ID NO: 280765 - DNA, 25 bp, Mus musculus
attctaagcaaaagcctcggcctgt

SEQ ID NO: 280766 - DNA, 25 bp, Mus musculus
attctaagcaaatgcctcggcctgt

SEQ ID NO: 280767 - DNA, 25 bp, Mus musculus
attctaaggaatacccgaagacctg

SEQ ID NO: 280768 - DNA, 25 bp, Mus musculus
attctaaggaattcccgaagacctg

SEQ ID NO: 280769 - DNA, 25 bp, Mus musculus
attctaatagctccctgtcagttcc

SEQ ID NO: 280770 - DNA, 25 bp, Mus musculus
attctaatagctgcctgtcagttcc

SEQ ID NO: 280771 - DNA, 25 bp, Mus musculus
attctaatcattagtcacagacact

SEQ ID NO: 280772 - DNA, 25 bp, Mus musculus
attctaatcatttgtcacagacact

SEQ ID NO: 280773 - DNA, 25 bp, Mus musculus
attctaatcccaagcctgcagttta

SEQ ID NO: 280774 - DNA, 25 bp, Mus musculus
attctaatcccatgcctgcagttta

SEQ ID NO: 280775 - DNA, 25 bp, Mus musculus
attctaatgccactttccccaagac

SEQ ID NO: 280776 - DNA, 25 bp, Mus musculus
attctaatgccagtttccccaagac

SEQ ID NO: 280777 - DNA, 25 bp, Mus musculus
attctaatggctaccggcccaagag

SEQ ID NO: 280778 - DNA, 25 bp, Mus musculus
attctaatggcttccggcccaagag

SEQ ID NO: 280779 - DNA, 25 bp, Mus musculus
attctaatgggtaagatcccacttt

SEQ ID NO: 280780 - DNA, 25 bp, Mus musculus
attctaatgggttagatcccacttt

SEQ ID NO: 280781 - DNA, 25 bp, Mus musculus
attctaattcccctctaatctgtga

SEQ ID NO: 280782 - DNA, 25 bp, Mus musculus
attctaattcccgtctaatctgtga

SEQ ID NO: 280783 - DNA, 25 bp, Mus musculus
attctaattgctatgtattccaggc

SEQ ID NO: 280784 - DNA, 25 bp, Mus musculus
attctaattgctttgtattccaggc

SEQ ID NO: 280785 - DNA, 25 bp, Mus musculus
attctacacaacctgcagacgacaa

SEQ ID NO: 280786 - DNA, 25 bp, Mus musculus
attctacacaacgtgcagacgacaa

SEQ ID NO: 280787 - DNA, 25 bp, Mus musculus
attctacaccaaaaccaggcttggc

SEQ ID NO: 280788 - DNA, 25 bp, Mus musculus
attctacaccaataccaggcttggc

SEQ ID NO: 280789 - DNA, 25 bp, Mus musculus
attctacacgagatacgactacatg

SEQ ID NO: 280790 - DNA, 25 bp, Mus musculus
attctacacgagttacgactacatg

SEQ ID NO: 280791 - DNA, 25 bp, Mus musculus
attctacattaacccaggttctgcc

SEQ ID NO: 280792 - DNA, 25 bp, Mus musculus
attctacattaagccaggttctgcc

SEQ ID NO: 280793 - DNA, 25 bp, Mus musculus
attctaccaaacatctccagctgat

SEQ ID NO: 280794 - DNA, 25 bp, Mus musculus
attctaccaaacttctccagctgat

SEQ ID NO: 280795 - DNA, 25 bp, Mus musculus
attctacccggaaggctccaaggaa

SEQ ID NO: 280796 - DNA, 25 bp, Mus musculus
attctacccggatggctccaaggaa

SEQ ID NO: 280797 - DNA, 25 bp, Mus musculus
attctacccgggaatgctgcatcat

SEQ ID NO: 280798 - DNA, 25 bp, Mus musculus
attctacccgggtatgctgcatcat

SEQ ID NO: 280799 - DNA, 25 bp, Mus musculus
attctacctaccctccattgtttct

SEQ ID NO: 280800 - DNA, 25 bp, Mus musculus
attctacctaccgtccattgtttct

SEQ ID NO: 280801 - DNA, 25 bp, Mus musculus
attctacctgagagcgactgcccaa

SEQ ID NO: 280802 - DNA, 25 bp, Mus musculus
attctacctgagtgcgactgcccaa

SEQ ID NO: 280803 - DNA, 25 bp, Mus musculus
attctacctggaagcttggctcctg

SEQ ID NO: 280804 - DNA, 25 bp, Mus musculus
attctacctggatgcttggctcctg

SEQ ID NO: 280805 - DNA, 25 bp, Mus musculus
attctacctgtaccattatcctgtt

SEQ ID NO: 280806 - DNA, 25 bp, Mus musculus
attctacctgtagcattatcctgtt

SEQ ID NO: 280807 - DNA, 25 bp, Mus musculus
attctacgcaatctgcttccaaggc

SEQ ID NO: 280808 - DNA, 25 bp, Mus musculus
attctacgcaatgtgcttccaaggc

SEQ ID NO: 280809 - DNA, 25 bp, Mus musculus
attctacgcgtcacattggtttcat

SEQ ID NO: 280810 - DNA, 25 bp, Mus musculus
attctacgcgtctcattggtttcat

SEQ ID NO: 280811 - DNA, 25 bp, Mus musculus
attctacgctgcagtgctgagatga

SEQ ID NO: 280812 - DNA, 25 bp, Mus musculus
attctacgctgctgtgctgagatga

SEQ ID NO: 280813 - DNA, 25 bp, Mus musculus
attctacggaccagacttgtcacag

SEQ ID NO: 280814 - DNA, 25 bp, Mus musculus
attctacggacctgacttgtcacag

SEQ ID NO: 280815 - DNA, 25 bp, Mus musculus
attctactacaaatcagccactggg

SEQ ID NO: 280816 - DNA, 25 bp, Mus musculus
attctactacaattcagccactggg

SEQ ID NO: 280817 - DNA, 25 bp, Mus musculus
attctactcggcctatctagttgca

SEQ ID NO: 280818 - DNA, 25 bp, Mus musculus
attctactcggcgtatctagttgca

SEQ ID NO: 280819 - DNA, 25 bp, Mus musculus
attctactctatacttgccaacgtg

SEQ ID NO: 280820 - DNA, 25 bp, Mus musculus
attctactctattcttgccaacgtg

SEQ ID NO: 280821 - DNA, 25 bp, Mus musculus
attctactcttgcagagaagacctg

SEQ ID NO: 280822 - DNA, 25 bp, Mus musculus
attctactcttggagagaagacctg

SEQ ID NO: 280823 - DNA, 25 bp, Mus musculus
attctactggctatagtactgttta

SEQ ID NO: 280824 - DNA, 25 bp, Mus musculus
attctactggctttagtactgttta

SEQ ID NO: 280825 - DNA, 25 bp, Mus musculus
attctacttagtcaaatcatcttct

SEQ ID NO: 280826 - DNA, 25 bp, Mus musculus
attctacttagtgaaatcatcttct

SEQ ID NO: 280827 - DNA, 25 bp, Mus musculus
attctacttatcagtccttcctatg

SEQ ID NO: 280828 - DNA, 25 bp, Mus musculus
attctacttatctgtccttcctatg

SEQ ID NO: 280829 - DNA, 25 bp, Mus musculus
attctacttattagacacatcccgc

SEQ ID NO: 280830 - DNA, 25 bp, Mus musculus
attctacttatttgacacatcccgc

SEQ ID NO: 280831 - DNA, 25 bp, Mus musculus
attctacttcagaagctgttcagaa

SEQ ID NO: 280832 - DNA, 25 bp, Mus musculus
attctacttcagtagctgttcagaa

SEQ ID NO: 280833 - DNA, 25 bp, Mus musculus
attctacttccgactgttgttttga

SEQ ID NO: 280834 - DNA, 25 bp, Mus musculus
attctacttccgtctgttgttttga

SEQ ID NO: 280835 - DNA, 25 bp, Mus musculus
attctacttgggaggtcagctctta

SEQ ID NO: 280836 - DNA, 25 bp, Mus musculus
attctacttgggtggtcagctctta

SEQ ID NO: 280837 - DNA, 25 bp, Mus musculus
attctacttgtaagtcctcttttgc

SEQ ID NO: 280838 - DNA, 25 bp, Mus musculus
attctacttgtatgtcctcttttgc

SEQ ID NO: 280839 - DNA, 25 bp, Mus musculus
attctagaagatcggtcagggtgca

SEQ ID NO: 280840 - DNA, 25 bp, Mus musculus
attctagaagatctcccatgcccag

SEQ ID NO: 280841 - DNA, 25 bp, Mus musculus
attctagaagatgggtcagggtgca

SEQ ID NO: 280842 - DNA, 25 bp, Mus musculus
attctagaagatgtcccatgcccag

SEQ ID NO: 280843 - DNA, 25 bp, Mus musculus
attctagaagccacccagggacaag

SEQ ID NO: 280844 - DNA, 25 bp, Mus musculus
attctagaagcctcccagggacaag

SEQ ID NO: 280845 - DNA, 25 bp, Mus musculus
attctagaaggaacactgtccagta

SEQ ID NO: 280846 - DNA, 25 bp, Mus musculus
attctagaaggatcactgtccagta

SEQ ID NO: 280847 - DNA, 25 bp, Mus musculus
attctagaaggccagctcttgcttc

SEQ ID NO: 280848 - DNA, 25 bp, Mus musculus
attctagaaggcgagctcttgcttc

SEQ ID NO: 280849 - DNA, 25 bp, Mus musculus
attctagaagttacccaatgtacac

SEQ ID NO: 280850 - DNA, 25 bp, Mus musculus
attctagaagtttcccaatgtacac

SEQ ID NO: 280851 - DNA, 25 bp, Mus musculus
attctagagccgctccacaaaggag

SEQ ID NO: 280852 - DNA, 25 bp, Mus musculus
attctagagccggtccacaaaggag

SEQ ID NO: 280853 - DNA, 25 bp, Mus musculus
attctagatcagctaacttattacc

SEQ ID NO: 280854 - DNA, 25 bp, Mus musculus
attctagatcaggtaacttattacc

SEQ ID NO: 280855 - DNA, 25 bp, Mus musculus
attctagcacccagagctcaagcag

SEQ ID NO: 280856 - DNA, 25 bp, Mus musculus
attctagcaccctgagctcaagcag

SEQ ID NO: 280857 - DNA, 25 bp, Mus musculus
attctagcagtgcaggctgatttcc

SEQ ID NO: 280858 - DNA, 25 bp, Mus musculus
attctagcagtggaggctgatttcc

SEQ ID NO: 280859 - DNA, 25 bp, Mus musculus
attctagccataccatttcctctaa

SEQ ID NO: 280860 - DNA, 25 bp, Mus musculus
attctagccatagcatttcctctaa

SEQ ID NO: 280861 - DNA, 25 bp, Mus musculus
attctagcgatgctcatacacatac

SEQ ID NO: 280862 - DNA, 25 bp, Mus musculus
attctagcgatggtcatacacatac

SEQ ID NO: 280863 - DNA, 25 bp, Mus musculus
attctagctagtccctccattaaac

SEQ ID NO: 280864 - DNA, 25 bp, Mus musculus
attctagctagtgcctccattaaac

SEQ ID NO: 280865 - DNA, 25 bp, Mus musculus
attctagctccacgaggtccagtgc

SEQ ID NO: 280866 - DNA, 25 bp, Mus musculus
attctagctccaggaggtccagtgc

SEQ ID NO: 280867 - DNA, 25 bp, Mus musculus
attctagctcttcgagatggaggca

SEQ ID NO: 280868 - DNA, 25 bp, Mus musculus
attctagctcttggagatggaggca

SEQ ID NO: 280869 - DNA, 25 bp, Mus musculus
attctagctgaaatctgatgcaaat

SEQ ID NO: 280870 - DNA, 25 bp, Mus musculus
attctagctgaattctgatgcaaat

SEQ ID NO: 280871 - DNA, 25 bp, Mus musculus
attctagctgctctggagttgaaca

SEQ ID NO: 280872 - DNA, 25 bp, Mus musculus
attctagctgctgtggagttgaaca

SEQ ID NO: 280873 - DNA, 25 bp, Mus musculus
attctagcttcaatccacattcttt

SEQ ID NO: 280874 - DNA, 25 bp, Mus musculus
attctagcttcattccacattcttt

SEQ ID NO: 280875 - DNA, 25 bp, Mus musculus
attctagcttttcgttgtttcaaca

SEQ ID NO: 280876 - DNA, 25 bp, Mus musculus
attctagcttttggttgtttcaaca

SEQ ID NO: 280877 - DNA, 25 bp, Mus musculus
attctaggcaagaaagtaataatgt

SEQ ID NO: 280878 - DNA, 25 bp, Mus musculus
attctaggcaagtaagtaataatgt

SEQ ID NO: 280879 - DNA, 25 bp, Mus musculus
attctaggccagcaaaactttatct

SEQ ID NO: 280880 - DNA, 25 bp, Mus musculus
attctaggccaggaaaactttatct

SEQ ID NO: 280881 - DNA, 25 bp, Mus musculus
attctaggctacaatgcaagtttga

SEQ ID NO: 280882 - DNA, 25 bp, Mus musculus
attctaggctactatgcaagtttga

SEQ ID NO: 280883 - DNA, 25 bp, Mus musculus
attctagggttcataatacttactg

SEQ ID NO: 280884 - DNA, 25 bp, Mus musculus
attctagggttcttaatacttactg

SEQ ID NO: 280885 - DNA, 25 bp, Mus musculus
attctaggtaatagtgcatcgtgat

SEQ ID NO: 280886 - DNA, 25 bp, Mus musculus
attctaggtaattgtgcatcgtgat

SEQ ID NO: 280887 - DNA, 25 bp, Mus musculus
attctagtatttccccaggttggag

SEQ ID NO: 280888 - DNA, 25 bp, Mus musculus
attctagtatttgcccaggttggag

SEQ ID NO: 280889 - DNA, 25 bp, Mus musculus
attctagtcacaaatcccagagcac

SEQ ID NO: 280890 - DNA, 25 bp, Mus musculus
attctagtcacatatcccagagcac

SEQ ID NO: 280891 - DNA, 25 bp, Mus musculus
attctagtcagtcatgttcccatgt

SEQ ID NO: 280892 - DNA, 25 bp, Mus musculus
attctagtcagtgatgttcccatgt

SEQ ID NO: 280893 - DNA, 25 bp, Mus musculus
attctagtccttctaactttgaact

SEQ ID NO: 280894 - DNA, 25 bp, Mus musculus
attctagtccttgtaactttgaact

SEQ ID NO: 280895 - DNA, 25 bp, Mus musculus
attctagtggtcctgtttgtcttta

SEQ ID NO: 280896 - DNA, 25 bp, Mus musculus
attctagtggtcgtgtttgtcttta

SEQ ID NO: 280897 - DNA, 25 bp, Mus musculus
attctagtttccagaattgggattt

SEQ ID NO: 280898 - DNA, 25 bp, Mus musculus
attctagtttcctgaattgggattt

SEQ ID NO: 280899 - DNA, 25 bp, Mus musculus
attctagtttggagtacttgctgta

SEQ ID NO: 280900 - DNA, 25 bp, Mus musculus
attctagtttggtgtacttgctgta

SEQ ID NO: 280901 - DNA, 25 bp, Mus musculus
attctatagacaaggttggccccaa

SEQ ID NO: 280902 - DNA, 25 bp, Mus musculus
attctatagacatggttggccccaa

SEQ ID NO: 280903 - DNA, 25 bp, Mus musculus
attctataggtcacttgcagcctgt

SEQ ID NO: 280904 - DNA, 25 bp, Mus musculus
attctataggtctcttgcagcctgt

SEQ ID NO: 280905 - DNA, 25 bp, Mus musculus
attctatatgcgatcttgggttctc

SEQ ID NO: 280906 - DNA, 25 bp, Mus musculus
attctatatgcgttcttgggttctc

SEQ ID NO: 280907 - DNA, 25 bp, Mus musculus
attctatcagatctgccactgtgca

SEQ ID NO: 280908 - DNA, 25 bp, Mus musculus
attctatcagatgtgccactgtgca

SEQ ID NO: 280909 - DNA, 25 bp, Mus musculus
attctatcccaacgtcaccacaaat

SEQ ID NO: 280910 - DNA, 25 bp, Mus musculus
attctatcccaaggtcaccacaaat

SEQ ID NO: 280911 - DNA, 25 bp, Mus musculus
attctatcccgcaccgtggacggga

SEQ ID NO: 280912 - DNA, 25 bp, Mus musculus
attctatcccgctccgtggacggga

SEQ ID NO: 280913 - DNA, 25 bp, Mus musculus
attctatcctttcaagttcccagtg

SEQ ID NO: 280914 - DNA, 25 bp, Mus musculus
attctatcctttgaagttcccagtg

SEQ ID NO: 280915 - DNA, 25 bp, Mus musculus
attctatcgtatcccccatgaagtt

SEQ ID NO: 280916 - DNA, 25 bp, Mus musculus
attctatcgtatgccccatgaagtt

SEQ ID NO: 280917 - DNA, 25 bp, Mus musculus
attctatctgctagctgtgaccagc

SEQ ID NO: 280918 - DNA, 25 bp, Mus musculus
attctatctgcttgctgtgaccagc

SEQ ID NO: 280919 - DNA, 25 bp, Mus musculus
attctatctttcatgctgctggcgt

SEQ ID NO: 280920 - DNA, 25 bp, Mus musculus
attctatctttcttgctgctggcgt

SEQ ID NO: 280921 - DNA, 25 bp, Mus musculus
attctatgaactcccaacgtaccct

SEQ ID NO: 280922 - DNA, 25 bp, Mus musculus
attctatgaactgccaacgtaccct

SEQ ID NO: 280923 - DNA, 25 bp, Mus musculus
attctatgacatatctgctcaccac

SEQ ID NO: 280924 - DNA, 25 bp, Mus musculus
attctatgacatttctgctcaccac

SEQ ID NO: 280925 - DNA, 25 bp, Mus musculus
attctatgagcccaaaatcccacag

SEQ ID NO: 280926 - DNA, 25 bp, Mus musculus
attctatgagccgaaaatcccacag

SEQ ID NO: 280927 - DNA, 25 bp, Mus musculus
attctatgctttagacctacgaatt

SEQ ID NO: 280928 - DNA, 25 bp, Mus musculus
attctatgcttttgacctacgaatt

SEQ ID NO: 280929 - DNA, 25 bp, Mus musculus
attctatggcctctgaaccctctta

SEQ ID NO: 280930 - DNA, 25 bp, Mus musculus
attctatggcctgtgaaccctctta

SEQ ID NO: 280931 - DNA, 25 bp, Mus musculus
attctatggtctcccatggactgcg

SEQ ID NO: 280932 - DNA, 25 bp, Mus musculus
attctatggtctgccatggactgcg

SEQ ID NO: 280933 - DNA, 25 bp, Mus musculus
attctatggtgacttcatttcagcc

SEQ ID NO: 280934 - DNA, 25 bp, Mus musculus
attctatggtgagttcatttcagcc

SEQ ID NO: 280935 - DNA, 25 bp, Mus musculus
attctatgtgaaagggcagctcccg

SEQ ID NO: 280936 - DNA, 25 bp, Mus musculus
attctatgtgaatgggcagctcccg

SEQ ID NO: 280937 - DNA, 25 bp, Mus musculus
attctattccgtctggtcacagaca

SEQ ID NO: 280938 - DNA, 25 bp, Mus musculus
attctattccgtgtggtcacagaca

SEQ ID NO: 280939 - DNA, 25 bp, Mus musculus
attctatttcctcttctatattctg

SEQ ID NO: 280940 - DNA, 25 bp, Mus musculus
attctatttcctgttctatattctg

SEQ ID NO: 280941 - DNA, 25 bp, Mus musculus
attctatttgaaatttagtgacaat

SEQ ID NO: 280942 - DNA, 25 bp, Mus musculus
attctatttgaattttagtgacaat

SEQ ID NO: 280943 - DNA, 25 bp, Mus musculus
attctcaaaccaccacgtcgttgct

SEQ ID NO: 280944 - DNA, 25 bp, Mus musculus
attctcaaaccagcacgtcgttgct

SEQ ID NO: 280945 - DNA, 25 bp, Mus musculus
attctcaacatcatcgagcgtctct

SEQ ID NO: 280946 - DNA, 25 bp, Mus musculus
attctcaacatcttcgagcgtctct

SEQ ID NO: 280947 - DNA, 25 bp, Mus musculus
attctcaactcaccaggatgctgaa

SEQ ID NO: 280948 - DNA, 25 bp, Mus musculus
attctcaactcagcaggatgctgaa

SEQ ID NO: 280949 - DNA, 25 bp, Mus musculus
attctcaacttgagtgctattcgta

SEQ ID NO: 280950 - DNA, 25 bp, Mus musculus
attctcaacttgtgtgctattcgta

SEQ ID NO: 280951 - DNA, 25 bp, Mus musculus
attctcaagaggacttgccaatcag

SEQ ID NO: 280952 - DNA, 25 bp, Mus musculus
attctcaagaggtcttgccaatcag

SEQ ID NO: 280953 - DNA, 25 bp, Mus musculus
attctcaaggctaacatgacttagg

SEQ ID NO: 280954 - DNA, 25 bp, Mus musculus
attctcaaggcttacatgacttagg

SEQ ID NO: 280955 - DNA, 25 bp, Mus musculus
attctcaagttgacctggaagccct

SEQ ID NO: 280956 - DNA, 25 bp, Mus musculus
attctcaagttgtcctggaagccct

SEQ ID NO: 280957 - DNA, 25 bp, Mus musculus
attctcacagcaagcatactggttg

SEQ ID NO: 280958 - DNA, 25 bp, Mus musculus
attctcacagcatgcatactggttg

SEQ ID NO: 280959 - DNA, 25 bp, Mus musculus
attctcaccatgaaacagtcctact

SEQ ID NO: 280960 - DNA, 25 bp, Mus musculus
attctcaccatgtaacagtcctact

SEQ ID NO: 280961 - DNA, 25 bp, Mus musculus
attctcacctggaaagcacatgtgt

SEQ ID NO: 280962 - DNA, 25 bp, Mus musculus
attctcacctggtaagcacatgtgt

SEQ ID NO: 280963 - DNA, 25 bp, Mus musculus
attctcacgagaccatttgttttac

SEQ ID NO: 280964 - DNA, 25 bp, Mus musculus
attctcacgagagcatttgttttac

SEQ ID NO: 280965 - DNA, 25 bp, Mus musculus
attctcacgcacacatagtccaaat

SEQ ID NO: 280966 - DNA, 25 bp, Mus musculus
attctcacgcactcatagtccaaat

SEQ ID NO: 280967 - DNA, 25 bp, Mus musculus
attctcacgctcagtatagtcactg

SEQ ID NO: 280968 - DNA, 25 bp, Mus musculus
attctcacgctctgtatagtcactg

SEQ ID NO: 280969 - DNA, 25 bp, Mus musculus
attctcactggtcgtccaggttcca

SEQ ID NO: 280970 - DNA, 25 bp, Mus musculus
attctcactggtggtccaggttcca

SEQ ID NO: 280971 - DNA, 25 bp, Mus musculus
attctcactgtgaatctccctgctg

SEQ ID NO: 280972 - DNA, 25 bp, Mus musculus
attctcactgtgtatctccctgctg

SEQ ID NO: 280973 - DNA, 25 bp, Mus musculus
attctcacttgtagtccccaccgtt

SEQ ID NO: 280974 - DNA, 25 bp, Mus musculus
attctcacttgttgtccccaccgtt

SEQ ID NO: 280975 - DNA, 25 bp, Mus musculus
attctcagaggtatggactttcgta

SEQ ID NO: 280976 - DNA, 25 bp, Mus musculus
attctcagaggtttggactttcgta

SEQ ID NO: 280977 - DNA, 25 bp, Mus musculus
attctcagagtgacttcagtcttta

SEQ ID NO: 280978 - DNA, 25 bp, Mus musculus
attctcagagtgtcttcagtcttta

SEQ ID NO: 280979 - DNA, 25 bp, Mus musculus
attctcagattcacaactcaattgg

SEQ ID NO: 280980 - DNA, 25 bp, Mus musculus
attctcagattctcaactcaattgg

SEQ ID NO: 280981 - DNA, 25 bp, Mus musculus
attctcagcaaaaggttccgctgtg

SEQ ID NO: 280982 - DNA, 25 bp, Mus musculus
attctcagcaaatggttccgctgtg

SEQ ID NO: 280983 - DNA, 25 bp, Mus musculus
attctcaggaacacctcaggagtca

SEQ ID NO: 280984 - DNA, 25 bp, Mus musculus
attctcaggaactcctcaggagtca

SEQ ID NO: 280985 - DNA, 25 bp, Mus musculus
attctcaggcaaacacgtgcaacga

SEQ ID NO: 280986 - DNA, 25 bp, Mus musculus
attctcaggcaatcacgtgcaacga

SEQ ID NO: 280987 - DNA, 25 bp, Mus musculus
attctcaggtgccatgcctttgggt

SEQ ID NO: 280988 - DNA, 25 bp, Mus musculus
attctcaggtgcgatgcctttgggt

SEQ ID NO: 280989 - DNA, 25 bp, Mus musculus
attctcaggtggctctctgttttac

SEQ ID NO: 280990 - DNA, 25 bp, Mus musculus
attctcaggtgggtctctgttttac

SEQ ID NO: 280991 - DNA, 25 bp, Mus musculus
attctcagtaaaaagtcaagtgcag

SEQ ID NO: 280992 - DNA, 25 bp, Mus musculus
attctcagtaaatagtcaagtgcag

SEQ ID NO: 280993 - DNA, 25 bp, Mus musculus
attctcagtatgattatagctcagg

SEQ ID NO: 280994 - DNA, 25 bp, Mus musculus
attctcagtatgtttatagctcagg

SEQ ID NO: 280995 - DNA, 25 bp, Mus musculus
attctcagtccaccaaacactacgg

SEQ ID NO: 280996 - DNA, 25 bp, Mus musculus
attctcagtccagcaaacactacgg

SEQ ID NO: 280997 - DNA, 25 bp, Mus musculus
attctcagtcgcatggtgaatcaca

SEQ ID NO: 280998 - DNA, 25 bp, Mus musculus
attctcagtcgcttggtgaatcaca

SEQ ID NO: 280999 - DNA, 25 bp, Mus musculus
attctcatactcaaaagtcgcggtg

SEQ ID NO: 281000 - DNA, 25 bp, Mus musculus
attctcatactctaaagtcgcggtg

SEQ ID NO: 281001 - DNA, 25 bp, Mus musculus
attctcatattcacgaagtgctggg

SEQ ID NO: 281002 - DNA, 25 bp, Mus musculus
attctcatattctcgaagtgctggg

SEQ ID NO: 281003 - DNA, 25 bp, Mus musculus
attctcatcaaccagtacatcgcag

SEQ ID NO: 281004 - DNA, 25 bp, Mus musculus
attctcatcaacgagtacatcgcag

SEQ ID NO: 281005 - DNA, 25 bp, Mus musculus
attctcatcagcagttgtagaagtt

SEQ ID NO: 281006 - DNA, 25 bp, Mus musculus
attctcatcagctgttgtagaagtt

SEQ ID NO: 281007 - DNA, 25 bp, Mus musculus
attctcatcaggaggtgcacactct

SEQ ID NO: 281008 - DNA, 25 bp, Mus musculus
attctcatcaggtggtgcacactct

SEQ ID NO: 281009 - DNA, 25 bp, Mus musculus
attctcatcccaatgaccctgtttt

SEQ ID NO: 281010 - DNA, 25 bp, Mus musculus
attctcatcccattgaccctgtttt

SEQ ID NO: 281011 - DNA, 25 bp, Mus musculus
attctcatccccatgtttagctgac

SEQ ID NO: 281012 - DNA, 25 bp, Mus musculus
attctcatccccttgtttagctgac

SEQ ID NO: 281013 - DNA, 25 bp, Mus musculus
attctcatcctcaggtgcttgttga

SEQ ID NO: 281014 - DNA, 25 bp, Mus musculus
attctcatcctctggtgcttgttga

SEQ ID NO: 281015 - DNA, 25 bp, Mus musculus
attctcatcggcctggttcttggaa

SEQ ID NO: 281016 - DNA, 25 bp, Mus musculus
attctcatcggcgtggttcttggaa

SEQ ID NO: 281017 - DNA, 25 bp, Mus musculus
attctcatcttcactgaggcggtat

SEQ ID NO: 281018 - DNA, 25 bp, Mus musculus
attctcatcttctctgaggcggtat

SEQ ID NO: 281019 - DNA, 25 bp, Mus musculus
attctcatgaatcgtactttctgta

SEQ ID NO: 281020 - DNA, 25 bp, Mus musculus
attctcatgaatggtactttctgta

SEQ ID NO: 281021 - DNA, 25 bp, Mus musculus
attctcatgcaaaccaccattctat

SEQ ID NO: 281022 - DNA, 25 bp, Mus musculus
attctcatgcaatccaccattctat

SEQ ID NO: 281023 - DNA, 25 bp, Mus musculus
attctcatgctaagaattgctttaa

SEQ ID NO: 281024 - DNA, 25 bp, Mus musculus
attctcatgctatgaattgctttaa

SEQ ID NO: 281025 - DNA, 25 bp, Mus musculus
attctcatggcaaattgcaccggga

SEQ ID NO: 281026 - DNA, 25 bp, Mus musculus
attctcatggcatattgcaccggga

SEQ ID NO: 281027 - DNA, 25 bp, Mus musculus
attctcatggctattctatcttatt

SEQ ID NO: 281028 - DNA, 25 bp, Mus musculus
attctcatggcttttctatcttatt

SEQ ID NO: 281029 - DNA, 25 bp, Mus musculus
attctcatgtagcagaacttcctga

SEQ ID NO: 281030 - DNA, 25 bp, Mus musculus
attctcatgtaggagaacttcctga

SEQ ID NO: 281031 - DNA, 25 bp, Mus musculus
attctcatgtgcaatgcttgcttcc

SEQ ID NO: 281032 - DNA, 25 bp, Mus musculus
attctcatgtgctatgcttgcttcc

SEQ ID NO: 281033 - DNA, 25 bp, Mus musculus
attctcatgtttcctgttatatctt

SEQ ID NO: 281034 - DNA, 25 bp, Mus musculus
attctcatgtttgctgttatatctt

SEQ ID NO: 281035 - DNA, 25 bp, Mus musculus
attctcattgagacaggcttctatt

SEQ ID NO: 281036 - DNA, 25 bp, Mus musculus
attctcattgagtcaggcttctatt

SEQ ID NO: 281037 - DNA, 25 bp, Mus musculus
attctcattgctaccaaccttggct

SEQ ID NO: 281038 - DNA, 25 bp, Mus musculus
attctcattgcttccaaccttggct

SEQ ID NO: 281039 - DNA, 25 bp, Mus musculus
attctcattggaacctcacattacc

SEQ ID NO: 281040 - DNA, 25 bp, Mus musculus
attctcattggatcctcacattacc

SEQ ID NO: 281041 - DNA, 25 bp, Mus musculus
attctcattggcaccccttgtctgt

SEQ ID NO: 281042 - DNA, 25 bp, Mus musculus
attctcattggctccccttgtctgt

SEQ ID NO: 281043 - DNA, 25 bp, Mus musculus
attctcatttctcctggtgatgctg

SEQ ID NO: 281044 - DNA, 25 bp, Mus musculus
attctcatttctgctggtgatgctg

SEQ ID NO: 281045 - DNA, 25 bp, Mus musculus
attctccaaataagctaccctgaag

SEQ ID NO: 281046 - DNA, 25 bp, Mus musculus
attctccaaatatgctaccctgaag

SEQ ID NO: 281047 - DNA, 25 bp, Mus musculus
attctccaacccagcgaagcttttg

SEQ ID NO: 281048 - DNA, 25 bp, Mus musculus
attctccaaccctgcgaagcttttg

SEQ ID NO: 281049 - DNA, 25 bp, Mus musculus
attctccacatcctgggatttgagt

SEQ ID NO: 281050 - DNA, 25 bp, Mus musculus
attctccacatcgtgggatttgagt

SEQ ID NO: 281051 - DNA, 25 bp, Mus musculus
attctccactccacagaaagctcgg

SEQ ID NO: 281052 - DNA, 25 bp, Mus musculus
attctccactcctcagaaagctcgg

SEQ ID NO: 281053 - DNA, 25 bp, Mus musculus
attctccactgcctatgagggctga

SEQ ID NO: 281054 - DNA, 25 bp, Mus musculus
attctccactgcgtatgagggctga

SEQ ID NO: 281055 - DNA, 25 bp, Mus musculus
attctccagattcaaacccttacag

SEQ ID NO: 281056 - DNA, 25 bp, Mus musculus
attctccagattgaaacccttacag

SEQ ID NO: 281057 - DNA, 25 bp, Mus musculus
attctccagcagatagccgatcact

SEQ ID NO: 281058 - DNA, 25 bp, Mus musculus
attctccagcagttagccgatcact

SEQ ID NO: 281059 - DNA, 25 bp, Mus musculus
attctccaggaaccactggcctgtg

SEQ ID NO: 281060 - DNA, 25 bp, Mus musculus
attctccaggaagcactggcctgtg

SEQ ID NO: 281061 - DNA, 25 bp, Mus musculus
attctccagggaacagactattcta

SEQ ID NO: 281062 - DNA, 25 bp, Mus musculus
attctccagggatcagactattcta

SEQ ID NO: 281063 - DNA, 25 bp, Mus musculus
attctccagtgcatggctagagcta

SEQ ID NO: 281064 - DNA, 25 bp, Mus musculus
attctccagtgcttggctagagcta

SEQ ID NO: 281065 - DNA, 25 bp, Mus musculus
attctccagttgacttccctggtga

SEQ ID NO: 281066 - DNA, 25 bp, Mus musculus
attctccagttgtcttccctggtga

SEQ ID NO: 281067 - DNA, 25 bp, Mus musculus
attctccattgaatgatctctacca

SEQ ID NO: 281068 - DNA, 25 bp, Mus musculus
attctccattgattgatctctacca

SEQ ID NO: 281069 - DNA, 25 bp, Mus musculus
attctcccaagtcagttccagactt

SEQ ID NO: 281070 - DNA, 25 bp, Mus musculus
attctcccaagtgagttccagactt

SEQ ID NO: 281071 - DNA, 25 bp, Mus musculus
attctcccagacctggtttcctcaa

SEQ ID NO: 281072 - DNA, 25 bp, Mus musculus
attctcccagacgtggtttcctcaa

SEQ ID NO: 281073 - DNA, 25 bp, Mus musculus
attctccccagtatctttcacatgg

SEQ ID NO: 281074 - DNA, 25 bp, Mus musculus
attctccccagtttctttcacatgg

SEQ ID NO: 281075 - DNA, 25 bp, Mus musculus
attctcccctcaataaggcaccaga

SEQ ID NO: 281076 - DNA, 25 bp, Mus musculus
attctcccctcattaaggcaccaga

SEQ ID NO: 281077 - DNA, 25 bp, Mus musculus
attctcccctctagcacgagagtaa

SEQ ID NO: 281078 - DNA, 25 bp, Mus musculus
attctcccctcttgcacgagagtaa

SEQ ID NO: 281079 - DNA, 25 bp, Mus musculus
attctcccgagaaactatgtctgct

SEQ ID NO: 281080 - DNA, 25 bp, Mus musculus
attctcccgagatactatgtctgct

SEQ ID NO: 281081 - DNA, 25 bp, Mus musculus
attctcccgccacagctattaaatt

SEQ ID NO: 281082 - DNA, 25 bp, Mus musculus
attctcccgccagagctattaaatt

SEQ ID NO: 281083 - DNA, 25 bp, Mus musculus
attctcccgtttcctttgtggcctg

SEQ ID NO: 281084 - DNA, 25 bp, Mus musculus
attctcccgtttgctttgtggcctg

SEQ ID NO: 281085 - DNA, 25 bp, Mus musculus
attctccctacaagagcttgttggc

SEQ ID NO: 281086 - DNA, 25 bp, Mus musculus
attctccctacatgagcttgttggc

SEQ ID NO: 281087 - DNA, 25 bp, Mus musculus
attctccctattccttcatactgaa

SEQ ID NO: 281088 - DNA, 25 bp, Mus musculus
attctccctattgcttcatactgaa

SEQ ID NO: 281089 - DNA, 25 bp, Mus musculus
attctccctcaacctcttgttgatt

SEQ ID NO: 281090 - DNA, 25 bp, Mus musculus
attctccctcaagctcttgttgatt

SEQ ID NO: 281091 - DNA, 25 bp, Mus musculus
attctccctccgctggataaactga

SEQ ID NO: 281092 - DNA, 25 bp, Mus musculus
attctccctccggtggataaactga

SEQ ID NO: 281093 - DNA, 25 bp, Mus musculus
attctccctgccactgaacactggg

SEQ ID NO: 281094 - DNA, 25 bp, Mus musculus
attctccctgcctctgaacactggg

SEQ ID NO: 281095 - DNA, 25 bp, Mus musculus
attctccctgggatgctttgcgctg

SEQ ID NO: 281096 - DNA, 25 bp, Mus musculus
attctccctgggttgctttgcgctg

SEQ ID NO: 281097 - DNA, 25 bp, Mus musculus
attctccctttgcattgagttccca

SEQ ID NO: 281098 - DNA, 25 bp, Mus musculus
attctccctttggattgagttccca

SEQ ID NO: 281099 - DNA, 25 bp, Mus musculus
attctccgtcttaccatcattgaga

SEQ ID NO: 281100 - DNA, 25 bp, Mus musculus
attctccgtctttccatcattgaga

SEQ ID NO: 281101 - DNA, 25 bp, Mus musculus
attctcctaaccctggtcagatggt

SEQ ID NO: 281102 - DNA, 25 bp, Mus musculus
attctcctaaccgtggtcagatggt

SEQ ID NO: 281103 - DNA, 25 bp, Mus musculus
attctcctagctaaagaaaccttat

SEQ ID NO: 281104 - DNA, 25 bp, Mus musculus
attctcctagcttaagaaaccttat

SEQ ID NO: 281105 - DNA, 25 bp, Mus musculus
attctcctatgacagcaagcccagg

SEQ ID NO: 281106 - DNA, 25 bp, Mus musculus
attctcctatgagagcaagcccagg

SEQ ID NO: 281107 - DNA, 25 bp, Mus musculus
attctcctcacacaaatcgcctgag

SEQ ID NO: 281108 - DNA, 25 bp, Mus musculus
attctcctcacagaaatcgcctgag

SEQ ID NO: 281109 - DNA, 25 bp, Mus musculus
attctcctcagcattgcctgtttta

SEQ ID NO: 281110 - DNA, 25 bp, Mus musculus
attctcctcagctttgcctgtttta

SEQ ID NO: 281111 - DNA, 25 bp, Mus musculus
attctcctctacatctagttcttct

SEQ ID NO: 281112 - DNA, 25 bp, Mus musculus
attctcctctacttctagttcttct

SEQ ID NO: 281113 - DNA, 25 bp, Mus musculus
attctcctcttcagataccacagat

SEQ ID NO: 281114 - DNA, 25 bp, Mus musculus
attctcctcttctgataccacagat

SEQ ID NO: 281115 - DNA, 25 bp, Mus musculus
attctcctgagaattccatccttca

SEQ ID NO: 281116 - DNA, 25 bp, Mus musculus
attctcctgagatttccatccttca

SEQ ID NO: 281117 - DNA, 25 bp, Mus musculus
attctcctgagcaccgagttgcgaa

SEQ ID NO: 281118 - DNA, 25 bp, Mus musculus
attctcctgagctccgagttgcgaa

SEQ ID NO: 281119 - DNA, 25 bp, Mus musculus
attctcctgataatactgggctcct

SEQ ID NO: 281120 - DNA, 25 bp, Mus musculus
attctcctgatattactgggctcct

SEQ ID NO: 281121 - DNA, 25 bp, Mus musculus
attctcctgcagaatggaatcctag

SEQ ID NO: 281122 - DNA, 25 bp, Mus musculus
attctcctgcagtatggaatcctag

SEQ ID NO: 281123 - DNA, 25 bp, Mus musculus
attctcctgcatagtgctcatacat

SEQ ID NO: 281124 - DNA, 25 bp, Mus musculus
attctcctgcattgtgctcatacat

SEQ ID NO: 281125 - DNA, 25 bp, Mus musculus
attctcctggctacgtttttatact

SEQ ID NO: 281126 - DNA, 25 bp, Mus musculus
attctcctggcttcgtttttatact

SEQ ID NO: 281127 - DNA, 25 bp, Mus musculus
attctccttattactccatagttca

SEQ ID NO: 281128 - DNA, 25 bp, Mus musculus
attctccttatttctccatagttca

SEQ ID NO: 281129 - DNA, 25 bp, Mus musculus
attctccttggcattcttaactggt

SEQ ID NO: 281130 - DNA, 25 bp, Mus musculus
attctccttggctttcttaactggt

SEQ ID NO: 281131 - DNA, 25 bp, Mus musculus
attctccttggtactagggtctgca

SEQ ID NO: 281132 - DNA, 25 bp, Mus musculus
attctccttggttctagggtctgca

SEQ ID NO: 281133 - DNA, 25 bp, Mus musculus
attctccttgtaattaactagattg

SEQ ID NO: 281134 - DNA, 25 bp, Mus musculus
attctccttgtatttaactagattg

SEQ ID NO: 281135 - DNA, 25 bp, Mus musculus
attctccttgtcctggtatagttgc

SEQ ID NO: 281136 - DNA, 25 bp, Mus musculus
attctccttgtcgtggtatagttgc

SEQ ID NO: 281137 - DNA, 25 bp, Mus musculus
attctcgaagacaccatgcagcaat

SEQ ID NO: 281138 - DNA, 25 bp, Mus musculus
attctcgaagactccatgcagcaat

SEQ ID NO: 281139 - DNA, 25 bp, Mus musculus
attctcgacctcaactgcataggtg

SEQ ID NO: 281140 - DNA, 25 bp, Mus musculus
attctcgacctctactgcataggtg

SEQ ID NO: 281141 - DNA, 25 bp, Mus musculus
attctcgactatctctttgcacacg

SEQ ID NO: 281142 - DNA, 25 bp, Mus musculus
attctcgactatgtctttgcacacg

SEQ ID NO: 281143 - DNA, 25 bp, Mus musculus
attctcgagcgaattatacatccgt

SEQ ID NO: 281144 - DNA, 25 bp, Mus musculus
attctcgagcgatttatacatccgt

SEQ ID NO: 281145 - DNA, 25 bp, Mus musculus
attctcgaggaacgatccagcctgg

SEQ ID NO: 281146 - DNA, 25 bp, Mus musculus
attctcgaggaaggatccagcctgg

SEQ ID NO: 281147 - DNA, 25 bp, Mus musculus
attctcgatctgctgacgtcgattc

SEQ ID NO: 281148 - DNA, 25 bp, Mus musculus
attctcgatctggtgacgtcgattc

SEQ ID NO: 281149 - DNA, 25 bp, Mus musculus
attctcggaagcaagaagcggagtg

SEQ ID NO: 281150 - DNA, 25 bp, Mus musculus
attctcggaagctagaagcggagtg

SEQ ID NO: 281151 - DNA, 25 bp, Mus musculus
attctcggagttcctgccctcaata

SEQ ID NO: 281152 - DNA, 25 bp, Mus musculus
attctcggagttgctgccctcaata

SEQ ID NO: 281153 - DNA, 25 bp, Mus musculus
attctcggattacctatctcgagtg

SEQ ID NO: 281154 - DNA, 25 bp, Mus musculus
attctcggattagctatctcgagtg

SEQ ID NO: 281155 - DNA, 25 bp, Mus musculus
attctcggcgcccacacaggtgaca

SEQ ID NO: 281156 - DNA, 25 bp, Mus musculus
attctcggcgccgacacaggtgaca

SEQ ID NO: 281157 - DNA, 25 bp, Mus musculus
attctcgggaatacttcaatcgcag

SEQ ID NO: 281158 - DNA, 25 bp, Mus musculus
attctcgggaattcttcaatcgcag

SEQ ID NO: 281159 - DNA, 25 bp, Mus musculus
attctcggtatgaggctagcttcaa

SEQ ID NO: 281160 - DNA, 25 bp, Mus musculus
attctcggtatgtggctagcttcaa

SEQ ID NO: 281161 - DNA, 25 bp, Mus musculus
attctcggtgctatagcctttcatc

SEQ ID NO: 281162 - DNA, 25 bp, Mus musculus
attctcggtgctttagcctttcatc

SEQ ID NO: 281163 - DNA, 25 bp, Mus musculus
attctcgtccatcaagttcctgtgg

SEQ ID NO: 281164 - DNA, 25 bp, Mus musculus
attctcgtccatgaagttcctgtgg

SEQ ID NO: 281165 - DNA, 25 bp, Mus musculus
attctcgtgtacaacccactgtgga

SEQ ID NO: 281166 - DNA, 25 bp, Mus musculus
attctcgtgtactacccactgtgga

SEQ ID NO: 281167 - DNA, 25 bp, Mus musculus
attctctaaactactcctgctgcct

SEQ ID NO: 281168 - DNA, 25 bp, Mus musculus
attctctaaacttctcctgctgcct

SEQ ID NO: 281169 - DNA, 25 bp, Mus musculus
attctctaattaaccacccttggtg

SEQ ID NO: 281170 - DNA, 25 bp, Mus musculus
attctctaattatccacccttggtg

SEQ ID NO: 281171 - DNA, 25 bp, Mus musculus
attctctaccaccaacggaaagctg

SEQ ID NO: 281172 - DNA, 25 bp, Mus musculus
attctctaccacgaacggaaagctg

SEQ ID NO: 281173 - DNA, 25 bp, Mus musculus
attctctacctcagggctatacctt

SEQ ID NO: 281174 - DNA, 25 bp, Mus musculus
attctctacctctgggctatacctt

SEQ ID NO: 281175 - DNA, 25 bp, Mus musculus
attctctagtttagtctgttctctg

SEQ ID NO: 281176 - DNA, 25 bp, Mus musculus
attctctagttttgtctgttctctg

SEQ ID NO: 281177 - DNA, 25 bp, Mus musculus
attctctatcatcaacccgatgaca

SEQ ID NO: 281178 - DNA, 25 bp, Mus musculus
attctctatcatgaacccgatgaca

SEQ ID NO: 281179 - DNA, 25 bp, Mus musculus
attctctatgtccactgttgtagcc

SEQ ID NO: 281180 - DNA, 25 bp, Mus musculus
attctctatgtcgactgttgtagcc

SEQ ID NO: 281181 - DNA, 25 bp, Mus musculus
attctctattttctacatggcgcat

SEQ ID NO: 281182 - DNA, 25 bp, Mus musculus
attctctattttgtacatggcgcat

SEQ ID NO: 281183 - DNA, 25 bp, Mus musculus
attctctcaagtctccaaatgcatt

SEQ ID NO: 281184 - DNA, 25 bp, Mus musculus
attctctcaagtgtccaaatgcatt

SEQ ID NO: 281185 - DNA, 25 bp, Mus musculus
attctctcagaacttaccgctatta

SEQ ID NO: 281186 - DNA, 25 bp, Mus musculus
attctctcagaagttaccgctatta

SEQ ID NO: 281187 - DNA, 25 bp, Mus musculus
attctctcaggtctctttgttagtg

SEQ ID NO: 281188 - DNA, 25 bp, Mus musculus
attctctcaggtgtctttgttagtg

SEQ ID NO: 281189 - DNA, 25 bp, Mus musculus
attctctcatgaaggcgacagggat

SEQ ID NO: 281190 - DNA, 25 bp, Mus musculus
attctctcatgatggcgacagggat

SEQ ID NO: 281191 - DNA, 25 bp, Mus musculus
attctctcattgcacaccagatgtt

SEQ ID NO: 281192 - DNA, 25 bp, Mus musculus
attctctcattggacaccagatgtt

SEQ ID NO: 281193 - DNA, 25 bp, Mus musculus
attctctccaaccatgtacctttag

SEQ ID NO: 281194 - DNA, 25 bp, Mus musculus
attctctccaacgatgtacctttag

SEQ ID NO: 281195 - DNA, 25 bp, Mus musculus
attctctccacgctgctaagttgac

SEQ ID NO: 281196 - DNA, 25 bp, Mus musculus
attctctccacggtgctaagttgac

SEQ ID NO: 281197 - DNA, 25 bp, Mus musculus
attctctccactaccgagttttgtt

SEQ ID NO: 281198 - DNA, 25 bp, Mus musculus
attctctccacttccgagttttgtt

SEQ ID NO: 281199 - DNA, 25 bp, Mus musculus
attctctccaggaacctgctattga

SEQ ID NO: 281200 - DNA, 25 bp, Mus musculus
attctctccaggtacctgctattga

SEQ ID NO: 281201 - DNA, 25 bp, Mus musculus
attctctccccaatgatcattagtc

SEQ ID NO: 281202 - DNA, 25 bp, Mus musculus
attctctccccattgatcattagtc

SEQ ID NO: 281203 - DNA, 25 bp, Mus musculus
attctctccctactgcaaggaagca

SEQ ID NO: 281204 - DNA, 25 bp, Mus musculus
attctctccctagtgcaaggaagca

SEQ ID NO: 281205 - DNA, 25 bp, Mus musculus
attctctcctgcaactgtggattcc

SEQ ID NO: 281206 - DNA, 25 bp, Mus musculus
attctctcctgctactgtggattcc

SEQ ID NO: 281207 - DNA, 25 bp, Mus musculus
attctctcctggatctttaggttag

SEQ ID NO: 281208 - DNA, 25 bp, Mus musculus
attctctcctggttctttaggttag

SEQ ID NO: 281209 - DNA, 25 bp, Mus musculus
attctctccttaaggccttcctaat

SEQ ID NO: 281210 - DNA, 25 bp, Mus musculus
attctctccttatggccttcctaat

SEQ ID NO: 281211 - DNA, 25 bp, Mus musculus
attctctccttccacgaggaaaagc

SEQ ID NO: 281212 - DNA, 25 bp, Mus musculus
attctctccttcgacgaggaaaagc

SEQ ID NO: 281213 - DNA, 25 bp, Mus musculus
attctctccttgctcaggtgagtat

SEQ ID NO: 281214 - DNA, 25 bp, Mus musculus
attctctccttgcttcactcatgaa

SEQ ID NO: 281215 - DNA, 25 bp, Mus musculus
attctctccttggtcaggtgagtat

SEQ ID NO: 281216 - DNA, 25 bp, Mus musculus
attctctccttggttcactcatgaa

SEQ ID NO: 281217 - DNA, 25 bp, Mus musculus
attctctcgataatctctacatacg

SEQ ID NO: 281218 - DNA, 25 bp, Mus musculus
attctctcgatattctctacatacg

SEQ ID NO: 281219 - DNA, 25 bp, Mus musculus
attctctcgcacatggttttgccgg

SEQ ID NO: 281220 - DNA, 25 bp, Mus musculus
attctctcgcacttggttttgccgg

SEQ ID NO: 281221 - DNA, 25 bp, Mus musculus
attctctctcgtatttggtaggaca

SEQ ID NO: 281222 - DNA, 25 bp, Mus musculus
attctctctcgtttttggtaggaca

SEQ ID NO: 281223 - DNA, 25 bp, Mus musculus
attctctctgatctttgtctcctga

SEQ ID NO: 281224 - DNA, 25 bp, Mus musculus
attctctctgatgtttgtctcctga

SEQ ID NO: 281225 - DNA, 25 bp, Mus musculus
attctctctgtcactctcatgagta

SEQ ID NO: 281226 - DNA, 25 bp, Mus musculus
attctctctgtcagcgcaagtgtca

SEQ ID NO: 281227 - DNA, 25 bp, Mus musculus
attctctctgtctctctcatgagta

SEQ ID NO: 281228 - DNA, 25 bp, Mus musculus
attctctctgtctgcgcaagtgtca

SEQ ID NO: 281229 - DNA, 25 bp, Mus musculus
attctctcttctcgccaacttgtat

SEQ ID NO: 281230 - DNA, 25 bp, Mus musculus
attctctcttctggccaacttgtat

SEQ ID NO: 281231 - DNA, 25 bp, Mus musculus
attctctcttggcagcagatatcca

SEQ ID NO: 281232 - DNA, 25 bp, Mus musculus
attctctcttgggagcagatatcca

SEQ ID NO: 281233 - DNA, 25 bp, Mus musculus
attctctgaagaactccgccagcaa

SEQ ID NO: 281234 - DNA, 25 bp, Mus musculus
attctctgaagatctccgccagcaa

SEQ ID NO: 281235 - DNA, 25 bp, Mus musculus
attctctgaggccactttgtgatct

SEQ ID NO: 281236 - DNA, 25 bp, Mus musculus
attctctgaggcgactttgtgatct

SEQ ID NO: 281237 - DNA, 25 bp, Mus musculus
attctctgatccagcatcacctact

SEQ ID NO: 281238 - DNA, 25 bp, Mus musculus
attctctgatcctgcatcacctact

SEQ ID NO: 281239 - DNA, 25 bp, Mus musculus
attctctgatgtatgcctctgtgtc

SEQ ID NO: 281240 - DNA, 25 bp, Mus musculus
attctctgatgtcctggcgtgctca

SEQ ID NO: 281241 - DNA, 25 bp, Mus musculus
attctctgatgtgctggcgtgctca

SEQ ID NO: 281242 - DNA, 25 bp, Mus musculus
attctctgatgtttgcctctgtgtc

SEQ ID NO: 281243 - DNA, 25 bp, Mus musculus
attctctgcagcaatgttgcttcag

SEQ ID NO: 281244 - DNA, 25 bp, Mus musculus
attctctgcagctatgttgcttcag

SEQ ID NO: 281245 - DNA, 25 bp, Mus musculus
attctctgcccaatgcatcttaggg

SEQ ID NO: 281246 - DNA, 25 bp, Mus musculus
attctctgcccattgcatcttaggg

SEQ ID NO: 281247 - DNA, 25 bp, Mus musculus
attctctgctataaaggacatgttg

SEQ ID NO: 281248 - DNA, 25 bp, Mus musculus
attctctgctattaaggacatgttg

SEQ ID NO: 281249 - DNA, 25 bp, Mus musculus
attctctgctggctacaggctgcta

SEQ ID NO: 281250 - DNA, 25 bp, Mus musculus
attctctgctgggtacaggctgcta

SEQ ID NO: 281251 - DNA, 25 bp, Mus musculus
attctctggctgataccgtgttcaa

SEQ ID NO: 281252 - DNA, 25 bp, Mus musculus
attctctggctgttaccgtgttcaa

SEQ ID NO: 281253 - DNA, 25 bp, Mus musculus
attctctgggcgatcctgtatctat

SEQ ID NO: 281254 - DNA, 25 bp, Mus musculus
attctctgggcgttcctgtatctat

SEQ ID NO: 281255 - DNA, 25 bp, Mus musculus
attctctgtagtcacttagcttctg

SEQ ID NO: 281256 - DNA, 25 bp, Mus musculus
attctctgtagtgacttagcttctg

SEQ ID NO: 281257 - DNA, 25 bp, Mus musculus
attctctgtggacttttttggtttg

SEQ ID NO: 281258 - DNA, 25 bp, Mus musculus
attctctgtggagttttttggtttg

SEQ ID NO: 281259 - DNA, 25 bp, Mus musculus
attctctgttctccaaacctgggaa

SEQ ID NO: 281260 - DNA, 25 bp, Mus musculus
attctctgttctgcaaacctgggaa

SEQ ID NO: 281261 - DNA, 25 bp, Mus musculus
attctctgtttaagcaatgtgctcg

SEQ ID NO: 281262 - DNA, 25 bp, Mus musculus
attctctgtttatgcaatgtgctcg

SEQ ID NO: 281263 - DNA, 25 bp, Mus musculus
attctctgtttcacactgggactct

SEQ ID NO: 281264 - DNA, 25 bp, Mus musculus
attctctgtttcctctccagtgaaa

SEQ ID NO: 281265 - DNA, 25 bp, Mus musculus
attctctgtttcgtctccagtgaaa

SEQ ID NO: 281266 - DNA, 25 bp, Mus musculus
attctctgtttctcactgggactct

SEQ ID NO: 281267 - DNA, 25 bp, Mus musculus
attctcttactcattggacctcttg

SEQ ID NO: 281268 - DNA, 25 bp, Mus musculus
attctcttactctttggacctcttg

SEQ ID NO: 281269 - DNA, 25 bp, Mus musculus
attctcttataaaagctaagccgca

SEQ ID NO: 281270 - DNA, 25 bp, Mus musculus
attctcttataatagctaagccgca

SEQ ID NO: 281271 - DNA, 25 bp, Mus musculus
attctcttcaacacactgggactca

SEQ ID NO: 281272 - DNA, 25 bp, Mus musculus
attctcttcaactcactgggactca

SEQ ID NO: 281273 - DNA, 25 bp, Mus musculus
attctcttcatcatccacagtatgt

SEQ ID NO: 281274 - DNA, 25 bp, Mus musculus
attctcttcatcttccacagtatgt

SEQ ID NO: 281275 - DNA, 25 bp, Mus musculus
attctcttcatgaacctctatgcta

SEQ ID NO: 281276 - DNA, 25 bp, Mus musculus
attctcttcatgcttgtgttctatc

SEQ ID NO: 281277 - DNA, 25 bp, Mus musculus
attctcttcatggttgtgttctatc

SEQ ID NO: 281278 - DNA, 25 bp, Mus musculus
attctcttcatgtacctctatgcta

SEQ ID NO: 281279 - DNA, 25 bp, Mus musculus
attctcttcctcaggtagataggga

SEQ ID NO: 281280 - DNA, 25 bp, Mus musculus
attctcttcctctggtagataggga

SEQ ID NO: 281281 - DNA, 25 bp, Mus musculus
attctcttctccatatccatggatt

SEQ ID NO: 281282 - DNA, 25 bp, Mus musculus
attctcttctccttatccatggatt

SEQ ID NO: 281283 - DNA, 25 bp, Mus musculus
attctcttctgccttctagttagga

SEQ ID NO: 281284 - DNA, 25 bp, Mus musculus
attctcttctgcgttctagttagga

SEQ ID NO: 281285 - DNA, 25 bp, Mus musculus
attctcttctggacccaaagttgaa

SEQ ID NO: 281286 - DNA, 25 bp, Mus musculus
attctcttctggagttgcaacaaag

SEQ ID NO: 281287 - DNA, 25 bp, Mus musculus
attctcttctggtcccaaagttgaa

SEQ ID NO: 281288 - DNA, 25 bp, Mus musculus
attctcttctggtgttgcaacaaag

SEQ ID NO: 281289 - DNA, 25 bp, Mus musculus
attctcttgaacctatgcttatttg

SEQ ID NO: 281290 - DNA, 25 bp, Mus musculus
attctcttgaacgtatgcttatttg

SEQ ID NO: 281291 - DNA, 25 bp, Mus musculus
attctcttgcatagggtcctcttcc

SEQ ID NO: 281292 - DNA, 25 bp, Mus musculus
attctcttgcattgggtcctcttcc

SEQ ID NO: 281293 - DNA, 25 bp, Mus musculus
attctcttgctcatgtatgtgcatc

SEQ ID NO: 281294 - DNA, 25 bp, Mus musculus
attctcttgctcttgtatgtgcatc

SEQ ID NO: 281295 - DNA, 25 bp, Mus musculus
attctcttggcacactattaaatac

SEQ ID NO: 281296 - DNA, 25 bp, Mus musculus
attctcttggcagactattaaatac

SEQ ID NO: 281297 - DNA, 25 bp, Mus musculus
attctcttgggtccacataatagca

SEQ ID NO: 281298 - DNA, 25 bp, Mus musculus
attctcttgggtgcacataatagca

SEQ ID NO: 281299 - DNA, 25 bp, Mus musculus
attctcttggtaacctggctgtcct

SEQ ID NO: 281300 - DNA, 25 bp, Mus musculus
attctcttggtatcctggctgtcct

SEQ ID NO: 281301 - DNA, 25 bp, Mus musculus
attctctttacaaagggcctctctt

SEQ ID NO: 281302 - DNA, 25 bp, Mus musculus
attctctttacatagggcctctctt

SEQ ID NO: 281303 - DNA, 25 bp, Mus musculus
attctctttcatcagactcaggcta

SEQ ID NO: 281304 - DNA, 25 bp, Mus musculus
attctctttcatgagactcaggcta

SEQ ID NO: 281305 - DNA, 25 bp, Mus musculus
attctctttcctaggtgcttagtca

SEQ ID NO: 281306 - DNA, 25 bp, Mus musculus
attctctttcctcggtgagtgttca

SEQ ID NO: 281307 - DNA, 25 bp, Mus musculus
attctctttcctgggtgagtgttca

SEQ ID NO: 281308 - DNA, 25 bp, Mus musculus
attctctttccttggtgcttagtca

SEQ ID NO: 281309 - DNA, 25 bp, Mus musculus
attctctttcgtatcttcttttatg

SEQ ID NO: 281310 - DNA, 25 bp, Mus musculus
attctctttcgtttcttcttttatg

SEQ ID NO: 281311 - DNA, 25 bp, Mus musculus
attctctttggtcttcactgtctac

SEQ ID NO: 281312 - DNA, 25 bp, Mus musculus
attctctttggtgttcactgtctac

SEQ ID NO: 281313 - DNA, 25 bp, Mus musculus
attctctttgttaatccagttagct

SEQ ID NO: 281314 - DNA, 25 bp, Mus musculus
attctctttgtttatccagttagct

SEQ ID NO: 281315 - DNA, 25 bp, Mus musculus
attctcttttaaaatggttgtcata

SEQ ID NO: 281316 - DNA, 25 bp, Mus musculus
attctcttttaatatggttgtcata

SEQ ID NO: 281317 - DNA, 25 bp, Mus musculus
attctcttttgaagactttctgggc

SEQ ID NO: 281318 - DNA, 25 bp, Mus musculus
attctcttttgaaggcctgcattaa

SEQ ID NO: 281319 - DNA, 25 bp, Mus musculus
attctcttttgatgactttctgggc

SEQ ID NO: 281320 - DNA, 25 bp, Mus musculus
attctcttttgatggcctgcattaa

SEQ ID NO: 281321 - DNA, 25 bp, Mus musculus
attctgaaatttatgcgctttggag

SEQ ID NO: 281322 - DNA, 25 bp, Mus musculus
attctgaaatttttgcgctttggag

SEQ ID NO: 281323 - DNA, 25 bp, Mus musculus
attctgaaccctcctgtgttgcctt

SEQ ID NO: 281324 - DNA, 25 bp, Mus musculus
attctgaaccctgctgtgttgcctt

SEQ ID NO: 281325 - DNA, 25 bp, Mus musculus
attctgaaccttccctttgaacctg

SEQ ID NO: 281326 - DNA, 25 bp, Mus musculus
attctgaaccttgcctttgaacctg

SEQ ID NO: 281327 - DNA, 25 bp, Mus musculus
attctgaactctaaattgccggctc

SEQ ID NO: 281328 - DNA, 25 bp, Mus musculus
attctgaactcttaattgccggctc

SEQ ID NO: 281329 - DNA, 25 bp, Mus musculus
attctgaaggccactcgttttctaa

SEQ ID NO: 281330 - DNA, 25 bp, Mus musculus
attctgaaggcctctcgttttctaa

SEQ ID NO: 281331 - DNA, 25 bp, Mus musculus
attctgaagtacagggcctttctca

SEQ ID NO: 281332 - DNA, 25 bp, Mus musculus
attctgaagtactgggcctttctca

SEQ ID NO: 281333 - DNA, 25 bp, Mus musculus
attctgaagtgtctaacctatttta

SEQ ID NO: 281334 - DNA, 25 bp, Mus musculus
attctgaagtgtgtaacctatttta

SEQ ID NO: 281335 - DNA, 25 bp, Mus musculus
attctgaataccacaaaaggccgag

SEQ ID NO: 281336 - DNA, 25 bp, Mus musculus
attctgaatacctcaaaaggccgag

SEQ ID NO: 281337 - DNA, 25 bp, Mus musculus
attctgaatattcggttcttagtga

SEQ ID NO: 281338 - DNA, 25 bp, Mus musculus
attctgaatattgggttcttagtga

SEQ ID NO: 281339 - DNA, 25 bp, Mus musculus
attctgaatgagagattgatgccca

SEQ ID NO: 281340 - DNA, 25 bp, Mus musculus
attctgaatgagtgattgatgccca

SEQ ID NO: 281341 - DNA, 25 bp, Mus musculus
attctgaattccctcaagtacgtcc

SEQ ID NO: 281342 - DNA, 25 bp, Mus musculus
attctgaattccgtcaagtacgtcc

SEQ ID NO: 281343 - DNA, 25 bp, Mus musculus
attctgacacttatttggatctggg

SEQ ID NO: 281344 - DNA, 25 bp, Mus musculus
attctgacacttttttggatctggg

SEQ ID NO: 281345 - DNA, 25 bp, Mus musculus
attctgaccacacttgtatgctgta

SEQ ID NO: 281346 - DNA, 25 bp, Mus musculus
attctgaccacagttgtatgctgta

SEQ ID NO: 281347 - DNA, 25 bp, Mus musculus
attctgacccctatctggatgtttg

SEQ ID NO: 281348 - DNA, 25 bp, Mus musculus
attctgacccctctgtgtgctctga

SEQ ID NO: 281349 - DNA, 25 bp, Mus musculus
attctgacccctgtgtgtgctctga

SEQ ID NO: 281350 - DNA, 25 bp, Mus musculus
attctgacccctttctggatgtttg

SEQ ID NO: 281351 - DNA, 25 bp, Mus musculus
attctgactacaagacacccttggt

SEQ ID NO: 281352 - DNA, 25 bp, Mus musculus
attctgactacatgacacccttggt

SEQ ID NO: 281353 - DNA, 25 bp, Mus musculus
attctgactgaaatttgctggcaca

SEQ ID NO: 281354 - DNA, 25 bp, Mus musculus
attctgactgaattttgctggcaca

SEQ ID NO: 281355 - DNA, 25 bp, Mus musculus
attctgactgtgactctactggcct

SEQ ID NO: 281356 - DNA, 25 bp, Mus musculus
attctgactgtgtctctactggcct

SEQ ID NO: 281357 - DNA, 25 bp, Mus musculus
attctgacttacctctccattacaa

SEQ ID NO: 281358 - DNA, 25 bp, Mus musculus
attctgacttacgtctccattacaa

SEQ ID NO: 281359 - DNA, 25 bp, Mus musculus
attctgagactaagtgtttctgcaa

SEQ ID NO: 281360 - DNA, 25 bp, Mus musculus
attctgagactatgtgtttctgcaa

SEQ ID NO: 281361 - DNA, 25 bp, Mus musculus
attctgagagcacctgtgctccgca

SEQ ID NO: 281362 - DNA, 25 bp, Mus musculus
attctgagagcagctgtgctccgca

SEQ ID NO: 281363 - DNA, 25 bp, Mus musculus
attctgagaggaatggtggattcat

SEQ ID NO: 281364 - DNA, 25 bp, Mus musculus
attctgagaggattggtggattcat

SEQ ID NO: 281365 - DNA, 25 bp, Mus musculus
attctgagcaacctatctttattga

SEQ ID NO: 281366 - DNA, 25 bp, Mus musculus
attctgagcaacgtatctttattga

SEQ ID NO: 281367 - DNA, 25 bp, Mus musculus
attctgagcattatggtttttctcc

SEQ ID NO: 281368 - DNA, 25 bp, Mus musculus
attctgagcattttggtttttctcc

SEQ ID NO: 281369 - DNA, 25 bp, Mus musculus
attctgagcccacgcagaggcacca

SEQ ID NO: 281370 - DNA, 25 bp, Mus musculus
attctgagcccaggcagaggcacca

SEQ ID NO: 281371 - DNA, 25 bp, Mus musculus
attctgagccctagatttaattctt

SEQ ID NO: 281372 - DNA, 25 bp, Mus musculus
attctgagcccttgatttaattctt

SEQ ID NO: 281373 - DNA, 25 bp, Mus musculus
attctgagcggccaaggctcctaga

SEQ ID NO: 281374 - DNA, 25 bp, Mus musculus
attctgagcggcgaaggctcctaga

SEQ ID NO: 281375 - DNA, 25 bp, Mus musculus
attctgagctcacattatattatag

SEQ ID NO: 281376 - DNA, 25 bp, Mus musculus
attctgagctcagattatattatag

SEQ ID NO: 281377 - DNA, 25 bp, Mus musculus
attctgagctgtagcgagctgggcc

SEQ ID NO: 281378 - DNA, 25 bp, Mus musculus
attctgagctgttgcgagctgggcc

SEQ ID NO: 281379 - DNA, 25 bp, Mus musculus
attctgaggaacagccacttctggc

SEQ ID NO: 281380 - DNA, 25 bp, Mus musculus
attctgaggaactgccacttctggc

SEQ ID NO: 281381 - DNA, 25 bp, Mus musculus
attctgaggcacattgtttaggcaa

SEQ ID NO: 281382 - DNA, 25 bp, Mus musculus
attctgaggcactttgtttaggcaa

SEQ ID NO: 281383 - DNA, 25 bp, Mus musculus
attctgaggcgccagatgccattgg

SEQ ID NO: 281384 - DNA, 25 bp, Mus musculus
attctgaggcgcgagatgccattgg

SEQ ID NO: 281385 - DNA, 25 bp, Mus musculus
attctgaggctcataaaatggtgcg

SEQ ID NO: 281386 - DNA, 25 bp, Mus musculus
attctgaggctcttaaaatggtgcg

SEQ ID NO: 281387 - DNA, 25 bp, Mus musculus
attctgaggttgaatgccattctga

SEQ ID NO: 281388 - DNA, 25 bp, Mus musculus
attctgaggttgtatgccattctga

SEQ ID NO: 281389 - DNA, 25 bp, Mus musculus
attctgagtactagtgatcatcccc

SEQ ID NO: 281390 - DNA, 25 bp, Mus musculus
attctgagtactctgtgactttttt

SEQ ID NO: 281391 - DNA, 25 bp, Mus musculus
attctgagtactgtgtgactttttt

SEQ ID NO: 281392 - DNA, 25 bp, Mus musculus
attctgagtacttgtgatcatcccc

SEQ ID NO: 281393 - DNA, 25 bp, Mus musculus
attctgagtagtaacactgcctgcc

SEQ ID NO: 281394 - DNA, 25 bp, Mus musculus
attctgagtagttacactgcctgcc

SEQ ID NO: 281395 - DNA, 25 bp, Mus musculus
attctgagtggaaaccctctcctaa

SEQ ID NO: 281396 - DNA, 25 bp, Mus musculus
attctgagtggataccctctcctaa

SEQ ID NO: 281397 - DNA, 25 bp, Mus musculus
attctgagtggcaatatcttcctga

SEQ ID NO: 281398 - DNA, 25 bp, Mus musculus
attctgagtggctatatcttcctga

SEQ ID NO: 281399 - DNA, 25 bp, Mus musculus
attctgagtgttagtctagcctgga

SEQ ID NO: 281400 - DNA, 25 bp, Mus musculus
attctgagtgtttgtctagcctgga

SEQ ID NO: 281401 - DNA, 25 bp, Mus musculus
attctgagttctccagtcttgtgaa

SEQ ID NO: 281402 - DNA, 25 bp, Mus musculus
attctgagttctgcagtcttgtgaa

SEQ ID NO: 281403 - DNA, 25 bp, Mus musculus
attctgataaccacagttcttccct

SEQ ID NO: 281404 - DNA, 25 bp, Mus musculus
attctgataacctcagttcttccct

SEQ ID NO: 281405 - DNA, 25 bp, Mus musculus
attctgataagtcctctgtaagtct

SEQ ID NO: 281406 - DNA, 25 bp, Mus musculus
attctgataagtgctctgtaagtct

SEQ ID NO: 281407 - DNA, 25 bp, Mus musculus
attctgatattcaatgtctgagtgt

SEQ ID NO: 281408 - DNA, 25 bp, Mus musculus
attctgatattctatgtctgagtgt

SEQ ID NO: 281409 - DNA, 25 bp, Mus musculus
attctgatccttacaggccctaaag

SEQ ID NO: 281410 - DNA, 25 bp, Mus musculus
attctgatcctttcaggccctaaag

SEQ ID NO: 281411 - DNA, 25 bp, Mus musculus
attctgatgcagagccgaaagggcc

SEQ ID NO: 281412 - DNA, 25 bp, Mus musculus
attctgatgcagtgccgaaagggcc

SEQ ID NO: 281413 - DNA, 25 bp, Mus musculus
attctgatggctcagtcacttgtcc

SEQ ID NO: 281414 - DNA, 25 bp, Mus musculus
attctgatggctgagtcacttgtcc

SEQ ID NO: 281415 - DNA, 25 bp, Mus musculus
attctgatggtgacgaatcggatcc

SEQ ID NO: 281416 - DNA, 25 bp, Mus musculus
attctgatggtgtcgaatcggatcc

SEQ ID NO: 281417 - DNA, 25 bp, Mus musculus
attctgatgtgcctggaagctcttt

SEQ ID NO: 281418 - DNA, 25 bp, Mus musculus
attctgatgtgcgtggaagctcttt

SEQ ID NO: 281419 - DNA, 25 bp, Mus musculus
attctgatgttgagaccagagcaga

SEQ ID NO: 281420 - DNA, 25 bp, Mus musculus
attctgatgttgtgaccagagcaga

SEQ ID NO: 281421 - DNA, 25 bp, Mus musculus
attctgattaataggcactggtgac

SEQ ID NO: 281422 - DNA, 25 bp, Mus musculus
attctgattaattggcactggtgac

SEQ ID NO: 281423 - DNA, 25 bp, Mus musculus
attctgatttacactctcccacaat

SEQ ID NO: 281424 - DNA, 25 bp, Mus musculus
attctgatttactctctcccacaat

SEQ ID NO: 281425 - DNA, 25 bp, Mus musculus
attctgcaaatcattcaccttcttt

SEQ ID NO: 281426 - DNA, 25 bp, Mus musculus
attctgcaaatctttcaccttcttt

SEQ ID NO: 281427 - DNA, 25 bp, Mus musculus
attctgcaacgcctgtagccaatat

SEQ ID NO: 281428 - DNA, 25 bp, Mus musculus
attctgcaacgcgtgtagccaatat

SEQ ID NO: 281429 - DNA, 25 bp, Mus musculus
attctgcaatatacctcatgtctca

SEQ ID NO: 281430 - DNA, 25 bp, Mus musculus
attctgcaatattcctcatgtctca

SEQ ID NO: 281431 - DNA, 25 bp, Mus musculus
attctgcacaacaccatggagtctt

SEQ ID NO: 281432 - DNA, 25 bp, Mus musculus
attctgcacaactccatggagtctt

SEQ ID NO: 281433 - DNA, 25 bp, Mus musculus
attctgcacaagaaaccggtctgcc

SEQ ID NO: 281434 - DNA, 25 bp, Mus musculus
attctgcacaagtaaccggtctgcc

SEQ ID NO: 281435 - DNA, 25 bp, Mus musculus
attctgcacatacggctcaagtatt

SEQ ID NO: 281436 - DNA, 25 bp, Mus musculus
attctgcacatagggctcaagtatt

SEQ ID NO: 281437 - DNA, 25 bp, Mus musculus
attctgcacatcctatttgccatca

SEQ ID NO: 281438 - DNA, 25 bp, Mus musculus
attctgcacatcgtatttgccatca

SEQ ID NO: 281439 - DNA, 25 bp, Mus musculus
attctgcaccacatatgcggagtcc

SEQ ID NO: 281440 - DNA, 25 bp, Mus musculus
attctgcaccacttatgcggagtcc

SEQ ID NO: 281441 - DNA, 25 bp, Mus musculus
attctgcacctgcttatgtgaggaa

SEQ ID NO: 281442 - DNA, 25 bp, Mus musculus
attctgcacctggttatgtgaggaa

SEQ ID NO: 281443 - DNA, 25 bp, Mus musculus
attctgcagacaacaactggtcctc

SEQ ID NO: 281444 - DNA, 25 bp, Mus musculus
attctgcagacactgtgaagcccac

SEQ ID NO: 281445 - DNA, 25 bp, Mus musculus
attctgcagacagtgtgaagcccac

SEQ ID NO: 281446 - DNA, 25 bp, Mus musculus
attctgcagacatcaactggtcctc

SEQ ID NO: 281447 - DNA, 25 bp, Mus musculus
attctgcagcctaccagattgacgg

SEQ ID NO: 281448 - DNA, 25 bp, Mus musculus
attctgcagcctctcaataccaggg

SEQ ID NO: 281449 - DNA, 25 bp, Mus musculus
attctgcagcctgtcaataccaggg

SEQ ID NO: 281450 - DNA, 25 bp, Mus musculus
attctgcagccttccagattgacgg

SEQ ID NO: 281451 - DNA, 25 bp, Mus musculus
attctgcatctaaccctttcaagag

SEQ ID NO: 281452 - DNA, 25 bp, Mus musculus
attctgcatctatccctttcaagag

SEQ ID NO: 281453 - DNA, 25 bp, Mus musculus
attctgcatgcaaagagtgattaca

SEQ ID NO: 281454 - DNA, 25 bp, Mus musculus
attctgcatgcatagagtgattaca

SEQ ID NO: 281455 - DNA, 25 bp, Mus musculus
attctgcatggtattccagtgtgac

SEQ ID NO: 281456 - DNA, 25 bp, Mus musculus
attctgcatggttttccagtgtgac

SEQ ID NO: 281457 - DNA, 25 bp, Mus musculus
attctgcatttacctgtatctatat

SEQ ID NO: 281458 - DNA, 25 bp, Mus musculus
attctgcatttagctgtatctatat

SEQ ID NO: 281459 - DNA, 25 bp, Mus musculus
attctgcatttgattccgtgggagc

SEQ ID NO: 281460 - DNA, 25 bp, Mus musculus
attctgcatttgtttccgtgggagc

SEQ ID NO: 281461 - DNA, 25 bp, Mus musculus
attctgccaacaaataggtgtgttc

SEQ ID NO: 281462 - DNA, 25 bp, Mus musculus
attctgccaacatataggtgtgttc

SEQ ID NO: 281463 - DNA, 25 bp, Mus musculus
attctgccaatcataattttatata

SEQ ID NO: 281464 - DNA, 25 bp, Mus musculus
attctgccaatcttaattttatata

SEQ ID NO: 281465 - DNA, 25 bp, Mus musculus
attctgccactcctctgttaaacat

SEQ ID NO: 281466 - DNA, 25 bp, Mus musculus
attctgccactcgtctgttaaacat

SEQ ID NO: 281467 - DNA, 25 bp, Mus musculus
attctgccagcgacacattgcaggt

SEQ ID NO: 281468 - DNA, 25 bp, Mus musculus
attctgccagcgtcacattgcaggt

SEQ ID NO: 281469 - DNA, 25 bp, Mus musculus
attctgccatctactaatgttacta

SEQ ID NO: 281470 - DNA, 25 bp, Mus musculus
attctgccatcttctaatgttacta

SEQ ID NO: 281471 - DNA, 25 bp, Mus musculus
attctgcccaccatgtttcgcgttt

SEQ ID NO: 281472 - DNA, 25 bp, Mus musculus
attctgcccaccttgtttcgcgttt

SEQ ID NO: 281473 - DNA, 25 bp, Mus musculus
attctgcccagcagtattcataatt

SEQ ID NO: 281474 - DNA, 25 bp, Mus musculus
attctgcccagctgtattcataatt

SEQ ID NO: 281475 - DNA, 25 bp, Mus musculus
attctgcctaaaactgctttctctt

SEQ ID NO: 281476 - DNA, 25 bp, Mus musculus
attctgcctaaaagtcagggtcggc

SEQ ID NO: 281477 - DNA, 25 bp, Mus musculus
attctgcctaaatctgctttctctt

SEQ ID NO: 281478 - DNA, 25 bp, Mus musculus
attctgcctaaatgtcagggtcggc

SEQ ID NO: 281479 - DNA, 25 bp, Mus musculus
attctgcctaccagtactttttgct

SEQ ID NO: 281480 - DNA, 25 bp, Mus musculus
attctgcctacctgtactttttgct

SEQ ID NO: 281481 - DNA, 25 bp, Mus musculus
attctgcctctgcaaatcttttctg

SEQ ID NO: 281482 - DNA, 25 bp, Mus musculus
attctgcctctggaaatcttttctg

SEQ ID NO: 281483 - DNA, 25 bp, Mus musculus
attctgcctcttaagccccaggctt

SEQ ID NO: 281484 - DNA, 25 bp, Mus musculus
attctgcctctttagccccaggctt

SEQ ID NO: 281485 - DNA, 25 bp, Mus musculus
attctgcctgacatgaggaccctgt

SEQ ID NO: 281486 - DNA, 25 bp, Mus musculus
attctgcctgacttgaggaccctgt

SEQ ID NO: 281487 - DNA, 25 bp, Mus musculus
attctgcctgcaccccgaaactgag

SEQ ID NO: 281488 - DNA, 25 bp, Mus musculus
attctgcctgcagcccgaaactgag

SEQ ID NO: 281489 - DNA, 25 bp, Mus musculus
attctgcctgctcgtgatgttgctc

SEQ ID NO: 281490 - DNA, 25 bp, Mus musculus
attctgcctgctggtgatgttgctc

SEQ ID NO: 281491 - DNA, 25 bp, Mus musculus
attctgccttccataaaaggtggtg

SEQ ID NO: 281492 - DNA, 25 bp, Mus musculus
attctgccttccttaaaaggtggtg

SEQ ID NO: 281493 - DNA, 25 bp, Mus musculus
attctgcgccttctgctgggacgag

SEQ ID NO: 281494 - DNA, 25 bp, Mus musculus
attctgcgccttgtgctgggacgag

SEQ ID NO: 281495 - DNA, 25 bp, Mus musculus
attctgctagtgcatcctgtgtatc

SEQ ID NO: 281496 - DNA, 25 bp, Mus musculus
attctgctagtggatcctgtgtatc

SEQ ID NO: 281497 - DNA, 25 bp, Mus musculus
attctgctcacacattaaccacatg

SEQ ID NO: 281498 - DNA, 25 bp, Mus musculus
attctgctcacagattaaccacatg

SEQ ID NO: 281499 - DNA, 25 bp, Mus musculus
attctgctcatcactggggggctga

SEQ ID NO: 281500 - DNA, 25 bp, Mus musculus
attctgctcatctctggggggctga

SEQ ID NO: 281501 - DNA, 25 bp, Mus musculus
attctgctccctaccaggaaagttc

SEQ ID NO: 281502 - DNA, 25 bp, Mus musculus
attctgctcccttccaggaaagttc

SEQ ID NO: 281503 - DNA, 25 bp, Mus musculus
attctgctgaccatctagactggaa

SEQ ID NO: 281504 - DNA, 25 bp, Mus musculus
attctgctgaccttctagactggaa

SEQ ID NO: 281505 - DNA, 25 bp, Mus musculus
attctgctgcttcccagaaacagct

SEQ ID NO: 281506 - DNA, 25 bp, Mus musculus
attctgctgcttgccagaaacagct

SEQ ID NO: 281507 - DNA, 25 bp, Mus musculus
attctgctggacatcggtgctttgc

SEQ ID NO: 281508 - DNA, 25 bp, Mus musculus
attctgctggacttcggtgctttgc

SEQ ID NO: 281509 - DNA, 25 bp, Mus musculus
attctgcttaatacaaaaccgggct

SEQ ID NO: 281510 - DNA, 25 bp, Mus musculus
attctgcttaattcaaaaccgggct

SEQ ID NO: 281511 - DNA, 25 bp, Mus musculus
attctgcttattatgggttatccaa

SEQ ID NO: 281512 - DNA, 25 bp, Mus musculus
attctgcttattttgggttatccaa

SEQ ID NO: 281513 - DNA, 25 bp, Mus musculus
attctgcttctacatgacaggccag

SEQ ID NO: 281514 - DNA, 25 bp, Mus musculus
attctgcttctagatgacaggccag

SEQ ID NO: 281515 - DNA, 25 bp, Mus musculus
attctgcttctgaccggacatccag

SEQ ID NO: 281516 - DNA, 25 bp, Mus musculus
attctgcttctgtccggacatccag

SEQ ID NO: 281517 - DNA, 25 bp, Mus musculus
attctggaaactcctctattaactg

SEQ ID NO: 281518 - DNA, 25 bp, Mus musculus
attctggaaactgctctattaactg

SEQ ID NO: 281519 - DNA, 25 bp, Mus musculus
attctggaacccatcccagaggatt

SEQ ID NO: 281520 - DNA, 25 bp, Mus musculus
attctggaacccttcccagaggatt

SEQ ID NO: 281521 - DNA, 25 bp, Mus musculus
attctggaagaaactctcctttctc

SEQ ID NO: 281522 - DNA, 25 bp, Mus musculus
attctggaagaatctctcctttctc

SEQ ID NO: 281523 - DNA, 25 bp, Mus musculus
attctggaagagatttccgcctcca

SEQ ID NO: 281524 - DNA, 25 bp, Mus musculus
attctggaagagttttccgcctcca

SEQ ID NO: 281525 - DNA, 25 bp, Mus musculus
attctggaaggcaggtatcctctca

SEQ ID NO: 281526 - DNA, 25 bp, Mus musculus
attctggaaggctggtatcctctca

SEQ ID NO: 281527 - DNA, 25 bp, Mus musculus
attctggaattgcagcatcgggtct

SEQ ID NO: 281528 - DNA, 25 bp, Mus musculus
attctggaattggagcatcgggtct

SEQ ID NO: 281529 - DNA, 25 bp, Mus musculus
attctggacagaaacctctgtgggt

SEQ ID NO: 281530 - DNA, 25 bp, Mus musculus
attctggacagatacctctgtgggt

SEQ ID NO: 281531 - DNA, 25 bp, Mus musculus
attctggactccagtatcttcacag

SEQ ID NO: 281532 - DNA, 25 bp, Mus musculus
attctggactcctgtatcttcacag

SEQ ID NO: 281533 - DNA, 25 bp, Mus musculus
attctggactctaccctatctgcta

SEQ ID NO: 281534 - DNA, 25 bp, Mus musculus
attctggactcttccctatctgcta

SEQ ID NO: 281535 - DNA, 25 bp, Mus musculus
attctggacttgatagacgcacccc

SEQ ID NO: 281536 - DNA, 25 bp, Mus musculus
attctggacttgttagacgcacccc

SEQ ID NO: 281537 - DNA, 25 bp, Mus musculus
attctggagagcagctgggtgcccc

SEQ ID NO: 281538 - DNA, 25 bp, Mus musculus
attctggagagctgctgggtgcccc

SEQ ID NO: 281539 - DNA, 25 bp, Mus musculus
attctggagttcctgtcgaaggtca

SEQ ID NO: 281540 - DNA, 25 bp, Mus musculus
attctggagttcgtgtcgaaggtca

SEQ ID NO: 281541 - DNA, 25 bp, Mus musculus
attctggatgttcgagttccctgca

SEQ ID NO: 281542 - DNA, 25 bp, Mus musculus
attctggatgttggagttccctgca

SEQ ID NO: 281543 - DNA, 25 bp, Mus musculus
attctggatttgagctcgattgtat

SEQ ID NO: 281544 - DNA, 25 bp, Mus musculus
attctggatttgtgctcgattgtat

SEQ ID NO: 281545 - DNA, 25 bp, Mus musculus
attctggcaaagcttaaactgtcct

SEQ ID NO: 281546 - DNA, 25 bp, Mus musculus
attctggcaaaggttaaactgtcct

SEQ ID NO: 281547 - DNA, 25 bp, Mus musculus
attctggcaagaacacactggttac

SEQ ID NO: 281548 - DNA, 25 bp, Mus musculus
attctggcaagatcacactggttac

SEQ ID NO: 281549 - DNA, 25 bp, Mus musculus
attctggcacagaggtgctcttgcc

SEQ ID NO: 281550 - DNA, 25 bp, Mus musculus
attctggcacagctggagattccct

SEQ ID NO: 281551 - DNA, 25 bp, Mus musculus
attctggcacaggtggagattccct

SEQ ID NO: 281552 - DNA, 25 bp, Mus musculus
attctggcacagtggtgctcttgcc

SEQ ID NO: 281553 - DNA, 25 bp, Mus musculus
attctggcagctaccaagtcagcca

SEQ ID NO: 281554 - DNA, 25 bp, Mus musculus
attctggcagcttccaagtcagcca

SEQ ID NO: 281555 - DNA, 25 bp, Mus musculus
attctggccacacaagtcctttctc

SEQ ID NO: 281556 - DNA, 25 bp, Mus musculus
attctggccacagaagtcctttctc

SEQ ID NO: 281557 - DNA, 25 bp, Mus musculus
attctggccgagatgtgcttggcac

SEQ ID NO: 281558 - DNA, 25 bp, Mus musculus
attctggccgagttgtgcttggcac

SEQ ID NO: 281559 - DNA, 25 bp, Mus musculus
attctggcgtttatgtctgtaaagt

SEQ ID NO: 281560 - DNA, 25 bp, Mus musculus
attctggcgtttttgtctgtaaagt

SEQ ID NO: 281561 - DNA, 25 bp, Mus musculus
attctggctcatcatttcagagaca

SEQ ID NO: 281562 - DNA, 25 bp, Mus musculus
attctggctcatgatttcagagaca

SEQ ID NO: 281563 - DNA, 25 bp, Mus musculus
attctggctgaaaggaaaaccactg

SEQ ID NO: 281564 - DNA, 25 bp, Mus musculus
attctggctgaatggaaaaccactg

SEQ ID NO: 281565 - DNA, 25 bp, Mus musculus
attctggctgctctaacttggtaag

SEQ ID NO: 281566 - DNA, 25 bp, Mus musculus
attctggctgctcttgagtcattat

SEQ ID NO: 281567 - DNA, 25 bp, Mus musculus
attctggctgctgtaacttggtaag

SEQ ID NO: 281568 - DNA, 25 bp, Mus musculus
attctggctgctgttgagtcattat

SEQ ID NO: 281569 - DNA, 25 bp, Mus musculus
attctggctggaaacctcacaaagc

SEQ ID NO: 281570 - DNA, 25 bp, Mus musculus
attctggctggatacctcacaaagc

SEQ ID NO: 281571 - DNA, 25 bp, Mus musculus
attctggctgtgcttgactgccact

SEQ ID NO: 281572 - DNA, 25 bp, Mus musculus
attctggctgtggttgactgccact

SEQ ID NO: 281573 - DNA, 25 bp, Mus musculus
attctggcttctaacctttaccaca

SEQ ID NO: 281574 - DNA, 25 bp, Mus musculus
attctggcttctctaatgtagtatt

SEQ ID NO: 281575 - DNA, 25 bp, Mus musculus
attctggcttctgtaatgtagtatt

SEQ ID NO: 281576 - DNA, 25 bp, Mus musculus
attctggcttcttacctttaccaca

SEQ ID NO: 281577 - DNA, 25 bp, Mus musculus
attctgggaattacactaggcactc

SEQ ID NO: 281578 - DNA, 25 bp, Mus musculus
attctgggaattccggctgggcccc

SEQ ID NO: 281579 - DNA, 25 bp, Mus musculus
attctgggaattgcggctgggcccc

SEQ ID NO: 281580 - DNA, 25 bp, Mus musculus
attctgggaatttcactaggcactc

SEQ ID NO: 281581 - DNA, 25 bp, Mus musculus
attctgggacggagagctgttgatt

SEQ ID NO: 281582 - DNA, 25 bp, Mus musculus
attctgggacggtgagctgttgatt

SEQ ID NO: 281583 - DNA, 25 bp, Mus musculus
attctgggacttaaggtgccttgca

SEQ ID NO: 281584 - DNA, 25 bp, Mus musculus
attctgggactttaggtgccttgca

SEQ ID NO: 281585 - DNA, 25 bp, Mus musculus
attctgggcgttactaagtacggca

SEQ ID NO: 281586 - DNA, 25 bp, Mus musculus
attctgggcgtttctaagtacggca

SEQ ID NO: 281587 - DNA, 25 bp, Mus musculus
attctgggtagtcacacttccctgt

SEQ ID NO: 281588 - DNA, 25 bp, Mus musculus
attctgggtagtgacacttccctgt

SEQ ID NO: 281589 - DNA, 25 bp, Mus musculus
attctgggtcagctcttacccttgg

SEQ ID NO: 281590 - DNA, 25 bp, Mus musculus
attctgggtcaggtcttacccttgg

SEQ ID NO: 281591 - DNA, 25 bp, Mus musculus
attctgggtgtcaacccttcacact

SEQ ID NO: 281592 - DNA, 25 bp, Mus musculus
attctgggtgtctacccttcacact

SEQ ID NO: 281593 - DNA, 25 bp, Mus musculus
attctgggttctagtccttgctgtc

SEQ ID NO: 281594 - DNA, 25 bp, Mus musculus
attctgggttctatagcatgcttag

SEQ ID NO: 281595 - DNA, 25 bp, Mus musculus
attctgggttcttgtccttgctgtc

SEQ ID NO: 281596 - DNA, 25 bp, Mus musculus
attctgggttctttagcatgcttag

SEQ ID NO: 281597 - DNA, 25 bp, Mus musculus
attctgggtttgactggtgtctaca

SEQ ID NO: 281598 - DNA, 25 bp, Mus musculus
attctgggtttgtctggtgtctaca

SEQ ID NO: 281599 - DNA, 25 bp, Mus musculus
attctggtaaatcgtcttgtgccct

SEQ ID NO: 281600 - DNA, 25 bp, Mus musculus
attctggtaaatggtcttgtgccct

SEQ ID NO: 281601 - DNA, 25 bp, Mus musculus
attctggtatgtcccgttcttaaat

SEQ ID NO: 281602 - DNA, 25 bp, Mus musculus
attctggtatgtgccgttcttaaat

SEQ ID NO: 281603 - DNA, 25 bp, Mus musculus
attctggtccacatgggtagaagta

SEQ ID NO: 281604 - DNA, 25 bp, Mus musculus
attctggtccacttgggtagaagta

SEQ ID NO: 281605 - DNA, 25 bp, Mus musculus
attctggtccagacatacttgtatg

SEQ ID NO: 281606 - DNA, 25 bp, Mus musculus
attctggtccagtcatacttgtatg

SEQ ID NO: 281607 - DNA, 25 bp, Mus musculus
attctggtccctatttgtggttatt

SEQ ID NO: 281608 - DNA, 25 bp, Mus musculus
attctggtccctttttgtggttatt

SEQ ID NO: 281609 - DNA, 25 bp, Mus musculus
attctggtctgaaaactatgtcccg

SEQ ID NO: 281610 - DNA, 25 bp, Mus musculus
attctggtctgataactatgtcccg

SEQ ID NO: 281611 - DNA, 25 bp, Mus musculus
attctggtcttgatatgctgtgtgt

SEQ ID NO: 281612 - DNA, 25 bp, Mus musculus
attctggtcttgttatgctgtgtgt

SEQ ID NO: 281613 - DNA, 25 bp, Mus musculus
attctggtgctcatgatactcttaa

SEQ ID NO: 281614 - DNA, 25 bp, Mus musculus
attctggtgctcttgatactcttaa

SEQ ID NO: 281615 - DNA, 25 bp, Mus musculus
attctggtggttactaagtctgccc

SEQ ID NO: 281616 - DNA, 25 bp, Mus musculus
attctggtggtttctaagtctgccc

SEQ ID NO: 281617 - DNA, 25 bp, Mus musculus
attctggttagaactggtgcctttc

SEQ ID NO: 281618 - DNA, 25 bp, Mus musculus
attctggttagatctggtgcctttc

SEQ ID NO: 281619 - DNA, 25 bp, Mus musculus
attctggttatgacctgcaggaaac

SEQ ID NO: 281620 - DNA, 25 bp, Mus musculus
attctggttatgtcctgcaggaaac

SEQ ID NO: 281621 - DNA, 25 bp, Mus musculus
attctggttcataggcgttttgcca

SEQ ID NO: 281622 - DNA, 25 bp, Mus musculus
attctggttcattggcgttttgcca

SEQ ID NO: 281623 - DNA, 25 bp, Mus musculus
attctggttgctctgttcctggaag

SEQ ID NO: 281624 - DNA, 25 bp, Mus musculus
attctggttgctgtgttcctggaag

SEQ ID NO: 281625 - DNA, 25 bp, Mus musculus
attctggtttcaaatccctccttga

SEQ ID NO: 281626 - DNA, 25 bp, Mus musculus
attctggtttcatatccctccttga

SEQ ID NO: 281627 - DNA, 25 bp, Mus musculus
attctgtaacccagatcagtagtct

SEQ ID NO: 281628 - DNA, 25 bp, Mus musculus
attctgtaaccctgatcagtagtct

SEQ ID NO: 281629 - DNA, 25 bp, Mus musculus
attctgtacttaccagagacatgga

SEQ ID NO: 281630 - DNA, 25 bp, Mus musculus
attctgtacttagcagagacatgga

SEQ ID NO: 281631 - DNA, 25 bp, Mus musculus
attctgtactttaagtttgttatca

SEQ ID NO: 281632 - DNA, 25 bp, Mus musculus
attctgtacttttagtttgttatca

SEQ ID NO: 281633 - DNA, 25 bp, Mus musculus
attctgtagaagagtgcgctccttg

SEQ ID NO: 281634 - DNA, 25 bp, Mus musculus
attctgtagaagtgtgcgctccttg

SEQ ID NO: 281635 - DNA, 25 bp, Mus musculus
attctgtagcacacctcataggtat

SEQ ID NO: 281636 - DNA, 25 bp, Mus musculus
attctgtagcactcctcataggtat

SEQ ID NO: 281637 - DNA, 25 bp, Mus musculus
attctgtagccaagacacagcctta

SEQ ID NO: 281638 - DNA, 25 bp, Mus musculus
attctgtagccatgacacagcctta

SEQ ID NO: 281639 - DNA, 25 bp, Mus musculus
attctgtagcccaaatatagcgttc

SEQ ID NO: 281640 - DNA, 25 bp, Mus musculus
attctgtagccctaatatagcgttc

SEQ ID NO: 281641 - DNA, 25 bp, Mus musculus
attctgtagctgagactccagcttg

SEQ ID NO: 281642 - DNA, 25 bp, Mus musculus
attctgtagctgtgactccagcttg

SEQ ID NO: 281643 - DNA, 25 bp, Mus musculus
attctgtatgctaccacggtgtgac

SEQ ID NO: 281644 - DNA, 25 bp, Mus musculus
attctgtatgcttccacggtgtgac

SEQ ID NO: 281645 - DNA, 25 bp, Mus musculus
attctgtatggtaagtggccgtata

SEQ ID NO: 281646 - DNA, 25 bp, Mus musculus
attctgtatggttagtggccgtata

SEQ ID NO: 281647 - DNA, 25 bp, Mus musculus
attctgtatgttatcccctaaaatg

SEQ ID NO: 281648 - DNA, 25 bp, Mus musculus
attctgtatgttttcccctaaaatg

SEQ ID NO: 281649 - DNA, 25 bp, Mus musculus
attctgtattcgaggctggtgcatc

SEQ ID NO: 281650 - DNA, 25 bp, Mus musculus
attctgtattcgtggctggtgcatc

SEQ ID NO: 281651 - DNA, 25 bp, Mus musculus
attctgtcaatgatgccaccttcac

SEQ ID NO: 281652 - DNA, 25 bp, Mus musculus
attctgtcaatgttgccaccttcac

SEQ ID NO: 281653 - DNA, 25 bp, Mus musculus
attctgtcagacacctttgcaatgt

SEQ ID NO: 281654 - DNA, 25 bp, Mus musculus
attctgtcagactcctttgcaatgt

SEQ ID NO: 281655 - DNA, 25 bp, Mus musculus
attctgtcagatcggtgtcctttca

SEQ ID NO: 281656 - DNA, 25 bp, Mus musculus
attctgtcagatgggtgtcctttca

SEQ ID NO: 281657 - DNA, 25 bp, Mus musculus
attctgtcatgtatttgtttttata

SEQ ID NO: 281658 - DNA, 25 bp, Mus musculus
attctgtcatgtttttgtttttata

SEQ ID NO: 281659 - DNA, 25 bp, Mus musculus
attctgtcattcctccacatgtgga

SEQ ID NO: 281660 - DNA, 25 bp, Mus musculus
attctgtcattcgtccacatgtgga

SEQ ID NO: 281661 - DNA, 25 bp, Mus musculus
attctgtccctacgtgttttgttca

SEQ ID NO: 281662 - DNA, 25 bp, Mus musculus
attctgtccctaggtgttttgttca

SEQ ID NO: 281663 - DNA, 25 bp, Mus musculus
attctgtccgatccctgttaccttt

SEQ ID NO: 281664 - DNA, 25 bp, Mus musculus
attctgtccgatgcctgttaccttt

SEQ ID NO: 281665 - DNA, 25 bp, Mus musculus
attctgtctattctcaccctaatct

SEQ ID NO: 281666 - DNA, 25 bp, Mus musculus
attctgtctattgtcaccctaatct

SEQ ID NO: 281667 - DNA, 25 bp, Mus musculus
attctgtctccgaggaagccattat

SEQ ID NO: 281668 - DNA, 25 bp, Mus musculus
attctgtctccgtggaagccattat

SEQ ID NO: 281669 - DNA, 25 bp, Mus musculus
attctgtctcctcttatgaccgcaa

SEQ ID NO: 281670 - DNA, 25 bp, Mus musculus
attctgtctcctgttatgaccgcaa

SEQ ID NO: 281671 - DNA, 25 bp, Mus musculus
attctgtctgaaatctagaggctcc

SEQ ID NO: 281672 - DNA, 25 bp, Mus musculus
attctgtctgaattctagaggctcc

SEQ ID NO: 281673 - DNA, 25 bp, Mus musculus
attctgtctgtcacagaggaatctg

SEQ ID NO: 281674 - DNA, 25 bp, Mus musculus
attctgtctgtctcagaggaatctg

SEQ ID NO: 281675 - DNA, 25 bp, Mus musculus
attctgtcttaccttagtggcttga

SEQ ID NO: 281676 - DNA, 25 bp, Mus musculus
attctgtcttacgttagtggcttga

SEQ ID NO: 281677 - DNA, 25 bp, Mus musculus
attctgtcttctattatgcttgtcc

SEQ ID NO: 281678 - DNA, 25 bp, Mus musculus
attctgtcttcttttatgcttgtcc

SEQ ID NO: 281679 - DNA, 25 bp, Mus musculus
attctgtgaaggcaggagttcccaa

SEQ ID NO: 281680 - DNA, 25 bp, Mus musculus
attctgtgaagggaggagttcccaa

SEQ ID NO: 281681 - DNA, 25 bp, Mus musculus
attctgtgacacatattgagcaatg

SEQ ID NO: 281682 - DNA, 25 bp, Mus musculus
attctgtgacacttattgagcaatg

SEQ ID NO: 281683 - DNA, 25 bp, Mus musculus
attctgtgatgacttgttttcctgg

SEQ ID NO: 281684 - DNA, 25 bp, Mus musculus
attctgtgatgagttgttttcctgg

SEQ ID NO: 281685 - DNA, 25 bp, Mus musculus
attctgtgcaccactgaagttgctc

SEQ ID NO: 281686 - DNA, 25 bp, Mus musculus
attctgtgcacctctgaagttgctc

SEQ ID NO: 281687 - DNA, 25 bp, Mus musculus
attctgtgccatctaccatataagt

SEQ ID NO: 281688 - DNA, 25 bp, Mus musculus
attctgtgccatgtaccatataagt

SEQ ID NO: 281689 - DNA, 25 bp, Mus musculus
attctgtgccccactttgtaaactg

SEQ ID NO: 281690 - DNA, 25 bp, Mus musculus
attctgtgcccctctttgtaaactg

SEQ ID NO: 281691 - DNA, 25 bp, Mus musculus
attctgtgcgtaatgcttgttttca

SEQ ID NO: 281692 - DNA, 25 bp, Mus musculus
attctgtgcgtattgcttgttttca

SEQ ID NO: 281693 - DNA, 25 bp, Mus musculus
attctgtggactagctctggtctcg

SEQ ID NO: 281694 - DNA, 25 bp, Mus musculus
attctgtggacttgctctggtctcg

SEQ ID NO: 281695 - DNA, 25 bp, Mus musculus
attctgtggcacaggcggactgcat

SEQ ID NO: 281696 - DNA, 25 bp, Mus musculus
attctgtggcactggcggactgcat

SEQ ID NO: 281697 - DNA, 25 bp, Mus musculus
attctgtggcgtagtttgcttttta

SEQ ID NO: 281698 - DNA, 25 bp, Mus musculus
attctgtggcgttgtttgcttttta

SEQ ID NO: 281699 - DNA, 25 bp, Mus musculus
attctgtggctcacccaggtgacat

SEQ ID NO: 281700 - DNA, 25 bp, Mus musculus
attctgtggctctcccaggtgacat

SEQ ID NO: 281701 - DNA, 25 bp, Mus musculus
attctgtggtcaaatggttcatctc

SEQ ID NO: 281702 - DNA, 25 bp, Mus musculus
attctgtggtcatatggttcatctc

SEQ ID NO: 281703 - DNA, 25 bp, Mus musculus
attctgtgtcagatcattacctatt

SEQ ID NO: 281704 - DNA, 25 bp, Mus musculus
attctgtgtcagttcattacctatt

SEQ ID NO: 281705 - DNA, 25 bp, Mus musculus
attctgtgtcctcgctaaatctaga

SEQ ID NO: 281706 - DNA, 25 bp, Mus musculus
attctgtgtcctggctaaatctaga

SEQ ID NO: 281707 - DNA, 25 bp, Mus musculus
attctgtgtctcatgcgcctttgtt

SEQ ID NO: 281708 - DNA, 25 bp, Mus musculus
attctgtgtctcttgcgcctttgtt

SEQ ID NO: 281709 - DNA, 25 bp, Mus musculus
attctgtgtgctcaaattccaaccc

SEQ ID NO: 281710 - DNA, 25 bp, Mus musculus
attctgtgtgctgaaattccaaccc

SEQ ID NO: 281711 - DNA, 25 bp, Mus musculus
attctgtgttacacttggtttctgg

SEQ ID NO: 281712 - DNA, 25 bp, Mus musculus
attctgtgttactcttggtttctgg

SEQ ID NO: 281713 - DNA, 25 bp, Mus musculus
attctgttacaacgactactcccct

SEQ ID NO: 281714 - DNA, 25 bp, Mus musculus
attctgttacaaggactactcccct

SEQ ID NO: 281715 - DNA, 25 bp, Mus musculus
attctgttatacaactgcccggaga

SEQ ID NO: 281716 - DNA, 25 bp, Mus musculus
attctgttatactactgcccggaga

SEQ ID NO: 281717 - DNA, 25 bp, Mus musculus
attctgttattgaacaaccacctaa

SEQ ID NO: 281718 - DNA, 25 bp, Mus musculus
attctgttattgacactgcaagagt

SEQ ID NO: 281719 - DNA, 25 bp, Mus musculus
attctgttattgtacaaccacctaa

SEQ ID NO: 281720 - DNA, 25 bp, Mus musculus
attctgttattgtcactgcaagagt

SEQ ID NO: 281721 - DNA, 25 bp, Mus musculus
attctgttcactaacaaactggaga

SEQ ID NO: 281722 - DNA, 25 bp, Mus musculus
attctgttcacttacaaactggaga

SEQ ID NO: 281723 - DNA, 25 bp, Mus musculus
attctgttgtttagacgcattgcgc

SEQ ID NO: 281724 - DNA, 25 bp, Mus musculus
attctgttgttttgacgcattgcgc

SEQ ID NO: 281725 - DNA, 25 bp, Mus musculus
attctgtttcctaatttcacacctg

SEQ ID NO: 281726 - DNA, 25 bp, Mus musculus
attctgtttccttatttcacacctg

SEQ ID NO: 281727 - DNA, 25 bp, Mus musculus
attctgtttctcacatctgtacttt

SEQ ID NO: 281728 - DNA, 25 bp, Mus musculus
attctgtttctctcatctgtacttt

SEQ ID NO: 281729 - DNA, 25 bp, Mus musculus
attctgtttgtgaggatcagcccct

SEQ ID NO: 281730 - DNA, 25 bp, Mus musculus
attctgtttgtgtggatcagcccct

SEQ ID NO: 281731 - DNA, 25 bp, Mus musculus
attctgtttgttcggaaagctcctg

SEQ ID NO: 281732 - DNA, 25 bp, Mus musculus
attctgtttgttgggaaagctcctg

SEQ ID NO: 281733 - DNA, 25 bp, Mus musculus
attcttaacaggcacattattggaa

SEQ ID NO: 281734 - DNA, 25 bp, Mus musculus
attcttaacagggacattattggaa

SEQ ID NO: 281735 - DNA, 25 bp, Mus musculus
attcttaactcaagggccggttcat

SEQ ID NO: 281736 - DNA, 25 bp, Mus musculus
attcttaactcatgggccggttcat

SEQ ID NO: 281737 - DNA, 25 bp, Mus musculus
attcttaagcgacctgcctgggtga

SEQ ID NO: 281738 - DNA, 25 bp, Mus musculus
attcttaagcgagctgcctgggtga

SEQ ID NO: 281739 - DNA, 25 bp, Mus musculus
attcttaatcttagcaccttttcct

SEQ ID NO: 281740 - DNA, 25 bp, Mus musculus
attcttaatctttgcaccttttcct

SEQ ID NO: 281741 - DNA, 25 bp, Mus musculus
attcttacacataactatgtcacta

SEQ ID NO: 281742 - DNA, 25 bp, Mus musculus
attcttacacattactatgtcacta

SEQ ID NO: 281743 - DNA, 25 bp, Mus musculus
attcttacacggcaagtgcctttat

SEQ ID NO: 281744 - DNA, 25 bp, Mus musculus
attcttacacgggaagtgcctttat

SEQ ID NO: 281745 - DNA, 25 bp, Mus musculus
attcttacactacgttatatcacga

SEQ ID NO: 281746 - DNA, 25 bp, Mus musculus
attcttacactaggttatatcacga

SEQ ID NO: 281747 - DNA, 25 bp, Mus musculus
attcttacagtaaacaagtttccta

SEQ ID NO: 281748 - DNA, 25 bp, Mus musculus
attcttacagtatacaagtttccta

SEQ ID NO: 281749 - DNA, 25 bp, Mus musculus
attcttaccacacaattgaccagcg

SEQ ID NO: 281750 - DNA, 25 bp, Mus musculus
attcttaccacagaattgaccagcg

SEQ ID NO: 281751 - DNA, 25 bp, Mus musculus
attcttacccatcgatggtcaccat

SEQ ID NO: 281752 - DNA, 25 bp, Mus musculus
attcttacccatggatggtcaccat

SEQ ID NO: 281753 - DNA, 25 bp, Mus musculus
attcttacctacctaagccactaca

SEQ ID NO: 281754 - DNA, 25 bp, Mus musculus
attcttacctacgtaagccactaca

SEQ ID NO: 281755 - DNA, 25 bp, Mus musculus
attcttacctccaagggaatccact

SEQ ID NO: 281756 - DNA, 25 bp, Mus musculus
attcttacctcctagggaatccact

SEQ ID NO: 281757 - DNA, 25 bp, Mus musculus
attcttacgttaccagaacatttta

SEQ ID NO: 281758 - DNA, 25 bp, Mus musculus
attcttacgttagcagaacatttta

SEQ ID NO: 281759 - DNA, 25 bp, Mus musculus
attcttactatcctagcctcagcac

SEQ ID NO: 281760 - DNA, 25 bp, Mus musculus
attcttactatcgtagcctcagcac

SEQ ID NO: 281761 - DNA, 25 bp, Mus musculus
attcttactgagagaacgcctcctc

SEQ ID NO: 281762 - DNA, 25 bp, Mus musculus
attcttactgagattccttgataac

SEQ ID NO: 281763 - DNA, 25 bp, Mus musculus
attcttactgagtgaacgcctcctc

SEQ ID NO: 281764 - DNA, 25 bp, Mus musculus
attcttactgagtttccttgataac

SEQ ID NO: 281765 - DNA, 25 bp, Mus musculus
attcttactgcgacacaattactgg

SEQ ID NO: 281766 - DNA, 25 bp, Mus musculus
attcttactgcgtcacaattactgg

SEQ ID NO: 281767 - DNA, 25 bp, Mus musculus
attcttagagatccactgctgctgc

SEQ ID NO: 281768 - DNA, 25 bp, Mus musculus
attcttagagatgcactgctgctgc

SEQ ID NO: 281769 - DNA, 25 bp, Mus musculus
attcttagagttcccaggtagcccc

SEQ ID NO: 281770 - DNA, 25 bp, Mus musculus
attcttagagttgccaggtagcccc

SEQ ID NO: 281771 - DNA, 25 bp, Mus musculus
attcttagctccagtagactggaag

SEQ ID NO: 281772 - DNA, 25 bp, Mus musculus
attcttagctcctgtagactggaag

SEQ ID NO: 281773 - DNA, 25 bp, Mus musculus
attcttagctttagggctggtggaa

SEQ ID NO: 281774 - DNA, 25 bp, Mus musculus
attcttagcttttgggctggtggaa

SEQ ID NO: 281775 - DNA, 25 bp, Mus musculus
attcttataaaaatgtactgcctag

SEQ ID NO: 281776 - DNA, 25 bp, Mus musculus
attcttataaaattgtactgcctag

SEQ ID NO: 281777 - DNA, 25 bp, Mus musculus
attcttatacagacccacagtccag

SEQ ID NO: 281778 - DNA, 25 bp, Mus musculus
attcttatacagtcccacagtccag

SEQ ID NO: 281779 - DNA, 25 bp, Mus musculus
attcttatactcaattcccgcgtta

SEQ ID NO: 281780 - DNA, 25 bp, Mus musculus
attcttatactctattcccgcgtta

SEQ ID NO: 281781 - DNA, 25 bp, Mus musculus
attcttatagcaatgctggcccacc

SEQ ID NO: 281782 - DNA, 25 bp, Mus musculus
attcttatagcattgctggcccacc

SEQ ID NO: 281783 - DNA, 25 bp, Mus musculus
attcttataggtatgtatggtgcca

SEQ ID NO: 281784 - DNA, 25 bp, Mus musculus
attcttataggtttgtatggtgcca

SEQ ID NO: 281785 - DNA, 25 bp, Mus musculus
attcttatcatgcaggcaatagcct

SEQ ID NO: 281786 - DNA, 25 bp, Mus musculus
attcttatcatggaggcaatagcct

SEQ ID NO: 281787 - DNA, 25 bp, Mus musculus
attcttatccaacagcagctgtcca

SEQ ID NO: 281788 - DNA, 25 bp, Mus musculus
attcttatccaagagcagctgtcca

SEQ ID NO: 281789 - DNA, 25 bp, Mus musculus
attcttatccacctaaatctggttc

SEQ ID NO: 281790 - DNA, 25 bp, Mus musculus
attcttatccacgtaaatctggttc

SEQ ID NO: 281791 - DNA, 25 bp, Mus musculus
attcttatgatcacagacggccctg

SEQ ID NO: 281792 - DNA, 25 bp, Mus musculus
attcttatgatctcagacggccctg

SEQ ID NO: 281793 - DNA, 25 bp, Mus musculus
attcttatgctcatacttatttcgg

SEQ ID NO: 281794 - DNA, 25 bp, Mus musculus
attcttatgctcttacttatttcgg

SEQ ID NO: 281795 - DNA, 25 bp, Mus musculus
attcttatgtctcccagctgggtga

SEQ ID NO: 281796 - DNA, 25 bp, Mus musculus
attcttatgtctgccagctgggtga

SEQ ID NO: 281797 - DNA, 25 bp, Mus musculus
attcttatgtggctgcaggatcctc

SEQ ID NO: 281798 - DNA, 25 bp, Mus musculus
attcttatgtgggtgcaggatcctc

SEQ ID NO: 281799 - DNA, 25 bp, Mus musculus
attcttattcagactatcacaatgg

SEQ ID NO: 281800 - DNA, 25 bp, Mus musculus
attcttattcagtctatcacaatgg

SEQ ID NO: 281801 - DNA, 25 bp, Mus musculus
attcttattgaaccacagcagtgca

SEQ ID NO: 281802 - DNA, 25 bp, Mus musculus
attcttattgaagcacagcagtgca

SEQ ID NO: 281803 - DNA, 25 bp, Mus musculus
attcttatttgcacccatctagtca

SEQ ID NO: 281804 - DNA, 25 bp, Mus musculus
attcttatttgctcccatctagtca

SEQ ID NO: 281805 - DNA, 25 bp, Mus musculus
attcttcaacctaagtgtcctctac

SEQ ID NO: 281806 - DNA, 25 bp, Mus musculus
attcttcaaccttagtgtcctctac

SEQ ID NO: 281807 - DNA, 25 bp, Mus musculus
attcttcaccatcgaaacattctga

SEQ ID NO: 281808 - DNA, 25 bp, Mus musculus
attcttcaccatggaaacattctga

SEQ ID NO: 281809 - DNA, 25 bp, Mus musculus
attcttcaccccacccagatggagg

SEQ ID NO: 281810 - DNA, 25 bp, Mus musculus
attcttcacccctcccagatggagg

SEQ ID NO: 281811 - DNA, 25 bp, Mus musculus
attcttcacctaattttctttgcac

SEQ ID NO: 281812 - DNA, 25 bp, Mus musculus
attcttcacctatttttctttgcac

SEQ ID NO: 281813 - DNA, 25 bp, Mus musculus
attcttcactgtctaactcttttct

SEQ ID NO: 281814 - DNA, 25 bp, Mus musculus
attcttcactgtgtaactcttttct

SEQ ID NO: 281815 - DNA, 25 bp, Mus musculus
attcttcagaatcgcaattgtggag

SEQ ID NO: 281816 - DNA, 25 bp, Mus musculus
attcttcagaatggcaattgtggag

SEQ ID NO: 281817 - DNA, 25 bp, Mus musculus
attcttcagagccatgttggcctct

SEQ ID NO: 281818 - DNA, 25 bp, Mus musculus
attcttcagagcgatgttggcctct

SEQ ID NO: 281819 - DNA, 25 bp, Mus musculus
attcttcagcatcttcctggaatca

SEQ ID NO: 281820 - DNA, 25 bp, Mus musculus
attcttcagcatgttcctggaatca

SEQ ID NO: 281821 - DNA, 25 bp, Mus musculus
attcttcagctgctaagtccttctt

SEQ ID NO: 281822 - DNA, 25 bp, Mus musculus
attcttcagctggtaagtccttctt

SEQ ID NO: 281823 - DNA, 25 bp, Mus musculus
attcttcagtttatggacatctagt

SEQ ID NO: 281824 - DNA, 25 bp, Mus musculus
attcttcagtttttggacatctagt

SEQ ID NO: 281825 - DNA, 25 bp, Mus musculus
attcttcatccaccaatgttgtaca

SEQ ID NO: 281826 - DNA, 25 bp, Mus musculus
attcttcatccagcaatgttgtaca

SEQ ID NO: 281827 - DNA, 25 bp, Mus musculus
attcttcatctaaactcctgacact

SEQ ID NO: 281828 - DNA, 25 bp, Mus musculus
attcttcatctatactcctgacact

SEQ ID NO: 281829 - DNA, 25 bp, Mus musculus
attcttcatggacttgtgttcttgt

SEQ ID NO: 281830 - DNA, 25 bp, Mus musculus
attcttcatggagttgtgttcttgt

SEQ ID NO: 281831 - DNA, 25 bp, Mus musculus
attcttcatgtgaactggttctgcc

SEQ ID NO: 281832 - DNA, 25 bp, Mus musculus
attcttcatgtgtactggttctgcc

SEQ ID NO: 281833 - DNA, 25 bp, Mus musculus
attcttcattttcacttgtctctct

SEQ ID NO: 281834 - DNA, 25 bp, Mus musculus
attcttcattttgacttgtctctct

SEQ ID NO: 281835 - DNA, 25 bp, Mus musculus
attcttccacctcggcggaaaactg

SEQ ID NO: 281836 - DNA, 25 bp, Mus musculus
attcttccacctgggcggaaaactg

SEQ ID NO: 281837 - DNA, 25 bp, Mus musculus
attcttccagatatttgacagtgaa

SEQ ID NO: 281838 - DNA, 25 bp, Mus musculus
attcttccagatttttgacagtgaa

SEQ ID NO: 281839 - DNA, 25 bp, Mus musculus
attcttccaggaccttatcttttat

SEQ ID NO: 281840 - DNA, 25 bp, Mus musculus
attcttccaggagcttatcttttat

SEQ ID NO: 281841 - DNA, 25 bp, Mus musculus
attcttccaggtatgttatgcacta

SEQ ID NO: 281842 - DNA, 25 bp, Mus musculus
attcttccaggtttgttatgcacta

SEQ ID NO: 281843 - DNA, 25 bp, Mus musculus
attcttccattcataatactgtacc

SEQ ID NO: 281844 - DNA, 25 bp, Mus musculus
attcttccattcttaatactgtacc

SEQ ID NO: 281845 - DNA, 25 bp, Mus musculus
attcttccccagcatatactgcctg

SEQ ID NO: 281846 - DNA, 25 bp, Mus musculus
attcttccccaggatatactgcctg

SEQ ID NO: 281847 - DNA, 25 bp, Mus musculus
attcttccccatctagattgtatca

SEQ ID NO: 281848 - DNA, 25 bp, Mus musculus
attcttccccatgtagattgtatca

SEQ ID NO: 281849 - DNA, 25 bp, Mus musculus
attcttccctcccaggtactgatgg

SEQ ID NO: 281850 - DNA, 25 bp, Mus musculus
attcttccctccgaggtactgatgg

SEQ ID NO: 281851 - DNA, 25 bp, Mus musculus
attcttccgggacagacctggcttt

SEQ ID NO: 281852 - DNA, 25 bp, Mus musculus
attcttccgggagagacctggcttt

SEQ ID NO: 281853 - DNA, 25 bp, Mus musculus
attcttccgtggacagtttatcacc

SEQ ID NO: 281854 - DNA, 25 bp, Mus musculus
attcttccgtggtcagtttatcacc

SEQ ID NO: 281855 - DNA, 25 bp, Mus musculus
attcttcctaatcctttgcggcaga

SEQ ID NO: 281856 - DNA, 25 bp, Mus musculus
attcttcctaatgctttgcggcaga

SEQ ID NO: 281857 - DNA, 25 bp, Mus musculus
attcttcctcccattggacatataa

SEQ ID NO: 281858 - DNA, 25 bp, Mus musculus
attcttcctccctttggacatataa

SEQ ID NO: 281859 - DNA, 25 bp, Mus musculus
attcttcctctcatggtcgctagcg

SEQ ID NO: 281860 - DNA, 25 bp, Mus musculus
attcttcctctcttggtcgctagcg

SEQ ID NO: 281861 - DNA, 25 bp, Mus musculus
attcttcctgctatgcttaggtcaa

SEQ ID NO: 281862 - DNA, 25 bp, Mus musculus
attcttcctgctttgcttaggtcaa

SEQ ID NO: 281863 - DNA, 25 bp, Mus musculus
attcttcctggacaacatttctctg

SEQ ID NO: 281864 - DNA, 25 bp, Mus musculus
attcttcctggagaacatttctctg

SEQ ID NO: 281865 - DNA, 25 bp, Mus musculus
attcttcctgttaacttcaccgaga

SEQ ID NO: 281866 - DNA, 25 bp, Mus musculus
attcttcctgtttacttcaccgaga

SEQ ID NO: 281867 - DNA, 25 bp, Mus musculus
attcttccttacctctgcaaagcac

SEQ ID NO: 281868 - DNA, 25 bp, Mus musculus
attcttccttacgtctgcaaagcac

SEQ ID NO: 281869 - DNA, 25 bp, Mus musculus
attcttccttgtcggcctgaaacat

SEQ ID NO: 281870 - DNA, 25 bp, Mus musculus
attcttccttgtgggcctgaaacat

SEQ ID NO: 281871 - DNA, 25 bp, Mus musculus
attcttcctttgatctaaatcttag

SEQ ID NO: 281872 - DNA, 25 bp, Mus musculus
attcttcctttgttctaaatcttag

SEQ ID NO: 281873 - DNA, 25 bp, Mus musculus
attcttcgagctcaaaccgtactgt

SEQ ID NO: 281874 - DNA, 25 bp, Mus musculus
attcttcgagctgaaaccgtactgt

SEQ ID NO: 281875 - DNA, 25 bp, Mus musculus
attcttcgtcatccaagacttttga

SEQ ID NO: 281876 - DNA, 25 bp, Mus musculus
attcttcgtcatgcaagacttttga

SEQ ID NO: 281877 - DNA, 25 bp, Mus musculus
attcttcgtttacacatctgccaaa

SEQ ID NO: 281878 - DNA, 25 bp, Mus musculus
attcttcgtttagacatctgccaaa

SEQ ID NO: 281879 - DNA, 25 bp, Mus musculus
attcttctaacactgcagccaggac

SEQ ID NO: 281880 - DNA, 25 bp, Mus musculus
attcttctaacagtgcagccaggac

SEQ ID NO: 281881 - DNA, 25 bp, Mus musculus
attcttctaagaatcacggtttcaa

SEQ ID NO: 281882 - DNA, 25 bp, Mus musculus
attcttctaagattcacggtttcaa

SEQ ID NO: 281883 - DNA, 25 bp, Mus musculus
attcttctacccacctggcttttgg

SEQ ID NO: 281884 - DNA, 25 bp, Mus musculus
attcttctaccctcctggcttttgg

SEQ ID NO: 281885 - DNA, 25 bp, Mus musculus
attcttctattaaactgttgtgagg

SEQ ID NO: 281886 - DNA, 25 bp, Mus musculus
attcttctattatactgttgtgagg

SEQ ID NO: 281887 - DNA, 25 bp, Mus musculus
attcttctcaaaaacttgtttcaca

SEQ ID NO: 281888 - DNA, 25 bp, Mus musculus
attcttctcaaatacttgtttcaca

SEQ ID NO: 281889 - DNA, 25 bp, Mus musculus
attcttctcagtccatttatccttt

SEQ ID NO: 281890 - DNA, 25 bp, Mus musculus
attcttctcagtgcatttatccttt

SEQ ID NO: 281891 - DNA, 25 bp, Mus musculus
attcttctcctgcacatggactgag

SEQ ID NO: 281892 - DNA, 25 bp, Mus musculus
attcttctcctggacatggactgag

SEQ ID NO: 281893 - DNA, 25 bp, Mus musculus
attcttctcttcactttcagatgca

SEQ ID NO: 281894 - DNA, 25 bp, Mus musculus
attcttctcttctctttcagatgca

SEQ ID NO: 281895 - DNA, 25 bp, Mus musculus
attcttctctttaggtccccaacat

SEQ ID NO: 281896 - DNA, 25 bp, Mus musculus
attcttctcttttggtccccaacat

SEQ ID NO: 281897 - DNA, 25 bp, Mus musculus
attcttctgaccatgcacttaatgc

SEQ ID NO: 281898 - DNA, 25 bp, Mus musculus
attcttctgaccttgcacttaatgc

SEQ ID NO: 281899 - DNA, 25 bp, Mus musculus
attcttctgttgagtgtcccagcta

SEQ ID NO: 281900 - DNA, 25 bp, Mus musculus
attcttctgttgtgtgtcccagcta

SEQ ID NO: 281901 - DNA, 25 bp, Mus musculus
attcttcttattcagcgtactctca

SEQ ID NO: 281902 - DNA, 25 bp, Mus musculus
attcttcttattgagcgtactctca

SEQ ID NO: 281903 - DNA, 25 bp, Mus musculus
attcttctttggcaaacacctgggc

SEQ ID NO: 281904 - DNA, 25 bp, Mus musculus
attcttctttgggaaacacctgggc

SEQ ID NO: 281905 - DNA, 25 bp, Mus musculus
attcttgaagtgagtattgcagtta

SEQ ID NO: 281906 - DNA, 25 bp, Mus musculus
attcttgaagtgtgtattgcagtta

SEQ ID NO: 281907 - DNA, 25 bp, Mus musculus
attcttgaatacagttagacctgac

SEQ ID NO: 281908 - DNA, 25 bp, Mus musculus
attcttgaatactgttagacctgac

SEQ ID NO: 281909 - DNA, 25 bp, Mus musculus
attcttgacatcactgtaccacact

SEQ ID NO: 281910 - DNA, 25 bp, Mus musculus
attcttgacatctctgtaccacact

SEQ ID NO: 281911 - DNA, 25 bp, Mus musculus
attcttgaccgtaggactagctctc

SEQ ID NO: 281912 - DNA, 25 bp, Mus musculus
attcttgaccgttggactagctctc

SEQ ID NO: 281913 - DNA, 25 bp, Mus musculus
attcttgagctgatgtagggaggta

SEQ ID NO: 281914 - DNA, 25 bp, Mus musculus
attcttgagctgttgtagggaggta

SEQ ID NO: 281915 - DNA, 25 bp, Mus musculus
attcttgaggcaacacgaagtggta

SEQ ID NO: 281916 - DNA, 25 bp, Mus musculus
attcttgaggcatcacgaagtggta

SEQ ID NO: 281917 - DNA, 25 bp, Mus musculus
attcttgagggcacgagagccagtt

SEQ ID NO: 281918 - DNA, 25 bp, Mus musculus
attcttgagggctcgagagccagtt

SEQ ID NO: 281919 - DNA, 25 bp, Mus musculus
attcttgaggtgctagactgacaaa

SEQ ID NO: 281920 - DNA, 25 bp, Mus musculus
attcttgaggtggtagactgacaaa

SEQ ID NO: 281921 - DNA, 25 bp, Mus musculus
attcttgatgcaatctaaggcttaa

SEQ ID NO: 281922 - DNA, 25 bp, Mus musculus
attcttgatgcattctaaggcttaa

SEQ ID NO: 281923 - DNA, 25 bp, Mus musculus
attcttgattctaagcgctttcgtg

SEQ ID NO: 281924 - DNA, 25 bp, Mus musculus
attcttgattcttagcgctttcgtg

SEQ ID NO: 281925 - DNA, 25 bp, Mus musculus
attcttgcactacgtgcccaaagaa

SEQ ID NO: 281926 - DNA, 25 bp, Mus musculus
attcttgcactaggtgcccaaagaa

SEQ ID NO: 281927 - DNA, 25 bp, Mus musculus
attcttgcagcaccaaatggctatg

SEQ ID NO: 281928 - DNA, 25 bp, Mus musculus
attcttgcagcagcaaatggctatg

SEQ ID NO: 281929 - DNA, 25 bp, Mus musculus
attcttgcagtaattccctatggac

SEQ ID NO: 281930 - DNA, 25 bp, Mus musculus
attcttgcagtatttccctatggac

SEQ ID NO: 281931 - DNA, 25 bp, Mus musculus
attcttgccaatccttattgttctg

SEQ ID NO: 281932 - DNA, 25 bp, Mus musculus
attcttgccaatgcttattgttctg

SEQ ID NO: 281933 - DNA, 25 bp, Mus musculus
attcttgccacacaacgaaagtcga

SEQ ID NO: 281934 - DNA, 25 bp, Mus musculus
attcttgccacagaacgaaagtcga

SEQ ID NO: 281935 - DNA, 25 bp, Mus musculus
attcttgcctcccattcaggactgg

SEQ ID NO: 281936 - DNA, 25 bp, Mus musculus
attcttgcctccgattcaggactgg

SEQ ID NO: 281937 - DNA, 25 bp, Mus musculus
attcttgcctctatccataattcat

SEQ ID NO: 281938 - DNA, 25 bp, Mus musculus
attcttgcctctttccataattcat

SEQ ID NO: 281939 - DNA, 25 bp, Mus musculus
attcttgcctgtattttctctagta

SEQ ID NO: 281940 - DNA, 25 bp, Mus musculus
attcttgcctgttttttctctagta

SEQ ID NO: 281941 - DNA, 25 bp, Mus musculus
attcttgcgctgcgccccaagagca

SEQ ID NO: 281942 - DNA, 25 bp, Mus musculus
attcttgcgctgggccccaagagca

SEQ ID NO: 281943 - DNA, 25 bp, Mus musculus
attcttgctctgattgttggtgtaa

SEQ ID NO: 281944 - DNA, 25 bp, Mus musculus
attcttgctctgtttgttggtgtaa

SEQ ID NO: 281945 - DNA, 25 bp, Mus musculus
attcttgctggtcctaaccaaggct

SEQ ID NO: 281946 - DNA, 25 bp, Mus musculus
attcttgctggtgctaaccaaggct

SEQ ID NO: 281947 - DNA, 25 bp, Mus musculus
attcttgcttatacctgctaccaag

SEQ ID NO: 281948 - DNA, 25 bp, Mus musculus
attcttgcttattcctgctaccaag

SEQ ID NO: 281949 - DNA, 25 bp, Mus musculus
attcttgcttcacgacccaaaccag

SEQ ID NO: 281950 - DNA, 25 bp, Mus musculus
attcttgcttcactgtcctatggta

SEQ ID NO: 281951 - DNA, 25 bp, Mus musculus
attcttgcttcaggacccaaaccag

SEQ ID NO: 281952 - DNA, 25 bp, Mus musculus
attcttgcttcagtgtcctatggta

SEQ ID NO: 281953 - DNA, 25 bp, Mus musculus
attcttgcttctcacagaagccggg

SEQ ID NO: 281954 - DNA, 25 bp, Mus musculus
attcttgcttctgacagaagccggg

SEQ ID NO: 281955 - DNA, 25 bp, Mus musculus
attcttgcttggagcctacaggtgc

SEQ ID NO: 281956 - DNA, 25 bp, Mus musculus
attcttgcttggattgcatctgtga

SEQ ID NO: 281957 - DNA, 25 bp, Mus musculus
attcttgcttggtgcctacaggtgc

SEQ ID NO: 281958 - DNA, 25 bp, Mus musculus
attcttgcttggtttgcatctgtga

SEQ ID NO: 281959 - DNA, 25 bp, Mus musculus
attcttggaaataccttcactgttc

SEQ ID NO: 281960 - DNA, 25 bp, Mus musculus
attcttggaaattccttcactgttc

SEQ ID NO: 281961 - DNA, 25 bp, Mus musculus
attcttggacttagaggaactctta

SEQ ID NO: 281962 - DNA, 25 bp, Mus musculus
attcttggactttgaggaactctta

SEQ ID NO: 281963 - DNA, 25 bp, Mus musculus
attcttggagaaatgggagatccca

SEQ ID NO: 281964 - DNA, 25 bp, Mus musculus
attcttggagaattgggagatccca

SEQ ID NO: 281965 - DNA, 25 bp, Mus musculus
attcttggcacaagagggaccctcc

SEQ ID NO: 281966 - DNA, 25 bp, Mus musculus
attcttggcacatgagggaccctcc

SEQ ID NO: 281967 - DNA, 25 bp, Mus musculus
attcttggccacacagttgattatg

SEQ ID NO: 281968 - DNA, 25 bp, Mus musculus
attcttggccacatatagagttcaa

SEQ ID NO: 281969 - DNA, 25 bp, Mus musculus
attcttggccactcagttgattatg

SEQ ID NO: 281970 - DNA, 25 bp, Mus musculus
attcttggccacttatagagttcaa

SEQ ID NO: 281971 - DNA, 25 bp, Mus musculus
attcttggccttagccgttgttaga

SEQ ID NO: 281972 - DNA, 25 bp, Mus musculus
attcttggcctttgccgttgttaga

SEQ ID NO: 281973 - DNA, 25 bp, Mus musculus
attcttggctccattcttcaaatgt

SEQ ID NO: 281974 - DNA, 25 bp, Mus musculus
attcttggctcctttcttcaaatgt

SEQ ID NO: 281975 - DNA, 25 bp, Mus musculus
attcttggctctaagggtcagcctt

SEQ ID NO: 281976 - DNA, 25 bp, Mus musculus
attcttggctcttagggtcagcctt

SEQ ID NO: 281977 - DNA, 25 bp, Mus musculus
attcttgggctaagttgtgcttaat

SEQ ID NO: 281978 - DNA, 25 bp, Mus musculus
attcttgggctatgttgtgcttaat

SEQ ID NO: 281979 - DNA, 25 bp, Mus musculus
attcttgggtgactgatggtttaac

SEQ ID NO: 281980 - DNA, 25 bp, Mus musculus
attcttgggtgagtgatggtttaac

SEQ ID NO: 281981 - DNA, 25 bp, Mus musculus
attcttgggtggatgccattaacac

SEQ ID NO: 281982 - DNA, 25 bp, Mus musculus
attcttgggtggttgccattaacac

SEQ ID NO: 281983 - DNA, 25 bp, Mus musculus
attcttgggtgtctagtcttctgct

SEQ ID NO: 281984 - DNA, 25 bp, Mus musculus
attcttgggtgtgtagtcttctgct

SEQ ID NO: 281985 - DNA, 25 bp, Mus musculus
attcttggtattctctggccagcta

SEQ ID NO: 281986 - DNA, 25 bp, Mus musculus
attcttggtattgtctggccagcta

SEQ ID NO: 281987 - DNA, 25 bp, Mus musculus
attcttggttcaacatactccagac

SEQ ID NO: 281988 - DNA, 25 bp, Mus musculus
attcttggttcatcatactccagac

SEQ ID NO: 281989 - DNA, 25 bp, Mus musculus
attcttgtaatcatgcccataaaaa

SEQ ID NO: 281990 - DNA, 25 bp, Mus musculus
attcttgtaatcttgcccataaaaa

SEQ ID NO: 281991 - DNA, 25 bp, Mus musculus
attcttgtacttcaggtctgtccat

SEQ ID NO: 281992 - DNA, 25 bp, Mus musculus
attcttgtacttgaggtctgtccat

SEQ ID NO: 281993 - DNA, 25 bp, Mus musculus
attcttgtagatcacatggctgata

SEQ ID NO: 281994 - DNA, 25 bp, Mus musculus
attcttgtagatgacatggctgata

SEQ ID NO: 281995 - DNA, 25 bp, Mus musculus
attcttgtccttatggattagtaag

SEQ ID NO: 281996 - DNA, 25 bp, Mus musculus
attcttgtccttttggattagtaag

SEQ ID NO: 281997 - DNA, 25 bp, Mus musculus
attcttgtcttcctcaaaactccaa

SEQ ID NO: 281998 - DNA, 25 bp, Mus musculus
attcttgtcttcgtcaaaactccaa

SEQ ID NO: 281999 - DNA, 25 bp, Mus musculus
attcttgtgaatcagactgctcttg

SEQ ID NO: 282000 - DNA, 25 bp, Mus musculus
attcttgtgaatgagactgctcttg

SEQ ID NO: 282001 - DNA, 25 bp, Mus musculus
attcttgtgcacatatgcccacata

SEQ ID NO: 282002 - DNA, 25 bp, Mus musculus
attcttgtgcacttatgcccacata

SEQ ID NO: 282003 - DNA, 25 bp, Mus musculus
attcttgtgtaaatctatgaccttt

SEQ ID NO: 282004 - DNA, 25 bp, Mus musculus
attcttgtgtaattctatgaccttt

SEQ ID NO: 282005 - DNA, 25 bp, Mus musculus
attcttgttaacaccaacctccgtg

SEQ ID NO: 282006 - DNA, 25 bp, Mus musculus
attcttgttaactccaacctccgtg

SEQ ID NO: 282007 - DNA, 25 bp, Mus musculus
attcttgttaccatgttctcctgag

SEQ ID NO: 282008 - DNA, 25 bp, Mus musculus
attcttgttaccttgttctcctgag

SEQ ID NO: 282009 - DNA, 25 bp, Mus musculus
attcttgttcagcatcatggccaac

SEQ ID NO: 282010 - DNA, 25 bp, Mus musculus
attcttgttcaggatcatggccaac

SEQ ID NO: 282011 - DNA, 25 bp, Mus musculus
attcttgtttgcctcttagtgtact

SEQ ID NO: 282012 - DNA, 25 bp, Mus musculus
attcttgtttgcgtcttagtgtact

SEQ ID NO: 282013 - DNA, 25 bp, Mus musculus
attctttaaccacccttgagctgta

SEQ ID NO: 282014 - DNA, 25 bp, Mus musculus
attctttaaccagccttgagctgta

SEQ ID NO: 282015 - DNA, 25 bp, Mus musculus
attctttaacctacaacccacgatg

SEQ ID NO: 282016 - DNA, 25 bp, Mus musculus
attctttaaccttcaacccacgatg

SEQ ID NO: 282017 - DNA, 25 bp, Mus musculus
attctttaagcaaccaactccacac

SEQ ID NO: 282018 - DNA, 25 bp, Mus musculus
attctttaagcatccaactccacac

SEQ ID NO: 282019 - DNA, 25 bp, Mus musculus
attctttaccatacgtgtgaccact

SEQ ID NO: 282020 - DNA, 25 bp, Mus musculus
attctttaccattcgtgtgaccact

SEQ ID NO: 282021 - DNA, 25 bp, Mus musculus
attctttacctgactgctgctggag

SEQ ID NO: 282022 - DNA, 25 bp, Mus musculus
attctttacctgtctgctgctggag

SEQ ID NO: 282023 - DNA, 25 bp, Mus musculus
attctttagaagagcaacccgtgct

SEQ ID NO: 282024 - DNA, 25 bp, Mus musculus
attctttagaagtgcaacccgtgct

SEQ ID NO: 282025 - DNA, 25 bp, Mus musculus
attctttattcgcagactcctggat

SEQ ID NO: 282026 - DNA, 25 bp, Mus musculus
attctttattcggagactcctggat

SEQ ID NO: 282027 - DNA, 25 bp, Mus musculus
attctttcaaacctatttaagccag

SEQ ID NO: 282028 - DNA, 25 bp, Mus musculus
attctttcaaacgtatttaagccag

SEQ ID NO: 282029 - DNA, 25 bp, Mus musculus
attctttcactaatatactacagga

SEQ ID NO: 282030 - DNA, 25 bp, Mus musculus
attctttcactattatactacagga

SEQ ID NO: 282031 - DNA, 25 bp, Mus musculus
attctttcagaaacgtgttccagga

SEQ ID NO: 282032 - DNA, 25 bp, Mus musculus
attctttcagaacccagagaccgtg

SEQ ID NO: 282033 - DNA, 25 bp, Mus musculus
attctttcagaagccagagaccgtg

SEQ ID NO: 282034 - DNA, 25 bp, Mus musculus
attctttcagaatcgtgttccagga

SEQ ID NO: 282035 - DNA, 25 bp, Mus musculus
attctttcagatctgccactgtgca

SEQ ID NO: 282036 - DNA, 25 bp, Mus musculus
attctttcagatgtgccactgtgca

SEQ ID NO: 282037 - DNA, 25 bp, Mus musculus
attctttcagttaggcttggcttaa

SEQ ID NO: 282038 - DNA, 25 bp, Mus musculus
attctttcagtttggcttggcttaa

SEQ ID NO: 282039 - DNA, 25 bp, Mus musculus
attctttcgcagatgggattaagta

SEQ ID NO: 282040 - DNA, 25 bp, Mus musculus
attctttcgcagttgggattaagta

SEQ ID NO: 282041 - DNA, 25 bp, Mus musculus
attctttctcaaaccattgcttgga

SEQ ID NO: 282042 - DNA, 25 bp, Mus musculus
attctttctcaatccattgcttgga

SEQ ID NO: 282043 - DNA, 25 bp, Mus musculus
attctttctcccatttggccttgaa

SEQ ID NO: 282044 - DNA, 25 bp, Mus musculus
attctttctcccttttggccttgaa

SEQ ID NO: 282045 - DNA, 25 bp, Mus musculus
attctttctcttcatcaggatggtc

SEQ ID NO: 282046 - DNA, 25 bp, Mus musculus
attctttctcttgatcaggatggtc

SEQ ID NO: 282047 - DNA, 25 bp, Mus musculus
attctttctgacatccactcattgt

SEQ ID NO: 282048 - DNA, 25 bp, Mus musculus
attctttctgacttccactcattgt

SEQ ID NO: 282049 - DNA, 25 bp, Mus musculus
attctttctgagagctacgtgggac

SEQ ID NO: 282050 - DNA, 25 bp, Mus musculus
attctttctgagtgctacgtgggac

SEQ ID NO: 282051 - DNA, 25 bp, Mus musculus
attctttctgctctttgtcacaatt

SEQ ID NO: 282052 - DNA, 25 bp, Mus musculus
attctttctgctgtttgtcacaatt

SEQ ID NO: 282053 - DNA, 25 bp, Mus musculus
attctttctgtaaactgtgtatcga

SEQ ID NO: 282054 - DNA, 25 bp, Mus musculus
attctttctgtatactgtgtatcga

SEQ ID NO: 282055 - DNA, 25 bp, Mus musculus
attctttctttacaggcttcctgac

SEQ ID NO: 282056 - DNA, 25 bp, Mus musculus
attctttctttactgggatgatcca

SEQ ID NO: 282057 - DNA, 25 bp, Mus musculus
attctttctttagaggcttcctgac

SEQ ID NO: 282058 - DNA, 25 bp, Mus musculus
attctttctttagtgggatgatcca

SEQ ID NO: 282059 - DNA, 25 bp, Mus musculus
attctttgactgactgcgtgcagag

SEQ ID NO: 282060 - DNA, 25 bp, Mus musculus
attctttgactgtctgcgtgcagag

SEQ ID NO: 282061 - DNA, 25 bp, Mus musculus
attctttgagtgacttctggcacag

SEQ ID NO: 282062 - DNA, 25 bp, Mus musculus
attctttgagtgtcttctggcacag

SEQ ID NO: 282063 - DNA, 25 bp, Mus musculus
attctttgcaatacttacatctcta

SEQ ID NO: 282064 - DNA, 25 bp, Mus musculus
attctttgcaattcttacatctcta

SEQ ID NO: 282065 - DNA, 25 bp, Mus musculus
attctttgcagaagccatggtcttt

SEQ ID NO: 282066 - DNA, 25 bp, Mus musculus
attctttgcagatgccatggtcttt

SEQ ID NO: 282067 - DNA, 25 bp, Mus musculus
attctttgcatgcaccttgtacata

SEQ ID NO: 282068 - DNA, 25 bp, Mus musculus
attctttgcatggaccttgtacata

SEQ ID NO: 282069 - DNA, 25 bp, Mus musculus
attctttgcccgattgtctatctga

SEQ ID NO: 282070 - DNA, 25 bp, Mus musculus
attctttgcccgtttgtctatctga

SEQ ID NO: 282071 - DNA, 25 bp, Mus musculus
attctttgcttaaattgccctgtag

SEQ ID NO: 282072 - DNA, 25 bp, Mus musculus
attctttgcttatattgccctgtag

SEQ ID NO: 282073 - DNA, 25 bp, Mus musculus
attctttggagtctagtaccaccag

SEQ ID NO: 282074 - DNA, 25 bp, Mus musculus
attctttggagtgtagtaccaccag

SEQ ID NO: 282075 - DNA, 25 bp, Mus musculus
attctttggattccgctccaaagaa

SEQ ID NO: 282076 - DNA, 25 bp, Mus musculus
attctttggattgcgctccaaagaa

SEQ ID NO: 282077 - DNA, 25 bp, Mus musculus
attctttggcgccatctggagtatt

SEQ ID NO: 282078 - DNA, 25 bp, Mus musculus
attctttggcgcgatctggagtatt

SEQ ID NO: 282079 - DNA, 25 bp, Mus musculus
attctttggctgcttcttaagtatg

SEQ ID NO: 282080 - DNA, 25 bp, Mus musculus
attctttggctggttcttaagtatg

SEQ ID NO: 282081 - DNA, 25 bp, Mus musculus
attctttggtgtccagaaactctgc

SEQ ID NO: 282082 - DNA, 25 bp, Mus musculus
attctttggtgtgcagaaactctgc

SEQ ID NO: 282083 - DNA, 25 bp, Mus musculus
attctttgtaataggctctgccctg

SEQ ID NO: 282084 - DNA, 25 bp, Mus musculus
attctttgtaatatgctgcaaccca

SEQ ID NO: 282085 - DNA, 25 bp, Mus musculus
attctttgtaattggctctgccctg

SEQ ID NO: 282086 - DNA, 25 bp, Mus musculus
attctttgtaatttgctgcaaccca

SEQ ID NO: 282087 - DNA, 25 bp, Mus musculus
attctttgtcatatagccctttcta

SEQ ID NO: 282088 - DNA, 25 bp, Mus musculus
attctttgtcatttagccctttcta

SEQ ID NO: 282089 - DNA, 25 bp, Mus musculus
attctttgtccacatcccttaaaag

SEQ ID NO: 282090 - DNA, 25 bp, Mus musculus
attctttgtccagatcccttaaaag

SEQ ID NO: 282091 - DNA, 25 bp, Mus musculus
attctttgtttcagcactcaacctt

SEQ ID NO: 282092 - DNA, 25 bp, Mus musculus
attctttgtttctgcactcaacctt

SEQ ID NO: 282093 - DNA, 25 bp, Mus musculus
attcttttaaagagaatgccaccca

SEQ ID NO: 282094 - DNA, 25 bp, Mus musculus
attcttttaaagtgaatgccaccca

SEQ ID NO: 282095 - DNA, 25 bp, Mus musculus
attcttttacttcacctgccatcag

SEQ ID NO: 282096 - DNA, 25 bp, Mus musculus
attcttttacttgacctgccatcag

SEQ ID NO: 282097 - DNA, 25 bp, Mus musculus
attcttttagagatgttatacttca

SEQ ID NO: 282098 - DNA, 25 bp, Mus musculus
attcttttagagttgttatacttca

SEQ ID NO: 282099 - DNA, 25 bp, Mus musculus
attcttttcaagcaactcagctcta

SEQ ID NO: 282100 - DNA, 25 bp, Mus musculus
attcttttcaaggaactcagctcta

SEQ ID NO: 282101 - DNA, 25 bp, Mus musculus
attcttttccaaacacactgaacat

SEQ ID NO: 282102 - DNA, 25 bp, Mus musculus
attcttttccaatcacactgaacat

SEQ ID NO: 282103 - DNA, 25 bp, Mus musculus
attcttttccctatgtggtgctttt

SEQ ID NO: 282104 - DNA, 25 bp, Mus musculus
attcttttccctttgtggtgctttt

SEQ ID NO: 282105 - DNA, 25 bp, Mus musculus
attcttttctaaagaccgctgtctt

SEQ ID NO: 282106 - DNA, 25 bp, Mus musculus
attcttttctaatgaccgctgtctt

SEQ ID NO: 282107 - DNA, 25 bp, Mus musculus
attcttttctccagcaagttcctat

SEQ ID NO: 282108 - DNA, 25 bp, Mus musculus
attcttttctcctgcaagttcctat

SEQ ID NO: 282109 - DNA, 25 bp, Mus musculus
attcttttcttgctcatgttcttac

SEQ ID NO: 282110 - DNA, 25 bp, Mus musculus
attcttttcttggtcatgttcttac

SEQ ID NO: 282111 - DNA, 25 bp, Mus musculus
attcttttctttcatcagtctgctc

SEQ ID NO: 282112 - DNA, 25 bp, Mus musculus
attcttttctttgatcagtctgctc

SEQ ID NO: 282113 - DNA, 25 bp, Mus musculus
attcttttgctcaggagtttggtga

SEQ ID NO: 282114 - DNA, 25 bp, Mus musculus
attcttttgctctggagtttggtga

SEQ ID NO: 282115 - DNA, 25 bp, Mus musculus
attctttttatactgctggattttg

SEQ ID NO: 282116 - DNA, 25 bp, Mus musculus
attctttttatagtgctggattttg

SEQ ID NO: 282117 - DNA, 25 bp, Mus musculus
attctttttcatcatctgctctatg

SEQ ID NO: 282118 - DNA, 25 bp, Mus musculus
attctttttcatgatctgctctatg

SEQ ID NO: 282119 - DNA, 25 bp, Mus musculus
attctttttccaaatggtcctccaa

SEQ ID NO: 282120 - DNA, 25 bp, Mus musculus
attctttttccaattctcaatgaaa

SEQ ID NO: 282121 - DNA, 25 bp, Mus musculus
attctttttccatatggtcctccaa

SEQ ID NO: 282122 - DNA, 25 bp, Mus musculus
attctttttccatttctcaatgaaa

SEQ ID NO: 282123 - DNA, 25 bp, Mus musculus
attctttttgacactttcactggtg

SEQ ID NO: 282124 - DNA, 25 bp, Mus musculus
attctttttgactctttcactggtg

SEQ ID NO: 282125 - DNA, 25 bp, Mus musculus
attctttttgtcatttggatgtatc

SEQ ID NO: 282126 - DNA, 25 bp, Mus musculus
attctttttgtcttttggatgtatc

SEQ ID NO: 282127 - DNA, 25 bp, Mus musculus
attcttttttacctctgacaagtga

SEQ ID NO: 282128 - DNA, 25 bp, Mus musculus
attcttttttacgtctgacaagtga

SEQ ID NO: 282129 - DNA, 25 bp, Mus musculus
attcttttttgtctcccataccgct

SEQ ID NO: 282130 - DNA, 25 bp, Mus musculus
attcttttttgtgtcccataccgct

SEQ ID NO: 282131 - DNA, 25 bp, Mus musculus
attgaaaacagcatcactcgccatc

SEQ ID NO: 282132 - DNA, 25 bp, Mus musculus
attgaaaacagcttcactcgccatc

SEQ ID NO: 282133 - DNA, 25 bp, Mus musculus
attgaaaagctcaggccaggacctt

SEQ ID NO: 282134 - DNA, 25 bp, Mus musculus
attgaaaagctctggccaggacctt

SEQ ID NO: 282135 - DNA, 25 bp, Mus musculus
attgaaaatactaagccaggcgtgg

SEQ ID NO: 282136 - DNA, 25 bp, Mus musculus
attgaaaatacttagccaggcgtgg

SEQ ID NO: 282137 - DNA, 25 bp, Mus musculus
attgaaaatctgagactagtgctga

SEQ ID NO: 282138 - DNA, 25 bp, Mus musculus
attgaaaatctgtgactagtgctga

SEQ ID NO: 282139 - DNA, 25 bp, Mus musculus
attgaaaatgaactcctgcgttatt

SEQ ID NO: 282140 - DNA, 25 bp, Mus musculus
attgaaaatgaagtcctgcgttatt

SEQ ID NO: 282141 - DNA, 25 bp, Mus musculus
attgaaaatgagagatccacctacc

SEQ ID NO: 282142 - DNA, 25 bp, Mus musculus
attgaaaatgagtgatccacctacc

SEQ ID NO: 282143 - DNA, 25 bp, Mus musculus
attgaaaatgctaacactccctgtg

SEQ ID NO: 282144 - DNA, 25 bp, Mus musculus
attgaaaatgcttacactccctgtg

SEQ ID NO: 282145 - DNA, 25 bp, Mus musculus
attgaaacacccaccagctgaatac

SEQ ID NO: 282146 - DNA, 25 bp, Mus musculus
attgaaacaccctccagctgaatac

SEQ ID NO: 282147 - DNA, 25 bp, Mus musculus
attgaaactgttcgtctcaccaggc

SEQ ID NO: 282148 - DNA, 25 bp, Mus musculus
attgaaactgttggtctcaccaggc

SEQ ID NO: 282149 - DNA, 25 bp, Mus musculus
attgaaagagtcagccatttatcag

SEQ ID NO: 282150 - DNA, 25 bp, Mus musculus
attgaaagagtctgccatttatcag

SEQ ID NO: 282151 - DNA, 25 bp, Mus musculus
attgaaagagtgagtcctcctcgct

SEQ ID NO: 282152 - DNA, 25 bp, Mus musculus
attgaaagagtgtgtcctcctcgct

SEQ ID NO: 282153 - DNA, 25 bp, Mus musculus
attgaaagcaagctggctccgcctt

SEQ ID NO: 282154 - DNA, 25 bp, Mus musculus
attgaaagcaaggtggctccgcctt

SEQ ID NO: 282155 - DNA, 25 bp, Mus musculus
attgaaatacccaataaagtgctgg

SEQ ID NO: 282156 - DNA, 25 bp, Mus musculus
attgaaataccctataaagtgctgg

SEQ ID NO: 282157 - DNA, 25 bp, Mus musculus
attgaaatagttacaggcacctgct

SEQ ID NO: 282158 - DNA, 25 bp, Mus musculus
attgaaatagtttcaggcacctgct

SEQ ID NO: 282159 - DNA, 25 bp, Mus musculus
attgaaatatccagaaacccagttg

SEQ ID NO: 282160 - DNA, 25 bp, Mus musculus
attgaaatatcctgaaacccagttg

SEQ ID NO: 282161 - DNA, 25 bp, Mus musculus
attgaaatcagccagcacgccaagt

SEQ ID NO: 282162 - DNA, 25 bp, Mus musculus
attgaaatcagcgagcacgccaagt

SEQ ID NO: 282163 - DNA, 25 bp, Mus musculus
attgaaatccacctcaaactgggat

SEQ ID NO: 282164 - DNA, 25 bp, Mus musculus
attgaaatccacgtcaaactgggat

SEQ ID NO: 282165 - DNA, 25 bp, Mus musculus
attgaaatctggattccacctccaa

SEQ ID NO: 282166 - DNA, 25 bp, Mus musculus
attgaaatctggtttccacctccaa

SEQ ID NO: 282167 - DNA, 25 bp, Mus musculus
attgaaatggtcatacggtgtcaca

SEQ ID NO: 282168 - DNA, 25 bp, Mus musculus
attgaaatggtcttacggtgtcaca

SEQ ID NO: 282169 - DNA, 25 bp, Mus musculus
attgaaattacacctccacctcttt

SEQ ID NO: 282170 - DNA, 25 bp, Mus musculus
attgaaattacagctccacctcttt

SEQ ID NO: 282171 - DNA, 25 bp, Mus musculus
attgaacaaagccatccactacttc

SEQ ID NO: 282172 - DNA, 25 bp, Mus musculus
attgaacaaagcgatccactacttc

SEQ ID NO: 282173 - DNA, 25 bp, Mus musculus
attgaacacccaaaacctgatgcgg

SEQ ID NO: 282174 - DNA, 25 bp, Mus musculus
attgaacacccataacctgatgcgg

SEQ ID NO: 282175 - DNA, 25 bp, Mus musculus
attgaacagaagaatcgccccggaa

SEQ ID NO: 282176 - DNA, 25 bp, Mus musculus
attgaacagaagtatcgccccggaa

SEQ ID NO: 282177 - DNA, 25 bp, Mus musculus
attgaacagagtacccaccctgtac

SEQ ID NO: 282178 - DNA, 25 bp, Mus musculus
attgaacagagttcccaccctgtac

SEQ ID NO: 282179 - DNA, 25 bp, Mus musculus
attgaacaggagctcactggcttcc

SEQ ID NO: 282180 - DNA, 25 bp, Mus musculus
attgaacaggaggtcactggcttcc

SEQ ID NO: 282181 - DNA, 25 bp, Mus musculus
attgaacagggcactacactagaac

SEQ ID NO: 282182 - DNA, 25 bp, Mus musculus
attgaacagggctctacactagaac

SEQ ID NO: 282183 - DNA, 25 bp, Mus musculus
attgaacatgccattatcctctaca

SEQ ID NO: 282184 - DNA, 25 bp, Mus musculus
attgaacatgcctttatcctctaca

SEQ ID NO: 282185 - DNA, 25 bp, Mus musculus
attgaaccaaggatattacacatgt

SEQ ID NO: 282186 - DNA, 25 bp, Mus musculus
attgaaccaaggttattacacatgt

SEQ ID NO: 282187 - DNA, 25 bp, Mus musculus
attgaaccactgcagtctgtggatg

SEQ ID NO: 282188 - DNA, 25 bp, Mus musculus
attgaaccactggagtctgtggatg

SEQ ID NO: 282189 - DNA, 25 bp, Mus musculus
attgaaccagacatctaatcctcgc

SEQ ID NO: 282190 - DNA, 25 bp, Mus musculus
attgaaccagacttctaatcctcgc

SEQ ID NO: 282191 - DNA, 25 bp, Mus musculus
attgaaccatctctttaactcacaa

SEQ ID NO: 282192 - DNA, 25 bp, Mus musculus
attgaaccatctgtttaactcacaa

SEQ ID NO: 282193 - DNA, 25 bp, Mus musculus
attgaaccatgcaatgccagtgctc

SEQ ID NO: 282194 - DNA, 25 bp, Mus musculus
attgaaccatgctatgccagtgctc

SEQ ID NO: 282195 - DNA, 25 bp, Mus musculus
attgaacccaaccttatatccacct

SEQ ID NO: 282196 - DNA, 25 bp, Mus musculus
attgaacccaacgttatatccacct

SEQ ID NO: 282197 - DNA, 25 bp, Mus musculus
attgaacccacaatcatctaaaccc

SEQ ID NO: 282198 - DNA, 25 bp, Mus musculus
attgaacccacattcatctaaaccc

SEQ ID NO: 282199 - DNA, 25 bp, Mus musculus
attgaacctgacatgagtcctctaa

SEQ ID NO: 282200 - DNA, 25 bp, Mus musculus
attgaacctgacttgagtcctctaa

SEQ ID NO: 282201 - DNA, 25 bp, Mus musculus
attgaaccttcgaagtttcaccaag

SEQ ID NO: 282202 - DNA, 25 bp, Mus musculus
attgaaccttcgtagtttcaccaag

SEQ ID NO: 282203 - DNA, 25 bp, Mus musculus
attgaacctttacgctagggctctc

SEQ ID NO: 282204 - DNA, 25 bp, Mus musculus
attgaacctttaggctagggctctc

SEQ ID NO: 282205 - DNA, 25 bp, Mus musculus
attgaacgaggaagttttcatcccc

SEQ ID NO: 282206 - DNA, 25 bp, Mus musculus
attgaacgaggatgttttcatcccc

SEQ ID NO: 282207 - DNA, 25 bp, Mus musculus
attgaacgccataagaagaagatcc

SEQ ID NO: 282208 - DNA, 25 bp, Mus musculus
attgaacgccattagaagaagatcc

SEQ ID NO: 282209 - DNA, 25 bp, Mus musculus
attgaactaaaccacagatctgatt

SEQ ID NO: 282210 - DNA, 25 bp, Mus musculus
attgaactaaacgacagatctgatt

SEQ ID NO: 282211 - DNA, 25 bp, Mus musculus
attgaactacatagacccgcctgcc

SEQ ID NO: 282212 - DNA, 25 bp, Mus musculus
attgaactacattgacccgcctgcc

SEQ ID NO: 282213 - DNA, 25 bp, Mus musculus
attgaactccctattgctagtgaca

SEQ ID NO: 282214 - DNA, 25 bp, Mus musculus
attgaactcccttttgctagtgaca

SEQ ID NO: 282215 - DNA, 25 bp, Mus musculus
attgaactctctcaactttgctgcc

SEQ ID NO: 282216 - DNA, 25 bp, Mus musculus
attgaactctctgaactttgctgcc

SEQ ID NO: 282217 - DNA, 25 bp, Mus musculus
attgaactgacaacacctacctttc

SEQ ID NO: 282218 - DNA, 25 bp, Mus musculus
attgaactgacatcacctacctttc

SEQ ID NO: 282219 - DNA, 25 bp, Mus musculus
attgaactgtacactagtggctgtt

SEQ ID NO: 282220 - DNA, 25 bp, Mus musculus
attgaactgtactctagtggctgtt

SEQ ID NO: 282221 - DNA, 25 bp, Mus musculus
attgaactgtggcaattgacctatt

SEQ ID NO: 282222 - DNA, 25 bp, Mus musculus
attgaactgtgggaattgacctatt

SEQ ID NO: 282223 - DNA, 25 bp, Mus musculus
attgaacttgatctcacctccacag

SEQ ID NO: 282224 - DNA, 25 bp, Mus musculus
attgaacttgatgtcacctccacag

SEQ ID NO: 282225 - DNA, 25 bp, Mus musculus
attgaacttgcccaccatccagcag

SEQ ID NO: 282226 - DNA, 25 bp, Mus musculus
attgaacttgccgaccatccagcag

SEQ ID NO: 282227 - DNA, 25 bp, Mus musculus
attgaacttggtcttctgtgttcta

SEQ ID NO: 282228 - DNA, 25 bp, Mus musculus
attgaacttggtgttctgtgttcta

SEQ ID NO: 282229 - DNA, 25 bp, Mus musculus
attgaactttatccgtgttgcctct

SEQ ID NO: 282230 - DNA, 25 bp, Mus musculus
attgaactttatgcgtgttgcctct

SEQ ID NO: 282231 - DNA, 25 bp, Mus musculus
attgaagaaccaccggacctcagcg

SEQ ID NO: 282232 - DNA, 25 bp, Mus musculus
attgaagaaccagcggacctcagcg

SEQ ID NO: 282233 - DNA, 25 bp, Mus musculus
attgaagacacacacgccatataca

SEQ ID NO: 282234 - DNA, 25 bp, Mus musculus
attgaagacacagacgccatataca

SEQ ID NO: 282235 - DNA, 25 bp, Mus musculus
attgaagagcctatccagtccagag

SEQ ID NO: 282236 - DNA, 25 bp, Mus musculus
attgaagagcctttccagtccagag

SEQ ID NO: 282237 - DNA, 25 bp, Mus musculus
attgaagcaagcacagttccatatg

SEQ ID NO: 282238 - DNA, 25 bp, Mus musculus
attgaagcaagctcagttccatatg

SEQ ID NO: 282239 - DNA, 25 bp, Mus musculus
attgaagcattccacatccctacac

SEQ ID NO: 282240 - DNA, 25 bp, Mus musculus
attgaagcattcgacatccctacac

SEQ ID NO: 282241 - DNA, 25 bp, Mus musculus
attgaagcctgtagactgatggtcc

SEQ ID NO: 282242 - DNA, 25 bp, Mus musculus
attgaagcctgttgactgatggtcc

SEQ ID NO: 282243 - DNA, 25 bp, Mus musculus
attgaagcgctacgctgcagcatgg

SEQ ID NO: 282244 - DNA, 25 bp, Mus musculus
attgaagcgctaggctgcagcatgg

SEQ ID NO: 282245 - DNA, 25 bp, Mus musculus
attgaagctatgctggcttttgtgt

SEQ ID NO: 282246 - DNA, 25 bp, Mus musculus
attgaagctatggtggcttttgtgt

SEQ ID NO: 282247 - DNA, 25 bp, Mus musculus
attgaagctccaccctccttaaata

SEQ ID NO: 282248 - DNA, 25 bp, Mus musculus
attgaagctccagcctccttaaata

SEQ ID NO: 282249 - DNA, 25 bp, Mus musculus
attgaagctgagacttgacctcctg

SEQ ID NO: 282250 - DNA, 25 bp, Mus musculus
attgaagctgagtcttgacctcctg

SEQ ID NO: 282251 - DNA, 25 bp, Mus musculus
attgaaggatacactggcccacagc

SEQ ID NO: 282252 - DNA, 25 bp, Mus musculus
attgaaggatactctggcccacagc

SEQ ID NO: 282253 - DNA, 25 bp, Mus musculus
attgaaggcatcatttggaccaact

SEQ ID NO: 282254 - DNA, 25 bp, Mus musculus
attgaaggcatcttttggaccaact

SEQ ID NO: 282255 - DNA, 25 bp, Mus musculus
attgaaggccaaactgggcaatgta

SEQ ID NO: 282256 - DNA, 25 bp, Mus musculus
attgaaggccaatctgggcaatgta

SEQ ID NO: 282257 - DNA, 25 bp, Mus musculus
attgaaggccacagcacatctactc

SEQ ID NO: 282258 - DNA, 25 bp, Mus musculus
attgaaggccacattcttgcagttg

SEQ ID NO: 282259 - DNA, 25 bp, Mus musculus
attgaaggccactgcacatctactc

SEQ ID NO: 282260 - DNA, 25 bp, Mus musculus
attgaaggccactttcttgcagttg

SEQ ID NO: 282261 - DNA, 25 bp, Mus musculus
attgaagggatcagccgcttgggca

SEQ ID NO: 282262 - DNA, 25 bp, Mus musculus
attgaagggatctgccgcttgggca

SEQ ID NO: 282263 - DNA, 25 bp, Mus musculus
attgaagggcctctcagatgactga

SEQ ID NO: 282264 - DNA, 25 bp, Mus musculus
attgaagggcctgtcagatgactga

SEQ ID NO: 282265 - DNA, 25 bp, Mus musculus
attgaaggtcctcttcatctgtgac

SEQ ID NO: 282266 - DNA, 25 bp, Mus musculus
attgaaggtcctgttcatctgtgac

SEQ ID NO: 282267 - DNA, 25 bp, Mus musculus
attgaagtaagtccccttccatccc

SEQ ID NO: 282268 - DNA, 25 bp, Mus musculus
attgaagtaagtgcccttccatccc

SEQ ID NO: 282269 - DNA, 25 bp, Mus musculus
attgaagtaatgctgcttgtcccca

SEQ ID NO: 282270 - DNA, 25 bp, Mus musculus
attgaagtaatggtgcttgtcccca

SEQ ID NO: 282271 - DNA, 25 bp, Mus musculus
attgaagtccaaactgtccacgcta

SEQ ID NO: 282272 - DNA, 25 bp, Mus musculus
attgaagtccaatctgtccacgcta

SEQ ID NO: 282273 - DNA, 25 bp, Mus musculus
attgaagtctcaacccttggactcc

SEQ ID NO: 282274 - DNA, 25 bp, Mus musculus
attgaagtctcatcccttggactcc

SEQ ID NO: 282275 - DNA, 25 bp, Mus musculus
attgaagtctccattaaagtctctc

SEQ ID NO: 282276 - DNA, 25 bp, Mus musculus
attgaagtctcctttaaagtctctc

SEQ ID NO: 282277 - DNA, 25 bp, Mus musculus
attgaagtctctaaccctagtccta

SEQ ID NO: 282278 - DNA, 25 bp, Mus musculus
attgaagtctcttaccctagtccta

SEQ ID NO: 282279 - DNA, 25 bp, Mus musculus
attgaagtctgtctccttgggttta

SEQ ID NO: 282280 - DNA, 25 bp, Mus musculus
attgaagtctgtgtccttgggttta

SEQ ID NO: 282281 - DNA, 25 bp, Mus musculus
attgaagtgtaaccctgtgcagcgc

SEQ ID NO: 282282 - DNA, 25 bp, Mus musculus
attgaagtgtaagcctgtgcagcgc

SEQ ID NO: 282283 - DNA, 25 bp, Mus musculus
attgaagttatcattcccacaatgc

SEQ ID NO: 282284 - DNA, 25 bp, Mus musculus
attgaagttatctttcccacaatgc

SEQ ID NO: 282285 - DNA, 25 bp, Mus musculus
attgaatactgcactggctggagtt

SEQ ID NO: 282286 - DNA, 25 bp, Mus musculus
attgaatactgctctggctggagtt

SEQ ID NO: 282287 - DNA, 25 bp, Mus musculus
attgaatagtacattgcccctgcat

SEQ ID NO: 282288 - DNA, 25 bp, Mus musculus
attgaatagtactttgcccctgcat

SEQ ID NO: 282289 - DNA, 25 bp, Mus musculus
attgaatagtatcgcccgctacagc

SEQ ID NO: 282290 - DNA, 25 bp, Mus musculus
attgaatagtatggcccgctacagc

SEQ ID NO: 282291 - DNA, 25 bp, Mus musculus
attgaatataccacgcatcacaagt

SEQ ID NO: 282292 - DNA, 25 bp, Mus musculus
attgaatatacctcgcatcacaagt

SEQ ID NO: 282293 - DNA, 25 bp, Mus musculus
attgaatatccaatgcctttagtca

SEQ ID NO: 282294 - DNA, 25 bp, Mus musculus
attgaatatccattgcctttagtca

SEQ ID NO: 282295 - DNA, 25 bp, Mus musculus
attgaatccgtaagtgcgttcccat

SEQ ID NO: 282296 - DNA, 25 bp, Mus musculus
attgaatccgtatgtgcgttcccat

SEQ ID NO: 282297 - DNA, 25 bp, Mus musculus
attgaatcggccctgtaactgtctc

SEQ ID NO: 282298 - DNA, 25 bp, Mus musculus
attgaatcggccgtgtaactgtctc

SEQ ID NO: 282299 - DNA, 25 bp, Mus musculus
attgaatctcgtcgtggttagctag

SEQ ID NO: 282300 - DNA, 25 bp, Mus musculus
attgaatctcgtggtggttagctag

SEQ ID NO: 282301 - DNA, 25 bp, Mus musculus
attgaatctgaaaaggctgagttac

SEQ ID NO: 282302 - DNA, 25 bp, Mus musculus
attgaatctgaataggctgagttac

SEQ ID NO: 282303 - DNA, 25 bp, Mus musculus
attgaatctggccacaaggttctcc

SEQ ID NO: 282304 - DNA, 25 bp, Mus musculus
attgaatctggcgacaaggttctcc

SEQ ID NO: 282305 - DNA, 25 bp, Mus musculus
attgaatgacagacaggcctgaaca

SEQ ID NO: 282306 - DNA, 25 bp, Mus musculus
attgaatgacagtcaggcctgaaca

SEQ ID NO: 282307 - DNA, 25 bp, Mus musculus
attgaatgacctcgctcgagatccc

SEQ ID NO: 282308 - DNA, 25 bp, Mus musculus
attgaatgacctggctcgagatccc

SEQ ID NO: 282309 - DNA, 25 bp, Mus musculus
attgaatgcatcacccaaggccgtg

SEQ ID NO: 282310 - DNA, 25 bp, Mus musculus
attgaatgcatctcccaaggccgtg

SEQ ID NO: 282311 - DNA, 25 bp, Mus musculus
attgaatgcctcatctattttctgc

SEQ ID NO: 282312 - DNA, 25 bp, Mus musculus
attgaatgcctcttctattttctgc

SEQ ID NO: 282313 - DNA, 25 bp, Mus musculus
attgaatgtgaacccggtatcgcgg

SEQ ID NO: 282314 - DNA, 25 bp, Mus musculus
attgaatgtgaagccggtatcgcgg

SEQ ID NO: 282315 - DNA, 25 bp, Mus musculus
attgaattacctcgttgtcagccgt

SEQ ID NO: 282316 - DNA, 25 bp, Mus musculus
attgaattacctggttgtcagccgt

SEQ ID NO: 282317 - DNA, 25 bp, Mus musculus
attgaattcatcaaatcggcctgtg

SEQ ID NO: 282318 - DNA, 25 bp, Mus musculus
attgaattcatctaatcggcctgtg

SEQ ID NO: 282319 - DNA, 25 bp, Mus musculus
attgaattccctacacatcctataa

SEQ ID NO: 282320 - DNA, 25 bp, Mus musculus
attgaattcccttcacatcctataa

SEQ ID NO: 282321 - DNA, 25 bp, Mus musculus
attgaattccgaaatggcatgttga

SEQ ID NO: 282322 - DNA, 25 bp, Mus musculus
attgaattccgatatggcatgttga

SEQ ID NO: 282323 - DNA, 25 bp, Mus musculus
attgaattcgatcactcttgctgaa

SEQ ID NO: 282324 - DNA, 25 bp, Mus musculus
attgaattcgatgactcttgctgaa

SEQ ID NO: 282325 - DNA, 25 bp, Mus musculus
attgaattctctaagctcgtgtgtg

SEQ ID NO: 282326 - DNA, 25 bp, Mus musculus
attgaattctcttagctcgtgtgtg

SEQ ID NO: 282327 - DNA, 25 bp, Mus musculus
attgaattcttgcatgcagtggcag

SEQ ID NO: 282328 - DNA, 25 bp, Mus musculus
attgaattcttggatgcagtggcag

SEQ ID NO: 282329 - DNA, 25 bp, Mus musculus
attgaattgagaactctagaaccca

SEQ ID NO: 282330 - DNA, 25 bp, Mus musculus
attgaattgagatctctagaaccca

SEQ ID NO: 282331 - DNA, 25 bp, Mus musculus
attgaattgctcacacaaataatgt

SEQ ID NO: 282332 - DNA, 25 bp, Mus musculus
attgaattgctctcacaaataatgt

SEQ ID NO: 282333 - DNA, 25 bp, Mus musculus
attgaattgttcaacagctgccggg

SEQ ID NO: 282334 - DNA, 25 bp, Mus musculus
attgaattgttctacagctgccggg

SEQ ID NO: 282335 - DNA, 25 bp, Mus musculus
attgaatttcagatcaccccgagct

SEQ ID NO: 282336 - DNA, 25 bp, Mus musculus
attgaatttcagttcaccccgagct

SEQ ID NO: 282337 - DNA, 25 bp, Mus musculus
attgaatttctgctatcttcttgaa

SEQ ID NO: 282338 - DNA, 25 bp, Mus musculus
attgaatttctggtatcttcttgaa

SEQ ID NO: 282339 - DNA, 25 bp, Mus musculus
attgaatttttccaaagtggctttg

SEQ ID NO: 282340 - DNA, 25 bp, Mus musculus
attgaatttttcgaaagtggctttg

SEQ ID NO: 282341 - DNA, 25 bp, Mus musculus
attgacaaacttatcctggacacct

SEQ ID NO: 282342 - DNA, 25 bp, Mus musculus
attgacaaacttttcctggacacct

SEQ ID NO: 282343 - DNA, 25 bp, Mus musculus
attgacaaccaaaagtctcattaca

SEQ ID NO: 282344 - DNA, 25 bp, Mus musculus
attgacaaccaatagtctcattaca

SEQ ID NO: 282345 - DNA, 25 bp, Mus musculus
attgacaaccacagagatctccttc

SEQ ID NO: 282346 - DNA, 25 bp, Mus musculus
attgacaaccactgagatctccttc

SEQ ID NO: 282347 - DNA, 25 bp, Mus musculus
attgacaactgaaggctgctggagg

SEQ ID NO: 282348 - DNA, 25 bp, Mus musculus
attgacaactgatggctgctggagg

SEQ ID NO: 282349 - DNA, 25 bp, Mus musculus
attgacaaggttctgtccaggctgc

SEQ ID NO: 282350 - DNA, 25 bp, Mus musculus
attgacaaggttgtgtccaggctgc

SEQ ID NO: 282351 - DNA, 25 bp, Mus musculus
attgacaagttacccagcaccgtgg

SEQ ID NO: 282352 - DNA, 25 bp, Mus musculus
attgacaagttagccagcaccgtgg

SEQ ID NO: 282353 - DNA, 25 bp, Mus musculus
attgacaatcttactaccaggagtt

SEQ ID NO: 282354 - DNA, 25 bp, Mus musculus
attgacaatctttctaccaggagtt

SEQ ID NO: 282355 - DNA, 25 bp, Mus musculus
attgacaatgtgctgggcttactgg

SEQ ID NO: 282356 - DNA, 25 bp, Mus musculus
attgacaatgtggtgggcttactgg

SEQ ID NO: 282357 - DNA, 25 bp, Mus musculus
attgacaccaatatgcatgcccgag

SEQ ID NO: 282358 - DNA, 25 bp, Mus musculus
attgacaccaatttgcatgcccgag

SEQ ID NO: 282359 - DNA, 25 bp, Mus musculus
attgacaccaccaccaaatttggcc

SEQ ID NO: 282360 - DNA, 25 bp, Mus musculus
attgacaccacctccaaatttggcc

SEQ ID NO: 282361 - DNA, 25 bp, Mus musculus
attgacaccactatatacactgaca

SEQ ID NO: 282362 - DNA, 25 bp, Mus musculus
attgacaccactttatacactgaca

SEQ ID NO: 282363 - DNA, 25 bp, Mus musculus
attgacaccgatacttggcattcag

SEQ ID NO: 282364 - DNA, 25 bp, Mus musculus
attgacaccgattcttggcattcag

SEQ ID NO: 282365 - DNA, 25 bp, Mus musculus
attgacactgaaatcgcttccttaa

SEQ ID NO: 282366 - DNA, 25 bp, Mus musculus
attgacactgaattcgcttccttaa

SEQ ID NO: 282367 - DNA, 25 bp, Mus musculus
attgacactgtgcactggtaaactg

SEQ ID NO: 282368 - DNA, 25 bp, Mus musculus
attgacactgtggactggtaaactg

SEQ ID NO: 282369 - DNA, 25 bp, Mus musculus
attgacaggattatccacccagtga

SEQ ID NO: 282370 - DNA, 25 bp, Mus musculus
attgacaggattttccacccagtga

SEQ ID NO: 282371 - DNA, 25 bp, Mus musculus
attgacagtcagaccagagccttct

SEQ ID NO: 282372 - DNA, 25 bp, Mus musculus
attgacagtcagtccagagccttct

SEQ ID NO: 282373 - DNA, 25 bp, Mus musculus
attgacagtcctaatggctcagcta

SEQ ID NO: 282374 - DNA, 25 bp, Mus musculus
attgacagtccttatggctcagcta

SEQ ID NO: 282375 - DNA, 25 bp, Mus musculus
attgacatatttctactggtgccta

SEQ ID NO: 282376 - DNA, 25 bp, Mus musculus
attgacatatttgtactggtgccta

SEQ ID NO: 282377 - DNA, 25 bp, Mus musculus
attgacatggacaagcggacctacc

SEQ ID NO: 282378 - DNA, 25 bp, Mus musculus
attgacatggactagcggacctacc

SEQ ID NO: 282379 - DNA, 25 bp, Mus musculus
attgacatggagaagcctgctgaga

SEQ ID NO: 282380 - DNA, 25 bp, Mus musculus
attgacatggagtagcctgctgaga

SEQ ID NO: 282381 - DNA, 25 bp, Mus musculus
attgacattaagctcttccctggct

SEQ ID NO: 282382 - DNA, 25 bp, Mus musculus
attgacattaaggtcttccctggct

SEQ ID NO: 282383 - DNA, 25 bp, Mus musculus
attgacattcacacaactctgttgt

SEQ ID NO: 282384 - DNA, 25 bp, Mus musculus
attgacattcactcaactctgttgt

SEQ ID NO: 282385 - DNA, 25 bp, Mus musculus
attgacattggtctgtctgtgcctg

SEQ ID NO: 282386 - DNA, 25 bp, Mus musculus
attgacattggtgtgtctgtgcctg

SEQ ID NO: 282387 - DNA, 25 bp, Mus musculus
attgaccaaatgctaccaggcgctg

SEQ ID NO: 282388 - DNA, 25 bp, Mus musculus
attgaccaaatggtaccaggcgctg

SEQ ID NO: 282389 - DNA, 25 bp, Mus musculus
attgaccaacaaagacgaaaacgag

SEQ ID NO: 282390 - DNA, 25 bp, Mus musculus
attgaccaacaatgacgaaaacgag

SEQ ID NO: 282391 - DNA, 25 bp, Mus musculus
attgaccaacccaccatcaaagaaa

SEQ ID NO: 282392 - DNA, 25 bp, Mus musculus
attgaccaaccctccatcaaagaaa

SEQ ID NO: 282393 - DNA, 25 bp, Mus musculus
attgaccaacctcatgttacaacga

SEQ ID NO: 282394 - DNA, 25 bp, Mus musculus
attgaccaacctgatgttacaacga

SEQ ID NO: 282395 - DNA, 25 bp, Mus musculus
attgaccacaaccataaagatgccc

SEQ ID NO: 282396 - DNA, 25 bp, Mus musculus
attgaccacaacgataaagatgccc

SEQ ID NO: 282397 - DNA, 25 bp, Mus musculus
attgaccacagcattttccagacag

SEQ ID NO: 282398 - DNA, 25 bp, Mus musculus
attgaccacagctttttccagacag

SEQ ID NO: 282399 - DNA, 25 bp, Mus musculus
attgaccagacaccgtagaggactc

SEQ ID NO: 282400 - DNA, 25 bp, Mus musculus
attgaccagacagcgtagaggactc

SEQ ID NO: 282401 - DNA, 25 bp, Mus musculus
attgaccagataccagccactatgt

SEQ ID NO: 282402 - DNA, 25 bp, Mus musculus
attgaccagatagcagccactatgt

SEQ ID NO: 282403 - DNA, 25 bp, Mus musculus
attgaccatatacccaaagccatca

SEQ ID NO: 282404 - DNA, 25 bp, Mus musculus
attgaccatatacggctcgaaagtt

SEQ ID NO: 282405 - DNA, 25 bp, Mus musculus
attgaccatatagccaaagccatca

SEQ ID NO: 282406 - DNA, 25 bp, Mus musculus
attgaccatatagggctcgaaagtt

SEQ ID NO: 282407 - DNA, 25 bp, Mus musculus
attgaccatctactgtgtgcatagc

SEQ ID NO: 282408 - DNA, 25 bp, Mus musculus
attgaccatctagtgtgtgcatagc

SEQ ID NO: 282409 - DNA, 25 bp, Mus musculus
attgaccatctgaactccatgcaga

SEQ ID NO: 282410 - DNA, 25 bp, Mus musculus
attgaccatctgtactccatgcaga

SEQ ID NO: 282411 - DNA, 25 bp, Mus musculus
attgaccatgaaaagcgtgtaccac

SEQ ID NO: 282412 - DNA, 25 bp, Mus musculus
attgaccatgaatagcgtgtaccac

SEQ ID NO: 282413 - DNA, 25 bp, Mus musculus
attgacccagacaaaaggcccttct

SEQ ID NO: 282414 - DNA, 25 bp, Mus musculus
attgacccagactaaaggcccttct

SEQ ID NO: 282415 - DNA, 25 bp, Mus musculus
attgacccatcaactggtgtggcat

SEQ ID NO: 282416 - DNA, 25 bp, Mus musculus
attgacccatcatctggtgtggcat

SEQ ID NO: 282417 - DNA, 25 bp, Mus musculus
attgacccatgaatagagtttgcta

SEQ ID NO: 282418 - DNA, 25 bp, Mus musculus
attgacccatgattagagtttgcta

SEQ ID NO: 282419 - DNA, 25 bp, Mus musculus
attgaccccggaacagtaaacactg

SEQ ID NO: 282420 - DNA, 25 bp, Mus musculus
attgaccccggatcagtaaacactg

SEQ ID NO: 282421 - DNA, 25 bp, Mus musculus
attgaccccggcattggaagacaca

SEQ ID NO: 282422 - DNA, 25 bp, Mus musculus
attgaccccggctttggaagacaca

SEQ ID NO: 282423 - DNA, 25 bp, Mus musculus
attgacccggacatcaaagacttgg

SEQ ID NO: 282424 - DNA, 25 bp, Mus musculus
attgacccggacttcaaagacttgg

SEQ ID NO: 282425 - DNA, 25 bp, Mus musculus
attgaccctctccttccagatgatt

SEQ ID NO: 282426 - DNA, 25 bp, Mus musculus
attgaccctctcgttccagatgatt

SEQ ID NO: 282427 - DNA, 25 bp, Mus musculus
attgacccttacacactacttgaac

SEQ ID NO: 282428 - DNA, 25 bp, Mus musculus
attgacccttactcactacttgaac

SEQ ID NO: 282429 - DNA, 25 bp, Mus musculus
attgaccgaatcatcctctggatgt

SEQ ID NO: 282430 - DNA, 25 bp, Mus musculus
attgaccgaatcttcctctggatgt

SEQ ID NO: 282431 - DNA, 25 bp, Mus musculus
attgaccgctatccccggaaagtga

SEQ ID NO: 282432 - DNA, 25 bp, Mus musculus
attgaccgctatgcccggaaagtga

SEQ ID NO: 282433 - DNA, 25 bp, Mus musculus
attgaccggactccggaataaacac

SEQ ID NO: 282434 - DNA, 25 bp, Mus musculus
attgaccggactgcggaataaacac

SEQ ID NO: 282435 - DNA, 25 bp, Mus musculus
attgaccggctcaactccatgcaga

SEQ ID NO: 282436 - DNA, 25 bp, Mus musculus
attgaccggctctactccatgcaga

SEQ ID NO: 282437 - DNA, 25 bp, Mus musculus
attgaccgttacacagaggctttgc

SEQ ID NO: 282438 - DNA, 25 bp, Mus musculus
attgaccgttactcagaggctttgc

SEQ ID NO: 282439 - DNA, 25 bp, Mus musculus
attgacctaacccagcttgtgaatg

SEQ ID NO: 282440 - DNA, 25 bp, Mus musculus
attgacctaaccgagcttgtgaatg

SEQ ID NO: 282441 - DNA, 25 bp, Mus musculus
attgacctccaaatagactccattt

SEQ ID NO: 282442 - DNA, 25 bp, Mus musculus
attgacctccaattagactccattt

SEQ ID NO: 282443 - DNA, 25 bp, Mus musculus
attgacctctaacaatcctggaccc

SEQ ID NO: 282444 - DNA, 25 bp, Mus musculus
attgacctctaagaatcctggaccc

SEQ ID NO: 282445 - DNA, 25 bp, Mus musculus
attgacctggtgatctccttcttta

SEQ ID NO: 282446 - DNA, 25 bp, Mus musculus
attgacctggtgttctccttcttta

SEQ ID NO: 282447 - DNA, 25 bp, Mus musculus
attgacctgttgatgaaagatgacg

SEQ ID NO: 282448 - DNA, 25 bp, Mus musculus
attgacctgttgttgaaagatgacg

SEQ ID NO: 282449 - DNA, 25 bp, Mus musculus
attgaccttagtaaaccttctgtat

SEQ ID NO: 282450 - DNA, 25 bp, Mus musculus
attgaccttagttaaccttctgtat

SEQ ID NO: 282451 - DNA, 25 bp, Mus musculus
attgaccttgatcacgagggctcct

SEQ ID NO: 282452 - DNA, 25 bp, Mus musculus
attgaccttgatgacgagggctcct

SEQ ID NO: 282453 - DNA, 25 bp, Mus musculus
attgaccttggccagaacgatgtgt
